United States Patent 10,058,623 (COMPOSITIONS AND METHODS FOR MODULATING UTRN EXPRESSION) - sequence listing, part 2

SEQ ID NO: 4 - DNA, 503548 bp, Mus musculus
tgagaaatcaccttagctaaaactctcatgcattgcttgtcgcgtgtcctatgcttgctagttatcaagcagaactcactctcctgccatccttgtttgatccaatggttacttgaccattttgtttgatacttgacagtcttagagccccctccaagacgggtgcagtgactgaaggcacttgtcttgcaatgtgggtatttggaagctgcatgacattgggaaacttcctacatgtgcacagaaatcaatcacctgcatagggaagctgaactgagtttcttatataacaagtgcaactctttggaataagaaacccacttaaggggctacactactggatgttcgtgaataagggtgtgtgctgtgtaatcatgaggacctgagttcaagacctaccccatgtaaaaaggctggcctggctgtatgcatgctcgtaagtccagcataatagggatggagacagaaagatccctagggcttgcttaccaccagcctgactccagtttcagtaaaataccttgtcccaaaaggaataatatggagagtgatgcagtaggacatacaatatcctctcctggctactgagacccatgtactatacacatgtgtacaacacacacacacacacacacacacacacacacacacacacacacacacacgccaaaaagaaaagaatcaattttaagaattcagtcacacaaaattccatgcaaaagatagagaaaaaggcaggtgtggtggtggcacctgtatcccagcactctgcagacttgaggtgggaagattgtttcaaatcggggactggcttggaccacacagtgagttcaaggctagcagaaatacagagcaaatgtctgtctccaaaagggagagatggaaacatgtcaagagtaaccactaagaatccagaggaccatggataagttggagatgctgaaaactctcttcttggcactctcccaagaatcccataaagtagacggggctctgaccatctgcttcagacacaaagcaatattgctaagtggtaataaacttactgattatagtcagacgatatggatgtatatccaagcaacaagcctctcttccatctactgtaattttatggttgcctttgcaaattacctcccttctgcccctccctaccccaattcactctttccttcaggtgaacatggtctctaagcacagctcatatttgcttgctcttcctggatttctccctgatgacacactcacacacatgtgtgtaatgcatccacacaaacacatgttctagcacacatacatgcgcatgcatgcacacatatgcatacccatacacacgcatacatgcacatacacaccattttttaaaaatgtagatacatatggtaaatttttttcagtgcaatttgctttgttaatctgtcttttgtaactgaggtcagatctgagaactgagaagtggagaaggggaggttgtctgttttgttcctcggctcctcactttacagcttagctaaaacacagaatctgataggaaagcaaaattaagattggaaatagtccttttcaaaaacacctccaccaccagctgaagatacggtaaaaacaacaataacaaaaacaaagaataacagcaaaagagaagaaaagaaagaaaaagactaatgatgtgcttataattttatataatttaaaataacaacaataacaaaaacagaaccatatagggttttttttttaaatgggtcatagtatataggagaggagggtctttaattgagacttggataattacttcccataagtaaaagggcattgggaaaagaactttcttgtgttaatcaaaaatccgtgtgggaaaatggagtggaagatccacgagattcctgtaaatagaaaccaagcactcattttctctttttactcctaacttcataagaatagtaagtggaaaccacacatgtttagaaaaacattaacataggtgctataccatcagccccaacccctgcctctgttctaatgctttgggagtgaaccaccattccagcagtagctgtaggtagtgacctttagacattctcatgacctcgtccatatcaaaccactgttgaatcttcagtggtgggcttgttttcttcttgtgaacacagacacaccagctaaccatatagggtgctatttactctgcacactgatgtgccagaggaaacagtctctttacagtgcctttctcaaaatctcacagcctcccaattcttttttttttaaattaggtattttcttcatttacatttccaatgctatcccaaaagtcccccataccctcccccgccccactcccttacccaccaactcccacttcttggccctggcattcttctgtactggagcatataaagtttgcaatatcaaggggcctctcttcccaaagatggccgactaggccatcttctgctacatatgcagctagagacatgagctctggggggtactggttagttcatattgttgttcctcctatagggttgcagacccctttagctccttgggtactttctctagctcctccattgggggcccagtgttccatccaatatctgactgtgagcatccacttctgtgtttgccaggtactggcatagcctcacaagagacagctatatcagggtcctttttagcaaaaccttgctggtgtatgcgatggtgtctacagcctccctattcttaaagatggtacagctagttcagacttgagcttagcaatgtctgtgtatctcaactgagccaaccacagcagatttcaacaagagacttatgtggacaattattctagtgatataagttgcttttgaaggccagcctgctatcatttggaagtaaagtgtctacctagaaggctcaggtgttgatgggttgaccaccaatccttttataagaatgcaatcatttgaaggtgatcgagttataaaggttcacagttcttcaagagattactacattgatttgattcctaatttggaattattggaggtgatggaccccccccctctctctcccccccccacacacaaacacacatgtgggtatttttcttaacaaagttggcctttccagatttccccagatcggtaactgaaagacaagcaagacgaataattatggttgcccacagcaggacaggccattagaaatccaaagccattatcacaccatatcttgaaaagttggttcctgctgccacagagatgacattcagtaacctttcacaggagccaggtttaatgcctgaacttacatagaaatagaacttaggaacaaagggtctatatttggagtgtgtctgtccggctccattattgttatattcttgatgaaaaaaatgttcacagaagctcaacaatatgtaatagggtttttttttcctcccccaacccccaaaatcactcactagtcttcctacctggacagaaacttggtaaacttattcctactttctgtaaactttctgacatcacccaagatagattttcagcaacaactttcttttctgtacaaaaatatcatgatattatgctagatctgggaactatactatcaagggggcattcttaatcagtttctcctgtctttaatatcctttatttcacactttaaaagaaacccgagtagctggaggaaccatacacattatacattatatactgcaaaatgctggcaagcatgcttaataatgtcactatcactatagaaaccttggtctgtctctttggactcaggaaattaaatgaaactgtgtttcagaacagagctgcttcctttttttttttttttttaagagatggtcatttcagagaaagtaagaatgagcgctgtgtcccaagaacattgtttggtgtacctctgaagacattcagtcatgcgtatgtagcttctaggcactatagctgggtagatactgatttattctaacccaactctgctggcctggtctggcctggttcccagccatcttggtttcactctaggacttccttcttcactcatgtcaccatggtgatttctctccttgtcccctgagaccctctgtttctctctcagggtacagacatctgccctatcctctcctgcccagccagaggctgaccagctcattattgaccaatcagaagttgatggagaccaaagttttacaaaatactgagtcaggaaatactttctaataatgaccaagccaggcctggactcctggtgcagaatcaacattcgaatacacagtgcacaaaacattccccaagagactttgctttacagtcacactggtccttttaaccccacagccattccccttggttcatttgggtagtccctgcatgagaagtaggcttcacactctaaactcatcctttagttttattttaatgtttgtataaattgcatctgagagccttgggttttacaggctctccactcaacacatgacccatcaaatgaccttctagcacaaggaatgggagaagctgacacattggaccacttcaatgactccttccaccccaaaccatgacaccaaaatctatgatgatgatgtagcttgatcgtgatgtgtcttttgggggtgggagaagctgcagaaagcttgaaaatccacatcatccacagctacacacagtgcaatgacttcaaaggctattatctttaccagaatatcagtactactcctgttgttatcatttattacagacaatccctctaggttcctcccaacagtgacctagcaacagcatatcagcacctgcctcccactctgtaagttgtgggtggcctggcagcatataaaaggactgctcactaccccagcccagcttttcattgctttctctctcccttctcactcactctctttttctctctctgttcccacatgttcctggcaagcctttctttccctctttctgcccttctctgtcccctcctcttctgctaccccttttacccccacagtaaacttcccttatatcaagtctgtcgcatggtgtgatttctcagggcgacgacccttagtcttgctactgccgcccccttatatttcataacagtcatgattttattaaaactttatttcaggactagggatatagctcagttgatgagagtgcttgcccaacatgcaagaagaactgtgtttaatcatcagcaatgagtatagaaaggttgcctatgatgccagtattctggtggtagaggcaggggaattaagaaagtcaagattagagcctacaggatggcttagtgagtagaggcacttagtcccccaagcttgcccccaggaaccaagaaatcgaggagagaattgacttctgaaagctttcctctgacatctatactggtgccatgacagtccctgcacacacacacacacacacacacacacacacacacacacacacacagtgggagggagaaatcttcatacaaacatacacatctgcacatatacacatttctgcactcacacatctttatatacacacatacctgcacatacatgcacatatacttatacatgataacttttaaagaggtagttcaagatcacattagctacatactaatttttgaggatggctgggctactcaaaaaattgtctcaaaaccaaaccaaaaaaagaaaaatctttattaccgaaagttcctgaaaattctatttatttcgcatcaaaacctaatcattcaacacacaacacaaaaccatgttcccctgattataaaatcctccgtcccaacaggttccttttgctgtacccggaggtcaaggcttacacccactgtgttttgtagtcctagctggagcctttcccctttaagacaacataaattattcagccaaatggtttccctgtttgctgttttaaaagataaattctgctccatcttatcatttattttaatggtacttgggaggaccagcaggattatagggtagactctcaagcgtggcctgtagatactcactctgtgggtcccccaagagcccaattaagcttcaagagatattgaggaaaaagatatgaggatcataacttagtgctctaactcctagactggttaagatgaaatcagttcactaaataattcatctttgaggcaaggcaaacattcacggcaaaccctggtgctcatgagcttctcttaactgagcagcagatctgcatgggatgaacctggtgagcacagagcttggtagcagctgtcaggaagttctgcctgcatccgaatggcagatcgctagggttcttctttccattgaggatgctccacttcatatttgcccagcacactaagggaggcttcaaaagaatctcaagccagctgtgactccaaaaaacagtcctcctgccagaaatgtttacctgtgtgggaaacaaccagatcctcaaacaaaatacggagatgaaaataaatggagtatttccaggtattgtacgccagtcacgctccggttggaaaatgtctggatcagatttaggaaaatctagacagtcctgtttccttcctcgctctcttcttccttttattttgtttattttttgctttgagacaggcccagagtatcttcagtctagctatctaatccgggatgaccctcctccccttcttgcacacacccacctgctcagcgctgggatcacactctctgcctggcaccctgctcttaagaaaactaagacatagtaaacagtgtgatatcgggaaatcgcttgtaaatggctctgctggtcccacctattgttgtgcttcacattcatgtctggcttagccatcttagagatgcggtttctagaaatacagatcattctttatgaattaaagtagcattctttatttgttttccttgttcctcattcttgataaagcatgccttttgataaggcactctttagttgcccacaaggctcctttcatgtttaaaatcctaaaattttattgataatttaagagaaaactagttttgagtcatttttatagtcttcgtgtgttgctgcctcaaatgtatactggcaaaaaattgaaacataggattgctatccaagtgtacatcacaaagcatgttgagaaaatacaagaattaaatgctatagagatccagagagatttattttaaggcaatgggtcttaattttcctaatgctgcaaccctttaatacagttcctcatgttgtggtgacccccaaacatacaattatttttgttgctagttcataactgtaattttgctagttaatgaattatagcatgtgatacataggatatctaatatgtgacccctgtggaagggttatttgatccacaggaggtcgtgaaccacagattaaaactgctgcattaaggcacattatctttcttcagatttctcatagcttttaacaggctgatgtgtgctgtgaatctccaaagggcgctggtgcaacagagcatcgcgaaatcagttagccaagagatatttttcttagggaaatgctgggtttcacttgcaagtgtgtcaccattatgacatcatttgtcacaatgtggctccacaggtggtaacaagttctatacatgctttttgcgagcagtatccctgtatgtagaaacatatagtggaagcatggggtgcagccacatctgtataggaacagactcggccccctccacttcccaaaactgctattgcaacagtttgcttggcactgtgtttatctgctagattaggaacaccttgaggcagaggctcccgttgtttttagcaatttggatggtgattttatttttaagtaatagtctaaaatatatgaccaaattttaagccaaaaatgccattttgatgcatggttagcatccttcatttaatcataaagttgtttgactcacattttttattattactgaatttgtgtggacattgtacccagcaaacattcttgttttgtgacagactgcttctaaaattattgtcgtataaaccaacttgagatggaggagctgggacgaggagaacagagcatatgagacttgtgtgccacaggtatgggcacaggttcatcatgtgtgaccgactatagctgttcacggggcgaacacagctcaggcagttcagaggataataaatgacaccgtgctggagtttgatcagctcaacttgagccagacttacaataggatgatttcagcctccccagcagtctaagtactgacatttttatttcaactaaattaaagcagaagagatttttaaaatataatgatcttacactaaacatttaaaaaccaggatcttaacatttggggaaaatgatcgatcataagagagcaatattgggtcctactgtgattataaaccagagttagctgggaacttgtctcctttactgtgatgaaacagttccatgtatcattgtaactaggctgaggaatgggcacatatctgtttaaatattttcaagtcactggagacatttctgggaaaattagcatttgaaatgctagatgtgaaagacttctggtgtggggagggccaggcccatccattgagacctatagaaggataaatcgagtctttctgcttgacctgggaggtccaccctctgctgttttaggttattggagcttctgcttctctagtcccgtgactccaaatgagacatacactttctgtctccctggctcctggggctggactgaaacaacccctaccaagacatctgtatgcatttttttttttttttttttttttttttttttttttggtttttcaagacagggtttctctgtatagccctggctgtcctggaactcactttgtagttcaggctggccttgaactcagaaattcgcctgcctctgcctcccaatttctgggattaaaggcgtgtgccaccacgcctggtgcatgaagtcatctttcaaagtgtttttctacatctgtctctctctctttccatacttggaatatgtttcttgaagaacattgacaaacagaataagaaataagaaatttgtgacttctgggacttctggaacagaggtcggtacagggcaggctgtcagataatttttccaaattttcctatctacaaagttcaaaaagggaccaggaaataagctgcctgcaaaagataacctggaatcaagtgcaaatagtgctttgtggtttggtttggtttttttcaagataggtttctgtatagccctggctgtcttggaacttgttgtatagaccaggctggccttggccttgaactcaagagatctgcctggttctgccttgtgagtgctggggttaaaggagtgtgccaccaccacccagtcacagtgccaaggattctgaggtgagagttagtgccagtttggaagcttatgcaaatttcatgcctctgatgacatgcatggcttgctgggggacaaactcaccacttgcatcttgcccacctggcaaagcaaggaggcccccatgcaatattcttctactaaaatatgtaattcactctgacttctcatttactctatttttaagtctaaaatctctgatttttttgtttttgttcctaattttattgttaccttccatttctcttaagtttgtttttgtttttgttttttttgttttttttttttttttttgccacatatgtgccaagtttctctgtctctgaggttacatcttgagttggagggacttaatacacactaattttattattatctttaattttaatcatacagaacaataccttttgatcatattcttttgctttccccagatccttctagacaatacactaaataaaaaagaaaatctttcaacaaacaagaaagaaaggacagacagacagacaggccagcaatctgtatttcagcaaggtatcacgtgaaaacaagccctgtaataatccaaactgcaaggactgatttttaaatccataagcatgacttaaaaagagcggtatagaaataaatcaggaaaaggtggcaaggagacacttcttttctcttccattctactgaactgagaagatgcctgtggcagcagatagtctggtactctggccctaagttctctgcttccagagcttgcatgacaaaaaaaaaaaaaaaaaaaaaaaaaaaaagtccctattcattgtgtgccatgaaactgcagctctttgcagcttctctccatgagatgttatctactcttccctagccttgagattttctttgcctaaacccttcacacagctgcctttgcatgaaaccaggttggcttgccaagaatgcagccaagtgtctataaccatgctagactatctatgatctatccatcaacatgcagcctagcctagacctgagaggaaaccagccaccatcaacacaagcctctggagatcagaggtacgtgtaagattctcactgaggttacaaaagtccctcccaggtgagcttaacctacacgtctcatgagctgaactgctgtctaccatcatcatggaataatggctatcacaggcattgaacactgtgtgtgtgtgtgtgtgtgtgtgtgtgtgtgtgtgcgtgcacgcgcgcacatgcatctgagaaagaccattcagttaacaagttaattgggttttacattcagcacatgggtttcagtggtggtgatggtattttgatggttctttgacacggggaagggatttgaagagccagtctgctcaagtagcaaagagtcatcagaggcaactatgtcatttaaaatacaatgagaatatcaatgtcacagaaacaaagctgttctggttgtcactccggaggcctttcagtgacgactcagtaaagtcactggaaactaatggtttccttaggaattattaatgtgatacttcatggtagatgagacgtttaaaatattggtctaattgtttctgttctcttttaaaataatatattttggcggaattttctaattcttggagggttgctgacttaattgtacttaattgtaatttttgacaccattttgcccttatgagcttcagaagcaagataaatctgataccagactgtatataaacatatatttactatatattgtcctgtatattttatatatgtgtactatatataaaacacacaataaaatcaacagcaccaatgaacaggtaatgtagagtctgtactggtttgaataagaaggacccctatgaggccgtatgtttgcatgcctggttctcagttggtacaactgtttgggacagattaggattagtgtcactgggggtgggctttgagatatcaaatgactatgtcatttcagctctctcagtctgtctctgtctccctctgctttagatttgcccaccccttataagctcttagctacttcgctagcgccttgcctgtctgccagctgcaggcatgggctgaatccggatggacatgggctctactcctctagaaccatcagtctctgaatgaaatgctttgttttataagttagatcagttatggtgctgctttacagcaacactgcacagaaaactaactatatatatctaaaataaatataaataaatataactatatatacatacacacatatatgttcatgtatatttttatttagttataataatatagatacatagaaaactatgagtctagtgatgaaagtggatttgagagagtaacctgataaatctcagtagctccaagttataaaaatgaaggcccaatgggctttaggaatgtacttataacatccattttccctagtaataagactctgatttgtacaggaaattgaaaaatatataatcatatttatatgcaagaaaggagagagagataatgagtgaatggagactagattaatgtataagagagagtttcagaaaatatttagatttatcagaatatagatcatcttatagttagctttcatcacatacattcagagatctgatttcatcagtgaacacagccaaacatcaaagtcattttgtgttaaaattacttttattcaggatgaaaaatacggtatgtaacagattagatgacagtctgcgattaaccacatatttcaaaagaacaatacacttatttctcatcatggttactgtaatatatttcctcttatttattactcagaaggttacaatgtagtgttttgtgtagctttttctgtaatagcagatagagatcattttgcatacaaatacaggcaggaaataaaagaatacatgactcctcaaagcaagaacaaggacgacaccaaatctacaacttggggttctgagttccgggagtttctgttgatcttctttacacaggtgcttcctgggtatggaaaggcctgactacagccctaggttttgcacactgcggcatataaagctatgtccaacacaatggaggaaggtggttctgaggtagaaaggtgatcatggctctccccttatataaaacaattttcttcgtctcaaaatatctatgctgcaaatagacacccttgccccccaacccacccaaccgatcctaaaagaatagcaatttctaactttcagcctccttctggccagatcccagtgaaagagaacccaaagttagcatgtcctgatgttttaaaagcatatatgtttgaatcaaaacatattaccttcacctttatttttggtttctctaaaatcggcaattaagtgttaaattaaaaaaaaaagaaaagaaaaagaaaaagaagccaatacctagttgaacacactcagaagtagaggcagggatacaatcatccgagcactgatttcattctagagaagccgtggtgtaggcttgtgagtgacatccttctcggatgtgctgctggccaagtgaggggtcatgagacatctgactatctgctccaaagcttcaaatgagacagccaataagtatctgcctgctttcacaaaggaaacaaccagagctttcaaaacttacacaggactcgaaaaatacaaaaacaacaataaaagtctattcaaaggaaactgaagagcatgatgtgtgctctcctcacaatgggcaaagcctgccgtgtgttttctcatgaaaaccaaggttgcaagtactaggagaggttgtaccaactttggtttctgaatcaaaatgaaaatatgcttaaatggtaacccttggtaaaataattttttgagactattacaatacagtcttctttattatagagattgcaagatgaaataaataaagacgtcaagatctacttacaaaaaaggaataaaaacaggaggaaaaataccccagcagcttgccgttaaagtccacaggatttttagtgtagtcatccagtggttactaaaggatggtgtgtgtgacgtcaactaaagttaaatagtatcttcagaatgcctgcctactccacatatgtaaaatatttgattcaaatatatgaacttaggaatttggccagattatagaaacaaatacatagaatctatttgtttgtatggctgataaatttataaataaccaaaacataatggtaaaacagtcaaataataagtgaagttattgtacaaggttaatgtgaacagcagaaggaatgtaataatgtaaagtggtctaattcttatgcaattttttctcttggttattaaaaagacagtttcatattagaaagcccccacccactttcccatggctgtatatattatacaaatcagtgacaaatgctttaccacctccaaatacttctctgttcattaatttacagttgcatagaaaggggagaagaaaacaataatatacgttattagaaaaccaaaatatccttttctctttggatagtcagtgtttggttccctcagtagaacacccagtaagcactcaacagcttgtgtcgtggagccacggagctttggggttgaatgggtcttgggattggcatttgcagaagagggcaatactgaaggtcgggaaatgttggctggctggatagatgctcacattgcctgtggcaagggaaaacaccaaggtcagaacagcatctgcataaggacattcaggtaatgaagacttgtcagttcttcatgggaaaataagggcatctttcagaactaactaaaactttatatggctgtgttcaaaggggaccctcccccaactgctcatgtgggatgaggacatttccttcaccctgaagtcacatgccagctgtttattacagtagtcaacaccaacataaaagcagaggccaggggtgacaagacgtctttttttttttttttttttttttttttaaacaggctagaaacccaggtcaaattgagaggtctttgcttcttgggaaaggtagcgatgatatatgtgttaggctaccaaaagagtaccccattccttcatgtcctagagaggaggagacagatgtctagtggtgtctgctatgtggaaaatgccaatgggtctaaatacgggctacacaattttgaagtagatttttgaaaaaacatgtctaacttgagtacttttaacaaatggattgttttgggatgtgtctgcttccctgcacatgagcacatcttcccatctcttcttatacctctgagggttcttctgtcatctcacttccctttaaaatccttgcttccaatggaccaggacaatgggcatcaccggaagatgctaaccctacctactgtgtcacagactgctttacagacacctgtcttctagccaagaccccagttccacttgctaataagatgaaacaatgttgactgttttgaaaggactaataaattcactcaagaaaatgttttataaagatctgctttggctccgtggtatattttaattaatggctcctcataaggaaccaaacaaaactgaaagctactgggctaaagatgccagaagagctcaacgtattttcttaaatgaaaaaggcaactctgtcttcattggagtaatgatctcagtattgccctgtagtaccagggacatttcaaagtcactgttctgtgacaaatgtgagatttgaggtcagtcagatttacacagaaacttgtatagtagagagcatggaatgagaactgaaatccagcatgggtactttgggtgcctcatagagtttggtttggggaaccaaatggtcccacccaacatcttcaaagcaacaatctgttgtacagaaccaagtaacacttaaacatcacgtggctttactcatttatatggagaatgaagtaagactaaactaaatcaatagcagctaatgtgcttacgcccagatgggatcaagaaagcgaagtcaattgaaccattaactcttacctgtggcctgctggggacatttgctgaaaaagaaaatagaagaaatcaattgagggctttactattgctttgtgccttcccttctcatgcatgcaaatgtatagaatgcttttcagaggaagagaatagctctgcccttccaaggatgctagcaggaagcagaggccagccaccctgaccctctaagcaaggctagttttccaagtaaatgtctcatattctatgtgatttgaaatgcaaacattctagagagagagagagagagagagagagagagagagagagagagagagagagagagaagaaaaagaaaaaaccaaaaccccacacaaaacatatactagctcttttaaaacattcaggaaggatcttggtccgggacccgccgaacttaggaaattagtctgaacaggtgagagggtgcgccagagaacctgacagcctctggaacaggcagaggcacagaggcactgaggcagcaccctttgtgggccggggacagccagccaccgtctggaccggaggacaggtgcccgcccggctggggaggcggcctgggccacagcagcagcggtcgccatcttggtccgggacccgctgaacttaggaaattagtctgaacgggtgagagggtgcgccagagaacctgacagcctctggaacaggcagaagcacagaggggctgaggcagcaccctgtgtgggccggggacagccggccaccttccggaccagaggacaggtgcccgcccggctggggaggcgacctaagccacagcagcagcggtcgccatcttggtccgggacccgccgaacttagggaattagtctgaacaggtgagagggtgcgccagagaacctgacagcttctggaacaggcagaagcacagaggcgctgaggcagcaccctgtgtgggccggggacagccggccaccttccggaccagaggacaggtgcccacccggctggggaggcggcctaagccacagcagcagcggtcgccatcttggtccgggacccgccgaacttaggaaattagtctgaacaggtgagagggtgcgccagagaacctgacagcttctggaacaggcagaagcacagaggcgctgaggcagcaccctgtgtgggccggggacagccggccaccttccggaccggaggacaggtgcccacccggcaggggaggcggcctaagccacagcagcagcggtcaccatcttcgtcccgggactccaaggaacttaggaatttagtctgcttaggttagagtctgtaccacctgggaactgccaaagcaacacagtgtctgagaaaggtcctgttttgggccttcttcttcggccaggaggaggtccaaatacaagatatctgcgcaccttccctgtaagagagcttgccagcagagagtgctctgagcactgaaactcagaggagagaatctgtctcccaggtctgctgatagacggtaacagaatcaccagaagaacaatctctaaacagagtcaactataactactaactccagagattaccagatggcgaaaggtaaacggaggaatcttactaacaggaaccaagaccactcaccatcaccagaacccagcacacccacttcgcccagtccagggaaccccaacacacctgagaacctagacctagatttaaaagcatatctcatgatgatggtagaggacatcaagaaggactttaataaatcacttaaagaaatacaggagaacactgctaaagagttacaagtccttaaagaaaaacaggaaaacacaatcaaacaggtagaagtccttacagaaaaagaggaaaaaacatacaaacaggtgatggaaatgaacaaaaccatactagacctaaaaagggaagtagacacaataaagaaaactcaaagcgaggcaacactagagatagaaaccctaggaaaaaaatctggaaccatagatttgagcatcagcaacagaatacaagagatggaagagagaatctcaggtgcagaagattccatagagaacatcggcacaacaatcaaagaaaatggaaaatgcaaaaagatcctaactcaaaatatccaggaaatccaggacacaataagaagaccaaacgtacggataataggagtggatgagaatgaagattttcaactcaaaggtccagcaaacatcttcaacaaaattattgaagaaaacttcccaaatctaaagaatgagatgcatatgaacatacaagaagcctacagaactccaaatagactggaccagaaaagaaattcctcccgacacataataatcagaacatcaaatgcactaaataaagatagaatactaaaagcagtaagggaaaaaggtcaagtaacatataaaggcaagcctatcagaattacaccagatttttcaccagagactatgaaagccagaagagcctggacagatgttatacagacactaagagaacacaaattccagcccaggctacaatacccagccaaactctcaattaccatagatggagaaaccaaagtattccacgacaaaactaaattcacccattatctctccacgaatccagcccttcaaaggataataacagaaaaaaaccaatacaagaacgggaacaacgccctagaaaaaacaagaaggtaatccctcaacaaacctaaaagaagacagccacaagaacagaatgccacctttaacaactaaaataacaggaagcaacaattacttttccttaatatctcttaacatcaatggtctcaactcgccaataaaaagacatagactaacaaactggctacacaaacaagacccaacattttgctgcttacaggaaactcatctcagagaaaaagatagacactacctcagaatgaaaggctggaaaacaattttccaagcaaatggtatgaagaaacaagcaggagtagccatcctaatatctgataagattgacttccaacccaaagtcatcaaaaaagacaaggagggacacttcattctcatcaaaggtaaaatcctccaagaggaactctcaattctgaatatctatgctccaaatacaagagcagccacattcactaaagaaactttagtaaagctcaaagcacacattgcgcctcacacaataatagtgggagacttcaacacaccactttcaccaatggacagatcatggaaacagaaactaaacagggacacactgaaactaacagaagtgatgaaacaaatggatctgacagatatctacagaacattttaccctaaaacaaaaggatataccttcttctcagcacctcatggtaccttctccaaaattgaccacataataggtcacaaatcaggcctcaacagattcaaaaatattgaaattgtcccatgtatcctatcagatcaccatgcactaaggctgatcttcaataacaaaataaataacagaaagccaacattcacatggaaactgaacaacactcttctcaatgataccttggtcaaggaaggaataaagaaagaaattaaagactttttagagtttaatgaaaatgaagccacaacgtacccaaacctttgggacacaatgaaagcatttctaagagggaaactcatagctatgagtgccttcaagaaaaaatgggagagagcacatactagcagcttgacaacacatctaaaagctctagaaaaaaaggaagcaaattcacccaagaggagtagacggcaggaaataatcaaactcaggggtgaaatcaaccaagtggaaacaagaagaactattcaaagaattaaccaaacgaggagttggttctttgagaaaatcaacaagatagataaacccttagctagactcactaaagggcacagggacaaaatcctaattaacaaaatcagaaatgaaaagggagacataacaacagatcctgaagaaatccaaaacaccatcagatccttctacaaaaggctatactcaacaaaactggaaaacctggacgaaatggacaaatttctggacagataccaggtaccaaagttgaatcaggatcaagttgaccttctaaacagtcccatatcccctaaagaaatagaagcagttattaatagtctcccagccaaaaaaagcccaggaccagacgggtttagtgcagagttctatcagaccttcaaagaagatctaactccagttctgcacaaactttttcacaagatagaagtagaaggtattctacccaactcattttatgaagccactattactctgatacctaaaccacagaaagatccaacaaagatagagaacttcagaccaatttctcttatgaacatcgatgcaaaaattcttaataaaattctcgctaaccgaatccaagaacacattaaagcaatcatccatcctgaccaagtaggttttattccagggatgcagggatggtttaatatacgaaaatccatcaatgtaatccattatataaacaaactcaaagacaaaaaccacatgatcatctcgttagatgcagaaaaagcatttgacaagatccaacacccattcatgataaaagttctggaaagatcaggaattcaaggccaatacctaaacatgataaaagcaatctacagcaaaccagtagccaacatcaaagtaaatggagagaagctggaagcaatcccactaaaatcagggactagacaaggctgcccactttctccctaccttttcaacatagtacttgaagtattagccagagcaattcgacaacaaaaggagatcaaggggatacaaattggaaaagaggaagtcaaaatatcactttttacagatgatatgatagtatatataagtgaccctaaaaattccaacagagaactcctaaacctgataaacagcttcggtgaagtagctggatataaaattaactcaaacaagtcaatggcctttctctacacaaagaataaacaggctgagaaagaaattagggaaacaacacccttctcaatagccacaaataatataaaatatctcggcgtgactctaacgaaggaagtgaaagatctgtatgataaaaacttcaagtccctgaagaaagaaattaaagaagatctcagaagatggaaagatctcccatgctcatggattggcaggaccaacattgtaaaaatggctatcttgccaaaagcaatctacagattcaatgcaatccccattaaaattccaactcaattcttcaaggaattagaaggagcaatttgcaaattcatctggaataacaaaaaaccgagaatagcaaaaactcttctcaaggataaaagaacctctggtggaatcaccatgcctgacctaaagctttactacagagcaattgtgataaaaactgcatggtactggtatagagacagacaagtggaccaatggaatagaattgaagacccagaaatgaacccacacacctatggtcacttgatcttcgacaagggagccaaaaccatccagtggaagaaagacagcattttcaacaattggtgctggcacaactggttgttatcatgtagaagaatgcgaatcgatccatacttatctccttgtactaaggtcaaatctaagtggatcaaggaacttcacataaaaccagagacactcaaacttatagaggagaaagtggggaaaagccttgaagatatgggcacaggggaaaaattcctgaacagaacagcaatggcttgtgctgtaagatcgagaattgacaaatgggacctaatgaaactccaaagtttctgcaaggcaaaagacactgtctataagacaaaaagaccaccaacagactgggaaaggatctttacctatcctaaatcagataggggactaatatccaacatatataaagaactcaagaaggtggacctcagaaaatcaaataacccccttaaaaaatggggctcagaactgaacaaagaattctcacctgaggaataccgaatggcagagaagcacctgaaaaaatgttcaacatccttaatcatcagggaaatgcaaatcaaaacaaccctgagattccacctcacaccagtgagaatggctaagatcaaaaattcaggcgacagcagatgctggcgaggatgtggagaaagaggaacactcctccattgttggtgggattgcaggcttgtacaaccactctggaaatcagtctggcggttcctcagaaaattggacatagtactaccggaggatccagcaatacctctcctgggcatatatccagaagaagccccaactggtaagaaggacacatgctccactatgttcatagcagccttatttataatagccagaaactggaaagaacccagatgcccctcaacagaggaatggatacagaaaatgtggtacatctacacaatggagtactactcagctattaaaaagaatgaatttatgaaattcctagccaaatggatggacctggagagcatcatcctgagtgaggcaacacaatcacaaaggaactcacacaatatgtactcactgataagtggatactagcccaaaacctaggatacccacgatataagatacaatttcctaaacacatgaaactcaagaaaaatgaagactgaagtgtggacactatgcccctccttagaagtgggaacaaaacacccatggaaggagttacagaaacaaagtatggagctgagatgaaagaatggaccatgtagagactgccatatccagggatccaccccataatcagcttccaaatgctgacaccattgcatacactagcaagattttactgaaaggacccagatgtagctgtctcttgtgagactatgccggggcctagcaaacacagaagtggatgctcacagtcagctaatggatggatcgcagggctcccaatggaggagctagagaaagtacccaaggagctaaagggatcttcaaccctataggtggaacaacattatgaactaaccagtacccctgagcttttgactctagctgcatatgtatcaaaagatggcctagtcggccatcactggaaagagaggcccattggacacgcagacttcgtgtgccccggtacaggggaacgccagggccaaagggggggagtgggtgggtaggggagtgggggtgggtgggtaagggggacttttggtatagcattggaaatgtaaatgagctaaatacctaataaaaaaaaaaaaaaaaaaaaaaaaaaaaagaaatccaaaacaccatcagatccttctacaaaaggctatactcaacaaaactggaaaacctggacgaaatggacaaatttctggacagataccaggtaccaaagttgaatcaggatcaagttgaccttctaaacagtcccatatcccctaaagaaatagaagcagttattaatagtctcccagccaaaaaaagcccaggaccagacgggtttagtgcagagttctatcagaccttcaaagaagatctaactccagttctgcacaaactttttcacaagatagaagtagaaggtattctacccaactcattttatgaagccactattactctgatacctaaaccacagaaagatccaacaaagatagagaacttcagaccaatttctcttatgaacatcgatgcaaaaatccttaataaaattctcgctaaccgaatccaagaacacattaaagcaatcatccatcctgaccaagtaggttttattccagggatgcagggatggtttaatatacgaaaatccatcaatgtaatccattatataaacaaactcaaagacaaaaaccacatgatcatctcgttagatgcagaaaaagcatttgacaagatccaacacccattcatgataaaagttctggaaagatcaggaattcaaggccaatacctaaacatgataaaagcaatctacagcaaaccagtagccaacatcaaagtaaatggagagaagctggaagcaatcccactaaaatcagggactagacaaggctgcccactttctccctaccttttcaacatagtacttgaagtattagccagagcaattcgacaacaaaaggagatcaaggggatacaaattggaaaagaggaagtcaaaatatcactttttgcagatgatatgatagtatatataagtgaccctaaaaattccaacagagaactcctaaacctgataaacagcttcggtgaaatagctggatataaaattaactcaaacaagtcaatggcctttctctacacaaagaataaacaggctgagaaagaaattagggaaacaacacccttctcaatagccacaaataatataaaatatctcggcgtgactctaacgaaggaagtgaaagatctgtatgataaaaacttcaagtccctgaagaaagaaattaaagaagatctcagaagatggaaagatctcccatgctcatggattggcaggaccaacattgtaaaaatggctatcttgccaaaagcaatctacagattcaatgcaatccccattaaaattccaactcaattcttcaacgaattagaaggagcaatttgcaaattcatctggaataacaaaaaaccgaggatagcaaaaactcttctcaaggataaaagaacctctggtggaatcaccatgcctgacctaaagctttactacagagcaattgtgataaaaactgcatggtactggtatagagacagacaagtggaccaatggaatagaattgaagacccagaaatgaacccacacacctatggtcacttgatcttcgacaagggagccaaaaccatccagtggaagaaagacagcattttcaacaattggtgctggcacaactggttgttatcatgtagaagaatgcgaatcgatccatacttatctccttgtactaaggtcaaatctaagtggatcaaggaacttcacataaaaccagagacactgaaacttatagaggagaaagtggggaaaagccttgaagatatgggcacaggggaaaaattcctgaacagaacagcaatggcttgtgctataagatcgagaattgacaaatgggacctaatgaaactccaaagtttctgcaaggcaaaagacactgtctataagacaaaaagaccaccaacagactgggaaaggatctttacctatcctaaatcagataggggactaatatccaacatatataaagaactcaagaaggtggacctcagaaaatcaaataacccccttaaaaaatggggctcagaactgaacaaagaattctcacctgaggaataccgaatggcagagaagcacctgaaaaaatgttcaacatccttaatcatcagggaaatgcaaatcaaaacaaccctgagattccacctcacaccagtgagaatggctaagatcaaaaattcaggtgacagcagatgctggcgaggatgtggagaaagaggaacactcctccattgttggtgggattgcaggcttgtacaaccactctggaaatcagtctggcggttcctcagaaaattggacatagtactaccggaggatccagcaatacctctcctgggcatatatccagaagaagccccaactggtaagaaggacacatgctccactatgttcatagcagccttatttataatagccagaaactggaaagaacccagatgcccctcaacagaggaatggatacagaaaatgtggtacatctacacaatggagtactactcagctattaaaaagaatgaatttatgaaattcctagccaaatggatggacctggagagcatcatcctgagtgaggtaacacaatcacaaaggaactcacacaatatgtactcactgataagtggatactagcccaaaacctaggatacccacaatataagatacaatttcctaaacacatgaaactcaagaaaaatgaagactgaagtgtggacactatgcccctccttagaagtgggaacaaaacacccatggaaggagttacagaaacaaagtttggagctgagatgaaaggatggaccatgtagagactgccatatccagggatccaccccataatcagcatccaaacgctgacaccattgcatatactagcaagattttatcgaaaggacccagatgtagctgtctcttgtgagactatgccggggcctagcaaacacagaagtggatgctcacagtcagctaatggatggatcacagggctcccaatggaggagctagagaaagtatccaaggagctaaagggatcttcaaccctataggtggaacaacattatgaactaaccagtacccctgagctcttgactctagctgcatatgtatcaaaagatggcctagtcggccatcactggaaagagaggcccattggacacgcagactttgtgtgacccggtacaggggaacgccagggccaaagggggggagtgggtgggtaggggagtgggggtgggtgggtaagggggacttttggtatagcattggaaatgtaaatgagctaaatacctaataaaaaatggaaaaaaaaaataaaacattcaggaaggtcttagttttataaatgagaaaaaaaatctgaaaacttcattttataactatgccatgtattttttgacttttgtataataagtacagaggagagcctatatgttgtgttgaatatacagtttgattctgaccaaaagggtccttagagggaattagtattttctgcacaccttggcacacccttgctgaaagctgtaggaagaaggtacatttgcatcagtgaaaaggctagtcattcatcagcagtcttcagaacggggatcaacagtgatgccttacatgggttcagtaaagagcacagaagttagcctagggtgctaataacccttcaacattatccttgcatcggagcccatgacaaagaagctgatgtcgtgggcttacggagaactggcactaccaagacttttctagatctctgctttgtcaggtccatttttcactgagatcatgttcatgaccccttgttcttgtgatcttcactaaaaacaattcagagattaaaatgagtatagtctagaagacaaagctgatggcagagcagggtagagcccctctgaagagcagcaatggtccaagagaccactgttcacacagacattataggcgggctatcagtggttctcaaccttccaaatgccgtgacccttccacatgctgtggtgaccccagctgtaaaattattctcattgctacttaataactgtaattttgcttctgttatgaattacaatataaatatctgacacacaggatatctgatatgtgaaccctgtgaaagtgtcatttgactctcaagagtatagaggtgcacaggttgaaaattgttgctttctatgaaagaaaaaataaaaaatccaagggctgaagagatgctcatctcagcagttaagatcatcttcttcttcttcttcttcttcttcttcttcttcttcttcttcttcttcttcttcttcttcttcttcttcttcttcttcttcttcttctttttcttcttcttcttcttcttcttcttcttcttcttcttcttcttcttcttcttcttcttcttcttcttcttcttctcctcctcctcctcctcctcctcctcctcctctcctcctcctcctcctcctcctcctctttctcctcctcttcttcttctcctcctcttcttcttctcctcctcttcctcctccccacttctccttcttcttgcctccattggcactacatgcacatgttacacagacatgcaagcaagcaagcaaaacttgcatgaacataacataaaataagagtaaataattcttttaaaactatctctgaactttcctgaggaaatctgggctgtgcaagtaactatctcccataggagggagaaggggtaagcctttgtcctcaacgcctagaaagtttaggattcctatagtcttccaggcaggatgtctacctccttctaatactagagacacatttcaggacccattgttgctgttgttgtgaacagtaattgaagtctaactgcttcaccattttgctttacaggccattggctggctatgtcctctaagcctgccaatatttgacactttcgctgcagattcatattcaacatagggaaagaaagggtaatgatgacaatatctatccttggccaaaggggagtgtctctaatcaagtagcatgttacatgcttccaatccttcatttttctgtgataagggggaaaaaggacatctgtggctcatttgtgaggagagagagagaaaaagagagagagagagagagagattgattgattgagattgatttcctccctgtgatagcaggggagaatgtgagccccggtatttgggagaagaaccagggaaacataagcctagtcctacaaggtgtttcccatcagagaaaagagtgaacccctgtcctcatgtgagctataccccggaggtagctgaggtgaattattagtaaagacatgttgtaaatatacaccccatctgaaaagaaagacagttaggcttctctcttaaataatggatatgtaatagtcaaaccctagacagaagtcaaagccattttgccttcctatctcttttaatcaaataaaacattataggcggttcctggaacaagctgtgtattttaaaagaaaattaggtaatcattgtgcttttgttaagtcttgagtttttgatggatgccattcaagcctgacaaatgcaggctgatcacagcagaaacacaaggtaagttaacaataagtctaaaagcattacttctagcagaaaaagaaagaaagaaagaaagaaagaaagaaagaaagaaagaaagaaagaaagaaagctcaatttactattaatattccacatatttgaacaaactataagcagactatattatgccaacaaagaaacagttatagtcattagaattttctactacatgactggataactgtcaacacaaattaaattcaattctttaattgttagggtaagatggcgatgcctgtgtctctgctttgagattcaatgtcattttaagaggtcataattcaaagatgctaccattgctaactgcaatattgattcaaaatgcaagggttttaaaagtctttacacacaacagcatataagacacaatataaaaaataagctaacagagctattcatgctattaggatttatgaatacagacactcattttaattccaaaattgccatgagtgaaattcatttgtagccatgcaatttgtttaatccacaaaggatcaaaagtcaagattaacatgcagctcagcccatccatcacacactggctacaagcaatttgaacattctccttctctatagaaactcaagagattgtttaggcaatgagagcatgccaatcctatttagttagataaacttccaaaggtgatcaggaagcttgggagttgcagactctcgataaaatatttgctaactgagcaatttaaatggaacattaaagctaatgaatcctgcaaaacctttctaagtgctagctgggaaattttcaaccattatatttctctagctagaaacatgactgtccctgtaaaccactgacaacatcaatctggaagtctgtgttaggtaccaggtctgtaccatgcactaattgattctgtacaatttgaaatgatttagtaatcctaggtaaaattctgaggtatgcattaattttgtaaacaagacaatggagttctttttttttttttctagattggaaagcattttttttaccttgaagatttttatatttgccagagaaacatatgaatataaataatgaaaaggaacaaacaatgccattttcagaagtaagaacacatagtctgtggatcccacaggactctaaaatgtactatgtaccatttcttatttaagaggtgcctggattcttcattataacaaatgactaggagtgctcatgtatagaaaatctcaacattataaacactggtagatatacacactgccagagaatgccaacagttttcctcttaaggaactgcaagcctctttaaataacccagtgagcgccaaggatgatgtcacaggtaaagaggtctcaatgcaagggaagggtttagccactgcagtgtggtctccatagagactaagcctcttctcaggaaccaatcaccgtgagtggttcaactcaatgggaattttatccttgtatcaggggtcagggcatgaggtagcaacagttacctttgaagattaggtgttatacagttatagtttttccattatattctattttaagcaaggcatagatgaacattttaaaaatcaaatatacatatcagaatatgccttaggaaagatttagaagtgctttagaaaaaaagactcgtaaaagaaaaatcctgaacttgaagcacatttccattatagaaactatgcattttatatttttatatttattacaaagcgtagatttaagcatatctcacactctgatttcactgccaacagagttttaaattgaaaaggtccaacattaaatttaaataaaaacttctaaacagaattccacttacagaatttgctctttagtgatgaatacatttaggtggcagttcagctaaaaagtattagtgtttagaaactttaattctgaaactctaattcataaaacatgatagtttttctagccattgggtactacataagccagaacaaaaacttctgagatgaaattcaacctttaacttcaattactgtaacagatttaacatgtttatcaattacaccaacaattgatgaatctctttctcctgacttagatttgtctagggagctgacagaaaacagtaaaccaaaaaacagagacttccacaaaactgtagtttactgattgactggttttaacatccatttgagaggccccacccccaaatgataagtgaccctttcatgctccttaaaagtatttgaaactgtcacaatccagtggtgagtctgtgtctatggactctgtggacagctcctgagtagagagaccacagaggtctctgaggtgagagtgcagcagaatctcaagggtggcaagatgccaggagagaaaccacttaaaaaattcaatcgattaaaatcattatgtaatttcccctgggatttggactgctctcattgggcgattttttttggctcctggctgttcatatggagacttcagactcataatttgtgaccctgtgaatcatctggttttcacacaatgattattttattccctgaagggaaaaaaaaaagaattcttttaaaggagaggggaggccagaaataattgctttctgtgcctgactacgaagacatgtggagatatatctcaaggaacgtagaaagttaccttagaaaagctgtgttcatcctagattggcatgccgttcaaggctcttctttgaagtaacacaagtttcttatagcctgcacttaacccaagttatattctaaaagcagacattgtgctaatggactctatttagtcgcttttgaggcctgtgggaaaatctccaaggccgggatcataccatcagtggacctcagaatctctctgccatctgaatggggcttcactttctctgtcaacacatatgtctgtgttatttcaaaacagcctgcaatcttgtctctaacattggctttgctgtcgtccgaaagaagacaagagagttgcaagtggggaaggaggaaggacaggacaggcacaccacgggggcataaaggtgttactactcacagctgcaagagggaaacgtgctgttgatctgctccatcacgtccgtgaggtccgtgctagtgtcgtgaggtggggccagcaggtcctcagatgctgagacaaaacacggaggaaggagggagcttagaatcaatgtccatccttctaccaaagaaccgcttgcaggcaaaaaataccgtaaccagccccaaaataggaacaggatatgaactgtcattgaaaagaacaacttctgggggaacagaagcatctgtattcatttgacatgtcatacatgcaagcatgtgcacacacacacacacacacaaagcatacaggaacgatacagtgcgcgcacacacacacacacacacatacacacacacacacacacacacacacacacaaagcatacaggaacgatacatagatctttataaaaacatagggggaacattctaccactgagcaacatccttagctccagcagtagacttttatatagttaaaaatgtatcatatgtttatgtggataaatttatatactaagagaaaatatgaaagtgaaaaataagtagcagtgaatttgacgctagtgtgctagctgaaaaatccattattttgcacataaaatattctagcaatttctttcttttccattttggagcttttatcacagtctattttgtcttgctttatattatctcgatatgtattttattctatgattgaaactacaatagtgtttttaacagcataacagtgaggtgacactgtcactgatggtgttggtggcacttctgctgtagagcataggtggagcaatgtccacagagactaggatggataaggtagagaagaccacgttgcaggctactcttcagcattaggttctgcatgtacatgaatgtaaaagttgtagagaaacatatatgcaaacgaccagtcttggggctgaagagacggctcagtaggtaagagagcctcctgcgttgggtatgagaccgagcctggattccagagtccaactaaaaagctggctgtgatgatgtgtgcccgtaacccttagtaacgaggggggagggagctgagacagaaggactgctgaggcttcctgcccatcctatcccaggtcagtgagggaacttatctcaaagcaatcacgtggaggatgagagccgggcaccggatgtcctcctctggctcttggagcatcttcacacatacatgaacatacactacatgcacatgtgtgcacacacacacacacacacaagtgtacacacatacatgtacacatgagcacacacacaaatattctcaaagcaaaataaaagtcttgcttatttcaaatgaaaggagaaatttttcatctttcaccaaaattgaatccactcctacacattttataaacaagcacattatgactaaagtgtttttttattattaaaatggatctacattcatttcagactaaagagaataatgttctatgctccagagcacacagacgtaagaatgctagcaaccaaacaccaaaaccataaaaactccagcctagtccaaattcaactgtgcttcagtgacacttacctgcctggtggaactgtgggcctgggtcagtgtcaagtgagtagctcaatgcagaatgctgtggggaagcccagggggagacaccattgatgcgggagtcagagtcaggctgcaatcacatgggatgttagagtaagaaagatgcctgcaacctagaaaggacagtattcctcccccacctccagcccctgccatggtccttgggcaatttcagcctaggttatggcccgaacacttctcctgagacccaaatgcttgctccatgtttgtgctttgaagaacttcttcttacaccacagaatttctttatgtctgccattttcatctcccaaattttacattatttttacaccaatgtagtaaacttagaagtaatttgggttcatctttcagaaagtgccattgtactttgaaaatggcaaatgtactaactttcaatagctcccctcagaggcgatatagagagagagtgcttttatccccctggattttggattcagcagcttgaattcaaagtccaacttggagcactaagaatcagtacaattctaggcaaactacagaaacttttgtgttagatgctgtgtacaaactgttttagcattaacaccttagtgtggatgaagaacccggaggaagagatgctaaataaagctttatgggccatagccgcggcatagaattttgccaggaaagtgataaatgagtctttccaaagccatttgcccagtccgacacagggcgaaccctccatgataactcccgtgcatatctttgtgctaccgaagggcatgctgataagtacgtggtcaaaatagaaagcaggatctataatatgagaatgtagaaattcctctttgatgtagattttccattaaatccctattagttgatgtctggtagttttccctgtttatattgagttaaaatttccatctacttctggcacgcacactaaatcgttatgaagagataagagctccacagccttggatattctgagccacttagacatcagctagttccaaaaacattactgtgtaattgtgaaggcctatgagccactaggtccttggtctaatgggatggcaggggggaggttggaagaatgagtccaggaaccttttctttcctcccaagagcatcaaaaaggtatacagcacgcaagggcttcgagcagagcttgtgtgatggttccaagtggacgctaaactgtggacatcaacagttgatgattcgcaaccttcctagtgctgtgaccatttactacagttcctcgtgtcatggtaacctcaaccttaaaactatctccgttgctacttcataactgcgattttgctaccattatcactcatagtgcgagtatctgatatgcaggatatcttacatacaacccctgcagaagagccatccaatgcctccaaagaggttgtgacccacaggctcagaactgccgctctaagagatcacacaaggaaacttatgctgtactaaggtactacgtgggaacttcaaattcactctacaagcaacacccgcccctgccaatatatgtgacactgaggataggatcaagcaaacagtctgaggtcttaacagaaagccaagttttgactcacttagcaagccattattttccaaagatggagaattttcagtcttttaagtaaatgattcacacagttatatcaaagaaactctatgatgacagagagagagagagagaaaagcaagtggccaaaggagggaaagggatcaactgtccactatgttggtaatgcaaaaattataatgctttcaagattcctgacaagataaaaagaccctggtggcaactaagccaagacagctttcgtaaacgtaagcaaatccccggagaaatggttttctttaatgcagtacagcacatgtgggaaagggcatctctgttaggatgtcacaggacgccaccccacacaggctggagaaaaaggcaaccgtgctaggactgctggtgccagtcaggaaatattatgtggggaaatcaacattatatctgtctgcagcaaaggtgttctccctgttagctctgcgagctgactgccctcttctagttaagttagtcaaactattaactctctgcctgtggctccttgccacgttgtttcttccccctcacagaggggcagaagcagaaaggcagaagccacaaaccaaaggatggtagtttctcaaaactgtcagttattagccagtatttaatcataaaagaaaggtgccagtattaaaaacggtcccaatattataaaaaggaaagcaagagaaaacaaggagggagagagggagggagggagggagggagggaggaaggggccggggaaggggaggagggtaagagacgccatctctgttaaaggtgtgcatccatctctgttaaaggtgtgcatcatttcatactcatcagaaacatacgttttcctcaaaatgaaaattgtactgcttgttgtcaagaaagtttccaagtcactgctatagcagagcatcccccgtgtaagaaatgacagtggcaaactagcagccacctgttcctctgcttccttttgctgttgtcgtcgttgttttacagacagtgatttctgaggtaccttcttagtcctagttctctggaagaaagtgttagattgaagattgtaggtcacctgctgtccctattctctgtggaatctttcctgatgaaagtcaggctcgtggctaccacaggattctggtttttttttaaagtcaaactgttctaaggtgatattttagtacaaaagaagaaagaatttctatgagtcagataggaaaacagacaattttgtatcagtggagattccactcatacacagaattaactgtgttgctcatgaattgacgggtccaggcttcagtgaggtgggtgggtgggtgggtgggtcctgtggaggtgctgcacaggaatccacacccctacctgctccaggagctgtctgaggcggtgcagctgagactccagctgtttattgtgatcttccaaaatttgcatcctcgcctccagccgccctttgtgctgccgcaggagtttagcttctgctataagttctgagtcctcagatgtgtggtgaggagatacgatggagtctggaggggagcccacagggagaccccttcttaggtgctgctccttcagctgctcatactccacctgcagatttctaatatggaaagggaaaaatataaaattaaccagaattattatcagataattatctcccccaaactgcctgggaactccaaatttagtttgatactcttcatctcatagaaaaacatttattagcacgaagagctaggagggagaaaatgggcttcaagcaagagtttttccaggatccatcattaaatcacagatgcacgaggccctacccacatcccagcctgctaatgtcctctcaaacttggacctcattgtgatgtcttagataacatctctgaaaagacagaaggaagggaaggggagcgagtagtgtattttcttctcccgggtctagctcacctttgctcttcctccaagtcagcaatgatccgctccagttccccacgctcttccctctccacggacttcaggatctgagctggactctgcggctgactcacaggtgactccccgcccagggtctggcagtactgctggatgagggcatgctcatcctccctagagacaaggaagatgcccatcagctcacatctgggtgctgagatctcagagcacacaagaaataaaacctgtgacgcctggaccggtggctggaccaggctgcttcggaactctgtgtctccatggccatcctttgaaactcgagctggatgctggagttcatgctacagtgcttgtgtaggatgagctcaacatatcaaaactctcatgccacaatttgttattctcacaatccccagagagccattccactcaacagaaaaaaaaaaaaaaaggcacatccatgcctataaataagagtaataagttgctataaatcaggcttaatggggtgcacccaacctatgaccataagccgcatgcagctcaggagagcttgaaatgtagtccaccacatttttagataagaacatgttacaaatatcaatgggttggacatacctagaagcagttaacataaaagttaaagatgatataggcaagcatattgcccactgactaccaaaacagtggactaaaagatcacagcaccaagaatgactgatcttttgatttggctataaccagttttcctatgtttgataacccaaaggatttacaacgtatttctatttaaataacagcataaacacaattgtacatatttataaaatagcagtagctattttacttggtgtcatcataactaatttttaggatcaatatcctgcattaaatcattaattacatttaattcattgaagttcttcatccaatgatctgttactgaactagacacatcgacagtagtgttgatgcatgactgtcagcagcagaagagtgaagggagacaaggccaaatatgtctgtggtaatgaaaaagctttccagctgggctggaatctctgttcttcctttgtgaggcagatctagttggatgtcctcaggaaggtatgactgtcacatccatctcctggctcaggagatttcagagccctctagcatactggacatggcctggtttgatagtttttgtcaagaggggaaataaaggataaggcatcaggaaaataagacataactgatgtgttcaccagagttgaaaatggagctgtcctatggctgagccttcagtataagctgtgcagctgtacggttctctcagcatctttcgctgtagccctggatcagactctgtgctaaaacagccaaggagagcctggcagtctgggaactttattgttccacctggaccttaaaacccctttgctcttgtgcagtactggatactgggcaagcactctgattcttatgtgtgatagaaaatccatccttggcatatcacacttttgttctgatagtcaggggtctgaaattgcatctatgatttagtgtgttcttagaaaaaaatgtgtttcaggcaaagagatcagagagagagggagagggagagggagagggagagggagagggagagggagagggagagggagagggagagggagagggagagggagagggagagggagagggagagggagagggagagggagagggagagggagaaattcttggtgacttaatgggcctccttcctgcattgagcactctcactttccttccttcacagacacacacaaacacacagacacagacacacacacacagacacacacacatatgagagagtgtgactgtatatcaaaaataaaactcatgtactttggctaagcttaaagcctaacttaacttccctccctcctgacaaatgtggcctttttaaagagggtcttttgaaggttgtttacaatgatggtggaaaataaaaatacagcaggtagatgacacaaaagatagaattggccatgacgtcatctcacctttcatagtaaatgcaagatctctagagggaacaaaagaagtcgcatgatgtcctgagggttcaaaggatgagaagagcaggaaagttgatatacgacccctgcacagcagctaaaacttctaggctactctagtggcttggatatgtttggctcatgggaagcacactattaggagtgctgatgccactgtgtgtggggactttaagggctcctagcactcaagctctgcccagtataggagagagttctctcctggtagcctttggatcaagatacagaattctcaacatcttctttataatcctgtctgcctggatgttgccatgcttcctgctatgatgataatgaactgaacctctgaacctgtaaggcagccccaattaaatgtgttcctgtataaaagttgccatgggcatggtgtctcgtcacagtgacgaaaccctaagacagctacccacacagaagaatgaaacagagctctggcaaggaaaatgactctacaagtgaaagtggttgccccaagccagatcactggagtttgctctcccggagccacaaggtggaaggagagaactaacttccataagttgccctctgaccttcatgtgtatgaaactcacatgcacacacacacacacacacacacacacacacacacaagttcatgatcagtagcctagacataagtacttgaagaggcagaagcagagatgaagccctgacgccctgtgatgaataaatccatagcctgagacacgagttagagactgtgtatcatgggtggtggttccactctgagatcaagtggaaaataaggcagtaggaaaagatgtgagtccaagatgcatcgaggacagaacagatgggcaaggtgtaaggatggagggcacacacactaaagcaactgcaaaatgagagcacagcagaacatactgcaaatattccctttcaggctgaaacacacctaagcaagcaactaaacaatgggatatccaagaaagcggaaaatgtgttatgtcagtaaatgttctatgttttaaggataaaacaccatgagtaatccactaaaaatcaaagcaaaatgagcagtcatttacaaaggaaagaaaagcttgggcccctcctgtcccagatacctaagattcaatgacaagggggtgatgtgtggaatcctacctcagtcattcgcatcagattgacgcagatttagttattgaaataaataaaaggcaagtcaaattagttatataatgcctgtggatactatccctaaaaaactcaaagtcaataccttaaaaaggataaatcataagaatcttctgaataaaaatcatgtacccccaaaatagcctgaattatcttatggctaggactggccacagatttggactagagcccctgcgattgggagatagcagagatcatttattccctaagaacatttgtgtagacacttgggcctggggactaggtgcttcgtaataacataaaccacacttttggtttcaaatgttgggctggcaagatggcccaagtggtaagagtacttgctcatgtcctaggttccaacatctgcaagctacacggtggaagaaaagattagcctcctgtaagttgtcttctggtctctgtacacatgcaagtatgcatatgcacacacaactgagaaattttttttttttaatctgggcactgggaaaccacttgaacttctctatttgggaagcattttgttgtcagtattaatgtaaattcgcctcctttgtgaacttgatgtacagggcgttgtaataattatcatggccactaactacattgtttgttatggtgtctggaagagaattaaggtcatttctgtaaaatgaaaaatagaataatttacatgtagcataaaatcttggccttaaatattttcatagattattagccttaaaggttaaatacaaaaatagatctgttctagtgtttaattgtgtataataaaaaccaagagcaccctcattatgcagatgatacatcatgcaccagattagggctattaaacatcaatagtgtgcatcatgctgaaatagaaagtttttttaaatgtagcctgtatcaagaggtatcattagatgcaatataattatactgtatgtgatacatatagtaaatactatctacattacaaaattagtacctgtcacatgatgaaagagctgtgattcccttgatgaactttaaaaccaatgctctattccagctttcagatttacaaatggtaatgttgaggtagaccatgaccaagccccaacttcagtccacataaaacagcatcacccaaaggcagaaagtggatggagtgagaagctggttaacggcctcagggactgctgtctaagggtctctctgagtcttgcccctcctgaagatgtatttgaataacttcctacgaagatactgagaagccttaaaactaatgccccaacagatcatctggagtctggctttcagagaaataggggagtacttgggactggattatgtaggggtcaattttgggaaactggtatatatgatacatgaatgctcaatacacagtgaaggttcatggaggggagtacttggagaggggacagggaattgtttccatgatcctacttgaaggatgaaagccacctccaactacaggtatgttggctatagctgaaggcacaaaacccaaataaacaaaaaacaacccaaaaccaaatattggtgaatgatctttgctagctctgtggttggaggtctcccatggtgagcaagctcacccttcaatagtgtgtgcagaagatgcggaagatacacagctgcatacccccccaccccccgactaaacatcacccaggggcagcgagagtacaatgaggtaaaaggagctggaagcacatgcttgtcaccagaacactttacagggtgagacggaagattggaaatctgaggccagcatgtggcacatagtaaaaccctgtctataaaagagggaggaaaataaaaacaaacaaacaataaaataacagcaacaaaacacaataagaacaaaaacagggctggtgggttctgagcactctctcctaaaactaaacttaatttacttatcaatgcacatacatgagagaatacacagactggaatagggctctgccaaacaggccacatacgtcctgagtgtaacagctgcctctcacaagtggctccatcacttcactaccgtctaggaataaaatgaatatctgttgaatgaatcaccacaccaaaggtctctgtgttaaatctgttgagctgctaatcatctggataacttctccgttctgacacattcgcgagaaaactaaaggacagtgcacattgtatttcctatgttctgcccacatagaaaggaacacaaatgttctgaagaagttagatttttatcataactattatttttcagttcattaaattccctgctgcttttaacactggtgaggtgaggactagcctgatttaagagatatttaagcaacttaattactttatatgaaacacttactgttaggttatatatgaaagagcagggcaaatattttattatcttgagctgaagtggtttctggttcataacacctgaataataatgcctcagccatgacttatgatgcctaagatgccaaacttttgatatttaaaatagaaaaaagttcccaagagcttctacttataagcttaatgataaatgaaatatgaaacagacttaagggagtcattctttatcagtgttcttagcaatgattatcaacctgagggtcacaacccctttgggagtccagtgactctttcacaagggtcacatagcaaatatttgcactatgatccaatcagtagcaaaattacatttatgaagtagcaatgaatgctacttcaccacaacacgaggaagtgtctaaaggatcacagcattaggaaaggtgagaaccactggcttgaggtattattctacttggctttcttccgtctttgtgagtgagaacatgtgcacactatattctagagcttctcaggttctcctgggctccctgactggtcaaaaccatagtgagcctacaagtcacatcaacttgaaactatacaagcctttttacacatcatctcataaaaaaacaaggtcaaaacaagtcccaaagagaaaagatctattacaacattaacatcagagaggaagcgtttgccaagagcattccacagccaagcttaagatgtacaaataaggaaatgagatataaaatatctagctccgaagctatttctaaaagatattataagtcaatgaagctttccccacttcctgataaaataaaatatttgtaagggagttatttttcagtgaatggcagaatgagtctgtccaagcatgtgtggagggcactgttaacagcagagactatgaagaaaatgttagaacgcacaggagagaggaagttacaaaagtgtgttgatcctggatgtgcatttgtaaaactatcaataaatttgtaaaactatcaatactatgggtgcgagagacggctaggttggtaaaacactagccagggagccaatgaggacctgagtccagatcccagctctgatgtacaagtggggtgtggtagcacacatctctagttgagggaattggataggggtgggggtggggggtggagagagacagagcttatagggtggccaaataaatgagatccattttcattgagaaactttgtctcaaataaataaataggagaaaattgataaagatatctaatatttatccctgtcctccacatacatgtgcaaccatatgaacctacgtatatatgtgtacatacccacataaatacaaacataaaacatataaatatccacaaaaatacatatcaatattatataattatgcagcaatctgattattctaaagcagataagttgattcctaagtaaataaacatgcttcatttacactaacatggctttaaaagttaaaatgtgcatagactaatatgaaacacacatcagtttggattgggataacaactcagatgccatgatctatgaagattaatcctgagaccataatacaaggaggcaaggttagtcagccaagaacctcccacattccagaaccaggttccttcctgccttccatggcccagtcatcaccaataggacacgtttccaccatcacataccctcccagtgtatgtgctccatatcccctctaaagcccaccatcatgacctggcccatctctctgttgttccatccctcctcggaggcagccttctacatctcctcacttccccagtaaatcttttctatgaggtctgttgcatggtgtggtgtctgtggccttccttggccccaatctctgagatactctttcacaaccccaactatttcagttggcctcttgggcagactcaatgcacgatgcacttacacgcttcctgttgtagagctgctatcagttaggaaggacccgtttgtcctttccatctgggccagtctggaaacacaaaaacgagaagatgacattacacggctgcaactggaacagtcctccagaagcacccttgctggcttttaaatctatattatgacctaacagaaaatagtccagatctcactcagtggtggaattaaaaccatctgtactggtgagctgaaatttgattgccattcactttgggcctgtaggcggtataccacagtgtgaggtcttctcattgagccctcaggccctctagctggtctccactgaaacagagcaacctttcacacaaacctaattttgttcctctcaggtctgaagattcaccatgacttctcttgacctagaatgtgaaccaactcctgatcaaccgggctctgtgttatcagactatggtctttgttaaccccacagactctccactcctctcccttctgtagttcaataaagaagctacattcttctgtagcatgttatccaacagctccaaaaaatctgacttagtcttaattcagcacaaatgtgaccatttttttttaatttgtttttttcgagacagggtttctctgtgtagccctggctgtcctggaactcactctgtagacctggcctcgaacttagaaatccacctgcctctgcctccaaagtgctgggaataaaggcgtgcgccaccaccgcctggccgactattttttaaaaatagcttttaaactaaggactttggagacagctgccttctagtatgaccaatggttgattttacacactttcctgaaagttttgcacactgcatgcagatctatagtttgctctgcttagggacttaaaaacaaaccctaataatcaaatattagcataagtttaattacatattgcaattcatatgtgcgcagtctcccaagggcagttccaaatgctacctttattcattggaattaggttatattctctttatcctgactgcttgatgtttggagtctcagcagctctgtaatggcagtctattgtaatctactcttcacagaatatatagcaggtgtttggtaaagtacaaattacatcatgaatagataaaaggccaggatccacatggaatagaaccatgacttctgcaaatacactcctaccacaaggtttgtcagcagcactgaactactacaaaagcagagtgggggatggttatcagtctcttaccgtgtagcgtattgctctattcttgagtgggtgtcatcatgaaacagctgaggggactgggaggggctgaaaagggggaaataaaaaggcaaaggatttattctcaatattgacagatgttaccagttagaaggttagttaagtaacgaatctgccatgcaaacaaaccaccagcactgtcacccaggatgtaaaagtagtagtttagacccatgctaatattcctgattagaactccccgcctgtgcacagggggctgtgaatactcactcatagtgctctggccacatactgatgagcgtgataggactgcagagaggggacagggagacaaaagtcacagaacaaacatttagagcgatttcagacaaaagcagacggaggcagattcgtcttccactctcatttggcttccttgatcatcacctcaccgccagggaaactgaaagcaactttcccacacctgcagcatccatgtgtcaagatgggcatcatgttttagaacagtgagagtgaaaagatcagccaaatgtgctaagatcgtcccacattataggctgttggaagatgatgttccagaatattctaagggagacacagttcttttttttttttttccttggaaaagacattgaattagaaaggtgaatttattacctaattactagactattgacatcagaattgaagtaagaggggtttatggctcttcattcagaaatataaaagtttaaattatgtgtacaccacatttctcaatttcagaaacacatggaaaagaaaagttttccttcctacctatgccctcctcagagtcagagcatcagcacactgagggtgacctcgccaggacaggacagacttccatccactatgatgctattaactagaagttcgctctaggaaacaacatgggccaaccagctctgcttgaatcaggggcttgggtctgaggcagtgcaggggccgccctagattttcagatcccctgagagcctcaaatctccatgaaatgccattgaaacaactcatcccaattaaacagtagttcaaactcttaacttttgagagaaggtggtgacgaattacctgatgaatgtagaattttaaaagcacaaggaaaattagtactctaattatgtaaagtctcttgaaaaagctattgctgatcaagcaaaatcctttcagatttccttttctattacatatgtggactggagacataactatgatcttattatctcctgctgtgtgaagcacaagatgatatgtgcactacagacattaaagagatggaggtcatcttattgggtagaaagctaaagttctttagatctgctttcaaaagtgggcattcatcctctatgtctgccaaaatatgtattctgtaaatagagttaactgtgtccatgtaaaggagaagccgggacagtggagacacagtatcattcctcgtctttagtatatcactacttctcattatccctgaaaccttgcaaatggcaagagacagacagctctgcaccctgtgtcactcttcctaaaacagcaactgcttaagaaattatctctaaaattcaagcctaggacaacattcaatataagctttcaacagaaaaaaaattgtgagtgtatatatatatatatatatatatatatgcacttatcttaagaaaccctggcaaagctttgtggattggctttagcgattcttaggaagttaattgttggcacaaaaatttgtgaactaagaatggaacaggcagaaagctggactgaaagaagaacatttttcacggacaatatcaaataaaggaaacagatacaaaatcaaactttaggtttctttgccttcagaggactttggctcacagggagaagttgtgatacaagctcacactcagtaggaagaaagaacagcagcgccgcgcttcatccctgggacctacagtaagaagggttgagctcacttgccaggctgcttgtttggcatagatgagtctctgactgctactgccagcacccaaatgcagagaagtaaataataaaataaaggcagcatcaatctgtgagctaccactgacttcaaaatggagctgcttcctgttttcagtgtagcagctcagcggggggtttgactaatttcatatgctatgagaagaatcagactctaatataaatgtaagtctatgaattccaacatagacatctaatgacgcaaattgccagcagtctcctcatatttccgtgtttttgattctttaacccatttgctccaaagctgttaactgtttctacctgttagatcatagcctggtgcttgaaaaccagactagtcttaccccctccctctccactccctatagtcagtctgtccactgaggacagcaaattaacaagaccctgtaattctggctggttcgcatgccataaaatataatgtgaaaatgtaaacaaatatactttcctatctgcgtcatgtggtgttatagccaagctccccaacttctctgtctctctagattgtgtactttccacctttaccatgttgtctataactaacactacctataacactgtctatagctaacattacctacaacactgtttatagcttacactacctacaacattgtctatagctaacactacctacaacagtctatagctaacactacctacaacactgtctatagcttacactacctacaacactgtctatagctaacactacctacaacactgtctatagcttacactacctacaacactgtctatagctaacactacctataacactgtctatagctaacactacctataacactgtctatagctaacactacctataacactgtctacaatggctaacactacctcttctacacattcaacttaaagtaactttcttttcaagacttatatttgtatttgtctgtgtatatgccactgtatctaccctatgtctgaacatgccaaatgtggggtgggtgccttcggaaaccaggagaggccactggatgtccaggagctagagttacaagtggttgtagctacccaacatagtcactgggaattaaactctggaagagcagatcaggctggtaactactagggaatctccctagccccaggcaaactttcgcaatgcttctataattctctcctacctttcaggcccatcaagatacctctgatatgatatattgttgctcaaaatgctctgccatgaccatggttcctgtgttagtgaagcccccttgctcctactaaagttcattttctgaagggtaatttcatatcaacatctttcctgaaccatccaccactcttttctcgtaattgttacctgtgaactctctcactattctcaagttaaaccctggagatgtgagcatagataacaaggtcctttatcatctggctctgcctctctcatttgtttttgatattagtttcgtgttagaactttaatccaggcttttgaaaatgattcatttggccagtgagtcttttccttcacctctggccatcctgagtcctcagcagatgattcaggcaggtctcagcatcgttatccgtcccttccagccttgaacatccctctccacaactgcgcctgctctgtagggattcttcaaagagtgactcagtcactatatattatatattatattcactatggatatattacccaataccagaagtcggtgtttcttgttgtttcttaatctctagggaaactaaactaattctaaagtcactaataatctctcagaactctcaaattattcctgccaccattttattttagctctttttttcaacttcattatgaataaatttttctcattttgaaaattcttgcatagagacctattaaattaactgaataagccttagcatggacatgtttacccccatttagtaataagcatttctcctcatagagtccctgcatgcatgcctgcatggctaatcactggtcagaaattaaagtaccacattggcaaagatgaaagaagtcaaaggaagctttacccagctccataaataacttcaacactttcaccacttcaatggtttttctccaatgttctctcctcccacaagtaggagaataaatgaaatcaaacatttttttctttaaaaaaaaacaaaaaaacaaaaccctacccactcacataaattgttccactggaatgattaagtgaccttggagcagaagagggttcagcagaaaaatgaactacagcaaatccacagagctctgcataggatttgaagaacacccacccacactatctagtagctcataaatcttgttcaaaagggatttggtggcatccaatttaatcagatgccccttcctttctccttcttgtatctctcttggaaaatggtgggaaatttatgttaatcagggtgaggcattttcagcgtagtatatcaaaagcagagaatgtaattattttgcatggttttctgttcatttttacttggaaaaaaaagtctctaagtggatcctgaagatggctcagtcagtaaaatgtgttcactgcaagcacaaaacacatgaattcaaccccctgacccacatggaatctggtcacctaggatcccagtacagaggcagaaactggaggatgctggggacttgctggctagccagccttgctcagaaagcaagctccagactcagtgagtgaccctgtctcaatcaataagttgtcagcaattgaagatgacaactgatgtcaatctctaggctccacatacacagatgaactcaagtgtgtgcccacaaatcaaatgtcatgatcattttgacatgtaaaggcaaaacattaaaatttaaaagaaaggagcaggaaatatccatctatctatggctcatgtgaagggtggagatatttgggatgaaaaatggcgatgatttatgaaaatagtgcaaggcaacattgctcaatacaagtctactctcttccctcttagatcccagcacgatgtgatagtcaacctacaacactatatgccacaatgagctatgtcaaaggttaagtcgatgtgatcagagcagaagaaagactttatcaggtcttcaggaagtcaaacttgtatcggatacaacaacaagaataattaatatacactctttaaagacaaaagcatattcacaaaagacatgcattttctaaatgtatttaaatagctttgtttaaaataaaacaaatgttaaatttgtcttatgtggtatggaagcaatgagaaaaaaaatgtattgttgtgggtagtgtacatacttttttgggtgtgtgtatgcatgtatatacctacacatggaggccagaggtgaatgctgggtgtcttccttaatcaatcacccctcatatagtcacatgggtgctttgcttacacactccagcatacaaaaagcattgcagttgaaacgctgaagtacatgctttaaaaagggattcgatgagttaaaatcacatctactttgatctcaatagaagactgcctggtgatttaaaatgtccatgtatgtatgtcttctggctcattttaacatctttcttcatctcatttcaagctctagagtcttttgttttctttcttagctttatgatcccattgtaattttttttctccctcctaatttcttagaagatgcttgttaactcaaattgcagacttgtaagcaattttgtctgcttcatagatgcataaagatacttcatttttgccaactttatctttaaggagatgacaatgaaacataaaacgagggttcagagaagagttgcatttgaagtgtaagatgaaatatttttgataatttaatttaaaaagatataatgtggagctgaggatataactcaaaagtagagtccttctctagtaagtataaggctcagggttcagaccagtaccacaacacgaaacaaaataatgaaaggtattataacaaaaagattgaaacctatgaaagggaagaaaggaagggaaataaatgaaaaaatgaaggagcaaataataccacattgattgggcaaatatttctaaatacagagagagagagagagagagagagagagagagaagaaaagaagaaggagaaggaggaggaggaagaggaggagaaggaggaggaggaagaggaggagaaggaggaggaggaagaggagaaagaagaggaggaggaagaaataataatacacattcggaaacaacaaacaaaaatccccagataatacaaattaactgttgaagagcaacttgtttcaaaataaaatatttcatcaggacacaaatctctttgaaaagatgcaatttgtttcatgttgttagcactagtattaaagacaatgaggtgcaagcacgcacaaactgaatgctagaacagaactcacgtttctaagttgtccccttccagcacggtctggacaggcaggtagccaagccgaggatgtttggcaaaatatttcttggacctgaacttgttcttcagcaccttagtgaaatctctcacatcttccccagatgttgtctataggttgaaaaattcacagttctggttaaaaaggctacaacaatatctacaacaaaagctgagcagaagtaaggtgacggtcattaaatgccaaaaatacctttatatacctttgaaaagcccagtatcaggaaaataaagggtaattgagactctatgaaagacacattcagttatgccataatttaataaaacgtgttaaaagtaaaccactaaatagcttctttattctatattttaaaacttgatcccaaaattacagttttggaaagcttactggaagattcctgtgagtaaactgatttccatctacaagagtagtgatgacattccagaggacatactttgaattgggtttaaaaactgaggtcagtgcttagcctatgctgcccacaagctaccacgcattctagttgggagaaattttaatcaataataaagaaagggcagtggaaggggacatggaaggtgcatgcccataatctcagcacatacaagaaagagacaaaggatttatatgtagctcaaggccagcctcggctacttggtgaggccctaagtaaatctcaaaagagctgaggaagaaaacaaagcagtcaaatgaacaaacccttctaaccaggcatggtgtgcaggcccataaaccccaggacttgggagatacaagcaagaggaataggcataccaggctagcctgagctacatgagacactttctgaagaaggaaaaaaaaaagcacaagaggggggaggggaggggaggggaggggaggggaggggaggggaggggaggggaggggaggggaggggaggggaggggaggggaggggaggggagaggagaggaagcaaagggccacctcaggattctgttaggaaaacagtctaagtttctcaagtctttatcaaccaagcagaaaaactattgttatacccagattaaaatgtaatatgatgtatgatgttgcaatttccttaaggatttcaaaatgattggtgttttagtttgttgtttgtttctctgcttcgttgagccagggtgtctttacatagccctgaaagtgctacagcatgctctgtagacaaggctggcctctgcttcttgagtgctgggactaaggtcatgtgtcaccatacctggcaagatgataaatctataaccatttacatgtgagatatgcttagaatcctcaaagccaactctcttatctgattccatcaactgttttctaagcctaattttatactatcaacaattctagtgttcatattcaacacagacagaaactctagtcctggcgatccagttacatattcagattattagcagaatgctgaactactactcaggtagtttgcttccacacttagcgcagagtggattcattgccctctttataaggagacagagaagttatctatataacacaaacggaatgatgcgtatgtgaatgcactgtgccaactggtcccactttctgccttttatttaatggcaagtgacccagcatcatagagacttgtttacaaactgaaactgtttatttctggatagggatttgtgattccactgctcctgtgcctgctcttagcataggcagttaacatacaaagaaataccaaatgaagaatgtgctctagcttcaactcggcctgtaactaagtttggctatggttaggcattcatcgctgagtccagaggacttgaatttgtagccctgagatgaatgaaagaaagccacatgaccaggttccaagcttcgctgccaactccccagtagtgtacagtatacaactcactggttatgagtccacttctacttaaacaaccacaaccctgtctacttacatatacaatgactctatcactcttcaaagatactctatgactactacccatgcccaggccctgccaggtattaatatagcttctgtctctatgagattgcttattctgggtgtttcatagacagatcttcatatagtatgtcttctgtggtttctatgctgttctggcttatctattctgggtacctatgtagaatcatatttgaataaaaagagagaaaccactcaaaggtaccactcaaatgtccaatcgcacattacacactcttcttcaactatatccaggacctagaaaaccagggccaatctaatcaagcaataaagaagcactatttctctattcttcccccatcaccaaaaacccaacagacccctgatcatttcccccagagttaaggcatacagtggagttagattgcttctaacagtgcatgtgtattataaaggagacagccacatagaaacagcatgttttaatttcttcagtaatttttgtgttcagggaatataactgtttgccatccaaagttgtaatctaaggctgctatttcactggctctataaactttatcgcaacaccaaagaagatatgaaaagtgactcttctcatagccatgggagatgacctttggtataagagaatgtaattctgcagttggaatagagccaaggaaatgatttaagcttaatattttgcactgaaatggtaaaacattgttgtagacttcgtctaattagccacctaacggcatttgctagcacctctctattttatagtgctaatgcaatgccttggcaaagagaaacccaccacctaggataatggaagccatcattgccatcaaactcaactcccgctgcacattaggtgtagtgttttgttgtttaaaagcagacagctgttgctgttacggcgggaagcatggaatggaaaggaacttactggaaattactgcacaatgagtcaacctgttaaatgccagatgcatttcttggaacattaggtacggtttttttctcactttattgaaaatagattcttttctctcatactatatcctgaatacagtttcccctccctctacttttccaagtcccttccctccacccctcctatccagattcactccccttttgtctcttactaggaaagaagagacttctaaaagataatattaaaatataacaaaataaaatatggaaagatgaaacaaaactatcacatggaagttggacaggagaagcacctcaatggtagacttctgctcaaaagcagcagtcctgttttctacaaaccatgtgatgtctctagaggatctacagttcccaagcacttttgcttccttctctttccctgacatggtgataatccagtaggtcctgtggctgatggtggcctgtcatcagttttgtttggagactttcttggacctggattttattgcagatattggctctgtggatttctagattttgctaactaactgctctgttactttttaggtagctaacaaagaagaggaaacagcaaacacaaagagaatgagatagcttgaaaccacagagccaccatctccctcaaagtccctctagactgatagctcacagcctgtaagaactcacaacagagagctgccctcctttccttctctttttctttcaaagctagtgatagtgcggcactgtgaaaatactgggtgtggggatcctcaagaaacaccccattcccctgaagtgaagcagcaacgacaggatcaaagcttatttaggtaatgagaacagctagttctccactggctttccatcatcacgaatgaatgaatacaatattgaaaggcattacccaattataaaggctaccacagatccaacctaatcatgtaagcctctacaaaactcctaaggtattgaaaccaagtaactgcatttccaggccctattttaccaatgacaataacaataataaaagcctgcagtgtgtgtgtgtgtgcgcgtattaaaataaaaataaaaaatatatataatctttatatatatttgatagtatgttttgcttgcatgtatgtctgtgtgccatacatataaactacttgtatagggcagaagagggtatgatatcccctagaattgaagttacagttaaaagccactttggagctgagaatcaaacttaagtcctctataaaaccagccagtgctcttaaccactaaatcttcactctagcccctatcaagaatattttaaagtcctctctaattactccttaattgagagtaaaaatagtctacttcaggtgatgtagactttgagattatctttggcttcaattgaatatctctatattaatgcatgtccatgaatccccatgttcctggtccatgttttaaactgcacatccttagcttaactgttgactccctgcacaatcttacacttgaaatgcattgatggatgactgacagttacttccttctcatttaatgtgacaaatgaaaatgcaaggccaaggcgcagaagagtctaggattcagaaatacggacctccatgtaatttattggcaattgacttgttgaataaattactcctctacttcagctgaagaaccaacagctcctaatgccagagagccacaaggcaccatggagaaagagtctgctcacaatgatgccaaaaaagtccaaggacaaaacccaactgctaattccagattaatttaagctgaataacaaaaagaactgaaaataagcaaaactacaaccatgtttgtttttttttctacctcccagtaattttctcagtcataactcaagtgacagtaacatcgatgtccataacaaacatgtccagcattagattttcaactattaaattcaaatattaataagttgtacatagggagatacagaagtgtgatgatgtaaatcaaggtaatataaagatgcgtagtcatgtgatacatggggtgaataagaaaatgctgccatgtgaaccacgcacaaacgctgcaattattaaatcgaaggaagcacactcactagcaggtttactgaggacagagctgagggacacatgcacacttctaaatgtgcatttcattatcctaagacttgaagacactccaggatttttttcttttttaatggcaaaactaaccctgggttttcactgatttcaacaaagtaaaattaagacatgtctggattctacagcttggtggaatcagtaagagaaactcaaagccttctgaatcttaatgagggagggcccagaaagctaaaaattaagtaacattgacagaatcaccgtgaacaaggatggtaataagccaccgatgtaaagcagagcttgttgcagcctcctcttaagagctaatggctcatctaaatgtaccagacttgctggggaaccaacatcagggagataagagccgaaaatcaccacttcgggatgctgaagtcagagaaatggcaacgaggctgcagttttagcatattggccaatatcccaatgcacatctgaagaagcaggcctgccaacacaaaccgtgccgacggcaccaggacagagtcagcactttcttccagttgatactcacagccttcagaacacaaggatgctggcaaaagggaggagacaaagccactggtgccagttggtcccttttttctcttttatttgatttttttctcactttttgccaatacaattcaaaaaggcacatttaacttaattaaaaaatgttttttaatataatattttgattctattggatcctaaaaccacagataattatccacctacaaattcagagcattaagaatattatatagccaaaggccaagagcaataggatatttcctatactttaacaactgggctatgatgacttggaatgtgatttcaacgaggtaaatatttggagcccaatcttaagagatcaccacgtcctctacccaaaagcccagccccaaggaagacaacgtatgctgtaaactagcccaggagataagatcaaatatgtgctgtccccagctgttctacactctgcaagaacttatctgcagcccctgcacaatatatcagtacatcgtctctgcttctgttctcagtaaatcctttttacctgcccatacctcttgtcttccacactatattttgcataacaaatatgctaagagctgttctaaaaataacttttttttttttaactatagtaccctggaagtctccatacttttgctaagttgactgcagaacctgatgaagctattgatgggattctgaaatacactgctactattggacttttcacataaacaaactgtaggtatcgggaaaccttagccgtgctgtcacttctgtaaaaagatttgtctcagtttcctgtgttgggtttataccacacagcacttcacagctaggtatgagtgtttgttgttgtttctgtttgtgagaagtaacacattgtattaaatacatacggtttttagctacacagttttgattaaacaaagtattttctaagtaatgaagatacagccatgtacttgcttaaaaattacactaccaatctgttttaagtgacagtaatttagtgtcttcacagaggtactcactccccagccccatcccagttcttcttagtggatcccagagtaaccaccagtacaatctagctctgtccaatgaccctcaactgatcaagatttactgtgactcaagaccaacagtgagaatctggacatagccaatacttctgcccttctaggtaacaagtttttgtaaatctcatctctagaaaacacatctctcaaacaccctagccaacccttcatattctgaactctgtatgtagcaataccacagcctctgggtttttcctttcccctaacttagcgggggccactgtctctcagcacatgcacacagcctctgtctacttttcctgcttcactgttgtaccctctacttgcttccaaagattcccctataacatgttcatatctttttccataaatgaatcccagtgctgatgacaacagaaaatggggtttctattccatggagctcagtacatgttgcctcaaacaaggcatttgaaaaaaaaaaccagcagaaccaggatggtcactctctgatcttctccaccaaagaaactcatgaggcctctcttggagaggtaggaatcaccatcttgttgctgagtgttgaaagtgtcccacaaattgtggataggatgttatgacatgattgggtaatatgggttctgatatcatcagtggattaaggatatggcagaagagtgcctgatgaaaaggatgtgtgtagctctttctcttttcccctccatctcttttgtgttatcttgagtgtccttcagcatgcaataacctaacacaattgttatgaccagaggcagaatttaatcttagatttctcagactccaaaactatgtgacaacgaaccagctgtagtttgtaaacatctcgttttcaagtgttctgttatggcagcagcaaatgtcttgatgggttttgaagatacaggacatggagcagagtcttcacatgcaggctttttatttctctaggatcataagctataccctatataagaacatctttgttcacttagaattctctgtctattctttatgaaatccttagcactgaactaaataggcttcccattttcctgggtctgcatttcctcatggaagcctcagaggtcagggaaacttggcactaaatgaacttgtgtgcatttgataatctctcttcagctctgatcttaaaaataggaagaagagatatttcttttccttcccttacattattcccctcagcctcaccatctgtagccaatgtactattgaagcctttctaaagatacaatatcacacagctataacttgtcattttcttaaatgtcctcttacttctgaaaccctctacattcaattttagttaaatgttgggatgtaactacaccttaagccttgctaaaactcaaaacatttttcagtctataaaaaataactagggaaaaaactgttaactggactctttgaagtctccctctccttttgggggaggccttgggggtggtggatacaagtctttgtcaccccagtactttcatctctagccctttcatctgcaatagggtttcttcagcacgaggaaagcccatgacaatcacaataccataactacttggggatttcttactgctttggcctttaactaaaattatcattgtctaagtctacagctcctaagcgctggagagccagagctaacaactctttggtgattgcctcagctgtgcgcttgtgtcaagatagcacctgacttttctcttggtgattcagcctgaccctagcagagattataagcctttcccactctccttagactgtaaccctatttagcgctcgctcatagttagaaattgcacacactcttataaactatgtgtataccaccagcctgaaatctaaagatatactattactgattcagccaccatggaaaatggtctgaagtcctttaaagaagttaaaggatcaatacaaggtgatctagaaattctacttctagacacacacccaaggacaatgacaacatggtctcaaagaggtactagttaaatattccacaatacatggattaggaaaatcaacacacacacacacacacacacacacacacacacacacagagagagagagagagagagagagagagagagagagagagagagagagaacatggggaagggcttataatttatattcagccttataaaagaaggaattcttcccatttttgacaacacagatggacctgagtgaaatgattcagatatacaaagaaaaatattgcatggtctcatttatacaaagaatgtaaataagtgaggagttaagctgagagtggagagggtagaatggtgattctcaaatctggagagaggttcaaaaatagaaagccatccaaactgtcagttgtaacaagagtgagttcctgagtctccatagatagcactgtagctatagttaagagtgtatgttgggtctggtagggcagccctgtagttctagattctcagaaggctgaggttggcagacagcaagttcaaggtcaagctatgcaattttgaaaccctatctcaaaataaaaatgccttttaaaagatctgggatggagctcagaagaaaagtggtttcctagcacgtgtgagaccgtgagattggtccccagtaatgccaataccaaaatcaaaacccagtctaacaaaaatgttgtatggatgaaatagtaaaataactttttttaaaaaaagaactttcaaattctctaattacatgaatgatttttctaattcaaattaaattttggttatttacagcagcaattatttaaaggagactgaattttcattacagagacaaatgattttattttttagatgtgctgggaattttatctgaaggcaacagtgtttaaaagtagaatccttaagagtgaattacatcatagataccattaaggatggatttgatcacaagagctactttttagcagtgaagattcccgatagagaatgtgttcagatccttcccctctctttcacacaggagctgtcttgcccttctattttctaccatgtaatgatgcaagagatttctggccccatgaggtcccttccaacttagacttcctcacttttagaaacagccaagtaagagtctgttcattacacatcacctatctgtattattacagcagcttatagggctaactttggatactgagcgttccttgaaggtccatatatcaaaggcaatctccagtgtgtccttatggaacttggcagaagcttttggaaggtgaagcctattggatggtcaagtcactggtatggtgatctttaaggggattgtgggatactgtctctgcttctcttctctgctctctggctaatgatgtaagtagtttgtttactgcatgcttctataatgatgcactgtccttactagaggtctaaagcctagaggaacctctaaagattcctctacaagaatcagtcgagttattttgggggaaaggtaagatgcaaatgaatagagagagaaaggggacacacactaactagaatccaagtcacgctatcacttgaacataaacttttgttgaactgaaggaattataaaggtacacatttggattatagaatagtaatgggtagtaagagttaaaggcagtttcgtaaaaacaaaaattccactccatttcctcatgtgaatattttattagtagtataataaaataccttcatgaatcatgagagctaatttagacctcattagtttccctacatctaaacacaaacacagtcataggcaataagctgataggttggtggaatatttggggagtctggagcctcattataaggctgacaaagtatactttttaacaataaacacattgaaagaagggtaagatgtgaccttggaggagaaagagagaagccagtgatatgaatgggccattttcttaacctgaaatgaagacaggttgggagaactgcaaataacatggtgcttatggaaaggccacaaccatttaatgcacaaatatcacttcactgaaaaaaagaaaaacaaacctgagcactgtttaagcccattttttaaggtagatgtcaaggtaaagatgaatgggccatacatacagcttgtttataacgaagagagtagaatggaaaaggtctaaaggatttaggtgaaaaacactggaacgtaattaagtcacatcataccatttaaagcaagactatgcctctaagactcagtttacagacatatctccagaagttaggaaaggttataagttaagctctgtagtagattgattgtctagcatgctctgtggtgagttgtttgcctagcatgcatgtacgtctggggctgattcccaacacaaatcagataaaaatggactagaagttgtaggttaaatgtagaaactaacccagataggattgccacataagatcaggaaaggtgaaatgatcccctcccgcaccgaaaggatgataccatccaggaaattaaaaagcaagatggaacctcagaaatgaaagccacttggaaataaccacacagaagaaagattttgggaaggcttaaagcggtggttctcaacctttctaatggtacaaccctttaataaggtttctcttgttgtggttaacattattttcattgctacttcataactataattttgttagctattaatggtaatacaaatatctgtgttttctgatggtcttggcattcctattaaaggatcattcgacctgaggggtcgtgatctacaggttgaaaactgctgacttggagctttgttttctttttaaattcaacattagtagtaggaaaggaaacttcatacatgtgttactggttgcaaacaggcttccgttgatcaatgatcattaaacatgccttgctttcaacttgcttagaaatgttaagaatttatttaaaattattgtatttagtgagaataaaaacagtaattctacgtcattcctctacccttatccacttatcttgattttcccatttaataccagatctttataatcagctccctaaatgtctagctattatcatgtaaatattaacattatactgcttcccaatccaaatctattataaggatctgaagagcattgtacaacctgacactatttcatcaggccctttgttctcccactgtctttgtcattagacagaaggcctagctagtcgcagagctaccatgctcagaacatccccagctcagtttaatgatcctttattgtcacttggaaattcatagtatcttttgaacaggggaccctaccttttcatttttctctaggcacttcagcctgccctgtgtcttgtttgaaggacaggttccacttctgttctatatcttcttgtcagcctcttgcctgctatcagagttctttctgagactgctgcttcttccgtctcaatgccttgttactctaccccattctgtacatggttgctgaatctctccaccttcatattcaatccaaatgttagcttctcaaactggacctgattgctcttatctaagatggtttctcccatctcctcatcctgcttttcaaatacagccactagacccgtagtcatctcatttctctgttgccttgctcagtatcacatatttcctcttcctatatagacagcagtggggacatcagtaatcttgtctttcctagacaaccgacaaaccattagagttgactctaaagacagattctctcttggatctaactaaggttcatagccttctattctgtcgaatttctgacctacaaaaataacacattctcagttattgttccatccaccccatcccatcctcttttaaaagacttgaacaggcatcaccttgatttctgatagctcaaggctgcatacttcttatgacctccagctgcacataacagcatagaacaagtagataccttgtagaaactatgctgctcaaaacatttcctgtctgtgtaatgtcacactgaaatgagccctgaccactccaagaggacttatcaaaaaggaatgaggagtcggaaaccttggtgtggtcctgaaatgggcagatgatcgcttagaactcaggagccttgtccttgaggacctcgaaagccatttctctgaaaggagattattaggtaagaaggcaatgccttccagtttttatggagatttatcctaacttctctaactggagacacagctggtctccagcatcacacttttgtcacttttcttttgtcttctgcttagctctgtccctgtccttctcactgccaagccagtatccccttctcacatgctcaaatacttctgagcactccactatgtgtacagacatactcctcacacatacatgtggattctactgaataaactgtcctaccacttcaactagcagctagctttgataatcatgtaagacatacagtaagaattcaatattaactgggttagtaaataaattaataactgtaatagatatttccccagcttcattgggagcaatattttcctagttaatgttgggcatcaagattatttcatccattataattcagcaacattttctagaaatttcctctccacatgaaagaatctctattgacttaaaataagacagcaagaataggagaattatatgtgcatattttacaagtactgctgcctttgtatagatttatgggctaaaaagttacttaattctctaaaccaaagaaaatatacaactctataaataaattttgccacaatctggaacaaaactaaggaatggctattgacagaaaatgaggataatcttaggacaaagcaactttagatgaaaggaaccataactgtgtccagtgtgagggggctatggcaaaatgaacacattagcaaatgtgactgtatgatatggtggcagggacctcttttggaaaacaacttgacattaagtattttggccacagagctactcatagtcattgacctagctcacctacttctggtcatttgcccaaaggaaatgtaatttatataacacatataaaatgttaccttctcagtaatgctcttaaatgctgtttataggaaactaaagacttaaatctaaaagatggttaggccagctatagcaattcattcacttaatactttgttccaggaagctattgtctaaggaaaaatgggggtgggggtgggggggcagacaaactccagattgaagaaaattcttttattagcaagcatggtagtgcatgtcttcaatcctggcactcagaaagcagacatagatggacctcagtaagtccaagaccagcctaatacacatagtgagcaccaggccatcccatgctacatgagtgacatacaatgtctttaaaaaaaaaatcaagtaaaactatacatatgttttataaaattagaacatgcttaaatattagaaggtagtttgttcagaaactaaatgtatggatgaatttttaatttctctatttttcatttttgatcacctataactctttttttcaaaaaacatcctttaaaaatttaagagaaacatggttgttttcagcaagtggtttcattttcatcatagctaaatcagtatgagttcttaatatgcttccaaaaaagttaagtttaaaatgaaaacacatatttggtaagttaacaaattacatttggtataatgtagaatttttcttaattcaacataagaaacacttatatttaaaaggaaagaaaacaacaaaatttacaaccataaatttttgaaggtttaaaaaatagttaagtaaaaatgtattagataaaagtgtcattactagccaggaggtagtggcacatgcctttaatcccagcacttggcagccagaggcaggtagatctgtgagttcatggccagcctggtctataaaaagagttctgggacagcaaagaatacacagagaaacccttctcaaaaaatccaaaacaaacaaccagccaaccaatcagccaaacaaataaggaaataaaaataagattaagaaaccagtgatataactgctcagtagattcaaaagatactcaccggtatgcagtattctaccatcgggtaatgtaacttgtggccctttgctgttcttccagaaaagaagcaactctggcagacatcataattaaaatgctttaggctcctgtatctgtggtggagaaaagaacaggcatcactcctgccactgaacccaaccctgtgccttagcaacaagctttgcacttaggaaaccaagagcgcatctgctacaaatgcaagatgatgtttctcagtgtcaatttaaaagcgatggctgtaatcacatgtagactaccaaggataaatgacataatgtgaggtttccatatgaaaagaccctattcagaaagaaaccaatctggagtaagcttttatacattctgtatatttttattaagtgtaagacttttgcttctataaagttggagttagaggaaggtatatgcgtttataatttagtcacattacattagattttagatttatgtacattttgtgtcttgtctgtcttaataagacttctgcttgttcttgctctaggggggaaaaaaaagaagtttatctctctaacaaggggagaggaatttaagtatttgttaaaaaggatctcagattatgaaggaaggtagaagccttgttcctaagttaggttttgtaaactttttaattaatttttttctttattactgagaattagatgcaggcataccatgaaagatgataaacatgtgtaaatgcatctaagagtctgaaaacatgcttgcacatgtttacccatgatgtgaagtctagaatcaatgtcagaagagtctgcatgagatctgagtgtggagaggaaatgatagagaaaagttatgacagtgagcatcacacattattttaaaatatcaacaagaccactcataagaaatgaatataagattccttcataagaacactcgtttctaccttgagcatttttaggttttgtttaaaatcgttattaggaagagagagagagaaaccttgatcattacacagtcttgaaagaaataatgttttaagcctctcgtagaaagtaaccctgtgcactgatgtctatttgcagaaacaacactcttaagtcttaaacttctatggagtctgaaaggaaaatgctccccaaatagcccactcagttaagacaactgggggaactaagaaacatacattacagctgtatagatagaaacatacattacagctgtatagatagaaacatacattacagctgtatagatagaaacatacattacagctgtatctgtagagggacattttaaatgccaagactagcaaagtcaaactagaaagacactgtaaaggttatgtgaggttaatatacactatcaagtgatgaaggacttttaaaatgacatgcaaaaatgcaagttatctgaagacaatctatttataccagctttgttatgctcctggcttgatagatcacttatatcttttaaccttttctcataggttgacaaatatggctggcattgtctgtcctttgtgaaatcttctttagtgcaacccttcccttttcttcaccagggagaaactcttgcactgtcactatgttttagccatgtgctttgctaaaactgctgtttctcagtcttgcttgctgatggtggtaagcaggacaatacagggtgaagtcttgggcaaggctttcccttgggattttaagggaccaattgaatgggaagaagggcatggcttttccctctcttcaaaaggcagaaatgacatccagaggagccaatttgccagtggagatcagcgtgaaaattcaagtcatgggttggggataacagagattatgaaggcaggcaaaaccgagagtcaagatgagcatgcagccccagccttggcatatctcttagcattttgttcacatgaaaggagatgaggcctgcctgttattcatgctactgtgaccagctgtgtggaatttgaaatgaaacaattctcagctcggtaaacaccttagagatctaagatttcactaaagctcaatttgaaggactggagaggtggctcagcaattaagaacattcactgtacttccaggtgatgcagatttgattcccagaacccatacagaggctagcaaccatctgaaactctagctccgagggaaccaacaccctcttctatgggtgcacacacaggcacatacatgcgcatacacatacagacgcataaataaaaataaatcttacacacgtacattcctcatgtctccacttttacagaaaagttcaatattactcataaggtcagtgtattatcatttttggctgaccataactaataatgtgatcagcaataatgtttaaagcatatactaatagctatgtaataactatttctgagaaatcataaaccccaggaaaagaatgtggcatactttttcaagaggtaatgaaggaaccaacgtgaacaaacacaccatcctgtgaagaccaaggtaagagtcctacacagtctcctctaaggctttaagtcagtgtccttgacacgatgagaaaaaaagatggactgagtgtggcaggactggcttagccaactatgaagatctgagttcagattcttcagagttggcataaagatgctgagtctagtggcatgcaccagcaacccgagatgatctgaatactggggaagcagagacaggacgatgcccagggcatgccactcagcctagctgacgtcaaactcaagattcagagagagctctggatgaagaataagctggagagtcattgagaaagataaagatacttgacctcaatctctggtctccatgcacatgtacacatatccaggagtatatacatacatgctcattaagaaaaaggtaggagatggagagagagagagaatagacaatcaacagaattaatgagcaggtgaaatgtagaattgatcacaacaaacttagcacacgaaacagttttctgataacttcttgctcatattttacatattgcttttgtcttactaactttgatcccaaacaacttagaacagccaacaaatttgatcaagactatatgtacctaatctacaatgcaattatcctgcgcaggtattcctatggcctcagtgaaaggatatttataaaactttctgattctggactaaagtattacaaataactacaagaatcaaaataagtttgtgtatagatcatgaggaggaatggtacattggaaagaaggacgctgtggagcataaatgtactccaaagacaaaccaccaagcaggaataaatgggaagggatggccatatgaggagagcagagaccattgagttctgatttctcttagtgcttctcacctgaacccaacaatcgggcattctttgcagatgttgcatttggcctgatgttttgcagtctcagcagctgcgacccgatgcagaaccggcaaccacaccatggactggggttccaaatgcatccagtctataaactccttcacactgatttctggcttgttgttattctgggggaagagacagaaagtgaagaacagctcttcattgaagctgcagcaagtgctgctgctgcaaattggcacgagagaaaagtcaagtgactccaggccagccaagacaataggttctttaaggtaagaaaattctagaagctaaaattagaagaatgcaggaaggggtagggaagcagccattgccatatggttggggggggcaattccttagtgctcagattttcttttttatttgtgggtttttaaatgttcatctatgcaggtacacttgcatgcaggtcacatacatgaggaggcccgtggacagcctttcattgattgagcccaaggatctgcctgtctctgctacattgatgctgggattacaaggacaggccatgcgctactacacgtgacttaagcgggtcatggagataaatcccaagtcctcaggcttctacggaaactccctttaactgggccgtctacctagtccctctgtgctcaaatcaaaaagaaagaaaaaggaagcaaaatgaaaacccacacgattccaggtaacccagcctttaattctgtagcacaagtttatctaagatggtaaacgtacgagacgaggactcctcaccttccagacaaagtggaagactctacacgagctttacaaatgtttcccaaaaggagtcattgctacgccccgcctctgttctatcagagcatcacactggaggcagaccagcccggatccaccagataggttctctaagctcatcaagacagactttgtgaggcaactcaagtcttccttgaatcctaatgctgaatgattgtgggtgagagcagaggtaaattccgccaactgcctcttcccgcaggggttgaggtcattctgagcactgacacatatgactataaatcatatttagaaaaaaaatcatttagcatttttttatttctaaaataagaaaaagggccattataaaatgtaataacccgtgacattgattctcctcaaagataccgtgtgagcatttctttcgctcaacagtgataaatcattggctctgctttggaaaaatatctgtaggcttctaactttatgcatatggatgacatcagtagcatttataaatgttcttctgcaccgtaagcatttaaaaaagaaactgtggcttttgcccaggtgaaaattagcagctcagatcagtgcaaaaatttgtacatgactttgtgtgtatgtgcatttgagaaaagatggctgtttttgtaatgctttcatattttaaaggatattctccacagagaacactaaagcatttttattccttcaataagaaaacgtatcaaagtcaatatgaggttcaacgtattatgaagggatgagcaaccatcagattgttcttctgaagtgcattgggcaggccaagaaaacgctgtcagaaagctttcttcagcacatgtcaaacctgctggaaccttaatcttcaggctctcagcctctccaactaaggaataaacatcagttgttcataacccaccagttcatagattctgctatagcagcttgagcagactaagactggagagacgtgtgaaggcatagctttgtctccaggaagcttaggtggacaaggaagaagcaatacaaaccaattaattacatatctcagtatgatgtcacactgtagtgagcatgacagggcagaggatcttcacctgatagggcttgagcagacacaagagctaagccagcacataaagacagaacagaacgagtgggagaagagagtgtgtgcacacaaaggaagaacattctaaacagaagagtgcatgtccgagggcatggaagcaggaatcaaggagtgaagtgagtattacgagaagctgagcacaaggggacaggtcacagacatgagtacagagccagcatgttgcaattccaacactgcacttcaatgtatagtccctgaaaaagatgtatatctaccaaggttttactatgccttgagtcaaatgtaacttaagaaagaaatcatcagcttagagggctgatacctgaaacctccactgtttgatgctagcacaactgactcccttcttggaaacattaagtccctttctcaacacaccatacatacccataatgcccatgcctacctgctggaagcagctgcggacactgggctcaatgttactgcccccaaaggctgctacttcccccagctgcctagggatctggatggcatcgtgaagtagcaggccaagctgccgctggtcacacatctctgttggccctgccacctccttaaagagacctacaaagaagaagaacgagatgttaccatctacctactcaaaacattatcttacttaaagcgttatcttcggtgaggtagattaaactatgtcaacttaaaaccaaaaaccaaacaaaaccaaaaaaaaaaaaaaaaaaaccccacaaaaactaacaaaacaaaacaaaacaaaacaaaaaaaaacaaacaaacaaaaaaaacaaaaccaaggagggatattatccagatcaggtgtcttaatctgccatctgtaaacagaaccacatgtcctagaatgatcttatatggggctgaagagatggctcaatggttaagagcactgactgctcttccagaggtcctgagttcaattcccagaacccacatggtggctcacaactatcagtagcaggatccagtgcactcttctggtgtgtgtctgaagatagcttcagtgtactcatataaataaaaataaataataaaagaataatcttattaacataaaggaatctttaaaaataaaagaataatcttatgttatagattattacattaaatctggtcagctaatagaaaattactgttttaaatactataaagaaatgtacattggttaattttatagtctaaggcattccctagaaaaagcatgaggcaaaacaaaggttcccttataatttgctagagcatatagtatataaaggatagcttcacattttacaattgatttattaacttctttgttcactcacaaattcaatatcctatgcacgaacatttcatcttattttaggtatgtttatattcatacctcctttgtattataaataccaaaaataaataaggaggtttagcttttcattttaggaacttaataagttattttctgtaatgaaacatttttttctttcaattttaagacataaaaatgtttgtatctttgcctttctttggcttttccatgcataaacaaggcaaacagtgctttgttttctaatattcttaagtcaacaacattaaaactcctcttcccaggatatttatctttgatctactatgggtaacattttgaggattataattaatagaagattctcacgttggtcttcattcttcttgattttcttgtggtttgcaaattgtatcttgggtattctaagtttctgggctaatatccacttatcagtgagtgcatatcaagtgacttcttttgtgattgggttacctcactaaggatgatatcctccagatacatccatttgcccaagaatttcataaattcattatttttaatagctgagtagtactccattgtgtaaatgtacctggatacttcatgcctccttagaatagggaacaaaatacccatggaaggagttacagagacaaagtttggagctaagacgaaaggatggaccatccagagactaacccacctggggatccatcccataatcagtctccaaacacagacactattgcacatgccagcaagattttgctgaaaggaccctgatatagctgtctcatgtgaggctatgccagtgcctggaaaatacagaagtagatgctcacagtcatctattggatggatcacagggtccctaatggaggagctagagaaagtacccaaggagctaaaggggtctgcatttaggtggaacaacaatttgaactaaccagtacccccagagctcatgtctctagctgcatatgtataagaagatggcctagtcggccatcattgggaagagaggccccttggtcttacaaactttatatgccccagaataggggaatgccagggccaagaagtgggagtgggtgggtaggagagcagggtggtagtggggtaataggggacttttgggatagcatttgaaatgtaaataaagaaaatatctaacaaaaagttgaaaaaaaataattaatataagattcccaatgaagaagctaatgtaggaaaggacattactttttctgcatggagacacacctcattaaaaaatattccttttatcataaaaactgacacatttgggaggcattgttgaattgtaacagtccaaaaaacatactatttaaatgttcgtcatgtaatgctaagaagaagcattaaatattaaatatttaagatgttcccccaaaccattttcaaataatatccaaaacataaacagcagataaaacgtcattctccccttatctaacagtgtcaacagtgaagttccaaactgaagcatcctgagtgatatcgacacagtaattatcatgaaatacagttttaattatataagcacaagaaggggaaggaaattcatctgagataaaattaattattgttatcatttgttcatttagatttgtttatagagctccacttgttatattatttgaaaaaggctatcatctcccccaaaacattggccccgaattcttaccatgatgcttattgtgcatctatgtgcatgtgaaatgatccttatagagaggtgcacatttttaagagcatcagttctgcccaacgttcccacatctaggctgaaagctaagcttctatgccactgcgaaggtgagactactcataaagaaaaagtgtattgtgcatggagaaaaagtgacaccaagcactgcgttcttattcttagaagcgtatacaagaggtggtatgcagaggatgtgaagaatgggtcacaacaagtttttaattgagaggatctgccagaacctgaccaatacagaggaggttggctcacagccaaccatcagactgagcacagggaccccaatggaggagttaggggaaggtctgaaagaacggaaagggattgcaaccccataggaagaacaacaatatcaaccaaccagacctccttcccccagagctcccagggactaaaccaccaaccaaagagtacacatggagggacccatggctccagtcacacatgtaacagaggagttccttttctagtatcaatgggaggagaggcccttggtcctgtggaggctagatgccccagtgtaggggaatgctagggtggtgaggcaggagtggatgggtgggggagcactctcatagaagcatggggggaggaaggatgagatggacagctcgaggagggggaattgggaagagcaatctagcatttgaaatataaataattaacaaaaaaaatggaaagaaacaactaagagacaagcttgaaaaaaaaaaaaaaaaaaaaaaaaaacaaaccagaggagatccaaggggctctccaaaagatgcttcctgagtgtgcttctgctgatgccagcaagcccctggccatttgcaggacggcccatggaatgtcagaaaccactccaaagtcattctcagtaagtcacaagtaataggcacaagtaggacaaagactctaatatcagccactgcaaaatgcttttcagatggatgcctcctgttactgaggctaacgagcagtttgttttgaatattaattttaacaaagaaaataataatgaagagatgttcccacaacactggggaaatcaaaggtggaatcggagttgctcaagatctcaagataagaaacaaaactgaacctcaggacatttccagggcctcaatatttaagtaaagatttagattaaagatttagcccaagagatttcttatttaattatgtcctgaagtgacatccatcatgagttatatagactagtagaaacttgcaatgcaagggcctctgctttcttgcccaaatgtgagcacttaatgctgttttgcagaaaatgcaaatcttgagcttgaatttgcattcattttagagtccattcagcactatgatgtaactgttacttttaaagccccaagtcttttgggagcgtatgaaaaaccccgaatcacagatgattagtaagaaaatcttttcctaattttggaacactgatttttcagtaattctttcctttcctaatcagtttagaaatggcaagttctccgctttggaaatatcttttcctgataatggtgaagattcctgaagttctagacaaaggaccatagacaaaactttatgtaaggtttatttattcagggcttcttcccgtctctctacatggcttgcaaggctcagacacacttcagcatcctcaactcctggttcttcagtaagctcatgctctgtacaaaacccacagctctttcttgaacattcttgttaacatttgtaagaaaatcatgcctttggattctaggcttgacatttaaatcaaacaataacagttatccccaaaatacacgatgttgaatgcttttagaagaaactcaattgacttaggttataagaacaatgatcacatacctttacttggggaaaatttttttcttgattttggggataggagcaaggacattgcgtagcatgagatggaccactgagctattaatagaccctcatactactactcctttcttgtacccatttttgtcttctgatatctttctattcaaaaattattatccacactctcctccaaatacacagatttatttgcacagactcatctagaagtaggcttggcagcatcaagctacttatattttatgaacaaataaaactaaacgacatgctgtcaccatggcaatgagtttggagacacatggagatggtaatcatttacttgaccactgctatttttgacaatttgtaatctattaccttgatttcctcccaatggtacaattgttggtctcatctctcaccctctggtgtacagctcagtgtaccaggaaatagtggtaatattacttttggctagacgtactaaaagggatcaagacacccatctaatgacacttgatcactaagtgggaaagatataactacaggtcccactcttgagcatgccaagacattgttcagtaatcaatagctaatgaggcacttacttgaataaccgaaataaaagttgaaagcatctatcactttataatgtccaaattacaaaataatactatttagaataaaggctaataaaagttttagtccctcttacttttctctctctctctctctctttcttccttccttcctttctttctctctctctctctctctctctctctctctttctttctttcttctttcttttcttttttttttctaattatcattaaccataaactgtagggagtctaatgctaaggtcctgttcccaggtggttcttgattgctcaataaagataccagggaccaatcaatgactgaggatggggtgggatacttaagagttacccaggaggattcagggagaatctggggaagaagaaggaggcagtagcagcaggagattaagccaaccagtgatgtgagttttcagttgcggtcactgagttagcaaaagcactctaagactcactggagagtatgtgtgttgtttttaatccatggatgcaagggagtctgggtggggctggtagtgtggtccacctggagcttaaagtggggtagcaaaaactacttgctacaataaacggaagaaatgagatttttaagagagaaaaaaaagggggttatggagtccttagctcaacaccaacattttaatgggtcatacggcctttgactagattcttgacctatttcagcattaatttgctcacctaaaagaatgggagttgtaatacctactagaatattctaatattaaatgaatgtacatttgtgcttagtttgtgctgtatctgtacacctcactcttgccccacaatcagtttttcaaatcatccaaattctcttcacattgtcatctttgttcaaactggtacacatagtaagcacctccaattggaagctaacattaccgcaaactatataaagtcagcgcccaataaatttagattattattagaagcaccatggagtaaaaggtcttacatacatctgtatttctcttctaagaggcctttggagagagacatcaatccaatcttcagactctgtacccgaatttttccagtccggcccctgaaattataagatgggttatatgcatttacacagcaagttgaatgccattttcttgggagtaaactactgcataataaattcgagttaaagattcaacttgtctacttggttttaaccattactgccaaacctacatcacaacttcatgacagttcaacatctttgaacaagtccagaaaaatacactgacgtccttttacacacaagacacagcccaagaacacatgaaatgaatataaaaacaacaatcataaagccaaatagattttacttaaagaaatgctataactgaaatctgttggttttaaatgtaaaatcaaaatacgcatcaaagctagatagcaagcaggctgtacaacatatgaacgcaacattatatagcaagagaagaatactaataaattaaaacccaaatgtaaaaaaaatatacgtagaaaattatatgttgaagactcagggcttatgaaactttagagtttgctgtcttcattcactttgatctctgccaatgtagtctataaattattattgcaattttaatagtgaatggtttcaaataggctggggtgatatctgtattagaggaagcatgaaattgtaattaaaaatggaatgtattaattagtcagctctaggaaatactttcacactaagacagtgaaacatcatttcaatttcacttaagaactggagattttacacacacacacacacacacacacacacatttttattccaatgcctatcaaagtattaagctgttaaacaagccctgggatgcagaaaagcaccataaaattaacagaacatgatctttccagtggaacaacacacaacccaggaaaaagtcttctcactatatttcttgtttcataatcttcatccgttttcagcttgggtttattctctaaaatttcttagatttaaggcatacatattgaacgtttaaaacacataagcgaatgttcacttactatatgggcacataagacagtgtagttgtatgaataagcaatgttagtttttgagctatgtccctggttgtggccctgtcttgggtaggtttaggaggtgtgtcctcactggagaagggatgttactgaaggcggactttgagttctcttactctgcttgctcctccaggccccatattgcatccatggttggcactttaccatgatgctgatggtctcccatgcccctggaactataagccataaaaaacctgtctttctataagctgccttggacacagtgttttatcccagcaatagaaaagtaactaatacaggttgtgatttacagtatttgaaaaatacataaacatctgtaatgtgctttgttagtcatactaagtaatagtcttccattttcaagtgataaatgatcaagtaaatgtctgcatatatagcatgacaccaaacatataaatgttctttaaaagaaaaagaaagcatgcttagattatggctaaggatggtagcaacctctgagaattcaacaggcagaaaaatgacaagttctagcctaacctagcctagagtcaagaaataccagccagtttcaaataaactgagccatacttcaaatcatgtttctacttaatatttgtagagttttccaaattatcatatgaaatagtgtttattcccttcaagagctggaaagtgtttatcctctgaacacaggcaatttacttttagaaagtaataaaggttaatgaatgaatgtagctaagggattggtgcaagaatgttggtaaaaacaaaccagtcctttaagggatcagaaagataccagtagagctgacttccaagtctactgggaaaacaggagagctacatcatcagaaagacaattgaaaatgtcaatcagctaccatcagctgtaaaggcttactgtaatctaagatcccagaattgttccatgaacttcaagaagaagtagagaacctgattcttactcaataacccacatactagctagggaagtaagacaagagggtgactatagaaaatacagtatcaaccctaatgtgtggaaatgaaaaaccaaatacaagatgactgtggttggtaggtttttgagagagcactttgagtagttcccagcctctcacagttaatcaagaagttcaaacttaaggcctgccattggagctcagtggcagagtgcttgccttacatggagtgggccagccctagttaatccctagtactgtcctcctccctctaagaaagagaagattacaatcagacatacatgagatgtcatagcacacgcctgcgtaagagaacataggtgtgggtgcaaacacaccccctccaacacatagggtggggtgagcatttatacacaggctcactggctgattaatctgtgcatacatggggccattcttgactattttgatgtcaagtaggatatctaattggagatgcatctgagagctaataaaatgtatgagtgagcgatctagcccaatagctaagtatccaattcccaggacagtttttgtaagtgacttctgaaattagtttaactgtgaagttaagtgccttcaaaattatattcatctcaggatagtgggagaaatatgacttattataacaaatgaagctaatattctctatagagaaaaaaaatgtttgaaccaagtgttccagactattgctctgaagtatgatttaaatgatttggatttccattaaatctagaaggaagattgtgaaattaagacttttgaacctggcaagataaagacagagtgaggctgtgaattcataaatggaatcgatttgattgctatagtttataaagcccctttctatatatattagctcatttgcccctagtattcaccttttgtatggtaagctgtgtgtttatttttaactaaattttccagatactgagatgccaaaagttaagtggttgccaagtaacatagcaaccagggcacaaaactgaaaatatgacgtgaagctgggtatatgttaaaactcaaaagtttagttgattttataaagcgtcatggctaagctacagcaatatgataagactatccatgcaaccaaggaaataaaatctacaagttagccctgtaactatgattgatttgtaacaggtggttacagaaaaactctggtatctccatgtgtttgttttccaatcagttaaatagagggcaaaatggaaagatcatatctcatctctaagtcatatgtgtattagaattctttgatctcctctatctgcatgactcattatttcaagttgacgttgagaaggtctgccctggttacatcatatggcaataaatcaaggagttgaaaatacctaacagtttacagtttacatctgaaaaggtccctgaggaccaggagaaactttaaaagccagaacctattagatgacctctgagaggcaaaccctcccagaagaaaacaggattgtcttccctttcttgcatttctgggtcatgtgatgacagtttggtccaccagcattcccaccatgctgtgctacctcacctacagtcaggggcaagccagtcatgggttgaaacctctcaaatgactatccaaaaactatcttcctctgtgtgagttgatttcatcacctgcttatgatagtgttgtgtggtggtttgaataggcttggcccatgggaagtggcactattaggagatgtagccttattggaggaggtatgtcactgtggaggcggggcctttaggtaatatatatgctcaagctctgcccagggaaagacacagtctcctaattgccatcagatcaagatgtagaactctgttcgtccaccacatctatctggactctgccatgataataatggactgaacctcagaaacagtaagctaactccaattaaatgtttgcctttataagacttgccttggttgtggtgtttttttacaacaatagaaacccaaacaatgaatgaatgaatgaatgaatgaatgaatgaattgatgggtggatggatggatggatgatggatggataggtaaatcaatgtaactctttcaagtggtctgcttttctcttgggaattcactgtccatttcctaagaaactctttcgctcccccaacacctgtgcttcaagtaaatctacattaaaatattttcttaaagaactataactctgtcacataaaacttttttaaaaaattagctgaacacaggcatcatttttaagttcaaagccttctgatggttctgtaatatccaagatccctactctgggtagagtaaaattatagttagttgatcagagtcactcagaggaccattacttgaagtagagttaacagtcattgctcagataaacgaatgggccatatgaagtagagaaactcaggtagtcattgctggacatcagtgattactgcctacaaagtaactgaattttccttagcttaattaatttgttatttgttttttattagatattttctttatatacatttcaaatttcaaatgcttagcttaattcatttatcccaatagaaagtgagaccgaagggaacccatctgacccagaggggtgattgatgtttcattggtattgaggggaagtaagttttgcaggattttttttatccattaaaaacaaaacaatggcatatttcgaggtattgtttttctagtagaaaaaaaaattctatgtagcatttctatgtgttcacatctggcagtcagaaatgggattgtgccaacatttaactcccagaaatgaatcacaacattttgcacactgggtgggtcctaacaaagagtcactgcctcctcattctagaataacagcatcctctctatatgttctgagcttaactgtgttcctctcgatttgcacactgaagtcctaactctttgtatcttaggatactgcttttcatgccaacagcatctttcaagagtcagttaacatgaagatggaaggggagaccttaatccagaatgcctggtgcacttgtaggaaaaaagagcaagtagaaagaatttatggctctttatggaaagaagagagaaactgaagagccaaggagacgttctggagaaaacaacacagcagtcagccccaccatcaccgtgagctcagtcttcaggcctttacagatgtgaggaaatgatgtttaagcaacctagtatactaggtttggtttcagcaacctagaaatctacaattgtcatagtaggaacctgctggggggcagattgttccccagaaactttgatcaagttgtcctcctcttgctatttcagagtcagatgaagtccccagacgttctcatttagctttctttctgagatgggaagccatgttacaggctactgcacagaaaacacggaaataacgagctatttgcggtgaatttattgtagaaaagatgtcctttgagactttgaaatagtgatgagcaaattaatgagctacttacactaaaattaatattgtatccaagaagaattacaactttgtattaaaaagcataataaaagataccaggcagcagtgtattacagtaaatcctcttctctttctggtaactgagcttcactctcactcacaaggctatccttttattttatttttttaaaagatatattgatatttgttactactgaaagataaaggatctcttttcctaatgaaaggagtagataaaattatagataagtcatgtctattatcatcatcatttacacagaatgaatcggcttcagaacatgtacatttatgaactatcatctatattctctgtctatgacgaccacttaccttctctgtcttcagatcaaaggctgacaaatgtaaatcttcatgtagctacttaatgagaactaagttttgagattcaagagaaaagcaagtcttcattttcctctttcatttttgcatacttcaaccccctaccagagaatgaataattcccaacatttctgaaatgtcagctcacagcaagtcttttgataactgattagtgcacaaatacattgtcaaaatcaaaagggtcacacatatgcgggatgtgctgggctggaagttaagggtgctccttctatacactgagaaacagttcaagtacatgtgttagtgtcatatagcatcaattataaaggcaagaccactttagaaaaacataaccacaatggcaattatttaaggacaaaccaagttttattcactgctgtccaaattacactcaaaccgccaccttacaaagttatagagattcttatatgctaaaaatcattttaattcacagtgaatgtcagcttttgtttgcctgttgaaaaataataatctaagatagtaaggagcagagagaaagaaaagaaaccatgcagctcaggtttccctagctgtttcctgaaagagaatgcatgctacatccccagccttcactgactaggaagtcacgaaagaacacttgtatgttccctcttatcctatggttaggagcaaaaggacttggaaaaccagttacttttaaacaatcagaataaatctttctactgggcgagaggattatgaaaacatctttttaaagaaatcacactagggtcggagatgtagctcaatggtaaagtgtttgccatgtgcaaacttattcccaagttaaaactttagtatcacccattaatgagggtgacagagaagaaggagaaggaggaggaagaggacgaggaggaagaaagaagaagaaggagaaggggaaagggaaggggaagaaggggaaggggaagaaggggaagaaggggaagaaggggaagaaggggaagaaggggaagaaggggaagaaggggaagaaggggaagaaggggaagaaggggaagaaggggaagaaggggaagaaggggaagaaggggaagaaggggaagaaggggaagaaggggaaggggaagaaggggaagggaaaggggaaggggaaggggaaggaggaggaggaggaggaggaggaggaggaggaggaggaggagaaggagaggaggaggagaagaagaagaagaagaagaagaagaagaagaagaagaagaagaagaagaagaagaagaagaagaagaagaagaagaagaagaagaagaagaagaagaagaagaagaacaacaacaacaacaacaacaacaacaacaacaacaacaacaacaacaacaacaaggcgatgatgatagtgcccagtttattatcaatgtgcttcgctcactagtgatcatttaaaggataaatgacacacttacgtgtcgtatacgttgagcagccagttgagacacatatcgacgcagagtggaacattgaccaagtccttgtgcagctgctcaagcccatcgtaagtggtggtcagacagttgatgacgtctgggacactcaggagctgatcattttggttcagtttgtgctgcttgaaaacttcattcgtcgtattcagctctaagagatccactaattgaatgaggagaaaggattagagagaggcatcgccttacccaacaacattgaagcccagcactcctattctccagcttttagcttgactggccaactcatgaactgatccttcccagttaacttcagctgttagtgagataacattttcattctctcagatcaaatatattctctctacctttgtgcctgttcatctagacgctgtagcttttggatcttttacaaatttttggtctttgaatttttctttctttttgacatccttgttatagtcgctctgtgtttttcagtacagaaatgagtagtctacaaatttattccaaacattaaaatatcccaagtaacaacactggtcacctcatgttagctcactttctaactgctttttaaattctctaaagttagtcttaagtgattctcatagaaacaccaaagttgcgaatattgaggaggaactctgtgatttcaacagatatctacactaggtgatatttaaatctgggtaacccatcatcccctcaaacgtttcttaacatgtgtgcagggaaaacattcaaaaatcctttactctaactctttgaaaagtaaagcaagttttattatctatagtcacaacaacagacaccagaaccctagttttaattataacctgtaattatataattatggcctatcaagcagttaatctccataccactgtcaagctaacaattctctaacagtatgcaaaaatgtatataatggcattaaaagatcaccggagatagttttttagaaaaatgaagcaaacaaataaataaataaaagaaccagatttcatagaaaagtaatagctctctaccacctgaaatgagtgacatcagaattattctcaactaccagaattggcccaaatcaagtcaagcccctttgcatttcagaccacctgtcactaagatggattcctactgcttcacagatcactggccttcaggtatttatttcatttcatctttactcttcttatgtaaagcacagatggagggtaaggctggtgctagagcatgtagggtgtgcacggagctctttcttaagcacattactaagaggaaggagggaaacacctgggagaaggatggacaaccgtgtgagagagcagacacaggctaccaactcatggttggaaatgctgtaaggggagcattttgcatttttactttctttaccttctaccttcttggtggttttgtaacatatgcataaactcagctattttatgcagctattgtggatggggctcaagtctaatacaattgtcatttatgtttcatgtataccttatgtatgccctaaagtaagctggtaagtaatttgaaagaacagtgcttattactgtgtctgtgtatatctgtacaccatgtgactgcagatgtccttgaaggtttggagccttccaagagtgatcagtgagtacctgatgtgggtgctgggaactgaaccctgttcttccaaaagagcagcaaacattttgctgagtcatctctctaaccccttatacagtatttttaatgcgactgcatttctactgagattcatgcaccaagggtcaggcatgcaattctgcaaccatggcagcaaaccataagcttctgatcctgtggttttcacattgcagatgtttggattaggaatgcttggccaaaggaaagcttgaaaagactccctagaaggtaaattttgaaatagtctttgaaagataagatagacaaaatataagagatccaggaaagcaagggagggggagatatttaaaagcactatcttccaggaagagatgttgctttagaaaagacagaaattaaattactctaggattccactagagaaaacagatggcagctagtatcaattgtgacacatagtgggctatggtcttactgaggcagctactgtacacaaagcttccaccccctaaaaaagttattccttagcaaggtgaaaacaaagccaagcagaccatcaaaccactatgcacttactgaacgtggaaatgacccaattcgtaacagacaggcaagggaaatcgcaggctggcgctaatttaaagtttgctcatggaaatgaccattatgtaaaatgtttgcttcatcttccgtttccaggtttttagcactgaaaagcatctaagtgggactgagaacatttaagcaactacttctttcttttctaataaataaacttccccagcccccatggcatcgtttgacagtgaaccaaagcaaagaaacagcttcctttgtatctgagtacttgtagctagtgactaattactaattttaaattttaagtacatttatgaaatatgtctatgctggctgtttaaacaacatttcttttttcaagttgactacagtagaaaagaagtatatgttaaaataacatagacaaatacaacttcttcaataactcaatagggaagacttcttaaaaagactccagcaggagacataggaattctgaggaagaggccagtcccttttcttttagatgtcaacaatatcaccctctaaatgtatgctactaacaaaaataatttgcataagcattccatgagctggaaatagtgccaaaaaaaaaaaaaaaaaaaaacccacacaagagtaagtgacctgggaatcatctatatttttcattatcattttgctccatttcttggtactataaattattttcaactctgaacctaggatagcagtagcaaaatccactttctacagcatctgacaaagggacctgcttaatcaaggacagtcgactgagaagcatggttctccacagatacaaagaaatatattcaattactgccagaatgttaagatttctgaattccaacactaattatgccagccgcaaaacacacagggacaatggaccaaattgcaaaaacatcattccgggatcagtccacccttcactccgttcagaaaagccttccttgttatccactctgggacccagacagtaacttgccacttcccacaaacgatcctgtcttcaatttccagtgatttacactgacactttgacttagtgcctaagccaagcaggcatcttgctgaagcatgtcacatttcggtaccttttaaagaacagactacatttaaatcacaggaaattatgatttttgtctcttcagagggagaaaaatgacagcttagtcatgcatgcagtaaatggaacaaacaggcaatttgttttctaagcaagttacagacttttctagattctcacatatgaagcacaggggtcaaaaagagacatcatcatgccctcttctaggtcaggggagggtagaactgataaaaacagaaggacactgctgagtacctgattcagggctttggacacctctccaggtcttggctgtgtgcaccatgtcctcttcctgggaaacacttctacacgcaagctttcaggcttggagttttaatctgcagagatgatggctcatacctctcaccacacagcatctctttagatgattccacattccctttcctgcctcgagtctcgtggtgaacaccagcctgttttcactgctcagtccccatctctcagaaacttctacctggctgtattcctaatcaaaaccttaccttcggaaatctggtctttagcaattctaggaccttctctccttcatcctttacaattctccaactaccaatccctttgtaaaccagtcacaaacaggcagtcctatgaatcttcccttatagtgggcttagcctcggtcatctctggcaagaagcacctacccattctattctctcttgtcttcatgctaaaatactatttaggacatacaccgtctacttggtttgactgtctcaaagtagaaaatgattgtatactactgaattctagacagaaaaattatccaaactttaaagccaataccatggagatcaaaatactaaagaaattagaaatggcttcactttgtcaaacatctcttatcctagaactagggaaacaggaggaatgcaaggctagcctgggctacatagtgagctccaagacatctgggctacatagtaaaatactgtcttgataagtaatgttagtaatagttaataataatacctccaaatcagaaatttcaagaacaaaatttaaatgaactctgaaggaatctaaatgggatttagggaaacctcttgatactgagtaagctaattaaccataatacattggttgacactctcgacctgtatccaagcatttgattggatgcatctaactcctatatccttatctcagattagtgtccacatgccgaaatccaaggtggctcttatggtcgagtaaatagaactgtgatacaaggacactggctttctaaacaccatagggactgcttctgtctcagccagtgttttctcttacttctctgcatggcctgctacaaaaagtcgtgtgtgtgtgtgtgtgtgtgtgtgtgtataacacatagaatgcatagtgtgttgaagaaaaaagaatacacaatctgttacacaccaaagaaaatgaacatactagcatcatatgtaattatatgccatcatgatcacgagggtaatctctaaactttgaatttactttaagttcttaaaagcatgtgtgtaccataaatagaatagtaaggctttgaactatatataaatgaaagtgaactatgcaaatgtcttttcccattagttttacagctttcgcatggaccatgctgatgctgacggtcagttcattcaggttttgttcctgtattgtaacatattttgagtaagtcaaaattaaataaatctgactactacaaagcatgactctaaatcttttacgtgtcttctagtacacacctatgtcaccttcaaactcgaaccttgctcaggatggcctacatgactccagctctgcaccagaaactataggagggctcaggtagggaagaacacagcacagactcttccttctcataaaaatatagttattttggaaaggcaggcaagaagtatgtagaaagaatattaagagttatgattctgaccacgtgtctaagacaagcagtgtaataaaacaaaagcacacactcacataagaaaagactagatggagctaccaggagtgagggaagaggagccatggtattaaagcatagctggcagcctgagacccacaggatagcacacaccagtcacgggaagattgcaaatgtgaagagctggcacccagagcttttaggctggagaaactgggtataatctgctaggccactcttcaaggtgagctgatgggagcaaagggaaggaagtagggagacagaaagcagatgccagccaggtaaagagccctaaattataaggggagtgcaatctgctgaaagcatgaaccttccagccacctgcattgtgccctttggatctgagccctttgcagggtggaatgagtctcttgccttgttctcagaaccaaatcaataaagcaagagtgaaagaataaagacaaatgtgctctctcttttatgctggcaagaaggcactatgctgagtgcagacaggcacagaatgagaggtgaccatgacctcaaagccactgtgtgtagagacaggtcaacctcctgacacacaactattacaccaggcaagcaagtgaaaaacagcagcttcaggccatcataaaaatgctgggaaaattagaaacaggtgggatgagcatgaaaattgtagaagaggcaaattctaaaaagcatcaggaagaaataaaagatgagccagggcagttcaagtaaacagagaatttgagagagaaaagttgatttggtcaaacaggtaaatgtgacaagtagtatagaggctccaggctggagccctgtggtggccagaggcagtggaaagagggatgccagtggctgtcaggagatccctgaagctatttaagctgacacaaactggggacattgttcactgtactttataaaatatcttttcgctcttctgctcctctcgggtttggacgtgatccagagagagacatcttccttcaggagtaagagaaaccaagaaagcaaacccttagtgcataaagagggctctctacccaggtgcagaacagaacattggtaacatgttcgccatgttacaaaacagtggttggccagtggaaagtccatggctgggtcatctgccctcattttaaaacccaacaggcctggaaagacaagactagctggatgtagggttcaaaactattatcactacagacacattgaggagatagacaacctgccttctgttcacagtcagcttcctatcccattcccacccaatacacagatctctagcccaagtgcgagagctcccatgttttgaacaggtcattctggaacatgttttgtaactactacaacatgctgactacctttgagcctgaggggataacgcaaggcttgaggtcacctcctccttccattccgtggcttagatattgctgtttctctgcctgttagacatctcatccaaaaggaacataggtctttcttatttaatactttgtacaactctgtcttctctaagtgattgaacatctccctttgctcgactctgctcacccagccaacttaaaatggatccataacttatatttagctattgaaatttattttccttagttggggggaggggtgtggtgtgcaactgtgagtccacagaggaaaacttacaggagttggttctctccttctaccatgagatccggcaacagaagtcattgtcatatacaacaagttcttcttccatatgagacactcatcagccctcccatgattggttttaagcacaatttttgaccctaacataccatttttctgagggtagttttcaaaacttcactgagctacccaggcagatagtagttcttaacaaagagtagaaaacaagcatatatggaattttccaaatctcccaatctttaaagtacatgcaaatattactttgcataatagtatctagcaaggcttaaatgttgcttgggtcaggtcaataatccaagcaaagacagaatccagaaagcctaaatcaatactctatttacaaggatacacatgtctgctcactttttgatattctcggcataaaaagaacctttggttagaatgactaccatagaatatcccatgagcatgccctccacagggaaaaatccattaatgacacagataacttctgtcatgtttaaaggaaaacagaattttctatcatgtttatggttttagttcccagagaaatcagcaatgtgactgctttgcatttctctttcatgattgtactgagtcaaacagcttggaagcctccagtttggagtggacaaaaaggacttactaggcaacaacctacagctttgattcaatggcttaatcttttaaaactgggtggcagtataaatttccaaagagcttttcctgcgtttggataaattttgcactctgaattcgagtggcactgctcattggttttgccagtacccactgacgacaccaatcatgaagtatgagtagaaatgcagctaactccttcaatgaggggcactgaaagtcagattgactctgcaaatacctcagcctcgccatttgtctctgtcttaatgataacaacaaagtcaacctcccaaagcaaggtgattcagttagtgtgataactcacgacataatgctttttgcagccttcgaattttgattgctgtgcggtaggcagagaaacgtacattattcagatcagctgaaatggaaaagagaacaagttaaaggcctgcttattatttaacttctactgaatgccaagaatgaacatatttgcttattttggatcataaaaaaatgtgtgagttcatgataaaaaaaaacttcctaaatttcacatcaatctataaaaatatgatcaaatgattgttcataccttattgggagacactgcaaaacaatcttatacaggaaactcaaattccctttccatgaccaaatcacagatcttagacgcctcttttccaagacgagtgataaaatggaggtcactgtgaccttttccatcctcatttgaaactacaagtaacatatcatgtcctcccctttggaggaaaagaacaatatgcatagaagttggggagaacctggacacataaggtggcttctccttcattctattcaccagcagaacatctctcctcgtctcatcagactacctgacttcatcagagccatacagaagtaaaacatttccttactttccacttctctttcataacacaaagctttgatccaataattttgcactgcttttctatagaacctgtcttgtgctgtgggtgtgtcagccatgacccgtgggggtaatgagcatggggaaaagttctgccctgcgggaaaacaggaggtaccactatgactggggactaccagactgctcagctaacagggtttctccttcagagtcattggcttactggggcaattagttttctgtcatctgccagctcatcccagtactcatgggggctgttcttctacgctctgtctaccctgatcaatttgcttcttttattggttcacagatttggttgttctaagcagatctatgaaaataatcaacattcctatcttggaaccagtgaatattacaatttcttcctctgttccctaaagataggttagcagaaactgacagagttggaagaaaactcaaagatcactgcctcttttcccccatctcagtctctaaatcaagcaaagcagtgacttttctcttgcttttcttctgcagactcaactaccaagggagagtgcccaacagagcccagtgtttaagagaaacaagtgtgtgcgcctggtcttaaaatgggaaggagtggagcacaggatgctgccatatcctcccttagcaccgcctcggtttctcaaggactaaacttcagtgactactgtcaacctgatgaaggccatctcaccaataagctgaaagtcactgcctactgacagtctaaaaacagaaatctttttttccccctgtcaaaataagtttagtttatgacttaaaaattaagtaagctaatttgagaaaattttcccacatagaaaacaaaatggtttaaatcggtaaatttgaggttactatattgttactatgttttccctttttttagtgtgcagagctgaactataagatgaggtaagacctacaacaatcagatctctcccagaaaatgaagtccttttggctggtacacttccaaatcaccgagtcttgctttgtgtgtttaccttaggagtgcaactacctttaaatttcaggactcttgttgtagcatgtcggggcactgtcttctcatgccacagcatgatcctttcatccacacaagaagaaaagatgagtagctgagtttctttttacgactattcagtccttggctatgaaggccgttcatcactactaaacacagcaacactcgctaaggcctactcataaatacagcagcactcactaaggcctactcataaatacagcagcactcactaaggcctactcataaacacagcagcactcaccaagggattggaagagctcagtcattttaggatgatcccaacaggttgtctgtgtttgatggctggggagaaaacaaaaatgtaagtataaacaacacactacaaaatacaatataagctatcgtcttctaaaatcccacatagacttgcaaagcaggcaaaaaaaaaaaaaaaaaaactccattatggatcgctcagaaatctagtactcaattattactcagtattcaagttatgaataataggggctggggagatggcttcaggagtaaaatgtttgccaaggaaatatgaggatgaaaattcagagccctgtactctgtgaatcctggtaggtttggaactcatctataatgccaggacagcggagagaggcagggggtgtctgcagtgaactagcaagctagactttggtgagctctgggttcaagtgaggtaccctgcctcaatatataaagtgtagaggaataaaggacctgtgacctccatatatgtacatatattctctctctctctctctcgtcattttccacatacatgggaacatgcataaacttgcacaatacacagacacatatacatacaaaaacactatgaataaccaattttgcttgtgtaactgtattaagaaaagatagacaaaattctgccttctgtatcgaaaaaacaattgcaactacaatctgaaacacagacataagggatgactgccagggatgcttggacccagagtagggtgtggccaaatcaatgtggcctccggaataatatccatcttgttaggctgatgttttttttccattcccagtaaatgctttgacagcagaaggctatgacgagttgctgcattctgaagagttaccacactttaaaagtcctaatcaaatttctaaagagcagagaaatgaagactctaaatctgaatatcatgtgctcactttgccatctcctgagctcttctgtttgttaaccccggttctcttcctccctagttcatgcctgctagctctcctttccttacacaaccccaggccccagcctctccttagctaagtgcttttctcttgtgatttttaaactctagctccatcttcctagttttactcaataacgagtactattatttttggaggtggataattttacgtatgatccctattctttatttgaaaaacacacctttattttattgctataattcatatatgttacttggaaatcttaaaagaatagattgtaaaacaaattacagtgggtcacaaattaggtgtgtgcatatatgtgtgcatgggcatgtttgtatgtgtgtgtgactgttagcatgcaaacatatgtgtgtgagtgtaagcatgtgtggggggaatatgaatcaatgtgataatattaataatgagttaatatgagttaactttgatgatttagtagccttatatttaaaaatagtttgcagtccattatctaggccataacaaagcaataacagctaatggttctcaaaagacttctcagatgacccttaattcttaagaaactgtttagcaagctatgtgaaatagcacagaccatgagagatgatattagaatattcataaaaataaatttaagagaaatcactgcttttataacttacatgatgcaccagaaaagtcgcttgcattgctgggcaaggaacagaatcattattttgtatacttgggtaatagaatgccctggtaattcaaagtgggtttcaataaataaataaataaataaataaataaataaataaataaagcttacttttgaactgagtcagtaagacgtcctatgcccttgaactgagtcagtaagacgtcctaagaatctcaaatcgaatagttctatggagggaataggttttagaacccactggaaagctgtttgcctcccatcctctcatgcttagctccagtacaaagggacaagtatttccacttgacctgaacatcaacaaaaccactctatcctctaactacccatactgccttaaagatcatgggcatgtagaagatgtctggcctaaaagaatggctgttcacagtatagccatgagcttggcagaaacacatctatcagccaccagtaagatttaaagaacagtttagtgaaaatgtagtacagtcccatgctgctatcatgggttcctaatctcaaacaactaagactcagttgatagttttctctctctctctctctctctctctctctctctctcttttttcccctccaagcaatttcagtcctggtcacagcactattgtccaaagatacccatctcatccaaagataccaggacaaaccaaagctcacgggccaaactagagctctcagcaatgcagaatcagacttcaggcttaaatattatgtatgccttctctagaactacaaatgtggaccttccccttggacaatcctacattgccacaagggcaaaataccactggcaagttaggcaaacaattgaggattccaaagcaggctgctaatggttctgcgctgatggctcggcatcctgggagcctaaggaacacacacatttggcaagcagatggagggaggagcagggaggctcctttgtgaattcaatactagttgattcattaggcagaactgcaaaggctcaaagtaaacacagcctctggttacaaagtaaagctgtgggttacacaacaacaatttggggggggggatgtctttctttctccctttctttcttcctctctctttctttctttctttctttctttctttctttctttctttctttctttctttctttcttccttccttccttccttccttccttccttccttccttccttccttccttctttccttcctccctccctctctctctctctttctttctctcctttttaagtggagaaagaggatcagaacacaatccatatgagatgtaaaagctaagtatatgagcagctgcaggatccctagagcagggaacccttgccataaaacttccagcttgcctagagcaggcaaccaagacagaagcaaaggaatgtcttccctcaaaacaacagaggcaatcttcttatcttccaagcaatcccaaggcccggtagggggagaagttaaccacagcaccccggagaaactattctgccacactggagtgctgctaccaaaatcttacttcaaaaaattgtacctgatccaggaaggtgtcccggaataaaattaaaatttaaatatccaaatgaatatttaggttcaaaaaatctcttgaagcaaaggatagtgtgagaagtgacctctcaccaggacggccttccatccaagggtttgccttcataggggaaacaatagcaaaactgttgaagcctttgatgaggaaaagtctacagggtaccctgggacttacatttattttgatatgccatagaaagcaaaatgcagatcatacaggaaagcattcaaacgaacgaaattagcactgcagagaggccatgaagcaaccaactgcacagttcagctttggtgtcctttttgataggcaaataggaaatatatggatttctgagcaaacttctgctgagggatattaagtaataggataatattacattaaggcatggcttacatattctatacattttgaaaatcaagttttactaagtaatattaggtattagcctaatattccagtgagcagcttggacttttctgtatgtgaaaagctcagtccacgttatgatgctgcccgtgacttaggggactctgatggctgttttcagatgtgggagggcacagtggagagaaggcacttagataactcactgaaggcctcgggccaggagcagtatggagatctgaacacagatggtctgatttaagcctgagctcttgatatggaagtggatttgcagaattaacgtttttaaatatttcttgatgaatccatccagatttgagcccacagtccatcattataatcactacaaacaacttttatcactctgccttcccccttacccctggcaaatctcgggcctggatctactcaattactttgccgtttctgaatcaaagcagctgcgcctgaatatggagaagaaaaaacaaaaaaacccaaaaaaacagtctacatacagactgtttctactttaaacatttgattccaagcttcaaatgcctgcctacaaacaagtgaactagtgtccctaaagtccaagatcacacaccccttccttcctccttctccttgcttacccaaaaggaagttcccttccctgatactatcttgcctttgtctcacacttcattgaaaaactataaactgatagattccatctccctacttccaaatccacaacgttctctcttctacccgccttccttgccaccctcaattgaaagtcactgataccagcagtggccaattccccaccaatgattcaaagggaaaaaaatgtgctatattatcagctcatctcacaataaaactgatctgctcaattctcctgccaaacacacacacacacacacacacacacacacacacacacacacacacacacacaccataaccttaaacatacccttttcccgcttctccacaaacaaaacttaccattaccatctattatgcaatagttaaacttcctgctgtcacattatctactcaatcaatttgcctttggctcctaaatttctcctccatctaaactggtcttatcaaaactgtcaacacgccacaacgttcccagtggaaaagccctaacttaagggataagacatttcctaaggatgttatgtaataggacagaagataagaaatgataagaaaaaaacacagataataaacctgattaagataaaacataagccttgagattattgtaacaattgtttaaatatggtttataaaagttggattagtaatccaataaccaatcaattttttagaggcccctaaactatatagtgaaacaaacgctgttagtcccaagtgatgccagtcatccaagtgatacagtctcaaagccctaaaagatggtatttgccaccgtcatcatctcaatttttggtttcgccgagtgtgccccataagaagaaactccagtaccccagcgctcaccaacataacttgagtcctcactgtgaacaggattgcataggctgagggtctgctggggcagcaaggcactgtccagcaagcctaacagtaaccccatgatcctcaggcaatagaaaacttctcgaacctcgtcacagcattttgtcttttggacttttaaaggcaggaaatttaagattatattttttgggagggaatggaattagaaactcacagagttaaggagagggcttgacagtcaacattccataacagagagtgttactcctcatgcaagtgagacagattgtaaagggccagagtcaaccctaaaaatgtcctggctcctcatggtaatgaggacatgaggaagaaaatacaaactacaaacagcaaagaactggatttgactgtacagtttatttaagataatttgagattcaggagcaagtccaaaggcaaagctataagtaggttcactacatccctaaattcagaaagtcaatactgtgggcagggatgacagaatagttggtatagaactgtgcgagaagctgtgttggttcttggctttaaaggaccagcagaattaattttcagggtggaatgaacctggggtaaggggaggggcaggcgacactttgctacagggcactaaagattgattagaagaataaacatgtgcactacctcaatagatacaggggcaccagaactaataaggcacccccaactgccacctaatatctccacctccctctcatcctcaaataagggaacggggaccacccatcaacactgctggaagccatctccttttgccttgtccctgggacgcaaaacaaacaaacaaaacaaaacacacacatacacatacacagccttcccctttaaagggactcagtgtgtcctgtgggcctctacttacaaatcaggagctcagagatataatctgtcctttggacaagggaaaaggaggaaatgtgttgtagggagagatgtagagggtaacatatttttcttgtactgggcattaaaccattgctatagattcaattggttctagtttgaactttcaagaatccttaaaaataagttgtccttatcacttaagctgttgctggtagagaaacaccttcacgagcttcccctttgttgtctggctgggtattagggtttcctataatagcccagcttccctacccttggttagggaaaaacaacactgccatcctcactatttgttattgtatgctctataccacacacacacacacacacacacacacacacacactccaaagtataagctgctaaatgtttgtttgtatgtatgtttgtaaggccctaggcaaccaattggtattctcttcactggggaaggccacctcgcctactcccagccgtcttcagtcgcctatagttttttgtccagtgttgaggacctgtggattttcctccagtcaggctggcatccactgatgtcatccttgcgctcctgtttgggcagataggtcagtgagactttatgggtgtagcttccaatgttactaggaaacacagtctcagagtaaactccctgatcccctctggctcttacaatctttccaccacctcttctgcaatattccctgagtcttaggtgagggagtgtttgtagatgtagccattaggaccaggctccacaactcagcattttgattaaacctgtttttctttatgaccttatttattcctctctggcatttgttagtgcaccaggcacccaactatcacaggcagtaacagagtcatgccagatagacatgttctcacagttcacatctacatcctgatgctcttcaaagacatgcctctcactaccatgaacttcaaaacgctaatgaagggccatctcgatctgtatcctatatttttaattcacctatacaattaagatataaccccaaaataagtttcacctctccttaagtctcttgctgcactccagcattacatgtacgaaaatgcaagcttaaaatttctacttgaatactattttctgacagctaaattaattcactcactttgccccaggaaattctaatagcgtgacaataatgctaagtaggttttaaacatttttttctacttatatgtacagacatgcaagaggaaatacacattaaaagttctttcattcatcatttacttgcttatgaatttacccaaggattgactcttgttttcgtaacaattctaagtgaaaactggcactctaaactctacctcccaagtttaatgttcctttttctatggggaaataaactggaaagttgcataacagagtaaacaatgaaaaactgccagattagtgaattttatagaacccggagactttgctctaaattgtgaataccataaaagacatttaacgctaaatctgtatgtatttaagaaaatgacccatttccaggtgggtagccatggaggatctgaggcacaaagtacaaacaaaacaaagcaaaagacaagaaagcaagaagaggagctcttggtaggaggggggattaatggaggtgggaaaaggacaggagagagtgaggagatgagcagttaccagaatgtatgtatgaaactgccaagtaataattactaaaaagagaaaagaaaatctgatatttactaagatatagaaaacattataggaagcttaacctttaaacattaaagaattaaagaattgccagtgctgttttatatattatttttccagtgttggttatgagcaagcaataagatgtcggataggccaactttgctcccacgtgttttctctccatgagaattgactgactgagcaagaacactcttccactgtgccgcaacataaactccaggggttagacaaggtccaactgcttaattcttcgtcatctattactgatgtatacaaatggaaattcttcagctaatggaagtgtgtgtgtgtgtgtgtgtgtgtgtgtgtgtgtgtgtgtgtgtgtgtgaaatgaactgtagatgtcttcccgacccccacaaaaacaaaacaaaggaaaagagtaagccatttccaattttctctatctagtgaaaacaaattctgttttactagatcgcgtttacattttaaaatatctgattatagaggagtctaggtcaaactatccatgaattcattttaatcaatctttatggatttctaaacttgggactgtatgtatactcattttttaatgctaccacacaaaaagcttccaaaggctagcattgagcacggcatggatgcttctgggaggtctataaggaccacaccccttctttcccagcttcttccaattgtctctattcccagaaggacattccacttcctccattttcaaagttgcatctgtatttccctcttccagtctggcttctcctcagctgctttcttccttttaaaaggctcacatgatttcactgacatcaggataatctgcctatggtagcctacaacctggagactgttgctaaatgttgttgtcaacactgttatgtataaagagaactgagtcaaagtcccaggggttaggattggacttctttaaggggagggcttattctgtctcagatttataactaaagccttattatttgattcaggtaaatatttacccaagcagactaaagctcttcaataccattgctaaagttattattaattgaaattaaaatgtaaaacagctaagaaattttaaaattttaattagatggccacaactgctttcaaccaagacaaatcatctcacccagtcttggagtcctttccattcctgtctgtagaaatgacacactcatcaattgccttgatgcctcattctagaatccatcacaactcaatataccaaatgctgtctatgaacaaaagagttcaattctcacaagacaatgtaacacatactgcttatatttttatagatgatgaccagtttgttttaaaaataagaatggatttcaggatagaaggaagggcatattaaaatgtcctattcaacaaatattggtttcacaagctttttccaaacaaagatccgaaagtcaattaatattgaaataggatttttaagagaacacactttgattttcaagagaccacagttagtttcagacaccatacaaagagatcttggcacagagacttttttttattcaactcacccaaggccacacagctaatgtgagccacagctgtcttttgatactcagtgtgcactctcagaattacaatctagttctcctaatacataatagggtcgatgacaatgcttagtgctggattgcgttgtaaagcaactgcttcactaacctccccttccagagataacagaggagtgcttcatcattcttttctgggacaaagtatacagtaagtaaaggaccagcatcctgagatggtgtgcaaactagataagggtcagaatatgtcacataagaagtaacaggagagagaaactaggctgaaaaaaccttatgatgaggagaaagaggaagatgaagatgatgataaaatagcaactcagtgacctgtccccaaggccagaaagacctaaggaaggacaactcgctgatcttaaaattaatttcttcccattattatcatgcacatcttcctcttggtaagcggattgaattctggattaaaacgtccagggagctgggtttgtgccgcagaccctctgggtccggtacacagctttattcccagcacttggaaggcaaaggctgggggtgggggtgggggtggggatctccctgcgttcaaggccaacctagcttcataataagttccaggccagccaggactacatagggagaccctgtctcagaacaaacaaacaaacaaaaatgaccaacaacaaaacaagttacataggggagcaggagcgctcttcaattattcggtaaaactttattttcttggtacataaaagagaactgaagtggacttacttgatgtaatagggcactttattatgtgaaatggatctctgccacggcagctggactgaagctgaggaaacaaaaggaagttattggaagcagcaagccttacaccttaatgtaaaacaaatgaacacatttcggagcaactcttgagggacccgttctggctctgagctggattcctgcaattaagaaaagcacgaggccaagcagcacagctttaaagcttcatgtgaagtgaggaaaagaaccaagactcaacgtccagagccgattctgtcagaccctaacaatgaaaacactttcacaaaatcaggttattgttcataaacattgcaacacagaacacagtgccatctgcaaagcatgctccctatatgctgtacattcagatttaaaatgacagttcccaagatggaatttctagatcactaatagtattcttcactttgcaccatattcataggctcagctattatgaacagatggcactcaagcaaatttaattataagaaggttttagaaagaaaattcaacataaaaataggcaaggggttttttaagaagcaagcagatcatctaagaaaaatatcagatatttattttgatccgcagtatttaaaaaacagttttccatgtttgtagtatgtttgagatgtttgccacgattgagatatgatgccttttaatggaagttctttcctttttgaaattctgtttactgattacttgtaaagatacattacattagtgctttagtaaatcaattagttaaatgtttatttaagtagagtagccacatgaatttagaaccagaagaattttgctaagcaaggtaccaggtaaattaaaatgaaagtttacaactatctctagaccttcatatagacacgtcactattttttcataatttcttggcacattgatatcttgcaaatatgcaacattctaaactttgccaagcatcccaaatccaaactttattttgaaaatgcagcaagatccacacaccaatgtccagtataatggagaagaagctaaatacgcagagttaaaaatagctgcccaagggctggagagatggctcactgtctaagagcactgcccgctcttccagacgtcctgagctctagtctcagcaaccagatgatggctcacaaccatctgtaatgggaatcaatgccctcaactggtgcgtctgaagagagtaacagtgtactcatatacataaaataaataaataatgagagagagagagagagagagagagagagagagagtcctgtgatatgagcccccctcccctaaaaaagaagaagctgcccaaagtccttttcaaaatggtgtagttcagatactacaacacctttccaaaaactagctcagcaaacttcctccttaacaattgttctggtcttgatcaaaggcaagcactcatctttacaactgtgtccacagatattcacaaacagacacagaaatgaagactcaggtatgctaaacttctcataagagctagcctcacttcatggtggcaccaggctgataggtcaggttttattgtgtgcctcatggaacttgctttttaacaagcatgggtaaagtccaaagaacacaatcaagccaaagaccgtaagcagcaaggaataagaattattaaatgtactaattgcaagttttctcacacttcttcatttattcagtaattattttgattcgaataaccaagcttcttggactgtcggttgaagaccacgtgcttgaacaccatgtagtgtattgcaattctgcagtgctttatgactgaagaaacatgaactagatttccatgggagaggttgccaggtggaaaggtagggctccatcaatattagcagataaactgatcatttgaactacagagtctccattatttacaaatgcttcttcaatttggtcttagttattctatagggtttagaaatctataatacttaatatctaatgagtataataagaggctatttatttcaacaatagtgctatccatatgttaagcattaaaaaaaaaggtccgcccttacccaccacaaagggctatacctcactcagagacaaacacccacaggctcagcttaggaactgaagatgggtaagtcttagaggtaggggacagaaaatgacaaatgtgacttcacaagaatacaaaagtaaataaaccctgaccctttctctgtggtttcagagaaaataagtttccataattgagaagtattcttggccttgagcttaaaatttacttaaatttaattaaattacacaacttgttttttttccatatacttcccataggaaattaaagaaaaggcattaatatgtgctgaaagcatctttgccaaggtgtggcttgcgtgcttggtctaacaggatagactactgaatttcattcttgaggcaatctgaggaaataggtatgcagagatcaagaaattaattttcaaaaattctcaggtctagtaaaagacaatgttaacatttaaaatcagtttgggagtttcaaaattcagcattcttaagtatcatcagaagtggatgataaataaaacagggctcaaaattatttccctaagacttcatgaagtgcacataaaattacaagttccagttggaggatgttccattaaacctaccttggtgcaacacttaatgtataacatttgtccatgagatgactaccttgagcttagtaaaccaacattttctcatttaagtatttatatagtgaattaaaattcatgtgaagctttaaaaaaaaaactaagtatacatatatagagagagaattgaaataaactggttaaaaaaccttacagcataaatttttggtatgagacattcataagctttgcatgacaaataccatatatgttatcataaccaatgtttaaatgagaaaacatatctagatacaaatttacttttgttttcctttgaatatttaccaatttacatactgcatttattacataagcaataagtaatatttcatgaacatgttctcttaatttaaagtatagttagagcaaagatagagcttcttgggcagaactgaacgaatttgcaaattcattcaagttaagcaagaacactcaaatttattgatacttactggacagaaagtgttgagaagatggcccaaaatctctgtgggcttcctggagctgcttaaggcgatcgtccacggaaacctgcacacaagcacacgccagatgaaacgactgacttcaagacaatggttttcataacatccttgacgtaattactttatcaagtaatgctgttgctctatcaattcattactgtttgggcagaaaacttctcttcttattaatgcggcagcatgaaaatcaacttctgacattaaataatggtaaagaaagtcagagatcattctaaactatctatatgaactttcaatctatacaataaccacattagcttaatattaattgtggttatcattttagatatgaagaaagcaagacacaaggaagggccagaggacacaactagtcagaacaaagtgaatattcatgccttggccatcggagcccatctttatgcctgaaaactgttctccccaacttggtggcaggaagcatgcttctaagacagcttaagatgtggccatgggaggagcccttatccatgcctcttttataaaaaaagaggataaaagtaccacagagaatgtgtaggaaatggagcttagagaactctaaagataaagacataaacagatggatagatgggtagacaggcagttaagcagatgatcctagatggttacacaggttgataagcatattgataagtaggtaggaaggtaggcaggcagacagatgggagatagataaatgagtatatgagatgacagaagagagaaaactggaagctgggtgtgaaacatcttctgatttccctacaagtttgcatctgatggtctttaccaaaggaaagaggagcctctgagaatccctgctccaggctgcaatgtgtcaccagtgcatcccagccatgactcccttctatggttgttagtgtggattctattgttaccgtgccacaggacaaaaccagttatgaaaccaaatgcaaatgaacaacaattgcatactgccttctgacatttccatttccctggccctgttatttgtctgtgcagtggtggtgagctgttccatttgaatgaacaatttcattttcagcacactgtaaataaaacttgcatctgcctagctcactgggcatctcagctttctcctggtcagctacataaattgcatcagagtgtactttattcattatgagagatgctcaaatgtcatattttataagtaagctgctagtcctgaaatttaacagcactgtctgctaacagggatttgtctttgcttatccaggactgatatttgaaccctagtagctaccaacatcaaagataaaggtggaagaatgttcccatcaaatctaacaatacatctgacatctgtagagatgaggataacagaggcaaagcaaaaggaaatcaagaaagaccagaaaagcaatcttcaaatgagtataatgaatgataacgatgcagagagatgggacagaagcaaaaagaattaggttcagacatctctgtgagcacttacaaatttaatatgcttagcctgactaatcccggattattgacatccttcacaaggataggaaagatcgtcacatatggaatattcacatctcacactttcaacttcattaagaaaacatgtaacattaaattaaaaaaaaaaattaacgttcatgtattctacatggagaggcgtgcgggtggtcaggacacaggcgtcacaaagcatcttttagaaggtggccctttcctctaccaagtgagttgctagggacagattctggtgtttacaaatgcatttacataccaagtccaatctcagtcacctccttatgcattttgatgttggataatgtaagaatatattataacctaaaatgtacagtacttttcaaataaaatgacggaactgcacatttgtattactacatgttatattgtagagaaattagtcagaattatttactattactcttctagttacagcctcccctgcggattttcagcaaaaaggcatagctgctttgactgataggaggtggagagcaaatgtgtcccagaccctttgtaccatgaactgctgcctggcatggacagtagtcagccaatgcttagacctggaacactcatgagtcctggctcagctaatctggagtctacaagtagggtcaggagccactgaaacaattgccttgggaaggtcggatctagacactaagtgcaggtgtgctttctgtaaacagaaagaaaactcctgcacagtgaacaatgtaaagaaaacgaagaaaagctttgtaactttttcaaaagagaaagaacacataatgaaagtaagacaatgatttctttacaggttacaacaggacaaaggatcctgtggctgactccaggttatcattgctgcaacttactggcttttgtgtattttttacaagtattatatacagtgtaaatataaattataaccaagaaatccatactcataactaaatgatgctcttggtttcaagatatagaaagacaagtacctgcctactaaatttattatcaaacaccctcagtaaagagagagacgagataatatgtagtttacaactgaggtgagttttaaagaccatctgagtgtttctgtttgtgtacatcctaatgtgtgtttttcaggtttaaaaaaaaaaccccacaaagaattgttacactaagaaactaaatacaaatcaacaattgtatagcctgacatttctattcctgttctgtattctttatgcagtgttagatagcattctgaaggggctaagccgatacctgtagaagtttccatcgcatattaaggtcatccagctggcgagacatctttagagatggatgcaagtcaagtggagacagctgactggacaggtcattcattgtttttacttttaagttgattggtgcaatttcttctctaaacgcctggtagaaaacagattattttagaatgtcgccagaagagactttctcaaaagccagagttgccatcttcttagtgaagaccataggaaggccatagtgatgctgtcaagtagagacactacttaacagcagctgactggatcagacctgtaataacctatacagccagagactccctgagccttaaagtatgtgggcaatgagacaaactcaagttgtgaactcatttaagacactaaacatttctgtctagtctataatatgcaaaccacaggattactgttgcatggtccatttgctgtttttattgaagcatggctgccttactcctttatttcaccagacacaacaagttgacttgatctcagtcatgcttagattaggggtcgagtaaaagtagctttcctcactactaagctatagttattggataggagagaaaagttctgtatctccctgaacccgctaggatcacagtctgtgcttaggggatgggcaggaagagcagagcatcatggaaaatctatagctgagtctcagtattgaactgctgcctctgggtgaagaatagacccaggtaaaaagtatatgtcctgggcaagcatatgaaaagggaagctagactttaaagccaatgagagcaaacagcataatgatatagtcatggcctcagttctccgctgaattccacctgtcttctaaagcactggttcgctttctctgacaagtctttctctacatcccactggatgctgaaatgcctccgtgaggagatggccctcggcagccttgcctggaggcctttccccagcactcctggattttctgttcggtgtcactaacccagctatgactttcagccaacatatcaaaacgtacaaaccacacacgtgtcacatgtcatgacatagctattctgacagttcagagctattccaaccccactgctggacacctcagatttcagttcctatcccttagcattcacattcctcctgccccatggaagaagctgcttgggaggggacactttcttacatttagaacctgcgcgcacgtgcgcgcgcacacacacacacacacacacacacacacacacgcacgcacgcactcatctgctgtctttctgatgcttttttatagtaaggaatggaatgtacctcctttgttccttggtcttatgttagattttaggacagataaacagccttccaagatggcagggataaaattttgcctctcctaaaacctatcctgaattataattattgctaaaacccaatattcaggaatcaaatatttccaatggtaaacagggaatatactttagtgttttcaagttcttgactctgcctaaaggcatgcggttaagttcaaaggagagttgaagaacaaaccacatgagaagagactgagagccagaagccaacatgtaaaatacaggcatcagagagagcagggtatgaatgctgtttgaatttgtagacatgggagtcaccaggtgtttaataagatctatttccaacctcagtagataccactgtatcaaaagaagtcagaagaaaggaagccccaaaggacacatgtcctgctacaacatggaaagagaaagaattttgatttgcagtcagttttgtctatccctgccgatgccagacatctgaagatggtccaaaatgcacacgcagattgtaatgtaattgggcaatgtgcacaatgtataaatctggttatggggcatacagtgacatagtgacaggcatgacaggtgcaaaggattaacaaataatacaggtgtgggagacagagggaaggacacagagtttatcagcgtggactctgaaacaagtcagattctcccagacacagctgaacacacatgctagacctcaaatgtttctagagtttttaactgggattttttagcttggtatattaatattctctttcacagataaattcaaagaccttaaaactggatccatattttaaaatcaatatccttttagttttagatattaaaattttaaagttaacatgctatttgataggtttttaattttaaataacaaccagttttatatcaacagatggtgatttagaaatttagaaaggtgttttagaacttgattataacttcatgcataatttcaggacaggatttttttttaattttaaggaacaataaagaagcttatatttctactgtgtaaaaaaaaatcctatttttgttttgttttgtttctattacaagtcataggtgaaacattgacagagctttaacaggaaagtctttctggctctgtttgcacttttatggcaaggtgtttttatggcaatgaggaaactttctatcaaggaagtttatcttttgccttttaagagtttccaaattggggcttgaaataaatggagttataaatggctttcagaactgccatgtgttcttgtataaagaactaattcatcatgttttgactgtattttcctataagagaatacaagtctacgtagccctcactgctataaaaacagaaacatctgctactatcaaaggtgctcattagactgttggcaggtgtgtgtctcaaacccgtctggtaccacaaggtatatatgcaaaaaaaaaaaaaaaaacaaaaaaccagcattattaaagacaactttagcaactgaaattatttacttatttctgaggattttatttccagctttgacatattaactaatattttgcaacttctagtatttaggttttacctctctatatgcctacagtaagagaggggatatactttacggaaaatgtaaactattacacacattgagtttacttgatttgattcagtgagacttgaatttttaatttttacctctaaagatataaaagtaatttaatccaatttattctttcccattagactatttgcttctgtgtttttgcttttttttttttaagcttcccacttaagtagatttgaacaaaagaatttggctggagaggcaagtcagtcctttaatttagtaagactgccaattctcaaactctttggtcttttctgcagatacaaatttttatttttttccacactaattttccccagttatcatgtgatactttcaaattcaaaaaggtaagttcccactcaaatccggaggtattaaggttgttgggtttttttttttttttgatactaattgtatttagactttttaggctttaaaattagttaagccagatttgatgtcaaaggcctgtaataacagctacatgggagggtgaggcagaaagcctgcaagattaagggctattggggctatggagtgagttcaagactagcccacacaccctagcaggatcttgtatcaaaataaaaagtaaaaagaaggctttgcacccagctgagtggcgctgcattaacccgaatacacaaggcccaagtacaacccacactacctaagataaacaagtaggaaaaatccagtgtccaatatttgataaagatgcactgataaatgaatgattatttttttcttagactatgttaaattcacatgtatccagagaaatgtttttcagaatgctctaagttcttgaagaggtctgcttaatttatagagtaggcagatgcatatctatcatcagaaatggagaacactatattctttgttaacatttgttttacatttaaaagttttaagtttaaaagtgtttgaattttagagggtttaaattcaaagggttggtcaaggctgtgtttaacattagatctctgcagtgaaagagaaggacaattaaaaaaaaccaaaaaaaccaaaaaagtatcacagagaccctaaacctaactagctgtgtgggcttggacaactgcagttttgccttcaggaaataatccttaccgtgttgacagtgtgtggattaaacgagataaccacgtgaaatgactaagaacaattcagctttaagaaatgctggctgtcactactcccctgtctacacacacagatgctctcactcctgtaactggcctgagcattaagttaatttcccagagcttgcctttccactcagccacactcatataaaggaagactgttacccggtgtctatgaacacaggatgtgtgtaccttttgcaatgaaaactccatgcatgatggataatgttggatgcatcccttctgattgtctcagtgctcaccctctggcgtgattcatgtctatacaaacattgctttctctaaagtttctctctgtgtcttctgctgcctaaattctgttactcccccacccacccacccacccatacacacacacacacacacacacacacacacacacacacatcctgaaaatgtagaatgagtaagcaaagctgctttacaccatagaactaatatccttaacctcgggcaactcctgattacaaatggaatttataaccaaatttatttttcacttacttagacaataagatagaaattatagatgagaattcccactaaggcagtttgtttttttattaaacctgtaaatccaaccaccagtttctaggagacagacctgtaggctgtaccacatgggcacgattctattaaatctaggctgcaggaatcattacaaaataaacaatataaaaaaaaaaacaaatgaataggaaacaaaagtaaatgaaatggaaggcatatctagaaacaaattgaacttaaaaagtttgtgagaggttttgtcttgttttaaatggttaagcctaatctacactatttagggatacttgaatggaatttttaaaatgtttaaacaaactaaattatcataaagccatcttggtggggtcttgtttttttgagggggttatatatggaaaacatctgccataattcctgatttaggtggggagctgaagtggtaccagcttataagaatcccttatatgtgggtctccttatatgtgttctctgcaacaacaagaatacatttcttaaatattctttgtcaaaggcagtggtgctgaccagggttttctcgatgtgatcctgcagggagtctataagcaggtctcccacgggcttccagccattccgcacagcctccacctccttcatgtctgcgtccaggtcgtccatagctccctgcaggtctcggagtttctctaacgccttccctacttgcttttgccagttgctagtgacagcatttagattttcccacttctctcggacttcagaagactgcttgcgcatggctttggcgatcttctgggctctctcctcaggagtcaactctgttgataaaaacgagaaggtctaacctgggtgtctactcagttatacaggtattcttcaaatccaagtatgaatctcactgttaaaagggttactagtgtatagattaaaaaggctgagttacaatggtatctatatgcgtttaccagtaaggcatagttacatctaaatggatactcaaaaggaaaagaaaatggttgcgcagattagtaagtggtttaacgttcatggaaacttctgaattttaatactttaacacgtgtaaggcttgagatgtagcaaaataactcaagaaagaaaacatttttcctttaccataaatttacttctgtgaaaatccaaagacagttttttatttcattgttctcaagtgaaattagaagcataattagcaaagattagctgtaagttatttaaaaaaagattaatttaccatgtttctttaaagaacaaattcaaggcatatgacatcttagagacttcatcatctgtaaatttgcttgcctgttcatatttaacaaaggacattttccgaagactagacatatggaaactgaatgtttatccacacttcaccaggaagtctgcaagattacaaggaccatccttgacatgtaacagagccaggagtctgagtttaagaaataaactaagcctttccaatggaaaggaaacacacaatgtaaggctagcaagaaaagcgacagcccagcaatgaagaaaagttgcacagagaaaccaaagtcaggttggaacaaagctcaggcacagaaacactgaatccaacaaagcaaagacaaaaggacacatttggacacagagagtgactcccaaagcgggacaacccaagtataggaatgtctgggactctcacccccacacttgaggaccccctctttattctagctggcttaagtgtaccttcttgactgtccccagaaacagagaggcagaccaaacccacacagatatggcaaaaggcagggttgtctaaggcagacacgtatacagatgtttcgggacttaaggtagtgttgtggatacgcccatcctaagctgaggggaatctcagaaatcaaaagcacatttattagatctgacctagcaaacaccacagctcagcctatactgaatatggatagagtcccgatataagcctgtagttagacaagcgcactgaacacaaagcttccttcatgataaaatgctaaaggtctcataatgtgcagaatactactccaaatgcttgaaacggaatggccacagggctgtagtctcccatggctggagccccccaaatgttttaagatgactcatcctaagtctttatctggaataatatcccatctttaagtataaacgacatcataaaatgaacggaagccagcgttcttaaaccttaatatccatccttataaaaagcctgcctctctgtcctcatctaagtgtgattcaaaagacaatttaaagaacacagactgtatgtttgtttaattttccagaaaattttaaacactgatactcagactgtgaccaaatggcctacgaagaacccagtctcaagggactactgggtaggagagtccagggtgagacgggaaagcaccaaaatagtgggtactctgactataccagactgagcctcaccagtacgagcgtgcacacacacacacatctctaaaaccatacatgcacacacctacccacaccacatgcacacgtactcacacatgcacacacacactaacacacacacacactaataataagtgaaagccaatttaggatcctaagccaggaagtctagagagaagggccaataagtttaaccaacacataaggcagccagactccagagagggggaaacagtgtcattaaaaggcaagctcctctaaatacttatgccttcgagacatctgtaaaatgctaaatataacacctatattttatattttacacaaatgtaaaatgttatgtgtgagatgaaaatttcattcctagcagcctcaggagaagtggagtagcttttatgagggctacacctgtgctggttaataagttactgggctttgcgaagaatgtattttaagcatttgtgtttcaatgtctgtgggagggaggggaggagggagggaggaagagagagacagtgagagacagacagagagacagaggcagagagacagacagacagacagacagacagacagacagactgcctgttcatgttcgaggcaagacagcttactcacagtggtttcccttggatgaaatacaaactgtttctaaaccaaccactaaatatcagtccacagaggggcacacagagctttctcatcctgggatgaaacatcccatattggctgccacattttcgcccagtggaagttcttctctttgtacagtcctttcgttggtttatcatataatcccctctcaagcagctcgccaatagaggagcaaagctcgacactaaactccccatctgtttaccacagaggacctgtgcccactaagcactctgtagtcagaacaccactgtgtcccgctgcagcaagccttagaagctgttcaaagccaacgagaggataacaaacaaaacaaacccaaagttgtccacgtttgtgaggcatataaaatgaagcaatacataaaagttcaagttagggcaatttgaggggacaaagaagaaagagaagaagaaaaaggaaagaaagtaaactcgaagaggcagaaaagatttacagggaaaagaataaagttcttaaaggatgcattctttaaaaacaaaaccttctcatttgaaaaccaaaggatgaatgtttttttcaagtatgaaaagcttctatggtaaattctgaagccccgggtggagacgcatcctagccagtctttctatagcatggtattgtctgagaaaccctgctgagagctgattcaaaccgatactctctagaagctgctatcagagacccacactccagcatagtgacttggcccatcaagctggagattcctggagagatgcccacactgccccagtggtcccagcatctgtcagtagagcatgcctagcttaatggaacacagtgatgcgctggtcttgaagctaaagacacatttgccttccactgcgttgatgtatcaatcccatgtacaacacagctactcagtctaggagacctgggagcccagtgataagagagcactctaatttgcatttgaaaacaggaacaggagctgagaggggaaataggaggacaaagccaaacccatttgcctgcacttctgatgccagaagagctctttccttgtcactggccttcccacccagtgtctgtgtgcacctgtatggatatattcatcccaaactctccaccctcccctgttcaggcctggggatccaactgcccagaatttgaaggaagaattatatttacattcttgggttcatttgacagtatattctacgtcctaccatactttatggatatcttgtgtgttttctatttttattctgttattttaaatagtacagtctataatgtgcgacagatttttagaagaccgagaggggtaaagttggtgtcacatgcctgtaacctctgccctttaagtttgaggccagtctgggctgcacggagaagaggagagaaaactcagcagtctttatatctctccgtgtgtgctcgtggattgtcctgcatctgtcacaggctcttctgtacagtgggagcgaagactagagggaggaaagcagacggaggctaggagccaggcccagacttccgaagcagaagcacttccttcatgtgcatgcaggttgctcaagcacgggcacgcagcatgaatacttacttcacccctgtctttccaagaggaaactccatggaatcctcttctctcattctaggaaaacactctactcttcagtgtttacgagaggtagacatttcccctgtgtgtgcttgtgaaaatatttattttaaacataattcttatataaaatagtgatgttgtcatttactggagtcatcctggtcttaaggatgattaaggtcaacgttaaccttaaggttggtaaggacgatttcctaaccttatcatatttttttcttagttttggtactggcccggcttctacttctcgttactactgattctaaacgtttatgtcacgaacatttatttcctttccatgtgggttgagaacccagacaggggcccagtctgtcactgacttgcagtaaatactttagctgtactttttaaaagcaatactaaactccatttttaaatgcccacttcatttttcccctccttgccaaccccatgtcaagctacatattcaaattataaaccttcaaaagtcatttaacctatggtcattccaaatatttgacgtgtactatgtggggtcctttttgcatttatttgcagtcttttatactttatcaatacatgaaaggttaatgttaacaatgacaaagaaaaagattgtaagtaggatttcactgctatacaactctccgtaagaaaagattagaaattctagcagtacgatatattatcctagatgctgctcactcttatttgttagaagctgagtttataactacaaaacacacacacacacacacatcacacagtcggtcctcagtgaagcgtctagttctaatctggagctctggaatcctccagtgattgtccgcataatcctggctgattagaccactggagttcaacagaaaaaaaaaaagaaaaatttactcactctcttttggtgtttctgagtcacatgggacagggttagattaaggggacatgggacataaaagaagattcactctggaatctgattggcctttcctgcttgcatagttgagactcaaggaatttaaaaactgataaaaccaaagttgactacagagataatgtaggctctacaagagacctctccaaggaggatgtttaataaggataagtcaataaatgaacaatggttatgcaggggaaacctgggatgtttctaatgttcgatctaatgcccaaacctatcagtgtgcatcctaaaaccactttgcaatttcctttaccaaaggaaatcctgtaaggtaagagaaacaagtaaattgactattattttacttgtaaacttcacttttaagtttgttttaaatcttgttacaaattacatccattgaaagatgtgcatgcatgcgtgtcttttaaaggtagttcaatatgactccagcgcacactcatgtctccctaaatacttctgttttatctgagtggagtaagcaaaaggtcacattccttgggattctggcaaaagtgatgggttgtgcctccctatggatgctcacacttccagtatctttatttctctctctttacagcccctcccctctcttcataatcaaaaggtatttctgattaaaataatggggaatatcttatttccactcccaagtattctgattaaataattaagatcaaattaatctctttaaaatggtctgtcagtggctaaggggaccctgtccacttctagtctgggaggtggcagatggtaacagttcattatggacaagatcacaagaatatcaagtgcactcagctggttaagacttctaattatgctcatctagcaaattataaggttgacaagttagtaggggctactcagctgattgcccagcagatgagaaaactacagctttcaatgaggataggctaaaggtagtatggtgaatgagagagagagagagagagagagagagagagagagagagagagagagagagagagagagagaaagagagagagagagagcgcgcgcatgggaggggggaatgagagaaaatatatatatatatatatatatatatatatatatataaagttcaagaaaaaaaaggtaggaaacatcttccagaatctcaaaaggcaactttctgcagagcatgaggtgaggaaggaggaggagagaggcaggaggaccaccctgagggctgaggggtctcagtgagggcaattctgattagaaaatcactgttttgttggggaagggggataggggaaacactgtaggagagggagtaaccaggagggggaagtgaacaggatgtcaagtgaataagtaaaaaaaaattaaattaaataaaagaaagaaagaaagaaaatcactggtggtcactgagattttattctgcctacaaaacagacaaggattcccaccatgctctcagatgtaagcagtgccagtgtgctgagctaagggagaaactcctaatgacagccatacacagggcaggagcaggaggggcaggaagaagctgaacgcagcagggcagcttgcgtggcacccagagagccaactcctgaccctccggactgactctctgcagcagtgactccctgaatgtcctcctgctgacaacagtgtcacactggacagcaatgagcaggtcactggggacaggaagacagtactgaatggggtaaaaatactgagaacattcgatgtcagcaggacaagggatccacaatgctctcacatgtattcccagggcctctaataccccatgggttctataagaaagcaagctgagcaagccaggggaaataaggcagtaagcagcatccctccatggcttctgcatcagctcctgcctccaagttcctactctgtttgagttcctgtcctgacttcctttgatgatgaacagcaatgtggaagtttaagctgaataaaccctttcctcccaacttgcttcgtggtcatgatgttttgtgcaggaatagaaaccctgactaagacaccgacccacaaccatctccccctacccacccaacccaacacacaccaaagaatcagaggacaggagccatagatttaaaagctctttcttgacacattagcatccatttctccccacaccttgggctgtttccccgcaacacacaaaagctagtgatctttaagtcagaaatttcagaagctttctacctgagcttagctattcttattgaagaagtacgtttcatgtttatgttctgtgaaaacaatcgatgagttcagcggaagagggacatatatgcctttgatggccttccatcttcaaaaccacggtgacatctcagaagtttctagctcccaaccaagaaacaacaaccagaaaaaacaccacactctgctcaagggctgtagcaccttcctgtcctttatgctaaaatcagaaagtgacatcccggatgcagatccccataaaatatatccctgtaaagtgtcaccatatctttttatgaagcaaatgtgttttatttattgatggccacaacactggctggggaaagtagcagctggcaagcaatttattaaaaccatgtctgtccataacactaacttctgttctcaatagagagagtgctgacttatttacttacacagaactttcttgcagtgatattcataaccactaaaagaagttttgctttctaaaaaatgtctgcccaatccatgggcttcttcagttcaaggttggatcactatatctatctgtagttaagaacactgaaacagaaagtaacatatttttctatgccctttcatgtgttacaactttacccatctaacttggacttgggaagctaattaaattattgctgtgctctacagatctgagagcaattactcatacttcaactctttatgtgaaaattgaaaagacaaattctaatgttgcttaaacaccttctccctcggtaagggaatcggtgaactggtgtatgactctattaagcagtgtgggactttaggatgggaagtgtagcagagggtacaaagaaggtatatgcatttaattatgctgctaagtttcctacagaaataccaatgaggatagaagtaaatttaaaaacctctagaggttacaagcaccaagtttaatgactcaaatcttggcttctaacttgcatagacttatgaactgagcattctaaatgtccctatctgtacaatgggtggtagaaagcactcttaatgcagagtgttctcatggacttagcctggggcttctgaggatagatcctggccagtcctagaaagcctcattcctcctcacttaacctaaacgaggggaaggctttcctcaagagactccagatgacgagagaggcagtctactcccatcccttgtgaaaaagaagctaaggaaaagaaaaccagcagagaggaaaccaggaaggccaggttcctgggtggcatttcagctgctgctgccagctccatccctgctcctcctgtgactgggttgtggggcccatagggcctaggagtggggaagcagggaagcaaggacgctggtaggggcatgagggtccacctttacaatgaagggatttgaaagataagcctgttacttgcaaaacaaacaaacaaaaagcctggaggggaaaaccacctgccagtttaatagcttaattatttctgttaggtaagatgtaatttggcctcattttattggctacaaggaaacaatggaaccctaagttacttggagaagccatacaaaaaggacattctattaaactatatgacaattccctaccgtcattcattcaatgatcataaaatttttttctgcacaaatctgtcattgctgctataaaatgagctgacatggaattgcaatgtgatttagattctgaaatatgtctgtagttctccaaaaggataagcacccttcagcctgtcacaccaagcccagctgggttcttctgccagataactctgtccgaggggttctagtcccacgataaaacaccatgcacaaaaacaacttgggcagaaggatttatgtcagcgtacaattctaaaatcacacttgattgttgaaggaagtcaggtcaggaacccattcagggcaggaacctgaaggtaagagtgatggagaggccatgaaggaatgctgtttactagcttggacctcatggtttgttcaacccactatctagtagctcccaagcccaccagcccagaggtggaagcacccacagtgagctgggccttgccctgttaattatcagtgagcatcaatatcctacaatataggagccccataagagagaaacactgccaggaattggcctttggaaacattatattgttgtgtttggtatttcaaagagtacaacatacactgagatagaacaaatgttgttaatacacacagctagccatcggagacccaaagaggaaacactgatctaaaaaaaatgattatttcccattgacccccggtccagtcacattgaactaattgcgggtatagcactaacatacaccagacatataactaactatacacagataaacacattacactaagaactatatttttctatgactatttgtgaatatcatttaaatgaagcaaagatgaccagcctaggataaagcgagccattctcacaagagaaggatactgtagtcacggtaacaggaaggctttagctgaaatcatttttaaagcttatttgtgggaaaattaatgaacaaaatatcatattgtgttataatgcattagaaattgctattgatggtgatgggcagttgggaaaatgccatgttctgccccccactaactctagagaatggagggtggggaggcagaggtggtccctggctgtgtaccccacagtgagtagatccttgagccagcacacaattcagatgcagctctgagaacagcaagggaagttggcagcacaaagaagagccaagaaatgtgtgtgcaaggctaagaggttcttgacacgggagtcaagaaggagctaggaggtcagcagccagagcattccacatgagcagagatggagagggtgaaattacagggatgggcctaaagccagtgaaagcccaggggtgagagaaggtgaataagcagcagcttagtgctggatctgcatcttcctttgattatctcaatgaccttgctcggccaagcaagatgctcttggccttagtatttggtattttttttaaaaaataataaatggtacctttataatctgtctagcacattcacctggttcaaagaatgaacacaaatgcagtttaaaaagtagggaaaaaaaaacaacacaaatgataagaaacgtatatcccattatacactggatgataatgatcaactaaaagcaatttgcattaaaaggaaaaatgtgtcgatatgatagattaaatgagattacttccatgccgttcaaacaagaacactgaacacaaagctctttaaatctcctactttagttgcacaaaaagaaatcgtatttacttgaatcatttctaaacagtgcacgttgttctggtaactgagttttccacatagttacatgataccccatttaactcaatttctttattgttttcactttggggaggaaacttattaaaatacagtaagacctcttatgccttctgccttcagaaataaactgcaactcatagcttcagattttacaggtcttatctagtatctgtattttttaatttcccctggtttgtgtcatctggctgtggtcactcctgtcaaccttgtccctgtcttgtcacttctacctagttacttgttcgcaattcacaggtcatggagttcgagtacttacaacctgtctaaaatgtcagtctgtgtctctgagaaagtacctgtaggcttcacctgcgttcagaacagggtctatatgtcccacttattgtatttactgttcatgttcaaatcccttcttcagattcttgataaacaggaagtcagtggggccccagggtgggctaagtgcccgagtcagcctttggtggcatggtttcaccgatgataaagtgctaggaaatcaggcaagaatctgtcagcagagtacttaagaagtcgctgagacagggctgagcttgggagggggttggtcgagcaagtaggtgctgtgccagtatatgaggaaggagctggagagcagagtagagggatcatgactggaaaagtgaacagtaagacaaggcagtgcatggctgcagaaagcagaagtctggtgtccagtggacatcgagcgtggggcacagagtgggtggcatgagacagggtcgtcactggagcagactggtcgaacactgacgtcaggtgtctgctcaaccttctacaccaggtcccattctaaaggaatgccagtgctggtctttagacagatcacttgggtcacgggctgatggttcagtaagtaacatatgtaccatgccagcaggatgacctgaatccaatgcccagaactcccatgtaaaaagtcagctataaagtcacatgcctgtaatcctactgacagggaggcagagacaacatgtagacctggggctcgacggccagacagcacagcatagctggatggagagctataggtaaaaatgagagaccgtgtctcaaaaggaggtaaagaagaggttaaaaaaaaaaaaaaaaaggaaaggtaccagaggttaacctctggcttctgcacacactcacatgtatgcgcaccctcacacatgataatgctgggtggtactgcttcccaaatatttgaaaatacatgcaacaccagttattaataaagttgataacagaagaacaaaatgagtggaatggggcttgcaagggaaaaagacgtttgagagaaaaataatggagaaaactattttctagaattaaaaagagatggatctatctttgtaccctagggcataatgcacagagcgtattcaaaaactgcttattaagtagaactaaaagccatctacggcttgggctagcactaatgcctccaacacagagcacttcactattactcgggatgactaatgctcaaacagtctctgtttctgatcgcagttgtgcataagtcacagtaaacaaaaaaaggatagaagctattatggataatttccctccatttacttttaacagcaggtaaaatgggctaccattacagaaaataatatcaaggaaggagagggttggaaaatggttccttgcaaaaccaaaccaaaccaaaaggacaaacctcataaagttaaattgatgtaacatttttctcttgccagttcccccccacccccaattggtggttggaaatgggaactgagcaaaatcctgagtctaagaacaaaggagagaagctacaaaagtgtcctttaaagatttttttgtttttttttgtttttcgagacagagtttctctgtatagccctggctgtcctggaactcactctgtagaccaggctggcctcgaactcagaaatctgcctgactctgcttcccaagtgctgggattaaaggtgtacgccaccacgccctgcccctttaaagttgtttttttttttaattaggtatttatttcatttacatttccaatgctatcccaaaagtcacccacacgctcccccacccacccactcccacttcttggccctggcgttcccctgtactgaggcatagaaagtttgcatgaccaatgggcctctctttccactgatggctgactaggccatcttctgatacatacgcagctagagacacgagctctggggtgggtactggttagttcatattgttgtttcacctatagggttgcagatccctttagctccttggatactttctctagctccttcattgggggccctgtgatccattcaatagctgactgtgagcatctacttctgtgtttgctaggccctggcatagtctcacaagagacagctacatctgggtcctttcagcaaaatcttgccggtgtatgcaatggtgtcagcgtttgggagctgattatgggatggatccctggatatggcagtttctagatggtccatccttttgtctcagctccaaactttgtctctgtaactccttccatgggtgttttgttcccaattctaagaaggggcaaagtgtccacactttggtcttcgttcttcttgagtttcctgtgtggctgtcttctcacctaatcacctcttctcccattttaagggtgtgcacggagacagtagtctctactctgatcctcaaactccctgtcctttgtggtgtacaaccaagcccctggacaaatacagggtattgtgggtagtggcaattgctttctttcttacctctttgtgttaggcttcatctgcaactagcctaaatcctttttatgaaatgtgtccgggggggggggggtcttacctatccccacgccgtactctgttgatactttaatccatttagtaactatgtgagaggcagggatcacatcccagacactacaaaatacatcagtgaaggagatggatagtgggaagagtgtgtgatacagaaacaggaggacctgagttccgatcccagcactgcgttaagaagctgggcaaggttctgtgcaggcatcaccagactgtacatgcttgtggacgtcaagactggtgacccccaagcttgctgatgggtcagtctagccaaaccatagggaccgtttatagtagaaaactaaaaatccaaggtaaagcaggattgaggaaaatactccatgttgactgtgtcctccacatacacacggacacacacattgatgcacatgtgcacacatgtgggcacaacactgggaagaactaaagatgcaacatttggatgaagacccaagtagaagggaagggaggagtaggaagagggatagaagcagagaggaagggagggtgggaggagaagtggggaggtagtggtggtaggagtaggcatggggatctgggagaggagcaggaatgttccagaaacagggaagagacacacaaaggtttcgagattggagcaaccctgaatgttcaaaacatagcagtgcagccaggaaggcagaaatgaggatgcagagaggagcaactgagaaaccagggtggtgatgaggagagccagccacgaggagccttcctggggagtcacactgaagtcagctggctcacgctgtcatttgcttgtcattattatccggttgctgcaggaaggcaatatcttaaaaggggaagcaggggatctagcatgatgcttaaactggaatgagagctgaggtaagttatacatatagagttcaccttcagtgaggaaaggggctcccactgaccccgcccctcataaggaagtgatctgcactgctaaacacagtaaggcactctgcatgcctgcttttcctgggtaaagtgaatgatgggaaaatactttgggcaacatgtgtttttatacaacatgtatgagcggtttacccatacccatgttatgtatgcataccatgtgtgtacccggtatccttggatgccagaataggtcatgagattccctgggactggggttaccaatggttgcagagattcaaacccaggtcttctggtagagtagccagggcgccgaactgctgaaccatatccaaggctctgcatgtttgtttgtttttgaatataccacagagcttcttttggcaacactgcaaaatctaataatgatattaagaattgatgtttcctaataaagaagttagttcctgcttcattttaagctaaatatcccgatgtgacaggccgtcatttgtacatgcttgatgctgcaagaaaaaggcttggttggttgtcttttttttttttttttttctaaagaaatgaaccacgctcacctgtctttgattgtgggtttcttcttggttcttcgggggcctctattggctgatcagccagaaaaactcgagcttgatctacggcgttcagcacagaatactctttctcctttagctcacgtctcagcacctttgcaaaaagaaacagaaatggagtatataaacaacttcccatgttttcagcaaatgaacgcagggtttagctttaccacttctgactgaagctgcagagggagtggcttaagccaacattcagataagttacaagtgaaaatgtgttacaggtaggaacaacagaaagtgtgaataaaagccaaagagagggctcctgaaaatgttgtctgtgttgaaggaaagaagaaaatgatgaatgtcgggaaggacactttaagattttcatctacaggagttagctattgtatttgaatttaccaaatgtgaacttagagaatccccactgtgtagagttgctaaaacataatagcctgctcaaagacacttcttccttaagactgacaagaacaatcgcatccaatgatactgaaggaggtgagttcacatgtggtaatgaaggcctcagagggttttatgttctttagaatacactgagaaaaaattaagagataggcacaaattaaagtgtatgaaatcaaaactaaagcaaagagaacacataaaagacagtctccaattatcttaaaacacagtccgtccgtctctcatgctgaggcaattactgttttccctggtgaggtttgcatgcagatctgggactcccagaacaactggtctctagcacatttattcttttaagtagagatgaactttcacccctgctcctataaaatgtttggtgattaggactctaattgacaagggtttcatgacagccacactcactcggggataagacaccaacatgtaaatatgtctcgtgccctgttttcaatactaaagcaaagctaactgaaagctgctgctgtcatttctggccagtacagacacagccacgtcttcaggccctaataactgatcatagaacaagccagtggctatgcactatgaacatgcaaggggtctttttcctccctaaaatatttccccttaagattgtagaatcaagtctttccttttgcctttccggaatcattaaatgtttggatagtgcttgacacaatggtgataggacgcaaggttacttggaggccaaatcatcatcttttgtactcagtaaaaatggaaaaaatgtagaagttccagaataatcatcacatagagacagcaaagataaactggcgtgggccaaagtcagagggagctgttacaggtggagaggaaagggacagccagggcaaggacaattcaaggttatttgacttcatggacaattattatctgctaagaattttaaaaaatgaaagtaggacctccccagccccttataaaataaaatctacaacccaatatatgtaaggatctaggtgggaaggaaaactgtctctgaaaataatttccatagataacacttatgcatactccctcacttatcacaccaaagcctgacagcagagtcagtggagaggggacaaacccccagtcaaggagtgttattaaatggtcatgttaggaaacacagccttcagcattcctggtcaagaaaagcagctcaaggtgttccagggtctcatagctgcacgagatgaaacagatcagttttctgacacatagtgttttcatgtatgtaaagaaaaagtcagaagagaatgagaagaaatacatgtatttatgggtctgctccacatttcttaacaagagattatcacatctttagatgagagggatctagagatgcagaggcattcctaatagttaacttccaaaaccacttataaataaatataaaatggtggtatgagaatatcacattcatttatatttttgaacttaaaaaaaattaatagtcaagagtactcatctcctagagctgagtgcaactaggtaatagaaaagcagtgaagattcataaaatggcaaccagggctctgctgcaactctcctccctgagaggacttgccagaaatgtaactgttcaaatgcaaggtacagaagaagaggcagaggtgctagaagactacaccttccctcgggggcatctgacacagagagagagagagggagagagagagagagagagagagagagacagagacagagacagagacagagagacagagagagagagattgaaattccttagagtgttttagagacattgctaaagggaaaccagaacagacattttaaaaaatggaagaaagactaagtctgaagaggaaatgagggagagcagacagatgttgggcctcaggaggaagaaaattctgatggggagatgtcccagagggtaaatcccagatgctatggtggggaacctaggagaggtgatccagtgactggaaaaggagtatttgtgcctggccagtcaaaatgtctcagttcacaaagtgccttggagagtgctgtgggagggaaggggacagacagaggacagttgttcttaaaattgtgtttagagtctctcacattcaaatagaaaataaacgtttgtctacagaaaaactactgaggagacaaactgatcgattccccacatggctgaaactttatcaattatgcatggagactctcacaggagagcaattgtgttggctggctgttggctgagctcagaaagctctctccccagacagccacactggaggttcttcaaaccattaatgctttatagatggaggttcgcacagtcaccctaccattacagtagcgctcacctttcccgttctgtacatttcctgttcccattactctgtttatgtctttttgtacttcccagatctattagtcaaggacagtatgtattcctttttttatgttttatttaatttctacctttctcagatacaccataaattctcaggacttctggatcttatactacaggaagttgagcactgagcttggctccaaagtgcttcctcatgatgtggggtgggggctggggagggggcttcatctgagtcttgcaaagagagaaagtttcttcccccagagaaaaaccatgcgccagccttggggggaagattccagtgtgtagatcaggagagaaccacacgcctttggcccctatacaaggcaatagctaaggctcaagacacaggtagaagtgaaggcagaagtctatgtgcgcacctttgtacacctgataccaaatgacaggcaaactgatgaagagccaggcaggcaaatgggttaggaagtgactacaaatttacatagtcttcttaacaatattgttgggtcgtctagataataaaaatgaaatcagagtagtagagagtcttccatagttaatttgcatttcttagcacattaatctacaacctgccaaaggtgtgtgttggggggggggaggatcacccagccttgaattcttggtaaggaatatcaggtgagctgacttgataagccagagaagaagtacagcaggcatgggcaggtggaaagcaccctaagtaaaaacttctgggactctgaccctgataccatctctctccccagtagcctagagaacacactcagtatacctgtacatacgctcttttgacgttttaattttgttattcaatttgccctatttcaattgtatttaattgcactcacaaagggattcgactctcaactgtattacacacataatcaccacaccttttacctctccattcgacgtaaaagaaagccttcattttcctgagcattaatgataaggtaattagagtccaatgagttgttttgtatacaaagtagcatccactttctggtatctcgtgtctcatttgggagccacttaaatgagtataagataacctaattggaatttttctgtgttaatgactttatatttttaccgaaaacaacctctatccaaacaataacaagcttaggtaaagttgtgaggaactgaattctcacacactgttggggatcgtagactcataagacatttcagtttggtggttcctcaaaagttaaatacagggtttattttaccctgtatcctagatatcccataactaggtctacccagaaataaaacatctgtacagattaaacacacacacacacacacacacacgtgaatgttcataacagcacggcatcaaatgttcataacagcacgccatcatagccagaccgagggaccaaccaaacatgcagccattgatcagtagataagcaaaatgcaaccgagctgcacgacagatcttagcaaggaaaatgagttacagaccaatgcagactaccactagataaaaacctaacaaatgttctcagcgaaatgactcagagggaagcctgtggtgtgagattccattaccacagaggtgtctacagagagaaaaaaaagtatatcagcagctgcctagtgttggaggcctgagggggttcaggtacacaggggttctttttcatgagaataaacttcattacactgggtaataaatgcaaaccaaggtgcaaatggttttagtccttctcttccagggaaagtccatcagcttagtgcaaacatgtcagtagagaaattccacgggtgctcaagtcctgatagaacactctctttgctttacttacaacttgcacattttagattgacttgagagcactcgccacacaactgtttaatcaaagaaactctatctcgcaggtgccacactggacagccatgcagtgagcttctaagtcaatcattgagtcctaaccactgggggcctaagtcctgggatgttatgaagaggaacttgggttacaatgagccaatgtgagtgatacaaatggtaaacacatccataggaagatgaaggggagacactggagggctataagggaacttcataggcaccttttacatgaaagctttaaaaaaggggagggaagaaaaagacctaggccattcctaaccacttaaaatgctcatcttaactaactccaaaatatttacccaatttttgagtgtttcagagtataatgagccaggacaggggaaacaaagcaaaaagaagccgtgcagttactattttcaggttggggggatgaattttctttcaacaggagaaatgagctgaaccctcccatctcatagaaagatgtggggaccttctgaactatcaaaggccaggatctgacattgtaatctgcttcagccacgcactccagaaccagccctggagtgaatgaggtgaggcctcattttagcctctccacggtgctcttgcttgctgcatacctgtttctaatctccttccccaagtcatagatgatggccaaactctacatgtttgctttgaggcatctggctgtttccagttcccagggcagcctcatggtggtagctcacaggactcagcaactgaaggaggactgtggaagtctacagggatagatgcttccagtattggtgtcaagggcatggtttccaggtttccaagtttccaagtttggctttgtaaaatatctacctaccccaaatgacatggatagaggatgcagtctagtcagcccatcaaggcttcagcaacagtgaggccaaagctaaggctatagctttgttccattctttcgaagataatgaaatgctaaacttaggagtcaatgatgctcacttgattctgtaaatagaccaaaggctgaaccatacacttaatggggtaaacttaacgatatgcaaatatcttgttcttaaactaaaacataaaaaaaaaaaaaactgcaggtcatgtttctttttcagtttctttataacacacatacatgcatatacacaaacatatatgtgttactatatatcactatatatcacatgtgtgtgtaagagttgatcttcagggtttgagcatatttagtcatacaatggatcctctcactcattctggaacacttcctaccttgctgtctggataccctgtgtggctatgcacccgtcccctgcatcaactggctaaggagaatggagaactatactccatcactggatgagaggaacaatcatgtcagctcaagaggaaggcattatccattattctaacaataccatacgcagacaagcaagaatgaattgggattggtaacattcagtccagctgttcaaaggaagcatttcacaggctgtgaggctcatccaagtgggtactgcctagtgacagctgaaattatgccgagcgaggaaggatcagggatgttctttctgtgacagtgttttagaatctgagtctttgtgtttgcagggagaaatacctggtaaacatgcacttcctgtctttgcagacacctggtgactttgccaaaccaaacaaagctcggccactaagctagaagcacactcgtgtggcagcttggccctgcctgtgacacattcagctgatacaatcaccactcatgttgagacggattggttgacgtagggttggaacgtgaggatttaagaggggatgatgtctttcttgtgagactggacaagttctcccaggaactgataaattctcataaggtccaattactgcacagcaggtcacagcatctgtcctgtcccctgctgtcagaggcagccactgccttctgctatcagtgtgcatagagtatgaagacctcactagatacagctctgcttctagagctatgagatatgtgaactacttttccttatatattgttcagtctcaaggactctgttatagcaaaagtaaatgaactaatataccttcccagtaaataagtgccctaaataatctccaggacagaacagtgtaaagggaaattttagcttacatgtagtaaacaagactcaaccggaacaaggaagaaaacttcaaaataactcacaaaaataagataacttcaccaaagaaagcagaaactggactttaaagcctaaacgttctaaaatgtttactagacctcaaatgctcaagagacaacaatagaaaagggagaatacaaaaagtattttgtgtccattaaaaaataaaattcacttagctgagtacagtagtctcagctctcaagagactaaggcaggaacaacacaagttccgggacagcatagtctacctgaaaacctgtctcgagtggagacattctactgtctcccaaggtatggagctagcaaagtaccatagagttttccaccctaataaaaaagttaaaacaaacactactctcatactgaatatacagaaaatggctagacatagccacagatcatgtcatacaatctaaaagggggaggagaagggcagaatgtgataattgtcaccagactttgaaaagcacaagcaggctatcaagagccctactaagtacaaacatacaatgcagggaggaagggtgaacaacttctcaaacataggagtctcttaaaggcatatgcatctctctctctctctctttctctctgcattttgccttttgagtggtgtgtgtgtatgtgtatgaatctgtgtgagtttgcatgtgttaagtgcatgtgtatcaggatacgaacatatatgagtgagcatgtatgtagagctcctgattgaaatgaggaatcactcctgatcactccatcactcttccatcatctctcagtcaaacactacccctgtatcactagcctgcctgccctgggaatcctcccgctcctctttccaaggctcaagttacacaggaccacccctgcccacctggcatttacttgagatctggggatccaaatgctagtcttgccaggcaaatgatttaactgcagaggcatttcccattgaacttttcatgtgaactacaggtttaaaaacacataaatggacagaaagacagaataattgagagtaaagccatctagtctctcatgtgcctcaaacgaaaacctgaacattagtatcagaattttattccttccagaatatctaggagctcagcatccctcttaactgagccatcccttcttccatctgaccgtcccgagcatctgaacagcaaggagggctccagtagccacggctatttcccagagtgccaggcagcacaatgaatttctgcagatccaactataagcacctgcagagattcttcactgtggctcactggtcagggaacacttctggctcactggtcagggaacactccacctgctagaacttactggaaaggccagggattaaggggtaaggtggttgaagaagtgactggcttggcaaaggtcaaaaactaccacctgtcaatcacagctcttcgttttcattctgggcacagcatcagcttggtgtcatgtaaaagttgctgctaaacaaacaatattatccgttcttctgcagaaacgtggagagcctgcaagtctctccctaagaaaacaggctcacaggagacagaatgcggtgaagcagctctgctcttcccttctctccttgacatgcgtcctttctttctgggctgacagaggggcaagcagctttcttccctcatacattcccactatgatgctgcccccttaccatatgcctaaaaatattagagtcatggactggatcttcttatatcatgaactaaagagcaaacctttctactgttttaaggtggttacctcaagtattttgttatagcaagaaaaactcgctaacacaccaatctcccctttccaggaaaaactgaacttaatatgtatcccaatgttcacgtgatgtggttaggaaggctgtgaaactttgtgattccccaagattaagctaaaatatttgatacatataaaactttgcaatatatttagactcttagatgagaaaaaaatttagtctttttttatctaaatcttctccataacagtgaagtaaagctatggggacttaggggttgattagatcacatcccatgtgatataaataggaactttctcccccagaaagttcaagaaaccacatctccctgctactctacacatggctaagtcaaacagatctcccaaattttcctctttattctttgaaaagaagagaagcatgggccagacctgtatagaatctgaaaactgttttttccacccactgtggagtagcagagtttgggtgctagcagtgcaagtccatcagacaaggagcagaagtgagagagtcaagcaagagagcactgacgtgtccatattttctagagggagggaaatggtttgatcatttgggaaacccaatttggcagtctataaagtcattatgctgatcacatggtatgaaacaagaatttcacctttgaggatggagtctaagaaaatgaaccagaggaggggaaaaaaaagtctacacataaaaaggtgtccactgcaacattatttatgtctttaagaaattgagggcagcttaaatatccaacactaggaaattattgagatccacaatggcaggtccacactaggaaccattacacaaccttcaaagattactatgataatggccacaagagcaaggtcagaacgtgagcatgacagaaacctaaaggtgaaagcagagtaagaaaacgaggcctccaattaaagctaaggacggtgtgtatacaagaggagataccaccatgggaacatgggtcatggcccctttgcagaggtcaaattaccttcttacaggggtcacctaagacctttggataacacagatattcacattacgatctgcaatagtagcaaaatgacagttatgagctagtaatgaaagcaattttatggtaggagtggtgacttccacatgaagaacagtattaaaaggtcgaagcattaggaaggatgagaacaatggcactagaggaaggtaagacagaagagtgtgtattttgctttgctatcactctgcagtgtgagggatggaagcagcgacttgtgcgagcccagctagagtctgaccactgacatacaaccccagctggctatccctttttactctgaggcaagatctcactcagttgagttaagatcagactggtctggccttaaattcactgagaaatgcactccaggcaggacttaaatgtgtggtcccccctacttcagctcttgagaagctgaagagataagcttgaataatcaagacccagctgttcattatttcatctgtaaatattatctttatgattgaaaattatacctaaaagaacacttaacagagagctcattaatcatttaaaatatcattgaaaataggttttgggttttttttaattggatattttctttatttacatttcaaatgttatcccctatctagatcttctcttcagaaaccccctatcccatccccccttgcctctatgtggatgctccccacccacccatttctgccttcccaccctggcattcccctgcactgaagcatcaaacacactcaggcccaaaggccactcctcccactgatgtttaacaagatcatcctctgccacatacgtggccagagccatgggtccctccatgtgtactcttcagttagtggtccagttcctgggagctctgagaatatggccggttaatactgttgctccccacatggggctgcaaatcccctcagctctttccaactcctccactggggaccccatgctcagtcccatggttggctgctagcatccacctctgtatttgtcaggctctgacagagccccccaggagacagccatatcaggctcctgtcagcaagcacttcggggtatccacaatagtatccacgtttggcgactgtatatgggatggatccccaggtggggcagtctctggaggccttttcttcagtctatgctctacacgttgtctccatacttcctcctgtgagtattttgttcccccttctaagaatcactgaagcatccactctttgattttccttcttcttaggcctcatatggtctgtgaattgtatcttggaaatttcaaatgtttgggctaatatccacttatcagtgagtgcctaccatgtgtggttttgttttgccttagggattttattgttgaaaagagacactgtgaacatggcaactctttttttttcttatttgtttgtttgtttgtttatttacttatttatttaatattttcttcatttacatttccaatgctatcccaaaagtcccccataccctcccctcccactcccctacccactcactcccactttttggccctggcgttcccctgtgctgaggcatataaagtttgcaagaccaatgggcctctctttccaatgatggccgactaggccatcttctgatacatattcagctagagacatgagctctgggaggtactgggtagttcatattgattgctgttccacctatagggttgcagacccctttagctccttaggtactttctctaactccttcattaggggccctgtgatccatccaatagctaactgtgagcatccacttctgtgtttgctaggcccccggcatggcctcacaagagacagctatatctgggtcctttcagtaaaatcttgctagtgtatgcaatggtgtcagcgcccgtttggaggctgattatgggatggatctgcaggtgtggcagtctctagatggtccatcctttcgtctcagctccaaactttgtctctgtaactccttccatgggtgttttgctcccaattctaagaaagggcaaagtgtccacactttggtcttccttcttcttgactttcatgtgttttgcaaattgtatcttgggtattctaagtttctgggctaatatccacttatgaatgagtacatatcatgtgagttcttttgtgattgggttacctcactcaggatgatgccctccaggtccatccatttgcctaggaatttcataaattcattctttttaatagctgagtagtcctccattgtgtaaatgtaccacattttctgtatccattcctctgttgagggttctttccagcttctggctctatagcagtaccatgcagtttttatcacaattgctctgtagtacagctttaggtcaggcatggtgattccaccagaggtccttttatcattgagaagagtttttgctgtcctaggtttttttgttaccatgtgtgttcttttgtgactgagttacctcactctggatgatatttccaagttccattcatttgcctatgaatttcatgaagtcactgtttttaatagctgagtagtgttcaactgtgtaaatgtaccatattttctgtatccattcctctgttgagggatgtctgggtggtttccagctcctggctattataaatatggctcctatgaacatagtggagcatgtccttattacatgttggagcatcttctgagtatatgcccaggagtcttatagctaggtactcaggtaatactatgtccaattttctgaggaaccaccagaaagatttccagaatggttgtaccagtttgtaatcccacgagcaatggaggagtgttcctctttctccacatccttgccagcatctgctgtcacctgagtttttgatctaagccattctgattggtgtgaggtggaatctcagggttgttttgatttgcatttccctgctggctaaggatgttgaatatttctttaggtgctctcagcccttcgagtttccttaattaaaaattctgtttagctccgtttcccattttttaatagggttatttggttctctggaatctaacttcttgagttctttgtatatattggatattagccctctattggatgtagcattggtaaagatcttttcccaatagttctaaactattttttctacttttcattaagaaataaaatatatacatctacctcatataatgctttattttgaaataaataataaacttgcagaatggatcatgcagctaacatatgtaatatctcatatagtttgagcttcttacaataatattaaaatatagtctttcaacaattttcaagaatgttatacatgttattaattatagtctctaggctgcaaaacagaagtcgtgaacaaattactacctttaaataacacactattagcaattacatatgtatgggccagggcaatggctcagtggcaaaaagggattgctgttcttccaaatgacccgagtttgcttcccagcaccagaactgggtggcccataactacctgtaggtccaaggggtcagacagcttcttctggccttcctggacaacccataactacaaataaatctataactgcagacacacatatatacacaaacaaactcataactaaaaataaatttatgaaataaaagggagactgtgtattagaagccaatgcttcatttctaaggcagtgtatataaatttttctacggatttccttcagtgatctcttccaggttagattcatttataaaatgagatctacgacaatcattgaatcaaagagtctgtacatttacattcctatggtcattggagatcttaacatatttagttttaaagagtatctgatatttatttttaaagcatctatttaagggataataggagccatgcacagagggacaatctgatagcatattccagaagtaaaatgaaccatatttagaggatgcctcaataaccttgatttgccagtccactccctctcatcccataaacattactttcccaccccctgagtggaacaattaaggcaatattgagacagagaagagataatttcttgaccagaaatgatggcacccacttagactctcagcactgggatgacactgaaaggtaaagccacaagttcaaggccaatgtgaactgacacggaaggaaaagaagtctcttaactaatacatgttaaactatagctgtgccggtagggtttcttacagtccaactcttgcagatcaaaaaaatatcaaaaaattatctctaagctgtcgatgaaagatccttgcttatatgtctaaagagaggatcatttttcctaaaaattcagttacttaaagtagcaaaaacgccaaggtaacagctaaactgggagagggcttgcctcgcatgcacgaggtccctggtccaatcctcagcttaacatagcctgggtatagtggtacactcctgaaaaagtactcaggaggtggaagcaggagagttagaagttcaaggtcaccctcagctacactgcaagtttgatattcacctggcatacataaataagacagtgttttagaaaattacgcacacaagtgttttttaaatgtgatatttggtaaatgaacgaaattaaaaggattacatagatataaagaaattaaaaagaatcaaatacccttaggtatgtgtcagtcattttgcattcaacaagtctttattgagtttatggaactgtgggtacacaaagaatagaaaatagtacagcagctacataggaagatgagaatgctggaacaaagagaggttgccaggattggaaggtgccatccagcaccttgaggagcagcggagagttaactttgtagactatcagaaagaacattctaggacacagcaagggtctgtgattgaatcacagcaagaggccagcatggctgagaccagtgtgggagaagatgagcaagagctgaactgagcttggtgtgtgggaggcgtagggggccacacggggctcttgcatgccttcctgagactatgtctattactgggtgtttgatttattaacaggaacatactggctgctgtgctggggaccccagagtcagatgaatggtggcaagtggccaatttagattctctatcttgatgagaaaacttaaaactccctaacacattgaatgagaaagatggggttcaaggtattattattattattttaagcaacttaagtcacatctctaccaagtgagatgggggtatagaattcagggtagaatgtcttaaaagtcaactctgcagtgctttcagcttggccataggatgtgcaaaattaggatccctgtagaggtgacacatcagcacattcacaaagctgggagtgtctggcctgcagatagattctaaacccaggaaaggctacatatagtgacatcaggatggcctggctcctagtgcttcccagttctacaaggagcttaaagaacggaccagagagggaaagagacggagcttcattgagaggatgagaaaatcaggagggcagggtacctagaagtcaagtagagaggaccaagtgtgggccgaagcccaagactagccaactctaacatccacaagttaagacaagaggcacacgactcagtgtaaggaccatgcctgaactgaggagagagacgctcctggaaatacattctcagagtcttttgttatttttaacacattatagtttatatatgttgaagcataatatactttttatttgtctgtttggctggatggggttttttttgtgttttttgttttgttttgtttgtttgtttgtttgtttgtttgttttgagacagggtctctctatatagccctggctgtcctggaactcactctgtagaccagggtggcctcgaacacacaaagatcaccggctcctccctcccaagggctgggattaaaggtgtgtgccaccaatacctagcttacataactgttcttgatgccaacagatctaactataaaacagcaaactccacagcaagatgaaaccacagggccacttatctgaatatttgggcattcactataacagcaaggcctacaacaaagcacggagagcccttcccacaacctggcactaatgagagcatatgggtgccctagtagctggcatggacgaggggcatctgcactggggcaggctggaggcagtgttggtacacaccaggcttctttaacctttggttctcaaaagaacttcatggcttactgcagaagagagatagaaaaaaaatgatggaaacgtaaggagaatctgccagaatataatttactcccttcctcctcccagcttgctttcagagctaaatcagcatgtatggatctaagtcattttgtacggtagcaaagaaggccagacagtcgttaaagttgatagcactaataaaactcaaagaaaaaaaagagaaaaatgggattatgttccattggtatgcaagcaaaaaattcttttaattctccttcatagtgcacagtgccgtaaaagttttggttaatgtccctaaatgatcagttaaatgtataaattcattttggttccaccccactggcatcaaaaaataaaggcaaaataggaatactaagtatgaatgctaagagcaagacaggactctccaacgtgtcacagtaacaaaccagtctttcctctgcattgttgaacacagacacacacacgtacacatgcatggagatacacagacatgcgcctgcatccctcttattcagcaaatccattagtagcttctctcatcagcccctgttaggtgctaacattcaagttccttctctttgagctttgctctcagtgttaggctaaagcatccatttttaatctgtgagctgacccctttgtggggtcgaatgactctttgacaggggttacctaagaccatcagaacacacagatatttatgattcattaaagtatcaaaattgcatctatgtagtagcaattaaataattttacagttggcagggagagtcaccacaacataaggaactgtttcaaatggccccagcattaggaaagttgagaccccctgagctacaagcatgaatgcagtacaccccattactctaagaaacacaaccaggaacacgcaagatcttcaccatagtaacctggataacattctttaaggactttttactttacggactctctactccaggacttcctaaagcctttctttatcagccacagcatacagtcataagcatctctgcttcctggctgtgtgttcatgtccctgatgcagggcttttgatagtgtttatcttcttgtgaaggtcaatcctgcgactaggcagtgtgttttgtgaaaatacaggaccctctattgagtgatgtgtgctgagtatctgtcttagttagggtttcagttgctcagaagagacaccatgacccaggcaacccatctaaggaacaacacttaattagggctggcttggttcagtgcattctcatcatggcaggaagcatggcagcatccaggaagacacagtgataaagaaggtgccaagagttctacatcttgatccaaaggttgacataggatgactgactctggacagacttgagcatatatcagagacctcaaagcctacccccacagtgacacacttcctccaacaaggccacacctcctaataatagcgccactccctggaccaagcatatccaaaccaccatagtacctaatacaggatgtcaactatcagatttaacatggaagctgaaagaagaaatgagctgttaaacaaaggaaatggtcactaagcaacaaagatcatagaagtggttcacctggaagcgggtggctggtttcacagaggccatttcgtgcccaagaatggccatactctttatttcatcaccagtctgacagctctcaagctgccccctgtccctctaaacacggacattgtgtgagccccagctcttgggagtgagtcttcatctattgctcccaaacttagaggacatgatcacctgtagccatatgaatggttaactggagtagagatggctccttaagaaagctgattcagggtgcctataggtataggctctaccaacagatggggtgcagtgtgtttctgagaaggaaagcaatacagttgcaaatttcagaagagcacttagaaatgcttaactttagaacattgggttgaagaggtagtacagtttgtaaagtgcttgcaatggccttgtacactgaggatgtgagcttggtctccagaatctactttttaaaagctagacacagtggggcatatgcttgtcatctcagaacccaggagggagggagagctgcatgggaccgtgaggctcactggccaaccaccctagccagtgtaagactttgtctccaaaagatatacaaagaaagtggggtggggagggaaggagggaagacaaaaggagggaaaggaggaaggactctaggattgatactcaaggttattcctagcctccatatggatgtacacacagagatgtgcataatatacctgcatgggaactcctcaacccaatcagaaaataactaatttactaccatagaaaaaaatctcataacatacagcaagacctcaacattacaggtttgtaggcaacctcagattaatagaactgcatcatacacacatgcaaatgcacagaacccaaatttaacaaggaggtattgacatttcatttttgttgtagcttgctggtttttgagaaagggtcttattacatagccttgactagcctggaactcactatgtagaccaggctgacctcaaactcataaaggcccacctacttctggttcttgagtgctgagattaaaggcgtatgtgtccacacgtggtggaggttttaaaaacgacatcagaatctgttactttaatgactaagttttcttatgtatcttggcagtttggtttaaggcccaaatgtcctgattcttacataatgaggtttggatataagaaattaaattgagttaggcaaagggcaaagtaaccctgagggaaaagatgcacaccaggaaattatacctgaatcatgcaatttaatcattcttggtgatttgcttttataaaaccaacatgcattttattgggaaaagcgtgttagagctctgataattgcctacgcataactcagtatttacattactgtgaaaataaagtgcaaattgaatattcaaaactgcatatgcaactgtaggcaacttttgagtatctgaagttaattcatggcatgcatatcaacactatgcacactgtaggtgctttataagaaataactgactggacgacatgttgacaatgaagttgcatataaatcatccactttcaagactcaaagaggcaaaaaataataataattaaagtcattgagaggaacgttcagccatcttcactcatttttcaagccactaaaagttatatggtagttatttattttaatatttaaaggaattaaatatgtacatatatgagaaaataacacgactgtgttatctacccaatctgtaaagtctggaatgtgactcttgaataattcaacaaattaatactgcataggaagtggggaggtgggggaagcactgttgggctgtgttggatggttactaggtattaatggcattgtagctccctgaaagagctcatatagcctagacagaattaagacagagtgatcaaaaccaccaacacagaccatggtgctaagctttaactgccaatttgacacagtctagaatcagcttggaaaacatttcaatgaggaattgtctacactcagtcagcctatgggcttgtctatgggacatttcgttgattacattaactgatgtgggaacacccagcatgcagtgggctacaccattccctcggtttaggttctgaatcacttaatagtagagaggagtaataagcattcttgcattaaagcatttctctctactcctaagtgtgggttagataggatttactgcttccagttcctggttacttgacatcccttccttaaaatgatgcactgtaacctggagttgtgagctcacataaatcctttctctcccaagttactttttgacagcgcttttgatcacagcaacagaaacaaagtaaatgcacagagtctcaacaattacaagagtaaacaccagcttcttcatgctgagcattctaccttgtatccagtcacaggccaggtcatcaacaagcccaatgaaattagtatcaacacaacacatcttccagaaaactacaggcatgatctagcatctgtactagaaagtggaaaaatttccatccatagagggctcacaccagcaaggagagacaagctctgaggagagatgccaccccaagtcttcagtatggctcatcttcctgcaagccttttttcatctcttcaggagcatcaacttcagtagctactttgcttcttgtaggctaaaggtagctgttgtgttttggagcagagttatgctatgggtggttttctactttttaatgtttttcctataattgcaagatgtttggtcaaggagcgatttaaagcatgatcctgtattacctttctaactgacaatctcagagccaaattttaaatggataggatttcctttggatacatccaaagaaaccacaagaacagatctctgggggaaaggaactattgaaacatatcagagcggtacagaggccaggttatactgctttctggacaaaggcaccaactttaacatataaggcattccatgaatagtatacaaggggtgtgggtggtgaacagactggtaattctattatcaaagaaatgctttggaaatgtatcattaaatcacatttttttttaattaggaagacttttttcaactttatcaggaaaatttaagcatctaaagcagataataaaaaccaacaataacaaaaaacaaccaaccccccaaaaacccaaccttgcactttataataaaaaaaaaactaaaagagggagaaaaaaaaaagcccaatgaatttttcacaaagctaaaaacatatctgtgaaaacattgtttaaaaaaaaatcatttcatgttctgcactgtaatgctataaataaagagagttctaagtcctttagagaggaatttggagataaacatgtccatgacctcaattgagtccgtgtgcagtgtaagcaagaacaaagactggaagataggagtgaacaaacagggatggacagacagacagcaaccaggggaaactgcatgaataagcatgtcacagtcctgccatagctttctctgaatgctctcttactacacagacacaggctgtcccctgcacagaacaggagctgtgtctgctctctgtaccagtggcttagaaactaccagcccacaacaggaatatgatgagtatctgtgaaagtgaagggggacgcgggaggtggagggggggcacagctgctcggatttcatcaagctaagcagcactcatccattttcctctatgcagtgagcaggtccttgagcttctgacaactggttagatgttgcaggtgtacacatagtaagtaaagatttctcttcataggaagaatgtgagattggagaaaatggactttaaaaaaaaatgttgcctggcagcacacctgtaagagactaactttaagggaattgcttgattctactgtagttcaactgtcagagatttttcaaatgatggtggtgttccataagaaaggtacgtaacttcagacaggtattagggcttcagtgtgcaccatcttccagaggaacacactgcaggatatttaaccacactgtgaattactgtgttctttactgaaaaacaaaacaaaactgtttctagttgtggtgtggctcagtccctagcacacaactttaatcccaaacaaaggtaaagatggtttgcagaaggaagcagccatgtttgaatgtgatgtctaactgagtggcagacaaagtgatgaatcagagaaagacttcacagcacatgcccaactctcaggaaacgagagagggaagggaagctacttaagagagcaatgcagagagagggagggaagaaacagttttactgggagaattttacagagacagattgaagaaggagccagccagagaatgggaaggagccagaaaattagaacatattgctaaagttagtatgaggccaagcagagcaactcagtaagaaactgagagaagctagattagaccagccagccagagatcagaaagatctagaaacggtgagtgtaagtctcagaggcagaaaacattgtaggcctagataagactgtacagaagctaaaaactttcaggactaggcctcagttagtaagcttctgagacatcaatgacaggagaataaacgttacatttacaggatgatgtgtggacacttgggcactagctggtagtgctatgtagggaggttctagaagctttcagctttgcagcccagtggcaggggctgctctacctcagacccaagctctctgtgcaatggaaaatcttgctttgttaacacctgggaatgtaaatgaagtaaccgcctccctgaggctctcatgtaggcacacctagtgggtattttcttagtctctgtgtctttctatctcagggttatctgtctatcatgttctctttctactgaaatagtaattttattcaccaagcacagggtcaaaataaaatagaattcaagaccctatcaacatcggttagaacatcttctgtaatagatgctatcttccctcaggaacatgcatttgcattcatctttcaattgggaacaaggacacaatgttgcattgaaatgtgcagacttagaaggagaattcatactgcacatgggtaggaaaaaatacaacagaactaaatgacatttaatatatgagaaaagagtataaaaggatataaataaattaatggaacttggaataggagaagatatttaaaaatctaaaggctgagggatatgtcaggtgacatttcaggattccttgttcattgtcagaatgcaaacacagcgtgtgtagaggtggatgtcatgcagaaggaaacagaacttagagaaagaaaatgaaacataaaaagaccataaaatgatcttttgtttcacactgtgatcttcatttgatacaggactgaaatctgccctacagattttctctacttttaattttaatgaacaagataatttcaggttttgtttgtcttagtttaatctccagcaagctaggcaagtgctctaccactgggctatatgtacagagaatatcttgtgtattgtatggatgtattgtttgtcagtaaaaacaaacaaacaaacaaacaaacaaaaacctctgccctataggaaagggtagaatagaaagaaggtgggacatccagaggcagaaaagattaagaattgtgggatagagtaaggcagggagagcagtgttcacccaggaagaggacagaggacagatgcatgagacctgagcagacgtagccagtcacatggcaaaacttagattagaataaacaggttataagttagatggagaccaaaccaaagcatatggccaaggtgattgcagatatattttgagtctcaaaagtcttcatccgaggagcttggggccaataggaaaagctcacactttaaagctatatccttagaactactttggaattttatttatgtatttattcattgacttgaaacagggtctgagtgtatcacctttgctggcctcaaactcacatagatccacctgcttctgcctcccgagttctacattaaaaccctttctgacaccatgacttctatactcctgattaggttacagttagatataacagcagacacgcccctgtaatcctagcactgggaggctttctagaagatttctttggatatcagcatattggaaaaaacttcacaagttatcttttatttttatctaagtatggatgtatagatgcatgtgtgcatggattttaaaggtagggtcttgctttatagcctagtctggcctcagacttaatcatgttacctaagctaatttcaaccttatattgatcctttagcaaccaactagatgccaaagaggggggaacgctgtggtaattagtttaaattttcatttcttgagaacttcattcagtttgtttatcgaaattaatttttaaaaaagggcacaaatgttgtacttaccttgcagtggtcatactggagctgtaaggcagggacgtcccctccaatgggcatctgcttcttaagctcctcatctttcatattgagccatttgatcagctcttccagcgatgccagcaaccggttccatttctcagcactggcctccaaatgggccctggtgacagataagaatgaaggtgatgaagaccttccaggtgctagcaacaaattaaaaagtgatacatactcctttgacctaatcaccatatacacacaactaatcaccaaacaacacatccaaatcaacgagggagaggaggaggaggaggaggaggaggaggaggaggaggaggaggaggagaaatttttcttgtggtgcacaaaaaatactctgtgagaaacagttatttcaaaacagctatattatccaggctatgtctgaaatgcttaaaattacaaaccaggttctgattgttcgcataccctatgcaaatattaaatacaaaaattcaaatatttttctcatttttatcaaaatacatagttagagggagaagaaaaagaatgcatacgaaacatctggagtctagttggtgtcttacacctttaatcccagccctcaggagacagaggcagggagatatctatcagttcaagaacagccttatctacagacacagatcaaagtagttgagcaagggataaacagtgaggcttgttgcaaatacacacacacacacacacacacacacacacacacacacacacacaggaaagaaaaaagacacacagacactagttactaacttttatgtttaaaaagtatttatttaaaatttattcatttttctctctaaatgaacagactaatcttatttttttaaagatttatttttctattttatctatttatttagggttttccgagacagggtttctctgtatagccctggctgtcctggaacacactctgtagaccaggctggcctcgaacccagaaatccacctgcctctgcctcccaagtgctgggattaaaggcatgcgctaccacgcccagctctctattttatttatatgagtacactgtagctgtcctcagacacatcagaagagggcatcagatctgattgcagatagttgtgagccaccatgtggttgctgggaattgaactcaggacctctggaagagtagtcggtgctcttaaccactgagccatctctgcagcgcccagactaatcatttaaggagaggaaatcattaacccccaatctttcttacactgaagtaaattgttagaattaagacattagaaatatttactccaaactgttgaaaatcagtaagtcactatctagccaagaactgcttggctttaagttgactagaatcctttgagaatcttagtattaagcagaggacaaattcttcctggttttcactaagaccctggaaaaggcccatccatctagattggatcccataggagggctggatttaaaaacatgtactatttagagaacctccattcattcaaggaatccatttccctcaggactgctatacccagtgcatgggcatgaatgtgaactcagtgctgagctggtgagatgggctgccttgcacatctgcaatcagccaggtgcagagggtcgagcctactggaaattcacatagcctcactgctcaacatcttccaaagggaaaggcttagcatgtatgtgaacaggtgtgtgtgtgtgtgtgtgtgtgtgtgagagagagagagagagagagacagagacagagacagagagacagagacagagagagagagaaagagagagagagagggagagagaaagagagagagtgttatcttagaagcttcagccacatagagcacacattcagactctgtgtcttctttattttttctaattaattaatttatttttattttttacactccatattttatccccccccccccacatctaccctctgactcttttacagtctataccttctccccaccccctgtctccacgtggatgtccccacaccacctgacctctaaactccctggggcctccagtgtcttgagggttgggtgcatcatctctgaatgcacactgactcagcagtcctctactctatgtgtgctggaagcctccaatcagctggtgtatgctgtctgtttggtggtccagagtttgagagatctcaggggtccagattgagactgctggtcctcctacagaatcgcccttccctaactcaacaacaggagccagctgcttctgtccattgattgggtgcaaatatctgcatctgactctttcaactgcttgttgggtctttcagagagcagtcatgataggtccctttttgtgagcgctccacagcctcagtaatagtgtcaggccttgggacctcagcagactccatgtcttctaagacaaccttcaccatgatgttggcattaggatcctcacttccataaatctgattctttaccaaggacatggaagctatccaccaggctcagccactgctgtctctcagaccacggaggtaatgtcctgtgcacctctgttccacttgcacgtctgtctcaaagtgaacagttttgctagaggtaccacgacaagcattacctcactgatcgcatttaggagctatttccagcgatcctcactcaacaattatcgtaaattttggctaaaagttcatctagttcatctctagctcatataacaataactggagtctaccgtccaatactctagatggaaaggaaagccggttctctgggtgcactttaaaatactgcatgccagcattcacacagttattgcaaaggccaattatcttcccatctcttcacagatgtgttgccatctggctaataaaaccaactactcaaacttgaacattctatgcctcattccaaaaggttagctataaaatactaaaacataatttttaagtcttaaacatgttcaaagaattttgtaactacctcaaaactgtatagcttaaatctcagtttagtttagaattgagaaacagatcagtagatagggtgtttgctggacaagcatgaaaactggattcagatccccagaacccacatcaaaaacaaaccaaaccaaaccaacccaaaccaaccaaactaacccaaccaaccaagctaacccaaaccaaaccaaaccaaaccaaatcaaccaaactaacccaaccaaaccaaaccaacccaaactaacccaacccaaaccaaaccaaaccaaactaacccaaaccaaaccaaaccaacccaaaccaacccaaccaaaccaaccaaaccaaaccaacccaaactaacccaaaccaaaccaaccaaactaacccaaaccaacccaaaccaaccaaaccaaaccaactcaaaccaaaccaaaccaaaccaactcaaaccaagccaaaccaaaccacactaccaagcaaaaaatcaaataaaaagggaaggcagacatggtagctacacataatcccaacaatagaaaggcaaagaaatctagctacattagctggaatccatgagctctgagttcagctggagaccctgactaactaatgaagtagagaaaaacagagggggagacacatgattcaacttctggcctccgatgtacttacacacatgagcatgaacccatgaggacacatatacacaagacacacacaaacacattcattttctcttctttcttttactattgtttctatttgttccataaatgccaggatgggcatatggtagtaatctgctaagcacagaggtgtgatgcggagaggaagcagagcgggttttctaggcggagattctgtccgatgagctcagtgttctgtgtcaaagctgtgttctgacaagatcctgcttccacatgagctccagcttttctggattcttattaatttggggcaagtcatcctgataaacaaactttcttgccatagagcatgtctaaatcattccaatcatattaaccaaaatccctgtacagttatgaaccctaatgcaaaatgcttgttgcatgatgtatatctgacagggctgttacaattgcttacaaaccactgttaaatgcaaagacagctagaaatcacagctctccattcaacccagaagtgttgactatctactgagtaaaccacttctgtgcatatccgacctcttacccagatctgatgcggcatcatcagtgtctgtaatttcatcatcaataaataagctacatatcaattcccttgataataaaaccctatatgtttcctgaagagcacacaaatgtcttcctagtgcaatggactctattgactagacagaaatactgggattgatcattgatcattacaatgttcaggaatccagccccagaaggagcatctgcacaaatgaaggctacacttttacaagagatgctaaagctgctttgaaatgaaaatggaagcatcgattccatgtacatctccatagctctgccttcccattataaacactgagctcatctgacagaatctctgcctagaaaacctgctctgcttactctccacatcgcacctttgtgcttagcagattactaccatatgcccaaacaggcccagcctgctgcagtagcctttgctgttcctgattcagtttagttctttcatctttcaagatgaaagtcttttcctggtcagtgggtggaaggctctgtaaggagaaactgtatatttgtgcttggcttagttgtggtctctcaccattgactatagacattttatagcttgaactgtgccaatactacagatcgcaggtcatccacatgttcagggcatttacaggtaaacactgctttacctagttcattatctgtagaaacgtttttcaataattatcacagtgtcttattgacatcagttaatacttaccatatgtaagatttgcagtgcaatagaccctctcattgattatagtattaaccttagatagtatccataatggattctgccttacacagatttcccaactctgggtgaaatatcattttataaagctctaagttttataagtttttacatgactagttattcaaaaattatagacttattagaagaaaaacatttattaaaagctttccttaccaattggctatggtaagaaaagaactacagagtgaaatgtacactcatatctgttttgaatcaccaaagtgatttttcaaagtaactgtcatcaaacaaattatctgactcctctccagaatataattatcaacaaagaaaatcgtgtaagctaaaagatacccatttggggaccagagccagaagtcagttggtagagtgtttgtttagcatgcacatatcctggtttggttccccagcatctcataaaccaggtgaggtggtgccctcctgtaacctcggcattcaggaggtagaggcaggagaatcaacagtgcaagatcattctccacagcggcttccaagccagcctgtgatgcatgagacgctgtccaaggaagaaaatggggaagaaaaggtgtgggagggtaagggggagtgagagggagagaggcaggaaggaaaacagttctcaatcatcagtacgaaccagtgttcaaggagcacccttaggtacaacaagacttctaaaacaaaaggcaaaatgttaatatttgaaggtcaaattggaaaaatttcaagttcaccaaatacactcccaagatgggaaggctgatggccactctgctaaatatcgggacactgagggagccaaaggcctcaggcagcactaggaagatgtggacttcagccaaccacggctttggttagcaacagcaaaaggaggaaaactataaactgctcaactaaatggtacacaagtcaaaagcactttcgcaaactcagtctcctaagctttgtaaggatctcagtgaaaagacaacaaagacagagacatgctacctcccagagcagagaaaactacacagatgaaatctgtcattcaagtacaagtgtgatctcttttcagatattgtgaaactcacttaatttaaattgtgtaacaatgaaaaaaaaaaaccaacaacaaatgtaactaagaatgtacatgtaaggtgacaacattcaaaagagattattcctgctcccaaaatgagcatggaaggccaaccaaataaaacagacagtccttaaaattcagccactaaagagcaccccagagctatgactggatatggcggacacctgtgatgtgcagctatggaaacacacatcttcagataactaggacttaaactcagctcctcagtcacactagccataatttaagagttcaaaatgccacttgtagctaaccgggcatggtgtaaccagattgacagggctccttcctgccaccacagagagccctgctggagaacgttctaagaggagaatagaatcttgttttgttacatttaggagaaggagactttagctttgtaatgtagttagcaaaaacaagcccttaaggttaagaatggtgctgtaaaatgtgacaacaccaaggatgacagtgaatagccatcgcccataagggcttggagaacaatgacccaaatgttaaaaagacttataaaagaaatgcaagatagatttttatctttaaactctgtttctgtcacatttgacaacttgcccagcctttgaaacccagtgttaggatggatctatattaaacatcattaagccgataagtggatatttaattaacataatcttacattaaataaatttaatttaaaaatgtaagccatggcattcagtcttgaatttattagtataattccaatcagttttaaaagtgatcataaagtactgccagcactcctaagagcctcttttataaatgaaatcttaagtcttcagctaatttgttatatactgacctgatactccattgtgtactggcgtgtgtatgtgtgtgtgtgtgtgtgtgtgtgtgtgtgtgtgtgtgtgtgtgtgtataaaatcaatgttatatataattatatataatgctatgcaacattatataatatatacaagtatatattataatgttatggattgtatttaagatgatacagcatatttagcacactgaattttaatatttaaagggctcaatcatggtcatccaaaaatctttaaagtaatagttcaggtagctgttccaatgaccacagcatggttaaagtaggtgatgtccataaatatttaagagtagattatcaaaacaaaacaataaagagcatacatccacttcctaaaaacaaattaaaagaaacatttccccatggtggtagtatgaactaaacactatttgaaatacacaatccacaaatattatggaattgaaggggcagggtgttatcaatcaaatggcctcatcctcagaaaatgattaagtcatccagagaaagaaaggcttggaaactgaagagaaaacaaggcctttgaagatagacatggcagtgaataaaatagaaaaatattcagaattataacagcaatagtaggcagtatcaaattatatcaaagaaaccttagcttctgcctgccaccccccttcctaaagcaccacacatctggggagatggttcagttggtaaaatgcttgggatacaagcatgagcctctatgttcagattcccagcttccacataaaaggtggcacttgtaaccctggagatgtggaaacaggaaaaatccctggggcttcctggctccaggttcaatgagagaacctgcctcaaaattaacaacaacaacaacaaaaacaaaaattgtttttaaaagtggaaaggaaaatacacatctttaatctctccatgtttgtgtgtctacatgcagaagcatcttaagagacacatggtcatgagcacacacatacacagaaagggaaggaaggagggagggaaggagggggcaattaatccaagattaatagtaggggatagagagaaggtggtgaccaggatatatcaatgtgaatagaagtagaagagaaagctcaactggggtttgggggacaatacaagggcatggctctgactagaatgtgttatgaagagctccaagctggatggaaggggttgagaaaatgcctctatcacactggcctgtaggcaaatctgtggagtactgtcttgattaatgactgatgtagaaaggcccagctcacggtgggtgaggtcacccttgtggtccagagttgtataggaaagctgcacaagccacggaagaggccagagagcaaggctccctagcagtctctgctcagttcctaccctgaaagactgtgacgttgaagtgtgagggagataaagccttccctccccaaattgcttttattacagcactggaaaaccaaactaagacagaaatgaagcagtccatcatggaaaaggctggaacaaggctggggtggcctgagaggacctgagggagaggacggaatatgatcaaaattgtgtgaaaaatgttaaatcaatgaataaaaagaaaatgttggaggatctacatttttaaatatagtgcaggtggctagagtaatgtagcttcattataaataaattgtatgaagtaaataacacagttatagaatagtacacagatggctccagctaaggaggaaaggggccctagctggagaaggtccatcactttcatatgagagggtttcattaataatgcctaagtttgatttggtttaaccaaggcccatctctgaggaattcacgtgtccagtggaatgcacctgaatccctctggagatcaccctgcccatggtcccctggggactgggtgatctcaaggaggccaagatgaagatgaaatcaatggaagcccaggatgagcaggtctatgggacttaagaatagaaatgagctgagaacgttcacagacagtgcaaagagagacttgaagattaaaatacaaaaatgttattgctgggtgatagtatatacctttaatcgcagctctagagaggcagatacaggcaactctctgagttcaaggccagcctggtatagagagcaagttccagaacagtcatgactacacagagaaagtctgtgtcggggaagaaaaagttaccagtgtgaatgtttccaccaaggctgagagctgagggcggaagataaaaggaagtagtgtgtgtacttcaaagagaaaggaaccatatgcccctatagattaggagtaagatgataaaggggcagaaatatagatgcattgttttaaaaaaaaaaaggggggggggagatgtgaagagatgggaatcaaggcaggaggagccacaagaggctgccaattggccacctatccctatgtgacagggctacttctgcaggcaaactgccttccacggccagtttatgactgatatcctaatgcgtggtgtccacaggaggcttaatattcagagtattcccactggcttctaggcaaggaaaatggaggaaattaacctctattaaagaacatttcaagtaaagtttggcaattaagagaaaagtcaattttcaattaattacagggaagagtgataatcggataccaacagaaggcaatgtgagaaccaggctggactcctaaaggcaatgtgagtaccaggctggactcctaaagccagagaagaaagggaggagtgatctgaacagcaactccacccacatcatttgcgtgtataatgaaggaggcggagccagaaagagactggcccagggaagaattttgctgtaaaataatagaccttgcatgtagggtgtctcacttgggaagccacctttgagtagtgactactgggaattctgcatcagtctaggtttgagttagcaacctaagctctaagccagttcctcctttcacctggcttctgtccgtcattcccatggcattagattttgtgaggaagccggctaaacccacttttctttcacatttgttcagaatccagccaggaaagagggcactgcttactggtgagtccctcaaacagttcctacactcatgactaagatatgggaggggctggggaggagaggaatttaccacacaagtagtggctgatagcagtaataaacatgacccacttcttgcatgtattgtatgtgggctaactaaaacatgcatggaagccccactaaggaaattactcttgcttcacatacaaggaaactgaagcacacacatgggtcaataacctgcccactgactgctgcatgacaacaccagtgtttggacatagtgtctctgcaaagcgcaatgctctccaaagctgctttgttccccttctttctaagctgaacttcctatgtgaagagcccactactgagaaagataaaccactatctcatacaaattcataaaggatacgtgatttcatctttttacatatttgaagattaaaatatgaaaagttctttcctctttagttacacatatctaatcatagaaaacacaagtgagtccatatggacataaacatagatagtatctacacagcataagcaaagcttgggcttccatctctagcacaaatgaacaggagaggtggctgatgcagagataatttccaactggagctatagggagaagagtgcatagcgccacaattcactcttcctaagaaatagaggggttgtaagttttaatttatgagacccagtagagcacatggtacttttctttattaataagaaaatcatacaggacaaaaaatagtggatgatttccattctctggcagccgctctatggattcccaacacctgctgaatccgatccactcacccaaccttgtgtatgagtaatagcctagagtctactttaaccagggtctacagagcctgagaaaaaatcaaatcattctagttggtcttcctgacaatcaagtgtgttggatacagatagtacaccttggcaaagttcacaggggtaaagtaatgtgtccaacttcagaaaatacatagcaaagtgcaaaaatcaaagtcggtaccatttggttttaaggttatgcatattcaacacatgatacaaccaaatctaaggctttaaccaacattcctctttggaattatcattcttgctactatggtcttctgtaagtatccctttaacttgctgccaattagaaactgtctatcagctactgagtatgaacttaaaatgtgcttgaagtccaataatggtaccagtctgttactctgggtaattcgttaatgctgtttccttgtcagagccctgatcctattgtccgtacttaactgaattttactttcatccaaagcagaactgaatcatcacttctacattttagtgtttataagaggcaattaatctcaataaataaatatattttcaaagtggacataaacacttgatggggcaaaatagattcaataccaagatttaaagaaatctacattcaaattctggctattatcttattatcttaatctttatattcattaaacttctcatatggaaatcctgaccttctactttacagggattttttttcaagaactatcatgtgccacttaacaacagaggcacgttctgagaagccatcagatctctatagtataaattaagtagttgtgtgaaacaactactgtacataaagtgatggataagttagtacacagtgcaagactactaagtaaagtaattgttctaaatgggcaggatgggacttgtatgtaatgtcagcacactctggatgaagaatgaaaaagtcaaaggccagggcctgagaaagatagttcacaagttaggagcacctagtgctcttgcagaggagccaggctggttcccaatatctacatggcagctctccagttctaggggattcgatgtcctcttccacttccatgggctgctacacacatggtgtacatacatttacaaaagttatatacatgtacataatttaaatgaagggttttgtttttgtttttgtttttgtttctaacaaagcattaaaggccaaccttgcctacacaataaactcaaggtcaacctgggctatagcacgcctgctctgtgaaaaatgaatgtctttatttcctgcacttgagtggcaaaggtgagcagataactctgagtttaaagtcagtccggtcatgtagtgatttctaagccacccagtactactaccttgtctcaaataaattaatagatggatggatggtaggtaggtagatagatagatagatagatagatagatagatagatagatagatagatagacagatcaatagggctctaatgatcctaacacagtataaaacatacaatataatgataaacacttatcaattagcaagtgtcagtgacattattatccgtattgttgtatggtttaaaacatgactatgaatatcctggaacaaatagtagagcacactgggtatataaacgaggcaaaaacttctaactacatatttattcttttggtagtgctgaggattgaacccaagacctaatccacagttaagtcctctactgttaagtatatcttcagtaccaactggaaagaaaacagactttggatttcaatcttaaacaaattctgatagagttgtactaatcctttctctttctgatagacccaaatctacataagcgcgcacacacacacacattcacacacacttttttttttaaatctcgagtggtctgacctgatgctagcagattttgccttcaaatcattccatctttggttcatgtcatccagtcgatgctgaagcattgttgcttcctcagaattccccagagctttcaccatcttctgccggtttccatcgatgcttttaaatatgtcattgtgggcatcaatttctgcctggatgtcctaaatagaaaagcaaagagatgatgcaaatgctaaaggtcacttggggcacgttgcaggatctttacatgaacagttacttttggatgtgcagaagaactgtttttaatcaaaagactttattttaccatcagtaatgtaaaacaaaaccaagtattcccacagttccatcattgaaaataatagtctttaaatctctaatacatcaattcccagtgtcctaaaagcagaatttataacattctacattcatgcaccatcctgtttgatgttagtattttagagggagtgggcattttttaaatttttattactattgtaagtcactacttactctccctctgcctgtcattttaatctcatacaatttattctaaaacctttgaagaatattcacatatgtttagcttcactaagaaataataaaggaaaaataatttttcttctattaaataggaatgtgaaagttaatactgaaattacttgcagaatgtacggaaaaacaaacttgttacattatctatcctaagaacttgttacagtatctatcctaaaaacatgttatagtatctatcctaagaacttgttacagtatctatcctaagaacttgttacagtatctatcctaagaacttgttacagtatctatcctaaaaacatgttatagtatctattcaaagaacaggatgcagcctgagtttcctttttgggaccccagctttaaagggtgcaggtataaccacaaaatatagctacttgaatcaaaatctgaagcatcattgagtataacctacatacgtatagatttgtatatgaaacttagaagactacttttgcagtgctgttgatctatatcattaccatatttctcaagagactcaatgatagaatcaacaaggcctctctttgctttccattgccaagggaacttggccttatattctctgcacagattcttaagaacaatgggccaaaaattcacaacacaacctcaagcccaggactaaaggggtcatgcagtgttttggagatgccagtaccatgagatgaccaccaagagcagcagcagcagtggagtacaggcacctagaggacgacgcctgtgctacaaagggcatggctggaaaagtgacccaagcccttggaggagcccagaagatcgtgagttggatcccagacattggatggttggagattgatttttgcttttgattgtgactgtgccctgatattttccctcttgaaggaagaaactattttagtggagcccacagttaagagacttttaattgtaaaaagactttggatttaaaagagatggatattataaagagattgaaattttaagaatatgtaaagagtgtgggacttttaaagttattctcacattagacctggttcctgctacccttcagatccacgagaccagaaagacggatgtacaacaggatatagaaatgctatggtccacaagagcactgcctaacttcatacgtttggacactgcagatgtgaagcaaatttctcctcacaatcatggcaggtgatatgtttcccaattcagcaaagacagtaaagatgtttggccctgaaggcactgagagagaactgcagtgatgtcccagttggaataaagcctgcaagatgtgagaaacccttccatatgagagcaacatcaacagttaggaagaaacgccaacaatcagaacatgaacaaagaaaaagagatcaccacacattattttgttttatttgccttttggtgacatattcttccaaaatcacccagaattgaaaacaaacacacaaacaaaaaaataaaattaaaaaaaaaaaaaagaaaattgtattatgtttcttctgcatctttcacagcttctgttatacaaaataagtctaacataaaagaccaatgtcataaacaaatactcatacatcttgactggttgacaagtaagccacagtagtgacaaaggaagcaggtgatggattgaacagcaatggggtaaatgtttaagttcaatttcctcacttaaaagtttggatatgaaaaacgtgaaatcatttagaagccggtgctgtaaagtcctatcaacgctctcactggaaactcagaattaaatgaagttaatgaatcatgctccttgatagatagctgtgcaatgatgcgaagcttttaaaatcaagatgccagcacggagggctttgagggcaagaccctcaagcagcactaaatgctaaaataaatcaaagttccataaaggaagtgttccttttgttggccatccaggaagatgtagttctattaatgcttacctctgtcacccagcaagccctgcagaaggttaaatagcactaaacagttactgataattagcaagggactgtaatccatctagaagcacaaagcaattctcttccaagctcttaacataaaccagtcatgtgcacactggagcaagtagttgaactaataccttgaaaacaaggctggtaaatgtcctaaggatgcatgtagggggtgtaagcacaatggggagggttaagaaagaagaagggctggaaaagaaggccactacttttcctcttactgaaacaccatcagtagcatgagatgcaaaccccatcacagctctccaaaacagggcttccagagctaagtaagatttgctgatttgctgattagcagtagtgtttctgtgaatagctctcactatgtaggtccaataaatggcacaaagaaaggaatacattaattctgtattgtacttactttatatttgatatcttaatagcagatctgcctcatttggtcattcttttaatgaagatataaataaagatatcacagaaatacaaatacacacacaatttgtttgtgttgttgttatgtttttgcttttgagtgagtatttcactatgtatcctagcctgatcctcccatggactatttcaagtgttagatttacagatataggccactgtgccctgatatactctgttccctatgtcttactaacactactaatgtaacttggaaggtaaaaatgtttctttagatttacccaaacagaactgtatgaacattctaatagggcataataccatcaagccaacttcaacagctaaatccctgctagattccatgcattctctttgagactaattgactcaactttattttttgcgtggcttatttctctaaccctatatggctatagcaatgtttcctctggaggagtgttgacccctgtcctgaaggtggagaggggaaatgagcaattattccattagcctgtcccaaacttaggctaaatgaacacagtaacccgtgggatgaaaaataaatccggtgtgcctttaaaaagccatgttggatccaggagatagggaagatggactgaaagagatgctcaaggagctttgtattttaaagaggagtttcataacttgaaaaaaatccagatatttttccaaataaaaataaatagttaatataatcaaatgtcaagtcaaaagtatgttttcagcatttgaaacttgtaagaagttactcaattatttattgatttcagttaccctattaattgtgctaaatactgtatttccttccaataacttgtcttgaaattttgagtcaagctgtgagtcctattttgatcaacattagaatgccattctgactgtaaagctgatagtattgacggttacttttacaaattaagaaatcagagcaattaatgctcttctcccactgtttgtgatgtaaatatatgtaagataatggagtagaaaaacttttgtcttggtttgctttgtgttgctttgataccacactgagtaaaaccaagtggggcaggaaaggatttatttcatgttacaactcctaggtcacagtctatcactagggaggtcaggacagaatcctggaggtaggaactgaagcagagaccactgagaaatgctgcttactgccttgttcctcctggtttgcttggctaactttcttattcagcataaggatggtgctgcccacagtgggctgtgccctcctacatcaataagcaattaagaaagatgatatcccacagataagctcacaggacaatctgatggaggaaactcctcaactgagagtcgcaggaacatctgtctacacttatatcaaagagacaaaacctatgacaagtctatttactaatttacaatttactaagtttaagatcaccatttactacaatttcaaggtgatttcaacaagccagtttccaataaactataaactgctttttaaatgccaacatgtaaacactgctgtaaacagaactatcttctaccaccaaaaaaaaaaaaaaaaaattatttcaagcttttaactctgaacgtctaaaccatatagttttaagccacactaaatcacactacagtgactttcctttcaaagcacacactacataagcacagactatctgcatcacaagtttctaggaacactcccttaacctttcaagtggccaatataatgttttaactcaactcctctatccagcattgtgatcaaacttaagtctgacctcacaccaatggactgttgtccttcacactaatcaaacattcaaagctacaatcctggggtaagcttctcttcaaatcccaatcagtgttgctgctgtgctctgtcaatgaagatcctagtgagtttctccctccacccaaatccacccatgctgcgcaggagctcgcaaaccggaacacaacctcagtttctccttaagcttaaactaggttttgaaatcacagatataatgcaatttctccagaggagactttataaaaccagtttctactgttactatacttgctattggctgagtgtgagggctcattcctgcaactgcccagcacttgggaggttgaggcaggaggatcaccaagaacttgattacaaactgatcaacacaatgaccaactctagaataccccatctcaaaagtaagctgaattaaaacaaaactcagttaagctaaaagaaactggacaaaataagcctgtttgaaagaaagtggttcctagaggcacatcaggagggtcactattaggaggtgtggccttgttagagtagctgtggtttggttggtagaggttcatcactagggtatgagctttgagctctcagatgttcaagtctgctgcctgtgagttgaggatgtagaattctcagcttcttctccagcaccatgtctgcctatatgacaccgtgcttccccaggcatgatgataatggactaaacctccaacagtaagccagcaccaatgaaatgttttcctttataaaatttgccttggttatggcatgtgtctcctcgcataaaacaagcaaaaaacaacaacaacaaaaacccacccaactaagacaataggataaactgcacacttatcatgtaaatcttctcgcttaaggtctatatcctaccactacaatagcccaatgaaggaaagagtgggccccacgtggttgtctcccatccctacattcaaccttgataactggtacttcagaaatattccctaaacagtaaatgaaggaatttactgtctcttccaggatctacccacatttaaattaaatatttaatttgaattaaatatttaattggagggttggaggtatagctcagaggttataacagttttaatgtgaaacgtcccccatagacttatgtatttaaaatttactggagttgtttttgaaatgttatgaagactgtaggagagagggtctagctggaggatgtggttgccaagtggcaggcaggcttgaatattataccctggccccacttctctccaatccagtttttctcctgttgtacctgcacatctatgagcaaaccatcctaattgccaccagtgggaacaaaaccaccatggcagccatattttctccaacatgatagaccatcacctatgaaccatggctcacttctcttctagcttttaaaatatcagactcatgcttgataaagggggtaaatgccatagagatgcattacatagtcagtgactatattgtcactatgaagagtctctttctttaaagactcaccaagtgaacactgccatccagatacatggtaaggatccctcaaaggagaacacaaccgaccatattctatcatatgtttcaaactgtgataggagattttgtatgtctaaagagcaatggaatgataaatgtttcagatgatggatggcttaaagagcctgagttaatcatgacataatatataaatgtaacaacattgtcacatgttaccccataaagatgtatgattatcatctgtcgattaaaaacaaaaacagaaccccttgggatgaccattatcattaatcatctagtagcagggctataaaaaaattaataaaagcgacagtcatttaaaatgtcactgagctagagctgcccattactcaagtctctgtaggactaagcaacagacacaaaaccagtacacaatacaagaggctctgctaagacagtacagcactaacgctgttatgctttcgttaggaaagtttgctcaagaaaaacgctggtgaattaaaatgagtggaaccatgaaactaagccagaggctttgacaggggttccctggtgagtcatctctttgtctacaaacttgagcttgctgagaagtcactctcaggttcatgggcatagctgcatgtggcttaaggatactgagagacctccttattggcggatccatcacacggtgaggtccttatcctctagtaagaaggtcctcctcttaggagggaatggttccctgagcttggatgagcatctctgaaagcttcctgcctcttggacccccaaggactcataacatggtggtttgaagagacacgagtcctagttgcaatctgcccaggagtagatattcattcatatgatagatgttcagatatgtgtgaaaagagcaaagttttcactagtttccttaaaataatgtggctttctcttcatctccacagtctggtgccttaaaggcgggcagaaggtttgctttcaccccatccaatgatcttagatatctaacaagtcaatctctcagtatcagtcagcactgggtaacctgccaagcacggacctcaattaccaaacatatcaaatctgcatctactatcccaagatggactcttagttttcttcaagccagaaatggctttaaaaataaagcaaaattgacatttggttgtgataacttaccatctgattgaacaattaaactgctgttatgaaaatggtggcatgtctgaggcaaggaggaggaggaggggaggaggagaaggaggaagaaaaactaagagaactgaaagtaaagggagtcccctagtgcacatagtaggtcagctcctgtattccatggaataaagggagtctaccactgcacatagcaggtcagcttctacagtctttggaataaagcaagaccacaaatgaacatggtagcttctgcatgccacgggaaaagggagttgagtgtactgttgcaagtggcagtcagcaccccacgtggctttccaattacaaatagttcaaatgtccccagaaatggcagcgttgctttctgggttagagaaagggaagtagctgaatttgagaggtgtgaagtagtgaaacctttccagaattccggttttcctggcaatgacttaatggagcataaactgaatatatgagacagctttgttagaatatacaaagggattttttttaaggtgcgagttggaaaaatacacactggtgggtgatggcttcctaccagtgaaacacatataagtgttaccttcatccaggctttgaaaacatgcccaccacaagaatgagcatacataaagttcatattcaatggaagcagggtggtctcttggaaatctatccttggagaaaattttcaaatcaagccttttacatatataagcctttcttttgctgtcaagtcaactcctaaagtaaaaacaagattaagtcatgttcagataccaaggcctgggaattaaaggagaaagcataccaatgtcagaacatctgactctacccacaagatggcccagaggcctaagaaactaggttgctcacctcagctatctgacctaagcctgaagacaaatagcagcaattagaattcaaaagtccagctattgcaccatgattattggaggggggtgaggatgacaagcatgaattattattcctgtcacatatgctctatacctttttatgtgaatgagacaaatctgcagaaaacaagctaacagacctctttacggccataaagtttgtcacctgctgttcgcagctgccacaagagcgatattctttctttgtcatgccctttgtaagtgagcaagccaactgtgaactggctcttgctctccagaattcagacccttaccaactatgaaagcaacaggtctgtcccatgttacaagcaaattctccactactcaagttgggatgtgagataggaagcactctatgaggagggactaactttttgctgttgttatacatacttctgataggctgcttccatcactgggaagccaggatggctgcaattgttcaggaaaagcctaccacctttttaaagggtatcactttttacatcttttcctctggcagttgcaattcctaagaaaaagtctattattctttgaatgattcaagatgcttatatttgtactttcaggaatggtgggaaaaaccagaacacatttaacagttgataaacagttcatctgtgcctatagggataaaggaccctgcctctttcttttctttctctccccactcctttaagtagcagaaactggaacaagactggcactcaggaagccactaactggctcggggaggtttctgctttgtttaattcaaaaagtgaggaggtagcctttttacaggctatgctccaccctggggtgtgccaagagccttgggggaagagagggtgccaagtgcaaagttagtaatccaagccttaaaccttatccacttttaaaacaagagattctgaaggaaatgccagacagcagatgtgccatcgttaccaagggccagcttctggggctcagagctgaatcctcagccggggctgcaagggcaggctcagccgcagcagcctgagagataaacaaacctgaggggcatggaaaacagaatacacgcttgatgaagtcagcctttggcacccaaacccagtgtttgttgctggatttggctgttgttttgttttctccccccaaataaattgcaattaagttaccagctgacttgactctaagccattccttctgatgtggaacgttaaagctgacaagcatgagaactcttcctgaccaagggaaagaactatgttccctaaaacacaatctcaaagaagctattacattaaaattaaaaatgaaaatgctttagaagttacagtaaacaatggaggaggaggagaaggagaagaaggaggaggaggaggaggaggaggaggaggaggaggagaagaagaagaagaagaagaagaagaagaagaagaagaagaagaagaagaagaagaagaagaagaagaagaagaagaagaagaagaagaagaagaaagaggagagcacaaacagaagaagaaacagaactaaaacagaagtgcgtccgtgaagttttctttctgcataccttttcaaattttgtcaacaattctcgtaagctgaagttcagaccaatcatcgtccgggagcccttgaagcctacatcttcctggcaaacttccttcagacaacaacgtccaacttttaaaacccgtatcttcactagctatactttcaactccttcgtaaaatccttttcaatccttgcccttgagcggtggcccatgagcatcagcagcttgcgctgggacattttagccaccccaccttgggtccgtttcctcacggacttcggagctcggcaggcagagacctgcttctgtgttttcttgtagctgtgttccacgaggctggcatggtctccttttttgccctgggaagcccaggatctctttctgccggcctccctaaagacctgcaggccaccactgttctcttcagagcccaggcttagagtttggtctcaattacacacagcagaaaggaaagggggaaaaagctatagcctggaaacttgcaagagagaagggagggaaaaaaagccaagcattaccaacttcctccattcaggctgccttcaaaaagaaaaaaggaaaagacaggaaaaaaaaaaaaagtctgagtcaagagccaattttaaaacagcagggcttatgtagagttccagtaagcaggagtgtgctcctagctgaagacgccccaaaaaacccgagacacgagaccaccagcttccattctcccagacagcagaagcacagttgctatggtgaccaccaagctagtttcactccgcttgctcacttcagcacagcctaaggtacgctgtcagtgccgcggagttaaaacttttaaaagttgctttgctccggtccggaaggaaaggtcttgcaacaaatctcaggatgccctcctcaggacagggtgtgcagtgcccagagggagctttgcagcagctcccgcgactcccagacctgatctgacagcacccggactctctcctaggcccctgtttattattttaatcagcatcctccctctcccgccacccctcacccagcaggactgaagcttcctcccacttcctggaggccgccctgccccaaacttcagtacagtatcctttacattgtctcagtcctgaatagaccccaggagccatagtccccttgggagcccacccaggaaaagaaaggggagtgggtgcgccacacaccacatgccacaaaaggaaacaagcttcattaattccattattagtgcaaagaaaataaaacgggctgcaaaggcaaaatgatgagggaaatagttcttaaagttctttgatcttattaaaaagtcgcccggtctgtttgcataaggagaatttgatacggacaaaatgaaagaaaatattccaattttgacaaccaatgacaccgaacttattttccacttcaggtgggatgactttggagggggaagttcagaacaaactacacctttgtactgatcagtcatcctaccatttcacagggtgttttgtcttgttttgttttgttttacatagctatttagcatagccataaaaggtaagaacggtggggctgtccataggaagcatctttctctagtcacggggaggatttttaccataaacagtgttttaatggggacacatcacaaagggtcttaatgcaactgaatctacttttttgcatcaggtcaacagcaaaggtggaagagcacgctgaaattagagttttctacacaattacctgagtatcaaagttgtgagcatccatttaaacctatacaaaaagatcttcacatgtaagagttcaaatctaccaggaatccatcactattacaggtgtctgatctacaaacctgttctctttccacttcattcccaacctattttcacatcagtatttccatagcatgtgttttacatatgtccatttatacaaaatttaacaagcttttaaaatattttcattacttatttatagaaatctatatattcccctggggggcaaaaatggctatgtaggatttccaaagcaccacattttgatggataaatagaaactctcatttttctccaaccattattcagaaaatatagaggaaaagcagtctgcaatgtggctcaaaacagactggacaagactggagtactgacattcacacatccaggggactctttctcagcccttgctttagccaaggtgacccagtctgccagggctcaggccacatgctgagatctttaaacagcaacaaataaactttttacataaattcaagacaaaagaaaccaccaccacagctaccaccaccaccaaccaccacccagaaaataaataaataaataagaggaagaaaaagagcaaactctctcagctgggcaaacttccagctaccacccagagtgctacaggactgtgagctgacatgtgcaaacaggccgcacatatctaaagagtgaactgaaaagactctaccaagcaacagacaataggaagcacaagaaggctcttacccttagagggtttttacaccaagctaaggagcacaatgctattagaagtgcctgagatatcctgtttccttccctaagaataaaggtcaaggcataataacagcatccttctttagggcagatctcctccagagaagacacatttctgagtgcggtaaatgtccatattctgtacaggataaggaaaaagaaggaggggaccagcagctttgcagtagaacataccaaagctgctgcccgttctcagaattgccaccctctgccggcaaagaagagagggcactgagatagaattttcttcacaccgttgtcaaaactgtcaaagatgggggtcagcctagctatgatggtgcagtaaacaaaggtgaccagcatagactagggggtctatattcaaaataaaccactggaaaggtggtggagtcgttcagaagacatctttttttttttaagatttatttatttattatatgtaagtgccctgtagctgtcttcagacactctagaagagggtgccagatctcgttactgatggttgtgagccaccatgcagttgttgggatttgaactcaggaccttcagaagagcagtcggtgctcttaactgctgagccatctctccagtcccctcagaagacatctttacactcttgtttttaagatttttattttttgttatacatgtatgtatgggtatgggtatgtgcatgagagtgccggtacctgcaaaggcgagaagaaacacactggatctgctgggactggaattacaagaggctgcaagccacctgacctggatgggaactgaaccccaaggcctgggagaactgtatgaacacttaagggccaggccacctctccagtcccaatctccgtagtcttcactttaattacatactgtcaccacactaaatctgtattgttatgttttcttattcatttatctgttctagatgatcaaactcagggccttatctacattatgaaagtgatcggtcattcagctgcagctccagcatgtaaattaagagcttggaaatgaggcattaaaagtaagacttcgaaaatctaaatgtagtgaactgccttctatctattggtgatgacatttcctcagtttaaattcagttcatgaattgtgatatgtactcccccttttttgtacagcaagcttttcttgatacattatcttctgtaaatcctataagtcctagagaagcctccagtgaaattaaaaagccaccagagagacaacaaattggatggtggcatttgaagtagttgacattttctccgtttaaaccagtgtgcaaataaaaggctcactaatcctcaggagtgcgaaggcatgccaagctgctggtctctacgatagatcaacctaagcaacccagaatctttagctaagtaagacatgtttcaaattcaagcatacagttccatgagaaagccaaggaaggccccggaaccatggagaagcacaggaaaatccaaccaataaaatccaaatccaaattacctaatgaaaaccacattccagtgtcaaaatgaaaaggcctgtatggcttccccatgaacttccaaagagcaggctgataaagtaatattctacatttaaaaactgtgttgcgtatagcttgctaaaagataacttacttgtaattttataaaagcagcaagagattatctagggttaacataaagagtagctttggggaactgatattttctcctacagtgaacttaagcgttccttccctctaaataccaagctcacatgtcttaaaactgtaaaaataaagtgttttttttttctgcataaaacctaacagatttctcctgatgtggccaatacaaagaaccctgagaaaagaaagagattttaggagcctgtaaagcaaagcatacgggggtcaataggtggccacagataaatggcggctggccgattcacaaaatgaacagcttcaggcatgggcaagaacattgtgcctgctgtaagcccattctgactcaagaaaagacccttgtttatttcttgtgaagcaaatcacctcatttctcctcttcataacctgctaacttggaggtcagaactaaaataaaataaagtataaaataaaataaaatcgctccaagcccctaatcccgaggagagatttcttctcattgtcgcctaccacggtggttccattaggagacgctaccccatccattacagcgttccagttcacatgggccggcagtgcagtctgtcagctgcaagctatttaaggtaatatacagccccaaagggcagaaagttcaaccaggagatggaggcctgagccccctgatgaaaggggtgaaacctcctttcatcccaggaagccggggcataagactgtgcacaaggtcttattttataatgttcacctttaataaatgccacatctattttgataatgataagggtgggtgttgggaaataaaaaaaaaaaacaccattcataagaaaaaaaagttactactttagatgtttccatagttcatggccagaaggttttaacagttatggtaaaagcacaaagagctttttttcttccctgggagagtggggaaggggttcaggggcaggcccgccagctgatccacttctgaattagccagccaggtgcaggggtcagctttccacggccctctaaatagttaaggattcagagagcactatagtaggttattcagaaaataataccgagacaagttactgtccccaaaatatatccttcccgaaaacaatgcagcatcagacaagggtaaaatgctcttaacagccaagcctcagtgtaagcgcataggacagatgtggccacgtgacatggagctttaagaagaaggctctggaaggtttggcagctttgtgggaatgcccaggttaaagaaatcaaagtctgtacactttccacaggaagcacaaatacagcgcccctaaagacagagacagtaattttctttgtttatctctctctactgcacccaccctctgattgacatgctgtgtctttgcctgactcctttctatgggtgttctgcgcattgagctctacactggttctttgtttcttctccacactcttcttctaccaaacacagtcagtcaacccagaccatgacacagaaaattgtgggctgtttagagttctgcctatgcctggcagaactagggtaaccactccatttcctgaagattactagaaactgcccagtctggggacagaggataattttaaatgcttatgacctttgacacagaaattctacccacaggaattcacaataagctccatttggacaggaaacatgtaaagaaatgatggcagattcacgcattaaggaacacagaaaagtggataggctggcaaataaatagtgcacagagagaaataagccatatgtgtatcttcaaaggggaggaggatgataaaagctttatttagtaataatctatggtaaacggaacaatcaaatgatagaaataatggctatcactcagaaaaaatgtagaaatggacatggagagataaaatttatcttaaatctccttgatttaaattgaaaaacatttttttacctgatcatgtaatattttttttcacacaaaatgaagtccactagaacactcccaagtaaaccatgttcatccttttaggtcgctctccataccacaatggcagcatcattttacttgacagttaataacacagcacacaatctttcccccccccctccctgaaagtctcagaagttttgaagtgccagatggtccaccattctaacaaatcagccctcaataaaaactggcctcagcagaacagggtttacaaatggcaaacttttctaaaggccacaaggacaaagcccttttgttctgaaaagttactctgtaaccagcaacacctgcttatttaaatgataactgtgtctaaataggcaactatatcattctagcttctctctcttcaaagtgatctttacttctgttatcatcagatacatgatactgtatgctatacattgtgtgtgtgtgtgtgtgtgtgtgtgtgtgtggtggggatggggagggggttaccccccaggaaaccatcacttgacctctccagaggggctcagtagtcccaccttgtttgcaaagaaggaagacgcaaggtttgccactaggacaaccaccacccctgccagacaggttacctgaaaacccatttatgatcaaagttatcttaggaaaaaaggaaaatatcatgaaccctgcttgtcttgatgtgctaagattactattaaaaaagcaaaagtactgaaagaaatatcccgtgacatagtcagcagccacctgctgctgtacagagagggtcgtacatgtgtcattcctgcctctgcgtaagaaactgtcagggcaaggggtactgagagcgatgttcacatcaggaatctgactgagctcatgtttcagctttataattagatgatggcgtaaaataatccgttaaaagcaacaccctgaatctagtggtcatcccactctcaatttaaaaacaaaaacaaaaacaaaaaacaaaaaacaaatttctgaaaggtcctgaaatacagctacttcgcaaaatcttttaagactcatataatgaatttgagatgtcactgtttgatttatagcgtaactttcacccctactgatcactagagttatctgtatgacctgttgagatacaaaccccaagtctggactaattgatccagtctactagcactcagtagactcactatacagtattaaggatgctacaagaactatataataccaaaaagcatgaaatcaatttagaagacatacatgcaatctaaaggtgactgtgagaattattaatttattgacaacaggtatgtcatcctctccaaactcatcagcccaacccccaaagccaccagctttcctctagccatggtgtcgattctttcttgctcagctaactgtgagcaccagactctccacacacaggacaacaggttaggatggttaagaccatcagtgtgtcgggcagcggctctcaaccttcctaatgctgagaccctttaacatagtttgtcatgttgtgttgaccctccaaccgtaaaattattttcattgctacttcagaacgggaattttgcaactattatgaatagtaatgtaactatctgtgttcctggggattttaggcaactcatgtgaaaggagttgcgacccacaggttgagaaccactggcttagaagataactttcttattacaaatcataggggcacagtcttctattaggacagttggaaaagtaaccagaaactttcgtaattatgagatgctaaactaaattcatatttgaattatattcctcatctgtttattttaccccagctcttagacatagtatttctcatgagaccaataaaaaaaagtataatattcagccatttcatctcagacactaatctggttttacaagcctggagcctttgcctgaatcttgatttttgtgtgaagagtgtccctgtgacacttaagcaaacacttttatcatgaaggctgttcagtggggccatatataacttcttactaatggcaacaaaaacatcatttaaagtagaacagatgtagttgttacaggataaccaagacgttcctataatcccatgggacacaaggagtagctacattgaatgtttcaggggccagggctctcgtaaattttcatgaatttttaagatagtatagaaacttattttgagaagcctagtatgtggtatttttaatatctctgcacatttttatcagagtgtttacaacttggtaggagtgactattattagcaacaaaattttaaaaataaatacatgctacataaacatttattactgattacaaattattaaaatgcaatattaactaataaaatatttatcacagcagtgaagcgattcctaatatagcaacacactgtttctctgttgatgtttttcctggggagattctaacactctctcacacataggaaacacaagcaagggactggctgctacggagcagaagctactgatcatacacactgttgctatggtatcgaaaagtaaattctaatactttttttttcttggtttttcaagacaaggtttctctgtatagccctggctgtcctggagatcactctgtagaccaggctggcctcgaactcagaagtccgcctgcctctgcctcccgagtgctgggattaaaggtgtgcaccaccacgcccggcaaattctaatactttaaaacaacttgaaatggtcaagaattacacctccattcaaacaagtatcaaaatatctttaaattttaaagatttaattatataaatgtgtgtgtgtgtgcgtgtgtgtatatgagtgtgtatttgtgcacatgagtgcaggtgtcctgagggtcaggagtgcagactcccgtggaactggagctacaggcagttctgaggcacttggcaatagtgctgggacatgaacttgggtcctgtgcatgactcatctctgtgcatctcagaacattaatctctgcgtcatctcttcagcccctctcctaatgacttacaacatcatttgattcagatctctctcacatcccaacaggatcactttataccatcattccttttgtactttctagactcaaattattttccatgccctggctgtcatgataaactaagctgaattctccttaaaatctactttaatgaaaaagtgtttcccaaaatcctctagttccttgactatgaaactagtacgtgactgatgaacataaatgaagcatgacattcttaaaaacatatacaaaatacaatttgctggcaaactgtgtttggtccttgaacaacaaaatagcaattaaaagtagaaagataaggaaaagagggaagaatagagaggaaggggagaaagaaggcagaggaggaagagggtgagaacagcaaagctgatctttactgacagcattaaaattcaactatggtttttattattatgccagctctccaacttgacagttctccatatccaaacctaacattattgaaactgggcagtgtgctgtccaggaggtcttgctgcgataagaaaacagtctatattattgacattcccacagcaagaactagagccactaatcccttgaaaggtggctgctacgatggaggaactcagcatttgcttaatttaaacttacaatgttggaaagacacatacggctagtgaatctgaaactaggaaatgtagcctgggctgaagctacagcttagtgatagagctcagtgatagagctcagtgatagagctcagtgacagaactcagtgatagagctcagtgatagagctcagtgatagagctcagtgatagagctcagtgacagagctcagtgacagaactcagtgacagagctcagtgatagagctcagtgacagagctcagtgacagaactcagtgatagagctcagtgatagagctcagtgacagagctcagtaatagagctcagtgatagagcccttgtctagtttgtacatgggatgtacagcacgctgcaaaagaggaagaaagaggtcagaattagcacttggttttggggttctgtaaagccggacactgtttccccacaatgctctcaatagtacagtcttcataactttcccaggaaggaaggaaggaaggaaggaaggaaggaaggaaggaaggaaggaaggaaggaaggaattaattctacttttgctccactggcggattctcttctctttcatcccaccttcccaatgttttctatccattcaatgtttatccagttgggaggtcaagttcaatacccacactctgcacaaagcctcaccctctgactttctctctgcagttgttcactggagtctgtcttctacactgtgctagtatcccatattgcttcacctgaagtctggttgttgccagcttattttttgctttaactttctctctaaacccaagctaaggcatgttccttgaaagaagaaaaaaaaaagttatatcaatctgtccatcaagtgagctgttgaatgctaaacaaacaacaaagtatgcttttttttccaggagaaaaggaattagaatattaaaatcacaaacacacacacacacacacacacacacacacacgattctatagttgaagaggaagtcatggttttggttgactcaaccatttataagattacaaattaataaactaattcaagcctcaaacagaaaatcctagaggttagcattacattttcaagagggaactcaagtgtactatggtttttccaatcttactccccaattctacgagagagagagagagagagagagagagagagagagagagagagagattgattcccttcctgctaggaaccattcaaacttgatgttatattggagaaacataactgactgtattttttttaaagtcatacttcaggctttagaaggaagtggtgccccttcgtgaaaggaggtagaagatttgtcactgggctgacagctgaggaaatactgcaaagttaaattttaacattaagagaaaaagagtttatcgcaaaaccgtgcatgtttcccattgggggctctccatcctgtctccggtcaactttctaaccagatgagggctgactctaattgaaaaataatgagtgggttggtaggtttccctgacataaatggaaggttcgggaagggctggaggtgaggagctgtacaaatgaagtggacaagggcaacaaaaatgagttgataccaacatggcaaatctcaaggcaacactgtgactatgacctcagagaagagaaaaactgtctatgttctaatcatttacctatgaagttagtattcaataatactgcaaactgtggagagctgtgctgagctacagtgaaagagcagagggaagcagtaggccagagtgtgctacgtagtaagtactaattgccacaaacaaacagtatggtctatggaaattcaatggctacaatatataccatctcttctttaggcagcttccatagcccaagtatggttctgggagatattatgttctgagttatgaaagtatatgaaaaacgactcactccaagatctcataaataacaaacatattcacaagtcaaggtaatggctactataaattccataagctttaagaatccagttaaatacatgtacttaaaacctacttaaattgggcatggtggctcagaacactgtgggtgggcttacaccatcgaagaaaagaagctgagaaagtctgagaaagcaagccagcaagtagctctctccccttgaaccctgcttcaattcctaattccagatgtctgccctaaaattccttcccacctaggattcccaaggactggaccagggaagtgtaaggtgacctagccacaccccatctcatccacaagttcctgttgatcaacttgatgtcttctcacaacagagatgcaaactggaatagccatcttgcttattttttcaacactggcgatggtgagtatttcacagactgtatcatgactcataacatggggacacacagtcaccatttacatataactattaggaacaggtctgtgcttgtttttaaaatgttgacaactgtttaatgtgactctcagcactcgaaggaaattgtctacttaaacgtaatcttcgggggaactctttgtcatgtagaagatcttttgtcaaattaaaaatcaccctctggtacatttgttttgctggtttgaatctttatacgtgagaagttttctttataagaaaacataatacttttggagtcttattatgacaggggataaaggagcactgtgagagtcgagaggagtctcaagggagagcaggaggcttgtatctggttagtatggtgtattttcgagcagcttcctttaaaaaaaaatccctttaaaaaaaaaagaatagaaaaactgtaattcctctgacttaggattctaaatacttccctgttcaaatagcagatagccaaagaaaatcaggaacatctcagtgagctgagacacaaaaccagaagaaaattaaccatcacatgatttaaaatattttaaattaaactatccggggccctaggcacaaggaagacagatccatcacactcggagggaacatgtcacttgtgtgggttctcaagccaaaaaagggaaggtagagcgctgcccataccctggacagctctcagggagcctgctgcccaccactgaactccccagctcctcagcatcctgagaccaccagtgcacagtggactgcctgggcaggaacccacgcaccacgcacgggaatcaacaaaggcagaaaagctgggaaggaacaaagtagcacggcgctcacattgaagtctctcattgagcggtggaggtacatgtcagacaaagttgggtagaaggtgaaatagaacaggagacttaaggcctcattactctgtacctaatgaggaaaaccagaatttgttcagtgacccatgctggagataaatacagggtttgcaagtacagaaaatgagaaaaatgaacccctggagtgtgtgctaaacaacgttctcaatacagatgtgttgatttaatgtgatgggccactgaatcccattttgacacaaatttctttaaagagttgttggttttctctctattgccttcgctaatagccaacgttactgtctgccattgccaggagcaagcctaatccctcaccaacgtggcttttcctcccttgcttttgtttgtttgtttgtttgtttgtttgaagggggtgttgctgggttgaactttggccatctatactggaccagctaatcaataacccttttttaaaatttttatttattatatttaagtacactagctgtcttcagacaccagaagagagaatcaggccttgttacagatggttgtgagccaccatgtggttgctgggatttgaactcaggacctccagaagagcagtcagtgctcttaaccactgagccatctctccagccccccaataacacttataaacagcatttggtaatgtggatcatatttccactattgatctaaatgtttctgttttttctattctcttccagaaaagcccaaggagaacaaagaaataggggtctgtgagaaagctcagtgggcaaaggtacttgacacccacgggggagttcaatctctggaatacacagattggcagaatgaaagatcctactttacaatttatactctgacatgcatactgtggtactcatacccacccacacatgcacaatgatggtgatggtgatgatggtggtggtgacgatgaggatgatgataacaacaatttttaaaatcaaagaaatggactttgaagccaatacaaaaacacattcaatccaaagtaatttataactaagttcaatgcaatttcttttttttggggggtgggggggttgttttttgtttttcggtttttttttttttttttttttttgagacagggttcctttgtgtagccctggctgtcctggaactcactttgtagaccaggctggcctcgaactcagaaatccacctgcctctgcctctgcctcccaagtgctgggattaaaggcgtgcgccaccaagcctgactcaatgcaatttctaggactatatttttttaaatgtgattccattttagtaaatatgtaaaaaatatggattgtagttaggaccgacaaaaataattttatagcagcttcaaaaattaaaattccttgggaacaggaatccaaatgaatcactggcatggacatattcccagagttttagaaaattctgtcagctggatttaaattcattatcactacttaatgaggataaagtcaacttccctggtaagttaagaattaggaaatacagcttcatagaaaaagtaaaaactgtaaaaacacactgccaggttaattatatgagttaaccatctaagaataaataaccaaaaataaaaataggttacatttcgtagttgtcatgattccttgggttgtgattaaatgatggatgatttgcaaacctaagtaaggccacgttatcatttgcctatttgttttcatcacaaaggttgccctgctctggcccttcctccctgcttcttcccagctccactcccccccccacccctttctactctgagaaggcagctcccctctcatctccccaccttggtgcatcaagtcacagcaggactaggtgcatcctctcccactgaggccagacaaggcagccctatactacataagtgtctggggcttgggccagcctgcgtatgctctttggttggtggttcagtgtctgggagcccccaggggtccaggttagttgtcactgttggttttcctgtggaaatgccatccccttgacgcttgtccatccttccttttactgttttacaggagtccctgacctctatccaatgtttgtctgtgagtgtctgtctcagtcagctgctgggtagaacctctcagagggctgctatgctaggctcctgtctctgccggctgttccaggcagaccggcttcttaattcttaatcagtgaaatgagaccatgcacaccagacacttgttttgccattccaaaactcccgtttagatgagttttgaacccacaggtgacactattttgcacctctgatcatatgaccataacgacagctattggaaccagttgaagggagcatccaatatgaattttagaattgcttcccaaaaggcatgagatggtgagaattaggaagttttatgagtgcttggttttctatatggttacacaggactttgctgttagcacacataggctgggttaaaccagtgtggacacacgcctttaggcatttgtatgtcactgctcctttgacacatctgacaaaatattatggtatccttttcaggatgataaaaatagccaactaatctacaaatatacccagttacaattgacagagactcatgatatagccagactatgatttttaagattgcatggaagaatgtaatagcacccaggctcaagctaatttagcaagattaatacaaaattttaataattcaatcatttacaaggaaaagagatggagagttacaaattctcatgagaatgatccagttgagcctaccctcagtgaagaacatgatacttattcccattcagtcataagcaatatttcatgttttggttttctgtatttgtagtctcctcaaaaatatgttcttatttctcccaacctgcaccctttctacttgctttatggtaaatcaaaatcagaacttcatttcccaaggccctccactgtcttctaataatgctaaatgggcagcattctcacaggtcagggactggattcaccatgccctttggaaactgaacaggttaattacacaggactcggtcagtgtaactgttggtgcttttgatgtttctttagaaatggattcaccatggaaccaggttggcttcaaacttgctatcctcctgtctcaccctctcaagaaatgccttgttccacacttccttttagtttaggttttttttttttttttttaactgcaatttacttctatgaatgaagcagttttccaggactatctcctatcatttttcctgaaacaatccaatcaggtgaaatgaacgggttctagggtctgtaagactccatagaaaaatgtaaaggctgtctgaacacccaaaggggatggggaataattcgattaggactcaagaccaaaaacaaaggcagattaaaataaagtattttagagcatttacacggctctgtcatagggataataactacacccagtaaaagataatacacggtaaccaagactgacatcttctccctcaagataaagaataactgcactttactctgaaggaaacaagtactgattagccggagacaaaactcccagggaccctgtgacagtttttctctttttcctaattaataggatatgaaaattggaagttatggaggctattttgagagaagagtggagtcgagggcagactagacattcaatctctcttagctgactgcagctacagtagatagttggaaaggagccatatgtgtgctgttcaaacttcctcacaatgtacccacttagccttggcaataaggggaagatgaacaagagattcacagcaaagaggacgatggagatgatgtcaggtgagcccaaagctgaaaggaaactgttggaagagctgaaatattaaccaagacaactcagggatgactacaaccagcgtatctctgtgaatccacggaacacattaacttcattcctgtaagatttcctggaccacggtcctgggtgcttgtatgagtaacataaagtttaaagaaagttgcccagaataagaagcctggcaggacgagacaacaatcaccgtaccaatcatcacagtgccttggaagatgagcctggagtatgttggatgtggagccagcctgggtgaggcacagggtgtcagtgccatgggtactaaaaccttgacctacagctgaactacatgtccatccctgccagagctttataacaaaatcaaattcgataacaagtacagagaccataacaaagaatatcaccatgggcccctaccacacacacacttggggttttgtttctaaaaaggaacattctatctacaatctcctctgagatgtcattaacttcaaataagtccaaggcagagacaaacaggctttgcctatcacagtacattaaattagagttaaatatagttgccaattttatattcatgtaaacacctgcattgcctcagtcaagaccactcagcaagaaaatgtctgtaaacctaaaagcacagcatcaaccaatcacaaattaatttccttattcatggagatattattcagctcatctgtgttttttttcctcaatagatgactattaaatttcctgattgtgtacgacaaacacagactctgaaagtcgcttgctatcacttcatatacaagcatgaatctataattactctagagttaggaaataattataatgaggtcactggttataacaagttggtgtcctgactgttaatttgcacataagtatcagttttattgttttattgactgaaatgcccccaatctcaatcccccaactcttcctttcacttaaatcactaacatgagatagttattctttgcataataatttctgtttttttttttaattaaaagcaaaaaagaaaccaaagattggcgataaaaactattccagctgcagttaactgaaaataacaaggatattttggatttttaaaacaacaaagatcacagttgagagcaaaattttcaaaatattttgatctactacataaatattaggatcatgttggcagactttcatacaatccccttaataataacagttgttaaaataagtatttatatagcaattttcagaagactagcctttgaacaaataaataaaactgactatatgcctcctacctagaatctgtgcattataggatttagtttataggatactaaaaccaaatatatgtttttctagcaattctttaaaaattattttaatattcttagcagagaaatggagatattttactgtgatgactattagagtatttatatattctttgtttttattttcattttatgtataagagtgttttccctgtatgtgcatttgtgtatcatatgtgtgcctagtgcccactgaggccagaaagcagcatccaatcctctgagactggagttgtgagtggccaggtggtgctaagaatcgaacccatgtctctggaagagcagcagtcagtgttcttaaccactgagccatctctcctgtgctgcatagcttcacaaatacttccaagctataggtaaaagtgcaaaggctaggaagctcttcagtatcattctaagggacaccctcgacacagcagggctggactggaatgtagcagtgctctaatcagatttttttattataatccaatcctacccataatatttttaagaagtactttctaccttctatattatcatcaatgtgatatgcaatcaagtctcagtctctgtacaccaaatgaaaaaatgtcttcttatcattagggtctgaaactcatcttgtctgtgatgtattttagcttcttctagtacaagacaaacatttccaaaagacaacccttctgctatttgaaattattaatagcttagtttctctttttctctatttaaatactttgctcataagccatttttaagtctcctctttctgtgagagagagagagagagagagagagtgtgtgtgtgtgtgtgtgtgtgtgagcacacacatgttctatatgggtatatgcgtgcagatgcaagtgcatgtgttcacacttatatatgtagaagacggaggtcaaacttgggtgttgctcctgggaaatatgaacctggtcttttgagtcagagacatgggatttgatgactaagctcagaggtcaggccagcagcagctccaagcacccgcttgtccttgcctttaatgtgctaagattacaaggctgctccatgacacctggcttttcacaatccagattacctattgctccagatcacattttccaaatcccaacgctttctgcattgttttaggtacatggtgaagcctctctcactcttttagcaagccccacacatagtaatctctattcccgtgtccaacatagtcttcagaattgcctacagacatcttccctacacagtttgctttgatttctttaaagctcagttaatgcttgtaagttctacattgaaagtctaatagcaatattggcagatggctctaatgctgcacttatcactgtgtttgcatagcttgagaattcaagaatactgaagaagaggaagaggagtaaggagaagggagaagaggtagaggaagaaggaggaagaggaggaaaaggaaaatgaagaggagggagaaggtgaaggaggaggaggagaaggaagaggaggaggagaaggaagaagaaagaaggaagaaggaagggagaaggggaagaagaagagaagaagaagaaggagaaggagaaggagaaggagaaggagaaggagaaggagaaggagaagcaagaacaacaataacaattgtgttcagtgataggtaaatgtctgcttgggttaactaggcaagattaaccaaacaagggaatccagtgagaggcatacttgggggttttacaggtctgacagatggaattatcaacttctatatcgaggaagcagtcagacataatggcttagagcagggagagagataaagaaacaactcatcacttattagatacacatgggccagggaaagcagaaagtgaagagacattttaggaaacacatctggaaagtctcaagcaaaagggaagaaagaagacagtgaaaaaaggaaagaaatggccaagtgtgccaatgcaatcctaagcacgtgatcggcccacagaggaggaaaaccgaggggaagatttctgtctagcacagtaaagagaagtgaactgaaaatccacaagagaaaactaacagctttctgacagatcctaaaaatatcaaggctatgcttgaagcagacgctggaataccatgtactatggccaatgcaaaagggcagtgtcgaggtaataggaaaagaagctgtttgaaggctggagagatggctcagtgcttaagagcagtgactgctcttccagaggtcccgagttcaattcccagcaaccacatggtggtttacaaccatctataatggaatctgatgctctcttctggtgtagacagtaacagtgtactcatataaacaataaataaataaaactttaaaaaaaaaagaagctgtttgagcggattgactgtaaaagacaacatgcatgaatgttacaaacactgtgtcctcatgggttcacaagaccctaacagttgtagaatttaagaacaatattagttcagactcctaaccctggacgcctatcactagagccactcaaaagcaccatgacagccagttcacttagctgccttctagaaggaccaccatcaaacagtaccaactcaatacattccattccctcattaaaggaaatttctaattaagtgcattgtaacatccaaagtcaacttcaaacatgaatggtagccaaagcgccattaagtaaactttgtatgctagagccgaagtctctgaaacaaagatgcagtatgtgctccagtgacccaccctggcaagacaggcctcggcgaaatggtttctctcactcgtaagcaaaaagtcaagtgatttcccacctgggaactcacatgtaaagaaagcatctagggtctacagataagcaattcttaaagtactacaattgatatttaccacattcaaagcacagcactgtagtctgaaagaatggcagtgggggtattttctatttcaatatcataccaaagaacaatccagtgtgattacacaagcaaggactgcaaattcataagcacttatcctaaagacataaaaggcactacccgtaagtacagtttccgtgatatagaaatatctaaaatgttccaactagataattattcttttctaataacactttctgaaaaatatcttttgcaagttggtaagttacatttaccctttggagtatttcagtcctaaatactcattaaaggggtaacttcttaagtactgctctgctctgtgatgtcccagatgctaaaattatataggcacagaacactgtccactgcatcaggtcaagcgcgcctcttctagctgcatgttcaatcctcctacacactgaaactgtttaaacaaagttcacacaaggaaaagaaactttcaagtattcttttttttaaagaaatagttaagaaaaggggagaaaattttaagaaagtcaaggcttcattcagcaggcaactacaatgagctcagggctcctagaaattttaaatgagattcctgactgccacagcaaacagaaaacgcagaaactagttaaatcattatgtaatgtcagttacaagcagagggacaggcgatgctataagcatattaatgtatggaacgacactagggataacacttagaacacatatggctataaatacatttaatgtattagcatgttctgggaggaatataggaactaacggttgctcagggattcggggctcggaatgtaaagcttcatctggggcaagaggcacctcctattacagcgttcctgggctatggtagtcatgtttttctttcgggtaactttcattattgtaaaacgtaaagtctaacaaaatgtatgatttataactctttacttgagaaatgttatttaaaaacacagaagaatttcctctaggttattatttaaagtgggccaacccaaagcacagccagtcctcagtacccatgacttctatattagtggatataaccagagatgaggaataactagaaaaccaaataaaaacaaaaataacccctaaatgaatcattccataaacaacgcaatatagaagacaatatcatctcagcaccaaagagctatattagattctgaacatgaaaatataataaacataaacatgtgggatttttaatgaatctgccagaaaagagctactgtgtaaaaccctgtcaatcttctctaaacttgaagagaggccacagaagaacgcaggcatggtattccataacatggtaaagaaacaggaggatacggagagctagagagaaggaattgaaaagaagagcaaataagagatatttttggacttagatatttttggatttagttattgtagtctagataaaatgcttatgagaaataaaaagtacagctatacaaaaagccataatcaaatgtttacagcaagattattaataatagccaaaaaagtgaaaattactccaacaaccatcagtcaatagagacaaataaaatggtatctatacataaaatgaattattatctatcaagaaaggaaataccaacccaaactacaaaatgggcaaaccttgtaaatataatgttaaatgaaaaatacagccaaaaaaagccatataccatgtgatcccatccattcgaaacagccagaatagtaaagctataggaagagaaggcagatcttcaagtcattgagcctgagggagtatgttgatcagatggacagagggtttcaagtttctctggaagtaaagattaggtcctagaatagactgtggtgacagtacacagtttcgagtcgacagggatcccatggtctatggggagaaaggccaggtcaggtctacaccatccttccaggttaccacaatcccaaagtggttcaggtcctggacttagaatgatgcaatgcttgcatatagtctgtgctcatcctcctctacaattcagttaagtcatcagtagcttattcatgatactgaatacaatgtaaatgctatgtaaatagcagacacgttgtactgtttacagaatggtgcaattagggttatttttgttgttgttcttggtggctggctgattggttttgttttgtgttttgtttttctaattgtttctcatctctggttaattatatccactgataaagaagctgtggatatgcatggccgactgtgctttgaaatgacatctatatgggtaacctatatgaaatatattttaaaaaaataaaagcaagacttgctttcactgtttctatgattcaggggctctaagctatgcctctgtaggagattagcatagtggctgacacctgtactcagcattcagggaggctgaagaagaatttgaggtcaggctacctaaggagtaagatcttggaaagggagggagagagggtgggaagagagggaaggatgggaggagaaagggtgggaaggctggggggatggagggagagacagatgggaggagggacagagatatagaaaggagggggacagaaaaaggtagaaaggaagagtcttcaattttcacccagacaattatgctacccaggaatgattccctagtccccaccaaaggacctgcacaaagtaacagcttaccgtcccacctgagaaggccccactaagaataggacttttccattcgatggggactaagtttcttagtccataatatttctgagtggcagaagtgttgggatttaactaaaataaataacagcccaaagtccccgtgcctatttattcattgtgttcagttcctgggtcctccgtcaccaagactaccataaaccccatgcctgaatgtgtccatgctatattccagcaacctgcacggatgccccagttctgcatcatatcctggcattgccttgaaggcagcgtgacagtgggggctctttggggcaacgcgttccaatcatccaggtatccaggtgctctttttgctacacaacgtggtatctacgacacacagaatacttctacctgcttactgaacccaagacccttgccacctcacaaacaaacacaacactaacaaacattgaaattgcaacacacggattcaatcattcctggcaagcattaaaacacagctttcaagtgttctccgtttcctggggttgaatgatgccagttttaaataattcctcacacctaaggctaagggggggagaaaagaatgaaaagtatcctaacagatcactaaaaatatccagtcaattcatcaaagagaactcagaagaatctggatgcagcacaactcattaaaaggtagacacactgctttccttccctttggatggcaactccagtgactacgagaaaggagacactcagcatggcaatgcattactatgaagcaatggcgatgtagtgctatgctcctgaggaaaatattttgtggacaaaaacagaagcgatgatatacatctaaatatgtgtgtgatataaatgtgtatgtgtgtatatatagtatatgtgtaggctatatgtgtatatgatgtatttatatatgtatatgatgtagatgatgtatgtgtgggtgtatatgacatatatgtatataatgtatcaattttctttactccttaagaaataaactatttgatggaagaagtaaaagaataaaacacacattttacctttattttgtaaaatgcctcatttgcaaatacacaatgaaacattggcacgacactaaattattctctataatggtagttaaaaagaaattcatgatagagccaacaatatgggtcagcagacagcatttttttgccacaagagcctgaggatcagagttccaactgaggaacctaaaaagctaaccctcgcctcaaattccaggagttctacatcacaatgggaggaaaagacaaaagatctgctggtagcctggagtgcacgccacaggggaagtgctatgctctctttagcaaggtggaataaagataaagaagactgtttaagtcacagaggagggagctgcatacccagcccggcagaataattcacaaaacattactctctcatgttataaggaatcattaaaaaggtctcagaacacaggaatcaaactagttttcgtttcattcctagtatttctggaatttctggggataaattagttacgagaaggactgtacatcatcttactgtctggacattctcttgctttctaggagctctatggggaaggggagatagccctctctgacccaggactctcctcacaaatggctctacttgtggtgattccttactcttagaaaggtttatatttgccagtttgaggctttttgctttttggcaccagggcctgaacctagagccttgtgtatggaaggaaagcatcccatcactaaactcagacacatttgttcaacaattatggtacagaacacagcgtatatacaatgaaaatagcaggttctatgcatggttccaagcacagacttcacttgttttcacagaggatgaaactgggtgaaaactaagctctctctctctctttctctctctctcttgcttgcgcaggaggggaaggggagggagaggggagaagaggacgaaggaggtggggggagggagaaagagagagagagagagagagagagagagagagagagagagagagagagagagagagttttgcacagttttgcatgctctgagagctgacagtccatagggaactcagaggctgggggagaaaccgttctaatgactctccctggggtttcctggggcctcctccgatgggatctggtcatttgctgagcggatcttcactttttaaggatgactcagccctggctggcctcactgcagctcagaagaggaagcttccgttcctcccagtcgcctgcttttcctttctcctcagagctctgacaccataaagcttaggacactgttgtctttccaatggcagctagaatgtcatttcaaacccacaaaaaaactttctcaaaacaaaaaaataaataaataaataaaaagaaaagaaaagaaagccagtaaactcccacagacaacaagagatgtaattgaaagcaaagaaagatgctctatagtaaaccaggaaaaaaataaaggaagagaaagaaagaaaacacaaaattcaaagagacatccccacactcccttgaactcagaaccagcgcatccttcttcatgcccagttgtctcccccccccccccccccccccccggctttcacagaactaagcaccatccaccctgctgctccactcttccagaaaccaccctccccagagcccaccccacacctcacatccgtattgccatcctcccaagtaaaacgtttagtgataaatgattattgcatatgttctccaaactggaacttccttgccacctccctccctctgtctaacatttggagcacggggcaggtgagtggttcatttgggttccataactactcctcagtcactgattttgttgcagaaactccgataatcgttggaattaacaagctcaatctctttgcatcccccaaactatctatattccccgctctctttcctcccccagcgcagtctgtgcatgttccgtcttcctgtaagacataaccttcatgactggcaatcagagtgatgctttgctccaaaatttcaaaaaccgtcttcccttttctgaatgcacattctacactagcaggtgtagcccaaataacatgaatgcactgcattgaaagtgctctttcgggcaggatgagcttattagcaacatctaaatccgccacggctaacacagaagcaaagtctcagcccagatgaggagcactgtgattaccaagacgcatctgccctgggtggaagaacattgaagaactcatcagagtcagtaattagcctgtagcctgtccgcttagggagcacgtggcaagcgcggttagggtaccaggctctgctcctttaatggagacagtgctggcagcactcgattcagtgtggctactatttaagagcagggaggaattccatggaggaggcacatacagcttgcagagaccagaaattctcttcaatgagttctttgcagtgattatttagagcgcctgtgttttatatgctgttccacctgcattttgtgttttaaaataaaaagcaagtcaggtgtgatggttctaccacctaagcacatgggagcctgaggcagagggatcgaaagtttaagaccagggtgggacacaaagggaaaaaaacctctgtagggtttgttatttgtttgcttggttgtttgcttgcttttaaaatacagactagagaatatgttagtcagtaaaactcttgcataaggagcagagtacaaatgcctaatacccatgttaatgtcagccagcctgcttgtaatctctgtgcctaagaggtggagacagaaggtttccagagcaagggaatgagctataatagccatattggagaactctgggttcctgtgagagacccagtcttgatatataaagtagatagcaattaaaaaaaaagacatgaaatcaatctctggcctctacacacatgtgcacatgcatgcatctaacccttataaaggcacctgtgctcacaacacaggtatacacatgcatgagcatacacacacacacacacacacacacacacacacacacacaccccgctaagcctaatacagtaacttagtctgtaagaagacaaaagaaactagtattggtgtctatccttcaaaactgcagctcctatcaataatcaggaaggggttttgattccccagccttaaaacaaaacatgcattctatcttttgcaaaatgagagaaaataagtagggacacatgaagtatctgcttacaaatgcagagtattaaaatcgaaggtaagcaatgagactggtgtctcatggccaaggaacaagatcttcaaagacagaagtaattgctgcctgctgttgttcatattcaatgtgtgtgtgtgagcgcgagtgtgcgcgtatatatgaagagagttacaagttcaatatgccatttttccatacacctggaaatcatgagtcaatttaacacttgtagaaccgtatttccatagcctaaaggtttatgctgttttaaaagtaaggagcccaaacaggataaaggccctgattagttaatccagtccttagcttcagatgtcaaccccccccccccaggatggggagtagggcagaccaggctcctcttacggtatataataggaactgccaatcatgtgatctataacccacagactccaggaatcttcagtgaaaattgaagttcattatacagcaagaagtcttaatcgcaacatgccaactaaaatgaaatcaacaacatatttccacatgctgggggaccacacagtttagaaaaatgagttagtaagttgggttagtccagtgcagagagcaacaggaatgaagaaaatttcccaaagcatgtatgcagtgggaaggagcagaaagatgggggttgggaggaggagaagcagcagcagcagcagcagcaacagcaacagcagcattgaaagtttaagttctaaagcaacatcatgcactgaacttctaaagagctgagctttgcagaaatgcttctggcatagaaaccaataatttcaggttgacgtttgaagcacttggaggtcacacgtgtcaaagaataggtagagatgtgtggctcagtgacagaaatggggcttaatatacatatagttccagaatctacacctggtattaaatcttcacagagggcctagaacctgccactcccctcccagggctaaaatcatgaaagaatactacataaatatagattttaaaagaactgtatactgagaccagacgtaagagatgaaaaaaatcaggttaaaagtcttgtttacatatcaaaaagactgaaagtagtgattctagaaatacttgttaaccaatgttcacagcaatattgtcaaaacagccgggagggagaaatagcccagtatccaccaacagatgaaccgataagcaaaatctgtcacatgcataatagaacaaaatccatactgaaagaagaaggaaattctgacacaacctagataaatgttaagggcaccgtgctcaataataaacaaaccagccacaaaagacaaagataaatattttgttttcctttatgtggtggacttactgcagtcaggatagatatggggtatagaatgggggtctccaggggctggcatcagaggacatactgtttaaatgggtagagagtttctggtgtggatggtgagaatgttctagaaacagatgctgaccgctgtcacataccacagttaatatacttaatgccactgaaatgtgcacttaaaatggttaaaatcctaaattttatgtctttagcccagttttataaatagatataacagtgaactcctataatctacagaggttcctgaaagctttacaaacaaaacccatgtattacggaccctatgctaaggggattttaggtatttgttgagttgatttttagtgtcatggtaaataaagtggaaagatgagaagtaacaggcaggtttagttatgtaaatctgaagttttattaaggttttaaatgagttttcaatacttaacatatcttttagttaagacctttccaagtccatatttgcttgtctttgaagattcaagtcattaaacatcacttagcagttatagttaggcttgaatttctgtgatatagttataaaacattccctaaagagaaatgattgctcagtccatgattaacacaatgctttttagccagaaatgatccctaacaacctcattccactttcaggactaggcttttttttaaataaataaataaataaataaataagtaaataatctccatttttgcttatatttttaaaatacttaagcctcacctgatactgcttgatactcttattgtatagagaagatggaatgtattctattcaaatcctattcaaatagacaaggtgtgcacataagttttgttctgtgcaatgggagttggttctggcaaggagcagatggctgaaggatgggagacaatgtccagggctgaaggactggagagaaatgtccaggcaggtggattcacatggcttttattgttacttttgctcagatttggtagcttttcactgaccacagacacactaatctatctctgtgagctctgcagctcctcacaagtctcctctggggaatccgggtaaattccactgcaatgactttaaaactgtatcagtgataagcccaagacaagcaaaatgcctcttagcaaagtccacattttcaattctgatcattgagtcaataagtcacaggactcaaatacacaaataagcatcactccgattatcctatcaaatgtctcgatggaaagtttacaatataaaatatgactcaaagtaagctaattagacagcttttcatatgccaagtggcccacagggatctctgcagatatgatgacggcggaacatggattttttttgttttgtttttaataaatctaccctgcattactgcactgtgggcttagcacatgtgacaggcctgaccatgctgcatttttggaagagtatggaagactttgggactttagcctaacacagtggttaaaaagtagaagcagaccataataggccatcctagtagaagcctggaaggccatgctgagcgcaatttggactgtatgtatccagctagagaggtttcagaggggaagagtattagcagctgggttgggtcattcttgtgacattttggccaaaacaaaaacaaggcacacaaacaaacaaaccaacatgtgactactgtttaccggagtattaaggatctgcctgaggctaaatggaagaatttttgcactaatttcattggcaaaacagattttaggacagcctggtattgattctgttgcttgttaattagtggtcattcttactcagatctataatgaaaaagagcaaatgtggggcaaataaaaacaaaccaatcagttgggaggcaggagagcactgaggggaggcagggagagcaccaggaaacattggagccaaggctgaaagacctaatgtgaaatggagtaaagggagtggtaccctcaggacaagaccccacccacttagccctgaaacttgagaaacacaaggctgaaatgatcctcccccttaagagcaaccatagagaaaagcttatgcaaacaaggctcaagcaaggcgccaggctccaccccaagcagaaagcagaacttggctttagagtcaggaaaggatgcaggactaaagaggtccctggaatcttgctctgaggttaaggaaagctgctgaacatgcaacagggtaatgcctacatcaaaacctggagaaaccagtgtgtgaagcctggactgggttcggattccagacccaaggaagatttgccacagagacctgaaaagggtgagctgagccagcctaatagaagtaggttacagtcagcggagctggaggggaggcacttgacttcagacatggagctttggagtttgcccggctgagtttcagtcttgctttggtccagtatttcctcactaggcagccattcctcccttatggaatgttggcgtatattctgtactactgtacaatccaagtagccaactggttttctgaattcacaaagaactacaattaagaaacttccatgagcctcagaaggaacttgggtgtttaaactgtgttgaaactgtgaaacattattgagacttttgaagttggactgaatacactttgtgcatatatatgcgcatgtgtgtgtgtgtgtgtgtgtgtgtgtgtgtgtgtgtgtgtatgcgcctatgaggccccagggagtgcaatgtggtagctagaatgagccaccaggttcacatattggaacacttggtctccagttagtgagacagtttggtaagggtgaggaggtgtgaccttgttagaggattatgtcactggagcagagtcgccctctctctgggactagtacttttgggtcagatgtacactctctgctattgatccagcactacgtcctgctgctgtgcccctcatcatgatgaccatggactcgccttctgaaactgagagtccccaataaactctttcttcaataaatcatcttggttatagtgtcgtgcttcagcaatagaaaagcaatagacaatccagtgccaggtcccttcatcccttccatacactactgttctgagtttcttgaacacgatggttagtttaactttgctaaagcacaatggtgccctccttcaagatcttcaataacagccaaaggtcttgaaataataaactttgaattctttggcaagatctcagaatcttgggtgatttgaccaaactcttcctattacatccccaattcgcccctttaacaacccctcaatggccaaggactaggtttttcccgttctcaatctactcaaaaagattcctcccatcctcattgtggttgccctccttgcctgcccttcatactcttagaatccaacagtaaaccttcaccaagttgccaattctggacatgtgactctcaacattcactttcttctacttgttatatctcacctgttccaagatagttttatctgctctctcaaacaccagtttactaaaagcccccttcttttctctacatcttaacaaaagcactgcaatgtcctcaagagccctgtaaatgtctgttattgagtgataggaatttggaaggaaggaaggaaggaaggaaggaaggaaggaaggaagaaaggaaggaaggaaggaaggaaggagagagagagagaaggggagggcaggggagaggagggaaaggggagggtaaggtaggggagggaagggaagggaagggaagggaagggaagggaagggaagggaagggaagggaagggaagggaagggaagggaagggaagggaagggaaaaaagacttttgagtctctaaaacactgacaaagcaaagagtggactggaaacgttagaccatgagaagcttctccactccacagtcaaggctctgggagtcaagtcacactctcacaccaggagttgttcaacagctgacttgggaatctgctgaaaggtggctctttactgtcactaattctggggagcattgataaaatgaaacacaaccttctccagtctgctaaaggggatcaaccacaacctaaaactgaaccgagtcattaaaatcatttcaattcctttatggaaaagctttatggagggataaggaggtggctcagcaattaagagctctctggctgctgctccaaggaccagggctaaataaattccccaagcgcccatgtggtagtcaacaacctgcccaaactccagcagggagtctgaaacccacctacttcaggccttcttgggcaatgcatgtaaatgatgcccaaacatacatgcagacaaaacacctacatccataaaataaaagtaaataaatgttaacaacaataacaaaaacaaaactacaaaagaacaaaaagaaacccagcttcatggactcctgctgtgctgatagtcatcaatacagtactctatagcatttcaaaggtaaactggaagtatatctgtaaatctaagaaaaaaagactagctgggccaagtctttactaacattgccaatgcttctgttgttgggctgggttgaaatggtactatatgtattgactcagcctttctcatcttacagacacgatgaaagataaggagctcagaaaactcaggtgcaaaaagctagcaaagatgccaaatccgattccaagtctaacacatgccttgtcctcggctcaacagagctactgttgctcaacagagccactgttctgccccataaactaagcaacaaagtaatgatgaatttgtttggaacaagcttgcttgtttgtttgttttctgaatacatctgtttggctgggactagagtcactatgtttctttgaagtgttattttatgtgtatggctctctagaccacaatggccagtgctcgctttacactaatcctagtagtaaacacacacacacacacacacacacacacacacacacacacactcctattatctacattaaccttattttaagtagaagcactgtagaatctgagagatgttaccttcagcaggcctgggtccacaataacaagtcatttcccaagggggatggaaatttcaacaattctgtcccaattccccaaaataactgacgtccttgtgagaaaagatatttaaaaggttcattgatgataaagacctctaactgttcgaggtcatctcccctgggtatgggtgataaagccctgcaatccagaagctttctaatagatccacaaagatatgaggaaaacaaccatcattattccaacaaaaacactacaccggaggatatttcttatcaggcaatgccacaaatttacatttagttattattcttaaactttatgtcatcatattatgtattgtaggaaacatctgttgctagcataaaccactggttcagtgacaagtataggaggccattttataagcatgtataaataaaaacagaaattattcaactggttgttgactaaactttcataagaatgctgtaactaatgaacaggatgaaaatttatttacactaagagaagagaaatctctgtgggaatgagtaaaagtgagcacagcttcaaataaatatattccccaaccctgaaaactgcagcctagcagaaagaggcagaaggaaggaagggataagaatagaaaaaagaacaaagtcaaggaagagagagaccacagaaaggaaacatgacaccaacatcccttcgacaaattaaatgaaagttcctttgaatatttgcagggaaacaacaatacttgctacacatgctaaagacacccatttccagggaaagacgccatgatctctccttctgagagtatgagctgagaacactatgaaatggtcacatctttcctcaccaaaggtcagccacagacaggcatttcatttttttatgtgcatgtctaaaatgatggaaaaactcaccgtcaggctccagtgagggaacgtacaaaggtaagaatatgagtgcattataatggatcaagtgctagattaaaaaccactaagtactacaaaagctcaattttggaagtgagctaaatctctttatagttgttattagggaattcacaaagaagataacagagaaaagctctagcaaatgaatagaagattccagaagaaaagcagtccaggcatgaagacagatgcacagaaaagtgcaggacttctttgaagagccatgaacaatttcatatatgaatggtctattcacattaacaacaaaaaaagtttctcactaaaatgatttacaatccatgaatttttacctcacttatattgatatcctactcttaaaaattataataaaatatgtacattacagttaaatatacttctctaagcatttttaaattacacttttaattatgtgtatccatgtgtacctgattgtgtgtatgtgttaatcagtgcagtacgcacagtggccagaagggggaatcagatcccctggagctggagttactgcagttgggagtgaccgaaccaggaaagtactgggaacgtgactgagcttttctttaagaagagtaccactaaacaatctcttcaatccctggtaagcatttgtaacacaattgtttggtttatcatcacacaaccataaaaggtaatgataaagttaccatctcacttcataggggaaaacagagaagttaaccaatttggctaatgtaatagcttggcttcagaatatctcccaggtgctggatcaccaactccgtcctacagcaccaagccacgctcacttagaaacttggtctcaagctccaagctatgtccagtatggacgggaagaacagaaacaaccaccaagtccctccttgcacttcctttgagtccttccaatcttttcctttccttccttccttccattcacttctgttgacctctatactgccttctacagaaatcccctattctcccttcattctcctggaaatgtaacaagagggcttaattaagaaatgaattaagaaaagtagaaaatctaagataggtaaatgcccagagctgtcttggtcccggcccatcaaacctcagggaaggcttagtttcatgaactacagaaacaatgatctaccaacagaacaaaggatcaagaaaaacagtgctgttttagatattaccactcagttaccacatctattcaccagactgagggtggaaatgtaaattcttcccaaataatacattttaaagggtacacttagtgttgcccttttgaaccaggctttgtaaaaatgtaaaaaagaaaaaaagaaaaagaaaacagggaaaacacacaagcccaccaattaagcagatggtgcttttattaaaacagggtcaggcgctaaaagggcaaccacatacacacccagattaatgcacctcatcagcatcagagttgaaggaacccattttgaaataaaacatatcaaacaataaaccccagaaggaaggctcagtagaacaagtgggtacttaaaaatgatttaaactggtactccgtactggtattttccccttagccactatggttatcacaatgaaggagctccttaaattcacaacctagcccaaagaagccactcagtatgagcagaaggtgtctaaagtatagcgatgtaaaaaagagaatgacatattaacgcttattctcggagaagggtgaggaagggaggggagtaggggtgggccatggagagagacaaaggagaaggagggagggagggagggagggagggagggagggagggaggggtgacagagacagagatgaacagaaggcagaaaagtgacaggtgggcccattaggctcactggagctctgttagaaagttctggatcaaggcatatccacaacgaattcctgtagtgacatactccaagtttaaagacagaattctctttctcggtgatctcatattgagacactcacccgtgtggtttaaaaatgtttccttatttctcattcaattataatatcaacacgacgcgcacacaatcacagtcagggctagagggatgtttagaggcaatatttaagatttcttcttcaatcatgtctgtacatatgtgctaggatgtgcaaagctgtgatactttatagcattgatacatttggtccaaaaacagtgaaattctagagcaacttcccacagatgaaggaaagcactgagggatttactcatcattgacactttaacgcgtttctccacacaggcactcaacagattcaaaggcaaaccagacctctcccacattctggtgcacggggctgtgaaactatgttctgactcaccaatagtctgcttcattaggtgttaacatttgtaaactgatcatgttgacaagtgacattctcaaataataatggcaccatttaaatagaacatagatgccaagcaattctattgccttaagaaactattttcctttattaataaataagatttatttaatctcactgacagcaaatttgtaatgcaccaccactaagaccttgagggagacctttaagaccatatagttgctgtgatcactaggcaattgtatttaatataatgggctatttgctaactgtcaacaaaatcaatcagtgtgttttaatagactgaacagtttaatcacagcaagaattgtacatggccgatttcattatcatttttataaaagcactgcttcaaaaagcctaaattacgatagaacaacaaaacttattaaatattatgcctaaatggatcatgttagaggtttgagtataaatgaaatgtatttggtcaaatctattctttagcgattatattttggtagtacagcaccaatgtttggctttagctgattcagaatatgagcacaatgtatgttaacttccatgtattaaacgattatgacagagaaaaaacaacgagccaagttactgccttagttaggatttccactgctgaaaagcgatgccatgactaaggtatctcttatgacacaaaacatttaattgagctgacttacaatttcagaggttcaatccattatcatcctggcaagaagaatagcatcttgtaggcagacatgatcagaaggcaaacaggaagagaccagcattctaaactgggtggggcttgagcatagagacctgaaagcccacccccacagtgacacacttcctccaacaaggccacgcccactgtaaggccacacctcctaagagtgccatttccaggggccaagcatattcaaaccaccacagttagcataccatccaatatatagtgaacataaaactaaaatattcataaaacaaagcaacaagatactaacagatgaaattgaaatggtgtttactttatacaattcatttattacttaaaattagtattagtagcagtgtgttgcgtggcatgtgtctgccatggcacataggcccaaggacaattttcaagagtcgagtttgtccttacatcatgggtgccacagatcaaattctgatcaccagacttacatggcaagcacttttacccactaaaccatctcaccagccttatttttactttttgaaatgagagctgcagatgcaacttagcctggccttgaactcatgatccttctgcatctgcttccttagtgctgaattaaaggtgtggactaccatgactggtctgaaatttcatgattgctgaaggatttttgacacaaatggatttagagcacctttttaaaactacaaagtcttctggccggggtacagctattaacctcccatgttttattcataactaattaatacacagaactatcaactcaaattagaagttgaaagctagcttgtggcataataggcttgtagctgaagaaacacctatgatcgtatactcatgaggatgctcccaccagcatcagtaagaaagaatgagtttgcctttaaaattgaaggaaagctttgagcccactacatttttaaatttggaattaacatggcattcagaaggagaaaatctttaattggtaccccaaagcctctctttcccatcatatgacaatggcattaaaaattatcaccctaattatatctcaaatagtaacagatggcatctctgaatggcctctgtatcttttaatttactctgcaaaaaaaaaaaaaattatcttttgaattacaatacatgtgaattaacactcatatgtgttctctctttaaagcaccaacatacaatttgcaagcttttaaagacacaatgaactccagttaaagcaagccatttcccagaggcctgctgcacccgggaacagagttttgattatctggagaaaaggctggagtacagacctcagaaatgcctccctaaactccaaagcaagcatggaatgggcctgagtggggggtaatgaatgagattgtgcccctgtgcaactgtacttctctgctgaatagaagcttgaagccacttatgaaatgcaagatggctgtgcttccatttactaaccatgcaaagcaggcctgggagacatttgtgaggagaaggaaaacaaagaaaggataaactgggccctaaagatcagtctatacaactctcctgagatcagctaaaggtatacaaaaagcaggctcatcctcttgcaaataccaagttgatcgatcgtacagtccacacacataatgtctacagaagcaggaagataattaaagcaaatataacctaatgcccatggcctgaataagcaaaatccacaaagaatactatttataagtgtagggtattggcgaaaatgaagaggaagtagttgccaaatgtactcccgtgtaccagactgaggggtcttgtttcatacatgcagtaacactggctttaacacaggacacatctcgtgtaaactgagatagaggagcttcccaatagttaactgatattaactgactggtgactgaacagggagacaaggagataacgtaaaatgtcatttcctgatgttacttgtgttacacaacaggtctctctcctagggagtgccttgcttgctgcccacagagtaacacaataatggatcgattcaagcaaaagtggattcaaatcattaacttgccacgtgtggaaagatgcaagtcagggcccagtgaaacacacaggacacgttggctaaacacaatgaaaatgagcctccgatctcccaaccgatcatgtattgacactgaacttagccaacagtacaacagtataatggaatgagctggtctgaaaatcaataatgcagggactggatagaattcatggggcttagttcgataataaattcctttttgcaggtagattcaaaagcaaaggacctatgaatgaaagcaaccaaaattccttgtggtgcctaacagatttctttaccagtgaactgtgaacttttggcaccctgtgaactggcagtgccaaaacctacctgtgcctagaatacagccaagcagggccaatgtaggctcacagttcttaagagcagaacaaggagagaattcagagtgcgtgccccatgagttggtgggcaaagatgaaagaacttcctaaggggaaaaaaaaattgaacatatattctattttcccccctcaggcaatatcaaataactagactaattgacataaaaattaaggttaaaagtaaaaacatttactttggtcaattttatgtgaattttacctccacctattgatcttaagaaatcaatcaaaagaaaaatatgtaagagaaaatgcaaacttcaaaatcaaccagagctccacagttgataaagaaacaaatataaatttccaagagtggaaatttccatatttgctgttataaattatgaattaaatgttaagagttgctaatatttgtttctctcatcagcatgacttttttttatcatttgaagctatctgataaattgtctccatatgacagccccaagccccacaatattaagtagttcttaagcacacatataaattatagttagcaataagaactattaaataattgctcagaattgatacttcataggtcaacatataggtagcatacagttaacaacaggagttattaaaataatagttgagttgatacttcttcattggtcaagtttaccaacagatactctatctagtatatagaaacagaattaaaccaggataaaatatgacataccatcctggccaactgcttaactaagcaagaattgttacagggagatgagtgggaactgcctccaggtatgttcagtaattgcatgcctactgtgataaaggactgcatgcctactgtggtaggtatgttaagagtggactacaaagagaaaagaggccagtatggctcacatgtagtgaatcaaagggacaggggtgacttaaaatcaaaatagcagcaacaaaaacacatcaacagacagaaacttgatcacccagaattacacatagtggacaaaggcaatagggtatagtatgattgtgaggctttcggtgtgattcaactagatagtgcactaagaggacccagtgcatgcttctctaagacctctggtgccctgagaagactgatgcaggagagcaatcacaagcagaagcaaagagaactttggggactattactttggtccagttacaaggacatggttttgagcgatcatcagagaagagagatgtgaatggctgtttaagatacagttgagaggttgaggaggtggctcaggagataaagtacttaccgcacaaaggagatgacctgaatttggatccccaaagccacataaaagctgggcaggtattatcccagcatgaggaaggaatgaaaataacaatggcttacatgttcagaaaaagaaagggcagaaagtaagtgacccaggcaagcatgaatcacagggcaatgggtttgagctaggcattcagaaattgatcaggatgaactgtcagggcagcaatgggtaccataagagcacagagaaagagaagcagtcagcaagggcttccaaaagaagaataaggagtacaagactcctgggaaaacattctatagagattgatgaaaacatgcttacaaaggctcagaactacaagggcacatccatacatctaaaaactgcatccataattattggtaacactcatcatggcaaagcaatacaggaagtcgtttctaagaagctgcactagtgacaaatgtacatgcttataaaatgcatatgtttactgactcctcaggagccaaatatctggtagtttctcaatatgccttcaacagaagaatttttggatgactaaaaaccatctttcagaaactaccaatagtggctgacttgtaatgacatttcataatccttcaatttttattatgcatctcaacttttctgttacattatctggtaccctaataagtggatatgaggaaacaaaagctggacaagtggctctgttacttatactaccccaggtgagacctttgataagaagaaacaaagtgttctaatttgtgcttttggaatttgggggttcttaagaattcagatattaaattgccagatcttttccttgtttgatataaagacttacttctaagccattataacataaataacttctcagaagaagaataacttaggaaaaatttatttccaaactcatacttgtccccatatttaaaaccactaagcaatcccacagggtgtgctgtcacttcctgctgagagagatcatcttgagtagtatactggtgaaaatggaaagcacaggccaaaaggccctgacaacagtcagactccactaggctcctttcgtgaactcacccactggttcattcacttgtttttctcaagaatgagcaaatgacacataattatacatctaaaacacctataatcatttcatcactttttactttggaagactcactgagaccaaaataatgatctagctagctgagacttaatgcttacattaaaaaaattatccaagggacagaggatggctcaatccatatagcacttgccttgtgaacacatggatctgagattgagcaacagaaacacagtataaatccaggtgtggtggcatgattgtcattgctaggttgggcaggaagacagaggcaggttcagggcttgctggcctttttgcctagcttaatcagtgagttccaggccaacgagagccactgtctcaaacaataaggtagaggtctccagaggaataataactggggttgtcctctagactccatacacatacacacatggatatgcaactacacccccatgtatctacacacatatgaacacacatacacacatgcatgcacatacaccagacacacacaaacgttcactgtaaactctcaaggaatctatgattgcccttgttttgcatctttagtctatgctggtggctgtgttttgttgatatttcttctgcatctgctcgtctgagaatcaaccagacctcctctgccatacacactttatcacttctgttttaagaaaatatttgtcgatcactaagagtataattaaacacttttcatggcattttcagaaaacaggcagaagagcctttaattactaacactttacatattctttcaggctattcccccatagccatcaaaaaactaatgataggtaatgtgatagaaccaaagtgccctcggacaggtatgacagcgatacaataaaaatctatttgtcctgggttattttagctatcaactggacacagcagagaacaacctaaaaaaacacttcctactccccaccccgaccccccccccaaaaaaaaaaacagtttcagttgagtagttgtcttccctgggttagactggagcatgtctgtgaggggtgtcctgatttattagttgaagcacaatggcctagtgccctgtgctgtgtaagaaagtaggatgagccggagtaagcaggcaagcagaaaaatcctccacagtttcggtttcaacgttctgcttgagttcctgattgacttccgccaaggatggcctttgacctggaagtgtaagatgaagtaaaccctttcctcccctgacctgcttgtggtcagaatgtttttatcatagagacagaaatcaagctgggaccttagtattttgtgcaagtctatatgctaattatatttacacatatataaaaataccgaggttttaacaggttaaaaataataacaagaggagaatcaggtggctgagcagacttgcagcgctaagactacactgaaaatctaacatgcaggaatcaaaatctctgccttctttgtttgtgctgcaaccaggtagagggaaagaggagaaaattactgacagtctgaccagtattttagtctcagtagtcagaagaaataaactagtggaacagacattctattgggcaaaagaatataattttaagcatgcatttactttgtatcatatggtatggggcaaagcttaaccataattttaagttcctttctcagttttcttcttcttaactccgtctgagaccccaaagcccacccatggtccaagggtattattattattctcagtttaatgtgaattaaaacttaatgaaatttacatgaaaaaatccacacagagtgggctgtgaaagatacaatttattatccccgttagtatattaaaccttcctaaaatgtcattaaactgtatttacaagctgggtttctgttgtcttgttttgttttttcatttaaatctagtgtcttccagaaataaaaagagttctctgacttggcttgtctgcttgacaaaaggctagagataccagagagaagccagccccacaccattttggctacgaaatgaactctcatcttataaattttatacgaagatcttgggatactttgctgaaactccttcacaaaaccatatcagcattcataatccatgagaagctgatgtttcctgggctcacaggtagaacagagatctctccagagagcagttgggttatttgttattatttaagcaaagcagacagctggaagatgagtccacagtgaaggtctcttctcagcactcagcaaccaggctccatccccagccagccctcagccaaggactgctgggcttccttcccagctgaaatggggatttggagaaagctagaccttttgatcaaatttgtctattgttgtgtcctgtccctgggctttggaaatgaatctgggtatagatgaatgaatgataagactccatcaaccattgaacagtgcattgatgcattaacaccctaaaaggttaggagttgtcagctttccaactctatactcatttcacttcttggcaaataatgcagccttgtcctgccttgtgaaagaagggagtgtacagaaagtcatccacagaggcagctcgaaagacatttttggtacaaaatatttagtctcaaaaatcatatctgtccctaaaaataaaataaaataaaaacaagagacagagaaaatgtagacacaagtgcatgtgtgcgtgcatgcctttgtgtgtccctgtcatctgtctgaccaagaaaggagaaatacaaattctaacttctaaaaacacaatgccattcctctccttgaacaggtgagggaaaggaaggagaggttgagaggctcagaaaagacagcattgtccccttgtccccaagaaggccacgacattaagttgttcccctcccccccagaattttccccaatatactctatctagtccatggatccccttcaactaaaataagacaaattaatgagtctccttcacactacaattcttaaaactcagtgagaccaaatgcaaaccaggtggctgtggtacccagttgcaatatgaggggtaaaggccactctggcccactggagacacaagctatagcctctaatcgattcagaaagaaaggtagaggatagttctttaaaaagacataatagaagccgttcaggcaaaaccaggtggatacttgtggaatgagaaaacataaaactagagaaaatattgaaaatgtcagtgcgctgtgtggtgcttaaagcaagcaccagctaattttaatgattgctttctcctatgatcctgccaatattgccagcaacagatgttgttgctgagcatggtgattactgtagatcctagacacaccacccagcaccctttccccttttaccagctctcattggtttgaattaacagctccctctgcacatgtatatgccacaatctaaagttgtgttttgtgtaggacgatgtcaccacacaaaactaacaaagacaagttatgttattttccggtgtctaacagtgcttttgggctatccttgaataaaacattgagctcatatatgatgtgtgattattacgttttaagtcaatagtgtacaatgagaatttattcccatgagcaaataagaaaatgcccacaaattaaaagaacaaaataagaaacacaaaatctatctcatgagaatgtccataaagagatgccacaacatgaacttcacgaccattcaccttgttcacaacttaaatattattcttcttaactcacaaagaaagagcatttgcaaagaggacaggaagattccaaatgagactcaaatgctgtttggaatcctcaagatgatttcctctcaactcctaaataacctaaatatcaggaaactcagtctgcagttacaggagctcagcagcctaaggagagacttcttgcttagtttggttgtttgaaagaaacctgcagaacatcaagtggatccatacccgaagctgaggaactaacgctgactggttgcaagaatgcaggattgtatggcgcctttcaaagcagaggtgacatacaaatagaatatcgattcatttctaaagccagtttctccaagtaattgacaggtgctctcttgccaaagctgataaggaaaagttactgagtcataatgaaagaagaacagaaataggcttagagttgaggtcttatggtcacattgaaaaggaagatctattgaactctgtgacctaactggtcaagtgatagcaacgttctaccctgaatcacctcaggagacgctccttactatcatgtgctactgccagacgccagggctggcatcctcacgggcaaggcaaacctttagcagatgcacaataaaatttcactatatgtaaaattaatttttgtcacaaatggcataccatggtgttctacatacaactatcagacaataatgatggtgttggtgggggctgtgagctgaaacaaaccaccaggctcagacactaagagactctatcaagccagggccaaagagaatgctttattcacagagaaccaggatttttcagagcagtacagctttgcacaataacaatagggagccacgggggacccaaaggctggctgtgatgacgaccctcttctgaaagcattacaggactctgtactcagataaaacacttgtggacattaatgactttgctttgtcttttaaaagccattagacatgccacaaactgtaatattcaaagctgaaaaacaaccaccaaatattccacatactgcactcataggaggaatcataacagaaaaagaaagttttcatggtatcaagaatgtatttactatggaataatgagtcactcatagatacacagataaaaataaataattggatttttctagagatctagtagcttgtcttacatttttttaaacatacacttattttttttttttatgggaagcacgcacacacgtatatgtctaagaataacttgtgggagtcatttccacattataagaccaaactcagattgaaaaagcattttctaaaatacagagcactgtgggactggagccattgctacaatgacaacttttcaaataaagaaacgctaaaatgcttataaaatccgttagaaacaaatcaccgctgccaacacaatccttacttaagaaagcagaagacattgtgtgaaatactatctcagtgtgttcaatgtgcataactgagtaaaaagaaaggaaatacgatgttactagtgttgctctctgatgagcaaactgagctggtcagctttcttttcttcttccctcctagatatttataaaacaggtgctttctctttcatatatccaggagttacactataaattccacttttagagctaatgaaatctatatgatgaatatgcatagccaaaaattgtcaaaatgcttcattgctactaaaatccaggtcactaaaagcattttaatatggtgtatgtgtgtgtgtgtgtgtgtgtgtgtgtgtgtgtgtgtgtgtgtgttcacggatatggaggcatatgtagtggggaagacagaagacaattctcaataacactgtcagcaaccttctttgaaagggggatggcggcatgttcatgtacatggaactgtatatgatatgggcctgtgcaaggaaggcagccctcaagaaatctcctcctcctcctcctcctcctccccctcctctgagatagtgtcataactggtcgtgggcagttcagtgacccacaaggatgctgcagtccttgcctacccatcagtgagctcacaagtacataccaacaggcacagccctttttcatggatcctggatatagaactgagtcacttgtccttgcaaagcaagcactttgctgagttagccattaagccctacccccacaaagccataaaacaatatttcatactttagagaaaccagcttaagtgcaagtatgaacaacaacaacaaaaataataacttacttgtaacagttaaggtctcacccatttcactcctctgttcaaggtatgtccagaaatcccctttacccttccttgcctagggttcccttcattcatttagctgttttacaattctttagttatttctcaaaggatctgatatcatgaaaaggaaaacagcatgtcgcaccaggggtggccctgtggtaacacacttgtcaagtgcgctcaacagcctggactcaatctccagcaagattaaaaaaacaaaaaacaaaaaaatcatgcagaattatttaaatgagtgtcctcctctctctgattccaaactgaagcacccactcacttccccgtgtaacggctgtatcaggaaatacacgcggtggttaaatgttagtgtttgatttctgacctttattaaaagtgagacttcaactacgctatgtggcgtaaacaagattttcagcaagctgcaataaatatttgttaattttgatttactttaaggagttggaagttaatcaagagcaattaatcaacacacaaactagatgtgagaaataaataaatagaatgtaaaatcttccaacaactcagctatttctaggtcacatcatgacatccaattcatgtgtggaaatcaaaatatcctatgctataccatactctataacttaatgtttgcaatattacagaatgtcagtttatacagtgaagtagaacacgctagaaataataagattttttttaattacttgaaaattttaagagtaacaagaactctggaccctgaggcaggaggattgctgggagagcaaaaccaacctgagttccgacccagcttgagttacagacctgagaccctatctatctcacctgagttacagacctgagaccctatctatctcaaacaggaatgaggcgaagcctgagaagatgctcatttaaatttactcactaggtaaattcttgctgaaagacttgaagatgtgatttcagagtcacaggtctgttgaatctagggctaaatgacagagaaaaaaaatatcccaagtgttcgctgaattggtgagctccaggtccaataacatttcttgtcaaaaaccaagtaataataatagttattattatttctgcttgattgaagagattccagtatcaaatactaacatctacatgtactggcaaaggtaagcacgcccaaatacacacatgcatatctacttacatacatcacacatgtacacacatatacccccaaaaatatactaacatatgttctgaaagaaccactctagatgtgattaagtcaacttatgaaatagatagcgtaaatgatatcagagaattgataaaagcaaaataaaacaatgtaacacaaatgagctatacagtcatttaatccaaataaatgattctttgacaaaactgatgtgccttaaataaagatgaggactgcaaattgaatctttatgaatagagaaccataaaatcagcatgtgcatcaatatgtgtgagaggatgcataccccttatgcaagtcccaaagaaatgtcaacatttccagaaagggctggaaactgtgcctaaataggaattcagctggatgctaaagaaataagattattttctttttaatctctacaggaatttgtgacctatggcatatcgtatctcatgtttttgcaaagttataaatgttgataggaggtatatgcaggttttgtaaaaagaacagatagtgatgtaaaatatatttcatttgagtttgagttcaaagcatgagagctatggatttgttctgcaaatacttatcaccaggtaaatggagaatttttcaagcattttcaacgtatcactgtcttaacttggctatgagagatagcggcccataagcaccttacaggaaactgacccatcttatgattgaatggctgctacttttccagcatttcatcataaaaacactcaagtatacaaaacagttgaaagcctagtaaaataaccacaataacatctggagttggcaacagttaaactgttagcatgaacattttatccaaaagctatgtttacaaccatcaggtatatcatttgaggttaaccattcatctcagagacctacaaagcccactttagatgtaacgtatcataaaacccacaaccagagtatatcgccatgagagaagttagctgctgacactattgatgaaagttaggacagatcacttaaccttttgacgcacctggtccatggattttacacaaaatgcaaaagctaaggccaagtgtatactctaagcactggggaggctgagccaggagattgtgaagccaacctgagctctaacaagttcctgtctcaaacataaaagcagaacaaagaaaccaaagaggaagctaaatttaaaaatgtcaagttcacttctagttattaaattttaataatatttcaatgctgtaagaaaattctactctcctcaccttttattgtctacatgtagaatttaaataaataaacacctacaagaacaaaagcacagccgtctcctttggtcctcactcctgagaatattcatctacaagttcctacggcttttaaagtaagggtgacatttggcaccagcaaaccactgaatcattaaattctctaatgaagtattgattctcaaccacatgtgtgagttcctgaaattttggtttctattatataatttctcaaatccttcaccggcttcctattaagctgttccgctcttcgaaataagcataataggtcattaggcttccattagaagcaattactgggaaaaaaaaaaagaggccatgtttactcctactttacctccactccacaccacatgagatttttctacactggaagggcatgcaaagaagtaatgaggacttggcttcaagaactaaggcaaaccaagactatccctgtggtcattaattcaagttcttcatcaactatcaagaccttattctcaatagagaagttacagaaaaaatatgagaagtatagaatgtttaattatcattaaaactcaaggaaaatcttcttgcagccttccctagtgctcgtgagcatctgaggttattgatgtatggacttaagaaaccaaagtggcccggtatggtagtacataccttcaaaaccaatactcagctctgtgaattcaagggcagccagatccagcatagtagttcctggaccaccatgcttacagtgtgaacctatctcaaaaaagaaagaaagaaagaaagaaagaaagaaagaaagaaagaaagagagagagagagagagagagagggagggagggagggagggagggagggagggagggagggagggagggagggagggagggagggagggaaggaaggaaggaaggaaggaaggaaggaaggaaggaaggaaggaaggaaggaaggaaggaaggaaggaaggaaggaaggaaggaaggaaaccagagaaggaagagaaaagagcaatcacagctgcccctaattttgtgttgatgatttcaaagcatgttgccccagaggccattagccactggtcttagactcttaagacatgatacaatgtgtgaagttctaattagtgatggatgtgtttggaaaaaccactatggtttttactggcagaaaatgtatcctaataaggaagttggaaataagcttcgggaagaagaaagctgaaatggccgtgaactacaaaaggacctggagttctcagtaggctaagtgagcgaggacggacacagactctttgggttgtgtgttatattccaaatgaactgtgattaaacaaggagataaatattatcagtgttgctgcttgtagaaaagggaatcatagaaaaggcagtttcaataatactttagctcttcagggcaagttcaaaagcattaagataccaggccaatgagaccttcctgaagttatggaatgtttaaatgagaaatctcaagaattcataggtcatatgtgccttttataaaatgaagtggcaaatgaggttgcgtcacataggccttctgatttcaaattcagcatttccccctttattcttatgcttaatgaacttatataattattatggaaagtcagttatatatagctctatagggtttataaagattgaacttaggtgtcttatttgttatttctaattaaactgtactgaattctcattgggaagcagaagcaggcagatttccgtaagatcgagaccagcctggtctacaaagtgaattacaagccaagctaagactgccccacaaacaaaatcaaaatatagaattctctaagctaaagtagtaagtttaccacagaaaattataaggggttttccatgactttctattttgcaatgttgacaaactgaatcacatactaaaaaaaagggggagctggagagatgactcagtggttaagagagtcaaaacaggagtttggtcctcagcacccaaatccattggcctgcaatcatctataaccctaagtaaaacctgacagcctctttttgcttctgtgagaagccagcacgtgtgcatttcacagttgcaggcatacataaacatttaaaatacgtgtgagtgtgtgtgtgttccatatagattaatggaagaaaagctaaggaaaggcagtggctgtctcaggttgacagacacggaacataaggaagggtatctatctgttttagaaggtcataaaatgttcacaaacaaactcgtagtggtggttgcagaaccctaaatatataaatttttatttttattttactgaatagaataaattgttctagatatcaattttatttcaataaagctctttgtttctaagatctatttttacattttatatatatgaatgtttgcctgcattgtgtatgtgtaccatacacatgtgttgtgctcggcaaggccagcaaaggctgtcagcttcttccctggtactgcagttacagacagttctgaggcctcatgcaggtgcttggaactgaaccctggtccactgagagaatagaaaagtgctcttaactgccaagccatctctcctgcacatcaataaagctgttataaaaaagaaaccggagccattacatattgcatttctgctttattatagtaacattctgaacatcggattatttatatattgttcagtattctaaggatcaaaagatactgataataagacatggccccaaattttaaaaagttcataattgaaaaggtaaaacagacaaacagataaatgtagtactacgaaaagtgagaaaaatatgcatatatatcatcataacatgcaaatgtgtgtatatatatgtatatgtatatatatatacatacatacatatggatacatacatacatgtacacatattgatcatatccatatgtatgtacacatacatacacatgcacataaacatatatacacacatataaatatacatatcagagaaatccctgaaagctgagctgcaaaggaccacttggctgttcaaccttggctaccttcaaagtccatattcacactcacttgagaagttctatgtgtatgctaaggaattgcctcttcagatacaaaactttaaataatttcaaccattctataaaccctaaggttctataagtctagaatctaagttaataatagacacatttcccgtgactccttttctttttagatttctgcttgaaataccatgacatttcctcatcaattgccttccagctttttgtcactccaattgcagtcctgcattcagaggaaagttgtcccttggaaagaagacatcataagtaactatgttcttgccttaaatatacagacattaagcaatttagttttcagaattccttttcaggactgaagagatggctcagttaataaactgttagctaggcaagtctgagcacttgatgaggctccccagaacttgtgtaaatggccaggcatggtgatacaggtctataatcttagtgggaaagcagagagaggggatccctgaggctctctagataacctttcttgccaaattggtgagtgtaaaagttcagtgagagatcctatcccaaaaacaaggttgactgtgtccacagaagtcagggcctctgttagctatggagggaggaggaacaggcaggacacagtcaattctgctgatctattagcaagcagcagactcttggagggagacagtgtccaggtccatgctctggtgagcccagtaggctctcatgcttagttccaaactcagagtcacactgatgacccttctttaactcaacagggtataaaacaaaagccaaactagtaaatcgggggaaatagctaggaataggagcttatagggacagacgggaaaagcggggtgagcagaatacatcatgtgcatgcatgaagttgtgaaaaaaatattttttcctcatagatagaagattacagtaagaaatagaagacatttgatatcaatctgccacaactacaagtacacctatgtacatgcccctagatatataaatccacatgaacacacacatacacacacagacagatgaatgttcacgctcacacacccactcctccaaactttataattcctttccagagatgtttttcatgctggagcatctcatggattaaacttcagtaatttggaggagtcagggccacacacctggaaaccaaaagacttgttcaatgtcattacaatattttaatgaatgaactctggcaaataaatgcctcggtcccctagatgcaaccagcatgcttcaatgctctagctatctgcttgttctcttatctattcccagaagcctcagcttctctacaattctacctatccctccagatccatgttgggtactgccttttccctaaacacttcggtcatttcagttagaatgtcctaggttcggttttaccacacaccctctgtcatgcccatgtaggccctgtagtgttcgggttctcagcagtccattcagggacagaatatgtggttctctactttgccaaatgggggggtttgatctaataacttcctaaaatcatttaaccgacacctgctactgcctgtgatcatgctagaaattcatcctctcagctgggagagagcgtgcaagcaagtggcacctcacaaggtggaatttgaccttgcgtgtaagagcttttggaggttctgcgttttagtgcagttgttgtattctatgaaggtattctgaaagtcatcaggatgcagtcaggaatgcaggagtatgttcgccacacagtaatttatcaggagaacactggcaacaagcatgcatctcaccacatttgaaagcttggataaattatggcaaattgaagccattcaattgaattttatttacaccattgagggaaaaaaatcacaatgtaagaaatactttttgacccaggggaaagcattcataacatatgaagatgtaaagggaagttatacatgcaaggagaaaactcactagcaaagaaattatgcctacttagcttgcatataaaagcaagtcttagagaagcctgtcccctcagcttgtataggtcaggggcataggcactgtgatccttgtagattctgaaccaaaagacatacaggaaatgttctcaatctaatcaaattccccccttcttctcttcctctaagttctgtaaagtttacccttttaaaagtaagatttattattttataaaatacattgaacaattagcaagagcatttgttaaaggcctacacatagtaagccagacatggtggcacatgcctgtaaactcagctcttggtaggcaaagctggcaggattactccatgtctgaggcaagtccaggctaagcagttagtcctgggtcagcctgggctatacagtgagtcccagacaagcctgggctatgcagtgagtctcactcaggtcaccatgagctccaggcatgccgaggctggatgacatatgagatgagatcctgcctcaaaattagttaactaattaactatttggaaaaaaaaattatgcctacttagctaattaatggtaggcatacaccgaaaaacaaaacaaaacaaaaaacaaaacaaacaaacaaaaaaactcaggtgtttggtcaaaacttatgatatcaaaatgtattcattctgctatgtgtggtggtacatgcctttaaacctagcactcaggaagcagaagcaggcctctgtgagtttggggcaccgtggtctaaagaatgagttccaggacagccagagctgttacgcagagaaaccctgtctcaaaaaacagaaacaaaacaaaacagtgatcattcttcaagatactgaaaaatgtatttaagaagtttttgcttttctctatctctaagtaaatgtgttgtattctcctacagtggtcccaggacaagtgatgtctttcctggctttgtttaaaaagaacagagtctcttaataatgtctaaatcagtgcatgatagttgtattgtaggcttcaaagattataggcaataaggaggagcctggaaatccagaggagtgaacagaactggggaatgcatatcctatgggaatcttacctcaaggtcaagggaaaggattgcctggactttcccaagcagagctgcaaacagaaaccaagacacacacacacacacacacacacacacacacacacacacacacacacacacccctctgtagcactcttagcactctttccttattctctatagagaacagtggtgtaaggtagccctgctgaggatggcccagacttcatctcaggaagccagagtctacaaggtttgaatctttgagaggcactccccgggccattatgctgtggacttccttattaggatttggtggtccctttaatgttagagaataccaggaaagtaacaataccacacacaggcacgtgaagttatgggcacactccctaggtcatctcccttgatcaatgaatacccatacagcctgtgtaaagattcaagatgttagtgaaattcagagagattaactggactctcattttctggaaagacagctgagctatagatcctgtcaatggtttgtcaaggtgatgtcaacgtagtaaatgaccaggccaaaattatgtgaatacacatagtcttattctagactagtatgaacactttgactcacaacaattcttcaaaagttcataccattactactattattaattattaaaataaatggctgtggtggtatgagactgtaatcctagtaccctggaagctgaggcaggtggatgcttagtttgaggtcatcatgggctacatatgcagagacagcctcaaaaaacaaacagggctggaaagatagctagctcagaggattagggtcacctaattgcctttccgagtagtacagctggatgccagcacctatgttaagcaactcacaactgcctgtaactccagctccagaggatccaagcctctctggctatactcatgtacacatcactacagacacagacacggacacacacacacacacacacggacacacacacacacacagagacagagagagagagagagagagagagagagagagagagagagatacacacttcaaaaataataaaaacaaagctttaaagttttaaaacaaacaaataaaaaacataagaagaaaatattttaaatgtctttagaacaacttaaatgaacttctgggactgacaaagctggcacatccctgcacgctgaacatatatgtggtgcatgagaaccactgaatacatgactttcaaaacagagaagatgcttcactaaaacaaggtgctccacagctggctccttcccacttatcttctaaaggcgctattatgtgtcttaaatatgatgataaaaaactacatttgggtatggagaattaggcttggggaatacataattcaatacttgtggtattgagactcaaaccaagctaaattatgaatcaaaacccagaaccaactatatcaatttgcattaaaatgagccaatccatcctttgtacaaagctgagaaatgaatccattaggggggaaaaaaaaagcctatagaaactggaaacaaaaacgttcatatagccaaaatagtttcaaaaataatgtagctcattgtttttctttttttttttttcttttttttttttttttggtttttcgagacagggtttctctgtgtagccctggctgtcctggaactcactttgtagaccaggctggcctcaaactcagaaatccacctgcctctgcctcccgagtactgggattaaaggcgtgcgccaccacagcccagttgctcattgttttttcaacttcaagatgagaacaagtacctaggcatgcccaagactacgggtgatgaaacatctacacaggggatttccttcctagtacagtgaaaatacaacgaatgataactaaaagaaagtatagcaatgacttaagctactttctctttctttacccctcaaccgcatggttctttgtagctcaggataaccactgtgaccacctgaaatgaaatgcagagagacactgaatctggaatcagaaaacctgtcaacagtgccagttaaatcatgtactggccaagcatcgcctactctgtgccttcactgtggagttaaaagagcttgtttctccagatgttacatagaactggtgacaattttctttcccagacagatgataggtaggaagatagatagatagatagatagatagatagatagatagatagatagatgaaagatatgtagatagatgatatataaattagatagatagataaatagaagatatataaatggatagatgatagataaaacatataaaaatatatattaacactatcttaaaaacacatagaacgtttacaatcctattcattaggcgtctctgtccgtgtttcattagacgctttcccatggagtctagggttgttgctttcctgttaatttttattgtgctgtggttttctatgtcaacagtttttgttttcctagtccttttacagtaggaaaaaatacagacaccataaatatggcctgagaaggtggctcactggataaagtgcttgacttgagcttgattctcagaaaccacagaaaaatgtttgttgggtatggtggtgtgtgtgcactgtctttgtaatcccagagctagggaagtctaaacagggagaatccaccccagtctggacagcttggtgaggtcaggccaataaaagatcctgtctcaaaagagatggtcacttttgtgaatgtggtgttgaacaggtatggagcccatacacaaatgtatataagtgcttggcccataggaagtgacagtattaggagctgtggcctccttggaggaggtgtggccttgttggagaaagtgtgtcactgtgagggcaggctttgaggtagcataaggtcaaatgtggctggtgtgacacagtctccaactgctgtttgaggatccagatatagaaccctcagctccatgtctgcctgcactctgccatgcttcccaccatgatggtaagggactgaacctctatactgtaagccagcgcaattaaatgttttgtcttgttttgtttttttaataagagttgtcaaggtcatggtgtctatacacagaaactgtctaccaattctataataaacatgcacaaatatgtattaggaggaggaggaagagaaggaggaagaagagggagaagagaaggaggaagagcagggagaaggaggcacccaccctgaaaaccaacaccttccagcaactgcagggaattgcccttagggccttacatatgttaggcaaatgttcacctggcacaatacacaaagctttgatactttaacatttcaatacaagacagagagtcactaagttatacaacctgaccttcagttcactctacaaaccacccaggcctggaacaatcttccagcctcagcttcccagttagctgagagtacagaacctgtaccaccaggcctgacccaactacttcactttccattctagagggattccgttccggctttatcaggccatgctgtcacagcggccaattatttattaagcattaaaaagcactgtccgcttctgtgactgagctttgttacaaatcagtctttcagaacttcacagacctgaacaaactagaaaaagaaaaatgaaaagcaatcctctcccacactccacatcctttccaacttcaattacttggactcatttaccttgcctgagatgaacaaacttcgagcaagtgagaaaacgacaatggtgtgacattgtctatattctcctatccctgctaattgcttaatttccagagctaaatataaacaactaacttccctttgaaaggccagcagggctctgccgagaaccaagagaaagcggttcgtgcctatagctttcagatccatacatacaggctggaaatttccatttgatacttaataaactgcaccccagaggaaacacaagtcatcaagcttttagtcacgatgacaaaatagcattttctgaatctagagtgctatgccagctctcttctcagaaagaactttctgtttactccctactgtatccgcgtcagtcacgcagagttccaactaacgttttttgttcttaaagaaccacttaactttgtgaccggcatttgggggtgggggtgtttttcgagacaggatttctctgtattttcctggctgtcctggaactcactctgtagaccaggctggcctcgaactcagaaatccgcctgcctctgcctcccaagtgctgggattaaaggcgtccgccaccaccacgcccggctattttttaatcatgtaaaaagcactgcattaaatcataagtgaagtcattggtaacatgggttttctgattaacgatatgttactacttaagtaataaaagataattttgacattcgcgttgatatgaggaattatggtaaaaagggaggtcacagatcagctaagctgctgcccctttgggaagccacaaaacaaaactcctgtgacagtcacaggcagggaggaaggtctcctgttttgagtcagtaatctggacctcagcaggaactgcagaagacagagcattaagaaagtactcgttctgggagttcacacatctctgatgagacaccacaaacagcaccaaggaaaggggagaataaatgtgaatccctccgcatccgccattttgctccacggcatctccacctccatacaccttctgaactacccaacccactggcttctcatgaaagcaagaactgactcatgatcaaggggacctcaggctaggacgtccatttactgtggctcaagaaatatgtgtacggtttggttactgagagaaaccaagggagcctgacagatggtcttaaaatacctctgtcttaacattcagactgtggccaagtcaagcttgtttcatgctctgaaacacttcagggtttagttatccaaggagagcaacacaccccacctgaaagtaaaacctgtaaggcttattttaaaatgcaccactcacgtgttctatttttttcccccaaaacacatatgttcaaccttttttgttttgttttggtttatttttttgttttttcgagacagggtttcttcatgtagtcctggctgtcctggaactcactctgtagaccaagctggcctcgaactcagaaatcagcctgtctctgccttccaagtgctaggattaaaggcatgtgccaccactgtccagcacatatgcttgaccttatatgaacctcatattaacatacagatgccaggcagcatgtgaacttaaaagtcatgtcaaacactgagtgattgggatatgttcagttatagagttaccctttataaaagtacccacacagggtctatgtggttctcacacacaaacatatatacagacgtcagggaggagaaactgattttgtttaaacatcacttgtcatccctggctttccaagccgtcattgtcccctactaataagccaatggtgggagaaaaatgcacagaatgaaggggcgaatcagtctgggcagtaagaagacaatattgaccacacgaacaaatcaacactctatgattcttgaacagctgtttccttcttcatggcacctgtgcacaaccttgaattaataatatacaccaggatgcttaaaatattttaactcataggacacatgacaaaatgtttgggcacaaaattatttcagcgaaactgttttacatacatatgctggcagcacaaaaaaatcataaaactaaatcaaaataattagctaaatcaataaaaatgctgaagtcatgaaggactcaatttataatactaattatttttcaatgttctatgactcacccactaatctaccttgtaagaatctactttttaccacgtcaattattaaatatgccattaaaaatgtccctgagggggtgggggtgggggtgggattataaaattcctctctaactcaacataacctcaatcaggtttcaattcaaagactgaaaacaggccaagataatcacaaaatgcaaacaagttaaagtcagtagcaatcttaaaagtcacttacatccagctttgtgtccactgtgctctaatagaggaaaaattatcctctagagtcattaatattttaaagaagctaagtgatctaagccaaatcaggagaaattagcatctagcgtggggtggctcgaggtcatcagggcaatttcaatgctgctgcttctcaagtcagcagccaatgtgtttctgtttcctgcccaaattttagggattgtataaccagaaagaaacacctttaaaagcaaaaaatacaacaccatgtacagttggaggggggttactcagagccacagtttccccaagttctgcccatccctgtccctttccctatgagaaataggcagggggaaatacatacaaataaataaaactcaaaataagaatactgtgcacaattttccagtcgtttttcacttacttataaatgactgatacccatacaacagacaaaagaaagatgtgaaagatgaagagggtacaaatattcagacaccagttttcaaaatgccaagatgaacgcaaaatagactcttctcttctctctctctctctctctctctctctctctctctctttctctctctctctctctcgtctttaaatgtacttgaaatatagactttctgtattttttatggcaaaacactgaagtatttaacatttcctttctaaaagactaaatttagagaatgtaagggatatagggggaaatagctgtaacaacatttgcaatttaaataaagagaattcagtgtctcgctaagcagataaacagtacagctggtcaaacttgcagcacagtgacagcactggtaacaagtaggctcagtagatatagataccatgccattaacagagaaggacaactgacatttaagtctgtacctataattttatccacaatgatatgcattaggatccatttcccacatacaataagataaataaaagatacctgctaccagttcatttattcatagtcaacaacagcatcacgccacttccctgtctggagtccccaaacctcatatatcactgcctgacactgacacctactggaaagtactggaagtgtgtgccccccccctccctgtctgagcagtagctaatttcacatagggtagagaatatataaagggtaaatttcaattgcaaataagacaacctcaggttcccaaaaagtaatgcccgtgccgaagatttaaattctaaggcatctttgagaaattacaaatctcaataaatcttcccaaagaatactcctgttggaagtgaacttccccatgactccagtaacatgatgtgtgcttattcagggtcttatcataagactacttagtagctttctccagcaccttaactttgctttatgtgtggaagtcaacgcacccaatggccttacagctcaaaacccctctgcttttgtgaaagtgcttatgggaatagatgagaaaaataataacccagcttttttttaatgcttcatacatttatatccttagctttaaaaaagtaacatatattaatgattcatgtatctataccaatacttaaaaagtaaaatactaatacttatttagtgaatgcatttttcttctccattatcaaaattggctttttgtgaaaatgtaaacatcttacaaaaacacacggattctttaagcagatgaaatctcaacatatccaacagttagttctgtacttttccgactggattaataagttggatcaagctttaattaacttaacacaaatgaaaatatagcatctctttaaagcacgtctcactatatcaatcgatttcctaagattatattttaaaaagtaagtttctggacagacatatattaaattagacaaactgtaaagcacaacactgtgattaaaaaaaaaaatcaaattaacagaatccagcttcccagcctagacccattgctttataggcagagcctaggtgcttcaacacatcaaatttaacatcttcagaaaaataatgagataagaggcagttttcccaattactgatcagttgatcttttaaagaacagtaagattccttctttagaagcatactaagaattgtacagggagaaaattgtaataacataaaatttgatttgctgctgctataatcttccttttgcatcatatcatcttgtttttataaaaataaggagacagtacgaacactaaataagataagaccatgggcaataacaaatactaacccaaaacaacacaggaggacgtgggacggcttgtgtttagaataactgacattgcattcaaaatgtataactgtcaaacaagttatatcctaaaacactacttaacccacctggccacagaaaattgtgttcttcaactttaactaggacatgtggacacacaagaatataagaaatgtttacaatggggctaagcttgtttttaaaatgggcattacttttcttaattggaaaatatcagctataaaaagaagagcacggtaagcaatctgttgaaagagcattctgagctctctgcttgattttgctggagcttaacattgtattaatgtgtcattaaatattaagatattgtaaagtaccccagaggtaacaggtcttaatgaaaatagtttgtcatattttctccaaacaacccatctcagaagactaggttatagatggtaaaataaaatatgtactaaaatagtacttgtctcataggcttaaataaattttaatggagcgatttcttttaacagcttttgcaatcagttgcctggaaagggagtttttcctttccttcagaggagcctgaaagatgagtatttcctagccaggcaacagtggattcttcagacacccactccctatttccaatcagttaccttgcagagcttctggtaccgcggagaggaaactgccatcctttgtaaacgatgtaacaaaaccacaactttctgcagagacgttctcaccaccgccatcattttaagtttaccacacttctgaagagtcctcagaatttgcattataaatgaagagcagcgatcatttcctcccggtcactggacaatgatttgccagttctctgagcatgctcgtttccagacatgcatttgaaagataaaggggggtttaaggttctagagaaaaggaggctgggagtccatcaacttcttgatttgacaaaaacactgaagaacgccacccagacagcccccagcagatgctcacagccaggacctgctcagcctggcgtggccagaaatgaagcaagttgcagcgtggccaagcactgctggctgcagggaaggagagcgctccggagacgagaggatattaagtgaagcactaaagctaaagatacaaaggcgacttcccctggggacagagagtgaaccccatcacggccacggtgcatgcctggtagctgagtttacatgaggagaccgggtggcagggaacatgaggctttacagagagatgcgagcactcccagtggaacgcggctcccgctgtgcttgtggaatgagtagaaacactgaggagcactaagggatttgtctggaaggacagactgaagcccactctgtgctaataaatcaccttaagccagtctgggcattgcatcatccaaaacaaaactgaacatatttacggagggatgaaggtttacctcggctccaaaggcagagccaaaagataggcttccaggtccctgcacaggagcaaatcaggccagaaatcaaataggaccccttaagtaaacagccaagttaataacaagaagcctgcaaatgactgtagagcatcaccctccatctccctcttagacagcatcttcgtaatctttctgtttgtcctgaagctgttttaatttcacatataggaaatccaagagaacaattgtacatcatatgaagggtgtgtgtgtgtgtgtgtgtgtgtgtgtgtgtgtgtgtgtgtgtgtgtgtattatgtgcatgtatacatacatgtctgagagacgttttgcactatgataaccaatttgggcacaatatcttagaggaccagagtatcccaggatgattaagtggctgggcaaaagggcacagcctgaaactaagcccatatgtttctcattatcaaggtccggcctatcctaattgcccagggaacactgctcattcacctctctgtgatgctatggtcaggaaaatgacattttcaggaacttctttttgcttcctctgtctcctcagtccttcacactcgtgtgatttaaggtcttagattgggtcaaatagagctggttcatcaaacttcagcctgtgtatgtataatttgccatcagctccttattgagaacctatactgcctcctcctggtgaggctgccaaagccagagacattccattaacataatggaaagtgcttgttcttagttagataggaatacagattagttagtgataaaacaaggtcagggtctgaagggttgagaacgggaactgatcctaaagggaagtggacttctggggggtgcgtgtttgttctatgtcgaccgcagctatggctgtacatctttgagtgtacaaaaaactgaattatagaatgtacatagacagggcagtatgtaaataacagatagatgactagatataaaaaatatgaacttacaagttgagcatcgttcacatgaaaggcttgagcccaggagtgcttgaagcttcaggatttggttgtttttgtttgttgtttgttttttgttttttggggtttttttttggttttgttttggttttggttttttttggttttttggttttttagtttttgtttttttccccatcatggaataaaatagttgcataaatacactgaggtattccaggggtgggacccaagcctacagataagtcaattgtgtttcacacagaccttaagcacaaccctgaggatggtttttatagcattattagtgattctatgcatggaagaaactgtcacggtatagaacatgtaggacatcatgttagcatttaacaacttacagagtttagagtatcttggtttcagctttttggttttttggtttttgctttttttttttttaagttggggatgcttaacttgtataattcctgttccagagccagcaagtgaaacgggggttcaccccacaagttgggtgcagtggtagaactgaacgatcttctgtctcctacaatagaagtagaacacgtagctagcagcaagcacagggcaggacaagcggaagactgtgaaagacaaagactttcggatcaaatccagcacattctcacatccactccgcaaaggccatagggactccgaagcttatccggaaaagaactaacacttctcagtagttgatactgcaataaatagagcttacaactaaatgtaattaaaataatgaatgccctagactgtggcaatgaaaattaagacaaatgcgtcaattaataaattgagtttttaaatcaacaacagtttcttcttaaaataaaagagccaaatttggcaccttctacgggaggctactcttaacactttattctgctttaatcaaaatagaagaacgtgccatcccttcaagtccaaacaagtctctcctgttaccttcttctcctatgataccaactacattggattaccacacacatctcatgttcacctcctcccaaggccttcaactcctgcagggctgtacttctagctactatcacatctagcacaaatgaacctagcaggtacccttactgtctctgtcactgaggacaaatccattcctcacagagtcgtcagctagattcctgtaacttggaggctataatacctcactctctggcctaatcccctttatgacatctcccaccagcagcagattaaatatacattatactgccaggtacacaccaccaccaccaccaccaccaccctgccatgtacagttcagctctcaaggagcatctctctccagcaagtcatcaaaatcaaattttctcttactgaaagtcctctgcctagaagaaaaaccaaaacataaatacaagagtccaaatgaccaaatgtccataaaagaaatggtccagaaaggcttcaaccaccattgtgcttccaagcccttctttattaaaatatattcagaatcatctttaaactgaacacggtataaactgtatctccatgaaatacctctgtggggctttatatctggttggcacaaaatgctaatcaaatacaaacagtgaacatgtcatctcaggacaaatagatacagatggacggatagatagatagatagatagatgatagatgaatggatgcattgatgaatgaatagatggatgcattgatggatgatggatggatagatagatagatgatagatggatgtatagatagataggtgatagatggatagatagataatagatggatgcatagatagatagatgacagatggatgaatagatagatagatgacagatggataaatagatagataaatagatagataatggctatcagaatagatccatccatctcctgatcatgcaacaagagtacaatgaagtaaacaccacaccttacacagaaatctcagatggctggctcaccaccaccagcagcagctcaacaccagtaaatttatttcatgatttcaggtcttttctgatttcctcacatacctttccatttctgaacacgtttccatttgaaatcatgcacacaaacgagaaataaactacaaacccatgggaaaatttaaattcctttatctcagaaatgctcagccagtgccactacatatctaacaaccatctatctatacagtgccagaaacaaagtcattggattaatttttttgttttagtcaaacaatgggagggctataaactaagagtatccaatctagaagagcagaaggtggaagccacagagatcaccatactgtgaggcatcctggacacattccacgtttgtcttcagataaacagatatctgactcagctgttagcaaaggcctgccttcgtatgagcccaaacagactatgttagcaacatcagattatttttgagaagcaattaccgtacacattttctctccatccattagccaacagcctccttgggctgtcaatgtttgccataagacaagtaatccccagcttagttatttttatttaaaagattcccaccatttctatttaaatttatttttcccatagcttgaatattcattaaaaatggagaggagctggagctctggtaagaatatatcctaagagaaaatgtgtgagaaaacaccactagactctccaatgggcctgtgtgctgctcaggccagatattagcagggttcatgtggaaccttccttccttcccacaagttactgcttactggggggcacagtctaaacagcattgaaattaacaccactataaattaaatatctgcaagcatgtgtagatcaaatttatagttgtttaaatcacaaaactaatatggtttagcgtttacacacactgaatgcccactgcagcctcctgaaatgaggactttctcgaaatattttagcaattcacattaacagtcattctgagggtcgagagagtgacgggaaagagcacctttaactttgatacttgcctggacacactcatcaccaagtcacaagaacagtgtgcaatgcataagaaatgagcaagccaacagacattttctctggtatttgtttttctttcttttctaccatttctttgtgttggctggggtccatatgtgcacgtgtgtatatgtgggtgcccttggactgtgaaggctgacctcagatgtcttcctcaatcactctcctctccattgttttagacctgatttctcagtcaacctggagctcacacacagtttagggaagactgcctggccattgagaccctgaaattgcctgtctccaccctcctacccacagcttgagatagaagacccacagcaaaatcatcaggcaacccccacactaaacctttgacagtacaaagaattcaaactcaggtctttatgcttctgtggcaaaaacattgcctactaagccactcttcccaggccctaactctccttaatttcactatgagactgtaagagtcttcacacataaggatggattataaataagcctattccaaattaaacaaacttgttttaaaagttttttaaattttctgtgagtgtgcacatgtgcatacacatgtataagtgtgtgggcatgtttgcatgcatgtgtgccagtgtgtgcacatgtgtgtacaagtgtgtatgcatgtgtttgtgcacatgcacgtgtgtgtgtgtgtgttctcttgtagaaggtacagcaacaacactccttttaacacattaataataattatttttaacttagaaaatttaagagtaatagttccaaaaaagcctctagacctttaatccaatttgctgatattttataatatggtcttttagatatttcaagagaaaagcattcttaagaatggattaaaaattggttaacagtactaaatttcaactgcagaagttagaatcaagtgcatttacttgggacttgatcctgaaacatcatgtaaacaacaagaatagcatccctatgcttaaagaactatgtgagcaactaaggtaggtaaaatacatacactcaatgataacaaaacgcatgttcaccacaatggcagaagacagtagtcaaagtgatgaattcacatgtttgtaaataagtcacagcatacagacaaaatgtgatgtgtcgctgtggcacacaggagatgcccctgatgaagcaactttttaaaagttgtaattgagaaggcttatctaaaattgacaagaaatgatcactgcatttacccacgataagagaaaaagacgcaggagcacagaagggctatgacttggaatggaaagagagattctggcatgcttcatataatttcacacaaagttatttaaagaaaagctttaatattaccacatttctcaagaatgagatttgaacctcagactgcatatgtagtcatgattataaagtaaatacataaataatgtctttgagcctcatagatctggctataactgaatcacaaagatttgaaatttctacagcaagtatttatattaagtgtagtataaatacaagttattgttataaataataaatatatattataataaatataataatacaaattataatttcccattcatatgaaggtgaaatgaccttataatttaatattcaatagcactaatggcacaagggcttaaaatggcagaaaaccaagcagccctgagtctctagctctaaatacacaattatttctataaaacaaggtggtcttcagcctaatgttaagtatattaagtattctgtagatcatatccaaaaaaaaactagttattcatgggacagcacggattccataactcaaagtgcagacagcctcctcactttgaaacagtaatcagttccctggtggcccaggggctcaggagagactgctgcctgtggcttcccacacacttaccagcatctgctgtcggagctgccgggccaggacactgtcctgaagagcattctcccgctgagaggcatcggccagcacatttgctgtggtttctgcttcctgaagccacttgacaaagttctccaggtctctacgagaagtctgcactgtctgtagctcagcctccaaggcactctgtctatcagcgatgctaaaagaaacaacatagaagacacagctctgtgactttcagggtgatgtcatacatcatacgcacccaagacaaaattaacacacagcctcagaggaacctccatcctttaagccatcaaacggaaatgtgtgatttttttcatctgtgtgtctaaaataatccttaaagaggatgtctagtgacttgtgagataccagtacagagacagagaaatattaacaaagccacacccacaacataaaataaatcatgcctgtattttacatatcagatttgtgcattaacatgatctcttatagatttatgccaaaaatctatgaactgccataaaagggatgtcaatcaaaggtgatattaatacatagtcatacttcactcactgaatttaaaagagcaaattcaaaataaatatttaagacttaaaaacaaacaatacacaggctaacatggagagctcagtgttgaagcacttgcctagtatttacaaggccctgggcccaacccccaacaccacaaaggaaataataacttttggcttttgctaataatctaagtaaatataatgtgatttaataatacttgacttaataattaatatttagtaatatcaacttaatatttaatagtatctgaaagacactgaacaaacaagcttttatgaatgtttcataagttctacatcaaaactagagcaccgagagttatctgaattaggcaaggtatatacctgtaaatccaacatttatagctgtatatacctccaagtttcacagtgagaaaatagacaaactatttttattaaatggatactaggctagatagatggatggacctgtgacccagagtgtgtgatgtaccatcaccaggatgaagtttgggtctcagaaagtaacaagctcagtggtccaaagactcttgtaattccagctccaaagggcacaatgatacaattcctattctggcttctataaaggcaggaaggggcatgcacacacatatacactcacagataccaaataaataaatcttaatttgaaaaaaaggcactcacatatttttagtcctatctatctagacccaagaacactggaactgcccgcccattcaaagtgtcatacacaaatgtttagagcttcatgattcagaatactgaaacaccactgtacattatctgaaggaagcactaaccaatggaccattatatgctaatacatgaacaattactcaaccacagaatgaataaaaccatcctgataaacactctaacttaacatgcccacaccacaaaaataggctaagagaaggagtccaagttccaaaggacacatactgtgagattccatttgggggaaatctctaaagcaactaaactcaagacagggaaagcagatgacttatcctccaggaccataaacaacccaaacaggaggtggagagtaaagcgcactccatgcaagcaatgggataggactcagaaactgagacaaactacactcaatgatatgatcgggctctcaaattcatgcttctaagtgaaagaagccagatacaaaggacaacagtgaatcaattaatgtgaccttccgagatgacataatcatagcagcagctactctataaaattcctctagtcccatttgtctagaaaataaacccgaactgcctgtagtagtttgaataggaatggcttccaaagactaatgtgtgggaatgcttggcccacagcgagtggcactattaaaaggtgtggccctgttggaggaagtgtgccaatatggaagtaggctttgcggtcttctaagctcaagtatggtcagggtgacatggtctttctcttgttgcccacagatcaacaccattgcatacactagcaagattttgctgaaaggaccctgatatagctgtctcttgtgaggctaagccagggcctagcaaacacagaagtggatgctcacagtcagctattggatggattacagggaccccaatggaggagctagagaaagtatccaaggagctaaagggatatgcaaccctataggaggaacaacaatatgaactaaccagtacccccagagctcatgtctctagctgcatgtgtagcagaagatgacctagttggccatcattgggaagagaggccccttggtcttgcaaactttatatgcctcagtacaggggaatgccagggccaagaagtgggagtgggagggtagggaagtgacgggggaggttatgggcaacttttgagatagcattggaaaatgtaaattaagaaaatacctaataaagaaaaaaaaaaaagatgtagaactcttagctccatttccagcaccatgtctgtctgcaagccaccatgcttcctgccaggataatgaactaaactccattatctggaaactagctccaattaactgctttcctttaaaagagttggcatggtcatggtgtctcttcccaacaatagaaccctaacagagacactgccctactcggaatgttccgtcctctaaaactttttgccaatttctctccccaactttaacctctacttttctctcatattctcttcatgtccaagtaatgtttcagattttctagaatgttattgatagtatgactgtgtaaaaactttatacctacattatagtgtccttcctactatctctacttaacaagatcaaacttatcttttaaagtttagaacccatctctttgagactattctttctcaagtttcctcactctgggtttataaaaggacagtgagctgctctatataaaaaataatcatgtgtattctagaaaggtccttagattctgatctgcttccactctacactttataatatatagactttttaatctgtccacttattctacaacctacaggcagcaattgttttccatatttccacattcctcagagtccatactgcagaactatgatgttcaccagatggatatctggcctttgagatttgttcctaaatgccatttttccctaaagaacctggagatagactacatcaaactatatacaccatgaaggggtaaaattccagaaccaaagaaacaagactcctgacaacaggaaccatcaggaggctatttggtggtgacaaaggggatcaaagagagaagagtgtgttgtcactttgactgctctgtggtctctgtattaactcgacaaaacttacaaaagatatactcaaatgaaatgtctccaaaagggagaacaaaaccataagatccaagaagagatgacacattgagagaagaagaatagacatactcagtatggtgagtgaaggtacacacagaatgcatggcaccaggagagatgccttcaagataaagatagcagaagtgacagcttccctaacgtggcagactttgtgaaaaattacactgccaggctactgaaaagatgtgagaggaattagcaataggaacgaagaaacttatgcattaaaaaaaaaaaaaccacagaggtaaatactaacttccgataaagtaaaagaatcaaaggatcagtgaaagtccctgtctcgaggaaacaagacagagagcaatacagggagacttctggtactctcctctggcctgcacatgaacgtgcaaggatacacacaaaggcatataccatacatacacaatacaccttctaattataaaaaggaatattgaagtttagactctgtttatagaagtctaaatgatacatatgtcataatgaattatagtggaggacatatgtatgtctgtatatgactcagtagtagaatgcttgcctaccacatgcacaaacctaatttctagaactacacacacacacacacacacacacacacaaagagttatcatagcccacacatatatgtcactttgtgttctgatttctgacgttaatataatttatatgaagtttctaacagagtgcagctcagctgattttttgtttctaaaattagatccaaatctagtgtggtatactgaattttattcacacacacacacacacacacacacacacacacacgtgtgtgtgtggatagatagatagatagatagatagatagatagatagatagatagatagatagatagataatatgtatatatatatatacacacacacatatacaaatattcaatcaagcaggttaataaattatttttaatagccctgtatgctaccttcagaagaaaagaacctatttttgcctcttctgcaatttcccaggaacatggcttcgagtgaaccatgtaaaagtctttgatatatcagttctcgccttagaatgaagagcttggagcagatcagtggaagagccatttcagactctctaggggtccttttcaaactgtgtaagccattgctgatatcataggcacagctggaagagttcttccactgttgttcccatcctagcttgaaatcccacttcactaagtgtctctacttgtacatgaaatgttactggagcaaagaggttgagaggcactgatcctagggctcctgtggccatgcctagtactgaacccacattcatctagagtctcagggtgcatatgtgtgtgcacatgcgcatttgtgtgtaacagccaagggcaaactgatgtaactcctgagataccttctgcttttactaacacagtctggcaggccacataggctacattggctggtgactgagccccaaggatctacctatctctgtccccacagccctgggactaccagagcacactatcatgtttggagcttttcatttattacaaacatggttctgtaggtccagctcaggtcttcacccaatgcttgatttgctgggtctcaaataagaccaggatggagtagaagaagcaaaaggacaaagatgaccgtatgtatggaaaggatcctattataatgggaataaaagttttaactttaggaaatctgagttcagaagacaaaagcagggactttttaaaaatctaaatctttaaacctataaaatcaaaaaaagcaagaataggctgaaaacatgtaagatataacatttgaagtctacacagggtactttagctaaaatatttttatgcctcaaacaaaagaaataaccaactataggacacaaagaaaatagaaatagcttcacataggaaatgtaaggccatccacgggtgacagatttgtgatcgtttatattaaagggaaccaggattttctaaaatatgaagtcttagctttcacatgatgtctgtaataaaactcactgtgatagtctataaaacaaaccgatagccattttgtaacataaaatatagccacctacaaagcaggcttttgaaaacgcaattttaaagatgttaggcaatatttggtattttaggctacagaatgtaatatactgttctatgaagtatgtgtatgcttataattggtcaaagagaacattgtccccaaatttttttacaagatgcaaaacgagttcttaggaaagccacagttgtgtgttgctaattttgacgtctttaacggtgatctctgcagaagatttaaatgtatttatctctttcagcatggaaaatggcagaatcagtctaagtagaaggtaggaaacttacagggaagtaatttcctaagattttgttcatctgaaatagataccaacacatactgtggggaaagcctttcagtgtgcacagagaggcctggggaactgtagcagtccttgctacatagagattgcgcctttcccaagccacttaaaaattcaccccacaggtcttaaggggtctgtgtgctaaggcactgatgccagagcacttaaaagttaaagaggagagctctggccccagctcatgatgcaaggttgtgtagaacacagcagagcacctacttccctgtggggctgccattgccagttaaaaaaacaacaacagaccacccagacatttccataagaggctgcgttctcgctagatcttttttaattatttatttaaactagatcactactcacatttgctcttcactttatcaatcaatattttatcattccatacccttcccgacatgcaccggtccacgttccaaaggcatcttcaaccaagtcccagagctcctgctatacaatcagccagacttggaccttagtctcctcaggccaaggcctcatctgggcttcactgaaactggaattcttaagcccaaaagtactatgttttcaatttccacccccaccccacccccattcctgtctaatctggctgtcccctcctcacagcaaagttctctgaaattatttctataaatcgtctgcactttctcgcctctagattgtttttccccacaaagctacagtgtctctcagttcagtgtctttcataagattctatcttttaatatttccaccctatcacaccatacagctaaaccaccaaagcatgccaacatccaaggcagatccgaagactacagtatccatggctgcatcacaatagccaacaatgtcttcatttcaaaagcaattgtgtcctttctgctcttcccaactgttctttttagcccagtgaacaactctcaaagcatgatgtacagagattaagttggaaccaacgcagtgtcgctcccagacttatcacgcactagcctcccatcgcgctcatgccgagacgcctgtgcttcataaagttcacatctgaccactgggttttgctttctaccattttaaagtcccgttcttacattacactgccaacttcatttacaagttccaaacaaccgcctacaattatgttaatctttatcccaacttcttccataccatgtttgcattctactatttctcttaatagaatgtgagctttctggtggaaggaacacgtatgtttatggttggttcttctgtactctcttggggcctggacagatggagactagtgaatagttcattaattaaatgattaattcactgatggaataaaaacaaaacaaatgaaagaaaagacaaagactgtgcccactaaccctctatattatttgatgcaaaactgagaaaaatgtctgcatgtaggggcctggcacaaactgaacacaggaatcttctctccatacaccatacaaatagtatgtcatgatggctgtgctttattaagggcagaaaaacaatacatggactattaaatagcagaacagaacaatgtagaagagtataacttttatacttctctcaatgtgaacagcgtaaacaaaagaaacagactgaaaaccaaaggtgactattgaggaaagaaattgccttccaagaggaaagtccagctgactgatgcaaacctctggctctcataatagtaaatcagcaagaaggaaaaagctaactgcacttcccatcaaagtccattgactgagcatgacagtcgctaattttatgagctcagtggttgagcctggccaaagggtaggcaaaagcggtaatcctgatatgatgtctttcattggccactcttaaaaggttttgagccaatacctttttgtattgaaaaggtattgaaaaggggcccatgctgaagaatatacgctttttgcttaatctacagagacaataagcaaacacgacagagaaaggaaaacaaaacggaagcttggagacacgcgacaaaattcactgtgaaaactactacggtccaggaactaccaaattcagtccatttatttcagagtctcctaggtcccaggctgccccaaactcctggtgccacggaggatgtccttgaactcctgatcccactgcccacatctcttgagtgctgagattacaggcaattgttactataccctgtttatgcaggatttgagaattgaacctcaagacaagccatctacaatggagctatacgcccagtcctcaggctcagtcatcagtggacacaaaacttctgtcagtccatgtaaatatacccagtccatgagtaccaatgaataaagacagtcttatataaaaagaaaataaagttatttcactcatcagtttgaatcgtttgcatggcactcaatcaaaccatagtcctttaagttttatattcttttcttgccaggatggctagatctgtgctttagcacaagacacttgaatacaacatggattaagcaagtgtggtgatttcactaagtaagataattggatttttttaaaagaagtttcatctactaataaagactgagtgcaactctaatgcattcattaaagcagataatccaacactttaccatcaggatcagtagaaaccattcagaatgacaaacaagtctgcatatcagtcccgtggaagacatgacagcgatgatgttaatttgggtgcacttttgtggagcacagaccaggaaccaagaacgtttatatatgacttttgatctcacagtaggcctacccatcagccatgccctccgctttaaaggaaaagctgagacccagcgagatgaaataacttgctcaaggttcacactggacttgctctacctctaccatcctggaagtgccttccttataataggcatgtgtggtgataggacaagagaaagtccatagttaattagtgacttgtgagaaaccatagcatatagtcatgggatctgatttcctttataatccttcagaacagatcattctatttctatacatacacatacatatatacatccatactcatagacaggcatacattatttatatatgtatgtatatgtatatgtgtatgtgtatatatatacatatatatatatagtgttattttatctatatagagcaaaaataaaggactaaacaaccattcacatccaaatcaggcatccacgctccaaaacttgctataaattgagtattactaaccctgacacctgaaatgctctgaaatctaaaattgatttcagtactgacatgatgctgcggtggaaatttctgtttcatttactaaacatgttatataaattgccttctggttatatgtttaaaatatacatgactttttattagttaattaattacagtgctggcatggtacaaggcttcacacatgctacaatttcccaacttacacagtatgttgaaaacagaataaatttcatgtttagatttgagcatcatcttctatatctttcatcatgtgcctgtaaatatctgcaagtccaaaccacttcttgtcccaagcatttcagataaagaatattcaacttgtgcacacatatcttgactatcaaaatttgcagtaagtaattatctaactggcattaaaaaaggaaagcaaagatctaagaatttctatacatttctctatattacagatcatcttccagaaggtttagggaagcaatcaagcagactaatactcgtgctgctaggaggaagtcattcccactgcataaagactataattaaggcactcacattaaagggcagctgtctgttatcagggctgcttggggcttatacactgtagataagggaatgaggacctttaactatgaatggtcaatttcaattcataccaaacatctcccctgaaagctcatattaaactttatgaatcacagccactaacaacattactgtgtatgcaagtgtgataccccttcacctgtgcacaattctgctgacaatgatgtatattcagagtatattcagagatgatgtgaagtaagaggaagtgatgataaaggcctggcgggggccatcagagttggcacagtggccatgtgctagagcttgctctattctattattcacggaagctcccgtatctttaatctgatctgttctccatacacagtacagagaagcaccagtaaatagaaccgcagatctgagaagcaagagcacacagcgagcattcaccagcaatagctgacattctgataacaaagaagaaaaattaaactcttggtaaaggaagtaagagcctggctgtgtaggcaaaaaggcaaaaatccaaattccagctatgcttgatgagctgtgtgactctggggaactctctgctgcctctgagcttccatttacaaccaatgcaatgctgaggaagatgcgtcctgtctcttaaggctgtgggcgaactacaggagagctgtgtcaagtgcctaccacagttagaaacagtgagaagtcactcagatccacactggaaaaccacagcagacactcacaggagacagcagctgattaagtttgtcttccatgtttcagaattcagagcatggatagtgttaccggcttttggtcttaagaaattgtcgtttgctttctatgtcactaagcttgacagtgttaggctagcccaagtggtctcaaaggagttgcttagtagatctacccccagagtggtggtagaaaaactcactcctttttctgtctaactaaaaagcttaagtgcatagaatggaaacagactcacagaatactccattattaataaagcttcaaagattatacaggaagatcccaagtttaatcccactctgagctactttgcaagttcagctacattagtaagactctgctgtgcccccagaataattcatttactaattaattaaaatttcagtggaaggagttttaaaagcttcctgtggaagataatttaaaaagtggagaagtattggtctaaagtctgtctttataagaacaatgtcaaaaacacaaaagaaggttaatataatctcacaccttgcttaagaaaggaaggaatggtttatatattcccaagagatgtctatttaggatagttaaagatttgaaagacacacagtttcaatatagaagctgtggctgtcactcaggaaggattctgtgagccaaggttttgttgtattttcctaaccgcataaagaacaatatgacctaaatcatgtctgaatattaataggaattctcattactaaaacaactcagaaacagaataaagtgaagcacgtgttttcactacgacaaaactggggctctgtggctacctcaacgctgataaatgagagatctccttgggatataatttgtctttaattgcctcgtccgtctaacttaactgcagccatggactgtcttagagtatttacaaagaaaagcctcaatgttgctaagaaaaagcagactgttcattccagcgagtgctcaactttttggaattgcttacaaaaaaaaaaaaccaaagccatgtttcttacacatgtaatttctggaaatggatgaagcagttttaagatatatctctgtggtttttaatgcatttccctccctatcttagttatgagatctacacaaacaacatggcatgatacaagaacgctattctgctgaaactgccaagattgcagctatttacctttaacttttggcaaagctgtgtatttgttagggtctatggagaacctgagtaagcatctaacacgtaaacattctcatccttcaaggagttccagaaccttgttaaagaatctaactcacaaggctctccagaggtccaacctagtggtgtgctgcataaaggtgcattctcacaagcctcgcaccctgtagacaaaaagaaccaactcccttcgacaagagattctttggtctctatatgagtgcaatagcacccatggatacactcatgcatgagcacacgcatgttcatgtgcagatgtatacacgtacacatgttcacatgcacacacacccacacacacacaggcacacacacaatttaaaacacatctatacgcaaaaattcctctgtgttaagttaccattaaatttttggagttattttaacataaaatgttctggtagcaattttatccattacaaaataaatatgttttggtattaaaataattttcaagaaattgcacttagcataaaaaagaagccataatttcacttacatatgggcactaacagtaagctatataaatattttaactgatgatggacatacatggaatctggaaaaatgctaactgctgcccatgctttctcgatccctgcaagattaagtgagtgaaaccctctctgaaacacatatgttgttccaggtttttccatacataatgataagacaatgatggaaagaaaagataatgaattagccaaaactcggcacatagatgatttctgaggtcaggtggtagatccacagtgtctggtcctcatttgagagtatcccacccaaatatcatacgctatcacagtaacaattagtactaatattagcctgatgtagttacaactatctgtgctctcagagaactacaaaatgtattctaaataatacaaagaggcatagggaaaaaaataagaaaacttaaaataatactagcaaggtttatttttaaaaatacagtgttaaaacttcaagaagatataaaaatacacactctgcacaaaatatactgacatgaattttttcatcagaatttaaaagtagagaaaaataataagatacacttctaatatttgcctatttagcttgtttccatgggaaagcgaaggaaattggatgctcgggaaggagatgcacatgtccccacccaggcttacctttgtttgagattgacccatgatgttttcaagtactccgtggtttcttccacattccttgtgtcatcgccactgtattcttccagaagtttctgcaggacattatcaaacgccatgatgacaccatcgccagaccccagctcttgaagcaatagctaaggtgtaaattgaaacacagttagaactggtcactcagtaactattactaccacccctggttactcaataactagtactacccacccatggtcactcaataactactactacctacccatggccactcaataactaaaactacctacccatggctactcagtaactaggactacccaactctcatagtcctgaaaagatttagcacattttagacacagaaatcataagaaggaagcaagaggacaaactctcaagtttaaatcagaacaatcaaaccagagtaattctagaaatagcaaaaagagagcttttccaccatggtagtctgaagtcccaggcagtttcgggaggtggacaccctcttctgacctctatagccacctgcactcttgcatgacacacatatacacatgctttaaaatataataaaaatacttgtttaaaagagaacatgcctgaggaatcaggtgcctagtaggtgagagtaaaatattacccattgagatttctggcctcctcaaaccctcgtattcctggaatgcccttgtcattctttttgctgtgtagctaattctcacagaacatgaatcatatcaacataaactgagttcttgtgtatacatttagagacacgtcggaagattaccctggtggaaaccctctgccctttaactccgaatcagtctgagtgtttgcaaagataacagctggaatggatcaggcagccaatgaagatttgttcagcattctatctacacagatgctcagtgtatcacaggcacaatccccttcacaggttctcaacccagggaggttaagcggggtgtgtgtgtgtgtgtgtgtgtgtgtgtgtgtgtgtgtgtcaatcaagaaggacacttgtgtcacttgtatctgtaatgtttttgtagcaattgtgaaagaaaaatccaccttaaggcttcagaaagaacatacacactgttcattagagcagcagagaatctgtgtctagtacttgtgaaagactgctcccaaacctttccattccacagataccaaattcacacacatcccctagagaaaatggcatagtgtttgcacaataagacgtgcacgccctccagtgcactttaagtctcctgtgggttacttgcagtgcttaaaacagtggttctcaacctgtgggtcgcgacccctcagaagtcaaactatcttctcaccagggtcacatatcaaatatcctgtatatcgggtatttacattactgttcataacagtagcaaagtttcagttatgaagtagcaagaacaataattaaattgttgggggtcaccataacataaggagctgggctaaaggatcacagcacgaggaaggctgggaagaactggcttaaaatgacatcaatactcataattagttgtcctactgtgtggtcacgggataatggcaagctaacagaaaatccatgtgttcattttaaaatctgtagacatggatgctacagatgggaaggccaagtgcattctgggtatgaagatggaagcactggtgaacattgctgatcaggtttttctagtcatgtgtacaaaagcttcactcttacttcggggccatcgacaagcgtcataaacacatgggacaattcaggaactaacagacgtggccaggtggattttaaatgatacccatgagatgatagccacgagaagccctcgtgtgcagagatttaaggcattatttgcaggttctcagttttcttcccacattgttctagattactacattcttcctaaaagtacattttcatctcaggcaatcacaagggcaaatacaaagtatgtaaccacatgtccagcacaagaaaatttctgtgactacagaagtaatttttaaataacacactttaaacactgagtgttcaatattctcaccactattatgaaattggtcatgaaagctgttgctactgataaacatagaatagagaatgacactgaggtacgacttagcttgcacactacagaagtactcaaatggaagtctagaaaaattttatacattaaaataatctcagccgggcgtggtggcgcacgcctttaatcccagcactcgggaggcagaggcaggcggatttctgagttcgaggccaacctggtcgacaaagtgagttccaggacagccaggactacacagagaaaccctgtctcaaaaacaccaaaaaaaaaaaaaaaaaagaaaagaatctccctagacagaaaaagggtcaacaaatgaggattgccttgtagacgctaactatggctctactcacacaagtgcacgttcctgctcattgtgtctttagacatcttcccaaaataacaagaaccctgtgattaaattcccataaatctcaacatgtatgtctaagaacttgggaaaacgtgagagcccctaattatagttatcaatataaaacaagtaaatctatcaaatgactgcatcaaaaaactagccaatttgccttacttgattatcagaaacttgtttgctaagtgggtcccggcgggcctgctgcagcatgtagaagcgagcctcgtattttctcatgagctcttcagtctcttccctgtggtcgtcccactgcaggctgtccacaaccatgtcctccagctgctgccgccgcagctccacaccatgctgagtactctcccactgggtcttcagcttttccactggggagtgggagtaaaaagaaacctgttaaagtgaccaccacagaaggaaaagacctggttccaaatatgctataaatagatctagaaacagaaagagtggaagacgataaacatatcttaaaggaactctatgctcacctgccacaacattatgtacatagtataatgtattattatagtaagtaatgctatataatatgtacaggggttggagagatggctcgcaaatatgtacactgtgtaaaaaaatacattacacatcacaccattataggtatatgtagccaattctattggctcagcttcctgagtgctgagattattctacagtgctcagctcaccaatttttcttccttcagtgctgggctcaaatccaggacatttcacatatcaagtaaccactttacccctgaactacatacattgctcttctaaattgctttatttatgtaagttagtccttcctctgttccccagactagcctggaacttgcagctcccctgatgtggtatcccaagtagcttggctgacatccaggactgggctacctcaccacacatatttctaaaattgttcctgaacagcaaaaacttgaatacggcttatgttaaatacactagtcatgtaataacaaaaatatctactggatggatggatagatagatagatagaaaacaattccatagatagatagatagatagatagatagatagaaaacaattccctagttcctgtatttcacagaacctggtttgacaatgacacctaatggcagtctaggataggacgttaacaaaaagacaccgtctccttctgcctaacaatgacaatccctcaggcaaagaacactttttacatttgctctagtctagcgtgaggcctttctgactggcaatattttacatgttcaagttcaacagaaatactgagaatgaagaaattgcaagttctctgtacctataagttcacagtcataaaatttcatgctggctccccccccccccactcctgtaccatttctccttttctcagtcctgctttctctgtctctgtctctgtcttttgtccttcccttctctcttttccctctccaacactctctcctctcctgtcttttatccttatttttaaatcatagatctaaaaggagagagagagagagacctttcgaaatttacactttggttcattatcacaaggaaagttcacagctgtgggctgaaataccaggaaataatagttctccatatcagcccatgaatggcaaacacaaggctcagtgacatctggaggctgaacaacctcaaaggtacagaagaacgagcccaagaagaacttaactacaagacaaactccagccaggaatctggagttgctgctcctgcagaaagcccaagttggggccccgacactatcacggaggttcacagcgatccgttactccagttctaggagatcgaatgccctgatctgttctccatgggcacctgcatgcatgtggttcacatatttcaatgccatacagacttagaagcaggcgaaacactcacacacgtacagtttttgaaaactgaaaagattgggtttagttacaatgtaacattctggtaaaattcctaagattacatatggtcattgtaaatcatgaggctatcgacttggagttttttagaagtctgagagacttacatgtcataaattccattaaattgttcagtgagttataatttataaaaagtatccattgagatcctctgctgtatattgttttaataatgtaagaaaattactgaaagttttaactcaagggaagaaaagaccaaactatcatgatagtctaattctcagctaaatacttatggccaatttaactactgctacagttcattggtttgcacaaatacaagctgaagtatcgagtgacagcaaatatcattggcctatcataaaaaataaactgattatcctattcattataaatgataaacctgttactattagtgccacaggagctggtaagggctctttgcatacaataatgatgaagattaattagttggggagtggggaggacgaggggaggaagaagaggaggagaagacaaagaccagagacagaaataagtgataagggaagatattcaggagatagaaaccctgttgtcagagagagagggagagggagagggagagggagagggagagggagagggagagggagagggagagggagagggagagggagagggaggaaaggagggagggagagagagagacagaaagacagacaggtagacaaagacagacagagagagagacagagagagagagagagagagagagagagagagagagagagcacaagtgtgtgctagggttgcagctcaggcaagagtggtttcctagcgtgcccaagatcctaggctcagtcagcaacactgtctgggcttgatatagtgatctcagccagcagtccacctgctcaggaaaaaaaaataaagtcctgataagatgatcagaaagaaaaatgaaatgtggctagaaatggtctggtgctgtgaacagagaagatgtcctaccaagagagggaggaaagatgactccagagtgctccctcatatcggagtgctccatcataaaagatccatatttgatcaattatcaaaatcaggaagactaaaggatagtggctgtttaagtgaaaataaatcaacgccatctgtcactcaaagtccccaggctaactgtctccatcaggaaccactttgttccacttattttgaaagccaaacccatctattaagcctatagccgaatgctctcccttaagaaaaattcaactttattcgcctagtttacattctcacgtgtatttaactgagtccctcatggtctgccaagtgggaggaccagagaccaggaaggtgagtctgcatagcctgggaatgggaaagaagattaaagcagctatgggatccagaggaaactgatggggaaggaggctgtggcaagaactaaagatagaaaatgcagtccacaggggagcatgtgtgggtgggaaggactcacagagggagggacactttagctgctgagtaatctcaccccaggagaagaacaaaattgaggttgggcggggagaatatggataaaagttaatggctggaaatatcagggactttgaacagggatccggagcaggccaggtctgcaggggacaggggctgaggagaaagactatgatagccaccagacaccatcgttaagaatccagttccgcatgcgacacagatcctcagctccaacactaactccaaacagagactctggtttgttagtgttccacccattctttttattggctgtttaattttctttttaactgaggcatccccacatgaaagccgatcagaaagcaagtacgaagtgaattctcacggaagtttaagagatggtgacagccagtttccgtgagtaaggcacaatggcagaatggatttatgtgactatgagtttagctagcttattccattagatgccttaaaccaatatcccaatgttggccaggcatggtggtgtatgccattaatccccgcactcaggagacagaggcaggtgggcatttgtgacttccaggccaacctgatccacaaagcaagttcaagaacagccatggctctgttacacagagaaaccctgtctcaaaagaaaaaaaaaaaaaaaatagaaaaaattcttaaaataaaagaaaaaattattaaatgtataagagttcagaagggaggaataggtatgaaaagactttcaaaaacttgaagataaaaagagagaaaaaagtattttcttctaaaaataacatttatttctagtaggataatctctgaagacatttttgcgagtgttaagggaagtagctgatactataaaggacattttttttttttggagggggggaaggggttcaagacaggatttctctgtgtagccctgactgtcctggaactcactttatagaccaggctggcctcgaactcagaaatctacctgcctctacctcctgagtgctgggattaaaggtctgcgccaccacgccaggcaggacattttttttttaacttacatttttctgtgattgctgtcctcacatctgaactggaagctttgtttttcaaattttgggccaaggtaaatacacaatcaagctgaggatggcgttgttctaaatcagcctttgtgatctgcaaggagacaagttcaaagggattaatgcatcctgagataagcccctagctgtgtattgggtgtgtcttcttcctctaagaggcaatgaaacatcatcgatgtaacagaggaagaatatgtgatttggagtcagaggccttaggttcaaatctcaggtcttccataaccagaaatggcatctgccctctccattggctcccccagctcagttccatcaaatctaaggaaattaaatcaaggaactctcactataaatgctctcaaaacatcagcaatcttcgctactgactccttgtgtacctgttggacatcagatatgaatgcacatgtggatgccctacagtaatggttcccaacctgtaggctgcaatcctttggtaagcctccatctcccaacatatttacatggcaatttataacagtagcaaaattacagttatgaaaaacgatgttatggatggaactgtattaaaggggtccagcatgatgaagtttgagaaccactggtgtagaaagatgaaaacggcatgttagaaaagcaataattacaataactgcaaatgaatcaccttcataaaccacccttttttcatggactatgtgtcttagctgataaatacagtgagggctaagaattccaggaaaagtctattctaattctagaaccaataaataccaaaaagaattagaaaacacaattcacagttggtacaaacagtgtgccaaaagattggtccagccggctccctgcgggtaaactacttctctagacctcaatcactcctacaggagtaagtatttccaaatgaacgactcctactccagctctagatcccagagcttccgtttatgctgctgactttcttccctctgcacaacagactcaaagctaaatcactcagagggtcactggagctccgcttctcctcctcctcctccctctacttcctctacttcctctactggaaacagcatcgtctcagcccctcaggaagggctcctttccctgacttaagcatctcctgcctccgagccatcctcatcttctactaaagcaaagcattattatcaacagtccccagccacgaatcaggaaccagaaagaaacggccgagcacgcttgtctactgattgcagactcttacgtccacgaggctgtgaacagcttcgcatgcctcttctcaaagaactaagttaacttttccataaggggaaaacaaaaacaaaaacacttcttgcacaaatgccggctctaagtatttgatcaaccccaagcccctgcctcctgtcccctatgatagaacggtaaatatctcataaacccacctcctgatcccagggctactgaaacagcccctccttggcctgtctcctctaacatgtggctgacactcccctgggacatttattagaaactattttgtcagagaaaaccatctgcttgatatgcccatcttcccgacctcttaaaacaacagttctcaaccttcctaacactgcgaccctttaatacagttcctcgggttgtggtcacacacacatacacacacacacacacatacacacacaccccagccatgaaattatttttgttgctacttcaaagctgtaatttagctatcataatttgaattggaatgtattgttttccagtggtattaggcaaccccaaaagggtcagacgtacaggatgagaaccactggtttagaagttcaaagttcttggtgatatgggaatgaattggcacctaccataccagattgttatgatatagacaagacaatacatgtgaaagtaagaaaatgttcaacacacattaagcacttagatgctagcaatagctattattttgttatgcatatctatctaaaacattcttttcagccttactctatataacagataagctatagcctagcatatactaagtatggaaaaagaattttccaggttgctacttggtggtctctattctataagagaaaaaaaaaacatatcatcagaacacattcatttctaagatcagaaatgaaatgtactcattatgaaatctaagatgaaacataggcttagaaattattctatattgcattgcgcattaaatggaaaggtagcttacagttatgtggtgtccagcttcacagtatcaatactagagttttacactgagccttcagttctatttgatcaacctgcgctaactgaagaaaagcttgactctttggagttaaccctgaagggctacccagcagataaggaatatcggtaagcttgttttctctaaatttaggataaaccacagagacccaaggagagcgtagtgccctggcaaaacttcacattctgcacctactttcatccgggaaactgtcttattgatctctttcacgtcccccacagtgacaatgttggacttcagcatttggtcgatcaataccagccagtcagccagttctgtgatggttttatccaaatcagcaggaaccgagatttccaggccgccacgcagaggagcatctgatgcagatgatactagcaccaccttttggacgttgggatgagctgaaacaagagatgtagcaagttgaaaataatcaacaggaggcaatggttaagatatgtagtgagggcatgtgcatttgtgtactaagtaaatttccatttttctaggaaggtatttttatgttgaaatggcatagattgaaataaccacgtgtatttaatagccatagatccaatataacacagccctctcaaaattccatgcaatcaataatgcacatgcaatcaacattaacacaaaaaataaagcagtaaacaaagcaaatacacacacacacaaacacaaacacacacacacacagacacacacacacacacacacacaaacacaaacacacacacactgataaaattaaaagcattatttcattgagtcaggctactgtaaatataaagcaaatttatttctaatttttctgttcttttcatttaactttacagcatattcaccttttatttttatctcctgtttctttgcctctgtctgtttcacacactctctgagacacagagtctcaaagtgtagccctagctgacctggaactttctatgtagactgggctggcctcaaactcatagcgatccaaccttctctgcctcctgagttcagagattgaaagcccacactaccacacctggactgcatatctcattcttagctaactataatgtgaagatctgtataagaatttacacaaatagtcactgacttttacagcaccctttccttcagctacacattgagctgtacatgtacaaatctcctgaaatccattctttaccaaagagcttaaagggaaactctttttgagtatagtattttccacatttccagtttccaatttagtagagatttcccaaagagaaatcactgggtcagacaacatttttaaattcatgtatttaatctccttgccaaagggaattcacttctccaacaactagctaaacaccctgtatctacatcaacaggactccatctcagtacacacctgcctccattactgtaatggattaattactaataaaggtgttttcatgcttctgcaccgagtggtatagttagtatctgtattagtctggtttttgtttctttggaatctacttctttatcaatttggatgcctttgagatgaaagctatgctactgtctggcctgtttgttttctcctgtttcatttttgcaatgtgttatgtcctcccttcctctttctcctcctccctaagtccttctactttgtaattacttatatcttaacaaacttgaggaagtcaatttcattactctttctgagaggggctgtcctcctagggttttgctttatttattatatttattttatttattattgtttattattttattattgttcttacttattatttggtttattttttgaattattgtttcatttttatttatttatttatttgatttatttaattttatttactcctttctgtcagaggaatccacccttgtccttcacagtgagcagaaggatcttacatgtcctcccaaaggtattaaaatcaattcttgtcttctccaaagaactgataaatattttctttctctttgttttgtgcttggttttatttctgttacacgtatgagtgttttgtctggagattagatagatacagatacagatatagatattcacaacatgcgcatgcctgatgcccacaggggccagaagaggccacccaatccccagaaagatagatgtgagcggtcatgtgtatgttggggatgaattctgggtcttctggaaaagcagccaatgatatcagacactaagccacctctccaaccctttggttttgtttctgtctttgttcttggttttgtttctgtctttgttcttagttttgtttttgtttttcttttgtttctaagagaagttaacagttggtttcaatataagatgtagttaagacgaatactaaatctacctggcacctagcataaattcagtacaattctaataaaaaccccaacaggtatgcaggcagcttggcaaaatcacagatactaatttctagttgttcaataagaaagaaagggaccctcctcttcccccccaaaaaaatttataaaaatatttgtgtaaggagatatgccctacaattattgagttacacttttgaccaatgataactgtatcccaaaataataaatagatgaccaggagaggagaaccataaggcacagggacagaaagacctgacacagaagtggcattgtggaaggatgctaaagacttcactaccccgtaagcactgctgtctggcagctagtatggcaagatgatgccacggaatctgacctcatgtgcataaaggaaaatagacacctggagatgaaggcatgaaggggaaaaactatgactatcagattaagacgtagaagaatatctttatgagtcgagagcacaacacaaagacaggcaaacttgttaatgcaccattaaagctctaaacgtctaaggaaagcaccagagaccgatccgttcaaacatctctgaaagactaagaaaggaggtgattgctaggcacgtgaatttaattagtgagcaaaatgcttttattctttagagctctggacgaggcgacagataacctactacacagataacagggacagcagttcaacatgaaacatgaaagagaaagcactaattaaagcaaaatgttttgcaatcacaggtcagcaaagtgtgcaggtctcaggttggcaaagtgacagctgacaagcactggcctccctgtgcctcttccaagatatctggatgctggtaatagcaccaccaccaccatacttatttgctttaaatctcccccaggtatataatgacacatcacctgcaccatctttacagatgaaacccagaagcataaatgagaaggtagatatcatcttcaaagccagatacttaggttgtaaaaaggcaaaacaatgtcacttccttcattttcactttctcttgaaacatagtagattttaatattataaaaatatatattttaaaagcataatagattggttattgccaatttggggaggggggtttcgagatagggtttctctgtatagccctggctgtcctggaactcattttgtacaccaggcgggcctcgaactcagaaatccgcctgcctctgcctcccgagtgctgggattaaaggcgtgcgccaccatgcccagcctgtgccatttttaaacatacagataaacaaaaattttgtgaagttccctaggctaaatgaaagaaacattgtgtgacaccatttatacgagatagtcaagatggaccaatctgctgacatggctggcatgcacactgttggataccagacgctgagaatctgggggtcggagggaggagcagagagaagctactcaagcacaagaactctaacttgagaatagaaatattttggagctacatagaggtgaagcttgtacaacactgtcaatgaactaaatgtccttgaattatttattttaaaaatagatcattttacttttaatatgattttaaaagaagaaaaatattaaactaaaaagttgtgtaagggctggagagatggctcagaagttaaaagcacatattattcttgttagggacctaaattcagttcccaacatttatgtgggatatttcacaatggccattccaccccagctccagtggatctggcctctccaggcacctacactcatgtacaaacacagataaacacataatttcatcattttctacatttaaaattttttacttagaatttaaaattattcatttagatttttacattttgtgtttagacttaaaaaaaaaaaacaagaacactgtagaaggaaagtcatactgaaattggcttcaggtctcacacctgttttatggagggttgccttaaggaaaacaaactgcaaacctactgtaaagtggttttgctgttggtcttttataatctaaggatgtacataaactttttctactcctttgtcaatgttctaaaaaaggtaaacctctgcagctgtacttaataaagcaagctgtttctttatggtcatagaattgaagcaagatagacaaaaagacagacacatacatatatacatacataaatacatatgtacatacacagatacatagatatagatgatagatacatacatgcatgcataggcacatacatacatacatacatacatatgtacatgcacagatacattgacagatacatatagatgatagatacatacatacatgcacacatagacacatacatacatacaacagatacaaagacacatacatatatacataaatagatacatagatatagatgatagatacatacatgcatgcatacatagacacatatatacatacatgcatacatagacacatacaagacagatacatatagatgatacatacatacatacatgcatacagactcatatgcatacatacgacagatacagatatatacatacatgcatgcatgcatacatagatacatgcatacatacgacagatacacacacatacatacatacatacatacatacatacatagatgagagagaggaagagagatacatatatacaaatctcaattcaattgttctaaatataatcaagaaaaccaatcaggccacagggatttccaagacaaggtactgaggaaaataagtaatgcagaacacacactgggtcataagcaatgctgcaatatcaggaaggaaatacacattgtttttaaaggaaaagaagaagatataaagaagagaagaagaggtggaaatggacaaggtgagcccaggtaggaggcggcaggtgggaggcagagttgaggagaggaggagagatgaggggggcactgaaaaacagtgagaaagtcccaacctccagcctcagctggcaaagagacgtgggtggctggggttagtacagctaaggactacagacagcaagcagaatgtggtgggtaggagagtgagcaaggccatagtcccagtggctatatggtctacttgggacagaaacagaaggaaataaacaggaatcatgagaaaatatacaatgttccccataactaagggaataatatttgctaggacatggtttcccgggaaatgcagccttcgaaaccccacagtcaggggtttggaagggatcaaaattctatgatcaggatcaaattgtacacactaaacatgtgttgtcatggcaggttacacaagataacttgaaaaagtgcatctctccattaaattaactcagtattttccacctagcccctctttccttccttcaccaggacccatggccatccagatatatctttgactcggagaacaacaaatctttccccatgctaagcatccagtctggattcagattatgaacagcaatcacgtgatgtttttcagtaagttcttctaataggatgttcccactataagtttgtctgtgttgataaaaatgactcctaaagagcaaatgctttcttaccagccatcctcatctgtggggcagagcaggggtcttgggtgcgtgtcttcaggaggctaggcacttctctgcatacctgtagcatcaagccaaacacacaagagaaacaaacgatgattgtatcttcgaaacacagccactcttccatacgacagctcaatcaattttctttcagttcccaccctagcttgcatctccaccttcactatccactgtgatgttactaggacatggtttcctgggaaatgcagccttcaaaactccacgatcaggggtttggaagggatcaaaatcctatgatcaggatcaaattatacacactaagcatgtgtggtcgtggcaggttacctcccctgacagtaagcgcaaggatgccaaccagtcctcatgtgtgacacttgcaccactggagctgcccattcccctcacaactcaaatcctgtaaagacccagtgagtctgaccttcttcctgcctctcttaagtttccttcactgtccatcaagtgccattgctgtgcaggttaaacctttgacctttcttactcttcatttcctatatggatgcttcagaggctaaagaactcccccagtaatatatcttccactcagctttctgtctaatagatctttagacacatccaaacctcagttcacgatttctgtcttccaggaaactgcctttggtaagcttctcttgaaactctacctgattgttccatacactgagcccaccttccctacagtatagctatggggtctttctaacagaaatctgtttataaataaataatagctgtccatttccctcaaagtagtgaattcttctcaagatagagcccgaattctgtagagtggcacatttgctcaataaaccaggatctggtctctggagtgactgggcatctctcgggtgactgttttatgtataagtctattgtagaccacagatgcacttccctcacggtgtgtcctctagagccttccacttgctgtacttccccgtcaaagcctgttacttcatccctcacctaagcagtgaagcttttataacttaggctagataagatcttctcccacaggccttccttgatcactcgaaagtatataagtgtcccctgaatgttccttgcttccaatttttaattattgatctctttgtcttatccatgtcaaaccaactgggtgataaaaaatttcctatagtccttaaaatggggccttgcatgaaccaggggtgtagtgaaatctgctaagtatataaaagaattgaaggaataaaatattccagagtagcagttcctaacatgattccccacacaagaagcattttttttttgccttagatgtcataattacccaaagtgggcaatactaaaacctatgttaatttaattccagcagtaatagaagcttcaatgctgcctatcatggtgttccccaactggccacaataccctttaatctataataccaagcaaaaccctctgtgttccataaaaatgtatgctctggatgaatacgtgcaaatggatttggcaagtgacatgggagccaatatgtccagagtggagagcagaagagagagcatcagataaactcagagagagcagctaggcagggtgagaggccttataaatcacacggaggacaattggcttttactctcagtaagacggaaagtcgttagtggacattgttcagagagttactggatctcacttacatcttaacaaagctttggctgctgtgctctgacaatgagaaagggtggcagaagagaccaggaaggagggctttcccagagatgacggtggcttgggataagcaatacaaaggagcggtgaagtccaatttatgccattatttttctaacataaagaaaactgaaataactgtgcagaaacattcgtgcacaaccaatattctacacatcaaaaatttgccctcatctgccttatcacatatagctgcctactatcaaactatccatcaagtccatggaaaaagccaatgacagggacatcaaagaattggggggtggcgggtgaatctgtctgtctgggtgtgtgtgtgtgtctggatgtgggtgtctgggtgtgtaagaaaaggaagaaatgtctctttattgagttataattcacatatataatttatgtgccattttaatgattcaggatttctgatttaggcaacaatagagacatacatgccattaattgaggaatgtgatatacactaaggcccaaagataaggtagaaatcaggagttcaattttgtaactgttgagacatctattagctcccaaagcagagacattgaacattcaagtgccgaatacagagaaaggtctaggccagagatacagataacgagtgatcacttggacagtaactcatagtcacagaggctgggtctagaaagcacacataggttgttagatacagcataataccacttcattctcatagctcgtcttcctcctctttcctcttactctttccttcttgagataagatctcactatgtagcccaggttggctttgaagaaactctcctcctaccttagcctagtaaatgtcaaatgtcagagctactgatgcatgccaacacattcgccaggacttccagtttgatagaattgaaaagagagtcaagtgactggcagtcccgggtgggacacatccattccatgttcaaatagacaccatacatcgacccagtgggtactaagacaaaatgagaagaatcctatgatttcatctacctttaaccatttcctctgtgaaacaaagtaatcatataaggaaaataactcccatcttagtttaatttttgtcagatgttattaaattccacaggatcctaacaataaaaacatactaaaggaataaaaaaaatcaccaaaaataaacagatgtgggaaagtcttgttcaacatcaagaggctattttaaggtcttcattttcagactataattactggcattttactgctaaattccaatagacaatcatatgtggtatgtttgaaaatatacacatcccctagaacaaagaagtccatgtgaaataaaagatattctttgagaatacatgtgatagtggatgaatatatatagatatattgtgtgtgtgtgtgtgtgtgtgtgtgtgtatgtgtgtgtgtgtgtgtgtgtgtgtgtgtgtataattgtaaagtgctgaaaaaacacacatatgtcagacctgtatctgtacacttagagcaatagcaagagaacaatttaaccaaggactcagtaaataggggtcaacaagatggctcatctggtaagattgcttgcactaagccttacagccttagctcaatccctggaacccacatgagagaagagatcaattcccaaaagttgttcccttatgtgtggtactttctctatgtctctgtctgtttgcccccccccctttgcatgtgcatgtgtgcgcgcacaaacacacacacacacaaatacacacactccaaagcaagtataattctaaaagtcaatagacaagaggaacacgttacaggattcccacatgcacaccttggtccatgttgtgtttacattccttaaactttccgaaagtttctctctttcacgcaaactcagatttttgtctgaaagcatttccagttctgctctgttcagccacttaatgttttcagcttgaacttccgtctcttgggctaaatcctgaaacaaaaaacagccatggttagaaggttgttctgagggagagttactatacacaatatattctcttgggaaaatatccttatacattcaggactcaggcatcttaaatggaaagtcagcttaccgaaattgttaacacactctcactgatagagcatgaatgtacattcctgtgtatgtgtctgaatatacatgcacaaacacatactcttttttattattcttaaccaagtgtatatattggtggaagggctctacacttgagttcacagtcttgagagggcatcagattacttgaagctctagttacaggcagttccaagctgcctgcctgacatggggcctctgaaagagcagttagtgctctggcctgctgggccatcgctctaggaccagcaccacttcaccaggcgcacactatgtttacattgttaagatacatcatgatcaccactaaatttcttcatcttaacatgctgtcctaccctttgtaaattttccaaatactttataaacaggatatttgaagaaaattcttgactctttacataaagaaggaatatcctcatacttcaaaaaaaaaatttaatgaacaattcccacgtttcccatcatcactaaaagtttctttctcaagatactttaaccatacatctctatgacaaaaccacttctcaaataagttgaatacttttttgaacatagttttacatgtgaatgtgtgtgtatgtgtgtaatcacattcaaatacaatttttatgttattttaaatttgagtgtgtatgtgtaattacattcaaatacaatttttatgttattattttaaatgtgagtgtgtgtatgtatatgtatatatattaacacattcaagtacaatttttatgttattattttaaatgtgagtgtgtgtgtgtgtgtgtgtgtgtgcgcgcgcacacacacatgtggaggtcaaaggacaaatttggggagtcagttccctcctttcgccttacttaagtgggatttctctcgtaccgagtacccagactagctggccctcatgtatctaagtaattctcctgtctctacctagcacctgtctgcaaaaaggctggcactccagaggcacaccgtcatatctaaatttttttaccactggttgggtgattgaaccaagttaccagatgaccacagtgagtgttttatctgatgagccatcttgccatgtctgtgacgctttcagaaaatggatcctgtccaacgttgtactattaatgtctcaattcttaatagagactacagatgctcatggacctgaatatttatggagatttggcatttagatatctatatatctttatatatttttatagattgtgtgtctgtgtacacatgtgcatgcatgtgcacagatgcacaaccattaaaaatccctgttggctacaaatcaacaagaaactctgattgctgaactgtaactctaagcctgcttcaagctgcaaggcgctaactgcacaacacccaggattttcttgtaagtcaccacacagttaccttttcaatacaaaggcagaaactattcttcatggctgcattgtgttctaagtcactttaagatagtctacatcttttaataaaacatcaaggtcagggttactaatcttttgtttgatctctgcatgaccaaaatagtataaaataatgggaaaaaaaatcccaactctttcaaatttaccatacttatcataaagaacaaagttgtacttccctctcaatttcagtcaaaacgatcttatttcccaagttcattagatcctgcattcgaaggctctggaaagctacaaactccttactgttaattcctgtgggctttcttccgggtcaggggttgatctcttctgcacagcactctccactttcgttaaccagcaggtgacctcatctagccgtctcttataccccaacacctgctgactttctccttttagcctaaaagaacacagtagggaaaatattgacagaaattactgagtaagcaaaacaatatatttgttttagaaaacttgctccccatagccccagtagaaataatttctaataatgatattaaatatgtagtttttaaattaacattaataatcatgcatacagagtaccatactaaaaattacatataggactaaagggattttttccccttaattaaattcagacacactgagaagtcttatcttctcatcataaaaattaaatggcaagttaatatgaaaatgtttaagttagctattgctgtataatacagttaacgaacagtgaacatgtccttgtgtaaaataaggaaaaaggaataattatctgagttctccatggagacagaaagacatcattgtgtagccttggcagtcctggaactcactctgttgaccaggctggccttgaactcagaaatctgcctgccactgcctcccaagtgctaggattaaaggcgtgcgccaccaacgcagatacaacaagatagcagtatttgtccattctacccatataacagcaaaaatatgagtactgagaatcgaaatcttctacaaacatatatgcttgattagttcattaaaataaggataacatatgcataggatgtcatattgcataaaggagatgaagggaaaaaaatccagccaaggtccaaaagataaatgtaggccacaggatgactatgacatcagaatcccccagttagaacttcctaacagtataagaagaacacctagggataccagccatctgccagacaatgaagtgtgatcagaacccagatgacaaataagattgcagatttaagagagagagacagagagagagagacagagagagagagagagagtttgaaagctgttaagatcttagtgggatcatgacttttaagctactgcaactagacgctgattgaaaactgagtgtgacactttaataaattacactgtgccatccctaatggaaattaatggtctcatgccacctcctatattttaaccataaaaagcataatacaatataatacatacaacaaaatatgcatgtaatatgtattacgtcaatatgctaatatgtgatattatatgttaatgttacatagtactaacagtcataatggaaaggtataatatttaactatttaaacctaataaaaattgcttaaaatgtaacttattttttaaaaagtaaaagaagaaaaaaaagaagatgcactttgaaattaaaaaaaaaatgaagcaatgatggcggtagtagaaattataataaaatgtaatttaaaaataatctaacaactttagaaacactccataatacttgtatagttcttttctttcagatatattgaaaattaaattgccagtgtttcataatcatgactactttcatgctctaaaactagaactataaaagaaactaatattaccaagtaattttcatctgtaaaccagctaaatataatgtacactttgctattcttaagagtagaaacaattctaggataagaattgcttattaaggaatgacaccataaactgtaaatgtgcaaatatttacctgcaggtactgaatacacagagaaatgaagcagtgtggtaactgtcaatgaccctgaacctctggggcttccaaagtgaccccaatacacacaggttagagaaacagtgaagttcactacgaatttctgaaaaccaatattgttttagtgaatatacaagaagctaagaagaaactcattactgcattcacttccaaaagcttgagtaaagtgtgggtcgaggtcatcctgtaggttggggaagaatggcttccacactccacagaaacccacttgaaaattgaggggtatttctgcagctgttaatatcttgccagcagcaggtttgtttattttttcttttttaagaagacataaatagccacttatcattatgttattatataagttaataattttattattgatataattattaattggttgctattttattattaagtatgtactgtttattatatgatatatgaattgattgacaatagtagtagtggtaaaattactattaatattaatgcattactataacaataatctgattaattgttgtaggaaaggatgatccatgaattccttcccttgtgatatcgagtcctcctatcttgtctcctcatctgcccatctctctcacacagccctgggtgtggtactcacaaagcccagttctacatcttctctcaagaaggtttccagtttcgtctgaaatctcctagaggcccctgaggctactgggcagtggtggcaattttataaaacctgatggcagtcttcagcacatggggcctgtgaccttgaaggagaagctgacacaggaacctcagtcgccttttccctctcctgcttcctggccatgaagcaagctgtctgctctagcaggcaccccaaccacaatgtcccagagaagggccaaagctgtggggctaaacactcacagactggcacccgtacaactgagaaccaaaataaacattctctctttataagctaatcatcttgattatgcattattgctgcagaaagctagctgccacaaaggctcaccctagaaagaatgtacagaaaattgctataaatgcctcgaaactcagcttcagcatccctcttcatcagtacccaattccatagctcatctttcctgcctctgtgtcaacatcttcatgtggatgtttcccttgatcacgcttttttcctttctacttcatcttttcagtctgagttcatagtaacatctgaatgctcagtgcgagagaatattgataaagctgattacattaattgactattagcaatacacagcaacaacacgctgggagaatatgttcgagaaaggattataagaaatggatattttaaatgttcgccataaaaagttaagacatacacatttttcaaatacagtctcatttaaccctcaagcaactgtctgacattatagctttcttttgtagaaaggaaacagtgaccataagtgctgtggtgggtgaccagcacaatgcattaaccctaagggtacaagagtgcaacaatacctttatgcaactaatagctctctaactgggcataaagcccattcagaaaaaatggaaactatgcctgatactggaaacctatccagctatccaaggttagtgaagccatggaacttggatgtgctcttacaaccgccacttgcctaaatcaacataattcataagtacaatctaaatatttaacttcttccaacccagataagtataattctgatccctcatcaaagaaacctctctttgcaacagggaccatttcacacgggtgctggaggtctaagcaaggctctctgtgcttgcgtggcaagcactttattgactgagccatcaccctggccccaaagaaagttttatacataggaaatctgaacagaacagtaagatttacaagacagcctaaaaactgtcctaagtaacatgaacagtgaagcctcaaatgccactaatatttttatcatggtattagatcagcttctatgtagtttacatgaaatcttcgcccctctgctcaaaacattcagagctgagtcatcacctgggctgcaaagcctccacctcagctacaagagtgctccagcgctggttgaaacctgccagcttctccttcaggaagcttgcctccgaggggcggagtctctgaacaaggtcctccccctttcggttaaccttgatcaggctgggctggtggctgctgaggccctcttccagttcctatgacagatgacacattatgaatttctaccactcaatcaagctgttcagataccttcagtgtacccaagtttttaagcatcaatctaacacctacagaaacaaattcggggtagggctataatgtcttttcaaagaatttaaaattgcatttccagggacatgtggataccacatacacacaaatatttggtcaataaaatttttatgtccagccatttataataaaaaatcctcaatgtgcattttactgagatgctgcctctgtctgtaaaaattttaaagtcacagattaaggtctacttcaaagtcaagtctaaatacttacctgtaactcaaactttcacacacacacccaaaaaaaaccgcagcaccatgtctgcaagtgagggggaggcattgttttcgacgccccatgaactgtctagagaaaatacattttgaaaatgtactaaaacaagaaatacatttgacaatggacatctgagcttctgcttgctccatttctccctttagtgacctattgtgctggcaggctgactgctgggtgctacatagtctcgaggctgagtcctacaagaggctggctttgtccataaagaacagcatcctctcatgacaataatcaatgattttttaaaaaaggaaaaagaaataaccgggatgcctaggtgttaggggtacaaagcagaggtgacattgaatatacacatacttttctgtctttcatatagtcttagatataattttttgtgttagtatgaatataaaatctcctgaggagaaatatatcttaaaatatttttaaaaataactatctctcacattaacaacctaagagtgccttatccttttaaaaacttctttaaaatctggattataaattgtatgatgggggccaggaaagtggacaggttaggggaggggaagggaagaggggaacctgatctggtattgggtgagggaaaaagattgaggaccagcagaaagaatggaaacaggcaacctcaggaaataggaggttgggaagacactcccccccccccccaataatgcaccagagacctgagaggtgagaaactcccagcactcaaagggagggaccttagatgaatcggccaacagtagagagagggaacttatagagtccacctccaaaaggaagacagggcatcaaatgagggagagggttgccaacccacagtcacatctctgacccataattgttcctgtctgaaagaattacagggatggaaatggagaggagcctgaggaaaagaaggtccagtgacaggcccaaggtgtgattcaggtcaaggggaggccccaaggcctgacactattactgagtctctggaatgctcacaaaaagggatctatcatgactgccctccaaaagacccaacaagcagctgaaagagtcagatgcagatatttgcacccaaccaatggacagaagcagctgacccctgttgttgaactagggaaggctgagagaagctgaggaaaagggtgaccctgtaggaagaccatcagtctcaattaacgtggacccaagatctctcaaacactggaccaccaaacagaagcatatatcagctgatatgaggcccccaacacacatacagtagaggactgcagggattccttcattcagagatgatgcacctacccctcaagagactggaggccccaaggagtttagaggtcaggtggggtgggagggtagggacatccaggtggacacggtgtggggtggggaggagatgtgggatgtggagcagtcggagggtggatgaagggcagggaatggaatatggaatgtaaaaaataaattaaaaataaaataaaataataaataaataaataaattgtataatgaccagtgtttcttagaattttaaaactgggaactagatgtaggaaaaaatgtacagtggtaaaaattacaacaatctatgaagcatctgaccttcccgccctgcccctgcatgccctgcctcccccttcccaccccaccccccaaacacacacacacacacacacacacacacacacacacacacacacacacacacactctgcccccaggatgggacacactcaccagctgctgtgccctggctttctccaggtccaggctaccatctggagcacaagtgtctaccagcaggtcttcagcttcagatagccactgtgtaaggtcatcaaggtcatggtggaactgcctccattcctccacagccctggcaaaggacctggagcacgagagacagactcagtggagcttcaagcttcacagagcaatccagaagtaacctctctttcaaacccatcctagtaataagtcaatcaaatctgatttaaaccgaagagtttaaatggaatgtgttatgtcaaaaaggtttttgctttctctgacttacacagccacttttgattaattgtaggcatgttaatccatccaaatttatacccttaccgtttaagtatagtgaaacagaaacacatgattaactacctctattctcttcgaaagtatgtggtttcagtgatagaaggcttcaattcaagttgaaacaaagtaaaaacaagttaaaacgaaggccaaaaaagagtaactgttctggaacattgaagggaaattttacaaattacaaataaaaatatagcatttagttaaaatgaatggtgcatcaaagcataattagcaccactaaattaatacacaataacataactttaaattatgacattttttgctaactataaggacaatgaaaacttatggggagacattggtcatttctttaagaacaatgaggcaaattagagctggtaaatatttatctagagatgcacaaaaagttgcttaagggtttttggaaagtagaggtgcatgcacagactcatggtactgaagctgtggtacaaaggctcctgagctgggccctgaacagaggtcataccaaaatcaaaaccaagcaactaagattgtttccaaaccatacattattatttcctcagacacagcaaatgtaaggaatggatatgtaagttttgttaactgtatacaatcataaaggaaacaactataagatataatttcataaaactaagttggctctacgtcaaagggtacaggccattttgagtgacatacaaaaggctgtaaatactcacaaataaacaaaaatatacataaataatatcttccagttagaaaaacaattttaaacagtaagtattactcccttggtttcaaagatgagccattactgggcacaaagaaacttcaagtcccattgagagcacagtaaagaaagacaacaatgaagctatcactgtaatattggagaaatattcctgccaataatagccaggcttctaaaggaagggtgagtttataaatatccctggcagggtacagtagccaagttcatgttataatacaaatcgagtttcaacatcttgcttttttaattgtcttcatgtaataaccaagtgctgtgatttgaatgtgaaatgtcacccataggctcgtgtgttagaacacatagtcaccagcaggtggcgctgtttggagaatctttagaagacagagcctcactggaagaagcacatagcttggtggaggctttcaggttttattttatcctactttctgttctctctacacttcctgattgctgatgaaatgtgaccagccaacctccttctcctgtgatcatgtcttgcctgttatgcgaagtgtgtgtcctgaaaccataaaccaaaacaacccttcctttttaaggtgctttgatcaacatttgtgtcaccaatgaagaaagtaactactataccagttctaacaaacaaacaaacaacaacaacaaaaatacacacacacacacatatacacacacatatatataaatgtacaaaagaatgttcactaactacacaaagagaccatattataaatttacatagcaacaaagatcattaaggcatacttcttcactgattaaacagtcacatgaattaaaaaaattttaaccatatgattccttgctttcgtatctgaatacttgcaatgtattgctctatagtaaattctccattacatgttatttttgttgttgttgttgttgggctatttcatgttgtatttgcatttaactacattcacagctactgggggggggggggggatcacactcatttttctttactcctattcacaggtccctgttcgaagtctaaaaacaacaggaaaaaaaaaaaaaaaaactccgaaacatcctatgaagcagaaggttatagagcagaaaaaccgggaagaacgggcctgtggttatatatgaattccaattacctgaagctgcttctgttcctcattcacattaatcatgccgtgtgggagaaaggaacattaataaaatcctttctaattaaaagggagaattatttttaagctaaaaactaaaggtgcccccatatcattaaggtattatgtgcttaatggctgtgtgcctgtggacacatttctctttaaggaatgaagctcatctctatttattaatcatgtcatattagaaatacatgaaaaatggtttccatgatcctaatgcacacttggactctgtcaacgctgcatggcctggtactcgtgtgacttagagataactattcacttagttcacacctaccctctccgatcactgtacactctattcactcggtcccattttgcattcagctgagcgagcatgtccctgatctgaatggcctcagggccagaggcttccacgatgacatccggctgcttctcgtgaacaactgcaatctgctctccaagtctgtccagttgacctttgatactctgcaaacgcatcattgtacaaaacaccagaaccacagataaagagttacatgtatgacactcatttaaagtaatagtggggctaattactgttctgtgtgcaaatgaggggattctatttttttcaatttatttcttcactttacatcctaattgcattcacccctcctcctggtgacccttgcatggctactttcctcaatcccactcccattcttttctgagaagggggatgccccacctgggtatccccccaccctggtacatcaagtcactgcaggactaggtgcatcttctcccactgaggtcagacaattgtcaaaccaagctgcacatctgtaacatttgggggtggggggtaggtccagcctgtgcttgctctttgtttgatggttcggtctctgggagcccccaagggtccaggttagttgccgctgttggttttcttatggacttttctatataaaaatctcagagtcaccaaaatgtgaggaataccatcacaatggcgaatgggaaggcaccctcctagatgtcctgaccggcttcaaggcaggatacaggaaaggtagctttactaacatactatgtaggtgaaaaaaaaaaaaaggagacacttctagaattatagttttaaatgcctaatcactgtagcttaaatgagaaaataaattattgaatctatcagaaataatacgacatctttatatagaagtacaatcaaatacatgggaaaaaactttcaaagaactcaaaatgttaacttgcaatcaatacgcaattccacaacggggcaactagccaatctcgaatcaatatggatgacctgacatcatttgacacaaatgacaatcgagtttacatcagattaaaattagatctctgctgttgcaaataaatgtgcattcataagagtccagacctagatgctttttaaattgaaaaaaaaaaatgctgcatcctaccagggaatacagtaaaatctcactatttatacactgttgttgctaatttggagtaatcaaagatttggattatctaaataagtacaagagcaacttccatctgagcacggcaatcatgcctgtaatctcagctctccacaggcaagaaaaggagggtgagcatccaattagcctggactatctaaggaagccctgtctttaaaaagatgaggggaaaggaaaaaagaaaagaagggagggaaggagggaaaaggttaaaacggaggaggaaagagagaaagagggagggaaggagagagggtaggaggaaagaagagagggagggaggggaggagggagagagggggagggaaaaggcaaaacaggaagagccggagattggccttgtttctgtactttttctattaacaatggcaacggacattccgcacttggatttttaccttcagagagtcttcctggaaagagaagtctttgtagacagtggtgtttagctccggcatattaagtgataattcaatgtcatccagagtgagtaaaattttattaatttcaaccaaataatctgcagggagggctgatgatgtaattccagaagaaactggaattgtttttctctgctggatagggattgtctattaaaagattcaaaaaaaatattaatgcaggtatgttaacccccccccatgaaagtaacaacaaattgggggtgggggggttgaagaatcccagaatgtcaaccaaagttgtaagaaacacaagtcaggtgattatgatcaaaacacactatgtacatgcacaaaatgtcacaatgaaaccattatcacacaattaataaatgctaataaaaataacattcaatataagttttcttcttttaaccttcattgctacagaaactccacaagctgcctcagctttcatcagcagtctgccactttcatgccaaaaggcaacctcaggaccaccacccacccactgaggaagggtctttcattggtctcatggctagagctcaccaattaggtgagactgcttggtctacagagccctgggatcctcctgtctgccactccagcactgggatcacagcactgtgccaccatgcttaacatttttacataaactgagactggagactgaactaagacagctcaggtcctcatacgtgtgagacacacacttcccagaccactatcctcagtccaaagcctaatcgttgtaagtcctgcttcctgtaatgaacaggaaaataggtgaggatggtaatgaagtttcctccatctacacagacgggctatttttttaagaggatagactaagaagggaaatggggaaagtggacgacaccaatggcaacttccattggatcgtacaacaaggcacgtgcagtcagagacagctggtagacagcaagccaaggcacaggactccactcagattccgaagtgatcaaataaaactcatttcaggaagaactaccaaaaaatagagctctggggaacagcatcacttaaaacaccacaaggatattactcttgccgtattttcaatgtctgcagatgcacagttgaaaaagaggaacaccgaggcttctgggacaacccctacctccaccctacccctaaaaaattaatagcctaagaaggtagccatcaaagagaagttttgaaagctgtgataaggatgctgaaatgtagctctccacaactgatggcttctggcaagggtggggaaggactcagtttccctttctcattgggactagaccatgcacaagtaagtttaacacaaaatggtctgagggtctttttcctccccttccctcccctctcttcctctcttcctctctccccccccccacttcctccccttgtctttgttttggtttttggtttgttttttttttttacatttaagggagcagacatgggaggactgggaagtgcgtgtgatcagagtgcatgatgggaaattcccaaataacctataatatacaccaggaataggatccaatcctaactccaaaaaataagcagtaattacttaaacttaaaaagacagtgagggggaaatatataatttccctaggtgatttgcttgaatattgcttgtgtctttaaatattacatccccagcctggatggtacaactgggtaagttatttctttgctgcggagaccacagcaacctaccttaattttgttgtaacgagtatgcaaaagtaacaactgcaagcggatcttttctttcttactgtcctccataggttcatgtaacaaatgctcccctctttgtagaacttcctcaatctgggcttgctcctcatccatctaaatatttaaagaaagaaaattactgaaaacaaaaatacacagacaaacttcgtactctccattgttcagtgttaagaactatgctgagacagacagggcagtgtgggtcaagccacatcggcctgaatgacacaactgctcttgattttcttcaaatactttatattggaaaatcaaatatcccaaagctaatttatcaaaacgtagctaatgattacagctagtcaggaaggagggggtggagctgctactaccactgtttcctctccttcttctcctcctgcccttcctctttctcctgttgctcttcatcatcatcatcatcaccaccaccattagtgtttgcttgtttgtttgtttgtttgtttgtttgtttgtttgtttgtttcttgtagcccaggctatcctcatacttgctctatcgctagagaagatcaggaactgggattcctcctgcatctgcctcccaatgttggggttagatgagcgttgtatgtgaacttcaagcattgcatgagttacctgacagcttcggcagtgactctcataaatcacatctggattacttcagttacatgtggtgggtcaagcaaatgaatccatattgttaaggagagaaaaaaaaaaaaaaaacgagggtagggtttgcagaccacctaccttctcatcgttattggggtccaagtgcttttccacaactttcaacatgttttctatgtcttgttctaagttttccaagtcagagaaagactcagcagcttgaacagttccagcagggtccaagccttggtaggatgaagggtcctgaccaatcagcatctagggaaggaaaagaggcttctgagagttgattttctaaaatcatcccgagaggcagggtcacagcagaaaccagcatttatctgaaatgacttcaaggtcattcatcacagagcaatgacttagggcaacctgggtgtactcgaactgctcatttttcaatctggagccaggaatgtaaagtgcattccgttccctgtggctgcttcgagcacagtagggcagctgccaaggtgaacatcctacagggccgtgatgtgaaccatccctgccacaagccatgaaagaaacaatggccagtcctcactccagggtgcaaggagaccctagagaacgcctcccatacatgcccaccaagaagaacaccccttgggtgttttaatgacagaacctcaaaaagatttgtatttccaaatgccacattttcacatctatagagaaaaacatcacatttgggaaaataaaagtaaaaatggccattttaataaaaataaatgaataaaacatccagcgtctatgaagaaggtagcagtctcacttcttaacctgcacagattttccactagcccctgctgaaagtgtttggaacggccctctacaccctctgcaacaactcaatggattctaaaatccgataccagcagaatagtaagagatgagccagcagatacgagtaagatgattttaacaaagacaacattcccaagggcccaatattcacaaagttaacctagcaaattataacagcccatagaacattactgttaaaatccatttcaagggagcatgtacagaatgctataattttttttttttttatattttggaatcatgcatcagtgagtaaaaattgttaagcaacagagtggtttgcaaaggtcatttgaggggcaatgctaattttctttattatttctcttagcaccgtcctttgcttagtttttaatgtcaaaaaaaaaaaaaaaccctcccatgaatctatttaaacaaataaaatggaattaagtcatacaataaggaggcaaagccaagattaaagaagacaaatgctcaaggaaggtctgactgtattgttttaagtcgtgaataattatatgctggggcatagaaaaaagtgtggctcactataccagatattttaagttaaaacaaagttaggtaaaacttacttcctgcacacatataaaacaaacgatcttttctctttgttatttcaatagataactgccaagaggttcaattgactacttctttaaagtgccaccagatgtgcacagatgagattatataaaacgctcagcatcctgtgatccctcagcatgggcatctcaggtccaccgctctccctctaagctgagaaaatgcttgcatcgtttccacctcacatttactcaagctccatctgtgctcggccttgagaactctacagtaaagcttgtctcctgcccccctctgaaaataaagaataacagagggggggatgggaaagatacaggggggctgaaaaaataatagagtagtacagacaccattttgtaatgacagctgttatttatgacccttcttttaattgataaagcgttttcaaattagcgaattcagaaaatttccctgtgaactacaaactgtgagtctataacttataacatttaaatctgtcaacatataaacacatacacacacatgtattttctataaacacatacattaaaaggatgcatttaggatcaggaattgataatcatgtgtcagttgggaaatgacttatttctattctctttctatcccgactgtcaactggctctgaagcctgtcctgggtgagttatttactaaacaatattttcttatatcaacaatcacacataagtaacagcagttgctttgccaaacagttattaaaattcatttacaaattaataggcttgaacaaaattatgtaccattatacataaaccatggggagaaatggcatcctatacaaatgcaagcactcactcgggcgctctttatgtgctgggacaccttttcaaagttcctgctcagctcggctaattttggttccacgagttccctgctggcgcttccacgagcattcaccaagatgatggcttgttcccgaacattctcaacctggaggctggcatcatccaattcagacagtaaacgctgatagtaaaaggagggagggagggggggagggaaggagggagggagagagagagaagaatattattccaagcacacaagatgcttactatgaattaaaggtatttgaaataaacatctgagattgctaggaagactctcagcaccagaggatgtggtggtcatagaaacccatggtgatcttggtttctcccaccaaaaagcaaactgcttgagaacaccacacacactgctgacagcacacggcacaagagaacagcaaattagcctgcgggactcatgaggctgactaccttcacaatttcttcctgtttactcgctggtttcttttcgatctcatccagcagagcttcggcttgatagagccaggtactgatgtgagcgacgtgtccatcaaatagctccagctggttttgatggttctgcaaaggaataagatggtgctgatgagctttaaatgaaatattaagatggcaatcttagtagagattgaagaggccatcaaagagcatgctgcatgtcacacaatcgtgtcaacaaagaacgaagtttgctacatactttcacttggtttgttttggtttggggttattttggagggaggggcgactgctttaaagttctgcagactgagcatagggcctcatacactgcgcaactgaatatgacctcaggcctcttcttactttttattttaaattatttaggctatccttgaatttactatatagcccaagaagaccttcaagttgtgatcctcctgcctcagtcatccaagcagcaggcttacaagcctgtgctaccaggtgtgactattctgaggggagaaggggtattgggttttgggggttttgtttttttggcgtttttgagacagagccttgctatgtaaattgacctttatcattagagactcttgttttggtctcttaaattctgggattacaggtatgtatcaccatggccagctttagctttacttttctctctacattggtatgtggtgatgtattatattacagaatttgcataaagttataacagtaatgagtcatggactagaatataaacctctgatcaatcaagacctaagcacatgagctcctctgccctgtatatcctaactgatttgaaaaaaaaaaaaatcccaaacagatcacttattcttatatctatgccaatccattactggggaaataactgagttaaagtcctatctgatgtgctagaataaagtaataacttataaattgtaactctcacttcagagataggggctgccatatgttaatcattggtagaagtagccaggaaacactatgaaagtggaatagttataattaaaagaaaataatagggtgtttaacatattgttatataataccactacacattttaagtcatttaattattataaaatcatacaaggtagaaatgataataacgcccattttgtagatgagaaaaagaaagaatagagtttgtaagtaacttcactgaggtagtagtcaagaattttacaggcagcaatgtctgggataaccctttatctgtgctagtatataactaagacactgtgaagactgtgtgtatataaatatacatttctacatacatgtgcatatgtatgtataaattatatattatgattatactagcaaatactcttatcattaaaacaaaactatgtttactaaaatattaagtaacatggcccctgtgtttggcatgaatatttgacttttatcagaggtgctgtaaattcttctttttggtatcttttcagtagaaaaataaaataataaacctaacgcacaagcgaagcaaagcagacacacacagagccctaacgagggccgcatgctttccaatgcagctacttagagaagacatccccagtggcaggcatgttctggcatcttaccagcaaggtgttgcaccagtcttcggtccacgtccgcactcggctccatccagcattgagcacacagaggttctcttccagaacagactcactgcccaagaccaagtgctgaagggcggcactgctctctgtaatgccatttaagtcaactttcctcttttccagatccttgagaatactctagaagaaaaaggaaaaagaaaaaaaaaaaaacccacttgactttcagaacacactaacatttacctaaccttatgtattgtggtttgttctttagcttttttttttccagcaataacgagtcaatggtttctagataacttgcaataccttaaaggtttataaaactcaactctctgacacattgcaactctcaagccataaaaaaaactgaaatggttaagtaggtgaatctgaaaagacataagaaattcagataggccttccttcttcttgagtttcatgtgtttttcaaattgtatcttgggtattctaagtttctgggctaatatccacttatcagtgagtgcatatcatgtgagtttttttgtgattgggttatctcactcaggatgatatcctccagatccatccatttgcctaataatttcataaatttattgtttttaatagatgagaagaccaaagtgtggatacttcattcctccttagaacggggaacaaaatacccatgaaggcagttacagagacaaagttttgagctgagacgtaaggacactaccccacctggggatccatcacataaacagccaccaaaccaagacactactgcatatcccagcaagattttgctgacaggaccctgatatagctgtctcttgtgaggctatgctagtgcctggcaaatatagaagtggatgctcacagtcatctattgaatggaacacaggaccctcaatggaggagctagagaaattacccaaggagctaaagggtctgcaaccctataggtggaacaacaatatgaactaaccagtaccccggagctcttgtctctagctgcatatgtatcaaaagatggcctagtcagccatcaatgggaggagaggcccttggtcttgtgaagatcatattctccagtacaggggaatgccagggtcaggaagcaggagtgggtgggttggggagcagggtgggggagggtataagggactttaggaacagcatttgaaatgtaaatgaagaaaatatttaattaaaaaaaagaaatattacacatgtcctgagacgtgagtgatgatactaatgctaaatattaaaaatggagagaaaaaaaaaagaaagaaattcagatgggaaatacagcttaagtaaatcaaaggagaaccaggaaaatagaagctttgaacatcagcttcatgccttgcagtgggaacactccaggagggaaaatggccccgggactcacacacacgtgaaggctcaccaggaaagtgcacattcacagaaattcaaatcatgctgaaaatgcaaactatcctgaaatgacatatggaaacacccgtggcccccttactcctcaactgttgttcctttttcaaaaagtacttttcatatttctgtttatttaagtgtacgtgtgtgagtttatttaagtgttcatgtgtgtatgtgtatgcccttgaggacagaggtgtgcgtgtgcccttgaggaccaccagatgttccagacctaaagttacacgctgatattgggtcctcaaaatgaaacactggtcttctgcaagagcagcaagtgctcttggccactgagccacctccctgtggtacgggttcttaaatcaacatttaaagaaatcacttcaaggaattcaagttcttatgtgaacactgctgaaaatcacatttctgaatggatacaaatcacaaacccacaagggagtcaaggctgaaacactgccttggtcatgacacttagagacgcatttgaaaggcagtcgggtatttcctgctcctactcttcccctaaatgagagaaaaagtctattacaaatgtactctgtgtagttcagactttctgcgctccttcagtggttctgtagtaactgactaaaattggctggaagaaccataaaaaataactacagacaagtaattaagtttaaataatacatacacaagtctggtgggttttatggtaaaaagtgtttaaaataatattgaatgtatggaataaatttcccacttacatccacaaataaaaacaccacttaaattctgcatttaaatattgcacataatatttaatttatgaaactaaaatatcttctaaatctttaatggttttaaatcttaagacatatcattgaaaaggtgggcaatcaccaaagagcatacatggcctagacctgggtacctgcatgtatgtagcagatgtacagcttgatcttcacgtgggtctcataacaacgggaggcggggctgtccctgactctgttgcctcctatggatcctgttcccctaactgagctgccttgtctggcctcagtgggagaggatgtgcctagtcctgcagtgacttgatgtgccacagtaggttagtacccagaggggcctcctccttctcagaggaaaagggtaggagaataagagaaggggttgagtgggggggggggggggtgctgcaatcaggatgtaaataaataaataaataaataaataaactgatagaaaaagaaaagtgggtggctatgctccacatcaacgttcctcccaccccactgagaggaaagtgctgggtgcttcctagatgccaccctaactatgtcagatctgtaaaacaattagttgggaattcaaaattatatatttcacaagcttaccactatttatagtctgtcttcaaaaatgatagttaacaaaaaaatggaacttatgagaccagaaaaaaaggatcatcaaatattagtatatacaactcaatctcacctatatattatatatgcacacatataaaagcaatcagtaaaaaaaggaaaatgcacatttatatggtaataaaacaaaataatataaaatagatgcattattcatatacacacacacacatatatatatacccacgcatatacacacaatgtttatacaggaaaaaattaagatattatgagggaaagtaaaagaactgaaaggtcaggaaagtgagacatagcattttaataaggactgaagcctgtcgtggtggtacgtgctagtaggatgtgctaaagaggctgaagcaagagaatcaccagggtgaggccagcctgggctgcacctagaggccagcctgggctgcacctagaggccagcctgggctacacctagaggccagcataatggctcagcagacaaaggcatttgctgttcaagtctgaaaatccaagttccatccctggaaagcacataaatatggaaagagaagaccaagttctaaaagttattctgtgaccttcacatctatgccctggcacaagtgagcctcactcatacattctctcacatacatgtgcacgcacacagacatgtatatacacaacaataacaaccaatatttgttttatttatttataaatgatttagcaaggctggcagggcactcgcatggcatgggccaggacctgggattaatctccagcccccacagaaacaaaaggcaaaatacataagttctcatctaacaagtctagagctttaaagtaaatccacacaaaagttattttacaaatatggggactatttctataaaagtacataagccacgaagagaatcataaagagaaggaccctctactgagaattaaaatagctaacggaatgactcactcagcagtttgggaactgggggagggtagaagaccagaattgtacaacagaaaacaacaatgatatattaactactgtgttagactagagaagaactcagaactcagaccgacaaacctgggagcatacgtttgttcttcggggagaagttcagagcctctctcctaatatagagcaaattagcctctaaggattaaacattaaagttgaagggatgagactacacaagatcatgaagaaattccacagaagctcagggtcacggcagcccttctgaaacggaaggcaccaataacaaggaactgagtattctgttctttaaaatcacacttaagtgtgtgttaaaaaaaataataaggacaggaagtgaaccgcaatgacaaagaaaggaatttcttaaatactacacaacacagcgagcattaataagtctgatgaagaaatcaaaattagcagtttaatctggttatttaaaaatggtcaaaactacaggaaaaatatttttcaaataggggctaccgatggtctataagccatggaaaaggttctaactggatagtcagagaccgtgtttgtacaccacggtcgaatgtattttcaaaatccagggaggaattgatgcatatgtggtgcttgtaatgcactgtctatggcacagacttgaagcacacatgagatttaaaatgggtgtattctttggccttagattttccagctactaaaacacattcaggaaacaattataaatgtatgctgaaaatcagccataggaatgttgttcatagaactatgcataataatgaaaatggagggtggtaaacagctgtgagtggaagaattgggcaataaaaacaaccaaccataggagtaggcttgtctaacatacactagaaaagcagagggaaagacaaactgccaagctcacagttagcttgtgtttgactttattttaggtcctacacataaactgtgactttagcaactcagaaagccaaggagagtttgtgatctctgggaaacagtgaaagtcgtagagataataaggaaagaagacagtgtgtccaggccctgatggcactggcctgaaatcctcaccatcaggatgccgaggcatcaagagttcaagaccactcagaactgcatggtgaaacccagtctcaaaagaagaggaatggtggcacagggaggggcgagagcagggggaggagcctggagctgtccaagggaagagaagaattgctttcagcatactaaacaaagatcacagttaacaaaatcaatttggcttcttttctttttcagccagtcagaatacaccagtgaccttcaagttccttttccttccacatccctctctctgctccttgtcccccacacacagagcatgagctcctttccatgtactgtcttagaaactggaatattcttcccagagcaacagcttgactttctcccaagtgtccctgccactgagcgttcaggcgagtgggagttacgtcattaagcccgagtcccttctcacagaggtcgcaggaaaccctacagagttcactggagagactttgggtcgtccatgtttctgcagccagtgtatcctgcgaaggttctcaagcatgcctgtgtctttcatacaaaaggaactcaggaaaagagaaggcctccatccaatcccgtgtccagctcagaaacaagacgctacatgttaattcctaagtaggaattattccaaatagctagaaggctaaaggaaactgtgtgagttttgctttacattatgtgattatgatttctgcatcagttattttgcaataagtagatagatagatagatagatagatagatagatagatagatagatatagggataaaggtagtgatagctatgtagctagagatagataaaagagagagagaaagagagatataaatataaataatatgaatatagaatgaatactgggagaaaatgtcatggacaggtgattaatttttttctgttgtttcttttcctttcttttttgagacagggtctctctacattgccctggctatcctggaactcttgaacactctgaggtctacttgcctctgccttcgaagttctggaattaaaggtgtgcaccaccacacccagctaaggaggctaactgttaatataacatcttcagatactacctaagcataatgtaaaaaaagggcctgatgactcctaggacttcagcgcttttggaagggaaatgaagtgttttatcggggctgtggaggcagctcagttggtaaagtgcttgctgaataatgaagagctgagttctgatcctgcacactgctgtaaaaagtcagaaacgagagcagaattctagcactggggaaaacagagacaggagtttgctggcaagtctagccaaaacagtaagtttcatgttcagaatgagagtttgacccagagaaagcaactgagaaggacatatgacatcaaccacaggcctacacacacacacacacacacacacacacacacacacacaaattcacatacactcacaccgaatctcccacacactcacaaatacacatgtgaacactcacactcattcatacacactcactcacaaacacacatgcacacatttatactcacactgacacacttgtgcatacacggacacacacacatacacacacaaaagtactgttaaaatgcctggttttaactgagcatagttgcacatgatggtgaccctagcactggagaagctaatgaagagaaactctgcagatttacggccagcgtgtgatattcaatgaatgcatggcagcccaggttacagagagaaacctctgaaacaaggtgtattcaaaatgttcttcccagatcacagaagagggaaagaaagggagggagaagagcagaggttacaattaatacgaaatagaggcagtgtccagccagattgtccaaagcaaatgccactgatgggacatgtccaacccaactaaaactcactttagcccaggagatttctgtgtccaggtcaccaatcacgccttctgatgtggatttctgcactagttctgcctctgtggcagagagccattcagagaggacggcagcctccttcttcatcttcctggacagctgtgaggctctttccaggtcttgcttcccttctgtcacctaaaaagggggtcaaagacatggtgagcgagtcaaagataaacaaggggaccaaggacactgtgagacagagtaaacaaggaggtcaaggacacaatgagaaagacacagtgtggttcaactgaatccataacactcaattaatagcaccagaacccagcctggtctacagagtaagttccaggacagccaccactatacagagaaaccctgtctcgaaaaacaaaaacaaaaacaaaaaaaaccaacaaaacaaaacaaacaaacaaaaaaaaaatagcaccagaacacagactttaaatagtatacacttggggctggagagatggcttagtggttaagagcaccgactgctcttccagaggtcctgtgttcaattcccagcaaccacatggtggctcaaaaccatctgtaataggatctgatgccctcttctggtgtgcctgaagagagcaatggtgtactcatatgcataaagtaaataaataaatctttaaaaaaataaatagtaaacacttgaattacagaatgcttctctgactgacatgcccgagcagctccacaagtaccaccaaacttagtgctcacaaagatttctgtatcaggaagaaaagcatccaagctcaacttataaggatgcacactttttctcaacctcatcaatgtgggctaagggcatctgcaagggaccataggaagatgtaaggctttacctgactgctcatcccttcccttttagctatagaaccattccttcttggtaaacattttaaacactctcatctcctctcttctctctctctctctctctctctctctctctcactcactcacacacacaccccaacttacctggatattctcccttccctcttagttataggaccattccttctgggtaaacattttaaacactctcatgtcacacacatacacacacacaccaacttccctaaatatccactgtctacttttaccatatgatcaaagctgcttcttagagtgtggtgctatgcctgacttctcacacatcccttgctaaattcaataacaaccccaaggcaacagatgcaaagggcatttttaagtgaacacaatattcacagagccatgactgaactcatctttgaaatactaccctcctggtttcccagagctcatccctgccatacacctatcacacctgttatcttcttattttaaagtttgttttgctaatccgtaacacttgctcagtagcctcattttccctcatcatatcctctccctagctaatttcacgtattctttggactctaaatttcagggcaaaccctcaaagtcagaggacagtttttctatgggatttagcaacagaaaatggcctgcctaccaactcttaacactcactcattgaagtatacaatggacgcttttagtctcggtagactacctaccaccaagtatttactagatcctgacatgataacatacctactgaatttagatatccaaaaccaaagtttatacagaaactattaccttgttgagtttccttagaataacttatgccaatggccatggaaaatataaatatcatcctgtattaagtaatctaaaaatatttatataactaataacgattatactactgatgtacaagtaaagattaaatttgataaatgttgggagagggggtgacagataaatagagagaggagagagagagaagcgccccccacctgtgcgcccaggtcattgtagaggactttcagagatgtaagctgttcgtccatgcttttcgggttgtccgtctgctgcttctggacaatgtgcctccctgttttgatgacagtctcaacttcaagtttgacttcactcaacgttttatatagtttctttaaaaaagaggaaaaaaaatttccattgttaacagaaaattcccgactggcatcatttcagagcacagcttctgtggctggacagataatacctcatcccggatatgaaagggcacactgtctgtcttgaatatggtttgaaggttgaattaagtgaagtcaggattgtaatgcttcttcaaatcagataataaactaatagagtttgcgtgtgtttaaatataaaacaagacgtgcgtattaaatgtcagtagaaatcctggataagggctcactgtaaccatgtttccttcaaaaactttggaaagttacaggatgcaaactggaatgtctctgtgtggaaccacactgtagggatggcagactccttactgagaaagcatgggtttactatgcacaaggtccttggttcaactcacggcactgaatgaattctttaatcctaacaccggtgactggaagacagttgcctctggcaatctgtgcccgaaagaatgtggaatccctaacatttatttgtttctattcctcagagaagacaaatgtaccataatgagtataatttatattctgaaatacacttaatactttaaagtgtcaaaatggatatgagtatgaagttggagttcaacaggtcaaattccaaattgccttcgtacttgtcaccgtgaacccccaaactctgtctaggcagcttatccatacatgagcatccaactcaaaacacttcaaggatacaaagccagtatctgtgatgtcaaatacagtgacatctgctactctgtcccaatgagcaaacagatgcttacaacactttcatgtgattcaaacgtctcctacctgtgcactattccacccacataagaaacaaaccatggaaaagacagtcctaccaatatctcctcccaggagatagaagagcaccgggcacaataaggctaagttcaggtcctccccacaacatcatttaaaactctctattagggctggcgagatggctcagtggttaagagcactgtctgctcttccagaggctctgagttcaattcccagcaaccacatggtggctcataaccatctgtaatgggatcttctggcatgcaggcatacatgcagatagagcacttgtttaaaaaataaaaaacaaataaaatttataaacctctattaaactaactacaaacaatggaatagtaaggtcttatttgtcattcatttctgcccatctgaagtttaaactttgacttgaatgtcattttcctagcaaaatattttttttactctataatattccaaatattagaggtacttcaaatttattgtggaaagtttcatttatcagttgcatccttcagagaggtctttcccacttcatgttgtagtttatacatttctttctttttaaatccatgttatttatgtgcaatctgcttcctttatctgcacagatcatacctgttgctttcatactcccctattactcttatactgtctatttttttttctgggagagccacagttctttttgttctgacacagtctccatcatctccataccctgaactaaagaataagaagggatgctctatactaaaccatcagagcagctctggccatgtgagctgcctgctgggcctcaggctcaccatgcacttgtccaagtgggcctgaatgacgtcagggtccacatccctcacatcgaggacatgaagctcggccttcactccctccaacacacgcttgcagtccagcatccgctgctcgaaatttgcgggcttctggaaaagctggaatttggtggagacctctcgaagtttcctctgtttgcagaaataagagtaagccactcactttcgctctaactagatattactataatacataatgccgaaagacttttcaaaaaaaaaaaaaaacaggccaacccaggaaaccccagaggaattaggacggtcatataaagcagtagttcttagcctttctaatgttccctttaacacagttcccacgttgtggtgaccccgcccccaaccataaaactatttcactgctacttcataactaattcagtgactgctatgaatcataatatattatctgatacagaggagatctgatatgcgacccccaaaagggtcacatcccacaggttcagaaccactgctcgatgtcatgagtgagcagtactcagaatttcagtctccaaactacatctggagacagatggtgtctctggatgagaaagtccattcatttactcactttttcatgaacatagacctcagatgccttctaccacattaagagtggaagctcatttccctctacctactgaggccctgagtgcccagacatcagcctctgagatcagagaatggtctacacaaagtcaactgctggcctgaactcatcccctcttctcagccaactcttaaagctcatagtttccttacccagctaacaacctgttcctgttgccatgagcctttaatactccgctcccatcccatgtttgaatcatagcacagagcgaaggtaccgaagtccttaagcctttctgcttttcttttctatacccaccatatataaaaagcaaagggaagccagtccttacctgtagcatgtccatctgacttcctcctctggtggccctgccctcaggggacgtcgggggctgggagcgcacattcttcctcagctcctccagggtgagctcatgggctgagatttcggcttggatcttctaccaagaagataaaaaacgggagaaggtgtgtttttaaagtacacaaagaagccctgggtaatggcccatgcttgtaatccttagcattctggagtctgcagctggaggatggctgagtttaaggccacccttggctgcatagtaagtcccagacaagcacgagttacagtatgcctttacacaacatgtgagcttttatataacaacagttggaatacagcagtatgtctttatacaacaaccaagtacaggaagaaatataatacagaagttcaaggtagttgtatagtatatgatcctatatctaatacacactaataagcttgtgggatacatgataataacaaactgttgcacagtacaccaccgtgtgctatgcacatgctaaggtctttgcttgtcattattaatgttcacatctgatgtatacagaataaactgcctgaactgtatagctacaaaggaaggaaggaaggaaggaaggaaggaaggaaggaaggaaagagagagagagagagagagagagagagagagagagaaagagagaaagagagaaagagagaaagagagaaagagaaagagaaaaagagagaaagagagaaagagagaaagagagaaagagagaaagagagaaaggaagaaatctattttctaacatatcaactgtgtgaaaggagctggagagatggctcagctgttaagagcaccagctgctcttccaaaggatctaggttcctttcccagtccccacagggtggtttacaacagtctaactccagttccaggggcctcactgctgtcttctggcatccacaggcagtaggcacgagcacagtgcacagatgcacatgtaagccagacacccatatgcataaaatggtagggagaaaatgtgtcaagttctcacacaaggaacaagaacagcccccacccaaaggctgttccatacagagtcctcctgactctggcagtgaggaccaggctacagctgccctttctcaagacgcaaaggctctcggctttgcagcaatacctgagcttcctgtggcagttggaaggcatcgatcctgtccgtcaggtatgtggtaagctgtttgtccagctcccccaggctctccttcagcacctgaagcatgtggtcagtttcgcggaggacctggagttgcttctccaaagaaatctgtttgctctccgcctgcacagaggagacatttcctttgtaactgctcagcacaaatataaatagctgaatgtgccttctggccatgcagattataataaagtactggttcaagactgtagctcttcttataaataattaataacgatcataataagagtgcaaatgttcttctagtatctcatggacacagcagctgaacctctcatttttaaaagaattatttatttattttcattttaaatacattggtaatttgactacctgtatgtctatgtgagggtgtcggatcccctgggacaggagctaaagacagttgagagccaccatgtgggtgctgggaattgaatcaaggagagcatccagtgcttttatctgctgagccatctctccagcccctgaatctctcattcttacttctattaacctatactatgacaaaatacaagtacaaaaagattcccccataggacatataaaatagaaaaaaaatgtgtatttcaggcgactggctcagtggctaagggtacttgttgccctagtagatagtgagggtggctcacgactatctgtgctccagctatagggggtcagatacccgcttctggacaacatgaccatgagacgcatatatgggacataaacatctatgcagacactcacatatacaaaatgtcttaaacttagtaaaatttgtaatttctaatttttttattttactagaaatataaagcaattttaagaatctccaatgcctaacaaaaaaaataagacatagtaagaatgtctatcaagtgaataaatacctaatttttttttctaaaattgagaacaagttctaacagtgcacatgtgagtcaaaccactaattgccacacatctttggattaagctcaatgatatttttagtctaatctcagcagttgttacttggtaatctggtatagttatctaatgatcaactcaaccttcttacaaaagaacaaggtcccttctcttatcactgatatggatatgcatgttgagatataatctgagcatcagccgagtgatgtagctttcataacagttaatgtcaaattcggaaggccctaatcgttattaggacatacatatagacgttattattcttagacatagctgtaatactattcttacagaaaactgcataattcacaaatagaaataaatctcaaagaggtgttggagatagaaggtaactgggaacttaacacatagccttgtgtgtacaacaaaagtgctttaccactgggctacatccagtatctgacaaagtttggtttggtttcatttttggcttggcttggtttggcttggcttgggattgggttgttgaaacaataccttactatgtagcttcacctggcttaagactccctatgcagagtattctagcctcaagctcagagatattcttgcctctgcctcttaagtttttggattaaaggcatataccaccatgccttgtcctggcaatttggatgtttgtttgtcttttgtttgtttgtttgatcaagctgcatctgacctacaaatattagatctattcttctatacttacttcaaagcccttatgctcccattaacattgcctgcctactttaactcccaccacaccaaagcattatctaatggggaccaatttatacattaccaagtgtaaccagcacggaagctccgagtaagagagagagctctcagagttagcttgtggcagtaactacctaatcacactgcacatgtctggttctcaccaagtgactcagctcttcgtagcggctgttaaaagcctccagcttctcgctgattatgtcatccaggattccaccatcaatcagagtctgcccaagttcccgaatctgggtgcgattatccgccggatggcgcaaaacagactcaagagactgcagttgggcaggggaaaaaatacattcaatgggtctaaatggatcaagatctgcaaaatgccattttaagcattaatattaattccactttctagaaatctatttaagaaacaagtaatgacaaatattaaggaaataactaattcacaaaattatccactatagattaacaaaatcacaaaactttaaaaaaaaacttcaagaacatatgcataaaataatttgaataattattaattttatgagaaactctcagtgtgacatacaaaactgtactctacaaataaaattatctcatgttattaactacattggtaaaattagagatccatttttctaccttatgatacagaaatacactaagtatttctatgtatacagttttatagacacaagtccaactaaccttatgcatgaaatactactcccattctacagatgggaaatctgaaagccataaagttcaatttgacaaaagagagtcaattaaaaaaaaacaaaaacaaaacacaaacaaacaaacaaaaatcctaaggctccaaactctttccgaagctcttaggactaggagccctttgactgcatttactgccctgcagtatacatgcacaaaaggaatgctgataataaagaaaaaatacagggggctggagagatggctcagcgggtaagagcactgactgctcttccaaaggtcctgagttcaaatcccagcaaccacatggcggctcacaaccacctgtagtgggatctgatgctttcttctggtgtgtctgaagaaagcaacagtgtactcatatatatataaataaacctgaaagaaagaaagggagtgagggagagagaagagagaagagaagagaacacagaatgtattaaagtgtttatcatggagccttcttttccttttctccattgtctggatttctagaatgtatatttatgccctatgagaaaagcatgcttgctgtttgttcaatgggcatgtagtggtttccatgctgtctatgcatcctctactctgctgtgtttgagaagtgacaattctctccctgcacggcatccatcttcaggaatggagccccattcacccccaccccctgggaatagctctctgacttcccattctgctgttcatcggatccccaaatttccctactactcctgtacaagtgaaacctctttggttacactgtaattcgtttctgaagtaattaccacagtatcgtgtgtactcctgggctcgaaactacagaacgaggaagccttcgggatatttcttggccccaggagcctgaagcccagccttgtcatccagccccactgtgggagcccctgccttcacgaatgcacatagcagcctgctttaactttttacatctgagaatgatgaagaagccacctgaagcatggttcatgccatagtcataagtgcaaagaaacaaaacagggtttgttcagagaatggtgaaaagaactggaccctactagtgactatcgctgtgtctaacatgcactcatgtagctcctgccttacaaaactgattataaagagttcccaggggccggtgagatggctcagtgggtcaaaaggagcttgccacaaaccctaacgacctggatttgatccctgggatctatgttgcaagggggaaaataacttttacaaattgtgctctgacctcaacacacatcctattgtatgcacggatggatggatagacagacagacagacagacagacagacagacagacatctttcccattcacagtgaaaataactgtggctcagacatcaggtgccaacctccagagcttcatgaacagcttctgccctctcaggcagggcctccgtgctcctcacgcgctcctccaaggtgttcaaccacgtggtctccaggtccagatagtgaagcagctccacccagcaagaccagacctcctaacaaatgtgaagggaaaattaacacggaagagaagccataaccatacgtcatcccttcgatcaataagaactccatttcagtgagtaatatacaggaatccagaaaccagcgaagctagaatatcaaataaatgaggcaaaactaaatcttcaataaaataggagcaattaagatggaaggagaaggaaaaatggaaaagaagctgcctcggttttcagtaaaatgagttccaaggacctggctaaatgttaaaaaaaaaaacaaacctgaataattaataggggaaaaaaacagcagagaaatacattttctgtttgtttgtttgtttgtttgtttgttttaaagaaaatgttagagccggagatttagctcagtggctacaacctgtacttgcctgacaaaggccctaagtccaatccccagtaccaccaccaccaccaccaccaacaccaccaacaccaacaccaacaccaacaccaacaccaacaccaacaccaacaacaacaccaccaccaccaccaccaccactaccaacaccaccaacaccaccaccaccaccaccaacaccaccaccactaccaacaccaccaccaccaacaacaacaacaacaacaacaacaccaacaccaccaccaccaacaacaacaacaacaccaacaccaacaacaccaccaccaccaccactaccaacaccaacaacaacaacaacaacaccaacaacaccaacaccaacaccaacaacaacaacaacaacaacaacaacaacaccaccaacaacaacaacaacagcaacacccccagaaagagcaaaaggtaaaaaccattcaggatatttttttatagaaacttaaatctcctaggacatatccaattccagttcctagatgactgatgggagcagatgtctctgtagccatctggacttctttccaagtgagtaaagatagacacataagaggatgggcccattttaccaaaacaggagccaggtagtcctgtgttctccctactcagagttccgaagtaggagagaagccgaggaaggcatgcatttagagccttctatccccttgctccagaacaagagaggatcttatctgactgctaagattagagctctgcacaaaatcccctgcatctgtcttctctaccaaggtagggcacagtcccatccattccccacatcagctctgctcgccagaacagggctcagccggtatttctcgagaggcacagagaaggtatttcagactttaggggtgacatccatagtttgtcacagcttcatctttggtgtataggtgtttacaccatgttcaatcctttagaaataccactcttaaccaaacctaccccccccccaaaaaaaaccaactttttttttcagggcagggtttctctatgtggccctggctgttccagacctcaggtgtaggccaggctggccttgggctcagagatgcttctcccttcagggtgctgggattaaaggcatagaacaccattgcctagctcaaactacacaatttatacctgaggcctctaccataatttgttgactcttggttcagagcaaaagaagaaagagatttctagtccccttctcccattaatcttacaagaagcaggccgaaaaatctgctcagatcttacaagaagtacaatgagtaaactcagtttaaatcttccctcggcattatcagaactcaccagaatgtaattgcttattgtagggtgtgtttcatttaaatttgaataactcaaaacgcttcttaagacttttgaccagtttttttttaaccatgaagatgagaaagcactttattaaaataatcccacagaataatctaggtcttcagtctgataggcagtgagattctccacctaaaaatgcaatgaaatctctacatactgaaattctttttcccctccagtaaatattagacacgactcaaaataaaaataaaataacagtcagccaggtaaaagagagctgtctggattcttatggtaacctgagaacactagtgagcacacaaacctgcggggatcaattatcaccattgaacctcctgagaaatgcaggcagatcttggtctccttttaacacaaaacaaacaaaaatctctctatttttttatctacttggtccataaaaattacttttataatccaatgtttgacaaagtaatggcgctttctttcttcttcttcttcttttttttaaataagacagggaaatccacacagcagagctgggatctcaggatggtagccctggggcaaacaagctcttacctccagtgtgtggcacttccctcgaattctattgcacagaagctggtagctctccagcacctcgttgaattccgacgtcaactcctggccaccagagggcaccttggcagccaccagcttgatgctgtccttcagaattttcaccctcacctccttctgcagcacctcctcttttgccctctgtcccaagaaaggagcaatttgaaacatggctctctgtgactaatatctttctttaaaaaataataataatgattaatccaatatcaaaacaactaaatgattctatatgcctcagtagaacactatttaaaaaattctgtaacctgagttttttgaaagaagaatgctaaaaataaaatctcacttactcttctagtttccaattccccgagcccacaacagtttctttttaataccaccagagtttagaggcaagttatcctaaatagtgtctactggcaagatatatttttaaattctggactcagggtaggaatctaaatgaactcattttaaatgaccactggaggtctgaacacattaaattgaaataaataaacaccccccaaaatggcaggacactgtggcagaggcatctattaaaatggcccacaaatccttgtaaaaacattttcctccttgaccatgggtccatccatccttccaataatgaagatgaagaagctcctctggacaacctgatccagaaatagctgcttcctggctttctctcggtgcccaaggtgctcagtctcacatgcaggaaaacctacctgcagccgtctttcactcccccctttagcttgctttattgcttaatggatttcagctctcccagggtgagggaaaaagtaattaagtgtagtggcttttaaattcctaatggctgttttaaagaataaaaataaatagagtgttgcccaatcagggattgtaatctcatttttcttcactgtcaactacaatgacttttaaaatcagcagcaaactgcagctccaaaagtgtgagtgataaatgagttagccattctttacatagtaatctacttttaaatattttcagtactaaaaatagttttaaaacttttcaaaaagagctacatgaccagtacccccgaagctagtgtctctagctgcatatatagcagaagatggcctagccggccatcagtggaaagagaggcccattggtcgtgcaaactttatgtacctcagtgcaggggaccgccagggccgggaggtgggagtgggtgggtaggggagtgagggaggagggtatgggggacttttgggatagcattggaaatgtaaatgaggaaaatacctaataaaaaaaattttagaaaaaagaaaattatatatatattgatccccgacacagattaaataagtctcttttcatatctactgactcaagatagcatgcatgaatgtcacatagaatctttttaaaaactacctgcacagaaaagtttgccttagttatactactagttgagttaaccaacttaattggtagtataactactagttaacaatataccatgttacttgatcttttacaaagagaagtgtactttttttttttaattttttttttaaggacaggatttctccgtgtagccctggctgctctgaaacttgctctgtagactgactagcctcaaacacagagatccacctacctctgcccctctgcccctctgcccctctgcccctctgcccctctgcccctctgcccctctgcccctctgcccctgcctctgaagtactggggttaaagctgtatccccaccaccaccaccacctgacaagaaggatgactcttaaagacagaatcacgccctcatgctagaaggatagtggaggcaaatgtgggtctgaggcccagttctttccttatacaaggacaactactgacacaggaatagatgtttctggaaccacagcttgtaactccaacttatcttcaccttatcttctctgtatacgccaagatttctgctcaaggacattgtggggttcctatgtgccctcattactgactctatatctcctacctcctgctcctgggatgttctggggttcccatgtactcccaatactgacttgaatgtagcctttgcctcctgctccaaagacattctggggttccctgggcccccacgaatgactagaatgaaacccattagaactagaataacctccaagtctcctttgctccttaccaaaacttacacttcctggaaacagtgatagaagtcacacggtaccatgactagaattaacaccataaaatatacaccaagaaactgctaaaagggtaaaaaaaaaatttatattatatgtgtttattgcaataataaaagaaaaatgagtttctcctcacaacccttcttcgagacagaaacctccatgactatccacagggacttcccagaatcgatctactctggggtggacttgaaccagtggactggcatcagcctctttcccaactaagattaccacagctgctcatcactcactcctactgagagcagacttgtccatagggttctgtgcagtgtgataggtgaaagaccaacagactaactagtgtgaagagggcagtcgggaggaaggccttaccttcatttcctccaccgcactctcgagttcttctggagatttgtactcgaagtccctctccaggtagtcctcttcagcctgtgccatccactcctgcatctcagccaaatcctttttcaagttcagggctttttcttgactatctgacagcctgcttttttgaatagcaatctaggaaggaaacgccaattccactcaataaataaattttaatacgttaaatgccaagttctaccctttaatatttaaaggcactgcaatagatttccagtcttattttttaacatttaaataaaacttttaaagcatcctgtgctggtgctgtgtaatgtaagaaaggatgaaaatataatgacttctatacaacattttagacatgaacctaactagaagatatctaatataactctgaaaatagggttcacagctggtgttttttctccctggcagcctgcactgtactcccaacactgtgaaaggtaagcagcagaaactaactaggtttctgaccttttaattccacattaaggagcttcacctatagcgataaaggtatgaacatcaagtaatttaattgtaacactgtctattatataaaaaataaaacaggaagcagaattcccatggtgtggcctcacattctaaactgagcctggagttgggcacagtcacacattcttgtaatatcagcccttggaaggcagaagcaggtgtgtctctgtaaatccagggctagcctgctctacagaagaagacctgttctcaaaaaaatgttcttaaaaataaggggaaaaaactgaggatgaaaagaactattacaaaagatgtccacaaggcattaccctataaaatgttggttagaaagtagaaggtaggactggagagatggctcagtggttaagagcactgactgctcttccgaaggacctgagttcaaatcccaacaaccacatggtggctcacaaccatctgtacagttacagtgtactcacatacataaatcttaaaaaaaaaaaaacagaaagtagaagatagacgttggagagatggctcagtggttaagagcacttgctgctcttcccgaggatgcaggttcaattcccagtccccacatgatggctcacaactcctctgtaactgtaactccagttcaagttcaagaaaatccaacactctacatacacagacatacagacagacaaaacaccaaggcacataagtaaagtgttttgtaaaagaaaaaggagggggaggagaaggagagaaggagagaagaagaagaaggaggaggaggaggaggaggaggaggaggaggaggaggaagtagaacatatatttgaaaatagctatctgtctgaatctggctcagtaactttatgaagtacttcagaggagtctgggaatattttcagagctcctcacctaaccacaaatgcacttcggctgaaagagatgatcgtgtcacacaggaatcgtccaaccttcccctgacacgtccagtagcctgctcaaattacatgtctgagtggaggccagagctgacagaaaccggaggccaggccaggaacaggatgggctcacaggaatgtgggttaaggaatggttagtggctttcctgttccctccctccaaacaggagcacaggcctaaaaatagacaaggaacttttctttccatgcccaccccgcaagctagggtgtgactcttctaggagaagccacaatagcacacagtgctcctctcccttgctcaacactttaagcagctcttgataaaactatggcatagtgtgtgtgtgtgtgggggggggtaaaatgcaatgtagtcacataaatgtagactcttggtttacatttcctgaacaacaataaatattatcattttagtggatccatagaaaagttgaaaataaaatccacaagatcataactatagacttggtattttaggacagtgttaaattctgtcatggtagcatacatgagacacatttctgtacattttagtttgacatggcctgtgtttacttatttttattttgtgtgtagggatattttgcctgtacacagtctgtgtacagactgtgtaactttgtgaagtacttcagaggagtctgggaatattttcagagctcctcacctaaccacaaaggccagaagcgggcaaatcaaggtcacctggaaatggagttccagactgttgtatgttgccaatgtgggtgctggaaatggaacctgggtcttcagcaagagctgaagggctctaaactgctaacccatctctccagccccagatagacctatgtttcctaagtacatttgtgtgtatatatatatgtgtgtgtgtgtgtgtgtatacatacacacacactatacaactttttaaattttactagtgagtgagataaaccgtctagaactgatctaaatactttctgtaccgtagattttatattgttatgagcaagtgggtgaacagatgaacttgagtagatggatggatggatggatggatggatggatggatggatggatggatgtgacagataggagatggtaatggtagacaatggatggatgaagatgatggaggatgaaggacagatggataaatgcatggatacaggagacaggggataagtagacgaatggatgctacatggttgcttattcctcaatgtcacttaggaagcttgtcctttatttccttagataaaatccccagctgcttacactgtcagattataaagcagatacagaaatacaaacttggatagtgtattcagtgatattacaaaaaaagattattttcttgagttggatcatggcatcttgacaaatgcctatattataatatatgacaataatttcaagttcctgtatgaagcatattttcagagatacatagaaaatataatacaaaactagctactgataaatcttggaataggtccatgggtgtttctctgtaggattagtatgatttttctcctcataaaatatgttcaaaatgaagatgttgggctaaaacaagaacaaaacattcaatcatgccaccatagggttccttcccattccctcccccactgtccattgtcacttccttccccacctcgccaggggatgcacttttcttggggtcatccgaagtcgctcctgagttaaagttaaagcttgatttttaactcagataacctgactcatgcctctagctttattcacctctcttactatcttctgcttcccatgccccaagggcactaagaattttaaaagctaaaattttaaaaagaggaaaaataagaagcagcctttgcatgcacagagttacctccacctccatccttccagaacaggtctcatccagttacctgctgctaggaagcttctgctcctgggttcttatcactcagagagcaccacaatccacacagaacacacgcacgaacgcacacaccgtttgccaatctctggagccacccagagcatcagttttccatctgacattgtcctccacccaaggcctgtctctgttcccaagggatacagctcacacgtgctatcctgaccacaaacatggtctctccagccaagagtcaccaactctcagacctctgcaatgtcccaatgtgagcaactccctgactaaacgattgccaagaactctaccttctcttaattcttggctgcccctccctgacagctcacctgcctcataggaatgcaaaaacttttcctctggtcatttctgtgtcccagagcatacaaagaagcctagcaacagacactaattaagaaaatactacactatatttattaattatgcctaattaataaatatgtgctgcttaaaggattaatagctataatcagtagataccacactgaaatgtcctcaaggcaaggcaagtgtcataaatgaatgtgtggaactcagttgaaaacagaaagaataggacagtcctgagtctcactaagcaagcagtagtcttccttaatttttatatatatatacacacacacatatatatacatatatatatatgtctttgtatatatacacacatatataatttatacaatatactaatataataaatatatataattcatacaatatattttaatttaagatatttaatatatcttatatacttaatattaatatacatattttatatacctaatatatctttatatatctttatatattatatgtatatgtagtatataaataaataaaataagtaaatatattatatataagatatatgtatctttatatatgtctttaatatatatttaatatctatcttaaaactatgaaagaatattgtttgtatgtgtgtacatcacacacagatatatgtatgtatatgtatatacatgtatatatatacacacagacacatatatatatatatatatatatatatatatatatatacatatatatatatatatatatatatatatatatatatgcatgtgtctgtgcatgtgtgctttaagtgtgttttatgctgtcctgtaaaaattgtagagcactattttttggttttgattttgtggtcaagagaagccagtgacagtgtgtccccttcctaaagaaggtgccaagctcacctctttgctgaatttctccagttgggattggtaatccactagtcttgcctgtacccatgtcttgactccagtgactggacacctctgaaggctagtctctacttccctcatgttcttcagagatgactcgatggtttcgatttcattagcaaacgtctgaatacaggagataagtccatgttaagtgtactcccatgtaagtggacatcagtatcacacctatctacctggatcctgcaaatatttcaaggacatagtgactggtattcaggattctcagctacttaagagatgactcacttcaagaaactcattttgcctagcatttaatacagtcgcccgctaaaaattaaattagaattacttgaatctcagtgggaagtatgacttttaattaacttagagtagcggttctcaacctgtaggcctttgggggtggggggagggtcacatatcagacagcctgcataccagatatttacattatgattcataacagtagcagaattacagtcatgaagtagcaatgaaaataactttatggttggtgtttgccacactctgagggactgtattaaaggccacagcattcggaaggctgagaaccactgctctagagagacctggtgagtctcaagtataaattgtgttgctagcacatttcatttgctagatatgctgctcagaaaggttcgtcatgtgctacaatggcagcagcatgcttgtgataatcattacattaagatcacaatcttaacagaagaaaacagcttccaaagaaataaatttgctcttgttctcatcacgaatcctataaccacagacggcagtataatatgagcaatctgtctgtcctttattagctacgaagtaaaaataaaagctttacaataaaagactctttatctagacttcataagccctattcttacaattttaataatggcaagtgacaaagagcgagaagagaatgttatttattccagtaggattgccagagcggaggcactcacagcacattggtcaagctggctctgcagcgcagcagcgtctccttgagcagcctgttctttcatgaggaagtctttgatgccactcacccacttctcaatgacttctgaatcagcctaaattgaacacaataacagaggggcatattactcagtgacatacaaccccaggacatctcaagatctactgggaccaaagaaagagacaacttctcaaaactcaataacatcgttttcatttgtttcatttcctctttgaagtctcccaacttggaaaataaagtctttagtttatcctcaaggaaatgtttccaaaaatgacactgcggtggtcatccaccagtctcaagccactctggaataaactattgtatctaaatgcaagcaatatttaggactaagattcaaattacaggaaaaaaaatgctactctagtcatagtcaaagcataaacaaaaatcttttgctttcaactaacttagagcaattttttctcggaagttactggaactaggagtaagcacacagcatcatgaaggaacatgacacaggactctccaatcttccatgggatacctccttctctgaaaacagaactagccactgtctggtttatttcagttcttctaaccactcaaagttaataagtacaaagagaaggcaaacgttttctagaaagtaggcttgagagaggagatcgcaaaggaatagctgtagagaagtcaactgcagccacacttaaacttcagtactaaagcattggctattttccccaaagcctcctgtcccttcattggttagtctgccttgctaattcccctaatgtttctccgagtccccttcagttctactcttgatcacgcctagaaatagaaataaacctgaatggttaattcgaaagtgaccaccatgtgtctccctagtcctgggaaggctaaatattccttcttttgtgacatttacagggcaatatagccgggtaatgcacaaaccattctgatccatgtactctggagacaacaaaaaatattttatattcctataatataccaaacaaaaccaactattaatattcttatgaagctggaatgaatcgtaaagacatacaactatggcaagttacatctataaaataggttatacctataaaataccacctaaaaccattttaggtttttcttatcgtgaatttgtccaatgattcttttgggttaaacttgtttgttcttaaatatatcaggagcaacatgaagactaaaaccccagtgttctcagtatttacctcaaaataagcttcccctaccaaacattgcttaacatggatagaatagctatagaacttgatcattataaataccaaattttgttttattatgctgacaacagaagtttaaaaaatagatcagcaacaagccaacagaataattagaacttttaacctttccactttcctaccaacttctcttcctaactttcctctacttggaaagtggacatagaaacacaattttctattgggtacatggtttgggtccgcttggttggttggttggtttcaattgggtttcttgcttttgagtgttaggatttgtaagtgaaatcatggcgcccattgtttataattaataaatgctaataaaaatagaagtggggctggagggataccccagcagacaggaacagtcactactcttacagagaagcagggttctgttctcagcacccccaagacaatgcataactgtcttgaattccaactccagaagatctagcgccctcttctggtccccataggtaccgcatgcccatgttacaagtacagatgtacaagttcacagataggcacataagatttaaaaataaatcactaaaaataaaatcttgttccatgaaacaagccttttaaaattgcctgcttaccccattgcattgttaatctccattctgaactcctaaataacatagtatttctgaggaactaggaaatccatcaaagctaattttgaaagaggaaaacagtttcacagctaagatttttcagtaacacatagaggtgcctcataccccaagagggctaatagtcacagtcacctctgactaaaatagacagctttaacccatcactggggaatgagaggaagttttaggggctcagtcacctcttcctcgcctcagacaaccccagacaccggtgagggcacacagcccaggaacacccgttccttcttgctctcagtttcactgaggaaaaaaaaaagaaaggagaatgtagcagacacacacacacacaagccacagaaatatcagagacggagcaacaaacaggcattctgcttctcactacagaaaatctgacatataatccctgtaccctatgatggggagacgccgagctcaccagctaacagcatggctgtaagaaactaattctgttttggcacctcagttgctcacctgtaaaaccagaataacaacaataacaactgtgtttaattgttctgaaaaatcacagacagtgttgggacagagatcgccacacgaatgcatgcaacatacacttagcacccacgaaagcatctgcctcactattaacaatgaggacctcgttagagagccaatgcttccaaatcctagaacttagatcttgtcagagatgcccaggaatgccacagtgaagttgtgtttgctaaaaatcaggtagttggttgttgttttgttgttgttgtccttttttattgctgtcagcattaacatttgttcagtcctataactattttaaagtccctggaaaatggccagctgaaagctcaatcgtgctatatctgatgggcatagttaaagagctcagcagaaaaaaagtcaaggaaacgggaaccagtccaaactttgaaaatgccttgcaggggcagatttagtagacacaccgccctgtagccacactatgaagcaaggggtcactactgaagaccagccaccaccagcctgcagagggtgcagagacccagctccacgctcctctttcacactccccagactatctatttttccctggaaggaaaatcgtctcatgttcctgtagcagaaactgccggtcgataccacgagccagctcatctgtagtcagtggtaatgcacggtacaagactaagaccactagaacagttttcaaccaaattcgaagcaagcgttaaagaaatactggccaggatgaaggactctggtcaggtccattccagggatcatcggacatggagtcacattccactacaactttccaagcaaacctacaaggctgcatatttctcaccagatccaatcagaggtaagcatacacgctggtgcacttcctgccagggtccctcctgcctgcctctgagtgatcaaacacatctggtgcagtcaggtggaacaaatttgttaagggaagtcagaacatgtggcttgttatcttatagaaaaatcagtctccagcatttctccatctgtccctggacaaggggcttcatggatctcttatgtacagtcactaaaacttacaaactctggctctcacattagttcctcagctaagtcccaaagaacatgaaagaattcacaaaaacaagagaatctctctagccatttaaaaaccacaccactaaagagcttaggggggactggagagctggctcagccatttagagccctgactgctcttctagaggtcctgagttcaaatcccagcaaccacatgatggctcacaaccatctgtaatgggatctgatgtcctcttctggtgcatctgaaaatagctacagcgtactcatatacataaaataaataaatctttaaagcgcttaggagtctacagtctacaacagcaatggtttctttgcctctatccaacttgctgaacaaacacaagaatacacacacatgtacgcgcacaaagttctttaaggaacttctcttctgctaaataaactggtttaaagttcccaggagaagctcgggaggtggctcagtcagtaaactgctttcctggcatgcatggggacctgagactgacatgcagaaccgacatgctggtaaaaggtacaattcctgggaagctaggagattcccggggttcactggccagtcaatgtagcctaacctgggagccccaggtcccagagaccttgttttaaaaaacagtgcaaatacagtcatctggcctctggcctccacacatattctcataagcacacacatcttctctgtctatctgtctttctgtgtctgtgtctgtatgtgtctgtccctgtctacccgtctctgtctctctgacacatacacacacaccattgccagtaaatttctaataaaaatgtctgcaaaaaaaattaatcggtcctcatctaagacagtaatcatttctcattctcatttttactcataaatattcaagtacgatgaaattgctaataacatggttatttagaggaccttaaaataccaaagattctcctttggaatgtggaaaatgtttaaaaaccttgaccatccatccctccagaaaacttcttgagcgggcaacacccaggggcaggtcacagaggagaaatgtagggtcaatgaaacaatccctttgcaccttaccctgcccgcctcctgagctggagatagaagcatttgaaagcttggaagctctggacaggagagcctgagactcgagggtgcactgcagcccctcattctggactacagccacatagctggcatttttgctttcctgctcccccatcagctggaatgtatgtggatcctcaagctgctaatttctgcctgggacagggacaaaccagctttgaaaatagagttggcataggaatttaatgtaaagagcttcctaatttgctcagtttggtgacattctggagcctgtaacagacactacctggggtttcaaggataccataaccctactcaaaagactgttataaaaacggtgttctgtcacagagaggaaggccaagaataacattgccaccacatcaacacatctaaacctgtgtcactaaatccaaggtgtggaatggcccattgtttcctgtaatgagtaaaaatgatggggggaggggacagtattttaattactatatcaggcttgtattctctagaaagactaaagtagctaaatacgggatgttcgtcttccttatcttgaccctgaaatacttccaaaataatttcaaatcctgtgtcttcaatggccccgtccccacatgtcttttcagcatcctggggcagaacaccttggtttggtgagtgtccttgactttgagcaactgaaggaagagaacaagcagagggctgtgtgatctttgaggataagtgggtctgagactgctcactagagagggggaaggctacctgatagagtcacacctactgagtgagtcattctgatcactgccattcaccccctcttacttgctgggcaccccgcagagttctatcttcaaagagctcataccctgggaggggaggagaaacacagagctctaagttgataaaactccacagggtgtggatgggagcatgaaaaggtgaggaaggttcaggctgtactttggtgctgagcaagactggtgactggccatgaagtttgttcttagagactcagcctgggtgggggtagtgggtggggctgaagaggtagctcagtggttaggagcatagttgctctcccagcaaccacatggtggttgccatttgtaatggcatttgagcactcatatacaataaataaaataataaagctttaaaaaaaaactactgtacacattaaaaaataaatcagccagggaaacataatattccaacaagtaggtgtgtcatgtccacaggaaggcaatacagtccagggtagtcctttgggacccatgattctctcccaacttgatgccactcacagtggggacaataggcaagctagaagaagaaagggcagggactgtgtgataaagtgtgaacattttactctgatgacgataaccagaccatcccttgcttcagtgggaagatgaatttccaaggtaactgctgggaatcgggagttggaactgttataaagtggagggcagagccaagaggcaaaactaggtttagtgggcacttgcagacatgctggtaatgttccaggtattcccacactgtaggatcttgagtaggggaaaggaaataatataaaacatatcacagtccataataaccgaagatattactgcctgtgtgagagaaagaatcagagaagaaggggcctctttggattttattttgtactcatgattcataaccgaaagcaataagaaaaaaatgcctgtttcatgtttttcaaatgtcttgctaccaggaagggaggtgatggattgtgaagcaaagcacagaacagactttaagtccatgtttgtgcctagcactgtgggagacaatagcgggctagtctaaccttagcctgtacaaaaggaattagctgtaaagacaacggaaatgtcaacaaatgccaagaaactaagaggcaactatgaccacagacacaaacctggggactcttcttgcaaatatcccagggctggaggatggaagctaagcaccaccacgattaactcagcttctaaaagtgctatagactcttgaaagacttcattctgagcaggaggagtcactttctaagctttgcactctattaggtattgaaatgtccgtataaactgatggtatgaccactccatggatggttaagggaaggtttatatagagcacagagagtttagagttaagagatttggggagcatttgttcgtgaagtgagagaacttgctacggtctgtgagaatttggaaatctaatgcgccatctttggccattaactgagttggactgagaccatttgcagcaagacagaatggaatgtctctgaggctgaggagggaaagattagaaaaggaggggaaagtgtcacaaacaggaactctgtcagagggaggattccaataatctttaggagggagccgagggcacctggggagtgaagcagctggagaaaagcagcagcccaggaggtagaacctggaattcagagttgaatatggtgggaggcagaagccagcagaaataaatgatccatatcttaccagagttaaatcaacagtgtggtttggaaagaggtccaactgtgctcctcccagatttcagcaccacacatataaactgacaacatgactgcttcttagtatgcataagggaatggtgtttatgagataagagggagagagagagggaggggaagaggaagggagggagggagggggagagggagggagggagggagggagggagggagggggagagggagagggagggagggggagagggagagagagagagagaacacacagccagaagtatctggaagagtccagagcagagagaggagagagacagtagttgactaaacatggccagcagactgaacatggccatgagagaaacagaagcacaagggggtgggggtggggcgggtaggttaacacagaagatagggagtgggcaaaagaataagtgtagctgaaatggttgggttataaagagaatgtgtcaacctgaatcccagggagctcctagagactgagccaccaaccaaagagcaagcacaggctggtccaggcctgcggcatgtatgtagcagaggactgccttgtctggcctcagtgggagaaggtgcacctgatcctgcagagacttgatgcccctgggaagggggtctgcaggggtgggaggcaacctcttagacaagaaggggaaggggaatgggagtaagaactctgggagggggagggggaacatttgggatgtaaatagataaaataattaatttaaataaataaacaaacaaacaaacagaatgtgtagctggtggaaaggaagcctcttagctagagggagtcacagtaagaaaggaagtgggagacaccaagatgctagcatggactttgaaatgtgtagctggtacttctgatgctgagggagcccaaaggcctgcctgtgcttaggtatgctaacagacgccacagatagccacctgtccattctgccttttggaacctggggaaatggactttccttttatcttaacaatccctcatcaggatctacagtagtgtattctatagtacagaaaaaacaaacaaacaaacaaacaaacaaacaaacaaacaaacaaaacaccccagattggaattagtagtatgtgcggactgtatgtacatggaaattctgcaaacattcactgtgaatacaagcctgccaggacgggacatagaactgggactaagaatactgttggcaatgagtattcctatattattcagtatctgcacaatagcagtcttcatgcatcacatataggattaaaaacgcattttaaaatcagcagcttctgatttccaccaggctcagtaggtgcctgtgcacctttaatcccagcactttggaagcagaagtaggtggatctctgtttgctagagaccagcgagatcctcaaggggagttcatctacataatgacgcccagtctcaagtaatcaactaattgatttaattaaattaagcaaacaattccactaccttatcccaaagaaactccataaattggcagtgaatctaatacccactgtgctcacggctttaaagaatagagcttaaaaactaaaacatgcatcaggacactggaaaaagaaaaaagttatcctgtgagtgagtgtttactacaattatcttgtaactttatgaagaaactttgaagttttcccacatgaattctgagtagtgaattaacaagcaattcgtttgaaacaagagagcaagcgtggcctttagcattgaagtcatacatgtgttacgccgggtgttggtggtgcatgcctttaatcccagcacttgggaggcagaggcagtcggatttctgagttcgactctagcctggtctacaaagtgagttccaggacagccagagctacacagagaaaccctgtctcgaaaaacaaaaacaaaaacttacatgtgttacatgcatgaagttacacaattaaaaaataaatacaaatactatcaccaaccttgctgatgacccaccaaagaaaaacagaaaataacaagatgttaaagtctgctactgtaataccaaatagttgaatagagatccacgtgtttgatggatatgtgtgtgtttgtgtgtgtatgtgtgtgtatggtgtgtgtgtatgtgtgtgtgtttgtgtgtgtgtgtgtgtgtgtgtgtgtgtatcaaactggccactaaaggtgccatattcaaatactggcacaccatcccatttaattttaaaatgtcaacttgtctcagccaagagtcaatgagtctcaactgagggactgcccagatcaaattgacctatgggcctgtctgtggggaacactcttgcttgttaactaattgacttagacgtgagaggacccagacatgtggatggcaccattctcgaggcagatgatctaggactgtataaaaaagataggcaagcataggtctgagagcaagccagcaagcagcaagttcctccacggctcctacttcagttccttccctgactccccatagcaacaggccgtgatcatgaagtgtaaacacctcccaccccgagattctttagtcagaatagtttatcccagcatcaggaaagcagctaaaacacatacatctaacccacccgaaaataaacttttcaggagtcactcatgaattcccctaactaaatttaaatttgaaaatataaaatcagttcacacagcatgggtcaaccttgaactctgacatttgggactaaacagttctgcctctatgagggccaacctgggtgccataaaacagctagctacatccctggctactaagcctctgtttgtcactgctctacctcacccctattgccatgtcagtgacaaccaaagatgtctctagactaacacatatcttagggtgaggggaaaatcaaaaacactgctggttgagaatcactgataggtcaatgtgaccatcatcaaaaaatgttacaatcacagacaagtataactctcattcataccattgtaatatgtatgttctgtgaatgcagcagaaggttgtaaaagcctctcacttgtagttggaacactcgaagctgtgtggcagagtgcctacttagcatgataagaccctgaagttaacctctgccacaggtttaaaaggcaggcacaggcggtggtggtgcacacctttgatcccagtacttgggaggcagaggcaggcagattcctgagttcgaggccagcctggtctacaaagtgagttccaggacagccagggctgcacagaaaaaccctgtctcaaaaaaaaaaaaaaaaaaaaaaaaggcaggcacagtggcacacacacctgcactctcagcacttgaggtgactgaagggtcagaagttcaaggctatccttgactagatagcatggtttaaggccagcctaggacatgtgagagcctgcccctgtgtccccgactccattctctgcctccaactaggttaacctgctccactctaactagtcaccgctgtactttgagcactggttcatagggccatgcagatccccagatgaaagtctatcttaaccgctactaagctacatcctcaacaaggtcttgtacacctctaccaagaagccttctctctataaggcaaaagaaatacatgtgcttgccagcacattaaaatatctctgataagcaaattatgaatcccaacttaagcatataacaaacgtgggacaaggaagaaagcaaagaactcagaaagcagatatcccagtcttgcatgattatcgctgtgtgccctgaaacaagcctaaactcctatcgattggcctctcgatttacctcaaaatctcggagtctgggggtgatttcctcgagcaagtgtaagtctctggaaaccttggtctttactttattccatctgccttggacatcatcaaattcttgtttatacattttccccacatcaggaagcatatttttctccaaagtcttcgtttcttctgaaagcttatgtaacgtatgtttctgattctcaagggtttcatcaagggcctacgaaagtgtcaagagattaaaaccatccacaacaatgtacatatgtattagcacagatgtagtaacatatatatacatatatatggagaagagggtatcttacttaaaaataaaaatctttcttttctcataagtaggtgtggcatcatggattctgtacattaaaccctgtaacagcacacacagtgtagaacaagagcccaaggtcggcagttggtcttttctatcaggtaccgtagtatagaacagtgtttctcaatctgaggggcgagactcctttggaggggtctaacaaccctttcacagggcctgcatatcatatattttgcatatcgaagatttacattatgattcattccagtagcaaaattggagttatgaggtagcattgaaaataatacgatggttggaggtcaccacatcatgaggaactgtgttacagggtcacagtggagaaacattggcattgagccttcaggccactggacgcaggagagtggtttagtcaatataatttaagtggctcccagaatgtgggaggctgaggcaggaagactgcactcaattctcagccagtgtgtattacagagtaaaactcttgtctcaaaaaaaaaaaaaaaagaaaaaaaagaaaagaaaagaaaagaaaagaaaagaaaagaaaagaaaagaaaaaaagagagagaggaaaaaaagaaagagaaagaggaaaaagaaagaaagaaatcaggtcacctaatacacctcacattattttaggagatatatctagcagattaggaacaggtttagaattttatttaaatgatttaaaaaagtaaatgtttcccagtaacacttaatatctttctggacctcaaataaattatttaaggtaattaagtttaaaattataaattcttaggcctgcagattgactccacagatgaagatggcagccacacaagacttaagattgaatgaacgctccccctggaattcacagtggaagagaaaaccaagttgccaaagtcgtcctcaggactcagcacacacccacctctgactcagcacacacccacctctacaataatactaataataaataataaacaaaaaataaaataaattacatttactctgcaatttttgtaacaaatttttaacaatcttaaaagacttcatcaaaaatggtcattttttttaatcactgaaaaaccacttcaaatacataacaggaactctcagaaatggccaagctcccaaggacagcttacctttttctcctgcagggcctgctccaccgctatgggatcgttcagggcattcagagaggcctgggccgccttttctgactcgcttagcatttttttcagggtattcagtgtgtccaaatacgcgggtccaggctggctcttcagctctgacaattgaacatgcttgcttagggaaaacagcgctaggacttcactactgttatcgactgcaccattaatcttctgtatataataaggagactccagtagataataaattagatcccctgattacaactgaaaaggctctctgttgcttaacaagaccagccatccctctggcatttcagacagacagaccgtggcttcattcctctcgaggctggtgtttgaactattaactcgctagcatttttctccatttgatcatgctgaaatgtctctatgaagcttgaaggacaacattcgtttttgtctcacacaacctcccctcccccaaatgatacccaaagaataaacagaagcgaagaccctgccaccagccttcctgaaatcccatgagtgtacacaaactacatgggaaccctaagaccgtaagaaacaggggtgactggcaacagccagctaacacagagtatccctctgtgcctctgtacaaatcccagacaatcagcatttgtaccaaagaggaagtgagctgaaatgtgaagcaccaagaggtgaaaccaattagcagcatgagttcaactgcccactcctgatcctcgtcataagggaaagcttggtttgcgggggtcagccgggaaagacatcttctctggtttttaatgtcacactaagttaacagatttccatgagtgaaatgcatgaagtccaaatgcacagtcaagagaaaagtaacatggtgcctttgtctaacatgcatgccttcctaatgcctgtacatgctgtacgggagctaacatggtggaggtcacagtcagagcacagagagcacatggcacatgacaacccagggcagcagctgacgagacacagaaagcgacatacaagctttccaaatccagctacccgaaccagcttcattccactgtctccaattctaccttgctcaattttgttcaaattctggaaaagcaacatgatccctttcaaggatcgagtggggctactaagaccttaaccactgggagcaaacagaaatcgatgatgtttttgtttgatgagaacaaagtggtttctcccattaaattctccttaagggctggagtgcaaatcatgtgcctagcaagcatggggcactggggttcaacccatcaccaccaaaagaaagcaaagtctcccagaagtcactatatcctactcatgcagttttacagcatgccaagctggcttggtttgttgggtggttgtttgtttgtttgtttgtttgtttgggggagggatgttgttgagacagggtttctctgtgtagccctggctctcccggaactcactctatagaccaggctggcctcgaactcagattgcctatccctctgcctctgctgcttcccctgcccctgcctcccaagtgctgcaattaaaggtttgtgccaccaccacctggccaggtctgaatgtattataatacttcaagccacagggatgcagggaagaaagcatgaagccagaatgaaactcaagacacactaaaggtggaaatattgggagtaattttagatttaaggaaaactaagaggagaaccagaggaacagagacagagaaacagagacagaaagacagacagacagacagacagacacacacacacagcagaggagagccaatatttaccattttctagttgttgttggtattcctctaaagccttccgcacagcctggtaatgatgtcgaaggtcgtcaaaaccctgctggacaaaacctgggacacagggctgagacttcagggctgaacagcttgcacacagcgtctcaattctggggtgaaggccaaggagatctgtcagttccctctgaggaagagaaaatacggtcacttcactccatgaatacgagcgttcccataaacagttatgaaagaagcaaagacaaagctcatgataccagatccatgctcccccgctctctgctttctcttcagatttcgagaccttttgccttttaggagatacagcctctcgggctacagatacggctcagtgggtgagagcgcttgctaagcaatcatgtagacctgagtctggatacccagaacccatgtgaaaatgtgggtatcaccacctgctgcgaccctggaattaagggagggcagtgacaggagggcagctgggacttactagacaccaggctccaggttcagtgaaagaccgtatctcaaggaataaggtagagtgtggtagggcagggcacctaatgtcctcctctgacctcttctggcatccatgagtagagatatgtgtgctcacacacacacatgcatcattcaccacatatactgaatgatatttcctcttcatatatgagattcaacccagaaaggtctccatgagtagagatgcacaccccacacacacacacacacacacacacacacacacacacacacacagcccactcaccagacacactgaatgatatcttctctttttatataagagactcagcccagaaaggctctacagtcctatagtgcagccatttctcaccctacctggcaagaatcctttaagcctggcaagggctgccggggcgattcagaaatgggtgtgcccctcagccactcttccttctccttgatggtctcctcaatggcatcaagctgcttaaaataagcatttatatcttcctgcagctggatcttccttcccagatcttctagctgctgagatatcatcttccactccaacgaaaccctttccagaacatcgtttacttcttcagtggaaaggccttctacggaaacaaaaaggtccaggtgcatcaaagcacttcatccagtaataccaaagtggcttagaattggtcctagacatctaacacagtgaaagattaggcaatgttacgtaaaatggtcatacccttaggccatacctttcagtcatacccttaggccatatccttagatcatacccttaggccatacccttaggtcataccctgaggtcatacctttcagtcatacccttaggtcatacctttcagtcatacccttaggccatatccttaggtcatacccttaggccataccctgaggtcatacccttaggtcataccctgaggtcatacctttcagtcatacccttaggtcatacccttaggtcatacccttagatatgactattttacaccattatgatgtactaataactggatatgctttaactccttgacctaaggggagttaggaatgctaagagttcagaggtgatatggctatctcataaggtatatctataaagcatccactagttcctcttctgtagaccatgtctccatccccgacactgtaacactctgctaacttataatctgatgcaggcaaatcaactcaaatgcctgaatttgtgcagagctcagacatcagaatatacgccttctgccataggaaaatgaagcagaagactagcagaactcagagctggctgaagtctaggatgacaaaagatgacaggagtccctttgcctgcaagcaaatgggtacatgtaagaacattaaactagatgccaggttcaggaagcatcaagaagcctacgaagcactctgaacacatatgagtaaatataaacatattattattatattatataaatattatatatgagtaaatacaaacaatgccaaagtaatgataatggtagctactctggagacacagctcaaaaaatgttattctattatgttactcttacaagctcccagatttatttacttattttgtattgggggggctgccacatgccaaggcatgcacatggaggtcagatgacaaagcgctggaattatgtctctctttctactgtgtggctcccagggaaggatctaagtcattaggtttggtggcaaaaagcgttacccacagagctatctttccagccactgacaagcttaaattttttttctcaaattttagaaagctatgcaatgtccttagaattgatttaaaaaaattatctataacaataacactttccataccctttgtagtgctataaactatcattaaatcttttgttaagtgagtgagaggtggtatagaaaagtggcaatccgtggaggtttggtctgttgctatgcactgtaatgctagattctttaccagaaagcctaggcccacccgtgaactaccagcttttcttgtgtagaccttgttccttaacttaaaactactggttgaatataaggggctacagccactgactggagagatcagaggtaggcaggtttttaagttacctggttgagcatgggagaactggaaagaggagggagagcagagaaggggccatgagagacgagactaggggggccgtgagcccagatccaggagtaagagtaggtatctggggtacacctctggggaggtagccaggccagcagtcagaagatcagattataggtgccccccccccaagaattgtcaaagctaaataaaataaccagactctgagtctcattcatttgtaagctagttggggataagattaaattgattgtactacagcaaccaactctatttggcagacacacatgctgaaaggagagactcaacaccttcaggatatgagtaggagtgcagagtcttctctgtgaacatatatgatcaacatccacagtcatggaaacccaacatgaaaggaaaatgtcatggaaactgagaagccacccctgtctcaccagcaatacaaatttggaaggttttgtgtcacaccacatctcctaagaatcagagatacaaacatgcacaccatggtagaaaggtaccacccacatcagctgttcaagggcacttccaccagcaagctgctaagaggacattaaacctaagcaaggcattcacaccacagtccatgtgcaagtatcactgctaacggagtcatggacaagaaaaagcaccattttcttagcaactgtgtgaacaatggacatgcatatgatggtgctttggcgtggtcaaatacttacttacatgctggcaatacttaagcacatacaatagaaataaatcataaagaaaatttcattccaaaagcagtaattgcaaaatgattcacacacacacaaagttaaagatgtaaaaaaaaactactggtttaaagatttggtataactaatctgccacattgtgccttggttgtttatagctctgatcaagggcagagccaggcacagaacactttcaaaggcaggcgagtgggtcccacctctccctgggcaggagttgaataaatatgtgaagagctcttaaataccattaaagctgacatgagtgttagtaagttcctatcataagcattccttctgttgttggttttcccataaataaaaatgtgacagaaggggtgacctaactccccaaatgatactcccagaatctcctgactgctgcaagccaggggactatcaataaaatggccaggcaggctgcccttcagctggcctcagccacgcggaatgatggccccacaggtgccttaggggacgcacatgacagtcaaggctgcaacacaggcccaactcctgaaggtgcagcaccaaccatgagagtttgaactacacattttgctagcttcagcaaacagtagatgacactgcacacatttccacgcacattggcctttcctccttggcctcaaaacactaatgtgattgttacaaatggaacaatgtgattggtacaaatagaacacttggtataggcacaacctttatttatttttgaggtttgctgcaattgatacaaataccctttctctggctacatgataggacggtttggctcacttggggaactagctggaaaacatactcttacaccctcccaggatgtaacattaggtccagaaaaggcttttcctgtatggtcttttattgtctactgtcaggtggatgagctgagcacatgccagaaagacaggagcaacagagacagcaagaagtgacagctggagagtaaagccagcagccctgaaccagaccagcagtggccaagggatggggactggatgcctgacagcttcaggaaagacaggggagaccacttatgtgtgcaaagtcttgaatgcaatatatccctagtacagacgtgagttcaggggaggtgttggcagaaagggaggaacggggtttagaaaaagagatgatagagagagggaatacagaactgagcagtactagtaggctaaacttcgaaatagacatctgacaacaagacagaccagagcaattagcaggccaagctgcagaaggggcagagcctctactgacagtggcacaaaggctgaggtagccaggtcctgagcagcagcaatggggatgtagccacagacacagctgcaatgcagtggatgtgagataatagacagggtaggagagaaggtggaaataaattggaggcaagagagggtagagggaggaggagagggaggaagagggagggagggaagaagggaaggggaaagagagaggggaggagggaatggagagagagagagagagagagagagagagagagagagagagagagagagagagagagagagagattaagaagaaactacaagcatcagtcctcagaatagacccagaaagctgtcaagcctttagagccaagagtgttaggcaccagaggtacagaagctataatattggccattgcccaaggttgaggaatccctacagctatgtccacttacaagaaacaaagccagccactctcttgggatgaaggctccccacttcctaggcctaagcaataactctgatgcttatagaagagtcccactgtgggaaggctaatatcagagagcactgcctgatgtcgctcctgcctgctgaggccatacactgctgtgaacagatgctaaagctgcctacagaagactagcccttcccttgccgatccatgatttccatgcaggcggagctaagacccaaccatctgacaggcaacctaagtatttttagaagaaggaacaggtgcacaggaagtgtgcttcgtggtgtcctccctctagagttctcaaggagggagtttctgcagtcagcctggccagtcctacctgctcctgcctatgtgcacctactggcgtgtgcccgctacagtttctgcccttcaacccgggcctaaagcagcatgcgaatctcacccgactgcaacccatgccccagcctttgacatctcagcctgccacatcttttcttaagagggaaggaagaaaggtccagtaccaccaaagaaaaaaaccatatgccaaactaaacagccacagaagagaaaatactaattttaggtttctctgtgtctatgcaaggctttagtgaggagcaagggtctttgctgcttgaaaattttttgaatacaagtaacatcaaatttaagtagaaaaatgtttctagagtatattaatgtgatcctccgaacgtgaccaaatatcaaacattaataagtgtcctagatagctgtaattgtccatctgacacagcctagcatcatctgacatcctagactgaggatcacacagtagccattgtcttgatcattaagaaatatagaacaggctggcggtggtggcggcacaagcctttaatcccagcactcgggaggcagaggcagacaaattcctgagttcgaggccagcctggtctacaaagtgagtgccaggacagccagggctacacagagatactctgtctcaaaaaaaaaaaaaaaagaaaaaaaaaaaaaaagaaaagaaaaagaaatgtagacgagtccagcccactgtgggcaacaccattccttaggcaggaggtcctaggctgtaaggaccaggcagccaacaagcagcatcctccatggtttctgctttcagatgcttgagttcccaccctgacttccctcagtgatggactgggacctgtaagctgaaacgaactggttcttcccgagctgctctgagtcatggtgattgtcacagcagcagaatgaaactagaataagtttaccttaaggcgacttcatatctaagacattgccagcataaacatttctctcagtgccctcatgtataagaaaaattcagagtatgtaaccccaaaggtgaggttttacaatcttgtgcactgttggattttaattgctctgctgaggttttcaaggtttctagttttctgacccccaagtgggagcagaacgactttgattttatctgtttttaataaaaagcttcaatataagatttcagtttttgaaagattctgctgcctcaaaaaaaaattgaaaaccagatcttttttctatctttgtgtattaaatgttttgtgtgttaagctgcaaatattaagtgtgaccttctaaaataatctgagagggaaaaaaaagccctgcagggcctcaccttttcccatttgctcccggagggtttgtccggtttgattcagttcgtccagtcggggcagattttccttctgttctttctctaatccctggaaacaaagaccaaatataaaacactgaaagcatcccttctcgatgcaacgctgatgttattttaaaacctcatattttgtgccctcttaacttttctttaggtatttcaaagtttatctacaaagtactgtaatgaaaaaactacgcaattcctggccactctctagcactcggagaatcagtacgtctgaaaaagaaaattccaaaatgatgacagtgaatatcaactttagattcttttagaagggaagattatatgttctgtaattatgagttcattatcaaggggaaataattaaaattaacatttttggtctaagatcgactttttaaaaaaagctgtattgtttaaaggaaatattttgaggaaattttaatacgccaaatgctttgttagatacaagggcagaatatctctgaaacaatacaaagtcctaagttactatgtaccagaccatgtaaatttaaatctacatagagggcaataatgatgactgtatatacaactcaacgattaaggaggaaaaggggaaaacatttttaatttctcctacatgtggtgatctgatgtttacggtgaagctctaaaagccatctgtggctacatgtattttgcaatagcttctggaccctggcacatctctgtgccaatagtaaaattagcctgatgaattattttacttcctggcatattcattgtatattttaccttcaatttctttttcattcctgaggtctcctgcgacttcttatattctttcatctctgtgttctgaatggcagtctttgatttcaaaatccagttcagcagctctgtacttatagcatcaaacctggtcaagatggagacatttgcctctgtcactggtcagcttccagtgttgccttggcccaataaagaccaacctgaatgcccaccaggcaaggatattcaaactctgccccaaaatagagcaaccacccataatacttttacaattaaaagtgaaaacattatagggctaataaaataattattttttttttacttaattgggaatcatttgtatttttataagctattgtagacaacaaaaaacagatttagttagatgataacagaaaaaggacaagtacaaacatttataaaactatcctctgctgctcaatacatagttaaccagacctatctcagcctttcgggggcctcaagtcatcaggaagcaactgaaattgacaagtaataagaaaagtatatgctaggtaaatcccaggactgccaaggactgactcctaacccatccgtggaaagcatggtctcagggcataagtgtggctgtgtttgacagcttcccttgcaaagagaaagcaacggaaatagaggccatattttgccagctacaaataggtgtgtctggtatagagagtgatgcgagggaaggcgaaataatgatgtggccaagagtcaaaggggccaataaagccctgggtgatagatgatggatttaaacaaagagcagtcatcagctgtgttaagcacagaactgataagagtctgttcatagtgtccagtcactcactgtggggccagaacccaagactgcacagaaaagaccaccacagatagaacacaagaggaactcagcgagcggtaatgggagggggaagagtgggcaggctggacatgggatcccaaagcaggtgaaaaccacagttttctgaaaggtgaccagagaccaggcccttggttaaaccttccatgtctatcgttaacgcaaagaatcctcaccactctctctgaaaatacttttgaatatcctgttagagtcgaagcaactgagctcatacgggttttgaataatggaccccatactaataaacgaagcaagagctattcaaacagaggcagtccatgcagctgcccccttaccctggcgtgactcagcatcataagctgagaagaggtatttgaaggttcctctggaaagcagctcttaatgtgtttctagtagattctgagtaagttttctgtgtaatatgtgattttaaaaggcattttctacaatatctcaaatctaaatcagaggaggcaagagttaagggaattaattaatagctaccagccagaactaacatgatagttccacattcctgaaagcaagttaaaactgacctggcatctgtggtggctgtaccccaggcaccacaacctgttaatatataaatgtcccagactagtgagcaagaagcagcaatgcttcttagggactctgcacccagccactcagaccaagcccttcagcaccttgcagtctcacctctaaatatggccaggtaaacacaatgtactcaactgactcttccttcgctagtcttccctaggacaaagcgctctgaggactgcagagagggatggctctgtaggtaaagcatttgccctgcaagatctgacttctaagtcattcctgcattttaaaagtctggctgggtggcatgcttttaatcccagagctgtggaggcaggcagagtcagccaaattcctgaggctcactgacaaataagccagggggaccatgcctgaggaaggaaacctttggaatccagagagagagagagagagagagagagagagagagagagagagagagagagagagagagagatccctgtactcacagacacaaacatccacataaccacactcacacacaaacctgtactcacgtatacatatcacatctgtgctcacacacaaacatctacataaccatatatgcacactctatactcacacataaacatccacataaccagacagacagacagacacacacacacacacacacacacacacacacacctgtactcacacacaagcatccacataaccccacacatccacacccacacctacataaccacactcacacaaacctgtattcacacacacacacacatatacctgtactcacacaaagcatccacataaccatacacacatacctgctctcactcacaaacatccacataatcacactcacacataaacctgcattcacacacatatgcctatactcacaaacatccatataaccaaccatgcacagacagacagacagacagacagacacacacacacacacacacacacacacacacagaggttttgggctattagttcccaagtgcccatttccatctactgaacccttttgcttttgtaggcttcagaatttgtccctgagccactcattaaaccccttttatttcagacatctgagggtcgataaattttacttcaacataagagtgtgtgatgctctagctaagtaaccagaatccagatgtccacagtttctctctgagataagagaaatgagcaagacacattgaccccagtacaagataaccagatagctggaaatgcctgacctgagcagattttaaaagaaacgaaaaaaaaaaaaaaaaaaaaagagaacaaaataaaattgactaccaagaataagtaattaggtaatttagggctctcaattgtctgtggagtccaacacaagttcatgaccgtttttacagctaactgaatacacaaaagggtctgaaaattatgtcatacaaggaatagctaaggagagcctcgtctttaggacaatggaagtgactgtgagagctaacctcaaacattcgtgagggaccattttgaggagaggaggttggggagaataagggggaagtgaactgcattaagactgagaggttcaaggccagcctggtctacagagtgagttccaggacagccaaggctatacagagaaaccctgtctcagggggaaaaaaaagaaaagactgagaggttcacacagcagaaaaaccagctggcagagaggaagactggaaaccttcatagccaaggttaacagggaaaggacactgcatggatgcagaagagccagcactgcacacacacggagaatctcctcggatgcccaggacccacagcaggtcacaagaaagcctggggctcggagcttgggcttccagccttgtgctctgctctggtccatgccttctcctgggatgtgcacaccgtatcttaggaaactgtcagcttctgcaacacctaagcatccctgtctacttccatgttctaggaaactggaactcccagtgggcagccatcggaccctgctactgcctacaaaagcatgcctgggctctacaaagacagcacacaggacgttctgaggcaaacatggggcataaaaaaaatttacaaatgagatttctgctaccgtggacagcatgcactcaggcctctgccgaggaattaattcagtaatgaatgtctgcctcaatccaccctcgaaggtcaggactcatgactcacaacccctctctatactttgtacaaactgcatagactggggataagggaaggacacatgacccggttcatctggacctccagtaccattgccgtcagcttataaacttgaacaagcaagggacaaaatcctggctggtgacatcggagacccagtttgctgagaagacaaagcactgtgaggaaaagcaaccaagccaacaatagcagggacggcagtgggaagtctgcttaagtgcatcctctcgccacagctgggccacttctggactgtttcttgtcatacgacacgataatgagttgttgaagtcaccttggtcacagcattttgtctcttgcagcagaaggctcattattcactacaggcaagtttaaatgagcctcccatcaggatacaccctgtctattccaaagccagccctggagacacacagtgccagatgcgcccagcagctaacaagagttcaggaaatggaagattgctgctaatgttgacatcgacagcatctccttctctgcctgctgctctggccaaagtaaaggctgctgctcacaacggcaggtgcgccagtcatgcatgaggcaccgttaggaggcagaaaacaggctgagggtcaaaaggagaatcatcagatacgccccacatcctgattcctctaataaagctatcctatggaaggaaagcttatctttttattcaggcccctaataactgccaatgtccctgaaccctgggatcgcactgcaagagggagcatgagagcaagcttgaggccgagccgaaggctcactgtgaccaggcgtaccagatccagtgcctagaacacactacattttaaagcagcagttctcaaccttcctaatgctgccatcctttaatacagttcctcatgtggccgtcacctccatcaataaaattatttctttgctacttcatagttataaatttgcaactgttatggatggtagtgtaaatatctgatatgaagggtttttgatatgacacacacacacccccaaaggagtcgagacctacaggtagagaatttttttaaaggctctgacacagcaaaggcccagtgaatgcagctgaaatctcattcttctaacaatctccagttttctttcgaatcagttagataaaagggacattttaacccaaaagagctctttcagcaaaacagaaagcatctattaagaaacctgataaaaggaattatcaaagaaaacctaaatacatggatgggtttggtgggggggggggggataaaaaggaaaggaagaagaggaagaagaggaggagagacagacagacagacagagatcgtgaggtcacaaaaatgcattgtcttcctgaactgctattgcagtgatgagcagaggaaagagattcacaaagaataaggaatttatccaaagccaaactgtcaggtcttaaaggtatgaaagaaagaagaaagcaggagccggaccccaaaacaatcgtcctctgagaaacagatggggattgataacagaagggttactccacaccagtctctaaatttagcagaggatgagtaaagtccctcagggcaatttagctgcttagctcctgggaggcagaatcttccagagactcaaagccagtaactgagctcatgactgaatttacataataatgagcatgtctaaactctcatttgattagtgattagtgcgagttacaggcaggcctgaggctgggacatctctcactttttcttggcctccacgtccacgtgaatctgtctcttctttggtgggggaggaggaggcagttcctgcttgggcttcttcaccatcccttgttctctcacatgaacggtctccaataggtccttctgtggaatctgggacatgccgagcttcgctaccgcctgagtcacctgaaaggcaagtcacgcccagcgttggctttaaatgaaagccgctgctgagagttattcacataaaacgctccctataaaaataaacagttcaagccacgcatggtgccacactctgttggcttattgacaattcctttaggcctcgcccaacagctacctagcaacagcctgtgtcaaagtccaccaggtgagagagaagggagcaagccaggcatataaggagggactggctgctaccctagcagctctctccatcttctttccctgtacccacgtatcctctctcttctctttctctctgcccttctctccccccagccccacagttctttgccctcacacctctgttgccgcttctccaggtccctgctcccttcccccacagtaagtcttctttatactaggtctgttgcatggtgtctcctcaggaagacacctcagcatgggcctgccaatatatccccgccgatgattatactgctttataaaacttaacaccctcctgtaatcctaggacttggtaggagaggcagaggttagaggttcgagactagccagaactgcacagaagcaaagggaaaagtccactgcagtgggtattggtgtgggtattggctacagactttaggtcaacatcagccatggctatgccagcttgtaatactcctccattctgcttgaataatgacaactgcccgaaccaaagtcatctctgtttctaaattatagtcacttgtttttctagattcttgccctggccatgccatgggcctgcactgatggctgcccaagcaagatgctggttgacattttctatgtcaccatttaaccttttttagcacaggacaaaagaaaacattctagtatccttgcccagatcaatccctttctatcctgtagctaactaccctagcctataagtagacagtgtgctctcattcccagactagaaaccctgagggcttttcttctgaataaaagcttgtactatctttgaatagcccatacccgtgtctgtcttgtcttctcattcactccaagacaacttaatcagcccaaatagaaccttgatatctgttcacagcatcccactccctaatcaccaccgctcgaggccactgagcacctgccaggttctgcctgtcctgcacaattcatagttcataactatcatgcatgactggcttcctctatcatgatgttttcacagttcagccacattgtactgatggctcaatctttcgtattgtcaattaataaagcacactttggatctcagactgcatttttctgttcctgtacacacaattttttcatggtataatatactacccaaatcaaaaacgtacctggttagaagagtcttcgagtctctgaaccagagaatcccatctctgtgttagctcctcagagtcactgttcatcttcttagatgccttgggattactgagtaattggcccacatcctggccaatctcactcagttgatccagagtctgcctcttcatttccatgtcttccttcaatatctagaatgtcaaatatttatcacacaacaactatagagaatatcttaggtctatatggacatgacacctgtcaataataaatctgatggcctaaggcttaggcaggaaataggaggtagggcattcgggaggagaaaggattctgggatagagccaggtgggagatttgccagaggaagatgtgagaagacagaagtctggtacctgagcacaagtaaccagccatatggcagaatgtggattaaaataaatgagttagccgggcgtggtggcacacacctttaatcccagcacttgggaggcagaggcaggcagatttctgagttcaaggccagcctggtctacaaagtgagttccaggacagccagagctacacagagaaaccatgtctaaaaaaaaaaaaaaaaaaaaaaaaggagtttttctaagttacagtctactcagagaagagtctagctatatggccaagatatctaaatatattttgcctgagtcttatttctgggagcatggggctgggaggaagagtcaggaccaacttccacaaataattttctttctctcaagaaagtttatcttcctcgggaagtataatcaagtagatttgtaatcccgccaacagtgtgttctgccattctctatgcaataataaaaggctcctggtacagtaccatggctggaagcgatgtagtaatgggaaataagctataatctgtattcattcaagtatattaactcttagttataaaacactacacatcacaggcttacaacagatgccgacagggacacacttacagccagacgccggacactgacacttagttccttctggtctttaaagttgctggtttgaactttattcaaagcctcttccttttcggtgagccaagcctccaacagacactaggagtaacaacaaaagttggaaagagacatggtcaatcacctgacaattctgtgactcacatgtagatcgggataataagaacctcaaatacccgagttcaaggactggcaaaagcatagcctctataacttacaacagattaacctgtcattaggtctaatcgatagtgataactcgtaaggtgtgaatagagtttagcatgtccttaaagggctcctgtgtaggaagagcatggtctccagtgtggcaggagagaggctagaatctgtaagatatagaagctaggaggaagtctcagatggtgctgcccgcagaagagagatatgctgttcttctggggcctccataagttcctgagaatcactgttacaaaagagtaaggctggcgcctcctgacctctggcttcctgtgtctccacaccacctccccctttggtgcacactcccactgcagtgctaagtactgtgatgtgacaggcagggattcctcgccagagctagcaccgtacttttggatgttcacaactctaaaacactgaatcaagcaagccttcaggactatgggtgcaactcagtggtggagctaccagctcgaatcattagtagaatatagtcatgaaacaatacgaataagcctcatatcactagcccctggggggcatgggagtggggtcttgctagtatatcaagctgatcttgaacttgcaatcctcctatctccatctcctgagcaccacaagcatgtgacgccaaacctggctagggaatttattacagtaggagaaaataatcccatatagcaactaaccctagatctcaagaaggtgagtagacaaaggatactaaatccaattatgctgagctttaaaaaaatcatattagaactctaggttttaattcaaaggaagctcatagattttcttgttcctgctgctcattttagagaaggaaacagacgtcaagttacatgtttgaggtgagtaagctactaaatggctgagctgggtcataaactcccacccctaaatcaactgtctgtccacagcaccaggagggaaaagtatgcaaatggtcaaagttcaaatgcaattacattaaaggaagaaggatgaagatgtcccaaagccaacaacaaaattatttaaaactcacagccaaaagtgtgtgttctttggaagatgttaagtgatggagtgagatgctcttaagacagccctattcccaaaagtagagtgtattacactctcctttttttttctttttttaatttttttttctgtatagctaaggggcaaagggttagttctggacttgcaatgggaagaattctttctcagttgtctcattaatcaacgtattttcaagctactccttacctctatagtctaccaccaccaccaccaccccaaaaaaagtgaaaattagaaaaataaaagacaaatgcagatcctatctcctcgcctagtaaagttaagatatgcgtataaatgaccagggagcaaaacagaaggtgcagacatacccttctctctcaagagagagagagagagagagagagagggagagagagagagagagagtgggagagagataaaatgtcctagcaatagacaataatgaatagacggcctatttaaaactacaagtgacaggctagagagatggctcagtggttaagagcactgactgctcttctagaggtcctgagttcaattcccatcaaccacatggtggctcacaaccatctgtaatgggatccgatgcactcttcttgtgtgtctgacgacagcaacagtaaagtcacatacatgaaataaataaaacttcaagtgatacagttggtcaaaaatcccttgttttctaaacatttttttaatcctaaagttatttccaaactttaatagagtttctattgctgtgataaaacaccatggccaaaaggagcttaggaggaaaggctccgtctctaagggacacagggcaggaattacagcagagaggaaggaatgccgccagctgcctcagtcatccaggctcatgctgcctgcttcctgctacaacgcaggaccacctgccccaggggcagcaaccccaaagtgggggaggccctcccacatcaatcattaaagaaaatgcccgcacagacttgcctacaggctaacctgatgaagacattgtctcaattgtggttcctcttctctaataacacactacagtgtgtcaagctgacaagaaacaaagaagcaataagcaaactggaaaggcagaaaaggcaaaccaatcttgttctgataatgactgatgtccgtcattattactttagaaaaataaactactgtatgggatgctttgatttgaacataaagatctggggtgatatacacattaccaaaatgcaccatccatatgtcatgaagcagaataaattatacaattgttttggtgggtgtctgtcttgagacaggttcttttaacccagattagcctcaaacttgctagccagctaagtataaccttgaaattctgatcctcctgcttatgtctcggcatgcaaggtaagttgtggtatacaccacaacacccactttatgagttactgaggatttaacccaaggcttcatacacattaaacaagcactgagtcacagccccattatgtagtccctgatttaaagaggaggaagaggaagaggaggaggaggaagatcattgaccaccatgcggattaatcatttgtaacagtatttaaaatgaactatctgcctctgcctcagcgaagccccaggatctcacccatctggttcctgaccccatgcagagaacagagctgctttttctggatggaaatgcaacagagccaagatggacgctgtgggaaccttgtgtctgcttcttttctaggctacagctgcttggcactggggagaaattttttacttctttgtactctgttttgataacaacctttgtgtaaagctaaaaggtgatcgaagagacaccaaaccaagagaaaagctgtgcagacggctttgcacacggagccactgaatgcttatccaaaagcaatgctaggaaatattttctcactagtttcatcctgtatgctggttaaaagttaagaggaagattataatttaatattcacagcatatggagaatattcctgtaccttttatttactgagcacaaactgtatgctgggaattgtgctggtacacattcaaacagatccctcaacaaaagcccatgagtaattaaaccatgaaaagtaagtcaagacaggaacagacctaagcactaacattgtaaataatgaacagaaatcaaattactattaccatggagcctcataccatgatcttaatgagtaagctgcagaaatggatataacattaatagaaatttgactttcaaaataataaataggggactggaaatgttgctcagccggtaggctgcatggctaccatgtaaaggaaggccctggcttctccccacagcccccacaggaatcggggacgatgccacctttactgctggaggcagaaggatcgattgggagctcagtgccatccttagttacacagtgagtatgaggacagaataaataaagtaagccaaaaaatatgtaagcaagcaaaaagatgaattaatgaatgcagcagcagtcaataatgcatacacatttgtataaaacttaaactgatagaaatggtcagattacttgttttcccttggttttttttttttttaatttttaaagtgattagcaaaccattatttccaaatttcataaattattttcaaaataaggcctttcaaaaaaagggaagagtgtagctagctggtctttggctactttgtgggttcttcttccttccaccctcttctacctacgccttcaactcgttcgattccataacactagataggagggagaaaagaatagaggggagagagcaaagagatccatgaacaaagtcagggaccagaaaggggtcaacgttatccttagactatttcctgctgattacgggtgccaagtccttcgatgtcaggatatctaatttcttcttgttgtttcttctttgtgcaggactaaccttgaccaccaacaaagaacaacccaacaaccctcagggccccaggatttatatactgttctggctagttttgtgtcaactcgacacagctggagttatcacagagaaaggagcttcagttgaggaaatgcctccatgagaaccaactgtaaggcatttcctcaattagtgatcaagaactactttttccttctacaaattgataagaatgtaacaaaggatcctttgtgagccagaaagaagccctcaccaaattggactcattaccttctaaattgcaagacacatttctttgtttatatgctattccctattaaggatctctccctctcccctctcattctctctctctacccccctctccttcttatccactatgatattaacaacttttgtccacagtgtcaccaccacttgtgggtggaaccatctctgggcttgtagtcttgggttctataagagagcaggctgaacaagccaggagaagcaagccagtaaagaacatccctccatggcctctgcatcagctcctgcttcctgacctgtttgagttccagtccagacttccttggtgataaacagcagtatggaattgtaagctgaataaaccctttcctccccaacttgcttcttggtcatgatgtctgtgcaggaatagaaaccctgactatgacatataccctctgaagagtccacaggattacaaaggccacacaatcacagaaaatatctgcagctggcaaaatcacatccccaccagagcacgaggcaaatcataatcagctactgggggagggggaacaacctaagataaaaaaaaaacatattcttataatatttctgtgttttttaaagaagccaaagttccagaattctcactagagaagagggcagccacattccacagccatactgaaacgatgggctccttgtcactgttttgtcctcagtggacagtggttgagtttcatacctgctcttccaataattcctgccacagaatactgatttcttgcaacctgttccaacgttcttcagtccagcggcatacagctgtccagcgctcacccagtttctagggaagggagaagcagtctctgtcagcccagccaggagacacaattactacagttttccaaaacaccaatctacaaaaaatacttttaagtacatatatgagaaaaaaactaactttcatagggtagacttacttaaattactcagagatgaggaaaaaaaaaaaactagaattcctgttcctacttcactgtaaggtttgtatgggaatgcaacatttcacatgtatttgaaaattgggtatatgtgtctgagggttgttgtatttttttttttcaaccactgctacaaccacaatctacatgtttactttctatgcttcaaaccttccaggctatggttgccttcaccaattcttcaagtgactgttctgggggaagcctgggagtcacttgaatgagttctggtgcttttaaatgttgtcaccattatacacaagggagcagaataacaatctcatgccttcactgcaaggactcgaatgaaacaaggaatgcctagctaagcctgaaaccacacaatgaggaggcctaactgggagatacaaccaaaaacaggtgccatgctttgtgtcccaccccaccccaccccaccccaccatgaattcaaacaagaatttaactaaaaaagatttgcataaatagtatcaagaaggtggaaattcagattgaggatgggctttgtttctggttagggtggggaaatctgatgttttgttttgttttgtttggtttggttttaggggggttctaaatcagggcacaaaggtggccgatcatgataaattctaatggattaaaaaattaaggcagagacacaacacacacatacacatgtttctgttctattagacatagccaagggagaacatttgtcaggctgtctgaactgccagcctccaaaactgtgagctaagtaaactttgttctctatcaagtagcctgcctcaggaccttcattacagtaacgaaaagatgattaaaggagtctacttttttatacccttctgtacaaacaaggatgcccaggaggaacaatacatggaccttgaccagagagtggatctgaagggcatcctacttctcaaggtcttacctgtaactgatcttccagaagagctgtggcactctccccactgttttcatccacaatcaccaccatgtgagttaaggaatttaccttcacctgttcagcttcaaggtcattttgcaaactctagaggaaaaaagaaaagataaactatgatatctgctcttcctcatttacctatttaaaaatccgcttcttcacgatagtaattaaggaacctaatgaggcatggtattgccattcccaaccattaccctaagtaccatactaaagaaagaaacctgaacacacccttacatttcattaggagccagagtctgcgagtgcaacttcaaaaccaattgtaaatgtgtgacaatgtgtgccattttcagtcctaattcttcccaaaaaaacaagtcgaggtagaagaagatgagaaggaagaaggaaaggaggaaaagaagaaaatctgtgtctattctaggaattaaaataaaaatatatccatatgcaggtatcccagcactaaagaggcagggacaggaggatcgcagtgagtgcaaggccatcgtggtctacatagaaagttccaagtcagctagtggtacacaatgagacactggaaaataaaaaagacaaaaatgtagacctgactactctaaaaacccagagtttaagcaaatagaatcagaggtcattttctgtagttccataatgtgcaaaatgaggaaaaggctgtatgactcatagaagctattctgattagctccccaagagagcaaccaagaacaagcatatggacaccttcacttccctcttccacaggaagagaacagtcattagacatctgtagagagtaattggtttaaacagtagcaagagtatggtgaaatgcctcttgggtagtgtttcatgtgaccctaaagccttagtatcagctatctagatgtttcactgatcaacaaaattctacctttcttctgctataaaaaccgaaccactcatctcagaaccaaaccacactgtccaccatgtgctggttcctcactcagcacttcatgctcttctgaaaagaggtaacggggggctagagagatggctcagcggttaagagcactgactgctcttccggaggtcctgaattcaaatcccagcaaccacatggtggctcaaaaccatctgattccgtcttctggtgtctgaagatagctagtgtacttacatataataaataaagtaaatcttttttaaaaagaaaaaaaaaagaggtaacagtctccctgacaggattgggtatatatcctaatcctaattaagtataagtatatatccctgtttctttctccacccacactgtgtattcctgcccatatgttcaggttctcatgcacttgtgagtccaaaaccacccttgcctggctggagagatggctcagtggttaagagaaccaactactcttccgaaggtcctgagttcaaatcccagcaaccacatggtggctcacaaccatccgtaatgagatctgatgctctcttctggtgcatctgaagacagctacagtgtacttataataataaataaattaatctttattaaaaagatttataaaaaaaataaaacaaaacaaaaaaaaacaaaaaacaaacaaatcacccttgccaaatgtgacaaatgtcacacactttcagaagaaagacatggacatgtgtgcaaagctgtctctttccaaaatgtcacctcccaacgaacaccttctgaataaaaagcaacagggaagaagtagcccaactccacaccgagagaagccatcaggccccgggtcagctcagcactcttcctacacaaggaagtagaaaaggaacaagcagcaaatttactttatgttcttgaagcagcttctgcagggagggcaggtcatcacccagcgggaggctctccatcttctgaatgcgctcttctgtgagggccagccagcttgagagctgctgcagctgtttcttctgcagctccatcagagcgtcgtgcagcctggccaggaggacagagtgtcattccctcgggcttgtcccctggcacgggcacccactctgagcaccagggaagcgggggcaggaaaacacagccttgtgtaccctaaccatccaagtagcagagagtccatcagtatagaaactaagggggaaagctctgatttgattcataactggagttcattaagggcagtcaggaatataaataacagctccctgtattcaaaacagaatcattgtttctacactcaggaattcctggcgtattaaattggtggaaacggcaccggaacgcgaatcacaacgtggaaagtgaaacagaccatggtataagcctgctctttaaactgttacagaccactgaacagtaagtaggcccgtggcacactgtcctgtggtgacagcctcaatgagggggctgtctaaatgaggttaacctgaggccttgtctgtggggagctgcattgattattaacctaattgatataggaaggctagtctgaaaccgagcagcaccactccctggttggggccctggactgtatgaaagtaaagaaagccagttgggcactagcatgggcacagtcattcttctctgctcctcactgtgcagtgacatgactactgaattcaagctcccactcctcgggggtccccaaaatgagaccaaaacctggaattgttagctaaaataaatcctttcctcccttaagttgcctttttggccagggtgttttatcactgtaacaaatataaaattacaatatcacccatgcaaaatataacttcccctcttactaccctctgcattccaactgtcctctatgatcttgacagagatgagactcacagagcggtgtgaggacagtggaaggcttgccctgtactgattttagtcacagccccgcaggcctgtacttgagtgtcactgtgcactgtggtctggggagtcaggctctcggtccttgagctccactcaccgggactgcctctccatgctctccacccggagcgcctcccaccttgcattcagcaaggtcatctgttcctggatctcaaactcctcctcctctgacagagtcccttgtgtcatcagctggttgccagcctgcaggacgctccccacgctgctctggtgtgctgtcagctccatcataaaagtctagcaaaggagattgtggtagttagtgagtcacttgctgcgaagacatgaaacaacaaactggtagtgcataagcccaacagcaacgccccagagaaaggaacctgtgcaaagcaaagacggaggaggctttcaccaaaggtggaaagctctgaaatgagagatttggtattaaccataactcaagagaaagctagatcaaagaaaacaatgttatggatgataatagtagattttaaaagttttacaactattcatgggtgtgtatccccattcacccgtgaatgtgtccatgtacacacaccatgttcagcatttcaacacacatatagggaatcacaggacagctcataagaggtggatctgtcattccaccaagtgagttgcagggaccgaccttggatcatcagttttgcagcaagcacctttaacagctaagctatctcttaagtaaatgatgattatgttgttaatgtaaaaatagagaagaagaagaagaagaagaagaagaagaagaagaagaagaagaagaagaagaagaagaagaagaagaagaagaagaagaaggagaagaggagctgcttacacacacacacacacacaagaacccacttaaccgtaaagaatttcccatagagtgaaaaatcatgattctatctctaaatagcaggtagctgcccttgcataaaatcgtgcaggaacactggatataacactggcttaatcagacaacaaataaaaatactggcttttagggtagcatgagaaacctgattatttgggatactagttggctatgttgatttgcaactacagctcaatatttcaaaaaggaacaatgttcacactgatttaatcctcagttctaaaaaaatacacaaaatgtcacaagactgcctgaaatctgattctcatgaactgtcgatcactccagttttctaacaaagcccacgtaaataatgcaggcactacatcatgatctttttacagagcatcatttggtaaataccaagccaatggtgaagtcactccacctaccaccacccctaaaaatcaggcccggccctggaaaaatatggctctcggccacagatatttacttcatgggtagcaaactgctctttgacttcttcgacatcatcagaaatgtcatcttgctcctggaacgtgtcctccgcggacagcagccacgtcagcacttcctctagcgctatctggtagctgtccaaatccatgtccacttcagtgacggtgctaggggtctcagctcggggactctggccttcctctgccagcactgcactctgtggaaacaaagccacagcaaccatgaacatacagacgctcaccacatgagcaatgtctggagaaaccaaggtagggactaggatctcaggagacaacccccagttttcaggagctgagtgaatgaagccatgaattaatcagaggacactgacagccaagaaatacaaaatagagtacacacacaagcgccacattggaagaggcatggagagaaaaatatcccacatgagtcactggacaaaaataaaactccaaatgccagtatttgacttcaagacatagagaattttgatggagaactaagaacatgctggcccttgaacaacggttgcagtttacagaatagagagcctgacactctgctttgacccctgcttagaattctttagggaccctgcattctggtgccatgtattaaacagtgaacaagggcgcacatacaacctgtggaacggatgggatttcatgtttcattgttttgaggcaacagccctctagtgtgtgagctgttctgtttgggggatgtggtttgagggttaggacttgtaaaataaatgtctgccgatctttctctaacttactagtttctctttatgcacttaatgatcttgtaatcaagcctactggctctgctgttcctttgtttccattcaaacaaaacttcttcaagacgtgtgtaaactatcccacatgtacataaatgaggagaatggtaaaagtcatgcctacacatgttaccaccaaagtcttaacagtctgcttcaacagtctcaacatttgcccccaaatgactgaaaagctgacaaagccattttcccagacttactttttagagtaatcatacaattagccaatcaattaaaatgtttctgataacagctatgccggaataacaggcaccaactggaaacaagagaagccaggtctcacgtggttcttccagaagcctcccagtggctgtgcctggagccgatccatcctgacttccaaagctctccttcccaatccagtggccctgcccatctgcaagcagtaaccctcctgaacttctttctcccttctttcgatataccttaactaagtgatatcatctattcctatttgatttttaaaaaataatctagattcgatagatattttatttctagtaaaactctcttctaactttcagcagcaataacatctgcagcatctttaaagatatatcaaaccagacccacatttaaacactcatttgtttcacccaccccaaaacttgccaacacctaccccaggctccatgcacctaggcaccacagccaaaaacctgggtgatatacttggacacacccctctttcttccctctcccgtgtttaatctgcaaactagtcctaccttcaaagttcaactcaaatccatgcagacctctccacttctgcaccacccgtctctcctctggcccacaatggcttgctaacccttggcacccacagtcctatctgccaagccacttctcaggcagcagagagaatggtctctctcatgtgttcacacccacaggtcgcccggcctgaaatccctcactatcctttccacggtcttaagtcactatttaaaattcttgacatagttcacaaaaatactgacagggcaagaaagactgtgggcacatagagacggatcttaattggttagggagaaactcaaaggttctgtttaagtgtaggaaaaggggaaggcatgctcagagaccatataggtagaagatccttcatagatggaattcaacacacataagaatcaggaatgaagaaaagcctactctgactgcaatttaaagcataagaggtattaaatcctcatgaaaacttggggttgaagcccagaaaatgttgttttataggagagatcaaaggaatgttttcaactgagttataggagttaaagaaaccagtcatcataagtaaaaacactggcaaattaagacgcaaacaatgccagggcataggaaggaaaataagctacattctctcaacttaaaggcctgaagtcacagtgctaagataattcagaaggtgaggtaagcaaaagtctagacaatgggaagaacatgcaaaactaggactgctagtcatcagccaaaggtcatctgtgtaggcaccagcatccccccgaggggtggaaagcagcaaagcctctccatgtaaatacgcaggagcttttcaactggcgtgtttctaaagggaaactcagggattgcctactgacctcccaatgctactcagcatggtgggagaaagaggattcagagagaaggctggctggcagtcagcattccttagagaacagtggacagcaagacaagccaacgaggagacaatcaagacttgaccacatcattccctcacttaatggaacttagcctctaagttaccaataaaagcatacaataaacagcgtgagcattaaaccactcagtcattaacaaatagaaagtggtttctgaaattcttaccataccaaccttgcatgctaaagaagtgattgttttagctaaataccataaaataagtaaaatccacttctttttcctatgatttgctatgtttctgtatgagtatatacatacatacggaggctggtgaacaattatatagtgcactctcctaccattatgtgagttctacggatctaacctaaaccatcaagcttcagaacaaacaatcacttttaccaactgaaccatcttaatggcccttcctttttgagaggacagccttaacactaagaattgaaatatcttctctttttaacaaaaataaatcagtccaatgaagaaatgactgtaaatacaagaggcaagacctacaggacagcccagaacaccatcttagtcacccagtgaaagtacatcattgaaccaaagcagtgtccaggagccaaggtaaacaatttgcagtagttaagggttttccttctgcattatttgatgatcaaaactaaaaagaaaccaggattcacaatcaggctccatctctcccttttcctattcaataaggtgtttttctcctttttctaaatggataaaaataaaatgattactacatgccacccaaaatctaaaagagtaagtaaactctttgaatctcataaaaataggggaaaaagatgatatgttcaagattattataattggaaaattgagtaacttttttaaaaaaatgaaagcaaatttgctaaatgagaatgtcaaagcaaatctggagagaaatctatagtaatgacagagaaacgggcttagcaagtgagtattctttgtgttgcctttgccaaggaggtaacattaaccacagtggtcaagaggccaagtcactgaccccatccaagtaccagagggtgacatgtaagctgcagggcacacactcatccaaaatgcacttctcacaaatttgcaatcctcaccccctctttttcctcatatgtgtatatctatgtggtgtgtaagcatgtgtgttcacacgaatgtggtagccagaggttgatatctagtgtattttccaatcactcaccaccttccttccttcactgagacagtgtctctcactgaaggtggagctcagtgactcacttatgctggctgacccatgagttccgctaacccgcccatccctgtctcccagcatcaggatacagggagaccaccaaacccgatgtctatgtacatgcagggcatcctaactcagctcctcaggcatggacatagagcactctactgactgagccatctccccagcgcctgtgtgaacatctggacttagttgctaaaatgcatgacttcgaaaatctgaacggtcttccttttatgaatgaagaagaatgggattttagacaaaaatcacaaagagacaaaatatgggttgagtcaagccagggtaatggagaaagaaaaaaatccattattcatatctccttaggaaaatctcatttatttgctggtgaaatcatctgttagcccatttctggaaaaatctgatgaatgatttatagtacagtgcctcttccaggggaaagggaaagtaaggctggtattttgagaatccttatgagaagatattgggggcaaaagttctctattaatggaccccaaacagaaagaaaattactacttaacaaaaattacccaggacaacatgagagaaaacgttccccacaccaggtcaacgccttggcctctcagcataaacagaatccaccactcagcatccagttgactccatagtagagcttttagcgtaccacacagcaccacgatcaacagccccagacgctactcaccttgagaaacaaaacacttccctgtttcataaaaaacggaactcagaaaaaaaaaacacacacacacacacatgttcagaaaacaccctgcacaagtttgacctgggggaaatcaaacaggcacggcaaaagtttcgagaaaaatgagccagcacctggatatgaatttcttcctcttcacattctttcttatacttccttgggagagtctccacctctcggatggcatctatcgtgacttgctgaggaagcacctcaaacagagacgttaaatacataattatggatttcttgtcagggagatgcacagcaacatctaaaagcagaagaaaagatgactcagaaacgtgtggactgctcgataccaagtaaaaagtgactgttcttgtacccagaaacaatgcctcatttgtgatctccataatgctgcctctcaggaaattgctgctgcagatcacaaaatatggacagaggtgaagacttattcagcctccggttcttaagttttccataaggtgggcatgataatgcatactgcaattcagctcctgacaggctgaggcaggaggttcatgagtttgaagactgcctaggctccatactaactaagaccctgccttcaagaacaaattttaaaacaacaaacaaaaaactgtctcaaaatgctctaagagctactcatgtagccatttaaaatatggcacaggcttcactcacacaatagagtgggcagaattcaaacctaaagttgcaattaaagtcttcaaaccatacacaaatgctcacacgtacatgcattccaagaaaccaaactaattctgaattatttctctagcaagtaggtattcctagacttttccaatcctacttgatacaagttaactcttatctggtgaaatcattaacctgctgtctaaagactacaaacaggacaaaagatttactgcaataaagtgctttgtgggagacgggaggtggaccccacaggctcattgccagtcagcccagctgacagcgcccatgtcttaaaagacaaggtgggaagtggtaaagacacctgattccctcctctggcccacacatgcattcacatatgtgcacacacccactccactcatgcacaacagccacacatactacacacagaaaagtaggaaaaccaacacaaagatataattatggccaatatggtaaaatgaggatcccttaattgtcatagtgttttgtaaaaaagaaaaacatcatcactgctaaaggtgttcaaaattagaaagcagaatcaagttcagcaggtttttatgtaacaaacttatacatagcagaatcaagatctcaaccttaccttcaggatctagaagcttttcaattcccaaataagtgtgggccttgctaaaagcatgttcaagtctctcaattggggacattttgaccactctgtcccagctgaagagatctggtctgaaatcagtgacagaaaaatataatggaaacaatgtagatagcaccgtaattcattgcacttcaatttttttttttaatttgtgagtgctattttaaattgtatcttttgcatctcaagtttgtaaaatctaaaagtgacatgtgtgacaacgataacaataagtaagaaaatctcaggttcttggcacagttgagtgtacagtgtttcccagacagtatattatgagtaaaggagacgtatggatacagagaagaccggggaagaaaatgatacagaaacaggaggtgaaataagctccaacacagtggtaaaaacgaacctaaatatatgagttaccaaatcaattattttaatggactaaattctacaaattaatggattctatgattttattgcttcacaaatttaatgattttaatagactaaattccacaattaggacaaaggtacactcctgatattacagttctaagggttctaagacaagaaggtcaccaattaaaagctggcctcatccacatagccagtttcagtccagcttgggctgcagagggagaccctgacttgatgcctctacacaccagaagagactaagatgagcacacagatactctagtgcaactggacttagttatcctaaaagcagaggtgcaaagggggctggttcccttccgttcatctttctccatgaaaactagttttcctttacatcttgtctttcttccagcctcacatcgtggacagtatcactggcttgacagacctaaaagttggtccctttctttgcacttcactcttgtatcttacatgcaccctgagactggtctccccttcccccacccccgttctcctttctacctcttcctctgtcccttagccaccacagccaccagcctcccccatatcagatgcctcttccctctcatctatcgtctttttctttagcctgtctaccatttctatatcttcacatccccatacacacattttgtgagacagagtcttccacatgtagcccatgatgacctcaaaatagttacacaggtggccgaggatcacccagaacccctgatctttctacttcccaagttctgagatcatatgtgcaccaccatgcccagctataatttacattttctaaataaatctctgtctccagttagaaggaactgagatgtttgtctgttttgctcctgctctatccttgtgtctagtgcaagacactttatatccatttgttgaatcaaagagcctaaaaaggcaaaggataatggataaatgcaacagtttcttaacagtacaggacaggatcttcaagatgacagaaaaagagcgggagaacaggagagggaaagggtctttaaccccataacaaatcaaaataccaaaacttaaatctatagcacacatcgatcctatgtgaaaaatattaaaagcattgctttggtatcaaacattcttctcactgtcactaatttgaaacaatactacatgaagaacagaatcctataaagaaaaggaggagaaggggaaaaggataacacattttaaggttatcctaaattcagccatggctacttccccacctaacaatctaccagcaaagattaaaaaaagaaagaaaagtaagaaacaaagaaagccaaacctatattatacagagataaacttagtgaaatgtagaacataaatacagaagcttgtacttcatttgtatatagcaggcaagaacattcaggggattaaatgagaaaattaataattcataacagcaacaaaacacaatccacttttcctgcttttggcacttaatctctgagggatgcagaattacttgtctggtgtgtcaaggcacatatttacatggttaaccaactgccccataccgcatgttcagttgcaatgtcagctcaactggttatcagaccggtctatacaggagagctcttcctcagctcttagtacctccaggatggaagctctaagagcttgttcttgtatatctagcacagtccaatgctggcacctttacatgcaactataatgattctactccattttatagctctgtattcatacagtgtcatgattttttactagaaagttatttcaggctgtttattcttctggggtataatggcgacttttgtattaaattcttacatacaagttagaatctagtttatgagatttcataagaaaattgtatagctcttcgtaaatgtgggtaacacaataaacagagttgtccttctgctatcagaagaaaagctacacacaactctttgtgtgtgttactggttaggccagatgagtgggagtgaactatgtcaattatcttacacttcttagtttataaatgtgtaggagacaccatgggctttgcactccagccctgaagtccgaaagagatacccggtggttgatctgcatggtattgctttccttgatgcttttcaacatgagcaatgtgggcagcagaggtagccgaagggactatggggaagagaagtagaaaaaagacacagaggaggtaagatttgcagaccggaagacatctcacttgtgccggtggagcacggcgttgaacgcgagtccatcggtccagctggtggtgaagttgaggacgttgacttgactgtagggcctggtggtctgccgcacccagctcagcaggatcttctcgctgtttgtctgctgcaggtctgacatgatatctttcatgacatccttcacctgtgcagaaagacccacacctgcttataacgcaaagaattaagtaattttcctgatagcaataattatactcttaagaactgacagtttgtcattatcctaaagcaatatgtatccatatgcataagaaaggcctcagagaatgacagagatctatcaaaaggacctttagccaatgtaaaggatcagaaggagttgaatctaagacaatcgccatatcaagatgaataatattagtaaaagttaataaacttatataaaagcccataatacgttgatgaacaggtgggtggttgatggatggatgggtggatgcatggatgggtggatggttgacacactgataaaaaccgattttttttataaacagagctagctaataattgtagaaggaacaatggcatcagaaacttactatttggcaaggatcttaatgatttgggtaataataatgaatggctgctaaaactaatggttcaagttgggaaactaactagacatttatactgtcactaagtacgccccaacaagatacacttaataacaagggacagtcaccttacaatggagaaaaacttgggaaataccactttaacctaagtaaatatggccagagagagagagagatagttggcagcacatgaccctgacacggtgactgagaaaattcaacacttctcctgtaacaagtctatacaaggaacaagctcgatccaacgtgctggtgggcagagtcaatcccacggacattgtatgaagttcagtgttcttcaaaaacatcagcacggtgaaaagaaaggctccgaaagtgtcccaggttgaagagataccaaagagaaacccaatgagcatcgctcatgatctggacctactgttttcctggcttatcatcctgcctccctccctccactccactgctactgggaactgagcctagaacctcatgcctactgtcaatcactgaaccactgagctacgctcccaggggtatattactgacgaggtgagtcaaacctccatgagacctatagataactccactatcccaaaatcatcttcctgactttgacaactatctatcattttggtacttaatgattgtgataacacagtaacagatggtaatagtacacattttatatttgtatgttaatggtattgtggctatacagtggagttcctttttatttttttaagccatgtttttagaccgaagcttgggaagtgtatttggtgttttataaaaggaaagagcatccaaagtactcagacagagaacgccagagtaagctcaggaaatgcgggtaagtgttaacatttggggaatctgaatgaacggcatttggaaatcccttaggctactcctacaacctcctatgaggctgaaagcaaagcagttttctcaatgaaatatgaaacacctttttttctcctctgccaaaaatctatatcaggctgccaacactgtccattgggaatctgtaaattagacgtgttctctggagatccatatgctaacgccagaacatcagcaccttaaaattgagccctgtgtgaagtagggccgctgcacacagaactatttaaggtgcaagcacagtagaggagggtggccttcaaacacagcatgactgatgaccttcccaaagaacaaagggaaatctggacaccaacacagagagtgtgtcatgaagactaagcttgcctaagccagcacaccgcagtttacagcaaactcgaagttaggagaaagacaaggagctgctgagaagatccagctctgctggcacttgggttgcagacttgcagacacgaggagtttgaggcaataaacacctcctattccagccaagccgtttgtggaacttcgatttgacagctgtagaaaatgaacagagaaaataatacgaggcctatctcaaggtgactgggaaggtccccacctgccagtgcagaatgatgctccagagtaaccctaaagtcagcttgggatttccatccacaatgtccgtgcctccaatattcaccaagtccacctgtcagagcaaaataataacacaacaattaaattcgtgggacagcgtcaccatcgaactccaaaccttttgattaagtatatttatacagcaatataaacaaggataaaattttcattttaggaattggatcaatgcaaaactcaaaagcgtattatttatcctacagatcaatgagagcatcggaaaaggcatgtgacttatccgtcactcacagaacaaattcaaaactcccaccaagaggaaacactgccaagcatcaactgacatatacagcaaccagcaggcttcccagcaaacaacaatgcctgcagcagctgagatccctaaatgttacttacattgttctgatgtaaaacctgtagcactcggttgacattgtttaaggcatgcacccttgtggaaccacgttcctttggctggaaaacaaagcaaaacaaaacaaaataaaacaaacaaacaaaaaccaagtaagagtccctatcccttcatgtgttgacaaactctgacacagaaacggaagcagaatagcaggtcagcatccatgtcaccagcctgggtaccacaggatggaaattcactaagaacatcctgaaacatgggctcatttaccagcatgcctactaaaatcatctaggagacattcaaacaggcctggcagtttcctgcccccacatgagacagtgatttaaaggacttaggctgtgacatggattcagcattttcaaaattgctctagttactcttcacaggcaggtagacacatttgagaatcaattctgtcagacaaagcttttttatttaaacttctccagaggcagaaaaaaacagcagaatagtctgcctgctttctcctgcccatgtaggaacaacagagcaaagagacattgtcccaaactccaagtcacatgagaagagtgtgccacctagggcatgacaagctagtcatcttccttctacctcacgggccagggaatctcatgagagatatcggtttagcctgaagctgcccagcctcggccaggaaggcagacagaggatgcagtactcaggcttcacaatttagtacccagagagaatctcccaatctcaacagtgccagaggcactccatcagccacattctcagagatggccatcctctcctataggctagagacatagctcaagtggtagtgtttccctatcatgcatggagccctgtgttccaacctcagcactgcccaaatgtggtgtggtggacacctcagtacttgggaggatggagaggcagaaggatcagaagttcaaggtcagctacacagttaggttgtaactagcctgagggaaacaagaccctgtctgaggaaaatgatcagagatgtcctctcaccaatgatgttcctgtgaggccttcgagaagatccaagagctttctcccatctttgaggtctgagaacatatcactgatgggtggtttcccactctgcaatgaagaagaagaaaactaaggtcgacttcaggaccagaagttccacatcggggctggtgagatggttcaaggtgcaaatacgctctctggtgaccgtgatgacccaagctcaatccccagaatgcacccagtggaaagagagaagaaatcccaccatctgtctcaggggcaccacgccatgagtgagagcgtgtatgtgcatgctaataaatatagaaatgtaagaaaaatgaaaacatttaaaatacttttggccgtgtttggccacagtccacaaacacaaggaaattcctgcacagaaaaaaacaagagcctcagtttcaaacacagtctgaccaagaactacccaacgagacttaatcagttacctaagctcccttaaggcaccggctatgttaaataccaaaaagtataatgtgatgtgagaatgtactaaaaatcataaaccatgatgtaataaatctataatggtcttggatgttgtcacttcttcatatgaaagatagagctaaaagtccttccctgccagtcctagatattacataatcaagaactatctttttgtgatcacttaaaaaaaaaaaaaaactatatgaagcaagactttaaatttgagacaagaaaagaagggttccctgatcctcctactgaattcttactcggttttgaataactatagtgtgcaatctgttaagaattcttagcatgtatcttaaaagttcataggctctaggagggaacatgtggcccaccacagaaacagtggggaataagctggaccctgtctctgaaatacagctatctcttcggtttgccaccgtgttgtagacacatagattatctctaccaactacagcaacaagcagactagatgagctcagatgccactttcgagagacactggagacttctgaactatcaacaaagcaaagggtggacaagcccttgttaacagcctgtcttcgaggctcctctcctgagctcacacagagctcaatcctctctcatgtcttacgcagcaaagagaaagataagaggtcaagtccatagaacagaatgagttatctaggggaccgccacctactagcattcactttccaacgtacaacaaaataatatgtaaaagcctattataaagtgaagcaaattccattatttccccatatcagataattgttgatatctatcagtgtcctttgacacaagcaggttgtgctgtacactagccacaaactttagtcatgttacctggtctttacacactcacttgtttgttaaaaactcaaatggaagctgggcatgatagtgcacgcctttaatcccagcactcgggaggcacagacaggcggatttctgagttcgaggtcagcctggtctacaaagtgagttccaggacagccagggctatacagagaaaccgtctcgaaaaaacaaaacaaaacaaaacaaaaacttcaaatggttaacccagtattattatcagttataccacaagcaaaaccttcatgctttctattattataaaaagtactattgaagcagaagagatggcttggcaattgaaatcacttgttgctcttgcagaggatccaggtgcggttcccagtacccatgtggtgactcacagccatccacaattctagatccaggggacccaaagccctcttatgaactgttcaagcagcaggaatacacatggtgtatatacattcatgcacgcaaaacattcagacacataaaataatcttctctgaaagaaccatacattttcgataatatctgaggggatttatggaatgagtatcttcccagtcccaaattcacagaaatggtcacttgtgggaacctttcctattcaaaaacaattcacacagacacctatgtaggaataacacagatgccagaaaggctccattgcaaacgaagacttctaaaagttgccattaatggcacactctttttccctcacgtccaaatagtccaattgtttaacaggcaacaagtttaagaaaggctcctctagaatattctgatgggaaaaaaaaccatgaagatgcagttctgtccctgtaaaagtcaaatataaacgcaaggatgaccagagtacccctttcccttaaacagaaggctcatggtaacgacagctcagtttcttccttctgtttctcaatctcagacgatcactgacgacaagctatacagaatgtgctgtgaatgtgtgcccttccctccatgttcccacacatgggtgtggtacactggcagtcaattctctaagaaagaaccccaaatccctgcagaatggcagacaaggaaggtgatggggctccgctggagagagtaagagatggtgcctagactctcacaaggaactcatcaaaatctgtgctgtaaaacttatgtgtgagtgatggccttaactaatactcgggaggcaggtggatctctgtaagttcaaagccaccctggtctacagagcaagttccaggacagccagggctacacagaaaaatgctgtctcaatcaacaagcaagcttctgtgctctgtcaaactctcaggcccctggatccagttacccagcaccaaaaccattcccccaaggacaggcaagtattctgtcagcaagccatcaatctttaaaccacagtactagtttccacccattcctacaattaaaatggtgaaaaatattaaaatactctacttgagactagttcgttcctgtcctttaagcacaggcatggccgttccctggttcttctctgctctgtccagagcactgtctcccaggaaaatgttaacgagctgcctcagcatcaaaacactagaaaaggcaggttcttttcttggtagtttatccgccgagtttttggtttttgatttcagttttgtttcattctgagaaaaggtctccctttgcaccttggctatcctagatctcactctgtagactcggcagcttcttagtcacaccgtctttgggagttttaaatacttttgactccttgaagaaggaactgtctgtgagagtaagaaactctacacacctgtgtgtatatatttttagcaataggacacggactgaaaatgtgctgggggaaaaacatacatggaacccacaaccacggcacatatcccagcatgcaagaggagaactacaatttttggtctacacagaaagtccaaactcagcctgagcaggagccagagatgtagtccactgataggtttgcctagcaattacaatgcccaggatacaacccccagcactacaagaaaagaaaattaacacatgcatgcacccacacacagacacacatatccaagtgtgtacactcagcgcacacttagactgtcattacaaaacactaaatatccctgacacatgcaacttccaaatgttccacataaatacagaaaggactagtagtacccaagaggacatgtccccgcccaatatgtacaagtagctggtgtgtaagcagggtccttgttctacacaggagggcagaacacttcttatgtaaggacaggtcagtacatattttagactttgttggctgtgtggtctctgttgaaactactcagctctgttgtaatgggaaaacagtcattaatcatacaagaatgagtaagccaactgaaagacaactttgttctaatttcatgaacactgaagtccaaatttcatagcattaacacaaattataagataatatgttgctcctctgtaaatataaaaatgattttaacttgaagaccatgcaaaaccacacagtgacatagtaaaatgttctaacacaataacagtcagcatttactgtgtgcataggttaagttctgagaattgtatggatttagattcattgtttatacatattctttcctcctaagtggtctaaagggaacagcttcaacattcccattttacaactgaagagactgagacctaaaggtggcataacaagtgagagacagaaccaggatctgatcttacaaaacctggctccaagtccatcttctcaacatttgagccaataaatattaccaaggcatacaatgcagtaaacaggggagcaagcattttaattgcaggattgggataaagatagacagaaatgtagatgatatagagagatataaattagtagagattgaaatctagagagatacagatatatagacatagattatagatgtagctgtagatatagatataggtatagattatagatatagatatatgaatatatagatatatgaatatatagatagatatcaacttctcagaacaacagcataaatcaccacactgtactaaactaaggcaccatttcccagcagcccactgtaaagcatctctggtgttttttgtgatgtgggctgtaaacatcggctctgggaacaagtctagaaatgtcaaaagtcatcttttaataaaaataaggactgattcatcttgaacatcaacctcacatttaaatctgtgcaaagactgacttgcagcaacttctttggcagagaaaatacagtttaataacccaatcacataaatatttggtgaatatcccctttgtgccttagtcctggcaaaatgctgagttcacgtcactctctccagtctccttatgggaccattttcattacttactaataaacacaaaacggtacagaaaagcaatcttgaacttggggggaagataacacttatgtcccattttactttttaaattatttttactttattttatgtgtatgggtctcttgcctttatgtggtctgtgaaccacatgcatgctgttcccatggaggccaaaactgggcaatggatctcccagaattgttgtgagctggggaccaaactgtagacctttgtaggaggagccagtgttcttaaccaccaagccatcactctaagaatctcctttttctttcaaagcctaataaacagaagcatgatggctgtagtcctagactgcctaattaggactggcccccactctcatccttttctactagtccatctttggacaatctcagtaccagccctgggcccaccattttgacaagagaactgcaacatcagtactatttcctggaacatgagtgcgactgcatttaaaagcatctgggcaaagatgctaccaatcattgctaagcaaaaggagaggtagaggcagctgtagggagcaggcttcacacatgtgatgacatgatgaagggaagcatgtctgatgggcatccgtcacacatggacagtcagcaggtgctccctgctctgtgccagcacagcatgaccatgcagaaatcaagactcgctgtttggcagggcttcctgtttaaaagacaagttgaaaatctgaattggcctgtgcagcactggtaattttctagaccatcacaccaggcaagtaagtcttgtctacaggcatactgagtcgtaagatgaatgacaggcaatcaccaagtagggcagggccacatccaaaggaaatatagggttagtcaatagtgagtctcttaaggaattgtaaactctgtgaccagtacacaagtatacacacacatggacgccttcatgacaacatgtgtgtgctctgtcacgcacacacacacacacacatacacacacacttaaatgaaaatgtaattcttaaaaaatgtcacatggggtcagctaatagctcaaatgcttttatccaaaatcatgttcagccaagactgaaaacctgaattctgtcctcaggacccatatggtcaaagggaagaagtgatacaacacattgtcttctgatctccatgtcatgtgagcacacacacacacacacacacgaaataaaacaaaacctaattttttaattaaaaataaatcaattagaatttaggcaaaaggaggcaagcaagaaagaaagctagctagcttacaaaagtaccaccagagtatcctaaagatggtggtcaagaatatagagaatattttattgtttattttttctcattggtatttgggaattaataaaaattgaaatgtctttttaagaagaggacatatgaggctgaagagatggctcagcagttaagaacacctattgcacttccaaaggtcccaagttcaattcccagcacccacatggtggctcacaaccatctgtaatgggatctgatgacctcttctggtgtttctgaagacagctacagtgtactcataaatggaggaggaggaggaggaggaggtggtggaggaggaggaggaggaggaggaagtacatacagctcttaaaataattagctctgttgacatgaaatgagtatcaaaaccaatgggtagcacatggttcagctcaaggaagcctgcagtgcctctggtagtactcacaaggagatgaaccatctccagggggatggtgctcccagctgctctgaccacacattctgtagcatcttcttttccagatcccatttttatgactattaactcccaagattcaaggagcagaaaacagcagagcacacacatccgtgtcccagactgtttaaagggcaactgcatgtgagcagcaactcacaccagaatccaggctccatgcttcacagccctgcctcctgttcagtggatatagatttcgagtctgcaattgttacccatgggaatttgtcttttcaaaaggaggaaagcagaaacatgcattttctgcattttcaagtttgcatattcttcccctaactgcactgatgaaagagcttctgtaatttgtagtctctcggctctgccagatgagcagctctgaaagtgagccaaagaaagcgcaggctccaagtcaggacacattgcccaacagcttccctgtctcccctgggagagccacatgcaaatcagactccaacaactagaaagtccaaaactttgttgcatggttttacacaccatgcaacagtctcaagagggcttatttctatttggaaatgtgtagcagagagcagggaattcacaaattagtggtgcctcatgggtttttgttaacattcctgcacagctatactcccggacactacaaggcaatgatgaccaggggtgtttaatggataaaaacataaaacacagttcctcttaaaactgcccccaggtttgcctgaggccgtaaataaatgagcagcacacccaggagcgagcgtttcttaaccctttatgcagccagtttctcctttgctcttcacctctataaaacatcagaccatgactggctgcagtgtgaactgcctttcaggaccccagggctctgaagcattgtggactcgggcaaattaacaagcacttccagctatatacatcgataataggcagacatctgcttgggaagatacaccaacatgaaacatacacgtaagtgtcctccggtgagggaattgtttttagcttctgtatagccacatatacttcctaggaaaagatagttttagatccatatcattcaatatgatcaagcccttcatccttaattaaggagacaactaaaaaatcatggagctttaagtcaagtttaagttttttcattccctgtgaattaagtagttgagggtcaggatgaagaattctactgaaagatggagagatagcttagcactggctgctcttccagaggtcttgagttcaattcccagtacccacattgtgcctaaggcccctgaaagagcagcaagggctcttaagtgctaagtcatgtctccagcctactcttttcatttttagtaaaaacagtaagaatctcaacctattgtatctattttcatgaaataacactaggtattttgtactcaaaacattattatatttttatttatatatctttattattttatatattataaaattaatatattattatatatctctttccaataaaactgtctctagctgttttctgaacatatagttttagacatatttaaaaaaatgtctgtgttactgtcactcatttctttagtaaactgtcttagtcagggtttctattcctgcacaaaaatcatgaccaagaagcaagttggaaaggaaaggatttattcagtttacacttccacactgctgttcatcaccaaaggaagtcaggactggaactcacacaggagaggaacttggaggcaggagctgatgcagaggccattggagggatgttccttactggcttgcttcccctggcttgctcagcttgctttcttatagaacacaggactaccagcccaaggacggcaccacccacaatgggctgggccctccccccttgatcactaattgagaaaatgccttacagctggatctcatggaggtaatttctcaagggaggctcctttctctatgataactccagcttgtacacaccaagccagccagtacactctggaagtgtgatttgaattatagctactttaaaggtataatcttttaatatataaacatatcttcgaggccagcctggtctacagagtgagttccaggacagccaggactacacagagaaacactgtctcgaaaaaacaaaaaacaagcaaacaaacaaaaacatatctacccttatctttaagctcaaaaaaaaaaaaaaaaaaaaggtatccactactaaatggcatttcaactcaggcaaggaggaggcccatgagcagactagaacggggctgaaaaggaaagcatgcacagaggctgtagaaagctgcccggttgccgggtgtggtggcactcgcctttaatcccagcattccggaggcagaggcaggcagatttctaagttcgaggccagcctggtctacagagtgagttccaggacagccagggttatacagagaaaccctgtctcgaaaaaaaagaaaaaagaaaaaaaaaaaaaaaaagaaaaagaaaaagaaaaagaaaaagaaaagaaagctgcccggttgaaaacacaggcaatgtggatctaggatggtgagaaggtggcagcagaaacaaagaaattaagagcaaatcaggccaagggcctgaaagtcaacagagatcaaactcgcactatacatcttaagtacacacaattctaattttcaaaagaaatacagttaacaatgagcagaacattaagcatcctctaaaagaaaaggaggcaaccaggcctctgaggccacaccagctacttcatcaaagcttggaaggaaaagaagaaaggggaaagagcccatagctggtcatagtgctccacatgttcaaagacaaggtcccaaaaagatgggatgataactcccaggcaaatgtagcactagcctggtctgaagtctttactaatacattgttcactggaagaacacatacagtaccacaatcacttcaaaggagaattcaaagagctacgcatctacaggcagaaaagggaatcaaatgtagtgcgaaaatgcataagttgctctatggcaataatgaattccttttcagctaacctttaaaaactgggtgaattccttttcccccactgttgagaatggagagcagaagacagatgaatgaaagagagaagagggtatggggtaatagaaatagctgagaaagaataaaggaagaaaaatctctatgatgatagtcttggaagtttcagagacccaaataacacagatttatctatggatgagataattttcatcatctactttctacaatgtatcaagctgtaatgtactttcaaataacaaaatgtagggctgaggatggagctaggttgacagggtgcttgcctaccatgcatgaagatttagggccaatccaaaccacagcatctcaaaaatgaggtctgattgcatatgtgctgaagttcaaggccatccttagctacaaagcaagtttgaggccagcctgagatacaggagtgcccatccccaaataataagtaatagtaatagtaattatagtgatgatgataataataataatagggaaagaagaggaagaagaggaagaagaggaagaagaggaaggaaggaaggaaggaaggaaggaaggaaggaaggaaggaaggaaggaaggaaggaaggaaagaggaggaggaggaggaggaggaggaggagaaggagaaggagaaggagaaggagaaggagaaggagaaggagaaggagaaggagaaggagaaggagaaggagaaggagaaggagaaggagaaggagaaggagaaggagaagaagaagaagaagaagaagaagaagaagaagaagaagaagaagaagaagaagaaattaaagtactaagtaatggaaggtagagctaatccagaggactgagccaaacaaggtatccactaatattttttcccatttttagaactttaaaaagtttttctaatatacgtaatagtaacttagaaacggaagatattgatcagtgaatacaatgagtaaatgaattctggatgcatgcaggcattagaattaacaagatgatcacttctctgccttttggctaagatcaagtgtagaattaacaagatggtgtctcatagacactctagataggggggtagcctgaaatgaaatatcaaacaatatatcggttttaaaacaaattcctaaaaggcagaagataccattggtgtctatgtggaggtctcatagtgaagagagccaacagacacacaaaataaatatgtttcagagttcatcaaaatatatgcaaaagggcctaggtaaacaagaaaaataataagtttattttcttttaacaacctgtgtgtatagaggagatatagacaggtaggttgtatataggtggatagattaggtaggtaggtagatagatagatagatagatagatagatagatagatagatagatagatagacagatagattaaaatgatggatgatagattaaaatgatggatgatagattaaaatgatggatggatggatggatggatggatggatggatggatggatggaaagtcagacagactagcttcaggattgctcaatgaggctacacaaaaatggaaatgcaagcttttcaatcccaatgagtattaaactgcataggaattccaagcccacaaatgtactgtgccctctcctacccactagtagactaaagtcagcagaaggaaggaaaacagaacgtggatgaaggctgttgaacatggatggaattcccttccttccagtcacatcctcatcatatcttagataaatgacttcctgttggaaacagtctgacaaagtaagttttcaaggccatccctcctttgatcttttctctaaacaaatcaagaccgcacagtctctgcgggagcccaaaagccagctcactaggctctgtccagtaactttgactctcccagcaggaactctgaacatcctaggacaaagaaatggaattacaaccccctgtgatgctacaaaagaacaacacagttctgagttaaagagaccccttcacctttctatgaatacacatatgtaaatatcagcttcattaaataaccaagggtggtcctagtagaatctgtgttatttgggtccctgaaactgccaagactatcaccatagtgatttttcttcctttattctttctcagctatttctattattccataccctcttccttctttcattcatctatcttctgctcaccattctcaatagtaaggcaaaaagaattcacccaattttaaaggttgcctcattcaaggtgtcccaagtctctgaaaatggcctttcaatgttaaaactagggcactcctttccctaataagtgcgtgaaactgctgaaaaccatgcgtcttcactagttctagcatagaaaatggccatgaccccagtaataaccaggctggataatcccacccacatgagctctcaggagattgcagggagggaacaactctggccacactctgtcactaaaccttgctgagaatgtaacacatgcagagacagaactgtgaatactgtcaagtccgtgttatgggctccttgccactacagaatcaaaccatttaacatttaccaaacatacctagcaatgctgtaagacaatcaggcacctgaagccatcagtcgtgaagcacttgtgttcttccgtcactctctgaattcttgggctggagagaaggctcagaggttaagagcactcactgctcttccagaggtcctgagttcaattcccagcaaccacatagtggctcactctctgaattctttttatatataacatatgaaacaatatgacatgattctgcacagttttgcggacgatcacatacagaggtatacacataccgcttagtgactcattctattgcatttacttacttattaatttattgacagatgtgtatgtataagtgtgtatgcaatatgcaaggggaagagagggaaatgaatttatagaggtcagaggagaacttggtgacattgcttcactccctcgaccgcgtgagtcccagggattgaactcaagatgtgaggattggcagaaggtgtctttgcacactaagtcagctccctgacccaaaatcctgcaatcctcactactctatctgtccgttttcacaccccttctactctcaagggcaagataaaacaaccttcaacaaaaagctgtaaaacctaagaaacactgcagtcaagtaataaataattaatatctctgagtaataaataaataataaattgagtaataataaagtaataaataaattaatatctctgagtctggagataggcactttggttttgtttaggagatggggtatccttatactgttcaggctgacctcaaactcctgggccaagtgatcctcctgatgcagcctcccaagtgtcatgtgccactgtacctgacctgtgagacatggggcaactgtgaaatgtgtcactatttaaagtcaccgtaagtcagcctctccttccctccaggaaacaccagtgtcggtggccctgactttacaacttgtaaacacagaactttcgactaaaagagcttccaagagactggaaagattaccacccacacaagagcactggctgctctagcagagggcccagttcagttgaagcacccaggttatggctcacaaccatctataactccaattctaggggacccgatgccctcctctgacctctgaggttgccttcatgaaaactgtgcacatacatacaagtaggcaatacatctaaaataaaataaaccaatctctttaaagggatcttccagactagtttaaagataaccaaagaaacctttcttcttcaagttcctgtcttagagtcaatcaacccaaaggctgttcccatataagacttggaaggggtgggggtgggggattcctaccttctataactatttcacatttaaagccaatgtgaaacccctcattttaccatactccacacctctccctccctctcccccaattctgagcatagcaatgattatgttccactggttgcagatgctgataaagagcagacaagtaaaggagagagaggatggataatgctattagccatactcacaggaggaaaagcctatcactgttgcacagggcagaaaggatgcctgagttttcatggttaaccatgctaaaggaactggtcatcttttttagctatgctaaagtcagaaggaggcactgaccacacagtaaaatccaccagcatcttggataccttggaaaatcgagcgtttatccatttggtaaaggttttcttctgtacatcattgtgttcatctgcgggagagaaagaaaagacaagaacaggatgaatgtttgtactgatggtgagtgtaataaatacaaccatctcctcccttggcagcttaagattgacatgtatacagcacgaggcaagggacacatagctattaatgaacccactgatggggaccaccaacttctacagtaaagtgagactcagtcatctcacccaagagtcctggtatgaaatccacgtttgtgtgctacactatagatgttaccttacatgtaacactttcaattacattttaagtatactatcaaacatgataaatatgtgtgatagttttaattttcagtgtgacagaatctaggatcatctgggaagtatgtctgcatcagggagtctatagaaccagctggcttatgggaatgtgtgtgatgaactgtcttgattgtgctagttgatatgggaagacctgctcctcaggggaatggcagcatcccacttagaatcctagactataggaaactggagacagcaagctgaacagtagggatttgtgcacgaattctccctttgctcttgactgtggacacgtgcaagtgcttaaggctcctgcctgaatccccatgacaatggaccctttcagggtcaaaaagatcctttcaggtaatgaagctagaccaacacatcccaccaaaaagttactcaacagaaacttaagactccatagctactccttcttcacacaagtcctaccccttctagaaaaaaaaagggggggaatataagatttctagtcagttatccaacacattttcttgacaaaatggggggagcaacagagtcacagtggctttaaactttaagtacagtttaatatttaatttaccatgtttaatcatgtgtatatatgtgtctatgtgtgggtatatgcatgcgagtgcaaacacccacggagtccagaagagggcatcggatcctctgaagctgaagttacaagaggttacagccaccatgcaggtgctagaaactgaactccagccattcttcaagaacagtatgtggtcttagccactccagccctcttaaacaaacattttaatgagcatataaaccagaagaatttaaaaacattatcaactctggctcaattacaaatccattgggcaaggcacaactagcaccaaacatctgaagaacctcaaattgcttgaaaatgagccaagtaaatgaagtatgtaaggagactacatggtacaatagcaccaacagcaaaagcaatgtgtattagggccaaatagatcacattctgatccacttctcatgggattctgagttaagaaccagaagagtcatccacccccaaagtcctcatctgcaagatggaaataaatattaactatattgtaagatatattgttatgctgacaagtgaaacttttccgcaaagacttgatgtggtggtttgaataagaatagctcccacaggctcatatatttgaacacttggtctctaattggtggaacagtttgggaaggattaggaggtgtggccttgttagaagaggtgtgtaactgggggtgggatttaaggtttcaaagcctataccacccccagttagcgttctctctgccttgagcttgtgggtcagatataagctctcagctactcttctagcaatcatacctgctgtctgacccatgttccctatcatgatgaccatggactctaaccctctaatactatgagcctcaaatcaaatgcttcttcttataggttgcctgggtcacagtgctttgtcaaagcagtagaaaagtaaataaggtacctggcatttagtttttggttgtcaaaatgatggcataactatgaacaaacaggaaaacaacagtccagttttatcatttcccattatatgattcaagcactctccacttttctattaaaactaacagaagtcattgttggttgaacacctacaaagtaatatcttaactacctgtgagtagttctgaaagcagtctatattcagaatagtccataaagccatgggtccatctaagtgcctcacctactacagcacacttctaggcaacatcatcacaggaagagacctgtgtgttctgccagccaagcacacaccacaaagggactgcctgtatttggtaaagaggaacatctcactaataaataagactgactacatctagtattatagtttggaaaaagaaggtccccttcaaaggaccatgtattaaaaggctttcgtcccctttggatgcactgggaaaggtggaaacctcaataggggaaccttgttgaagtacttaagtcactggcagaatgtctatgaaggggataagaggtccccctactttctcttcgtcctcccttggctctccacccattttctctgccacccattcctggctattgccacatggtacagaaactaaaggtctattcagtcatcaactctgatcttcagatctataagccaacataaactttttcttctataagtcaactatctgtcctggttgatcttttttgtcaattggacacaagctacagttatctgggaagagaaacctcaattgagaaaatgcctccaccagattaacctataggcaagtctataggacattttcttaataatcaacgtgggaaggcctggcccattgtagatagtaccacaccagggaggtagttatggaatatataagaaagcaaactgaacaagccaataagtagcataggttcctaccttgagttcctgccttggctttcctaactagactatgactcagaatatgtaagccaaataaatctttcctctcaagttggttttgttctttaactttatcttggttactccattgttcatatagatgattggctaaaacatcaagtttgtgataaattcgtgttctaatagcttatggaaagtgtgcagatttggatgaaaatggtccccatagggtcacatgtttgaatacttggtctacagttagtggaactgtttgagaaggactcagaggggtagctttgctggaggaatgtcactaggggggggggcagtcttttggtttcaaaagctcatgccattctcaagtgttgcaagaaatattttaaaaaggtaccagcacgttcccgcacatgtgctggtaactcttggccctgctggctctgtctctacctgccaattttctggtggggctggagttcccaagttcctctcattggcatgcaacaaccacccaccccacagtcagctaatacaaaacccatttacctggtagaatagaaactcttaaagcttataaataaccaatcagatttatgcatcaataaattctcaattaacaagatgctaatacaatcatttcagaaccaattgataatgataaaagctttattccaattgttctaactttctgatatcataactatttgtggttggttaaaggtacactggttcatgtctgcctccatttttctttctccttctcactctctacactctctgtccctgcaactcttagctctgcctcccttttctctgtccaatcacaggcctcctgttaccctaatgtaattggacagggaaaatcctgcaacactcaggtagctctctctgcttccagtcagtagatgggaatgtaaggtattccagcaccatgcctgcctatttgccaccatggtaccagccatgatggtcatggattctaaccatctagaactaagttccaaattaatgtcttcttttataagttgctttggtcacaatgttttgccacagccaatagaaaagtaactaagacagaaggaaaatttgtaactgaaaggccatccctgtgataaatataacagttctagaaagagagtttgcagatccataaaggaaattggagagcaaccctaaggctcaaaggggacagtatagaaggacactaagaagattcttgatgttaatggtgctgaaaggtgacctgcatctcagaaaggacagggaagaaagtcatcagccccaattccagctttatacattatctgatcgatgctacaaagtcattaatcaaggagacttgcttacatacacagaatgtcccagcctttaccatcaaacttcagaaggacagagctgacaatacagccagcgtgcaaggctatactaggtacatctacctataaacagtcactataccagcttggctgaaaagaatttaattttaaacatctgtgtttgaaacacttaacataataatatgttccatgactctaaaggaggtttacttttgtaaattgtgttgtacccaccatcctttaatcttatgaagaagaaatagaaagttcacaaataaatattctcttactttcataatgttcagacaatttaagagttctttaacgctaagcagtggtggcatgcagccttaatcctagcactcaggaagcaaaggcaggtgaatctctgagtcaatgatatcccctggtctacagaaagaattccaggacagccaagacaaatcctgactcattaaaacaataacaaacaaaacaaaacaaaacaaaatcctttacaataaagataagaaaaatggaaaatattcacagaaatataacaatattttatttttaaacatatttcaaaagtttcaactttcatgatcatattaagtctcatgatatagcccagcagtagtgaatgtgcacacacccaaagctctgcctccaatccccagaagggtgaggtgctggggagtaattaaagtatctaatgatgtacagagttttctctgtaggttgaccacagaaaggagtaactaccaatttacctttctatgccatctactgtagaataacataaaatttgaaaataaagtcccacataaagagatgtttataagaacaaagcagtgtttcccctaacatagcctagaactttttagtcaaatcaacacatatctatatctcggtgcccaacatgaaatggagtgtttggccatcaaagataacatccaggcattcaaaaatattccaaaatgtacagatactcttttgtatttatttcccctaaacaacttgaaagatttgtattcaacacatctatagactgcccactcctttgcccattctcccctcctctcctctctaaccccatgatctacaaattttcagtaaaggaaaggcttttcagtcatggaaaatataaaaaatgtgaacagccaggaagggagctcccaaggaacacaagatgtgctcctagcacctgggctggacagctcaaaactgcctccaaatcaaggggccaggggctttgggggtccttgaacacttttattcctgtacacacacatgcacacacacacaattaaaaataaaatactttctaaggaaaaaaaaaagaatgagaagccattgttagtagagtaactgctctccatgtcctcattggtaactcagaaacaactgaaaatctgccatgctgttatcatttacccttcaacttcctataaaatgacacagagcttgaagagcctcactggggttgtagcccacagtagagtgatggcctagcgtgcctcaggatccaggatcaactccagttccacagaaaaagatcaaagaacttcaatagtctcaggctaagtctgggaagatgcctcaacaggtgaagatgctcactgcccagcatggtcgtctgctctgattccttggaactactacatggtgaaaggagaaaacagagccctgaaaatccctgtatacacaccatggcacatgtgcgcacacacatattcacaaaataaagaaatgcaaatattaggaaaaataggggactggagagatggctcagcaattaagagtactttctgttcttctagaacacctaggttcagttcccagcacccacattgggcagctcaaagccacctgtaactctagcttcaaagcatccaacaccctcttctggccttcataggcacctgcattcacatggcatatacacacacacatacacacacacacacacacacacacacacacacacatgcagacacacacacataaacacacacaaaataaaaaaaataaaacaatgcttagaaaaagattcaaacagtttctattacaattctcatcaaacagaccaattgattggtttaattcctgacccccccccaaaaaaaatttagaaacatacaatataacccctcatcttattaagctgatcacatacagactgaaatagtaagaacaatgcatgcagctgatctacctcctcaatgtgtattctttcagggtcccaaactgaaagcaatgtattcattagacaggaattttagaattcccttctaagagcctttgctgtcttagcaaatctcatcatcaatgacctctctccattagggaaaaaagcacggggttgaattaggagaagaaaaatgtgttaaaccccttaaggctgcttttccaaattcttctaaatattttgctcttcttaaatactcctgacatgctcatacaaatccaagggccagcgatgctgcctggcctagaattttattgctgtaatctgtaaaacaggaaacaccaatgagactatggggtttaaaatgacttcagttcgcccgctaaaatgtataatgaaataaatatcttttaatagacctttgccatgaggggaaagggagatggtcagtaggtccagtgctggccaaaaaagaatacagacccaagttcagatcctcagaacacgtgtgaaaaataaggcatggtagtacgtgccggtaatccctgtcctggggaagcagaggtgggatgggtcccagcgccttgcagccagacagtctaacttagtggttctcaacaggttgtgatccctctgtgggtcaaacgactttcacagaggtgacctaagaccatagtgcatagcagacatttacattatgattcataacagtagcaaaattacatgaagtagcaataaaaatgattttatggttggtgggtcaccacaacgtgaggttgagaaccctgatctaggtgaattaggtaaattctggatccagtaaaagaccccagctccgaaaaaatagatagtggttgaagaagacactgaacattaactctgcatcacaaatatgtgcacacacaaaaatatataacatacatacacctctgtatctattacagacagacaagccctgataaaagggcttaaaaggaaagcagcatcctcctaacatattttgaagcaatttaatagtggtcaaccagctcaccctaacctgaactccacaaaatttgagaattcagaaaagaaatgtggactataaggaatgtgtggctggaggctttagacctcggatctgctttataaattaaagcctcattcacagatttaacacatcctagaacatgacagtaattacagaagcaacaagaatgctcagcctacagcccattccctcattctctgggctcttcccatgagtgacccttaacacaccatgatgagacacggacgcgccttctactctgatgtcttctgtgctgtctaaatgaaatcaagtcattcattcacagactatgcatttaaaatatcatacagaaatagtaggtatcatctaataatctgtaacatgcaatcttttcctagacaaggaactcccccaagcagagtcctttaatactgagcatactttcaaagaacaaaaagaagaaaaaaaaaaaaaggaaaacaccttgatatggaaagggtagccttgagaatgatccaaactgactgctgaaatgctgagtttgttgggtgtcagggcaatgagaaacacaaaactgtccctttcctgttttacttcctggaactccctaagcttatcttgaaagactgtgtgagatttagaggggcctgacactgccttaaaccctctctctagaggtgtgtttttggaaagaaatcaattcttaaagccttaagccttgggggtggagattcagcttactcacaggtagagggctcacctagaattcgcgtggccccaggaacctaggaacagcctctgatgctgaaggagaaagtttgccacgtgggaaatatcaagcacagtacacgtgttgcaaacataccagaacaaagactctggtgggaggggcagctccaccacgcttacaaatgcttccctccagattgttatgagccttgttttaatcaattgtgatagcacggaatagaaggaggttactcaggaagagagcagtggggtcactgactttttaaaatgactatcaagagattaaattgactcatgaagaaaaattcctatacaattggatccctcctgttactgttgctcttactaactaggaaatctcaaggcagagtatctgttttcatctacaaataatttgagatgtatggaaactgttttaaaaaactaaacctggacaacactgcagtgatctgtcagccttggcatgagttctgcttgtcaacaacagaaatatatccttacaagactcagtcatcatagatcagtctcattccaattcatttattctattagtttccccatattgtaagggattctttaaatccctcataaatttaaaaaaatcacaatacattttttttcgaaaattttgcaatactcacaaaagcttggaggctccgtcttggccatccaagccggtaattccatcactaggaaggaatatgcagatgagggtaagcttaaggccagactggaccacctaaagaggctctgtctaaaaatatacaaatattttccctgtcttgaaaaatcttaataaaatattttctgcctgagttagggtttctcttggtaacaccctggctagaactcactctgtagaccaggctggtcttgaactcacaaagatccacgtgcctctacctccaagtgctgggattaaaagtgtgttcgaccaaaaagaaataaataaataaaataaaatagggaacaatactgccagtaacaaacatcttgttccatttgtaaatagcaatattatttttctatatagctgatatataaaacatttttcatctttgttttacatttatctagtgtgtgtgtgtgtgtgtgtgtgtgtgtgagtgtgtgtgtatatgtgtacatttcacatcttttatcttaacatccctatataatgcctaccatataattaggagatctcagccacgaaactcacaacatcacgtctattactttaagtcaaaggttcatcttcaagaagcccaaggaattctcaaatgtttaagttgacagctaatatttatcatgaatttaaataggcaaaaatatgtaatttctagctgcaaggttttttctccttaaataataagaggatgacttctctgttccctaactgctgagacttctcctccctgtcagaccaaccaggcacatcacatttaaatctctggcaagagaaggcagacttgagttttctatttaaaaatcacactgagggctggtgagatggctcagtgggtaagagcacccaactgctcttccgaaggtcaggagttcaaatcccagcaaccacatggtggctcacaaccatccgtaacaagatctctcttctggagtgtctgaggacagctacagtgtacttgcatataatcaataaataaatctttaaaaaaaaaaaatcacactgatatatatcttcagaggaatatctcacttcagaatcctctatccgggataaataggtgggtaggtggatggaaggatagacggatgaatggataggtggatggatggataggtggatgggtgggtgactcagtgcatgaatgagtggacatgtgggaaaatgggtgggtgggtggatggatggatggatggacggacggacggacggacggacggatggatgagtaggtggatggttgggtagataggtggatggacagatcaaaatgtggatggaatggtgactgggtacaaagccttatccagggtgtaactgaattctgcttatactaagtgcctgggagaagtgaaccactacatgagttaggaatgctggaaggtacgctcttctttcagcaacaggaaaggtgacaatgaaaggtggataaacaaaaggaaagcacctaagatgcagccttgggcttaaccaggagagggttcatggccacagaagcctgaaagacttcagggtgtctccgttgttcccatctagaataaactgatgaatgatgaatatattccctagacatcccatattatcagttaaacagaaaacaattccttcagtctagatgctaaatccatgagggtcctgtcagccattagctagataggttctagccatctgatgccaattacaacatgaccccaaatcctattgcaaaaattgtgctgtctagagaaatgtcatattagtaacattatagaatttatggctttgttttggttttctttctttttttttttttttttgaagatgttagagatttaacatgaaacctcatcagatagtcaagaccaggacacatatcaagaagctgaatccccagccctgattgggtttggttttgtttattaaattggtttttagtgcattggtattatgaatgcttgtatttctgtgtgagggtgtcagacccctagaattgaagttatagccagctgtgagctgacatgtgggtgctaggaactgtacctgggtcctttgcaaaagtggccagtgtggtcagtgttctcaaccactcagccttctctccatccacccacaccagcccagtttttatactttttttaaaaagatttatttatttattttatatatatgtaaatacactgtagctgacttcagacaccacaaaagaagcatcagatctcatttcggatggttgtgagccaccatgtggttgctgggatttgaactcaggaccttcagaagagcagtcagtgctcttaaccgctgagtcatctctccagccccttttatactgttttttgtttgtttgtttgtttgtttttgttttgttttttgttttgagatagtgtctcactagttgtgcagactggtcttggatttacagtctaccataggctacgattctccagcctcagctgaagaagtagcaggaacgataaccctgcaccttagacctaccctgacatataaacttttaaaatctctactagccacacttaaaaagaaaaaaaaaaaaaaaagtaaagctcattttagtatacgtgctgtttccaggttcagttgttatttagcccactacatctaaaatgctatttcagcacatactcaatgctttactgtgcactgccatctaacaccattcatcatactaagactttgtgatccaatgtgtatttcatttccagcaccatctgaatctggatcagccacactgcaggtgccctgcacccaacaatgaagaaggtcagctcagctctagaatatctttgtattcactgtaactaaagccttggtgcccttcagaaggacagagagaaatggcttatcgctcctgctaactggcggcctgacagctaaggagcccagtgcggatattgactgtcttgtgaatgccaatgatggtggcaacattttatctaaaactttcctccattcaatccctagaagatggatggatactcatacacctccttgtcaggcacttggagctaatattgtcaaccaaaagaaacagaaaattttacagtgtaaatgattactttagcctaggtccttttatagaacttctgccccagtaaatgattaaacaaaagaaactttgcaatggctagtaacagtaaatggcagttagtttcatacctaatttatagaaaacactatacaaaagaccaaataatgacatttactgatcagcaggcagagagaaagacactaggcctgacttgggctttagaaacctcaaagctcaacctactctaacaaagccacaccccctcatccttcccaaaaggttccactaactggcaatcaatcactcaagcatttgaggctatggggagtatttccattcaaaccactataccgagtgtctactatgcatgattccaaaatcaagcatcattagcattttcaagaaggcagtggttttggacttgacagatagctcaagtaacgtacatgtgcagaaaggatgaggaactgagttcaactcccaaaacccacattaaaaagaatccaagcatggtgatacaggcttgggatcccagcatgagagagacagaggcaggttggaacttggggctgattggccagattgactggaaagctcaaggtctcagctcctaagtaatggcacccaggccatcctatggcttctctatgcatgtgctttggtagactgtgcacacacaaacacacacgcacaaaaagaaagcatgattattgttgacaaggaaggataagacaggaattgaaaacaataggcaattgtaactactatgttaggtagatatatattcagaattatataggaaagatatttcgtcattgttgtttgaggcatgtaaatggccagaaagagcatttataaaaaggtgaagagccgcaggcaagtcctaatgaatgcaaacagatgaaatgagagtggtataaggcatgtgctttcactgtgcaagcatgtgacatgattgaaggtgactttagtgaaatgggggcgggggcggtataggtataggtataggtataggtataggtataggtataggtataggtataggtataggtataggtataggtataggtataggtataggtataggtataggtatagatggattcagagccatccatgataaacctctgaaaggctgcagggctgaggagaaaaggaataagaaagggggatatggaagcaatagagaccaaacccttgaagaatagcttttcccttaaacattatatgtacgtatgactatacgatgcatgactgcaaaaccaagaaataaaataccactgtatttctaaagagattctaagaaattcttatactcatttgtgttaatttctatattttttcagtgttataagaaatcatactacagcatctcaagttgtctgtcctataaaaaagtgcattttcttctacctcccatttgacatgtaaggaagcagaaagattggtgaccaagacacaacttgcctggcaggtctgactgtctatgctgataggaattctaagaataaggcgccccatctgtatctgtaattacagacaggtaggcaggatcaagactggagggagatgcttaggtgtcagtagctaagaagaagggtcccctgcagaggtcaaaaggagagttagaagcaaatgaacctgactctgttttacagtgaagctcatatatttgttaaacagaaactcaccagattaaactgcttatatttctatctgattttccagtgggcattactttccagtctgttgatgtaactaggtataaaacaactgcagctatggaaaccatacatctccaagttgactcagtagagaaacactgagcaagagggggacaaaactacacagcttacaactttcagggggaaaaaaaccctcaagtaccaacagacaaaatgacaattataaagatagaaactataaataataatgataataataataataataataataataataatatacaagagaaatcacgaacaagtcatggaccaagactttaagcactttcagaaaagcaagacaaacctgagggaaagcaagacacatttgccatttgttcctgtgctttatttaatggcatgtcacctgctgcaaatgcgttcaaatttttaaatggtattcagaattttttttcttttctctaggtgaaggtttttatattgagccttaaattaaaaccaaatgaagaggggttggtaagatggcttggagggtaaagtcactttgtttgccagtctgatgacctgagtttcatccctggaaccttacagaggtggaaagacagactcctcaggcctccacaggttcaccacgtgaggagaagaatcactaaaaatgattattttcaagtaatttaaaataattaaaatttcaaagcagcaagtccactaaagtgcaatcttctgtccaagataaatatttctaagaagctgggaaagtgtcaggaaggacgctgtgtgcccttccagaagtcaagagaaaagatttctttcaatgaaccttcttgagaaattagcccagggagcacagacctctgcactttgaggtggcacaaaatgatatgtaaagtattcccatgagctaataaaacctttttttatttctggaaatgcctgataggtcggggcaaggacaagatgacacccatagtgcaggcaaactctgatcccacttcaaactcaaatctttccgctagagtgctgatattaatatattatccttgacatcactatcaaaaattatagttctcagggatctacctcagccgatatagtgcctacctaccatgtacgaagccctgggttcaatccccaacaccccataaatgtggtaagtctctaatcccagcacacagaagataagacaggaggattgttgcaagtaaagagactagcctgtgctacattataagaccctgtctcaaaaaactaaacaaataaattaaaaaaaaaattatagaggctggagatgtggctcagttgttaagagcagtggctgctcttccagaagacatgggttttattcccagcacccacaaggcagttcacagctatctataattccacctctagtggatccagtgccctcttctggtctccaaaggcactaggcattcacatggtacacagacacacaaggaggcacaacactggtgcacatggaagaaaattgtatacaccatcacagagaatggcaattttatttactggcttctgcatgaactagctctttctttttcttcccaacacatgcctcttgaaggcatcaaaaagttcagctgtagccagcggtggtgccgcataactttaaccccagcactcgggaggcagaggcaggcagatttctgagttcgaggccagcctggtctacaatgtgagttccaggacagccagggctataaagagaaaccctatctaaaaaaaaaaaaagttcagctctgtttcacagctgaagattaaaaagtaaggtggaaatttctggttgcttctgaaactccgctatgtcatatgatgctttgctgggtcagacaggtgaagggatattttgctgaagcagactcaggtgagagatgttttcctgaaacggacatgtgagaggatttgtgatgtttacaaaggatataaatatgaccgcagacaatgggaggagcctcttgagttgctaatctttgattgtcatggcttcatacgaaggaactctccaaagaacttcaagatactctagtggcttcttgcagcttcctcggactcctgccaattggtggagctctgaggtttcttcaggattgaactgctgttgctgaccctagagtggtgctcaactaatagctgacaaccaagactgaaagagccccaaagaactatttctaaattggtccacagaccccatttcctattaacctttctttccccaccaactctagtgagtggtgggctacaagggaggttgagccagttaagaacccttattaaagtaggtttttaaaaatctaagcctacaagaaggaccttcttttcatggttgctgtcttagtcagggtctctattcctgcacaaacatcatgaccaagaagcaagttggggaggaaaggatttattcagcttacacttccatactgctgttcatcaccaaggaagtcaggactggaactcaagcaggtcaggaagcaggagctgatgcagaggccatggagggatgttctttactggcttgcttcccctggcttgctcagcctgctcttttatagaacccaagactaccagtccagagatggcaccacccacaaggggcctttcccccttgatcactaattgaggaaatgccttacagttgggtctcatggaggcctttcctcaactgaagctcctttctctgtgctaactccagctgtgtcaagttgacagaaaactagccagtacagttgcctttctgaactatgtgaccttatagccagtaaccctatcaaatttccacttccaccttcttagactggagaagccttatcgttggatcgctcttaggagacaacaaatgtattctctctagggctggggtttccttcagaacactctcactgttaaatcatttaggcacgagagcaggacctcagtcagtcatccaggctcatagcaatgtggcttttcaaagagtggaaatgtccagtttccttcttcacttccttcctgatgagctgccaaggacgtgtgtccttctgctccaaagctatgcaacagccagtgcattctgggaacactataatctcttccttccttcctccatctcacagattgtgtcaactataattcataatgaaagattttttccttgtttgaatgagtgacccttaacaataagatctggatgtttaatcattcaatcgagatttagcagtttctgctggatgacagtgaaccaaccaccatgactctagggcttggacaaggggctgcccagcagactgggttacataatacaacccagtcgctaaagctcaaacaacaacggcaccagcaaactcaaaacagtgtaagaaataaaacacaggatctgaaacagactcttggactttataccctcatgctcacaaaaggtacttactattcatgagagcaaatggatcaaaccaacacaaaagttcttcaatagaattaattagcaagacatgaactattacagagtccttacaaacaatatcctatgagatatgttacacatggatgaacgcttgggtcattgtaacgagtttcatgttcctgtcacatgagcacagctgttctgtaaatccacgatcaaagcagtcacacacatagagataaaaatcgatactgtagcttccaggggctgaggggagaggtgagagagaaattaattgttcaatgatacagagtttaagctttgtaacattaaaaaagtttgggaaagatgattgtaattgttgcacattgcaatatgaatatacagttaaaactgtgaatattatatacatgctaccaaaattttatataatggtgaaaagcacaagcaattttcattgccatgtcagtgtgattagtcttaatttgccttttgtttctggttccttagacagaatcttactcagcagttcaagctaatctagaacccattatgtagccccataatgcccctagcacagccccctgagtaattgcattatagatgtgagacaccgctcagtgtgatctctgttcattgattgaataatataggtatttgtggcaggggtaatgtacgtgagtgcaggggaccagaggtgtcagatcccccagaactgggagttacaggaagttgcaagcaagtagatgttggtactaagaactgaactcaggccctgtgcaagagcaatacatgctcttaactgtgaagccatctctctggccaccgaagtgtaattttataggagactgcagggtgctctagtgcaaccattcctccacataacagtaaagagatgggctggtgagatggctcagtgggttagagcacccgactgctcttccgaaggtccagagttcaaatcccagcaaccacatggtggctaacaaccatccgtaacaagatctgactccctcttctggagtgtctgaagacagctacagtgtacttacatataataaataaataaattaaaaaaaaaaaaaaaaaaaaacaataaagagagtctttttgtttccaaccaaactttcaacctatctcttgtttcactttgagacagggtcttaccctatagcccaggctatccttgaacttatgatccttcttcctcaacctgtgctcaacaacagccaaggtttaatatgttccttaggaatattagcaccgggtaacctaaattttagaatcagaattggctttactgtgaaagaggaacatatctgttcaaggtcactgtagtgaatggggctggttaccaacatacacacacacaaaacctttccacctttttttttttccagacaggctttctctgttcctggctgtcttggaactcacttttgtagaccaggctggcctcaaactctgaaatccacctgcctctgcctcccaagtactgggattaaaggcacctttccaccttcttatttacaagataattctggggttttgtccctccagtaaggtgaatggctaagacacccacctgctcttacaaacagggatggctacacagcatttctggccaggcactgagcacactgagtggacaatccatgaaagctactatttccttgccgagagtgacagtgacctccttgctgttggttgcccttcccccttagtcaggtccccaagcaagtcaccagccctgacttttctatctataaagttgacttgagaaaaaaaattcctcttcacaaaacccagagaaactttcctactccccattaaattcagttataatgccactgaggtcaatctaagggaagaatttcaggaatactcctggagtacaagatgaaatgagaacactctccctctctaaaattgacattaataagaacgaaatgtaacaggccatgtgacattgattgaagaaataccgaaaagactggaaactgaaataatgagatgaattaattgattaggaagtcatgggctcgagccacaaatcgtgtgttctcatactaaaactaacatttactaacagtttacttgccagattctggtgtgttcacttcaaacccatccccaccttaccttcaatagcccttaacaaagaacccatattcctactttaagaattgggtttttaagggcttatttttatctaaatatttgtgggtgtgcttgtgtgcttgtttgtttctgtgtgagtatatgcacttatgtgtgcatggaagccaggagagttaccttggagttataatctgaacttccatccctcataacttcaaagcaaatgttcttaatgactgagccatcctgccaggttcagggactgtgtatttatttctttgtttaattattttagattaagtttattttatgtgtatgaatgttttgcctgtatgtatgtatgtatgtatgtatgtatgtatgtgcacaatgcgcatgcatggagcccaaggaggtcagaagagggcatccgatcccagggaactggagttatagatgattgtcagctaccacatgggtgctgagaactgaatcctgcaagagctgagccatttctccagccccaggaactgtgttttgatagtcttggatgcatgtaaaattggggccaaacccaaaatggtaaactcacttaaaatatagcgagactctttgctcttctatttctttctttccttttgccttccttcctttcttccttttttcttcctcctccctctcctcctcctccttcttctttttgataaggactgtatatttctccagcatgaactttgtaggctacaatgtatcacaataccaaaaggtggacaaacctgcatgctttaaactacctgctttgatattcctgctgtaaagaagggaaagaaaaaggccagtaaatggctacaagagtaaatgctactataatctgcatctacatgcacacaagggttaattataaataaaatctgtcatcatctgataaaggacaatgtactgcagattcccacgctctttgaacacctgtattagatgaagaatcttctttggggggggggggggcggagtttccagacagggtttctctgtgtagccctggctgtcctggaactcactctgtacactctgtagtccaggctggcctcgaactcagaaatccgcctgcctctgccgcccaagtgctagaattaaaggtgtgcaccaccacccggcatgaagaattttcttaaaatgcagattccttaaccctcaggcctgagttaggtggagcccagtcaagtagacatgtgcaaatcaggtctttgtgaatgcaccaagctgccacactgttaccccaaatgattagcgtacttgtcttcctaagccactccctgctgaaactgcttgggggacagtggatgtcactccttctcagactgggtgcagttaagtaagctattcagaggcatcagagagcagctttcctatggcacaatgttgctagtgtatcagctggcttggtggctccaaagtcgagagccaagtcttatactgtataacttcctccaccaaattttaaagattagtattatcatttcatttttgatttgcaaaattacctatactgtacaactaaccatatttatgaagatttacccaaacaaaatgaaaatgtaaactactttctctcccctgaaggaggaagtgaaatattgacatatttacacagctttctagacattcttgcccacttggtttttgttttgttttgttttgttttgttttgttttgtttttcacaaaaaatgaagacagatagcaaatataacctttatttaaaatatattatgaataaatttattattttagatgtattctttaatgatagcatttttaagcactattcatattttgtagcctggaaattaatgtatttatcacttgccctacctagctatttctcgtatgtgcacatacatgtgtgtgtgtgtgtgtgtgtgtgtgtgtgtgtgtgtgtgtagagagagagagagaaagagagagagtatgttttgtttttagcccagtttagattggaactcactgtgtagttcagaatggcctcagtctcatgggcgttcatcccttagttctgaaattacaggcaggagacaacggagccctgggaattcacacacaggtcctgtgcaagtgaaaacctcaggcatttttcccatcttatagtttgtgttgctgtcatgtgcatgtgtacataatacatttatgcatgtgttctcctgttaacctgtctgctatggctctattttgtacaactcatagagtctttagagtatggaagggttcatatatggaccaagcatcttcctgacactgccacagaaatacagcatagacttgtatcagcattaacacattgaatgaagactgatgttctctcaaatccactggtccaccttcactcattcaattattcctgcctggacctgtcagtatctgtaacagtggcttccttctcctcagcacagtctatcaatgcacacctccactgtaacctcctgggatgattagttttaattgtcaacttgacacaatctataatcacctgaaaaggcagtgtcaatgcgagattgcctagcttaggttggcctgaggactaatcaaggaattatcttgattatattaattgatgtcagaagacccacccaatgtgggcattactattccctagtctaggaccatgaactgtgtaaaagcacacaaaatgaactgagcataattatgcatgcttaaattccatcctccctgttctggctttcatggggtggcggtgggggggcacattttatcacagcaacaggagataaaacttatacatccatcatcctaagatattgtcgtttctttcctccaacctatagccaacaccatctctcactatttcctaaattctattctttctcctctcagactggctctctaaagagcagctggctgaacagtaaaatttctaaaaaccaaattaacacatttacaaggctacaaaccaattgaccaccctgccccatcttctcagggtgctctaagcgccggcctttgtgccacctgtaaagacccagcccttcctgccccagatatctacgcatgtgctgttctccttccctcgagtcttcacaccattctcaccctctctggacattctacatgccacaggcatgtgccagggtgggttggaaccccttcttctctagggggaatggagggaggggctgtgagagagggggacctggagaatagggggactgtgatggagatgtaaaataaattaatgaatgaacgaaaaaaggttttaggtgccattttatacctttcctcaaagcagattctagactcccccctcccccctcccaagcacttaaagcaccccgttttcttccctcttatacaccaatgcttacttatgttgataacattgaggtgagttcaggaggtcaagaaatatgtaatctggtcaacataaaagttgtagttcctgatacagattgccaatcgaaaattactgaatgggcttatttagtgtgttctgtaagtctcaatgaactacatttaccaaaatttcatatcaactgttaatatgtacacttcaaaggaaaaaaaaaagagcatgaaccagttatacacattacgtcttcatacttgtgcaaataattcgagtcacaaacatcaagatgacctgctgactctctttgccatcccatccattcacgtgtttgaagatcctttctcattattgactaagataaaaatctgacttctagcaacattccaagcaaggaaatcaggtataaaaatagtccctgaaggcaagcgagaaaagcagctcaaagcccattagaggaggacatcgaccctgattgatctaagtaggaacatctcattccgttgctcagagatcgcatgactcatcggctcccattccaaagcccagtggttataaatgcagggaggatcctgattcatgcgaagagtattctgtgatgaagaaatcagaggccagttagtgggagaaccaagaactactactaataagggcaagccaaaacagcactggatggtggtgccctgcctctccagcttccaggaacagctatgcttgctgtaaccagagatgtgtggctccagggagtagatgctgtgggctatggggccacacacaggcagaagccccacaattaccagaccaatacaaccacccagaacagaaaccgtccatacctcctgtgatgaaaaaaacacagaaaccacccttacctccaacttcccacactacagacaccaaaatccaagagtgttgcacaaacctctttcagcttaaaaagatatttaagggggaaaaaacaacaacaacaacaacaacaacaacttatgtttacaagccaagttataaaattagaaggctagactgctttgactgcttttactttggtaaattcttcagaaaaataaatttatttatttatttatttatttattatttggggtttggagacagggtatcccagagcccggggtggctcatatgcagctgagggtgaccttgaactcctgatccaccccattgccttcaccacttcagtcctgttatcactccactgtggtaccagacacagctaaaagtggaaatcttttttttttttaaagtggaatcttaatcaaagagttgaaccaaggcaactacagttgtatacaaagctctctaacagctgaattcccagtgtttgctgaaatgacttattctgaacactacaatttaaaaaaaaaaaatgctatattctgaacacaatcacctgtctcaaaaaattcaaagcagaatgagaccagagagcaaagcaacaaccatttgtaagtctcgtataagtaaacacaatttgaatactaatctccccattaaacctacagtaaatccctcaaagcgtggccaccttacctggagaaagaaagcatgacctcaagctatcaggccaaaggtggtgactttcagaaattattctgtgccctgaccagaagagaggtgtcccgggcagccaccagacacagaggaagagtggaggaaacatgccaccttgcttccctctatgtgagtgaaacacactgtgtgccacccctccccccatagcaagtcacacaccagccaggttgatcgcctactggggcatacagagtcagagccacagttctactgaaggtcaaagggaaataagaagagtcagaggccagcaaaaaaaccacagagtgtatagacacacagaaatcaaagacaaatctaaccaggttgcatagccaaacaaagatctcagagggtcaccatgatgtctagctactaggagactgtgacataatcttggtactgctaatgatgaagttagaatatccttcaaagccaacttacaaagggggaagttatgaaccagattaatttcagattcatagcgtactccataagtaaatagtctaatattatttaccaacaatatttattaacactacactttacatgagcacaaacacttcttaaacctgaaaattatgaaatgcccccaagtctcatctgtgaatggttcagacaggagcacagggcttcaagatacatcaacactttttgcagagggtacaaccactgatctacatcaccaagaactgatgtctgtctgaaatgcatgttatgtacctggtaagagaccccaggtgtggttatcagtgtacctcactcccgcaagtctcacaccacaacccctctcccaaagggaagcatgcataagttctatgacgtcagatgaattccacgggactatcccaactttttgaactgccccatctaataaatcaaaccaaagagagcaaaaaagaaaaagatctctacatggaatatgacctgcaaagaagtcctttatcttacttaaatagtaagaagttgcagaatgtacagatgggaaaaacacattagccaacaataattcagcagcatctcatctcatctcatctcgtctcatctcatctcatctcatctcatctcatcatctcaggactcgctcataaatgcagacttttaaaaacacacacacaggcagctggagagatggctcagtggttaagagcactcactgctctttctgaggtcctgagttcaattcccagcaaccacatggtggctcacaaccatctgtaatgcgatccaatgccctcttctggtgtgtctgaagacagcaacagtatatttatatacgttaagtagataattctttaaacatacacacacacacacacagaggcgttaacgtgctagtgtttctgtacattcaacaaagttgtgccataattaccactcgtgtcagacatgttatttcattattcctaaaagaacctccccccacccatcccaccccccgcctccatactcatgagctgtcatccctggattccctgccctacctgtcccctgagaacatcaacactaatctcctttctatccctgtgcacttgcccagtagagagacgtcatcccatagagtgtgatgatgtgtggctgcttctgcaggcttcttccacctagcagtattctttcaacaaccatgcatagcatggccctcgccaggacctcatgtctccttgtgagcaaactctgtgccatcttttattgattatattgatttattggcagttcatcagctgccaggccaattttagtagtttctactactactactactactactactactactactactactactactactacttatgatgggtagctgtttcaggcatctgtgtattattttcgaggtggccttagggtttcttctcctttaaatgcataactcatacagaaattgctgttatgtggtaacttgacacctaactaactctcttaggagctgacagaaaactccaagagcatagtgcatttccaccagcagggtaagcctaacacttctcagccttttcaagtcctgttctctgccacgtttaggggttgtttgtttgtttttcaatcacacccaccctagtatgtacaaagtggaatccctgtggtttgaatttcgatgtccataatgctactgatcaccttttcctgggccaactggccatctgtgtatcttccttagagagacagctattcctttgcccactccacagttgtgtttgcttgcgttgtgcctgtggctgtccaataaatctttatatattgcattctagactttaatcagatgtaatgtgcaagtgtttgtttttctacacaatgtcttttcatttagattgtcttcttttactccttacaacaatcaagaggtgcagctgacaagaggtgcagcatacacctcagtccaggtcctcagcttccatcacgagtggaagacacagtcagtcctcccaatctgagacttccacatcttcagaatcaaccagctgcatgtccaaagtggtcagaaaatcttgtgtctgactgaatatgtacaagcactctttcttgtccttcctccctaaacaaatatttgcatagcattcacattgcagtgggctatacaagtgatatgcgcagggtttatcgacaaatatgatccagcttcccacagacaacatgagcagcctcagaagagaaagagggctcctggaagcgggatacgggacactgacggatagtaaactgtcccagcctgcccttcttccatagtggagcaatagaagtaataaaacaaggaggattcaaaagtccttacttagaaagaaaccatattactgaagccgtgcctagaaataccagagggccagtctcctggctcttctcttgaggaagaagagattaaaaccaagtgcatttagccttagaaggcaaaacttggcctctacgtggcctctgttcttttcaattgtaggaaacttgctgttttggttgttgagttatgtcgttgaaacaaaaggcctcagaatacaagtggtatttttgctgagagtcaaacattgcacagagtcacagtgggtgttctgggaggcgaagcctgatttcttagtcaacactcaccccttcttttaaatgtctgcctcccccagtcccacccaggcactcactggggcgagagaacaaagaggcctcagcaactcagaggtcacaggagctccctctgagtccagcctccagctacactgcacagcagagctcatccgtaagccctttgactctggctgtaacattacgctcactctgcccaaatcagcaaagtacaaaggtgctagggatacggatggatagacttgaaatgcacttgtagccccttcagatattcaattatggtgtatctcagcagaaaaaaaataaaattaattagatttaatcattgaaatcatttttataacatgagctagatgtggtagctcctgtttttttataatcctaataagtgaaggcggagtcgagagaatctggaattcaaggttttcccctcagcagacagttcaagaccagcctagactgcttgaagcgtcaacccccaccaccaaaaaaaaaagaaaaaaacaaacaaacaaacaaacaaaaaaaatcttcaaaggttttaaaaagaatatattcaaactactggtactgtgttaaaaaattttttttaggtaaggcaaaaagataaaacaaaaaagacaaaatgaaaacaaaaacccttataaaaccatagaagtaatacagtattataggtagtatttctgaaggcagtggatgtacttgcccagcacacacaaagctctggggtctatctccagcaccaaacaggatgggtttggggacgcgggtgcgggtggtacaagcctgtaagcccaaaactctccaggaagaaacaagacgataagaagttcaaggccttcccccaagtcaggagcaagcctgagcttccagagatcaaatctaaaaagaaggtggagggagagggagaggcaacatagacaccaactacatgggacattacaagccgtgctctaagtcaccactgggtcctcgaacctctcagttgtgaaaggccaaactagaaattaaaaaataaatcaagccgggcgtggtggtgcccgcctttaatcccagcacttgggaggcagaggcaggcggatttctgagtttgaggccagcctggtctacagagtgagttccaggacagccagggctatacagagaaaccctgtctcagaaaaaaaaacaaaaaacaaaagaaagaaagaaaaaagaaacaaacaaacaaacaaacaaaaacaaaaaaagtaaataaatcaaatacctaagacggcaaacccagagcgaccccttcaaaatcaggcaagcagccctgggtcttctttgggaccctgctcagtgattctttgcctgacacagaaataattttatcgttggttaaatatactatttgtaggaattaatgttgatgcttctttttccataaaacaccatgcaaagcctttcctatgtcaagaaaaggaagcatattacgggggccttttcattcttacctctcctcctggctttggcccaacaaataagttattttcttgaaggaaatattttccttgaaaaacagaagctgggaggatttatccatttgaacataaaagatttaggtacctgaaatagggcattatcacactgccaggatacctatctgtctaccggatactgtacttccagaaacccgagtcttccagaaatatgtgttttccaaaaagcattcaaaatatcaggattctaaattttaggatagtacattctaatcttctctgtatcgttccaattttagtatatgtgctgccgaagcgagcacaggatagtacattctaaactaattaaactatttaacaatgtgttatctctgatgacgggggggggtgggtaaagaaaattgttttctccacagaatttaattcatatctataaaactaacaaaaagtcagacatggtggtgcatacctttaatcccagcacacgggaggagaggcaagctgatctctctgagttcgaggccagctggtcttcaaacactcacaggacaggcagggctataacatacagaaaccctgtcttgaaaaaacaaacaaacaaaccaaaaaaacaaaaaaaaaacaaacaactaacaaaaaagtggcagaccaaagtgattattatgtctgagaggtattttcagaacaaatctctggttcacagatgctctcatcttaaacatgtatgttgacttcctgtggtgccatgaacaggtatattcatattttcaatgttgtccacaagccctgctattttaattttatcaaggttttgattgacagggtagacttttcaaagagaaagactctctctgtggttctggctggcctataaatcagtatatagcctgagctgacctcaaaaatgtagcaatcttcctgcctcagccttccaagtgctgaaattacaggtgtacaccaccatgcctggctgaaccacatatcactttaagacaccattttctttttttatattcatatggcgataataccatctgagttattgggtcagaaggaaattgtaatacacataaaatctgtaccctctgccacaagaaagacaatttaccgaaaatacatttgcgagaatggagagatggctcatggttaagagcagtggctgctcatgcagaggacccaggttctgatcccatcccacatgacagctcacaaccatatgaactccagttccaggaaatccaatgtcttggcctctgcaggcactgtgtatatatggtacacaggcacacatatactcaggaaaacattcatacacataaaataaacataaattaatctttaaaatgtgttttaagtgaatccattccagagatgagattcccactaagcatacggttcatttttttaatgcttgctatctaacctctgaacttctgcacttcccctgaatttggaatcacttgagttccactgtttgcttagctgttcacttgttttcttcccaaacactcttgaacactgtcggatgctctcagagccaacagcactgagagaaagctactgagtcacagccactgtaacgtgtagcttcagaagatagtagactaagtagatggcaaggacgttctctggtttctgtcacagtagagttaataacccacatctataatgtgtgcagatgccagcatcctgctgtccctaatgttaaaacaacttgagatggtccttcccttcccccatcaccagacaaacagacatcctgatacacacaaaaacttttttgctttttgtttttcgagacagggtttctctgtatagccctggctgccctggaactcactttgtagaccaggctggcctcgaactcagaaatccgcctgcctctgcctcccgagtgctgggattaaaggagtgtgccaccacgcccagcatacacaaaaacttttaagaacaactctctgtgctgttgttttaaaatagtagcagcagcagcaacaacaacaaattgattgctaaaaaggcatgctgacactaaacccagacatacaggacaaaatgaggaatgagcgtccatcttaaattctttgtgcttacattcttgtgacaaagaaatgatcagaagttcccactatggaagacaaaacaatataactacctggtccagtctccccacaaaagaccttcatgtactgatagtgagatcctgatggtgacagcatttcactacctgaagcatagtgtgagacatggagcagcatgtgttcatttgggacaatcagctgattttggaacagggcaatcattttggcttattccagtatgcccaacgtcaccacacggctctttatatgcataagaggaaggcaggagagaattggcgtcagcaatgtattagaacctgacctataactgctgcttttgagagtgccattgaccatgagccaaggaatgaagcagcctgttggacaggaaaaggaaacggactcatccctggtactttcaagaagggcagagcccaccaatatcttcattttatcccaatgagatccacaacagaaccccacaactgaaagattaaaggactgctaggctggaaaatcagcattaatgggacacgtctggcagcaagagggaactgacatgggaactgacacagccgccgccaccacacacacacacacacacacattcacacagagaggggggagggagagagagagagagagagagagagagagagagagagagagcaggtctcaagcagaagcagaaagcagcaggagccttcagagagccagagcttcgagcccagcagggcttaattacaagctctgggtctccacacataatccacaggatgattccataggtgcagacctggaagacagaaatgtgacagccgcacccctccaaggctccttttaccttttgctagaggacagaagggagaagcagatgtccatgggaagtgccttcagcaggtgttagctgggattcagcctagatggtgctgacccaacaggggggcacttcatcccttggtcacagtcacactctgaagagcagtgagctcagcctttggcagcagaatcttaaatattaaaatccatgcagggagctttgccatcactcattttaatcactcactggagccaggataatcatgcccagacttccagcctcaggagggaagtcctccccaacttccccttccagctctctcatgagcaccacgccatccacccacacccacacccacacatgcccctgaccttgaaattaattctgcacctctgaacgatgctcaaaacctgtggtctctgtgtcggccctaacaagtcagcccctcaaacctggagcattttccctcagatccggattcccatcaacccccacgtctttccttgaggccaacatgtaggtgccactgatggttcaactctgggcctcctatatgccacacaggctctggaagagtttgtttgaattcgagtttgagacatggccaaattttcccaggctggggttgaagtccctgaagcctcagacagcctgaattaagaatcaggctgactcggcctcctgaggagacaggattacacgtgtgtaccacttgtgcccaaatggtattagctttcacggagtctttaaagaaagcctctcccttagcagtgtagcactctgtccactcctttggaatttagacaggacttaattccttgcttactacaaatcactttacatgtccatgcctgcgtcatcagctctcctaatgagaccttaatccttagaggaagaaacagtcttatcccttcactcttccccatacttctttacacagagaaatgatgctgatgggtagagtccaacgaagactgcatctctacccgcctgaagtcacctctaccctacacctaagttcacacaagatgagttaggaaggccttggaagctgtctggtaagagactggagaccctgtggtaatgcaagcaaacagtaacttgacagagaaagggaagtcaccttgccaagtcaaccttcaaccaccttagttcgtacttgttcagagataatagactctccctctatcaacttcaaactaaatctgcccttgtcatttataattaaaactgctagctagatcttgtgataagaaaccctctatccaaacagacatgaagagatggacttcaaaaagatctaggcagtcccattctgccacggagtgctattagtagagaaaggacggaagtagctctttccttgacgtgcttttttttttaaagatttatttatttttattataagtacactgtagctgtcttcagacacaccagaagagggagtcagatctcattatggatggttgtgaaccaccatgtgattgctgggatttgaacttcggaccttcggaagagcagtcgggtgttcttacccactgagccatctcaccagcccccttgatgtgctttttaaagtatgtattaatatcaagggattggctcagtggctgaatgcttccctggaatacacaggccctaggcttgggcctcagcatttaaataaaattaaatggcaaagcaaatcacatggagaatggcatgtccctgtatcttctgctccatttctgaaattattgaggtgtgcacgcacatcagtctaccacaccttgccaaagtttagttcacacgggcaatatctcatgacctggaagtctatgctcaacaatgaagtcatttggctttctatcccacccagttattaatctcaaaaaacaaagggcgaaatttcccttggaaactgtgtacctctgctggcccacatcctgtctgggttgtaaaggtcaccgagacccatgcaatggcctccactcttctgaaatcaccttccatattttgttggagaggaaacagaaaaagtacttaaatctatgacaaatgttcttggaaatttacaggcaaagaagagcagcagaggctgagaggaaaagaaggttgtaaggctgaggaggcccagcacttgcccttcctagtaggccttttgctgtctacatttgaatagaaggattctagcatccaatgaccacaccaggccttcttcagcattcctacataataataataataataataataataataagccatttattagctacattagcataactgtggtcatcagcacacctgtcagacacaacttgaaggaagaacattttaccttggttcatggttctgatggtttcagacaatcacgacagaactgaaagcccagacccagagacctacctgcaccagctatgcttggcctcccaagtgttcctcggcctcacaaagccacatcaccacctggacagcaatggtcaaaacatggaggtaggggctggggagggttccctacagatccaaagcacacagctaatttgtttactctttccaaagatgactttttagaaatcatcaccaatgatgagttgggttgggttttcttattgttgttgtagcttaatgaagtagatatttacaactgttttaggattgtttccacaatgattggtggtgatggtagctttaagaatctggcctgtgcttttaatttcttttaatatcagtgaggaagcagtggcataatggatgtgatcccaggaagtgccctgtgcctgcaatcaacacgcccatctttccttacagccctgcaaagcccctctcagcagccagaaatagaaccatctgctctttccccaactcctggatggttttcactcaagcacagccctctggactaagctcacaattaaaactaatattgtcctgcctactaagctattttaccccccaaggcatgaataattagctgaaaatgaaggacaaaattagaaaactctataaaggggtccctccccacttcctaatattagtcatgttctgtgtgagccaggccacaagggaaaactgtagtcactctgaaatcctgcaaggtccccaggacagtgtgagacagtgggttgagtgtcacttcaattgaggacactaaattccattctgccatgcattagaccggtcctgtagactagggggaaagttcttccttcttctctcatcagccacggtcatgagatgagctggctaacatgatactttggcttatcttacaaaggagatactaaggtgaagaatcaagtctttgtcatttctcttggaagtagcaccaggaaacacagaaaatatgaagatgtgataggaatcgtcctagtcagggttactattactataatggaacatcataaccaaaaacaaggtgagaagaaaaggtttattcgcttacacttccacatcatggtccattatcaaaggtgtaagggcaggaaacaaacagggcaggaacctggaggcaggagctgatacagaagccataaaggagtgctgcttcctgctttgttctccatggctttctccatctgatttcttatagaacccatgacccagcccagagatggcatcaccaacaatgggctcagtcctccctcatcaatcaccaattaagaaagtaccctataggtttgccggcagcccaagcttatagaagcatttactcaattgagggcccctgggttcaattcccagcaaccacatggcagctcacaactatctatatctctaataccaagggatcctggcctctcgtgacatggcatgtatgtagtacacagatgtgcatggaaataacaacatctacacacataaaaggtaaatattcttttttaaaaaacaaaaaacacataatacaaacaagatactgcatgaaaacaatatcatcaaacatactaaacttgactgagtctactgaagatcacttaacaatccatattaatagtttcagtgttgcatgtagcttttgctaccctgcctcagctccagaaatggactgcactaccagcacccccacccccccgagagtatttgatccatggatgaaaaacacagacacacacacacagacacacacacacacaaaaccacagacaaaagttgctcaagttcaactttcctcattggctcaattgctgggcattattaaactcccgtggctagtgtacgcttcccaatactcttagctcacaaccctaaatctgttttcaattttagctgctcagttgttagtccaagctcaagaatcccaaccttgtgcctgtagaaccagcctgtggccatcctgtccaatatctcacatgacagacgggtcaccttttgtccttccaaagcatgaccaaaaccctctctcttctccttgagtctgcctgcttgcctgcgggggcccagaagtcctgcctattccttatgcccagtaactggtccatggcatctttactgacagatcaggaaccaattgggggataggaccaatcagcaccatccctacaacctaaaattaaacttcttatcccaaaagtaggttcataggaagttattggaaataagtaactagaatccagaaaggaaccaatgacaatgaaagtaacaaaatccagaacaaggctgggcaaacttggggaggcagaggcaggcgaatgtctgagtttgaggccagcctgatctacagagggttccagaacagccagggctacaaagagaaaccctgtcttgaaaatccaaaccaaacaagaaaatacgtatctaattctctctcagcaatgcctatggttgggcagagtccacactgtcacatcaaactaagtgtggtgacacaggtctgtaatcccaacactagttagaggcgggaggatccgaggttcctgccatcttcaactaccaatgggtttgaggtcagcctgggtttaagaaaaaacaataacaagaagaacttcataatcaaccaatattagcaagtaagtatttactgagaaacacaacagagtcattcaaagcacagtaaggctgcccacgtttccacagaagggctgagatggaagatgctacatggggcattcatctcaccctctgctcccacacactgttctgtttcagtggattaaggactaaaaaaaacacattctgttaataggaaaatggctaccttagaaaacatagcagaaggactgcttaaacaatggaggtgtctgtttctggaaccctgaagagggcaggaaggctaagtataaaatgatgtttgtagacagtaagttattgggtttcaccaactccagcatagctgcacccacccagggcatatactacaaaatgaagtcacaaaaacaaaatgctgtgatcttactagattcccaaagcgcagattaacttaacaaataacagggatcaggagactaataacatatcatcatggggaaatgagggagatttggcaggaaccaaagtacaggctccaagcatgctgctgcgatcactcaaagcaggcagcaggtagctgaatggggtttgggagaaactggcctccaaattccacacctcctagtcctttcaggggtctcctcttcccacgggaaccaaagggacagtgcagagagcagcagtcaacctagagatctatatccctcttctgcagtgggagtctctaagaaaatttgaattcaaaatacacccctgcccccccccccacctctttaagataggctctcgcagcacacaggctagcctccaattcaaattctctatgtagccaaggatgacactgagtagctgatcctctggtgcaggcatgagctacctctcctgatgtgtgtgctactcgggattgaaggcagggtctcatggattacatactggacaacgctcagccaactcagccatatccctacaccaaaatgcaaccgcatcataaaagaatgaaaaacttatgtttatctttttaaacaagttctcaggttttctttaagttattctctgtctgtctgtctgtctgtctgtctcggtctccctctgtttctccctctctgcctgtcctctctctctctctctctctctcggtctctctttgtctctgtatgtgcacgtgtgtgcatgtgtgtgttgtctgcatgtgtgtgttgtgtgtatgtggctgtaccagccagagcacacaagtagaagtcagaggacagcttgcagtagttaactctcatcttcccaccatcagttccagagattaaactcaggtcagagggctgccacacagcaaatgcctctacctcctgagccacctcactggcctagaacctcatttttaacacatagtgacttaccgtctgatgtcccactaagctaaatgtttttaattgatcagaaataacaaatgaaaaaagacatcaaccatggcaaacatttatacagtactcactgtcagagagcctggctgctatgactgccttacattaggactaccaactgaatcatacgacaatgtctagagacatttatagggcactcaaaagttagcagggcagttattcatttttgagtgggcctcttttctggtcatttgctcttggatctgattggtcaagggctattccatacctattatttcgaatgatcctttctgtttgaggagattataagtaactcaaacgcatgtgtaataaaacctaaggtactagcaagtaattattttcattactgcaaagtaatgcagagattttagacataagtcagcctttaaaatagccttctccttcaccaggtcccagaaggctcatcagagactgactcccacgtcacaagttttcatctgttttgtcaatgtgtttacaaagtatgacatgtaaggattcaaaagctctgagcctgagcacactcaaaaacaattcaagtcaaaatgtgatatgttataaataatagctataaatattttttaaatcaataataactcttaaggaaacttgggatttctgataatgacttcatgattaatatactaatggtccatttgttttaaaaaatgtagcaatgatggtaagatattaactaagtagagaagggactgagtacactctcagaaccatctttacaattttcctgtaaatgtaaaaccttctaaaagaaaagtaaaagtgcagactagcaagatgtgcataaagttgtttgccatcaaacctgacactctgggtgcaatccccagagtctatatgttataaaaagagaactgatcccacaagttgtcctctggcctccatatccattcctagtcatatacatgcacaaacaaacacacatacacatcacactaaaaataatgtacaataagcaaataaatgagaggaggaaaaatattttaagagttaaaatacaaataatatgttttctcaaacataaacaaaagcaaaaactagccataatgtgtattaaattctcacatattgctgatctataaaacaaaacaataaagattagtgggctggaattcctcatatgacttcattcagatgtctggattccaccagcacgtaggcctgcatccatacaactctgagtcaattattgttcactggccaaaaaatccctaagccaacaaataacccaggaactgggatgggtctgaggaatcaagttagtaagaacagacaagacttaaactgagagcctaaaagaaggttctcagacacatagcagtagaagcaaaaaagatgttcccaggccctacatggcagagacagactagctttcaacagcacagatcagcagcatatctcataaaggcagtgttggggaatatatccagggatatctgaacttgatcccttgggaaagatgtagatcagagaggaaggaaactcatatttagaagtcagggaagaattcttggacaagatgtacttgatcacctgaatagagaattattctaaaagcagaataaactgtgaggacatacctggctttccaagcacctggctttccaagcagctagctgggagtatgattcagttgtccagcacttgctagcatacaagcaaccttggattcagccctcaggctcagagaaaccaggcatggtggcatgttgcaggttatttgatcacactgtgaaccccaaaattttgttatttactgtatgtatgtatatatacatatatatcctgtttctagtaatggtgtggctcagccattagcacacacctttaatcccaaacaatgaaagtaacgttagtttttagaaggaagcacccatgcttgtaagtggtgtctaattgagtggcagacaaagtgtcaaatcagagaaagatttgacagagtaggatatgctcaagtttcacaagaggaaagggaaatgacccgagggagcagcagcacagaaaaggagaaagaaggaggcagttttatcaggacagttgtacagagacaggttgcagaaagagaacaaactagacactgatgaagacagaatgagctagagaatgagaaggagccagaagattagaacatattgccaaagatagtatgaggccaggcagggccattcagaataggctgagagagaagccagattggaccagtcagttgaagaggagttttgagccagaacagctgagttgaatcagccagccagagctcagaaagaataagaaagggtgagcctctgcctcgggaggcagaggcaggcggatttttgagttcaaggccagtctggtctacaaagtgagttccaggacagccagggctatacagagaaaccctgtctcgcaaaaacaaaaacaaaaacaaacaaaaaaaaagggtgagcctattcagccgtaagtctcagtggctgaaaacactctaggcctagattagattgtatggagactagaagcttccagaactaggcctaggttagcagactgaggtgataagccaaggagaccagtcaacaattgcatcaggttaatacaagttacttttccagtggtaaacacctgtcatctcagccttcggatcagaaggtccaggttggtttgggctacaaagaaactcaagctttggaatgcctctcagtggctttcaagtgccagtcaaacagctggaagcccacagagcagatgagctcaactccagccacactcaggctggaaaaccagggctggggtggggggtggggggagttggtgttttggtaggacaaaatgtgaaaacattattttgaggttgaatgggtgttccaactcagaaaaatcaacctgcttccattaacttacagccatttccacaaacaagccttttcacatgctaattatttttccacttttagcctacttgaacagcaacatggtgccctcttgaccaggttgcttagcactgcagggtttttttttcctgtcctctgcaatctgcctgctggtgggcacatcagtactatcaggatgttgatgtcagtgacactcacacccactcactaccttttcacaggacggatctagacctcaaagccaacactcaagcatgagatgaggccctaccttaccatcactgatgagcctgctcctcttactcaggacaaacgcttatcactagctctgtgcactgtctgcaaagtgtatgctgtgaccctgggctacaaagcaaaacaatacaacaaaacctatttaaaactccccacacataggcagcagaagtgcagtttggtcttcatgtgggtctcaaacaactggagcatgggctatcctaaaagctgttgcctgggaactgaccatagaacaggaacccaccaaaagagatcccaaagacttgaggataaaacagtctagcccagggctggacagatatctcaaaggtcaaaagcacccgctgctcttccaaaagacctgagttccattcccagcacccaaatcaggcttcttataactacctgtaacttcagctgtggggggaatccaacacccttttctggcctctagagacatatggcaaagattcatttaaacatagacatatatacataaataaaataaatcttatctttaaaatacatatatttaaaacactgtaacaagtggtctggagagatggctcagctgttaagagcactgactgctctttcaaaggtcctaagttcaaatccctgcaaccacctggtggctcacaaccatccggaatgagatctgatgccctcttcaggggtatctgaagacaactacagtgtacttacctacactaaataaataaataaatttttaaagccttaaaaacaaacaaacaaacaaacaaaaaacactataatacttccacttggtcttaagaccaagaaaacagcaggcactcaatatgtgcttagcagatcatttctttgttttttgttgtttttttttttccccagagcatagcaacaggctagggatttttcatcataggaccccagaccagaactgctctctggcagggcatgcaaaaacaccctgactatacttttcctgttatacactagtgactcagagttagataataaatacacgtttttttttttcattctcacttgcatgctttcaacaagatcccattatttaatcctgacttgcctagacctcactgtgtccaccaggctggcctgaaacaatgcctccccctaccaagtgctggcatcacaagtgcacgcccaccatgatgcccagctgatgcatatttacagccatcttaactaattcagacaactagcagacactaccaggcatggctgagtctctctcttgagttatcacaaaaggggatcagcaaaaccacccagcagcgacaaacatcagaaaaggggtaaatgccatggaccaagcagaagctgaaagcatgcagatcagaaggcagcaagaaaacaggccaggtcagaagccaggagactaaccttggcactaagttctcaacaaggagcttgttgtaccaaccgagagaaaagggtcagagctggggcagtaagaggagctgctttgtggagggtcaggcaaatggctatctggcagtattttcactgatgatgatgatgtgcaaagctagctggaggaatctgtgctcggtgtctttcttcctagcaccttagggtcagcctcctgtagtatctgagcaacagcactcactgggcatccatcatgctcctagactacggtgacagcgctcctttagttggagaaataaacctctctgcagactaaataaagctttttgtacaagacaccagaaagcaactaggtcatgaggcagagaactagaggggcagctaggtgcccaggctctctgcttgccagcaaacagagatggagatcctttctgagcaaatgaaagtgaactctaaaaacagcaacaccacgttgggcaccacgcctcgatcacatctcccacacagctcgtgtctcctgtatggctgtgtagctcctgccatgcagagcatctacagttaaatgaacccagcctaaaattacaggctcagtgctcggacgtggaaaattcctaagggatctatctggattgaagaatagggacgtagcaacaaataataaatggcggtaagcacggtgccagattgaaacaaaagtctcatcttcctttaataaccacatgtactttcttctatatcaacttgaaagactccattatcataagtggtcctcgtttgttataatccttccctcaactgggcttagataagaaatttgtattttcacatgtctttacaaaacaaaatgagccttaccaacttcatcttgaagacactactaatcccagcacttgggagacagagacaggcggatttctgagtttgaggccagcctggtctacaaagtgagttccaggacagccagggctacacagagaaaccctgccggggggtgggggtgggaggtagaggcaccactaacattgaattttaagtgtatttgtgtgtatgagtatatgtaggttcatcggtgtgtgggtgccttttaaagccagaagaggctgttgggtctcagggaagaaagttatggatggttaagagccaccccatgtggggtcctatgcaagagcatcaagtagccttagcactgaggccgccctccagccacaggcttcactgcattcagtgccaagagaactgctatttagtttcaagtttcactccacagcctcctggccctgactgtaacaggctccacaatgtatggaccttaaagaattccgggcttaccatccatgtgaaattaattaccagtatatgaaaaatgtaataaaatattgagggtacctaaataatgactggtctcgtgtggtttaggatggcagctgtgtccacagccaccaaaaagagagggaaaatgtggggtctgagtccaaagacgtaaacctctatctcacagaccagcaaaaggatgtcaatcttttaagttagaggttaaccaccttaaaagtcaaacaaaattaaagcaagttattcaaactcccccgttttatgtaggaattggttttggaatcgctaagagtttcaaaatcagggatccacacaacagaagaaaacgggcaccagcataggaaaggatgattggaaggtttgtctcaagacacattggcacacacagggacacacacaggcacacacacacacaaatcctctcacccaccctctacggtggcagcgtaataataaaagcacacatgctctcacagcagcccagtacgctaagatgtgtaggccctgatattaatatttgtaattttcagttatttgtttgtggcttgtttttgctttgctttgatttaattgcatgctactaacacacaacgatttttatttgatacaaaaaggaacttttgtactttatatttttatactcatagcaaaagggttacacagaacacccaaggcagtaaccctggttatggggatgggaggaaagggggggaggggaggacattcttctgtcccatataattttgattctgtatagatttttgtttgaaggagtctgactccttaagattgttcaaagcattattaagaattaggtttgaagtgaaacatccgttaaaataaaatgttcctccaagatgagagtaatttcaccaaaatggccaccctggcccataatcccgtcacccccacctaccccccccccagttcgattattctgatttacacaaaaagcctgacctgtgttctttagccctagactagcatttcacctcacacaatggcagaactaggctatgactcatcttcctccaccaaacaatgcaagtcctggtgcagtgggaaaaaactacttagagttgccaggtcactgaactgttgagatgaaggtcaaagtgctgagacaggaatgggggagcactagacccagatcctatcaaattaccacacagtacctaacatcgatttccaacaagtgctgaacctgctaatgattgaaacaggaagcacctggtgccctctaagcacgggtcagagaaacggatgggaaaacattaaacagatccaggaccatgtccatgagcagccattcaagtgataccaaggaaaaatacacaggagatgaggaggtgagagcctgtagcttacatgtctttgggtacttttggtatttgatatgtctgatttgcttttcctagacactgatcagcagtccaagtccattatcaatccatttatgtcctaccggttacacaacttatgaatcataatgtaaatatctgtgttttccaatggtcttaggtgacccctgtgaaagggtcttatgatgcccaggggtctcaacccacaggttgagaaccattgctccagggtcttcttgatgacgattctctggtcaccttctgcctttcttctccccaaatcactggcattcttgtgcctttgtaattgataggctacctggtcttcagaaccaacttctcagttccctttagccagcagggttacagaggcacctcagggcctgcactatgctctcaagcctgagctccatcatggggtcaagcatctggcaagtcagacaacaatggcccaggcctcttacccagccccagattttagcccatgccccatagaggcaattttatactcttagcgcttcccagggtacagcctgtaccaccaggtagctacatgttaactaaaaggaattaaagaagacctcaacattcaagggaaatcaaacttgcaggctgccaacccaagcaccagaagaagccactagagtacaggggaacttcctgccaatgtttccaaatctccctccaaccttctctccctctccctttcttctccccctctccctctcccccttcctcccctctctcattcactcttaatctctgtaacacacacacacacacacacacacacacacacacacacacacacacacttcctggtgtaaatctaacttctaaagctcccaattttccttgcttcatcagaacattccagtgagtgagtcacccattccttaagatcactttcttgagcttctccctctcagctgtcaatctcagcatcacacaccacgccctgaacatcagcacacactggaagctaagtctttgcctgatcctacccatggaatccacttgctcgccccacagcacttcagacttctgcttcctcaggtggtgacctgggtatgggggagataatgccttcttatccatctagggtggaactaactgccagttcagttggcacaaaagtcatcgtctccacaggcccagccacactgctccatccaggacactccagagagctatggcaaagctacaaagtcactgtctcagttcagccacatcagagcctctggaaagagcctcaggatacaggtggctacaatagacagctggagtcttggatcgtctgctccatccatctaaaaaggaaatgccaatctaggcatggagtctcagcagccaataagagagtgggaagggtggcaagctaagcaggctctcccaaagttgttccctgagcaggggaaacctcaggcgcatcatctggtacttgactgtgtgttccatcaaaataccactttaaccactgattctattatctttacttctatcaagatcactgaagaaataacgcattacaaaactagaatgagcccagcttaatttaaaagaaaagatgctgaactcctatagaatttgggaccaggtaaacactggttttctatttttatgaaaataacatccctgaaatatttttattttttaaatgttatcttcacaaagtctctatagcagccagagcaaaggaaggagtactacctaaacagagcagaactcagccaggacagtttttaaactatctgaccttgtcatctagtaactttgtttactccggcccataattttcttctggttggtctctgactgcaaccacagcagctgctccagactctctgcagcaagacaaggtgtaggctgacatctggggcaggagaaaagagaagtccaccagacttaaagggatttcagaaaggtcacagtgccactgtgactacctctgttcagggagcgttcgtcacagccctgaaaggtctcatgattatatgttgggaccttagagctcctcagtaagaaaacaaagacaggggcaatgtagataattgcagcacacgaacaccccagagctgttggccaagaaagctcatctctaagaaaacacaagctggccctcttatttcggtagcatgcttataggatacacctagtgcagtgttcctatgttactacgaaccaaaatattgaaaggagggaagaattgcaatgaagagaagtgttttaaaaaaaaaaaaactacccttaattttattttgttttttgtttgtttggtttttttatggtttgttgttatctggtttggtttctgttcttttctagggaaagtattaactcaaagaacttacagcacatgaaaacacatctttaggatttttttttccctcagacagaccacagagccagcatatccatgaatccatctaagaatacatggatgtctgcaacgatcagaaaaactaagccactctggaaatggactttaattaggaaaaaggtcaggacaccaaccccctggaagctctgcctttccaaggacaaacctgtaagaaacagaagcccccagtttcccccactcaccccaatgtagtaaacagacaccccaacaatccaccaacagtgcaacgcttccttgtgctccttctcagctctgaactacatctgtacttcctagaatgttgccttcctagaaagatctgtcaacagtccacacctcagcatctgacttggtgcctcacaccgaaaatccagctcaccagaggtggagctggaagacctagaggtcaaggccagcctgggctacatcagtagcctgccacggaggaaaagtttctctttaagagtaaacagtcagggagctggagaatggctgctgtgtttgagagcactggttcaattccggggactcggacatcctcacacagacatacatacatacatacatacatacatacatacatacatgcatacatacatgctggcaaaacaccaatgcatgattaataaaaatgaaacaggagtaagcactcaatactgaaccagctgcctcgaataaagtggcaaaccttggacacaaaggcgttcaacagcttcagtccaaagaagaaaagcacctgatgtgtggccgctcttccgctccacagagacctagtctctggaggaacaggccacctctgcctgtcacagataagccctgctttcagccgcttcctgacttacacatcagacttatcgagagaaagtgaggctctgccaactcgaacaccctctgtccaaagcctcccttagcaactgcagtctggccactgacaaacttaccgggggatctcctgcaagcctggagaggcacctgcccaggcagatccaacctccactttttccaacgaaatgtggtggctgccaggctgctcatcacctacagtggctgagatgagggaaactgtgaaggaaatcaacacaaaagccgcccgcgaactgcacactgggatgtcctgttaggttgggttttgtttttttcttttttaaagtccctttgattttttcccacgagaggatctgactaaatctaactccacctcccctcagacaggaagttaaactccgcagtcagttaagaactcttgaggtacttttggtttttaatagtcacagcttagagcttttgaatgttccaaagcaactagagagatgctaacttttcttgtttgatggtgtctgacagcacacacacacacacacaccccactatgcatactcacaacagtgtttactttggtggtggtacacgcctttactcccacacaggaggcagaggcaggtggatctctgtgagttcaaggccagcctggtctacagtgtaagctccaagacagccagggctacatagagaaaccctgtctccaaaaaccacaaaggaaaagagaaagaaactgctacggtggaaaaaaacaataaccacacagactcatattttccagacttctgttttagatggttgttttgttctcttgacatcatttgcatatgtgttctccacacacgtgcaaaagagaaggaaaggtgtttgtactgccatgcctgcatccttagtatggatctaatagctttctttcctcctctgaaacagaatccgtacctagcacaaagattctcacagaatatgtaaccctaccagggtccacaggagttccaagtaaaaggaacctatctatgtagctcagaagaccatagacttgagactctggaaaaaacaactaagcactctgtcctctgatcctcatcctccaacggaataagatggggtgagacagtaaagaatcagaatggctccagtcatgtcacttagtcaaaacccagtttactgctataacccacgtagtaggaaatcgtaagtacacatgcagagcccaagtcaacagatatcagtgtgtttgcagactctgcagccaccccaccatcaatgctatagcctcccttcactcctgcagatagcagtcattcacaggcttccttgcccagcccaaggcagctactcccatctccctctggtctccagagattcactggttctagatacttcctataagtgaaatcagcagaatttgctgcgttgggtctggcttctttcacctagcatgtttgcaagcctctgcactgaagcggacgtcaatatctcatcgtgtgtggcagaatgatgctttcctgcgtggataaggcacgtcgcagccttcatccgttcacaggcaactgcattgggctcacctttggactattattaacttttcagctctaaatatccgcatgtaaattacgtcgatggacacattttcactcctcctggagataacataaatcccaggaggagagccacaaaggaattatataacactatgaatgtagtgaagaaccactgtgcacttttccaaactggctctaccacttaacattctccccagcagttccatgacgacactccatatccactgtccatcgtaaaccaaagcatctccgttcccataggcagagctaagtagccaaagcaacaagcaagaatggaagcctgaccccgcataatcccagagaaaagaggtacccatctacagcaggagccagcttcagaaagggaccagggaatcctggcatagttgtgtgggtctgcacttgctacagtttgtcttcttaaccagaagtagaccaaatgactgcaggctttggtaagttattatttgtaaatattcttcgggagaaaatcctccaaaaaagagcctttgtgacatttatggggcaagggcataagccaagtcaccccctgtgagggtcagggagacactcagggttggtcctagggcttgaactctggttgcctggcctggaagccagcatgcttacccactgagctgtcacacacaggttaaaggtaaccaagttcatatgcagacagtaactttaaattacctttccctatcaaaagtattgatatgggagaatacaatgactactcaaaaaaagagtccagggtgggtatgggggacctttgggatagcattgaaaatgtaaacgaggaaaagagtccaaatcaaaggtctgatagttctttcaaaccttagcatgtctgaacaaattcatgtaggatgatatcaattacctctttatgtaacattctactgtagaatttaacttttttaatcctccctcataaaaaccaaacagaacaaaatctatataaagtacagcaaagaaaatactgcaagaccatgtggtgttttgaactgtgcttggcccagggagtgccactattaggaagtatagccttgttggagtaggtgtggccttgttgaaggaaatgtgtcactgtaggggtgggtaatgagaccctcttcctaacgacatgggagccagtcttctcctagcagccttcagatgaagatgtagaactctcagctcctcctgcaccatgcctgcctagatgctgccatgcttcccgccttgatggtaatggactaaacctctgaatctgtaagccagccccaattaaatgttgtccttggtcatggtttttcttcacagcagtaaaaccctaagataggacataagttcaaaagaaaatagcacttggagctggagaggtggctcagtggttaggaggcctaactgctcttggggaggaaccaagtgcagttactggcaaccacatagcagctcacaaccacgaaaactctacttccaagggagcaaacaccctttcctggccttcacaaacactgaatgcatacaggcaaaataatcatcatagaaaataagaataattattttacccagaaagagaaattataaacaacaaaaacagaaaggcccttttctgttttccaacgcaaggcctcatgtcttacaacctgtattaataatatgaatcatacatcttttaaatttttccatgtcccaaggctgctgcactacgcaatccattgttttagttatttcttggcacatggctgattttgaaagtgaccattgaactttcatatgtccaagagaactttccactgtgggaaattttctaaaacaatctcactgagctaaatagaaatgacatcaaagctcgaaagcaaagaagccacacatcggcccatttagccaccaccctggcttctctgcaggaccgatgaaagatggagcaacctttgggcaaagcgctggggctacccctaacccctgagaatgggaaaaaatgacgtgaccatcagttctctagggttatctgaaggaactcctaaaaacctctcatgacaggctctttcccaaaaactcttcgggcctgtgggaacctgttcctcacagatctgttcttctgataggttacacggtggcctcggtcctagctcatgtgaaaccaataggccatttctgtcagaattatctgtccagggtatgcacactctcattcatctggtgttgagacagctgtaatcacatttggtacataccactaactctattatagccccgaagcaactggctgtgagactaggtctcttctcaccagcagggaaagaaaggaatggcgtggaaagagaataaagaacaaataaacagctgaaacacacgcagcacagcaaagcaggggagagaaggaaagacattcagatacccatccgctatggaagaaacacagccagcatatcacacacacacacacatgcataaatatataaatataaacacaggcatgtgtacatacacctatatgcaaacacacacacaaatatatacacatatgtaaacatatacacaaatataaaagcacacaaactttcaagcccaggtcagctgactgagccacagaaggtacacagtctccttatcctgctatggggaaaccctcttggctttgaacatcatattatgactgtcagtccaaactaatgaacctacactcttaacagtgccaagcaccaggtaaaagccagtgccaagccacaccccaacaccagggtgaccaagtgggagggccttggcgctcctccatcagactcagcacagcactgtccttggctgccagctcttctttactgcccttcagcggaagccatagctttgcttttcattcatgtcaagaaaagaaagaggtccggtacggtacgctgtgtccttctgactctgaaatagcgcctgacttcacctgcggatttctaagaccagcgaacgccctgccctgctaacgggcaatctctacttaacagcagtgggtataagactgttctctgatagccttctcacctctttataatagcctgcctcgaaatagaaagtgatgagcacttttgtttcatgtccttataaactgtcttgaaatgaccttacacccattaaaataagttgtaaaaatggcacacaaaattttcatgtcacctcccataatgtgagccttttacataaccacggaataatgatcctgacagggagttaacgttgataacaatggtgcaaacaagtctacagatctggtgcagacttcccattctgtcctgtttctggcccatgcttccatcagagatcacacatatgaatgaagaagaatccataaacagtgctctatctatgtctgtgctctgcttcgcttcatgctgatgagctggtcgttactaaccctgagtgtgccaggctagacattcagccctcctcatttctgctatcacttcatgtgctgagtttcatagcccctgtccccacccagcctgaaacaaagtgttgccaattaaacccctgccatgagagaagagaaatcatatatcagaaaacacaggttacatcaaaaaaaaaaaaatcaaaaagaagcaagacccaaggcatctccctggaacgaaacccaatgccttctgcagcagacatgcttaggggtggtgaacagaatcagagaagactgaaagaagcccacagaccaggtttggtttccctcccaggtcaagtccaggttaaacttcaaatgagtgataaggaaaatccctttccttatatccggagcttcctttggatatcatagctgcagaagacggatcccaagtctgtactcgtgaaccccacagcctcaccaagcccccacactcccttctcacatctttgttcatctggtggctcagagcactctacctacaaagctagggccttgggcatgcggggcaagtgctttatccacgagccacatgatcagccttccctctcatgttctcatcagagtgacattacttgggatgcaattctcctgagtatctgaaaggggttggttccaagcctgcctgcagatatcaaaacccagagggtcaggtcccttatgtaagatgctgtaacaatcccacccgctgacaatctttacattatctgtaaattactcatactaactatcataatataagcagtctgtctcatttaaggaataatattatgaaaaaaaagtctgtacatatacagtagaaaggcaatttttccccaaaatttttgatccacaactagctgaattcacttatatagaaaccctaagaaacaatagttcctcacaaaacattctaggatttctttaattcattcatgtctcactatgaaattctatcttggcttttaatcacattaaagatcattagcaaaaatcctacgttagggtgaaaagaactcttcacgcgatgctgacaacatatgttgagaatgttcatattattgctgatatgattcaacaacaaaaagtcaacgccaggaaaaactcttgtaaaaataagcaaagccaaaaaaagcaaaggcaaggatggtatttcatgggtggagtaatttcacatcagactattttcccaaagtaacaaagatataaataaaatctaaagtcatgtcttcactaccatattagtatacaatggaactgaaggacattatcattcacaaaaccaagttacagagagtcaagtctacagcacacgtggaaaggtaagatccccaactgcacagaggctgagaaatgtgcccccgacacactcaccatgtgcttgaaggatcacctgtttttgcaacggcgagggcggtaacttggaataaggaagggaagggaattcctaagagtcaagcttgaggttaaaatgactcctttcctcacaatcaggaaagcatcatggaggtatacagaggagaaacacaacacatcacagctcttggtgaggaggaggggaaagcaggaatcatagctttggaaccctgggaagaagctggggttgtaagccaacgaggctctctcttctctcatgacagggtgcacacatcacagtaggaagcagctaaatctgaaggccggagttgctttctggtgtaagtggccagtgctttcacgaatcaagtagtagctcacagggctctgcggaagaacagaacaacactccaggatgcccggtgaggcaacctcttagcagcagcaagatgggcctgtcagagacttaggagaaaccagcatagtcaactgcttagagcaggagtccttcagatagccactcccactaccagcacctaccctgatggcaggaaagaaggccattgcctgggcgattcctggaaggaaggacagttacttaaccaagaccgcaaatgataaacaaaacacaaaacactgaaagacaaagaagaaagtagaaacactatttggtttggtttggtttttcaagacaagagtttctctgtgtagtggtagctgacctggaactcactctgtagaccagggtagcctcgaactcagagacccacctgcctctttgcaccaccaccgcctcaatttagaaatactatttttaaaaaataaaaggacatgtgattttctgaatcatctacatgttttgttttgttctttgtttttgtttggtttagtttagagggttttttttttttttcaaagatttgttgttgttgctgttgttgttttcaattgggtatgtgggtggaaggttatatgtatgtgagtaagatctccacagagaccagggctgtcagatcccagtggagctgagtgacaggcagttgtgagctgttcaacacgggtgctgggaactaaacccaagtcctctgaaaatcacttacatacatgctctgggctgctgagccatcatacctccaaccctagcttgggatttttgagaccctgaggactacactatagtcaaatttagcaatcctcctgccttgacctccgaagtgcggagattacagtcatgtgccagcatatctgaagttacatgttctgtcttttagaaatctgtaagcatcctgcatattgtagagcgaggggcagtaagtggcttttcttatgaacatttgttgggattgtgagaaaaacctgaccagtttctagagagttctagaatgctcaagctttatggcaaggcgtgaagaagatatccaagagtttttcttttattatcctcgataacaaaacccaacgggaaacctgaccaaatgatgcccaccagcctatgggttcaaatagggttgctcagaacactaccccactgtcacctgccactgcctgtctccccactgactctctgcagctaaacatactaatttccccagttcctaactactggcacccgctcacattgcctgtgcaaatactgaagtctgcctcaaagacccagccctatcagctgccccgtccaaaaggcaactctatccctgcttacaaaccggcttccatgggcaccatccactacagtccaccaggcacagttgtctgcacgtcaaccctggccacaggactgtttctttccctgtgcaaatgtccccatgcaaatccgagggtgctctctcttcagaagatacggggattaacacatgtgagtcatcgaagagccagcctgcagctgctaacacagagacggtctcgtccaaacatggacactccacccactcggactcttgtgtgtcatcatttctctccactgagaatgagataagcatctatttatgacagttagggccagaactgaggggaaagtgaaaaaaacccaggtaataactagacagggtcatccctgggaaaggaaccagaggtatttgccatctggtagtgtgtgtgtgtgtgtgtgtctgtgtgtgtgtgtctgtgtgtgtgtgtctgtgtgtgtgtgtgtacacctgcctgcgtctctgtgtctgtcttctatgtatgtgaatttgtgtctgcatttatgtctctgtatgtgtgtgtgtgtttgtctatctgtgtctatctgtcagtttctctgtgtatgtctgtctgtatacatgatagagtatgtgtctgcctatatatgtctatgtatgtgtgtccgtgtgtgtctgtctctgtgtgtgtctctgtctgtctctttgtatatgtgtgcatgtgtgtcttgtgtgttgtctgtgtgtctgtttatatatgtgtgtgtgcatctgtgtgtctcatgtgtctgtctgtctgtctatctgtgtatctgtgtgtgtgtgtgtgtgtgtgtgtgtgtgtgtgtgtgtgtgtgtgttttcctgggtgcaggtgcataaagcccagaggttaattaacctcaagtatcttcccagatcactgtccactttgtttttgtgagaaagggcccttgctggaattcatctaagctagctggccaggaagcccagggatgctcccgtctctgcctcctctgccctgagattacaaatgtgtgttagcacactcagactttttcaaataatttccggtaattaaattcaagacctgaccctggcaagcactttactgactgactattgtcccagaccatgcccttgcagtttctaacacaatgtggaagagtcacaagaaagtgtccaaatgagggacagaaaggacaagtgttagttctcgattcagtatctccaaatcaggacactcagcaacaagttcccagtatccaggtgatgtgggctgctcattcgaccaataggtttggagaggaaagaggattgctctcttctgtgcaccacagccctgaaagagctggttcccaggccagccaagggactcagtctgcaggccacaggtatcatggcacctgctgtgtccctactgcaaggagcagctcaagtcctgggaccgagtagccagaggctgcaaaaggaacaaggaaaggcagtggctgagaaaaagaggttgtaacgagctctgctaaaggagaagcacagagctggcctgtgatgagagtgatcatcagcatgaagagaaaggcagaatagagaaagaagatcagagggcagggttagcaaggagaaaacacagagattcaaagaagaaacgagagacaggcctgcaggcccagggcagcccctccagcaagcgagacattccccaagcttgccagtctgtaccctcgccagtaaagtcttctcccctggggaatatctgtgagtaaggctgtctggccaacaaagtataaatacagtaagtataacaaagttgattctgaaattaagaatattgggctcagatcacttccagctggatgccaatccaatggcaagctacagcaacgaatgctccggctcagtccttagcatataagtcaggtggtgcccagattgagggatggctggccttcactgttcattgacactgactgccactgatgcccatggccctcttacaggttacgctgtgtcaggactctgactcccacttgaaagatgaggtatgtaaggtttcatgacagcaaggagaacagccaacttaagtgttcttttcttcctttgtggcccagcctggtaccgctccattctgccggatcatttgccctcgaaggcagctccctggctccaaaggcactgactggactcacaggaagcccagagagtccaaagctatttttatgaaagtaaatgatactatacaatacttcctttcctcactcacggccacggccaaaaaccatttgatgccaagaggaaatagacgttcctcaaagcactacaagtccaggtgtcaggtggcagcagctgccagagccagtgccacccctgacctccagcacaaacactagctgtggactgtcatgacagaaggacaatgacggacagccttactacccctgaatgcatttaagtcacagacctgagggacccgtgatgttggccagctcttctccaagtcactccctgaaacccacaaccccacccccactcccacccccaccccacccccaccccaccccacaatggcacctgaaagagcagagaggaaagagaaaccaaagaaagtgactctaggctgtgggtttcatattcaagaagagtcagcaacaggtgtgtgcctctggggaaatatgaagtctctgagcgcctttcacctcagcagggcagaaagccaagcccagaagcctgacattaggcaatgatgtcagaagtggaaagtgccaccgtcctccagccacaccaaacagaccacaatttaagttctcccgtgtagccgcctgaaacacacttgaccgtaaaacagccgagacactagtcatccgtcgtacaccatctttaaggcctagcgactggtgcatgctgggtaagcaatccatagctacctagtgagtgagagtgaacgggagtgaagcaagaggggagcagaaaatgctctccacaataaagagagccaaagctcacccccaaagtaggacataaatgcagtttttaaaggacatgagcaggagggagttgggacgtgaggctaatcttggaggggtcaggatgaggaacaagatgaaaatagattgaatgaaattctcaaacaatgaataaaaacattttaagtttctggtttgttttttgtttgtttttccattctcccaaaaagagaacacaaattgggaagcagagacagagggcaagagacatgcctgggaacatagcctccccagagatagccagcttgccatcccttgagctaacagtgtagggcaaccgtcatcagttagaagccaagtgacaagtcacggtcattaagccatctacttctagttctcagaaacgaagctatttggtaagatctaaaagctgtcagagaagctgttgtggcagggcaggtctgcagtcccagtacttgggatgtgagggggcagaaaggtcacagaaggaggccaccctacgagctcagtgaacattgactgggctatacagaaaatcctgttttcaaaaaacaaatacaaagaaaaaataacaacaacaaaatccgacagaaggagtggagaaatgttatgatggtattgacccctcaaatgtctgttactgggataaagaaatgctatcagcgtgagaacatcactactaattatgcaatgtaaagggtttaattgggttaaattataatgatattaattataggaatacagtaccgtcgttggagcacggacaagaataagtcagcaagcaacaccaccaggccatgtcagaaaactaaataaaatgtgggaagcaactataaaatattataaagtatgattgtatctaaagaatctcaccatgtcattttctttgaaactgttaatttaccttctgtttataacaattattccaaagagtgtttctctgttccttgcatttttggattttttttttttaacacttaactttttcaaatagttccagaataaccccactgaggtcacacccaaaggtcctgaataagatcgtagtgaaagtccttggtgcctacatcagaacagccccaaatttcaacgaataaagagtgctttttgcccggccgggcagtggtggcgcacacctttaatcccagcacctgggaggcagaggcaggcagatctctaagtaagagggcagcatggtctacaaagtgagttccaggacagccaaggctacccagagaaaccctgtctcgaaaaaaacaacaacaagaagacaaacaaacaaacaaaaaagagtgcttttgcttcttgaacgacatctcttgactccttcatccccaggatctgtcaccctaaggacagacactctccaaagcgcagagaacaagacctggaaggccaagaagcctgcattaaacaacacgagaagcaactttggcaggtgccctgaagcaaaccagcaggcatgaggcagaggattacagggcacagtccaccctggagggagtcaggacggagatggagagggagcgagctaagggctaaggaccagcttaacaggcaggagaggcagaccacagagcgcactaaccatggagccaaaagcccacccatgtagctggatggagcagtaggcagagagaacaggcacatcgcagactggaaaccatcacctcaccacgtgattcatgggcacacacacttaactgaagatgtgtcctcacccatatgttcccataggcctagtgttcttctagactttcctctgatatctcaaacatccactgtttgggaaacattctttgcctgatcttccccgaggcaggagagttccaatctgtgtcccatgtgactgctgggcccaacctagtataaacctcagaacttgtctcttaccgtactacacagccacacagggctgcagttccaagcttgtgagaagggatctctcagtatttatgttttcaagaagcccatcacaaaatttagcaccagcagagattaaacaaatggcaagtcactaagaaaacaaaccaggaagaaatagacaagctaagtggatacaggggtgggtgtttattcaagacacccttgttggagacttggtgccaccgttaatcccctttacccactgaagatttgggggttgggaggagctagtgaggttcttacccaaacaggattctcatagaacagacacttctgggcaaatccctccacacattcaacagataggcagtaagtggcagaccagaaggacaagaagtctggtcaaccgagtgaatcgtggttccaagatgtcttttaataagtgacgtcaaatccttcctttaaaactgacacatttcaaaataaaactacaggaaccggccatccaaaaaccaaatcatttagaatctgtcataccaatttttgtctgactgaacagtgcctccgtttacttcctatgaacaaaaatatccaagcaaccgcaccattccgggcgagtctcctttacctgcctgtgactctctgctggctccatctgtggccacagatgtctcttccatttctccctggcacagcatgccctccaaatgtggtttcagttcccaagccagcagtacatgctctgtggagtcacgaagatgcacgtccccctcggctgaagggagacctggctttgatgcagtcaaattgaaaaacagggccaaagtatatgggagtgaggagagatgagtccctccccaactgcccagaccagattggttacattcttgcctctgagcagagcccaatcctggtgtgtacctcagagcctctgccaggcattgagtctgtcgccttaaaaacccagacttgtgacagcccttatctgcctaggccagcaaagcacaaatttctacaaacaccacagggctaatggttcagcaaacagaaaggcaagcacacacacacacacacacacacacacacacacacacacacacacccgtacctcgcctctcctgccaccttaggcttccctgttcattcaagccaaagacaaaactgactgagcaaagacattaaggaacttcagaccagcaaatacttttctcccagtttctaactcttgcaagagagtttcttacaaattttgcaatctggtctctctcggttttgcaattaaatgtttagcccctggtaatccatatgaatccctaaagcttttagggatctatccgcgaaagtactaaataatacctgctctctgactgaaaggtaaaggactcctgtcccatcaggatgacaaatattcttgaataaaatgccaagtgcagcctggccaacctcagcacacagccttgagcacactttgcccacaattgctggctttgtcctggctctgcacaaacctggcaagcatgaagtcctggagctgatgattcttttaaggagctcttccttaacttccacagcctatctcagccgcctcgtgattcccctcagaacactgcagaatatgtatcaactgggcagctaagcaactatctgtatattatgatattaggggtttttttttttgtttttttttttgtttgttttttttttccgactactgggcacattcaagagtccagacaccatggtggtggaagtctgttgctctgcctgctacagattgtgcagtaggggacagtcacagaacagtcaactccatgtcaaacagtcacctctgctataaaggttttctgaaacactcggccgctattgccaggctctgagcaaaccagcatgcacttgatattatcatctttatcctgggttatgacctggcaggaagcccatgaattcagacaggaagaagaaagtggtattcccgctaacttctaacaggaatctgtatccccttccactgggatgtgaggtcataaaacacactacagtctttgcagggatcaccaacagaaaccacacacagagctgagaggtagtaggtagttcagtaggtaagatgcttaccatcacagctaataaaacctcagttagattcctagagcccacatgatggaaggagaaaaccaactcctgcaagtcgtcctctgacacacacacacacacacacacacacacacacacacacacgtttaaaaaaccactccacattttcacattaccttacagctagatcaagtactttgaaaaataccatttggtttaggaaaccatcacggtaagagccattagagtgtgctgttcaaggcactagccaggcacaaatatcatttagctccgcctttttaattattttggtaaatatgtggcaatataattagcttcttttacagcatatgaattttaccttgtgcatttaaactcatctatctggcttcacccaactgctaaaatggtccaacggggaagaaagggattcgaggaaagacaaagaaaaacctaaccagcaccaagaacaacacactggatgcaccaagaaacatttgcattttgttcccagtaggctgacatattttcactcactctgaaaagcaaaaagattctcctaagaacgattcactactgagccttgaagcccatgggtttggagtgggttaccaggcacacatacacatcatctgttcccctcgctcccccaggcattctctgcctcagcaatgcgaatggagatctgcccttccttattagctgtagccactcagtgcgcatctgtacacgtcgaccaggaccagcagaggtgtgtcagcagcacctgaccaggggctgctttagccagctgatggacaagaaagagtttcaatgtgaatacagagtcctaggtggagtttgagaaccatgggacaccttccagcttgtggactcacacgggaaagattcccaaaacaccccaaaatcaaattctgccatgtctcgctggcgaccaataaaccctggatgcataatctaggctgttctaaatgaatgctcactgcaacacttctgtaacacagagttaacacaggttctagccagttttactcagtacctcccgttctgcccaataactctctccatcgctcaggctaaagggaaaataacaaaagggaaacaacccctgcatcctcccgcccccccccccctttcctcacccagtatccttgtatctctgatgcttaaactcctagggtagtgcagtcagcttgctacaggtgtctcactccttcctaatatttataattccacctcaagccgcacactacagacagaacccaaagtcctctgaaaaatgcaaacatcccagtatgctcatctgaggatgtattaaactgatgaaggctcccgttttctggtacaaaaccaccagaccactgtctacagaaggtgaaatgtgggggaaataaagcgagagtttttgaggtccaggtgaccagagacccagaaagaatggagagtctggggttttaactatctaaatagaacaacttaatcttaggaaaatcataccttcctcctgaacagacatacctcagtgacaaagtgaagagactggtacatctatctgagcatcttatatctctacaatgtcaccgtgttctgtgatgatacgacatagcagaggagagagactagtggtcccttcaatcatcttaatctctacatgtcgtgtggggctgagccaacacattcacccacagctgtgtctgacctaggagaggaattgtcaacatggtgtgtacaacagaagatactggaaagagactatttcaaaactctcaggccctagcattactaggaaactgaataccacaagtgaaatatctaatgggaaaacattctactatcactagcaatgcaaaaagcaatgagtaaggaccgtatgagaagagaaacttgcctcaaaaaaacccacatgtatagtgtgaccaggagcatgatttctaaagccatggagtctatcgggcctcatagaaggaatataaaaatgttagggcaatcgcagtcatatactgctattagtaaaagacactataggggaaacattgaggggactgtattgctcacagagctgtatgtgactgccaaaaaagtggaatcatgttgtatttcctatactcccaatatagtttcgcaataaattatttctaaagtaaacctctcattttgcatttctcaattctaacataaacacataaagtgtgtttttaaattgtgtgtgtgtgtgtgtgtgtgtgtgtgtgatatgcacaatgcacacacataaatgtgttatgggtgcaagtgcccacatacagtatgcagaggccagagcaggacatcagtatttctctctattactctcttcaccgttttctcttgagatagactttctaaatgtttggctaaactagtgtgccagtgagctctcaggatctgcccatctccatttctcattggtaggacaagagcatccatgcctagcttttgaaccggggatttgaactccgatgctgatgtttgcaaggcaagcacttgtacccaaggggccatctctccaaaccatagtttggttttagccaaataggactaaaacccaagctagcagcaagtctgtcctagtcacagccttcataactccatttctagaggatggaagtcctcttctggactctatggtactgcattggtgtgttggacatataggcaagtatatgcatacatacacacacacacacacacacacacacacacacataaaataaggtggaaaacaatttaggaagaacatccaatgtcaatctcaggtcttcacaggcaagagtacatactgcatgtgtgcacatgtacacacacgctcactcacacacatgcgtatacaagaaaaacaaaatgaatgataaataaatgactctaagttttgctttcttcggtttatactttggaataacctaaaatagtctcatctccacacgcctggacttgagttgtatttgatgacagtagccaagaaaggaatggttcccgtgaccccagaggtcaaaggatggaccttttgccttttctttcttgtctgtttgtttggggttttttttgtttatttatagttgttttgtttttatttatttgtttgtttggcacatggcttcactctgtaccccagactggcctcactcttactggtaatcctcctgcctcagcatcctaagagatgagattacaccacactagacaatactatgaataacatcactgttaactgttgttttctacatggtgacagccaataggaaatttgattgcaatatttacaaaatgactccacagagagagaaattctagttacaatatgaaatggtctttcctccattttcgaatgtgaggcttgactttggccattattcttcaatacggccaaattactgctgttattttagtacctcagtacagtcactttatgtgcataaaatcctaaattgctttaaagttttatcaaaatgttaatacaattgatccctggaaatgtaagccaagaaactcaaatacttactaaatatgtccttactatatacttactaaataatctgtaactgttctgaaaataataataataacaataataataataatagtagtagtagtagtagaaaagcaaccaaagccagttctataaccccagtgcttggctgtctgtgacaccccagcccagagaacagcatgtttatgatttttgcaagcagtggttatttcctgtcttagacatgaatggtttcttagacactttaaagggaaaacttttgggccagaaagaactttgaagctggacactagcattccaccacaaaccctgtgatcctgaggctatcacagagtggaaacttcccaagctgctttctctggctgtaacaaaatcgcaacaataatttaagggaaggaagatctatctgggccccttgttttaggtttctgttcttagcctactagttcgcatcctttggggcctatggatggtgaggtagggcacacggggaataccaacgctgctcacggtacccaggaagcaaaaatcagagaggaaggaatcccagcatcaccttcaaagacagttcctctatctccctgacctaacagcttccttcctctggggctcacccccaaatctccattatctaacagtgccacaggctgacgatgggccttttggcatatagcccttcgagggccttgtggaactgaaccataactatggtaaaaattaaacaaacactgaagcgtgtacaagcatgtttaatatgatgagccaaaggcaatgaaaatgatcagctgcttccaggcagctgcgccctccagcctttgccagagccagcctactagactcagtcagcaccttccccagcccatctccattcgtgtcaaaggcacaataaagtccaataagtaaggcaccaatgaaacagaaggtgttggaaaaatacttgatagtctcaagaatgccaggtcaggtaaatggtcccagcactcaatgatgcatgtgctaattcaatagcaaccacctgcaagccgcttacaccacgttgaagctggcaggactggagagtactggcaggcactaatttccttgttcagtatttccctccctaatcctacttagcagcaactgtcctggccacagagtaagccctctcttcctcgccctcttgtctcctcacctgctagagcatgaaatttcataagaacactacagtgtagacgactgaaactcaggcaccttctgacttatatacgaaataacttattataattaataatacaattgacattaatagccagttgctgtctctttagaacactctggcctgaaatttaagtccaactcctaaagatgccccattgttgcccatcaacagcctagagaaagtcaaaaatgatgtgaagaacagacagaaggggtggtgctcggttcaggtagtaaggcactaaccacacaggcctaacagcctaagcctgatcaccaaatcgtgtgtgaacaagccagattcagggcacacatctgtgatctcagcactccaacaactgagatgggaccgtaaagcagagtcacctggaccaaatgcaatatgcacatgcagaaaccctagcaaggtcaacaacagcatgtgtaagggagaaagacaccttgtgccataccctgagaagagtgaaattcacttaagttgcaaaaacaagagagagtagtaagaaagatttacttcggttgactagagttgaagaagtggctccctgccctgccctactctgccccatctatgaggttctggggggaaagagatcttttgtgtcaggagcttaaagcaaaactggtccactttggcaaacacagtttggaaaattgatgggcagtgtcaatcttgtaactaatcattttctttatttttctgcccagcaggacaagttgagacaaatttgcatcggaagtttaacaaggcaacagatagaacatcatctctaaatatagcaggcaagagttcagtagagccagctacggtcggcaaacacctttattcccagtcctctagaggagggagagccaagtaagggcagagccagtctggtctacattgtgagtcctaggacacagctacctcaggaaattcactctcaaaaacaacgtgtgtgtgtgtgtgtgtgtgtgtgtgtgtgtgtgtgtgtgtgtgtgagagagagagagagagagagagagagagtgtgtgtgtgtgtataaaatgcatacataacttttatatgtgatatgtgtgggtgtgttttgatagccttttgaccttaacttagtgacaagatacttatttcttttctctgtatttttgttgggttttctctcgttttcaaaatcatctctggatgaatttagaatgtgagtggcgataaactcaaaatctgagtaatttctagaaagaaaaacaactgtatcttccccacagaattaatgacaagtataaatgagacaaaagtctgggaaggttcatctcctacctagctctctacctccctcgacttttttaggaaatattttctccatttaaaatgaattttcctcacagtctaggtatttagcaagcaagcaatcagttcccatgttcctagctcttatgctgtaaataactgactgaagttttaaaagttaatatgtctccagacacttcccataggacattggctaagactcctagactcatgtattacataaagtaaaagattaacagattgtgtttaattttcaaagaaagtaatgtaaatgaaaacagcactaacaaagaaccccacagaccaatgtgcttacccttccaattgcctaggctttctctcaacacaggtacatagcccaactcagagttcactgtgattcaactacatgaagtcagtaagagccaccaagtaccatgtatatctaaagaggaaccaataatcttttcttttcttctccttcctcttcctcttctttctcttcctcctcctctttctcttcttcctcctttctcttccttcccctcttttttcttcctcctcctctttctcctcttctttctcttcttccgcttcattcttttttcttttaattaatactgggagatagaatccaaagctctgctggacagagctgtatttcactgagctacaaccacagtcccacagtggaatgctctttccactgcatgtatgtctgtgtgtgtgtcaggttgtctgcgtgtaatttgcagacatgtatgtgcctacacttgcccatgtcatacgtatgcagagcccaaagaagaacatcagaagtcttctttattcctttctactttcccttttgaaggagggtgtcccactgaaccttaaggcttgccatttttgctcccacgctccacctgttgggtccacctgttgccagtctccaatgctagggttacaggcacacaagttatcttgctttagtttctgatgctatgataaccatcacgtccagaagtcacttggagaggaaagggtttactccaccttacagtccatcccccagagaaggctaagcaggagcctgagcagaaaccatagaggaatactgcttacaggctcgctttctctggcttgatcaattggctttactgtgctgcctaaacccacctaccaagggatggcaatgtacacagtgggctgggccccaatacaccaattaacaatcaagaagatgtcctgcatcccaagaactagaaagatggtacagtggttaagagcacttgttgctcctacagaagactcaagtttggttcccatggcagatcatgaccatcagtaacttcagttactagtaatccacttctggacactgcatgcatgtggagtccttacatacatgcagagaaaacactcatacacataaaataaaaataaatcaatctttaaagaaagggggaaagttcaagagaaagagatagatagatagatagatagatagatagatagatagatagatagataaataccaacccacacagacatgcacacagaccaatttgatggatgctatcctcaatcaatattctttcttcccaggtatgtcagttaacaaccacgattagccatcacagagatcttgctcagcattgacgtgggtgtgggtaccaaacccaggtactccagcttttatgggaagcacttacgcagtgagccatctccccaggcccttcccttctccccccaacccctccctcacccctgcacagacttgagaaaaaaaaaaaactgaagaaaggactacctggggaaaacgtatcctgaatcaccttagctgcctcttccattaagatctgattaggccagcaataggaccagtttcaaaccatcatgagctcacagggctgtgttctcacctgtcaagtggcaatacaacagctgtgcctaagaccgtgggcgatccccagggctgtgccatccacaagtgttttctttccaggcaggttcctgctggtgccgcactgtctgaactcatgcacggcaggctggcccctgctggatggctttctccggtggcaggtaggactgacctcccactggcacaatggcataaacaaggacatgagaatgcccatggcactgtctctcctgcaaggctaccttgtccaaatgtctactgagagacaatggcctgacctaatattctctaaaacaaagcactgccaagcgggtgagcagattaacgcccatcgcctagtgagaacagaaatgtgaggttagagtttgccagccccagagggtgtcacaatctcaatcaagccaagccttctcttctacccacacccagccccaaaacacaagtcacccacttggccacattctcaccatagctgcccacactgctgtggagtccaccacagtgccctgaccgattgccctgtcaggcctcaaggagtaggcacaaggagaagccacaaggcaaaaagaggaagacggacagacaggccaaggacctggttcttgtcctgtttttcctccggaaacaagatcacagcagatagtgacaatcgaaggccctttcccgctatacttctacaaagtacgaagctgcctttctacaaagcaggcttactttctaaagtttctgacaagcagattagcaactttagataacaaagcaaaatgcagggagaatggctgaagtttagggactgtcctagtatgtgggagactctgggtttaagtcccaccactgaaagactaaggaatattgatttaaacataattgatttcacaaagcaagcatactgttttaccaagggaggctgggtaagccactaaccctcagaccccttatctggtttggggtttggtttggtttggtttggtttggtttggtttggtttggtttggttctgttttaagggaaaaggatagaatcacaacacaagcttactatcacccatagtcccagttccaagaattttgaaaaggaattaagggctggagagatggttcatcagataagagcactgactgctcttctgaaggtcctgagttcaattcccagcaaccacctgatggctcacaaccatctgtacacttacagaagaaaagcaattaatagtctataccatgccatggtcccaagttgaaagaggctccctggtcaaccaagtacattctataggttagagtctctctctctctctctctctctctctctctctctctctctctctcagtgtttgtttgtttgtttggtttgttttgttttttgtttttgtttttctagactgggtttctctatgtagccctggctgtccaggaactcactctgtagaccaggctggcctcgaactcagaaatccctcctgtctcttctgggattaaaggcgtgcgccaccccttcatcaacatcaaaggcttatcacaagcacattaaggcctggcctccctgagcacagcagtggctcaaccctgagacagcttagaagaagtatcctggtctcttccaagtcagtgaccagagtgagtgaatgggaggagccactgggatgctcagagagagaccatgggagccggaggggagccagacatgctgcaggatttcactggctcccaggtctggagccatcaggtacattcttatgccttgagtagcagcttttcatttctagacttttcaaagtgaatctagtgttcactcccagcactggctccctctggtctgggcaggctgccattgagtcacaagggccactcaaaagattttggtttttttgccttaagctgttgagaaccctaagctaaataagtgactattcactagcctccttccctgtcccttccctccctgtacctctattaaaatgacactcgatttatgctacacagttatgctactctggatggataagtaagtaatatgcatactataaatgactatgaatattaatattaatgaaatgagaatatcaggaaagtggctcaattggagaactcactggataatttttctttgtaagacaagaaagaatccttgccctaaaccctacatgtgagaggcccttctctctgaccccttcttcccctttctgacccatagcgatctcagaatctagcagacacacatacccaggcccaagcacagaaacccatgcatctccttctgcagtaccgacccaagttccgcaatctgcttaaatgagccctgtactcaccagccagggctggaccacaccaatgcttacacatgggtcagggccaatgtgtatttgttgttttgcttggtttttgttttgctttgttttgttctgttttagacaggtctaggtagccctggctgccctagaactcacagagatctacccgcatctgcctcccaaaggctgcgattaaaggtgcgcaccaccccagctttacagatggaagttgaagcaggtgagcagaggtgggttaggacagggctgcgccaccaagagaaggcaaagcctacgaactgactccagcttccctgtgctatgcttgggcacaggtctcagatgggctgtagttcaatcacgtctggctccctaacttgcaagtatatttgttattttccattctcttttttctttccatcaaaaatcctgcctcctgcaacccccagttataactgaacacttggcttgcatgccacagagcagattcctcaaccaccctcgcagatacatgaagctacgtgagttagctacagccagggcagccacctattcctgccagcctttaaaaagggaaatgacttctttctttctttttaagtttcccttcttccctcttcatggactatacaacatagacaagagtagaaggactagaaaacaggaaagaaccctggggctgaagagatagttcaatggttagagcacatactgttggttcttcagtaggacaggagttcagttcccaacacccatattggtgggctcataatcaacactaattccaggagcagcagatccaaccccctcttctgggcacaaatgtggttcacgtaaactcacataggcacacatacttacacataaacaaacaaacaaacaaataagtcagttattttttttaaaaaaaggaagaggggaccctgagtcccgagagaccctgctgagcatagcagtgcatgaaagctgaccaataagatgagaaaaattaatgttaaccttatctgagtcactgcattttgaagtttctttgccacacagtttaaaaatctatccacctagtgcatttgcacatggtctaaatcaaccagtttcaagttagacttagcaggcagcacagcaatgtcagacaacgctcaggatcacagctaagaacaaagcatcatgcctcctccagtaagaaggaaaggaaggggtggaggggagagaaaataaaaacatcatggaggaggggtactgtaagaagcagtcatgatggctaagatcaaaaattcaggtgacagcagatgctggcgaggatgtggagaaagaggaacactcctccattgttggtgggattgcaagcttgtacaaccactctggaaatcagtctggcggttcctcagaaaattggacatggtactaccgaaggatcccgcaatatctctcctgggcatatatccagaagatgttccaactagtaagaaagaaacatgctccactatgttcatagcagccttatttataatagccagaagctggaaagaacccagatgccattcaacagaggaatggatacaaaaaatgtggtacatttacacaatggagtactactcagctattaaaaaggatgaatttatgaaattcctaggcaaatggttggacctggagggcatcatcctgagtgaggtaacacaatcacaaaagaactcaaatgatatatactcactgataagtggatattagcccagaaacttagaatacccaagatataagttacaatttgcaaaacacgtgaaactcaagaagaatgaagaccaaagtgtagacactttgccccttcttagaattgggaacaaaacacccatggaaggagttacagagacaaagtttggagctgagacaagaggatggaccatctagagactgccttatccagggatccatcccataatcagcctccaatcgctaacaccattgcatacactagcaagattttgctgaaaggatcctgatatagctgtctcttgtgagactacaccggggcctagcaaacacataagtggatgctcacagtcagctattggatggatcacagggctcccaatggaggagctagagaaagtagccaaggagctaaagagatctgcaaccctataggtggaacaacattatgaactaaccagtacccccagagctcttgactctagctgcatatgtatcaaaagatggcctagtcggccatcactgcaaagagaggcccattggacttgcaaactttatatgccccagtacaggggaacgccagggccaaaaagtgggagtgggtgggtaggggagtgggggggagggtatggaggacttttgggatagcattggaaatataaatgaggaaaatacctaattaaaaaaaaaaaaaaaaaaaagaagcagtcatgatttcaaacatccttccagaaaactgtgtcagtaaataacagaagataaagataaaagaatttcatatgcaaatgagccagatcatccaaaatccatgaagtgagctgaaagtgcttagtctttctcagatgttcttctaagttaaaggcatcaaaaacaaacaggaggggcccagaatgacagcctctgcctgcaccccagtcctcagtactcccaccccagtcctcagtactctcaccccagtactcagtactcccaccccagtcctcagggagcaccagaaggaggagcttcatctaaaagcagcataaactgcatggcaaaaccctggctcaaagcaaacaacaacaaccgatccagatagagtggacatatttaagaaataaaagcacgggtttagaggtaaagcagctaaatgtctttgctttgtaagcatgaggacggaagttcaaatcacatgaaagccaggcgtagaggccaggctggcaagatgcctaagggaataagggactggacacctgatgatgtgcctgggaacccaaggttgaccctcagaacccacagaacaaactccgtgaagttgttctctgacctcacacgtgtgcacagcatcctaccaacacatgtgcatgcataagcaggggtgcactcgcacgcacacaggagcacacacacagacagaggcacacacatgagtaataaataaaaatttcaagttatttaataatccaggcatgcctatgtgtacctataacctcaacgctgagtgacagagacaggcagatcctaagaggtaggtgggtcagagagcctagcaaaacaggaagtgtttggttcactgaagagacccagtttcaaggcaacaggatgggagagaaagtgagaaacatcccaacatcatcgtccagcctcagcaagcaccaatgcgcacacacacacacacacacacacacactcgcatacatgcactgcacacacaaaagacacacatttagctgcacttcactctgcttcctgcccaaaaaggaagagtgtgtggctgccaccgtcacattctccagagttcacagggtcaagagatcctggaagtcacagcaggtcacacgatggctaggagtaaaggagaaaggcagagctaaagggactattccaaaaacagaggaagggaagctgcagaaattcacaaaggaagtaaaggaaaggacagcagaatacactagaaagagctgaacacgccctcagcaaagctgcttcctagcagtggaaaggggagcagaaaccacatggggggggggggctggacaagctgtcccacccctaggacaagcaagccctcagccctcacaagactcaaatccaactgggggcgggggggggggaggtgggaggctgggggggggtgggtcttggtgacggtgatccttccaggacaagtaatggtaataaatcccattttgttactttgactgccccgaagcgtcacagctggcaccatctccagagagaacctgttattaacagctgagctaccctggagacctgagaacacggagcaatttcaggtgagggagtttcaagttggtatcccatatctgcagagtgaggaatggtctggggatgtggtggcagagaacaggagagcccaattctgctgggctgtagggtgcggctggcagaaggctggcccatgtagggaagtggctaggaagagagggctcccacccttgatagacaggagcacatctcatcaactgagactaactctgaagtctgatagctctgagcctgaggtcacaaggtgggtagtctctagagcttactaacttccacacactgctgaagagcccaggaaccccaaaactgcagtgactgctacactccagcaacaggagccatctcttcagcagggagatttttactcacaggaagtcttcagagtatgaagtcatggggtgtctgaggacaggaactttcaccctgtgtcatgaccgagcctcagttcataccagtgaatgtctgtggtatatacaattggtgcctgatactggaggactgggctcagagtttccttttacgtgggaatagatgacatcgggcgacagagcagagcaaaaggaaagagctcaacaggaacgagaggagcccacacgagggcctgttgtggaaacaactgtcacatgtaaggaataatccgttgcattaatctggaatcatgatccactactgcagcctaaaaaaacagaaggaagactcagctcggcatttggatgacagatttgacttccatttcatgtttgtccaaagtgtgtgtttaatttaattttgctgtgaaatgtaatcactgataatatacaataaatgattccttgaaaaatctaaatgcacagaaaaaaaaaaaaaaaagacaaagttaggtcctctacatgtagacatagacccatggcagttgcttctctgcacacttgcaaaaatctggagacaactcttggctagaagtccagccacccagtgagtacaatctggggtcgtgggggagagtaaaaggacccactcagcacaaaggcatgggttcctacaaaagaaagctacggagctgaaggaagcaccagccaccagcaaacccttggccaccacacactcagcatcagcagaaaccaagagcaacagtcacaggctcagctggccacagcaacgccaccccacacatgatttacctctcttctttttccaatgttttgtcccgtttcttcccttttttatattcctctgtgccccacctgcagcagtattgcaacttgaccatattgggcttttttatttcttattcttacacccaaacaattttatatttgaaccttttcattactgggaaactttcttccttcttttttacttttagttattgtttcaaatatcttgctcctttctcttttccatcataatgtcccccactgttcttcatatttaggatacttgaagactccaccagagaactcctagaactaataaacacagccagtaaagtagcagagcataccaacatactcagtagctttggctatcccagtaacaaacttacacatacatacatacatacatacatacattcataaatggctagcagtgtttgaaaagcaatttttaaaactatctaagaatgcaaaattaatgactctgtcaataaaatatttgcttatacacttaagacccttagttttatcaccaaaagatggagatcaagggagggagggagggagaaaggaaggaaggagagaagaagaggagaaggaagagaggaaagccaggcattactaggtacatactcatgataccaggagactaacaacaccaggcagactggcagagatctccaaggcacactgaccaggtagcctactaggtgatatcctggccgccgagaggctttctctccaaaaacataggtaaatagcaccttaagaacaacagaggttgtcctctggctgcaacaaagtgaacacaccaaaagataaggcaagatgctcatgaattaattagcagaattaatgctgcaaaaatggctgtattagtgaaaccaatctccagatacaatgtaatccctatcaaagtttgagtaatattctctacataaccagaagaagcaatcagaaacttgcataaatgcacaaaagaccccaaatagccaaagtaatgctaaagtactgtgctggctgtatgacaatgcttggtctcagattacactgcagtgccatgtagtcataaagacagacacatataccatcagagcagaacagaaggcccaaaaccaaacccaacagccatagtcacctcatgatttacaaagctctcagaaacatgtggtggtgaaaagatagcatcttaagaattggctctgggagaactagaagtctacatgtgggagcgtgaaactaaacccctatcattctgaaccaatggtcaaagatgcatctagaagaaaaactggcatcattttactaactaggcctttatatgtttgtccttttaaaacagtgtctcactggctggtgtagaactcactacataaggacaggctggcctccaaatcacagagatccacctgccactacctcccaagtgctgatattaaaagcacgcatcatgtgggggatgaaggtagagggtggcacatgcctttaatcccagtacttgggaggcagaggtagcagatatctataagttcaaagccaaccttcgagttccaggacagccaaggctacacagggagatcctttctcttgaaaaaaaaaaaaaagtatgactggctaaagggcaatgttggcaacccactaatatccttccaatacactgactcagtcgtcattccatgcctggctattgaaaacagggttatgaagacattttcttcacatcaggaaaaaaaaaagaaaaaagattttgataccaaccctaccagagcctgatgcagcacaagtttcactaattaaaacataaataactaaaacctcaaccaggctgttaattagtaatttatgtctgattatttgccacttttagcaaaagggaaagatttgtcaacaaataaaaattcattatatgcaaaactgggtcaaacaagatcacaaattctgtccttcacactttgtgtcttctcaccttgtgtcatctgagcaatctagtgactgactggttctaggaaaacaagggccaaagtaagggggacttggagtgacagcaacgatgtgagccacagaactcccagctgcgtactaccatcggaatctccatcaggaatgatattagtaccgtgaacacagaaccctagttacacatcatgccttcctctctaaaacttaactcttagagcatagatctcctggaagaacataatcatagcccagagaggaggcccagtgactacgggtccacgacagcaagcgcgacaacctgagtgtgatccccagatccacaagtaggagagaatcaatacacaaaagttgccctctgacctccacatgtgagaatgaggcacatgtgtttgtacacagagagagacagagacagagaaaataaataaatacacatatatatatggtaaaactatattttacaaaaagaacatgtatcagaactgggaaatttttccaataaaatgcgcataagccaaagtattttttaaaaaaacaaaacaaaactatatattggttcagtcagatcccagcagctgctgtggcggctcagttcttcagtagccctttctgtcttcgtttctggaaacatggcctctggcgtggctgtctctgatcaaggtgttcaatgacatgaaagttcacaagtcctccaagccagaagaagtgaagaaacacaggaaggcagtgctctttttcctgagtgaggacaagaagaacatcatcccgggggagggcaaggtacgagatgcagggcagactgtggacgacccctacaccacttttgtcgagatgctgccgctacgcgctctatgatgcaacctatgagacctggtggtcatcttctgggcccctgagagtgcacccattaagaccaaaatgatctgtgccagctccaaggatgccatcaagaagaagaaggtaacaggaatcaagcatgaattacaagctaactgctacgaggaggcagtcaaagaccgcggcaccctggcagagaaactaggtggcagagccatcacttccctggaagacaaacctttgtgagccacctccagccccctgtgtcttcgtcagagtttctattcctgcacaaacatcatgatcaaaaagcaagttggggaggaaagggtttattcagcttacactttccacattgctgttcatcaccaaaggatgtcaggaactggaattcgagcaggtcaggaagcagaagctgatgcagaggccatggagggatgttactcactggcttgcttcccctggcttgctcagcttgatctcttatagaacccaagactaccagcccagggatggcaaccactcacaaggggacctcccaccttgatcactaattgagaaaatgccttacagctggatctcatggagacatttcccccaactgaagcccctttctctgtgctaactcaagttgacacagaaaaccagacagtgcaccaccctgcctggagcatctagcagcctcagatctgctcttgggtgtcacaggctatccctctatgtatggggtaggggaggcaggaggagacagagacagaaagctgtggtcaatatcaagtgtctgcctctgtcattctcaaacaaatagttctagacatggcttttattcctcccatagttcacaaatttggggtaggctgctggctggccattgagaatgccccaccacacccccagcactggggtcgcaaatacatgtgttactgtccctacagtgtcagggaccgactagggagctaaactcaagccctcacactaagtgagttacttcctaacctgagagtaactacattttacctgtgaaacagtgtcctatgacctagatcaatgacctacccaaatattaagcctcccaaaccactcactgtcccaccttccggtgtcttccatctttcttgttgttgttgttgttgttgtttgttttttgtttttcgagatagggtttctctgtgtagccctggctgtcctggaactcactttgtagtccaggctggcctcgaactctgaaatccacctgcctctgcctcccaagtgctgggattaaaggcgtgcaccaccaccgcctggcatcttccatctttcatattacctctctaatgctcactccacagccaacctaaaacctcagaaaatacgaaaggaataaaatattcaaaacatcgataaaagttttaatagtgccctttaattagtgcccatatcgtgtgagcctcactttgtacacatcaagctctcagaggccagaaggacatcagatctcctacatagacctggagttacagttatgaggcaccccttgtgtgtgctgggaattgaacttggatcctctgtaaaagcagtactatgttcttaactggcaaactaccactctctagctccctcaatgctatcactatatgctctataatttactagagaaaaccatcaagagtcctgtggtggtctgaatgactcccataggctcatgtaattgcatgcttagtctccagttagtggaactatttgggaaggattaggaggtgtggccctgttgaaggagacatgtcagtgggggagggctttaaaatttcaaaagcccaagtcattcccaattatttgtaggaaaaaaaatcaaaaacaacaaaaaaaagtaagctctcagctattgctgcagtactgtgcctgcccactgccacactccccagcaagaccggcacagactataaccctctaaagccctaaggctttcttctaagttgccacccttttcagggactgaaacctagcaagattgcaatgacaaaacacaatgtattttgccaaaccaaaaacacaggtatcagcagcacacaggcctaatcattacgagagctttgaaaggggctcctccagtctgcttcaaagttactgtggtggtggctcatgcagtgtacattcaagttagtccactggatgggcaactttggaagatggaactttccatccaacaagataggaacagcttcctccagtcaccaatcccaaatgctccccagcagagcacaaccaaaagcaggcatctgttagctgaataattatgacttcagcacatctcagctttattgactaaactccaatgacctttccactgcttaattattccctaaatgaaaggtattcttcaacatctgctctcgatttatttttaatttgcatttactccatcgtctctgctgaagctgaattcggtaacacaggatgacatcatctgcacagcatcaggctaaacacccccagtcttcaattaaagttgagctcaaaccgttttctgggctctcttgcctgcagattttacttgtcggagatgattatccccgcttcaaagtgaggttagtgttctttccttgctgtctttacaaagaacgcttggtctgcgttgcatgacgcctttctatgtctacactctacagtaaggcatcctctaaccctttgcagagacaacatggagatacaaagaccagaacacatccagagcttaactcagagctcactgcaagctaggctttgggggaaatggcctggaatcttccacactaattaaattcaggaacatcctctcatttctgagtcaatatttacattgtaaatttcaaaaagcattatcatttcacacaagacacgacaacaattcactgacaactggatcctgtatcacttggaaaccttttttgctgtttgggatagtctgtttaggatagattttattggttctattttgtggtctctttcttttaagtcaatctaaatatggtttttcctaaatgggttgttaagacttgccccactcttcattgtagccaatgtctgcacaaaattctgtgtccccgtcacagatagacagcaagctactcaggcccaacccacaatgcccttccacgtatccatctgaaactgcccaggaaatggctcccactaaacttggggggggggtgctcaaattccatacacagaaacaaacacaaaaattactatcttcaaccttgagggttgccttctctaggaatgaaccgacatcccttcctacactttcagagatgtttaactcagtggtattcctgcagaggtctatgaaagatttgggatttggtttggtttcattcagttttggttcttgaaacataaagatattacaagccctccaggatgttcttgtagatccctaaggaacatgctaccatggtcacgacccacttaactccccctccttccctttatccttttttatcctgtctgtatccttttttatccttctgcctgtgtgaatatctgtgaaccatgttcaagccatgcccacaaaggccaagagagggtatcgcatcccctgggtctagagttacaggtgattgtgagctaccacatggtgctaggaatcaaacccaagtcctctagaagggcaggcaatgctcttaaccactgggccgtctctccagtccctttataactttttaaccctttgacacacaaatcaccctttcctaaaattcactggttttgaaagaatgagagggggctggagagatggctcagtggctaaaagcactgactgctcttccagaggtcctgagttcaaatcccagcaaccacatggtggctcacatccatctgtaatgagatctgatgccctcttctggtgtgtctgaagacagctacagtgtacttgtatataataagtaaataaattttaaaaaagaaagaaagagagaaagaaaagagagagactgcttcatctcaaagggagcagaaacaccaaacatcacgtacttagactttaaaaagcagagaggcaaatatacttacaacttttctgtgagcataaagaaaatcaggaaagtagcacagattttttttttttcttttcccattaccagtgacaaatacacccttttaggaagtaatgtcttagaaactatatagtcatattaaggggctggggaggggcctcagttggtagaaatccccagttctccataaaccaggcatgttggcatacatctgtcgtctcagaactttgggcatctgaggctacatgagaccctgtctcaaaaagggcgatggaggtggagtcggggtggagagaaccagccaagcagccatccaagtacacaacacaaatcccagccctcggaaggccaagacaggatgatctcagtgagtctgaggccagcccagtctacagagcaaattccaggatggtcagaaataaacagtgaaaccctctctaaaaacagaagaacaaacaaacagacaaaccaaaagaaaagaaaagaagaaagctttcacaaagaagcaatcagagcagtccttgctcaggagctgtgggcaggaaagttaaccaaggttagcctcaggaaagggctaaccacgctgaggtgtgactatagtacagagcggacagagacagccctagtcagtatttgggagggacattccagttcagatgccccagaactgaagcagcatctgtcagccctcccctgacccactttcctgagtttcacctcctctcagccaaacccaagctccaaactatgagacaccaaaccatcaaaggccaatagtatgaaagccattaccttttaaatctatttaccaggaaatgtttctgagtaaaaataaacaacacttgactctccctttcctcccttcgggggaactcaggctgctctctaaggctgagacccacaggcctgactttcactatctaagccaaggcactaggaaggaaaaactctcagggctcatggaaattcctgagtcagaatccaggagggcgactctgacacagcctgaagctcaaagcccagtgttcccaataagagaacacacatcgatctatgtgattacagaatttactttaaataatgcaattcacgggtgcccttgacggggtatatcagtctcaaaatatatctcctccacataaatactgtagagccaaaaatcataggaaggcaaccaaacctttctaatatgcaggcatattggtatttctgaaagggcgggaagcaaggccaacgtcccaggctttatcacgtcagatgccaagtaccaagtcctatactgaaatagatttctctgctgagaaggtcctgcattctcttggtttgggttggttggtttgggttggttggctggtggaggggaggggatgtgattttgttgctgttttggtttggtttgggttttttggtttttagtttgggggagggggggggtgttgttttggttttggttttggtttgtttttaaggtagagtcttactgtgtgctcctggctgacctgaaactcactgtgtagactaggctggtctcaaacttacagaggaactccactagcctcagcctcctgaatgaaaggcacgcactgccacacccagcccggagtctttttttttttttttttttttcaagacagggtttctttgtgtagtcctggctgtcctggaactcactttgtagaccaggctggcctcgaactcagaaatcctcctgcctctgctccccaagtgctgggattaaaggggttcactaccaccaccccgcccagagtcttactgtttggacagaaaaaaagttttgtgacagaagtaagggccacaaggattgtactggacacataagattcctagcgtgtgaaatagcacacgctatttgtgtgtttgctgtgtaactgagctccaccactttgacagaactgaaacacacacatacacacacatatagtcaccaaaatctatttgtagaacccacatacatcgagaggagaaaaccaactcccataacctgacctctgacctctacataggcacatatacacacactaaaataaatgttaagaaaatcatttttaaacaataatataacaaaaattgagttcccaaaactagttggtggctgtgccacaccaagtcggaatctcagctgccacacatgcaaaagagaccaacaagtcacttgtgagtcatcgtgccatgaaagccagcctcagcaaaagcagccccgtgcgtgggacacacagcttagctgagaagtctgaggacttcctaagtccctaagtgtcacctgcaccctgagaggggaggaagcaatggcaaatgggaaggaagcctgggatccaaggctgggtctggtccccaggctatcatctcgagagtaaatctctatcatcctgtagctcactgggtaaggcgcttgccttgtaagcgcttggtatggtggcagcatttggtatgcttataattccagaactagggagatggagaaaggaggacctctggggctcagtgtgcaggcagactaccaggagccactcagtgcgagaggcttaaacaaaaacggttcgcagctgctaagaaacagcacctgaggccatcccttggtctctatgcacccacgcacacatacacatacgtgcagacaatctcacgctggctcgcattccaaatattgagttgagcatagctctcattcagcagttttaatttttaaaagtgcatatcaaaacaacaccatagtaaatgcttgtttctccacacagtgaaagagggcgggactctagctacctgcatcctattctccactgctttagattaaactttaactagtgtttacaactgcctgcatgatctcccttgttcccttgttcccagggaaaatcatgatatcagcatccagtgcaaacttctgggttcaaataaggttcaatcaaattgagttttcagtcctgtctatataatgaacacaccgcctctgctagaatattggcacagacaagatcttagatcgctcctcctcagcctcgtgaggacctgtgacacaggcaaggcttttgctcgtcccaagactgctgttctctaacagacttgagtttccacccgggtccctgtctgtccctcaaggcaagtcccaagggcttgtggaaaaaaaccaagcccgctgaaaggcttcccttcaaaggacagatatttcagctaagggaatctccagaaggagcaaggaactgttttcatagtcccttaaactgtggagaaaaatctctcttggatactacgatcagtgtaaaccttttaaaaaccagaccactcactccctaaacgcaacttagccactgtgttgtctgaagaggaccttctgaaaggtcaacagagaaagccaacctcctcaacctttctctcactccagaccttgttgggcagctctaatttacaccagatatcacagggcatgttttcagtaagctggctataatggaacacagcgtaaaccatcagcaaagaaatttgctttcctttagtttcatgggctcctctgccctcccccaacacatctcgatagcacagttacctccctgggcaccagatcagggcctaccctgtgccaaatgtcagtgcatctgaaatcctaccttctttgccatccagttaaaagccttgaacagccatcagaggaagagagaaagagaatccacgtcagagacagtgtcagtctctcatcttccgccccaaggactgtctgtcctccaatgttatcccctttgtcagctcccggaagagaatgacaggacagagatagaaaagaaggcagccaagcagcagcaggtcctgtctcttatgtgggctacgataccactagggaaccaaagcagccccagacttcagcccagggtcaccctcagtaggtagcaaggagggagcaagagaggacctgtgcacagttaacaccgggcaaattcgcaaggaacagatctgagcataaaataatgaccctcctggcaggcacaggatgaagactgtgcagagttcagactccaggtttcccccgtctaacctgatcctgaattcaaatcccagcgcgtgaatctccaagccatggaaccttttccattgggtaagtacttatcacttggctacaatccactgtgccctgggcttgatgccagaggtgtactggttccccaagtcacatggagtcgagctgcattgaaaaaggatatcagcaagtacaaaatgcaagcaaagtaccagatagcgagaaagaaaacacagagaagtcacaagcagtgatagggcacagggtgactaagcagggtgtggtgtgtacacctgtaactccggcacttgggaggctgaggcaggagcatcatgagtttgaggccagactaggatataaagcaagcccttttctcaaataaatacagaaagaaaagaaaaaaaagagaagaataaagaaaaagtgtaggtcaaaaacaaacaaacaaacaaacaaaaaacatgacttccaaagtcaacagagaaggccactcaatgaaggctgcatttaaatattaacctaaatggcagggaaccaggtgcacctgggaaggtcctacggaaacagagaaaaggctagtgtaacaaatgactcctctatggcttttgattgccacctgtgaacgtgcagctgtgatgcaggaatcagcatcagcatcaccgctaagatgctagcattagaggctcagctttgcatgggctctaatttcctcaacaattagaacgcagagttagataaaaaaccaaggaggtagccagccacagtgaagcaagcctttagtcccagcacgtgggaggcaaaaaggggtgtgtgtgtgtgtgtgtgtgtgtgtgtgtgtgtgtgtatgcccagcctgttctttgacatttcatcatgtcccaaagaaaagttaataaaccacacactccaccagtagcacattttctctgaagattactctctttttttgtttgtttgtttttgttttttcgacacagggtttctctgtgtagtcctggctgtcctggaactcactctgtagaccaggctggcctcgaactcagaaatccgcctgcctctgcctcctgagtgctgggattaaaggcgtgtgccaccacacccggcttctgaagattattcttggactaccattttaaaatctttataaacctgttaggctttccgactgacacagattaagagctgtcactattctagccacttctcacaaccttatctcaagtgctttagcagacagtgaaggctcactgtcagcagccctaaaccctagcccagtagacaacaaatgctttctagactcttcttttttctattttgttttttattgggtgggggtggggtggcccggttggtttgccggtttttgaggcagggtatcttagagtgacagggtgtcagtgtgtcatgacaagctgaggataccctgaacttctggtcctcctgcctccacattctgagcactgggattgctggtgtggaccaccacaacgtgcttatgtattggtggggattgaacccagagcctcatgaatgctaggccataactctacaaagtgacccacaggcttcacatctaaggcaatcacaaagtgtgtggcttttgttctttaaactatcccagtgcctacctttgatcacttagttgtagggcaggagtgaagcccagagtgagtgtgttgttgatgtgagcacagccatgcctcagcctcctggaagtggccacgccctccctgggtgagactcaaagggatggctaggcattcctcaaattagattgtggatcttgacagtgtttgcagaaaatgtcttccataactcccctattcctccaatgtttacagtcttagaggctgctctcttatagagactgctcctagcaagcttagggaaacaggcctctatttccaggtgtatgtaataagcccacctccctgttaaactgtatataataagcacgctaagctacatcagtcagcgcatcccacaagacccccgcttttctgtcgttttcatccctcatccgaatcctgggggcgacatgcaagtaactggtgctaggtatttctcttcagatggcaaaatggcttttaaacactgaattacgaatctgatgcacaacttaagatggaacgagggcaataagtggttggttagttggatggttggttggttttgtgagctaagagctcatatcttgatccaaaagcaggaaacagagagaggaatactggtattgggctgagactttcaaaaccctaaagttcacccacagtggtccaactcctccaacaagggcaaaagttcctggtttttcccaagcaggtccatcagtgagggaccctgtattcaaacacagagcccatgggagccgctgtccttcaaaccaacccctggaaggtcaaccaggccacccagtggatagccactcaagagtatatggaaatacaaactggattcagggggaaaaaaaaaaaaggaagcaaatttgtgtgagtagggaaggaagagtagatctgagagatgtttaagaagggggagaatatgaccataatatattgtatgaaattaccaaagacctactttaaaatgtaaagtctagatatggtggcacatgtctttaacaccagagctcaggaggcagaggcaggtggatctctgtgagtttaaagctagcttggtctacatagtgaattccagacgagccacagttacataatgagaccttatgtctttgtttgggttactattactgcgatgaaaccccgtgaccaaaatcaagttggggaggaaagagtttatttggtttagacttccacattatagtccatcatcaaaggaagtcaaggtcataacctaaataggacaagaaccaggcaggaggcggtgactcagaccagggagggatgctgctaattggctagcacaggctgctttcttataagaatccaggaccaccagcccacaaatgatggtccgtccacaatgggctggcctctcccacatcaatcattgatgaagaaaacgccctctagctggacctgtcttatggagccaatttcttaactgaagttccctcctttcagatgactccagcctctgtcaaattgactcaaaagtagccaccacactctgtttcaaaaatgaatagatagatagatgatagatagataggtagatagatagatagatagatagatagatagatagatagatagaaatagatagataacttttaaagagtatatgaaattgaacaggactagaagagagacgtgaagaatagaaagggaggtaattggagatcaacttgatcaaaacacattatatgcatgtataagattctcaattttattccagtcttttaatctccaatagaaagaaaaatattcctttataggaggtaggggtgtttcgctgagatgggatctccctaaattgcccaggctgggtcccaaatagtgtggctgcaggcatgcagcaccacacttgagttctctactctctgtttatgatgttatgaccttttttttttattggccttttactctcgattctatctccacctcccaaatgctgggattataaacaagcaacaggtacagggtgaatattccttcttaaaaagtggaaaactaatatgcagcatggaataacataaccagtaaaaatctttcaaatttatttattggatatggatcattccaactatttaatctagacttctaaaagtctcttaataatgtgtaaactttggagtgtcccgagatcctaccctgtgtactaagcatttgccacaaacaaaaatcaagagtatggcttccagaaatcaaagagatgactcacagactcattcaaatccaaattgatctgccagcttttgcaacacaatccagccagaggaatgtgattcatagctcagctatgcaggagctaaattttcgtcgtgttttgaagtaggtgccattcaaagggagggcacagttataacactgacagtaaaaatgctaaaagcaatttgagaattttttaaaacgtaagaagttaagtaatacaagtccatcaagcggctttggaaaacacgtgtggccggacagtaagaaaaagaacgatcccaaatgccaagattctgggatatagctcacatctttttggaggcaggatctcatagcccaggttggcatcaaactcaaaatctccctgttccagcctcccacctgataggagagcaggtgtgtgtttacgttgttattttatgtgtacgagtgttttgcctgcgtgtatgcatgcacactgtgtgagtgcctgctgtcctcagagatcagaagagagcattagctaccctaggagttacagagggttgtgagccaccatataggctgtgggaatgaacccaggtcacctagaaaagcaacaagtgctcttaaccactgactcatcttccggctcccaccggcaagcttttaaagggtacttttcacatcaacagcctcctgtatcataatcacttaacaatacctcatagcaccctccatgtttgtaatgtttatatacactcacatccacacacctcaatatcatcacttcttatgaacacgtcgctgcttcagtcatgcgctctatcttaattacctccactgggatgctgcgtcatccacacagctgtgcgaccccagtaaggagacagtaagttcctagctatttctagagttatttgactaagaacacagactttaaataaaatagtaacaacctaagaactggcggtcatttctaaacactctaggcaacaatgacctaactcatgtccaaattggatttttatggtgctttctctctctctctttttttctattgtaaacagtgctacagtcaacttcttaaatgtacatttatatcctctgcctaggaagaaactctataagcagagtcattcgaacagttgatgttccctatttaaaaaaagcagcacggaaggttggcaaaatggctcagcaagaaacccaagtttggtctcctggatgcacgtggcacatcacagaaagctgacatttgtcctctgacccccactggcgtgctgtggcatgagcatccaaacccccatgtacacaccaatgagaaagtaaatgaaataacacttgtcttccttagggttctattgctgtaaagagatacaatgaccatggcaactctcataaagggaagcatttaactggggctgccttacaggttcagaggctcagtccattatcatcatggcaggaagcacagcagcatgcaggcagaccaacatggtgctggaggagccatcttgatgcacaggcagcagaagaagaccgtgtgccacactgggtgtcgcttgagcacaaaagagctcaaagcccgtcctaacagtgacacattttctaatagtgctactccctatgggtcacgcactcaaacattgagtctatggggaccatagctattcaaaccaccacaatattttataaacaaactatcttaacaccaaaaagtatacactgtaacaaattacccccagccatgtatggaccttactaactttataaatagccattttaaatttaagaaatagtttggaagtgtggatactcagaatatactctaaaagttaaatttttccataaaactattttctagtggacaaagacagagaaccagtgacaaatatctaaagtcttttttttagtgtattttatttactattgatgtatatgtgtgtctgcgcacatgccaatgtgcacgtatggagtaagaggacagtttctgtggaaagggttctctcctctccctttctttactggggtcccgagagctgagcgcggatcactaggcttcgacagcatttacccacgcagccaccttcctaccccagaatccaaggtcttctgtaataaaggttgattcgggacgatgcgaaggatcacctggcctcacaagttatagactctgagacgtacagagacatctagctgtctctcttccactttcctgtcactttccacatctctacatatgaattctgtacccctaaaatgacatttaggagatcacagtgaatacaccacacaacatgccgacgcacttcccaaagagtccttaaagctacaaaaaccactgcatagtcacagccttatctgtaacatccagacgtttcacagaccaagcacaaccagcatcacgaagggcaatgcatatcctactgagatctcatttcctgcacgtattttagcagtttcgactaagaaatgaactcttaccataacacacagacatttccaacaggaaatatcacctttgagttctattcaatgttgttgttgttgttgttgttgttgaagagtgacacgaaggaatgtttataatgctggagttacaaaaggacaatgctcacacccaggtgagaactctatataattttcccagcttaaaaaggccatgcttgctcaaaaatatctcccctttgagcctgtctcggaaccatgtttgaagctcttttaaaaatacagaaattttcattcagtgggtttggagcagagccaacacatctgcatttgtaaaaaaactcccagttgattcatttggagagccagaattgaaaagcagtggttatataataagctgggggtggggtggcatccaaagacctccaatccgaatgttcacatgaaagtcattcgtcggtcttagtctggctgatttgatcacactggggaagactgtatctttagaaactaacatttctaaaaggaaagagaaggtcacatgccagtgttagcatccaacagcaattagcaggtgggcaaaaggttaaggaatcccaccacaaaatgatctttccaccagaaactatggtattcgctactctaagcatgtgattcctttccgttttcaggtaataagggtaaatgttagactaagcttgtctatcttattgacatcataactgcgcagcatcagttatgctgtaggcaggagtttctcccagtaaaactactgcacacacaatgtaacaaaggcaagctgggagtgtaagataggccacacagagactggagattgcctttcacagagcaatagtcactcacggctcagaattcagtttctcagaagtttacttaacaagaacaatgcacaacaagctaagaaatctctgtcttcaacacagtctatacagagggctccacagtgatgcatccattactcaccagatctggacttaatgatgtcactgaattcgttctgcccatcatcaggcctggcttcaaggtccccatacttggccatcttgaatgagtttcagtataatccaaaggctttcccagatcctcttctgaaggctaaatctgaaaaatggtccaggctagcatgaatacctaacaggaaaagagaaagtattgagtagaaatacagaaacatattccttatttgttttttcctttgcttctggcacaggtctgtgtgtgcacatgtgaaaggggtgggtgtgcatgtacatgtgtgcatgtgcacgtggaggtcagaggctgacacttgggtgtctgcctcaactgctgctctctaccttttatgttaaagcagggtctctgtttgaaccccagggttcccctgaactcacatcccacgtgctgggattacaaacaggctgccaaatgtgccgggcatctgcacggatactgaggtggggtgtcaagtacttaactgctaagccatctccagccacatatagtctaagacacagttacggagtggcttcctgagcacatccacatgaggctttatttagcacagcctcttccacgtgagtgaggcttatggacaccgagcttcacggataaaatgaaattcactctataatcaatgacctcattacaaccctgatgactgacagcagtccggaagagaaagataaagtcataaagtcataaagtggacgagtcacacctgcccagggccactgagaaggccttcctaagcaatgacatttgggtctatccttcaaggagaggaagaagttcactagctacagggcaagtagaaaagagaagagcttggtatgtgaaatattagcgccgctgagaactgggaggcagggggctaagtcctgcttttgggaagcacgtcacacagccgaggaagaaagctggggccagagattcctagagaggcttggatacctgtctgaggagaaggacaatcagagaggtgacataagcccgttcacaccatggcttgtcagtagaccagagtaactcaggaagcaccaaggactacagtacattagagcagtgctctcattaaagaacttaggccgtgagaaaggagatgtcgaatggaaacatttcagctcttctctgcatctgaaattgtttcatgctactgcgttagagaaaaataatcccacgcttgaccagactttacaaaagcatcaatggggcctcaggtgataaatggaatcacagcgcaccctctgttgagtatctctgtctgtcggagaatcaatcatgaggcttatcatgggcacacaaattggaagaggctatcaaaacaaaaggcctagggaattaggagatgggtctgtgggtaaagagcctactgcacaatcatgggaacctgacttcaatccctcgaattttataaaaataaaagagggaagcaagcatgggcatgtgccagcaatgcctgtttccaactacttcctctggaaacaaaggatcatagccaaccagcgagccccaggttcaatgagagatcctgtctcaaaaataaggcactatgccaatctctggcctccaaactataatacacacaaacaacacacacatcccacaggcccagtgtcactcaaacaaaaaccacccaaagaaaggtagtttcttcatggattaaacaaaacaaaagagacctgaccaccaaatactatcctgggttgaattttcaaagaaaacattttagggtttactttaggcaatattattataccaatgttacactgcaggattagttagcagcgatgttagggaggaggatatcttccattgtaggagacactatgaagtcattagtgagaagtatgacaggatcttcgacgtctatgcatttatatatatacaaatcgatacgcacaagcatacatgcaaagatacacacaggcagaggaagtaaatgttataaagaaaatacgagcagctctgtatctgttgtgctaatctctctgttataacgctgttaatataagcaatatgtgattgtggcctcaatggattagatggaaaaaaaataaatagatacacaggatattaaataaaaggtcaataagactcagggacagccctggcattagagacgcaggatactagcatgctgagtgactcagctggcacagggcagctcagaagtagacgaactactactcggttgggaaccgctgaggacattacagagaagaatggatgcggtttggattttctcagtgtaaggtgcttctgagacacagaaagagaaagggagcattcgggaaatacggatctggacctcaggggtggtacggcttgtagatgtatgtagaaatgtagatagccatgttgcccactgataaaaacttcattctggaagggtcatgacaccaattctgctgtacatgggtaggtaccactcagataaaacaatccaatcttcagtaactgtgagaaatatctccagggcctaaagatctgaagatctgccctgcaggagcacccgttcattaagaacgccagcaaacactgctcctctctgctcccgagcttcctggattacactgcccagagaggagccaagctcagtctctcagctcagtctctctgtctcttccagaccacggccccctttaagagcgccccaatgtcaatgaacttaatcactacttaggaatatcagagtcaagacatcccaacagtaatctgcagagaaagtacactaattcacacattaaaacacgcgtcagagccaggcaaggtggtttgtgtctgtcatccctgagatgacagatcactgagttctaggtcggcttgagctgccaagtcagacccccaccacctcaaaaaaaaaagagagagagagagaagcaaatgtcagaactagggtttctttctaggtagtaatggaccaccaattctttagtggttcttctttacgattttaaaatatttttatgtgtacatgtgagtgcctgcatttttgtctctgttaattcctgataccttcgaaagccagaaaagagtgttccattccctaaaagtggagttaccagtagtcttgagtcgcccacagtgggtgctaggaactgaacctggagcctctgggaaagtaagaagtgctctgagccaaggagccatctctccagcatgaatccttacttcgaagaatgaattgtactatattgttattttaaatttcttatttgtgtaatagttgtgtgttccattattcaatagtcattcaccgtagcaaacagtactttattatataaatattaacattatgcaacataataacttttctttctgcaagtcaggaaatgagtagagtccattaataagagcaaaatgagagtgaatgcagtagaagcgaaggaacactgggaaactgttaaagctttaagaaccatttcctctccatatatggattgcttcatcagtctcccagactttaaaggacattaaaaaaattcttaaatgtttattctgactttatggttattaaggatttacagacctgggtatagtgactcacagctgtaaccccagcatttaagagacagaggaaaaagggtcctcaatatcctaggctagcctgagctacagagtaaatcccaaactagtctaggctacctgtctaaaaattaaaaataaactaaaagggctgaggatgagccttaatggtagcctgcagggtgtgcatgcatggtcctgagttcgatccccagaactacaaaaacaaaatgaaagtcaaaagtaaccagcgaagaggactggcagcctggccatttgccaagcagctttcgccaggagtgaacaagtaaccccagttggagaagacagagtttaacgccaccttctgctacacagagagtttgagggcggcctgagctacatgagactagggggtcacggaacagctccctacaaagaatataatcaaaagcaaatatattcctatcttgaggtacagagtgtgaaagattttctaaacttttatgtgtatccttaatatattagagaaccaaaatcttgtccacagaatatgtaaacatttaattacaggaaatcccggctgtctaagaaaaagtctctttcctggaatgaagttcctttgaaagacaagtccagtgccacttcccaaggggctttatgcagggacctccagttaggcttccaaaaatgtttccactctgttagaaagagacctgcccctaaacctgatcaccacacattcgataaataaatgtcgaaaaatgaattttttaaatttttgtgtgaatgtctgccttgactgtctagtgcccaaggaggccaaaaatggacataagatagtgaacgtggactctctcttaaccactgagccatcttttaaaaatgcacacatgctctctctctctctctctctctctctctctctcacacacacacacacacacacacacacacgcactcacacacaaacactgtcaccgatttgattttgaggtaaagttaacttgtgcacagggttgcgtttcatttgcatagatccaataatgccatttcatcgtgatgtttgattctgcctttcacattgggataatttttccagtcgtgtcttcttcctaatacaaatccctactacactgcaaaaacatcagaaaaaaaaaatcaatgagctagaaaagaatgaagagggacacactaaaacattgaacagcgtgaaaggggaaatcatttgaaatgtaaataaagaaaatatccgagtgagttcaggacagccagggccacacagagaaaccctgtctaagaaaagaaaggaaaggaaaggaaaggaaaggaaaggaaaggaaaggaaaggaaaagaaaagaaaagaaaagaaaagaaaagaaaagaaaagaaaagaaaagaaaagaaaagggagaaagaaagaaagagaaaatatccaataaaaagaaaaaagaaaaacaacaacatttaagagccaccaactcttgttgccacgaatgtcccaggagctccatgtgagttggagagtttaaggatacctccttccaaactcccagatgccaaccaggtgtagtggtgcacacctataaccccagctacttcagaggctgaagcaagaggagtgccagttcaaggccagcctaggccacacagtgagaccctttctcaaaataacataaataaaatgctactgcaactctatcaggctgttcaagttacattgggctagaaccaaggctttcttagtaacaatgtgtcccaaagacattctgccgccatccacactggtggaatggaagtagccacactctacacccggataagggagaaactagaggtgaatgacccggaggttgtatagggctcctatgcaattgctgtcctccgttctcttccctcaaaatgacagctggtgacgttgaccgagtgtttcccctactgaaacctacacgcaccacagcacaggcgccagttcccccttcagggtggacgcttcttagttataccagaacagaacgccaggggtgatggctttataggcaaaagttcaagaatacacaacattcaaacggtgtcatcctaagggaatattcatccagacggctgtggaggaaacctagtcactcacaagtaaccaaaagctaggaatgctggcgatagtgaagagggatgccgaagaacaagtttgcccttctgcttgtaaaggaaaccgctgagtgccaagaactgccattcacactaagaagcgctccagggaaggttaatgccactgtgattaatgctgtttacaggcgcaataaattttgagtaaacacccaaaggagagttaaagctatctcgaaagcctcataaacgctggtgagggggtggggggacttcagcaggaatggcccatgcccctcactgccttgtcctcgggactgaacgacccacaagagcttcgaattcctccagctctggcaggcactagcgttatcagcaggctgcttctccagcgccaccagcagccagcccccgagggtccagcctgacttcacaggcccagggcaagttccaacgggacgatgagactgctgccatgccaccctggagatcccatctctcttggaattcgtgcgctctggccgcggcagaccctcccacttaaacgcatggagaggccacctctccagatcctggtgacccaggtgatctgaaggctagaagaataaaggatgatacctcagtgactccagagagtggggcccggaattacacccaggatctccaatttgggggtttaaaaaaggcgggtccctgactctgaagagtcacacacgttttctcctccccttgaaataaccctggaacgccacacggtcggaatccagggacttgaaaagtctctttgaacaatgtgccttctaaaagttgcacagcctacaattagccctttgttggttttgtaagtggccttgggcaagcagagcctcagacccaggccaaagaggggcatgaattaccttgtcagttgcagtgagggatgccaagagtccggaaaagcaggcggccgggcgggactgcgcaccaatgaggtacccctatcccctctgtctctccacagctgcaggcttgccacctcgccacactggggccccaccctcaggaacggcaaccacagagaggtcgagcacgcccccagcctggaggccggctaggaagctctccccaaccctcccaccgcacaaccgccctccccaccctctcctcccggacaccgcccgggccccgccttcccgggaccggaggtgtgtgacaagctctcagaagaggccacgtcccctcttggagatcgctagtcctgctgcccggctcggggcggtaaacggacaggcgacagacagcctctcctctcagggagagacaaaacaacagtactaaactagacctaggaatctgagaccttggcgaccagtacagattcccaccttctcaacccagctctctcccgcccaggcaggggacgctgagcttccagggaaagtgcagaagttggctacagctacttcgggacccgggcggtggaactgcagaaaggtcccacctcctttcaacccccgccccattccctaggggactgcggtcacattacccagaccgaagcttcaataatgcatgggcttacctgctagccaagtcccagaggccccaaggttcctctgggcgtgttcgggtggtggggagcttgccttggacgttacaagaattttttttaagtgaaacgtggaaagcccgacaagatccaaaggggggtgggggggggggagatccaaaattgacacccgattggaaacgccccctgacttgtgcaatcttcctgcccggtagttccgccaaaaacaaaacagtccaaacgctagcctgggggcaggcgcacgcaggagttttccctctgcaggaatgacccgaaagaaaaggggcgccgctccccgaggtggcccgatcggctgaggagcccagggctcctcctcggccctgggcgggagaaatcccgcgcccggcgctgcccgctcccctcctcgggggaagggcgactccacaactttgtgcgcgagagctgctcgccgctccggctcctcctccaggtcctcctccggctgccgccggcccctttgttggagagcgagggtggggcgctgctgggtccgcccgccaccccgggtaggggctcgcgtctcccagcacgaatcgcccagcctcggagccgtggatcccgcaggtcggacccgccgtctcgccgctcgcgcgccccggggccccaggccgggcaactttgttctcccggggagaccagtccccctcggctccgggttcggtcctgccccggcctgggaagccaccgcgggccgggctcccagaacgtggcgcttcgggtcacctgaccgcgcgcccggtcaatcagcgctagccctaggcgccctcccagcccgcagcagccggctccgtgcggtgcgcggtgcgagaatcccggaaccagtcgtgcgtgctggaagccagaagctggaatagtcaccgcgcgcacgcaccgtgccctttattcaaattgtccgaaaatgtgtgtcacacccctctaggcacactaggtctcttatcaacagtacttttaattttttttattattatcttacataaatctcaaccttctggccaattcgccccatttcagtttactgaggttgttgagtttggggttctaaatccaggggtatatttattttatggaaatttcttttgcatcattttaaatgctgtctaaacaatcccaagtgtccttatatgttcatatacacaaatagtgttggtgctgacctttaaaatttttaccgtgtgtgtgtgtgtgtgtgtgtgtgtgtgtgtgtgtgtgtgtgtgtgttgtgtgtatttggggtgctggtgacagtagacacaaatatcatacctatctaaattctctctgtctcaactttgtagagccagctttcaccttacacctttctgtgggacccaggaatcagactcaggtcttcagactttagtattcagtaggggtcttaccagtggcaccatctgccaaacctttatttatctagttatttatttatttattttctatttttccaagcaaacttacatctgtttgcagaacttgttgggagtttacgggcttagccgagacctatcacggacgtaatgaagtttgtgttatgtatgcatttttattatacatttcattctaacgtgttcccattactgttttcctgataaaacttggagaaggaaataaaaatagcaaccaaagtcgaagcagattgattacggcttattgcttccttagtactcaagggttaatttatgagccagtaaaaataattcactagccttgtgttaattaccagttgaaaacctctggagtctctaagtactgtgggctgggactgaaggaagtcttggaaaagacttttttataaagtctctgacttaacaacttcaccttggagggcattcttcatacaagccaaatagaacctaaacaccaactgggaactgatatgacttgatctcattcactttcattccttccattaacaagcatctatataaggcctactgaggcagatgatacatagaaatccaacatagatcttgcccttgaagaacgtagaattcattcaggtgagataagacatgtaagcaaaaacattggagattcctgctatcagatcaaacatgttgtatagattaccatctctgtgactgacaggtaagacttctgttagctctcggtttcatccgattcaggctgaggctggcctttgcttttgggcctgaggagtagcagaagctgtggtggagtgtgcacacctcatggctgtcaggaagcagaaagccatccagaaggaggtccagaaaaagacctgccctccaaagagatgagtccactaacttactgtctccaagtaggtccgcctccattgaattatgcattcaccaagtgacttaacccatttattaagtcaaaaacttcataaaacaattacctttcagcaactgactgagtctccaacataagaagtcttcatggatagtccatgatagtcttagttccaaacttggtctctgtaactccttttatgggtattttgttccctattctaaggaggaacaaagtatccacccattggtcttacttcttgattttcttgtgttttgcaaattgtatcttgggtgttctatgtttctgggctaatatccacttttcagatactaccccacccggggatccatcccataatcagccaccaaacccagacactattgcatatgccagcaaaattttgatgaagggaccctggtatatctgtctcatatgaggctatgccagtgcctggcaaatacagaagtggatgttcacagtcatctataagatggaacacagggcccccaatggagaagctagagaaagcacccaaggagctgaaggggtctgcaaccctatagttggaacaacaatatgaactaaccagtacccccagagctcgtgtctctagctgcatatgtatcagaagatggactagtcggccatcactgggaagagaggccctttggtacctggcaacctgagcaagcatatgtgtgggtgagtcacagaggaggaaaaaaagatcaaagtttggctgtgatcaagaattcccaccctgaccctgagttaggagaagaaaccacatctggcaggagactaagactacaaagggctctatttccataagagcagtcactatgagaccttttcagcccagcttcattttgaaggactgtgaacacgtctccaggaggcatgggtgactattgatgcactgcaaccagccgtccaccttttaatgcaccctgggtagtcagtggcctgtgacaacagaaccttctgcccactgaggctgctggaatgatcactatgaagcatgtggagggagtgataggaacatgaccctgggcccatgattaacctgaagtagtaattacactaagtggccactgaataatgaagactgaagatgtttatactgatgttactattgtaagggaagtcttttatagaagggaaaattattatatgagtaatatatagagagagtaatacataaaatatatgtacatgtatatatcatatgtttactctatgggcatgatccacataaatacaggggactgtatataatatagcagtccagaagaaaacattatctactgaacctgtgcaataacatgtaaatacaaccggacatgacatgtaaatacaaccggacatggtgggctacgcctgtaatcccaactacctgggaaactgagacatgaggactgcatgtttgaggacagcttgagcaccttagtaagaggatcagggacgttgttcagtggcgaaatgtttgcctagcatgtgcaaggctctaggttgaatcatcagtatcacagtatcaacaagagagagagacagacagagagacagagagacagagagacagagatgaagtatagatgcagtttcttttagaatagaaacatgagaaaacatgtgctatctttctgtgtgtgtctatgtgtatgtccctatgtgagggcatggaggccagaggacccttacggccttaaggattattctccaggcacttttttttaagggtccctcactagcctagaactcactgagtagactaggtagctgaccagtaaacccgagagatctatctaatactctccctcccagcactgggtttcaagtgctagctatctcccccagctttaaaaagaaagaaaacaaacaaacaagcaatcttgggtctagggatcaagcttaagttgtaaggcaaattgctttatcaagtgaggtatgtcaccagccccctatacaatgtgtgtttttgtgtttctgtttggttgggatgtgtgtatgtgtgtgtgtgtgtgtgtgtgtgtgtgtgtgtgtgtgtgtgtgtgtgatgatttgacagagtttttgtttggtagttgttgttattgtttaacagtgtctcactatgaagaccaagctggccttgaactcacagagatccacttgcttctgccctccaagttctgggattaaagcttgcaccaccatgcctggatatatatatatatatatatatatatatatatatatatatatatatatatatatatatatatatattaaaatcaagatatcacttcgtgttttccattagtgttgaatatgaataaacccacacggaagagaggggaaaggctttccttctctttttccgattaaaatatctaataaaactgcatatgtaagaggtgttagaatattcactcgtttaagaattcctcaggcgagcacataatactggtgagttgaaatttgaggttgaggatagctacaaataaaattctttgtaatcaagttaaggaaacaagataacacatgaaatgttttgacaataaataacacaaacacaatccaaggagctaaccatcatcccccagggagactattctaaattcagaatagtcctccctttgtcccccagaaattcagagtagggtctgctaggccacagacaccttcaacttcaaacagctacccccaaacc

SEQ ID NO: 5 - DNA, 46 bp, Homo sapiens
atattcacccatttctttctatctactcttgtttagaccacacttg

SEQ ID NO: 6 - DNA, 46 bp, Homo sapiens
cctgacaatgggcagaacgaattcagtgatatcattaagtccagat

SEQ ID NO: 7 - DNA, 42 bp, Homo sapiens
ctgtaaatatgtagcaactattgtgtagcttgacgggtcttt

SEQ ID NO: 8 - DNA, 53 bp, Homo sapiens
ttagggtatatccataaagtagaagattaagcattcataaaaagtgatacaga

SEQ ID NO: 9 - DNA, 39 bp, Homo sapiens
tgtaaagatattctccatgttgttacctcattatgctga

SEQ ID NO: 10 - DNA, 24 bp, Homo sapiens
cttctttgataaaataaccttcag

SEQ ID NO: 11 - DNA, 68 bp, Homo sapiens
ctctattagtaatttcagcttcaacaaataggatagaataaatgcaaattaaaaataaattaggagca

SEQ ID NO: 12 - DNA, 45 bp, Homo sapiens
ttaagtggtagaagggccctggagttcagttaataaagctgggat

SEQ ID NO: 13 - DNA, 60 bp, Homo sapiens
aaatctactatatatgctgatatttcagaaatggtggttcccttaaccttcaagaaaaaa

SEQ ID NO: 14 - DNA, 46 bp, Homo sapiens
ttaattaatgaaacttgggcttcatcaagctcaggtggaatggata

SEQ ID NO: 15 - DNA, 51 bp, Homo sapiens
cctgtggaattcttttagtttttctcttccatgtttatatatttgatatga

SEQ ID NO: 16 - DNA, 35 bp, Homo sapiens
ttattttacttgctgaggctggatattatattctt

SEQ ID NO: 17 - DNA, 35 bp, Homo sapiens
cacagactcacacacagagacacacacacacagac

SEQ ID NO: 18 - DNA, 53 bp, Homo sapiens
tttggagcataagatattttgtgatcagaagaaggtgaatctgtcagaggtgt

SEQ ID NO: 19 - DNA, 24 bp, Homo sapiens
gaatattttcaaaggtctgcattt

SEQ ID NO: 20 - DNA, 29 bp, Homo sapiens
gaattaagcaggttgagaacagggtgaag

SEQ ID NO: 21 - DNA, 355 bp, Homo sapiens
ttataggacatgtcaggcttattttatcttattttcttttatgagacaggttctcactctgtctcccaggctaaagtgcagtggtgtgatcatggctcactgcagcctcgaactcttgggttcaagtgatcctcccaccccaccctcccaagtagctgggaccacaggcatatgccaccacacccagctaatttttgtactttttgtagagacagggttttaccattttgcccaggctggtctcgaactcctgggctcaagtgatccactcgccttagcctcccaaagtgttgggattacagacatgagtcattgcgcccaggccatttcagcctgtttaacattccttttgcag

SEQ ID NO: 22 - DNA, 33 bp, Homo sapiens
aaaacgctaggttttggggtgtccttaggaagg

SEQ ID NO: 23 - DNA, 50 bp, Homo sapiens
atgcttaaaagaccagcaaatgttcaagacaaatgagaggaagagctatt

SEQ ID NO: 24 - DNA, 55 bp, Homo sapiens
agccacaggcaaattcttgttcttttactgaattcctgtctagtagaaaataaga

SEQ ID NO: 25 - DNA, 47 bp, Homo sapiens
agcaagttctcttggttaataaatggcttatgtggccttgatcagat

SEQ ID NO: 26 - DNA, 41 bp, Homo sapiens
ttagaacataatcaatgctttgagcaatattttttcatagg

SEQ ID NO: 27 - DNA, 50 bp, Homo sapiens
tttcctttttttaaaaaacacaattaaaaattgaaattgtataatttttg

SEQ ID NO: 28 - DNA, 40 bp, Homo sapiens
cgtgagttcttcttagtgcatcatatcggggataggtgat

SEQ ID NO: 29 - DNA, 50 bp, Homo sapiens
cacttggcatcggagagggcagtggctgcagtgacctgagtggggggagt

SEQ ID NO: 30 - DNA, 78 bp, Homo sapiens
tgtcaccaattgagagacttgaacatgccttcagcaaggctcaaacttatttgggaattgaaaagctgttagatcctg

SEQ ID NO: 31 - DNA, 61 bp, Homo sapiens
agcttcctgacaagaaatccataattatgtatttaacatctttgtttgaggtgctacctca

SEQ ID NO: 32 - DNA, 64 bp, Homo sapiens
gcaagtcaccatagacgccatccgtgaggtagagacactcccaaggaaatataaaaaagaatgt

SEQ ID NO: 33 - DNA, 52 bp, Homo sapiens
tgcgttggaggaagtgctgacctggttgctttctgctgaggacactttccag

SEQ ID NO: 34 - DNA, 60 bp, Homo sapiens
gagcaggatgatatttctgatgatgttgaagaagtcaaagaccagtttgcaacccatgaa

SEQ ID NO: 35 - DNA, 55 bp, Homo sapiens
aggcaggcaaccaactgataacacaaggaactctgtcagacgaagaagaatttga

SEQ ID NO: 36 - DNA, 57 bp, Homo sapiens
gattcaggaacagatgaccctgctgaatgctagatgggaggctcttagggtggagag

SEQ ID NO: 37 - DNA, 66 bp, Homo sapiens
acaggtgaaagtaaattcactaactcacatggtggtcattgttgatgaaaacagtggtgagagtgc

SEQ ID NO: 38 - DNA, 50 bp, Homo sapiens
aagaacgctggaataggttacaagaaatcaatatattgtggcaggaatta

SEQ ID NO: 39 - DNA, 41 bp, Homo sapiens
aaaggaactaagtgtcagtgttcgacgtctggctgtaagtg

SEQ ID NO: 40 - DNA, 27 bp, Homo sapiens
attttgaaggaagacatggaaatgaag

SEQ ID NO: 41 - DNA, 78 bp, Homo sapiens
ggaaaactgccattcagaccacagagataaaagagtatatgaagatgcaagacacttccgaaatgaaaaagaagttga

SEQ ID NO: 42 - DNA, 41 bp, Homo sapiens
aattaaaccaaactggacaaatccttgtggagcaaatggga

SEQ ID NO: 43 - DNA, 46 bp, Homo sapiens
ctactgaagaaataaaaaatgttctggagaaggtttcatcagaatg

SEQ ID NO: 44 - DNA, 44 bp, Homo sapiens
ttatttcaagcagcttgatgagcttgaaaaggtcatcaagacaa

SEQ ID NO: 45 - DNA, 46 bp, Homo sapiens
gagttgtgtgaccgtattttctcttccttagcgggaattgacaaat

SEQ ID NO: 46 - DNA, 54 bp, Homo sapiens
gtagaaaaattatataagcaagaatttgatgatgtgcaaggaaagtggaacaag

SEQ ID NO: 47 - DNA, 62 bp, Homo sapiens
ctaaaggtcttggtttccaaagatctacatttgcttgaggaaattgctctcacactcagagc

SEQ ID NO: 48 - DNA, 46 bp, Homo sapiens
actcaaaaaagtaggttgtctgaaagtcaagaaaaagctgcgaacc

SEQ ID NO: 49 - DNA, 42 bp, Homo sapiens
cagtaaacatactttggataacttacgttaacactgctgtta

SEQ ID NO: 50 - DNA, 46 bp, Homo sapiens
ctctggtggccaggagttgacgtctgagctgaatgttgtgctggag

SEQ ID NO: 51 - DNA, 28 bp, Homo sapiens
aaagaggggttaaaaacaggagaccaaa

SEQ ID NO: 52 - DNA, 75 bp, Homo sapiens
aagtcattttgtatattcaaactttactttttttataggtgcaatccaggttttcatgtaacagatgatctgtag

SEQ ID NO: 53 - DNA, 41 bp, Homo sapiens
cacggcatttctctttgctgtgatgaggccacacgtgtatt

SEQ ID NO: 54 - DNA, 55 bp, Homo sapiens
ctctggaatctgttctgcgccacccggcagataatcgcacccagattcgagagct

SEQ ID NO: 55 - DNA, 64 bp, Homo sapiens
tggccagactctgattgatggggggatcctggatgatataatcagtgagaaactggaggctttc

SEQ ID NO: 56 - DNA, 47 bp, Homo sapiens
aaagcaactccaggtgctgcgggaaactgaccagatgcttcaagtct

SEQ ID NO: 57 - DNA, 44 bp, Homo sapiens
cgttctcagcccctgacctccccagagagtaggactgccagagg

SEQ ID NO: 58 - DNA, 46 bp, Homo sapiens
aaactgtgattaaaacaggaagacatattgtccagaaacagcaaac

SEQ ID NO: 59 - DNA, 43 bp, Homo sapiens
atatttaattcaggctaatatttatactttcaatggctactga

SEQ ID NO: 60 - DNA, 60 bp, Homo sapiens
tgaatggctttctgctactgaaactgaattggtacagaagtccacttcagaaggtctgct

SEQ ID NO: 61 - DNA, 50 bp, Homo sapiens
tgcgtccttaacgctgggtggagccgagttcgtacctggactgaagattg

SEQ ID NO: 62 - DNA, 46 bp, Homo sapiens
tattggatgaaattgaaaagaaaccaacaagtaaacaggaagaaat

SEQ ID NO: 63 - DNA, 45 bp, Homo sapiens
ccgtggaagctcaagcagggagcttgtagaaccaaagttagctga

SEQ ID NO: 64 - DNA, 42 bp, Homo sapiens
tggtgtgcctttctctgacttggaaaaattagaaaatgacat

SEQ ID NO: 65 - DNA, 46 bp, Homo sapiens
tagatggatgaggagagtgcccagattgaggaagttctacaaagag

SEQ ID NO: 66 - DNA, 41 bp, Homo sapiens
cacttactcagctgaatgcaaaatgggacagaattaataga

SEQ ID NO: 67 - DNA, 76 bp, Homo sapiens
aaggagaaagtaagcaggtgatgaagtacaggcatcagctagatgagattatctgttggttaacaaaggctgagca

SEQ ID NO: 68 - DNA, 39 bp, Homo sapiens
ggagccaggatgaggaaggggatcacttctccagtgatg

SEQ ID NO: 69 - DNA, 41 bp, Homo sapiens
cgtgctctgctttagtagaagactaggatggattggaggca

SEQ ID NO: 70 - DNA, 42 bp, Homo sapiens
gcgccatcctcagctggattatgtttttacattggcacagaa

SEQ ID NO: 71 - DNA, 70 bp, Homo sapiens
tgtcttttaactcaacccaaaattcagtccacaaatatttattgagcaactactatgtgcttatgtgact

SEQ ID NO: 72 - DNA, 37 bp, Homo sapiens
tttttccatcacctctctttttgtccaaaacttcttt

SEQ ID NO: 73 - DNA, 46 bp, Homo sapiens
gaggagaaatagaaagagagagaaggtgataatgagtgaaaggaat

SEQ ID NO: 74 - DNA, 43 bp, Homo sapiens
tgattattgacagtcttcagtgggatgaccatagggaggagac

SEQ ID NO: 75 - DNA, 63 bp, Homo sapiens
aacaatccaagatggtattttgtaaaaggatgagtggtggtaccattcaccgaattgggaaag

SEQ ID NO: 76 - DNA, 41 bp, Homo sapiens
aggtgtctccagaagtgtggtaaacttaaaatgatggctgt

SEQ ID NO: 77 - DNA, 24 bp, Homo sapiens
gaagaatttaatttcacttggatg

SEQ ID NO: 78 - DNA, 24 bp, Homo sapiens
agaagtgctttttgggaagacttc

SEQ ID NO: 79 - DNA, 30 bp, Homo sapiens
aaatacatgtagagaccaaaatgaatgaga

SEQ ID NO: 80 - DNA, 44 bp, Homo sapiens
aatggagatttactttaacatgatctgattgttgagatgtgtgt

SEQ ID NO: 81 - DNA, 23 bp, Homo sapiens
tcatgagaaagtcttggttagat

SEQ ID NO: 82 - DNA, 45 bp, Homo sapiens
catttctgggcgaggtaaatgagtccaaataattgaaattggaaa

SEQ ID NO: 83 - DNA, 23 bp, Homo sapiens
tgtgattcttttagcacacatac

SEQ ID NO: 84 - DNA, 37 bp, Homo sapiens
atattatcttaaaacagaaacagtaaagcatggagaa

SEQ ID NO: 85 - DNA, 49 bp, Homo sapiens
actgtagttggttacattcagggtcaatagaaatgatttcttgagatat

SEQ ID NO: 86 - DNA, 43 bp, Homo sapiens
ctctgatgcctgggtaaattaatcggggtgtgcatgccattgc

SEQ ID NO: 87 - DNA, 45 bp, Homo sapiens
cctttcttatttcaaaaaatcactttgaaaaaaagcatagcttct

SEQ ID NO: 88 - DNA, 48 bp, Homo sapiens
ccaagataatactggttttcttactactttttttccatctcttgtaca

SEQ ID NO: 89 - DNA, 56 bp, Homo sapiens
ttttctttttgatctggctgccttcttggtgatattactatgagaatgaggaggga

SEQ ID NO: 90 - DNA, 76 bp, Homo sapiens
attaaggattattgtaaagtgaaatagcagctttgaggtctgaaacactgagggagaagaaggaaaagaagagaca

SEQ ID NO: 91 - DNA, 56 bp, Homo sapiens
gcttgcatagtaagagcagctccagtgtggtattagtagggttaatgattgagtgt

SEQ ID NO: 92 - DNA, 45 bp, Homo sapiens
gattgcttttaatttcattatggcacacagaatttagtgaagaaa

SEQ ID NO: 93 - DNA, 47 bp, Homo sapiens
ccaggtagatgttttatgctgggttcctaaaggtagaaatggtggga

SEQ ID NO: 94 - DNA, 69 bp, Homo sapiens
cctttgtaatttaatttatttgtgtcattttaggcatattgcatacctgctaatgtagaatggagatct

SEQ ID NO: 95 - DNA, 55 bp, Homo sapiens
tcttggctcatcattctttaaattccaaaaatgactaatttgtggggatacataa

SEQ ID NO: 96 - DNA, 46 bp, Homo sapiens
acacacaatttctttcagatagtcaccagagtagtcatcaaaagga

SEQ ID NO: 97 - DNA, 44 bp, Homo sapiens
aggggcattaacaaagctttgaaatgccaaagcagactttccag

SEQ ID NO: 98 - DNA, 52 bp, Homo sapiens
actggtcatttctgtcaattgtgaatctgctcatacttgttcttcatgaaac

SEQ ID NO: 99 - DNA, 41 bp, Homo sapiens
aagtcagctggtaatttaactgaaacttctttggagaaaaa

SEQ ID NO: 100 - DNA, 46 bp, Homo sapiens
tatagtaaacacatttcaaagtctcctcatttattccctacttagc

SEQ ID NO: 101 - DNA, 49 bp, Homo sapiens
gctactatgcttcaacatcgactggatgatatgaaccaaagatggaatg

SEQ ID NO: 102 - DNA, 35 bp, Homo sapiens
tggaaggggtagatacttgtgatttttgtatatca

SEQ ID NO: 103 - DNA, 52 bp, Homo sapiens
tgccacctgttctagactattcataaatgttcatatattttaaatctaacaa

SEQ ID NO: 104 - DNA, 337 bp, Homo sapiens
atatgctagatctacaatatttcaacttgattatttatttatttatggaacagagtcttgctctgctgcccaggctggagtgcgatggtgcaatcttggctcactacaacctccatctcccaggttcaagtgatgctcatgcctcagcctcccatgtagctggaaatacaggcacgtgccaccatgcccagctaatttttgtatttttagtagagacaaggtttcgccatattggctgggctgctctcgaactcctggcctcaagtgatccaccctcctcggccttccaaagtgctagggttacaggcgtgagccactgcacctggccccaacttga

SEQ ID NO: 105 - DNA, 72 bp, Homo sapiens
gtgctccgtaaatgtttacttgtgctgagtaaatgaaaaactgtattttattttaaccaatgctccttctca

SEQ ID NO: 106 - DNA, 43 bp, Homo sapiens
acactatttccttttatatctgtacactgggagaaggaataat

SEQ ID NO: 107 - DNA, 32 bp, Homo sapiens
gtcaaatttatttgctgcaaaatggcttagaa

SEQ ID NO: 108 - DNA, 46 bp, Homo sapiens
gaggccagcgctgagaagtggaacaggttgctgatgtccttagaag

SEQ ID NO: 109 - DNA, 46 bp, Homo sapiens
aggagatgttccagccttacagctccagtatgaccattgtaaggta

SEQ ID NO: 110 - DNA, 46 bp, Homo sapiens
ggctctgagatttcgccttagaatagggatataaagcaatgcttta

SEQ ID NO: 111 - DNA, 43 bp, Homo sapiens
agaggagaactggtttgatgtttgggttagtcatgcctagaag

SEQ ID NO: 112 - DNA, 45 bp, Homo sapiens
tgcttggaggccaaaacttcactttatacaatttgtctgggaggg

SEQ ID NO: 113 - DNA, 45 bp, Homo sapiens
agatagttaagcagaataatgagaatgggaaatgtaggggatgag

SEQ ID NO: 114 - DNA, 43 bp, Homo sapiens
gcccgagttttcttggctgatcagccaattgaggcccctgaag

SEQ ID NO: 115 - DNA, 42 bp, Homo sapiens
actcctactgtagtaataaaatctcatttaaataaacaatag

SEQ ID NO: 116 - DNA, 46 bp, Homo sapiens
atttcccaatattttaatcagaaacatcttttggtcatgaggaaag

SEQ ID NO: 117 - DNA, 52 bp, Homo sapiens
caaagaaaaatgggaaagtctaaatgctgtaactagcaattggcaaaagcaa

SEQ ID NO: 118 - DNA, 46 bp, Homo sapiens
gcaccaatcaactttaaagttaaaacggtgaatgatttatccagtc

SEQ ID NO: 119 - DNA, 47 bp, Homo sapiens
attacatcaagtaagttgattttaattctcctttatgataccaagaa

SEQ ID NO: 120 - DNA, 67 bp, Homo sapiens
acttttaaaaatagaattcagtcctattatctgaaagaaactgtgatatagttaatattaaaaagaa

SEQ ID NO: 121 - DNA, 36 bp, Homo sapiens
aatcccaggggcctttaaaagtggcaggggaggcag

SEQ ID NO: 122 - DNA, 42 bp, Homo sapiens
ggaaggtaaaggaagcagacatgatccttaaatgcaggcagc

SEQ ID NO: 123 - DNA, 46 bp, Homo sapiens
aattttgcatgattgccatgcaatgagaatttcctggagcaaatta

SEQ ID NO: 124 - DNA, 93 bp, Homo sapiens
tggagttcattgctaataattataggaccagtttgagtgcaggagaaaagttggaagccaaacagaagtggctggagtggtgaatgggacacg

SEQ ID NO: 125 - DNA, 84 bp, Homo sapiens
aggaagtagatatggtacagtactcattggtgaattttgcctgtgaaggagagaaaaaaggtgataactagcagaaaatgtaga

SEQ ID NO: 126 - DNA, 78 bp, Homo sapiens
aattggcctttaataagaagggggacaatttctcagttaaaggggagataggataacagactggcagttggagggaag

SEQ ID NO: 127 - DNA, 35 bp, Homo sapiens
tattaaggcagagaaataaaccagtttggggagag

SEQ ID NO: 128 - DNA, 45 bp, Homo sapiens
ctctctgccctagttttttccatctgtaagatggagacaatattg

SEQ ID NO: 129 - DNA, 46 bp, Homo sapiens
tacttttattctgttttggttgcctactctgggagaacttcaggca

SEQ ID NO: 130 - DNA, 50 bp, Homo sapiens
acagtactgttgtcgtggggattgaaattccctgaaagagaagacaagag

SEQ ID NO: 131 - DNA, 49 bp, Homo sapiens
catttaaaagtagttaaatttctaagggcaatgcagtaaacaggtattg

SEQ ID NO: 132 - DNA, 44 bp, Homo sapiens
caaacaaaagacatagaactggtttgcttagtttgtaaaatgag

SEQ ID NO: 133 - DNA, 42 bp, Homo sapiens
acacacaaaagggatgtttggtctgcgcaggagtccatggtg

SEQ ID NO: 134 - DNA, 47 bp, Homo sapiens
taaaaattcaaaattattagttattcagtggttacaaatggataaat

SEQ ID NO: 135 - DNA, 44 bp, Homo sapiens
tataaaaactgatgtctatgagcagaccttaaattaatgtggac

SEQ ID NO: 136 - DNA, 49 bp, Homo sapiens
gaagtttagaaaactgattataaaatgctagtatcaaaatatcataaag

SEQ ID NO: 137 - DNA, 40 bp, Homo sapiens
gcagcttatcctgcattatacaaggatagcttcatttttc

SEQ ID NO: 138 - DNA, 63 bp, Homo sapiens
ttagcttgaagaaacctttgcttgctcactcttgtgcctaaaccaggtatcaagtctggacat

SEQ ID NO: 139 - DNA, 55 bp, Homo sapiens
ttactcaacatttcctaaagtcgtttcatgtctgccttagaaaatgaactcaagt

SEQ ID NO: 140 - DNA, 45 bp, Homo sapiens
tgccaatatatctgcttatgatttatggtaatgttttcctttagc

SEQ ID NO: 141 - DNA, 47 bp, Homo sapiens
cctttccacccctgccagcatcaatgtacttcgtaagactataaaaa

SEQ ID NO: 142 - DNA, 57 bp, Homo sapiens
gtgataatgaaatgtaccgcttagcagtatgcatgtaccagttgggactactggttt

SEQ ID NO: 143 - DNA, 23 bp, Homo sapiens
gataaaatggaagaaaattgaaa

SEQ ID NO: 144 - DNA, 72 bp, Homo sapiens
atgcccacttatctgtgtaggttcagttctaaaatgtttttcacagtgagtcactgtcattagctttccaaa

SEQ ID NO: 145 - DNA, 46 bp, Homo sapiens
tatgagaggaaagacaaggaagtgagggtgcctaagaaccagatag

SEQ ID NO: 146 - DNA, 101 bp, Homo sapiens
tgtacgagacttcacaaaggtacttaagaacaagttcaggtcgaagaagtactttgccaaacaccctcgacttggttacctgcctgtccagacagttcttg

SEQ ID NO: 147 - DNA, 47 bp, Homo sapiens
cacattatgattctaatctattttttattgaaaatgaagacagcaaa

SEQ ID NO: 148 - DNA, 56 bp, Homo sapiens
tcacaatctcctcaactgtttcatgatgacacccattcaagaatagaacaatatgc

SEQ ID NO: 149 - DNA, 48 bp, Homo sapiens
tggaaaggactaatgggtcttttctcactgatagcagctccaccacag

SEQ ID NO: 150 - DNA, 400 bp, Homo sapiens
ggtatgttattgataggtatcatagaactaattttttgtttgtttgttttgtttgttgttttgttttgtttttgagacagagtctcactctgtcgcccaggctggagtgcagtggcacaatctcagctcactgcaaccttggcttcccgggttcaagtgattctcctgcctcagcctcccgagtagctgggattataggtgcccaccaccaagcccaactaatttttgtatttttagtagagatggggtttcaccatgttggtcaggctggtctcaagctcctgacctcaagtgatctgcccatctcgacctcccaaagtgctgggattacaggcgtgagccaccgtgcccagccaactaattgtttttttaactaatattagaataagtttacctctat

SEQ ID NO: 151 - DNA, 47 bp, Homo sapiens
gttttattttatatctatctactatatctttacgctttgtccatttg

SEQ ID NO: 152 - DNA, 30 bp, Homo sapiens
gttcatatctatatctatatatttctagag

SEQ ID NO: 153 - DNA, 47 bp, Homo sapiens
agtgagccagccgcagagcccagctcagatcctgaagtcagtagaga

SEQ ID NO: 154 - DNA, 115 bp, Homo sapiens
ctacaggtggagtatgagcagctgaaggaccagcacctccgaagggggctccctgtcggttcaccgccagagtcgattatatctccccatcacacgtctgaggattcagaactta

SEQ ID NO: 155 - DNA, 55 bp, Homo sapiens
aaactcctcaggcagcacaaaggtcggctggaggctaggatgcagattttagaag

SEQ ID NO: 156 - DNA, 45 bp, Homo sapiens
tgttttatgggagttgcttgcaagctttctggatgataagaaata

SEQ ID NO: 157 - DNA, 53 bp, Homo sapiens
cagcattctgcactgagctactcgcttgatccagatgcctccggcccacagtt

SEQ ID NO: 158 - DNA, 46 bp, Homo sapiens
aggacctgctggccccaccgcacgacaccagcacggatctcacgga

SEQ ID NO: 159 - DNA, 44 bp, Homo sapiens
tgctagatgactagggacaacttttatttgaccaagaacagatt

SEQ ID NO: 160 - DNA, 38 bp, Homo sapiens
atgatcatgtagcaaaagaggggacgaaaagcagatgc

SEQ ID NO: 161 - DNA, 52 bp, Homo sapiens
attgacctaaaaaaaaaatgactggtaccacagaggtggttttgttactttg

SEQ ID NO: 162 - DNA, 52 bp, Homo sapiens
ttagtaataatgtgccacaaagccacagcagctttggagaacattttctttc

SEQ ID NO: 163 - DNA, 46 bp, Homo sapiens
ggatcttaactaaaagacaagggtatgtgaagtaggctaggggtgt

SEQ ID NO: 164 - DNA, 45 bp, Homo sapiens
agggagtgaggttggggaggaggtgtcagaagtgcgaggagagac

SEQ ID NO: 165 - DNA, 49 bp, Homo sapiens
ttcaccagcctcattcgctcaccattggtaccttcagcagaaagaaatg

SEQ ID NO: 166 - DNA, 87 bp, Homo sapiens
taggttgggtgggttggggggcaagggtgtctatttgcagcagagatattttgaaaagaagaaaattgttttatataaaaaggaaag

SEQ ID NO: 167 - DNA, 4046 bp, Homo sapiens
ggagcgcttccgagtgtaaatggcagttcttggcactcaccgttttcttttactgtgtttcaagcagagcagcaaactcttgtccgcttggcttccttttctactatctcaatcgttcctaggttttggttcctatagtaaattaatgaatagtgtttgcattacacagcatttccatcataatgcacactgttggatatatatgtgctatatacataaaatatagtacaaaataaaaattatatacatatattcattgtataattcctaaaatcttaaaaaattgaaacattagttttgtctttaaggctgtcaccttatgtttattttttaaacaccttatgtttatttcatacactcttgcttggtggtccatatgacagccggaagcgttctgaagggagagttagtgaatatcgacttgactggattggtttcagtaagaacatctggcttttacagaatatcatttgagggaagggaaatctagggcagaggtaacaataaattgcatttgtatagggcttgaagcttctaaagcaacatctcattcattgattctcagtttctcacctagccttctgtgaagatggtgttccctccattttataggtgtggaagacggagggtcacactgggatgcattgttcgtggtgaaactttgattctgtctcctgagaaccaaagattctgcatttggcaattagaaggagtcatcctttgccttaagtgtactcaaattcctctggccattaatggcaagtaacctcagtggctatcactatttaaatagccttctgttattcttctttctccccattttcctctgtactctgatcaccttttctgctgtatctttgcaacctgtaagggattttcattatcaagaagagaaaaatttgaaaaatcaccttgaggagagtggcaagtgaaacattatagtgaagaagtgttactgataatgggcaaatggaataaagtagtgtgtaaacagttgacttttctcttttatgggtgaataaaggctttgggtagcatagaagtggagatcttggctaagaccaatagtgaagaaaagcattagacttactgctccaaagtgatacactgtagttctttccaggaaagagaatttttccctgggcaaacttaattttccatgataaacttttatagacattcttctgaacaaagtttttgattcttgaatataataaaatacacttaagaatttagcaaatcctttatagttatgtacttgaatgaaagaatgtaatcatataataatccataaatttttagcagtagtagagcctataaaaaatgaaaaaagttttttagactctcataaaatctgtcagattgatgatccaatcctttatatccaactctctctctctctcttttttttttttttttttttgagatggagtctcacccactcggtcgtcaaggctggagtgcagtggcagcgatcttggcccactgcaacctttacctcctgagttcaatcaattcccctgcctcagcctcctgagtagctgggattacaggtgtttgccaccatgcctggctaatttttatatttttagtagagacagggtttcgccatgttggccaggctggtctcaaactcttgacctcaagtgttagccaggttggtcttgaactctggacctcaagtgatctgcctgcctcagcctcccaaagagctgggattacaggcatgagccaccatgctgggcccaactctctttttgtcatctccgcttatataactcagaggcatttcaagctctgcaaatccaaatcacattgatgattcctttctcccagcctgctatcctcagtgttgcccagctcaatgactcacacttcacctaattgcctaagccaaaattggggagtcattttgcacattttgcacattggatatgaatctctcatatccaatcaattcccaaatcctattgactttctttgatatctaaatatcccacatattcacccatttctttctatctactcttgtttagaccacacttgtttcctgcatataatattacaatagaaagaatagcacaataaacacccagatgtcctttttattttattttattttattatttaaaatttttatttacatggagtagagacaaggtctcaccatgttgcctaggctgatctcaaacttctgggctcaagtaatcctctcgcttaagcttcccaaagtactgggattacaggtgtgagccacctcgcctagacccagatgccctttaacaagttttcccacttactttattttttttgagatggaattttgcccttgtcacccaggctggagagtaatagcacaatttcggctcactgtaaccaccgcctcctggattcaagtgattctcctgcctcagcctcccaagtagctgggattacaggcacctgccaccacacccagctaatttttgtatttttttttaagtagagatggggtttcaccatgttggccaggctggtctcgaactcctgaactcaggtgatgcacctgccttggcttcccaaagtgctgggattacaggcgtgagccaccttgcccggcctagttttcccacttattttacaatacttactgcatttttctgtctgtctgtgtgtatgcatatatacatctacatacatatatcaacctaaatatacctatatcagtatagacagatatatgctattctgtttgaacttaagttgaagataccatcacacttcattgctaaatatttcaccacatgtctcttacaatcaaagacattctcctgcaacaataccataattaatgttaaagaaatttaacattgatacaataatattgtctaatacatagtccaaattcagatttttcaaatgatcctcaaatgttttattttaaaattctgaattcaatcaaagattacatttcattgtcatgtctatttagtctcctttaattcacaaagctccccctctcccaggtaattttggttttcaagacgctgacagttttgaagaaaccaggccatttcttttgaaaactagccacagtctagatttgtctgctcatgagaagattcacgttcaacatcttggcaaggatattgtgtagatgatgtggtgattttccattcaattgcatgatgccccatgattggttatgtgaattttgatcacttggttaagattaggaatttttccccaacatattactatgaaaaaattctcagacatacagaagagttgcaagaaattttcattcagcattcatatacccatgagctaggttccttaatttgcattttgctatattctgccatagtcttcactggttccccacatattactgtggtctacctacaagccacaatcgtctttttttttttttttttttttttttttttgagatggagtctcactctcgttgcccagggtggagtgcagtggcgtgatctcagctcactgcaacttccacctcccaggttcaagcaattctcctgcattagcctcctgagtagctgggattacaggtgcacaccaccatgcctggctaattttttttttttttttgtatttttagtagagacagggtttcactgtgctggccaggctggtctcgaactcctgacctcgtgatccacctgcctcggcctcccaaagtgctgggattacaggcatgagccaccgtgcccgtcccttgacgatcttttaaaaaggccaatttgaccatgttggttccctccttcgaaccatctactggctccccattgctcttcagataaagacacaaacccttgacctgttctccatggtcctatccctggtcctgcccagcttcttcacctggttcaacaggtacacttgtctcttggctgtcttctttccagaaacactggcttgtgctccattctttgactgctccatgattctttctgccacttcacataggaagctcttaccttttctctttctgtttccctttttggctaattaaattcttgtcatctttaaaggcttggctc

SEQ ID NO: 168 - DNA, 4046 bp, Homo sapiens
ggccaggctggtctcgaactcctgaactcaggtgatgcacctgccttggcttcccaaagtgctgggattacaggcgtgagccaccttgcccggcctagttttcccacttattttacaatacttactgcatttttctgtctgtctgtgtgtatgcatatatacatctacatacatatatcaacctaaatatacctatatcagtatagacagatatatgctattctgtttgaacttaagttgaagataccatcacacttcattgctaaatatttcaccacatgtctcttacaatcaaagacattctcctgcaacaataccataattaatgttaaagaaatttaacattgatacaataatattgtctaatacatagtccaaattcagatttttcaaatgatcctcaaatgttttattttaaaattctgaattcaatcaaagattacatttcattgtcatgtctatttagtctcctttaattcacaaagctccccctctcccaggtaattttggttttcaagacgctgacagttttgaagaaaccaggccatttcttttgaaaactagccacagtctagatttgtctgctcatgagaagattcacgttcaacatcttggcaaggatattgtgtagatgatgtggtgattttccattcaattgcatgatgccccatgattggttatgtgaattttgatcacttggttaagattaggaatttttccccaacatattactatgaaaaaattctcagacatacagaagagttgcaagaaattttcattcagcattcatatacccatgagctaggttccttaatttgcattttgctatattctgccatagtcttcactggttccccacatattactgtggtctacctacaagccacaatcgtctttttttttttttttttttttttttttttgagatggagtctcactctcgttgcccagggtggagtgcagtggcgtgatctcagctcactgcaacttccacctcccaggttcaagcaattctcctgcattagcctcctgagtagctgggattacaggtgcacaccaccatgcctggctaattttttttttttttttgtatttttagtagagacagggtttcactgtgctggccaggctggtctcgaactcctgacctcgtgatccacctgcctcggcctcccaaagtgctgggattacaggcatgagccaccgtgcccgtcccttgacgatcttttaaaaaggccaatttgaccatgttggttccctccttcgaaccatctactggctccccattgctcttcagataaagacacaaacccttgacctgttctccatggtcctatccctggtcctgcccagcttcttcacctggttcaacaggtacacttgtctcttggctgtcttctttccagaaacactggcttgtgctccattctttgactgctccatgattctttctgccacttcacataggaagctcttaccttttctctttctgtttccctttttggctaattaaattcttgtcatctttaaaggcttggctcaaatgtctcttcaagaaagccttctctaattgcccagggcaggtcagactcctctgctgtgtgctcttaatactctgtgcttctcctttgtatgatttgtagtctgtcagtattgtaatgaaataattcattatgtaattaattgcttagtgtgcataagcgccgtaatggcagaggctatgtctcttgttcatagtcataacaccattgcctggcttggtgctttacacgtggtaggcactcaataaatatttggtgaatgaatagttactacgaataactatataaaatatataaatacattttttcaagtcagtactttcccttttccttttaggtattgatgtcaagctgaaccatcgtaggaagttgaaagccttagaaagaggacttggtaaagtttttggattatcttgaaactctggcaagatggccaagtatggagaacatgaagccagtcctgacaatgggcagaacgaattcagtgatatcattaagtccagatctggtaggtaaaggaagctcaagaaagctatggatttttatgtatttagaaaacctatgtttcttggattgatttgcattgttcttgcaagaacttcttggaggtgaagttcttttaagaaactgaattctgacaaatgactataattttgtaaaaggtatatgtaaaaggtataatatctctgagtgtcctatcctttctcaacccaattttgtgcttagtgaaactgctgcttgtagctaaaggttgttcatttggaagactactccattaaaataaaatacgaccgaacatttctctttctattttctggaaattgaagggattatatgcttaatgtaggaagtgccacagtttctggcaggaaagatctttcacagtttgatttcattaccatatatcctcacccccatccctgttcatagccattgataggccaacaggtgtcctaccttgaaatatcttatgagccttctcaaggtaaaattttcacctaggtaatctaataaaccagactcagacagattcatggttttcacacgaacagttaaattggggtcctcaggataccaccccctcctccaatctttttatataaccgagtgctttttgactctggctgtacagatgaatcaactggggagttttaaaaaacgcagatgcattggctccattccagacccattgaataaaaatttctgtatttttaaaaagcttcaaatatgattctgagacaaactcaaaggggagatatttttgaacaggcagaacacttctcagccttgaaaattacacagaactccaccctgagtgtgaacactatacttaagtaactttgaaaagttactttgaggtataaaattacatccagtgtcactttaaagacaaaaaaggaacccaaagcctgtttttgctgtgtgaaccatctttatgttctgttaggagcttgtttcttattatgtgaaactgtagaaatacacagtgaaaataagatctaaattaactgtcttaaaatacacattttcctccatgataccggtgttggttgattgataaagattttagttattacagatttggctgtaaatatgtagcaactattgtgtagcttgacgggtcttttgaaggtatagcttaatatcttgttttaaaatatgctttgaggatgttctcttcctgtaaaattctttttgttttaaatgttttagtggtataaggtactacaaaaatgtaagggattattaatatcatcttaggagtacggaatacatattcagacatatgtaaatataacagaggaaaatggaagagagacgatttaatgtctccatactagtcattttctataaattgtgaggaggtatattcctaaatagttttctgagtcagccttcattctagtaagacctttgatatttataacttgtactttagccgtgtccataaaagagtaattatctaatttcagaaataccgtgtatatataatgaacatataaactcccaaactattttaatttaaaattatcttttaaaaaggctgatgaacctaaaatattgctggagaacaatttggcaaaaatgataacatgtttttaacacatgcatatcaattaactgagtaattctgtttctagagtttttccctaggcaatacataaaaaggtacactcaagaaattgatcacagtatcatttataatagaaaacattgtaaacaccatgaaaatctaatattaggaattggttagatcattatttcccaaagtatttcgaaaagatcaaaagttctaggattgttaatgtgtaattcacaaaaggatgttatggtcaaatagctttaggaaatagttgtttaaacctattattctgtttctttactctagcacatctgaacagatcatacatgatctcagtagaggtaactaaattagggtatatccataaagtagaagattaagcattcataaaaagtgatacagatgtgtgtgatgtgtgtgtg

SEQ ID NO: 169 - DNA, 4042 bp, Homo sapiens
aggctggtctcgaactcctgacctcgtgatccacctgcctcggcctcccaaagtgctgggattacaggcatgagccaccgtgcccgtcccttgacgatcttttaaaaaggccaatttgaccatgttggttccctccttcgaaccatctactggctccccattgctcttcagataaagacacaaacccttgacctgttctccatggtcctatccctggtcctgcccagcttcttcacctggttcaacaggtacacttgtctcttggctgtcttctttccagaaacactggcttgtgctccattctttgactgctccatgattctttctgccacttcacataggaagctcttaccttttctctttctgtttccctttttggctaattaaattcttgtcatctttaaaggcttggctcaaatgtctcttcaagaaagccttctctaattgcccagggcaggtcagactcctctgctgtgtgctcttaatactctgtgcttctcctttgtatgatttgtagtctgtcagtattgtaatgaaataattcattatgtaattaattgcttagtgtgcataagcgccgtaatggcagaggctatgtctcttgttcatagtcataacaccattgcctggcttggtgctttacacgtggtaggcactcaataaatatttggtgaatgaatagttactacgaataactatataaaatatataaatacattttttcaagtcagtactttcccttttccttttaggtattgatgtcaagctgaaccatcgtaggaagttgaaagccttagaaagaggacttggtaaagtttttggattatcttgaaactctggcaagatggccaagtatggagaacatgaagccagtcctgacaatgggcagaacgaattcagtgatatcattaagtccagatctggtaggtaaaggaagctcaagaaagctatggatttttatgtatttagaaaacctatgtttcttggattgatttgcattgttcttgcaagaacttcttggaggtgaagttcttttaagaaactgaattctgacaaatgactataattttgtaaaaggtatatgtaaaaggtataatatctctgagtgtcctatcctttctcaacccaattttgtgcttagtgaaactgctgcttgtagctaaaggttgttcatttggaagactactccattaaaataaaatacgaccgaacatttctctttctattttctggaaattgaagggattatatgcttaatgtaggaagtgccacagtttctggcaggaaagatctttcacagtttgatttcattaccatatatcctcacccccatccctgttcatagccattgataggccaacaggtgtcctaccttgaaatatcttatgagccttctcaaggtaaaattttcacctaggtaatctaataaaccagactcagacagattcatggttttcacacgaacagttaaattggggtcctcaggataccaccccctcctccaatctttttatataaccgagtgctttttgactctggctgtacagatgaatcaactggggagttttaaaaaacgcagatgcattggctccattccagacccattgaataaaaatttctgtatttttaaaaagcttcaaatatgattctgagacaaactcaaaggggagatatttttgaacaggcagaacacttctcagccttgaaaattacacagaactccaccctgagtgtgaacactatacttaagtaactttgaaaagttactttgaggtataaaattacatccagtgtcactttaaagacaaaaaaggaacccaaagcctgtttttgctgtgtgaaccatctttatgttctgttaggagcttgtttcttattatgtgaaactgtagaaatacacagtgaaaataagatctaaattaactgtcttaaaatacacattttcctccatgataccggtgttggttgattgataaagattttagttattacagatttggctgtaaatatgtagcaactattgtgtagcttgacgggtcttttgaaggtatagcttaatatcttgttttaaaatatgctttgaggatgttctcttcctgtaaaattctttttgttttaaatgttttagtggtataaggtactacaaaaatgtaagggattattaatatcatcttaggagtacggaatacatattcagacatatgtaaatataacagaggaaaatggaagagagacgatttaatgtctccatactagtcattttctataaattgtgaggaggtatattcctaaatagttttctgagtcagccttcattctagtaagacctttgatatttataacttgtactttagccgtgtccataaaagagtaattatctaatttcagaaataccgtgtatatataatgaacatataaactcccaaactattttaatttaaaattatcttttaaaaaggctgatgaacctaaaatattgctggagaacaatttggcaaaaatgataacatgtttttaacacatgcatatcaattaactgagtaattctgtttctagagtttttccctaggcaatacataaaaaggtacactcaagaaattgatcacagtatcatttataatagaaaacattgtaaacaccatgaaaatctaatattaggaattggttagatcattatttcccaaagtatttcgaaaagatcaaaagttctaggattgttaatgtgtaattcacaaaaggatgttatggtcaaatagctttaggaaatagttgtttaaacctattattctgtttctttactctagcacatctgaacagatcatacatgatctcagtagaggtaactaaattagggtatatccataaagtagaagattaagcattcataaaaagtgatacagatgtgtgtgatgtgtgtgtgtgtgtgtgtgtgtatgaatatagaaatgtgttcttgatatagtaagtaaacaagtatgtattatatgaagtcatttatatgaaaaatgttttttaaaaatttagtgaagtatacaataaatgttaatagtggtcatcttggcatttgagattattacttttttttttgctgatttatattttctaaagttcttcaatgaacccacattactgagttcttatatttttaaagattatcaaattgcttagagtgtttagatgccaaggttatgactattactttttttgtggtggcatctacttcaaaacacactgaaaatttagttgttacatagctcagatatgaatcacattcttttggctgaattatgttgcaaaagccagtagataaatttggatttgaatggacccattagtcccaatctggcttcctctaagggactttttttgattcttttaaggcaaatgcttactatacagaggtaatatttcatggtactctaaaacttacatattttaagagatttttagtttagattaagtcataggaattgtctacatatcatatatgtattttaaagatcctctgtctacatgctgtatgccaaattggttgcttttccattttttaaaagggaatactttcctttaggaaaattttgatcctcatctgctcttccaggtttcttttttggggggaaattggatgaaagtggggggacggagagtgtggtttctgctctccaaatcctcgagtttggacaatccaaaaggctggcataattaaattggcataataaaaatgtctatgcattttatgttaagttattgtgattatttttattgtcctcacttagtattactttgtttcatgccattttgaatattataattttttaaattttataattttaaagccatttctaccatctaaacagaaataggaagttgtcaagggtacgtaatgaagtagtttcataaatacaaagccatgtatttatttatggttgtagtatacttgccttgggtttgggtgagtgttagaaaggaactggaaagaatttgatctataatgaccaaggatttggtgttgggtaaaagtagacctgtctttctctaactt

SEQ ID NO: 170 - DNA, 4053 bp, Homo sapiens
ccaagtatggagaacatgaagccagtcctgacaatgggcagaacgaattcagtgatatcattaagtccagatctggtaggtaaaggaagctcaagaaagctatggatttttatgtatttagaaaacctatgtttcttggattgatttgcattgttcttgcaagaacttcttggaggtgaagttcttttaagaaactgaattctgacaaatgactataattttgtaaaaggtatatgtaaaaggtataatatctctgagtgtcctatcctttctcaacccaattttgtgcttagtgaaactgctgcttgtagctaaaggttgttcatttggaagactactccattaaaataaaatacgaccgaacatttctctttctattttctggaaattgaagggattatatgcttaatgtaggaagtgccacagtttctggcaggaaagatctttcacagtttgatttcattaccatatatcctcacccccatccctgttcatagccattgataggccaacaggtgtcctaccttgaaatatcttatgagccttctcaaggtaaaattttcacctaggtaatctaataaaccagactcagacagattcatggttttcacacgaacagttaaattggggtcctcaggataccaccccctcctccaatctttttatataaccgagtgctttttgactctggctgtacagatgaatcaactggggagttttaaaaaacgcagatgcattggctccattccagacccattgaataaaaatttctgtatttttaaaaagcttcaaatatgattctgagacaaactcaaaggggagatatttttgaacaggcagaacacttctcagccttgaaaattacacagaactccaccctgagtgtgaacactatacttaagtaactttgaaaagttactttgaggtataaaattacatccagtgtcactttaaagacaaaaaaggaacccaaagcctgtttttgctgtgtgaaccatctttatgttctgttaggagcttgtttcttattatgtgaaactgtagaaatacacagtgaaaataagatctaaattaactgtcttaaaatacacattttcctccatgataccggtgttggttgattgataaagattttagttattacagatttggctgtaaatatgtagcaactattgtgtagcttgacgggtcttttgaaggtatagcttaatatcttgttttaaaatatgctttgaggatgttctcttcctgtaaaattctttttgttttaaatgttttagtggtataaggtactacaaaaatgtaagggattattaatatcatcttaggagtacggaatacatattcagacatatgtaaatataacagaggaaaatggaagagagacgatttaatgtctccatactagtcattttctataaattgtgaggaggtatattcctaaatagttttctgagtcagccttcattctagtaagacctttgatatttataacttgtactttagccgtgtccataaaagagtaattatctaatttcagaaataccgtgtatatataatgaacatataaactcccaaactattttaatttaaaattatcttttaaaaaggctgatgaacctaaaatattgctggagaacaatttggcaaaaatgataacatgtttttaacacatgcatatcaattaactgagtaattctgtttctagagtttttccctaggcaatacataaaaaggtacactcaagaaattgatcacagtatcatttataatagaaaacattgtaaacaccatgaaaatctaatattaggaattggttagatcattatttcccaaagtatttcgaaaagatcaaaagttctaggattgttaatgtgtaattcacaaaaggatgttatggtcaaatagctttaggaaatagttgtttaaacctattattctgtttctttactctagcacatctgaacagatcatacatgatctcagtagaggtaactaaattagggtatatccataaagtagaagattaagcattcataaaaagtgatacagatgtgtgtgatgtgtgtgtgtgtgtgtgtgtgtatgaatatagaaatgtgttcttgatatagtaagtaaacaagtatgtattatatgaagtcatttatatgaaaaatgttttttaaaaatttagtgaagtatacaataaatgttaatagtggtcatcttggcatttgagattattacttttttttttgctgatttatattttctaaagttcttcaatgaacccacattactgagttcttatatttttaaagattatcaaattgcttagagtgtttagatgccaaggttatgactattactttttttgtggtggcatctacttcaaaacacactgaaaatttagttgttacatagctcagatatgaatcacattcttttggctgaattatgttgcaaaagccagtagataaatttggatttgaatggacccattagtcccaatctggcttcctctaagggactttttttgattcttttaaggcaaatgcttactatacagaggtaatatttcatggtactctaaaacttacatattttaagagatttttagtttagattaagtcataggaattgtctacatatcatatatgtattttaaagatcctctgtctacatgctgtatgccaaattggttgcttttccattttttaaaagggaatactttcctttaggaaaattttgatcctcatctgctcttccaggtttcttttttggggggaaattggatgaaagtggggggacggagagtgtggtttctgctctccaaatcctcgagtttggacaatccaaaaggctggcataattaaattggcataataaaaatgtctatgcattttatgttaagttattgtgattatttttattgtcctcacttagtattactttgtttcatgccattttgaatattataattttttaaattttataattttaaagccatttctaccatctaaacagaaataggaagttgtcaagggtacgtaatgaagtagtttcataaatacaaagccatgtatttatttatggttgtagtatacttgccttgggtttgggtgagtgttagaaaggaactggaaagaatttgatctataatgaccaaggatttggtgttgggtaaaagtagacctgtctttctctaacttaaaagcacatatgccaagttcatcatcaagtactgtattattaacagccttaattagtaggctttagaaagttcaacaagttagtaaatattttgaaacaataggccaagactaagaatttttaaaaagtgaaatttattgccagtagagtgtgtgatgcagaaagtactgcttggaacattttaaacatgaaataataaaatggtttgggatgcatatacaatcgaagaatatcctcactgctatttcattcaataattaacatacattaaagctagtaacacagaataagtcatccttttctgttgctgtcagtgttgttgtggttttatcccagagccctgtagaaagagtagacctcagggctaaggacagtgtgtcagctggctccatgtggagttcttgacagtttgggattatagactctcagctgggaaagaactgtttgatgaatgaaatagttgggcaagcttcacatttttggataattcaatgtgttcttcaagcgaccttgggctggaagcctgtgtgtaacaattttatcatttcttcctttgcattttctcttcttgtctaatcttaggatctaattgttgagggaaccttaaacgccctataacccagccattcctgtgatgtgctcacccagtctctgtttgcacacctccaatgatggcatctcactgctgctgctgatgatgacgattctagcaacttacactaattgaacacattctgtgtgcagatgtggtgctaacagtttaatcctcacaaccgccattttgcagatgataaatgtgagccatactgaagtgatttgtggcactggacttctttctatttctccaaaggcccagtg

SEQ ID NO: 171 - DNA, 4039 bp, Homo sapiens
gacgattctagcaacttacactaattgaacacattctgtgtgcagatgtggtgctaacagtttaatcctcacaaccgccattttgcagatgataaatgtgagccatactgaagtgatttgtggcactggacttctttctatttctccaaaggcccagtgtgtcttcctcagggcctttgcacatctctcttcttccatctttgcctggctggttccttcttgtcatttagatgtaggcctaatgtcacctcttcagagatcttccttgctgactttagaaagtagctctcccagtcactcttgactgcatctctgtatttacgttccctgtgttgttcttagcactctctggtaccttttctggtactgtgtgttcattaatagccttcccactagaacagggctccccaactcccagggcctggactggtaccagtccgttgcctgttagggaccaggtggcacagcaggaggtgagtggtggctgagcaagcactaccgcctgagctctgcctcctgtcagatcagcggcagcattagattctcataggagtgagactctatggtgaaccgcacatgcgagggatctaggttgcctgctccttatgagaatctaatgcctgatgatctgaggtagaacagtttcatcccaaaaccatccccctcatcccttggaaaaattgtctgccatgaaactggtccctggtgccaaaaaggctggggactgctgcactttaattaactccccaagagcagggaccaatacatccctggtactgagcccaatgcctggctcataataggtgagcaataaatgtttattcaatgataaaggctacagagtctggaagtgccagagctggcatttgaactcagatgatctgactctagaaaccctgcatttgacctctatggagtgcccagtctcctaactcacaagacattttattccattgctgctcggtgactcttcttcattttgtgcctaattctgtcccttacacattttgcactgtattaattgtatttatacagctcttctatctctttttttgtagttttcaggggtgggaccctggactgtgaggtagagctcctctggaccccaggttagtatctcagagccctgacaagggaaggccaattgtaagagacacagcctactgcttctgggccagttgcatcctttcttgatttttggctctagtctctgtcattctctgttgagttagcaaaggggaaaataccagaggacaaacagtcctttgggtggaagatagagaaatggataatgtgtttctgacatgaattcctttttctcttttcttctgactactgctcaaggcttttaacgagctgaagttaaaaaaaaaaaaggtagtggatttcataaggactgacatttggcacagtgtaggtcctggtccgatgcccagataggtatctgtggtactgaaagagttggttgaggagtgtaggggaaggaagcaaagggttggttgaggagtgtaggggaaggaagcaaagagagaccagtgaaataaaaataaaacaaattattaaatatgaaatattataccaggttacatttatagcaagcctcctgaaaatctgctatgtttggaaagtaaacttgcttaacaagattcaattttatgaaaattctgaggaggattaccttatttgtttatctttctgaggcctttcttgaggaaagacagtggttaagttgtatttaggcagtcatcggtctatttctttcttttatgtttaaagcagtatctgtgaggggatttttctaaacagctcaagggactgtgaaaaaatagttcattttttgtttctcctgaagctttccttggctggaatacctgtgctttgaagggaggtctttgagcaggtttgtttttttccatgagccctggggatttgtagtgatagacagtaaccctgatggaaattcaactctggcagagaagggcagctattcttgtcctgcttgtaaagatattctccatgttgttacctcattatgctgaagtagtgcaatcatgagaaagtttttttgtattaatgtgattctcatgacctgttactatggttgtgaaacttttagaggagatccattcccgactggaaaacgtgaattgctgaggatgattctaagcaaaggaagtacgttaattatatagacagaacagagaactcaattttattgaaccttatttgtacccagaagtttgaactagatgctgatatgatgatttttctgggaacaagtcaacatgcaagactatttgagcagctgtaaatattagttaaaatttaatctaaagcaatggagaaagggtactctgctgaagtggtttcagatgcattggctggatttttttttctccccttaaattgtgtggaggcatagacatttactatgttatatttttatctttttatatgccttaactgtttaataataaatagacttatttcaatatttgaaatgtgaggcagtatgagttcttaatgtatacttactctcgagatgatggctcttggactgagaaattgaaaccaggtcccagtcctttcgcttttacttcctgtgacactggatttgcacatgtcaattccaggaagcaggtagtttccagcatccatgtggttttccaatctttgcatttgtgcctttaaacaaccaaatacctgacgtttattaatatcctgtggggctcttctatcagaagcacattctcttggcccggttcataagggaaatgtctgtgtatgcgcatctggcagctaagattaaggtttacagtggtataacctcaccttcacttttaagaaattaagtttaaaaaaaatgcagatctgtctttcatagcagtggagctcaacaacacatagagcatgagagtcacattttttgtgtgaatattttcgaatgagccttttttggtatgtggacgggtggctagttacattcagttcaatccttttaacatttaattatggaacaaaatcttttttcaaagtgtagagaaaagcatataagggcatttctgatgtagcagaggaatccaataaaaaatatgactttgtgtctctaaagtggtacagctttgaaattaacacatctgtataatttcaaaagtatgatctctttagatctttttctttaatttcatagtcttaatttttgcaaatttcttcaactccattctctaattaagattttggtatacaatatttatatgcaaaagatttttggtgcaggaaataacattttgaggttgatactaattgatttgttcacttgcccctcaaaggctacgtgtgagtcatgttatttaacattgatccagtcaatatgtagatttatgcacatgcttttattttgaaaactaggttttgagcttctcacatatggagttcctaattcaagctttatgtcagaaccacccttctgggtccagactcagatatgtggggtggggtcccagcatctggagttttaacaagttctgtgggctattctctttagtgctcttaatttatagacaaggaaggcaggtttaaaagtcatagaaccaaagtgaaaatgatctgcattttagaggagcaaggaaagctacaacgtttattatttctacttataaacacttccctttaaataatttgaaaagataatagatttcatgatgttgggcattttttcttttacactgtattttgaagagtttgggttgtgttgggtgaagttaaaagtgaggaaagtgggtcaggagagtgatgaaacctggtgcatttcttattttggcccattgaaccagaagatgataccaatatatctagtgccgacatatttctccactgcgctccttagttattgctgcagtgtgttcaaggtcttcttgctgtgagtgtaacatcacatcttgaactctttttctagggaatgcatcagcttagagtccgctgatgcattcattataaaaatgtattgtgtatattttctattacattatttcaaagacag

SEQ ID NO: 172 - DNA, 4024 bp, Homo sapiens
tcaccttcacttttaagaaattaagtttaaaaaaaatgcagatctgtctttcatagcagtggagctcaacaacacatagagcatgagagtcacattttttgtgtgaatattttcgaatgagccttttttggtatgtggacgggtggctagttacattcagttcaatccttttaacatttaattatggaacaaaatcttttttcaaagtgtagagaaaagcatataagggcatttctgatgtagcagaggaatccaataaaaaatatgactttgtgtctctaaagtggtacagctttgaaattaacacatctgtataatttcaaaagtatgatctctttagatctttttctttaatttcatagtcttaatttttgcaaatttcttcaactccattctctaattaagattttggtatacaatatttatatgcaaaagatttttggtgcaggaaataacattttgaggttgatactaattgatttgttcacttgcccctcaaaggctacgtgtgagtcatgttatttaacattgatccagtcaatatgtagatttatgcacatgcttttattttgaaaactaggttttgagcttctcacatatggagttcctaattcaagctttatgtcagaaccacccttctgggtccagactcagatatgtggggtggggtcccagcatctggagttttaacaagttctgtgggctattctctttagtgctcttaatttatagacaaggaaggcaggtttaaaagtcatagaaccaaagtgaaaatgatctgcattttagaggagcaaggaaagctacaacgtttattatttctacttataaacacttccctttaaataatttgaaaagataatagatttcatgatgttgggcattttttcttttacactgtattttgaagagtttgggttgtgttgggtgaagttaaaagtgaggaaagtgggtcaggagagtgatgaaacctggtgcatttcttattttggcccattgaaccagaagatgataccaatatatctagtgccgacatatttctccactgcgctccttagttattgctgcagtgtgttcaaggtcttcttgctgtgagtgtaacatcacatcttgaactctttttctagggaatgcatcagcttagagtccgctgatgcattcattataaaaatgtattgtgtatattttctattacattatttcaaagacagacgtgtttttgaatcatggtgggaaaaaaactcctcacattcaacctctatgctagttttcttatcttaagggggggtggttagagaaatgtattatatatgtattaatatttgcctccctgttttttaattctaaataggtgacatatttaatataactatgcttgcttttgaaataatttgcctaccattctttaaaatgagtgaattttaaaagatgtatagtgatttttatgtgaagatgaattaaagagttaagtgacatagaccaccgtagcattttccctatggatctgtaaaaacagcccaaaagtcttgtgatttttttttttttttgagccgtagtcttcctcttgctctgttgcccaggctggagtgcagtggtgccatctcagctcactgcaacctctgcctcctaggatcaagtgattctcccacctcagcttcatgagtagctgggactacaggtgtgtgccaccatgcctggctaatttttgtatttttggtagagatggggtttcaccatgtcagccaggctggtctcgaacttctgacctcaagtgatctacccacctcagcctctcaaagtgctggaaatacaggcatgagccatggttcccggcctcttgtgatatccttatattcagttaaccaaaccaaatcaagtcaaataacaaaccccaaaccttttatagaccttgagttatttgcagatctttggggttatttacctgtcttttgagctttaatcttttacctctttgaagatacaggaagggatctttatttcttctttgataaaataaccttcagagtgacttgagatacggaattgcttctttgtatatcattgtgtggtatttgagatcacatctcaaaatttaatgagacctgctcctcaggcagttttaagattaaggatcaaaaagggagccactggaaaggtgtgagtggctggtaatctatgttagaacagagactttggtgcagaggttggccatgttcatatgtggagtaagttttcatgaaacaggaggaagccttttcttatttgaaactaagaaactgcaaaataaaagtaataaaataccccgaagcaaatagactttaaaacaacatttggtcctaagttgtatatgaccaatttcttaaagtgattgttatattgccagttttgaaattatattatcttttaaaatttaaaatgtaaatattgtctcaggggtgggaggatgaatctccatcttatttagtgttaaaggctcctggacttaccctaaagcccagctttttcggtggggggctcataaataaaactgtgtgtgttctagtttactctgttacctcatctagttcctttaggtgattagaaaatgccgtattagcaaatataaaaaggtttacttttgtgtttttacatgtgaaatcaatggccagttctataatgttaacatatcagacccttaattatatattaactcccattttgatagtttgtatagaaaaatcagagttgacttgaattatttgaacttgcatacgctttttcaagatacgtaacgtgttgtaaattagaagagtgttggtgttttcggaacacatgcatatgcttgctgtctcagggcagccttgttgggcatttggtgtcagacataccttattctgagggccttggcatcaaggcagattgctcagagagggggtctctctgcatatatgtctaagggagacatttagggaagtctcatgccatcctatctttctttctttctttttttttttttttttttttttttgagacagggtcttgctccattgcccaggctggagtgcagtgactcaatttcagccctccgcctcccaggttcaagtgattcttctgcctcagcctcccaagtagctgggattacaggtgcctgccaccatgcttggctactttttgtatttttagtagaagtggagtttcaccacgttgccgaggctggtcctgagctcctaacctcaagtgaaccgcctgccttggcctcccaaaatactggattacaggcgtgagacactgctcatggccaccatcctactttctaacagcactgccccaccctccccctcgccccaaaaaccaccatgaaggaggcagagggcaccaggtgaagactgcccatggtccttttcttacctctgtgacttcgcttgttttgtgttctgggcttgattgttctccttctccctgcgtccccagttttgcaacctccatctttaaaacatcagcatcagtgccaccaggtgttctgctctctgtgctatctgcatgccagaatcaatctttcccacgtgttcactcttcatttctgtttgtggcccttctggcttgtgtatgtctatatgccttttttcatctgactttctgatgctagcctttagcttagtctccacacacacagtaagtgcttaacaaagacttgtggccgtgtgcagtggctcatgcctgtaatcccagcactttgggaggctaaggtgggtggatcatctgaggtcaggagttcgagaccagcctggccaacatgctgaaacctcgtctctactaaaaatacaaaaatcagccaggcgtggtggcactcacctgtaatcccagctacttgggaggctgaggcaggagaatcgcttgaactgggaggcagaggttgtagtgagacgagattgtgccaatgcactccagcctgggcaacagagtgagactctgtctcaaaaaaaaagacttgctatgccttttaatggttttaaaaattacacttgcttacatacatacctcattc

SEQ ID NO: 173 - DNA, 4068 bp, Homo sapiens
aaggaggcagagggcaccaggtgaagactgcccatggtccttttcttacctctgtgacttcgcttgttttgtgttctgggcttgattgttctccttctccctgcgtccccagttttgcaacctccatctttaaaacatcagcatcagtgccaccaggtgttctgctctctgtgctatctgcatgccagaatcaatctttcccacgtgttcactcttcatttctgtttgtggcccttctggcttgtgtatgtctatatgccttttttcatctgactttctgatgctagcctttagcttagtctccacacacacagtaagtgcttaacaaagacttgtggccgtgtgcagtggctcatgcctgtaatcccagcactttgggaggctaaggtgggtggatcatctgaggtcaggagttcgagaccagcctggccaacatgctgaaacctcgtctctactaaaaatacaaaaatcagccaggcgtggtggcactcacctgtaatcccagctacttgggaggctgaggcaggagaatcgcttgaactgggaggcagaggttgtagtgagacgagattgtgccaatgcactccagcctgggcaacagagtgagactctgtctcaaaaaaaaagacttgctatgccttttaatggttttaaaaattacacttgcttacatacatacctcattcattcagcaaatggttattgttcattcattgttagatgctgggctcagagataagcaagacccacctctgttcttaagatgctctcaggctagttggaaagaaagacatcaataaacatccccacacaaaccagggacacatggagggaggaaggatgtcttgctttggttggaatgagggtaggtttgagtaagagagcgtgaaagaggcaaggaatttgaggtgtgccttgaaggatgtgtaagaggcaacgctgtggacagtgtgggaagaacattgcagatgatgagaaaagagcaaggcatttgaagtctgtccctggtaactgagtgtggctggggtaatggggatgatgggagaagctggggtcagatttcgaaagcccttttgaagcagggtttatttgatctttccctgtaagaagccactacaggattttaggtgagttaatgactagctcagaactgtttttcagaaagataacttggctggcagcaggaaagatagatttggaaggtagcagagttagggggaggcagggaacaggtaagagttgtgaaaaaattgaggttaaggagtataaggacttggaccagagtggtacaagaggagactgagcaggggaaaggatgtgaaaagtggttagcagttagtaacagggtgtgcaaagcctcaatgtaaacttcgcctttgtgggatttgttagttagtaacagtatgtttaaagcctctaggtaaatttcacctttgtgggactttttagtaacagtatctataaagccgcaatgtaaacttcaccttggtgggatttgctttatgttttcaatgaggtatgtagtttttcaaatcgtactgtaattcagattttcaacactttcggttattagctttttctctagaattttcttgatcaatttcttaaccgtttacagttacttctacttcttactgaagttgactactgctgtttttctcacagtacctcttggtcagtttatatggggaacttcaaattcagttcagctgcaataggatctgtatttttttctatatatattctgagagaagggtcatgctttaggaaaaagttgatgaaaatgagaaaagagatggtttattcatgtctatgcagtatactattaacagttctttgaaaaagtagcaaagaaaggtaatgttaatctcatcttaaatgaaggtaaaactcttgcacagctaagagaaaatctatatactaaaagagtttggaaaactacttcagaggaactttaattaaagagtagtctaatgtgatgctgtgaagataatgccatcctctattagtaatttcagcttcaacaaataggatagaataaatgcaaattaaaaataaattaggagcagatgttgagaaatatcttacatttagggaattcttaagtggtagaagggccctggagttcagttaataaagctgggatgctcagaaattataataattcaggtaacaaatgctttccttaatgtgatgctctgctgtggaggttttgggaatagaagaaagaagaggctgttattgtcatactgtttgtaagttcatctttctttacattcagtggataactaaaatctactatatatgctgatatttcagaaatggtggttcccttaaccttcaagaaaaaacaaaagctctcatttgtaaacacttgcaagcattcttgggttgtctcttggtggtacccaagtttttgctttggccggtaagagacttttgcatagtactttgttgccttgcctctacaacatgttaggcttgtggattggcgcatggtgaataagacacagttccagttgtcgactgtctgtcacctagagagggcaggtacacaggaatttaagaaaacagattaaacaggcagttacacagttgtaaaagtaaaaacagcacagattgctgtgtgagctcacgggagtggtacctgacatcccagggcttcaaggaaggcatcttggaagagtggatatctaagctgagatctgaaagaatgagtggggatgtggggaggctgttaagacagagggagttgatgacaagaggtttggaggtgagaattgtgaggttttcaatatggctaaagcaggatgctggagaatgaagctgagaagagtgttataagccatctttaggagtttgagttgtatcctaagcataatggtgaatctttgaaagggctttaaaattaaaaaaatttatatttatatatttatcatttttaaaattctgaagtattcaatctaaaaaaatgtacaggaaatgatatatcagatatgctcgtgccctcatttgaaatttatcagctgttaatgttttgacttttttttttttttgaaatggagtttcactcttgttgcccaggctggagtgcaatggcgcgatctcggctcactacaatctccccttcctgggttcaaacaattcttgtgcctcagccacccgaatagctgagattacaggcatataccatcatgcccagctaattttttttgtatgttttgtagagacatggtttcaccatgttggccaggctggtaatgttttgacgtatttgatttaggttgtattttaaagagctaattatgtcagcatagataaatcttaaaaacaatttgactacaaacaaaaatcaggttgcacaatgtattgaatggtactgtatataaagctcatatacctgcagaaattgccctgcagtgtttatgtattcatattataaatatatagcaaaatacaaaaatttttatggaaattataaacactagatttctttagagatagtgagagaggaggttcttcagttttatctataatatttaattcctcaatgaaaatagaaatagaatcttaaattaatatgaaataatgctgatttgtgaactgagtgatgactgtcttaagcccagttccttggaagtaggatttgagacagagatttgtgtgcacttgagaacaattcctgttaatgaaagaaatgagggaagaaggactgggccagggaaaagctgaagtgtagttgagttacagcagggccaccattggatccatagggaatgctggtgctgggatggcccttcagagatttcccaacttgaggcaatgtgttgagcctggggacctttgccttgaccagtaggcttttggctgaccctgggaaggaggtgaggtgaaaatctgggcaaggtaacttggccaagggcagttcctggacggatgctcagctatgagccctcagctgctgggggaatgaatttgtgcattgccttgcctgaaaggcagatctggataggagattcactgcagtcatggaccttgtaccattttcttttgcctattattgtctat

SEQ ID NO: 174 - DNA, 4045 bp, Homo sapiens
tgcgtccccagttttgcaacctccatctttaaaacatcagcatcagtgccaccaggtgttctgctctctgtgctatctgcatgccagaatcaatctttcccacgtgttcactcttcatttctgtttgtggcccttctggcttgtgtatgtctatatgccttttttcatctgactttctgatgctagcctttagcttagtctccacacacacagtaagtgcttaacaaagacttgtggccgtgtgcagtggctcatgcctgtaatcccagcactttgggaggctaaggtgggtggatcatctgaggtcaggagttcgagaccagcctggccaacatgctgaaacctcgtctctactaaaaatacaaaaatcagccaggcgtggtggcactcacctgtaatcccagctacttgggaggctgaggcaggagaatcgcttgaactgggaggcagaggttgtagtgagacgagattgtgccaatgcactccagcctgggcaacagagtgagactctgtctcaaaaaaaaagacttgctatgccttttaatggttttaaaaattacacttgcttacatacatacctcattcattcagcaaatggttattgttcattcattgttagatgctgggctcagagataagcaagacccacctctgttcttaagatgctctcaggctagttggaaagaaagacatcaataaacatccccacacaaaccagggacacatggagggaggaaggatgtcttgctttggttggaatgagggtaggtttgagtaagagagcgtgaaagaggcaaggaatttgaggtgtgccttgaaggatgtgtaagaggcaacgctgtggacagtgtgggaagaacattgcagatgatgagaaaagagcaaggcatttgaagtctgtccctggtaactgagtgtggctggggtaatggggatgatgggagaagctggggtcagatttcgaaagcccttttgaagcagggtttatttgatctttccctgtaagaagccactacaggattttaggtgagttaatgactagctcagaactgtttttcagaaagataacttggctggcagcaggaaagatagatttggaaggtagcagagttagggggaggcagggaacaggtaagagttgtgaaaaaattgaggttaaggagtataaggacttggaccagagtggtacaagaggagactgagcaggggaaaggatgtgaaaagtggttagcagttagtaacagggtgtgcaaagcctcaatgtaaacttcgcctttgtgggatttgttagttagtaacagtatgtttaaagcctctaggtaaatttcacctttgtgggactttttagtaacagtatctataaagccgcaatgtaaacttcaccttggtgggatttgctttatgttttcaatgaggtatgtagtttttcaaatcgtactgtaattcagattttcaacactttcggttattagctttttctctagaattttcttgatcaatttcttaaccgtttacagttacttctacttcttactgaagttgactactgctgtttttctcacagtacctcttggtcagtttatatggggaacttcaaattcagttcagctgcaataggatctgtatttttttctatatatattctgagagaagggtcatgctttaggaaaaagttgatgaaaatgagaaaagagatggtttattcatgtctatgcagtatactattaacagttctttgaaaaagtagcaaagaaaggtaatgttaatctcatcttaaatgaaggtaaaactcttgcacagctaagagaaaatctatatactaaaagagtttggaaaactacttcagaggaactttaattaaagagtagtctaatgtgatgctgtgaagataatgccatcctctattagtaatttcagcttcaacaaataggatagaataaatgcaaattaaaaataaattaggagcagatgttgagaaatatcttacatttagggaattcttaagtggtagaagggccctggagttcagttaataaagctgggatgctcagaaattataataattcaggtaacaaatgctttccttaatgtgatgctctgctgtggaggttttgggaatagaagaaagaagaggctgttattgtcatactgtttgtaagttcatctttctttacattcagtggataactaaaatctactatatatgctgatatttcagaaatggtggttcccttaaccttcaagaaaaaacaaaagctctcatttgtaaacacttgcaagcattcttgggttgtctcttggtggtacccaagtttttgctttggccggtaagagacttttgcatagtactttgttgccttgcctctacaacatgttaggcttgtggattggcgcatggtgaataagacacagttccagttgtcgactgtctgtcacctagagagggcaggtacacaggaatttaagaaaacagattaaacaggcagttacacagttgtaaaagtaaaaacagcacagattgctgtgtgagctcacgggagtggtacctgacatcccagggcttcaaggaaggcatcttggaagagtggatatctaagctgagatctgaaagaatgagtggggatgtggggaggctgttaagacagagggagttgatgacaagaggtttggaggtgagaattgtgaggttttcaatatggctaaagcaggatgctggagaatgaagctgagaagagtgttataagccatctttaggagtttgagttgtatcctaagcataatggtgaatctttgaaagggctttaaaattaaaaaaatttatatttatatatttatcatttttaaaattctgaagtattcaatctaaaaaaatgtacaggaaatgatatatcagatatgctcgtgccctcatttgaaatttatcagctgttaatgttttgacttttttttttttttgaaatggagtttcactcttgttgcccaggctggagtgcaatggcgcgatctcggctcactacaatctccccttcctgggttcaaacaattcttgtgcctcagccacccgaatagctgagattacaggcatataccatcatgcccagctaattttttttgtatgttttgtagagacatggtttcaccatgttggccaggctggtaatgttttgacgtatttgatttaggttgtattttaaagagctaattatgtcagcatagataaatcttaaaaacaatttgactacaaacaaaaatcaggttgcacaatgtattgaatggtactgtatataaagctcatatacctgcagaaattgccctgcagtgtttatgtattcatattataaatatatagcaaaatacaaaaatttttatggaaattataaacactagatttctttagagatagtgagagaggaggttcttcagttttatctataatatttaattcctcaatgaaaatagaaatagaatcttaaattaatatgaaataatgctgatttgtgaactgagtgatgactgtcttaagcccagttccttggaagtaggatttgagacagagatttgtgtgcacttgagaacaattcctgttaatgaaagaaatgagggaagaaggactgggccagggaaaagctgaagtgtagttgagttacagcagggccaccattggatccatagggaatgctggtgctgggatggcccttcagagatttcccaacttgaggcaatgtgttgagcctggggacctttgccttgaccagtaggcttttggctgaccctgggaaggaggtgaggtgaaaatctgggcaaggtaacttggccaagggcagttcctggacggatgctcagctatgagccctcagctgctgggggaatgaatttgtgcattgccttgcctgaaaggcagatctggataggagattcactgcagtcatggaccttgtaccattttcttttgcctattattgtctatttctatgtctgaaagatatgacatattaaataaaaaaagcttccaatttctaggagcagtattcaccgaactacttcc

SEQ ID NO: 175 - DNA, 4060 bp, Homo sapiens
tagcttagtctccacacacacagtaagtgcttaacaaagacttgtggccgtgtgcagtggctcatgcctgtaatcccagcactttgggaggctaaggtgggtggatcatctgaggtcaggagttcgagaccagcctggccaacatgctgaaacctcgtctctactaaaaatacaaaaatcagccaggcgtggtggcactcacctgtaatcccagctacttgggaggctgaggcaggagaatcgcttgaactgggaggcagaggttgtagtgagacgagattgtgccaatgcactccagcctgggcaacagagtgagactctgtctcaaaaaaaaagacttgctatgccttttaatggttttaaaaattacacttgcttacatacatacctcattcattcagcaaatggttattgttcattcattgttagatgctgggctcagagataagcaagacccacctctgttcttaagatgctctcaggctagttggaaagaaagacatcaataaacatccccacacaaaccagggacacatggagggaggaaggatgtcttgctttggttggaatgagggtaggtttgagtaagagagcgtgaaagaggcaaggaatttgaggtgtgccttgaaggatgtgtaagaggcaacgctgtggacagtgtgggaagaacattgcagatgatgagaaaagagcaaggcatttgaagtctgtccctggtaactgagtgtggctggggtaatggggatgatgggagaagctggggtcagatttcgaaagcccttttgaagcagggtttatttgatctttccctgtaagaagccactacaggattttaggtgagttaatgactagctcagaactgtttttcagaaagataacttggctggcagcaggaaagatagatttggaaggtagcagagttagggggaggcagggaacaggtaagagttgtgaaaaaattgaggttaaggagtataaggacttggaccagagtggtacaagaggagactgagcaggggaaaggatgtgaaaagtggttagcagttagtaacagggtgtgcaaagcctcaatgtaaacttcgcctttgtgggatttgttagttagtaacagtatgtttaaagcctctaggtaaatttcacctttgtgggactttttagtaacagtatctataaagccgcaatgtaaacttcaccttggtgggatttgctttatgttttcaatgaggtatgtagtttttcaaatcgtactgtaattcagattttcaacactttcggttattagctttttctctagaattttcttgatcaatttcttaaccgtttacagttacttctacttcttactgaagttgactactgctgtttttctcacagtacctcttggtcagtttatatggggaacttcaaattcagttcagctgcaataggatctgtatttttttctatatatattctgagagaagggtcatgctttaggaaaaagttgatgaaaatgagaaaagagatggtttattcatgtctatgcagtatactattaacagttctttgaaaaagtagcaaagaaaggtaatgttaatctcatcttaaatgaaggtaaaactcttgcacagctaagagaaaatctatatactaaaagagtttggaaaactacttcagaggaactttaattaaagagtagtctaatgtgatgctgtgaagataatgccatcctctattagtaatttcagcttcaacaaataggatagaataaatgcaaattaaaaataaattaggagcagatgttgagaaatatcttacatttagggaattcttaagtggtagaagggccctggagttcagttaataaagctgggatgctcagaaattataataattcaggtaacaaatgctttccttaatgtgatgctctgctgtggaggttttgggaatagaagaaagaagaggctgttattgtcatactgtttgtaagttcatctttctttacattcagtggataactaaaatctactatatatgctgatatttcagaaatggtggttcccttaaccttcaagaaaaaacaaaagctctcatttgtaaacacttgcaagcattcttgggttgtctcttggtggtacccaagtttttgctttggccggtaagagacttttgcatagtactttgttgccttgcctctacaacatgttaggcttgtggattggcgcatggtgaataagacacagttccagttgtcgactgtctgtcacctagagagggcaggtacacaggaatttaagaaaacagattaaacaggcagttacacagttgtaaaagtaaaaacagcacagattgctgtgtgagctcacgggagtggtacctgacatcccagggcttcaaggaaggcatcttggaagagtggatatctaagctgagatctgaaagaatgagtggggatgtggggaggctgttaagacagagggagttgatgacaagaggtttggaggtgagaattgtgaggttttcaatatggctaaagcaggatgctggagaatgaagctgagaagagtgttataagccatctttaggagtttgagttgtatcctaagcataatggtgaatctttgaaagggctttaaaattaaaaaaatttatatttatatatttatcatttttaaaattctgaagtattcaatctaaaaaaatgtacaggaaatgatatatcagatatgctcgtgccctcatttgaaatttatcagctgttaatgttttgacttttttttttttttgaaatggagtttcactcttgttgcccaggctggagtgcaatggcgcgatctcggctcactacaatctccccttcctgggttcaaacaattcttgtgcctcagccacccgaatagctgagattacaggcatataccatcatgcccagctaattttttttgtatgttttgtagagacatggtttcaccatgttggccaggctggtaatgttttgacgtatttgatttaggttgtattttaaagagctaattatgtcagcatagataaatcttaaaaacaatttgactacaaacaaaaatcaggttgcacaatgtattgaatggtactgtatataaagctcatatacctgcagaaattgccctgcagtgtttatgtattcatattataaatatatagcaaaatacaaaaatttttatggaaattataaacactagatttctttagagatagtgagagaggaggttcttcagttttatctataatatttaattcctcaatgaaaatagaaatagaatcttaaattaatatgaaataatgctgatttgtgaactgagtgatgactgtcttaagcccagttccttggaagtaggatttgagacagagatttgtgtgcacttgagaacaattcctgttaatgaaagaaatgagggaagaaggactgggccagggaaaagctgaagtgtagttgagttacagcagggccaccattggatccatagggaatgctggtgctgggatggcccttcagagatttcccaacttgaggcaatgtgttgagcctggggacctttgccttgaccagtaggcttttggctgaccctgggaaggaggtgaggtgaaaatctgggcaaggtaacttggccaagggcagttcctggacggatgctcagctatgagccctcagctgctgggggaatgaatttgtgcattgccttgcctgaaaggcagatctggataggagattcactgcagtcatggaccttgtaccattttcttttgcctattattgtctatttctatgtctgaaagatatgacatattaaataaaaaaagcttccaatttctaggagcagtattcaccgaactacttccctgacacatacatacctcacaccctgcacacaccacacaccacaaaccgtagctgtaatatcaggttacatactttctgttttattttcccttttctctgtgtttttggttacttgagatggcctcctctctctcactcctggtttgggaaggccttgcttcctctgaaagcttgtgagcagagggctgatctgatcagatttgc

SEQ ID NO: 176 - DNA, 4046 bp, Homo sapiens
tgctcagctatgagccctcagctgctgggggaatgaatttgtgcattgccttgcctgaaaggcagatctggataggagattcactgcagtcatggaccttgtaccattttcttttgcctattattgtctatttctatgtctgaaagatatgacatattaaataaaaaaagcttccaatttctaggagcagtattcaccgaactacttccctgacacatacatacctcacaccctgcacacaccacacaccacaaaccgtagctgtaatatcaggttacatactttctgttttattttcccttttctctgtgtttttggttacttgagatggcctcctctctctcactcctggtttgggaaggccttgcttcctctgaaagcttgtgagcagagggctgatctgatcagatttgctcttctgagtggtgctctagaagccacgtggagcatggatggtgtggggtgtgtgctggatgaggcaagcctggggttctggaggacctttgggtggctgtcacagttagaggataagaggtattgaagccaaaactgagattgaggtagctgggaaggaggagaggggagagtttagaagctttaggtaggaggcagacctgataggacatggtggtggtcttcagatgatgggtggtggatgggatggagagagaagcctggtttttgactttaacactcgcaaatgaagcctttctttctaggttttgtggagagggcagtgcataaggggatagtaagtgaagttctagattgagttttgaggtgcctggagatatctgggaaaaatatgtaatatatatatttctcttacatgtatgagactggcttgggctggggtctgcccttgaaaactggcagctggagtcttgagtactttcctgagtcattttttgagctctttgcaagataatgttaaaaattcaagaggccgggtgtggtggatcatgcctggaatcccagcactttgaaaggccgaggcgggcggatcacctgaggtcaggagttcaagaccagcctggccaacatagtgaaaccctacctctactaaaaatacaaaaaaaaaaaaaattacctgggcatggggtcgcgcacctgtagtcccagctactcaggaggctaaggcatgggaataatttgaacctgggaggtggaggctgcggtgagtcaatatcacatcactgcactccagcctgggtggcagagtgtgactctgttgaaaaaaaaaaaaatcaagaactgttgcatattttatttatctttgtattttctgagatatttttgactgaccctaaaatgagcatctggatggtagatgacggcagcggaagatgaagaattaagaagtggtttttgatttgtaatattttttagtagatattattagttgatgccgcagttgttgactgtatttatctcccaagggcataggaagcccccttgcagatattactctacctagcctgactgggtgtttggggagggagagaagaggttaacaataaatcctgcaatatgtgcagaagtttttacacttgtgtttctgcatattttcttagaaaaagggtccacagttttcattatattctcaaaggagacctatgacttaatgaaaagttaagtcttgttagaggaagagtgacatattatagggttatgtcttcataatgtttctttttttctgaaattagattggcagtccaatacgctggcacgaactgagggtctcacacttttgctgtaactcaaattctggtccttactttacttctactgccttaaagccactcaaacaaaagacctgattgctagaattaggttgagaagacacaaagtttgaagggcaaaatttctgataatgtttgacccagttttgcatataatgtatttttatttgttgatgaatatttcccttttgttgctaaaagtggcaaataatcagacatagattactaattaacagtctgcctcagttttttttttttttaattaatgaaacttgggcttcatcaagctcaggtggaatggatatcacagtgctttattttttctgacatcaaaagaaatttctttgtcaaagtgtagacatgtttgttgtgactgccttttgtgtgggttcttttctcccagccctctcctactacaggagagagagataatggccctttgctcctcattccgcattcagaccagattccccagctgcaatctcctgccatcggattgcatcaccaactcaacctaattggtgagatgtcactccctccctccaccgctcactctcatttctcagtgagtttagctctgtcactctctctaaaagttactcttgttttagtgatttgggtgtaaacattgatgatccttctaatactctgtcctcttaatttctctaagttctctttctagtgatcttgtctcccagtgtggtgggtatattctggctagaccaggtcattgtttatggtggcagcccctctgtcatctgaatttaagcgtcccattttttcggtactagcatggctcactgcaacctccgcctcctgggctccagcaatcctcccaccctcgggtagctggggctataggcatgtgccaccacgcctggctaatttttgtatttttttttgtagataagaggtttcaccatgttgcccaggctggtctcaaactcctgggctcaagcaatccatccacctcagcctcccgaagtgttgggattacaggtgtgagccaccatgcccggctgactttgcctactcttgccctaagaaaattgaagcaaaccaaagaggaatccagaaacttcaataccacatctatcctcaaccagaacccacccaaggccaccctaaccgtgtacattgtacccatcctcctttacttactcaaagtcacctcccttctctcttctgcatccctatgatttcccctttagtggatccgcttacaaacatgctattgtttttcttctagcaaaactttactttgatcccacctgtctctgtagctaccacgccattcctctggtcccctttatgaaagagctcctcaaagattgtatgtaccaacatttgcagttcgtctcctttcattccctcttaagaccactcaaatcaggcagaccccctaccagtccagtaaaactgctcttgtcaaagttattagggacctccttgttgctaaatccagtagcctgttctcagtccttaccttattccacctctcaatagcatcaacactgctgatcactccctcctccatgactctttcttcatttggcttctaggacaccccacacgctcctggtttcccacccattatcttttgctgattcttcctcttaacgttggagggcccaggacccagtccttggacctcctctctgtccccactgttgccgtttgtcatctcaccagtatcctggtttaaatactatctgaatgctggctcaaatttctatctctagcccagacctcttcctctgaactgcatacttgcatttccagttgtttacttcacatcttctatgttcagatctgaaaatctgaactcctgatctcccgtaaaccccaaagctgatcccacagtcttgcttgtctcagataaaggcaatgtgattcttccaattgccccagttttggagtcatctttgtagtcctttctttctcgtatacccacatccaatgcagcagatcctgctggttctattttcctaatactgaatttatacagaatccggtcatattttacgatctccactgctactgtcctggtctaggggaccattgctttttctggaattgcctccttacttgtctctctgcttcctcccttggcccatggaggctggtctgaaccccacagtagagggatccttttcaaatcagaagtggatatgttgcttcaggtttccaagtctgcagtgactccccattccagttgtaataaacgcgaaagaccttacagtgatctacaggaccctgtttatcctgcctggcttcatctccccttactagtttgtgctcatt

SEQ ID NO: 177 - DNA, 4051 bp, Homo sapiens
cacaagaatcgcttgaacccaggaggcagaggttgcattgagctgagatcgtgctactgcacgccagcctggataacagagcaagatgctgtctcaaacacaaacaaacaaacaaaaaacaaacaagtgtgcaatccctgagaaaaatatcagttcaatctttgttgatctttattgtcccgattgattagctgcatgtcagcctttgactgtgtttcccagatgctcacgacagatcgatcacttgatgttgttttcaacaggcagtcatgaaatgagcagactgaggtcagtgtagtatagatatttgtcagcgtggttgccaactgcctttcctcttctaagattgccctttattgtgtgattatattacatttttagttggcatgaaaatgcccatttagtgaaatgatgaggatcttcctgggggaagaattctggcgtaagaagctttcttcagattactaagcactctaaaaggtcccaggttatggggctctggaaagtaacgatgcgaatacttcacttggttatgtgatttttatttttgccttggaagtctttctgcaaacaagtcttccagtggaggctcattttaggaatgtgacgatgcattgctgataggtaggatgtggctttctatacagcagagtttggggggtgggactggcaggtgagtagctcaacccaggcttctgagggtccttcatgtcttttggaacacaatttgaaaatcactgctttaattgctaaattctagaaaacctggatgccctatttaaaaaaagagcttagcttagtgtcaaagaggaactaggttccagttttagctctgcagatcaccagctgtgtgaccttgaatatgtcactcaagctgtctgcacaattaattgatttgtttgtaaggtaaggagtatggactagatgacctcacactgatcactttctaagctccagaaaacctaattgttaatgcttaattgtgcgagctgtgctcgggaagggctgtgttctagtaccttcttcctcatcactgtcatttcagtattatctacactgatcttcacaaatattctgcacacttggattctaacctgcaatattgctgttggggttatagaaatatagattatatgatggtatttagggtaagcatttttatctctaaaatgagttagatatcaaggatggcatggtattagattacacaatatttgaaaagaataataagaaaaatcctgcaggatttaaaaatcttattagtactcttctgtagaaatactttagggaatggttcagacagtatcaggtgctgtgggtgtaagcatggccacctgctagctctgtgaacctggacaaatggcttagctgctctgtgcctgagtaaagtagagatagtaatagcatcaacctcctcgtgttgtaaaaagtaagtgaattaacatatataaagcaatttggggccaggcgcggtggctcatgcctgtaatcccagcactttgggaggccgagacgggtggatcacgaggtcaggagatcgagaccatcctggctaacacggtgaaaccccgtctctactaaaaatacaaaaaattagccggcctgatggcaggcgcctgtagtcccagctactcggaaggctgaggcaggagaatggtgtgaacccaggaggcggagcttgcagtgagccgagattgcgccactgcactccagcctgggtgacagagcaagactccatctcaaaaaaaaaaaaaaagcaatttggaacatagaagcactcaagaaatgtaagccgttacctccatacaaataattattataatgtgggtttatttctttccagtcttttaaaataagcatgtaaaaatagttttaatcatattgcactaggaagatttgtttttgtttcttaaatatatacagaatttccctttttctgcttctttatatttaataacaagacattctaggatagactaagccttttcatggctaattgtcctgtggaattcttttagtttttctcttccatgtttatatatttgatatgattttctggtagaattcttgaaaaaataactgcatcacacagtagctctcctctcccattttattttattttacttgctgaggctggatattatattcttttggctgaagtcaccatagtggattcatacaactaatttccagccagtttatgtagatcatttgcaaatgtattagttacagagaggctccaggggtgtaccaaagaaacctcaaaatacagtggctcaaataaaatcagagtttatttctttctctccttacagttcagagttggtgggtgatggagggtgggaaggtggctccgcttcatatggtctctcagggatcctggttccttctctcttgttctgcctttccaaagtgttgttccattttcttgatgaggcttgcccctcaacactatgtcaagttctagtccaaggaaagagaaaagagaagtaaaaaataagcaattttttaaaacgtgcatggccctcaggttgcattcctgatttcttttcacatcccactggctgctgcttagccacgtggactcatcttgctgcaagggaggttgagaaatatggcttgtgctgagctagaactgtggggatggaggagaagagcaggtttctgatactgaaaaaaaaaaaaagaaaagaaaatagaaaggagaatggataataataaatatacatatgctttgatcacaatttcatgggccaagtttgagtttggaattttccaagtcctcagattctatgacagaacatggtggtggagagagctgccccctggctccagtttgcagactttcccctttgtctgcccatgctggctccatttggcactgggaagggctttgcacccaagtttgtggtcagttggccaagcacccatggtctcccactcttccccacttgcaaacagtagtgtggtccacccttgcttgggaaagagcccagtgctcatttgagcagtgagtactaggaccctgtgcctctagaccgtgctttaggacttgcatatccccttggtcctctgatttctctatttctgggggagagatggggatggaagagggtagagtgaggccctctaaaagtcaggatttaaggcaaggtccttgcttgtctaggtctacaggtgatgctacaaagagaatgttacattgattcagttcttaaaattttcccttttcctcatgcttctgtttcattaatattcatatttactttttataatatacatgttatgtctttaatacactaggagtagaatatttgtaatgaaatggagtgctgttttaatggatgagaaaggtagggaggggctcagagagggaggctggagaatattcacttatttagcttaatgttttcaacagcttaaaaaaagagaaaaaacaacctttgagtggcccttgtgattaaatggcagtttgcccagactagagggagccagcgttgggaataaaaactaagattcactttgaaaatctagaaaaaaaaaatgactacacaagtcataagaatgtgcttgatggcttgggttgtctgagtgcaagtgaagtagggcgcaggcctggtttccgcattccctgtctgctcagccttttagctcctaaccccatccactccctagagctggccagcccagacccaggacctggatgctgacctcttcagggcggagctgttgctgtgctcagacatcgtgacaacttgttgatgggaaatgtagctgaaagtctagcacaaaaagctgctcttgggttggccagcgaacctccttcatggtaaaactccccatcccttatccaaatccttgggaccagatatgcttcagaatttatgatttttctttttcccatttcagaaaggctatggcccatatgccctatgttacataaagcctccagaggagtttgggacagtaccctatcatccaatatcttcatcattctgcagaaaatgtatgaatatttacactaagtggaacacaaacagggttataaata

SEQ ID NO: 178 - DNA, 4035 bp, Homo sapiens
aaaacaaacaagtgtgcaatccctgagaaaaatatcagttcaatctttgttgatctttattgtcccgattgattagctgcatgtcagcctttgactgtgtttcccagatgctcacgacagatcgatcacttgatgttgttttcaacaggcagtcatgaaatgagcagactgaggtcagtgtagtatagatatttgtcagcgtggttgccaactgcctttcctcttctaagattgccctttattgtgtgattatattacatttttagttggcatgaaaatgcccatttagtgaaatgatgaggatcttcctgggggaagaattctggcgtaagaagctttcttcagattactaagcactctaaaaggtcccaggttatggggctctggaaagtaacgatgcgaatacttcacttggttatgtgatttttatttttgccttggaagtctttctgcaaacaagtcttccagtggaggctcattttaggaatgtgacgatgcattgctgataggtaggatgtggctttctatacagcagagtttggggggtgggactggcaggtgagtagctcaacccaggcttctgagggtccttcatgtcttttggaacacaatttgaaaatcactgctttaattgctaaattctagaaaacctggatgccctatttaaaaaaagagcttagcttagtgtcaaagaggaactaggttccagttttagctctgcagatcaccagctgtgtgaccttgaatatgtcactcaagctgtctgcacaattaattgatttgtttgtaaggtaaggagtatggactagatgacctcacactgatcactttctaagctccagaaaacctaattgttaatgcttaattgtgcgagctgtgctcgggaagggctgtgttctagtaccttcttcctcatcactgtcatttcagtattatctacactgatcttcacaaatattctgcacacttggattctaacctgcaatattgctgttggggttatagaaatatagattatatgatggtatttagggtaagcatttttatctctaaaatgagttagatatcaaggatggcatggtattagattacacaatatttgaaaagaataataagaaaaatcctgcaggatttaaaaatcttattagtactcttctgtagaaatactttagggaatggttcagacagtatcaggtgctgtgggtgtaagcatggccacctgctagctctgtgaacctggacaaatggcttagctgctctgtgcctgagtaaagtagagatagtaatagcatcaacctcctcgtgttgtaaaaagtaagtgaattaacatatataaagcaatttggggccaggcgcggtggctcatgcctgtaatcccagcactttgggaggccgagacgggtggatcacgaggtcaggagatcgagaccatcctggctaacacggtgaaaccccgtctctactaaaaatacaaaaaattagccggcctgatggcaggcgcctgtagtcccagctactcggaaggctgaggcaggagaatggtgtgaacccaggaggcggagcttgcagtgagccgagattgcgccactgcactccagcctgggtgacagagcaagactccatctcaaaaaaaaaaaaaaagcaatttggaacatagaagcactcaagaaatgtaagccgttacctccatacaaataattattataatgtgggtttatttctttccagtcttttaaaataagcatgtaaaaatagttttaatcatattgcactaggaagatttgtttttgtttcttaaatatatacagaatttccctttttctgcttctttatatttaataacaagacattctaggatagactaagccttttcatggctaattgtcctgtggaattcttttagtttttctcttccatgtttatatatttgatatgattttctggtagaattcttgaaaaaataactgcatcacacagtagctctcctctcccattttattttattttacttgctgaggctggatattatattcttttggctgaagtcaccatagtggattcatacaactaatttccagccagtttatgtagatcatttgcaaatgtattagttacagagaggctccaggggtgtaccaaagaaacctcaaaatacagtggctcaaataaaatcagagtttatttctttctctccttacagttcagagttggtgggtgatggagggtgggaaggtggctccgcttcatatggtctctcagggatcctggttccttctctcttgttctgcctttccaaagtgttgttccattttcttgatgaggcttgcccctcaacactatgtcaagttctagtccaaggaaagagaaaagagaagtaaaaaataagcaattttttaaaacgtgcatggccctcaggttgcattcctgatttcttttcacatcccactggctgctgcttagccacgtggactcatcttgctgcaagggaggttgagaaatatggcttgtgctgagctagaactgtggggatggaggagaagagcaggtttctgatactgaaaaaaaaaaaaagaaaagaaaatagaaaggagaatggataataataaatatacatatgctttgatcacaatttcatgggccaagtttgagtttggaattttccaagtcctcagattctatgacagaacatggtggtggagagagctgccccctggctccagtttgcagactttcccctttgtctgcccatgctggctccatttggcactgggaagggctttgcacccaagtttgtggtcagttggccaagcacccatggtctcccactcttccccacttgcaaacagtagtgtggtccacccttgcttgggaaagagcccagtgctcatttgagcagtgagtactaggaccctgtgcctctagaccgtgctttaggacttgcatatccccttggtcctctgatttctctatttctgggggagagatggggatggaagagggtagagtgaggccctctaaaagtcaggatttaaggcaaggtccttgcttgtctaggtctacaggtgatgctacaaagagaatgttacattgattcagttcttaaaattttcccttttcctcatgcttctgtttcattaatattcatatttactttttataatatacatgttatgtctttaatacactaggagtagaatatttgtaatgaaatggagtgctgttttaatggatgagaaaggtagggaggggctcagagagggaggctggagaatattcacttatttagcttaatgttttcaacagcttaaaaaaagagaaaaaacaacctttgagtggcccttgtgattaaatggcagtttgcccagactagagggagccagcgttgggaataaaaactaagattcactttgaaaatctagaaaaaaaaaatgactacacaagtcataagaatgtgcttgatggcttgggttgtctgagtgcaagtgaagtagggcgcaggcctggtttccgcattccctgtctgctcagccttttagctcctaaccccatccactccctagagctggccagcccagacccaggacctggatgctgacctcttcagggcggagctgttgctgtgctcagacatcgtgacaacttgttgatgggaaatgtagctgaaagtctagcacaaaaagctgctcttgggttggccagcgaacctccttcatggtaaaactccccatcccttatccaaatccttgggaccagatatgcttcagaatttatgatttttctttttcccatttcagaaaggctatggcccatatgccctatgttacataaagcctccagaggagtttgggacagtaccctatcatccaatatcttcatcattctgcagaaaatgtatgaatatttacactaagtggaacacaaacagggttataaatagcctcaggtcagttcaggtcacgttttgctgccaaatgggttatggaaaaagcctttggtttccagagcttttcagatcctggcattgtggataaggga

SEQ ID NO: 179 - DNA, 4035 bp, Homo sapiens
tttatagatagacagatttactactggacattctctggcagagaaaaatttcatggaaagtgaagtttaatgtgaaatggcacataagtggtcctgacttgcaaactcaggaatggcttgttgaccactgtcctggaataagagagcccagctttgttcttgtcttatttctggatcgccctttctcctttgtaccttctgacattgtttctgagttccctcctcccatctgccacccgctcctttgcaactctgtagagcattttaataacaggttgtttgtgcctgtcttgcctctgcagcactcactcccacctgtttcctcagcctctgacttctcctttcccctttttggcatgctctgacctgcctccgtagttgaacccgattcctgaggcaatgatatggcaggtccctcaactctccatctatagcacttgccttgcctggcctgggaaccggctctttcactgctgtactgcatggaacagagtaggcactgcttaaacctatcagctgcctggctctctcaaatgctctttccaggaactctggcactgtgaacccactgctgaatctcgtggctcataaataaactctcaagtgataattgtgacttgaattctctagttcttacctgaccacctcttaatatcatcctggaactgtctttatatcatcttggaaaccctggagctgatttgaaatacctctggtcagttcctcagcatcagttctgtctaatgaacacctatattcttcattgtctcctcactcttggctctaagttgtcacaagtagatgattatgtctcattcccaagtagagataggacacatgagagtgggtgggtgtgcccatagtttagacaggactatctttgtgtggtaccagctgcggcaggatctacagatgactcacacatgttaatacccacatcttctgagtggccaacatcctcagatttgcatgtgggcatttgcaagaggaagcacacagatgctgtgatcagggctgagatgcctacaggtgtgtctgctgggctgcggcaggtggtggccagtggaagacaggttgtaggtagggaaagtgttgcctcatggagggtgatcctgatatggtgggaacttcaatccagactccgacatcgccacgggcaagctgaatgacagtaaacaaccttcagggcttggggacgtcagcacactcacctgtggagagccagccagaagacaggcagtggcacaagttttctgaggtagagattgtgactgtaggtgaccaaggaacaaaatattatgaagaccacattggggttcataggctggtggccctgtaggacacttggacacattttttttcctgccaacaccaaagaataatttctaggtgtctcttcttcacaccttcccatgaagcttgaaagttctagagctcactagaaactagaaaaattttccttactatgacagcaagtgtgcttcgagaaaactcacttgctgacctttgttccacagcccagcaggttgccacctgatttataaaaacagattatggagacagtccagaaaaattactccctctttcttttttttttaaagtaatattttaaaattcctttctttttgaagtatttgggttgtttttatcaatttcgttcactgttgccttaaatgacaattcttgcctccctgaagaactcttggccttcattcctgccactacagtgagaagttctaagctggaagggccatcccagggatgactgctttaagcagccagtcatgtagggttgcgcctgtggccctggcagattggaccctgtttctaccaagtggtggcatcacttggcttccatgtagtgtttttctgttctcctgcagatcgctgtcagccactggaggcctcacccactgggttccagacagctgccacttctgtttagaagcaacactgccagtgagaaaccctgccacacacaacacacacagacacacacacacagactcacacacagagacacacacacacagacacacacacacagacacacacacacacaccacacacacacacacacacacacacatgtgagaggagggccaccctgggaggaaaccctgaattctcccctcttagcacactccttctatctactccttctatctcctggtagagggagaagctgtgtgcccctattactacctctctttacctcctcattaagggctttggtgcgattattgtctcccttttaatctcactacttgcatgcagctttcttgagaaaggttataatttaatcctgaaatacaacttctaggagttttctttttaattcatcattccaagtaggtgtctttgtctgtttccacattagaaaatgaaaccaatacttaaatatgatttccctgcttttattggcagctatttaagatctatgtctgaggtctggctccgtgtggtttggaatactttattgttattattattattattttgagatggagtcttgctctgtctcccaggctagagtgcagtggtgtgatctcagcccactgcaacctctgcctccctggttcaagtgattcccatgcctcaccctcctgaatagctgggattacaggcacacgccaccacgcctggctaatttttgtagttttagtagagatggagtcttaccatgttggccaggctggtctcgaactcctgacctcaggtgatccacccgcctcagcttcctaaagtgctgggattataggcatgagccattgcgcccagcctggaatattttctaagctctttgatgatggcggcttcgatttaactctctctgacttaattctgttgattataatgtcattcaatcccattagtatactcatatggaaacaaaggcatgatttcagattttatttatatcttcatgctttggaaaaacaatttcatgagaaatcactcagcccatgaagtaccatccttgacattacttttttgggtttgcttgtttttaaaacagtttttattggcttttgctttttataattttttgaaccataccaacagtcgcataatgagtatttttagacatgtgcttttaaaatcatgtgaaaattcttttaatgtcaacatgaagagttttgtttataatcattgctgtgatcaagaactgaggtagaatttcctagctggacacaaatgggttaaaaaaaaaacccgacatgctctttgattattggataagttgtattctaaacaatattactctgatgaagatattaaggggagttaattagattgtgagactcttgaggacagttgatgcctttttcatttttgcattcttcttgggtgccgtgtagttgatcagtatagtcatgggacttagttctgattgtagggagctgtgtgaactgcatgaagcagacgagactccatcctcgcatgggaaacctttaaggattttgaagctgggcaggtgcaggttaatagaaagatcactctgggctctgtaggagagtgatttggagagaagagcccctagaggcccagggaacattgcaggtggctctgccaggagaccaggtagaagatgtggtgagggtgggcgggagatggatgaaactgtggatttcgtaggtacagattcatcatccttcatctgtagctacactattgaagaagacctccgaaaaccagaaggtgttttatttgtagttcatttggcaagaaaacttgagtttgacctgaactcatttggtgttgaagcctgacttgaacagctgggactcttttaaagtccttatgtatgtcaggcatccttcataaacatatgtatttactgcagggctattaatgtgtttgattaggggaaattgccctggatcttgctgttttttgttttcactgtaatatatgacttgtgctatataacttttctcaaatgggaagagttctggttcagcagcacctctggccctagggttttggaaaagaggttgtgaaactctttgacatgtgtttacaggataaggt

SEQ ID NO: 180 - DNA, 4053 bp, Homo sapiens
ttttttttcctttttgctgccactttcttacttaaaagaataaaaatcaaagccaaattcatcatagtaatcataataatggcaacaacaacaaaaaaaggagtaaaatagagttgtgaatgtttgctttgttattaaacatatcaactcattggagctgatttatataaagttaaatcctgctagaatagctggattccttcctacatgggtggggtgggaatgctgagatcctggtgtgggcattccatgccagggtagaaatttcctgctcaggcacttagtgaaggagccaactgagggaggataggtgatgtgcccgcccatccggtggcacccagtgacctgtgcacaccaccccccatctgcccaggacccagccatgttgttcattgtacccttttcagactgctgacctccaggagcacttgtcttaaagtcacatagctgtatttttcctctccagaaaaattttgaatgtattttctaaatagctgaggtcattgcatggtcttcagtgaacttagctacaagtgaatgtgacctggagtgacccagagtgagtgctggccagcataggtttcacattttctgtgtgaaagttcttcttttgttgtttgtgattaataactggatgggatataaagccaaatgatttcattgttgaacacagacttgaaggtcatgagaaactgcctgttcaaattacactttgccaagacatggaaaaaggtctgcatcaacacctgaatagttttagaaatacggtagagaaggaaaaaaatgacatgccacttgttatgtgatgtgaaagttgatttccacgcgatgcaatatcttgggtccttacaacatctgacctatgaggctgatgagtttgcactgagtcaggactttaaaacaaaggtgtattgaggacctactgtgtgccaggtcatttagaatgagtttttatgctaagtaatgtgttatatttatgcttattttgttaagtgctcagtttctcttaggttttgtattatgtgggtttgctattttttaaaaaaatatttttaattttttgggtatggtttgctatttgaaatatgattttgaataagtttctcagtacatagcacttttaattttatgtttttaaaagattttttaatggttatacataataattgatggacacacaatagtatttaaatctaaaaatagagaaaccatggcacacaaaacacagtatcttacagaactgtattatttgcttcttttctatgtgttttctaggcttttgagtcagatgttaggaaagagtctgtccatctttaattttctcacttcgagaagcactgaaatatttctatacatatgtccattggtatagcgacctaacacaactttaaaatcattttgaaattgacgcacagagagcttggttttccagaactggtgaggtgtaagatggttgaggactgacttggcctggtcggacctgtttctttgtagcattattactatttgtttattttccacctgggccttacatcttccctctcaagacagcgtctaggtcccaactcagttggtaggaatttgtgcagtagcaaacctgcagatgggcagagatacaaactcactcaactcacattacagtctttccctgtctaaaacaaacaagaaaacaaaacaaaaaagggagagatcatataggcgtgtatatatacaatattttgttatagataaggaacaaagtaccatatgaattcaaaaggtgagggtgggatgggtttagagctgggagagaaaccatctaaagccttcatgaaagggggtaccatttgctgtggatactgatggcaatgttggggctggaggaaaatgttccaggtagagggcacagaattaatagggggtagctataaaaagcatgctgaataccatgctaggtaggcatttagccctgtagcatatagatgtatctgaatttaaaggcagtgggtgatgttcggaggtttggagcataagatattttgtgatcagaagaaggtgaatctgtcagaggtgtttaggaagcaaatacaagggtagatagtatgggaggttattgtagtaccttgagagaatgctattgaggacctggatgttgaggttggtagcctgggaatatctgggctctgttgatgaattaaattgagttatggcaaagctctcttcgtggatttcaatatttgcgattccactgcttaaagctgagctcactcttcttttcggtgtaactgtgatggaaggaacttgcgtgtgagagtctccctcttgttgggtctgtgctattggtttgttgattaggaactcaattggtacctgcagaaattgcctctgattgggacctgcttctccccactgtctcccttatgtttccccctgagaggtaaaaggagtgatttgggtcaaatgtcctttgttttgggttggtttgtgtgggatgactcctggtgtagattttgtgtgtgggtgctaatgtacttatagccagctggggctagaagctcaggcacccacagctttgctctccccacttcgcgtttttacttctgattttctgtttcccaatttgtgattcacaggcagggatgactgactgagaagcgttgcagatgagtccgtgtatttgtttcattttgtgattgtttcaaattagcacaaatttgatggcttaaaacaacacaactttactatcttacatttctgaaggttagaagtctgacacgggtcttactgagctaaaatgaaggtgttgacagggccatgttccttctggaagctccagaggagactcctttccctggtcttttccagcctccacaggctgcccatgtttcttggctcatggctctctttagtcttcaaaaccaacagtggtgggctgagtccttctcatgtggctcgttgctcgctctgctattcaactctcttccttttccacttagaaggccccttgtgatttcactgggcacaccaggctaacccaagataaccttctatcctaaagtcagttgattagcaaacaatactttcatctgcaacctcaatttaccccttgctgtgtaacctaaggtactcacaggacatgggcctcttttgcaagtggagaggaagaagatgtattattctgcttgccacattgcgtagctcttgattttcacttcttttaaaaaagaacatctgcagaaagaattgagagtggtggataattctccaatcattcctgctttctcctgaaataaatttcatgcctttcttttagcagttgatttaataattaattttaaaaataatgttagaagaagcttttcctgttcatgtgtgtgttatgatgcatatgtttgtctgatgaaggggaaaaagggaaggaatgactcaagtactttcaactttagggccagcctaggattggaattctggagtagatcatgaggaggagatggtcaactttcttgtgacaaaagcatgtacataaaccacttaggattctccacttttcacattttattctgaaattgcatgcttcagttaatgtgatttaatggttttctctcagtgtcattggcaggattgttactaagcgacaaacattcaccacagtgttcaaatgtacttgggaagaaaatgagtagccaaactaaaagtgggatttaaataactccaattttatgaaaagtgaagaagttcagagattacttaaggtatttttttggtgatctgtggattcaatgatcatttcgttcatggaaggaagttttatttttatttttttctgagactgagtcttgctctgtcacccaggctggagtgcagtggcgtgatctcggctcactgcaacctccgcctcctgggttcaagtgattctcctgcttcggcctcctgcatagctgggactgcaggcatgtgtcatcacgcctggctaatttttgtatttttagtagagactgggtttcgccatgttggccaggctagtcttgaactcctgacctcaggtgttccacccgtctcggcctcccaaagtgc

SEQ ID NO: 181 - DNA, 4024 bp, Homo sapiens
acacccactgtgactatttacaatgtttgcatctcagcaaaaataccatttgtattctgaattcctttgtttcaactacataactcaataagaaagaaagtttcctacaattgaaaagaatagacagtgtttaaaggccaagttttgccttccttttaaggctgaatgtgctttattttaagccactcttcctcctcaagttaagaagggccttctggtatttctgtgcaaagcaccagtaatactgtttctttttaagttaatcatttttaatcctgcttattttatttagtgcctattgctatagcatctaatgagctcagcgcttctgacagtatgtcctatggatgcctgggggcagattgcctgggttggactctgctccagttcttattagttgtgtatgtcagctctgttttcccatctgttaaatgggatagtaatagccacaataatacctcatggctgttgtgaggattaaaataagaaaatgcaagtgaaagacagtccagaggatgggagaaaatatttgcaaattaggtatctgctaaaggtctagtatccgcaatagataaagaagtctttttattttttattttatttttttttgagatggagtcttgctttgtcacccagactggagtgcagtggtgtgatctcggctcactgcaacctctgcctcccaggttcaagcgattctcctccctcaacctcccaagtagctggtattacaggcatgcaccaccatgcctggctaattttggctaatttttctatttttgtagagacgtgtttcagcatgttggcccggctggtcttgaactctggacctcaggtgatatgctcaccttagcctcttaaagtgctgagattataggcgtgagtcatcatgtccagccaagaattcttataactcaacaatctaaagacaacccaattgaaaaatgagcaaaggaatagatatttctccagaaaagataaacaattggctaataattattgcccatgaaaagatggtcaacatcattagtcacttagggaaatgcaaatcaaaaccatagcgaaatttttctactttgtgcccactggtatggctgtaataaaaatggaaagaaatacgtgttggcaaggatgtgggaaaattagaaccttatattgcttgtgaaaatgtaaaatagtgtagcagttttggaaaatattttggcagttctacaaaaagttaagctttgagttatcatataactcagtaatttctctctaagttttctgcccaagaaaactgaaaacatatgttcacacaaaaacttgtacatggatattcataacagcattattcataataggcaaaaagtggaaacaaccaaaatgcccatcagccgacgaatggatcaacaaaatatggtcatttcatataatggagtattattcagccatacaggaaatacaggactgatacaagctgcaacatgcatgggccttgaaaacataatgctaagtgaaagacgtctggcacaaaaggtgacatatcctatgattccatttatatgaaatgtctgccactggaaaatccataaagagagaaagtaggctagtggtttattagggctcagaggctggcagggaatgggggagtaactgctaatgggtttctttctggggtgatgaaagtgtctggaattaagattggatgattgtcgcacaactttgtgcatacagtaaaaaaccacagaatcgtacatccgttaaatccggatggattttatggcgtgtgaattacatcccaatgacaaaaaataggataatagctgggaggtggtaccatgcccctaacatggtaagcactctatgtgttagttatttctgctgctgctgtcatcattttcattgttactacaaaatcaattccattcattattcctaaaaatatcaatttcttatggttatattatttctagttcttttcttcaaattacacaaatattagccactcagtgcttgcagaatattttcaaaggtctgcatttgtgaacaggtcctgggatggagagcctttgaattaccgtgggtgtatgtgttatccatttgcttacactgcatcttcttactataaaataaagtacttcttggcagatcatatggcatttatagatttttcttcttactttcttttatttgatttatataattgggtactctcaactcccgtgatggagagaaagcaaagaaaccaagaataggataacgctatggaatgcctcaatcttcttttagttttttatttttggttgaataattttagtttagttcatggaataaggtaaatattttacatttgttaataactccatactttgttctaggttcagtggcttacaaaaatatgtataacaaaacaaaattaaaaaatgaatcagtagagacaaaaagagcatggatgttaaaatgtaactaaaagatgccctgcacggtggctcactcctgtaatcccagcactttgggaggccaaggcgggcggataacttgaggtcaggagtttgagaccagcctggccaatatggtgaaaccccatctctactaaaaacacaattttttttttttttaggtggagtctcactctgtcaccaggctggagtgcagtggcgtgatctcggctcattgcaacctccgcctcccgggctcaagtgattctcttgcctcagctcccagagtagctgggactgcaggcacgtgccaccacacccagctaatttttgtatttttagtagagatgaggtttcaccatgttggtcaggctggtcttaatctcctgacctcgggatccgcccgcccctgcctcccaaagtgctgggattacagttgtgagctaccgcgcccagccttaaaaatacaaaaattaactgggtgtggtggcctgcgcctgtaatcccaggtacttgggtgactgaggcaggagaatcacttgaacctgggaggcggaggttgcagtgagctgagattgtgcctctgcactccagcctgggtgacagagtgagactccatctcaaaaaaaaaaaaaaaaaaagtaactaaaaggaaatacttaaaaaatactggaattcctcaatcttgatgaactatcctttccatgttttctcccatagttaaacaaggagtttttacttcttttgggcagtagctacatagtatgagacttctagtagtgcactatgctaacatcatcacacttgaatgttttttgaaaatattttacgtaaaatacatgtcccagatggactctattctttagttggttatctagaattaacatttggattatgtttgctaaatgcgtcagccatatcctaagcgctgtgatccttttagaactattaacagatgagactggggggcattttatggttataagagctaaatgatatttatgcaagtgtgtaaacattaataactcagcgtttataagcatgttagaatatttgattatggctagggaaatgcatattagctatctagcacagatctaaaagtgatctgggctatacctttcatttctggatttctttccttaagcttaaagggtgttctaatttcattattatcaatctcaagatcatttcacagtttcctggtggttgggtgtcatggtgactttttgttttccaggctctttgtttggatatgtggccttgtttgagttgtctttgattgctatatatctgtacccttgtttgcttttgcctggctactgattctcagtgtttcactttgacctttgataaagctgtgactctgattcatttttaggggggattcacctcgttggtggaatctagccttgccctgccaggcggctgcctgggtgttgcttgctggttggaatgtatccattgaaggccttagatgttggagtccttgcttcctagctccacctctttgtttcagggcaccactcttctggtctagtgcacagcctggtctctgtcaatcagcacgttctgcctggcgttttatggcatgttttcttccc

SEQ ID NO: 182 - DNA, 4029 bp, Homo sapiens
atccgccctcctcggcctcccaaagtgctgggattataggtgtgagctaccatgcccaggcttcccagtgtcattctgatttgaatttttctagaaagatttctagaatttttctagaatgattattgtatcctaaacatttatagcattatgttctttactttttattgcttagaaaaaaatagtttagttactactggtaatttgcaaattaaagaattatgtataaaattgctataggtgcctgtggttaaattcttttaccaagatttcacttctagagaactgaagaatttaccaaagtaaaaatggtctaactttattacttggtttatagaaatgaataaatcatagttaatagtacagtatattaataatactgtgctctaagctacagattagaaaaatatgcaccctgtttgtcacaataaatggagtgaccaaagctatagtatttcaaatctgtgactattatatatttttctataccaagtcacttctttttttgtttgtttgtttttgggacagagtcttgctctgtcacccaggctggagtgcaatggtgtgatctcagctcactgcaacctctaccttctgggttcaagtgattctcgtgcctcagcctccccagtagctgagattacaagcgtgcaccaccacacctggctaatttttgtatttcaatagagaaagggtttcatcatgttggccaggctggtcttgacctcctggcctcaagtgatctacctgcctcagcctcccaaagtgctgggattacaggtgtgagccacggtgcccggcctgtaccaagtaacatttctttctgtgtgcaggaatatacatgtgcttgttacagagttgagtttatcatattctatcaccatgtatttcccataaatctattaagttaaaatctgtgccacttatcaaagtttggagtgattacatatatatacataaccctatatgatctttgaattcagagccttgatgctagcctgagagtctgtgtgtatgaatgcaggtggcaagagtgaggcatggattgttgctattttttctaccggagtgccattattaacagtttcttttctgtatagtcactgtgaacactgttgtggggctgctccctgtgtgtggctctgcctcagaacccacagagtcggctggctcccagacctactctgtctctggttacaagtcagtgtcttatttactggaagttaaaagacagggcactgttgatttacactgtgcttcagcatgcccttattagtatttcttggttcttccatcagtgagtctctgatttcttcaccaaaaaataatcttgcagagagtcatgatcaaccctgtttttataaaacactgagctttggaaagggaaatgattactcatcacaactctaaacactaggataaaatgttcccatttagatcaatcaggggccaatttaattttctaatgaactttagaattgcttttgtggtctgcctttagggactattattataccagcttttcttctttttaatgtttctagaagtcaattttcatctttgccaagaattaaaggatccttaaacatgtggaaaagatgagaaaaacagtcagtggatcatcttgatgatgatggtcttgcaattttgcagaaggttgaaaaggcaatacatataacagattcatgttctttctattgaaatggacaagttagaggtctagattgaatacactctgtgtttagacttaataaacactttcaataagcttattcaatattttttaaattgacaacctgtattgggaactgcatatactatagagatcaaagttgacatttcttgccctcttgggcttacccaaaacaatatgtaatcaaattaagataagtactgggtgcacaaggaaggaaaacaggttgcctttagagactggaggagtcgtccagaagtccgctctgaagagaagatgtttaaaattaaacctgcaatgttcgtctgaattaagcaggttgagaacagggtgaaggaggcaggcatagcagcatgaaccaatatcccgaggcaggaaagggctgggtttgtcagagtaacatgaaggtcagtgtgctggagcaaactgaggagggtgagtgtttcaagacaaggcttggcataggagtggtcagatgattcagggccatatgaaccatgttaatttagttgttccaaagttcagagagttgattagaaggaataagaagagaatttaggagacagtgtcagaaggttattggctttaggctggaggcaagagatgacagtagcttggactgggggttgacagtggaactgaagagatgtggatggactcaagctgtatttaggaattagaaccaacaaaagttgatagaagggttagattgtggtattagaagaaaggattcatttcagcatcctggcatgaaccagtgaatggatgaaagtgcttttccgtagttgggaaagactagaggcagaatagatttgagagagaagcaacagttcagttttttgatgggttaaggttgaaatgagtctgtgagctatctcagtggagatgtcaagtaggtggttagttacatagtatgtgtttatctcttgctgcataataaattattatgaaacttagcagcaaatctatattagttatctattgctctgtaacaagtcaccccaacattggtgctttaaaacagcaaatatttattatctcatgcagtttccttggccaggaattttgaagtggtttagctaggtgattccagtccagggtctgtcatgagattgcactcaagatgctggccagggttgccatcatctgaagcttgaccgaggctagaggatctgattccaagatggcttatgtacatggcttttggcagaaggtctcagttccctgctggttctcggtcgaaggccacagtttctcgccacgtgggcctctctctagggtgcttgagtgtcttcatgacatggctgtgagcttctcttagagtgagagagatatgaaagaatgcaaaggggaagctgtaatacttttagtctcaaaagtccgactcatcacttctgccatattctattcagtagaagtgagtcaccaatttcagcccatactcagtgggtggggaattaagccccccgcttgaatagacagccaccaaataatttctgaatgtattttaaaaccaccacacatgattttgtaattgagaagaaaggtttgggctggaaataagacattaggagttttgcacatagatgctgtggagtgagtagatgcgtgaccacttagtaaaagtgtgaagaggtccaagactgatcctttaggaaatctaacttgtagaggatctgctgtggaggagtggaggagaaggaagaaatggaatctgggaagatgagaagaatttttcaggcagggagtgttctattctgtggaagcctactggaatgtgtatttgactttcatttttaagaatttattctctgaatgaatgaagaatgaataaataaatgtcatgtatatgttcaaaattttaattctaagtatgattgttattgaaatgcttataaaattaagaatggaaatcagcattaggaatgcataataacagagtgggagatattggtaaaaaattatttaatgtccagacaataaaatacctatgaagctttaaaatgacattattaaagaatgtgcactgtaataaaaacagatttataaagtattttaaataaatataaaatactatgtaaggaagaagcagacaaaaatgtctaggaggatgtatataaacctgttaatactggttatctctgggcagagggaaaatgggtggtttaagtttccttcctttggtttgtctaaatcttccttaataaatggaaattgcttttgtaataaaatgtttgaaaatatcccctcccaaaataaagaaaaataatgaaaataatgatagttgaaactcaattgaggggcccggcatattggctcatgcctgcaatcccagc

SEQ ID NO: 183 - DNA, 4355 bp, Homo sapiens
ccctgctttatgcctggtccccaaagtgagcagaagtgaggcaccttgccctctaaagcaattcctttctttttttctttctttttttttttcatttgaaggatttcttttttaaacttttattttaagttaaggggtacatgtgtaggtttgtttcatgggtaaatgtgtgtcacaggatgggggtttgtttacggattatttcatcatccaggtattaagcctagtatccattagttatttttcgtgatcgtttccctccccccaacctccaccctccaatagaccccagtgtatattgttccctgctatatatccatgtgttgtcatcatttagctcccacttaaaagtgagaaatgtggtatttggctttctgttcatatgttaatttgctaaggataatggcctccagctccatccatgtccctgcaaacaacatgatctcattccattttatggctgcatagtattccatagtgtgtatatgccacattttctttatccaatccaccactaatgggcatttaggttgattcaaagtctttgttactgtgctgcaatgtctttgtaacagagcaatttatattcctttgggtgtataccctgatatggcttgtctgtgtctccacccaaatctcatcttgaattcccaggtattatgggagggacccagtgggagtaattgaatcatggaggcaagtctttcccatgctgttcttgtgatagtgaataagtctcacgagaactgatggttttataaagaggcgtttccctgcacaagctctctctttgcctgctgccatccatgtaagatgtgacttgctcctccttgccttccaccatgattgtgaggcttccccagccacatggaactgtaagtccattaaatctctttctttggtaaattgcccagtcttgggtatatgtttatcagcagtgtgaaagcagactaatacatactcagtaatgggattgctgggtcaaatagtatttctgtctttaggtctttgaggaattgctatgttgtcttccacagtgtttgaactaatttacactcccaccaacagtgtgtaagtgttcctttttttcttcaacctcgctagcatcttttattttttgcctttttaataatagccattctgactggtgtgaaatttatatcattgtgtttttggttggcatttctctaatgatagtgatgttgagctttttttaatatgcttggccacatgtatgtcttcttttatttaaagcaatttcacataagctacagcgatgttcttaagtcttgggaaaacagagggcatactttaaaatgtaggttctgtgaaggcagttgtgcaggcacagggtagattcctatatgtggcttaggtaagctttgtgatgatttggtataacaaagtggtaaagtttttattatcttgagaatacagcagttggtattcccttagaccagattccttcacatctctggatgactgggctgcacctgattccttaagcctggctggagtcaaggagtctgtattctaagacaattctccaggggattctgatgttttgctacatctgggaatttgtgcagtgtactattctttttgaccatgatgacagttgggttttattgagaattaaccatgtggctcttgccgcatgctgattattatctttaattctcataacaattgtttaagggttgcatttttaccctctttgtatataggagaaaaataaattgttcaagacataaagcagtcaaaaagcagttccataaagtagttgggagctgagttttaccttataaggctgttgggatcaaatgagataatgtgtacaaagtggttagccctgtgtctggcacatagaaagtgtttaataaatgtcagttttattatgagaaaacatgattcatggatggagactctgatagcatccttagtgcatgcatctccctattccagtcatctgtccttcagtgttacgttttagatcagagttataggacatgtcaggcttattttatcttattttcttttatgagacaggttctcactctgtctcccaggctaaagtgcagtggtgtgatcatggctcactgcagcctcgaactcttgggttcaagtgatcctcccaccccaccctcccaagtagctgggaccacaggcatatgccaccacacccagctaatttttgtactttttgtagagacagggttttaccattttgcccaggctggtctcgaactcctgggctcaagtgatccactcgccttagcctcccaaagtgttgggattacagacatgagtcattgcgcccaggccatttcagcctgtttaacattccttttgcagagctggaacatccaactccaacttgtagaccagaaatactcctgaatttctttcctcagacttatctcagtggcaccagattgagttaggattgagtttagctgcaagtaagagaaacccttttacgatagattaactaagaaagaactcatttttctcaagtaagcttcagtctgtaggtaggcaacccagggctggttacctgctcagggaaactggcagcttctgtcttcctggaggaagcagaaaggcccagggcaagatgttcatgccagccaagtctgttaatttttatcagggaaataatagttctcctgggtcttccacccaatatacttctcccctcctctgggcggaattgagccaaatggttatctctagttgcaaggcaaggtgaatattttaactggccaccttgctacagggaaaaaaaatgggattaatcttgtaagtgagaaggagagaaaggatgcttgagtaggcaactagcagtgtgtaccatagtgagttccagcaaatagttctatcttaaataccatgtctagaggcatgatcagagtgaaaacaattctgattctagaattcaggttacctgtaattatattctgaaagaatgataggttgaaaatatgagtattaaaagacaaaattggaaccaagtacaatttctccatttgtcttataggggaatatatgaaaagttgagataaattaatctcttttcttcaaaaaaataacactgtgaaatgaacatgaaaaatgtttattgcatctggtttttttcctctatgttttatttcagtaaaatacagataacataaaatttattattttagccatttgaaatgtacatacatcttgttatataaccatcactaccatcgttctcctgaattcttttcttgttgaaaaactgaaaatatatacccattaaaccaggggtccccaagccctgggccacaggtcgctactagtctgttgcctgttaggaggcgagtcacacagcagggggtgagcggtgggtaatcgagcattacctcctgagctctgcctcctgtcagatcagcagcggcattcgattctcataggagcacgaaccctattgtggactgtgcatgtgagggatgtaggtcgtacactccttattagaatctaactaatgcctgatgatctgtggtgaaacagtttcatcccgaaaccactcccccactgcctcccccactgccccgcccatggaaaaattgtctttcacaaaaccggttcctttttggtgccaaaaaggttagggaccgccacattaaacaacaactcctcactcctctctcctcctagcccttggcaaccaccattttactttcactattctaggtacctcatgtaagtggaatcataccatagttttctttatgtgactggctgtgtcacttagcacactgtcctccatgttcatccatgttgtagcatgtgtctgaatttcctttctcttcaaggctggttattattccattttatgtaaatatcacattttgctaattaattgatctgtttgtggacacttgggttgcttccatcttttagcttttgtgaatagcgttcctattaacatggatgtacaaatatctctgagattctgctttcagttcttctggttatatcattgcatatgctttttactcagatcccgtttctccttgacataaccctaggtaatggtagttagcttactcttatcttgagggaaatgctaaagttttgaggaaagatcattcatccaaatctttttgtttgattgactcttgctaacctccaagaaaaatttgtgatcacgagttatattttatacagtccataggttcagggaagggagtaattctagtgttcctaaaagatgccattgcagtgctgtaatgcagaaaaacgctaggttttggggtgtccttaggaaggagacaagaaagaaaacagagaacgttatccttcctttgcaaagccatgttgac

SEQ ID NO: 184 - DNA, 4033 bp, Homo sapiens
tcgccttagcctcccaaagtgttgggattacagacatgagtcattgcgcccaggccatttcagcctgtttaacattccttttgcagagctggaacatccaactccaacttgtagaccagaaatactcctgaatttctttcctcagacttatctcagtggcaccagattgagttaggattgagtttagctgcaagtaagagaaacccttttacgatagattaactaagaaagaactcatttttctcaagtaagcttcagtctgtaggtaggcaacccagggctggttacctgctcagggaaactggcagcttctgtcttcctggaggaagcagaaaggcccagggcaagatgttcatgccagccaagtctgttaatttttatcagggaaataatagttctcctgggtcttccacccaatatacttctcccctcctctgggcggaattgagccaaatggttatctctagttgcaaggcaaggtgaatattttaactggccaccttgctacagggaaaaaaaatgggattaatcttgtaagtgagaaggagagaaaggatgcttgagtaggcaactagcagtgtgtaccatagtgagttccagcaaatagttctatcttaaataccatgtctagaggcatgatcagagtgaaaacaattctgattctagaattcaggttacctgtaattatattctgaaagaatgataggttgaaaatatgagtattaaaagacaaaattggaaccaagtacaatttctccatttgtcttataggggaatatatgaaaagttgagataaattaatctcttttcttcaaaaaaataacactgtgaaatgaacatgaaaaatgtttattgcatctggtttttttcctctatgttttatttcagtaaaatacagataacataaaatttattattttagccatttgaaatgtacatacatcttgttatataaccatcactaccatcgttctcctgaattcttttcttgttgaaaaactgaaaatatatacccattaaaccaggggtccccaagccctgggccacaggtcgctactagtctgttgcctgttaggaggcgagtcacacagcagggggtgagcggtgggtaatcgagcattacctcctgagctctgcctcctgtcagatcagcagcggcattcgattctcataggagcacgaaccctattgtggactgtgcatgtgagggatgtaggtcgtacactccttattagaatctaactaatgcctgatgatctgtggtgaaacagtttcatcccgaaaccactcccccactgcctcccccactgccccgcccatggaaaaattgtctttcacaaaaccggttcctttttggtgccaaaaaggttagggaccgccacattaaacaacaactcctcactcctctctcctcctagcccttggcaaccaccattttactttcactattctaggtacctcatgtaagtggaatcataccatagttttctttatgtgactggctgtgtcacttagcacactgtcctccatgttcatccatgttgtagcatgtgtctgaatttcctttctcttcaaggctggttattattccattttatgtaaatatcacattttgctaattaattgatctgtttgtggacacttgggttgcttccatcttttagcttttgtgaatagcgttcctattaacatggatgtacaaatatctctgagattctgctttcagttcttctggttatatcattgcatatgctttttactcagatcccgtttctccttgacataaccctaggtaatggtagttagcttactcttatcttgagggaaatgctaaagttttgaggaaagatcattcatccaaatctttttgtttgattgactcttgctaacctccaagaaaaatttgtgatcacgagttatattttatacagtccataggttcagggaagggagtaattctagtgttcctaaaagatgccattgcagtgctgtaatgcagaaaaacgctaggttttggggtgtccttaggaaggagacaagaaagaaaacagagaacgttatccttcctttgcaaagccatgttgactgtgcacatggattacgatctgagattctggtctcctacttaaatgatttaacagtggaaggtattctagtgaaggaaacccaagtcccggagcgaatgcatttgttacttttgtaaaactgactaaggtgatcagtactcttcagtctaaaaatatgaaagtggaaagaagacatacttaccagctataagcttatttcagaaaagcaaacataaacttattcttctaaccttcaacagttatctggactttttgatgcttaaaagaccagcaaatgttcaagacaaatgagaggaagagctattttacactgaagatataattagcaagtttgcagtacccagtgatagtatagactgaatttacaaattttttcttttaaaggcaataaatgtcagactcacagtagactattaaataaagacagtgctgccagaactctatttttttttttttttcttttgagacggagtcttgctctttcgctcaggcttgagtgcagaggtgcgatctcggctcagtgcaacctccgcctcttaagttcaagtgattctcctgcctcaacctcctgagtagctgggattacaagcgcacaccaccacacctggctaatttttgtatttttagtagagacaaggtttcatcatgttgaccaggctggtcttgaacttttgacttcagatgatccacctgcctcagcctcccaaagtgctgggattataggcatgagccactgtccccggcccagaaccctaatttttaacagtgacaagaagttaacatgaaggaagtcattaggaaagtgagtggcctgtaaatgaagtttcttgcgcttttgctcaggcaatggattttatctgtccccctcatccaaccctacctgaatgagctttttaattaaaaaattcattagtaaggctgggagcagtggttcatgcttgttatcccagcactttgtgtggtgtaggcgggcggactgcttgagccccggagttcgagaccagccagggcaacatggcgaaacctcgtgtctacagaaaaatacaaaaattagccaggcatgttggcacatgccctccaggtacctgggaggcagaggtgggagaatcgcttgagcctcggaagttgaaggctgcagtgagccgtgatcatactactgcactcaagcctaggtgacagagtgagactctgtctcaaacaaacaaacaaaaagtattagtagtttatgtgaaccttttcatagttatgaaaattaaaaataagaatatgtatttttcaatatgagactaaacctttcaattattttatttattaacttccaatttatacccttttaggcaaagagttctgtgatttatgggccaatttttaaactgtgatgtccatgggaagaaatttttagccctgagttttgaaggggaatgcagtgttcctttctgacttgtttttcctgcttattataaatatttatcttggacaaaggattgcattttagcggatgtgcaattttacaaatttaattattaaaatgactcttcttcctttttttatgatcttacattttgtttttaacttgtcatggcggatattaaaacactccaaataaagacaaaaaaactcaatataaaaaaaaaccaaaaaccacttccgaaatactccattttttcttatttaaaaaaatgctatttatagtagtagttggcatttcatcaaagtacataagcaaaggacagatactcctcattttttcccaggtttctattctttttctgaaagtgagtaaaatattaggctttggagaaagtctaggtagtttggtgtgatctgttggtagcattttgttttgccttaatcttctatttttttcttcccattttatttatttatttttttgagatggaggctcattcactttgtcgcccaggctggagtgcagcggcgcgatc

SEQ ID NO: 185 - DNA, 4050 bp, Homo sapiens
ggcaagatgttcatgccagccaagtctgttaatttttatcagggaaataatagttctcctgggtcttccacccaatatacttctcccctcctctgggcggaattgagccaaatggttatctctagttgcaaggcaaggtgaatattttaactggccaccttgctacagggaaaaaaaatgggattaatcttgtaagtgagaaggagagaaaggatgcttgagtaggcaactagcagtgtgtaccatagtgagttccagcaaatagttctatcttaaataccatgtctagaggcatgatcagagtgaaaacaattctgattctagaattcaggttacctgtaattatattctgaaagaatgataggttgaaaatatgagtattaaaagacaaaattggaaccaagtacaatttctccatttgtcttataggggaatatatgaaaagttgagataaattaatctcttttcttcaaaaaaataacactgtgaaatgaacatgaaaaatgtttattgcatctggtttttttcctctatgttttatttcagtaaaatacagataacataaaatttattattttagccatttgaaatgtacatacatcttgttatataaccatcactaccatcgttctcctgaattcttttcttgttgaaaaactgaaaatatatacccattaaaccaggggtccccaagccctgggccacaggtcgctactagtctgttgcctgttaggaggcgagtcacacagcagggggtgagcggtgggtaatcgagcattacctcctgagctctgcctcctgtcagatcagcagcggcattcgattctcataggagcacgaaccctattgtggactgtgcatgtgagggatgtaggtcgtacactccttattagaatctaactaatgcctgatgatctgtggtgaaacagtttcatcccgaaaccactcccccactgcctcccccactgccccgcccatggaaaaattgtctttcacaaaaccggttcctttttggtgccaaaaaggttagggaccgccacattaaacaacaactcctcactcctctctcctcctagcccttggcaaccaccattttactttcactattctaggtacctcatgtaagtggaatcataccatagttttctttatgtgactggctgtgtcacttagcacactgtcctccatgttcatccatgttgtagcatgtgtctgaatttcctttctcttcaaggctggttattattccattttatgtaaatatcacattttgctaattaattgatctgtttgtggacacttgggttgcttccatcttttagcttttgtgaatagcgttcctattaacatggatgtacaaatatctctgagattctgctttcagttcttctggttatatcattgcatatgctttttactcagatcccgtttctccttgacataaccctaggtaatggtagttagcttactcttatcttgagggaaatgctaaagttttgaggaaagatcattcatccaaatctttttgtttgattgactcttgctaacctccaagaaaaatttgtgatcacgagttatattttatacagtccataggttcagggaagggagtaattctagtgttcctaaaagatgccattgcagtgctgtaatgcagaaaaacgctaggttttggggtgtccttaggaaggagacaagaaagaaaacagagaacgttatccttcctttgcaaagccatgttgactgtgcacatggattacgatctgagattctggtctcctacttaaatgatttaacagtggaaggtattctagtgaaggaaacccaagtcccggagcgaatgcatttgttacttttgtaaaactgactaaggtgatcagtactcttcagtctaaaaatatgaaagtggaaagaagacatacttaccagctataagcttatttcagaaaagcaaacataaacttattcttctaaccttcaacagttatctggactttttgatgcttaaaagaccagcaaatgttcaagacaaatgagaggaagagctattttacactgaagatataattagcaagtttgcagtacccagtgatagtatagactgaatttacaaattttttcttttaaaggcaataaatgtcagactcacagtagactattaaataaagacagtgctgccagaactctatttttttttttttttcttttgagacggagtcttgctctttcgctcaggcttgagtgcagaggtgcgatctcggctcagtgcaacctccgcctcttaagttcaagtgattctcctgcctcaacctcctgagtagctgggattacaagcgcacaccaccacacctggctaatttttgtatttttagtagagacaaggtttcatcatgttgaccaggctggtcttgaacttttgacttcagatgatccacctgcctcagcctcccaaagtgctgggattataggcatgagccactgtccccggcccagaaccctaatttttaacagtgacaagaagttaacatgaaggaagtcattaggaaagtgagtggcctgtaaatgaagtttcttgcgcttttgctcaggcaatggattttatctgtccccctcatccaaccctacctgaatgagctttttaattaaaaaattcattagtaaggctgggagcagtggttcatgcttgttatcccagcactttgtgtggtgtaggcgggcggactgcttgagccccggagttcgagaccagccagggcaacatggcgaaacctcgtgtctacagaaaaatacaaaaattagccaggcatgttggcacatgccctccaggtacctgggaggcagaggtgggagaatcgcttgagcctcggaagttgaaggctgcagtgagccgtgatcatactactgcactcaagcctaggtgacagagtgagactctgtctcaaacaaacaaacaaaaagtattagtagtttatgtgaaccttttcatagttatgaaaattaaaaataagaatatgtatttttcaatatgagactaaacctttcaattattttatttattaacttccaatttatacccttttaggcaaagagttctgtgatttatgggccaatttttaaactgtgatgtccatgggaagaaatttttagccctgagttttgaaggggaatgcagtgttcctttctgacttgtttttcctgcttattataaatatttatcttggacaaaggattgcattttagcggatgtgcaattttacaaatttaattattaaaatgactcttcttcctttttttatgatcttacattttgtttttaacttgtcatggcggatattaaaacactccaaataaagacaaaaaaactcaatataaaaaaaaaccaaaaaccacttccgaaatactccattttttcttatttaaaaaaatgctatttatagtagtagttggcatttcatcaaagtacataagcaaaggacagatactcctcattttttcccaggtttctattctttttctgaaagtgagtaaaatattaggctttggagaaagtctaggtagtttggtgtgatctgttggtagcattttgttttgccttaatcttctatttttttcttcccattttatttatttatttttttgagatggaggctcattcactttgtcgcccaggctggagtgcagcggcgcgatcttggctcactgcaacctccgcctcctgggttcaagagattctcatgtctcagcctcctgagtagtggaaattacaggtacgtgccaccatgcctggctaatttttgtatttttagtagagatggtgtttcaccatattgtccacttcttgaactcctgaccttaagtgatcctcctgccttggcctcccaaagtgctgagattacaggcatgagccaccatgcccggccttcttcccattttaataactaatgattttgccttaaaatacttgaatttattgcaaaaggtgtattttaaatgattcagctccctcttccacggtgtttctgtagtgaatagactggaagctgggaagaa

SEQ ID NO: 186 - DNA, 4055 bp, Homo sapiens
ttatggcaggccaggttattatgaagaagcacccaggagctatgatacatacacagcagtacggagagaaaaagaacagcttgtgagagcatgaagagccagcccctgggatcaagaaaataccaggaatagctcactgccctgcgggcttcttctctcagaagaaatgagactataatggcttcacaggtttgatagccagtgaggtgacacagcatcttgggaagacatggtccacttgtgttattattgcccatcggattcattccccaagcaactagttcattgtaaactaaagcaaaacatatcgttaaaaaaaaaaaatcaacttgtatttagctttttacagagtgaagtgaaactctgttttaaatgcggtttttagctttaataacgtcaaggtttaaatgtggcaaactcacaaaaatatcatttgaaatgttaattatctaaacttcttgtacacttaggtagttttgacaattctgaaaactacatttttaattttggcttttttaaggtcctctgaggatgtcggattttgaaagaaactcagggaggttaaacatttctgtttgagagcagtctgtatcctgttggctttgtttctttgtctacatacatatttataatattttacagattattatataatatttattattcccatttgacattttaataaatattgtttgaataaatgaattagtgtttgggtgtgattgggtgtgatgaaacaagagagcataatggcataactaagtgtgagtggcagaattatattgggagtgattcacatgtagggcccacaaaaagaagaaatgagaatatgatctgaaatgcttttgttacttccaaaataataatctttgctaacgagagattggctttctagggtgtgttaagttttgcatttgtgaaagaggccttaataaaatcaatccaagtttaaaatcatccaataagagatttctttcttggctaaaggtctaggtgctactttcctgaataataagctgcactttagggaactcatgttatgttagtgtcagccaactggacactcttaaattgcttcaaatggtgtactagaggataatgctttctctctaataacagtagagttttagaggtgatttgtgtgctttcataggggaaacaactcctaatttctctgccacatttccagtttaggatttaaattgatatatgttgctacgttctgctaaaacaattttccatacccatttgagctggtgaagtgaaaacattttgaaaccagtttccttgaagatttatcaagcagttttgttgatgtgtcttgctatacttcttttacctatcacagaaataaaatcccaggctaggcagcagtgaaggcctttggatctgtgtgagcatgtcaaaagcattttaagaagagcaaaatatttagaggaagaatttgggaaagcagccttaagggatttaacacatttttcttcttctaattcagtctcgtgttcatccctctaatggagaaaggtcattaatggataagatttgctaagccagcaaaggcttttagaaacaaaatggttttcaaaaatccaagcctaaggaaaacagggtttgaatttgggagcttgaaagaatacatttagagaaggtgtatatgcagtgtaaattatattcattcacttaatattatacatatatatttataatcaagttatagtatgtttgttgcattcttacacatttttgttttggagaagttaaaataacgaattggcttgataatgaagattgaaataatttcagactgtggaagttctgtataaatttctaggcagacaaaatggctgatcagaatagcatgacggagttttagttgtcctgttactcgtctgctatttttacgtgcccgagatctgggccaagattgtttaccttaattgttgtgatgtggaggttagtaagtgtgtgaaatttgttacatttcaatctcataattgaaaagccacaggcaaattcttgttcttttactgaattcctgtctagtagaaaataagaagtatgtgtgtttgtatgtgtgtgtgtgtctgaaaaaaggaaaatgcaaactagtctttgaaatatgtactcccttttccccatttttaactgtatcaagagaatgaatgcggaagtgtgtttataaactttgaagtatttttgaaacatttggatgttagaaaatgtatcgtttacaggcaaataatttgtctgttacttagacttatattctgacattgacttgacccataaaataaagactattgttgaaatattatcttactcatttttacaaacataagaatgggaatccataaattttatttcatttcatatgtgataaaatggaaagattattatcattgatagggtaatagtgctcatttctttgcccactttatatctggggagaaacctacatagtattagatattttaatatgtttttgaaataagaaagttaaatgctccggaaacaggttaagaaaatgtaaaatgtagtaagatttctctcttagaattttttccatttttatggccccaaattcttaagttgtgtgaatgttatcaaattaagataatttaatacttatttatgacctttctatatttttttattcatgggattaaatgaaactgcatataacaagatttatgaaaataaatcctttttaaggtagtgggacaaataattggattttccaaatgccctaaacactgatttttaatattaaattcattttggtgaggctggtatatccccccttcaggttgatgtgtggtggtagccttatattctgagtataatctctactgtgtccctctttgatatgaagatggtaaagggtcattcactgtgtaagcaagttctcttggttaataaatggcttatgtggccttgatcagataatataaagcttgaaatagggatcgttgctgtctttgctgtcctttcttgaaggaaggtcacctctgagcaccattaatatcaaggagtttcttaaacagcagttttgttttctataccacttgctcccttagtgtcttggagttggtctccaattacctttatggatttgtaaaagtgcatttttttttttctgaagctgctgctatatttattctgggaatgaccttttaattacaaactctccttccacaagggggtaaggaccgaagaccacaaactgggtgaagtggtaggcgaacctctaatgatcctagcagaggttcgtgagcaggtctgtatttaatgtggaactgacactggagggccaagcacacctgggcttcctccattattattttgctgctctgatgtgggaggcagcccagcagtataaaaggtggcaaaggaggcaggacacacatatggatggagccacacctttctgcactgtcgcagatacgccttggacagctttctgaacaactgatagagattgtgaaaatgctgttttgtaggatttaagccaacaatgactcttttactggctttaatagaaaatcgtggagtgatggaagagtatgatttgaagaggtccaatgaatatttatttatctaccttgcttacacttttactgtaatcattataacaacgagctgaacaccagctcttcgtcaagtgcttttcatttatattcactaacctttacaatactcttgcaagctaggtattatttatccccattttacagatgagaactgtgaggaaaagcgatgttataatgacccaaggtcacacaataaatggattgggacaccgtctatttggttctaaagagaaagtccttttctctttttgttagccacatggactccttgtatgtaaccaaatccttctacccatatttcaaaagttcagggtggtcagtcttttaaagtaacttttcttttttttatggctcagaaaatgaatttgtaatcaaaaccaaaacggataatggttttaaattcttctgatttttctacctgtaaaagttcgtatagatcaagatcattaaaacctcatgccaatc

SEQ ID NO: 187 - DNA, 4047 bp, Homo sapiens
tgtgttaagttttgcatttgtgaaagaggccttaataaaatcaatccaagtttaaaatcatccaataagagatttctttcttggctaaaggtctaggtgctactttcctgaataataagctgcactttagggaactcatgttatgttagtgtcagccaactggacactcttaaattgcttcaaatggtgtactagaggataatgctttctctctaataacagtagagttttagaggtgatttgtgtgctttcataggggaaacaactcctaatttctctgccacatttccagtttaggatttaaattgatatatgttgctacgttctgctaaaacaattttccatacccatttgagctggtgaagtgaaaacattttgaaaccagtttccttgaagatttatcaagcagttttgttgatgtgtcttgctatacttcttttacctatcacagaaataaaatcccaggctaggcagcagtgaaggcctttggatctgtgtgagcatgtcaaaagcattttaagaagagcaaaatatttagaggaagaatttgggaaagcagccttaagggatttaacacatttttcttcttctaattcagtctcgtgttcatccctctaatggagaaaggtcattaatggataagatttgctaagccagcaaaggcttttagaaacaaaatggttttcaaaaatccaagcctaaggaaaacagggtttgaatttgggagcttgaaagaatacatttagagaaggtgtatatgcagtgtaaattatattcattcacttaatattatacatatatatttataatcaagttatagtatgtttgttgcattcttacacatttttgttttggagaagttaaaataacgaattggcttgataatgaagattgaaataatttcagactgtggaagttctgtataaatttctaggcagacaaaatggctgatcagaatagcatgacggagttttagttgtcctgttactcgtctgctatttttacgtgcccgagatctgggccaagattgtttaccttaattgttgtgatgtggaggttagtaagtgtgtgaaatttgttacatttcaatctcataattgaaaagccacaggcaaattcttgttcttttactgaattcctgtctagtagaaaataagaagtatgtgtgtttgtatgtgtgtgtgtgtctgaaaaaaggaaaatgcaaactagtctttgaaatatgtactcccttttccccatttttaactgtatcaagagaatgaatgcggaagtgtgtttataaactttgaagtatttttgaaacatttggatgttagaaaatgtatcgtttacaggcaaataatttgtctgttacttagacttatattctgacattgacttgacccataaaataaagactattgttgaaatattatcttactcatttttacaaacataagaatgggaatccataaattttatttcatttcatatgtgataaaatggaaagattattatcattgatagggtaatagtgctcatttctttgcccactttatatctggggagaaacctacatagtattagatattttaatatgtttttgaaataagaaagttaaatgctccggaaacaggttaagaaaatgtaaaatgtagtaagatttctctcttagaattttttccatttttatggccccaaattcttaagttgtgtgaatgttatcaaattaagataatttaatacttatttatgacctttctatatttttttattcatgggattaaatgaaactgcatataacaagatttatgaaaataaatcctttttaaggtagtgggacaaataattggattttccaaatgccctaaacactgatttttaatattaaattcattttggtgaggctggtatatccccccttcaggttgatgtgtggtggtagccttatattctgagtataatctctactgtgtccctctttgatatgaagatggtaaagggtcattcactgtgtaagcaagttctcttggttaataaatggcttatgtggccttgatcagataatataaagcttgaaatagggatcgttgctgtctttgctgtcctttcttgaaggaaggtcacctctgagcaccattaatatcaaggagtttcttaaacagcagttttgttttctataccacttgctcccttagtgtcttggagttggtctccaattacctttatggatttgtaaaagtgcatttttttttttctgaagctgctgctatatttattctgggaatgaccttttaattacaaactctccttccacaagggggtaaggaccgaagaccacaaactgggtgaagtggtaggcgaacctctaatgatcctagcagaggttcgtgagcaggtctgtatttaatgtggaactgacactggagggccaagcacacctgggcttcctccattattattttgctgctctgatgtgggaggcagcccagcagtataaaaggtggcaaaggaggcaggacacacatatggatggagccacacctttctgcactgtcgcagatacgccttggacagctttctgaacaactgatagagattgtgaaaatgctgttttgtaggatttaagccaacaatgactcttttactggctttaatagaaaatcgtggagtgatggaagagtatgatttgaagaggtccaatgaatatttatttatctaccttgcttacacttttactgtaatcattataacaacgagctgaacaccagctcttcgtcaagtgcttttcatttatattcactaacctttacaatactcttgcaagctaggtattatttatccccattttacagatgagaactgtgaggaaaagcgatgttataatgacccaaggtcacacaataaatggattgggacaccgtctatttggttctaaagagaaagtccttttctctttttgttagccacatggactccttgtatgtaaccaaatccttctacccatatttcaaaagttcagggtggtcagtcttttaaagtaacttttcttttttttatggctcagaaaatgaatttgtaatcaaaaccaaaacggataatggttttaaattcttctgatttttctacctgtaaaagttcgtatagatcaagatcattaaaacctcatgccaatcttactacaggaaaatgggttacaagattgaccataaaccttatactgtcattctagagggtgtaggaccagtatgaagagggaggaagtcacgaattcctgagtttttattggataactttaatttttgtttttagcatgctgacattttgattatgctgaaattttacttgcacaaaatgtagcagaaagtgctacgggtactagctggaaagtagggctctgatttgatccgataaacctggatttggtcactgatggcaggactccggggtttagggtgagacaacctggtcccttgggaaaggtgcccgagcctccctctgttgtaggcagtgttgggctccataagtgtaccgggcagtcatcacattctgcattagctccgcctcattgtgctcaaggagctcgactaataggactattttaaactctccaggatagagataaccttatttggtgctttactaaaggtacagactctcatactttttccttctctttctttttccattccacagatgaacacaatgacgtacagaagaaaacctttaccaaatggataaatgctcgattttcaaaggtaactgagactttcaaaaacttcgatggttcagatgccgcattctgattgaaggagtttggttggaagtgcagtgaattttccccaggaaatgtcacctagccgaagtcttctgagtatgcagatacatttgttgttcctttattctgtcctaaaatatgtttaaacggaaattctcatgcacatagtttatgggacgctattgacttttacctggccttctccagatatctaaggcagcagttagctgctttcgattctgtgaatcctgggtacatcttggaaaagaatatatcattgggaaaat

SEQ ID NO: 188 - DNA, 4041 bp, Homo sapiens
atgaccttttaattacaaactctccttccacaagggggtaaggaccgaagaccacaaactgggtgaagtggtaggcgaacctctaatgatcctagcagaggttcgtgagcaggtctgtatttaatgtggaactgacactggagggccaagcacacctgggcttcctccattattattttgctgctctgatgtgggaggcagcccagcagtataaaaggtggcaaaggaggcaggacacacatatggatggagccacacctttctgcactgtcgcagatacgccttggacagctttctgaacaactgatagagattgtgaaaatgctgttttgtaggatttaagccaacaatgactcttttactggctttaatagaaaatcgtggagtgatggaagagtatgatttgaagaggtccaatgaatatttatttatctaccttgcttacacttttactgtaatcattataacaacgagctgaacaccagctcttcgtcaagtgcttttcatttatattcactaacctttacaatactcttgcaagctaggtattatttatccccattttacagatgagaactgtgaggaaaagcgatgttataatgacccaaggtcacacaataaatggattgggacaccgtctatttggttctaaagagaaagtccttttctctttttgttagccacatggactccttgtatgtaaccaaatccttctacccatatttcaaaagttcagggtggtcagtcttttaaagtaacttttcttttttttatggctcagaaaatgaatttgtaatcaaaaccaaaacggataatggttttaaattcttctgatttttctacctgtaaaagttcgtatagatcaagatcattaaaacctcatgccaatcttactacaggaaaatgggttacaagattgaccataaaccttatactgtcattctagagggtgtaggaccagtatgaagagggaggaagtcacgaattcctgagtttttattggataactttaatttttgtttttagcatgctgacattttgattatgctgaaattttacttgcacaaaatgtagcagaaagtgctacgggtactagctggaaagtagggctctgatttgatccgataaacctggatttggtcactgatggcaggactccggggtttagggtgagacaacctggtcccttgggaaaggtgcccgagcctccctctgttgtaggcagtgttgggctccataagtgtaccgggcagtcatcacattctgcattagctccgcctcattgtgctcaaggagctcgactaataggactattttaaactctccaggatagagataaccttatttggtgctttactaaaggtacagactctcatactttttccttctctttctttttccattccacagatgaacacaatgacgtacagaagaaaacctttaccaaatggataaatgctcgattttcaaaggtaactgagactttcaaaaacttcgatggttcagatgccgcattctgattgaaggagtttggttggaagtgcagtgaattttccccaggaaatgtcacctagccgaagtcttctgagtatgcagatacatttgttgttcctttattctgtcctaaaatatgtttaaacggaaattctcatgcacatagtttatgggacgctattgacttttacctggccttctccagatatctaaggcagcagttagctgctttcgattctgtgaatcctgggtacatcttggaaaagaatatatcattgggaaaatttttgagttctcttggttaagaggatgatgatttcattttgcctggttaaaaccaaatgttataattcaggcagtctttctaccctgtcagaaatatttatggatttttattcttgtggatgtggctaataatatttatctgccttgtgggttgttttttcttgtgtacttccttaattcctcccccaccccaaagatctactcttagcatttctaaccatttagaacataatcaatgctttgagcaatattttttcataggggcagagcatgctgaagagaggaattgtcagtgctattttcaaatctgttctaatatgattatctattagttattggtgttggaattttgtgcactaagcctgaggtaggaggagagttttcaggataacagattgtttaggactcttctacaacaagatgaaaaatagaagtttctcagagaaacactgttgtggtcttttaaatagtataaaagctattttaatgaagagttgcttttcaaaatttttggttgcttttcaaaagttgtaaaggtcagagagacaaacattggtatttcttgaggaaaaatgaggatatcttaaggttactttgagtagcagcatagtttaaaaaatgctccacgtcccaatatttatagttggttatttgatttcactgctttttgggctttgcgagtttatcttgaggggtattttatcttgcctgtgagtatgtaaggaacatgaaaaccaactttgacagagggttaaaaatacagagaattagaacataaaggtgcttgcataattggcagttatatgtgtaggattattccaaatcacatgcaggtgtgttttggtaaattttagtttgttttattccagagacacaggtaacatatgtgcatctcgggcttgacatgaataaaaacttttgaactattcatctgcatgtgaccattttccagagaatgtagttttagcaactgggagtctggatatgaggtgttttattccagtggtcttatgattgctcataaaagtaagattatttttcctggttattcacgaggataacacagtaattgtttagatagaacaagtgaagcagtttttagcagcttaatttagtctttggggaagaattgccttagaactaattttgaagattgttttgaaagcattaaacttggtagacctaagtttagagagcatttgaaactgggtaaattactttttacctatttatgaaaatggagagaaataggtagtaaaataggacatggaaagggtttgtagaggaagagagatgacaactgagacagaataattgaaaagaaatttctcaatatttatggtgggtcattgacacctttaaaaagacctcaaagaaaacaaaatctggtagtaccagactagtttattaaatgaacttgatatttaaatttgtgcatttataatgtctattattttgcaattaaatggggctttaagtcccatgtaaattgtttgccctggaatatttgtatttcttaccaagatactggaaaagacttggtaatttttatcatttttagtaaaagttatagttagttttagctaaaagcttctctattagtgtttggagatggtagtttctaagctcagcttctgtgttagtgtttggagatggtgtttggagaaaaactaccaaacgtgggatgactctgaaaacttttattttcatctagcaagaaatcaaaacctagaaggaatttatctgagaaattatgaatatttggagatgggaagctcatggcagtgacactaaacatccacattattttttctttcttctggctgtcttaagaccataagttggattgcttccaattggggatagtgaaagagggagtaacacatttctagactgggagatttccatagactcccatgtggcttaactcttgctgagctggggaaagaccgtattcatgcctggtattactaggtaatgcgaggatagaacaagaaaaaaaaataaatcccgttgaagggaacgaattttttttttcatttttaaaaatccatgtcctttggtacattgtggtgggttttacaatataatttttcagtgggtccactacttccctacagtgtgggttcctaaacagagcaacaggacctctgtgctgagaaatccaaacagacactgatggcaccttctgccatttaggaatttgttttaaaacagacatttgtctagatatttcctttgtggcctcctccccatcaaaag

SEQ ID NO: 189 - DNA, 4050 bp, Homo sapiens
aaagggtttgtagaggaagagagatgacaactgagacagaataattgaaaagaaatttctcaatatttatggtgggtcattgacacctttaaaaagacctcaaagaaaacaaaatctggtagtaccagactagtttattaaatgaacttgatatttaaatttgtgcatttataatgtctattattttgcaattaaatggggctttaagtcccatgtaaattgtttgccctggaatatttgtatttcttaccaagatactggaaaagacttggtaatttttatcatttttagtaaaagttatagttagttttagctaaaagcttctctattagtgtttggagatggtagtttctaagctcagcttctgtgttagtgtttggagatggtgtttggagaaaaactaccaaacgtgggatgactctgaaaacttttattttcatctagcaagaaatcaaaacctagaaggaatttatctgagaaattatgaatatttggagatgggaagctcatggcagtgacactaaacatccacattattttttctttcttctggctgtcttaagaccataagttggattgcttccaattggggatagtgaaagagggagtaacacatttctagactgggagatttccatagactcccatgtggcttaactcttgctgagctggggaaagaccgtattcatgcctggtattactaggtaatgcgaggatagaacaagaaaaaaaaataaatcccgttgaagggaacgaattttttttttcatttttaaaaatccatgtcctttggtacattgtggtgggttttacaatataatttttcagtgggtccactacttccctacagtgtgggttcctaaacagagcaacaggacctctgtgctgagaaatccaaacagacactgatggcaccttctgccatttaggaatttgttttaaaacagacatttgtctagatatttcctttgtggcctcctccccatcaaaagtcaatcaaacatcgagccttgttaattccaatacctacatatattcaaaattgtccacttactctatgtagagtgacacgtctcttttccaaggcattgttatttgtattagaaaaaatggtgagagactttacaatgggcaaaaaactagtgggtgtcctgttagctcaggcatctgaattatctctgcctttaattacttttgagctactttacgactaggtaagttgtggaaaataggtatgcaaatgattcttatccataaaaatgaaaattatttgtaaagcagttaattattactccttggatagaccagtttttgcatctattgcaaatctatttcagttttcatttttcttgtgtaaaacatgtgtttttaaaaattttcccctgaactggttgtaacagcttactgggtccctcattaattaatgagttaaataaatctttgacagacattattatcacattggtttgagagttatgactttaccttgttggaaaattatccttgaatacatggaccactgtgataatctgctaattggttcttccattccatgctccaccttctccatctccctttcctttttttttcttttctttttttttttttttttttttgagacacagtctagctctgttgcccagtctggagtgcagtggtgcaatcttggctcattgcagcctgcagcctctgcctcccaggttgcagcgattctcctgcctcagcctccctagtagctgggattatgggcgcatgtcaccatgcccagctaatttttgtatttttagtagagatggggtttcaccatgttggctaggctggtttcaaactcctgacctcaagtgatccgcctgcctcgacctcccaaagtgctgggattacaggcgtgagccaccacgcccggcctccccttccattttcaagagagtatctacggtgcttctaaagggtaaacctgaatacctttttctcttctgtaagctctttcgttgggtgcccattttcctttttttaaaaaacacaattaaaaattgaaattgtataatttttggtatatagtgtgatgttttggtcttacttggttcttaaagctctaaatagctgcctcccaatttactcctaattttattttactttcctctcgctccctcattttgctccagccacacggcctttgcttaccatcccggtgggccctccctggcctttgcacacagtcctttctctatctcttcctggccagctcctaccccttcctgcttgtctgagcttaaatgttgcttcctgaaggatctcttttctgagctcccagactagggtagataagctgtatactctcaaagtgttatgatttgaagcacttaccatactgtaatttaaatagttgccagccttttttcctaggttagacataaactctgtgggtgcagggactttctatttgcttattggcatatcttttggcatttagtaggtatccagtaaactatttgtaggcttaataaataaatgaatgacaatgacatagacatacattgaatatgcctaattctatatgttcataagccacttggggatggttgcattggagagacaggagtagagtttaggactgagtgcaacatggcatgaattgtgctaagtcctggatatgaatacaatgcatcaggacttttgctgcattattgacaaaaataaacaaatccagctatccaaactttccctatttacctgatttcttggagttgtgctgcagtgattgttaaataaccacttggacttaatgcatattattgttttatttacccaatacaattcttcacatagggtctaactattaaattcactgtgaagaaaaataagacttaaaacttaaagccagaacaattcttttcttgataagggatttggtaaagaacttgagaataatatcagtctaaaaccatcttttaatttgtaactgtaaatgaatatacagtaaccaagacagtgctcactcaaaatatgtattctttttgctgcaaatccttgtgaacatatcatggagtatacagtgctttggaattcaggatcctgagaagtcatagtgtagagtaaattatggctcttggatttttaaaagttatgaagagctcagaaaaagtgattatctaaaaaaagctaaaaattaggaaattaaacacttatttctggatatcctgctcatttatttatgacctcaggcaaattattagtcaattttttcagatcacctggtctacatttccatagccataagacgcaatcgatcattattaccttccttatatcgtgaagaaatattgaggcattgctgagaagtgtataggagatgataattacttaggaatgcaaaataaaaaccctatcatatacctcgaatctgtgatagtcctgatctgtggatccgtgccacacgtaaacagaaaagggaaaaagcactggctcattaagcccgcgttcttccattgtatggtgtgtatgacttgagtgttttgccccttctaaatttcagagcctctggcttgttagccggccggtctcccaagggaggcagcaaaggcctcattgctttgctttgggaaatttgctctgactttgagcctgcattttctttggctgactttcagagctgctcatctggcagagctgaaaacatacaaattgcagaagttcttttatccatttggtgagatggttctctaaagaggcttcacaaataaaggttaggtagaaaatatgcaaaattaaaaatgctgaacttgagtttgtgcaaatccctgcttttctcttttctaagacacagatgagccaagttttcatgtaagttacaattccaaccttgaaattcaaattgacagaacgtaagagaggaaagccatgaagcattttttatggattccaatatggagagctattaagatgttttcctttaggagacagtgagacattgcttttagattgttttcctacttttttcatgttggaagttaataatcactaaaataagggtgggaaaagatgtggagggag

SEQ ID NO: 190 - DNA, 4040 bp, Homo sapiens
ggttggacagaggtattggtgtttttatgaagctgcctaggagatttcaacgtgcatgcaagttagggaactggtatcttaagatgttgttagttgagggattttcatactgtgaacaccagcttccagggtggtaacctgagacctcagccagatctcctgcctctgaggggccctgtacgctgagcttcacttctgtgtgtatctcagtgctagtgttagtcaggcatatggagggacaatcagttttacttgcttttttgttttattttccagccaaaggaacgtggttccacaagggtacatgccttaaataacgtcaacagagtgctgcaggttttacatcagaacaatgtaagtgtgtaatgtgagttctgggggtctgtgctgccatcagcattatttattgtgaaactcaccaactgcttgatgcattggcatccactgattcttgcaaacattttttcttatgagaaatactgaactttttctgtgagtgaagaaacagtcatgtgctttttctgatggctgtattgatctgtagtataaataatacatttttgagatttaagcttacctgattctctaaaatgaaatttctcttatctctcacttatactgctgtccaaatgtgctaaaataaaaacctggagttctgtgaagaaattgtcttaaaagcgtttttgtttttgttttttgttttgtcttaataggtggaattagtgaatatagggggaactgacattgtggatggaaatcacaaactgactttggggttactttggagcatcattttgcactggcaggtggggaaatttccaatcactttttaatagagatggaaaatgtgttgtttgtcttttagtttcttaaggctgccgtaaccaagtaccacaagctgcttggcttgaacaacagaaatttgttgtctcccagttctggaggccagaagtccaagatcaaggcatcagcagggttggtttttcctgagggctctgagggagactctgatccaggccttgcccccaaattctggtggtttgtctgcaatttttgcagttccttggcctgtgataacatagctccagtgttgacgtggtgttctccctgtgtgcatatctgtcaaatttcctctttttgtaaggacatcagtcatattggatttagggcccacattactcctgtatgacctcattctaactagtgacatctgcaatgaccttatttccaaatagagcccctctctgaagtactgagggttaggacttcaacatattaattttagagaacataattcaactcataacaattttcaatggaagaggctgacaaaatgccctattttcctggcatagggaaaaaagtacctacctttcttatgttaaattttaaaaagggacataatttcacatctagaaaagttgcaggaatagttcaaagaattcccaagtacctttcactcacatttcctaaatgttaccagttgtctatatttcatttgtactctctctcagtctgcctaaaatatttagtgtgtattttctaacgccatggcattctcctaaaaacaagaactctcttatgtaaacacaatagcatattggtataataatatgagatgtaaaatattgatatttaaaatgccaattattgattattaaatatgaaaacttagtatataattattaaaatcaagaaaataacattgaaataatacaattatgtaatctacagatcttaagattttgtcagttgtcccaataatatccttagtagcaaaagaaaatctgagatcatgcattacatttatttttcatgtctctttagtcctctttaatctggaagtttttgagtctttgtatttcatgatattgatatttttgaagagtgctggctagttattttgtagaatgtctctctcagtgggcttgggcttggctgagctttccttatgattaagttcaggttgttcacttttggcagggacgtcacaaaagtgacgtgagttcttcttagtgcatcatatcggggataggtgatatctgttctttttctggcagtgttaactttgattgtttggctaaggtggtatttaccaagtttcttccctgtaaattgactaccctttgttattaaaagtatcgggtggggatatactttgagactgtataaatatttagtttttatcaaacttttagcacccgttcataatttttgcctggaccagctattattatgatgcttgatagataatgattttctaatttcattaatccttctacattagttggtgttctacttgtaaagaagagcttccccttgtttcttgtttctctatcttatctctctctccattcatttattcatttatgtatcagtatagattcatggacatttgcataggtttatgatcttttactagtactcatttcagtgttcaagtcatcctagatttggccagtgtgagccccttaaattggctcctgtgtcccttagatagatctatgtcattctttgagcactttcttaaaacatatttactaatttagaataatactataaaatgttagttctagagtataatcgtgattgcagtcaggaaagatactttattttgtagtcactcaaaagtttttcctttctcatttttgtagaaaataaaatttaattgaaaaggtctttgtaaacacatagagttaaatatgactttctatgactgtgaaagttatgttcattgtaaccaaacatagtacaagtattgcttaagatatagaaaacacagtaatgtataaaagtgaggtaaaaatcacctcaaattctagtcccccaaaataatcactgttaaaatgtattgctctagtgtctacagaaaaatctgaagtaaaatgaatgccagttacctgatccataatggttaattagtgcaatattgctttttcaaggacttcattgaagtaagttgaagtaaattactgaagtattagttatggacaggcctggtttctcttacataggtgaaagatgtcatgaaggatgtcatgtcggacctgcagcagacgaacagtgagaagatcctgctcagctgggtgcgtcagaccaccaggccctacagccaagtcaacgtcctcaacttcaccaccagctggacagatggactcgcctttaatgctgtcctccaccgacataagtgagacattactctatctagaagtgggctttacaaattcatgtctcctctctgtccctttgctgccaccactactccctgaagccccttctccagtgccactgctctcctttctgcacatgttctaccaaaaccttaagaaaagaaatatcatggaagaaaactacccatcaggtttttatttccttaggacttaaatgctgcaatacaaggtccatagtttctcctgcatatttatgaatttaaaaaatatgaaataattcacaaagttcaaccccactcattcagcactaactgataatgtatacaaaaaattgtgttagcttttcttctcaaactgaaagtaaaactctgtaaattcaatgcattcccaattaaaaatagccaaattgtctttaatgaaacttgtgaacagattctaattatataaaagacgaggcccaagaatagccagtagacttctgaggaagaatcaggctgaaatactttccaaaaagaaaccaaaactatgaagctatattaattaagactatgcagtactatcaatatacacaccaatataagctgaaccatatgaaattgccgacatgtgagtgtttttgctatataagaatggtgttttcatatggttcaacctaataaaattaagaactcagaaattgctccattacacaggaaaatctgatatacgcttgagctgacattgcagattaatagatgatttggacaattgattacccatatataaataaatgtattggatctttacttcaccacactaaaaaaaaaataataatttctacatggatcagggatttaaatgccaaaggcaaaatttgttatattttattgt

SEQ ID NO: 191 - DNA, 4050 bp, Homo sapiens
agttaaatatgactttctatgactgtgaaagttatgttcattgtaaccaaacatagtacaagtattgcttaagatatagaaaacacagtaatgtataaaagtgaggtaaaaatcacctcaaattctagtcccccaaaataatcactgttaaaatgtattgctctagtgtctacagaaaaatctgaagtaaaatgaatgccagttacctgatccataatggttaattagtgcaatattgctttttcaaggacttcattgaagtaagttgaagtaaattactgaagtattagttatggacaggcctggtttctcttacataggtgaaagatgtcatgaaggatgtcatgtcggacctgcagcagacgaacagtgagaagatcctgctcagctgggtgcgtcagaccaccaggccctacagccaagtcaacgtcctcaacttcaccaccagctggacagatggactcgcctttaatgctgtcctccaccgacataagtgagacattactctatctagaagtgggctttacaaattcatgtctcctctctgtccctttgctgccaccactactccctgaagccccttctccagtgccactgctctcctttctgcacatgttctaccaaaaccttaagaaaagaaatatcatggaagaaaactacccatcaggtttttatttccttaggacttaaatgctgcaatacaaggtccatagtttctcctgcatatttatgaatttaaaaaatatgaaataattcacaaagttcaaccccactcattcagcactaactgataatgtatacaaaaaattgtgttagcttttcttctcaaactgaaagtaaaactctgtaaattcaatgcattcccaattaaaaatagccaaattgtctttaatgaaacttgtgaacagattctaattatataaaagacgaggcccaagaatagccagtagacttctgaggaagaatcaggctgaaatactttccaaaaagaaaccaaaactatgaagctatattaattaagactatgcagtactatcaatatacacaccaatataagctgaaccatatgaaattgccgacatgtgagtgtttttgctatataagaatggtgttttcatatggttcaacctaataaaattaagaactcagaaattgctccattacacaggaaaatctgatatacgcttgagctgacattgcagattaatagatgatttggacaattgattacccatatataaataaatgtattggatctttacttcaccacactaaaaaaaaaataataatttctacatggatcagggatttaaatgccaaaggcaaaatttgttatattttattgttgtaaatgattacttttctcaaatttcacttcctctatgtttttttgctggtatataaaagtgcaatagacttttctacgtcttatatctggaaacttaatcagttcttacaaattttagtaagtttgtctctagattgtaggtttcttggaggaggagggattagaatgtcctagaattatgatccttttatttcttctgttttcttttttgttctctattgtgccttgtccttcaatgcaatgttgatttgaattggtgatagtgggcagaatttttgttgttgataataaaaggagtgcttttagtgttttaccataagaatgatagtttttgtagcttttttggtacactttttatgaggttaaaggaggttgccctaggtttttagttggttaagggattttatcaagaaactgtagaattttagccaatataccattccatttattaattaattgattcaacaaatacgtgtggggtgccttttatgtgctagacacagggtatacagcagagaacaaaacaggcaaaaatcttagttctcgtggagcttatgttccaacagagggagacaagacaataataaagttgtgtagtatatagaaatgtacacacactgaaggaaaatacatcagacaagagcagaggaggcacttggcatcggagagggcagtggctgcagtgacctgagtggggggagtaatgggagatgaattcagggagggaagtgggggaagtgcatcccagaaggtgggtgggtctaacatgcaagaacagacacagaataaagaaaatgattaacttttggataagtcaaagcaacaataatgtccaatttgtgagattaaaagaaaatcaagatagaaatgaaatacagtcctagacaatatagtagtagcatggaagcaggggattggagggaaactcttccaaggcttttgttttaggaatatcctgagaacagattagagctagattttgtgttctgctaatcttgatcttttaattgaagaatttagtccattaacattgattatgattatttatatatttaggttcatttttaccgcatagtgtgagctgctcatttttcttattttttctgtggttttttttttttttactttcttatctctttttgtatcggtaggtttccctttacccccttttcttcttctactctttgggaaacattatatactacttctagtcttaatggttaccacagaaaatagcagtcctatttagctaatacaagacccttggaaagtattatctgttattttcatatttgtgaattaatttcaagtatgtatttgacaagcctttgggatataaaaataaactcaaaaaaacctcacaaataaaaataatctaaaactaaaatgtattagattataacaatgcctactttgtttccacatatttcatcttcattgcattttatttgcatggttttcagacctgatctcttcagctgggataaagttgtcaaaatgtcaccaattgagagacttgaacatgccttcagcaaggctcaaacttatttgggaattgaaaagctgttagatcctgaaggtattgtccagtatttaatttccaccttgattttgctttacagttttgcattcttgaaaagcagtgtttctttgtccttttaaaaatgaattatgagacttgaagaaccttttcctttttggagtataggtgcgagtcattttattactgacacttattaatacttttgtacttagcagtttgtgggatcttttaggtagaaatttaactacagcactggacaatagttaatctaaattaagtaagagttaaagttttaagaaaatgtaattattagataaattcagtatctggttagtccaataaaatgcatttttatgtgagcatcttgcatgtgatgtaaagactttagttataaatgttgcaggattgaattctagacttattttcatagtatgaataaagtctgtatctttatcttaaatggtaacatatggtagcttatctttgaccattttggggaggcttttagggaagactttaaaaaatgagatactgaacaaaaataagtaatcccttttgcctttgtctcatatattatgaagtggcaatttactggtattgcaaagattatatattaggtattgtttatgggtactaaggagagttattttatatctaatattgagcaattcacatattttggacacctaatttaagctggttcttatattcttccacttttagatgttgccgttcagcttcctgacaagaaatccataattatgtatttaacatctttgtttgaggtgctacctcagcaagtcaccatagacgccatccgtgaggtagagacactcccaaggaaatataaaaaagaatgtgaagaagaggcaattaatatacaggtacaggtaacattttattaagatgtttggcttgccgtatttgttttctcctaggtactagataaaaacacttttagagggtttttttcttgactgagaacatcttggtttctcagcttacatttgcataagaagttcagcttagcagttagcattctgtcacatgtgtgtaatagaacaccataactcaatggactttattaagaaggaaaatactttatttcacccagcaaaactgggctgttgctcatgctgctgcatgacatgctgggaat

SEQ ID NO: 192 - DNA, 4078 bp, Homo sapiens
gtaaattcaatgcattcccaattaaaaatagccaaattgtctttaatgaaacttgtgaacagattctaattatataaaagacgaggcccaagaatagccagtagacttctgaggaagaatcaggctgaaatactttccaaaaagaaaccaaaactatgaagctatattaattaagactatgcagtactatcaatatacacaccaatataagctgaaccatatgaaattgccgacatgtgagtgtttttgctatataagaatggtgttttcatatggttcaacctaataaaattaagaactcagaaattgctccattacacaggaaaatctgatatacgcttgagctgacattgcagattaatagatgatttggacaattgattacccatatataaataaatgtattggatctttacttcaccacactaaaaaaaaaataataatttctacatggatcagggatttaaatgccaaaggcaaaatttgttatattttattgttgtaaatgattacttttctcaaatttcacttcctctatgtttttttgctggtatataaaagtgcaatagacttttctacgtcttatatctggaaacttaatcagttcttacaaattttagtaagtttgtctctagattgtaggtttcttggaggaggagggattagaatgtcctagaattatgatccttttatttcttctgttttcttttttgttctctattgtgccttgtccttcaatgcaatgttgatttgaattggtgatagtgggcagaatttttgttgttgataataaaaggagtgcttttagtgttttaccataagaatgatagtttttgtagcttttttggtacactttttatgaggttaaaggaggttgccctaggtttttagttggttaagggattttatcaagaaactgtagaattttagccaatataccattccatttattaattaattgattcaacaaatacgtgtggggtgccttttatgtgctagacacagggtatacagcagagaacaaaacaggcaaaaatcttagttctcgtggagcttatgttccaacagagggagacaagacaataataaagttgtgtagtatatagaaatgtacacacactgaaggaaaatacatcagacaagagcagaggaggcacttggcatcggagagggcagtggctgcagtgacctgagtggggggagtaatgggagatgaattcagggagggaagtgggggaagtgcatcccagaaggtgggtgggtctaacatgcaagaacagacacagaataaagaaaatgattaacttttggataagtcaaagcaacaataatgtccaatttgtgagattaaaagaaaatcaagatagaaatgaaatacagtcctagacaatatagtagtagcatggaagcaggggattggagggaaactcttccaaggcttttgttttaggaatatcctgagaacagattagagctagattttgtgttctgctaatcttgatcttttaattgaagaatttagtccattaacattgattatgattatttatatatttaggttcatttttaccgcatagtgtgagctgctcatttttcttattttttctgtggttttttttttttttactttcttatctctttttgtatcggtaggtttccctttacccccttttcttcttctactctttgggaaacattatatactacttctagtcttaatggttaccacagaaaatagcagtcctatttagctaatacaagacccttggaaagtattatctgttattttcatatttgtgaattaatttcaagtatgtatttgacaagcctttgggatataaaaataaactcaaaaaaacctcacaaataaaaataatctaaaactaaaatgtattagattataacaatgcctactttgtttccacatatttcatcttcattgcattttatttgcatggttttcagacctgatctcttcagctgggataaagttgtcaaaatgtcaccaattgagagacttgaacatgccttcagcaaggctcaaacttatttgggaattgaaaagctgttagatcctgaaggtattgtccagtatttaatttccaccttgattttgctttacagttttgcattcttgaaaagcagtgtttctttgtccttttaaaaatgaattatgagacttgaagaaccttttcctttttggagtataggtgcgagtcattttattactgacacttattaatacttttgtacttagcagtttgtgggatcttttaggtagaaatttaactacagcactggacaatagttaatctaaattaagtaagagttaaagttttaagaaaatgtaattattagataaattcagtatctggttagtccaataaaatgcatttttatgtgagcatcttgcatgtgatgtaaagactttagttataaatgttgcaggattgaattctagacttattttcatagtatgaataaagtctgtatctttatcttaaatggtaacatatggtagcttatctttgaccattttggggaggcttttagggaagactttaaaaaatgagatactgaacaaaaataagtaatcccttttgcctttgtctcatatattatgaagtggcaatttactggtattgcaaagattatatattaggtattgtttatgggtactaaggagagttattttatatctaatattgagcaattcacatattttggacacctaatttaagctggttcttatattcttccacttttagatgttgccgttcagcttcctgacaagaaatccataattatgtatttaacatctttgtttgaggtgctacctcagcaagtcaccatagacgccatccgtgaggtagagacactcccaaggaaatataaaaaagaatgtgaagaagaggcaattaatatacaggtacaggtaacattttattaagatgtttggcttgccgtatttgttttctcctaggtactagataaaaacacttttagagggtttttttcttgactgagaacatcttggtttctcagcttacatttgcataagaagttcagcttagcagttagcattctgtcacatgtgtgtaatagaacaccataactcaatggactttattaagaaggaaaatactttatttcacccagcaaaactgggctgttgctcatgctgctgcatgacatgctgggaatctatgttttcacatcatctggttgccagcttttatttctgtcatgtgctaaagatggtttttctcatatcagcctagttttttttctaagtactaattgtctttctttttttgccattgagaaaagattttttttccattatatatctcacaagggctatcaaaatgtaagccttattttccctttcctttaggaggagtaatgtatggtaaactacttggtgagcttttcatgaagggattacgatgatttcattcatcaggatataaatgaatttttaaagagagaaataaaatcataatttattttcttccttagttctactgtttgaatcaatccatatttaatctcattctgttttagtctagccagtccttgtaattcataagatgagagaatcttaagaattggaccttagaagtcacttggttcaacattctagtgaccaagcaaccaagacatacatgtagatttcaaaattataagaactacatttcagagagaaagaaagcttctctggatggaccttaaattcatcctgttgctacttgttttgggttgttacttaaactctcaatcacagttttgtctgcaaaatgtggttaaaaccaccaacttcataaagataatgaattcaaagtatctaaaatgacattaataaacactcaacaagcaacagctatcattattatcatttttcttcttgatttgttttggcattctcatttaacagatttctttaaaaaatattatttaattcccatattatgatactagtcttgaattgacatagcatcttttttttccatcctctgagattcagagaatttacttattcttttaaattttctttgggtaatatgtacccatcctt

SEQ ID NO: 193 - DNA, 4061 bp, Homo sapiens
ttgttgataataaaaggagtgcttttagtgttttaccataagaatgatagtttttgtagcttttttggtacactttttatgaggttaaaggaggttgccctaggtttttagttggttaagggattttatcaagaaactgtagaattttagccaatataccattccatttattaattaattgattcaacaaatacgtgtggggtgccttttatgtgctagacacagggtatacagcagagaacaaaacaggcaaaaatcttagttctcgtggagcttatgttccaacagagggagacaagacaataataaagttgtgtagtatatagaaatgtacacacactgaaggaaaatacatcagacaagagcagaggaggcacttggcatcggagagggcagtggctgcagtgacctgagtggggggagtaatgggagatgaattcagggagggaagtgggggaagtgcatcccagaaggtgggtgggtctaacatgcaagaacagacacagaataaagaaaatgattaacttttggataagtcaaagcaacaataatgtccaatttgtgagattaaaagaaaatcaagatagaaatgaaatacagtcctagacaatatagtagtagcatggaagcaggggattggagggaaactcttccaaggcttttgttttaggaatatcctgagaacagattagagctagattttgtgttctgctaatcttgatcttttaattgaagaatttagtccattaacattgattatgattatttatatatttaggttcatttttaccgcatagtgtgagctgctcatttttcttattttttctgtggttttttttttttttactttcttatctctttttgtatcggtaggtttccctttacccccttttcttcttctactctttgggaaacattatatactacttctagtcttaatggttaccacagaaaatagcagtcctatttagctaatacaagacccttggaaagtattatctgttattttcatatttgtgaattaatttcaagtatgtatttgacaagcctttgggatataaaaataaactcaaaaaaacctcacaaataaaaataatctaaaactaaaatgtattagattataacaatgcctactttgtttccacatatttcatcttcattgcattttatttgcatggttttcagacctgatctcttcagctgggataaagttgtcaaaatgtcaccaattgagagacttgaacatgccttcagcaaggctcaaacttatttgggaattgaaaagctgttagatcctgaaggtattgtccagtatttaatttccaccttgattttgctttacagttttgcattcttgaaaagcagtgtttctttgtccttttaaaaatgaattatgagacttgaagaaccttttcctttttggagtataggtgcgagtcattttattactgacacttattaatacttttgtacttagcagtttgtgggatcttttaggtagaaatttaactacagcactggacaatagttaatctaaattaagtaagagttaaagttttaagaaaatgtaattattagataaattcagtatctggttagtccaataaaatgcatttttatgtgagcatcttgcatgtgatgtaaagactttagttataaatgttgcaggattgaattctagacttattttcatagtatgaataaagtctgtatctttatcttaaatggtaacatatggtagcttatctttgaccattttggggaggcttttagggaagactttaaaaaatgagatactgaacaaaaataagtaatcccttttgcctttgtctcatatattatgaagtggcaatttactggtattgcaaagattatatattaggtattgtttatgggtactaaggagagttattttatatctaatattgagcaattcacatattttggacacctaatttaagctggttcttatattcttccacttttagatgttgccgttcagcttcctgacaagaaatccataattatgtatttaacatctttgtttgaggtgctacctcagcaagtcaccatagacgccatccgtgaggtagagacactcccaaggaaatataaaaaagaatgtgaagaagaggcaattaatatacaggtacaggtaacattttattaagatgtttggcttgccgtatttgttttctcctaggtactagataaaaacacttttagagggtttttttcttgactgagaacatcttggtttctcagcttacatttgcataagaagttcagcttagcagttagcattctgtcacatgtgtgtaatagaacaccataactcaatggactttattaagaaggaaaatactttatttcacccagcaaaactgggctgttgctcatgctgctgcatgacatgctgggaatctatgttttcacatcatctggttgccagcttttatttctgtcatgtgctaaagatggtttttctcatatcagcctagttttttttctaagtactaattgtctttctttttttgccattgagaaaagattttttttccattatatatctcacaagggctatcaaaatgtaagccttattttccctttcctttaggaggagtaatgtatggtaaactacttggtgagcttttcatgaagggattacgatgatttcattcatcaggatataaatgaatttttaaagagagaaataaaatcataatttattttcttccttagttctactgtttgaatcaatccatatttaatctcattctgttttagtctagccagtccttgtaattcataagatgagagaatcttaagaattggaccttagaagtcacttggttcaacattctagtgaccaagcaaccaagacatacatgtagatttcaaaattataagaactacatttcagagagaaagaaagcttctctggatggaccttaaattcatcctgttgctacttgttttgggttgttacttaaactctcaatcacagttttgtctgcaaaatgtggttaaaaccaccaacttcataaagataatgaattcaaagtatctaaaatgacattaataaacactcaacaagcaacagctatcattattatcatttttcttcttgatttgttttggcattctcatttaacagatttctttaaaaaatattatttaattcccatattatgatactagtcttgaattgacatagcatcttttttttccatcctctgagattcagagaatttacttattcttttaaattttctttgggtaatatgtacccatccttttatttcccccgtttcaaaaatagtgtgatttatagaaaaagaaaaaaatttactgaaaagaaaggattgagaaatgaggcctgattgtgaacccagggctctcttttgtagtgaatatcaaatgatgctgaggaaaattcctaacttactataattgaaaaaaatgctaggaagtatttgcctctaaaagtatagttattattctacattaatgatgcacctttttagttggctcagatgatcttctgagtttgttacagggttttagattcatttccttattgcattttgttagaaggaggagatattttatttagttcttatagttaagggccttctctcttaaaaaggaaggagacttcatttacttttcatgatgtgtagataaaataatcacttctgtttagggctcagcgtggcatgataagaacttcagaaaacatttgctatttgattaagtgcaagtgtattaacacctcttcatttgcaagctttcattagtgtcttagaggctgaattacgttaattgaaaactaaaatgtgatcaagttttaatcatctctctgacatagcttgccatctgctactctcctaatagtcagacttcttctgccctgttctttctacaaacatacgctggtggtcaatgaataattcctgcatttctctttaaatatccgtcagttgaaagtttcctcatgtgttcgaattaataccgtctgaacatttgtgtttagatagtgccttccttctcgacctcat

SEQ ID NO: 194 - DNA, 4064 bp, Homo sapiens
tttttggtacactttttatgaggttaaaggaggttgccctaggtttttagttggttaagggattttatcaagaaactgtagaattttagccaatataccattccatttattaattaattgattcaacaaatacgtgtggggtgccttttatgtgctagacacagggtatacagcagagaacaaaacaggcaaaaatcttagttctcgtggagcttatgttccaacagagggagacaagacaataataaagttgtgtagtatatagaaatgtacacacactgaaggaaaatacatcagacaagagcagaggaggcacttggcatcggagagggcagtggctgcagtgacctgagtggggggagtaatgggagatgaattcagggagggaagtgggggaagtgcatcccagaaggtgggtgggtctaacatgcaagaacagacacagaataaagaaaatgattaacttttggataagtcaaagcaacaataatgtccaatttgtgagattaaaagaaaatcaagatagaaatgaaatacagtcctagacaatatagtagtagcatggaagcaggggattggagggaaactcttccaaggcttttgttttaggaatatcctgagaacagattagagctagattttgtgttctgctaatcttgatcttttaattgaagaatttagtccattaacattgattatgattatttatatatttaggttcatttttaccgcatagtgtgagctgctcatttttcttattttttctgtggttttttttttttttactttcttatctctttttgtatcggtaggtttccctttacccccttttcttcttctactctttgggaaacattatatactacttctagtcttaatggttaccacagaaaatagcagtcctatttagctaatacaagacccttggaaagtattatctgttattttcatatttgtgaattaatttcaagtatgtatttgacaagcctttgggatataaaaataaactcaaaaaaacctcacaaataaaaataatctaaaactaaaatgtattagattataacaatgcctactttgtttccacatatttcatcttcattgcattttatttgcatggttttcagacctgatctcttcagctgggataaagttgtcaaaatgtcaccaattgagagacttgaacatgccttcagcaaggctcaaacttatttgggaattgaaaagctgttagatcctgaaggtattgtccagtatttaatttccaccttgattttgctttacagttttgcattcttgaaaagcagtgtttctttgtccttttaaaaatgaattatgagacttgaagaaccttttcctttttggagtataggtgcgagtcattttattactgacacttattaatacttttgtacttagcagtttgtgggatcttttaggtagaaatttaactacagcactggacaatagttaatctaaattaagtaagagttaaagttttaagaaaatgtaattattagataaattcagtatctggttagtccaataaaatgcatttttatgtgagcatcttgcatgtgatgtaaagactttagttataaatgttgcaggattgaattctagacttattttcatagtatgaataaagtctgtatctttatcttaaatggtaacatatggtagcttatctttgaccattttggggaggcttttagggaagactttaaaaaatgagatactgaacaaaaataagtaatcccttttgcctttgtctcatatattatgaagtggcaatttactggtattgcaaagattatatattaggtattgtttatgggtactaaggagagttattttatatctaatattgagcaattcacatattttggacacctaatttaagctggttcttatattcttccacttttagatgttgccgttcagcttcctgacaagaaatccataattatgtatttaacatctttgtttgaggtgctacctcagcaagtcaccatagacgccatccgtgaggtagagacactcccaaggaaatataaaaaagaatgtgaagaagaggcaattaatatacaggtacaggtaacattttattaagatgtttggcttgccgtatttgttttctcctaggtactagataaaaacacttttagagggtttttttcttgactgagaacatcttggtttctcagcttacatttgcataagaagttcagcttagcagttagcattctgtcacatgtgtgtaatagaacaccataactcaatggactttattaagaaggaaaatactttatttcacccagcaaaactgggctgttgctcatgctgctgcatgacatgctgggaatctatgttttcacatcatctggttgccagcttttatttctgtcatgtgctaaagatggtttttctcatatcagcctagttttttttctaagtactaattgtctttctttttttgccattgagaaaagattttttttccattatatatctcacaagggctatcaaaatgtaagccttattttccctttcctttaggaggagtaatgtatggtaaactacttggtgagcttttcatgaagggattacgatgatttcattcatcaggatataaatgaatttttaaagagagaaataaaatcataatttattttcttccttagttctactgtttgaatcaatccatatttaatctcattctgttttagtctagccagtccttgtaattcataagatgagagaatcttaagaattggaccttagaagtcacttggttcaacattctagtgaccaagcaaccaagacatacatgtagatttcaaaattataagaactacatttcagagagaaagaaagcttctctggatggaccttaaattcatcctgttgctacttgttttgggttgttacttaaactctcaatcacagttttgtctgcaaaatgtggttaaaaccaccaacttcataaagataatgaattcaaagtatctaaaatgacattaataaacactcaacaagcaacagctatcattattatcatttttcttcttgatttgttttggcattctcatttaacagatttctttaaaaaatattatttaattcccatattatgatactagtcttgaattgacatagcatcttttttttccatcctctgagattcagagaatttacttattcttttaaattttctttgggtaatatgtacccatccttttatttcccccgtttcaaaaatagtgtgatttatagaaaaagaaaaaaatttactgaaaagaaaggattgagaaatgaggcctgattgtgaacccagggctctcttttgtagtgaatatcaaatgatgctgaggaaaattcctaacttactataattgaaaaaaatgctaggaagtatttgcctctaaaagtatagttattattctacattaatgatgcacctttttagttggctcagatgatcttctgagtttgttacagggttttagattcatttccttattgcattttgttagaaggaggagatattttatttagttcttatagttaagggccttctctcttaaaaaggaaggagacttcatttacttttcatgatgtgtagataaaataatcacttctgtttagggctcagcgtggcatgataagaacttcagaaaacatttgctatttgattaagtgcaagtgtattaacacctcttcatttgcaagctttcattagtgtcttagaggctgaattacgttaattgaaaactaaaatgtgatcaagttttaatcatctctctgacatagcttgccatctgctactctcctaatagtcagacttcttctgccctgttctttctacaaacatacgctggtggtcaatgaataattcctgcatttctctttaaatatccgtcagttgaaagtttcctcatgtgttcgaattaataccgtctgaacatttgtgtttagatagtgccttccttctcgacctcatggatgctggtgcctatctcagtgacctttggctggtcactaactttcctggttcttagaaattc

SEQ ID NO: 195 - DNA, 4052 bp, Homo sapiens
cgccactgcactccagcctgggcaccattgagcgctgagtgaactagactccgtctgcaatcccggcacctcgggaggccgaggctggcggatcactcgcggtcaggagctggagaccagcccggccaacacagcgaaaccccgtctccaccaaaaaaatacgaaaaccagtcaggcgtggtggcgcgcacctgcaattgcaggcactcggcaggctgaggcaggagaatcaggcagggaggttgcagtgagccgagatggcagcagtacagtccagcttcggctcggcatcagagggagaccgtggaaagaggggagggggagggggagggagagggagcgaagttttgaaggaaggtcagaattacttatgtattaaatgtggaagatgaaggagagagaagctggggctggctcccaggtttgtagctggagtacctagttgcagggaggagccatctactgagttggagaagtctgaggaggaacaagctttggaagaaagtaaaggttttgaatatggacatggtttaatatgcctaggaggcgctgaagtagagatgtgaaaatagtgggatatgagagtttggaatccagactcctaggtggttctagatgttctttaaatccaataggagtagatgagattactcagacacagtatacagtggggagaaaaaagagcctagaacttaattttgaggagattcattacttatgagtcagcagctgctgttgaaccagcaggaaaccagggcagtgtcacagaagcagggaaacaagcttctgaaagctcaagttgctcagccttgaggagtgctaccaaggtctgaagcaaggaacgtgggtggccagctctccgggcttacttgggacagttctggtttggatttgttgtttgagcacagttatcatcaaaaatactctagtttgttggttaattatatggtcaccctgaagatgatgctagaaaggtccgtttggcaatgggaaggttattgatgacattggtaaaagccttttcagttgagtcatggggcaaatagcaagttgaagttaaagggaatgttaacaaaccatagctgttaaatacttgagcattttttgtattgttctctatacgtttctgtacatttgaaatattgtacttaaaaatcatgcatgagagttgataaagtagagacagaatgtaggcaagtcttcaagaaatcttgctctgaaagggaacaaaagaactagggagagtcaatttggttataagctcttaaagtatatatggaaatactcagttatttagaaagaggttgatagaaatttattccatgagccctaaaaggccatcagataaaccagagggcaactgcctaagaaaaatacaatcagtacagcagcctgtgtggctgtcttttagtgtctaaaatgcaatgctaaaatgcagttcagcaaaagcaatttacctaagggtcaaggcagaattctcacctttctttttctttaaattacagaaaaggcctaacacgttccagctcctctacgaaactttcctgttttagcctttgttgaactcaaatatcatgccttgttgggaccatggcatttacttttctaatagctgttcttcaatttctgttcagaagtgattcatgtgggttctctgtccctaactatattagaatctccttgagtacagaattcatgagtgcatgctgcttttatactctttgctaccctagtgcacttactcaatgcttctaactcattcatggcagtgcccatttggctcctgagaattggattagtgcctaagacagagtggtgggtactttgggttcgccatacagtgtgagtttgctgaacacctcttgctttgatgattagtgtgggtttttcttggctttgtttttacagagtacagcgcctgaggaggagcatgagagtccccgagctgaaactcccagcactgtcactgaggttgacatggatctggacagctatcagattgcgttggaggaagtgctgacctggttgctttctgctgaggacactttccaggagcaggatgatatttctgatgatgttgaagaagtcaaagaccagtttgcaacccatgaagtaaatatctgtagtttcttagcagggtgtgtcccccacgggacctgagccttaatcagggactctactctcctatttgttatctactgaattctgttctttggaaaggtcaatggtttatttcaggaactgtgatatttaaatagtgctttgtcacaaaattggtatgggtgattaaactgtgcctcagaattagattttagattttagtctccttgtgtgttttggagagccactgatgaaaatcattgcatagtactgctcagttctgaagtgcattgttatatttcaaaagcaaacgagtgaaccaatacaccaaatctttaagatttgagtgttccctaggaaatgattattctttttaattgcatgattaagcaaatgtcatacccagggttcctgtattttttcatatcataaaagtttcctgctcctttgaggacatactatattgcagcatagtgaatttcactatatggagatttcttttggttaaatttttcttttgtatagttatgtgaattgacagatcttatttgttgttttggatagaaaataatataagtggtaatatctcttaaacagttcctcttgggtgagtatggtattttattttatatatatatttatatatataataaataaatatatatttatatataaatatatataaataaaaataaatatatattttattttatatataaataaaatatataaataaatatatataaataaaatatataaatatttttatatataatctatttatatattatatatgtatatgtatatgtgtgtgtatatatatatatttataatttttttttttttaacagagtcttactctgtcacccaggctggagtgcagtggcacaatcttggctcactgcaacttctacctcctggcttcaagtgattctcctgcatcagcctcccaagtagctgggactgcaaacatgtgccaccacgcccggctaattttttgtgtttttagttagagacggggtttcaccttgttgtccaggctggtcttgaactcctggcctaggtgatccacctgcctcagcctcccaaaatgctgggattataggtgtgagccaccacacccagccttttattttatttatttagaattccatgttcatgatctatgagtagcatagtcagcatttactttaaaatagctggtattatcagatgcatcattgcttgctttgagctatttctcttttaacttatggcaggtgtttattcctattttcagagattaaaaaatgtggtcaatgtctattttatttgcgctctactaggctacctttttctgcatcactgacatttaggttaggcattagcaatttgttcagtcttccttttttttttttgcactgagtagctcacaaattataacaatgtccctttctaggcttttatgatggaactgactgcacaccagagcagtgtgggcagcgtcctgcaggcaggcaaccaactgataacacaaggaactctgtcagacgaagaagaatttgagattcaggaacagatgaccctgctgaatgctagatgggaggctcttagggtggagagtatggacagacagtcccggtgagtggaaagccaagaaatgcacttaattccacaggctgctttgcacagttgagctctagtagatgtctgcatgtctgtgaaagcgagatgattacagaacttgccttggaaaagtaagactcttttctacgggtaatattgctggaattctgcatgatctttgtttcccctttgatgtgttagccacaccaaaagataaaagttggaatacagaatttaacaaaaaggaaaaagaggataggcatggtggctcatgcctgtaatcccagcacttgggaggccaacgcggatggatcacttgaggccaggagtttgagaccagcctgggc

SEQ ID NO: 196 - DNA, 4060 bp, Homo sapiens
gtctgcaatcccggcacctcgggaggccgaggctggcggatcactcgcggtcaggagctggagaccagcccggccaacacagcgaaaccccgtctccaccaaaaaaatacgaaaaccagtcaggcgtggtggcgcgcacctgcaattgcaggcactcggcaggctgaggcaggagaatcaggcagggaggttgcagtgagccgagatggcagcagtacagtccagcttcggctcggcatcagagggagaccgtggaaagaggggagggggagggggagggagagggagcgaagttttgaaggaaggtcagaattacttatgtattaaatgtggaagatgaaggagagagaagctggggctggctcccaggtttgtagctggagtacctagttgcagggaggagccatctactgagttggagaagtctgaggaggaacaagctttggaagaaagtaaaggttttgaatatggacatggtttaatatgcctaggaggcgctgaagtagagatgtgaaaatagtgggatatgagagtttggaatccagactcctaggtggttctagatgttctttaaatccaataggagtagatgagattactcagacacagtatacagtggggagaaaaaagagcctagaacttaattttgaggagattcattacttatgagtcagcagctgctgttgaaccagcaggaaaccagggcagtgtcacagaagcagggaaacaagcttctgaaagctcaagttgctcagccttgaggagtgctaccaaggtctgaagcaaggaacgtgggtggccagctctccgggcttacttgggacagttctggtttggatttgttgtttgagcacagttatcatcaaaaatactctagtttgttggttaattatatggtcaccctgaagatgatgctagaaaggtccgtttggcaatgggaaggttattgatgacattggtaaaagccttttcagttgagtcatggggcaaatagcaagttgaagttaaagggaatgttaacaaaccatagctgttaaatacttgagcattttttgtattgttctctatacgtttctgtacatttgaaatattgtacttaaaaatcatgcatgagagttgataaagtagagacagaatgtaggcaagtcttcaagaaatcttgctctgaaagggaacaaaagaactagggagagtcaatttggttataagctcttaaagtatatatggaaatactcagttatttagaaagaggttgatagaaatttattccatgagccctaaaaggccatcagataaaccagagggcaactgcctaagaaaaatacaatcagtacagcagcctgtgtggctgtcttttagtgtctaaaatgcaatgctaaaatgcagttcagcaaaagcaatttacctaagggtcaaggcagaattctcacctttctttttctttaaattacagaaaaggcctaacacgttccagctcctctacgaaactttcctgttttagcctttgttgaactcaaatatcatgccttgttgggaccatggcatttacttttctaatagctgttcttcaatttctgttcagaagtgattcatgtgggttctctgtccctaactatattagaatctccttgagtacagaattcatgagtgcatgctgcttttatactctttgctaccctagtgcacttactcaatgcttctaactcattcatggcagtgcccatttggctcctgagaattggattagtgcctaagacagagtggtgggtactttgggttcgccatacagtgtgagtttgctgaacacctcttgctttgatgattagtgtgggtttttcttggctttgtttttacagagtacagcgcctgaggaggagcatgagagtccccgagctgaaactcccagcactgtcactgaggttgacatggatctggacagctatcagattgcgttggaggaagtgctgacctggttgctttctgctgaggacactttccaggagcaggatgatatttctgatgatgttgaagaagtcaaagaccagtttgcaacccatgaagtaaatatctgtagtttcttagcagggtgtgtcccccacgggacctgagccttaatcagggactctactctcctatttgttatctactgaattctgttctttggaaaggtcaatggtttatttcaggaactgtgatatttaaatagtgctttgtcacaaaattggtatgggtgattaaactgtgcctcagaattagattttagattttagtctccttgtgtgttttggagagccactgatgaaaatcattgcatagtactgctcagttctgaagtgcattgttatatttcaaaagcaaacgagtgaaccaatacaccaaatctttaagatttgagtgttccctaggaaatgattattctttttaattgcatgattaagcaaatgtcatacccagggttcctgtattttttcatatcataaaagtttcctgctcctttgaggacatactatattgcagcatagtgaatttcactatatggagatttcttttggttaaatttttcttttgtatagttatgtgaattgacagatcttatttgttgttttggatagaaaataatataagtggtaatatctcttaaacagttcctcttgggtgagtatggtattttattttatatatatatttatatatataataaataaatatatatttatatataaatatatataaataaaaataaatatatattttattttatatataaataaaatatataaataaatatatataaataaaatatataaatatttttatatataatctatttatatattatatatgtatatgtatatgtgtgtgtatatatatatatttataatttttttttttttaacagagtcttactctgtcacccaggctggagtgcagtggcacaatcttggctcactgcaacttctacctcctggcttcaagtgattctcctgcatcagcctcccaagtagctgggactgcaaacatgtgccaccacgcccggctaattttttgtgtttttagttagagacggggtttcaccttgttgtccaggctggtcttgaactcctggcctaggtgatccacctgcctcagcctcccaaaatgctgggattataggtgtgagccaccacacccagccttttattttatttatttagaattccatgttcatgatctatgagtagcatagtcagcatttactttaaaatagctggtattatcagatgcatcattgcttgctttgagctatttctcttttaacttatggcaggtgtttattcctattttcagagattaaaaaatgtggtcaatgtctattttatttgcgctctactaggctacctttttctgcatcactgacatttaggttaggcattagcaatttgttcagtcttccttttttttttttgcactgagtagctcacaaattataacaatgtccctttctaggcttttatgatggaactgactgcacaccagagcagtgtgggcagcgtcctgcaggcaggcaaccaactgataacacaaggaactctgtcagacgaagaagaatttgagattcaggaacagatgaccctgctgaatgctagatgggaggctcttagggtggagagtatggacagacagtcccggtgagtggaaagccaagaaatgcacttaattccacaggctgctttgcacagttgagctctagtagatgtctgcatgtctgtgaaagcgagatgattacagaacttgccttggaaaagtaagactcttttctacgggtaatattgctggaattctgcatgatctttgtttcccctttgatgtgttagccacaccaaaagataaaagttggaatacagaatttaacaaaaaggaaaaagaggataggcatggtggctcatgcctgtaatcccagcacttgggaggccaacgcggatggatcacttgaggccaggagtttgagaccagcctgggcgacatggcgaaactccgtctctactaaaaatacaaaaattagctgggcatggtgggccat

SEQ ID NO: 197 - DNA, 4055 bp, Homo sapiens
atggcatttacttttctaatagctgttcttcaatttctgttcagaagtgattcatgtgggttctctgtccctaactatattagaatctccttgagtacagaattcatgagtgcatgctgcttttatactctttgctaccctagtgcacttactcaatgcttctaactcattcatggcagtgcccatttggctcctgagaattggattagtgcctaagacagagtggtgggtactttgggttcgccatacagtgtgagtttgctgaacacctcttgctttgatgattagtgtgggtttttcttggctttgtttttacagagtacagcgcctgaggaggagcatgagagtccccgagctgaaactcccagcactgtcactgaggttgacatggatctggacagctatcagattgcgttggaggaagtgctgacctggttgctttctgctgaggacactttccaggagcaggatgatatttctgatgatgttgaagaagtcaaagaccagtttgcaacccatgaagtaaatatctgtagtttcttagcagggtgtgtcccccacgggacctgagccttaatcagggactctactctcctatttgttatctactgaattctgttctttggaaaggtcaatggtttatttcaggaactgtgatatttaaatagtgctttgtcacaaaattggtatgggtgattaaactgtgcctcagaattagattttagattttagtctccttgtgtgttttggagagccactgatgaaaatcattgcatagtactgctcagttctgaagtgcattgttatatttcaaaagcaaacgagtgaaccaatacaccaaatctttaagatttgagtgttccctaggaaatgattattctttttaattgcatgattaagcaaatgtcatacccagggttcctgtattttttcatatcataaaagtttcctgctcctttgaggacatactatattgcagcatagtgaatttcactatatggagatttcttttggttaaatttttcttttgtatagttatgtgaattgacagatcttatttgttgttttggatagaaaataatataagtggtaatatctcttaaacagttcctcttgggtgagtatggtattttattttatatatatatttatatatataataaataaatatatatttatatataaatatatataaataaaaataaatatatattttattttatatataaataaaatatataaataaatatatataaataaaatatataaatatttttatatataatctatttatatattatatatgtatatgtatatgtgtgtgtatatatatatatttataatttttttttttttaacagagtcttactctgtcacccaggctggagtgcagtggcacaatcttggctcactgcaacttctacctcctggcttcaagtgattctcctgcatcagcctcccaagtagctgggactgcaaacatgtgccaccacgcccggctaattttttgtgtttttagttagagacggggtttcaccttgttgtccaggctggtcttgaactcctggcctaggtgatccacctgcctcagcctcccaaaatgctgggattataggtgtgagccaccacacccagccttttattttatttatttagaattccatgttcatgatctatgagtagcatagtcagcatttactttaaaatagctggtattatcagatgcatcattgcttgctttgagctatttctcttttaacttatggcaggtgtttattcctattttcagagattaaaaaatgtggtcaatgtctattttatttgcgctctactaggctacctttttctgcatcactgacatttaggttaggcattagcaatttgttcagtcttccttttttttttttgcactgagtagctcacaaattataacaatgtccctttctaggcttttatgatggaactgactgcacaccagagcagtgtgggcagcgtcctgcaggcaggcaaccaactgataacacaaggaactctgtcagacgaagaagaatttgagattcaggaacagatgaccctgctgaatgctagatgggaggctcttagggtggagagtatggacagacagtcccggtgagtggaaagccaagaaatgcacttaattccacaggctgctttgcacagttgagctctagtagatgtctgcatgtctgtgaaagcgagatgattacagaacttgccttggaaaagtaagactcttttctacgggtaatattgctggaattctgcatgatctttgtttcccctttgatgtgttagccacaccaaaagataaaagttggaatacagaatttaacaaaaaggaaaaagaggataggcatggtggctcatgcctgtaatcccagcacttgggaggccaacgcggatggatcacttgaggccaggagtttgagaccagcctgggcgacatggcgaaactccgtctctactaaaaatacaaaaattagctgggcatggtgggccatgcctgtaatcctagctacttgggaggttgaggtatgaggatcgcttgaactcaggagacagagattgcagtgagctgagattcagccactgcactccagcctgggtaacaaagtgagactgtctccaaaaaaaggaaaagacatttcataggggcagttacttatttgcaatgttaagattagctaaacattaacttggtgtgaagacaggactatggagtattgatctacttttccattttgtgacttttattttaaagctttctcatggtttattttatttcatgtattgtgtcttaaggagcaaactgcattcattgccacttccacctatttaataagcaggaattcctgattgaagaaacaatgattctgatatgaatacagggtgctgctttttgcattctttgtctgcatttaatgaactccatttaggacaaaataaaagtttactttcctggcttctatatttaaagactaaatgctaccttgaatgtttagacaagggtgtcttcccttgccctgtatctccggtgcccagaatgtatatttgactttgcaaagggaaaaggcttgtaggaataatgctgtgttccccacggacaggctgcacgatgtgctgatggaactgcagaagaagcaactgcagcagctctccgcctggttaacactcacagaggagcgcattcagaagatggaaacttgccccctggatgatgatgtaaaatctctacaaaagctgctagaagaacataaagtaaatctgtctcatatttcttcgataccttatcaaatatgaaagagcagcacttagcatctcagaggctgatgacatctatcgttaacatgaagttgggacacttcttcagggttgtcttcatttagcagctcacagggtggaattgatagagatgagacttttctgagccagggataaaagggcacggtaaaattttatatgtgatgtgcagttttcttttgaaagtacatagctttcatacaactggagaagggttcttttggccctctaagtggctaagaacccaagcatgttggcgttcacatggtgtgtgggtgaagagcaaattcttcgtctatgattcaggaaagcgtcaggcattaagttaggaaccaaaattgggtgggcaatttaatttggtcacaagtctaggagataaacttttcatagtcaagataaggaaagatagaataaaatatgctctctgtaaattgaagacttttattgatcagtgaaacattgaggtaactaatatgtaaaactttaggaatacattaaacacaactctgagaagcatttgagaacactattgatagtatttaaataaattttctttctttctttcttttttttgagatggagtcttgctctgtcacccaggctggagggcaatggcaaaatctcagctcactgcaccctctgcctcctgggttcaagtgattctcccacctcagtctcccaagtagctgggactacaggcgtgtgccaccacacccagctaattttttgtattt

SEQ ID NO: 198 - DNA, 4057 bp, Homo sapiens
gtgggttctctgtccctaactatattagaatctccttgagtacagaattcatgagtgcatgctgcttttatactctttgctaccctagtgcacttactcaatgcttctaactcattcatggcagtgcccatttggctcctgagaattggattagtgcctaagacagagtggtgggtactttgggttcgccatacagtgtgagtttgctgaacacctcttgctttgatgattagtgtgggtttttcttggctttgtttttacagagtacagcgcctgaggaggagcatgagagtccccgagctgaaactcccagcactgtcactgaggttgacatggatctggacagctatcagattgcgttggaggaagtgctgacctggttgctttctgctgaggacactttccaggagcaggatgatatttctgatgatgttgaagaagtcaaagaccagtttgcaacccatgaagtaaatatctgtagtttcttagcagggtgtgtcccccacgggacctgagccttaatcagggactctactctcctatttgttatctactgaattctgttctttggaaaggtcaatggtttatttcaggaactgtgatatttaaatagtgctttgtcacaaaattggtatgggtgattaaactgtgcctcagaattagattttagattttagtctccttgtgtgttttggagagccactgatgaaaatcattgcatagtactgctcagttctgaagtgcattgttatatttcaaaagcaaacgagtgaaccaatacaccaaatctttaagatttgagtgttccctaggaaatgattattctttttaattgcatgattaagcaaatgtcatacccagggttcctgtattttttcatatcataaaagtttcctgctcctttgaggacatactatattgcagcatagtgaatttcactatatggagatttcttttggttaaatttttcttttgtatagttatgtgaattgacagatcttatttgttgttttggatagaaaataatataagtggtaatatctcttaaacagttcctcttgggtgagtatggtattttattttatatatatatttatatatataataaataaatatatatttatatataaatatatataaataaaaataaatatatattttattttatatataaataaaatatataaataaatatatataaataaaatatataaatatttttatatataatctatttatatattatatatgtatatgtatatgtgtgtgtatatatatatatttataatttttttttttttaacagagtcttactctgtcacccaggctggagtgcagtggcacaatcttggctcactgcaacttctacctcctggcttcaagtgattctcctgcatcagcctcccaagtagctgggactgcaaacatgtgccaccacgcccggctaattttttgtgtttttagttagagacggggtttcaccttgttgtccaggctggtcttgaactcctggcctaggtgatccacctgcctcagcctcccaaaatgctgggattataggtgtgagccaccacacccagccttttattttatttatttagaattccatgttcatgatctatgagtagcatagtcagcatttactttaaaatagctggtattatcagatgcatcattgcttgctttgagctatttctcttttaacttatggcaggtgtttattcctattttcagagattaaaaaatgtggtcaatgtctattttatttgcgctctactaggctacctttttctgcatcactgacatttaggttaggcattagcaatttgttcagtcttccttttttttttttgcactgagtagctcacaaattataacaatgtccctttctaggcttttatgatggaactgactgcacaccagagcagtgtgggcagcgtcctgcaggcaggcaaccaactgataacacaaggaactctgtcagacgaagaagaatttgagattcaggaacagatgaccctgctgaatgctagatgggaggctcttagggtggagagtatggacagacagtcccggtgagtggaaagccaagaaatgcacttaattccacaggctgctttgcacagttgagctctagtagatgtctgcatgtctgtgaaagcgagatgattacagaacttgccttggaaaagtaagactcttttctacgggtaatattgctggaattctgcatgatctttgtttcccctttgatgtgttagccacaccaaaagataaaagttggaatacagaatttaacaaaaaggaaaaagaggataggcatggtggctcatgcctgtaatcccagcacttgggaggccaacgcggatggatcacttgaggccaggagtttgagaccagcctgggcgacatggcgaaactccgtctctactaaaaatacaaaaattagctgggcatggtgggccatgcctgtaatcctagctacttgggaggttgaggtatgaggatcgcttgaactcaggagacagagattgcagtgagctgagattcagccactgcactccagcctgggtaacaaagtgagactgtctccaaaaaaaggaaaagacatttcataggggcagttacttatttgcaatgttaagattagctaaacattaacttggtgtgaagacaggactatggagtattgatctacttttccattttgtgacttttattttaaagctttctcatggtttattttatttcatgtattgtgtcttaaggagcaaactgcattcattgccacttccacctatttaataagcaggaattcctgattgaagaaacaatgattctgatatgaatacagggtgctgctttttgcattctttgtctgcatttaatgaactccatttaggacaaaataaaagtttactttcctggcttctatatttaaagactaaatgctaccttgaatgtttagacaagggtgtcttcccttgccctgtatctccggtgcccagaatgtatatttgactttgcaaagggaaaaggcttgtaggaataatgctgtgttccccacggacaggctgcacgatgtgctgatggaactgcagaagaagcaactgcagcagctctccgcctggttaacactcacagaggagcgcattcagaagatggaaacttgccccctggatgatgatgtaaaatctctacaaaagctgctagaagaacataaagtaaatctgtctcatatttcttcgataccttatcaaatatgaaagagcagcacttagcatctcagaggctgatgacatctatcgttaacatgaagttgggacacttcttcagggttgtcttcatttagcagctcacagggtggaattgatagagatgagacttttctgagccagggataaaagggcacggtaaaattttatatgtgatgtgcagttttcttttgaaagtacatagctttcatacaactggagaagggttcttttggccctctaagtggctaagaacccaagcatgttggcgttcacatggtgtgtgggtgaagagcaaattcttcgtctatgattcaggaaagcgtcaggcattaagttaggaaccaaaattgggtgggcaatttaatttggtcacaagtctaggagataaacttttcatagtcaagataaggaaagatagaataaaatatgctctctgtaaattgaagacttttattgatcagtgaaacattgaggtaactaatatgtaaaactttaggaatacattaaacacaactctgagaagcatttgagaacactattgatagtatttaaataaattttctttctttctttcttttttttgagatggagtcttgctctgtcacccaggctggagggcaatggcaaaatctcagctcactgcaccctctgcctcctgggttcaagtgattctcccacctcagtctcccaagtagctgggactacaggcgtgtgccaccacacccagctaattttttgtattttttgtatttttagtaaagtcagggtttcaccatgttggccaggctggtcttgaactc

SEQ ID NO: 199 - DNA, 4066 bp, Homo sapiens
tttgtgacttttattttaaagctttctcatggtttattttatttcatgtattgtgtcttaaggagcaaactgcattcattgccacttccacctatttaataagcaggaattcctgattgaagaaacaatgattctgatatgaatacagggtgctgctttttgcattctttgtctgcatttaatgaactccatttaggacaaaataaaagtttactttcctggcttctatatttaaagactaaatgctaccttgaatgtttagacaagggtgtcttcccttgccctgtatctccggtgcccagaatgtatatttgactttgcaaagggaaaaggcttgtaggaataatgctgtgttccccacggacaggctgcacgatgtgctgatggaactgcagaagaagcaactgcagcagctctccgcctggttaacactcacagaggagcgcattcagaagatggaaacttgccccctggatgatgatgtaaaatctctacaaaagctgctagaagaacataaagtaaatctgtctcatatttcttcgataccttatcaaatatgaaagagcagcacttagcatctcagaggctgatgacatctatcgttaacatgaagttgggacacttcttcagggttgtcttcatttagcagctcacagggtggaattgatagagatgagacttttctgagccagggataaaagggcacggtaaaattttatatgtgatgtgcagttttcttttgaaagtacatagctttcatacaactggagaagggttcttttggccctctaagtggctaagaacccaagcatgttggcgttcacatggtgtgtgggtgaagagcaaattcttcgtctatgattcaggaaagcgtcaggcattaagttaggaaccaaaattgggtgggcaatttaatttggtcacaagtctaggagataaacttttcatagtcaagataaggaaagatagaataaaatatgctctctgtaaattgaagacttttattgatcagtgaaacattgaggtaactaatatgtaaaactttaggaatacattaaacacaactctgagaagcatttgagaacactattgatagtatttaaataaattttctttctttctttcttttttttgagatggagtcttgctctgtcacccaggctggagggcaatggcaaaatctcagctcactgcaccctctgcctcctgggttcaagtgattctcccacctcagtctcccaagtagctgggactacaggcgtgtgccaccacacccagctaattttttgtattttttgtatttttagtaaagtcagggtttcaccatgttggccaggctggtcttgaactcctgacctcaagtgatccgcctgccttgggttcccaaagtgctgggattacaggtgtgagccaccatgcccagcctataaattttctatacacatgtatccaatgactatgctcttcccatggaaaaggcgagagaatctaaggtgtccatacttctttaactgctttattgggtagctaatcagagtaacttttgactatcgtgtagcattctacttatctctttatactgtcctacactagataaaatgatctctgacttggtttatttaagctctggacttttttgctttaccacttctacatttttgtattaattcctagtatggacactcaactcctttatgctataaattctgagggagggccagaacttgaataaaagtggtgatatctccatttgcagtctgttataacactgcatcctcaaactgcctttgttgataatggaatgtaaagatgtataataggattagtttcattagtagaacagttagggtaatgattggaaatttaaatatgatgcctcattaactgtccttaattactattgacaactgagtgcgttttaaataggtaaatgtgaaagtagaaataatggtttatcttaatttttttctctagagtttgcaaagtgatcttgaggctgaacaggtgaaagtaaattcactaactcacatggtggtcattgttgatgaaaacagtggtgagagtgctacagctatcctagaagaccagttacaggtaagagtgctgtaaagttggataatcctgagggacctgtggtctgagacccaattacatattgcccttgttcttcatgtcctttctcattctttatccagaagggtagaaaaacctacctttgattgtacttctcagttggggttctacagtgtgtgggctacaggagtacccaggtattgattcctttacttcagctcttggggtgaatggatggggctggttgcagtccccagcttccttgtgcataatgacaagatttggaagcacagtgtattagtccgttttcacactgctgataaagacatacctgagactgggaagaaaaagaggtttaagggacttacagttccatgtggctggggagacctcacaatcatggtggaagggaaggaggagcaagccacattttatatggatggtggcaggcaaagagagggagcttgtgcagggaaactcctttttttaaaaccatcagacctcgtgagacttactcactatcacaagaacagcaagagagagacctgcgcccatgaatcaattacctcccactgggttcctcacttaaaatgtgggaattgtgggagttacaattcaagatgagacttggatggggacacaagcaaaccatatcattccacccctggcctctcccaaatcttatgtcctcacatttcacaaccaatcatgctttcccaacagtacccccaaagtcttaactcatttcagcattaactcaaaagtccacagtccaaagtctcatctgagacaaggcaagtcccttccgcctatgagcctgcaaagtcaaaagcaagttagttacttcctagctacaatgggggcacaggcaaagagtaaatacatctgttccaaatgggagaaactggccaaaacaaaagggctacagtccccattcaagtatggaatacggtggggtagtcaaatcttaaagcttcaaaatgatctcctttgacttcatgtttcacatccaggtcacgcctatgcaagaggtaggttcccatggtcttgggcagtgctgcctctgtggctttgcgggaaatagccccctcctggctgctttcatgggtcagtgttgagtgtctgcggcttttccaggtgcatagtgcaagctgtcagtggatctaccaccctggggtctggaggacagtggccgtcttctcacagctccactaggtggtgccacagtagggactctgtttgggccacatttcccttctgcactgccctagcagaggttctccatgagagccccacctctgcagcaaacttctgcctggacatccacgtgtttccatacatcctctgaaatctaggtggatgttcccaaacctcaattcttgacttctgtgtacccgcaggctcaacaccacatggaagctgccaaggcttgtggcttgcacctttgccatggcctgagctgtacctttgccccttttagtcatggctggagcagctgggatgcagggcaccaagtacctagccacaaggcacggggaccctgagcccagcccacaaaaccattttttcctcctaggcctctgggcttgtgatgggaggggctgatgtgaagacctctgacatgcctggagatgttttccgcattgtcttggtgattaacttttgcctctttgttacttatgcaaatttctgcagccagcttgaatttctcctcagaaaatgagattttcttttctattgcattgtcaggctgcaaatttctcaaacttttatgatctgtttcctttataaaactgaatgcctttaacagcacccaagtcatctcctgaatgctttgctgcttagaaatttcttccacaggtaccctaaattttcccacatttttctgtcttcttctgagctctccaaatgtttccaacctctgcctgttaccgagttccaaagtcacttctacattttagggtatcttttcaacagcaccccactctactgg

SEQ ID NO: 200 - DNA, 4050 bp, Homo sapiens
ttttcccacatttttctgtcttcttctgagctctccaaatgtttccaacctctgcctgttaccgagttccaaagtcacttctacattttagggtatcttttcaacagcaccccactctactggtaccgatttactatattagtccattttcatgctgctgataaaaacatacctgagactgggaagaaaaagaggtttaatggacttacagttccacatcgttggggaggcctcacaatcatggcagaagggaaggaggagcaagtcacgatttacatgcatggtggcaggcaaagagagagagcttgtgcagggaaactcccttttgtaaaaccatcagatctcgtgagacttattcactataatgagaacagcatgggaaagatctgcccccatgcttcaattacctcccaccaagttcctctcaaaaaatgtgagaactgtggtagttataatgcaagatgagatttggatggagacacaggcaaaccatatcacacaggagctgatcttattaagtgatccactgacttcttctcagaagcacttgaggagcttgttaaaatgtagattcctaggctctacccactacctaaatctaggtgagggagggatgcagtgaatttgcaatgtaagaaaaatcatgtgcatagtaaagtttgagaatttcacctagtaggattcaatatctcagtgttttcggtagattaatatgtgaatttcaacaacagttttggaaacctcccaaaattgcttctttttgcacaaaggcaatagtgtatctttacaagtctttaacagataaatttattggtatttcatttgaacaatacttggattttctggtaagacgttgccaatttatttaaatatgatgcctcattaagtgaggcaatccaaactgtaatttcatcacgtgaggtccttttgcttttgtgatatttaaagtcagccagaggttctaagacttgtatgcagtagttagttattataacctgagagctaagtattcatgccttgactatttagcagtaaggaatctgagattcagagaggttaagtagtcctcctgagatttaaatagacaatgagttatcatgctgagactggaaatctatcttctggctcttaagttttctccccctttgtactatgaaaagcttattctcatattaagtatcaaaatagtataatatgaattaaataattcttgttcacatgtatatagtacaaaaataaattttaacatttgttaatcattatttgtaaaattgtaataaaatgattttgggagaaaataatcatgaagagtgattttttataattaataaaatttatttagtattgctgatactagtaagattctattgctaatttatgtaacttatggggaatttttttatggatcacataatgtaaacagaacaaatcatttgatttttttattgtctcataaaaattctcttattcaaaacaggttttataagttaaacatttttcataattttggtaccacagatgaaaattttcttggcatgtaaaagagagttaaggaatataacagacatgctggtttttttagctaaaaatttgaaaaatttgaagcacaaaaagtagatatgtttgttttattttttaataatatgtaaaaatgtcatattctcataaaaaccacaatgaaatagaaagagcaggtttggagtcaaagattcagaggatacagttctattatgttagtttctagctatgtgaaatcatttgttcaattctatggaaattagtttttctgattcatacatttctaggcctagtctgttattttaaagcaatttttataaaaatactttttataagttgttattctataataaagaacaatggaaatcatgaatttcttcaaggattgtgataactctctcttaaggctgtgttgacaaaggatggtttctcctttttctagaaacttggtgagcgctggacagcagtatgccgttggactgaagaacgctggaataggttacaagaaatcaatatattgtggcaggaattattggaagaacaggtatgaaactgttttccataaggggcaaaataaatggtgaaaagtaacccatcttttattgtgactttagaataaagttgccttgtttacttttctttgaaaggaaaatatataaataattattttaaagatcaaatttctatccagtttataactgatcatgaagcttattcacagagattgtgtcatttggctccattaatttgacctgttttcattacttggaatgttagtacttagaagatatgctattttcatgatttgtttgacatcatagttattagtggatttgtgttgggtgatgtatttgaatttgtatcaacacaatgcctagcatataatttgtgctcagtaaataatgagtaatgaatccactcaacacactgtgaactttaattccctagattttttcttgatttttaacaagtattgaaattaatgagaaaatattatttagtcacacctttgatttaacactggattaattgcatattttttccactaagtgttatcacagcaaatgaatctgttgtacaaagctgccaccttaatttttcaataggactggtggctctttgcctgttctctgtctttccagaaaagcaaccattgaaacaaaatacaaataaacaaaacttttctccccaaatgccaaacagttgtggtttaaaaaataagtagatactggccgggcagggtggctcacgcctgtaatcccagcactttgggaggctgaggcaggtggatcacttgaagtcaggagttcaagactagcccggccaacatagtgaaaccccgtctccactaaaaatataaaaataagccaggtgtggcggtgggtgcctgtaatcccagctactcaggaggctgaggcaggagaattgctggaacccaggaggcagaggttgcagtgagccgagactgtgccactgcactccagcctgggagacaagagcgagactccctctcaaaaaaaaaaaaaaaaaagcaaatactctattcccacatctctcagtgtccattttgattcttttaaatgcatttcatttccatctataagaagcaactatattctcttcaggggaaaaaactcaagtgtgtgatgttttgtggcttactaaatatggtggcagatagttgcagaatttgtccaaatataaattgttaatgactacttccccccccgccctcaatctgtggtcagatttttcttattaggaatcacaaaagggacctgattctgatttatgaaatgtttacatttcatgttacaaatatttacatttcactttataaatatttatgtttattgtgaaccttgtatttaggccaaaaagtctcagaatagttaaaattttacttcaataatgacagtagaaaggctgggcgcggtggatcacgcttgtaatcccagcactttgggaggccgaggcgggcagatcacttgaggtcagaccaacatgttgaaacctgtctctactaaaaatgcaaaaaattagccaggcctgcagtgggcacctgtaatcccagccactcaggaggctatggaggcaggagaattgcttgaacccaggaagcagaggttgcagtgatccgagatggcaccactgcactccagtctgggtgacagagtgagactctgtctcaaaaaataaaaataatagtaatagtaataattgcagtagaagacatcgattgctagagaaaaccattgtgttactcttctatccagtaaagtaattgcaaatttggaaataattttaatttgatgataaaaaacagtttaaaaatagagtgctagtatttcagtcacttgtaccactttaggttttaaactgacctttcatcgtgttctataatgatctgacattttaactataccttttgtgtgtgtgtgtgtactgtctacatgttctgtctgatggcatcattatttatgtgcatatcttaccagcctcactagactgaggacagtatccattgggggg

SEQ ID NO: 201 - DNA, 4041 bp, Homo sapiens
aggttgcagtgagccgagactgtgccactgcactccagcctgggagacaagagcgagactccctctcaaaaaaaaaaaaaaaaaagcaaatactctattcccacatctctcagtgtccattttgattcttttaaatgcatttcatttccatctataagaagcaactatattctcttcaggggaaaaaactcaagtgtgtgatgttttgtggcttactaaatatggtggcagatagttgcagaatttgtccaaatataaattgttaatgactacttccccccccgccctcaatctgtggtcagatttttcttattaggaatcacaaaagggacctgattctgatttatgaaatgtttacatttcatgttacaaatatttacatttcactttataaatatttatgtttattgtgaaccttgtatttaggccaaaaagtctcagaatagttaaaattttacttcaataatgacagtagaaaggctgggcgcggtggatcacgcttgtaatcccagcactttgggaggccgaggcgggcagatcacttgaggtcagaccaacatgttgaaacctgtctctactaaaaatgcaaaaaattagccaggcctgcagtgggcacctgtaatcccagccactcaggaggctatggaggcaggagaattgcttgaacccaggaagcagaggttgcagtgatccgagatggcaccactgcactccagtctgggtgacagagtgagactctgtctcaaaaaataaaaataatagtaatagtaataattgcagtagaagacatcgattgctagagaaaaccattgtgttactcttctatccagtaaagtaattgcaaatttggaaataattttaatttgatgataaaaaacagtttaaaaatagagtgctagtatttcagtcacttgtaccactttaggttttaaactgacctttcatcgtgttctataatgatctgacattttaactataccttttgtgtgtgtgtgtgtactgtctacatgttctgtctgatggcatcattatttatgtgcatatcttaccagcctcactagactgaggacagtatccattggggggtgaaatatagaggcaaggaatagttgttaaatatttaattcataaataaaattgctgagaaagaattgattccgttgcaaatacagaaccaagttgttttcctccctactaaatagaaaagggtttccaccctaaatgctacattttgggagaaattatcacaatgtagctacggttgttttccatcccttcttcaggattatctctctacatgactgaatatcctctgcttagaaaacacacattgttgtccaatgaagttgaaaaatctttatatgggctttgggtgctcttcagactccctcctttaatcataattgctgttgaaccttgaatgctagtgtggatttcctacatgatgccatggaaaacactggttttggggtgtggaccctggacccagctctgccattaactatccaagtgatctgggacatgtaacttgacttctctttccttcctttctaaaatgaggggctgggacaagacaatctccgagcttacttctgcctctaggaagttgtaatgtaattcctttggagacttgcatagttggattttcccttttccctccacctatctccttgagaattaggtttagttccctaggtatgaggctaatgtctgattgttctgttacaaatctgagaaggataatattttaaagaaaggtatctttctgggtcatttgtgcctcagacttaggtgtttgaaggccttcttatccccatgtaagggtgaagcctctaataaaataaaagttagaaatttggatgcatgatttaattgaattaccaaatgattttgcagataaagttcaacttttgttattacttgtagtgcttgttgaaagcttggttaaccgaaaaagaagaggctttaaataaagtccagacaagcaacttcaaagaccaaaaggaactaagtgtcagtgttcgacgtctggctgtaagtgatggggttgtcagcatctgtgttgtaagcctatgatatcttaatgttttatagctaatggttagtagaatttagtgaatgcagattacagctcattacctagcattagactgctgccctgtaacaatctggaaccacgagtcttaccttttagcatagtgaactgcaaagcatgtacattttactataaaagatacatgtttaaaatttttggctggggaacagaaagacaaagtcctgttaaaaagagtcatctaataaatatctgaaatactagattttgaaggaagacatggaaatgaagcgtcaaacattggatcagctgagtgagattggccaggatgtgggacaattacttgataattccaaggcatctaagaagatcaacagtgactcagaggaactgactcaaagatgggattctttggttcagagactagaagattcctccaaccaggtactttttgatttggatcatatgttgtgccatgaagtaaacatttaaaatttaaatgttcaggttagttttaatttgtatgaaataaactaaaaagttgtttccttacacctgatgaaaaattgacatgtgaaaatcaccttcagttttctaaagtaagttttaatagattatcttaatatcctataatttaatttatagtaactgattatacttagccaataaataatcttaacatcttaaatcttaagtaatcttattaatcttaaaaatattttaatgaattagtcaaacataaaacattggtttgtagacagatattcttagcagcattatttataatagccaaaaagtggaacaactcaaatatccatacacagatgaatggataaacaaaatgtggtgtatgcatacaatattatctgataatacaaaagaacgaagtattgacacatgctacaacatagatgaaccttgaaaacactatgctaagtataagaagccaatcgcaagattatatacgctatgattccattcataggaaatgtccacaaggggaaaatccacagagatagaaagtaaatgcatggttgccactggtgggagtggggaatggggagtgttggtttatggctatgggatttctttttggggtgataaaatgttctggagacagactgtgaggatgattatacaactgtataaatgtgctaataaccattaaattgtgtatttcaaagaaagaattttatagcatgtgaattacatctcaatgaagctgttataaacattgaaattttggatggcttttatttcaggtgactcaggctgtagcaaagctggggatgtctcagattcctcagaaggaccttttggagactgttcgtgtaagagaacaagcaattacaaaaaaatctaagcaggaactgcctcctcctcctcccccaaagaagagacagatccatgtggatattgaagctaagaaaaagtgagaagagatagagaaattgttcaaatccaatattgcacatactatattttctacttggtgcctattttgtactaatcattaatcataggcaaatctagacataataagtattattattatgaaaagtcaactactgaaccactcactgcccctgtcttctgaatattctacttggcactagctaagcatccaaattttcttggatgattttatttatcctgtgttcaattgggagaactttgtgatcgaagctttctttcttcctttcccattattctccttggaaggatatgattgtccatgactgtctttttattctttctttcactgtcacaactcgacagtgacctcctcagtctttgaatatagcttccccagtttttattgtcagaaagtgcaggggatccttaaccattcctattaacatggtttccagacccttttatatcttctgtctgctctagaaaccactattggtttgccttaaaatggactaccccaataatcgagggccttaaatgactgcttaatgcagtgcctagtttaaaatata

SEQ ID NO: 202 - DNA, 4027 bp, Homo sapiens
aatcacaaaagggacctgattctgatttatgaaatgtttacatttcatgttacaaatatttacatttcactttataaatatttatgtttattgtgaaccttgtatttaggccaaaaagtctcagaatagttaaaattttacttcaataatgacagtagaaaggctgggcgcggtggatcacgcttgtaatcccagcactttgggaggccgaggcgggcagatcacttgaggtcagaccaacatgttgaaacctgtctctactaaaaatgcaaaaaattagccaggcctgcagtgggcacctgtaatcccagccactcaggaggctatggaggcaggagaattgcttgaacccaggaagcagaggttgcagtgatccgagatggcaccactgcactccagtctgggtgacagagtgagactctgtctcaaaaaataaaaataatagtaatagtaataattgcagtagaagacatcgattgctagagaaaaccattgtgttactcttctatccagtaaagtaattgcaaatttggaaataattttaatttgatgataaaaaacagtttaaaaatagagtgctagtatttcagtcacttgtaccactttaggttttaaactgacctttcatcgtgttctataatgatctgacattttaactataccttttgtgtgtgtgtgtgtactgtctacatgttctgtctgatggcatcattatttatgtgcatatcttaccagcctcactagactgaggacagtatccattggggggtgaaatatagaggcaaggaatagttgttaaatatttaattcataaataaaattgctgagaaagaattgattccgttgcaaatacagaaccaagttgttttcctccctactaaatagaaaagggtttccaccctaaatgctacattttgggagaaattatcacaatgtagctacggttgttttccatcccttcttcaggattatctctctacatgactgaatatcctctgcttagaaaacacacattgttgtccaatgaagttgaaaaatctttatatgggctttgggtgctcttcagactccctcctttaatcataattgctgttgaaccttgaatgctagtgtggatttcctacatgatgccatggaaaacactggttttggggtgtggaccctggacccagctctgccattaactatccaagtgatctgggacatgtaacttgacttctctttccttcctttctaaaatgaggggctgggacaagacaatctccgagcttacttctgcctctaggaagttgtaatgtaattcctttggagacttgcatagttggattttcccttttccctccacctatctccttgagaattaggtttagttccctaggtatgaggctaatgtctgattgttctgttacaaatctgagaaggataatattttaaagaaaggtatctttctgggtcatttgtgcctcagacttaggtgtttgaaggccttcttatccccatgtaagggtgaagcctctaataaaataaaagttagaaatttggatgcatgatttaattgaattaccaaatgattttgcagataaagttcaacttttgttattacttgtagtgcttgttgaaagcttggttaaccgaaaaagaagaggctttaaataaagtccagacaagcaacttcaaagaccaaaaggaactaagtgtcagtgttcgacgtctggctgtaagtgatggggttgtcagcatctgtgttgtaagcctatgatatcttaatgttttatagctaatggttagtagaatttagtgaatgcagattacagctcattacctagcattagactgctgccctgtaacaatctggaaccacgagtcttaccttttagcatagtgaactgcaaagcatgtacattttactataaaagatacatgtttaaaatttttggctggggaacagaaagacaaagtcctgttaaaaagagtcatctaataaatatctgaaatactagattttgaaggaagacatggaaatgaagcgtcaaacattggatcagctgagtgagattggccaggatgtgggacaattacttgataattccaaggcatctaagaagatcaacagtgactcagaggaactgactcaaagatgggattctttggttcagagactagaagattcctccaaccaggtactttttgatttggatcatatgttgtgccatgaagtaaacatttaaaatttaaatgttcaggttagttttaatttgtatgaaataaactaaaaagttgtttccttacacctgatgaaaaattgacatgtgaaaatcaccttcagttttctaaagtaagttttaatagattatcttaatatcctataatttaatttatagtaactgattatacttagccaataaataatcttaacatcttaaatcttaagtaatcttattaatcttaaaaatattttaatgaattagtcaaacataaaacattggtttgtagacagatattcttagcagcattatttataatagccaaaaagtggaacaactcaaatatccatacacagatgaatggataaacaaaatgtggtgtatgcatacaatattatctgataatacaaaagaacgaagtattgacacatgctacaacatagatgaaccttgaaaacactatgctaagtataagaagccaatcgcaagattatatacgctatgattccattcataggaaatgtccacaaggggaaaatccacagagatagaaagtaaatgcatggttgccactggtgggagtggggaatggggagtgttggtttatggctatgggatttctttttggggtgataaaatgttctggagacagactgtgaggatgattatacaactgtataaatgtgctaataaccattaaattgtgtatttcaaagaaagaattttatagcatgtgaattacatctcaatgaagctgttataaacattgaaattttggatggcttttatttcaggtgactcaggctgtagcaaagctggggatgtctcagattcctcagaaggaccttttggagactgttcgtgtaagagaacaagcaattacaaaaaaatctaagcaggaactgcctcctcctcctcccccaaagaagagacagatccatgtggatattgaagctaagaaaaagtgagaagagatagagaaattgttcaaatccaatattgcacatactatattttctacttggtgcctattttgtactaatcattaatcataggcaaatctagacataataagtattattattatgaaaagtcaactactgaaccactcactgcccctgtcttctgaatattctacttggcactagctaagcatccaaattttcttggatgattttatttatcctgtgttcaattgggagaactttgtgatcgaagctttctttcttcctttcccattattctccttggaaggatatgattgtccatgactgtctttttattctttctttcactgtcacaactcgacagtgacctcctcagtctttgaatatagcttccccagtttttattgtcagaaagtgcaggggatccttaaccattcctattaacatggtttccagacccttttatatcttctgtctgctctagaaaccactattggtttgccttaaaatggactaccccaataatcgagggccttaaatgactgcttaatgcagtgcctagtttaaaatatatgcttaaaaaatggcagctcatttccacttctcttcccctggtgctgctgtggtggtggtttttaccagctcgcggtacagtggacagtcatttcctagaatgtagacacctgttcctgtgacctgcgatcattgcatcactcttgcccatattgagagcagatgctgactgagtctccaaggtcattggaaacgtgcgatttttagatggccgtctcttctctgaaatattaaatagaaagctgctgttaagatgacaggaggaacatatccctgtttgagcaataccttgaccccagatat

SEQ ID NO: 203 - DNA, 4078 bp, Homo sapiens
tcatttcctagaatgtagacacctgttcctgtgacctgcgatcattgcatcactcttgcccatattgagagcagatgctgactgagtctccaaggtcattggaaacgtgcgatttttagatggccgtctcttctctgaaatattaaatagaaagctgctgttaagatgacaggaggaacatatccctgtttgagcaataccttgaccccagatatttatctagagcatcacaaaatccctcacattttacagggaaaatctaccttgatgaaaagataaaatattcatagttcaccagaaacactttaagcaaagtttctcacaagaatcagcaataacgacttgtgccactgcttaatgtatcgagaagctctgtggggagggtactagttaagaagacagtcttggtttgaatcccagcctcaccctttgttagctttgtgacatgggacagttactgaaaacctctgtgagctcagtaccttcatctctaaaggggataataatagtgtatactttttagggtgctggtgaggattccttgagttaataatagacataaaacacttagaaaggggccgggtagaaggccagcaatcagtgatcgtgactcctcttgttcctccttgctgtggttttgaccaaccttctcaacacctctcaaacctgtcctttcgtcttccttcccactgttactatcttagttgtgactcccgttgctttcacagcctgttctcgactcgtctctctttaatgccttctcctcagtgaacactaaaggataaatagaatcatgtcagttccatgcatagaactctcccttggctctcaactgcctttgggttaagtccaaactccttaatatgtcctgcagggccttcttgtagctggtccatgtgattcttggccacatcgtcaattgtccctcccttgtgagttcagtactcattattccagacacgcctaactaatacttgcagtttgcaaaatgtgatcttccctttctctgctttcccttggcaagggaaactcctcagtgtaatgctgttgttctcctttaggaagccatccatgccccaattggattagaagccactcctgtgaattcctggaattagcacctagcaaattcttttgttattgcctgttactttccattgcttactagactagaagctccttgggagctgagatttgtatctggttcactttcatatcaagagcccagcccagtgcctgacatttagtaaggctcaatcattacatattgaacaaaagaagatgttaactttagtaatgtctgtacttgttctttgctgattatctaaccaactctggtttttattatctataagcatttataaaaatacaagtgattccttataaaggtgaaaattgttttaatatgtaaagttttaaaaatttttatttaaggccaggcatggtgggtcatgactgtaatcacagcactttgggaggccaaggcgggccgatcatgaggtcagcctggccaacatggtgaaactctgtctctactaaaaatacaaaaattagctgggtgtggtggtgggcacctataatcctagctactcgggaggctgaggcaggagaatcctttgaatctggaggcggaggttgcagtgagccgagatcgtgccattgcactcaagcctgggtgacagggcgagactccatctcgaaacaacaacaacaacaacaaattatttaattattttcttcaattgtttattaaccctataatattattactcttttcatacttttagttgtaaatatatgatctcattttgcatggttaccctatttctgggttgctgtttttgggggagtgataaaaagacatattcctgatgagcatttgagttgctctttctggagtcaagtaaaacagtagaaggaaacatgacaaatggtcacctctgaatcttcaaacaggtttgatgctataagtgcagagctgttgaactggattttgaaatggaaaactgccattcagaccacagagataaaagagtatatgaagatgcaagacacttccgaaatgaaaaagaagttgaaggtaaaaaacataaaccacatatatcctagtgcataaaatagttcatcatgctggattttctgctggcataaagacattatggaattcaaaagcctcctgtaaaataaatgtaggcagaaggtagcttttagtacattgtagtgaattttgaatccattcatgctagctgtcatcagatccctatttggaggacgttttttttttttcatctttgtcagtcactgagatgtacagtgaggaatacttcttatggtgatccagttagtggtactactttttagttagtttagatcacccttaatctggtatctaataatttatgactctatattaacattatgctgaagatgttttgccttcggaatacaacaaactattttaaatcaaaaagtgtattcaatatattttctttagagttgtaaaaaataaatacaattaaaaggtgtgggatcttagccctgccgctttccatgcttatgtgtgtttctgaagagtgtgatgggaacttgcagagcttttttgtcctgggtgctcatacgtctcctacacattactgcattaactatttgggcacctgggtagagaatctatagtctagtctcctgccatcttaagaggtagcaaaaaatcaacttgtaaaaagtagataattgcctttttctccagttcgatggtgacttttacattgatctttagttagacaaaataaacggtgtttcttagagtctcttactaatattccttgatctttgactataagaaggttgttctacctagtcacagtaaactttgtgaaaatcaaagtaggatagctgaatttatttgatagcacttacatgtaaacaatttagaattgggattcttctctggattgtctggttgaagtaatatgggttgctcagaagttgtgattgtgttatgatggatactatttgaatagtatataaatatgaataatatataaatatcagttggggatggaggaatgagagaaaattcaaataccgagttgtgtgcacatatagttgtgtttttgtgtgtatacatgattttacttgcttcattcttactagttctggaaagaattttgtcttgggagtatcaaactatagagataaaaaaaataatgaaattaggagccattcctcaacataaagaacaaaatgtgggttgggcttgccatggctcacgcttataattccagcacaaggcaggaggattgcttgagcccaggagtttgagaccagcctgggcaccatagggagacccccgtctctacaaaaagtaaaaaaaaaaaaaaatttgtggggcgtgagcttgcacttgtaactccaactactcgggaggctgagataggaggatcctttgagcccaggaggttgaggctgcagtgagccatgattgtgccactgcaccccagcctgggtgacagagtgacaacctgcctcaaagaaaaaaaaaaaaaaaaggaacaaaatgctttggtttgggttctaaagcatatttactattttcattatttaaaaattatgtatgaaatatgattgtgcttgaagtttgcattgaaccctagacttaatataacccaaacaaataatactgagcctcaaaatatttctatccattttttctgttttctttcttttgagatgggagttttgctctgttgcccaggctggagtgcagtggtgcaatctcggctccctgcaacctctgcctcccgggttcaagcaattctcatgcctaagcctcctgagcagctgggattataggcacacgccaccacgcttggctaatttttgtatttttagtagagttggggtttcaccatgttggccagactggtctcaaactcctgacctctagtgatccacccccctcagccttccaaagtgttgggattacaggtgtgagccaccatgcccagcctatccttttttcttgttagttaatttttgttcaacaacttctgtcataacacattcaattcttttgact

SEQ ID NO: 204 - DNA, 4041 bp, Homo sapiens
taacattatgctgaagatgttttgccttcggaatacaacaaactattttaaatcaaaaagtgtattcaatatattttctttagagttgtaaaaaataaatacaattaaaaggtgtgggatcttagccctgccgctttccatgcttatgtgtgtttctgaagagtgtgatgggaacttgcagagcttttttgtcctgggtgctcatacgtctcctacacattactgcattaactatttgggcacctgggtagagaatctatagtctagtctcctgccatcttaagaggtagcaaaaaatcaacttgtaaaaagtagataattgcctttttctccagttcgatggtgacttttacattgatctttagttagacaaaataaacggtgtttcttagagtctcttactaatattccttgatctttgactataagaaggttgttctacctagtcacagtaaactttgtgaaaatcaaagtaggatagctgaatttatttgatagcacttacatgtaaacaatttagaattgggattcttctctggattgtctggttgaagtaatatgggttgctcagaagttgtgattgtgttatgatggatactatttgaatagtatataaatatgaataatatataaatatcagttggggatggaggaatgagagaaaattcaaataccgagttgtgtgcacatatagttgtgtttttgtgtgtatacatgattttacttgcttcattcttactagttctggaaagaattttgtcttgggagtatcaaactatagagataaaaaaaataatgaaattaggagccattcctcaacataaagaacaaaatgtgggttgggcttgccatggctcacgcttataattccagcacaaggcaggaggattgcttgagcccaggagtttgagaccagcctgggcaccatagggagacccccgtctctacaaaaagtaaaaaaaaaaaaaaatttgtggggcgtgagcttgcacttgtaactccaactactcgggaggctgagataggaggatcctttgagcccaggaggttgaggctgcagtgagccatgattgtgccactgcaccccagcctgggtgacagagtgacaacctgcctcaaagaaaaaaaaaaaaaaaaggaacaaaatgctttggtttgggttctaaagcatatttactattttcattatttaaaaattatgtatgaaatatgattgtgcttgaagtttgcattgaaccctagacttaatataacccaaacaaataatactgagcctcaaaatatttctatccattttttctgttttctttcttttgagatgggagttttgctctgttgcccaggctggagtgcagtggtgcaatctcggctccctgcaacctctgcctcccgggttcaagcaattctcatgcctaagcctcctgagcagctgggattataggcacacgccaccacgcttggctaatttttgtatttttagtagagttggggtttcaccatgttggccagactggtctcaaactcctgacctctagtgatccacccccctcagccttccaaagtgttgggattacaggtgtgagccaccatgcccagcctatccttttttcttgttagttaatttttgttcaacaacttctgtcataacacattcaattcttttgactcaaaccattatttttatggcatggcgtactcagggtatgtatgtgaatagatatcctggatctaaaacataattttaattatttccttctaataggagcttataattatgaggtacattttttttcttacaaaagaaaccaatgctttttagttgctatgattacgtttgaatttaccttttcagatttaaaaagaatgtaggagggccattcaacttaaacatttaaaacagcaacattatattgagaagaaagtttgcaatattcttatgttgggacttcatttgcaggcattagaaaaagaacagagagaaagaatccccagagcagatgaattaaaccaaactggacaaatccttgtggagcaaatgggaaaaggtaagatccttgatttttttcccctatatttttcagatggtggcatcgaataatattacagtttgccctattaaatattttgctttaatactcgaatcctcttttggctagataaatggttttcaaaaatgtttttaggcagcagaatctttaaaaatgaaattttattctgaagctgattgtaaaaaagcagataaaagcaaagttgttctgattttatatggggtcggggctggataccctgattagcagaacagttaaaacccactagcatagtatattttaaaactgtatcctttgggtttatatattgggaatttgtttgcagggtggtagcaaaagaaaactttacttggcaacatttgggaaacgaagttacgttaaattcattaagggtatttgatttttgataacttttaatgcattatatttatttactacagtatttttatagttaagtttgataaggtgttacttatatatgaaatttttaaatgctcccaagacttttttttttgctgtagctcccagtgactcagaataagctaaagattaatattcttgatgtgcagttttgcatatgaatctctctttgttctagagaaatgttgaaagacatttcttgcactccatgtacgttggtctaataatggtaagcactttggaaggctgctgtagctctccttgacacctgtacagatacctatacagaattaggaatattagtttgacaagaatcttaaaagcagtagcatttaattttttattgtttgactttttgttatggaaaatataactgtataaaagcaaatagaatactataatgaacttccttgtatcagttacctagtttagtaattgacaatattctgccattcttgaattatctatacctttactcgttcctcagcctctcaattattactatttttacagttttcttggaagtaaaatttacttacattgaaatacatgacttagctgtgctgttttgacaaatagatatacctgtgtaacctacacacacacatcactgtagaaaatttccatctttccagaaatttctcttttgggttagtcaccttcctccctccagaaaacaactgttcatgttgttttgaccttagattattttgcctccagcctttaacaaatatgtttatttatttagtatgtatactggatatgtgtatacacacacacacacaaacacacagaaacatatatacacacacaaacatatatagatatatacacatacacacaaaatatggaatgtataccatgtggacagtgtatgtccatttattttgaaattatgcaaatgtattatcaatccatttattattaataaatgttaatttctttctttaaataaattaaatagaatagtatttaatattttctttcaaaatccattctagcagattgtcttagttgtccttcctgtgggcatcccacttggaggttactctttccagtatttacttgaagagatccagagacacaaacagatgataacttcccttgagattcattcaataattataatgcattggatgttgaatttatttcctttacaagcatagattttttacttctacctcagcattgtacctggtgactctgactttatctgatgtgaatatgggataatttcttgaatctgtgtactgaatttactcccatttctgtcaggttttcagcagtgtggcagaattatgaagatgggggagacttgatgtagatgagaagttggtgcgaggtgatgttatagtgagaataacagtgattgggggaatgggcaaacttggattctcctgtccttttctagtttcttatccttgggaaagtcttggaacccttgtttctttgccttggtgtctggaaaatgagggagtttattagctgactcttagctgttagtttatcaggtgactattagtttattagctgactataggctttggtccataaaattctaccataaatgggt

SEQ ID NO: 205 - DNA, 4046 bp, Homo sapiens
tcatctagtaaaatacagtagagtagttgggcatctggataatgtggctttatgaatcaatgcccattgtggttgcctaagcatataagcccaggaagtttggtgaaggtcctatgttttgtaaacgtttcccttgattccaatagtgatagactgagaagtgtaaagtcaagtgagactgagtggcaggaatgtgttctatgttctcccttttagacaattaataaagtgatcttctgttgattttgccttttgactagtcaccttctaagaactctgtgttttatagaaatagaaaattttaaactctggatctctgggagtaaaacaactatttttaaagacaatgtgcagttttccttttataagatgtaaattgtgtttgaatcattaccgggcatcactgtaaccagcaatatctcaggattagagaaagggagattcagatgtttaaaattggtttaaagaggcaaaatgaatggcttgtaagacattgtcagtgaaaaaataactgaagttgttttaaccgcccttgttcttgaagtgagcacctctttccagttttctagatgagtagtggtaattttccatctcagaaattttatttacctacttaattttcttccttgattagtatgaattgtccaacataaagatgatgtggctggtgttactattcctttgcctgcctagaatagaaatgatggggcaggggcatgacccatatctccattgttcatattgttaggaaaatggtgatttgttttgtatactctccccattaacaggggtaatgcagcatggcttgtggtgtgaatgctttgcttatgtctcatattctcttacctgagagatggtggtgaacagtgaacttctgcaattgacataggtgacacattcaaatgacagcatgatatgccctcatttatgattttcagtagacacagtgtattataaaaattttcaaagttgcattgtctgtggatcatacatgactttttgtttttatgcctttgttttttagttcaagctctcattatcctggattttgatcatatatgtttataaagcaggattgttttattgctttcctactcaataaaaatgtgaagccatccttttggtatgcatgttttcctccgaatagaaagattcctttgaagatttcccatactttttcatagtcattttagaggatttgaaggtattttagattaagggaaggactatgataaaacctattattatatatgactttattatttttaggaacattctctacttttcaaaaatatcggacaaataaaatgataagatttcagtaataaaaatggtggcattgttttccctgatgtgtttctaaagtagatcatcttattgctgcctcagtcttttggtatttgcttatttatgtgcaaggtctccagtgggcttgctgatgcttctagagcctggctgctggcttaatattcctgcactcaccaggttgcttcccagcataaggcatcctcgccattcattttttaatttatatgacactgtgctttggtcaccaagacctgagctgcctcctagtttttctagccagctttctttttttcttaggacaaagggtcttctttctgaagtcgggcctagacagatcaaggtagttgatcttatttcactggttcaggtgataaactagcagagtagaagcatggcatggatggaaacatatattatctagaaaaggcagtggctgaagttctactgatgtgcctgaatcgttattttaaaatgtctttcttctttgttcaaggaattgaaataaacatcattatttttaagtgcatcattataaatttttgttgttgtattaaaagggacttaagaaagtgatcattatgtgtgacattgcctcactattctgagtgttagaatgttcagaataaattcaagacacattttgtaatatatagactgtttgcttgtttttcatgtctgcatagaaggccttcctactgaagaaataaaaaatgttctggagaaggtttcatcagaatggaagaatgtatctcaacatttggaagatctagaaagaaagattcagctacaggaagatataaatgcttatttcaagcagcttgatgagcttgaaaaggtcatcaagacaaaggaggagtgggtaaaacacacttccatttctgaatcttcccggcagtccttgccaagcttgaaggattcctgtcaggtaaggagccaacggtctggaaagtggaggaattctatgtgcagttccagagttaaggagggcttctcgtatcatgaactttaagttaatgctgccctgattaacttcctgtgaggatgttcatcttcagtgagttgtgtgaccgtattttctcttccttagcgggaattgacaaatcttcttggccttcaccccaaaattgaaatggctcgtgcaagctgctcggccctgatgtctcagccttctgccccagattttgtccagcggggcttcgatagctttctgggccgctaccaagctgtacaagaggctgtagaggatcgtcaacaacatctagagaatggtaaacccaacaattttaaaatctcctgtctcagtttgccttaatgtaaacatgactcccaacatttagaacttgagtacacttgcttgctttgcaccaaccttctccattttcctttgtgcctgtattgttcaaagtcttaaagtcttctgtattcagattcttttccagattcacacctttttgtaaacatacaagcaagtttcacattctctaaaattgtgtcagtaggatataataataatttttttttttgtagctacaggatctcactctgtcacccaggctggagagcagtggtgcaatcatagctgcagtcttgacctcctgggtttcagtggtccttctgcctcagcctactgagtagctgggactacaggcatgcaccaccatgcctggctggttttttatttttagtagagccagggtctagctatgttgcccacgctggtctagaactcctgggctcaagtgatcttcccacctcagcctcccaaaataacaggtgtaagccattataacaggtgatataacagcctcccaaaataacaggtgttaggcaaaataacagatgttagcctcccaaaataccagggataacaggtgtcagccattgtacctgacctggatataatgatttttaaagattttttttttttttttttttgagaaacaggtgcaatttcttcctttggttgaggaggccacttaatatcattgctaggaggatcaaaatgaatgatcccttacttctgtttcctcaaaatagttaaagttttggcagtctcatactgtcttttaaaagaaatcatattccactgtcagattcagaaaaattttagagttcttacttttggaatacacttggttttggaaggttcactgttaaagattttgaaagctcatccctcctacgttacactatttacttcctagctgccatttgagttaggaactgtgttgcattgtgcattattttgtgaaatgcattgagcattgtgtgaaatgctccacatgtaacccagcctaacttcagcaattgtagattgtgtgatgactggaagtgtctgtatgtgtgcatgctaggcaaatgtgtcgtattgcctttcttctgaaagtgcatctggacagcatgtctttgttccttgaattcagttatgtgaaatatgtctttgagggtacctctttctccacttattggtacaagctgtgctttcacttttgacaaggatcagtaggcagtttaacttttgctgctagttggtttcacctctttgtgcttcaagagaactcacttcctttccacgcaagtgttacttctgtgatatttttacattagtgactgaggtagacactgttccagctggctgttcagtcattatttctcagggtacctgggcagcatggtggcagtatttccatataatctcctccactctggacctgggtttgtctacacggtggagctta

SEQ ID NO: 206 - DNA, 4044 bp, Homo sapiens
tatgttttgtaaacgtttcccttgattccaatagtgatagactgagaagtgtaaagtcaagtgagactgagtggcaggaatgtgttctatgttctcccttttagacaattaataaagtgatcttctgttgattttgccttttgactagtcaccttctaagaactctgtgttttatagaaatagaaaattttaaactctggatctctgggagtaaaacaactatttttaaagacaatgtgcagttttccttttataagatgtaaattgtgtttgaatcattaccgggcatcactgtaaccagcaatatctcaggattagagaaagggagattcagatgtttaaaattggtttaaagaggcaaaatgaatggcttgtaagacattgtcagtgaaaaaataactgaagttgttttaaccgcccttgttcttgaagtgagcacctctttccagttttctagatgagtagtggtaattttccatctcagaaattttatttacctacttaattttcttccttgattagtatgaattgtccaacataaagatgatgtggctggtgttactattcctttgcctgcctagaatagaaatgatggggcaggggcatgacccatatctccattgttcatattgttaggaaaatggtgatttgttttgtatactctccccattaacaggggtaatgcagcatggcttgtggtgtgaatgctttgcttatgtctcatattctcttacctgagagatggtggtgaacagtgaacttctgcaattgacataggtgacacattcaaatgacagcatgatatgccctcatttatgattttcagtagacacagtgtattataaaaattttcaaagttgcattgtctgtggatcatacatgactttttgtttttatgcctttgttttttagttcaagctctcattatcctggattttgatcatatatgtttataaagcaggattgttttattgctttcctactcaataaaaatgtgaagccatccttttggtatgcatgttttcctccgaatagaaagattcctttgaagatttcccatactttttcatagtcattttagaggatttgaaggtattttagattaagggaaggactatgataaaacctattattatatatgactttattatttttaggaacattctctacttttcaaaaatatcggacaaataaaatgataagatttcagtaataaaaatggtggcattgttttccctgatgtgtttctaaagtagatcatcttattgctgcctcagtcttttggtatttgcttatttatgtgcaaggtctccagtgggcttgctgatgcttctagagcctggctgctggcttaatattcctgcactcaccaggttgcttcccagcataaggcatcctcgccattcattttttaatttatatgacactgtgctttggtcaccaagacctgagctgcctcctagtttttctagccagctttctttttttcttaggacaaagggtcttctttctgaagtcgggcctagacagatcaaggtagttgatcttatttcactggttcaggtgataaactagcagagtagaagcatggcatggatggaaacatatattatctagaaaaggcagtggctgaagttctactgatgtgcctgaatcgttattttaaaatgtctttcttctttgttcaaggaattgaaataaacatcattatttttaagtgcatcattataaatttttgttgttgtattaaaagggacttaagaaagtgatcattatgtgtgacattgcctcactattctgagtgttagaatgttcagaataaattcaagacacattttgtaatatatagactgtttgcttgtttttcatgtctgcatagaaggccttcctactgaagaaataaaaaatgttctggagaaggtttcatcagaatggaagaatgtatctcaacatttggaagatctagaaagaaagattcagctacaggaagatataaatgcttatttcaagcagcttgatgagcttgaaaaggtcatcaagacaaaggaggagtgggtaaaacacacttccatttctgaatcttcccggcagtccttgccaagcttgaaggattcctgtcaggtaaggagccaacggtctggaaagtggaggaattctatgtgcagttccagagttaaggagggcttctcgtatcatgaactttaagttaatgctgccctgattaacttcctgtgaggatgttcatcttcagtgagttgtgtgaccgtattttctcttccttagcgggaattgacaaatcttcttggccttcaccccaaaattgaaatggctcgtgcaagctgctcggccctgatgtctcagccttctgccccagattttgtccagcggggcttcgatagctttctgggccgctaccaagctgtacaagaggctgtagaggatcgtcaacaacatctagagaatggtaaacccaacaattttaaaatctcctgtctcagtttgccttaatgtaaacatgactcccaacatttagaacttgagtacacttgcttgctttgcaccaaccttctccattttcctttgtgcctgtattgttcaaagtcttaaagtcttctgtattcagattcttttccagattcacacctttttgtaaacatacaagcaagtttcacattctctaaaattgtgtcagtaggatataataataatttttttttttgtagctacaggatctcactctgtcacccaggctggagagcagtggtgcaatcatagctgcagtcttgacctcctgggtttcagtggtccttctgcctcagcctactgagtagctgggactacaggcatgcaccaccatgcctggctggttttttatttttagtagagccagggtctagctatgttgcccacgctggtctagaactcctgggctcaagtgatcttcccacctcagcctcccaaaataacaggtgtaagccattataacaggtgatataacagcctcccaaaataacaggtgttaggcaaaataacagatgttagcctcccaaaataccagggataacaggtgtcagccattgtacctgacctggatataatgatttttaaagattttttttttttttttttttgagaaacaggtgcaatttcttcctttggttgaggaggccacttaatatcattgctaggaggatcaaaatgaatgatcccttacttctgtttcctcaaaatagttaaagttttggcagtctcatactgtcttttaaaagaaatcatattccactgtcagattcagaaaaattttagagttcttacttttggaatacacttggttttggaaggttcactgttaaagattttgaaagctcatccctcctacgttacactatttacttcctagctgccatttgagttaggaactgtgttgcattgtgcattattttgtgaaatgcattgagcattgtgtgaaatgctccacatgtaacccagcctaacttcagcaattgtagattgtgtgatgactggaagtgtctgtatgtgtgcatgctaggcaaatgtgtcgtattgcctttcttctgaaagtgcatctggacagcatgtctttgttccttgaattcagttatgtgaaatatgtctttgagggtacctctttctccacttattggtacaagctgtgctttcacttttgacaaggatcagtaggcagtttaacttttgctgctagttggtttcacctctttgtgcttcaagagaactcacttcctttccacgcaagtgttacttctgtgatatttttacattagtgactgaggtagacactgttccagctggctgttcagtcattatttctcagggtacctgggcagcatggtggcagtatttccatataatctcctccactctggacctgggtttgtctacacggtggagcttacagcaagactggttgaagggatctttgttttcttttattctttgtgtagctgttaaggaagaggagattatatggaacaaaagggacattgttgttccatcttcagagag

SEQ ID NO: 207 - DNA, 4046 bp, Homo sapiens
ataagatgtaaattgtgtttgaatcattaccgggcatcactgtaaccagcaatatctcaggattagagaaagggagattcagatgtttaaaattggtttaaagaggcaaaatgaatggcttgtaagacattgtcagtgaaaaaataactgaagttgttttaaccgcccttgttcttgaagtgagcacctctttccagttttctagatgagtagtggtaattttccatctcagaaattttatttacctacttaattttcttccttgattagtatgaattgtccaacataaagatgatgtggctggtgttactattcctttgcctgcctagaatagaaatgatggggcaggggcatgacccatatctccattgttcatattgttaggaaaatggtgatttgttttgtatactctccccattaacaggggtaatgcagcatggcttgtggtgtgaatgctttgcttatgtctcatattctcttacctgagagatggtggtgaacagtgaacttctgcaattgacataggtgacacattcaaatgacagcatgatatgccctcatttatgattttcagtagacacagtgtattataaaaattttcaaagttgcattgtctgtggatcatacatgactttttgtttttatgcctttgttttttagttcaagctctcattatcctggattttgatcatatatgtttataaagcaggattgttttattgctttcctactcaataaaaatgtgaagccatccttttggtatgcatgttttcctccgaatagaaagattcctttgaagatttcccatactttttcatagtcattttagaggatttgaaggtattttagattaagggaaggactatgataaaacctattattatatatgactttattatttttaggaacattctctacttttcaaaaatatcggacaaataaaatgataagatttcagtaataaaaatggtggcattgttttccctgatgtgtttctaaagtagatcatcttattgctgcctcagtcttttggtatttgcttatttatgtgcaaggtctccagtgggcttgctgatgcttctagagcctggctgctggcttaatattcctgcactcaccaggttgcttcccagcataaggcatcctcgccattcattttttaatttatatgacactgtgctttggtcaccaagacctgagctgcctcctagtttttctagccagctttctttttttcttaggacaaagggtcttctttctgaagtcgggcctagacagatcaaggtagttgatcttatttcactggttcaggtgataaactagcagagtagaagcatggcatggatggaaacatatattatctagaaaaggcagtggctgaagttctactgatgtgcctgaatcgttattttaaaatgtctttcttctttgttcaaggaattgaaataaacatcattatttttaagtgcatcattataaatttttgttgttgtattaaaagggacttaagaaagtgatcattatgtgtgacattgcctcactattctgagtgttagaatgttcagaataaattcaagacacattttgtaatatatagactgtttgcttgtttttcatgtctgcatagaaggccttcctactgaagaaataaaaaatgttctggagaaggtttcatcagaatggaagaatgtatctcaacatttggaagatctagaaagaaagattcagctacaggaagatataaatgcttatttcaagcagcttgatgagcttgaaaaggtcatcaagacaaaggaggagtgggtaaaacacacttccatttctgaatcttcccggcagtccttgccaagcttgaaggattcctgtcaggtaaggagccaacggtctggaaagtggaggaattctatgtgcagttccagagttaaggagggcttctcgtatcatgaactttaagttaatgctgccctgattaacttcctgtgaggatgttcatcttcagtgagttgtgtgaccgtattttctcttccttagcgggaattgacaaatcttcttggccttcaccccaaaattgaaatggctcgtgcaagctgctcggccctgatgtctcagccttctgccccagattttgtccagcggggcttcgatagctttctgggccgctaccaagctgtacaagaggctgtagaggatcgtcaacaacatctagagaatggtaaacccaacaattttaaaatctcctgtctcagtttgccttaatgtaaacatgactcccaacatttagaacttgagtacacttgcttgctttgcaccaaccttctccattttcctttgtgcctgtattgttcaaagtcttaaagtcttctgtattcagattcttttccagattcacacctttttgtaaacatacaagcaagtttcacattctctaaaattgtgtcagtaggatataataataatttttttttttgtagctacaggatctcactctgtcacccaggctggagagcagtggtgcaatcatagctgcagtcttgacctcctgggtttcagtggtccttctgcctcagcctactgagtagctgggactacaggcatgcaccaccatgcctggctggttttttatttttagtagagccagggtctagctatgttgcccacgctggtctagaactcctgggctcaagtgatcttcccacctcagcctcccaaaataacaggtgtaagccattataacaggtgatataacagcctcccaaaataacaggtgttaggcaaaataacagatgttagcctcccaaaataccagggataacaggtgtcagccattgtacctgacctggatataatgatttttaaagattttttttttttttttttttgagaaacaggtgcaatttcttcctttggttgaggaggccacttaatatcattgctaggaggatcaaaatgaatgatcccttacttctgtttcctcaaaatagttaaagttttggcagtctcatactgtcttttaaaagaaatcatattccactgtcagattcagaaaaattttagagttcttacttttggaatacacttggttttggaaggttcactgttaaagattttgaaagctcatccctcctacgttacactatttacttcctagctgccatttgagttaggaactgtgttgcattgtgcattattttgtgaaatgcattgagcattgtgtgaaatgctccacatgtaacccagcctaacttcagcaattgtagattgtgtgatgactggaagtgtctgtatgtgtgcatgctaggcaaatgtgtcgtattgcctttcttctgaaagtgcatctggacagcatgtctttgttccttgaattcagttatgtgaaatatgtctttgagggtacctctttctccacttattggtacaagctgtgctttcacttttgacaaggatcagtaggcagtttaacttttgctgctagttggtttcacctctttgtgcttcaagagaactcacttcctttccacgcaagtgttacttctgtgatatttttacattagtgactgaggtagacactgttccagctggctgttcagtcattatttctcagggtacctgggcagcatggtggcagtatttccatataatctcctccactctggacctgggtttgtctacacggtggagcttacagcaagactggttgaagggatctttgttttcttttattctttgtgtagctgttaaggaagaggagattatatggaacaaaagggacattgttgttccatcttcagagagacatttcatcatgaagaaatgaagaaaaattatagtgggttagttaatatttcaaacgtcaacatccgcaggaatgaagtcactgtctgactctcagaaatgccaatggaatgatctatgttgttaattaacagagacccttttacattttaatcatggggtctcctttgccatgtattggaattcatttaggataatggtctatgtaataatattggttcctaatatgattttttcaaactaaatatttttaa

SEQ ID NO: 208 - DNA, 4054 bp, Homo sapiens
ggtacctgggcagcatggtggcagtatttccatataatctcctccactctggacctgggtttgtctacacggtggagcttacagcaagactggttgaagggatctttgttttcttttattctttgtgtagctgttaaggaagaggagattatatggaacaaaagggacattgttgttccatcttcagagagacatttcatcatgaagaaatgaagaaaaattatagtgggttagttaatatttcaaacgtcaacatccgcaggaatgaagtcactgtctgactctcagaaatgccaatggaatgatctatgttgttaattaacagagacccttttacattttaatcatggggtctcctttgccatgtattggaattcatttaggataatggtctatgtaataatattggttcctaatatgattttttcaaactaaatatttttaaataaacagaactgaagggccaacctggacatgcatatctggaaacattgaaaacactgaaagatgtgctaaatgattcagaaaataaggcccaggtgtctctgaatgtccttaatgatcttgccaaggtggagaaggccctgcaagaaaaaaaggtaacatatatcttccatgttagaactctagcgcttcttctaatatctcctcttacatattttgaaatgttttttcagagattaaaaaaaaagttggtcagttttgttcatcattggtgcaaaaatgtgtttatgatttgagggttagtttgacctcacataaaagaaagtacagttattaaaaattttttcatagaagaaaagcatattttctccttctgctgtgattagcttaaaattctcaacctgttcataaaatctgctaaaatatctttatgaaatgaggactatcagttgacgtgttgatgtatacttttttctgcatcgaataggaatgtttccgaggtcatttagttgagtagccttatggctctgtgctattagatgaaaaggagagcagccattgagcactgcacacttggcccacactgggtttgctgttcccttggtttttagggttgagaatacactgtattgcccacacacaactcatgaagaaaaagctttaatttttatgattatgcctatttttttcatgagtttttcatgttttgttttgttttgttttttgatttccaacttttattttaagttcaggggtacttgtgcaggatgtgcaggtttgttaaatgggtaaacgtgtgtcatggtagtttgctgcactacgtattaagcccagcatccattagctcttcttcctgatgctttccctcccaccatgccccaccctccaacagaccccagtgtgtgtttttccccaccatgtgtccgtatgttctcattattcagctcccacttataagtgagaatatgcggtatttttttttgttgtttctgaattagtttgccgaggataatggcttccagctccatccatatacctgcaaaggacatgatcttgttcctttttatggctgcatagtattccatggttgatatgtaccacattttctttaagtagtctatcattgatgggcatttgggttgattccttgtccttgctattgtgaattgtgctgcaatgaacatagtgtgcatatatctttataacagaatgatttgtattcctttgggtatatacccagtgagattgctgggtcaaatggcatttctggttttaggtctttgaggaatcaccacactgtcttccacagtggttgaactaattcacactcccacccactgttctttttagataaaaatgctttctaatgcattttaaagtgacttttgactttatatagcccattttactatatctgtgcagacacatttttgtgcatatttttaatcttttaaaactttttccagacccttgatgaaatccttgagaatcagaaacctgcattacataaacttgcagaagaaacaaaggctctggagaaaaatgttcatcctgatgtagaaaaattatataagcaagaatttgatgatgtgcaaggaaagtggaacaagctaaaggtcttggtttccaaagatctacatttgcttgaggaaattgctctcacactcagagcttttgaggtaaatccagaggccactgggagtttaagtttattacggggtaaatagtaattatcttataagattcacgtatttattatttaaatattttacattctttctagatccccatttattatgtatttaagttgggacttatcaaagatgtacttttaatgtgctagagagcacatttatttccttttgcctggaagcaaagtcaaaagtagagtaaactggaccttgaagataagagaaaattgcttaaaaatggtcaaaataatgtttcaggcatggagggcctgtgtgaaatacagactgttgattagattatagtagtaacttggttggggtggtagaaatagcccaggtagtagtaaattgctgaatacatgaaactactttttgcaggtttttgacatttgaagtcaaaagtcagagataggccattgacagtgtcagagtgggaaggcaaatcgttccagggacatgaaaattcagaaacaggatccttcactacacctgaaaatgttgacagatgcagcagtgataaagtttaagaggaaaggataaatgtgaggatgtataaggagagagtcaatgtcaatagaagtcagtgtcagattttaacattctgcctgtgagaaagatggagaagcagagtttccaggtcacctggtattttaataggaaagttctgggtggagaatgaaccaatcacactctctccctgcaaggcttcctatcctccagtgactccttaccttggtctttttttttttttttccccatcagtcagggatctttgtcttttttaaatttcttattcaccgatgtatgccaagatgtactcataactagagcaatgcctggcacagagaaggcatccaatcaatatttttcaacgaatgaaatgaaattagcaataggagatttagatttggatatatctctgtatatctatctatctatatatatagatagatagattctcttggaagctaaatccaaatatgtgtagatatatatctatatatatagggagatgtctctgtatatatgcatatacatctttatttatatagagagaatctaaatccgaatctatatatatttagatgtagatccaaatatatgtagatacaatatatatatctacatatatttggatctacatctaaatattatatctacatatatttggatctagatctaaatatatatagatttggatttagatgctaagcaaatttgcataaggaatattgcccccaaaaagtgaaaagattgaaagcgaagacaaaaattaatgaaaatgtatgttttgaaaatcaaagtcagagaacacgtggtagaagaggagctggaagacctcacagattagtgtggaagggatccagccagattctctgagtggaccactgaatttggaggggcgttctttgactcaggaactaatgggtagttccaatgaatgatcagcagaagatacagatggaggggttgtgtgtgtgtgtgggtagctgtgtgtgatggtagtgacaggaggtagtttttctctaggtgtaagtgcagttctagatggagatctcattcaaataaaccagtaattatggagagaaatgtgttttgtgtggcttagtgtttttgactcatttacttttttttttttgagatggagtcttgctctgttgccccaggctggagtgccatggtgcaatcttggcttactgcaacttcagcctcccgggttcaagcagttctcctgcctcagcctcctgattaactgggactacaggcacatgccactatgcccggctaaggttttatttttagtagagatgaggttttaccatgttggccaggctggtctcaaactcctgacctcaggtgatccaccctcctcggcctcccaaaatgctaggattacagacatgagccaccatgcctgg

SEQ ID NO: 209 - DNA, 4062 bp, Homo sapiens
ctgggtttgtctacacggtggagcttacagcaagactggttgaagggatctttgttttcttttattctttgtgtagctgttaaggaagaggagattatatggaacaaaagggacattgttgttccatcttcagagagacatttcatcatgaagaaatgaagaaaaattatagtgggttagttaatatttcaaacgtcaacatccgcaggaatgaagtcactgtctgactctcagaaatgccaatggaatgatctatgttgttaattaacagagacccttttacattttaatcatggggtctcctttgccatgtattggaattcatttaggataatggtctatgtaataatattggttcctaatatgattttttcaaactaaatatttttaaataaacagaactgaagggccaacctggacatgcatatctggaaacattgaaaacactgaaagatgtgctaaatgattcagaaaataaggcccaggtgtctctgaatgtccttaatgatcttgccaaggtggagaaggccctgcaagaaaaaaaggtaacatatatcttccatgttagaactctagcgcttcttctaatatctcctcttacatattttgaaatgttttttcagagattaaaaaaaaagttggtcagttttgttcatcattggtgcaaaaatgtgtttatgatttgagggttagtttgacctcacataaaagaaagtacagttattaaaaattttttcatagaagaaaagcatattttctccttctgctgtgattagcttaaaattctcaacctgttcataaaatctgctaaaatatctttatgaaatgaggactatcagttgacgtgttgatgtatacttttttctgcatcgaataggaatgtttccgaggtcatttagttgagtagccttatggctctgtgctattagatgaaaaggagagcagccattgagcactgcacacttggcccacactgggtttgctgttcccttggtttttagggttgagaatacactgtattgcccacacacaactcatgaagaaaaagctttaatttttatgattatgcctatttttttcatgagtttttcatgttttgttttgttttgttttttgatttccaacttttattttaagttcaggggtacttgtgcaggatgtgcaggtttgttaaatgggtaaacgtgtgtcatggtagtttgctgcactacgtattaagcccagcatccattagctcttcttcctgatgctttccctcccaccatgccccaccctccaacagaccccagtgtgtgtttttccccaccatgtgtccgtatgttctcattattcagctcccacttataagtgagaatatgcggtatttttttttgttgtttctgaattagtttgccgaggataatggcttccagctccatccatatacctgcaaaggacatgatcttgttcctttttatggctgcatagtattccatggttgatatgtaccacattttctttaagtagtctatcattgatgggcatttgggttgattccttgtccttgctattgtgaattgtgctgcaatgaacatagtgtgcatatatctttataacagaatgatttgtattcctttgggtatatacccagtgagattgctgggtcaaatggcatttctggttttaggtctttgaggaatcaccacactgtcttccacagtggttgaactaattcacactcccacccactgttctttttagataaaaatgctttctaatgcattttaaagtgacttttgactttatatagcccattttactatatctgtgcagacacatttttgtgcatatttttaatcttttaaaactttttccagacccttgatgaaatccttgagaatcagaaacctgcattacataaacttgcagaagaaacaaaggctctggagaaaaatgttcatcctgatgtagaaaaattatataagcaagaatttgatgatgtgcaaggaaagtggaacaagctaaaggtcttggtttccaaagatctacatttgcttgaggaaattgctctcacactcagagcttttgaggtaaatccagaggccactgggagtttaagtttattacggggtaaatagtaattatcttataagattcacgtatttattatttaaatattttacattctttctagatccccatttattatgtatttaagttgggacttatcaaagatgtacttttaatgtgctagagagcacatttatttccttttgcctggaagcaaagtcaaaagtagagtaaactggaccttgaagataagagaaaattgcttaaaaatggtcaaaataatgtttcaggcatggagggcctgtgtgaaatacagactgttgattagattatagtagtaacttggttggggtggtagaaatagcccaggtagtagtaaattgctgaatacatgaaactactttttgcaggtttttgacatttgaagtcaaaagtcagagataggccattgacagtgtcagagtgggaaggcaaatcgttccagggacatgaaaattcagaaacaggatccttcactacacctgaaaatgttgacagatgcagcagtgataaagtttaagaggaaaggataaatgtgaggatgtataaggagagagtcaatgtcaatagaagtcagtgtcagattttaacattctgcctgtgagaaagatggagaagcagagtttccaggtcacctggtattttaataggaaagttctgggtggagaatgaaccaatcacactctctccctgcaaggcttcctatcctccagtgactccttaccttggtctttttttttttttttccccatcagtcagggatctttgtcttttttaaatttcttattcaccgatgtatgccaagatgtactcataactagagcaatgcctggcacagagaaggcatccaatcaatatttttcaacgaatgaaatgaaattagcaataggagatttagatttggatatatctctgtatatctatctatctatatatatagatagatagattctcttggaagctaaatccaaatatgtgtagatatatatctatatatatagggagatgtctctgtatatatgcatatacatctttatttatatagagagaatctaaatccgaatctatatatatttagatgtagatccaaatatatgtagatacaatatatatatctacatatatttggatctacatctaaatattatatctacatatatttggatctagatctaaatatatatagatttggatttagatgctaagcaaatttgcataaggaatattgcccccaaaaagtgaaaagattgaaagcgaagacaaaaattaatgaaaatgtatgttttgaaaatcaaagtcagagaacacgtggtagaagaggagctggaagacctcacagattagtgtggaagggatccagccagattctctgagtggaccactgaatttggaggggcgttctttgactcaggaactaatgggtagttccaatgaatgatcagcagaagatacagatggaggggttgtgtgtgtgtgtgggtagctgtgtgtgatggtagtgacaggaggtagtttttctctaggtgtaagtgcagttctagatggagatctcattcaaataaaccagtaattatggagagaaatgtgttttgtgtggcttagtgtttttgactcatttacttttttttttttgagatggagtcttgctctgttgccccaggctggagtgccatggtgcaatcttggcttactgcaacttcagcctcccgggttcaagcagttctcctgcctcagcctcctgattaactgggactacaggcacatgccactatgcccggctaaggttttatttttagtagagatgaggttttaccatgttggccaggctggtctcaaactcctgacctcaggtgatccaccctcctcggcctcccaaaatgctaggattacagacatgagccaccatgcctggcccattttactttgcgatggtcccacttctcgttgtgtattatgagttgcaattgttcccgg

SEQ ID NO: 210 - DNA, 4046 bp, Homo sapiens
gtttggaagtggcaatgaggatcaaggaaggtgataattagaagtttgtatctctatctatctatctatctatctatctatctatctatctatccatccatccacatacatatggtgacaaataattcattgtgaattactgattcaaaatacaggaataaatatatgggaaatttaaagtgtcctcaggaaggaggtaaccacatgtgtgaataattatctagagcatttccagactattgcattgcattgactagtacaaatgttgaagtagttttggacaaacataattttgccaaattttcattttgctaaaaagaacaggcatataaaacaaatcaacaaacaaagatagtctatttcatctattatattcatgatatcctgaaaaaaaggaacattttaatgccaaaaaatagaaagtatatattctcaggataattaaagataattttgagggtgttttgttgttgttaagcttatggtagtgtctttattttcttcatttctttttggatctgtgaaaattatattgctgactagtgttcaagaagtacacatacagagaattttctggaaatggggcccaagaatctctgtctctctctttctctttctgtgtgtgtgcatgtatttttatgaaaagctgaccaggttaacctgatgatcagccaggcttgggaatgggattgtgagtgttgctggcatcagctccttggttaccctgtggggacagtggaagaaaagctcttgtttggtcctgtctatttttatgccggagatcctgtttggagggagggactgggaaagcctctgtctcttgcttaactctaacttctgtgagaaccatccagctcctgtgctggcctttggttactatccacctagcagccaagcaggccctggcagggtggccactactgtggcgtttaatttgagcatgaggctgaacctgccaagtagaggttggactgtgactgcagaacggcgccttctctcacagtagaagtcagtttgtcgttatggggaggagtgctctgaaaatatttctagacttctccaaaatttttaactaagttactgaatcagaatcagacaactatctattttttactgtaacttttttgtgtctgtgtggcatatacaaacatagtagacatcaaaaccaaaattttatagagcggtgtcttatgacatctttaatagcagcctctccctccctgctttttaaaagtgaaatcttaatgggaagtgcagttaaaaagaagaaaatggacattttgattgcttctaggggttttttttttttttttttttttgagacagagtctcgctctgttccctgggttagagtgcagtggtgcgatctcggctcactgcaacctctgccacccaggttcaggcaattctcccgcctctacctcccaagtagctgggactacaggcatgcaccaccatgcctggttagtttttgtatttttagtagagatggggttttgccatgttggccatgctgatctcaaactcctgacctcaggtgatccccctgccgtggcctcccaaagtgctgggattacaggtgtgagccaccaagactgactggcttctagattttttgtttttgctttcttttttcttttttccattataagtagtgctacattaaatttacttcatatatgtgcttttactgttatagattagattcctacatctgggattacagtcaacagttatgcattgtcaaaattataatagctatttcgagataagagtattatccaaatgtggtgtggaatcccagtcttaagattattttcattactgcttatattccacagcgttagcatgagatgtatgagattttatctgaattttaaagcatgcaattcgttgtggaaagttattactgtgcctttaaatattaagagctaaaacttgacattgaacacattaacatttgtttatttgggggaatggcttttcctttgtagatcgctactcaaaaaagtaggttgtctgaaagtcaagaaaaagctgcgaacctgaagaaagacttggcagagatgcaggaatggatgacccaggccgaggaagaatatttggagcgggattttgagtacaagtcaccagaagagcttgagagtgctgtggaagagatgaaggtgaggcggggacgaccagtgccaacaggcttcatgcctccctcctccctttaaaaccagcacatcaatcatctgtctatctgtcaaacactatgtgcatgtagcatctttcacagtaggtttttgaattaaaaaaacataacagggtagctgctctaattttagcaggggaagaaagccaggagtccacatatttggcttggcccatgagttgagtccatgagggcccatgagacaagctcttaagttagacctttgggaggctacagagaatgacttaaaaacctctggtagtgggcatgaggaagaatgatcatttttttttaattggggtaaatacatataacattggtcagcttaatttttaagtgcacaatccagtggcattaattgcattcatcactatttccaaacattttcacaaagagttattttttgtaaggggaacaaaagagacctcccaagttgtctgaggtttattcttattttcctgttactaatcttccagttaatacatacggcacatatgaacactgacgtttcattagagcaggtaggaatagcggtaggaatgcatcggggagttcatattagttggatccactggatacatttcctgtaaacttgtactcctctgtcgatagtcttgaacactctctttttatatataataaaagaactgggcatcattcccaaatttctaacacagcttcaactgtccttgaatgttcaagccaaaggagatggtgttttcaaagcttttttttcctgtaagcttaagcaacacagtgactaatgttttacctcaaagttaacttacctagaagtgtaactaaagcaaaaatctgtgatttttttcaaaaaagggattatatgacattcatacattattatacatgaatcaaagtaaatatgacaggagacttgttggaagttgttttttcactaaaacatcttttttagtgtagctctttttgaaagatttaaaaatactcagtacataaggtattttaaaataggctaccatgttaagaattgtctcatttattgtctttctttacactattggcattgtagttctgtggattttaaaagttgctatagatgagatttgagaaaaatgatatttaaatatttgattgggcaacattttatttatttttattctttcaaacagccattaggacttacaaaaccactacacttaattactttcccccaatctaaggaagttcaaaaccattaagtagtagagaaaagtaaaggggaaagtgaaagactgttttatttgtatttattgccattaaaagtaatggcataaactgcaattacttttgcaccaacctgataggttgattttcctgaatgtcagattgtttatcttagcactgagaaacagctatttctggatcagatcatctcagtctaactttatcattgaaatgctattaattagcagaaggatacatgtgcctatgttctataattttttaaaaagcttaaattatttagagaacttttaaagatacttctaccatagtgtacctcaatttttgtgaaaatatatttatcacagtgtaatctgctcagccctccagtgataatgaaaattcactcacttaaattctgatcttggacccagactttgaaaatacttcatgtcagtaaacatactttggataacttacgttaacactgctgttatgaaatgaaaacatttgtgggagctgagtacattggatgcatgagtgaaatttcagagttagcattcttatttcaaaaacgctcaactgggctgggtgcagtggctcacgcctctaatcccagcactttgggaggccaaggtgggtggatcacctcaggtcaggagtttgagaccag

SEQ ID NO: 211 - DNA, 4042 bp, Homo sapiens
cttatattccacagcgttagcatgagatgtatgagattttatctgaattttaaagcatgcaattcgttgtggaaagttattactgtgcctttaaatattaagagctaaaacttgacattgaacacattaacatttgtttatttgggggaatggcttttcctttgtagatcgctactcaaaaaagtaggttgtctgaaagtcaagaaaaagctgcgaacctgaagaaagacttggcagagatgcaggaatggatgacccaggccgaggaagaatatttggagcgggattttgagtacaagtcaccagaagagcttgagagtgctgtggaagagatgaaggtgaggcggggacgaccagtgccaacaggcttcatgcctccctcctccctttaaaaccagcacatcaatcatctgtctatctgtcaaacactatgtgcatgtagcatctttcacagtaggtttttgaattaaaaaaacataacagggtagctgctctaattttagcaggggaagaaagccaggagtccacatatttggcttggcccatgagttgagtccatgagggcccatgagacaagctcttaagttagacctttgggaggctacagagaatgacttaaaaacctctggtagtgggcatgaggaagaatgatcatttttttttaattggggtaaatacatataacattggtcagcttaatttttaagtgcacaatccagtggcattaattgcattcatcactatttccaaacattttcacaaagagttattttttgtaaggggaacaaaagagacctcccaagttgtctgaggtttattcttattttcctgttactaatcttccagttaatacatacggcacatatgaacactgacgtttcattagagcaggtaggaatagcggtaggaatgcatcggggagttcatattagttggatccactggatacatttcctgtaaacttgtactcctctgtcgatagtcttgaacactctctttttatatataataaaagaactgggcatcattcccaaatttctaacacagcttcaactgtccttgaatgttcaagccaaaggagatggtgttttcaaagcttttttttcctgtaagcttaagcaacacagtgactaatgttttacctcaaagttaacttacctagaagtgtaactaaagcaaaaatctgtgatttttttcaaaaaagggattatatgacattcatacattattatacatgaatcaaagtaaatatgacaggagacttgttggaagttgttttttcactaaaacatcttttttagtgtagctctttttgaaagatttaaaaatactcagtacataaggtattttaaaataggctaccatgttaagaattgtctcatttattgtctttctttacactattggcattgtagttctgtggattttaaaagttgctatagatgagatttgagaaaaatgatatttaaatatttgattgggcaacattttatttatttttattctttcaaacagccattaggacttacaaaaccactacacttaattactttcccccaatctaaggaagttcaaaaccattaagtagtagagaaaagtaaaggggaaagtgaaagactgttttatttgtatttattgccattaaaagtaatggcataaactgcaattacttttgcaccaacctgataggttgattttcctgaatgtcagattgtttatcttagcactgagaaacagctatttctggatcagatcatctcagtctaactttatcattgaaatgctattaattagcagaaggatacatgtgcctatgttctataattttttaaaaagcttaaattatttagagaacttttaaagatacttctaccatagtgtacctcaatttttgtgaaaatatatttatcacagtgtaatctgctcagccctccagtgataatgaaaattcactcacttaaattctgatcttggacccagactttgaaaatacttcatgtcagtaaacatactttggataacttacgttaacactgctgttatgaaatgaaaacatttgtgggagctgagtacattggatgcatgagtgaaatttcagagttagcattcttatttcaaaaacgctcaactgggctgggtgcagtggctcacgcctctaatcccagcactttgggaggccaaggtgggtggatcacctcaggtcaggagtttgagaccagccccgccaacatggcgaagcctcatctcgactaaaaaatatgaaaattaggtaggcatagtggtgggtgcctgtaatcacagcttctcgggaggctgaggcaggagaatttcttgaactgggaggcagaggttgtagtgaacaagactctatctcaaaaacaaaaacaaaaacaaaaccccacaaagaaccattcactgttacctaaataatgttctattttggcagttagaatcatccagatgttttaactttggtttaattcttgaaaaaaaaagaaagaaaagaaattggttactgagaaagggagacgtttttcaagttcatccatcctttcttggaacagagggcaaaagaggatgtgttgcagaaggaggtgagagtgaagattctcaaggacaacatcaagttattagctgccaaggtgccctctggtggccaggagttgacgtctgagctgaatgttgtgctggagaattaccaacttctttgtaatagaattcgaggaaagtgccacacgctagaggtatgctattattattattgttgttattattattattattattattattattattttcagtgatgtatttctgagatccaaactctgtaatgttttggccattttcaaatcttggagaaaacttctcttttctttcaaattctggattataaagaaaaaatagttcttgggaaatagtttgataaaaatgaaagaggggttaaaaacaggagaccaaaatctgtccctaattatcagaaggttcttgggcaagtcattttgtatattcaaactttactttttttataggtgcaatccaggttttcatgtaacagatgatctgtagggcctattccagtccaaaaattgcagagcacatttcaagcctctcttttgttttgttttgcctggttgagtacatagagaggaattattttcttttgagtggtgtctaaagttcaagagtcacctgaaggaaaaatagaacttaaatatgtgacagttttactgggtcttagataaaataccttttttttttctccctggccattacacgtaaaatgtagatgagtctatgaaatttttttaaactaagagtgaggttttgcttgtttgtttttatagtagtatgacttttgttattgcttgttggaagatttaagaaggctttcaatttacaacaatttaatttacattcaatttgacgtaaaacaaatatttgtattgtggcaaatcttgaaatggtaaaaaatggcaactgcaatatttaacctaaattcattcattactttgatcattcattcatttgtaaattcattcgtttcttgttctaaaccaattttgtgctaagataaatatatatcattgaggcaagttagtaagaaagctacttgatttgggatctgtctgcttcttggaagtggtcttctttgagtcattttttctttcccataagaaaagaggttgtgcttgcatctgagcagatttttggtctgctttttgcttgtggaaattgggggactagaacctcttttcttttattctaattcagtggctggaaaattatggctgaggattttgttttgttttgtttgagacagggtcttgctctgtcacctatgctggagtgcagtggtatgatcacagctcactgtaacctcaaactcctgggctcaagtgaccttcctgcccccgcttcctgagtagctatgactccagccttgcaatgccacacctggctaattatttttaaattttttttgtagagatgggggtcttgctatgttgcccaagttggtctggaactcttgggctcaagc

SEQ ID NO: 212 - DNA, 4046 bp, Homo sapiens
atgatcatttttttttaattggggtaaatacatataacattggtcagcttaatttttaagtgcacaatccagtggcattaattgcattcatcactatttccaaacattttcacaaagagttattttttgtaaggggaacaaaagagacctcccaagttgtctgaggtttattcttattttcctgttactaatcttccagttaatacatacggcacatatgaacactgacgtttcattagagcaggtaggaatagcggtaggaatgcatcggggagttcatattagttggatccactggatacatttcctgtaaacttgtactcctctgtcgatagtcttgaacactctctttttatatataataaaagaactgggcatcattcccaaatttctaacacagcttcaactgtccttgaatgttcaagccaaaggagatggtgttttcaaagcttttttttcctgtaagcttaagcaacacagtgactaatgttttacctcaaagttaacttacctagaagtgtaactaaagcaaaaatctgtgatttttttcaaaaaagggattatatgacattcatacattattatacatgaatcaaagtaaatatgacaggagacttgttggaagttgttttttcactaaaacatcttttttagtgtagctctttttgaaagatttaaaaatactcagtacataaggtattttaaaataggctaccatgttaagaattgtctcatttattgtctttctttacactattggcattgtagttctgtggattttaaaagttgctatagatgagatttgagaaaaatgatatttaaatatttgattgggcaacattttatttatttttattctttcaaacagccattaggacttacaaaaccactacacttaattactttcccccaatctaaggaagttcaaaaccattaagtagtagagaaaagtaaaggggaaagtgaaagactgttttatttgtatttattgccattaaaagtaatggcataaactgcaattacttttgcaccaacctgataggttgattttcctgaatgtcagattgtttatcttagcactgagaaacagctatttctggatcagatcatctcagtctaactttatcattgaaatgctattaattagcagaaggatacatgtgcctatgttctataattttttaaaaagcttaaattatttagagaacttttaaagatacttctaccatagtgtacctcaatttttgtgaaaatatatttatcacagtgtaatctgctcagccctccagtgataatgaaaattcactcacttaaattctgatcttggacccagactttgaaaatacttcatgtcagtaaacatactttggataacttacgttaacactgctgttatgaaatgaaaacatttgtgggagctgagtacattggatgcatgagtgaaatttcagagttagcattcttatttcaaaaacgctcaactgggctgggtgcagtggctcacgcctctaatcccagcactttgggaggccaaggtgggtggatcacctcaggtcaggagtttgagaccagccccgccaacatggcgaagcctcatctcgactaaaaaatatgaaaattaggtaggcatagtggtgggtgcctgtaatcacagcttctcgggaggctgaggcaggagaatttcttgaactgggaggcagaggttgtagtgaacaagactctatctcaaaaacaaaaacaaaaacaaaaccccacaaagaaccattcactgttacctaaataatgttctattttggcagttagaatcatccagatgttttaactttggtttaattcttgaaaaaaaaagaaagaaaagaaattggttactgagaaagggagacgtttttcaagttcatccatcctttcttggaacagagggcaaaagaggatgtgttgcagaaggaggtgagagtgaagattctcaaggacaacatcaagttattagctgccaaggtgccctctggtggccaggagttgacgtctgagctgaatgttgtgctggagaattaccaacttctttgtaatagaattcgaggaaagtgccacacgctagaggtatgctattattattattgttgttattattattattattattattattattattttcagtgatgtatttctgagatccaaactctgtaatgttttggccattttcaaatcttggagaaaacttctcttttctttcaaattctggattataaagaaaaaatagttcttgggaaatagtttgataaaaatgaaagaggggttaaaaacaggagaccaaaatctgtccctaattatcagaaggttcttgggcaagtcattttgtatattcaaactttactttttttataggtgcaatccaggttttcatgtaacagatgatctgtagggcctattccagtccaaaaattgcagagcacatttcaagcctctcttttgttttgttttgcctggttgagtacatagagaggaattattttcttttgagtggtgtctaaagttcaagagtcacctgaaggaaaaatagaacttaaatatgtgacagttttactgggtcttagataaaataccttttttttttctccctggccattacacgtaaaatgtagatgagtctatgaaatttttttaaactaagagtgaggttttgcttgtttgtttttatagtagtatgacttttgttattgcttgttggaagatttaagaaggctttcaatttacaacaatttaatttacattcaatttgacgtaaaacaaatatttgtattgtggcaaatcttgaaatggtaaaaaatggcaactgcaatatttaacctaaattcattcattactttgatcattcattcatttgtaaattcattcgtttcttgttctaaaccaattttgtgctaagataaatatatatcattgaggcaagttagtaagaaagctacttgatttgggatctgtctgcttcttggaagtggtcttctttgagtcattttttctttcccataagaaaagaggttgtgcttgcatctgagcagatttttggtctgctttttgcttgtggaaattgggggactagaacctcttttcttttattctaattcagtggctggaaaattatggctgaggattttgttttgttttgtttgagacagggtcttgctctgtcacctatgctggagtgcagtggtatgatcacagctcactgtaacctcaaactcctgggctcaagtgaccttcctgcccccgcttcctgagtagctatgactccagccttgcaatgccacacctggctaattatttttaaattttttttgtagagatgggggtcttgctatgttgcccaagttggtctggaactcttgggctcaagccatcctcctgccttggcctaccaaagtcctgggattaaaggcattagccactgcacccggactggctgagggtttaaatctaacttgtagtttggttttggatacctggttaactgagaatagtttatacatttctcaagggttgtacaacacatacccccctccaagaagaatctgtgataggaagcaaatgtgtcctcccaaaacctaaaatatttactggctggccctttgtagaaaaatgtactgctccttgatctggtaagcatacttcatatggagagtggaccggcaggtgccttcactcatttatgtaaaccagaagatgcctccactcattcagtacattcaagacgacaagcccaggaggcatccagctgagttctttctcctaaacttaccactcaaataagttcctcttataataagggattataaatttataaatgtttccacccactacacaacccctgggtccctgctctggaaacctcagaggggaatgagtgatcaaaaccaacacagtaagaacagtataactccagttttggtaaaatgtggctctcttatattgacatgtcctcatgaatttagaaaaaagttgggaaggctacattgcaaacttttacatcagttagctccaagttggaa

SEQ ID NO: 213 - DNA, 4028 bp, Homo sapiens
ggatccactggatacatttcctgtaaacttgtactcctctgtcgatagtcttgaacactctctttttatatataataaaagaactgggcatcattcccaaatttctaacacagcttcaactgtccttgaatgttcaagccaaaggagatggtgttttcaaagcttttttttcctgtaagcttaagcaacacagtgactaatgttttacctcaaagttaacttacctagaagtgtaactaaagcaaaaatctgtgatttttttcaaaaaagggattatatgacattcatacattattatacatgaatcaaagtaaatatgacaggagacttgttggaagttgttttttcactaaaacatcttttttagtgtagctctttttgaaagatttaaaaatactcagtacataaggtattttaaaataggctaccatgttaagaattgtctcatttattgtctttctttacactattggcattgtagttctgtggattttaaaagttgctatagatgagatttgagaaaaatgatatttaaatatttgattgggcaacattttatttatttttattctttcaaacagccattaggacttacaaaaccactacacttaattactttcccccaatctaaggaagttcaaaaccattaagtagtagagaaaagtaaaggggaaagtgaaagactgttttatttgtatttattgccattaaaagtaatggcataaactgcaattacttttgcaccaacctgataggttgattttcctgaatgtcagattgtttatcttagcactgagaaacagctatttctggatcagatcatctcagtctaactttatcattgaaatgctattaattagcagaaggatacatgtgcctatgttctataattttttaaaaagcttaaattatttagagaacttttaaagatacttctaccatagtgtacctcaatttttgtgaaaatatatttatcacagtgtaatctgctcagccctccagtgataatgaaaattcactcacttaaattctgatcttggacccagactttgaaaatacttcatgtcagtaaacatactttggataacttacgttaacactgctgttatgaaatgaaaacatttgtgggagctgagtacattggatgcatgagtgaaatttcagagttagcattcttatttcaaaaacgctcaactgggctgggtgcagtggctcacgcctctaatcccagcactttgggaggccaaggtgggtggatcacctcaggtcaggagtttgagaccagccccgccaacatggcgaagcctcatctcgactaaaaaatatgaaaattaggtaggcatagtggtgggtgcctgtaatcacagcttctcgggaggctgaggcaggagaatttcttgaactgggaggcagaggttgtagtgaacaagactctatctcaaaaacaaaaacaaaaacaaaaccccacaaagaaccattcactgttacctaaataatgttctattttggcagttagaatcatccagatgttttaactttggtttaattcttgaaaaaaaaagaaagaaaagaaattggttactgagaaagggagacgtttttcaagttcatccatcctttcttggaacagagggcaaaagaggatgtgttgcagaaggaggtgagagtgaagattctcaaggacaacatcaagttattagctgccaaggtgccctctggtggccaggagttgacgtctgagctgaatgttgtgctggagaattaccaacttctttgtaatagaattcgaggaaagtgccacacgctagaggtatgctattattattattgttgttattattattattattattattattattattttcagtgatgtatttctgagatccaaactctgtaatgttttggccattttcaaatcttggagaaaacttctcttttctttcaaattctggattataaagaaaaaatagttcttgggaaatagtttgataaaaatgaaagaggggttaaaaacaggagaccaaaatctgtccctaattatcagaaggttcttgggcaagtcattttgtatattcaaactttactttttttataggtgcaatccaggttttcatgtaacagatgatctgtagggcctattccagtccaaaaattgcagagcacatttcaagcctctcttttgttttgttttgcctggttgagtacatagagaggaattattttcttttgagtggtgtctaaagttcaagagtcacctgaaggaaaaatagaacttaaatatgtgacagttttactgggtcttagataaaataccttttttttttctccctggccattacacgtaaaatgtagatgagtctatgaaatttttttaaactaagagtgaggttttgcttgtttgtttttatagtagtatgacttttgttattgcttgttggaagatttaagaaggctttcaatttacaacaatttaatttacattcaatttgacgtaaaacaaatatttgtattgtggcaaatcttgaaatggtaaaaaatggcaactgcaatatttaacctaaattcattcattactttgatcattcattcatttgtaaattcattcgtttcttgttctaaaccaattttgtgctaagataaatatatatcattgaggcaagttagtaagaaagctacttgatttgggatctgtctgcttcttggaagtggtcttctttgagtcattttttctttcccataagaaaagaggttgtgcttgcatctgagcagatttttggtctgctttttgcttgtggaaattgggggactagaacctcttttcttttattctaattcagtggctggaaaattatggctgaggattttgttttgttttgtttgagacagggtcttgctctgtcacctatgctggagtgcagtggtatgatcacagctcactgtaacctcaaactcctgggctcaagtgaccttcctgcccccgcttcctgagtagctatgactccagccttgcaatgccacacctggctaattatttttaaattttttttgtagagatgggggtcttgctatgttgcccaagttggtctggaactcttgggctcaagccatcctcctgccttggcctaccaaagtcctgggattaaaggcattagccactgcacccggactggctgagggtttaaatctaacttgtagtttggttttggatacctggttaactgagaatagtttatacatttctcaagggttgtacaacacatacccccctccaagaagaatctgtgataggaagcaaatgtgtcctcccaaaacctaaaatatttactggctggccctttgtagaaaaatgtactgctccttgatctggtaagcatacttcatatggagagtggaccggcaggtgccttcactcatttatgtaaaccagaagatgcctccactcattcagtacattcaagacgacaagcccaggaggcatccagctgagttctttctcctaaacttaccactcaaataagttcctcttataataagggattataaatttataaatgtttccacccactacacaacccctgggtccctgctctggaaacctcagaggggaatgagtgatcaaaaccaacacagtaagaacagtataactccagttttggtaaaatgtggctctcttatattgacatgtcctcatgaatttagaaaaaagttgggaaggctacattgcaaacttttacatcagttagctccaagttggaattgggtggggcccaggagatttcaattttctatgaaattattttttaaaaatttacaattgggagcaattttttcattttgttcaaaaaccaaactttttttttttttttttttttttttttgagatggagtttcactcttgttacccaggctggagggcagtggcgtggcctgggcttactgtaacctctgcctcccaggttcaagtgattctcctgcctcagcctcccgagtagctgggattacaggtgcctgccaccatgcccagc

SEQ ID NO: 214 - DNA, 4075 bp, Homo sapiens
tctttttatatataataaaagaactgggcatcattcccaaatttctaacacagcttcaactgtccttgaatgttcaagccaaaggagatggtgttttcaaagcttttttttcctgtaagcttaagcaacacagtgactaatgttttacctcaaagttaacttacctagaagtgtaactaaagcaaaaatctgtgatttttttcaaaaaagggattatatgacattcatacattattatacatgaatcaaagtaaatatgacaggagacttgttggaagttgttttttcactaaaacatcttttttagtgtagctctttttgaaagatttaaaaatactcagtacataaggtattttaaaataggctaccatgttaagaattgtctcatttattgtctttctttacactattggcattgtagttctgtggattttaaaagttgctatagatgagatttgagaaaaatgatatttaaatatttgattgggcaacattttatttatttttattctttcaaacagccattaggacttacaaaaccactacacttaattactttcccccaatctaaggaagttcaaaaccattaagtagtagagaaaagtaaaggggaaagtgaaagactgttttatttgtatttattgccattaaaagtaatggcataaactgcaattacttttgcaccaacctgataggttgattttcctgaatgtcagattgtttatcttagcactgagaaacagctatttctggatcagatcatctcagtctaactttatcattgaaatgctattaattagcagaaggatacatgtgcctatgttctataattttttaaaaagcttaaattatttagagaacttttaaagatacttctaccatagtgtacctcaatttttgtgaaaatatatttatcacagtgtaatctgctcagccctccagtgataatgaaaattcactcacttaaattctgatcttggacccagactttgaaaatacttcatgtcagtaaacatactttggataacttacgttaacactgctgttatgaaatgaaaacatttgtgggagctgagtacattggatgcatgagtgaaatttcagagttagcattcttatttcaaaaacgctcaactgggctgggtgcagtggctcacgcctctaatcccagcactttgggaggccaaggtgggtggatcacctcaggtcaggagtttgagaccagccccgccaacatggcgaagcctcatctcgactaaaaaatatgaaaattaggtaggcatagtggtgggtgcctgtaatcacagcttctcgggaggctgaggcaggagaatttcttgaactgggaggcagaggttgtagtgaacaagactctatctcaaaaacaaaaacaaaaacaaaaccccacaaagaaccattcactgttacctaaataatgttctattttggcagttagaatcatccagatgttttaactttggtttaattcttgaaaaaaaaagaaagaaaagaaattggttactgagaaagggagacgtttttcaagttcatccatcctttcttggaacagagggcaaaagaggatgtgttgcagaaggaggtgagagtgaagattctcaaggacaacatcaagttattagctgccaaggtgccctctggtggccaggagttgacgtctgagctgaatgttgtgctggagaattaccaacttctttgtaatagaattcgaggaaagtgccacacgctagaggtatgctattattattattgttgttattattattattattattattattattattttcagtgatgtatttctgagatccaaactctgtaatgttttggccattttcaaatcttggagaaaacttctcttttctttcaaattctggattataaagaaaaaatagttcttgggaaatagtttgataaaaatgaaagaggggttaaaaacaggagaccaaaatctgtccctaattatcagaaggttcttgggcaagtcattttgtatattcaaactttactttttttataggtgcaatccaggttttcatgtaacagatgatctgtagggcctattccagtccaaaaattgcagagcacatttcaagcctctcttttgttttgttttgcctggttgagtacatagagaggaattattttcttttgagtggtgtctaaagttcaagagtcacctgaaggaaaaatagaacttaaatatgtgacagttttactgggtcttagataaaataccttttttttttctccctggccattacacgtaaaatgtagatgagtctatgaaatttttttaaactaagagtgaggttttgcttgtttgtttttatagtagtatgacttttgttattgcttgttggaagatttaagaaggctttcaatttacaacaatttaatttacattcaatttgacgtaaaacaaatatttgtattgtggcaaatcttgaaatggtaaaaaatggcaactgcaatatttaacctaaattcattcattactttgatcattcattcatttgtaaattcattcgtttcttgttctaaaccaattttgtgctaagataaatatatatcattgaggcaagttagtaagaaagctacttgatttgggatctgtctgcttcttggaagtggtcttctttgagtcattttttctttcccataagaaaagaggttgtgcttgcatctgagcagatttttggtctgctttttgcttgtggaaattgggggactagaacctcttttcttttattctaattcagtggctggaaaattatggctgaggattttgttttgttttgtttgagacagggtcttgctctgtcacctatgctggagtgcagtggtatgatcacagctcactgtaacctcaaactcctgggctcaagtgaccttcctgcccccgcttcctgagtagctatgactccagccttgcaatgccacacctggctaattatttttaaattttttttgtagagatgggggtcttgctatgttgcccaagttggtctggaactcttgggctcaagccatcctcctgccttggcctaccaaagtcctgggattaaaggcattagccactgcacccggactggctgagggtttaaatctaacttgtagtttggttttggatacctggttaactgagaatagtttatacatttctcaagggttgtacaacacatacccccctccaagaagaatctgtgataggaagcaaatgtgtcctcccaaaacctaaaatatttactggctggccctttgtagaaaaatgtactgctccttgatctggtaagcatacttcatatggagagtggaccggcaggtgccttcactcatttatgtaaaccagaagatgcctccactcattcagtacattcaagacgacaagcccaggaggcatccagctgagttctttctcctaaacttaccactcaaataagttcctcttataataagggattataaatttataaatgtttccacccactacacaacccctgggtccctgctctggaaacctcagaggggaatgagtgatcaaaaccaacacagtaagaacagtataactccagttttggtaaaatgtggctctcttatattgacatgtcctcatgaatttagaaaaaagttgggaaggctacattgcaaacttttacatcagttagctccaagttggaattgggtggggcccaggagatttcaattttctatgaaattattttttaaaaatttacaattgggagcaattttttcattttgttcaaaaaccaaactttttttttttttttttttttttttttgagatggagtttcactcttgttacccaggctggagggcagtggcgtggcctgggcttactgtaacctctgcctcccaggttcaagtgattctcctgcctcagcctcccgagtagctgggattacaggtgcctgccaccatgcccagctagtttttgtatttttagtagagatggggtttcaccatgttggccaggctggtcttgaactcctgacctcatgtgatccacctgccttggcctcccaaaatgctgag

SEQ ID NO: 215 - DNA, 4041 bp, Homo sapiens
gctcaagtgaccttcctgcccccgcttcctgagtagctatgactccagccttgcaatgccacacctggctaattatttttaaattttttttgtagagatgggggtcttgctatgttgcccaagttggtctggaactcttgggctcaagccatcctcctgccttggcctaccaaagtcctgggattaaaggcattagccactgcacccggactggctgagggtttaaatctaacttgtagtttggttttggatacctggttaactgagaatagtttatacatttctcaagggttgtacaacacatacccccctccaagaagaatctgtgataggaagcaaatgtgtcctcccaaaacctaaaatatttactggctggccctttgtagaaaaatgtactgctccttgatctggtaagcatacttcatatggagagtggaccggcaggtgccttcactcatttatgtaaaccagaagatgcctccactcattcagtacattcaagacgacaagcccaggaggcatccagctgagttctttctcctaaacttaccactcaaataagttcctcttataataagggattataaatttataaatgtttccacccactacacaacccctgggtccctgctctggaaacctcagaggggaatgagtgatcaaaaccaacacagtaagaacagtataactccagttttggtaaaatgtggctctcttatattgacatgtcctcatgaatttagaaaaaagttgggaaggctacattgcaaacttttacatcagttagctccaagttggaattgggtggggcccaggagatttcaattttctatgaaattattttttaaaaatttacaattgggagcaattttttcattttgttcaaaaaccaaactttttttttttttttttttttttttttgagatggagtttcactcttgttacccaggctggagggcagtggcgtggcctgggcttactgtaacctctgcctcccaggttcaagtgattctcctgcctcagcctcccgagtagctgggattacaggtgcctgccaccatgcccagctagtttttgtatttttagtagagatggggtttcaccatgttggccaggctggtcttgaactcctgacctcatgtgatccacctgccttggcctcccaaaatgctgagattacaggtgtgaaccaccgcacttggtctttaaaaaacaaactaaataatgtttctctcctgtttttcttactaattatatagttctatttttgacatttaaatcagatcatggaatttattttaaagagtgaggcagcctcttgcccactctttgctccccacccttcaccaactggtctcatatgattttgttgattattttattttattttatttgagatggagtcttgctctgttgcccaggctggaatgcagtggtgcaatctcagctcaccgcaacctccgcctcccgggttcacgccattctcctgcctcctccagagtagctgggactacaggcatccgccaccacacccggctaatatttttatatatatatatatatttttagtagagacagggtttcaccgtgttagccaggatggtcttaatctcctgacctcatgatctgcctgcttcagcctcccaaagtgctgggattacaggcgtgagccaccacgcctggccgattttattttatttttttgaagtttcaactccatcagttctgaattcctaggtatactcacatccaaatgaaattattagcgattaaagagaatgtgtagtactagagatacgatgtgtgaaatggctttttgtctaatttaaaatttttcatgctttaggaggtctggtcttgttggattgaactgcttcactatttggatcttgaaactacctggttaaacactttggaagagcggatgaagagcacagaggtcctgcctgagaagacggatgctgtcaacgaagccctggaggttggaacccgtgatctccacggcatttctctttgctgtgatgaggccacacgtgtattacaatgaggaatgtaatgctttacgcaggcaaatgcatttgcttcctcagtggttttcaatgtcacttgcattttcttccatagcctgaagtgtttatacaatcatgtgtatttagattattggtgacccattatatcagcctcaagacgtggttagctgtttgacatcttacattttagacatgttgaagcactctagtggttttccagtttattttagtaggccctggacaaagctctgccatatgttattaggacaactgctctcttgtttcatcaacaagttatttttactcactaaacacagcactgacagtttataggggattcctgtctcttaccttcagatgctagaagttaagacagtggttgagccatgggatcttgtcgtaggagcttgtcttcaagcctggatttgaactccttgaggccaagaaatgtacccgatgctttgttattcctcagttcccagcacagtgtgtagcacatgttaacttaataaccgtttcttaaatgaaatacagtgcaaagagggtaggtttgcttaacaaaaaagaaaagggaagggggtagataggcttttaaaaatgtcatggtaccatgtgggaactgagtggacaactggattaaaggtcagaaatgagtaaaatgtggcacttacattccaggagacggatgctctgctagagaaaagatgtcacttctcaaatatagcagagtgagagacagagtgaatgaaaaatatgaaaagcttaatttttttcctaatgtaagagtgaatacgtatatattcttgaaatatggaaaataaagaaaagtataaagcaaactctaagataaacattttaaaacagtttgtagatttcttcctaattattatcttttatgtatgcatactagaaggtagtatattggatcaaaggctttggagtcttttatttacttatttatctttttatttgagatggaatcttgctatgttgcccaggctggagtgcaattgcatgattttggctcactgcaacctccacctcctgagttcaagcaattctcatgcctcagcctcctgagtagctgggatcacaggcgtgtgccactaccccagctaattttgtatttttagtagagatggggttttaccatgtcggccaggctgggctcgaactcctgacatcaggtgatccacccgcttcggcctcccaatgtgctaggattagaggtgtgagccatcgcacttggccaggctttggagtcttaaagctttagagccatgttggaatcttagctcttcttttgactgtgtgtatgtaggcaagtaatttaacctttctgagcttcaattttccaatctgtaaactgggaatgctatttagcccatatggttaattagatttatgtatataaaaagtgtgtatataaaacaatgcctcttattctgcatatattgtaggaaaatgactacttatttttagtaatataattaataaaagttgagatcattttgcttgtatagtactgttctctgcctttgaactttgtgtcatgagcatttccccatataattaataattatttttaactttttattattcatttatttattgtttagagacatagtctcgctctgttgcccaggctggagtccagtggtatgacagctcactgcagccttgaactcttgggctcaagtgatcctcctgcctcaccctcccataattaataatagttgaaattatttttgtgaaattatatcatatatcacttgtgctaatttctcaattttatgcattttttaatcccatgatggatatttttgtgaattagtaatttacttaacttttggtcctgttacttaggtagatttttagaaaatataattacttgtttaacaaatagacattttggggatccttgataccttttgccttagtaaatgcattattatttttttttcccatctccattccagtctctggaatctgttctgcgccacccggcag

SEQ ID NO: 216 - DNA, 4055 bp, Homo sapiens
tctttgctgtgatgaggccacacgtgtattacaatgaggaatgtaatgctttacgcaggcaaatgcatttgcttcctcagtggttttcaatgtcacttgcattttcttccatagcctgaagtgtttatacaatcatgtgtatttagattattggtgacccattatatcagcctcaagacgtggttagctgtttgacatcttacattttagacatgttgaagcactctagtggttttccagtttattttagtaggccctggacaaagctctgccatatgttattaggacaactgctctcttgtttcatcaacaagttatttttactcactaaacacagcactgacagtttataggggattcctgtctcttaccttcagatgctagaagttaagacagtggttgagccatgggatcttgtcgtaggagcttgtcttcaagcctggatttgaactccttgaggccaagaaatgtacccgatgctttgttattcctcagttcccagcacagtgtgtagcacatgttaacttaataaccgtttcttaaatgaaatacagtgcaaagagggtaggtttgcttaacaaaaaagaaaagggaagggggtagataggcttttaaaaatgtcatggtaccatgtgggaactgagtggacaactggattaaaggtcagaaatgagtaaaatgtggcacttacattccaggagacggatgctctgctagagaaaagatgtcacttctcaaatatagcagagtgagagacagagtgaatgaaaaatatgaaaagcttaatttttttcctaatgtaagagtgaatacgtatatattcttgaaatatggaaaataaagaaaagtataaagcaaactctaagataaacattttaaaacagtttgtagatttcttcctaattattatcttttatgtatgcatactagaaggtagtatattggatcaaaggctttggagtcttttatttacttatttatctttttatttgagatggaatcttgctatgttgcccaggctggagtgcaattgcatgattttggctcactgcaacctccacctcctgagttcaagcaattctcatgcctcagcctcctgagtagctgggatcacaggcgtgtgccactaccccagctaattttgtatttttagtagagatggggttttaccatgtcggccaggctgggctcgaactcctgacatcaggtgatccacccgcttcggcctcccaatgtgctaggattagaggtgtgagccatcgcacttggccaggctttggagtcttaaagctttagagccatgttggaatcttagctcttcttttgactgtgtgtatgtaggcaagtaatttaacctttctgagcttcaattttccaatctgtaaactgggaatgctatttagcccatatggttaattagatttatgtatataaaaagtgtgtatataaaacaatgcctcttattctgcatatattgtaggaaaatgactacttatttttagtaatataattaataaaagttgagatcattttgcttgtatagtactgttctctgcctttgaactttgtgtcatgagcatttccccatataattaataattatttttaactttttattattcatttatttattgtttagagacatagtctcgctctgttgcccaggctggagtccagtggtatgacagctcactgcagccttgaactcttgggctcaagtgatcctcctgcctcaccctcccataattaataatagttgaaattatttttgtgaaattatatcatatatcacttgtgctaatttctcaattttatgcattttttaatcccatgatggatatttttgtgaattagtaatttacttaacttttggtcctgttacttaggtagatttttagaaaatataattacttgtttaacaaatagacattttggggatccttgataccttttgccttagtaaatgcattattatttttttttcccatctccattccagtctctggaatctgttctgcgccacccggcagataatcgcacccagattcgagagcttggccagactctgattgatggggggatcctggatgatataatcagtgagaaactggaggctttcaacagccgatatgaagatctaagtcacctggtaagagttgggacatacatgggtgttgattaggtattgatgaagtggagctggccctaagctccatatcatagagctttaatgttggaaaaatctttaatgttggttaaagttggtaaccaatgctaacaggggcattgagggtattgaaatattcagaaaggaagaatagatctaacactctaagacagaactggatgattaaaaaaattatttttgagattacttctacttacaaacatttaattttcattaaggatcatatgatagctgtatataagaacaacaactcatactatcctagtaaatattagggccatgatatttcacataagctgctgtgaaagccatagtctcttagttcatatccaggttgtaacatacatattcgtatcacaaattagagaaagaacatttcttttataggaaggttgggtatgaatattaggtgcttccaaacacatattaaataataactgttgatgttcagcccatgaataacatcaagcttaacccaaaagtgctgtaaatagtagtttgatatgtatgtacacctatagaatttgttttaggctttggaaaaaaagagactctgatgtttgtgtattgatagacatttttcttatgttttatattcttaattggcagacattgctgattcctaaaaatgctttaaaattataataaataacacatttttatcttctgtttaatgcatcttatgggaaacctttacatttttgtatttcaacattatatatagaaagaagtaataattagtaattcagctgcatggtacataagatcctagtgggacattttcactgttatcattagtaattattatttatttataaagaaagctaaagtcttggatgaaagcttttatggtcttttcttagtggccagaatatatatattctgctatttatatttgtgttgggcaactaatgattcaatttctcctttgtgcaggcagagagcaagcagatttctttggaaaagcaactccaggtgctgcgggaaactgaccagatgcttcaagtcttgcaagagagcttgggggagctggacaaacagctcaccacatacctgactgacaggatagatgctttccaagttccacaggaagctcaggtattgccgtgcatttgagggcttttgagctgtaaagagagcttttgtaattgcctcctcaactataagagaacccctcctgctctccaaaaccgagagtcaatgggaaagattgaccttacttacagggcagcatttgggttttggagttctcttgctttctatgtgagactctggcaaaagtcttatatagtttattttattttattttattttattttatttatttatttgagacagaatcccactatgtcacccaggctggagtgcagtggcacgatcttggctcactgcaacctccgcctcctgggttcaagtgactctcctgcctcagcctcccgaataactgggactacaagcacgcgccaccacgcccggctaattttttgtagttttagtagagacggggtttcgccatgttggccaggctggtcttgaactcctgacttcaagtgatctgcctgcctcggcctcccaataatttttgtatttttagtagagacggggttttgccatattgtccaggctagtctcaaactcctgacttcaggtgatccaccttcctcggcctcccaaaatgctgggattacaggcgtgagccactgtgcctggctgaaaagtcctgtatattttaaattgtagttttcttagctgtgaagttgggacaattccttccttataaataagttgtgaacattagaaacgacaaatgcaaagcccttagcaggtgcgtcatgtacaatagtcataccatgcagtgggccatatt

SEQ ID NO: 217 - DNA, 4064 bp, Homo sapiens
caggcaaatgcatttgcttcctcagtggttttcaatgtcacttgcattttcttccatagcctgaagtgtttatacaatcatgtgtatttagattattggtgacccattatatcagcctcaagacgtggttagctgtttgacatcttacattttagacatgttgaagcactctagtggttttccagtttattttagtaggccctggacaaagctctgccatatgttattaggacaactgctctcttgtttcatcaacaagttatttttactcactaaacacagcactgacagtttataggggattcctgtctcttaccttcagatgctagaagttaagacagtggttgagccatgggatcttgtcgtaggagcttgtcttcaagcctggatttgaactccttgaggccaagaaatgtacccgatgctttgttattcctcagttcccagcacagtgtgtagcacatgttaacttaataaccgtttcttaaatgaaatacagtgcaaagagggtaggtttgcttaacaaaaaagaaaagggaagggggtagataggcttttaaaaatgtcatggtaccatgtgggaactgagtggacaactggattaaaggtcagaaatgagtaaaatgtggcacttacattccaggagacggatgctctgctagagaaaagatgtcacttctcaaatatagcagagtgagagacagagtgaatgaaaaatatgaaaagcttaatttttttcctaatgtaagagtgaatacgtatatattcttgaaatatggaaaataaagaaaagtataaagcaaactctaagataaacattttaaaacagtttgtagatttcttcctaattattatcttttatgtatgcatactagaaggtagtatattggatcaaaggctttggagtcttttatttacttatttatctttttatttgagatggaatcttgctatgttgcccaggctggagtgcaattgcatgattttggctcactgcaacctccacctcctgagttcaagcaattctcatgcctcagcctcctgagtagctgggatcacaggcgtgtgccactaccccagctaattttgtatttttagtagagatggggttttaccatgtcggccaggctgggctcgaactcctgacatcaggtgatccacccgcttcggcctcccaatgtgctaggattagaggtgtgagccatcgcacttggccaggctttggagtcttaaagctttagagccatgttggaatcttagctcttcttttgactgtgtgtatgtaggcaagtaatttaacctttctgagcttcaattttccaatctgtaaactgggaatgctatttagcccatatggttaattagatttatgtatataaaaagtgtgtatataaaacaatgcctcttattctgcatatattgtaggaaaatgactacttatttttagtaatataattaataaaagttgagatcattttgcttgtatagtactgttctctgcctttgaactttgtgtcatgagcatttccccatataattaataattatttttaactttttattattcatttatttattgtttagagacatagtctcgctctgttgcccaggctggagtccagtggtatgacagctcactgcagccttgaactcttgggctcaagtgatcctcctgcctcaccctcccataattaataatagttgaaattatttttgtgaaattatatcatatatcacttgtgctaatttctcaattttatgcattttttaatcccatgatggatatttttgtgaattagtaatttacttaacttttggtcctgttacttaggtagatttttagaaaatataattacttgtttaacaaatagacattttggggatccttgataccttttgccttagtaaatgcattattatttttttttcccatctccattccagtctctggaatctgttctgcgccacccggcagataatcgcacccagattcgagagcttggccagactctgattgatggggggatcctggatgatataatcagtgagaaactggaggctttcaacagccgatatgaagatctaagtcacctggtaagagttgggacatacatgggtgttgattaggtattgatgaagtggagctggccctaagctccatatcatagagctttaatgttggaaaaatctttaatgttggttaaagttggtaaccaatgctaacaggggcattgagggtattgaaatattcagaaaggaagaatagatctaacactctaagacagaactggatgattaaaaaaattatttttgagattacttctacttacaaacatttaattttcattaaggatcatatgatagctgtatataagaacaacaactcatactatcctagtaaatattagggccatgatatttcacataagctgctgtgaaagccatagtctcttagttcatatccaggttgtaacatacatattcgtatcacaaattagagaaagaacatttcttttataggaaggttgggtatgaatattaggtgcttccaaacacatattaaataataactgttgatgttcagcccatgaataacatcaagcttaacccaaaagtgctgtaaatagtagtttgatatgtatgtacacctatagaatttgttttaggctttggaaaaaaagagactctgatgtttgtgtattgatagacatttttcttatgttttatattcttaattggcagacattgctgattcctaaaaatgctttaaaattataataaataacacatttttatcttctgtttaatgcatcttatgggaaacctttacatttttgtatttcaacattatatatagaaagaagtaataattagtaattcagctgcatggtacataagatcctagtgggacattttcactgttatcattagtaattattatttatttataaagaaagctaaagtcttggatgaaagcttttatggtcttttcttagtggccagaatatatatattctgctatttatatttgtgttgggcaactaatgattcaatttctcctttgtgcaggcagagagcaagcagatttctttggaaaagcaactccaggtgctgcgggaaactgaccagatgcttcaagtcttgcaagagagcttgggggagctggacaaacagctcaccacatacctgactgacaggatagatgctttccaagttccacaggaagctcaggtattgccgtgcatttgagggcttttgagctgtaaagagagcttttgtaattgcctcctcaactataagagaacccctcctgctctccaaaaccgagagtcaatgggaaagattgaccttacttacagggcagcatttgggttttggagttctcttgctttctatgtgagactctggcaaaagtcttatatagtttattttattttattttattttattttatttatttatttgagacagaatcccactatgtcacccaggctggagtgcagtggcacgatcttggctcactgcaacctccgcctcctgggttcaagtgactctcctgcctcagcctcccgaataactgggactacaagcacgcgccaccacgcccggctaattttttgtagttttagtagagacggggtttcgccatgttggccaggctggtcttgaactcctgacttcaagtgatctgcctgcctcggcctcccaataatttttgtatttttagtagagacggggttttgccatattgtccaggctagtctcaaactcctgacttcaggtgatccaccttcctcggcctcccaaaatgctgggattacaggcgtgagccactgtgcctggctgaaaagtcctgtatattttaaattgtagttttcttagctgtgaagttgggacaattccttccttataaataagttgtgaacattagaaacgacaaatgcaaagcccttagcaggtgcgtcatgtacaatagtcataccatgcagtgggccatattattattattatacaaaaacgtattattattattttttagacggattctcactctgttgcccagg

SEQ ID NO: 218 - DNA, 4047 bp, Homo sapiens
tagtagagatggggttttaccatgtcggccaggctgggctcgaactcctgacatcaggtgatccacccgcttcggcctcccaatgtgctaggattagaggtgtgagccatcgcacttggccaggctttggagtcttaaagctttagagccatgttggaatcttagctcttcttttgactgtgtgtatgtaggcaagtaatttaacctttctgagcttcaattttccaatctgtaaactgggaatgctatttagcccatatggttaattagatttatgtatataaaaagtgtgtatataaaacaatgcctcttattctgcatatattgtaggaaaatgactacttatttttagtaatataattaataaaagttgagatcattttgcttgtatagtactgttctctgcctttgaactttgtgtcatgagcatttccccatataattaataattatttttaactttttattattcatttatttattgtttagagacatagtctcgctctgttgcccaggctggagtccagtggtatgacagctcactgcagccttgaactcttgggctcaagtgatcctcctgcctcaccctcccataattaataatagttgaaattatttttgtgaaattatatcatatatcacttgtgctaatttctcaattttatgcattttttaatcccatgatggatatttttgtgaattagtaatttacttaacttttggtcctgttacttaggtagatttttagaaaatataattacttgtttaacaaatagacattttggggatccttgataccttttgccttagtaaatgcattattatttttttttcccatctccattccagtctctggaatctgttctgcgccacccggcagataatcgcacccagattcgagagcttggccagactctgattgatggggggatcctggatgatataatcagtgagaaactggaggctttcaacagccgatatgaagatctaagtcacctggtaagagttgggacatacatgggtgttgattaggtattgatgaagtggagctggccctaagctccatatcatagagctttaatgttggaaaaatctttaatgttggttaaagttggtaaccaatgctaacaggggcattgagggtattgaaatattcagaaaggaagaatagatctaacactctaagacagaactggatgattaaaaaaattatttttgagattacttctacttacaaacatttaattttcattaaggatcatatgatagctgtatataagaacaacaactcatactatcctagtaaatattagggccatgatatttcacataagctgctgtgaaagccatagtctcttagttcatatccaggttgtaacatacatattcgtatcacaaattagagaaagaacatttcttttataggaaggttgggtatgaatattaggtgcttccaaacacatattaaataataactgttgatgttcagcccatgaataacatcaagcttaacccaaaagtgctgtaaatagtagtttgatatgtatgtacacctatagaatttgttttaggctttggaaaaaaagagactctgatgtttgtgtattgatagacatttttcttatgttttatattcttaattggcagacattgctgattcctaaaaatgctttaaaattataataaataacacatttttatcttctgtttaatgcatcttatgggaaacctttacatttttgtatttcaacattatatatagaaagaagtaataattagtaattcagctgcatggtacataagatcctagtgggacattttcactgttatcattagtaattattatttatttataaagaaagctaaagtcttggatgaaagcttttatggtcttttcttagtggccagaatatatatattctgctatttatatttgtgttgggcaactaatgattcaatttctcctttgtgcaggcagagagcaagcagatttctttggaaaagcaactccaggtgctgcgggaaactgaccagatgcttcaagtcttgcaagagagcttgggggagctggacaaacagctcaccacatacctgactgacaggatagatgctttccaagttccacaggaagctcaggtattgccgtgcatttgagggcttttgagctgtaaagagagcttttgtaattgcctcctcaactataagagaacccctcctgctctccaaaaccgagagtcaatgggaaagattgaccttacttacagggcagcatttgggttttggagttctcttgctttctatgtgagactctggcaaaagtcttatatagtttattttattttattttattttattttatttatttatttgagacagaatcccactatgtcacccaggctggagtgcagtggcacgatcttggctcactgcaacctccgcctcctgggttcaagtgactctcctgcctcagcctcccgaataactgggactacaagcacgcgccaccacgcccggctaattttttgtagttttagtagagacggggtttcgccatgttggccaggctggtcttgaactcctgacttcaagtgatctgcctgcctcggcctcccaataatttttgtatttttagtagagacggggttttgccatattgtccaggctagtctcaaactcctgacttcaggtgatccaccttcctcggcctcccaaaatgctgggattacaggcgtgagccactgtgcctggctgaaaagtcctgtatattttaaattgtagttttcttagctgtgaagttgggacaattccttccttataaataagttgtgaacattagaaacgacaaatgcaaagcccttagcaggtgcgtcatgtacaatagtcataccatgcagtgggccatattattattattatacaaaaacgtattattattattttttagacggattctcactctgttgcccaggctagagtgcagtggcgcgatctcggctcactgcaaactctgccccacaggttcaagcaattctcctgcctcagcctcccgagtagctgggattataggcgcccgccaccgtgcccagctaatttttgtatttttagtagagatggggtttcaccatcttggccaggctggtcttgaactcctgatgtcgtgatccacccgcctcggcctcccaaagtgttgggattacaggcataagccaccgcacctggcctacaaaaacttattaaagcttctgtggaggtcaacattatgtaaaatacgatatcatgtattacacaacgatatagaacttttgtattgtctctttttatacttaagtaaaaaaaaaaggacatcctctcccctttccaatctctttttagaaaatccaagcagagatctcagcccatgagctaaccctagaggagttgagaagaaatatgcgttctcagcccctgacctccccagagagtaggactgccagaggaggaagtcagatggatgtgctacaggtaaagaaggccaggagcttccttttacttttcaacttgttgggaattttcttcaaaaaagagaaagaattgattacttgggcaccgtttgtattctttgtgatgtaaaccatgggatgggagtgatgatgtgttgaaggttgcatcctagggcagcagaaacaaattgttgcatgtgtggaaaaatatgaaatctgattttgatagctgagatgagaaacaagagagtgagccagatttagaagttagctttatatacactttttctttaatgcagagcctctgtcagtatcgtgtggctgatgctgtgggcaggccgagcatgaattggatgcagcatcatttagttctttcatggttgatatgacattgactttcactctgaacttgtgatgaagggcattttgagttctaggttcctgaactatctttttgaacatgaagttttaattccagtgaggtcagctttatctaaatttcttatccaaatctattacttctgagattgagacactgagtgttgtaatttttgacactgggctatgc

SEQ ID NO: 219 - DNA, 4044 bp, Homo sapiens
gggtatgaatattaggtgcttccaaacacatattaaataataactgttgatgttcagcccatgaataacatcaagcttaacccaaaagtgctgtaaatagtagtttgatatgtatgtacacctatagaatttgttttaggctttggaaaaaaagagactctgatgtttgtgtattgatagacatttttcttatgttttatattcttaattggcagacattgctgattcctaaaaatgctttaaaattataataaataacacatttttatcttctgtttaatgcatcttatgggaaacctttacatttttgtatttcaacattatatatagaaagaagtaataattagtaattcagctgcatggtacataagatcctagtgggacattttcactgttatcattagtaattattatttatttataaagaaagctaaagtcttggatgaaagcttttatggtcttttcttagtggccagaatatatatattctgctatttatatttgtgttgggcaactaatgattcaatttctcctttgtgcaggcagagagcaagcagatttctttggaaaagcaactccaggtgctgcgggaaactgaccagatgcttcaagtcttgcaagagagcttgggggagctggacaaacagctcaccacatacctgactgacaggatagatgctttccaagttccacaggaagctcaggtattgccgtgcatttgagggcttttgagctgtaaagagagcttttgtaattgcctcctcaactataagagaacccctcctgctctccaaaaccgagagtcaatgggaaagattgaccttacttacagggcagcatttgggttttggagttctcttgctttctatgtgagactctggcaaaagtcttatatagtttattttattttattttattttattttatttatttatttgagacagaatcccactatgtcacccaggctggagtgcagtggcacgatcttggctcactgcaacctccgcctcctgggttcaagtgactctcctgcctcagcctcccgaataactgggactacaagcacgcgccaccacgcccggctaattttttgtagttttagtagagacggggtttcgccatgttggccaggctggtcttgaactcctgacttcaagtgatctgcctgcctcggcctcccaataatttttgtatttttagtagagacggggttttgccatattgtccaggctagtctcaaactcctgacttcaggtgatccaccttcctcggcctcccaaaatgctgggattacaggcgtgagccactgtgcctggctgaaaagtcctgtatattttaaattgtagttttcttagctgtgaagttgggacaattccttccttataaataagttgtgaacattagaaacgacaaatgcaaagcccttagcaggtgcgtcatgtacaatagtcataccatgcagtgggccatattattattattatacaaaaacgtattattattattttttagacggattctcactctgttgcccaggctagagtgcagtggcgcgatctcggctcactgcaaactctgccccacaggttcaagcaattctcctgcctcagcctcccgagtagctgggattataggcgcccgccaccgtgcccagctaatttttgtatttttagtagagatggggtttcaccatcttggccaggctggtcttgaactcctgatgtcgtgatccacccgcctcggcctcccaaagtgttgggattacaggcataagccaccgcacctggcctacaaaaacttattaaagcttctgtggaggtcaacattatgtaaaatacgatatcatgtattacacaacgatatagaacttttgtattgtctctttttatacttaagtaaaaaaaaaaggacatcctctcccctttccaatctctttttagaaaatccaagcagagatctcagcccatgagctaaccctagaggagttgagaagaaatatgcgttctcagcccctgacctccccagagagtaggactgccagaggaggaagtcagatggatgtgctacaggtaaagaaggccaggagcttccttttacttttcaacttgttgggaattttcttcaaaaaagagaaagaattgattacttgggcaccgtttgtattctttgtgatgtaaaccatgggatgggagtgatgatgtgttgaaggttgcatcctagggcagcagaaacaaattgttgcatgtgtggaaaaatatgaaatctgattttgatagctgagatgagaaacaagagagtgagccagatttagaagttagctttatatacactttttctttaatgcagagcctctgtcagtatcgtgtggctgatgctgtgggcaggccgagcatgaattggatgcagcatcatttagttctttcatggttgatatgacattgactttcactctgaacttgtgatgaagggcattttgagttctaggttcctgaactatctttttgaacatgaagttttaattccagtgaggtcagctttatctaaatttcttatccaaatctattacttctgagattgagacactgagtgttgtaatttttgacactgggctatgcagttcacttaggtgatcgggtaccctcactgagattcattaggagttttttattttgggtcatatttctgaatttttttcttttggtactttatggtacaaatttttagtagtatctgttatgctcatgatgagagagataatcatcctgatgggaattgcatattttcatttctgcaaacagaggaaactccgagaggtgtccacaaagttccagcttttccagaagccagctaacttcgagcagcgcatgctggactgcaagcgtgtgctggatggcgtgaaagcagaacttcacgttctggatgtgaaggacgtagaccctgacgtcatacagacgcacctggacaagtgtatggtgaggcttttgggtgattggcacatccagtggctttttcagcagctgttatggcttggtctagcaagtacatgcctagtgtgtccagtgatcactagtctacagtgtgctaaacataaggattgatgatggaaaacgtgttaaaaaataagaagtgtggtctttccctccaaagaaattagaagagataagagagatagctaaggaaactagaatagacatgtatataacatgatgacaaaaaccaaaacaaaagaaatacagcttaatcaccatgtgaagttaggagggcttcagcagagtgtgactaataagcaaagttttcaaggataaatttgaattagctagaagaaccatacttagaatggatatcgtaaaaattccattttctaggaaaataaaaatttcaatagaaatttaaaccttaagataggaaagaagaaatgatatataaggccttattacttttttagtcttgaactttataattcaattgaatagaaatttaaaaataatgtggctaaggggacacaatcttagaattagtgttctgcttgagaatcacagaacttaagatgagactctttaggacaggagaggtatagggacagttctttgtgcttttcaaaacaaaggataaattttaatatatatgtgcatgtatgtaagtatttatttgattattgtgacataatggtaatcagagaaagtgctgtccttgacttcatggaacatacatagttcaggggtctgttacatgacagcgtcctatgagatgttgagatgatgatgtataggtgtcaagagaagctgtttagaataaagctttttggtttcaggtaactaggaagaagacagctctgaatttgacctacagaactacgatttctttttttatatttaaatttatttttatttttaatttttgaagacttttaggttcaggaagtacatgtgcacgtttgatacatggatatattgtatgatgctgaggtttgggcttcgactgaacccatcacccaaataataaatgtagtacccaattggtagtttttcagctcttgcccctttc

SEQ ID NO: 220 - DNA, 4046 bp, Homo sapiens
caaaaaccaaaacaaaagaaatacagcttaatcaccatgtgaagttaggagggcttcagcagagtgtgactaataagcaaagttttcaaggataaatttgaattagctagaagaaccatacttagaatggatatcgtaaaaattccattttctaggaaaataaaaatttcaatagaaatttaaaccttaagataggaaagaagaaatgatatataaggccttattacttttttagtcttgaactttataattcaattgaatagaaatttaaaaataatgtggctaaggggacacaatcttagaattagtgttctgcttgagaatcacagaacttaagatgagactctttaggacaggagaggtatagggacagttctttgtgcttttcaaaacaaaggataaattttaatatatatgtgcatgtatgtaagtatttatttgattattgtgacataatggtaatcagagaaagtgctgtccttgacttcatggaacatacatagttcaggggtctgttacatgacagcgtcctatgagatgttgagatgatgatgtataggtgtcaagagaagctgtttagaataaagctttttggtttcaggtaactaggaagaagacagctctgaatttgacctacagaactacgatttctttttttatatttaaatttatttttatttttaatttttgaagacttttaggttcaggaagtacatgtgcacgtttgatacatggatatattgtatgatgctgaggtttgggcttcgactgaacccatcacccaaataataaatgtagtacccaattggtagtttttcagctcttgcccctttcctccttccctccttttggagtcccattgtctttgctttccatctttatgtgcatgtgtgcccattgtttaactcccacttataagtgagaacatttagtatttggttttctgttcctgaattaatttacttaggataatggccttgagctgcattcatgctgctgcaaaggacatgatttcattttttatggctgtgtagtgttccgtggtgtatttgtaccacgttttctttatccattcccccattgatgggcacctagattgatgacatgtctttgctattgtgtgtagtggtgtgataaacacgggagtgcatgtgtccttttggtagaacgattatcctcctttacttatatacccagtaataggatttctgggttgaataataattctatgtttagttctttgagatatttccaaactgctttccctaggggctgaactgatttacaatcctaccaacagtgtatggtgttcccttttctctgcagccttgccagcatctgttgttttttgactttttaataatggtcattcagactggtgtgagatagtatcttattgtggttttgatttgcatcagaaatctgtttacttatagttatatacatcttgatatatcgagttttgtattttttatcatacaaattatatatgttcattgtggtagacttagtacttctgagaaatagaaataaatgttaataattccaaatccaacagacagcagtagccagtgttggcttgttttagtcataacatgcaagattttttaaaaatgtaattttaattgtgataaacattctgtttttagtcctaatgttttcccattttatgtaggaaaaatatttatattatcaagtactttcataagcatttgtctgagattttgaaagaatgagcataaactctattagtttattttcttgtcagatttgaagaagttattacaagcttgatttcatttgactcgaccttcagaccaaatctgagaaagatgatggcctttgatcaccatagttaggtcttggctgtcaatctgtgtaagctgtggtctgacatgatgccagttggcaagttgtcaccacagtgtgtaatttgtctttttctttgtttgttttaaagaaactgtataaaactttgagtgaagtcaaacttgaagtggaaactgtgattaaaacaggaagacatattgtccagaaacagcaaacggacaacccaaaagggatggatgagcagctgacttccctgaaggttctttacaatgacctgggcgcacaggtgaggagagcagccccacagctcatctctctgtctctctctctctctctctcaatctctctctctctctcgttctctctcatgtatttttaaatttcattttttggaaaatgcatgtttgaaaattatgagattcatacgtgttttcaatttattgtaataattgttatatttctttaaatgtatgtggtaatattacagtgattcatagttacatagaaatttatttttggctaggcacagtggctcacgcctgtaatcccaggtctttgggaggctgagtcaggtaatggcttgagcccaggggtttgagaccagcctgggcaacatgatgaaaccttgtctctacaaaaaaatacaaatgaaaacctccaaaaacaaaacaaatttccaaaaaaaaattagccatggtggtgagtatctgtagtcctagctacctgggaggctgaggtgggagagctgcttgaacctgagaggcagaggttgcagtgagctgagatcacaccactacactccagcctaggaacagagtgagacactgtttttaaaaaaaatttatttttaatatttaattcaggctaatatttatactttcaatggctactgatattccataaattattctaaggatactacaagtaatatatgttcattgtggtagacttagtgtgtctggaattggtgggttcttggtctcactgacttcaagaatgaagctgtggaccctcgtggtgagtgttacagctcttaaggtggcgcatctggagtttgttccttctgatgttcggatgtgcttggagtttcttccttctggtgggttcatggtcttcctggctcaggagtgacgctgcagacctttgcagtgagtgttacagctcttaaggcagcgcatctggagttgttcgttcctcccagtgggcttgtggtctcgctggcttcaggagtgaagctgcagacctttgcagtgagtgttacagctcataaaagcagtgtggacccaaagagtgagcagtagcaagatttattgcaaagagcaaaagaacaaagcttccacagtgtggaaggggacccgagcgggttgccactgctggctcgcgcagcctgcttttattctcttatctggccctacccacatcctgctgattggtagagacgagtggtctgttttgacagggcgctgattggtgcgtttacaatccctgagctagacacaaaggttctccatgtccccaccagattagctagatacagagtgtggacacaaaggttctccaaggccccaccagagtagctagatacagagtgttgattggtgcattcacaaaccctgagctagacacagggtgctgattggtgtgtttacaaaccttgagctagatacagagtgccaattggtgtatttacaatcccttagctagacataaaggttctctaaggccccaccagagtagctagatacagagtgtggattggtgcactcacaaaccctgagctagacacagggtgctgattggtgtgtttacaaaccttgagctagatacagagtgccgattggtgtatttacaatccctgagctagacataaagactctccacgtccccaccagacccaggagtccagctggcttcacccagtggatcccgcacccgggctgcaggtggagctgccttccagtcccgcaccgtgggcttgcactcctcagcccttgggtggtcaatgggagtgggcgccgtggagcagggggtggcactcatcagggaggctccggccgcacaggagcccatggagggggtgggaggctcaggaatggcgggctgcaggtcccgagccctgccccgcaggaaggcagctaaggcccggtgagaaattgagcgcagcgccggtgggctggcactgctgggggacccagtacaccctccacagccgctgg

SEQ ID NO: 221 - DNA, 4043 bp, Homo sapiens
ttaatttttgaagacttttaggttcaggaagtacatgtgcacgtttgatacatggatatattgtatgatgctgaggtttgggcttcgactgaacccatcacccaaataataaatgtagtacccaattggtagtttttcagctcttgcccctttcctccttccctccttttggagtcccattgtctttgctttccatctttatgtgcatgtgtgcccattgtttaactcccacttataagtgagaacatttagtatttggttttctgttcctgaattaatttacttaggataatggccttgagctgcattcatgctgctgcaaaggacatgatttcattttttatggctgtgtagtgttccgtggtgtatttgtaccacgttttctttatccattcccccattgatgggcacctagattgatgacatgtctttgctattgtgtgtagtggtgtgataaacacgggagtgcatgtgtccttttggtagaacgattatcctcctttacttatatacccagtaataggatttctgggttgaataataattctatgtttagttctttgagatatttccaaactgctttccctaggggctgaactgatttacaatcctaccaacagtgtatggtgttcccttttctctgcagccttgccagcatctgttgttttttgactttttaataatggtcattcagactggtgtgagatagtatcttattgtggttttgatttgcatcagaaatctgtttacttatagttatatacatcttgatatatcgagttttgtattttttatcatacaaattatatatgttcattgtggtagacttagtacttctgagaaatagaaataaatgttaataattccaaatccaacagacagcagtagccagtgttggcttgttttagtcataacatgcaagattttttaaaaatgtaattttaattgtgataaacattctgtttttagtcctaatgttttcccattttatgtaggaaaaatatttatattatcaagtactttcataagcatttgtctgagattttgaaagaatgagcataaactctattagtttattttcttgtcagatttgaagaagttattacaagcttgatttcatttgactcgaccttcagaccaaatctgagaaagatgatggcctttgatcaccatagttaggtcttggctgtcaatctgtgtaagctgtggtctgacatgatgccagttggcaagttgtcaccacagtgtgtaatttgtctttttctttgtttgttttaaagaaactgtataaaactttgagtgaagtcaaacttgaagtggaaactgtgattaaaacaggaagacatattgtccagaaacagcaaacggacaacccaaaagggatggatgagcagctgacttccctgaaggttctttacaatgacctgggcgcacaggtgaggagagcagccccacagctcatctctctgtctctctctctctctctctcaatctctctctctctctcgttctctctcatgtatttttaaatttcattttttggaaaatgcatgtttgaaaattatgagattcatacgtgttttcaatttattgtaataattgttatatttctttaaatgtatgtggtaatattacagtgattcatagttacatagaaatttatttttggctaggcacagtggctcacgcctgtaatcccaggtctttgggaggctgagtcaggtaatggcttgagcccaggggtttgagaccagcctgggcaacatgatgaaaccttgtctctacaaaaaaatacaaatgaaaacctccaaaaacaaaacaaatttccaaaaaaaaattagccatggtggtgagtatctgtagtcctagctacctgggaggctgaggtgggagagctgcttgaacctgagaggcagaggttgcagtgagctgagatcacaccactacactccagcctaggaacagagtgagacactgtttttaaaaaaaatttatttttaatatttaattcaggctaatatttatactttcaatggctactgatattccataaattattctaaggatactacaagtaatatatgttcattgtggtagacttagtgtgtctggaattggtgggttcttggtctcactgacttcaagaatgaagctgtggaccctcgtggtgagtgttacagctcttaaggtggcgcatctggagtttgttccttctgatgttcggatgtgcttggagtttcttccttctggtgggttcatggtcttcctggctcaggagtgacgctgcagacctttgcagtgagtgttacagctcttaaggcagcgcatctggagttgttcgttcctcccagtgggcttgtggtctcgctggcttcaggagtgaagctgcagacctttgcagtgagtgttacagctcataaaagcagtgtggacccaaagagtgagcagtagcaagatttattgcaaagagcaaaagaacaaagcttccacagtgtggaaggggacccgagcgggttgccactgctggctcgcgcagcctgcttttattctcttatctggccctacccacatcctgctgattggtagagacgagtggtctgttttgacagggcgctgattggtgcgtttacaatccctgagctagacacaaaggttctccatgtccccaccagattagctagatacagagtgtggacacaaaggttctccaaggccccaccagagtagctagatacagagtgttgattggtgcattcacaaaccctgagctagacacagggtgctgattggtgtgtttacaaaccttgagctagatacagagtgccaattggtgtatttacaatcccttagctagacataaaggttctctaaggccccaccagagtagctagatacagagtgtggattggtgcactcacaaaccctgagctagacacagggtgctgattggtgtgtttacaaaccttgagctagatacagagtgccgattggtgtatttacaatccctgagctagacataaagactctccacgtccccaccagacccaggagtccagctggcttcacccagtggatcccgcacccgggctgcaggtggagctgccttccagtcccgcaccgtgggcttgcactcctcagcccttgggtggtcaatgggagtgggcgccgtggagcagggggtggcactcatcagggaggctccggccgcacaggagcccatggagggggtgggaggctcaggaatggcgggctgcaggtcccgagccctgccccgcaggaaggcagctaaggcccggtgagaaattgagcgcagcgccggtgggctggcactgctgggggacccagtacaccctccacagccgctggcccggtgctaagtccctcattgcctggggccggcagggccagcctgctgctccgagtgcggggcccgccaagcccacccggaactccagctggcccacaagcgtggcgcgcagccccggttcccgctcgcgcctctccctccacacctccctgcaagctgagggagtgggctctggccttggccagcccagaaaggggttcccacagtgcagcggtgggctgaagagctcctcaagtgctgccaaagtgggagcccaggcagaggaggcgccgagagcgagcgagggctgtgaggactgccagcatgctgtcacctctcattagtacttcaaagaaatacaagggaaaaaataaatgttaataattccaaatttcaatggatagcagtagccggtgttggcttttttctagtcgcaacatgtaagatttttctaagtgtaattttaattgtgagaaacattctgtttttagtcctaatgttttcccatttcatgtaggaaaaatgggaaataataatccctgtaaaaactcaagttgttggtccttagatttctaaattgaacagtctaccgagaaatgttaaaacatcagggctctagtaaataaccagtggcaagaagttcacattaatctaccaggatttgaaatcctggcaagaaatatctctaatttgggca

SEQ ID NO: 222 - DNA, 4060 bp, Homo sapiens
tctggcttgatgatgtggatggtgtggccattgagatgggtgctgtaagaaaagatagaggaccgggtgcggtcgcttatgcctgtaatctttgcacgttgggaggccaaggtggtggatcacctgaggtcaggagtttgagaccagcctggtcaacatggcaaaaacccgtctctactcaaaaaaaaaaaaaaaaaattagctgagtgtggtagtatgtgcctgtaatcccagctactcgggaggctgaggcaggagaatcacttgaacctgggaggctgaggttgcagtgagtcaagattgtgccactgcactccagcctgggcaacaagagtgaaaactctgtctcaaaaaaaaaaaaaggtagaagcatgcagaaatcacaggtatgtattggacatgttgacattttaagtacctttgagaatgttaattggaaatgtcgggtactcacatgattattcaggtctggagaatatatctggactgaagaggtggattttatgagtcatctgcatagaggtcataattaaagtaatcagggatgatagattgtctaggaacaggatatagtgaaagaagagggccctcaaccaagtcttaagaattacatcatttagtaagaaatctcaggaagatgagcttgcaaaagaaactaatgtaagtagcaagaagtggtagggacacagttgagtactaggtctggaaagctaggggaagatggtattttgacagagtgcagttacctgttttggatattttgaaagttaaatatgatgtccacataaacatattaattagatcagttgccattggggtcattattgaacttagcaagggcaatgtctgggagtgatggtggtagaagccagaatggcatggctcaatccaaagattgtaccaccctggccttggccttaacctctttaagtttcattttcattatccataaagtagaaagaggctttgtgaattttattgcatacgtgtgtaagattccttagcacaacacggaagctgtattaagagcttggtaaatgttagttaagttcatttgttttctgtcaacaacaatgagagcaaaataataataaggtttggtttgtatagtcgtgtactgcattttaagttaaagtggttaattataaaacatataattgtgaaaatggtgctattttcccctcaagttactataataccgtatttttccttcatggagaggattctaagatatcttatgttcaaaattataatagatactagtgatttttcaactttatttctgcccttttatgtgtgtttttctcgcttaatacacataacaatcttttttttttttgagacggggtcttgctctgttgcccaggctggagtgcagtggcaggatcacggctcactgcagccccagcctccagggctcaagcgattctcccacctcagcctactgaccagctggaactacgagcacgcaccaccatactggctaattttttgtattttttacaaaatgaggtctttcattttgtagaaaatgaggtcatgtttcccaggctggtcttaaactcttggactcaaaagatttgcctgcctcggcctcccaaagtgctgggattatagacatgagccactgtgcccagcctcataccaatcttttgagggctatacctctgccagtatcacttaggaaattaatgatagagctaagatgaaaacccaggattgcctggcacttaaccactacagcatattgcctccttgcagaaatgcaagcttagaggattctaaggtgctaagacaaaggttatgtatgtcttgggggttatatatgaatcagtttggatctttagttaacattctgattcattctcatttatgttcattcccatctcagtctcagtctctccctgcctctctccgtctcaggtgacagaaggaaaacaggatctggaaagagcatcacagttggcccggaaaatgaagaaagaggctgcttctctctctgaatggctttctgctactgaaactgaattggtacagaagtccacttcagaaggtctgcttggtgacttggatacagaaatttcctgggctaaagtaagttgcagttcagatgaaacaccagcatgatgccagcgtaacatggcatttgttcgggcgacctggttggataccatgtccctccattttatattaaatctagccttttcttttttgcattgtttttccacttctctgtcctaagaaaaaatattttaaaaataatgattatattttattttctttataatttctacttttagattaaggggtacacatataggtttgttacatggatatattgtgtaatgctgaggtttggggtatgaatgatcccatcacccaggtagtgagcatagtacccactaggtagtttttcagctcatgcctccctctgtttctcgcccctctactagtccccagtgtttatcgttcccttctttatggccttgcgtacccaatgtttagcccccacttgtaagcgagaacgtggtaattggtttcccattcctgcattaattcacttaggataatggcctccagctgcaaccatgttgctgcaaaggacatgatttcattcttttttatggttgtatggtactccatggtgtatatgtatcacattttctttatccaatccaccattgatgggcacctaggttgatgacatgtccttgctcttgtgaatagtgctgatgaacatatgagtgcatgtgtctttttggtagaacagtttattttcctttgcctatatacccagtaatcagatttctgggtcagtaatcagaattctgtttgaagttctttgagaaatttctaaactgctttccacagaggctgaactaatttacattcccaccaacagtataaaagtgttcctttttctctgcaaccttgtcaacatctgttattttttgactttttaataatagctattctaaatggtgtgagatggtatctcattgtggtttcaatttgcatttctctaatgttagtgatgttgagcattttttcgtgtgttgttggctgctagtatgtcctttttgaagtgtctgttcattttatttgcccactttttaatggggttatttgtaaaacagctcttttaataagatatttttatcctgattccaaaagcattacattcatggatcatcaaggcctttataggtattatttttatatagtacttaaaagcctaattcaccacctttaaaatcaatgacacatatttacagagtgtttacaaagaattgtgctgagtttaattcttctttaataacattttaaaaccaataagtaatctttctattgcaaactttcagatgtaaagaacttaggaatagaattttaaaaaatcaatacaagagttttctttaaccctgtactttgaaatcacagagattagaaagttgatttgctggttctggcttctgcagtagagaaagaattgaatggaacatgagtggttcttttaacaaggcattctgttttcctaaatctctttcctgagaaagaagcgagtatactagtgggaagtgctgaatataaatgatcaatactgtgactgatgtttatataaagccacaagtatcagtttgacaccctctacagctctacacgtttgctgtgggccttgaggagaaggtgctgagaggttgtggggtgacacaactcctgcttactttgaatgctctgtggagatgacagctgggagaaagttaagatagtagacactggaaagactattctcagtttagaaaaaagctcatgaaaagcgtgatcatgccatgagcagtgtgagtgtaaaggaagtgaagaaaggaatgtatgagggaaatgagcattgcaagtcatcggtgtgttgtggttgaatgcaaaacaaaggcaccaaactttattgttgttaaatttaagtttttcaaggacatattatcatcctcgtgcagtatactttgaaaatcattactttttaaattagtaacataagtaatagaagctatttgaatgaaatttgcctagt

SEQ ID NO: 223 - DNA, 4050 bp, Homo sapiens
tgttaaattcttaaattctattggaaattttgatttgaattgccttgaattcatacatttgtgtagtgcagaattgatatctttgttatattaattctattcggtaacatatatgtctcatttttgtcctaaattctttcacattcctacataatgttttgatttttttctttataaacattattcatatatgcacaggagtttattcctacatatctatttttattgctatgtaaaaatatacttttcggtttttttacagagtgcttattgttggtacataggtgatattgattttatatattcaatttttaaacatccatgttcatatactcataaattcaatttgtttttcagctgattctcatagcttttttaggtaaagactcaaagcaatgaaaaatttgtttcttttggaacaatatgctcttaagtttccatttaatcttatttcagaattgaaatgataaagatgatatatacaagtcacaaattcacagcacattctcttcattagagtaaatcaaatgaaacatcagtatatattaataaccaccatctttttatcactgtcttttcagatttaaggaacatgcagatttcaccacattttaatgtatttgcacttaaagattatgtaaaattattttcaatgcaaagcttaaataaataatattttcatttctgaatactgtttttattccataacttaaatataactattttcaatgtaatcttttttactgtaaaaaagtatgtgtactatttagatgtaattacttgtagttcattattttttatagttcttaaatgctattctagtcaatcagtacatgcccactgaagaaatgaaagattcttattaataattgctgagagcatagctattgggtatcctttattttctccccccttgctagagaataatattggaaagtagtatttcagttctgtcataaatatgccagtaattgacatggccaagtgagtgtttaaacctggactcatttgtgaatttgtaattggtatgctttccaaggtgtgatttaatgtagaaatataaacttgagctccttaaaatgattggtttaaatgttgatttaaaaaatggtcaataatagtagcagtagggtagatacatgcatattgctttttgattgaaagagctttgtagttttaattgtggaactcatgctctctctataattctgtgactatatactttgcctggtgaaacttacgaatgtgccgatcactttatcatcataccatccagagtattatctttgcacttatgacagttgtaagaccaaagcttagacttgctgctctcttgtgagttacttacatgaaatgtttttttgtaatgtttattcagtatattatatgtgaaatcacccagctgtaagatgttatccttgcaagtacctatagtacacatcgatagtttcctctggtaatctaggagataaattcattgtgaatttttttaagttgtgagttctaggatccttctgctttgccagcttgtagttactgaaaatgaaattgagcctttacatttagagtgatgatgaaggtaattggcattcatatgtaataaatggatttatatttaaataaatgaaataattgctttcccacagctgagtgtgttacactcactggtatttgttgaattacacattttgttttccatttggaacttaagaattctcactatgttaataagtttgggaattttgtaaactttgacattgtaaattatatagggagtcatggactactttgtatatgtggcagaaaagtttttaataatttaaggttgtatatacttttataatattctgaagcatcaagtaggtcttggtgtttttattttctagaatgttctgaaggatctggaaaagagaaaagctgatttaaataccatcacagagagtagtgctgccctgcaaaacttgattgagggcagtgagcctattttagaagagaggctctgcgtccttaacgctgggtggagccgagttcgtacctggactgaagattggtgcaataccttgatggtatgtctcaggaaaaagtaaatgatgaaatcttctcctctcttctagttattttttaaatgaatacaactttgattaaatttcaaatcctgtttactgtgtgtcacagtgatgttttgcttgtgaattaatttcattagactaggttttattttttctttggaaaggtaataactagaaagaatttacagtgtttctaaatattcatgatctgcatggaatgaggtactttcatattttagtaaatgcaccttatttgtttcattttaatgatttcatattgtatttgattttcgtactatcagaagctatttttatataaaatcttcatagtgtttgaataatggcatactggttaagagcacaggctctagcatctgacggcctatgtaaaaattttcattactagcttggtaacactggtaaagttacttaaacattctctaaacctcagttgtttaatttgtaaaatggacattattatatctatctcatacagttttgcaatgattgattatgagccttaaacatgtagtgctcttaaataactatatgcaaaacaaccaattttagattttgctatgattataattattaaatattgtatatgtgttagtctttggttatgccactgctctgtaaatttgcatctcatggaaatagttaccatttaatttttatatggttttatgttcctatgatactaattgtgaatatatggccaccccaccctcccctgctgaggaaggcattgtcatttataattttttttaattctgaaatacctgagataggacttttatcaaatttatagaattactaggtaatggatagagacataaaaaatacattatcatgtgtttgaatatttatttaaattcctcaggatgtgtagggcagtgaagagcatgggctttgctcttgatctctaacagatttatatccacagtccatgacttattatctgtttaactttagctaagttacttaatgttactaagcttaaatttccatatatacagaatgagaacaaaagtatatacctaacagagttgttaaatattgaatataatagtgaatatgagattcttggcacatagaatatgctcattaaatattttatatattaatttttaattactagctttatttcacattcttatggcccttatttctgtattcttcagtctacacctttcaaactctccattcaagcagtatctttctagtgctgttagaacatttgatttacctgcttaataggggtaaacaagtctggcactcatcagttcttcctacttagaatccagatcactgttgatattttctcatatcatttattagttcacattttctttttttaaaaatgtttattttaagttcaggggtacaagggcaagtttgttttatttttatattgtttatttgttcactttttttttttttctgaggctgggtgtcagtctgtcacccatgctggagtgcagtggtatgcaacctcgacctccccaggctcaggtgatccttccacctcagccttgagagtagctgggactacaggcatgcgccaccacacccggctaatttttttattttttgtagagagggggtttcaccatgttgtccaggctggtcttgaattcctgaggtcaagtgatcctcccatcagggcctcccaaagtactggattacaggcgtgagccaccacacccagcctacattttcttttttcaactatgtttcatattatagattaatgatttctttctttgtaaaaacttttactgtctaagcattttccagtttcttttatcccacaaaatataattgctaaaggttaatttcatcataagtctcgttaccctttttggtcacactctaacttcttgccttagattaactgtttttcccagtcataatctgcttaactcttgcttctgttttcaaatctgttctgtcaagcacatttcatgtcctgcttcag

SEQ ID NO: 224 - DNA, 4046 bp, Homo sapiens
ttgaatatttatttaaattcctcaggatgtgtagggcagtgaagagcatgggctttgctcttgatctctaacagatttatatccacagtccatgacttattatctgtttaactttagctaagttacttaatgttactaagcttaaatttccatatatacagaatgagaacaaaagtatatacctaacagagttgttaaatattgaatataatagtgaatatgagattcttggcacatagaatatgctcattaaatattttatatattaatttttaattactagctttatttcacattcttatggcccttatttctgtattcttcagtctacacctttcaaactctccattcaagcagtatctttctagtgctgttagaacatttgatttacctgcttaataggggtaaacaagtctggcactcatcagttcttcctacttagaatccagatcactgttgatattttctcatatcatttattagttcacattttctttttttaaaaatgtttattttaagttcaggggtacaagggcaagtttgttttatttttatattgtttatttgttcactttttttttttttctgaggctgggtgtcagtctgtcacccatgctggagtgcagtggtatgcaacctcgacctccccaggctcaggtgatccttccacctcagccttgagagtagctgggactacaggcatgcgccaccacacccggctaatttttttattttttgtagagagggggtttcaccatgttgtccaggctggtcttgaattcctgaggtcaagtgatcctcccatcagggcctcccaaagtactggattacaggcgtgagccaccacacccagcctacattttcttttttcaactatgtttcatattatagattaatgatttctttctttgtaaaaacttttactgtctaagcattttccagtttcttttatcccacaaaatataattgctaaaggttaatttcatcataagtctcgttaccctttttggtcacactctaacttcttgccttagattaactgtttttcccagtcataatctgcttaactcttgcttctgttttcaaatctgttctgtcaagcacatttcatgtcctgcttcagtacatcttgctgtggtctgtgccagatgtaatattaagggctggtgatactgaggtaaggatacaaaggcactgtcctttgagcagagcatacagaatctttttcaattcatattttcatcattttaaaaaattattccttaaatgagttttttaaaaatatgggccaggtgtggtggcgcacacctgtaatcccagcactttgggaggctgaggaaggtggatcacaaggtcaagagatcaagacttcctggccaacatggtgaaaccccgtctctactaaaaatacaaaaattagctgggtatggtggtgcaagcctgcagtcccagctactcgggagactgaggcaggagaatcacttgaacctgggaggtggaggttgcagtgagctgagattgtgccactctactccaggctggtgacagagcaagactccatctcaaaagaaaaaagaaaaaaagattgaagagggcaaatcagatcagttgtaatataagaataaggaataagagatgaacttgcattgaaattgaaaaagaaactttcaccttttattctacttcaactttttattgtgctgaggtctaaatcaaataaatttaaaaagtgttaagcaccatagatgtgcatttttaggaataagatgagttattcactgaagaagagctctgcaggaaggtgaaagctctcctttaaattcatggtacagtttgctctttgaaggtcttttaaatctcttttaagattatcatcttaaatatttcatatggttatgtaagcattttattaattcctttgtagaaccatcagaaccagctagaaatatttgatgggaacgtggctcacataagtacctggctttatcaagctgaagctctattggatgaaattgaaaagaaaccaacaagtaaacaggaagaaattgtgaaggtagcaaacacagacatcagtaacgcttttgggagtggcatgttttgttgtcatgttttctcttctggaatgctctaagttacttagctctcattcctcccaagcattagattcattaacatttattttgatgggagaaactgagacaataagagacaaaataagagacgaacttgaaattgaaagacttgtaagagatttcagcacaatcaaccggagtaagacctattcacataagatgccaatgagtcttgctgattgctgacttttgtattctccattgagtgctgcttacttctgtattctccagtgagtcttacttacttttgtattctccaatgagtctgtcttacttctgtactctccaatgagtcttacatacttttgtattctccagcgagtcttacttctgtattttccaatgagaattacttacctctgtgttctccaatgagtcctatgtgaacagctctcacctggttgattatgctgaaatctcttactggggatcccagatatttatttaaactacctttccttctgtataagcatcacactcatgtttgggtttgatttttcccatgagataattttgtgttttcttataattagcgtttagtatctgagctggatgatgccaacctccaggttgaaaatgtccgcgatcaagcccttattttgatgaatgcccgtggaagctcaagcagggagcttgtagaaccaaagttagctgagctgaataggaactttgaaaaggtgtctcaacatatcaaaagtgccaaagtgagtaattatgcttttagagtaaaccatttttcctatgggtatgtatctaaatgatagtcatacagtacatacatcaacaattttgttttattattttaattttattgttttctctctctgtcaccgaggctggagtgcagtggcatgagctcactgcaacctccgccttctgggtgcaagctattctcctgcctcagccacccaagtagctgggatttccggcaactgccaccacacccagctaatttttgtgttttttttaggagagatagggtttcaccatcttggccaggctggtcttgagctgctgacctcaagtgatctgcccgccttggcctcccaaagtgctggaattacaggtgtgagctgctgcacccggccaacaatttttaaattaaaatgtttttaatcactttttctttgaatggagcatttgtccgtatttatttgtgattgtgcatatgaaggagagaaaacaagcaattagtattgaagaaaataacctatttgagaaaaggtttcaaagactcagtcaaaggttagaattggttatgaaatgatgaaactaattcccaagctagggatgaatattaaaccctttattttatggtcacactctatatatgtcttcacattgcacacaccacagaacttgtttttttttttgttttatatgacgacaaatctaaaagttacagataatttcacagtttaatcctaatgtaggaaagtactacctgattttataaatttaataaagagctttagacatttaattaacagggtaataaataggacctttatgagagtgctagttttcccacacttagccaaccccagatggtatttatctgcatttagttttattaaaattgttttattgagttttatttaaacaaatataaaatttttctacgtagatgttatctgaaaagatgacattgagaaatatgcacttctttgacgtttgtgtatgaaaatccaaggggaattctactgaggaaacttaactgggagacattctgtgaggtgtccctgccctgggggctgggtggctgttcttcctttctgtggccatggtaaggatagtttctggatcatggccatagtttcctgctatgctcgcatgtggtctccaaatccacgccacaacactctgggcagccacaatgaattgcaatactacgtcacatccctggctagagtt

SEQ ID NO: 225 - DNA, 4045 bp, Homo sapiens
gagggggtttcaccatgttgtccaggctggtcttgaattcctgaggtcaagtgatcctcccatcagggcctcccaaagtactggattacaggcgtgagccaccacacccagcctacattttcttttttcaactatgtttcatattatagattaatgatttctttctttgtaaaaacttttactgtctaagcattttccagtttcttttatcccacaaaatataattgctaaaggttaatttcatcataagtctcgttaccctttttggtcacactctaacttcttgccttagattaactgtttttcccagtcataatctgcttaactcttgcttctgttttcaaatctgttctgtcaagcacatttcatgtcctgcttcagtacatcttgctgtggtctgtgccagatgtaatattaagggctggtgatactgaggtaaggatacaaaggcactgtcctttgagcagagcatacagaatctttttcaattcatattttcatcattttaaaaaattattccttaaatgagttttttaaaaatatgggccaggtgtggtggcgcacacctgtaatcccagcactttgggaggctgaggaaggtggatcacaaggtcaagagatcaagacttcctggccaacatggtgaaaccccgtctctactaaaaatacaaaaattagctgggtatggtggtgcaagcctgcagtcccagctactcgggagactgaggcaggagaatcacttgaacctgggaggtggaggttgcagtgagctgagattgtgccactctactccaggctggtgacagagcaagactccatctcaaaagaaaaaagaaaaaaagattgaagagggcaaatcagatcagttgtaatataagaataaggaataagagatgaacttgcattgaaattgaaaaagaaactttcaccttttattctacttcaactttttattgtgctgaggtctaaatcaaataaatttaaaaagtgttaagcaccatagatgtgcatttttaggaataagatgagttattcactgaagaagagctctgcaggaaggtgaaagctctcctttaaattcatggtacagtttgctctttgaaggtcttttaaatctcttttaagattatcatcttaaatatttcatatggttatgtaagcattttattaattcctttgtagaaccatcagaaccagctagaaatatttgatgggaacgtggctcacataagtacctggctttatcaagctgaagctctattggatgaaattgaaaagaaaccaacaagtaaacaggaagaaattgtgaaggtagcaaacacagacatcagtaacgcttttgggagtggcatgttttgttgtcatgttttctcttctggaatgctctaagttacttagctctcattcctcccaagcattagattcattaacatttattttgatgggagaaactgagacaataagagacaaaataagagacgaacttgaaattgaaagacttgtaagagatttcagcacaatcaaccggagtaagacctattcacataagatgccaatgagtcttgctgattgctgacttttgtattctccattgagtgctgcttacttctgtattctccagtgagtcttacttacttttgtattctccaatgagtctgtcttacttctgtactctccaatgagtcttacatacttttgtattctccagcgagtcttacttctgtattttccaatgagaattacttacctctgtgttctccaatgagtcctatgtgaacagctctcacctggttgattatgctgaaatctcttactggggatcccagatatttatttaaactacctttccttctgtataagcatcacactcatgtttgggtttgatttttcccatgagataattttgtgttttcttataattagcgtttagtatctgagctggatgatgccaacctccaggttgaaaatgtccgcgatcaagcccttattttgatgaatgcccgtggaagctcaagcagggagcttgtagaaccaaagttagctgagctgaataggaactttgaaaaggtgtctcaacatatcaaaagtgccaaagtgagtaattatgcttttagagtaaaccatttttcctatgggtatgtatctaaatgatagtcatacagtacatacatcaacaattttgttttattattttaattttattgttttctctctctgtcaccgaggctggagtgcagtggcatgagctcactgcaacctccgccttctgggtgcaagctattctcctgcctcagccacccaagtagctgggatttccggcaactgccaccacacccagctaatttttgtgttttttttaggagagatagggtttcaccatcttggccaggctggtcttgagctgctgacctcaagtgatctgcccgccttggcctcccaaagtgctggaattacaggtgtgagctgctgcacccggccaacaatttttaaattaaaatgtttttaatcactttttctttgaatggagcatttgtccgtatttatttgtgattgtgcatatgaaggagagaaaacaagcaattagtattgaagaaaataacctatttgagaaaaggtttcaaagactcagtcaaaggttagaattggttatgaaatgatgaaactaattcccaagctagggatgaatattaaaccctttattttatggtcacactctatatatgtcttcacattgcacacaccacagaacttgtttttttttttgttttatatgacgacaaatctaaaagttacagataatttcacagtttaatcctaatgtaggaaagtactacctgattttataaatttaataaagagctttagacatttaattaacagggtaataaataggacctttatgagagtgctagttttcccacacttagccaaccccagatggtatttatctgcatttagttttattaaaattgttttattgagttttatttaaacaaatataaaatttttctacgtagatgttatctgaaaagatgacattgagaaatatgcacttctttgacgtttgtgtatgaaaatccaaggggaattctactgaggaaacttaactgggagacattctgtgaggtgtccctgccctgggggctgggtggctgttcttcctttctgtggccatggtaaggatagtttctggatcatggccatagtttcctgctatgctcgcatgtggtctccaaatccacgccacaacactctgggcagccacaatgaattgcaatactacgtcacatccctggctagagtttggagaaaacgggtcattcagagaagtctgaattggtaaaatcattgccatataaatgaatgaaacaaaagttagctgagctgaatagaaaagtcagttaaaaaagtgttagtttctctcttgacaccccatctctctgattaatgatggaaagtcaaattaaaaatctattttcagagaattcttttccttctacagttgctaattgctcaggaaccattataccaatgtttggtcaccactgaaacatttgaaactggtgtgcctttctctgacttggaaaaattagaaaatgacatagaaaatatgttaaaatttgtggaaaaacacttggaatccagtgatgaagatgaaaaggttggttcaaggagatttcaaaaccatggtggtctcatttttcttctctattaatttcatttttacatcaagatgtttgcccatataatctgtcaaacatgatgaaacagattcaaatgtgattttttgatgtgtgtcaatgtaagagtcacatgattcatgtgcttaaaaagaaaatagactcagtttctgaactagacataatccttagtattatctaatgtttgctaaactctctttgagacattttatcttcaaatataaaatatatttaaaaaaaacataaattttttgatcgttcaggttaacatatcttgacgtatactatactaagtaggttagttttcctccttaggagttgataggaagtgaccttatgcattt

SEQ ID NO: 226 - DNA, 4042 bp, Homo sapiens
cttgctgattgctgacttttgtattctccattgagtgctgcttacttctgtattctccagtgagtcttacttacttttgtattctccaatgagtctgtcttacttctgtactctccaatgagtcttacatacttttgtattctccagcgagtcttacttctgtattttccaatgagaattacttacctctgtgttctccaatgagtcctatgtgaacagctctcacctggttgattatgctgaaatctcttactggggatcccagatatttatttaaactacctttccttctgtataagcatcacactcatgtttgggtttgatttttcccatgagataattttgtgttttcttataattagcgtttagtatctgagctggatgatgccaacctccaggttgaaaatgtccgcgatcaagcccttattttgatgaatgcccgtggaagctcaagcagggagcttgtagaaccaaagttagctgagctgaataggaactttgaaaaggtgtctcaacatatcaaaagtgccaaagtgagtaattatgcttttagagtaaaccatttttcctatgggtatgtatctaaatgatagtcatacagtacatacatcaacaattttgttttattattttaattttattgttttctctctctgtcaccgaggctggagtgcagtggcatgagctcactgcaacctccgccttctgggtgcaagctattctcctgcctcagccacccaagtagctgggatttccggcaactgccaccacacccagctaatttttgtgttttttttaggagagatagggtttcaccatcttggccaggctggtcttgagctgctgacctcaagtgatctgcccgccttggcctcccaaagtgctggaattacaggtgtgagctgctgcacccggccaacaatttttaaattaaaatgtttttaatcactttttctttgaatggagcatttgtccgtatttatttgtgattgtgcatatgaaggagagaaaacaagcaattagtattgaagaaaataacctatttgagaaaaggtttcaaagactcagtcaaaggttagaattggttatgaaatgatgaaactaattcccaagctagggatgaatattaaaccctttattttatggtcacactctatatatgtcttcacattgcacacaccacagaacttgtttttttttttgttttatatgacgacaaatctaaaagttacagataatttcacagtttaatcctaatgtaggaaagtactacctgattttataaatttaataaagagctttagacatttaattaacagggtaataaataggacctttatgagagtgctagttttcccacacttagccaaccccagatggtatttatctgcatttagttttattaaaattgttttattgagttttatttaaacaaatataaaatttttctacgtagatgttatctgaaaagatgacattgagaaatatgcacttctttgacgtttgtgtatgaaaatccaaggggaattctactgaggaaacttaactgggagacattctgtgaggtgtccctgccctgggggctgggtggctgttcttcctttctgtggccatggtaaggatagtttctggatcatggccatagtttcctgctatgctcgcatgtggtctccaaatccacgccacaacactctgggcagccacaatgaattgcaatactacgtcacatccctggctagagtttggagaaaacgggtcattcagagaagtctgaattggtaaaatcattgccatataaatgaatgaaacaaaagttagctgagctgaatagaaaagtcagttaaaaaagtgttagtttctctcttgacaccccatctctctgattaatgatggaaagtcaaattaaaaatctattttcagagaattcttttccttctacagttgctaattgctcaggaaccattataccaatgtttggtcaccactgaaacatttgaaactggtgtgcctttctctgacttggaaaaattagaaaatgacatagaaaatatgttaaaatttgtggaaaaacacttggaatccagtgatgaagatgaaaaggttggttcaaggagatttcaaaaccatggtggtctcatttttcttctctattaatttcatttttacatcaagatgtttgcccatataatctgtcaaacatgatgaaacagattcaaatgtgattttttgatgtgtgtcaatgtaagagtcacatgattcatgtgcttaaaaagaaaatagactcagtttctgaactagacataatccttagtattatctaatgtttgctaaactctctttgagacattttatcttcaaatataaaatatatttaaaaaaaacataaattttttgatcgttcaggttaacatatcttgacgtatactatactaagtaggttagttttcctccttaggagttgataggaagtgaccttatgcatttttcttttgagtcattttttttttccttttaaaaatttagatggatgaggagagtgcccagattgaggaagttctacaaagaggagaagaaatgttacatcaacctatggaagataataaaaaagaaaagatccgtttgcaattattacttttgcatactagatacaacaaaattaaggtattatgattggagagtctctgttgcatttaaataccttacttaactcttgccattcagatgtgtgatgctgcatcacagatgctttaaaacacaccagttggaatatcatctcctcctttctagtgtgtgttactagatgtgttcatatttttggatggtgcagaactcaaaatggaaatgtaaaaccttattattggccatctcttttggatttctgattatgttatcaaacctaaaagagatctatctatttcagaagtggcttcctccaattccatattttatttgtgaaggtcttgtctatgtcaaaaaaaatttctagtttaaaaataactcagtttgtgaaagtgatgtaatatgatttatattctagtaaagattcactaccagctccctttttatttctttatatttttcttttttttttttaaagatggggtatctctatgttgcccaggctgatcttgaactcctaggctcaagtgatcctcctatgtcagtctcccaagttgctaggactacaggtgtgtgggccaccatatccagctccagctcttttttaaacggcaatctttctagctgcattttaagtgtgctgttgttccctggggtccgttctttggtagttccttctagaacgatttttatttgatgactttggaaattaagtagatcgattatggtactgtatttttactgtaccttttctatgtttagatatgtttagatacataaatacttccaactgtgtttcagaattgcctatagtattcagtacaataacgtgctgtaaagttttagcctaggagcaattgactataccacacagcctaagtgtgcaggaggctgtaccatctaggtttgtgtaagggcactctatgatgtttgtatgacaatgaaataacctagagacacatttctcagaacatgtccctgttattaagcaatgcatgactatactttaaaaactagccattctctcaaggctgaagcctcaacatccttcttaactatttcttgttcctcacatatcttctcacatcacactgagtaggcattaaaactgttgagactgcttgaagcaacatacaggtttgaacgtgaagttagatattgctctaccagctgcttgttttatgaccatcagaaagtgccttagcttattttacttcactatcctttccataatttagactaatgattttctcccatgatattatatcccatggacatattcttatgtctgttttttctcactctagcatgtcctttgtctcttcctcacagttattctccccaaagtcatggctgatcatgtcattccttcatcgaagaaactgtttaggaaaatattgcaaaatacagaaaaagctttaaa

SEQ ID NO: 227 - DNA, 4046 bp, Homo sapiens
caaaagtgccaaagtgagtaattatgcttttagagtaaaccatttttcctatgggtatgtatctaaatgatagtcatacagtacatacatcaacaattttgttttattattttaattttattgttttctctctctgtcaccgaggctggagtgcagtggcatgagctcactgcaacctccgccttctgggtgcaagctattctcctgcctcagccacccaagtagctgggatttccggcaactgccaccacacccagctaatttttgtgttttttttaggagagatagggtttcaccatcttggccaggctggtcttgagctgctgacctcaagtgatctgcccgccttggcctcccaaagtgctggaattacaggtgtgagctgctgcacccggccaacaatttttaaattaaaatgtttttaatcactttttctttgaatggagcatttgtccgtatttatttgtgattgtgcatatgaaggagagaaaacaagcaattagtattgaagaaaataacctatttgagaaaaggtttcaaagactcagtcaaaggttagaattggttatgaaatgatgaaactaattcccaagctagggatgaatattaaaccctttattttatggtcacactctatatatgtcttcacattgcacacaccacagaacttgtttttttttttgttttatatgacgacaaatctaaaagttacagataatttcacagtttaatcctaatgtaggaaagtactacctgattttataaatttaataaagagctttagacatttaattaacagggtaataaataggacctttatgagagtgctagttttcccacacttagccaaccccagatggtatttatctgcatttagttttattaaaattgttttattgagttttatttaaacaaatataaaatttttctacgtagatgttatctgaaaagatgacattgagaaatatgcacttctttgacgtttgtgtatgaaaatccaaggggaattctactgaggaaacttaactgggagacattctgtgaggtgtccctgccctgggggctgggtggctgttcttcctttctgtggccatggtaaggatagtttctggatcatggccatagtttcctgctatgctcgcatgtggtctccaaatccacgccacaacactctgggcagccacaatgaattgcaatactacgtcacatccctggctagagtttggagaaaacgggtcattcagagaagtctgaattggtaaaatcattgccatataaatgaatgaaacaaaagttagctgagctgaatagaaaagtcagttaaaaaagtgttagtttctctcttgacaccccatctctctgattaatgatggaaagtcaaattaaaaatctattttcagagaattcttttccttctacagttgctaattgctcaggaaccattataccaatgtttggtcaccactgaaacatttgaaactggtgtgcctttctctgacttggaaaaattagaaaatgacatagaaaatatgttaaaatttgtggaaaaacacttggaatccagtgatgaagatgaaaaggttggttcaaggagatttcaaaaccatggtggtctcatttttcttctctattaatttcatttttacatcaagatgtttgcccatataatctgtcaaacatgatgaaacagattcaaatgtgattttttgatgtgtgtcaatgtaagagtcacatgattcatgtgcttaaaaagaaaatagactcagtttctgaactagacataatccttagtattatctaatgtttgctaaactctctttgagacattttatcttcaaatataaaatatatttaaaaaaaacataaattttttgatcgttcaggttaacatatcttgacgtatactatactaagtaggttagttttcctccttaggagttgataggaagtgaccttatgcatttttcttttgagtcattttttttttccttttaaaaatttagatggatgaggagagtgcccagattgaggaagttctacaaagaggagaagaaatgttacatcaacctatggaagataataaaaaagaaaagatccgtttgcaattattacttttgcatactagatacaacaaaattaaggtattatgattggagagtctctgttgcatttaaataccttacttaactcttgccattcagatgtgtgatgctgcatcacagatgctttaaaacacaccagttggaatatcatctcctcctttctagtgtgtgttactagatgtgttcatatttttggatggtgcagaactcaaaatggaaatgtaaaaccttattattggccatctcttttggatttctgattatgttatcaaacctaaaagagatctatctatttcagaagtggcttcctccaattccatattttatttgtgaaggtcttgtctatgtcaaaaaaaatttctagtttaaaaataactcagtttgtgaaagtgatgtaatatgatttatattctagtaaagattcactaccagctccctttttatttctttatatttttcttttttttttttaaagatggggtatctctatgttgcccaggctgatcttgaactcctaggctcaagtgatcctcctatgtcagtctcccaagttgctaggactacaggtgtgtgggccaccatatccagctccagctcttttttaaacggcaatctttctagctgcattttaagtgtgctgttgttccctggggtccgttctttggtagttccttctagaacgatttttatttgatgactttggaaattaagtagatcgattatggtactgtatttttactgtaccttttctatgtttagatatgtttagatacataaatacttccaactgtgtttcagaattgcctatagtattcagtacaataacgtgctgtaaagttttagcctaggagcaattgactataccacacagcctaagtgtgcaggaggctgtaccatctaggtttgtgtaagggcactctatgatgtttgtatgacaatgaaataacctagagacacatttctcagaacatgtccctgttattaagcaatgcatgactatactttaaaaactagccattctctcaaggctgaagcctcaacatccttcttaactatttcttgttcctcacatatcttctcacatcacactgagtaggcattaaaactgttgagactgcttgaagcaacatacaggtttgaacgtgaagttagatattgctctaccagctgcttgttttatgaccatcagaaagtgccttagcttattttacttcactatcctttccataatttagactaatgattttctcccatgatattatatcccatggacatattcttatgtctgttttttctcactctagcatgtcctttgtctcttcctcacagttattctccccaaagtcatggctgatcatgtcattccttcatcgaagaaactgtttaggaaaatattgcaaaatacagaaaaagctttaaatgcaaggtctgtcaatataacgacatacaaagtcttcagtctgacccctggctccttatgtctttgatgtgctgtcacttcccatgtagtacagctatgctggtttttctttacattttcctaaacacatcatgtgccttagcacatctgggaacttattaattttattccgattccctagagtgagttttgtctttttaggttagctgaaaaatgcgttatcttttaaaactcagctccatttttatttctaacttctgtcagattatattatagttctctgctttattgtgactttttaaagtatctttcttccctaatgcttctccaagttcaggcaatatctttttcatctttgggtccgaaatcagaaattattactggcacaaaatagaaataagttttaagcttttaatacataaataaatttgtttgttaaaagtactaatatatactatacaagctaatttcattctggctttactaacattggtaggcgaactatgttacaaacttcaaatcta

SEQ ID NO: 228 - DNA, 4041 bp, Homo sapiens
atataaaagttagctgggcatgatggtgcatgcttgtaatcccagctactcaggaggctgaggcagaagaatcgcttgaacctgggaggcagacggtgcagtgagccgagatcacagcactgcactccagcctgggaggcagagcaacactctgtcctgcacccccccaaaaaaataaaaatgaaaaagaaagctctgagaagaggatccagaaaatctatattagggcagatgagtagtccatagagcctcaagtctgtctaaatatgacacttcatgatctattttctaatgtaggatattcctgctctataatattattctcagagattaagattacatactgaattacctggatattactttaatcaaaaccctttgtgcatttcatgttgtgttatggaaacatgtttaacttgcttatatttttagcaatgaggtccaattttaaaattgtgatatttttaaaagagtgaaataatgtatcaaaatgttttatttcatacaaaactttgtgattggcaggatattctcattctttcaacaactcaagaaaggaattgttgttttttgtttgctaactgagtttagatggcatagatcttaaagcctgtcaaattaataacatacttatactgtttaatatcatgctgcagatgaaaattaggatacagattgttaaggttttctgttgcaaggtaggtttataatataaaatattaaaactaagttttaaaaatttggttcatgatattgcattccttcacacaatagtcttgttattattcattgtgggggtattttaagagatatatatatatatatatatttttttttttgctgtttttgtaggcaatccctattcaacagaggaaaatgggtcaacttgcttctggaattagatcatcacttcttcctacagattatctggttgaaattaacaaaattttactttgcatggatgatgttgaattatcgcttaatgttccagagctcaacactgctatttacgaagacttctcttttcaggaagactctctgaaggtagacctctgggcactgtgtttgaatggccacagttaatgtagaagtagaggaagaaatttgttcttgtgcctacttagatggtctatatcttttacaatttgtgccaggggattaataatatgtatgactagtaaagctttcctatattgtcaaagaaaatatattaaattttgaatttttaaaaagtgggtatggattgttaaatgtgcacagttataaattatttgcaacatcagagccttgtttaaaattaaacagagacatagaccaccttcctgtcttataaactagattgtcagttgatgttaattgtcagcatttatcaggcaatctataatggtttaaaattggccagttgaggtatggaatggcatcttgattgtaagttaattaaacttaaattctagcaaggcattttcatgtaacttgattgcatttatatgtaaaatcacaataaattcactgataatatggatttgatagtgcattcctctcatttaaactaacattattagatatttgaaaatatcactatttccagcttcaaatgcctcattacctatagagaatgttactgaagcctttcatgtgttctgtacaaatgctactattgtgaggactttttttcctgccttgagtatattatgtagcatattccacacactttggttaaaacagagtatcatttaaaaaaaaaaagttttcagttttcatgattaacaatgattatgtctcattattatttcaaatgagtgttctacaatataaatatctggtcatctgtgattcctttttttgttactttgctggattttgttaatctatgacaatatatttttagaatatcaaagaccaactggacaaacttggagagcagattgcagtcattcatgaaaaacagccagatgtcatccttgaagcctctggacctgaagccattcagatcagagatacacttactcagctgaatgcaaaatgggacagaattaatagaatgtacagtgatcggaaagggtatgtgtaaatgaaattaatatttaatttaaaaaaatgcctgcaagttcatgggcgtgaagaagatcatgtggacactgagattaatgagaacatgtttcatatccttgtaggatgccctattatttttttttcttttaagaaggagtcttgctctgtcacccaggctggggtgcagtggcatgatctcagctcactgcaacatttgcctcccaggttcaagcaattctcctgcctcagcttcccaagtagctgggattacaggcgcacaccaccacgcctggctaatttttgtatttttagtagagatggggtttcaccatgttggccaggctggtattgaactccggacctcaggcagtccgccttgccttggcctcccaaaatgctgggattacaggtgtgagccactgcacccggccttatgccctgtttaataaattgtgatgagtatagttccttaaaggaggaatgtgatcatgtatagatgaccatttataacataatatcttaatgatatggaagcacttctaatttttagtgtctaaatagtgtccattctctttaaaaaaactaaagaaatttttcattaatgttcactttctcagcacacttgatgattaatgtgagtgaagaacagaggcagctacagataattagaatccatatatagtaccaaactcttttttatagccttctgtttaaatgaatgcttttgagccttcttactagattttgaccaggactattaataggtagaaatgaaaacaggcaagatttttgccagtagctgtggatgtgatggaaaggcaaataagttatgaaataacccagtggaaagcgctgtataagaggaaagggagcacagaataatacattgggtaacttgagagacatacgcacaaaaactaggcatcatgttccttctctttttttctattttagcctacatatttcaatgtgactaatccttgaaaagatagcttttagtggcctttggtatattcctttgtttggattttacaaattttctctttgtacctttggagaacattcttttacatacatctttatccatacttatatttcattaggcttgatcattagatgaagacaaatttctttaaaaataatgacattttaaacccctgtattatatcatgaaattggttactatacccctgccaacagtatttgtaaaaatatccttctttttgagcccttactaacattgacaggttttttttttattatttaaaaaaactttgccagtttaatagtgatagattacatctcaattttattttcatttttaaatttttagtgctactaatttttgtacgtcaattttgtatcctgaaactttgctgaatttatttaccagttctaggagctttttggatgagtctttagggttttctaggtatatgatcatgttaccagcaaacagtaacagtttgagttccttttaaccaattcggatgccctttatttctttctcttgtctgattgctctgtctaggacttccggtactatgttgaatgcaagtggtgaaagtgggcatccttttcttgttccagttctcagggggaatgctttcaatttttcctcattcagtataatgttggctatgggctaaaagtcatagatggcttttattacctgaaggtatgttccttctatgccaattttgctgagaattttaatcataaagggatgctagattttgtcagaggctttttctgagtctgttgaggtgatcatgtgatttttgttttaattctgtttatgtggtgtatcacatttattgacttgtgtatgttaaaccatccctgcatccctagtatgaaacccacttgatcatggtttattgtctttttgatatactattggattcagttagctagtattttgttgaggatttttgcatctatatcagggatttggtctgtagttttcttttttgttatgtcctttcc

SEQ ID NO: 229 - DNA, 4076 bp, Homo sapiens
aaaacaatatttgtctttgtaaattaacgctaaacttcaccttaggttggtagtctatattaaattgggaccattttgggtagattgtatatatgttgttaacaaagtaattgagaattatcacacagttcaatttgtttttgtattgagtgcctgtagttaagtatttgcatagttcagcaacctgcagagttatttcttcccttttttggagacaaggtcttgttctgatacccaggctggagtgcaatggtgcaatcgtagctcactgcatccttgagcccctgggctcaagcaatcctctcaccctagtcttctgagtagttggggctgcaagtgtgtgctaccacacccagctgatttttaaattgtttgtaaaaataaggtcttgccatgttgtccaggctggtctcgaactcctaggctcaagtgatcctcctgcctcagtctctcaaagtgctgggattacagccgtgagccaccatgcccagtgggttattccttagtgagcaattgtttcttctgttagaacatgaatttataatttgtttttactcttggggataatatttaaaatgtagattatatttagctaatttgcagatgaaaatattgggtgactcaaatatatcttattgaaatcactttataatgctagttttcttcatagttctgttttgaaagtactaaattagtcatgatcttgaaacattggacgtgaaatttcaactcttttttagaaacaaaggcctataatagtattttgggtgtttccaaagttgtcatttaagttaaatacttttcactatggagggtagattacttgttttagtcttagtaattagtgctgttgctgtatttatttatttttaatcttaaaggagcattctttcttgatggatacttaaaaattatgattttgtagtgattttcatttttttaaacattatacatcaaatattgactgtttattaaatatagaagtattatctaatattttattacatgtattgcacgattatgtgagaacttttgtgattaaaaatgaaaactcctagctgcaaaaacataaattcttattaggaatgatacaatacaatttatttaaaaattgcattcagtttttaaaccagcagttaattatagcagctataaaaataaagataccaccaggcttttaatagctttcaaatccttttaaaaaacacataatcttatttgtcatatgagttctaatcatattcctctcttctgacagatggtttatattcttataaatgttattcttataacactataaagatctaattgaggcagttccttttttatattcatttgactgttttccttgcatcatttaaaatttttgctttgtttttttctatatctctttttgtaacagtgctctattcaaatataatagttattttaataaacaagccaaattcacatgtttcttgtcttccctaatacttgtaagattctcccattcttgataccttgctttgttcttattctttctgttctatgaataaagcagagtaatagttaccacctaatgtgataacatgtcatataatgattcctttcaatattcgtgaaacactcaaagagaattatgctttttccctattattttagataaagacatttttcatgttttaaaaaatttccattatgttgcggagtggtatctaactgtaaaaaaggcttttgtattcaatttctacataactttttatgatgagggaagataatattctttagtttcaatgtttttgaatttaactaaggaaaaaagcttcttggtctattattaagcaatctttatattgtagaatatatacattgtttcacttaaaatatatattaaaataattattagaaattatttattttgggaaatatttagtcaggatattcaaagcaaatatgtaaggttctgcttaattggacagtttttcctcaatatttttaaataatatattcttttaggctaaaaggagaaagtaagcaggtgatgaagtacaggcatcagctagatgagattatctgttggttaacaaaggctgagcatgctatgcaaaagagatcaaccaccgaattgggagaaaacctgcaagaattaagagtaagttgtttatttctgtctatatgccttttggtgcccgaacattatacttcagagtcacatactgcgtgtctcaagaagaaaagggaaaagaaactttgtactttttggtaaatgtggtgaacctgaaagaggaatatcttttattttttaaagagcagttataattttggtcttgcagagcttaaacttcacttatgtaaaaagaacaaactattatggtgtcagtattagaccaaaggtttttaggatattgtaaactgaccttatcattttaaaatacaatagggctatgaaatatcgttttttgtttttagatttggaagaaaattactgattattgtctataaagctgcaaaactcaactttatagataatcagtaattatcagagtgacttgctgaggaacaaaatgcagcttgcaataggtttagtgtcatggttgtattaatcagattttctttgttggtttgcaactaacaagtattgtttatagttgtatatgtatataatctataaaaattcatacatatatagatgtataaatatatccaaatatccataaattttgtattcataaatatttattttttgtgttaagaattaaaatacttgttgcagaacactcagcataatgtgctcacatttttttttaaaaaaagaaattgtgggctgggtgtggtggctcacgcctgtaatcccagcactttgggaggccgaggcgggtggatcacaaggtcatgagatcgagaccatctggctaacatggtgaaaccccatctctataaaaatacaaaaaaaaattagctggccgtggtggcaggcgcatgtagtctcagctactcgggaggctgaagcaggagaatggcatgaacccaggaggcagaggttgcagtgagccgagatcgtgccactgcactccagcctggctgacagagcgagactccgtctcaaaaaaaaaaaaaaaaaagaaattatgagtgtgtattcatacatgtacaagcataagtgtgtgtgaaaggttacttactaattcagagattttgtctataaaggagtatgattgaagcattttgagaaagaaacattgaataatgatgaaaaatattttgtggaacatatattaagttttctttttaaaatgtgacaatatctaacaagcttccttttttacctaaaaatttcagtggtttttttgggaatgtctcttttgtaaacaatttgaggagagttagaaaaggtggaacagtatattaggatggagtagcaaggaggagataagaacagaatgttaaattagcagtgtaaaaataatatatgacccggttaagagacagtgagtaccagagagcccgtttgtgcacaggagtgcaaaaatacacacagaaggcatgtgctcactcccttcctagttatcatttgttagcatgagcttaagcttcttataagtttattttttcacttaacaaattagaaagttacatttgtaataataccaaaaaggtttctaatacagttcttgaattttcccttatctgactaccttctaaccacacctatcttttaacttctccaggacttaactcaagaaatggaagtacatgctgaaaaactcaaatggctgaatagaactgaattggagatgctttcagataaaagtctgagtttacctgaaagggataaaatttcagaaagcttaaggactgtaaatatgacatggaataaggtgtgtgtaaagttactatcacacatttctcatatttattgattttgttgtcagagatgtgggatcatgtaactgctttactttcaagtatgtccaaatggggcaaattttactaaagcttactaatgtttatattttttatctgtcatagacagaggcatatattctagaagaatactttttattttatacagaactctttggcctaggggatttata

SEQ ID NO: 230 - DNA, 4039 bp, Homo sapiens
ctctgccacctacacattgtgactcttctcttctgttggtctctttaaatgtctcagtctataatatactgagttaataattattagctaaataatataacttaatatctgggagggcatattcctctatcaaaaaataatttgactgttttttgtccttttctcttcaatattaattttataaccagaaatttgaattaatgattttgttacattcaagcctgttgggatttttattaggattgtgctgaatttacagattggctatacattttagaaaattatttaagcctcatctaatatatcatacctgaagtaggttacagatagttttaattactaattcaactacttattgtatcaaaaccaatcaatttggcaatgaatattaaatacatacttttttttgtattttctgactcagtaattctacttgggaaatctatgctaagatagagatcagaaatgtgcaaaatactctacatgaaaagatattctttgcaagttttttaaaaaattaaaataaaatttcaggagcaatctaaatatccaagggttaaataaaagtgaatatgggtataggttattacataggtattcataattgtgtttactaagaataaaatatgctcacattataaagttaaatgaaaaaaataaaaaattatgaataagttggctttataattaaaatcatcttgccaaaataaaataatacttccagttctcccacatttgtacttttaatttttctcagtgtcagtgctgattatgttatagaatgttgcaaaactgttttgttggcttgatagctaccaaagacatatggatattacaggtaataccatagccatttcagtatgaaaaaataacctcttagaattttttttacttaaactaaattttatttaaatacacatacacgtgtcaccatgacaccaccataattaaaacatcctgttgattaatttctcttttgctacatttttcatttcagctcatcctaatgtccaaaaggtggtgctagtatcatctgcgtcagatattcctgttcagtctcatcgtacttcggaaatttcaattcctgctgatcttgataaaactataacagaactagccgactggctggtattaatcgaccagatgctgaagtccaacattgtcactgttggggatgtagaagagatcaataagaccgtttcccgaatgaaagtaggtgcatagtgtaaaagcttgtcatggaaacgccacaacccagaggtagaccagatctgtttgaatcccttttgtttatcctaaactatgagagaatgaggtttaaaaaattctgtatctgtcaaacaaccattcagggctaactacaaagcatagagcttttcttgcatttatactgttgtgatatgatcaggtttactgacttaaactaaagacccagtgcatttttaaaatctaaaactgataccgtaaagctaggcacattagtataaatataagctggcgttagcatttcatgcctgttgtgtgatgtaggataatctcctaaagtgcctttgcaacttatatttcataatgagattaatttctgattttaaaagtgaatatctcctataactttactactatacatgtaccatctaatattcatttgtaaaaattctttttccctatttagtgtgtgctaagttctgggctgtgagtggtacaaggatactgacaagaatattctaggtagaaattgggaaactacaatgaaataataataacagctcttgctaaattttattaagtgcttcatgtgtgctggtcatttttctaagtattgtacacgttatctcattcaattctttaatagtcttgtgagataggtactgtttttatccccacattacaaataagtccacaccgaggcagaggcactgagtgcatatgagttgacaaattactgtagcaaggcaagagtctaataaaagcctcaggagaagtacaggcaacctgttgggggagccaggatgaggaaggggatcacttctccagtgatggaaagcaaactgtgtgggattttggcatctgggacaaagtggtgacattcctggtatagggaacagagtgaataaagtcatgtggtacaggaggcacaaaggacagtagggccaacatttgtgcaattaagaaatacagtgtgaaacaaggcaggaaaagcagctcaaattccctttgtgaaggagcctgcaggctgtgcaaagccctttggatttttagtctgtaagcaattggtaaacatcttccttcccatttctttttctttttaaaattgtgtttatgaactcatgataaccgtgctctgctttagtagaagactaggatggattggaggcaagaaatgcataaatcaaggcaaagagccctttctgaaatgactaagatgatgctgttgcaattagcagaaataaggaatagaagaaattgagtgtgaatgagggtttgagtgatttagtttcagacgtgttgtggtggggagtccttatgccatttagaaggaagtgatcagtattcattaccatgtgccctgggatttaggattgaaagttgtgagcaatccatttagaagtaatatttgacaccaaaggagtagctggaatctacaaaacgggtgaatttgtaaagaggaaggactgggaaaaagtcatttgccactatttgtattttttgtaaattgctttctagtctctatgactgtcattagttctgtactgaaaacacatgattttcctgatgttgttaccatttctcccatatttattagcactgagagacaaaccatctacagcagcagtttttcgtgtctaagaggatttaatttatagttattcctcttagcacttttctgtgtcacccccaaccctatgacattagtttgtgttcgtacctgacacagaacagatatgcaagtcatcatcagcagcaataactgctaatgttttcagggcatttttcagcttttgaagggattttctttgtttaatgtcctcagactggatgtaattgagctgtcagtattttattatttcttttttgtgaaaacaaaaacacagagaggtaaagctccttgcctggtgactcaggtgctaaatggaagaactgagatttgaatgcaggatccttgactttaaatcatgcactcattttctgccacgttgctgatgcttcactatgccatagaggaggaaaacaacgacaactttgatgtcagcacaactgttttgcttattattcttctcatatggcttattaacctatccgaataatcatttctacttaacagattacaaaggctgacttagaacagcgccatcctcagctggattatgtttttacattggcacagaatttgaaaaataaagcttccagttcagatatgagaacagcaattacagaaaaatgtaagttttttaaaaaaagttatgtattatcatccactttccctgcaaatggtgacacacacacacacacacacacacacacacacaaacacattttcaaagattattcaactagaaagtaatagtgtttaatatttgttactctttatttatacagaaatgtagctttcccttgtttttatgttttgtgaacattgttacaataaccttatgaagtccttaattattaacatcacgactcttaagtaattacttacacattgggttttcttctcttaacttaggctttcttttagaggaataaaaaaaggttaaaggaactcacaagaatgcaaatcctttctctcattatactttattctctaaaatcaggtcttactgtgtcttttaactcaacccaaaattcagtccacaaatatttattgagcaactactatgtgcttatgtgactggcattaatttggggatactttagttataaatgagagaaaacaacaacaaaaaataaacatacaaaacaatagcaaacaaagatccttgcttggggtttgcattctagctcagaagcatctaggttctacaaacccttcttagtggga

SEQ ID NO: 231 - DNA, 4041 bp, Homo sapiens
attactaattcaactacttattgtatcaaaaccaatcaatttggcaatgaatattaaatacatacttttttttgtattttctgactcagtaattctacttgggaaatctatgctaagatagagatcagaaatgtgcaaaatactctacatgaaaagatattctttgcaagttttttaaaaaattaaaataaaatttcaggagcaatctaaatatccaagggttaaataaaagtgaatatgggtataggttattacataggtattcataattgtgtttactaagaataaaatatgctcacattataaagttaaatgaaaaaaataaaaaattatgaataagttggctttataattaaaatcatcttgccaaaataaaataatacttccagttctcccacatttgtacttttaatttttctcagtgtcagtgctgattatgttatagaatgttgcaaaactgttttgttggcttgatagctaccaaagacatatggatattacaggtaataccatagccatttcagtatgaaaaaataacctcttagaattttttttacttaaactaaattttatttaaatacacatacacgtgtcaccatgacaccaccataattaaaacatcctgttgattaatttctcttttgctacatttttcatttcagctcatcctaatgtccaaaaggtggtgctagtatcatctgcgtcagatattcctgttcagtctcatcgtacttcggaaatttcaattcctgctgatcttgataaaactataacagaactagccgactggctggtattaatcgaccagatgctgaagtccaacattgtcactgttggggatgtagaagagatcaataagaccgtttcccgaatgaaagtaggtgcatagtgtaaaagcttgtcatggaaacgccacaacccagaggtagaccagatctgtttgaatcccttttgtttatcctaaactatgagagaatgaggtttaaaaaattctgtatctgtcaaacaaccattcagggctaactacaaagcatagagcttttcttgcatttatactgttgtgatatgatcaggtttactgacttaaactaaagacccagtgcatttttaaaatctaaaactgataccgtaaagctaggcacattagtataaatataagctggcgttagcatttcatgcctgttgtgtgatgtaggataatctcctaaagtgcctttgcaacttatatttcataatgagattaatttctgattttaaaagtgaatatctcctataactttactactatacatgtaccatctaatattcatttgtaaaaattctttttccctatttagtgtgtgctaagttctgggctgtgagtggtacaaggatactgacaagaatattctaggtagaaattgggaaactacaatgaaataataataacagctcttgctaaattttattaagtgcttcatgtgtgctggtcatttttctaagtattgtacacgttatctcattcaattctttaatagtcttgtgagataggtactgtttttatccccacattacaaataagtccacaccgaggcagaggcactgagtgcatatgagttgacaaattactgtagcaaggcaagagtctaataaaagcctcaggagaagtacaggcaacctgttgggggagccaggatgaggaaggggatcacttctccagtgatggaaagcaaactgtgtgggattttggcatctgggacaaagtggtgacattcctggtatagggaacagagtgaataaagtcatgtggtacaggaggcacaaaggacagtagggccaacatttgtgcaattaagaaatacagtgtgaaacaaggcaggaaaagcagctcaaattccctttgtgaaggagcctgcaggctgtgcaaagccctttggatttttagtctgtaagcaattggtaaacatcttccttcccatttctttttctttttaaaattgtgtttatgaactcatgataaccgtgctctgctttagtagaagactaggatggattggaggcaagaaatgcataaatcaaggcaaagagccctttctgaaatgactaagatgatgctgttgcaattagcagaaataaggaatagaagaaattgagtgtgaatgagggtttgagtgatttagtttcagacgtgttgtggtggggagtccttatgccatttagaaggaagtgatcagtattcattaccatgtgccctgggatttaggattgaaagttgtgagcaatccatttagaagtaatatttgacaccaaaggagtagctggaatctacaaaacgggtgaatttgtaaagaggaaggactgggaaaaagtcatttgccactatttgtattttttgtaaattgctttctagtctctatgactgtcattagttctgtactgaaaacacatgattttcctgatgttgttaccatttctcccatatttattagcactgagagacaaaccatctacagcagcagtttttcgtgtctaagaggatttaatttatagttattcctcttagcacttttctgtgtcacccccaaccctatgacattagtttgtgttcgtacctgacacagaacagatatgcaagtcatcatcagcagcaataactgctaatgttttcagggcatttttcagcttttgaagggattttctttgtttaatgtcctcagactggatgtaattgagctgtcagtattttattatttcttttttgtgaaaacaaaaacacagagaggtaaagctccttgcctggtgactcaggtgctaaatggaagaactgagatttgaatgcaggatccttgactttaaatcatgcactcattttctgccacgttgctgatgcttcactatgccatagaggaggaaaacaacgacaactttgatgtcagcacaactgttttgcttattattcttctcatatggcttattaacctatccgaataatcatttctacttaacagattacaaaggctgacttagaacagcgccatcctcagctggattatgtttttacattggcacagaatttgaaaaataaagcttccagttcagatatgagaacagcaattacagaaaaatgtaagttttttaaaaaaagttatgtattatcatccactttccctgcaaatggtgacacacacacacacacacacacacacacacacaaacacattttcaaagattattcaactagaaagtaatagtgtttaatatttgttactctttatttatacagaaatgtagctttcccttgtttttatgttttgtgaacattgttacaataaccttatgaagtccttaattattaacatcacgactcttaagtaattacttacacattgggttttcttctcttaacttaggctttcttttagaggaataaaaaaaggttaaaggaactcacaagaatgcaaatcctttctctcattatactttattctctaaaatcaggtcttactgtgtcttttaactcaacccaaaattcagtccacaaatatttattgagcaactactatgtgcttatgtgactggcattaatttggggatactttagttataaatgagagaaaacaacaacaaaaaataaacatacaaaacaatagcaaacaaagatccttgcttggggtttgcattctagctcagaagcatctaggttctacaaacccttcttagtgggaatgtactaccaatagcaaacgaagtctaaattctcaagagtgacacctagggattgtcacaatctgctgccactaccccttttctcacttcagccctcagcccggcctgtaattatgctgttattccttaaaatatcctgacatttcctagtcttcttacctttatttgcattattttatttctcttggccttttcttcccaggtgcaattctacgcagcagctaaaatgtcatcccctttgtgacatctttccctcctcttctggtccctggtgaatgttaatttctatttttagttccttctatggcctttccccccattgctttattatagatc

SEQ ID NO: 232 - DNA, 4042 bp, Homo sapiens
cattcagggctaactacaaagcatagagcttttcttgcatttatactgttgtgatatgatcaggtttactgacttaaactaaagacccagtgcatttttaaaatctaaaactgataccgtaaagctaggcacattagtataaatataagctggcgttagcatttcatgcctgttgtgtgatgtaggataatctcctaaagtgcctttgcaacttatatttcataatgagattaatttctgattttaaaagtgaatatctcctataactttactactatacatgtaccatctaatattcatttgtaaaaattctttttccctatttagtgtgtgctaagttctgggctgtgagtggtacaaggatactgacaagaatattctaggtagaaattgggaaactacaatgaaataataataacagctcttgctaaattttattaagtgcttcatgtgtgctggtcatttttctaagtattgtacacgttatctcattcaattctttaatagtcttgtgagataggtactgtttttatccccacattacaaataagtccacaccgaggcagaggcactgagtgcatatgagttgacaaattactgtagcaaggcaagagtctaataaaagcctcaggagaagtacaggcaacctgttgggggagccaggatgaggaaggggatcacttctccagtgatggaaagcaaactgtgtgggattttggcatctgggacaaagtggtgacattcctggtatagggaacagagtgaataaagtcatgtggtacaggaggcacaaaggacagtagggccaacatttgtgcaattaagaaatacagtgtgaaacaaggcaggaaaagcagctcaaattccctttgtgaaggagcctgcaggctgtgcaaagccctttggatttttagtctgtaagcaattggtaaacatcttccttcccatttctttttctttttaaaattgtgtttatgaactcatgataaccgtgctctgctttagtagaagactaggatggattggaggcaagaaatgcataaatcaaggcaaagagccctttctgaaatgactaagatgatgctgttgcaattagcagaaataaggaatagaagaaattgagtgtgaatgagggtttgagtgatttagtttcagacgtgttgtggtggggagtccttatgccatttagaaggaagtgatcagtattcattaccatgtgccctgggatttaggattgaaagttgtgagcaatccatttagaagtaatatttgacaccaaaggagtagctggaatctacaaaacgggtgaatttgtaaagaggaaggactgggaaaaagtcatttgccactatttgtattttttgtaaattgctttctagtctctatgactgtcattagttctgtactgaaaacacatgattttcctgatgttgttaccatttctcccatatttattagcactgagagacaaaccatctacagcagcagtttttcgtgtctaagaggatttaatttatagttattcctcttagcacttttctgtgtcacccccaaccctatgacattagtttgtgttcgtacctgacacagaacagatatgcaagtcatcatcagcagcaataactgctaatgttttcagggcatttttcagcttttgaagggattttctttgtttaatgtcctcagactggatgtaattgagctgtcagtattttattatttcttttttgtgaaaacaaaaacacagagaggtaaagctccttgcctggtgactcaggtgctaaatggaagaactgagatttgaatgcaggatccttgactttaaatcatgcactcattttctgccacgttgctgatgcttcactatgccatagaggaggaaaacaacgacaactttgatgtcagcacaactgttttgcttattattcttctcatatggcttattaacctatccgaataatcatttctacttaacagattacaaaggctgacttagaacagcgccatcctcagctggattatgtttttacattggcacagaatttgaaaaataaagcttccagttcagatatgagaacagcaattacagaaaaatgtaagttttttaaaaaaagttatgtattatcatccactttccctgcaaatggtgacacacacacacacacacacacacacacacacaaacacattttcaaagattattcaactagaaagtaatagtgtttaatatttgttactctttatttatacagaaatgtagctttcccttgtttttatgttttgtgaacattgttacaataaccttatgaagtccttaattattaacatcacgactcttaagtaattacttacacattgggttttcttctcttaacttaggctttcttttagaggaataaaaaaaggttaaaggaactcacaagaatgcaaatcctttctctcattatactttattctctaaaatcaggtcttactgtgtcttttaactcaacccaaaattcagtccacaaatatttattgagcaactactatgtgcttatgtgactggcattaatttggggatactttagttataaatgagagaaaacaacaacaaaaaataaacatacaaaacaatagcaaacaaagatccttgcttggggtttgcattctagctcagaagcatctaggttctacaaacccttcttagtgggaatgtactaccaatagcaaacgaagtctaaattctcaagagtgacacctagggattgtcacaatctgctgccactaccccttttctcacttcagccctcagcccggcctgtaattatgctgttattccttaaaatatcctgacatttcctagtcttcttacctttatttgcattattttatttctcttggccttttcttcccaggtgcaattctacgcagcagctaaaatgtcatcccctttgtgacatctttccctcctcttctggtccctggtgaatgttaatttctatttttagttccttctatggcctttccccccattgctttattatagatcttacaactactttaattgtctctctcttccatagattgtgaatatccgtctttctgcccttgggcctttaacagtgccaatacaaattaactacctaataaatatttgtgacaaaatataaactggaaggataaatcctaatatttgtcaagggaagaaagtcagctactctccctgtaaaaagtatgttttgatttcaaaatagtcatggtagcaacagggttattataggagatacattagaaaagaacttttaatgtctaacagtgttggcttatttttactaaatacatcattttccttcttttctctttttatgaatggatggattgtgcctattatggaactttggagtgagctggtttccctcacatcacaggggagctcctctgctctagtgataccaaactattgacaagccatttccagtttgctttttctatcatcttgatgttttcttttaattattattttttccatcacctctctttttgtccaaaacttctttcaggtgtttgtttttttgttttacaagacttctcctaaatatcttccctttcccattgaatgtacacactctattttctctctatatataaatatttctgtgtgtgtagaggttctataaccttcatcactcctcattatatgaaaaacccttcccagggggaatgtattgctaccaatagtaacctcgttttagggcttaactcacaatgaatgggataatttgcctatttcttatgataaacctgtgatatttactctcgcttgatgtctttggtttcatttgtttactgttaaaggattctattagtaatagaattggtcataagtactttatgtaactttttaactgacaagagaacattatgatagatttggcctctcttccttaagtttaaaacttaagcaatttatttaaacagctaagacagaatgaaacagattgtctcattgagcaagttttaaagaatgatgacatgtaagtataacttaaggcctgaacag

SEQ ID NO: 233 - DNA, 4070 bp, Homo sapiens
gtacacgttatctcattcaattctttaatagtcttgtgagataggtactgtttttatccccacattacaaataagtccacaccgaggcagaggcactgagtgcatatgagttgacaaattactgtagcaaggcaagagtctaataaaagcctcaggagaagtacaggcaacctgttgggggagccaggatgaggaaggggatcacttctccagtgatggaaagcaaactgtgtgggattttggcatctgggacaaagtggtgacattcctggtatagggaacagagtgaataaagtcatgtggtacaggaggcacaaaggacagtagggccaacatttgtgcaattaagaaatacagtgtgaaacaaggcaggaaaagcagctcaaattccctttgtgaaggagcctgcaggctgtgcaaagccctttggatttttagtctgtaagcaattggtaaacatcttccttcccatttctttttctttttaaaattgtgtttatgaactcatgataaccgtgctctgctttagtagaagactaggatggattggaggcaagaaatgcataaatcaaggcaaagagccctttctgaaatgactaagatgatgctgttgcaattagcagaaataaggaatagaagaaattgagtgtgaatgagggtttgagtgatttagtttcagacgtgttgtggtggggagtccttatgccatttagaaggaagtgatcagtattcattaccatgtgccctgggatttaggattgaaagttgtgagcaatccatttagaagtaatatttgacaccaaaggagtagctggaatctacaaaacgggtgaatttgtaaagaggaaggactgggaaaaagtcatttgccactatttgtattttttgtaaattgctttctagtctctatgactgtcattagttctgtactgaaaacacatgattttcctgatgttgttaccatttctcccatatttattagcactgagagacaaaccatctacagcagcagtttttcgtgtctaagaggatttaatttatagttattcctcttagcacttttctgtgtcacccccaaccctatgacattagtttgtgttcgtacctgacacagaacagatatgcaagtcatcatcagcagcaataactgctaatgttttcagggcatttttcagcttttgaagggattttctttgtttaatgtcctcagactggatgtaattgagctgtcagtattttattatttcttttttgtgaaaacaaaaacacagagaggtaaagctccttgcctggtgactcaggtgctaaatggaagaactgagatttgaatgcaggatccttgactttaaatcatgcactcattttctgccacgttgctgatgcttcactatgccatagaggaggaaaacaacgacaactttgatgtcagcacaactgttttgcttattattcttctcatatggcttattaacctatccgaataatcatttctacttaacagattacaaaggctgacttagaacagcgccatcctcagctggattatgtttttacattggcacagaatttgaaaaataaagcttccagttcagatatgagaacagcaattacagaaaaatgtaagttttttaaaaaaagttatgtattatcatccactttccctgcaaatggtgacacacacacacacacacacacacacacacacaaacacattttcaaagattattcaactagaaagtaatagtgtttaatatttgttactctttatttatacagaaatgtagctttcccttgtttttatgttttgtgaacattgttacaataaccttatgaagtccttaattattaacatcacgactcttaagtaattacttacacattgggttttcttctcttaacttaggctttcttttagaggaataaaaaaaggttaaaggaactcacaagaatgcaaatcctttctctcattatactttattctctaaaatcaggtcttactgtgtcttttaactcaacccaaaattcagtccacaaatatttattgagcaactactatgtgcttatgtgactggcattaatttggggatactttagttataaatgagagaaaacaacaacaaaaaataaacatacaaaacaatagcaaacaaagatccttgcttggggtttgcattctagctcagaagcatctaggttctacaaacccttcttagtgggaatgtactaccaatagcaaacgaagtctaaattctcaagagtgacacctagggattgtcacaatctgctgccactaccccttttctcacttcagccctcagcccggcctgtaattatgctgttattccttaaaatatcctgacatttcctagtcttcttacctttatttgcattattttatttctcttggccttttcttcccaggtgcaattctacgcagcagctaaaatgtcatcccctttgtgacatctttccctcctcttctggtccctggtgaatgttaatttctatttttagttccttctatggcctttccccccattgctttattatagatcttacaactactttaattgtctctctcttccatagattgtgaatatccgtctttctgcccttgggcctttaacagtgccaatacaaattaactacctaataaatatttgtgacaaaatataaactggaaggataaatcctaatatttgtcaagggaagaaagtcagctactctccctgtaaaaagtatgttttgatttcaaaatagtcatggtagcaacagggttattataggagatacattagaaaagaacttttaatgtctaacagtgttggcttatttttactaaatacatcattttccttcttttctctttttatgaatggatggattgtgcctattatggaactttggagtgagctggtttccctcacatcacaggggagctcctctgctctagtgataccaaactattgacaagccatttccagtttgctttttctatcatcttgatgttttcttttaattattattttttccatcacctctctttttgtccaaaacttctttcaggtgtttgtttttttgttttacaagacttctcctaaatatcttccctttcccattgaatgtacacactctattttctctctatatataaatatttctgtgtgtgtagaggttctataaccttcatcactcctcattatatgaaaaacccttcccagggggaatgtattgctaccaatagtaacctcgttttagggcttaactcacaatgaatgggataatttgcctatttcttatgataaacctgtgatatttactctcgcttgatgtctttggtttcatttgtttactgttaaaggattctattagtaatagaattggtcataagtactttatgtaactttttaactgacaagagaacattatgatagatttggcctctcttccttaagtttaaaacttaagcaatttatttaaacagctaagacagaatgaaacagattgtctcattgagcaagttttaaagaatgatgacatgtaagtataacttaaggcctgaacagccttgttgatagcttttttgttttttgagatggagtttcactcttgttgcccaggctggatgcaatggtgcaatcttgactcactgcaacctctgcctcctgggatccagcgattctcctgcctcagcctcccaagtagctgggattacaggcacctgccaccatgcccagctaatttttatatttttagtagagacagggtttcaccatgttggccaggctggtcttgaacttctggcttcaggtgatccacctgcctcggcctcccaaagtgctgggattacaggtgtcagccactgcacccagccagttgatagcttttatgtttcactataaccatatattatcccaagaactttgccaaagtgttccatgataactcagctggaatgttatcttgtagttacgttcctcttgggcctggtacttaactatagcctttctttttgtctgatatccaaagcatctttcagcagcgtggttttaacattctacctacttatt

SEQ ID NO: 234 - DNA, 4037 bp, Homo sapiens
gaggatttaatttatagttattcctcttagcacttttctgtgtcacccccaaccctatgacattagtttgtgttcgtacctgacacagaacagatatgcaagtcatcatcagcagcaataactgctaatgttttcagggcatttttcagcttttgaagggattttctttgtttaatgtcctcagactggatgtaattgagctgtcagtattttattatttcttttttgtgaaaacaaaaacacagagaggtaaagctccttgcctggtgactcaggtgctaaatggaagaactgagatttgaatgcaggatccttgactttaaatcatgcactcattttctgccacgttgctgatgcttcactatgccatagaggaggaaaacaacgacaactttgatgtcagcacaactgttttgcttattattcttctcatatggcttattaacctatccgaataatcatttctacttaacagattacaaaggctgacttagaacagcgccatcctcagctggattatgtttttacattggcacagaatttgaaaaataaagcttccagttcagatatgagaacagcaattacagaaaaatgtaagttttttaaaaaaagttatgtattatcatccactttccctgcaaatggtgacacacacacacacacacacacacacacacacaaacacattttcaaagattattcaactagaaagtaatagtgtttaatatttgttactctttatttatacagaaatgtagctttcccttgtttttatgttttgtgaacattgttacaataaccttatgaagtccttaattattaacatcacgactcttaagtaattacttacacattgggttttcttctcttaacttaggctttcttttagaggaataaaaaaaggttaaaggaactcacaagaatgcaaatcctttctctcattatactttattctctaaaatcaggtcttactgtgtcttttaactcaacccaaaattcagtccacaaatatttattgagcaactactatgtgcttatgtgactggcattaatttggggatactttagttataaatgagagaaaacaacaacaaaaaataaacatacaaaacaatagcaaacaaagatccttgcttggggtttgcattctagctcagaagcatctaggttctacaaacccttcttagtgggaatgtactaccaatagcaaacgaagtctaaattctcaagagtgacacctagggattgtcacaatctgctgccactaccccttttctcacttcagccctcagcccggcctgtaattatgctgttattccttaaaatatcctgacatttcctagtcttcttacctttatttgcattattttatttctcttggccttttcttcccaggtgcaattctacgcagcagctaaaatgtcatcccctttgtgacatctttccctcctcttctggtccctggtgaatgttaatttctatttttagttccttctatggcctttccccccattgctttattatagatcttacaactactttaattgtctctctcttccatagattgtgaatatccgtctttctgcccttgggcctttaacagtgccaatacaaattaactacctaataaatatttgtgacaaaatataaactggaaggataaatcctaatatttgtcaagggaagaaagtcagctactctccctgtaaaaagtatgttttgatttcaaaatagtcatggtagcaacagggttattataggagatacattagaaaagaacttttaatgtctaacagtgttggcttatttttactaaatacatcattttccttcttttctctttttatgaatggatggattgtgcctattatggaactttggagtgagctggtttccctcacatcacaggggagctcctctgctctagtgataccaaactattgacaagccatttccagtttgctttttctatcatcttgatgttttcttttaattattattttttccatcacctctctttttgtccaaaacttctttcaggtgtttgtttttttgttttacaagacttctcctaaatatcttccctttcccattgaatgtacacactctattttctctctatatataaatatttctgtgtgtgtagaggttctataaccttcatcactcctcattatatgaaaaacccttcccagggggaatgtattgctaccaatagtaacctcgttttagggcttaactcacaatgaatgggataatttgcctatttcttatgataaacctgtgatatttactctcgcttgatgtctttggtttcatttgtttactgttaaaggattctattagtaatagaattggtcataagtactttatgtaactttttaactgacaagagaacattatgatagatttggcctctcttccttaagtttaaaacttaagcaatttatttaaacagctaagacagaatgaaacagattgtctcattgagcaagttttaaagaatgatgacatgtaagtataacttaaggcctgaacagccttgttgatagcttttttgttttttgagatggagtttcactcttgttgcccaggctggatgcaatggtgcaatcttgactcactgcaacctctgcctcctgggatccagcgattctcctgcctcagcctcccaagtagctgggattacaggcacctgccaccatgcccagctaatttttatatttttagtagagacagggtttcaccatgttggccaggctggtcttgaacttctggcttcaggtgatccacctgcctcggcctcccaaagtgctgggattacaggtgtcagccactgcacccagccagttgatagcttttatgtttcactataaccatatattatcccaagaactttgccaaagtgttccatgataactcagctggaatgttatcttgtagttacgttcctcttgggcctggtacttaactatagcctttctttttgtctgatatccaaagcatctttcagcagcgtggttttaacattctacctacttattatcagcaggttcttgcggatattctaagttattgtttattagtacctcagttcaagattatgaactaactctgaagtgattaataaaaaatttaagtttccagccgggtgcgttggctcatgcctgtaatcccaacactttgggaggccgaggcagacagatcacgaggtcaggagttcgagacctggccaacatggggaaaccctctctctactaaaaatacaaaagtagccgggtgtggtggcacacacctatagtcccagctacatgggaggctgaggcaggagaatcacttgtacctgggggcggaggttgcagcgagctgaaagccaggatcgtgccactgcactccagcctgggcgacagagcaagactctctctcaaaaaaaaaaaaaaaaaaagtttccttagatctgtctgtccttaaaaccttgttaaaaatagagaaaggagaagagagaaagcttgaggagaaatagaaagagagagaaggtgataatgagtgaaaggaatgaacaataataaaagaggaaggacaagagccagtatggaatttttatgatgaagagctgctgggtgcacagttcatgagtctcttttacttttagcatttctcttgaacttgaatatataaaattccttttagagagttttcctgctacagtaaaacaaatgcaaaaaaaaattcttacacagttcagtttcttctaaaatcaagactgccttagaaaattctcctttgagggtaacaggtgactatctctctgtcttaaagttctgtcatgaagtactgttaaaccctaccttcatcaaaccaggtctataaatacaactgtaaatacaaaattaaatagaacagtattttctttataattgtttggcagtatcagtttataatagtagatatttttttgggagttgttttagagcactgaaaataagagttcaagatttttttttctcaaacaccgtttcagaaatatatcaattgta

SEQ ID NO: 235 - DNA, 4046 bp, Homo sapiens
attgctttattatagatcttacaactactttaattgtctctctcttccatagattgtgaatatccgtctttctgcccttgggcctttaacagtgccaatacaaattaactacctaataaatatttgtgacaaaatataaactggaaggataaatcctaatatttgtcaagggaagaaagtcagctactctccctgtaaaaagtatgttttgatttcaaaatagtcatggtagcaacagggttattataggagatacattagaaaagaacttttaatgtctaacagtgttggcttatttttactaaatacatcattttccttcttttctctttttatgaatggatggattgtgcctattatggaactttggagtgagctggtttccctcacatcacaggggagctcctctgctctagtgataccaaactattgacaagccatttccagtttgctttttctatcatcttgatgttttcttttaattattattttttccatcacctctctttttgtccaaaacttctttcaggtgtttgtttttttgttttacaagacttctcctaaatatcttccctttcccattgaatgtacacactctattttctctctatatataaatatttctgtgtgtgtagaggttctataaccttcatcactcctcattatatgaaaaacccttcccagggggaatgtattgctaccaatagtaacctcgttttagggcttaactcacaatgaatgggataatttgcctatttcttatgataaacctgtgatatttactctcgcttgatgtctttggtttcatttgtttactgttaaaggattctattagtaatagaattggtcataagtactttatgtaactttttaactgacaagagaacattatgatagatttggcctctcttccttaagtttaaaacttaagcaatttatttaaacagctaagacagaatgaaacagattgtctcattgagcaagttttaaagaatgatgacatgtaagtataacttaaggcctgaacagccttgttgatagcttttttgttttttgagatggagtttcactcttgttgcccaggctggatgcaatggtgcaatcttgactcactgcaacctctgcctcctgggatccagcgattctcctgcctcagcctcccaagtagctgggattacaggcacctgccaccatgcccagctaatttttatatttttagtagagacagggtttcaccatgttggccaggctggtcttgaacttctggcttcaggtgatccacctgcctcggcctcccaaagtgctgggattacaggtgtcagccactgcacccagccagttgatagcttttatgtttcactataaccatatattatcccaagaactttgccaaagtgttccatgataactcagctggaatgttatcttgtagttacgttcctcttgggcctggtacttaactatagcctttctttttgtctgatatccaaagcatctttcagcagcgtggttttaacattctacctacttattatcagcaggttcttgcggatattctaagttattgtttattagtacctcagttcaagattatgaactaactctgaagtgattaataaaaaatttaagtttccagccgggtgcgttggctcatgcctgtaatcccaacactttgggaggccgaggcagacagatcacgaggtcaggagttcgagacctggccaacatggggaaaccctctctctactaaaaatacaaaagtagccgggtgtggtggcacacacctatagtcccagctacatgggaggctgaggcaggagaatcacttgtacctgggggcggaggttgcagcgagctgaaagccaggatcgtgccactgcactccagcctgggcgacagagcaagactctctctcaaaaaaaaaaaaaaaaaaagtttccttagatctgtctgtccttaaaaccttgttaaaaatagagaaaggagaagagagaaagcttgaggagaaatagaaagagagagaaggtgataatgagtgaaaggaatgaacaataataaaagaggaaggacaagagccagtatggaatttttatgatgaagagctgctgggtgcacagttcatgagtctcttttacttttagcatttctcttgaacttgaatatataaaattccttttagagagttttcctgctacagtaaaacaaatgcaaaaaaaaattcttacacagttcagtttcttctaaaatcaagactgccttagaaaattctcctttgagggtaacaggtgactatctctctgtcttaaagttctgtcatgaagtactgttaaaccctaccttcatcaaaccaggtctataaatacaactgtaaatacaaaattaaatagaacagtattttctttataattgtttggcagtatcagtttataatagtagatatttttttgggagttgttttagagcactgaaaataagagttcaagatttttttttctcaaacaccgtttcagaaatatatcaattgtataggatggcagatgtatattaaaattccttcaaaatgtgtttatcagcttgccttcttctgtttatagacttatttgtgatacatttgatatatgatattttttctttctcctgagggttacatgttgggatttttttttcttttataatgctaccctcagtggaaagggtcaagaaccagtgggatggcacccagcatggcgttgagctaagacagcagcagcttgaggacatgattattgacagtcttcagtgggatgaccatagggaggagactgaagaactgatgagaaaatatgaggctcgactctatattcttcagcaagcccgacgggatccactcaccaaacaaatttctgataaccaagtaagactcatcagatattttttggcagtattgttttgttggatatactttttttctattgttcactgtaattcttaacaataggaccctgccatgttttttcctaagttcttagagtgtctaatgaaatttatatgaagaatttgatctggaagatttttttcgaaaaatttctggaggcataacaagtaagaatatgcatgtctccgagatttatagctcactgactttttgcaagtgaaacacaccctcaaatcagcatctagaaagagaacactttcaagattccaggaaccctcttttgctcccttctgtactgtattagtctgttctcacattgctataaataactacctgagactgagtaatttatgaagaaaggagatttaattgactcacagttcatttgagggctactgtagtgaagcatgactgggaggtaccaggaaacttaaaatcatggtggaaggcaaaggggaagcaggcaccttctttacaaggcagcaagacagagagagatagaagggagaagtgccacacattttatttatttattggagacattgtctcactctgccgcccaggctggaatgcagtggcactatctcagctcattgcaacagccacctcttgggttccagcgattcttgcctcagccttccaagtagctgggatgacaggcgtgcaccaccatgcccagctaatttttgtattttctgtagagacggggttccgccatgttgcccaggcttgtctgcaattcctgagctcaagtaatctgctcactttggcctcccaagtgtcacacactgttaaaccatctgatcttgtgagaactcactatcacaagaacagcacaggggaaattcatccccatgatccagtcacctcccaccaggctcctccttcgattggacatgagatttgggtggggacacaaatccaaaccatattacttacttaccctgaaggttatttttattaataagtttttccaagactttcatttgaggactactatagtgaacaaatcagataagtaagtttagtttcctttaatgactttttaaccaaactgttttatcaatttcgtaatagcagacatcttttttgtcatcagttcagttatagagttgataatattgaacaacta

SEQ ID NO: 236 - DNA, 4043 bp, Homo sapiens
ttatgataaacctgtgatatttactctcgcttgatgtctttggtttcatttgtttactgttaaaggattctattagtaatagaattggtcataagtactttatgtaactttttaactgacaagagaacattatgatagatttggcctctcttccttaagtttaaaacttaagcaatttatttaaacagctaagacagaatgaaacagattgtctcattgagcaagttttaaagaatgatgacatgtaagtataacttaaggcctgaacagccttgttgatagcttttttgttttttgagatggagtttcactcttgttgcccaggctggatgcaatggtgcaatcttgactcactgcaacctctgcctcctgggatccagcgattctcctgcctcagcctcccaagtagctgggattacaggcacctgccaccatgcccagctaatttttatatttttagtagagacagggtttcaccatgttggccaggctggtcttgaacttctggcttcaggtgatccacctgcctcggcctcccaaagtgctgggattacaggtgtcagccactgcacccagccagttgatagcttttatgtttcactataaccatatattatcccaagaactttgccaaagtgttccatgataactcagctggaatgttatcttgtagttacgttcctcttgggcctggtacttaactatagcctttctttttgtctgatatccaaagcatctttcagcagcgtggttttaacattctacctacttattatcagcaggttcttgcggatattctaagttattgtttattagtacctcagttcaagattatgaactaactctgaagtgattaataaaaaatttaagtttccagccgggtgcgttggctcatgcctgtaatcccaacactttgggaggccgaggcagacagatcacgaggtcaggagttcgagacctggccaacatggggaaaccctctctctactaaaaatacaaaagtagccgggtgtggtggcacacacctatagtcccagctacatgggaggctgaggcaggagaatcacttgtacctgggggcggaggttgcagcgagctgaaagccaggatcgtgccactgcactccagcctgggcgacagagcaagactctctctcaaaaaaaaaaaaaaaaaaagtttccttagatctgtctgtccttaaaaccttgttaaaaatagagaaaggagaagagagaaagcttgaggagaaatagaaagagagagaaggtgataatgagtgaaaggaatgaacaataataaaagaggaaggacaagagccagtatggaatttttatgatgaagagctgctgggtgcacagttcatgagtctcttttacttttagcatttctcttgaacttgaatatataaaattccttttagagagttttcctgctacagtaaaacaaatgcaaaaaaaaattcttacacagttcagtttcttctaaaatcaagactgccttagaaaattctcctttgagggtaacaggtgactatctctctgtcttaaagttctgtcatgaagtactgttaaaccctaccttcatcaaaccaggtctataaatacaactgtaaatacaaaattaaatagaacagtattttctttataattgtttggcagtatcagtttataatagtagatatttttttgggagttgttttagagcactgaaaataagagttcaagatttttttttctcaaacaccgtttcagaaatatatcaattgtataggatggcagatgtatattaaaattccttcaaaatgtgtttatcagcttgccttcttctgtttatagacttatttgtgatacatttgatatatgatattttttctttctcctgagggttacatgttgggatttttttttcttttataatgctaccctcagtggaaagggtcaagaaccagtgggatggcacccagcatggcgttgagctaagacagcagcagcttgaggacatgattattgacagtcttcagtgggatgaccatagggaggagactgaagaactgatgagaaaatatgaggctcgactctatattcttcagcaagcccgacgggatccactcaccaaacaaatttctgataaccaagtaagactcatcagatattttttggcagtattgttttgttggatatactttttttctattgttcactgtaattcttaacaataggaccctgccatgttttttcctaagttcttagagtgtctaatgaaatttatatgaagaatttgatctggaagatttttttcgaaaaatttctggaggcataacaagtaagaatatgcatgtctccgagatttatagctcactgactttttgcaagtgaaacacaccctcaaatcagcatctagaaagagaacactttcaagattccaggaaccctcttttgctcccttctgtactgtattagtctgttctcacattgctataaataactacctgagactgagtaatttatgaagaaaggagatttaattgactcacagttcatttgagggctactgtagtgaagcatgactgggaggtaccaggaaacttaaaatcatggtggaaggcaaaggggaagcaggcaccttctttacaaggcagcaagacagagagagatagaagggagaagtgccacacattttatttatttattggagacattgtctcactctgccgcccaggctggaatgcagtggcactatctcagctcattgcaacagccacctcttgggttccagcgattcttgcctcagccttccaagtagctgggatgacaggcgtgcaccaccatgcccagctaatttttgtattttctgtagagacggggttccgccatgttgcccaggcttgtctgcaattcctgagctcaagtaatctgctcactttggcctcccaagtgtcacacactgttaaaccatctgatcttgtgagaactcactatcacaagaacagcacaggggaaattcatccccatgatccagtcacctcccaccaggctcctccttcgattggacatgagatttgggtggggacacaaatccaaaccatattacttacttaccctgaaggttatttttattaataagtttttccaagactttcatttgaggactactatagtgaacaaatcagataagtaagtttagtttcctttaatgactttttaaccaaactgttttatcaatttcgtaatagcagacatcttttttgtcatcagttcagttatagagttgataatattgaacaactatggtatttttaaaagtgcttttaagattctctgtataaaattataaaatattcttgaattggaggttttagttgtgaggttatagtttggtataacatttatttgcccttcagctagcctaagatggaagtgtatatttgtgaagaatttaagaaagtatatgtagaaaacaatcgaaaatgtggaagtatgtttttattctccacaaatgcagactttacttggttacagttttaaaagcaagtggccagttatatgcatttctggatcattctgtgtgtttgtgatactgctgactgtttccaccaaatgactcccaagtaatagtgaagcccctggccccttaactagaggaatacaattaaaagtgatgtcagtgtttcagttatcatattagaacattattttttaatcagcagtgtgattcttttcttctgaaaccttaggctgatttaaaatcttcccaattgctacaaaaagcattatattaaaggtttcagttgtcatttagatttcatggtgagtaccttgatccagagactctcagaggctgaaaaactatgtcaaagaaccaatgccagtggacaaattcagcatcagtttggctattcaagcaaactctcagtaaaccttgcttggcagcttgatccattcaagtggttatctttgtaaacacaccttgtgatccaggggcaagagatggaagacgtccatgttgttgattcttcacgtttctccaggcatgtatgcaggaac

SEQ ID NO: 237 - DNA, 4063 bp, Homo sapiens
taaatattgtgtatagtaaagactgattttgtaactattctgaaaacaggttaagtttcaaaaatttaattttgattgactttccaagtaattttgttgtatatttggaagcttctattatatctgttattactttttcagtaatgatgtttattgtccctatagattaataaaaatgaagcttttttcagcatttattctttgtccaatttggtcaattccttttaacagtgatcagtagaagatacttatattgggattgtttcataaggcctgatatcagccaggctcaaccttcaagctcttaaaaatgaatgctgtagcagctgtcattcccgaatgaatgggcttaggtgaaaagtacaggtagccttatcctcctagcatgcccaccaatatgaggttcagagatttgggtcagtcaacttgatttatcctctcggaagcttacttctttccctgaaaatcacctttatttttcaacttgttttgtttattttctttgctaggatttgatttttagttttcccttccaagctgggaataaagctggccaaaaagagaagggtaaaaattatagtcttctatattttcctcttctgttacgttgttttaatatttcaagtatcattttattactttttttaaaaaacaattgccaacaatgtctttgtgataaatgcctatgaatgttaatgttttcattttgtaaatatcaaactcaagcatgcggatattttctcagcacatttagctccatatcaaacaaactaaagagccaatgcccacagaaacaatgcccacagtctttgtttttgttttcatttgtttctttttccattaattgattaatcaaccagttaaacaagtatttatttagcttcctatttgccaagctctgtgaccagccctaaagattcaaccataaatacacctcattcctgctcccaggaagctgacattgcatagggggagcctgcaatgtacgtaagtggtaaataggaaaataatacataattataggaggttgttttggaggtaagagaaattaaagaggtgctatgtaagagagggacttaactgaggcaaatttagaaagcataacttggtggcatttgagctggttctgaaggttaagaaggaaccatctgaagaaaattacagagtgaacagcaaatataaaagtcatgaggcaggaaagagcacagcatgtggttgcaatataatgaatatgatggtaagagcttgagatgcggtaggagaggaaggcagaggccagatcatgctgagctttgtaagacatggggtattagtccgttttcatactgccataaagaactgcctgagactgggtaatttataaaggaaagagttttaactgacttatagttcagcatggcaggggagacctcaggaaacttacaatcatggcggaaggtgaaggggaagcaaggcaccttcttcacaaggtggcaggaagagaattgctgagtgaagggggaagagctccttataaaactatcagatcttgtgaaaactcactcattatcacgagaacaacatgggggaaaccatccccattatccaattatgtccacctggtctctcccttgacacatggggatataggggttataattcaaggtgagatttgggtgtggatacaaaacctaatcatatcacatgggaaggagtttggatattaaaagtacaatagaaagctattggaattgttaaggaagggagtgacactgtctaatgtgtatatatattaaaatttaatctctctggatcttatgtggataataggttgctagtgggtatagtagaataattgcgaagatcagaaaggaagtgatggttgtggtccaactgggacatggtggtccccgtggctactgtatgccagcaatgatggaaataagatgttagatttgcgatatgccttggaagtagaaaagacattttggtggattagatatatgccttaagggcttggaaacaatccaagatggtattttgtaaaaggatgagtggtggtaccattcaccgaattgggaaaggatgtgggagttttggaagaacaaaaattgcaagttggattttgttaagtttgagatgcctgttagatatctaagtatataggttaaataggcaattatgtatgttaatctggaactcagatgttctggacctcagatatgaattgagagttctcagcattcacattggaggttgaacatgtgggactggatgagatcaccagggaaggagtgaagatgaagaagagaggggtatgcttaactgagtccataaggcctagggtttggtgattgaacaaaaaaggaggaaggagcaaaagggactcagaaaaaatttccaatgaagtgaaaaaacgcagatttgtcatgttcagaaatagagggaggagaatatctcttagaggaaatggagagaggagaatgtttctaagaaagaatgatctactggattgaattgggctgaataaccaaataggatgacacagcacactattttggtaattccacagcttggacattcctggtgattttggaaagagcaatttggaggaagtaatgtggctggaagctagagagtgagatgaaggtgaagaagtagaaacagtttgtggaaacaactttagagaagtttgtgtgaagagggacagagattttaggtagtgcttagtgtgggggctgtaaggttaagagagtcgattgacttttctgttaaaatggattatagtaaagcatgtttgtgtgcctatgagaatgacccactagatgagagactgatgattaaatgcagaggggacaaaggaaggaggacaggaaggctttgagaagataagaaagtgagatttagagaattgggtttggtaagaactggaatgcatttttcattatgaccagaaaagtcaacgagaaggtgagtttagatgtacgtgaactagaccattagtggtggaagatgaaaggttctccatgcaagaactgagctttatgatctatcgagcacattgtcagtgaagttggaggtaggactaagagaagttggaagagagaggattgggtgtaagttcagatctttgtgagtgggatggagagtttcctagggtaaatatatggtattgctgggcagtaatgagtgcctatttgtggtttatattattaaatgtaaggaaaggtagccctgttgaactactctttaatagcattcatctactcaatgaggcaatgaagaagaatgcagatggaagtgggagaaagatggagcagggaagagtaagatctttggaaatgagaggagaacaggattgcctgtggtccataatagtgtctaatgtgtccctttctctgggtggtgtcattcctcactagagctatggcttggcaaacagaccttaagttggatttcaaacttcacttcctcattgaggcagtggtcaacctctatatacagtgcccctgaacctgaagctcagtataggaacagagtggatacatgtgttgtgctttctacagtgggattttgcctggaagatgggtgaacaataacctggaggtagcagtggggagcagggaggacccttattccagcttctcaaactgaggcataaaggatctgagagaaaaaggaaaagacttcatgaaaagtttgcagggaaccccatgcagtagctcatgtctgtaatccagcactttgggaggctgaggcaggtgaatcgcttgagtccaggagttccagactagcctgggaaatatggcaaaacctcatctctacaaaaaatacaaaaatcagctgggtgtggtgacacatgcctgtggtcccagctactagggaggctgaggtggtaggttcgattgagcctaggaggtggagattgcagtgagctgtgatcacaccactgcactccagccttggcgacagaaccagactctggaaaaaacaaaaagtttgcaggagaaataatggccctatggaaactggtttcagtgaagacaaaaagggattggcctggggagatggaaggtacagcaga

SEQ ID NO: 238 - DNA, 4041 bp, Homo sapiens
aggattattacacttttatctcctatgtttgcttttagcctcattttcatcgtcttgttccatagatgcagactttgattatagattgttttagattttctcctgtgcccagctgcatgcttagcactgtgtttgaggggtgaatgcctatctcatggggacttcatctgctggttctaggacaggaattatagcttcatacttatttaataacaactttcttggcatataattcacatactgtacagttcattcatttaaattttacaattcatttgtttctagtctattcacgattgtacgaccatcaccacaatcaagttagaacattttcattacctcagaaagaaaccccttccctttactagcaatttcccattcctccccgccaattccctcccctctgaacaatcactaatctatttctatctatttgccaaataccttaacattttatactctatcctttgaatatgttctccacttttggctttacacagatatggtgacattgttagcctcaccagagggaggcagtgtagattctcagtatggacctgcagggaaaaaagatacaggcagaagtccacagaacactgcctgatgaacacagttctataagacccaataaagtcggcaaagcactgcttgataaacaccgttctgtaagacacaatataggactttaaatcgttgtaacatgaaggactaagaaaggcaaatgaagtaaaggaggaaaaacaaatacttgaaaatactgcatttcttttaaagaatcatgacaacattagacagaggtgaaattgcagcattagcccggttaccagtttgagcaggacactgataatgagcaacatctgggttctatttctggctgtgctctttgacccagtcatttaatcatccagggttattttgcacatctcctgatagtactttaccccagttgatatttgcaatgatgttcaggctgcagtagagaatatgtctcaagtgtgtgtatatatatacacatagaaccccaaaattatgtactggatttttatatgatataattatggcctcatatttcctattcataaaattaaaacagctttatggcaaatacaatgagatcatgaagatgctgtctaaggggaaatgtggcaatttggaatgttcagtagtcaattacagacttttaattttttattcacttagctgtttaattagacaaatcctaacctattccatttctaatggctttccttctaggcaggcagatgagaatccactggatcgctctgcttttagggtgtcttagtcatataacccctgcaagtattttttgttttgctttatttttgttgttttgttttgttttaggtgattttgggctgagatctgtctgggggtgattttttagcacttaatgtatgggctgttgtcatcagagtcaggtgtacccttctgctcttctcaagatttataacagggtctcctgttcactaattcacagagcacagctagagctgcatttattgggtagtgaacatatccctctttagagacggtgaatgctctgttctctcttaatagaaaccagctacagggcatgcaccgtggtggtggcagtgatatgttgaatccctgttcccaggggatgtccgctttctatctgcagctttaatgtttcacttaatatcctctttggctactgagcgcactcctctcccgcagccggcagcgcttggctgctcgacaacttccttcatttctggccatgccgggctgagcaagtgctgcctgtgagcatctgctggggggctttctctgtggcgtttgtctgtgttttttaaattgagaagttgaaggaataccagcctcctttttcctagaacctaaccccctgtatctttcaaatgctttcctggaaacgagcatgctcagagaactgacaaatcattgtccagtgaccgggaggaaatgatcgttgctcttcatttataatgcaaattctgaggtgtctccagaagtgtggtaaacttaaaatgatggctgtggtgagaacgtctctgcagaaagttgtggttttgttgcatcgcttacaaaggatggcagtttcttctcctcggtatcagaagctctgtaaggtaactgagtgattgaaaataaggatctcgggtgtctgacagttctactgtttctcaggctctaaaaactaatctttcaggttcttatcaaggaaagattccctttcttagtaactgattgtgaaagctgttaaagtgaattgcataattacattttgtttaaaaatctaaaacaggttttagttttagtacatagtttcttttgcaattgacacaatcttgtcttctgagatgggctagtgaaatgtttggagaaaatatgatgcaaaactactacattcattaagacctgttacctctctggtactttgcagtatcttaatagtgaatggcacattaatcttatgtaaattttagtaaaattaaaagaagagtgccaaataatctttcagtagatttttaaaaaatgttccattgttttatagctaattgctttttcaattaaaacaattaaaagacattttaaaaaaatgatcagactgaatttcatcataaaacatcccctatattcttaaatctccatatattatagttacacttgaagaatttaatttcacttggatggatgaattaagtagacttactggagacaacttgtttgacagttgcaaatttctaatactacgtcatcccgaacataaaccattcaatcagctgctgtatttttttaagtcagctgttatatgtttgatcatagttttgttttattcaaactatgttgatactatgtcattacttttgtcaaaattagagtgttttgatataaaaggagagagttataatagcaatttttacactaccgcagtactatattcctccttcctatcatatttttagtaccgttctcaagaatgtatcttgttgctctgttagctgcccaaactcatttgtgatcaaaacaactgcctctaagaaaatattatttttctgatgatatacagtatggcatgtccaggcatctagatgatgcttatatggcagcagattgaggtgggaagcagtattccattaactttattatatcacactgtaatttcttacaatttggccaattagatatattgctgtctggaaactttttttttttccggaagttttgggagacagattcaggtagtggggtattcttttcagaaatacttacaagagttttatttgcataagaagttaattaaaacttaatggagcttaattaattcagttacaaagatttgtaaacctagttatttcaatgtgttgtgttttgctctacttcagtggataagtttattctggtaaaacatttatgtttttcatgaaaaggcaattttgataatagataagaaaagctcattcactaattcatgctatttaatttttttaactaccagtatgaatgtataaagctttcttttttttaagagcagggtcattttcctgatccgtttgtgtgtgtactttcacaaaaccaaatatttttctaaagtcgaaggtattaagttagtgcaaaagatgaaacagcagaagtcaagtattggagaaagttgctaattagtttgctaattctaccgcaaataggcacaagttaagtcactgaagtcattggataaattaccatcagaagtgctttttgggaagacttcttgatttataatttcctaaagataccatgaaaatttaaatgtttagaataaatgttacttatttcatttagagaattaaaatttacattatttgctgttgaaatactatcttccacgtattctttcccatatgcaaaattaacaactgcctgattaacgcaatgagaaatgtacaattccagtacattgcagcaggtgtcagtataaggcagtgacataggagattttgcctaaagaactggaaatccagattaggaagcggcacaattactatgaaataaataaac

SEQ ID NO: 239 - DNA, 4024 bp, Homo sapiens
acaatataggactttaaatcgttgtaacatgaaggactaagaaaggcaaatgaagtaaaggaggaaaaacaaatacttgaaaatactgcatttcttttaaagaatcatgacaacattagacagaggtgaaattgcagcattagcccggttaccagtttgagcaggacactgataatgagcaacatctgggttctatttctggctgtgctctttgacccagtcatttaatcatccagggttattttgcacatctcctgatagtactttaccccagttgatatttgcaatgatgttcaggctgcagtagagaatatgtctcaagtgtgtgtatatatatacacatagaaccccaaaattatgtactggatttttatatgatataattatggcctcatatttcctattcataaaattaaaacagctttatggcaaatacaatgagatcatgaagatgctgtctaaggggaaatgtggcaatttggaatgttcagtagtcaattacagacttttaattttttattcacttagctgtttaattagacaaatcctaacctattccatttctaatggctttccttctaggcaggcagatgagaatccactggatcgctctgcttttagggtgtcttagtcatataacccctgcaagtattttttgttttgctttatttttgttgttttgttttgttttaggtgattttgggctgagatctgtctgggggtgattttttagcacttaatgtatgggctgttgtcatcagagtcaggtgtacccttctgctcttctcaagatttataacagggtctcctgttcactaattcacagagcacagctagagctgcatttattgggtagtgaacatatccctctttagagacggtgaatgctctgttctctcttaatagaaaccagctacagggcatgcaccgtggtggtggcagtgatatgttgaatccctgttcccaggggatgtccgctttctatctgcagctttaatgtttcacttaatatcctctttggctactgagcgcactcctctcccgcagccggcagcgcttggctgctcgacaacttccttcatttctggccatgccgggctgagcaagtgctgcctgtgagcatctgctggggggctttctctgtggcgtttgtctgtgttttttaaattgagaagttgaaggaataccagcctcctttttcctagaacctaaccccctgtatctttcaaatgctttcctggaaacgagcatgctcagagaactgacaaatcattgtccagtgaccgggaggaaatgatcgttgctcttcatttataatgcaaattctgaggtgtctccagaagtgtggtaaacttaaaatgatggctgtggtgagaacgtctctgcagaaagttgtggttttgttgcatcgcttacaaaggatggcagtttcttctcctcggtatcagaagctctgtaaggtaactgagtgattgaaaataaggatctcgggtgtctgacagttctactgtttctcaggctctaaaaactaatctttcaggttcttatcaaggaaagattccctttcttagtaactgattgtgaaagctgttaaagtgaattgcataattacattttgtttaaaaatctaaaacaggttttagttttagtacatagtttcttttgcaattgacacaatcttgtcttctgagatgggctagtgaaatgtttggagaaaatatgatgcaaaactactacattcattaagacctgttacctctctggtactttgcagtatcttaatagtgaatggcacattaatcttatgtaaattttagtaaaattaaaagaagagtgccaaataatctttcagtagatttttaaaaaatgttccattgttttatagctaattgctttttcaattaaaacaattaaaagacattttaaaaaaatgatcagactgaatttcatcataaaacatcccctatattcttaaatctccatatattatagttacacttgaagaatttaatttcacttggatggatgaattaagtagacttactggagacaacttgtttgacagttgcaaatttctaatactacgtcatcccgaacataaaccattcaatcagctgctgtatttttttaagtcagctgttatatgtttgatcatagttttgttttattcaaactatgttgatactatgtcattacttttgtcaaaattagagtgttttgatataaaaggagagagttataatagcaatttttacactaccgcagtactatattcctccttcctatcatatttttagtaccgttctcaagaatgtatcttgttgctctgttagctgcccaaactcatttgtgatcaaaacaactgcctctaagaaaatattatttttctgatgatatacagtatggcatgtccaggcatctagatgatgcttatatggcagcagattgaggtgggaagcagtattccattaactttattatatcacactgtaatttcttacaatttggccaattagatatattgctgtctggaaactttttttttttccggaagttttgggagacagattcaggtagtggggtattcttttcagaaatacttacaagagttttatttgcataagaagttaattaaaacttaatggagcttaattaattcagttacaaagatttgtaaacctagttatttcaatgtgttgtgttttgctctacttcagtggataagtttattctggtaaaacatttatgtttttcatgaaaaggcaattttgataatagataagaaaagctcattcactaattcatgctatttaatttttttaactaccagtatgaatgtataaagctttcttttttttaagagcagggtcattttcctgatccgtttgtgtgtgtactttcacaaaaccaaatatttttctaaagtcgaaggtattaagttagtgcaaaagatgaaacagcagaagtcaagtattggagaaagttgctaattagtttgctaattctaccgcaaataggcacaagttaagtcactgaagtcattggataaattaccatcagaagtgctttttgggaagacttcttgatttataatttcctaaagataccatgaaaatttaaatgtttagaataaatgttacttatttcatttagagaattaaaatttacattatttgctgttgaaatactatcttccacgtattctttcccatatgcaaaattaacaactgcctgattaacgcaatgagaaatgtacaattccagtacattgcagcaggtgtcagtataaggcagtgacataggagattttgcctaaagaactggaaatccagattaggaagcggcacaattactatgaaataaataaactagtaacagataaattttatttgtgtggttatattttgaaaactgatctaagttattgagctatattaatgtaatgaaatgaaaatttagttgtagacttaaatattaacagttgccatctcaaatattgatagaggtagctataccaaccaaaaatacttaattgtattttaattatcaatagtccatgtgtcatacctaaaagtttaaatgggtttgacatttatttgctttaagacactgtaaattcccttcccattaaattgtaaatgctgtcttgactttctccttattcctcccacattctctaaatttagtttcttagaaaaaaatgctttaagtttgtgtatctccataaaaatacagaaacagtctattgtaaatacatgtagagaccaaaatgaatgagaataaaatgtggcataatctgagggaaatttgactatttaaaattcatattggcattttgaaattcagtgtctgaatatttttatcttcttttaaattcctcttgaggatcattctttttatgtattatttgtttagtcttttgttagacttttccctctgtggcagctcgtcttttctgcttattttcatacttctcttgtttgtcagaagatagtgtgtgtgttacacgagtagatacttgtgt

SEQ ID NO: 240 - DNA, 4024 bp, Homo sapiens
tggctgctcgacaacttccttcatttctggccatgccgggctgagcaagtgctgcctgtgagcatctgctggggggctttctctgtggcgtttgtctgtgttttttaaattgagaagttgaaggaataccagcctcctttttcctagaacctaaccccctgtatctttcaaatgctttcctggaaacgagcatgctcagagaactgacaaatcattgtccagtgaccgggaggaaatgatcgttgctcttcatttataatgcaaattctgaggtgtctccagaagtgtggtaaacttaaaatgatggctgtggtgagaacgtctctgcagaaagttgtggttttgttgcatcgcttacaaaggatggcagtttcttctcctcggtatcagaagctctgtaaggtaactgagtgattgaaaataaggatctcgggtgtctgacagttctactgtttctcaggctctaaaaactaatctttcaggttcttatcaaggaaagattccctttcttagtaactgattgtgaaagctgttaaagtgaattgcataattacattttgtttaaaaatctaaaacaggttttagttttagtacatagtttcttttgcaattgacacaatcttgtcttctgagatgggctagtgaaatgtttggagaaaatatgatgcaaaactactacattcattaagacctgttacctctctggtactttgcagtatcttaatagtgaatggcacattaatcttatgtaaattttagtaaaattaaaagaagagtgccaaataatctttcagtagatttttaaaaaatgttccattgttttatagctaattgctttttcaattaaaacaattaaaagacattttaaaaaaatgatcagactgaatttcatcataaaacatcccctatattcttaaatctccatatattatagttacacttgaagaatttaatttcacttggatggatgaattaagtagacttactggagacaacttgtttgacagttgcaaatttctaatactacgtcatcccgaacataaaccattcaatcagctgctgtatttttttaagtcagctgttatatgtttgatcatagttttgttttattcaaactatgttgatactatgtcattacttttgtcaaaattagagtgttttgatataaaaggagagagttataatagcaatttttacactaccgcagtactatattcctccttcctatcatatttttagtaccgttctcaagaatgtatcttgttgctctgttagctgcccaaactcatttgtgatcaaaacaactgcctctaagaaaatattatttttctgatgatatacagtatggcatgtccaggcatctagatgatgcttatatggcagcagattgaggtgggaagcagtattccattaactttattatatcacactgtaatttcttacaatttggccaattagatatattgctgtctggaaactttttttttttccggaagttttgggagacagattcaggtagtggggtattcttttcagaaatacttacaagagttttatttgcataagaagttaattaaaacttaatggagcttaattaattcagttacaaagatttgtaaacctagttatttcaatgtgttgtgttttgctctacttcagtggataagtttattctggtaaaacatttatgtttttcatgaaaaggcaattttgataatagataagaaaagctcattcactaattcatgctatttaatttttttaactaccagtatgaatgtataaagctttcttttttttaagagcagggtcattttcctgatccgtttgtgtgtgtactttcacaaaaccaaatatttttctaaagtcgaaggtattaagttagtgcaaaagatgaaacagcagaagtcaagtattggagaaagttgctaattagtttgctaattctaccgcaaataggcacaagttaagtcactgaagtcattggataaattaccatcagaagtgctttttgggaagacttcttgatttataatttcctaaagataccatgaaaatttaaatgtttagaataaatgttacttatttcatttagagaattaaaatttacattatttgctgttgaaatactatcttccacgtattctttcccatatgcaaaattaacaactgcctgattaacgcaatgagaaatgtacaattccagtacattgcagcaggtgtcagtataaggcagtgacataggagattttgcctaaagaactggaaatccagattaggaagcggcacaattactatgaaataaataaactagtaacagataaattttatttgtgtggttatattttgaaaactgatctaagttattgagctatattaatgtaatgaaatgaaaatttagttgtagacttaaatattaacagttgccatctcaaatattgatagaggtagctataccaaccaaaaatacttaattgtattttaattatcaatagtccatgtgtcatacctaaaagtttaaatgggtttgacatttatttgctttaagacactgtaaattcccttcccattaaattgtaaatgctgtcttgactttctccttattcctcccacattctctaaatttagtttcttagaaaaaaatgctttaagtttgtgtatctccataaaaatacagaaacagtctattgtaaatacatgtagagaccaaaatgaatgagaataaaatgtggcataatctgagggaaatttgactatttaaaattcatattggcattttgaaattcagtgtctgaatatttttatcttcttttaaattcctcttgaggatcattctttttatgtattatttgtttagtcttttgttagacttttccctctgtggcagctcgtcttttctgcttattttcatacttctcttgtttgtcagaagatagtgtgtgtgttacacgagtagatacttgtgtagaatattctcattttgtgggttttcttgtatgtttcaaagagaagggaggaatgaaaaaaggcatgtcacagctctcagagttaaaatatactcccctcccacaatctatttacacattcacgtgtattttttgcctttaaaaatatttcttctcggttatacatccaataaaatttgagcaggaagcaaaaacgtaagtgctgcttacttggagatataattagcagcattgaaattgccctgatgacctaaaatcaccctacactggatgctaattttctcagatatggttttgtttgcttagtttctttaaaattttcatgcctataaaataatttttcttttagtagagcacagtagaaaaaaagctgatgtaaatgatttgaaaaataatattgaatttaatttgtttttattgttacgtgattactttggggtgttttatatcatgaagtctttagattagaactgggttatttgtgttaatgttaaatcagaagagatttttgtaagtcctccttatttttttcttagtgccaatttctgtaaaatatttagcaattgagggcatggtaaaaagcagtttcctgtaaagtagattgggatatgaacattatagaaaaatgagaaaaatttaaaaatatttagtgctgtaaattgactccttcgtgactcaagcattttagaaaatgttgatttaagtgatataacttctatttgcttgaatgtatatgtaaatcattttagtttaagtggttttagtcaccccccaaactattctgatcatatttcttcagcaaaaatcttttaaacatctagctgtatatagatgtgtattcatttaaaaattatacatatatgccatggtgaaatcatgtattaaatattagtagtgtataattttgttcttactttctactgttgcctttttgtaccacagttgattctttttctctatgtggtatacacaacacgattttggtgactagtcatttacatacagagtgaaactatggctattcttagcctggccttctagggggcttgagctttcag

SEQ ID NO: 241 - DNA, 4030 bp, Homo sapiens
ctgttacctctctggtactttgcagtatcttaatagtgaatggcacattaatcttatgtaaattttagtaaaattaaaagaagagtgccaaataatctttcagtagatttttaaaaaatgttccattgttttatagctaattgctttttcaattaaaacaattaaaagacattttaaaaaaatgatcagactgaatttcatcataaaacatcccctatattcttaaatctccatatattatagttacacttgaagaatttaatttcacttggatggatgaattaagtagacttactggagacaacttgtttgacagttgcaaatttctaatactacgtcatcccgaacataaaccattcaatcagctgctgtatttttttaagtcagctgttatatgtttgatcatagttttgttttattcaaactatgttgatactatgtcattacttttgtcaaaattagagtgttttgatataaaaggagagagttataatagcaatttttacactaccgcagtactatattcctccttcctatcatatttttagtaccgttctcaagaatgtatcttgttgctctgttagctgcccaaactcatttgtgatcaaaacaactgcctctaagaaaatattatttttctgatgatatacagtatggcatgtccaggcatctagatgatgcttatatggcagcagattgaggtgggaagcagtattccattaactttattatatcacactgtaatttcttacaatttggccaattagatatattgctgtctggaaactttttttttttccggaagttttgggagacagattcaggtagtggggtattcttttcagaaatacttacaagagttttatttgcataagaagttaattaaaacttaatggagcttaattaattcagttacaaagatttgtaaacctagttatttcaatgtgttgtgttttgctctacttcagtggataagtttattctggtaaaacatttatgtttttcatgaaaaggcaattttgataatagataagaaaagctcattcactaattcatgctatttaatttttttaactaccagtatgaatgtataaagctttcttttttttaagagcagggtcattttcctgatccgtttgtgtgtgtactttcacaaaaccaaatatttttctaaagtcgaaggtattaagttagtgcaaaagatgaaacagcagaagtcaagtattggagaaagttgctaattagtttgctaattctaccgcaaataggcacaagttaagtcactgaagtcattggataaattaccatcagaagtgctttttgggaagacttcttgatttataatttcctaaagataccatgaaaatttaaatgtttagaataaatgttacttatttcatttagagaattaaaatttacattatttgctgttgaaatactatcttccacgtattctttcccatatgcaaaattaacaactgcctgattaacgcaatgagaaatgtacaattccagtacattgcagcaggtgtcagtataaggcagtgacataggagattttgcctaaagaactggaaatccagattaggaagcggcacaattactatgaaataaataaactagtaacagataaattttatttgtgtggttatattttgaaaactgatctaagttattgagctatattaatgtaatgaaatgaaaatttagttgtagacttaaatattaacagttgccatctcaaatattgatagaggtagctataccaaccaaaaatacttaattgtattttaattatcaatagtccatgtgtcatacctaaaagtttaaatgggtttgacatttatttgctttaagacactgtaaattcccttcccattaaattgtaaatgctgtcttgactttctccttattcctcccacattctctaaatttagtttcttagaaaaaaatgctttaagtttgtgtatctccataaaaatacagaaacagtctattgtaaatacatgtagagaccaaaatgaatgagaataaaatgtggcataatctgagggaaatttgactatttaaaattcatattggcattttgaaattcagtgtctgaatatttttatcttcttttaaattcctcttgaggatcattctttttatgtattatttgtttagtcttttgttagacttttccctctgtggcagctcgtcttttctgcttattttcatacttctcttgtttgtcagaagatagtgtgtgtgttacacgagtagatacttgtgtagaatattctcattttgtgggttttcttgtatgtttcaaagagaagggaggaatgaaaaaaggcatgtcacagctctcagagttaaaatatactcccctcccacaatctatttacacattcacgtgtattttttgcctttaaaaatatttcttctcggttatacatccaataaaatttgagcaggaagcaaaaacgtaagtgctgcttacttggagatataattagcagcattgaaattgccctgatgacctaaaatcaccctacactggatgctaattttctcagatatggttttgtttgcttagtttctttaaaattttcatgcctataaaataatttttcttttagtagagcacagtagaaaaaaagctgatgtaaatgatttgaaaaataatattgaatttaatttgtttttattgttacgtgattactttggggtgttttatatcatgaagtctttagattagaactgggttatttgtgttaatgttaaatcagaagagatttttgtaagtcctccttatttttttcttagtgccaatttctgtaaaatatttagcaattgagggcatggtaaaaagcagtttcctgtaaagtagattgggatatgaacattatagaaaaatgagaaaaatttaaaaatatttagtgctgtaaattgactccttcgtgactcaagcattttagaaaatgttgatttaagtgatataacttctatttgcttgaatgtatatgtaaatcattttagtttaagtggttttagtcaccccccaaactattctgatcatatttcttcagcaaaaatcttttaaacatctagctgtatatagatgtgtattcatttaaaaattatacatatatgccatggtgaaatcatgtattaaatattagtagtgtataattttgttcttactttctactgttgcctttttgtaccacagttgattctttttctctatgtggtatacacaacacgattttggtgactagtcatttacatacagagtgaaactatggctattcttagcctggccttctagggggcttgagctttcagtgtggtgctgatctcaaagtcttccccggaatactgtgtcttctgtggtattaaagcaactacttctgaatattctgtgaaaaatagaagagaccagaagattccacctgggaagtcacgattgaccagtgatgtctacaaaaggcttgctttgtggctgtgtgtgtgtgttttcatgtgtggacgtggacaacacagaactatgtagttgcttgtagtgctaatgagtaaatagataatgaacatgaaggcacattaatctctcagcaggtttttatgttcactgatgaagtaaggtcacatattatttttcatctacatgtacagctccctgtatttagaggtagttaaggttgagtatgtggttttttagaagacactgaatggagtggtgtattttcgaccggttgaattttgtattttttactctcaaacatttccccacctttttttcacaggagaaccctgctctccttggacaattaaatcctgaagtgatccagggcaatggagatttactttaacatgatctgattgttgagatgtgtgtattttaaggtcaactcttggattccctcagtttctctcaataaccaactcatacatagattgtttgaaccatggagctcagagtcatgaccctctagtctgcaagttagaattcccacttgatcatatgagttgtctcttcttggct

SEQ ID NO: 242 - DNA, 4044 bp, Homo sapiens
acatttatttgctttaagacactgtaaattcccttcccattaaattgtaaatgctgtcttgactttctccttattcctcccacattctctaaatttagtttcttagaaaaaaatgctttaagtttgtgtatctccataaaaatacagaaacagtctattgtaaatacatgtagagaccaaaatgaatgagaataaaatgtggcataatctgagggaaatttgactatttaaaattcatattggcattttgaaattcagtgtctgaatatttttatcttcttttaaattcctcttgaggatcattctttttatgtattatttgtttagtcttttgttagacttttccctctgtggcagctcgtcttttctgcttattttcatacttctcttgtttgtcagaagatagtgtgtgtgttacacgagtagatacttgtgtagaatattctcattttgtgggttttcttgtatgtttcaaagagaagggaggaatgaaaaaaggcatgtcacagctctcagagttaaaatatactcccctcccacaatctatttacacattcacgtgtattttttgcctttaaaaatatttcttctcggttatacatccaataaaatttgagcaggaagcaaaaacgtaagtgctgcttacttggagatataattagcagcattgaaattgccctgatgacctaaaatcaccctacactggatgctaattttctcagatatggttttgtttgcttagtttctttaaaattttcatgcctataaaataatttttcttttagtagagcacagtagaaaaaaagctgatgtaaatgatttgaaaaataatattgaatttaatttgtttttattgttacgtgattactttggggtgttttatatcatgaagtctttagattagaactgggttatttgtgttaatgttaaatcagaagagatttttgtaagtcctccttatttttttcttagtgccaatttctgtaaaatatttagcaattgagggcatggtaaaaagcagtttcctgtaaagtagattgggatatgaacattatagaaaaatgagaaaaatttaaaaatatttagtgctgtaaattgactccttcgtgactcaagcattttagaaaatgttgatttaagtgatataacttctatttgcttgaatgtatatgtaaatcattttagtttaagtggttttagtcaccccccaaactattctgatcatatttcttcagcaaaaatcttttaaacatctagctgtatatagatgtgtattcatttaaaaattatacatatatgccatggtgaaatcatgtattaaatattagtagtgtataattttgttcttactttctactgttgcctttttgtaccacagttgattctttttctctatgtggtatacacaacacgattttggtgactagtcatttacatacagagtgaaactatggctattcttagcctggccttctagggggcttgagctttcagtgtggtgctgatctcaaagtcttccccggaatactgtgtcttctgtggtattaaagcaactacttctgaatattctgtgaaaaatagaagagaccagaagattccacctgggaagtcacgattgaccagtgatgtctacaaaaggcttgctttgtggctgtgtgtgtgtgttttcatgtgtggacgtggacaacacagaactatgtagttgcttgtagtgctaatgagtaaatagataatgaacatgaaggcacattaatctctcagcaggtttttatgttcactgatgaagtaaggtcacatattatttttcatctacatgtacagctccctgtatttagaggtagttaaggttgagtatgtggttttttagaagacactgaatggagtggtgtattttcgaccggttgaattttgtattttttactctcaaacatttccccacctttttttcacaggagaaccctgctctccttggacaattaaatcctgaagtgatccagggcaatggagatttactttaacatgatctgattgttgagatgtgtgtattttaaggtcaactcttggattccctcagtttctctcaataaccaactcatacatagattgtttgaaccatggagctcagagtcatgaccctctagtctgcaagttagaattcccacttgatcatatgagttgtctcttcttggcttcatgagaaagtcttggttagattagtacagaaactgtgtgaaggttgaggtttaatggagaaaaatggcgtatgtagatgggtttgcctccatctaaccctctctatggatgctgtaggtgtgtttcctgggagctgtatggatacccacacagactactttctctactctgcgtttgtttctgcacttcctagtcaggtcaagattacagacaaaagtgagacgggatcaaggagaaaacacctgcacccctgcctgccactatcagacatgattcctgtggcttccaagagcacaagtgccattttagaaagctcttggacctctgttttgctgtagttccccaagttgatatgtgttgtcaaaattatgtttttaaaaagttatccaattaactaacattttcttaatcagaaaactcatgctatcaatgacttggataaagtcaatataattagctaaaaacagtataattagatctgatgcaatgctttgtcactcacttaaagaataactaatacattctataaggtagcattttaaaattcttttatagccaagatatcattatcattggtgtatgtctagaagtgtaatactagtacaaatccggaacaaatagaaggtccttctgagatggagttgaagtagtattaaggatacggataaaaggtctcttttatttgtagagtattatttgataattgtaacttaaagggttgatgatttgtgttttcctagaggcaaagtttattaaatttcaagtggaaatttcctagctgtaggtactgctagattttaaatgtgcagacatagctccttcctcttactcttaactgtgatcactaccaacttctcttagtatatttggtagtttatttttagttctctaaaataagtaattagtagagttcctaccatagagataaaagaatgtagaaaatgttatgccttggtagctttctcagtttcacaaagcttattcatttctgggcgaggtaaatgagtccaaataattgaaattggaaaggatgtgaagtgcatcagagggttgcttttcatttttcatcttctagtttgttcagttctgtggaactctaaaaagattaatttataacaaagctcacttataaaagcagacagtgccttttagtgcttaataaataataggcttatgtgaaagtatggcttcataaagttaagcaagaattttggaaaaacatcaaatggaagaagatgttgaactgtttgcacaatagacaactattttgtttttattttaacagaattgagagaaaaatggctgactacaacaatagaataactgttagctgttatgatgggaaaatatcttgatactgctagtacagtttccttacatttttagtattttagagtttacaatgtgttttctcatatattacatcattaataaatgtaatattaacaatattatattatcttgtgtccttaagagatagataggaaagaaatttgttttgcaagtcagcaagtgaaggaacatgccagtagttagttgctcagctagtatgcggtgcagcttgtgttcaacatagattttctgcttcaatagccagtgtctctctacctgtaattttagatagagaatttttggaattatattgggataaaatgggtcactcagtatagaagatatagaaagagagattacattaactaagtaatagatattgttttgttctgaattatttccatatgcatttccttgtctaaagaaatttcacctgcagtctcctttaaaacatgagctggagcatgagaacattccatgttcctttaaaacatggaattctggagaatgaggagatgt

SEQ ID NO: 243 - DNA, 4023 bp, Homo sapiens
ataaaatgtggcataatctgagggaaatttgactatttaaaattcatattggcattttgaaattcagtgtctgaatatttttatcttcttttaaattcctcttgaggatcattctttttatgtattatttgtttagtcttttgttagacttttccctctgtggcagctcgtcttttctgcttattttcatacttctcttgtttgtcagaagatagtgtgtgtgttacacgagtagatacttgtgtagaatattctcattttgtgggttttcttgtatgtttcaaagagaagggaggaatgaaaaaaggcatgtcacagctctcagagttaaaatatactcccctcccacaatctatttacacattcacgtgtattttttgcctttaaaaatatttcttctcggttatacatccaataaaatttgagcaggaagcaaaaacgtaagtgctgcttacttggagatataattagcagcattgaaattgccctgatgacctaaaatcaccctacactggatgctaattttctcagatatggttttgtttgcttagtttctttaaaattttcatgcctataaaataatttttcttttagtagagcacagtagaaaaaaagctgatgtaaatgatttgaaaaataatattgaatttaatttgtttttattgttacgtgattactttggggtgttttatatcatgaagtctttagattagaactgggttatttgtgttaatgttaaatcagaagagatttttgtaagtcctccttatttttttcttagtgccaatttctgtaaaatatttagcaattgagggcatggtaaaaagcagtttcctgtaaagtagattgggatatgaacattatagaaaaatgagaaaaatttaaaaatatttagtgctgtaaattgactccttcgtgactcaagcattttagaaaatgttgatttaagtgatataacttctatttgcttgaatgtatatgtaaatcattttagtttaagtggttttagtcaccccccaaactattctgatcatatttcttcagcaaaaatcttttaaacatctagctgtatatagatgtgtattcatttaaaaattatacatatatgccatggtgaaatcatgtattaaatattagtagtgtataattttgttcttactttctactgttgcctttttgtaccacagttgattctttttctctatgtggtatacacaacacgattttggtgactagtcatttacatacagagtgaaactatggctattcttagcctggccttctagggggcttgagctttcagtgtggtgctgatctcaaagtcttccccggaatactgtgtcttctgtggtattaaagcaactacttctgaatattctgtgaaaaatagaagagaccagaagattccacctgggaagtcacgattgaccagtgatgtctacaaaaggcttgctttgtggctgtgtgtgtgtgttttcatgtgtggacgtggacaacacagaactatgtagttgcttgtagtgctaatgagtaaatagataatgaacatgaaggcacattaatctctcagcaggtttttatgttcactgatgaagtaaggtcacatattatttttcatctacatgtacagctccctgtatttagaggtagttaaggttgagtatgtggttttttagaagacactgaatggagtggtgtattttcgaccggttgaattttgtattttttactctcaaacatttccccacctttttttcacaggagaaccctgctctccttggacaattaaatcctgaagtgatccagggcaatggagatttactttaacatgatctgattgttgagatgtgtgtattttaaggtcaactcttggattccctcagtttctctcaataaccaactcatacatagattgtttgaaccatggagctcagagtcatgaccctctagtctgcaagttagaattcccacttgatcatatgagttgtctcttcttggcttcatgagaaagtcttggttagattagtacagaaactgtgtgaaggttgaggtttaatggagaaaaatggcgtatgtagatgggtttgcctccatctaaccctctctatggatgctgtaggtgtgtttcctgggagctgtatggatacccacacagactactttctctactctgcgtttgtttctgcacttcctagtcaggtcaagattacagacaaaagtgagacgggatcaaggagaaaacacctgcacccctgcctgccactatcagacatgattcctgtggcttccaagagcacaagtgccattttagaaagctcttggacctctgttttgctgtagttccccaagttgatatgtgttgtcaaaattatgtttttaaaaagttatccaattaactaacattttcttaatcagaaaactcatgctatcaatgacttggataaagtcaatataattagctaaaaacagtataattagatctgatgcaatgctttgtcactcacttaaagaataactaatacattctataaggtagcattttaaaattcttttatagccaagatatcattatcattggtgtatgtctagaagtgtaatactagtacaaatccggaacaaatagaaggtccttctgagatggagttgaagtagtattaaggatacggataaaaggtctcttttatttgtagagtattatttgataattgtaacttaaagggttgatgatttgtgttttcctagaggcaaagtttattaaatttcaagtggaaatttcctagctgtaggtactgctagattttaaatgtgcagacatagctccttcctcttactcttaactgtgatcactaccaacttctcttagtatatttggtagtttatttttagttctctaaaataagtaattagtagagttcctaccatagagataaaagaatgtagaaaatgttatgccttggtagctttctcagtttcacaaagcttattcatttctgggcgaggtaaatgagtccaaataattgaaattggaaaggatgtgaagtgcatcagagggttgcttttcatttttcatcttctagtttgttcagttctgtggaactctaaaaagattaatttataacaaagctcacttataaaagcagacagtgccttttagtgcttaataaataataggcttatgtgaaagtatggcttcataaagttaagcaagaattttggaaaaacatcaaatggaagaagatgttgaactgtttgcacaatagacaactattttgtttttattttaacagaattgagagaaaaatggctgactacaacaatagaataactgttagctgttatgatgggaaaatatcttgatactgctagtacagtttccttacatttttagtattttagagtttacaatgtgttttctcatatattacatcattaataaatgtaatattaacaatattatattatcttgtgtccttaagagatagataggaaagaaatttgttttgcaagtcagcaagtgaaggaacatgccagtagttagttgctcagctagtatgcggtgcagcttgtgttcaacatagattttctgcttcaatagccagtgtctctctacctgtaattttagatagagaatttttggaattatattgggataaaatgggtcactcagtatagaagatatagaaagagagattacattaactaagtaatagatattgttttgttctgaattatttccatatgcatttccttgtctaaagaaatttcacctgcagtctcctttaaaacatgagctggagcatgagaacattccatgttcctttaaaacatggaattctggagaatgaggagatgttggaaatcatctgattcaaccatttcattttggacataaggaaacagagatagtctataatggatgttttattgctgacagctttttttttttctttttttgagacagggtctctgtcacacaggctggagtacagtggtgctatcatggctcactgcagccttgacctc

SEQ ID NO: 244 - DNA, 4045 bp, Homo sapiens
tcattttagtttaagtggttttagtcaccccccaaactattctgatcatatttcttcagcaaaaatcttttaaacatctagctgtatatagatgtgtattcatttaaaaattatacatatatgccatggtgaaatcatgtattaaatattagtagtgtataattttgttcttactttctactgttgcctttttgtaccacagttgattctttttctctatgtggtatacacaacacgattttggtgactagtcatttacatacagagtgaaactatggctattcttagcctggccttctagggggcttgagctttcagtgtggtgctgatctcaaagtcttccccggaatactgtgtcttctgtggtattaaagcaactacttctgaatattctgtgaaaaatagaagagaccagaagattccacctgggaagtcacgattgaccagtgatgtctacaaaaggcttgctttgtggctgtgtgtgtgtgttttcatgtgtggacgtggacaacacagaactatgtagttgcttgtagtgctaatgagtaaatagataatgaacatgaaggcacattaatctctcagcaggtttttatgttcactgatgaagtaaggtcacatattatttttcatctacatgtacagctccctgtatttagaggtagttaaggttgagtatgtggttttttagaagacactgaatggagtggtgtattttcgaccggttgaattttgtattttttactctcaaacatttccccacctttttttcacaggagaaccctgctctccttggacaattaaatcctgaagtgatccagggcaatggagatttactttaacatgatctgattgttgagatgtgtgtattttaaggtcaactcttggattccctcagtttctctcaataaccaactcatacatagattgtttgaaccatggagctcagagtcatgaccctctagtctgcaagttagaattcccacttgatcatatgagttgtctcttcttggcttcatgagaaagtcttggttagattagtacagaaactgtgtgaaggttgaggtttaatggagaaaaatggcgtatgtagatgggtttgcctccatctaaccctctctatggatgctgtaggtgtgtttcctgggagctgtatggatacccacacagactactttctctactctgcgtttgtttctgcacttcctagtcaggtcaagattacagacaaaagtgagacgggatcaaggagaaaacacctgcacccctgcctgccactatcagacatgattcctgtggcttccaagagcacaagtgccattttagaaagctcttggacctctgttttgctgtagttccccaagttgatatgtgttgtcaaaattatgtttttaaaaagttatccaattaactaacattttcttaatcagaaaactcatgctatcaatgacttggataaagtcaatataattagctaaaaacagtataattagatctgatgcaatgctttgtcactcacttaaagaataactaatacattctataaggtagcattttaaaattcttttatagccaagatatcattatcattggtgtatgtctagaagtgtaatactagtacaaatccggaacaaatagaaggtccttctgagatggagttgaagtagtattaaggatacggataaaaggtctcttttatttgtagagtattatttgataattgtaacttaaagggttgatgatttgtgttttcctagaggcaaagtttattaaatttcaagtggaaatttcctagctgtaggtactgctagattttaaatgtgcagacatagctccttcctcttactcttaactgtgatcactaccaacttctcttagtatatttggtagtttatttttagttctctaaaataagtaattagtagagttcctaccatagagataaaagaatgtagaaaatgttatgccttggtagctttctcagtttcacaaagcttattcatttctgggcgaggtaaatgagtccaaataattgaaattggaaaggatgtgaagtgcatcagagggttgcttttcatttttcatcttctagtttgttcagttctgtggaactctaaaaagattaatttataacaaagctcacttataaaagcagacagtgccttttagtgcttaataaataataggcttatgtgaaagtatggcttcataaagttaagcaagaattttggaaaaacatcaaatggaagaagatgttgaactgtttgcacaatagacaactattttgtttttattttaacagaattgagagaaaaatggctgactacaacaatagaataactgttagctgttatgatgggaaaatatcttgatactgctagtacagtttccttacatttttagtattttagagtttacaatgtgttttctcatatattacatcattaataaatgtaatattaacaatattatattatcttgtgtccttaagagatagataggaaagaaatttgttttgcaagtcagcaagtgaaggaacatgccagtagttagttgctcagctagtatgcggtgcagcttgtgttcaacatagattttctgcttcaatagccagtgtctctctacctgtaattttagatagagaatttttggaattatattgggataaaatgggtcactcagtatagaagatatagaaagagagattacattaactaagtaatagatattgttttgttctgaattatttccatatgcatttccttgtctaaagaaatttcacctgcagtctcctttaaaacatgagctggagcatgagaacattccatgttcctttaaaacatggaattctggagaatgaggagatgttggaaatcatctgattcaaccatttcattttggacataaggaaacagagatagtctataatggatgttttattgctgacagctttttttttttctttttttgagacagggtctctgtcacacaggctggagtacagtggtgctatcatggctcactgcagccttgacctcctgggctcaagctatcctcccgcctcagcctctcgagtagctgggatcacagctactgtgcatgccaccacaccgggctaatttttttgtattttttttgtggagacagggcctcactatgttgcgccggctggtctcaaactcctgagctcaagcaatctgcctgcctcggccttccaaagttcctgacagttttgagcaggtggctatgtacttgttttcctagaagtttaaaagtaaggaaatatattcttttcaaaactatttcgatgttcgatgttcaagtattggctatataatgttaaggaaataaagatttttaaaaatgagttcattttgcactttgataagaaagatggattgggtcatttccatccatattaaaatagttggttctggtttttgatttataacttaatttggtttgattcttaacagtacaaacgttaaattatgtgttcattgaacccagttctccatacccacatgtagttttttatcattatatttaaaaggacataatagctccctaagaaagaaactgaaaggagtcaactaacttaacagactgagttgtttaaaataagaaatatgtatatatttttaaaaaatttaattcaaagaacatgtattgaatggctgtcatgcatcagagatatgtgctaagcagcataaatgtaaaatgcagtgttgcattttccatgggaaacaaggaagtacaaatatgttgttctgaggaattttagtcgttcacacgagtctagcgtgagactaaattcaaacagttctggctttgccacttaccagttatgtaaccttggcaaatccttccacatctctgtgtttcagttcccttttcagaagatagggttggaattagtctctctctctctctcaatctacacacacacacacacacacacacacacacacgcacatgcacacacacacacacacataaggttgttgtaggagttaaataagttaatattgataaaatggtaaaa

SEQ ID NO: 245 - DNA, 4023 bp, Homo sapiens
taacctgaattaatgaccataatgactgagtgctgttttgcattaattcttgaaacaaaacctagattgcttcattacatggcctgtctttgtggaagatccttatacggtgtggtggtaaagaaaggggaacatttgctctattttgaagtaattgcttctaatggaagcctaatgacctattatgcttatttctaaaagctgagcagtaagcttgataggaagctagagaaagattggagaaattatgtcatataaaccaaaatttcaggaagttgcatgtggttgagaatcagtacctcattagacaacttaataattcaatagtttacttatgccaaatgtcatccttactttaaaagctggagtgatttctagaaatgtgtccacatccttgcgggttagggtacggggcagcttctggccagctgtcgtccaggtgtcttatggtttttccgagtttcatatgcagatcaaacagggcagtgagagtagagttttcctgtgggtattgaaatggtaacatttaataacctatggtgactttggatattctcaagtttagcttcctgattttttcaagatcaggagacagaagcttaaaagagttaatcctataggattaattagtagtggcaatgaccaaactgcgatgatatggatatattccatttttgggtttcatgggactgtactaccaaagtgtattttatatgtttctaatttggactattgacatcaaatgaatcaaatagttggagtaaatgatttacttgaaggtggttccaaaaattaattaatgaaatgtatctctttagataaaacacatatggtaacatcttaacagctgttgagtctggttgtcagtatatgggtatttattttactcttttttcaattattctgtatgcttgaatatttttatgataaaatgtcttataggtaacaacaaccctattctaataaaagcttgtcagattacttgagcccttgcatactttactgttgagcatcataaaagaacttgaaatgcttttgtttttggattcttcatgtttcaacttcagatggtgacaagtgcaaaatggcttaaaagtgccttggctaggcacagtggctcacacctgtaatcccagcactttgggaggccaaggtggacagatcatgaggtcaggagattgagactatcctggctaacatggtgaaaccttgtctctactgaaagtgcaaaaaattagccggatgtggtggcacatgcctgtagtcccagctactggggaggctgaggcaggagaattgcttgaacctgggaggcgaaggttgcagtgaaccgagattgtaccactgcactccagcctgggcaacagagtgagactgtctcaaaaaaaaaaaaaaaaagtgccttaacttacctggcaataaacatttattgagtctgcagctttcattcatttagctcatttacatttaactgaaacacatttaaaaattcattttttccttttgcaaaagctaggcatgcctactataaaagtttgcaacttttcaaagcatgaaatatgtagagttgataccctcatttattatattttactaattcctgtagagatgagcaacaaaattgtcctttatgaaagctgtcattctctaaaattcgatatagtaggaaagttggtgtgtaaccttatttaacaaggcttgcaactgataacttttgttgagacaggcatgggggcccttcttttggtgttgacataatatctttttgtctttcttattcatcaaggttagtagaaagttgtcaagtttctattcttaagctctagaactatcctggtctttatctatgaaagaagcataaactttgtcaaaggaatgatttactcataataagtcaatgtgaagcccattcataactatacctttttgttttgcttttctcatttctctgagtcattacttaaagctggtgctttataatttgacttaatcacatatggtgtgattcttttagcacacatactgttgtttttaaatcattacattttaaacttctttatatctagaatttttacactgccagataacctgaattttcccctgcttatctggtgaaagaatgataggaattacaatgtttgaaacatagggttgttccttatttactgaaaattatatggaacaacatatatcattctggcttccaaggatgaatctgtgaacgaaaagagtcaaactctgtaatatttgaagagatttattccaagccaaatatgagtgaccatggcccatgacacagccccaggagatcctgataacatgtgcccagggtgatcagggtgtagcatggttttatacattttagggagaaaatagacgtccatcaatacgtgtaagatgtacattggtttggtccaaaaaggcgggacaacttgaagtggcttccatgtcgtaggaggattcaaagattttctgattggcagttggttgaaagagttcatctaaagacctggaatcaatcgaagggagtgtctgggttaagataaggggttgcagagaccaaggttcttattattgcagatgaagcctctagttagcaggcttcagagagaatagattgtaaatgtttcttatcagacataaaaacgtaccagactcttaattaattctctcctggatagggaaaaagacctggaaagggaaggggattctctatggaatgtagattttccccagaagagacagctttgcaggggtatttcaaaatatgtcaaagaaatatattttggggtaaaatacttacatttctttcagggcctgctatctgtcatgttgatatcttgttactagagagagtctgttttgtcaatcataaggtcgctgtattaatgttaatgctagtcagctgtgcctgaattccaaagagaggaagttataatgaggcatgtccaaccacccattcccatcacggcctgaactagtgtttcaggtttactttagaatgcccttggcccagaggagggatccattcagttggttgggggccatagaattttacttttggtttccaaatcagaatgaatattgctagactagaaataactcaaaggttgttggagaattttaaaatgtatttatttatttatgacatctagtttgtgctcttgattaattgctcttgattaacctccctcgtctttaaattaaatcaaaattagcaaatatttattgcggtctaggagaaatctcatttaaggcacaaagcactgtgtaaagcagtagaatgttttctttactaataaaggacagaaattgaagaccaggaattaaccagcccatgtatttcctgatatatacctgatttagtacaggtgtatttggggaaatggggtggttggttagggctggaagaaagtgaggaagagtactcaattaagtagttctcttgatattattttatattgaaaaaatctttaagaggttaaacaaataattaaggtaattaacgaagcagtgagggacacactgggttggaggcgggaggttattattctggacatacctttaactgtgaggagtgaaatggatatgtcaactatgctgaaacttgttttttttaaatctctaagttgattttgtaaggtataaaaaatgttttttagaaaaacctctgaatgtcaaagaagtataatgacagcttgaatatgcatatacagcaaatcacttataattttgtttggcaaatgaaaatagatttcattagctttaaaatagcatttacacttttactcttggatatattaaaaagaaagtgcacattttgtaaaatgtagtagaaaggaaggaagaagaaaataaaacttaccagttaaccatactattcagaagggaatattattaatgtcttactttcatttcactcttcttttctgtgtgtacacaggcatacccccatcttatcacacatagctttactgtgctttccagctgtagcatttttacaaattgaaagtttgtggcaac

SEQ ID NO: 246 - DNA, 4037 bp, Homo sapiens
tgaaactgtaaaattcctagaagaaaacatggggaaaaagtttcctgacattggttaaggcaatgatttttttaatatggccgttcaccagcaaaaataggcaaatgggattgaatcaaactaaaaagcttctgcacagcaaaggcagcaatcaaagtggagagataacctacagaaggggagagaatatttgcaaaccgtacatctgataaggggttaacagccaatatatataagcactcaactcagcaagaaaacaaataaactgatttaaaaattgacaaagtacctgaacagacatttcccaaaagtagatacagaaatgatcatcaggtacaggaaaaaatgcttagcatcactaattacttgggaaatgcaaagcaaaaccacaatgagatattacctcaccccagttagaatggctgttgtcaaaaacatgaaagataactggtgttggagaagatacagagaaaaggaaaagaactcatatattgtgagtgggaatgtaaattagtatagccattatgtaaaatggtatgaaggttcttaaaaaggtaaaaatagaaatacatacaaccaagtaatcccacttctgggtctttatatccaaagaaactgcaatcagtgttaaagggatatttgcactctcacgttcattgtagcattattcacaatagccaagatatggaaacaacaacaaaacatccattaacagatgaatggataaagaaaatgtggtatatctccataatggtatactattcatcctttacaaatggtgtaaatcctgtcatttgtgatagcataaatgagcctggaagtcattatgtaaagagattaaagtcctttgtaaagaatgataaatactgcctgatatcacttatctatggaatctaatacatttgaattaatagaagtagacagtagaactatggttatcagaagcttggtgggtgagggagggagagaaggaaggggaaattgttgatcaaaggctacaaagtttcagatagataagaggatttatggcaaaccaaggagagacatgaatgaaaagagtggctaccaaccaaatcaacaataatgtgttatgtatttcaaaatttctaagagaataaatttgagatgtcttatcaagaaatgacaggtaagcaaggagatgaatcggttaattagtttgattgatcatgccgtgttgtatccatgtatcacattgtatcccataaatgtgtaccactatggtttttcaattacaaaacaaaaacaaaaacactaaatgcatgttgtatgatttcattcatatcacattttagaaaggcaaaattatggttatggaaagcagttcaattgttgacaggggcttgagaattgactacaaagggacatgaaaggactttctagagtgttaaaaatgacctatatgctgattgtggtggtggtcccgctactgtatacatttgccacgactcatcagattgtgtacttaaaattttattttaaattaattatacttcaataaagctgacaagaaacccctccccaaagaaaactgaggaaggaacttataaaaaatagtgatatgattctcttgtattttgtaaaattaaatatatatacacgcattaaaatgtgttctaatgcatgtatgcaaacatatatattttcaaaacactattttattttatcttttcccatactaaaagtactcatcagattgtcattgatttcttctttcctcctctcacctgtgactgtgggaaagaatgattctctcattatgagtcagagccttttttttccttttctgaatttatagtaacgactcaacactagaagtctcagcagcttggtttgcctgtcattaattttaccaatggttgcaggtgtagcctgaaagaataggtataatgctggtatgtaatgctttctcctgcttctaaaaggtgctgtggggaggtgttgaatgagattcatggtggtaaacaagaatataaattcaaatattatcttaaaacagaaacagtaaagcatggagaaaagatccagctgattctagaaagagcaaatgaagaagaaacaagagtgaaaagagtggctaccaaatcataggaaaaaatacaggagtcccaggaccttcccccaaggacagattcctgggaaggtttccagtgagtttttgaacctaaccgctaggttaaatacatccctttagtctcagctcatcttcctaattaagtacaaattcgaaaataattgtaaggttttctcagatatgtgatggattacatgtcagttgcatcacattcttcaagcaaagtaaatgaatgaatgaacaagggaatgaataaacaaaaggagctagatattccctgaacattgcaagcttcctttggcctgtggtgcttccattaccagcagcacttcagttagaatgatccctatgaattaacttgtaaatgaggaggtcaaatgtgcttttgcacagtggtgttaaatatgtggatgaataaattctttcttgtactttgggctatggagtctatgtagggttagaaatataggctttttctaagttgttctcctcttaggaaagttatttacatgataattaaagaagtttagaagcaattcctgaccttaaacaaagataacgtgtagctttcaatatatgaacctttaagaaaccctcaacatttcaaaggcacaaattagagcattagtctaaataacaaacccccctctttcccgatattcatttatagggtataaaatacttgacagaaaagttgagatacagaaaagatgctaaatttcatgaaacattgttatgaatcaattacagacattttagtttatttaaaacagtttgtttgtaactgttcagaaatacttacattgaaagaatgtccacaaagcactagatctgtagtttcagtggagagtcagtattatatattataatattataaaatgacacacttctcaatggcgcagcttcctagaagtcatttcctatattacttggccataatcactattaattcagtttcataaatgattggacatgatcttttaattctgagccttcataaatatgatttcctctgtctgtttagactgttttctttaggagtccacttgtctaacttcagttgccatctcaggcattacttctcctgggaagcctatctcactgcctttccctttagacacctggactaggagtttctctgtgctcatatgataccctttaggactttttcattcagttagtttctgaatcctttagctcaaaccagaacactctaagtcacgcttgattgctcattttttcacctaccctatgtattcctatttgttgtacctcagctagcacattggtctctgcctccaaagtatattcttaatcatctgtctctcttcattttcatggttaatccatcaaagccatgccattttatccagacaaatggagtagccatctaagtgttgtttttgcttctagtatttgaagcaaatacataacataagttatggaagcaaatacataacatgacataaaccaagtcatgtcagttctctgcttgaaacaacccaaaggctcccattacacttataataaaatctaaaccccttacgctgccctaccaggtcctacatgatcaggcagggccatttgtctctctgacattttaaaaatttttaaccatcactcctgtcccctggcccactgtatttggctcttttctcttccttgtacataccaagccttcctaccacaggacctttgcactagtgtctcattatcttgaaacagttttcactgatctccatgttgtaactccttctcggcagtagcattggaccctaaggatgtacaatgttttatactgtgtttaattcagttactctgaattagataagcagtgggccttaacagcatacaggtgaaatcttgaataatttaacaagtattgattctgaactattgttaaataattcacacagttaattataattaccattattgcttaaga

SEQ ID NO: 247 - DNA, 4049 bp, Homo sapiens
atttcatgaaacattgttatgaatcaattacagacattttagtttatttaaaacagtttgtttgtaactgttcagaaatacttacattgaaagaatgtccacaaagcactagatctgtagtttcagtggagagtcagtattatatattataatattataaaatgacacacttctcaatggcgcagcttcctagaagtcatttcctatattacttggccataatcactattaattcagtttcataaatgattggacatgatcttttaattctgagccttcataaatatgatttcctctgtctgtttagactgttttctttaggagtccacttgtctaacttcagttgccatctcaggcattacttctcctgggaagcctatctcactgcctttccctttagacacctggactaggagtttctctgtgctcatatgataccctttaggactttttcattcagttagtttctgaatcctttagctcaaaccagaacactctaagtcacgcttgattgctcattttttcacctaccctatgtattcctatttgttgtacctcagctagcacattggtctctgcctccaaagtatattcttaatcatctgtctctcttcattttcatggttaatccatcaaagccatgccattttatccagacaaatggagtagccatctaagtgttgtttttgcttctagtatttgaagcaaatacataacataagttatggaagcaaatacataacatgacataaaccaagtcatgtcagttctctgcttgaaacaacccaaaggctcccattacacttataataaaatctaaaccccttacgctgccctaccaggtcctacatgatcaggcagggccatttgtctctctgacattttaaaaatttttaaccatcactcctgtcccctggcccactgtatttggctcttttctcttccttgtacataccaagccttcctaccacaggacctttgcactagtgtctcattatcttgaaacagttttcactgatctccatgttgtaactccttctcggcagtagcattggaccctaaggatgtacaatgttttatactgtgtttaattcagttactctgaattagataagcagtgggccttaacagcatacaggtgaaatcttgaataatttaacaagtattgattctgaactattgttaaataattcacacagttaattataattaccattattgcttaagaactacttaataaagcagggtttgtggctagaatttaaagacaatttgttggatacctttaatctatagaaatgtataataaagatgagagaaataactgttagcgaatcctttggattaagctacaagccattataatttgcagtagcaagccttgtaatgctaatgacaaatataagtcagtttgtttcctatgcactcatggatcagtggttacttcggaaatttgtgttttgtctgatagttttttttttttttgaaaagcccttttttaaaaaagattttaaaaataaaggtgaatttcacacaatctaaaattaaccaaagtgaacatctttggtagccttttactttgatttttatgtatattattatagttatttaatagcctctaaaaatacccagaatggcttaccacttccttttcaagaaaagaattctttagtctccccaaatcttatgcccactggctcattgtacagtctctctgaattctatgccagttccgctcttataaattgtgagcctgtgtttcttgtgccaggttctattccaggcgcaggtgggcatcagtgcagccagcccgccatagcgttctaccacctggtgtagaaatctgttaggaatacgggaagactatttgtggcctttattgactatcctttgcctttgaatccgtgagcagaaatctattattgaataaagtcccatgaattcaattcaaaccctgcattattgattttcaagcagaacttgtgccataatactgttatactgtagttggttacattcagggtcaatagaaatgatttcttgagatatcagtggataattttcattgggattagtcaggaatgtgttctgtcttccatctgtctgcacattgtgagttcttaatgatttgatgcctcttttggctgaattatatccaccataccatcactctggtgagcaaaaagagaagcattctgtattatacaaatgatatgtttagaaacataactaagaatgtttttaatcacccactggcctacccatccaatccctgctatcaattaactattctgaaaccatcatcatgatttcacatgatatttcctctatttaaagtagtgtaactgtaagtcacctcaatttggtatccaggtttgcgtttggcaataaattcctcttggcagcttcagcaagttatatttcttaatactggatctgctgaggttatgtttatggagaccagaactatgagtattgatttatgtttgctttgaacatcttccagtctaaagtcattgtggctatgctttgttgatgaactgcaggagattgcccttgggattgcattgagtgaacttggcccctgtacttcttcagatcatttcaggagagttgaggtggacttctctttaggaaggtgttcttttttttcagctcttcgtaaatgtccatcagtcttgctctgcatagccaagctgttgaagcatgatcaccttgcattgaataagctgcacagagctactgttctaccggggagtatgcttgcaggggagcataatctcaaatttactgctacccactcggtaccatgcagagcttgcttgggagttcagggaggattgtttgaaatgggcagttcaactattcttccagataatcaaaaaagccatccctcgatttagcagaacattgagaaatcctttcctttgactgtattgtattgtttctctaaaagcttgctttgattaaattgcacctgggtgtttaaaaagagaatacatgtgagtgttaatgcacttacattgtaattcagatggatcttttttgcaaactaaattaaaaggtacagagaccattcagagaagccatctgtcactatttgaaagttataattagggtcataatttttaatgtcattgtcatacattggaaaatggaagctttgggatatccactggaggttttacctctcctctacaatgccacactaaatttggaaatttattcagctgaaattttttcaagtttaaatattatatttactttttattgatgatactactaagtacagtgcttccttgagtgtattccttaataaatatttcttcaatttgtttgaatattttgccacaaaccagtctttagcttgacatttgaatttaatcttccatgtattaactaggcatgtacaaaacacatgcttatttattaggcatgcactaactgtactttggttacaggctaaaagactttagagttggttttcaaaatctatttgcttcaaagaatcttagtagtcagtagttaaccaagaaactttaaaaaaatgagccccattttaattttatttacccatctagctattcatttatttgacagatatttatttttgtgcctactatgtacttggcacaatgataaccttttcccagttcttttactctgttattattgtttaaagtttggaaattaaaatactctatattatatgctatattagttaaagctaagcatggtgctgtatcattaaacacaacaataacagccaaataaagttagaacacaccaaatatgttttatttacatgcaaatatttaaaatgatatatttaggtatagtatttaacaacttttatgttcctcacatcagaatttatattctttcaacaagagcctttttaaagataaggattaaattgaccatgcataactttgatgtgattaagctatttgatcttttaaatagaatcattcgattttgctgacacttagcaatagcccattattttagatataatttctttgtgatcatagtaagtttagagtcat

SEQ ID NO: 248 - DNA, 4043 bp, Homo sapiens
ttaaatattatatttactttttattgatgatactactaagtacagtgcttccttgagtgtattccttaataaatatttcttcaatttgtttgaatattttgccacaaaccagtctttagcttgacatttgaatttaatcttccatgtattaactaggcatgtacaaaacacatgcttatttattaggcatgcactaactgtactttggttacaggctaaaagactttagagttggttttcaaaatctatttgcttcaaagaatcttagtagtcagtagttaaccaagaaactttaaaaaaatgagccccattttaattttatttacccatctagctattcatttatttgacagatatttatttttgtgcctactatgtacttggcacaatgataaccttttcccagttcttttactctgttattattgtttaaagtttggaaattaaaatactctatattatatgctatattagttaaagctaagcatggtgctgtatcattaaacacaacaataacagccaaataaagttagaacacaccaaatatgttttatttacatgcaaatatttaaaatgatatatttaggtatagtatttaacaacttttatgttcctcacatcagaatttatattctttcaacaagagcctttttaaagataaggattaaattgaccatgcataactttgatgtgattaagctatttgatcttttaaatagaatcattcgattttgctgacacttagcaatagcccattattttagatataatttctttgtgatcatagtaagtttagagtcatagatgactccctcgaggtcttagtagcatattatgaatttggtatctatgtgattaaataagcacaacaaaattcatatcaaattggtcgataaacacatttttaatattgtgccagactatcattattaatttttaaatcaatatgtagtagtatgaccacaatgtcatattcattagtaaagtacagctgttttttatgccatcaggattatttggcatttaagcagtgccttctactttaaatgatgccattatcctttgaggactctgcctatcaatttggtcagtctagaaatgcaactcattatagaatgaagctgaatagttactgaagcagaatacaactttacaacctcttaaaccagaatatgggagaagcccaatttacctttaaaacttttgggtgtctacacagaaaaaggtgttaatgtgccttgtgaaatttctcaatggtgaatacattttttattctatgtgatttatttctggagatgtacattaatctttgtgaagttgctgtggaatttggttgggtttgtcaaaatgtgtcaaaaatgtgaaatatcccagttctactaattttctaacacaaagttagatggacaaagttagatgacaaagaagaagacaaagttagatggactccataggagagaagaggacttaaaaatgatgccttaatatctgcccccattttgaaagtgaaattttgcggataatgtttctattgcagttgagttagaaataaggaagcattttaaaaccaggtggatgattcaacactagaccacccaggaagggcattccttctgtaataggaaaggtctttaaacctggagtaccacatcacatgtaatgtgtaagtgtggatatttctggagctctcccagatatccagtgtgtctgcatgaatgtgtctctctttatcttttttgttaaggatgcaaatggagagttatatattggattcctcttgcatcactttagatgccttctgtttatattgagcctggcttatttggagttagcttgtaaatttaatgagatcattgtgatggccatgattgcagaatggaaaatgtcactactatgtgccagtttgcttaaatcatttttaagtacccacctgtgctgctaaactctccatttgcattttattggctactatgtttttgctccagagcgggttcctttaactctgatgcctgggtaaattaatcggggtgtgcatgccattgcccttttagcttctgctcctgttctaataaaggctccatctgcttaattggtagacttacaggcctttcttatttcaaaaaatcactttgaaaaaaagcatagcttctcaagggaaagaagaaccagaactcttgaaaaatgtattatttgggagatgttaaatttctgccatcactgtgctgagatgtatgtagtcaatgagaaacagcatccaagataatactggttttcttactactttttttccatctcttgtacatctctatgtctgtatttcatgaaaacctaccttctctaataaaggtgtggtgagctggggacaagacaactctggggatttacctgttatagacaaactctttactttttttctttttgatctggctgccttcttggtgatattactatgagaatgaggagggaattaaggattattgtaaagtgaaatagcagctttgaggtctgaaacactgagggagaagaaggaaaagaagagacatggtaaggattctaaggaggcctgaagatatctgggattcccattctttttgtccacagcatacttaggttggtcaggtgtaagtgaggagagcttgcatagtaagagcagctccagtgtggtattagtagggttaatgattgagtgtgtgatttacagtattggatctaagggtatcatgaagtcagactgtaaccttggacaaactagttaacctctttgggccccagtctctccatctacaaaatgagagtaattaatggtggtattacctcttagggttgttgtcaagattaaatgagctattacaggtaaagtgcttagaaaaacgcctatttgtaatattcatttttactaataactgttattaggagtgggaatagcaatttcagtgagttataaaacattgattatgaaccattttagagaacgatagttgttttattgctaatgtgaacaaaccatactgtatatgaaactttttatggttctccagagaaaccatgtatttttttctgactttgtacctatccttttgcttggatgcctttcttctagaaagttttactgatccttcagggcccatatcaaatgtatcttatcagtgaattgtctctcatccctttcagacagaatgagtttacgccctatcttgggctcccatagcacttatctcgctatgatgcaattctcttctcagatttgtatattctctccttgatggcaatgcagagtcttctcatagtgttaataataacatatgtagcctgtgtatgtgaaacaggtggatgttgctgatacttaattaggaaaggtatagtgattctcatcgtgttcacaagtcagactctccttatacctcaatcactgccgtatcttttaccttgcatatgagacccccagtataagagtgtaataactatctgattcatttgctagtaatgctgaagggaattgttaagctgatctgtttggtttatggaaaagatgtttattcttcctacgccttctcttttttctcctttgcctcctccttttgtccttttccacctcctcttcctccttgtcctcctttttcttccttctctctccctcttctcctttttttggttataattagtttatttaaagctcttgcttatttttgctcatccttaatataaatagatcttcattgtattcgtgacatgttttatcacattcttcatgaaattttaataaacagttgaatattttctattatttatacatatgtgtaatattactcttctcaaatataccattgaatgagtgttttatcttacaatagatggtatccatttttttttgttgtttttttttttttttttttttggagacggagtcttgctgtgtcgtccaggctggagtacacgatcttggctcactgccacctccgcctcccaggttcatgcaattaattctcctgcctcagccacccaagtagctgggattacaggcatatgccaccatacctggctaa

SEQ ID NO: 249 - DNA, 4045 bp, Homo sapiens
aaaccagtctttagcttgacatttgaatttaatcttccatgtattaactaggcatgtacaaaacacatgcttatttattaggcatgcactaactgtactttggttacaggctaaaagactttagagttggttttcaaaatctatttgcttcaaagaatcttagtagtcagtagttaaccaagaaactttaaaaaaatgagccccattttaattttatttacccatctagctattcatttatttgacagatatttatttttgtgcctactatgtacttggcacaatgataaccttttcccagttcttttactctgttattattgtttaaagtttggaaattaaaatactctatattatatgctatattagttaaagctaagcatggtgctgtatcattaaacacaacaataacagccaaataaagttagaacacaccaaatatgttttatttacatgcaaatatttaaaatgatatatttaggtatagtatttaacaacttttatgttcctcacatcagaatttatattctttcaacaagagcctttttaaagataaggattaaattgaccatgcataactttgatgtgattaagctatttgatcttttaaatagaatcattcgattttgctgacacttagcaatagcccattattttagatataatttctttgtgatcatagtaagtttagagtcatagatgactccctcgaggtcttagtagcatattatgaatttggtatctatgtgattaaataagcacaacaaaattcatatcaaattggtcgataaacacatttttaatattgtgccagactatcattattaatttttaaatcaatatgtagtagtatgaccacaatgtcatattcattagtaaagtacagctgttttttatgccatcaggattatttggcatttaagcagtgccttctactttaaatgatgccattatcctttgaggactctgcctatcaatttggtcagtctagaaatgcaactcattatagaatgaagctgaatagttactgaagcagaatacaactttacaacctcttaaaccagaatatgggagaagcccaatttacctttaaaacttttgggtgtctacacagaaaaaggtgttaatgtgccttgtgaaatttctcaatggtgaatacattttttattctatgtgatttatttctggagatgtacattaatctttgtgaagttgctgtggaatttggttgggtttgtcaaaatgtgtcaaaaatgtgaaatatcccagttctactaattttctaacacaaagttagatggacaaagttagatgacaaagaagaagacaaagttagatggactccataggagagaagaggacttaaaaatgatgccttaatatctgcccccattttgaaagtgaaattttgcggataatgtttctattgcagttgagttagaaataaggaagcattttaaaaccaggtggatgattcaacactagaccacccaggaagggcattccttctgtaataggaaaggtctttaaacctggagtaccacatcacatgtaatgtgtaagtgtggatatttctggagctctcccagatatccagtgtgtctgcatgaatgtgtctctctttatcttttttgttaaggatgcaaatggagagttatatattggattcctcttgcatcactttagatgccttctgtttatattgagcctggcttatttggagttagcttgtaaatttaatgagatcattgtgatggccatgattgcagaatggaaaatgtcactactatgtgccagtttgcttaaatcatttttaagtacccacctgtgctgctaaactctccatttgcattttattggctactatgtttttgctccagagcgggttcctttaactctgatgcctgggtaaattaatcggggtgtgcatgccattgcccttttagcttctgctcctgttctaataaaggctccatctgcttaattggtagacttacaggcctttcttatttcaaaaaatcactttgaaaaaaagcatagcttctcaagggaaagaagaaccagaactcttgaaaaatgtattatttgggagatgttaaatttctgccatcactgtgctgagatgtatgtagtcaatgagaaacagcatccaagataatactggttttcttactactttttttccatctcttgtacatctctatgtctgtatttcatgaaaacctaccttctctaataaaggtgtggtgagctggggacaagacaactctggggatttacctgttatagacaaactctttactttttttctttttgatctggctgccttcttggtgatattactatgagaatgaggagggaattaaggattattgtaaagtgaaatagcagctttgaggtctgaaacactgagggagaagaaggaaaagaagagacatggtaaggattctaaggaggcctgaagatatctgggattcccattctttttgtccacagcatacttaggttggtcaggtgtaagtgaggagagcttgcatagtaagagcagctccagtgtggtattagtagggttaatgattgagtgtgtgatttacagtattggatctaagggtatcatgaagtcagactgtaaccttggacaaactagttaacctctttgggccccagtctctccatctacaaaatgagagtaattaatggtggtattacctcttagggttgttgtcaagattaaatgagctattacaggtaaagtgcttagaaaaacgcctatttgtaatattcatttttactaataactgttattaggagtgggaatagcaatttcagtgagttataaaacattgattatgaaccattttagagaacgatagttgttttattgctaatgtgaacaaaccatactgtatatgaaactttttatggttctccagagaaaccatgtatttttttctgactttgtacctatccttttgcttggatgcctttcttctagaaagttttactgatccttcagggcccatatcaaatgtatcttatcagtgaattgtctctcatccctttcagacagaatgagtttacgccctatcttgggctcccatagcacttatctcgctatgatgcaattctcttctcagatttgtatattctctccttgatggcaatgcagagtcttctcatagtgttaataataacatatgtagcctgtgtatgtgaaacaggtggatgttgctgatacttaattaggaaaggtatagtgattctcatcgtgttcacaagtcagactctccttatacctcaatcactgccgtatcttttaccttgcatatgagacccccagtataagagtgtaataactatctgattcatttgctagtaatgctgaagggaattgttaagctgatctgtttggtttatggaaaagatgtttattcttcctacgccttctcttttttctcctttgcctcctccttttgtccttttccacctcctcttcctccttgtcctcctttttcttccttctctctccctcttctcctttttttggttataattagtttatttaaagctcttgcttatttttgctcatccttaatataaatagatcttcattgtattcgtgacatgttttatcacattcttcatgaaattttaataaacagttgaatattttctattatttatacatatgtgtaatattactcttctcaaatataccattgaatgagtgttttatcttacaatagatggtatccatttttttttgttgtttttttttttttttttttttggagacggagtcttgctgtgtcgtccaggctggagtacacgatcttggctcactgccacctccgcctcccaggttcatgcaattaattctcctgcctcagccacccaagtagctgggattacaggcatatgccaccatacctggctaatttttgtatttttattagagatggggttttaccatgttggccaggctggtatctaactcctgaccgcaagtgatctgcctgccttggcctcctgaagtgctgggatt

SEQ ID NO: 250 - DNA, 4048 bp, Homo sapiens
tcaaagaatcttagtagtcagtagttaaccaagaaactttaaaaaaatgagccccattttaattttatttacccatctagctattcatttatttgacagatatttatttttgtgcctactatgtacttggcacaatgataaccttttcccagttcttttactctgttattattgtttaaagtttggaaattaaaatactctatattatatgctatattagttaaagctaagcatggtgctgtatcattaaacacaacaataacagccaaataaagttagaacacaccaaatatgttttatttacatgcaaatatttaaaatgatatatttaggtatagtatttaacaacttttatgttcctcacatcagaatttatattctttcaacaagagcctttttaaagataaggattaaattgaccatgcataactttgatgtgattaagctatttgatcttttaaatagaatcattcgattttgctgacacttagcaatagcccattattttagatataatttctttgtgatcatagtaagtttagagtcatagatgactccctcgaggtcttagtagcatattatgaatttggtatctatgtgattaaataagcacaacaaaattcatatcaaattggtcgataaacacatttttaatattgtgccagactatcattattaatttttaaatcaatatgtagtagtatgaccacaatgtcatattcattagtaaagtacagctgttttttatgccatcaggattatttggcatttaagcagtgccttctactttaaatgatgccattatcctttgaggactctgcctatcaatttggtcagtctagaaatgcaactcattatagaatgaagctgaatagttactgaagcagaatacaactttacaacctcttaaaccagaatatgggagaagcccaatttacctttaaaacttttgggtgtctacacagaaaaaggtgttaatgtgccttgtgaaatttctcaatggtgaatacattttttattctatgtgatttatttctggagatgtacattaatctttgtgaagttgctgtggaatttggttgggtttgtcaaaatgtgtcaaaaatgtgaaatatcccagttctactaattttctaacacaaagttagatggacaaagttagatgacaaagaagaagacaaagttagatggactccataggagagaagaggacttaaaaatgatgccttaatatctgcccccattttgaaagtgaaattttgcggataatgtttctattgcagttgagttagaaataaggaagcattttaaaaccaggtggatgattcaacactagaccacccaggaagggcattccttctgtaataggaaaggtctttaaacctggagtaccacatcacatgtaatgtgtaagtgtggatatttctggagctctcccagatatccagtgtgtctgcatgaatgtgtctctctttatcttttttgttaaggatgcaaatggagagttatatattggattcctcttgcatcactttagatgccttctgtttatattgagcctggcttatttggagttagcttgtaaatttaatgagatcattgtgatggccatgattgcagaatggaaaatgtcactactatgtgccagtttgcttaaatcatttttaagtacccacctgtgctgctaaactctccatttgcattttattggctactatgtttttgctccagagcgggttcctttaactctgatgcctgggtaaattaatcggggtgtgcatgccattgcccttttagcttctgctcctgttctaataaaggctccatctgcttaattggtagacttacaggcctttcttatttcaaaaaatcactttgaaaaaaagcatagcttctcaagggaaagaagaaccagaactcttgaaaaatgtattatttgggagatgttaaatttctgccatcactgtgctgagatgtatgtagtcaatgagaaacagcatccaagataatactggttttcttactactttttttccatctcttgtacatctctatgtctgtatttcatgaaaacctaccttctctaataaaggtgtggtgagctggggacaagacaactctggggatttacctgttatagacaaactctttactttttttctttttgatctggctgccttcttggtgatattactatgagaatgaggagggaattaaggattattgtaaagtgaaatagcagctttgaggtctgaaacactgagggagaagaaggaaaagaagagacatggtaaggattctaaggaggcctgaagatatctgggattcccattctttttgtccacagcatacttaggttggtcaggtgtaagtgaggagagcttgcatagtaagagcagctccagtgtggtattagtagggttaatgattgagtgtgtgatttacagtattggatctaagggtatcatgaagtcagactgtaaccttggacaaactagttaacctctttgggccccagtctctccatctacaaaatgagagtaattaatggtggtattacctcttagggttgttgtcaagattaaatgagctattacaggtaaagtgcttagaaaaacgcctatttgtaatattcatttttactaataactgttattaggagtgggaatagcaatttcagtgagttataaaacattgattatgaaccattttagagaacgatagttgttttattgctaatgtgaacaaaccatactgtatatgaaactttttatggttctccagagaaaccatgtatttttttctgactttgtacctatccttttgcttggatgcctttcttctagaaagttttactgatccttcagggcccatatcaaatgtatcttatcagtgaattgtctctcatccctttcagacagaatgagtttacgccctatcttgggctcccatagcacttatctcgctatgatgcaattctcttctcagatttgtatattctctccttgatggcaatgcagagtcttctcatagtgttaataataacatatgtagcctgtgtatgtgaaacaggtggatgttgctgatacttaattaggaaaggtatagtgattctcatcgtgttcacaagtcagactctccttatacctcaatcactgccgtatcttttaccttgcatatgagacccccagtataagagtgtaataactatctgattcatttgctagtaatgctgaagggaattgttaagctgatctgtttggtttatggaaaagatgtttattcttcctacgccttctcttttttctcctttgcctcctccttttgtccttttccacctcctcttcctccttgtcctcctttttcttccttctctctccctcttctcctttttttggttataattagtttatttaaagctcttgcttatttttgctcatccttaatataaatagatcttcattgtattcgtgacatgttttatcacattcttcatgaaattttaataaacagttgaatattttctattatttatacatatgtgtaatattactcttctcaaatataccattgaatgagtgttttatcttacaatagatggtatccatttttttttgttgtttttttttttttttttttttggagacggagtcttgctgtgtcgtccaggctggagtacacgatcttggctcactgccacctccgcctcccaggttcatgcaattaattctcctgcctcagccacccaagtagctgggattacaggcatatgccaccatacctggctaatttttgtatttttattagagatggggttttaccatgttggccaggctggtatctaactcctgaccgcaagtgatctgcctgccttggcctcctgaagtgctgggattacaggtgtgagccactgtgccaggctggatggtatcttctaatcaagaaaagatataagtatttttatgacatcaaatttaagaataatagccagttatatatttgtgggatcatgtgataagaaaaatatattggtttactattttagatg

SEQ ID NO: 251 - DNA, 4056 bp, Homo sapiens
tttactctgttattattgtttaaagtttggaaattaaaatactctatattatatgctatattagttaaagctaagcatggtgctgtatcattaaacacaacaataacagccaaataaagttagaacacaccaaatatgttttatttacatgcaaatatttaaaatgatatatttaggtatagtatttaacaacttttatgttcctcacatcagaatttatattctttcaacaagagcctttttaaagataaggattaaattgaccatgcataactttgatgtgattaagctatttgatcttttaaatagaatcattcgattttgctgacacttagcaatagcccattattttagatataatttctttgtgatcatagtaagtttagagtcatagatgactccctcgaggtcttagtagcatattatgaatttggtatctatgtgattaaataagcacaacaaaattcatatcaaattggtcgataaacacatttttaatattgtgccagactatcattattaatttttaaatcaatatgtagtagtatgaccacaatgtcatattcattagtaaagtacagctgttttttatgccatcaggattatttggcatttaagcagtgccttctactttaaatgatgccattatcctttgaggactctgcctatcaatttggtcagtctagaaatgcaactcattatagaatgaagctgaatagttactgaagcagaatacaactttacaacctcttaaaccagaatatgggagaagcccaatttacctttaaaacttttgggtgtctacacagaaaaaggtgttaatgtgccttgtgaaatttctcaatggtgaatacattttttattctatgtgatttatttctggagatgtacattaatctttgtgaagttgctgtggaatttggttgggtttgtcaaaatgtgtcaaaaatgtgaaatatcccagttctactaattttctaacacaaagttagatggacaaagttagatgacaaagaagaagacaaagttagatggactccataggagagaagaggacttaaaaatgatgccttaatatctgcccccattttgaaagtgaaattttgcggataatgtttctattgcagttgagttagaaataaggaagcattttaaaaccaggtggatgattcaacactagaccacccaggaagggcattccttctgtaataggaaaggtctttaaacctggagtaccacatcacatgtaatgtgtaagtgtggatatttctggagctctcccagatatccagtgtgtctgcatgaatgtgtctctctttatcttttttgttaaggatgcaaatggagagttatatattggattcctcttgcatcactttagatgccttctgtttatattgagcctggcttatttggagttagcttgtaaatttaatgagatcattgtgatggccatgattgcagaatggaaaatgtcactactatgtgccagtttgcttaaatcatttttaagtacccacctgtgctgctaaactctccatttgcattttattggctactatgtttttgctccagagcgggttcctttaactctgatgcctgggtaaattaatcggggtgtgcatgccattgcccttttagcttctgctcctgttctaataaaggctccatctgcttaattggtagacttacaggcctttcttatttcaaaaaatcactttgaaaaaaagcatagcttctcaagggaaagaagaaccagaactcttgaaaaatgtattatttgggagatgttaaatttctgccatcactgtgctgagatgtatgtagtcaatgagaaacagcatccaagataatactggttttcttactactttttttccatctcttgtacatctctatgtctgtatttcatgaaaacctaccttctctaataaaggtgtggtgagctggggacaagacaactctggggatttacctgttatagacaaactctttactttttttctttttgatctggctgccttcttggtgatattactatgagaatgaggagggaattaaggattattgtaaagtgaaatagcagctttgaggtctgaaacactgagggagaagaaggaaaagaagagacatggtaaggattctaaggaggcctgaagatatctgggattcccattctttttgtccacagcatacttaggttggtcaggtgtaagtgaggagagcttgcatagtaagagcagctccagtgtggtattagtagggttaatgattgagtgtgtgatttacagtattggatctaagggtatcatgaagtcagactgtaaccttggacaaactagttaacctctttgggccccagtctctccatctacaaaatgagagtaattaatggtggtattacctcttagggttgttgtcaagattaaatgagctattacaggtaaagtgcttagaaaaacgcctatttgtaatattcatttttactaataactgttattaggagtgggaatagcaatttcagtgagttataaaacattgattatgaaccattttagagaacgatagttgttttattgctaatgtgaacaaaccatactgtatatgaaactttttatggttctccagagaaaccatgtatttttttctgactttgtacctatccttttgcttggatgcctttcttctagaaagttttactgatccttcagggcccatatcaaatgtatcttatcagtgaattgtctctcatccctttcagacagaatgagtttacgccctatcttgggctcccatagcacttatctcgctatgatgcaattctcttctcagatttgtatattctctccttgatggcaatgcagagtcttctcatagtgttaataataacatatgtagcctgtgtatgtgaaacaggtggatgttgctgatacttaattaggaaaggtatagtgattctcatcgtgttcacaagtcagactctccttatacctcaatcactgccgtatcttttaccttgcatatgagacccccagtataagagtgtaataactatctgattcatttgctagtaatgctgaagggaattgttaagctgatctgtttggtttatggaaaagatgtttattcttcctacgccttctcttttttctcctttgcctcctccttttgtccttttccacctcctcttcctccttgtcctcctttttcttccttctctctccctcttctcctttttttggttataattagtttatttaaagctcttgcttatttttgctcatccttaatataaatagatcttcattgtattcgtgacatgttttatcacattcttcatgaaattttaataaacagttgaatattttctattatttatacatatgtgtaatattactcttctcaaatataccattgaatgagtgttttatcttacaatagatggtatccatttttttttgttgtttttttttttttttttttttggagacggagtcttgctgtgtcgtccaggctggagtacacgatcttggctcactgccacctccgcctcccaggttcatgcaattaattctcctgcctcagccacccaagtagctgggattacaggcatatgccaccatacctggctaatttttgtatttttattagagatggggttttaccatgttggccaggctggtatctaactcctgaccgcaagtgatctgcctgccttggcctcctgaagtgctgggattacaggtgtgagccactgtgccaggctggatggtatcttctaatcaagaaaagatataagtatttttatgacatcaaatttaagaataatagccagttatatatttgtgggatcatgtgataagaaaaatatattggtttactattttagatggaataataatgtgtcttttctgatatctttacaagaatgttagaaatcatctgtattgtaatgttgttttaccttatccaaggggaaataaagcatgaacatttataggcttttatttataaatggacttttaaaatatgttttctcacaaagaggaaatttag

SEQ ID NO: 252 - DNA, 4076 bp, Homo sapiens
tatattagttaaagctaagcatggtgctgtatcattaaacacaacaataacagccaaataaagttagaacacaccaaatatgttttatttacatgcaaatatttaaaatgatatatttaggtatagtatttaacaacttttatgttcctcacatcagaatttatattctttcaacaagagcctttttaaagataaggattaaattgaccatgcataactttgatgtgattaagctatttgatcttttaaatagaatcattcgattttgctgacacttagcaatagcccattattttagatataatttctttgtgatcatagtaagtttagagtcatagatgactccctcgaggtcttagtagcatattatgaatttggtatctatgtgattaaataagcacaacaaaattcatatcaaattggtcgataaacacatttttaatattgtgccagactatcattattaatttttaaatcaatatgtagtagtatgaccacaatgtcatattcattagtaaagtacagctgttttttatgccatcaggattatttggcatttaagcagtgccttctactttaaatgatgccattatcctttgaggactctgcctatcaatttggtcagtctagaaatgcaactcattatagaatgaagctgaatagttactgaagcagaatacaactttacaacctcttaaaccagaatatgggagaagcccaatttacctttaaaacttttgggtgtctacacagaaaaaggtgttaatgtgccttgtgaaatttctcaatggtgaatacattttttattctatgtgatttatttctggagatgtacattaatctttgtgaagttgctgtggaatttggttgggtttgtcaaaatgtgtcaaaaatgtgaaatatcccagttctactaattttctaacacaaagttagatggacaaagttagatgacaaagaagaagacaaagttagatggactccataggagagaagaggacttaaaaatgatgccttaatatctgcccccattttgaaagtgaaattttgcggataatgtttctattgcagttgagttagaaataaggaagcattttaaaaccaggtggatgattcaacactagaccacccaggaagggcattccttctgtaataggaaaggtctttaaacctggagtaccacatcacatgtaatgtgtaagtgtggatatttctggagctctcccagatatccagtgtgtctgcatgaatgtgtctctctttatcttttttgttaaggatgcaaatggagagttatatattggattcctcttgcatcactttagatgccttctgtttatattgagcctggcttatttggagttagcttgtaaatttaatgagatcattgtgatggccatgattgcagaatggaaaatgtcactactatgtgccagtttgcttaaatcatttttaagtacccacctgtgctgctaaactctccatttgcattttattggctactatgtttttgctccagagcgggttcctttaactctgatgcctgggtaaattaatcggggtgtgcatgccattgcccttttagcttctgctcctgttctaataaaggctccatctgcttaattggtagacttacaggcctttcttatttcaaaaaatcactttgaaaaaaagcatagcttctcaagggaaagaagaaccagaactcttgaaaaatgtattatttgggagatgttaaatttctgccatcactgtgctgagatgtatgtagtcaatgagaaacagcatccaagataatactggttttcttactactttttttccatctcttgtacatctctatgtctgtatttcatgaaaacctaccttctctaataaaggtgtggtgagctggggacaagacaactctggggatttacctgttatagacaaactctttactttttttctttttgatctggctgccttcttggtgatattactatgagaatgaggagggaattaaggattattgtaaagtgaaatagcagctttgaggtctgaaacactgagggagaagaaggaaaagaagagacatggtaaggattctaaggaggcctgaagatatctgggattcccattctttttgtccacagcatacttaggttggtcaggtgtaagtgaggagagcttgcatagtaagagcagctccagtgtggtattagtagggttaatgattgagtgtgtgatttacagtattggatctaagggtatcatgaagtcagactgtaaccttggacaaactagttaacctctttgggccccagtctctccatctacaaaatgagagtaattaatggtggtattacctcttagggttgttgtcaagattaaatgagctattacaggtaaagtgcttagaaaaacgcctatttgtaatattcatttttactaataactgttattaggagtgggaatagcaatttcagtgagttataaaacattgattatgaaccattttagagaacgatagttgttttattgctaatgtgaacaaaccatactgtatatgaaactttttatggttctccagagaaaccatgtatttttttctgactttgtacctatccttttgcttggatgcctttcttctagaaagttttactgatccttcagggcccatatcaaatgtatcttatcagtgaattgtctctcatccctttcagacagaatgagtttacgccctatcttgggctcccatagcacttatctcgctatgatgcaattctcttctcagatttgtatattctctccttgatggcaatgcagagtcttctcatagtgttaataataacatatgtagcctgtgtatgtgaaacaggtggatgttgctgatacttaattaggaaaggtatagtgattctcatcgtgttcacaagtcagactctccttatacctcaatcactgccgtatcttttaccttgcatatgagacccccagtataagagtgtaataactatctgattcatttgctagtaatgctgaagggaattgttaagctgatctgtttggtttatggaaaagatgtttattcttcctacgccttctcttttttctcctttgcctcctccttttgtccttttccacctcctcttcctccttgtcctcctttttcttccttctctctccctcttctcctttttttggttataattagtttatttaaagctcttgcttatttttgctcatccttaatataaatagatcttcattgtattcgtgacatgttttatcacattcttcatgaaattttaataaacagttgaatattttctattatttatacatatgtgtaatattactcttctcaaatataccattgaatgagtgttttatcttacaatagatggtatccatttttttttgttgtttttttttttttttttttttggagacggagtcttgctgtgtcgtccaggctggagtacacgatcttggctcactgccacctccgcctcccaggttcatgcaattaattctcctgcctcagccacccaagtagctgggattacaggcatatgccaccatacctggctaatttttgtatttttattagagatggggttttaccatgttggccaggctggtatctaactcctgaccgcaagtgatctgcctgccttggcctcctgaagtgctgggattacaggtgtgagccactgtgccaggctggatggtatcttctaatcaagaaaagatataagtatttttatgacatcaaatttaagaataatagccagttatatatttgtgggatcatgtgataagaaaaatatattggtttactattttagatggaataataatgtgtcttttctgatatctttacaagaatgttagaaatcatctgtattgtaatgttgttttaccttatccaaggggaaataaagcatgaacatttataggcttttatttataaatggacttttaaaatatgttttctcacaaagaggaaatttagctctagaaaacaggaaaggattgtaggaactcccatctgcattggaaagtgactgtcactctcgtattggacaatg

SEQ ID NO: 253 - DNA, 4056 bp, Homo sapiens
tttcaacaagagcctttttaaagataaggattaaattgaccatgcataactttgatgtgattaagctatttgatcttttaaatagaatcattcgattttgctgacacttagcaatagcccattattttagatataatttctttgtgatcatagtaagtttagagtcatagatgactccctcgaggtcttagtagcatattatgaatttggtatctatgtgattaaataagcacaacaaaattcatatcaaattggtcgataaacacatttttaatattgtgccagactatcattattaatttttaaatcaatatgtagtagtatgaccacaatgtcatattcattagtaaagtacagctgttttttatgccatcaggattatttggcatttaagcagtgccttctactttaaatgatgccattatcctttgaggactctgcctatcaatttggtcagtctagaaatgcaactcattatagaatgaagctgaatagttactgaagcagaatacaactttacaacctcttaaaccagaatatgggagaagcccaatttacctttaaaacttttgggtgtctacacagaaaaaggtgttaatgtgccttgtgaaatttctcaatggtgaatacattttttattctatgtgatttatttctggagatgtacattaatctttgtgaagttgctgtggaatttggttgggtttgtcaaaatgtgtcaaaaatgtgaaatatcccagttctactaattttctaacacaaagttagatggacaaagttagatgacaaagaagaagacaaagttagatggactccataggagagaagaggacttaaaaatgatgccttaatatctgcccccattttgaaagtgaaattttgcggataatgtttctattgcagttgagttagaaataaggaagcattttaaaaccaggtggatgattcaacactagaccacccaggaagggcattccttctgtaataggaaaggtctttaaacctggagtaccacatcacatgtaatgtgtaagtgtggatatttctggagctctcccagatatccagtgtgtctgcatgaatgtgtctctctttatcttttttgttaaggatgcaaatggagagttatatattggattcctcttgcatcactttagatgccttctgtttatattgagcctggcttatttggagttagcttgtaaatttaatgagatcattgtgatggccatgattgcagaatggaaaatgtcactactatgtgccagtttgcttaaatcatttttaagtacccacctgtgctgctaaactctccatttgcattttattggctactatgtttttgctccagagcgggttcctttaactctgatgcctgggtaaattaatcggggtgtgcatgccattgcccttttagcttctgctcctgttctaataaaggctccatctgcttaattggtagacttacaggcctttcttatttcaaaaaatcactttgaaaaaaagcatagcttctcaagggaaagaagaaccagaactcttgaaaaatgtattatttgggagatgttaaatttctgccatcactgtgctgagatgtatgtagtcaatgagaaacagcatccaagataatactggttttcttactactttttttccatctcttgtacatctctatgtctgtatttcatgaaaacctaccttctctaataaaggtgtggtgagctggggacaagacaactctggggatttacctgttatagacaaactctttactttttttctttttgatctggctgccttcttggtgatattactatgagaatgaggagggaattaaggattattgtaaagtgaaatagcagctttgaggtctgaaacactgagggagaagaaggaaaagaagagacatggtaaggattctaaggaggcctgaagatatctgggattcccattctttttgtccacagcatacttaggttggtcaggtgtaagtgaggagagcttgcatagtaagagcagctccagtgtggtattagtagggttaatgattgagtgtgtgatttacagtattggatctaagggtatcatgaagtcagactgtaaccttggacaaactagttaacctctttgggccccagtctctccatctacaaaatgagagtaattaatggtggtattacctcttagggttgttgtcaagattaaatgagctattacaggtaaagtgcttagaaaaacgcctatttgtaatattcatttttactaataactgttattaggagtgggaatagcaatttcagtgagttataaaacattgattatgaaccattttagagaacgatagttgttttattgctaatgtgaacaaaccatactgtatatgaaactttttatggttctccagagaaaccatgtatttttttctgactttgtacctatccttttgcttggatgcctttcttctagaaagttttactgatccttcagggcccatatcaaatgtatcttatcagtgaattgtctctcatccctttcagacagaatgagtttacgccctatcttgggctcccatagcacttatctcgctatgatgcaattctcttctcagatttgtatattctctccttgatggcaatgcagagtcttctcatagtgttaataataacatatgtagcctgtgtatgtgaaacaggtggatgttgctgatacttaattaggaaaggtatagtgattctcatcgtgttcacaagtcagactctccttatacctcaatcactgccgtatcttttaccttgcatatgagacccccagtataagagtgtaataactatctgattcatttgctagtaatgctgaagggaattgttaagctgatctgtttggtttatggaaaagatgtttattcttcctacgccttctcttttttctcctttgcctcctccttttgtccttttccacctcctcttcctccttgtcctcctttttcttccttctctctccctcttctcctttttttggttataattagtttatttaaagctcttgcttatttttgctcatccttaatataaatagatcttcattgtattcgtgacatgttttatcacattcttcatgaaattttaataaacagttgaatattttctattatttatacatatgtgtaatattactcttctcaaatataccattgaatgagtgttttatcttacaatagatggtatccatttttttttgttgtttttttttttttttttttttggagacggagtcttgctgtgtcgtccaggctggagtacacgatcttggctcactgccacctccgcctcccaggttcatgcaattaattctcctgcctcagccacccaagtagctgggattacaggcatatgccaccatacctggctaatttttgtatttttattagagatggggttttaccatgttggccaggctggtatctaactcctgaccgcaagtgatctgcctgccttggcctcctgaagtgctgggattacaggtgtgagccactgtgccaggctggatggtatcttctaatcaagaaaagatataagtatttttatgacatcaaatttaagaataatagccagttatatatttgtgggatcatgtgataagaaaaatatattggtttactattttagatggaataataatgtgtcttttctgatatctttacaagaatgttagaaatcatctgtattgtaatgttgttttaccttatccaaggggaaataaagcatgaacatttataggcttttatttataaatggacttttaaaatatgttttctcacaaagaggaaatttagctctagaaaacaggaaaggattgtaggaactcccatctgcattggaaagtgactgtcactctcgtattggacaatgattgttgcagatgatacctgtttcattctggatcacctttgtttttaaaatgagacataactaattaacagaagagcaagattattggcaactccattaatattagtatagagacagtgctagcaacatggcattttaaagaattaca

SEQ ID NO: 254 - DNA, 4045 bp, Homo sapiens
atgatgcaattctcttctcagatttgtatattctctccttgatggcaatgcagagtcttctcatagtgttaataataacatatgtagcctgtgtatgtgaaacaggtggatgttgctgatacttaattaggaaaggtatagtgattctcatcgtgttcacaagtcagactctccttatacctcaatcactgccgtatcttttaccttgcatatgagacccccagtataagagtgtaataactatctgattcatttgctagtaatgctgaagggaattgttaagctgatctgtttggtttatggaaaagatgtttattcttcctacgccttctcttttttctcctttgcctcctccttttgtccttttccacctcctcttcctccttgtcctcctttttcttccttctctctccctcttctcctttttttggttataattagtttatttaaagctcttgcttatttttgctcatccttaatataaatagatcttcattgtattcgtgacatgttttatcacattcttcatgaaattttaataaacagttgaatattttctattatttatacatatgtgtaatattactcttctcaaatataccattgaatgagtgttttatcttacaatagatggtatccatttttttttgttgtttttttttttttttttttttggagacggagtcttgctgtgtcgtccaggctggagtacacgatcttggctcactgccacctccgcctcccaggttcatgcaattaattctcctgcctcagccacccaagtagctgggattacaggcatatgccaccatacctggctaatttttgtatttttattagagatggggttttaccatgttggccaggctggtatctaactcctgaccgcaagtgatctgcctgccttggcctcctgaagtgctgggattacaggtgtgagccactgtgccaggctggatggtatcttctaatcaagaaaagatataagtatttttatgacatcaaatttaagaataatagccagttatatatttgtgggatcatgtgataagaaaaatatattggtttactattttagatggaataataatgtgtcttttctgatatctttacaagaatgttagaaatcatctgtattgtaatgttgttttaccttatccaaggggaaataaagcatgaacatttataggcttttatttataaatggacttttaaaatatgttttctcacaaagaggaaatttagctctagaaaacaggaaaggattgtaggaactcccatctgcattggaaagtgactgtcactctcgtattggacaatgattgttgcagatgatacctgtttcattctggatcacctttgtttttaaaatgagacataactaattaacagaagagcaagattattggcaactccattaatattagtatagagacagtgctagcaacatggcattttaaagaattacagtggcagttctcccaatcagccagatttcttccagaaaattataaaggaatctcctagataaacttattttcccactggtgttactttatcagcctaagtagtagctctgtaaatagaggactgaacacttgagtttgggtcctgattttgtaattagctgtgtgaattggatcaagtcgtttagattctctgggcctcaatttcttcatctgtaatatgagaaaggtcgaaataattgatttagcaatatattttatcaatcagaaatattagtgatgtcagtgaagcttgtgtatataaattcattttttcaatcatttaaggaacttagatataaaatacacctttaattcacctttggaaattttttacaaagtgttttatttgcaaatgacagtgatagtaagagttaatgtttaaggctattttgtaaatgactttaaatgattctaagtacttgttactcttaactacgctgtttcattcatacattgaaatagatcccctttggaacactggggaagattgaagattgcttttaatttcattatggcacacagaatttagtgaagaaaaatggtagtcctctttcagatagattactaagtcagctgtttggaagtcttggtgtaaaaatgtcttagagctttgcaagttacagagatagaaaatgtatttaattttaatatttctaattcactatttgctttgttagtatttagatttcagtgcttaaaaaattattcacgggattttttcccttcattcaacaacaggttctatagcacatcttgggaaaattatcctgcattggtaggggactgaaagacaggaagatgaaaaatacatgatacctttaataatttttgaattttgaattttggaattttagagggcagataaaactatatctctggggcaataaaagaagacaagtagaagaaagtaatcattgagagagaggaacaaagtcttacagtaattcagatttgggagattatttctatttgggaaaattggccaccaggtagatgttttatgctgggttcctaaaggtagaaatggtgggaaagaaagaaaatgacattgagggcagaggggacagcttgattagtggcttgggaatgggatgaagccagtgttgccaagtagtgtctgttaaaaggagcatattgggaaaatgaggacagaaaggtaaaattaggtcagataatacaggattttgagttcttgtcaaagaatatgaacttgagtctagatttgagtatattactgaaggtttttgagcaagggagggcattactgtgctttagaaagattaatctggccacaatttataatgtaatacagaaaagtaataggtggaaagaagagggagaccaggcacgacgacagtaagagcttagacaagagtcagccaacaaccgaagaatggaaatgtcactgaaaatggaaaagcagaagtagatgtgggcagtttgaattggtagaaaatagccactgatacctggttatcatgggtgtgcgagaggggagggaacatttggagatacttccaaaatttcagttcagaagatcagaagggtggccgggggccattaccaggaagagtgaagtgagggtaaggttgactggggctgggcagaaggggcaatgggaaggagatgaggagttttcggcttcattgacatcctggcagctaagtcagctctccagctagaaatgtgcagcaggcagtggtgatacagtactaagataggataggaagtcaggtctttacgagagcatttcagtaaatagccttaggaacttagattaaaaatcaatgcttgatgaggcagtgagtctagatcgtttttgacagtgaaatcaaataccatgaatacgttgagggagtaatgagacagagatttctttttagaaaagagagcggaatgtgttttctctgagggcagagtcagaagagaggacaagatgaccattataacagaggaaaatagtgcttctgaaattccatttcactttccacagcagtggctaaaattgaaattaaggcactctaatggctactaacattgaattattggattggcaataaaggccctaatgaagtactttcattaggaagaaaatatccacacgtctggaagaaatagtgtgatgccccctgtaaagaaaccagtgaatgtaacgtttcaaatatggagcagccacagcagacttctgtaattctaggtcaacaatgaattaatagaatcagtttcttgttaaaataactgtcttttgccttcatcaatattttagatacccttactggctacctgtcttatggaaagctatgtaattatactattttgagttggatttttatggtttatgctttccatggaaatttgatgggataatctgtttgtgaggtatttatctgcatatttgattccttaacttacctgcgacttcttgactttgttggttttcagaattaaaaacttgaaagaattttgtttattttggcatgtaaagaatactggtctaaaatcacaaccattagaattcatttagatttttcaaagga

SEQ ID NO: 255 - DNA, 4047 bp, Homo sapiens
cattgtattcgtgacatgttttatcacattcttcatgaaattttaataaacagttgaatattttctattatttatacatatgtgtaatattactcttctcaaatataccattgaatgagtgttttatcttacaatagatggtatccatttttttttgttgtttttttttttttttttttttggagacggagtcttgctgtgtcgtccaggctggagtacacgatcttggctcactgccacctccgcctcccaggttcatgcaattaattctcctgcctcagccacccaagtagctgggattacaggcatatgccaccatacctggctaatttttgtatttttattagagatggggttttaccatgttggccaggctggtatctaactcctgaccgcaagtgatctgcctgccttggcctcctgaagtgctgggattacaggtgtgagccactgtgccaggctggatggtatcttctaatcaagaaaagatataagtatttttatgacatcaaatttaagaataatagccagttatatatttgtgggatcatgtgataagaaaaatatattggtttactattttagatggaataataatgtgtcttttctgatatctttacaagaatgttagaaatcatctgtattgtaatgttgttttaccttatccaaggggaaataaagcatgaacatttataggcttttatttataaatggacttttaaaatatgttttctcacaaagaggaaatttagctctagaaaacaggaaaggattgtaggaactcccatctgcattggaaagtgactgtcactctcgtattggacaatgattgttgcagatgatacctgtttcattctggatcacctttgtttttaaaatgagacataactaattaacagaagagcaagattattggcaactccattaatattagtatagagacagtgctagcaacatggcattttaaagaattacagtggcagttctcccaatcagccagatttcttccagaaaattataaaggaatctcctagataaacttattttcccactggtgttactttatcagcctaagtagtagctctgtaaatagaggactgaacacttgagtttgggtcctgattttgtaattagctgtgtgaattggatcaagtcgtttagattctctgggcctcaatttcttcatctgtaatatgagaaaggtcgaaataattgatttagcaatatattttatcaatcagaaatattagtgatgtcagtgaagcttgtgtatataaattcattttttcaatcatttaaggaacttagatataaaatacacctttaattcacctttggaaattttttacaaagtgttttatttgcaaatgacagtgatagtaagagttaatgtttaaggctattttgtaaatgactttaaatgattctaagtacttgttactcttaactacgctgtttcattcatacattgaaatagatcccctttggaacactggggaagattgaagattgcttttaatttcattatggcacacagaatttagtgaagaaaaatggtagtcctctttcagatagattactaagtcagctgtttggaagtcttggtgtaaaaatgtcttagagctttgcaagttacagagatagaaaatgtatttaattttaatatttctaattcactatttgctttgttagtatttagatttcagtgcttaaaaaattattcacgggattttttcccttcattcaacaacaggttctatagcacatcttgggaaaattatcctgcattggtaggggactgaaagacaggaagatgaaaaatacatgatacctttaataatttttgaattttgaattttggaattttagagggcagataaaactatatctctggggcaataaaagaagacaagtagaagaaagtaatcattgagagagaggaacaaagtcttacagtaattcagatttgggagattatttctatttgggaaaattggccaccaggtagatgttttatgctgggttcctaaaggtagaaatggtgggaaagaaagaaaatgacattgagggcagaggggacagcttgattagtggcttgggaatgggatgaagccagtgttgccaagtagtgtctgttaaaaggagcatattgggaaaatgaggacagaaaggtaaaattaggtcagataatacaggattttgagttcttgtcaaagaatatgaacttgagtctagatttgagtatattactgaaggtttttgagcaagggagggcattactgtgctttagaaagattaatctggccacaatttataatgtaatacagaaaagtaataggtggaaagaagagggagaccaggcacgacgacagtaagagcttagacaagagtcagccaacaaccgaagaatggaaatgtcactgaaaatggaaaagcagaagtagatgtgggcagtttgaattggtagaaaatagccactgatacctggttatcatgggtgtgcgagaggggagggaacatttggagatacttccaaaatttcagttcagaagatcagaagggtggccgggggccattaccaggaagagtgaagtgagggtaaggttgactggggctgggcagaaggggcaatgggaaggagatgaggagttttcggcttcattgacatcctggcagctaagtcagctctccagctagaaatgtgcagcaggcagtggtgatacagtactaagataggataggaagtcaggtctttacgagagcatttcagtaaatagccttaggaacttagattaaaaatcaatgcttgatgaggcagtgagtctagatcgtttttgacagtgaaatcaaataccatgaatacgttgagggagtaatgagacagagatttctttttagaaaagagagcggaatgtgttttctctgagggcagagtcagaagagaggacaagatgaccattataacagaggaaaatagtgcttctgaaattccatttcactttccacagcagtggctaaaattgaaattaaggcactctaatggctactaacattgaattattggattggcaataaaggccctaatgaagtactttcattaggaagaaaatatccacacgtctggaagaaatagtgtgatgccccctgtaaagaaaccagtgaatgtaacgtttcaaatatggagcagccacagcagacttctgtaattctaggtcaacaatgaattaatagaatcagtttcttgttaaaataactgtcttttgccttcatcaatattttagatacccttactggctacctgtcttatggaaagctatgtaattatactattttgagttggatttttatggtttatgctttccatggaaatttgatgggataatctgtttgtgaggtatttatctgcatatttgattccttaacttacctgcgacttcttgactttgttggttttcagaattaaaaacttgaaagaattttgtttattttggcatgtaaagaatactggtctaaaatcacaaccattagaattcatttagatttttcaaaggaagtggttgaaaagccggaggactgagataaattggtgccatgttcagtgagaagctggcaaatttatgaaggaatgtgctaatgcaaatacttatgaattgatttgctctacatattttccctagggccccttagtcctctattacttattagaatctttaccttctgtaccacagaagtaaacctaaagcacagccttactaagattgtttttgctttcatggggccagttgaatatatttcatcttccttttatgtgacaaaaataattgagaaacatcaaatgatgtttaattgttttgaaaacataaacaaaactggagattttataaagccttgttctaagcttgaaaagaaggaaaaaaaatcagtttctggctgaaaagtttctgttgacactggaccgatcaaacagttttctttcagacaatatttctatagctgtatcacagaaattaggggctgacagtgaccagtagtttattttcattgcct

SEQ ID NO: 256 - DNA, 4069 bp, Homo sapiens
catttccttctgtgtttttttttttttttttttttgaggtggagtctcgctctgtcacccaggctagagtgcagtggcatgatctcagcttactgcaacgtccgtctcccgggttcaagcgattctcctgcctcagcctcctgagtagctgggattatgggtgtacaacaccactcccggctaattttttgtagttttagtagagacggggtttcaccatgtcggtcaggctggtctcgaactcctgacctcgtgatccacccgcctcggcctcccaaagtgctgggattacaggcgtgagtcaccttgcctggccaattttcttcttttttaaggctaattattatgcatatatcacattttgcttatctctttatcatctatgggtacttgggttttgacttcttggctattgtgaataatgctgctatgaacattggtgtacaagtatccgttttagtctctgctttcatttctttggggtctatataaacatgacgttttaatcagatattttattcacctctcaaagctcttgttccagtgttcacttcctttgaaaaatctgtatgaatatagtattcttttattattgtactcctgagaggagggtgttagccccttttttttgaaatgtgtgcagaactccagtgcttaaaacttccaccagaaaccattggtttctatcccacaagaattccactgaaatgcttctctttggaagccctactgagctgtttaaactgtgtttctttagaacttccaacattttcagcttttccttgactttttctctaatagacatgctttagttaaagctccttcattctgagttgttctgtgaactagatttcatggtttactaactcatatcctaaatagaatcatccaaaagaacgcatagaaacattctgttgattccattttggttggtatgtgactattaagggttcttacagtatggtgaatctcagattcctcagggggctccctgaggctgaggatgatagatctgacgattcacaactctcatctctttgggatacattggtcattgttacagagttaaactgcccgggcagataggaggttctggagttgagggctggtttaactgatcagggcatttaacctgtgtggcattggacctgtaaaatatgacaaatctttgggctggaggaataaggttctgcaactgttaaatttgattaatgattaccctgtgtatggaaaattgattattacattggtagctctctttatgaaattttcttttattctgagcatggccaatagcagtacttatccacattcttgaaaatctttccctttgactgtgacatacaaatcttcattgcttaccttgaatcttaatatcatgcgtgagcaaagtgttagcatatttgcttatttgctcttacttatttttcagaaggtgctacatagtttaaaaaaaaaaagcaaaaaggatgtgtagtaaaaaatctagtgtactgcgtcctaaatgacgcatcatgaccatagactgtcaccgcccttgcaagaggcagccaccgatgccagtttcttgtgtgctcttccagagatacttgctgtattgtcttttattttaaagtgtggcatacatacaggaaagtatgtaaaacatacatggacagcatgaagaatcataattaaaacaatcactattccaagttattgctgatccttagaagctgtctgtgcctccttgatcagatcccccttcttctctcaaaaagtaacctctattctgagtcttgtgattccatgtccagcaaggaagcagggatgttgcatcctaaatgcctaagtgtttaagtctagagactaattcctttaagcattgttggattgttcctggtgcttttgaactccaatgtagatgttgtcatgtaatcactgtgctcctcatctgagctgaaactttgcttctgctttagccatggcatgatttagatatgtgaaagataattccatctcctttgtaatttaatttatttgtgtcattttaggcatattgcatacctgctaatgtagaatggagatctagaatatggaagacagtttaaaacattttaaagcattcaaatgtggcattctggccgggcgtagtggctcacgcctgtaatcccagcactttgggaggctgaagcaggcggatcatgaggtcaggagattgagaccatcctggctaacatggtgaaaccccatctctactaaaaatacaaaaaaaaattagccaggcgtggtggtgggtgcctgtagtcccagctactcgggaggctgaggcaggagaatggcatgaacccaggaggcggagcttgcagtgagccgagatctcgccactgcactccagcctgggtgacagagcgagactccatctcaaaaaataaataaaaaatgaagtggcattctgattgggagttactaagcatatatattataggaaggattaacactcaaaaggagagcttagtcttgttaattttcatgctttgctgagggcctgtgtattagcctgttctcaccctgctaataaagacatacctgacactgggtgatttataaaggaaagaggtttaattaactcacagttccacatggctggggaggcctcacaatcgtggtggaaggcaaaggaggagcaaagtcacgtcttgcatggcggtgggccagagagtgtgtgaggggaactccccttcataaaaccatcagatctcgtgagacttattcactattatgagagcagcatgggaaaaacctttccccctgattcagttacctcccacaatacgtggggattattacaattcaaggtgagatttggatggggacacagagccaaaccatatcatcctgatacaaaacaggtcattaataaatatttattgaatagaattgagctggagagtttgttatatgcatatttaagttactctgcataccattaatatgtttcctcggtttgtagtcctgaagattaggcttgagttcagtatttatctgcttatgtgtcctgtgctgcaactgtcaccctccttgtccctcattcagccctgctctttcacaataaccaccccaagaagacttttcagatttttttttcatctgcatgtaaaaaaaagaagaagaaagaagatacttttattattttggttttggttcttctctcttccctgctttgccttcccttcatacatgcagtggtattagcggtcatgtcccctgaccttggttgaggcaaagcagagggtgtcatatcagttgcagtggaaagatccttctctgtccttgtctgtagctgaacctgctaagtgatattcccttctagtatgaggatggagtacaagtttttgaggttgcattgctgaaggtaaaaccaaaagagagagagagagaaagagagagtgagtgtgtgtgtgtgagagagagaggtgtgtgtgtgtgtgtgtgtgtgtgtgtgtgtgtaactattcttttgaagatgacttggaactattcctaagtaacctcctgtctggcattcactaatttcacctggccaactccagcaatgctgatcttaggatatcttattgtatagcttatattccaaatattggaggaaagagagggagtttggaaagaagttttagtttagagagctcttaaagtactcttggctcatcattctttaaattccaaaaatgactaatttgtggggatacataattaaggaagaaaaggttttgtgagggaaaggagtagcagggagtgctgagagcttggcgtatgtattggaaaattgtggtaacttaacaggtaatcaaggatgttgagagaggtgcttgtcatcatttcaaaagagcgtagaatattttatttcattttgtctactgtggatcggttctcctctcatttacttcttttcacatttcatatttgggagggctttgggctctatcttctatttccttctattaaaaaaagttttataagttattccacttggcattcggaacacaataatgtcatacttcactgaggcatactaatgctctggaaagaa

SEQ ID NO: 257 - DNA, 4055 bp, Homo sapiens
aacaatcactattccaagttattgctgatccttagaagctgtctgtgcctccttgatcagatcccccttcttctctcaaaaagtaacctctattctgagtcttgtgattccatgtccagcaaggaagcagggatgttgcatcctaaatgcctaagtgtttaagtctagagactaattcctttaagcattgttggattgttcctggtgcttttgaactccaatgtagatgttgtcatgtaatcactgtgctcctcatctgagctgaaactttgcttctgctttagccatggcatgatttagatatgtgaaagataattccatctcctttgtaatttaatttatttgtgtcattttaggcatattgcatacctgctaatgtagaatggagatctagaatatggaagacagtttaaaacattttaaagcattcaaatgtggcattctggccgggcgtagtggctcacgcctgtaatcccagcactttgggaggctgaagcaggcggatcatgaggtcaggagattgagaccatcctggctaacatggtgaaaccccatctctactaaaaatacaaaaaaaaattagccaggcgtggtggtgggtgcctgtagtcccagctactcgggaggctgaggcaggagaatggcatgaacccaggaggcggagcttgcagtgagccgagatctcgccactgcactccagcctgggtgacagagcgagactccatctcaaaaaataaataaaaaatgaagtggcattctgattgggagttactaagcatatatattataggaaggattaacactcaaaaggagagcttagtcttgttaattttcatgctttgctgagggcctgtgtattagcctgttctcaccctgctaataaagacatacctgacactgggtgatttataaaggaaagaggtttaattaactcacagttccacatggctggggaggcctcacaatcgtggtggaaggcaaaggaggagcaaagtcacgtcttgcatggcggtgggccagagagtgtgtgaggggaactccccttcataaaaccatcagatctcgtgagacttattcactattatgagagcagcatgggaaaaacctttccccctgattcagttacctcccacaatacgtggggattattacaattcaaggtgagatttggatggggacacagagccaaaccatatcatcctgatacaaaacaggtcattaataaatatttattgaatagaattgagctggagagtttgttatatgcatatttaagttactctgcataccattaatatgtttcctcggtttgtagtcctgaagattaggcttgagttcagtatttatctgcttatgtgtcctgtgctgcaactgtcaccctccttgtccctcattcagccctgctctttcacaataaccaccccaagaagacttttcagatttttttttcatctgcatgtaaaaaaaagaagaagaaagaagatacttttattattttggttttggttcttctctcttccctgctttgccttcccttcatacatgcagtggtattagcggtcatgtcccctgaccttggttgaggcaaagcagagggtgtcatatcagttgcagtggaaagatccttctctgtccttgtctgtagctgaacctgctaagtgatattcccttctagtatgaggatggagtacaagtttttgaggttgcattgctgaaggtaaaaccaaaagagagagagagagaaagagagagtgagtgtgtgtgtgtgagagagagaggtgtgtgtgtgtgtgtgtgtgtgtgtgtgtgtgtaactattcttttgaagatgacttggaactattcctaagtaacctcctgtctggcattcactaatttcacctggccaactccagcaatgctgatcttaggatatcttattgtatagcttatattccaaatattggaggaaagagagggagtttggaaagaagttttagtttagagagctcttaaagtactcttggctcatcattctttaaattccaaaaatgactaatttgtggggatacataattaaggaagaaaaggttttgtgagggaaaggagtagcagggagtgctgagagcttggcgtatgtattggaaaattgtggtaacttaacaggtaatcaaggatgttgagagaggtgcttgtcatcatttcaaaagagcgtagaatattttatttcattttgtctactgtggatcggttctcctctcatttacttcttttcacatttcatatttgggagggctttgggctctatcttctatttccttctattaaaaaaagttttataagttattccacttggcattcggaacacaataatgtcatacttcactgaggcatactaatgctctggaaagaaagaaaaagaaggaaaattaatttagagggaatggaggctaaattttccatggtgaagaaattctgaccttttctgagttatcgtaaaagactgacattgctaccctttggatgttaagaaaaagtctttcagataccttggcttgtaagggacctgggaagcgccagggtccatcaaaaatgtaaagacatttattagaacatgcatatccgaaagctttctgaattctgtggggaccatctagcttttacatgatcttgagggaaccaaagttgtactgagaaaacccagtttcctcttaattccatcctatgtgaaaacaacttaagtctcaactgcactaagttatgaaaatggatcctctttttttaacatttggtttttggttattcatattgtctatattctgttctataattgtatccaagtgttaaaatatattttataaatatactgacactgaaaaagaaatcaaaagctgagaaacgtttgtgaatatggctggagagtctcagtaagatgggggacatctcctcaaattgaagatctgggaagtaagtaatagaaacttacagacagattgaggtgcagttttttttctacttttttttcctgaaaatttcagaaatatgagaagtgaaataatagcaaacatgactcagacctttataaattgtctttcttgacagcagagatgtacaattttgtaaaatattgtcctcagtcttgaactgcagaaactcctttctctgatacctgcggtcttatttaatttttacatcttaacagcaagagcatacccgtgatttgttttcacaaatgttagaaatactgtgtaagaatagacttatttttatattgtaaacttttactttttttttttttttgagactgagttttgctcttgttgcctaggctggagtgcaatggcaagatcttggctcactgcaacctccgcctcccgggttcaagcgattctcctgcctcattctctcaagtagctgggattataggcatgcaccaccatgcctggctaattttgtatttttagtagagacagggtttctccatgttggtcaggctggtcttgaactctcaacctcaggtgatctgcccgctttggcctcccaaagtgctgggattacaggcatgagccaccatgcctggcccaacttttacctttttaaagtatgtttttaaacaaccaataatatttggcataatttagtattttgccagtgcttcattgcttatgtgcaatgaggcatttaacaaaataaattggacatatatatttataattattttacctattccgtcagatagtacatttcttaaggagtaaggaaacttgaaatataactcactacttctcctttttttttttttttttcctgagacggagtcttgctctgtcacccaggctgaagtgcaatggcgcgatctcggcgcactgcaagctccgcctcccgggttcacgccattctcctgcctcagcctcctgagtagctgggactacaggcacctgcaaccacgcccggctaatattttgtattttttttagtaaagacggcgtttcaccgttttagccagaatgatctcgatctcctgacgtcgtgatccgcccgccttggcctcccaaagtgctgggattacaggcgtg

SEQ ID NO: 258 - DNA, 4046 bp, Homo sapiens
agaggtgcttgtcatcatttcaaaagagcgtagaatattttatttcattttgtctactgtggatcggttctcctctcatttacttcttttcacatttcatatttgggagggctttgggctctatcttctatttccttctattaaaaaaagttttataagttattccacttggcattcggaacacaataatgtcatacttcactgaggcatactaatgctctggaaagaaagaaaaagaaggaaaattaatttagagggaatggaggctaaattttccatggtgaagaaattctgaccttttctgagttatcgtaaaagactgacattgctaccctttggatgttaagaaaaagtctttcagataccttggcttgtaagggacctgggaagcgccagggtccatcaaaaatgtaaagacatttattagaacatgcatatccgaaagctttctgaattctgtggggaccatctagcttttacatgatcttgagggaaccaaagttgtactgagaaaacccagtttcctcttaattccatcctatgtgaaaacaacttaagtctcaactgcactaagttatgaaaatggatcctctttttttaacatttggtttttggttattcatattgtctatattctgttctataattgtatccaagtgttaaaatatattttataaatatactgacactgaaaaagaaatcaaaagctgagaaacgtttgtgaatatggctggagagtctcagtaagatgggggacatctcctcaaattgaagatctgggaagtaagtaatagaaacttacagacagattgaggtgcagttttttttctacttttttttcctgaaaatttcagaaatatgagaagtgaaataatagcaaacatgactcagacctttataaattgtctttcttgacagcagagatgtacaattttgtaaaatattgtcctcagtcttgaactgcagaaactcctttctctgatacctgcggtcttatttaatttttacatcttaacagcaagagcatacccgtgatttgttttcacaaatgttagaaatactgtgtaagaatagacttatttttatattgtaaacttttactttttttttttttttgagactgagttttgctcttgttgcctaggctggagtgcaatggcaagatcttggctcactgcaacctccgcctcccgggttcaagcgattctcctgcctcattctctcaagtagctgggattataggcatgcaccaccatgcctggctaattttgtatttttagtagagacagggtttctccatgttggtcaggctggtcttgaactctcaacctcaggtgatctgcccgctttggcctcccaaagtgctgggattacaggcatgagccaccatgcctggcccaacttttacctttttaaagtatgtttttaaacaaccaataatatttggcataatttagtattttgccagtgcttcattgcttatgtgcaatgaggcatttaacaaaataaattggacatatatatttataattattttacctattccgtcagatagtacatttcttaaggagtaaggaaacttgaaatataactcactacttctcctttttttttttttttttcctgagacggagtcttgctctgtcacccaggctgaagtgcaatggcgcgatctcggcgcactgcaagctccgcctcccgggttcacgccattctcctgcctcagcctcctgagtagctgggactacaggcacctgcaaccacgcccggctaatattttgtattttttttagtaaagacggcgtttcaccgttttagccagaatgatctcgatctcctgacgtcgtgatccgcccgccttggcctcccaaagtgctgggattacaggcgtgagccaccgcgcccggcctgcttctccattttgttcacaaaatattttttcctcagaagtgtggcattgaatgatgtattgttttgtagtgagtacattatctcagtgaacacacaatttctttcagatagtcaccagagtagtcatcaaaaggaaaagcaatctaagtaccatttaatgggctgcactacactaatattctatttgatgaattaactgcatgtttttagttatctgttagactagttttcattcttttccttcccttcggtatgataaattcttttaaaatggttttattcaatcccaggaaactgaaaatacttgaaaaaataatattttgcaatttgtcagaaaatatttcctcactacttgactggtaatctcaagcatgattagtatagtgtttcctatgagctagaaggtttttggattagatgtgcaggaataggcattctgcctgcttttaaatgtctagctgcacagctgagcaaaaaagcccaacctggcagtcagaacaggctgcccaggggaactcctattgttcagccccattcaggcaaactataagatcacgcatagtgtccgagccggtgctggtgcctagtgagaacatggacagtccaggcatgggatgtgtggatatgctgccttcgcagtgatcaagaattcaggattttagagcccagtaaatagctcatgagaacttgggtttagaaaatctgaactgctgggccaccctgaagtatcttgaattgaggagcttgggtgaagaagtcctggtatcagttgggggcccttcagatgagctgccaccttgtgactgtccgtcagggtcatcttttggccatccctggttagcgttgccatgtgggtgacaactaggagactttacttgaatgttcccacagatgcatggctgggatggcgtaagttcttttctgtttctggcagcaatggctcaggattagggtttatgaggttaagattaacggagacaatagaagagaatcttgacttgataatatgttttttattttgtaaaagctttgttgcaatataattcatattccaagtaatgtacccattgaaattgtgcatttcagtggtatttagtgtatttatagagctgtacaaccatcaccaccctgtagctattatctccgcatccctacttctccctagctgctggaaaccttgggtctactttctgtttgccattctgagtatttcatataaatagaatcctacagtttatagtgctttaatgactgtcttttttcacttaggatcatgtgtttaaggtttgttcatgttgtagcttttgtggtactttcctttctcttcattgataaataatattccactgtgtggataggctacattttgtttgtccactcatcagtcgatgggcatttgggttgtttccatattttggctattccgaataatgctgctatgaacatttatgtgcaagtttttgtgtggttttattcctcttgagtagaactgctaggcctgttaatatgtttttagtcttttgtgtatatatgggaatattgtcacctagtatgaaatggtttttaaaggcaatcaacaatctaaaacctccagttatttgtgtgtttttttttttttttttttttggagacatgagacagggttttactgtgtcacccaggctagagtccaagtagtatgatctgggctcactacagccttgacctcctgggctcaagcgatcctcccacctctgcctactaagtagctgggaccacaggcacacaccaccacctctggctaattttcctattatttgtagatacagggtttcgccacattaccaaggctgctctccaactctgaggcttcagtgatttgcccaccttggcctcccaaagtgctagaattaagggcgtgagccaccatgcccagcctgcaatgtccttttctgaattcatagacttctcagtattacttagcagctagcctttttttttctttttttttttttttcttttcttttttttttttttttttttttgagagggagtcttactttgttacccaggctggagtgcagtgacacgatatcagctcactgcaacttctgcctctcgggttcatgagatcctcccacctcagcctcctgagt

SEQ ID NO: 259 - DNA, 4044 bp, Homo sapiens
aattataattgcctacgatagcctccactttctgatttaatgttcttctttttctgaatttttaaaaaaatctttttaaaaagttttattatggcttctttacgtgagccttttaaacaacttgagtgaataggaggattcaggaattatggctcatagaagagacatatttaaccttatgcatcagacattgttagacactacgctgtatttgtatagcttcagtgtttggtagctctagatatcaagatagtatttaggaaattttcttttccaacatgttagttagttctgaaataccccaaatggttaatgtagtttataaactccgaaaagctttttatctaatgagagcactgttttaaaaaaaccactaatgattttctagttgaaacatttgaaacaattttgaagtacaggggacttttctttaaaacagtgctcattatactcggaagataagctcttgagcatctgtcatccttgttgatgtattcatactgtttttattctttgaaatgtatttaaatagaaaaaatagttcatgttttttgtcattctttcagactgcagtgttttgttttgaatgtggtgaaattggttttattcctcttgggactgcttatctctagggcctggatgcttcctttaaatagggattcacaggtagtaaatcattagaatttttgtttaacagtgaaagaagtcacttaacataggtctgtcatagttctgtctttgtcactgtatgtagaatttcatagtgatacaacatccattttcttagcaaaaagttaggtctagggtatatctgtttggaaaattacatcagaattgattttcaattaatcaaagttactaaatagtgctctgagttaccagtggtatttaaaattaattttggaagttgcacacatactttatgtgtattttctttttcttgtatgagagaatgatatatattaaattgtagttattgcttataatccttttagaaggcaatggggctactcaaggaggctgaggtgggaggatcgcttgaggccaggaattcaagaccagcatgagcaacataacgagaccccgatctctaagaaattttttaaaaaaagttagtcaggaatggctcatgcctgtagtcctagctacctgggtggctgaggtgggaggattgcccaggacttcaaggctgcagtgaactatgatcttgccactgcactccagcctaagggacagaatgagactttgtttctaaaaaataaaataaaataataaaaataaaagaaaaggaaggcaatgatgttctgcatcagtgacaacagcatgggcattgccaagatctttgatgaccttactgcttacctctccccagattttacataattttatcttcctgtcccattgtacactgacaatactctccttcaagtgtcctcacctcttgatttgtcatatactcttaattttattgctacatttggccatttttttcactttttttctttgttcactttcctttgctccatacttaactaattttccagatttctgtccttaaatctctttcattttcactggatatactcttcccaggcttcccaggcttctgtaacaatctatttgctttgtctccatcccataactctccctgagctctaaattattatatgcaactgctcactggacatacaagttcgtgattcaacagaccctttaaaactcaaatctgtttcccttagtatattcccttgtttgttaatcttgctcagttacccaagccagaaatttaggtatcattcttgaatacattgtttctcttcctttccacacccgatcaatcaaatacacagtcttattgcttcttactttttttttttcttatcttattgcttttattttcagtatttttttgaatcatgaagctgtataaacagacaaggtgatctgtgttgtgttagggctgtctgtgccatgttgctgtgggagtttctatatggaagaggggcattaacaaagctttgaaatgccaaagcagactttccagggaagagcgtctgcagataattctgaagaatgtgttgatagtatcttggccacagggccatgaggcattatcaggggcaggagagagggaggctattcccaggaaaggctccagcatgtgccagagatgatgcagacaacattaagatttgaaaaaatggcccagtgaacaaagtgtttttggttttgagagagagagagattgagagacagagagagagagagaaaccaagggatcatgatagttatagtcaaatagaggaaggattatcttttgaaaatgtgttggttctgtgatacaagaggaagctaagacatatcgtggaaacatctcccccctccaccttaatatcaagaacaaattgtggaatctaatgttaatgagaagtagttccccactgtgtcagatgcgcaaagagaaattggaatatacttatcaagtatattatagatggaattgaattattgtaaagagtagattagagaggaccgccaaagtccagtcccaaacatgatacattaagtgtatcccttagtataataccaaggaaccccaaaagctttacagtgtctaaactctattttacgtcttcctaaactgatatcgtacattcaatttatatatttctgtactaagatcatgaatttagagtttattgagaaattgccagaaaaaaatgtgttaagtttttatcccttaaagagtatctcataacttacagatttgagcagggaggtatataatcaggagtacagtttatgtttgtttattcaaagctctgatctcatgaaaattgctatataaatgcttgttttaacaactgttattattaggggtttgtatgaaagtctgccaacttggtcccaatatttatattataaattaaaatgttttgaaaagaactgcttctcaactgtgatcctcattgtttttgaaacctaaaatatactaatttttaatttttgtagttgaaatagtttttaatgccagcagtcttttggttatcagtttcatttgaagaccagaagttcctgaacaaagaatatttatttcagattaataagtaaataaagtgaaataaaagatttttttcctttgaaattgaggaagatcagttattagtagtacaaactgtgcactagattgtatcttagggttcctaactcattcttaccaatgataataactctgaacccaagaatatctgagacagttctcaattaatttaaaaagtttattttgccagggttaaggatgcacctatgacacagcctcaggaggtcctgaggacatgtacccaaggtagttggggtacagcctgcttttatacattttagggagacataatacatcaatcaatacatttaagatttacattggttcgatctggaagggtgggacaactcaaaatggagggacgggtgcttccaggtcataggtagatttgaaaattttctgattgcctattggttgaaagaattattcaatgtagaaaagaatgtctgggttacaataaggggttgtgaagactaaagttttatcctgctggggaagcctccaagtagcaggcttcagagagaacagattacagatgtttcatatcagacttaaagtctgtgttgatgttaatgctggaggggtgtaatgaggcatgttgaccccctcttccatcttggcctgaactagtttttcaggttaactctggaacgcccttggccaagaggattggtccattcagatggttaggggggcatgtagagttttattttgggtttacataacccattatggaaatgattccttggccctaaggtaattatagattctggatgccatgcttatattaagtagataccaaaatgctacttttagagtttgagtttctcttacgtttttagaaattcaattgagtagaactcgttattaaggaaaaaatactcaagacccgaataatattgccatgaataaagcggttgattagtgattggttgactttatgc

SEQ ID NO: 260 - DNA, 4052 bp, Homo sapiens
aaggacactctaaggaattatttgtgtctgctttaattattaaaaataattttgtttattcagttcaatagaattgtatcttttaaaatacttatagtccttagatactgttttgttataaagtattttgttttgaagatgtctttaaattcactggcttcaaagataacttctgcattattccttgggctttcctcttagttcaatttagaaggaacagagaaaacacaaacatttaggtaaataatggaaataggattcacgtcataaaacgatactttgcaaaattgacaaggtggcaaacatacaggtgatgttagttttttgattaataacaagagacagaatctgaagggttagaggaaatgcataagaatctgaaaaaataaaaggatctggagaagacacccttaaaggtgatgatcaagaagtctgtgttgtataacggggctgttggggctcaaggagaacaaattttaaaagtggcaggaggtatggagaaagctgtgttggtgatgtgagtattatgggcttctcaaagcatggttctgactctggcaaaaagtgggaggtcagagcagagttggctgcttgtaatgggagtgggggagaaagcaactctttaaaaaaatttatgtcaaaatggtattcagtggtccatcacattgaatcaacacacctttattgaaaacatattatttagcacacactctaggggttcatttctcttattctctgaacttgaaatccttttcttgttgatctttcatatgggtcactaaacagattctattttacctgattaaataaatggtaacaaggcctaggtctactccttcgattttactgtatacttacttaacagttcactttgtcagacttctaccccctctacaagattaagaaaattagtggttacagtgtcatgcaattctattcggcttgaaaagttattgaggcatgtttttccacctttttaaccttcatttatttagtagaagcattcccttaagtgtatgatgagtcaacactggttttgcctgactccagtaaagtcaaagcattatttaatttaaaatgtgtgcatgttaagttcctttctttgcatttaattggagacttttttccacagttagctcaccaaaatgttactaggttcctctgtggctgtctactatttgaacagacaagcaactaattagaataacagaacaacatgactgtcattcctccattcttacaggttatttttaaaaagagattttgtttaaaaagagaaaatatgtattatattaaggaaatataagatccatactctccttgaggcattttttcacttcaccatgccaacattcctttattccctatcataataccgatcaagaaatgggaggttttcctaagtcaagaaaacctctcacacataaaaattcaaactgggaaagcaaatgtatcagggggcggcttttaatttgacaaaagatctgctacattacaaaagaatttttctaaagattactttatgtagacaactccctcagtgtaccgaaaatcaaagaatgttctacattttaaacacattttaaaatgggcacacctgttcctaatattcttatgtaaatggacctatttacatgtgagacccaatgtggtgggtaaatgaaaaccagtgtgtgagttactcaagtttgttaatgatgttagaaatatagtcaaaatagctcagtctgctcttgctatgctattttgtccagccaatctctcatcctcccttcatcctaattccagaagagaggataggagtaaaagcaaaatcttattacaaaaaacacactctggaaagaaagaaaactgtattggataatactcagtttggtatttgttttctcctgtctagttcttagtacccttagaattgagataattcattatttgtcactcaggtaggtttcgagtgaactgatatatttaattagatccttaaagcccataggatttatactggtcatttctgtcaattgtgaatctgctcatacttgttcttcatgaaactatggaataatttttcatgtattttcatgtgtcaatctgaaaagaaacttaggttctccagaacagaggagtttatttgaaaatagcagaggattataacccagaaaatgtgtgctgagccagatcacaggcgcatcaaggagactgggaccaaagggagacttttaaagacaaagagaagtcttcataaactgtttgttaaaccagaaagatcattggttacaagagcttgctgtaagagttggcgacaaatcattgttaaagacgtcattactagacagatgtccttgtgcaagctgcttatctggagctttgcggtctaggggaatttccttgctaaaagtcctgttacaggcaaatgtgcagtaaatgcgggaatgtctcctataaggcctttacaggcatttgtgagtgagggctcccccttcgtggccttccaactccatttgctagggtttgacataattgattccattttggtatcaacaactttcacacatggatagttcaaaatggaagctcctgtaaaataatactttcatatgtattttttcatggtgtctagtacctgtgccacatagtgaatgcctgaataaaggaccacatgtattacagttgttagattttcttagggaccctattgtttaaatgacttataataagcacttactgtgtgatggtaaacactatgctatttatgtcacctatacttcttacttaacattaacacaactctacacagtttggaatattgttgaaataatcactttatagctgagagtagagcatgtatgggttaaactcttgcccaaggtcagacagtgagttgacttgtgtcttcccatgttgtcactgatgcgtcttctcctttgctggctcttgttccctttattccttcagtaatatagagaaactacagcctttcattcccaatagagtgaaaatacaccactcattcattatttttcaattatagtgcaaggacgagcagtttaccctaatatccatttcttgtttggttgggaaattcaccaacagagcagaaaagcacagtggggagagacctcaggggaaacacatacaactttgagataaaccctgtttttgttttaatgttaaaatttaacttttaatccctttgtagtatttacacaactgtcagtgaaatgataaatcttctagctcatttcacaagagggcagcactttcttttaaaatttaaagtatgactaaaaaaatacaatcaaattaacgttttctatcatgaagttaagcttgaatgatttacaggaagatgggagcctctctgtcctgggggcaatttatgagttaagatgagtgcagatctgcagggtaacttgggatccttagaaaatggaacgatggattaaaatcaagccctagaatttttgacttgcagtttgaatttggagactattttggtaactttgtaaatgtgtaaaagtctgtcaagatcatgtctttcttttctattatggcaaaacatgaagagtgaatcattttaatatattcaaattgttttgctcatatcaaataaaaagtatttattgagcaatggttttatgtttaggattctataggtcatttgaggaacaaataaatttaacttttttcttcattatttaaagagcttaactcccttggggtgacaaggaagggaaagcacattggcaaaacaacctgtaaacaagccaaggcaacatgtaaataaggtacagggtaacagtacagcataatggagatggccgatttggatagggaattgttgaattagggttttaatgcagggctttgagtagaaggtggaaattgaattggtcctcagtgggtggataaaatttgaatagatttaaaaaaaacaaaacacgaggaggctattatttaagaaaatagaatcctgtcaacagagaaaaagtacaaagtgcatcagggcatgctaggaaagcctgttgtttagaacattgtaggaatgatgcctg

SEQ ID NO: 261 - DNA, 4041 bp, Homo sapiens
ttaggggttcccccccccactttggtctatgccctgatgcaaaaaaagtaaacttacttatattaaaatttacattattctacttgtggtagtgtcaccattataagcactgcatctttatgatgaaactctgcctacaactagagaaacatgtttcaaatggacatttctgttatactttattggtatactgtatagctatgtaatgcaaaagcaaaatcacatttgccttggaatgatatccataatatcactacaaagaatttataatttggattggagtttttttctttaaagcgatgacacttaaaacttcctggaagatggtgtttctctgagtgccagtagtaatttaacatcaaaatggaagacacattcaatgtagttattactcacattttgagtacagtagtttctctcattaagttttatgtcagaaacaagtaaattccctataagaaaacagtctgaatgactttcagcggcatcaaagagatcgaaacactttaaaactattttcttcatcagttgcctgctaacacctttttgaaaaataaaattaatcaacgcgtatttccttttgtgatttgtattgttttgtacattcactcccttttcttttcatgggttggctcccaactggaacatggaacctgtgatccattcaagattgagacaatgtaaaagatagagaactgacttttggggcaggcaggcctccaggaagtgggagtgagctttcacttcaaactgggtgaggggtggtggaaagggaggatgctgattaaaataataaacaactgctggaaagagaagttgattaccacactgctgtcagatcagccaggggagctgccagagcccactgaggctgctctcccctgccacaaagccggcagaagggactagatttgctgcgagagcttttctctggacagacagaacaccttttaaaacaagtttagttctgttgcattgacagcatcccttaggccaggctgacctagggaaatggactgaaactagcttggtggttaccatagcaacccaggctgctggtgtctgggagagtgagaaccggtggcctcttgtcctgtgttttggtgtttcttcagctaagagtacactcctccttcgaactctacataagtcatgctctttgaaaactggctctttacccaggattttttttttttcgttctgaaatcggtctgaatggaggaagttggtaatacttggctttttttttttcttctctcatgcaagtttccaggatatagcttctttttttgctgtatgtaattgagaccaaactctaagcttggggccctggagagaacagttgtggcctgcaggtcattagtgaggtgagcagaagggaatcctggacttcccagagaaagaggagaccatgccagcctcgtggaacacagctaccaggaaatacagaagcaggtctattccttgcgaactccgaagtccatgaaaaaacggacccacagtggggtggctaaaatgtcccagcgcaagctgccgctgctgctgatggaccatagctcaagggcaaggcttgtaaaggattttacaaaggattttaaagtatagccagaaaagatacggtgtttagaagttaaacgctgttgtctgaaggaagtttgccggaaagatgtaggcttcaagggctactggacaatgattggtctgaacttcaacttacgggaactgctgacaaaatttgaaaaggtatgcagaaagcaaacttcatgaatgtacttttttcctttctttcttgccttttttttcactatacatttagatagatgctctattgactctttggtggtttagtataatttataaggaatattcaattttgctgtctcctttaaagatgtttttcaagtaaagggctaattagcaattacttcctttggtcaggagggcttctcatgatgcctgtcacttttagaattccacatcagaagaaactctttgtactcaagtcagctggtaatttaactgaaacttctttggagaaaaaaaaaagaaaatgaaaataaaataaaaatccagcaaaaaacactgggtattggtgccaaagtctgacttcgtaggcatgggttctgttctccatacccctcaggtttatctgtccagccactgcctgccgtgcactgccctgtacagccctctgcctggggactcagctgtgggtggcagaagtcgcttcacagtgacagtggcacatctgacctcaggctttttatctgagcgtgtctgttttaaacatggagtgcttgcatgcactgtgaagctttaatgcttggattattaaatgtgcgtgtagctcttttttccataggaaggctcctggcacaatctagatggagtctagcctgccaaatactaccttacatttatagttaaaacagaaaacctccacatgcgtgtatgcgctcctgccctctttagcctttggatgccaaacaccaatcttcttccaatttccagtctttaaagaaaaagaaaggcagaaaggggtgaagtcctccctcacttggtatgtaagtcaattattaatatttaaaaagctgtgctcagtggctttcaccgtgaatgccccatggatcattgcaagtacaaatactgtagaagcgggactggattgagtcattaaaagaataatgggctttttcttacaaaccacaattgccagagggaaaagatgcaacatcatgccatctgaaaagtttggaagcttttccaaaacaattgcagtcactgcttgccttttgatgataggaacgttatggtgggatgaatgtggagagagaagaatttagctctttgctccctcctggctgcagttgcttctcccaatctctctctgcacctctactgtaatgtaaggattaggcttgtaacacagggcggacttcgacctctcgctttaatatgtggttaagcatctaaattcctgagagtaaaagacggttctccctcagcttgctctccacttagaaggggcggggaaggcaaggaatatcttccttatggcagctggtaacagcaggtgacaaactttatgaccataaagaggtctgttagcttgttttgtatagatttgtctgtttcttcctttaaaggtatagagcatatgttacatgaataattcattacttagaccccctgagaggcagtaattgtgggcaatagctggacttttgtattgtaattgctgctattagtcttaaaagtctaggtcagataccaggggttcctaacctgcctcagcttcaagccattttattggcagagttagaagttctggttatattagcatgtttccccttttaactcccatgtcttagtatttgtcttattcctattttagtagttgaattgacagtagaagatatctactggctttttcctgtcaaaggcttgatttgggatttttattattattattatctatttatttatttatttatttttgagacaaaaggcgaactcaaagaaacagtcctgatgtaattctcagtctgaagttctccatatatgtgtatttttgtgttaggcagttttataaaaacctatgtgaaagttgatctctttggccgtattttacttctaggaagttgtcgtacatgaatgtattctttccaaagtgttaataaaatcctttgcgtattcttacaaaatctgtctcatatattgagatgttgcttcattggtttattggcaggaaaactggaattacggaaaagtatcagtacctcacacgtctcaaatacaactaaccaccttcccccaacaaagcaataatgccatttctagggaaagaccaaggcctactgctataatgcagaagccacaggatcccttcagaagctgagtaacagccattctacacgcagaggtagagtccctttaccctcaattctcagtcctgtctcttcctcagtattagtaacctgtttctagagagaatactagccttaacgatttaccacttttcatatcagcagttgtcattgt

SEQ ID NO: 262 - DNA, 4046 bp, Homo sapiens
tcccatgtcttagtatttgtcttattcctattttagtagttgaattgacagtagaagatatctactggctttttcctgtcaaaggcttgatttgggatttttattattattattatctatttatttatttatttatttttgagacaaaaggcgaactcaaagaaacagtcctgatgtaattctcagtctgaagttctccatatatgtgtatttttgtgttaggcagttttataaaaacctatgtgaaagttgatctctttggccgtattttacttctaggaagttgtcgtacatgaatgtattctttccaaagtgttaataaaatcctttgcgtattcttacaaaatctgtctcatatattgagatgttgcttcattggtttattggcaggaaaactggaattacggaaaagtatcagtacctcacacgtctcaaatacaactaaccaccttcccccaacaaagcaataatgccatttctagggaaagaccaaggcctactgctataatgcagaagccacaggatcccttcagaagctgagtaacagccattctacacgcagaggtagagtccctttaccctcaattctcagtcctgtctcttcctcagtattagtaacctgtttctagagagaatactagccttaacgatttaccacttttcatatcagcagttgtcattgttcagtctgaagtttaggtgaccacagtagaaaggggattttgctgtattcctgaaggaatttcaggctttaagaaaacgagggtccactgttggactagtagactcaaatcctgatacgcttagtagttgaggccaacagctgagcagcaggccttccaatggtggctaatctggaaagttatagactggtcagatcattaaaattcccaggtgaaagcagaccttcagcataactttaagacagcagtttttttgtgaaggtaaattgaaagggatattttagttgatatttttgaattttggagacatccagtggttttgtgatttttactggatataagaatgtttggcatgttatactcatataagaatgtttggcatgtggttgagcaccttgtctcagcatgtgtgatgctgggattgtagtttcccagcacaggcaggatgggcaatttcttacattgggtactgatttctagtcttctagaaccagaaagggcaaggctaggagtctcttgcaggcaggaagtattatgttcctacaagatgacagctcattacagattaggaaggcccaattggagggaaccatgccaactcgagtggtacctaaagaggaagaacttcttaccaggggaggatgaccccataccaagatgtgcctgccagcaagcaggtcctaatcatctaacaaagtgataagggatgagaagttgtggccatgggctcaagggtgactatgggaagagttcacattcaaagttgactagtccaccaacacacctctctgagatccagccaataggtagttttatttgccacgctgattttaattaatttttttccctgaaagtacttcctaaaggaagtatctcatgactttagggactattaacatactgtcatacttaagccatttgcattgtgtactgtatttcttttgtttaatagtcacagaggatagtgtaatggccaattttagctcagtgacattttgagtgactgctgccttttattaatttattcagacctgctactgaatggttaatgataatcgtagttctctaagggattttttgatgtatgtgtctgctgtgtgtgtgagtgccgttctcttagtaccattctcttggtgactccttgggcaaagatgcttcctatcataacaacacagagagaaaccactcaatgctgaattactttatggcatttacctcctttcacatgactctatcttttataattacaatttgaagctatattgtattgctcagtttgccatatctcattttaaaacaaatgtgtcctcaataagatatagtaaacacatttcaaagtctcctcatttattccctacttagcaaatatttgtgaagtatgtaccaggtgctagtctaagtgtatagatggagaagacattgatcttatggccgaatgggaggatacagacaaggacattttcaatgacaactgcataattaagcaaaagtagatgaaattataagagtaatgatagccctaatctcagtacttgtgaagtctctcctggagaaattacatttaaactgagacttaacagatgagtttaagttgaaagaaggaaatgagattatataccaatgtgtgtgcatgtgtgtggcccatgggtggacttgtgtcaggggaagaaattgggagctttcagggtaacagggactgctttgacatgggtcagaagttgagaagctgtgtgccccaggcttgtagttttaaacatttgaaatgcgataatttttctctgggttttctgacctgttcagttttgattacacgatctgatttgtttgttcagttttcatcacactatctgagtttgttccacttagtaatttgactgttttctactctgttgtcttactttttttttttttttggagacatggacttgctgtgttgctcaggctgaccttgaactcctgggctcaagctatccacccacctcgagtcttacctatatttatcatcacagataataggaaaagaacattattagcatcgatttcttaattcagaaatgctgctgtagacctgatgataccacctctattgtcagtcaaaaatgtgattcaatagagtgattaaaatctgtgagattagctgttggaagaaaatttatagaataataattaaaatcaataaattaattgaataattaatgacaattactatcccagaaacctcacaaactgtttcaaaacatatttacatatgacataacctttgaagatgatgttatttgcctattctattattatttaagtaatatatatatatatttttaaaatcatgattcctcattttcaaaacctaaagctctggcagtaatcctgctgagctcctgataataattctgaaatctagtctgacttttgaaaggaatggtggatttattttcctctaatgattaactttgtttagttaggctgagctttgggacatgatagcgaaattgttctaacctcatttcttcttcaccttcaggaaaggggtcagaactccttcagaaaaaaacatcactgttgccacataaggttaagtaaatagttggtgcaaaaataaaccaaaattattttaacaagaccaaagaggatgaatctagtctagcacccatttagttgttgaagacttcctggtggtactgttctaaatctctgtttcctgtcagagatttcagacagttctgtttattataatgtgaggaaatatttttgcttacatatttaagcaaaatatgttttattttcatgatgttttattgatttgttttataatgtatatcacataatttgtttataatgttttataatcaagctactacttgtagctttataatcaagtagtagcttgactgtgaaacattataaacaagttatttgatatacattataaagtgtttacagttatatctctatgggttatatcattagagaaatgcccagttaagggcaaaacttgtagtcaaatactaattattaaataagtaaaaagtaaataaataaatgttttcccgtatttgtgaagtttatcttgatctgaatagtgggtgttgtttacagaaagactaaccacttatcagtgaacctcagtgagcttttgtagccatcttctggagggctgttctgagggtttgcatcttatgcttttgatggtgttttatttagagaaaagtgtgtagtcctatttttctaactcctggcttttcttaaccttctacattatacttacattgttttaaaatacttttcaagtgaatccttaggacattgcttctgccctgttttcaaatgttagttcaactgcttgaatatcttgccatggcccct

SEQ ID NO: 263 - DNA, 4049 bp, Homo sapiens
atttttgctgacacgttaaaagtttgttttttttttaattatactttaagttctgggatacatatgcaaaatgtgcaggtttgttacataggtatacatgtgccatgttggtttgttgcacccattaacccgtcatctacattaggtatttctcctaatgctatcccttccctagcccctcaccccacaacaggccccggtgtgtgatgaaaccgttgttactagtttttatttcttaaagatgatgaacttgtatataaaaatattcttttaacattttagaaataaattttataagactgaaaggacaaactattagtaaatgtttcaaaatgtgaaaaacactttagttatagttatgtaatatcttagtgacctctgtaagatgtaatattttaagggaagttttacctatgtgaaaacgggagagtaagagtctgttggatattaggcaaagttcagtgatttggcaacaacagttgtataagatttcaaaaattgctaattgaatctgatataccaacatctaactagctggtacatgaactatagattacaatacattttttaaaaaaattgaggagtcagtgtattgaacaccttttaaaaaatttcaatttaagttctgggatacatgtgctgaacgtgcaggtttgttccataggtgtacatgtgacatggtggtttgctgcacctatcaacccatcatctaggttttaatccctgcatacattaggtatttgtcctaatgctctccctttcctttcgccctaccccccgacatcccccggtgtgtgatgtccccttccctgtgtccatgtgttctcatttttcagctcccacttatgagtgagaacatgcggtgtttggttttctgttcctgtgttagttgctgaggatgatggtttccagcttcatccatgtccctgcaaaggacatgaactcattcttttttatggctgtatagtattccatggtgtatatgtgccacatttgctttatccagtctatcattgatgggcatttgggttggtttcaagtctttgttactgtaaatagtgctgcagtaaacatacatgtgcatttgtctgtatggtagaatgatttataatcctttgggtatatacccagtaatgggattctgggtcaaatggtatttttggttctatatccttgaggaatcgccacactgtcttccacaatggttgtactaatttacactcctaccaacagtgtaaaagcattccaatttcaccacatcctcgccagcacctgttgtgtacttgccattctaactggcaggagatggtatctcattgtggttttgatttgcatttctctaatgaccagtgctgatgagctttttttcatatgtttgttggccacataaatgtcttcttttgagaagtgactctttgaatcctttgcccactttttgatggggttgtttgctttttttcttgtaaatataagttcctcgtagattctggatattagctctttgtcagatggatagattgcagaaattttctcccattctgtaggttgcctgttcactctgatggtagtttcttttgctgcccagagtaattgatagattcagtgctattcccatcaagctaccattgactttcttcacagacctagagaaaatgactttaaatttcatatggaaccaaaaaagagcctgtatagccaagacaatcctaagcaaaaagaacaaagctggaggtactgaagatttaaagactataattttcagaataataagaattttggaagcacttgaatttcttataatttaaggtgaaatgaactattttgcttgagagcaactcatctgtgaatataaagatatactgattcctaacacttgcattatctatttgcttttttctgtttaggacatccaggcagaaattgatgcccacaatgacatatttaaaagcattgacggaaacaggcagaagatggtaaaagctttgggaaattctgaagaggctactatgcttcaacatcgactggatgatatgaaccaaagatggaatgacttaaaagcaaaatctgctagcatcaggtcagaatagtcaatatcaaaataaaaataatggggtggaaggggtagatacttgtgatttttgtatatcagaaagagaaagcgcagccttaccaccacttctatttcatcagaaatagtttaagattttaatgcaaagcctgtttccttgagttatatagttcaagctctatttgtgtccaatactttctgccacctgttctagactattcataaatgttcatatattttaaatctaacaatactagtaacaatactgttagcaacatctgctaattactgagtgtttaccttgactaagtacttgttaggatctttacaaatgttactttatttcgtaatcaaaaaatcctagtaaggtgggtggtaacattatttcttctatgaggaaacagaggtttaatgaatataaggaacttgccaagttttggggctaagaagtgccaagtcagagtttgaatctagatcttttttactcttggcagtgaacatgttttgcttaatcatgttgttttttatgcctcattcaagatgtatttatagaaattaaatatctcttatggacactaaaatggaaaattgatgattcatgtctgcatttggagagagtaaaattaaataaggatgaaccttaggaccagaattctgactaggaaaagaccttgaaaattacccagagagacagtatgattagtgttattgggatcaagaatattttaagatcatatttaatagagagtggacagctcctaattatatataaatttagtgaatactggctgaaaaatatgttattgagcaaaaatctaaaagcagaacattggcaggaagtcctggatcagcttttgttttgttttgttttttgccttgtaccaagtgtacatcctttaaaccaaatggtcttgaatttgactctgacttcactatttactctctgatcttgaacaaactactcagcctctttgagccttggattattttatttacaaaatcagaatagaaatatttaacactcatgattgctatgaagatttaatggaatggtttgatagttccctaatctatgtaaatcctgcctaagaaagcatctagttaagtatttttatacataaaggggctcactggatctgcctcagctggtttcaagatttaatggagaacagaattttcaatgattacttatcataaatgaattaaaatttttttttctaagatgtattgaaaggtttttattcttctggagctcagagagtggaatttgcagttcctcttacatgtgaggaagggagcaatgcagcatggacatggatgctctgtgtaaagttcccattgggaaatacaataggtcagcattggccaactactttttcttagtaagagaagaaaattagggagttctatgtagtgagggattatacttttttaagatttgaattttcaactgcctagatcccatcaggttgcaactttccattcctcataaatatgaacaaaaatatttaaaatattaatagtgaaaagcattcactgagcatccagcaagtcatctatgccagcaacctaagaattccagagctggccctagtgaagatggtatacatggtgctgggattttcagaggttagagaatgacttatttaggaagaataatttaatgaagacctatatcataaacagatcattctaagtaaaaagttacagacaagaaatttttggtctttcttgggagttattgcctaagcctatcatgacacatttttttttaacctggaaagaaagaacttataaactacagttggaatattatgtaataagtaagttaacattatttttagaagatgggagaatatgcttgtggcagtggacttttgcattaaggtagatcagacattccagtaaaatgtaataataaattaatgtgataatgaattaaaataacttttactttgattagtcacctcaagagattcaa

SEQ ID NO: 264 - DNA, 4035 bp, Homo sapiens
tgttgcacccattaacccgtcatctacattaggtatttctcctaatgctatcccttccctagcccctcaccccacaacaggccccggtgtgtgatgaaaccgttgttactagtttttatttcttaaagatgatgaacttgtatataaaaatattcttttaacattttagaaataaattttataagactgaaaggacaaactattagtaaatgtttcaaaatgtgaaaaacactttagttatagttatgtaatatcttagtgacctctgtaagatgtaatattttaagggaagttttacctatgtgaaaacgggagagtaagagtctgttggatattaggcaaagttcagtgatttggcaacaacagttgtataagatttcaaaaattgctaattgaatctgatataccaacatctaactagctggtacatgaactatagattacaatacattttttaaaaaaattgaggagtcagtgtattgaacaccttttaaaaaatttcaatttaagttctgggatacatgtgctgaacgtgcaggtttgttccataggtgtacatgtgacatggtggtttgctgcacctatcaacccatcatctaggttttaatccctgcatacattaggtatttgtcctaatgctctccctttcctttcgccctaccccccgacatcccccggtgtgtgatgtccccttccctgtgtccatgtgttctcatttttcagctcccacttatgagtgagaacatgcggtgtttggttttctgttcctgtgttagttgctgaggatgatggtttccagcttcatccatgtccctgcaaaggacatgaactcattcttttttatggctgtatagtattccatggtgtatatgtgccacatttgctttatccagtctatcattgatgggcatttgggttggtttcaagtctttgttactgtaaatagtgctgcagtaaacatacatgtgcatttgtctgtatggtagaatgatttataatcctttgggtatatacccagtaatgggattctgggtcaaatggtatttttggttctatatccttgaggaatcgccacactgtcttccacaatggttgtactaatttacactcctaccaacagtgtaaaagcattccaatttcaccacatcctcgccagcacctgttgtgtacttgccattctaactggcaggagatggtatctcattgtggttttgatttgcatttctctaatgaccagtgctgatgagctttttttcatatgtttgttggccacataaatgtcttcttttgagaagtgactctttgaatcctttgcccactttttgatggggttgtttgctttttttcttgtaaatataagttcctcgtagattctggatattagctctttgtcagatggatagattgcagaaattttctcccattctgtaggttgcctgttcactctgatggtagtttcttttgctgcccagagtaattgatagattcagtgctattcccatcaagctaccattgactttcttcacagacctagagaaaatgactttaaatttcatatggaaccaaaaaagagcctgtatagccaagacaatcctaagcaaaaagaacaaagctggaggtactgaagatttaaagactataattttcagaataataagaattttggaagcacttgaatttcttataatttaaggtgaaatgaactattttgcttgagagcaactcatctgtgaatataaagatatactgattcctaacacttgcattatctatttgcttttttctgtttaggacatccaggcagaaattgatgcccacaatgacatatttaaaagcattgacggaaacaggcagaagatggtaaaagctttgggaaattctgaagaggctactatgcttcaacatcgactggatgatatgaaccaaagatggaatgacttaaaagcaaaatctgctagcatcaggtcagaatagtcaatatcaaaataaaaataatggggtggaaggggtagatacttgtgatttttgtatatcagaaagagaaagcgcagccttaccaccacttctatttcatcagaaatagtttaagattttaatgcaaagcctgtttccttgagttatatagttcaagctctatttgtgtccaatactttctgccacctgttctagactattcataaatgttcatatattttaaatctaacaatactagtaacaatactgttagcaacatctgctaattactgagtgtttaccttgactaagtacttgttaggatctttacaaatgttactttatttcgtaatcaaaaaatcctagtaaggtgggtggtaacattatttcttctatgaggaaacagaggtttaatgaatataaggaacttgccaagttttggggctaagaagtgccaagtcagagtttgaatctagatcttttttactcttggcagtgaacatgttttgcttaatcatgttgttttttatgcctcattcaagatgtatttatagaaattaaatatctcttatggacactaaaatggaaaattgatgattcatgtctgcatttggagagagtaaaattaaataaggatgaaccttaggaccagaattctgactaggaaaagaccttgaaaattacccagagagacagtatgattagtgttattgggatcaagaatattttaagatcatatttaatagagagtggacagctcctaattatatataaatttagtgaatactggctgaaaaatatgttattgagcaaaaatctaaaagcagaacattggcaggaagtcctggatcagcttttgttttgttttgttttttgccttgtaccaagtgtacatcctttaaaccaaatggtcttgaatttgactctgacttcactatttactctctgatcttgaacaaactactcagcctctttgagccttggattattttatttacaaaatcagaatagaaatatttaacactcatgattgctatgaagatttaatggaatggtttgatagttccctaatctatgtaaatcctgcctaagaaagcatctagttaagtatttttatacataaaggggctcactggatctgcctcagctggtttcaagatttaatggagaacagaattttcaatgattacttatcataaatgaattaaaatttttttttctaagatgtattgaaaggtttttattcttctggagctcagagagtggaatttgcagttcctcttacatgtgaggaagggagcaatgcagcatggacatggatgctctgtgtaaagttcccattgggaaatacaataggtcagcattggccaactactttttcttagtaagagaagaaaattagggagttctatgtagtgagggattatacttttttaagatttgaattttcaactgcctagatcccatcaggttgcaactttccattcctcataaatatgaacaaaaatatttaaaatattaatagtgaaaagcattcactgagcatccagcaagtcatctatgccagcaacctaagaattccagagctggccctagtgaagatggtatacatggtgctgggattttcagaggttagagaatgacttatttaggaagaataatttaatgaagacctatatcataaacagatcattctaagtaaaaagttacagacaagaaatttttggtctttcttgggagttattgcctaagcctatcatgacacatttttttttaacctggaaagaaagaacttataaactacagttggaatattatgtaataagtaagttaacattatttttagaagatgggagaatatgcttgtggcagtggacttttgcattaaggtagatcagacattccagtaaaatgtaataataaattaatgtgataatgaattaaaataacttttactttgattagtcacctcaagagattcaagcacttattcaagcatgtaataaaaacttatttctgtgcttaaggcattgctattaataagatgtagtccctacccctagaggttcacaaatctgttta

SEQ ID NO: 265 - DNA, 4052 bp, Homo sapiens
cttttaacattttagaaataaattttataagactgaaaggacaaactattagtaaatgtttcaaaatgtgaaaaacactttagttatagttatgtaatatcttagtgacctctgtaagatgtaatattttaagggaagttttacctatgtgaaaacgggagagtaagagtctgttggatattaggcaaagttcagtgatttggcaacaacagttgtataagatttcaaaaattgctaattgaatctgatataccaacatctaactagctggtacatgaactatagattacaatacattttttaaaaaaattgaggagtcagtgtattgaacaccttttaaaaaatttcaatttaagttctgggatacatgtgctgaacgtgcaggtttgttccataggtgtacatgtgacatggtggtttgctgcacctatcaacccatcatctaggttttaatccctgcatacattaggtatttgtcctaatgctctccctttcctttcgccctaccccccgacatcccccggtgtgtgatgtccccttccctgtgtccatgtgttctcatttttcagctcccacttatgagtgagaacatgcggtgtttggttttctgttcctgtgttagttgctgaggatgatggtttccagcttcatccatgtccctgcaaaggacatgaactcattcttttttatggctgtatagtattccatggtgtatatgtgccacatttgctttatccagtctatcattgatgggcatttgggttggtttcaagtctttgttactgtaaatagtgctgcagtaaacatacatgtgcatttgtctgtatggtagaatgatttataatcctttgggtatatacccagtaatgggattctgggtcaaatggtatttttggttctatatccttgaggaatcgccacactgtcttccacaatggttgtactaatttacactcctaccaacagtgtaaaagcattccaatttcaccacatcctcgccagcacctgttgtgtacttgccattctaactggcaggagatggtatctcattgtggttttgatttgcatttctctaatgaccagtgctgatgagctttttttcatatgtttgttggccacataaatgtcttcttttgagaagtgactctttgaatcctttgcccactttttgatggggttgtttgctttttttcttgtaaatataagttcctcgtagattctggatattagctctttgtcagatggatagattgcagaaattttctcccattctgtaggttgcctgttcactctgatggtagtttcttttgctgcccagagtaattgatagattcagtgctattcccatcaagctaccattgactttcttcacagacctagagaaaatgactttaaatttcatatggaaccaaaaaagagcctgtatagccaagacaatcctaagcaaaaagaacaaagctggaggtactgaagatttaaagactataattttcagaataataagaattttggaagcacttgaatttcttataatttaaggtgaaatgaactattttgcttgagagcaactcatctgtgaatataaagatatactgattcctaacacttgcattatctatttgcttttttctgtttaggacatccaggcagaaattgatgcccacaatgacatatttaaaagcattgacggaaacaggcagaagatggtaaaagctttgggaaattctgaagaggctactatgcttcaacatcgactggatgatatgaaccaaagatggaatgacttaaaagcaaaatctgctagcatcaggtcagaatagtcaatatcaaaataaaaataatggggtggaaggggtagatacttgtgatttttgtatatcagaaagagaaagcgcagccttaccaccacttctatttcatcagaaatagtttaagattttaatgcaaagcctgtttccttgagttatatagttcaagctctatttgtgtccaatactttctgccacctgttctagactattcataaatgttcatatattttaaatctaacaatactagtaacaatactgttagcaacatctgctaattactgagtgtttaccttgactaagtacttgttaggatctttacaaatgttactttatttcgtaatcaaaaaatcctagtaaggtgggtggtaacattatttcttctatgaggaaacagaggtttaatgaatataaggaacttgccaagttttggggctaagaagtgccaagtcagagtttgaatctagatcttttttactcttggcagtgaacatgttttgcttaatcatgttgttttttatgcctcattcaagatgtatttatagaaattaaatatctcttatggacactaaaatggaaaattgatgattcatgtctgcatttggagagagtaaaattaaataaggatgaaccttaggaccagaattctgactaggaaaagaccttgaaaattacccagagagacagtatgattagtgttattgggatcaagaatattttaagatcatatttaatagagagtggacagctcctaattatatataaatttagtgaatactggctgaaaaatatgttattgagcaaaaatctaaaagcagaacattggcaggaagtcctggatcagcttttgttttgttttgttttttgccttgtaccaagtgtacatcctttaaaccaaatggtcttgaatttgactctgacttcactatttactctctgatcttgaacaaactactcagcctctttgagccttggattattttatttacaaaatcagaatagaaatatttaacactcatgattgctatgaagatttaatggaatggtttgatagttccctaatctatgtaaatcctgcctaagaaagcatctagttaagtatttttatacataaaggggctcactggatctgcctcagctggtttcaagatttaatggagaacagaattttcaatgattacttatcataaatgaattaaaatttttttttctaagatgtattgaaaggtttttattcttctggagctcagagagtggaatttgcagttcctcttacatgtgaggaagggagcaatgcagcatggacatggatgctctgtgtaaagttcccattgggaaatacaataggtcagcattggccaactactttttcttagtaagagaagaaaattagggagttctatgtagtgagggattatacttttttaagatttgaattttcaactgcctagatcccatcaggttgcaactttccattcctcataaatatgaacaaaaatatttaaaatattaatagtgaaaagcattcactgagcatccagcaagtcatctatgccagcaacctaagaattccagagctggccctagtgaagatggtatacatggtgctgggattttcagaggttagagaatgacttatttaggaagaataatttaatgaagacctatatcataaacagatcattctaagtaaaaagttacagacaagaaatttttggtctttcttgggagttattgcctaagcctatcatgacacatttttttttaacctggaaagaaagaacttataaactacagttggaatattatgtaataagtaagttaacattatttttagaagatgggagaatatgcttgtggcagtggacttttgcattaaggtagatcagacattccagtaaaatgtaataataaattaatgtgataatgaattaaaataacttttactttgattagtcacctcaagagattcaagcacttattcaagcatgtaataaaaacttatttctgtgcttaaggcattgctattaataagatgtagtccctacccctagaggttcacaaatctgtttagattaaggtagggcccaaagcagagagtggttactctcacttcagatgatcaaagaaggcttcataaaagaggtcattccttagctgagccttgaaacatatatagttattccccagatagtctaggtgatgactggggaagggtaactaagttaggggcttgaaataaca

SEQ ID NO: 266 - DNA, 4337 bp, Homo sapiens
acctctttccatctgtaggaatgctgatgttacatatagagagggactgtgactctacccctcatgtaagcctgaacctggaaggtacttctcttgtggggatgcagtcaccccactgttctagaatggctgtctacaggtgcacccacgccaagctcctgtgggagcagccccaggtgtgtctgcaatggtgggtgaaggagagaagtcccctcctccaagacccttcaggagcaccagggctgcctgactcttggggcagagctgcagactttctccactgagcccagcattacacccatgcctctgctgaaagaaacttcccacaggtggaaatgtctgggagtcaaggcctgctgtcttcattcttttgtcattcttttgtcccacgggttgctcccttgatgtggagcactccctctttcccctaggaggaggaatccctgagggccagactattgtgaatgctgctgctccactcagtctagcaacccatttggactgccacagtccaggctggtgcagggggaatgtctgcaagggatccagtgatgtgacctgtcctgaagtctcacagcagtgggtgccagcaccagctctgaggggggttgcagaggagtgatgtagactctgtgatattccttggttataaatagccttagtgtgttggctttctcacatgccatgtgtaatagtaacgaacaggtcacgtgggcagactcagggcctcctggttagccagggtgatgcaggtaatggtgacggccaaggtcacacaagttttccccttcctggtgtggtgttattctccttgcagatgctatcatggagtgagtcagttggcctccagctagaaggtggcacttggaaaagggcactggctgtggtggtactggtgggatttatgctttgccttatgttacccaggggaggtactctggtgtcccaagcaatgggaggggccatagagctcccaaaagtttctgttttttttttttttttttttttgtgtgtgtgtgtgtgtgtgtgtgtgtgtgtgtgttaagctaccaggaggagtgaaggggcaaaaccaggagggaggtgggtcaggcaagtccatgctctggctctccacaggcagacgcaagcagcagccctagtgggattggaggacagtttgctggctgctggggtagtgttccaaggaggagcacagctgcctctgctgcacagaagagtgcaaatgaggggggtgtagccagcagcagtaagacccacctagcttccctgcacttggcaaggcaggtctcacatctgcagcattccactaacagcaacagctagcaaagttccagccagtctgcactgaaactcaaaactgccccagatcataagccttcccagtggagatggaaactgcagggctttcaggccatgcccatcctcatctgcccatgaagcaggggcacccagctcctatgcccactcaagtttatatcatgaatttcagttgggagcatctcttaacctgcgacccgtgcctgagttaattggctgacctccacaaggtctcctgtgagacaggatcaggaatgacttcccttcatccctctggagactgggagtgcacacacagcacatcccgatgtggttccttctcatctactccccattgctcactacaccagctccggagctgggtagggttaaggccttttccctgacctggattgccaggttccccggtgggtgtgtatgtgctgtaggcagtttctccctttttcacactctggggacttacaatttttggcctggctcatgatatacactgcagcctgctgcttctttcaaagggtctgtggtgtctgtcagttttcttgttaagttcctgtgttgcttcttggaaataagttcacagtatgaatctttacacactatttcgtctttccaagtggaagaagcatgctaacaatgcttccaattcaacatctagggaaaaaaaaagttttattcagtttatatgctagatctacaatatttcaacttgattatttatttatttatggaacagagtcttgctctgctgcccaggctggagtgcgatggtgcaatcttggctcactacaacctccatctcccaggttcaagtgatgctcatgcctcagcctcccatgtagctggaaatacaggcacgtgccaccatgcccagctaatttttgtatttttagtagagacaaggtttcgccatattggctgggctgctctcgaactcctggcctcaagtgatccaccctcctcggccttccaaagtgctagggttacaggcgtgagccactgcacctggccccaacttgattatatttaaatgcacatcctaaagtattttcaactgtcaaattctccagcttttaaacatttattccttttttttcctgaattttcacatctttcttctaatcttcagttacttaaacccttcctcttttcagactccattaatcccttctacctagtttggagcccatcataagatacttcagcagtgtcaagagcttgaatttcctttccccttttaacttcttctatttcccagtctctgacattccaatgtccatactctctctatcccttgtctttaatcttggattctgcctagtgttgcactagaaagtgaaaaatggtaacattgatcctgctataatttgatactttctacttaaaattggcattgtgatttgcaatgattttctattatattcaccaccttgtctattttattttattttttaattatttattatttagatttcatgtttattttatttaacttttactttcagttcagggtacatgtacaggtttgttatataggtaaactagtgtcatgggggtttgttgcacagattatttcatcactcaggcattcagcctagtaccctatagttatttttcctgatcctctccctcctcccatcttccatcctctgataggccccagtgtttgttggtctcctctatgtatccaagtgttctcatcatttagctcccacttataagtgaagacatgtggtatttggttttctgttcctgcattagttttctcaggataatggcctccagcttcatccctgttcctgcaaagaacatggtctcgttctttttcatggctgcatagtattccatggtgtatatgtaccacagtttttcaatccagtcttatcattgatgggcatttaagttgattccatgttgttgctattgtgcatagtactacaatgaacatacatatgcatgtgtctttataatagaatgatttatattcctttgggtatatacccagtaatgggattgctgggtcaaatggtatttatgtttttaggtctttgaggagtcgccacactgtcttctcaatagatgaactaatttacactccaaccaacagtgtaaaagtgttcctttttctcctcaaccttgtcagcatctgttatattttgactttttactaatagccattctgactggtgtgagatggtatctcattgtggttttgatttgcatttctctaatgatcagtgatgttgaaggtttttttttaatatgcttgtcagctgcatatatgtcttcttttgaaaagtgtctgttcatgtcctttgcccactttttatggtgtttgttttttccttataaatttgtttacattccttatagatgctcaatattagacctttgtcagatgcatagtttgcaacaattttttcccattctgtatgtttactctgttgatagtttcttttgctgtgcagaagctctttagcttaattagatcccatttatcaaatttttgcctttgttgcagttgcttttggtgtcttcatcatgaaatttttgcccattcctatgtgtagaatggtattgcctcagttgtctttcagggtttttttttttatagttttgggttttacatttaagtatttaatccattttgagtttatttttctatatgatataaggaagaggtccagtttcaatgttttgcatatggctagccagttacccagcaacgtttattgaatagggaatcatttccccattgcttatttttgtcagctttgtcaaagatcatatagttgtagccatacagccttatttctgagttctctgttctgttccattggtctatgtgtctatttttataccagtaccgtgctgttttggttactatagacctgtagtatagtctgaagtcaggtatcatgatgcctccagctttattctttttgcttaggattgccttggctattgtgctcttttttggtttcatatgaattttaaaatagttttctctagttctgtga

SEQ ID NO: 267 - DNA, 4072 bp, Homo sapiens
ttgagtcttctctcttttcttctttattagtcttgctagcagtctatctattttatttcattttttttcaaaaacccagctcctggataagttgatcttttgaatggtttttttgtgtctcagtctcctacagttctgctctgatatcaccatgcctattttaaaagattttgatcctttttagtccccaaattctctctctgcaggtggccttttttttttttttgagagtgaggctatctgattgatactctttatgctacttggagtatttaatatgcattggttctgtatttcacattatgcttttattgcgctaaagttgatattaaagttttatagcataaaatgtcatggcagggaacatttgctctaatttatcataattttttaaaaagaaaatgtctgctaagatcataataacagctaatatttatatgctagatctaccctaagtgttttacaggtattaacttctttgaccatggtgtggccattggaacaatgtaataatatgtggctcaataccataggttaatatcttaaacgttatttttcattctctttggatagccatgattaaactttttttttttttttgagacagagtctcactgtgttgccagggctggagtgcagtggcatgatctcagctcattgcaacctccgcctcctgggttcaagcgattctcctgcctcagcctcccaagtagctgggattacaggcacccgccattacgcccagctaattttttgtatttttagtagagacggggtttcaccgtgttggccaggctgctcttgaactcctgaccttgtgattcacccgcctcagcctcccaaagtgctgggattacaggcgtgagccactgcgctcagcctaaactttttatatgctaaaatccaacatgctacatctcctttagcatctaaaacaatacatacaatgataaatttcacttcaatctgtacaagagaagaatgctaatgatttgaaacgtcagctagaagacaggctgtcaggaacttttattatattttttactcactggaaaaatatgaattggaaatacactaataagttctctgctgtggataacatgggtttaaattttcatgttaaacttatttaatttgagattgtcttaattaaatatccatttatcagcataatgatgtttaatatagatctttattaacatggtttcaaaggccagtaaaattgtcaaatctaatgaaaacagagttcaaagataaaattctatcttccctttcttttatgagtctattaaaaattcagggcacctttttaaaagcccgtagagaagattaacctttaacatcatcatttaaatctaatgttaccacattttacagtgtcattgacactatgtttagccttagatagttgcttttcctaaccatattgtgaaactactaaattttttttttttccaaatctaatagaggaactgctctcttttttttctggtttctctagtgtagcacattctaatagaactttctccaatgatagaaattatctatatctacactggttaatacaattgctgctagccatatgtggcctaatgagcacttgaaatgtgaccagtgcaactgataatctgaatttcaaaatttactcattttatttatcctaaattaaaatttaaatagccacatgctgctgatgtctactgtattggaatcacggctttggtgttcttttcagcaccgtcagactgaattctgaagacttgactcttttctcctaatatgtcttaattcctttcctgggagtaggaacaatcttttaaagttacttgttgttcttggactaataaaggtattttctttcattataacccaatttatagtttggagattttaccataaaccaaaatatatatatatacttttgtagtaagaataccaaattggacatttgattctgggtagtcattacacaacagaggatgggatatctgccagagtgggtgctccgtaaatgtttacttgtgctgagtaaatgaaaaactgtattttattttaaccaatgctccttctcacacttactcacactatttccttttatatctgtacactgggagaaggaataataacttgcttgaagatacagtttgtttgaaagttggaggcttttgctgatttaaaacagatactggtttgtagttacttccataattcctttctactgtgcttaaatgatgaagtaccatttttatgggtctttaccttctaacatgtttttgcattacattttttaagaataactggtcacttaaaaatacttatagagttgtaaaaaatgattcaattttaaaaggagtaacttgcgtaaaagatattctgtagtagacatcatcctaggttgataatacagtcaataaaagtgtttattgctttgtacatatcaaagtactaaaggagtgaactgaagcagctgagatgttagaataagtcaattgtctaaaaatatgaatgcccacagatatgtttgataaagaaatgttttatgtgaagattttgaaaatctggttgatcactagttatcaatagtcttagagaaatttaagttttaaaatgcttataggataattgagaaagtaccactaagctgaacgcaaatttaaagtttcttcttacaaagcattcgacctgttgcccaagaaaaggctttcatctttcaagatgaaagaattaaaatgaaactagaacactgaaggctgctacagaagcatgcatttatttgagcatatggtagtaatccactaaacacatagttataatctatttgagaataaccagaacagatttgccagacaaagattctggcagatcaacttgctttttactatgaaaaatcaaagatgcagagaagcacacatataccaatgttttctttttgatttcaaagccacttcagcatttcttttaaaaagtattgtcttcatcctcataattaatagatagtttttcagattctaaatactgtaagtttcagtaatcagtttcattatttctgtgcagtcaaagaagactgcattggaaaatatgtttgtgtgcatttcaatacaataagtgtttgcaactcaatttcaaaggaatataatgtgtgatttagttattgattattgagttaaactacagacgttgaagatgcaggatcaaatcatctgaaataaaagggcagggaacacgtataaatgttttgcacacggagacactcaagtgcttcttgattgaggacatctgatttctagctggttttgcaattaaaaatattggaaagaaattgcagtagctcagtcaaatttatttgctgcaaaatggcttagaactacagagaattttcagttaatataattgaaattatttagttctgctctgtgacaagtgaaattattagttatcagggaaaggtaattacatatttggcctaaagttaatcaatatgaacacagaaaagctggagctcaagcagaatcaggaccttgttaaccacagttttgtaaaatgagttcaattgtagcacctgtggaataaatagaactgatcataaatacaagaaaataaattttctaatcatactgttctcagagatttacaaaatgctttgaacttcgttctgtatttaaactttttttattatttcacacagcgttttttaatcagcatatgctgatgaaaggcagacgtgtgccttgttacacctctaaacctcaaagatcatgggcagtcacagtaattccatttccccaagttaaggcataagcccgcattcacagtctgccctctgggatgatgcaggattgagtcaagcccagttcgattccttgagtcgctggagttgtttctgactgatccatattttcaaatccagcccaccagtgggcctgaggctggataagtgggctttcaccagggccctaacaagagcaaaaaaggaacatgtgcatagatttatactcctattctcaagggcctttgctcttattggaaccttaaccatatcaaaatgtatttcctaaacatatctgtgattatg

SEQ ID NO: 268 - DNA, 4043 bp, Homo sapiens
cctggataagttgatcttttgaatggtttttttgtgtctcagtctcctacagttctgctctgatatcaccatgcctattttaaaagattttgatcctttttagtccccaaattctctctctgcaggtggccttttttttttttttgagagtgaggctatctgattgatactctttatgctacttggagtatttaatatgcattggttctgtatttcacattatgcttttattgcgctaaagttgatattaaagttttatagcataaaatgtcatggcagggaacatttgctctaatttatcataattttttaaaaagaaaatgtctgctaagatcataataacagctaatatttatatgctagatctaccctaagtgttttacaggtattaacttctttgaccatggtgtggccattggaacaatgtaataatatgtggctcaataccataggttaatatcttaaacgttatttttcattctctttggatagccatgattaaactttttttttttttttgagacagagtctcactgtgttgccagggctggagtgcagtggcatgatctcagctcattgcaacctccgcctcctgggttcaagcgattctcctgcctcagcctcccaagtagctgggattacaggcacccgccattacgcccagctaattttttgtatttttagtagagacggggtttcaccgtgttggccaggctgctcttgaactcctgaccttgtgattcacccgcctcagcctcccaaagtgctgggattacaggcgtgagccactgcgctcagcctaaactttttatatgctaaaatccaacatgctacatctcctttagcatctaaaacaatacatacaatgataaatttcacttcaatctgtacaagagaagaatgctaatgatttgaaacgtcagctagaagacaggctgtcaggaacttttattatattttttactcactggaaaaatatgaattggaaatacactaataagttctctgctgtggataacatgggtttaaattttcatgttaaacttatttaatttgagattgtcttaattaaatatccatttatcagcataatgatgtttaatatagatctttattaacatggtttcaaaggccagtaaaattgtcaaatctaatgaaaacagagttcaaagataaaattctatcttccctttcttttatgagtctattaaaaattcagggcacctttttaaaagcccgtagagaagattaacctttaacatcatcatttaaatctaatgttaccacattttacagtgtcattgacactatgtttagccttagatagttgcttttcctaaccatattgtgaaactactaaattttttttttttccaaatctaatagaggaactgctctcttttttttctggtttctctagtgtagcacattctaatagaactttctccaatgatagaaattatctatatctacactggttaatacaattgctgctagccatatgtggcctaatgagcacttgaaatgtgaccagtgcaactgataatctgaatttcaaaatttactcattttatttatcctaaattaaaatttaaatagccacatgctgctgatgtctactgtattggaatcacggctttggtgttcttttcagcaccgtcagactgaattctgaagacttgactcttttctcctaatatgtcttaattcctttcctgggagtaggaacaatcttttaaagttacttgttgttcttggactaataaaggtattttctttcattataacccaatttatagtttggagattttaccataaaccaaaatatatatatatacttttgtagtaagaataccaaattggacatttgattctgggtagtcattacacaacagaggatgggatatctgccagagtgggtgctccgtaaatgtttacttgtgctgagtaaatgaaaaactgtattttattttaaccaatgctccttctcacacttactcacactatttccttttatatctgtacactgggagaaggaataataacttgcttgaagatacagtttgtttgaaagttggaggcttttgctgatttaaaacagatactggtttgtagttacttccataattcctttctactgtgcttaaatgatgaagtaccatttttatgggtctttaccttctaacatgtttttgcattacattttttaagaataactggtcacttaaaaatacttatagagttgtaaaaaatgattcaattttaaaaggagtaacttgcgtaaaagatattctgtagtagacatcatcctaggttgataatacagtcaataaaagtgtttattgctttgtacatatcaaagtactaaaggagtgaactgaagcagctgagatgttagaataagtcaattgtctaaaaatatgaatgcccacagatatgtttgataaagaaatgttttatgtgaagattttgaaaatctggttgatcactagttatcaatagtcttagagaaatttaagttttaaaatgcttataggataattgagaaagtaccactaagctgaacgcaaatttaaagtttcttcttacaaagcattcgacctgttgcccaagaaaaggctttcatctttcaagatgaaagaattaaaatgaaactagaacactgaaggctgctacagaagcatgcatttatttgagcatatggtagtaatccactaaacacatagttataatctatttgagaataaccagaacagatttgccagacaaagattctggcagatcaacttgctttttactatgaaaaatcaaagatgcagagaagcacacatataccaatgttttctttttgatttcaaagccacttcagcatttcttttaaaaagtattgtcttcatcctcataattaatagatagtttttcagattctaaatactgtaagtttcagtaatcagtttcattatttctgtgcagtcaaagaagactgcattggaaaatatgtttgtgtgcatttcaatacaataagtgtttgcaactcaatttcaaaggaatataatgtgtgatttagttattgattattgagttaaactacagacgttgaagatgcaggatcaaatcatctgaaataaaagggcagggaacacgtataaatgttttgcacacggagacactcaagtgcttcttgattgaggacatctgatttctagctggttttgcaattaaaaatattggaaagaaattgcagtagctcagtcaaatttatttgctgcaaaatggcttagaactacagagaattttcagttaatataattgaaattatttagttctgctctgtgacaagtgaaattattagttatcagggaaaggtaattacatatttggcctaaagttaatcaatatgaacacagaaaagctggagctcaagcagaatcaggaccttgttaaccacagttttgtaaaatgagttcaattgtagcacctgtggaataaatagaactgatcataaatacaagaaaataaattttctaatcatactgttctcagagatttacaaaatgctttgaacttcgttctgtatttaaactttttttattatttcacacagcgttttttaatcagcatatgctgatgaaaggcagacgtgtgccttgttacacctctaaacctcaaagatcatgggcagtcacagtaattccatttccccaagttaaggcataagcccgcattcacagtctgccctctgggatgatgcaggattgagtcaagcccagttcgattccttgagtcgctggagttgtttctgactgatccatattttcaaatccagcccaccagtgggcctgaggctggataagtgggctttcaccagggccctaacaagagcaaaaaaggaacatgtgcatagatttatactcctattctcaagggcctttgctcttattggaaccttaaccatatcaaaatgtatttcctaaacatatctgtgattatggagttcataatctaagaatctgaaggtgcatttctgtgttaaatgcagaaat

SEQ ID NO: 269 - DNA, 4032 bp, Homo sapiens
acctttaacatcatcatttaaatctaatgttaccacattttacagtgtcattgacactatgtttagccttagatagttgcttttcctaaccatattgtgaaactactaaattttttttttttccaaatctaatagaggaactgctctcttttttttctggtttctctagtgtagcacattctaatagaactttctccaatgatagaaattatctatatctacactggttaatacaattgctgctagccatatgtggcctaatgagcacttgaaatgtgaccagtgcaactgataatctgaatttcaaaatttactcattttatttatcctaaattaaaatttaaatagccacatgctgctgatgtctactgtattggaatcacggctttggtgttcttttcagcaccgtcagactgaattctgaagacttgactcttttctcctaatatgtcttaattcctttcctgggagtaggaacaatcttttaaagttacttgttgttcttggactaataaaggtattttctttcattataacccaatttatagtttggagattttaccataaaccaaaatatatatatatacttttgtagtaagaataccaaattggacatttgattctgggtagtcattacacaacagaggatgggatatctgccagagtgggtgctccgtaaatgtttacttgtgctgagtaaatgaaaaactgtattttattttaaccaatgctccttctcacacttactcacactatttccttttatatctgtacactgggagaaggaataataacttgcttgaagatacagtttgtttgaaagttggaggcttttgctgatttaaaacagatactggtttgtagttacttccataattcctttctactgtgcttaaatgatgaagtaccatttttatgggtctttaccttctaacatgtttttgcattacattttttaagaataactggtcacttaaaaatacttatagagttgtaaaaaatgattcaattttaaaaggagtaacttgcgtaaaagatattctgtagtagacatcatcctaggttgataatacagtcaataaaagtgtttattgctttgtacatatcaaagtactaaaggagtgaactgaagcagctgagatgttagaataagtcaattgtctaaaaatatgaatgcccacagatatgtttgataaagaaatgttttatgtgaagattttgaaaatctggttgatcactagttatcaatagtcttagagaaatttaagttttaaaatgcttataggataattgagaaagtaccactaagctgaacgcaaatttaaagtttcttcttacaaagcattcgacctgttgcccaagaaaaggctttcatctttcaagatgaaagaattaaaatgaaactagaacactgaaggctgctacagaagcatgcatttatttgagcatatggtagtaatccactaaacacatagttataatctatttgagaataaccagaacagatttgccagacaaagattctggcagatcaacttgctttttactatgaaaaatcaaagatgcagagaagcacacatataccaatgttttctttttgatttcaaagccacttcagcatttcttttaaaaagtattgtcttcatcctcataattaatagatagtttttcagattctaaatactgtaagtttcagtaatcagtttcattatttctgtgcagtcaaagaagactgcattggaaaatatgtttgtgtgcatttcaatacaataagtgtttgcaactcaatttcaaaggaatataatgtgtgatttagttattgattattgagttaaactacagacgttgaagatgcaggatcaaatcatctgaaataaaagggcagggaacacgtataaatgttttgcacacggagacactcaagtgcttcttgattgaggacatctgatttctagctggttttgcaattaaaaatattggaaagaaattgcagtagctcagtcaaatttatttgctgcaaaatggcttagaactacagagaattttcagttaatataattgaaattatttagttctgctctgtgacaagtgaaattattagttatcagggaaaggtaattacatatttggcctaaagttaatcaatatgaacacagaaaagctggagctcaagcagaatcaggaccttgttaaccacagttttgtaaaatgagttcaattgtagcacctgtggaataaatagaactgatcataaatacaagaaaataaattttctaatcatactgttctcagagatttacaaaatgctttgaacttcgttctgtatttaaactttttttattatttcacacagcgttttttaatcagcatatgctgatgaaaggcagacgtgtgccttgttacacctctaaacctcaaagatcatgggcagtcacagtaattccatttccccaagttaaggcataagcccgcattcacagtctgccctctgggatgatgcaggattgagtcaagcccagttcgattccttgagtcgctggagttgtttctgactgatccatattttcaaatccagcccaccagtgggcctgaggctggataagtgggctttcaccagggccctaacaagagcaaaaaaggaacatgtgcatagatttatactcctattctcaagggcctttgctcttattggaaccttaaccatatcaaaatgtatttcctaaacatatctgtgattatggagttcataatctaagaatctgaaggtgcatttctgtgttaaatgcagaaattattattgaaacaaagacctcacctttaaatgagagtataaagtactgcagtgactttcgcccaactgttctctattcacactggtcatttgtcactagacattggtcaaccttaagccaaatagtatcctgtcgaagcaatgcctgattattttccaactttttgaagtaaacattgctattgttctgctttttggttacaacagaaggagtttttggttacaagagaaagtaacacatcagtaatttccattcctaaaaaagttaatcaagaccaggcgcggtggctcacacctgtaatcccagcactttgggagtccctggccggtggatcatgaggtcaggagtttcagaccaggctgaacaacatggtgaaatcccgtctctactaaaaatacgaaaattaaccgggcatggtggcacatgcctgtaattccagctgtattcaggaggctgaggcagcagaatagtttgaacccaggaggcagaggtcgcagtgagccgagattgcgccactgcactccagcctgggtgacagagcaatactctgtctcaaaaaaaaaaataataataataattagtcagtggtttttttttttttttttttttttttttggaaagaaaaatactatgagtctgttgtaaatccttaaatggcgtaaaaatagctaaaattaggtatttactgtgctcttagtggttattttcctctctctctctccatgtatagagataaaatgagaaaaaaatatatttggatgtgcgtatatactatacataaactatcaaaacttggtttataattgtacattctatcacggacatccttcttgaaagccttcgttttgtataggtctgtgttttaaattttgatagttattaccaataaatcctctgaatattatagcctattcaaaatagctgtttcttacaggaaatggatatatgtgtgtatacatatgtataaatatatatacttatgtaatatatgtattgtatatatgtatatcatacatatatatgtatatatagtatattataaatacatatatatatgtatttacaaggagtcagtctcttttgtggaagtaaacattacttggtcagataagattattatgctaaaggaaggtagataattttgtgaatgtaatttgcatttctaaatgtggttattattattattattatctctcaacagggcccatttggaggccagcgctgagaagtggaacaggtt

SEQ ID NO: 270 - DNA, 4046 bp, Homo sapiens
aaatttatttgctgcaaaatggcttagaactacagagaattttcagttaatataattgaaattatttagttctgctctgtgacaagtgaaattattagttatcagggaaaggtaattacatatttggcctaaagttaatcaatatgaacacagaaaagctggagctcaagcagaatcaggaccttgttaaccacagttttgtaaaatgagttcaattgtagcacctgtggaataaatagaactgatcataaatacaagaaaataaattttctaatcatactgttctcagagatttacaaaatgctttgaacttcgttctgtatttaaactttttttattatttcacacagcgttttttaatcagcatatgctgatgaaaggcagacgtgtgccttgttacacctctaaacctcaaagatcatgggcagtcacagtaattccatttccccaagttaaggcataagcccgcattcacagtctgccctctgggatgatgcaggattgagtcaagcccagttcgattccttgagtcgctggagttgtttctgactgatccatattttcaaatccagcccaccagtgggcctgaggctggataagtgggctttcaccagggccctaacaagagcaaaaaaggaacatgtgcatagatttatactcctattctcaagggcctttgctcttattggaaccttaaccatatcaaaatgtatttcctaaacatatctgtgattatggagttcataatctaagaatctgaaggtgcatttctgtgttaaatgcagaaattattattgaaacaaagacctcacctttaaatgagagtataaagtactgcagtgactttcgcccaactgttctctattcacactggtcatttgtcactagacattggtcaaccttaagccaaatagtatcctgtcgaagcaatgcctgattattttccaactttttgaagtaaacattgctattgttctgctttttggttacaacagaaggagtttttggttacaagagaaagtaacacatcagtaatttccattcctaaaaaagttaatcaagaccaggcgcggtggctcacacctgtaatcccagcactttgggagtccctggccggtggatcatgaggtcaggagtttcagaccaggctgaacaacatggtgaaatcccgtctctactaaaaatacgaaaattaaccgggcatggtggcacatgcctgtaattccagctgtattcaggaggctgaggcagcagaatagtttgaacccaggaggcagaggtcgcagtgagccgagattgcgccactgcactccagcctgggtgacagagcaatactctgtctcaaaaaaaaaaataataataataattagtcagtggtttttttttttttttttttttttttttggaaagaaaaatactatgagtctgttgtaaatccttaaatggcgtaaaaatagctaaaattaggtatttactgtgctcttagtggttattttcctctctctctctccatgtatagagataaaatgagaaaaaaatatatttggatgtgcgtatatactatacataaactatcaaaacttggtttataattgtacattctatcacggacatccttcttgaaagccttcgttttgtataggtctgtgttttaaattttgatagttattaccaataaatcctctgaatattatagcctattcaaaatagctgtttcttacaggaaatggatatatgtgtgtatacatatgtataaatatatatacttatgtaatatatgtattgtatatatgtatatcatacatatatatgtatatatagtatattataaatacatatatatatgtatttacaaggagtcagtctcttttgtggaagtaaacattacttggtcagataagattattatgctaaaggaaggtagataattttgtgaatgtaatttgcatttctaaatgtggttattattattattattatctctcaacagggcccatttggaggccagcgctgagaagtggaacaggttgctgatgtccttagaagaactgatcaaatggctgaatatgaaagatgaagagcttaagaaacaaatgcctattggaggagatgttccagccttacagctccagtatgaccattgtaaggtaagtggataacctatagtgagtcgcttaattcaaattctagtgaggtagatatttgaaatacaattatagataagtatcagagttgaaccaattatcacaggattcccccccccaccaccgtctgcttttagttgccagtagacatttaaagtgcatacattgtttccatttgtattatcttcacatttaactaaatttttttcaaacactaccagtatctgaagtataatattgcttttagcttattatgaagtttatctaaatttctaataggttttagaatcataatatattgaggttttgggttttttttgttttttgtttgtttgtttgtttgttttaccaagtttcactcttgttgcccaggctggagtacaatggcatgatctcggctcactgcagcctctgcttcctgggttcaagcgattctcctgcctcagtctcccaagtagctgggactacaggtgcctgccatcacacccaactaactttgttttttttttttaagatggagtcttgctctgtcacccaggttggagtgcagtggcatgatcacagctcactgcaacctctgcctcccaggttcaagtgattctcctgcctcagcctcccaagtagctgggactacaggcacctgcaaccacccccagctaattttgtattttgtatttttttttttagatggagtctcgctctgttgcccaggctggagtgcagtggcatgatctcagctcactgcaaccttcacctcctgggtccaagagattctcctgcctcagcctcccaagtagctgggactacaggcgcatgccaccatgcccggctaatttttgtatttttactagagacgggatttcaccatgttggtcaggctggtctcgaactcctgacctcaggtgatctgtcttcctcggcctcccaaagtgctgggattacaggcatgagccaccttacccgacctgagaaaatttttaaactacaaattaatcttaaattcaaaaggcatcgagtcataaggaattacaaactatcttgtttgtgtttaataaaagtgaaaaataaggacttgtagtaaaaaaaaaaaaaagtaatgcagatgaagaccatactatttaaaatcattttatgtgttttacttttctgagccaagccttttctttgattacatttttatactgctcaaatttctgttcctatgcaaatgtatacttttactctgatcagccaaaagatatgctgaaatgttatcaactgacacattaatccttagatccttgtgtgattaaatttgtgccttgttcactttccattgatttctttaatatctctttatgcccattttcttgtatatacatatcatcttattttattgtatttttcactcctcccatgtaatgaaagttctcattctaaatctggtcattttaaggtgacactatgattctatttccattttaaaaatgacaaacacgaatgcacacatctcctaaaggaaaatgtcatttatgtaataagttgctttaatacaaaatgataagaccctgaaatttatttatttgctttttgaacccttgtgactagattatcaaaattaccatttgggtgtattttttttctttctactcgaagcaggaatatgatagagaaatagctccaagataagaaaaaggaaaacactgttgatgtatgatatgcaagataataataataatagaagatttaaaatgaccgatttaagaaaatcctattctctcctaactttttctaacttttacttctattaattattcatacagtagtccctttttgtgggttacagtattagggatgaaacagaataacacaaagctcttctaatagatgtgctctgtaaggaatacaagctgcttatggcca

SEQ ID NO: 271 - DNA, 4046 bp, Homo sapiens
gggaaaggtaattacatatttggcctaaagttaatcaatatgaacacagaaaagctggagctcaagcagaatcaggaccttgttaaccacagttttgtaaaatgagttcaattgtagcacctgtggaataaatagaactgatcataaatacaagaaaataaattttctaatcatactgttctcagagatttacaaaatgctttgaacttcgttctgtatttaaactttttttattatttcacacagcgttttttaatcagcatatgctgatgaaaggcagacgtgtgccttgttacacctctaaacctcaaagatcatgggcagtcacagtaattccatttccccaagttaaggcataagcccgcattcacagtctgccctctgggatgatgcaggattgagtcaagcccagttcgattccttgagtcgctggagttgtttctgactgatccatattttcaaatccagcccaccagtgggcctgaggctggataagtgggctttcaccagggccctaacaagagcaaaaaaggaacatgtgcatagatttatactcctattctcaagggcctttgctcttattggaaccttaaccatatcaaaatgtatttcctaaacatatctgtgattatggagttcataatctaagaatctgaaggtgcatttctgtgttaaatgcagaaattattattgaaacaaagacctcacctttaaatgagagtataaagtactgcagtgactttcgcccaactgttctctattcacactggtcatttgtcactagacattggtcaaccttaagccaaatagtatcctgtcgaagcaatgcctgattattttccaactttttgaagtaaacattgctattgttctgctttttggttacaacagaaggagtttttggttacaagagaaagtaacacatcagtaatttccattcctaaaaaagttaatcaagaccaggcgcggtggctcacacctgtaatcccagcactttgggagtccctggccggtggatcatgaggtcaggagtttcagaccaggctgaacaacatggtgaaatcccgtctctactaaaaatacgaaaattaaccgggcatggtggcacatgcctgtaattccagctgtattcaggaggctgaggcagcagaatagtttgaacccaggaggcagaggtcgcagtgagccgagattgcgccactgcactccagcctgggtgacagagcaatactctgtctcaaaaaaaaaaataataataataattagtcagtggtttttttttttttttttttttttttttggaaagaaaaatactatgagtctgttgtaaatccttaaatggcgtaaaaatagctaaaattaggtatttactgtgctcttagtggttattttcctctctctctctccatgtatagagataaaatgagaaaaaaatatatttggatgtgcgtatatactatacataaactatcaaaacttggtttataattgtacattctatcacggacatccttcttgaaagccttcgttttgtataggtctgtgttttaaattttgatagttattaccaataaatcctctgaatattatagcctattcaaaatagctgtttcttacaggaaatggatatatgtgtgtatacatatgtataaatatatatacttatgtaatatatgtattgtatatatgtatatcatacatatatatgtatatatagtatattataaatacatatatatatgtatttacaaggagtcagtctcttttgtggaagtaaacattacttggtcagataagattattatgctaaaggaaggtagataattttgtgaatgtaatttgcatttctaaatgtggttattattattattattatctctcaacagggcccatttggaggccagcgctgagaagtggaacaggttgctgatgtccttagaagaactgatcaaatggctgaatatgaaagatgaagagcttaagaaacaaatgcctattggaggagatgttccagccttacagctccagtatgaccattgtaaggtaagtggataacctatagtgagtcgcttaattcaaattctagtgaggtagatatttgaaatacaattatagataagtatcagagttgaaccaattatcacaggattcccccccccaccaccgtctgcttttagttgccagtagacatttaaagtgcatacattgtttccatttgtattatcttcacatttaactaaatttttttcaaacactaccagtatctgaagtataatattgcttttagcttattatgaagtttatctaaatttctaataggttttagaatcataatatattgaggttttgggttttttttgttttttgtttgtttgtttgtttgttttaccaagtttcactcttgttgcccaggctggagtacaatggcatgatctcggctcactgcagcctctgcttcctgggttcaagcgattctcctgcctcagtctcccaagtagctgggactacaggtgcctgccatcacacccaactaactttgttttttttttttaagatggagtcttgctctgtcacccaggttggagtgcagtggcatgatcacagctcactgcaacctctgcctcccaggttcaagtgattctcctgcctcagcctcccaagtagctgggactacaggcacctgcaaccacccccagctaattttgtattttgtatttttttttttagatggagtctcgctctgttgcccaggctggagtgcagtggcatgatctcagctcactgcaaccttcacctcctgggtccaagagattctcctgcctcagcctcccaagtagctgggactacaggcgcatgccaccatgcccggctaatttttgtatttttactagagacgggatttcaccatgttggtcaggctggtctcgaactcctgacctcaggtgatctgtcttcctcggcctcccaaagtgctgggattacaggcatgagccaccttacccgacctgagaaaatttttaaactacaaattaatcttaaattcaaaaggcatcgagtcataaggaattacaaactatcttgtttgtgtttaataaaagtgaaaaataaggacttgtagtaaaaaaaaaaaaaagtaatgcagatgaagaccatactatttaaaatcattttatgtgttttacttttctgagccaagccttttctttgattacatttttatactgctcaaatttctgttcctatgcaaatgtatacttttactctgatcagccaaaagatatgctgaaatgttatcaactgacacattaatccttagatccttgtgtgattaaatttgtgccttgttcactttccattgatttctttaatatctctttatgcccattttcttgtatatacatatcatcttattttattgtatttttcactcctcccatgtaatgaaagttctcattctaaatctggtcattttaaggtgacactatgattctatttccattttaaaaatgacaaacacgaatgcacacatctcctaaaggaaaatgtcatttatgtaataagttgctttaatacaaaatgataagaccctgaaatttatttatttgctttttgaacccttgtgactagattatcaaaattaccatttgggtgtattttttttctttctactcgaagcaggaatatgatagagaaatagctccaagataagaaaaaggaaaacactgttgatgtatgatatgcaagataataataataatagaagatttaaaatgaccgatttaagaaaatcctattctctcctaactttttctaacttttacttctattaattattcatacagtagtccctttttgtgggttacagtattagggatgaaacagaataacacaaagctcttctaatagatgtgctctgtaaggaatacaagctgcttatggccatatgctaatagtgtttaccgaaatccacatcttgaggtatgaaatgattttcctcttctggccttagcacataaagtatgtatcagcctctcagtctgtcctgg

SEQ ID NO: 272 - DNA, 4046 bp, Homo sapiens
catttgataagaccaatggaaggtttggatagtagccagttatttttgaattgcttgaagagaatcttgtaaatttgtagtccagaggtaattctgcgattgcttcaatacttggaattgcaatagagttgtaagtactgattcttttacaagaccatgtataaaccaagaagtcttctgtattttccagtcccaaaactgaatcgataaaaaagagtgccattttttagataaagtgtttagaggctttgcctttggcctctcatattttcctttcttctctagaggctctgactcctcgggcctctgactcctcacgccttcatcccctctgagttcttctaggatctaagacaccagagaggtcctggtatagaaaaaaacacagtccctgtttacatgaaatttacattcaagggagatcctctgcttatccttaaacttagagttcctgttctctgtgttttgagaaatcatttcccaaaaggttatggctgagctgtgaactgcgcattgttatcccaaatctcaggttgtctttgcccagtcatccacttctgtaaccccaacttttctcccttggtgttttagtctgtcttttgctgctgtaacagaatgtcagggactgagtcatttataaggaagagagatttatttggctcacacttttggaggctgggctcacagttccagaggcggggaagttcaaatcaagggcctgtatctgatgagggtcttcctgctgtgtcatccaatggtggaaagcacaaaggcaagagagcgttcatgacagagaggagatggaagctgaacttatcctttgagcccactcctgctataactaacccactcccactgtgataatgacattagtccattcatgaaggtcaaaccctcatgacctaatcaccgcttaaaggctgctcctcttaatatcagcacagtgtcacttaaatttcatcttgagttttggaggggacattcaaaccatagtacttcgttgcaattcgggcaagcttttagttcatgtacccatttatttccaatctcttctttaagggaatacagaactcttttcaattataacattatgatgtagctttaaacagaacataaaataacttttaaaaccaattttttcagatatgttttagcttactgaaataaagttgcttctcttttcatttagtcttgtctattattataaattctgttagtattttttctgatctcctactttttaggtcttttcctttttgtaataaagtttaaaaatctttttagctacaaagaactcttgtcttacagctcaaaagtacataattagaatcaatcaagatcaaccctcagatggcttgatactaatattagccaaggttttttattccctaaaagttcccatagaaagaaagggaccttgtacttgatttctaattcattctctaatcttaaggtaatagtttgaattactttatttcaagcaacacaatactgattaatttgacgtaaactctcactgctaatttaagatgtctaaagaatatcagatggaattttgtgaagagacaaagaacttaacactaatttaattattccaaaaggtatgatctcataaatgcaagttttgaataccactatatacaacctttatttaggggttgatttatagaaactcatatattctgagtcttctgattccgaactatctttatatattctagtcctttatatgtacataaatgatttaatgactccttttcaaagttactctttgataatagtggtgccaatcatttcattccccatccatccacccacctatccacactattcaccaaatgtcttaatgttaaagttgatgcttctgtacgaagagcaataaggtatagcctctgcacctcagtgatatattttaataattcctattactaaaagccctgtgcttgtggtttgttggctgtatccagagggaatactttacatttaaatgtttaggtgatggctctgagatttcgccttagaatagggatataaagcaatgctttaaagcatctcctatgttcaaacacctagcggttatagatcaaatataaaaaacagaaaaccaaacatggcattgtgggctccaaaacatgacaatcattctacaggccagaaacaaagcagaaaagcaaactagctagtgatgttgatgctgctggaaaaatgtagcagaccctagtgatgagcaggcaggaagccccatagcaaagactcagctcaaaacccttctcttacacacagaaatgagtgattcacagattggcatcctttccttccgtagtgtaaatgccccaggcactgctattatgaaacttcagtgtattgttgatccttaattaaatgtgcgtactttcttgggtgttttaatcagtgtctcagaacattgatatattttcagcaacatcaataataaatactttgttcagtgcttcaacaatacataaacatttgagacctggggcctagcacatagtaaacactcagtaaaaggtggctgatatcttttcccataattgttgggagtcttttctgatagttttgatcatttttattttgtttaaaactatataggctacatgagcagttttaactaaataaaactgtattaatacctgttatttaccacctagtataacccaacagaactagctttcaattactatctagattaacccgtcaaattagacaagggtcaccttatagtctttgcaagtatcagtttggtaaacagcacactcattatttttttcgtgtaagtacatgtttaattccctcaaatgttaacataaattgctacttaaaaaatatgtagtgttttaaggactgttttaaaataaatggataggctaggcactgtggctcatacctgtaatcccagcactttgggaagccgaggcgggtggatcacttgaggccaggagttctagattaggctggccaacatggtgaaacctcatctctgctaaaaatataaaaattaggtgtggtggcgggtgcctatcatctcagctacttgttggagactgaggcagtagaatcgcttgaacccagggggcggaggttgcagtgaaccaagatcacacctctgcactccagcctggcaacagattgagactcccgtctcaaaacaaacaaacaaacaaaaaaaaaaaagcagcttactaataaataataaaataaatgggtaaagttgaatcttcccatctaatgacttcaatcgaatttttagaatcatttttgaagttttgaagaagctgaggtcacttatatgcaacttccctttcaagaatgtgagcttatcattcagtcaacaattacctataatgcacctacaatgtatatagtgtttgtaatgttatggatttactctaaccaaatgctcttgagtggataaaattgcagatgcagattttactgtacaatttgcacttcattttcataacaatgtaaatattaagttatgtaggagcaattatcagagctctaataccctttctccaatagaatgcatatttgatgttagaaaagcaaatctagaataattgaaagtgcatgattcaggtataatttcttgtttgtgtgttctttccctcagggctactctggcctttgcttaacccagtttatttcctatattcaagctttattatataagactcagaacatatctggccttaagctgaattgccaagaaacattagcaaacttgctcattaaaataacaaattctaacattgtctttaaaacaacaacaccctactgttaaatttaggctgtgtgtgtgtgtgtgtctgtgcacacgtaggtgtggtagaattttttttccctactaaagtaatcggagactctgcctgaaattctgtaattttgaggtcttgttgtgttagaaggttgcctacagtgggaaacttgtctttttctgaaattaaaaaaaattattttccaagttcctctccaacctttgccagtctgtgttgacttactccttattaaacgctcagctc

SEQ ID NO: 273 - DNA, 4043 bp, Homo sapiens
ggaaatcctgttggttctctgttcaaaatatagaatctgaatctaccacctgtgacactcctctgtctctggaagtatcagtccagcaaccagagtgttcctattaaaataaatcaaactctgtaggggcttcctaacttattcagaggaaaagccacagctctcggaatggtctgcaaggccctgcctgatctgacctaccccctactcacaccttgctcatttcctctcttgctgttttttctctgacacactggtttcggccacactggtcccttgctgagctttcagtcacagtgccagcctgtctgctctgcccaaaatgccccttctttactcaacttctctacttgaactgcagctccctctgagcactccttctctctctctcattctctctctcttccccccccacccttttctacttctttctttttctatagcatttatcagaatctaacacaatgacttattttctatgtcttttttttttttttgcttggtactctggatgctcgataaaagttgaatgttgactgaaagagctatacccaagggaacatgtcctttggtgtgaatgttccttttgtctctttatttctcagtaattcttttttattcatttgcgttctaaagaatattacattttgaaaatattcctactttaaatagccaaatgtttaataaaggtaataactgaaatagaagtgtaagcaataatcttgtctcgagagctagaaatcatttcagttacatgacatatttgaaatgtaagcaaattaaataacacaatggcactttatgccttgatattgtagtcagttcagaggttatcttttctctatcttaatactgcctaaattttcaactcaagaatgggaaagatttttatttaagggaaaatgaattggcatacctttaattgttgagatagcttttaaaatatagcttttttttttttttagctgtatgtgctggatattgctagattcttccagtgtttgtgcttctctctgttgtaggaatttgatacctttgaatgctagttgagttgagattcttaacaaatgcagggagaagcttaaacatgtggagtctctcattcagtgactatgttgtcatgcattatattttataaataaatatagccccaagtcattgaagcaaaatataaagggaaagttttataattgttacaaatacaaaaaatgggcttctaaacacatttgtaattcttcataatgctgttctttgaaagcagtaatttattcaatgctaaatgagctcaattctagtgggcattcctttcttaaaagtataatttttaattatgaaaataataacatattacagagtttatgaaataaagaataaaaacatggccataattttatcaccataacaacccttttcattttgcattatttcctttttgcatatttaccttttgcatagttttacttgggtgcagagtttttatgtcatctttttcacttagatacatgtcatgcctatttcttcacattgctatgtggtcattatcacaataacttttcaaggttgcataatggcctctattgtggccatatcatagaacctaaatatattccaggtgttggagatttaagtttctttcaattttttaaaaatcataaataatgttataatgaacacttttgtgttcgtagcttttctggatcattttcttaggatatattcccaaaagtgaaattcctgtttcacacaatatgaccatagtaatgacttttgatatattgccagcctactttcccaaatgatcaaaccaattttttgcctccagcaatgtgtgaaagtgaagctttaccataccctggcctgtgatttctcatttttgttctattattagtgatccttgtattgttagcagtaaaatactagtacttcatagatgtatagaaatttagaaaacagttttggaatatcagacacctgagtcaaggttctctccacaaagaggaagaggagaactggtttgatgtttgggttagtcatgcctagaaggataggagaaaagctctccatggcttgttaaacacattagttgaagaaatttatatttgtctgaaattagtgtgtgtgatgtcatctagctgaccatttatacctccttagagaattgttttgcccttttattctggaagaaaccggttcacaaaaaaaccgctgcatttatttctttgctttctaagaatctaaactgatatgagtcttgcaacacagttttctgcttatgaaatattttggctttatcttggagaatcacataattccatttttttctttttctttttcttttcttttttctttttttttttttttttttgagacagagtctcgcccagttgcccaggctggactgcaatggctcgatctcggctcactgcaacctccgcctcccgggtccaaatgactctcctgcctcagcctcccaagtagctgggattacaggtgcctgccaccacacccagctaatttttgtatttttagtagagacggggatttcaccatgttgatcaggctggtctcgaactcctgacctcatgatccacccgcctcagcctcccaaagtgctggtactacaggcatgagccactgtgcccagcctgagccactgcacctggcccatttttttcataattaaataatttatcccttagaagagttaagtcatctactttcagatgttcctgcaaacggagggctttgttctggcattggtcaaccaaagctctaggtaaaatggctagaaccttcctctacaagtaagagtgaatagaggctttggaaagaaattcagtctgagacaagagctgagaaacatggtagaattttagattagcatgattttaatagtaatgggctgggagtggtgctcacacctgtaatcccagtactttgggaggaaaagtcaggaggatcacttgaggccaggagttcaagactggcctggtcaacatagcaagactctgtccctatttaaaaaaaaattaattagcctggtatggtggcatgcaactgtagtttagctacttaagaggctgaggcagaaagatcacttgagcccggaagttcaaggctgcagtgagctttgatggtgtaccagcttgggcaacagagtgagaccctgtctcttaaaaaaagtaattttttattctacagcactgaatagtttcaaaatatcttttcattcactgtctcaccagtgaagttagtaaaatgagagagatgattaacacgcagagaatttaagggacaaacccaagtaagggcccatgagcacaggatgagtaagggtgtgcctgtgtggtatggactggactgtacctaaggctttggctgcaaatctttgtctggttttactttaccacagaacagtatttttaacatctcctccttcattcatacaaaaatttattggctttccgctatacctgctctggcacaaatttcagccttccatgagggctcagtctggcaccagagtcaggtttgcaaagaggccatggtgagggagtgtggtgaatgctggatccccgtgagggaaggctgcagctcatgctggtggtgcaggtggcactggagccggatccctgaagggtcaaaaggggtgagccctgtggatttctttgactttcaccagtgagggtcaatgagattgttaagaaagcaaaacaacacagatgttgtcttgagataataatgtcttctatgggggctggaaggggaagactacttccttctactgcagagttgctccatgctgctttcttccacagacctactttgtatgaaatgctcccatttctcaggtgttttccttccttgatccccttctaacaatggcctcctgaggttccacattttcttttatgccagtttattcattttctcattcattaatccaaaagatatactgagtgctagaatctaatgagaaagagcagagctattgaaaatttgaagcaaggccaggctcagtggctcatgcctgtgatcatagc

SEQ ID NO: 274 - DNA, 4045 bp, Homo sapiens
ccatctcaaaaacagaaagaaagaaagaaaatttgaagcaaaagccttctgaattgcaaagaccatgaggaggaaatagcttggcatgttctcggaacagaaataaggactttgaagctagaaatgagggtgtattaggagatgacatcagacagcagggagggtccagaccttggtaggaagtttagaatttattctaagtgcaacaggaagccatgggaggagggttttaaacagaagacaggatctgatttatctatcattttaattttgtaatttagaaaattttaagaaaagtgcatgttagcaaagtttggtgcttgatacacggacaatttggataatggctttagattgaagaaaggttaggaaagagttgctatttaaagaaggggggtgaccccaggatttatttcacacccacatgtttgcttttctctgttcttagctcagtccatatgaccaactgctagtttaggagagaagggtttagcagggattcccctcttccctccaattctcttagaccctgttttcttattaaaagatttgcaggatcccatctcggtcagtgatgtcagcaacccagccattatggtgagctgatgccatgctcatgaagaaaatgaagatcagctgattgacttccaagtatttctgccctaagccacgccaatcacttctttataccgtcttatcttttaatctcttgtctttctcactaagttgtagcaggtgggagaaatgttccaagaccattaaaggaggataattgggaatctctgtatagacatttaaagttgaataagcagcagtttattcggctgcctggtgctcagaggcacaccagtagcatccaaagagcaccctgagttcgaaggagtcggagaggtgggacaggaggaagggtgtcttcaataaagtgaattcaggctcttagacattctgttgagaatggaaactgtgatttttagtagctacattctgatatttacaatcaggtcttcattaatctgccatttcacggcttcatttagtttaagtaagtatgtggaaggtacacaatcggacaagccatgagagactacattaccttcaatgtgtttattctatctgttttcttgagttgctttccaccttattacctctaagctagttacaattttttttcaacacacagctcatgtgtgtttgagaaggttgacctccctccctcctctgtgtatttattcataatgaggctccttggtaccccgtgtgtacctctttcagagatttgtggcacttaaccacgttctgggctagtattgttctctcttcccctttatactataagtttctcaaagattgagtttatagctgatttttgccttctcttatgcctaacgtatttttatatattgtatatatttgtactttaaaatttttattttggtggaaatctttgttgaaaaatctattatatactttaatgccacctaaggatgggagaaaatttgaatgttttcttttggacacaagataatcattgtgctctccagttgttatttttgactcttgaggtatttgggattatatctccttctactaaacacctcagagcatgcgacttctaaaacatgatttcagtattccctttgttgctgttgttgttgttttgagacagtgtcttgctccgtcgcctaggctggaatgcagtggcaccatcatagctcactgtagcctcaaactcctggagccaagcagtcctgcctcagcctcctgagcagctgagactataggtgcatgccacaatgcctggctaatttttgttgttgttattgagacggggtctagctatgttgcccaggctggtgtcaaatttctggcctcaagcaatcctcctgccttggcctcccaaagtgctgggattacagttatgagccaccacagccagcctcagttttcctttttgaaattattttgtatcttcctacttattctaactgatgctggtctattgcttggaggccaaaacttcactttatacaatttgtctgggaggggaattgaaggtcttttcacatatctactacaggctgagcatcctttgtgtaaaattcttgggatcagaagtgtttcaaaattcagtttttgggattttggaatatttgtgtatccataatgagatatcttgtgaatgagaaccaagtgtaaacatgaaattcatttgtttcagatataccttagacacatagcctgaaggtaattttatacaatacttaaataatttcatgcactaaagtttgtatacatttgaaccatcagaaagcaagagtatcaggtgtggaatcatttcagcactcaagtttcagattttggagcatttcagatttgggattttcagattagggatgctcaacctgtagaatgcaaaatacataagctttgtgacaggttgtcatgtaagagcacttttagctcaatggccaagccttgagccagcaagtagccagatatctgctgcatagagaagtatgtggttgctaggtgtctctcccatcaaccacaaggactctttccctaacttccttgatagaaaacattttaacagaagcaatcaccctcattcttcactcactcagctctgagagcaccaatctctaagctaggcatgcacttgcctcagagcctttgcactttccattttctctgcctagattgctcttttgccagatattctcatgccttgctccctcacttccctccggtttttttttttaaatatcgctgtctttcagatgccttccctgaccacttacacaaaatattaccaaccctcatcttcaacccaccatcctctcccactcatcctgtgtggtagatttttatagtaatgaatcatgcctccctgtgtccacactcctatgcagagggaaatttttgctcttttcatcaaaagataaagtacatttttccattctcttgaatctgttctggcttcatgacatgcttcaaacaatagactgtgacaccgtgatgtgcaaactctagagctttgctgtgtaacataggaacccttagacatatgtaaccatttgtatttaaatcacaattagataaaatttaaaatttagttcctcagctgtactagtcatatttcagatactaaataaacatatgtgactagcaggtaccatattggagagcaattagagacgacatagggagaaactgaggtaccccagacaataggcagtgatgatttccagacatgtgagtgaggctgttttgtcccgccctccccatccaagctgcaggatgactataacctcactagtaatcccaggtggtaccagccaaagaacaggtcaaattgccaacccacacaatcatgaaaaataattgtcattgttttaagctataagttttatataggtttgatacacagtcatgataatggaaacacccttcaattctaatgactgacagtaatttggaaaccatgccctaaggggttacctcatgggtgagaatgtcacaaaatgaggaagacagagtgaatccataccatccatgacagtcagatcagttccttatttatctaaaaagagaaaaggatatttgctattactaaaataaaaaccaactgcagactgaaatacttattaatagcacagacttagttttacatcaaaaaattactaccagcaatttgcaaagtagataatttaaaaatacagaactaactgaaatccattatttcagtttaagatgaacagattgggtgactttgttatatcttgctctgacatgttttgtaacattaaatacatagtatttaattctgagagcatttctcccataatttattatgctcaagcatttattgagtgctttctatatatgtctaggcaggtacagtagaggatttcagatgattaagacctgaaccttaccatgcaagaactcacaatttaatggaggggacagatgcatggtcaaaatatatgcacattaacacagtacaagctctgttagaggaataggaagtgctctagaaaca

SEQ ID NO: 275 - DNA, 4045 bp, Homo sapiens
tctctagacttgcctgtttgggacattgcatggtaatggaatcttacactatgccctttcatgtctagcttctttcaatgagcatgattttaaaattcttccatgttatagcacatatcagtatttcattcatttttattactgaataagatgtcattgtattatggatatatcacattttgtttatccattcagcagttgatggatatttgggttgtgtccatcttttggctattatgaataaggctactataaacattcatgtatgagtgtttatgtggacatgtttttctttttcttcggtatatacctatgtgtagaattgctgggtcatgttgacaactctgtgtttagcattttgaggacatgccaaactgatttccagagtggctgtgatatggtttggctctgtgtccccacccaaatctcactgaattgtaataatccccgcatgtcatgggagggacccagtgggaggtaattaaatcatgggggcaggtttttcccatgctgtttttgtgatagggaataagtctcacaagatctgatggttttataaaggagagttccccagcacatgctgtcttgcctcccgccatgtaagacgtccctttgctcttccttcgtcttctgcaatgattgtgaggcctccccagccatggggaactatgagtccattgaatctctttcctttgtaaattacccagtctcaggtatgtttttactagcagcgtgagaatggactaatacaggttgcaattttaccattccaccaacaagcatcaaggttcctgtttcttcacatcctcaccaaaagttgttattatctggaacagaactgttttgaatgaaaatataaactcattaaaacagaaaaattccaattatattatgttatatgcatttaaggtggcccatatatcagtcacgtgatattagaacttaaagctgaatgccactttgtagctctgtgtacaaaacagctcattggagtctaatgatcttatcattaatgttcaccaggtggttgggaaatgcaggttttcttttatgtctaattgagagagttaaagtgtgaaatgattatatgtataaaactgttgaaagttaaatctatttctgacatacaattaaatataattgaaataggacaaattgaataacaaaattaaatttacaaaacaggatatgaatggaaattatcatatgtatgctgctttgtaggatatttgggtggtgcattggcatgagggccagagccctgtatttgtacttacttggcatggttcccacctgcccaggcttgcctcctgtacttccctacattggcatatcaaaggagttcgcgagacattctccagccagcaccctgcgcagagaggatttctttttcttttttttttgttttctgaagcacggagtttaatgtggttaggaagcaaaatacaatctaagactcagacttgcttttaatgaatccaggagacctgacaatgatacattataaaaaacaaaaataaaaatctgacaataccccccaacttgtcagtggcttcccatagcccatgattgggttgagtgagtctcagtgcataggaagcagtgcagtggtctttgtggcctgacctccgcccacaccttcagcttcagctgctaccgctctctgagtactgaagtttttatagttccctgagggcgcacactgtgacactcctgcattctctgctagtgtttagtttcctttgctgggagtacctttccctctctgcaagactcaatttacgcaccacctcccccaggaagcattacagatcccccaaggctctactaggtcccagacatggcattagtctgggtgctttgtttaccatgctgaacaaaaacagaaaaagtccctggtctagtggagcttatattttatctaagagagggactaaacaagaaatatagaaatgtcacctcttttgcatagtagaaggtgccaggtctaggaaatacaaagatagttaagcagaataatgagaatgggaaatgtaggggatgagaaaggtggaatgctacattcaataaggtaggtgggtgggcctcaccttctagacagccttaaaaaggatgagggaatctgtgatatggctaaatctagggaaagagctttccaggcagagcaaacagacagccaaagagattactctattgtgagagtctccatgttaaacaaataaaattccatccataaaggaagttgataggttggttttccaaagtatcctttctatagaccaatatgtacatatttccatttcaatttttgaaatctaaaaagaagttccaagacaaatctctcctttgccctcttccctccccacacccctgcacaatgcacattttgtggactattaatagtctagaattcctaatcagaaattactgtacacctaagttgcacagatcatattgtcttctttctccaacaaaagatctggatttgcctgtaaaatatatgccccgtaatagttttatatttccagagggccagttctgcctctgctcttccttctctgagtcatttgcctttatgtcccgtcttctctcagtttttaatctttccacattattgcctattggtgttttctggttgatcttttgtgctaaattctaaatgccattgtgtgaattcttcctcctatttgataaaccagagtgaagacctgttctaagatcttcatcttctcttcagtggcttgcattaaatctgtacattcctggaacttccccttccccaggaagaaatctagcacaggccttgcacagcattttaagaatctttaccactcctgagccaggcgtggtggcccatgcctataatcccagcactttgggaggccaaggcgggcggatcacaaggtcaggagatcgagaccatcctggctaacacagtgaaatgccatctctactaaaaatacaaaaaaattagccagacgtggtgatggggccctgtagtcccagctactcaggaggctgaggcgggagaatggcgtgaacccaggaggtagaggtgaaggttacggtgagctgagatcgcaccactgcactccagcctgggcaacacagcgagactctgtctcaaaaaacaaaacaaacaaacaaaaaaacccaacaaactactccttgctgggtgtggtggctcacagctgtaatcccagcacttgggaggccaaggcaggtggatcacctgaggtctggagtttgagaccagcctggccaaccatggccaacatggtaaaatcccatctctattaaaagtagaaaaattagctgggtgcagtggcaggcacctgtaatcccagctacttgggaggctgaggcaggagaatcacttgaacctgagaggcagaggttgcaagtgagccaagattatgccacttcactccagcctgggtgacagagtaagactccatctcaaaaaaaaaaaaaaaaaaggaatgtttactgctcccatatttactgatttgatttggattttggaaatatcttgaccactaaaattaaaaaaaataattttgctatattacctgctggttttcactattttttaagtaacatgatttttcatgtcgttattatatatttttaggtgattatggaagtaaatgctaggaatatttttattcctctagagcttcttgctctaacaacataataatctaagttaaagaactggctcaagacttgtaaatgtgtatttttttggattaaaaatctttttttttccatttttcttgtatctctttttatttccatatattaaaactttaagtgccagatgtatataatctttttttttttttaatttcctgaatgtcacacatcctgcgatttcttcacaagctgcgtttgttaaataggagatgatggaaggtttgttatccccgcccccacccaccaacatagtcatttaatgctcatcagtgataattgctgtgtgaatttagttgatttgtgcttgcttcgctgtcagtctttggttttatggatctaggaagga

SEQ ID NO: 276 - DNA, 4043 bp, Homo sapiens
ttttcttgtatctctttttatttccatatattaaaactttaagtgccagatgtatataatctttttttttttttaatttcctgaatgtcacacatcctgcgatttcttcacaagctgcgtttgttaaataggagatgatggaaggtttgttatccccgcccccacccaccaacatagtcatttaatgctcatcagtgataattgctgtgtgaatttagttgatttgtgcttgcttcgctgtcagtctttggttttatggatctaggaaggacatataaatgtacctttgcattttagagaaagttttattttatcctatatcctgtgttacatcactatatcttaattgtggattttttggttcactttgctcgttcatttaaattttttatcaaagtaataattgtatagtttaaaaatcaaaataatatttacaatgcttacacacaaaaaaatagcatttttgtcactccgtctctcactagttcttgtcagctcttctcatccctccccacctgtgagggttaagctacactttggttagtccaagcacactttccagtatgcttaccatgttatgacttatctcctctatacacgagtaggaaaattatcagtaatagtggtttctagagtagtacttgaggagggtaacgggtggcgtgtgcatgcttcatggccttattcaatcaagcactctactcttgatttactgctaaatcctccttgaatctttagatttcctaaaggctatcatgagattttctggatatagaaaatgtagcccattagtctctgtcagcttcattaccagggtttttttgtgtgtatgttgcttagatccatatttttatataagataattattctggtatttctagattttttcattcttaccttttattgactatggaagaaaaggatctagcctgcaaatactgtagcatctcaacatagtgatgtcaaatactactaaaaatttagttgtcttcaaaaggaaagattttattcattctaacatataatgaaagttcagtattttagaaaataaaagtctgacttttcataataggttgccagggaactacaccgaaggcaaaatactagagccagtaggtggttatgtgtttaattttaagaggataacaacattaacaaattccatttggcaacagcgttaaaattgcacctgggaaaatcttcattactcttatcttgcagcagtcactgaaggagtttggttgtttttataggtgcaggggtgaaagtttagctccacttcaaggaacaaaggtgctaaagagaaactattctgagaatcatagatttgcatgaaaaacctcacaaaagaaaaatagtaattgcctcagcatgagagatggaacatattttaagataattggagactgttttatatgtgccctcattggtttatttttgatttcatgtatgtactttgtttctatcgcttcatttttttttcttaatgtattctaaataatgtaaaacccttctgaggatcttattgctacttgtgaaattacctttctctgtatcattggatgtaatttttttgtcagtcagtcttacaagaaaaaagtatcttagcaaaggctattatattttatcaatctgacatcagtgaaaatcctaaaagtacattttgtgtaaattcaaatacactgtaacaatttcccttaagtgaatattttaaagctgtttctttttttgtatacttaacgtttacagaaattatcttttttcctttgtatttttcttcattcatatctataaaatttacattttggcttctaacttagctgaaatgcttgctattagtcattttcttgctaagtgtggtcagaagtggtatagttgaagatgtcccataatttggtgaacacgtgaggttacaaactcaacttttgcttctcttttgaaaggccctgagacgggagttaaaggagaaagaatattctgtcctgaatgctgtcgaccaggcccgagttttcttggctgatcagccaattgaggcccctgaagagccaagaagaaacctacaatcaaaaacaggtgagactggtttctccactacatcataaaaacacatgctaggagaacaaaaaacccaaaatcaagtaggaaatttccttacagcattttaggatctaatatttaaatcttttcttctaagtgttactttattcaaatatgtcattaattcacagatatctagattcttaaattaagaaaataaaatttttgtatacctcaatatcaattttaaaggaaattaactgcagaaaaaatagattgtctaaaaagtgtactgtaactataaaagtaatttctataagaaataaaaatttatattatatttaaacaagttacatgataaataattgcaagtagtagaaagttattaaaatataataaatatacaaaatatttcaaggtctataagtaagattacttttgataatgacacaccaaagtcctttcttttacaagcagacaacatttctttaatttaaaaataataccctgtgtgtttatttactttggcttaaaatttaaataataactaccttactagcaaatttactagcaaaaaatatatatttcttatatttaaacatgttatgtgataaataattgcaagtagaagacatttattaaaatataatagtaaatatataaaatatttaaatatctatatgtaaggttacttttaaaaatgagagaccaaatacttttcttttacaagcagacaacatttgtttaatttaaaaataacctgtaacatttatatactttagcttaaaattgaaatagtaactaccctactaacaaatagcaatatatcacatagtaaacttaagagaaaatgtgtaatgaattctgggtccaatatatatctgtattgtgatttttcactgctgacaataaaatcattctgatgcatttttaaaaataaacatgccattcaaaatcgtttttcatcattcacttcacatagtaacagcaaacctgaaagattgcctcatgctgtgtccagcagtgtaaatcatgaacatttattacttgtaagggaagcatagttagaaaatgctttctttgactataactggaactggatcagacatatggacaggtagccgttttcctactgaatcttactcaaggaaccttcttcagtccgaataaatttcccatcaagaccataatctttttgactctctgaaactagttgtatatatgtgtgtgtgtatatacacacatgtacacacacacacagcacacttaacttgtctagcatttctttttgttttctgctggtggtaacactgtctttccagttagcctcctacaaagctaagtcattgttgagtcttccacttttcaccaaatccagtggtctacaaatcactcataattattatttcttttctttttctttttttttgagacagagtctcactctaccacctaggctggagtgtagtggtgcgatctcggctcactgcaatctctgcctcccaggttcaagcaattctcatacctcagcttcccatatagctgggactacaggtgtccaccaccacgcccagctagttttcatatttttagtagagacgaggttttgccatgttggcaaggctggtcttgaactcttggcgtcaggtgatctgcctgcctcagcctcccaaagtgctgggattacagacgtaagccactacactcagccttatatttgttatttctatctttgaagaattattccttttgagtactctgttttatatatatatatatatatatatacatatatatatatatatatacacacatatatatatatatacacacatatatatatatacacatatatatatataaaaaatgtatacacacacacgtacatactcatgtgcacacacatactgccattaattccacattctcagccttttgtgtgtagacttagaatagttttaggcagaatctgttgctacttttggtagcattggtcccattgcatt

SEQ ID NO: 277 - DNA, 4042 bp, Homo sapiens
tttaaaaattattccagttaaagaattactgttactacaactactattttatttaagctgcctgaatatcatttctgtttcagcctggagcagtcaattttgcttaatttaaatattttattaataatcatagaaaaacccagctattacttaatttagtctatttgtgcatgtatagttgagtatagtgggtatagttgtgtatgtgtgtatgtgcatatacaactttatatagttgtgtatgaatgtatatgtgatgaatagttaataataatttttcagatgaaaaagtatgtatgggttaatgttttcctctttggtcctttgacagatggctatgtatatttagtacataatatggtatgtaatatttaactcagggtatactgtttaatttttaaatatttcctgatattttagaaagccaagtattaagactatttttcttccctgtaaaatctcatatattttgtgatacaacgaagaatttataagtgacatattcagtccactatgtcagtccactttatgccagtattagcaaacttatgcaaatacaatttcatagttattaaatgagtgaagatttgaaattattatatagtttagtagaagttacttttatattctccatataacttaaggttacaacattattttcttgtatgtaataaaatgaggacaaattacacattagttaatagaagtaactgggctagtaaaactaatgggtgttttctcccagggcttttgttttcctcactaacaactttattaattggagcctcattcattgtaaatgacaggcacacagcttccctaagtgtaggcatgaaggggaaggcattggcctccataaccgagccacggtagagacgtagctgaccacagggactggaataccacccagaaggcttttctccatgtcttcttctctgcttctctgtacaggttttcattttcttagctttcctatgactgtatagctcacaacctcataccaggaagggctcacccttctttagatccagaatattccaggagagggctctggttgacttggcccgagtaacatgggactcagggactgctaggattggcagaccttcttcataatatcatgctaaatggaggaagaatccaatcccataaaggaaggggaaagtgaaaaatggtagtaaatgcagacattcccaacaagccagaatttcacaggtgctgaccatgtgccacacactgtgccaagaaacttacctaccttgtttaattgcattctcataataattccttgaagggtgaatacttaccacccattctacagatgaggaaactgagagtctgagaggcttagaggcatactgtcttctatgtgacagagccaaaatacaaactaaggcttatgtcacaaaacttgatgctcttaactgccatagtgtactatcttaaactacttccgtaataattagtatttgtagctattcaatagaaacaacattttattttcattttcttcgattttaaaataattcacacagtaattgaatatgtttataactctttgcttttttctttattgttgctctttcttcactgaaataccacgctgcataatggaatcataaacagttcactgatttcctaacaccgagggagaaggtgtctaggcaatattagactttgtctttttaattttcatataaaaatttgaagtataagtaattgctttcaggcctatagaccacgacaataatttcattagcttctcaagtccaaattagattagtaaagttgtaatgcatgaaaaagcgcagaaaaatataatgttactttcttttccggtgttcttaactacagagcagtaatgtgatttttcacaaattaaagttctataatatctgtatgaatataatgcatctagtcttcaacttttctaaaatacaacgagccagctgagtaagcccatcgattgggtaaaaatttggaaaatgtttttcatgctaactcctactgtagtaataaaatctcatttaaataaacaatagtcttcatgaagaattatatgataaagatttgtttgatagacatagcattttcaattaattgtttaccatctgttatgttctctaatcagtgttacagccattcataaatcacatttgcctcataaaaagatggcaatcgtttacacgtgtgtattttattataatcagcatctgagacattactttctgatttaaacataaaggaccggaggatacaagactctttgagcgtggtataatgtacttatgttttgtgattgttgttgttcttagtagaaaactggaatcttccaagaattagaggttttgccattttttaagaagtataatcctagcaaaggcatgaattctcctcttcaattaaactcatcacttattttggcagtacataaacataagccatatttaacttataagaatggcagagcatgggtagaaagctccagacttctctgtagctcgatcaatcactaggggctgtgtttagctgggaagcagcctggggagagatgggcagtcatgtggcaagaaataaaagactttgaatctaaaactcctgtcctttgattcttgaaagagaaaggggagaattttcttctttattttctttttctagttaaagatattgtacagagattgatttatgcatttaacaagtacgttttgagtgcctaccatttacaaggggggtgttctagatactcgggatacagtagtaggcaaaacagatgtttttttcctcctgaaacattctcagcttttcctctttccttttattgccacctgcctgcccccagtgacccatctgttgatgtccagcccaaaggaattcacttgaataaatcgcaaaactgccactacttggaggaaattcagggattattcctgaatgaagaaaatggaaagatctcaggttgcttagcgaggccctggttgtctgttccagggtctctttgctcttcctgcttctttccttggagttgcgtctgtctagtggttggcccctgcttcttcctccactcaactctgggcttatttactttggccacttcacaagaagagtaaaccttgaatgtatttagactccagttctgcctctattgacttcaggtcagtggtgccatgtagctccctccaaagcgtgttttgtattctgagttccccttcatttgtgtcccctctcttaataacttgcatttactatttgtggaaggtagtccctaaatctgtttacttttgaggtcttgatgttccctaaatatatctaggttctcttttcttaaaaaaagaaaaaaaaagaatttgagaagtccactggcagcatggatgaatctatgccatctttatcatatctgtattgaaagatttaggctacatattaacaggtgaatctgctctgagtagcctcttgttattgtcatccttataatttattaaatggacataattagaagcactaatcagccgtggcacttgatgatgtacttgtaatctggctcataatgagtggttgtcatcagttattgtacagagtaggaaatggtcagggccctctcaaacactgattgaacatttcagagttattaaatggatcttaatcactttatcagaaaattaggaaataatgtatttcccaatattttaatcagaaacatcttttggtcatgaggaaagagagagagaaataggaggggggtaaagagagagagatattgagagagagcaagtcaagtcttttcctttgagttcttattggctaatcaacctggtttgcttatgtgaaaatctctacagatatctaagcctcccagagctagttataaaatagtaaaaaggaatgaaagagtaaccttcctcaagaacctactgtgtgccacacatgtgccagtagctttctatgtattaactgaggttgaaagagataaggaatatatctaggattatgtaactagttagtattggaactggcatgcaatctcctaatcttttcttctaccaaa

SEQ ID NO: 278 - DNA, 4046 bp, Homo sapiens
ttagactttgtctttttaattttcatataaaaatttgaagtataagtaattgctttcaggcctatagaccacgacaataatttcattagcttctcaagtccaaattagattagtaaagttgtaatgcatgaaaaagcgcagaaaaatataatgttactttcttttccggtgttcttaactacagagcagtaatgtgatttttcacaaattaaagttctataatatctgtatgaatataatgcatctagtcttcaacttttctaaaatacaacgagccagctgagtaagcccatcgattgggtaaaaatttggaaaatgtttttcatgctaactcctactgtagtaataaaatctcatttaaataaacaatagtcttcatgaagaattatatgataaagatttgtttgatagacatagcattttcaattaattgtttaccatctgttatgttctctaatcagtgttacagccattcataaatcacatttgcctcataaaaagatggcaatcgtttacacgtgtgtattttattataatcagcatctgagacattactttctgatttaaacataaaggaccggaggatacaagactctttgagcgtggtataatgtacttatgttttgtgattgttgttgttcttagtagaaaactggaatcttccaagaattagaggttttgccattttttaagaagtataatcctagcaaaggcatgaattctcctcttcaattaaactcatcacttattttggcagtacataaacataagccatatttaacttataagaatggcagagcatgggtagaaagctccagacttctctgtagctcgatcaatcactaggggctgtgtttagctgggaagcagcctggggagagatgggcagtcatgtggcaagaaataaaagactttgaatctaaaactcctgtcctttgattcttgaaagagaaaggggagaattttcttctttattttctttttctagttaaagatattgtacagagattgatttatgcatttaacaagtacgttttgagtgcctaccatttacaaggggggtgttctagatactcgggatacagtagtaggcaaaacagatgtttttttcctcctgaaacattctcagcttttcctctttccttttattgccacctgcctgcccccagtgacccatctgttgatgtccagcccaaaggaattcacttgaataaatcgcaaaactgccactacttggaggaaattcagggattattcctgaatgaagaaaatggaaagatctcaggttgcttagcgaggccctggttgtctgttccagggtctctttgctcttcctgcttctttccttggagttgcgtctgtctagtggttggcccctgcttcttcctccactcaactctgggcttatttactttggccacttcacaagaagagtaaaccttgaatgtatttagactccagttctgcctctattgacttcaggtcagtggtgccatgtagctccctccaaagcgtgttttgtattctgagttccccttcatttgtgtcccctctcttaataacttgcatttactatttgtggaaggtagtccctaaatctgtttacttttgaggtcttgatgttccctaaatatatctaggttctcttttcttaaaaaaagaaaaaaaaagaatttgagaagtccactggcagcatggatgaatctatgccatctttatcatatctgtattgaaagatttaggctacatattaacaggtgaatctgctctgagtagcctcttgttattgtcatccttataatttattaaatggacataattagaagcactaatcagccgtggcacttgatgatgtacttgtaatctggctcataatgagtggttgtcatcagttattgtacagagtaggaaatggtcagggccctctcaaacactgattgaacatttcagagttattaaatggatcttaatcactttatcagaaaattaggaaataatgtatttcccaatattttaatcagaaacatcttttggtcatgaggaaagagagagagaaataggaggggggtaaagagagagagatattgagagagagcaagtcaagtcttttcctttgagttcttattggctaatcaacctggtttgcttatgtgaaaatctctacagatatctaagcctcccagagctagttataaaatagtaaaaaggaatgaaagagtaaccttcctcaagaacctactgtgtgccacacatgtgccagtagctttctatgtattaactgaggttgaaagagataaggaatatatctaggattatgtaactagttagtattggaactggcatgcaatctcctaatcttttcttctaccaaattgtccaacagtaaaaatgccagttgtgaatttttttctttacttgattgttttaatatttccttttcgtcttttggtagaataaaacaataagattatagatacatgcaaaaaagcaaatagtataaataaggtatttggaattaccatacctgaaatgactttgtaaggttgatccttctatttcacaatagtttttttgtaagtgctttacacagatgtgagaaggaggaagaaaaatgaagtgaaaatatgtccacttaaaagtgtaaagttgaatgttctcaataaagaggagcactaaaaattcaattccgtccaactcaattaagtaattatatactgaggacataccaatctctagactggctactataaaatcaatatggaaggaaagaaaacattcttgacattgggctttaaaacgtaagtgtagaaaagccacaatggagattacaaatgttgatatcataattgagaaaaaaacaccatacatatgggaaatgtttattaaacaataacactgggcgaattctaataaatatctatcattatttcatgggagaaacatagtttcatttttaaaatttaaaaaatagctttgcataagcactcaaaggaagagttttttttcctctactatcaagatttctttgagatatacagaggctcaaccttcttacataattgaattgaggtaaaatagactcttgaaataaaatatttttctagcatgagaaaatagggtttgcacttgataaaattgggctgggcaggtcaagtaactggcctaggggcaatgggcaaaatgggagcaggactgattccaaatcctagtctctgttcctggtccagctttggtttttcacctgcattctagggaagtgtattatagtcttcttcctcatggtataaaggagagcgtggcataaatgctgtgccactaatttgcatatttgaagaagtaaaggtaattggatgacagaaaacatcaggattgatctttcctttttcctctcttcctttgtcttcttcctgtttcttctttctaaaagatagttatctgtggtcccttaaatagctttgtaatgcaataaataaattggtgtttaaaaattatgaaatatgaatataaaataatattcataatacatgatacataaatatataatataaataaatataaaagtataagtaagaggctaggtgcggtggcttatgcctgtaatcttagccctttgggagactgaggtgggaggatcacatgaggccagaagtttgagaccagcctgggtaacatagtgagacctcatccctaaaaaaaaaaaaaaaaaattagctggccactgtggcacataactgtgatcccagctactcagaaagctgaggtgggaggatcacttgagcccaggagtttgatgctgtgagccaggcttatgctactgcacttcagctggggcaacagagcaagaccctgactaaaaaaaaaatggtgtatacatatatatatatatatgtgtgtgtgtgtgtgtgtgtgtgtgtgtgtgtataaaatttttaaatatatagatatataaaaattatgtataatatatacataattttacttatgtataatatatacataattttacttatgtataatatatacataattttacttatgtatattat

SEQ ID NO: 279 - DNA, 4052 bp, Homo sapiens
cttaaaggtataaggatttaaataaagtttgtctttctaatgatacactggccttcagagagctgctttctcaagaagcctttgcaatcctgacatgttgcatgttttagggcttttctctgggctcctagacagttacttgaacctgtttctctaattcacttatttttttatttttatttttatttttttgagatggagtctcaactctggcacccaggcaatggcactgtgtcggctcactgcaacctccatctcctgggttcaagcaattctcctggcccagtctcctgagtagctgggattacaggcacccaccagcacacctggctagtttttatatttttagtagagatggggtttcgccatgttggccaggctggtctccaactcctgacctcaggtgatccacccacctcagcctcccaaagtgctgggattacaggcatgagctgccacacctggcctctaattcacttatgttctttatttatcttgtactggtatattcagcctatctaccagttgtgatgttttctcttcttccttcagttcagctgccaagagatttctgaagtttcctgtagacttccaccacttaagcagcacaacttgtagttctgcggttgctaaatatcaatgtctagaatttttttgaaatttagagagacaaacatatgtgttctgtcacctttgacttggcttttatataatatttaaataaagcaggcagaccaatttacactgaggatgaaagttacagtttaggagagcttgcttctgtgcattttatggtgaagttcatcttatgatgatcattttccaagtgatttggaacattttgaggtgaagtggaaattgctaatgtgatgtgtactgaaagatgagatgttatcacaaagaagaatgtgttttctgtctcaaattaatgtacagtttatgtcaattgcactgcctctttatttgcagtggacagttggataccaccatcaaaccagctagataggaaaggaggtattttaaggtgtagaagatagtgaggccccaggagtgtggagccatgctggagacctttctaagctgtcttgagaatttctcctcagtgttgactgcattcctctgcccttgctttaccagctccccatctcttatatttctgacccttggctttgaacttgactttgatttctgtctgtatcctttgcttctcctctggactgttccagcccacatcctgtggcctgtccatgtgttatgcttgctatttttatctgaaactctaagtttatttcaggcattgtggaagcccccttgctctattacaaacttaggatggtccttgaaatcttgctatcttcctgctaaaatgtctgtgggctgcagatgatgccctttattaaaactaaactgctaaacagccttagagagatgatcactatctaaggtatgttatttgtcttcagtatttatttttaggaacacaatacattaatcttattttctgagagtttttgcttataatttatagtcattcttcattaattatacttaccatttctcttgagaatactgaaatgaaaaagtgtctttggattttgtgtaactgaatttatgataaagaaaaattggtttatttcttgtgttatcttcttacatttcagtggctttagaaatatattaaagttcaaaaaccgggtcaatttattaatctcagtaactgttttattatccttttgagtgtgtgattaaatgtagcagagaattcatggatgaagtatggagaaattctttcttaccctggacaatttttaccctggagtaattttttcttactttttctccgtatttctcagtaacgatggtaacactcacacttggctattaagaatatataatcagacatccaaattattctttttcttttttttaatcacagaattaactcctgaggagagagcccaaaagattgccaaagccatgcgcaaacagtcttctgaagtcaaagaaaaatgggaaagtctaaatgctgtaactagcaattggcaaaagcaagtggacaaggcattggagaaactcagagacctgcagggagctatggatgacctggacgctgacatgaaggaggcagagtccgtgcggaatggctggaagcccgtgggagacttactcattgactcgctgcaggatcacattgaaaaaatcatggtcagcatcattgtctttgaaggatttttaagaaatgttttcttgttaaatataacacaaataaagagagccacgtatataaattgttataagggattgttacaaagccaacgccgctgcaaccccacccatcaggagtcaggacaggtgctttccatatgaccctcattggggttcattggaaccccctgcccccaaataacaactaatgcaacttttatgataatttacatttatttttattttttatccaactgtgcatctctagacaatgtagattaggtttacctatttttaaaaaatatttttaatccccagatttcccctctcttcctttttccttttcagtttatttgttaaagacactgaattgtttgttttgtattgattcccagagcctggattttgcagaattgtgtccatatggtatagtctccaggttcctctctactcggtatctcttgtaaattggtggatggagatagagatttaatcaaaagcacactcttttactgggaactctcatctataaattgtatcttattgtatattaatgaagaattagtttagctataaattctgtttgtagtaaggaattgcccaaagctatggatgttagacttatggttacctcccctttggttcccatattctagaacatctcctgaaaaaaaagttaataaaatttagacaataagagatataagagatggtttaaagtataccccaaatctcattgacagtgtagtcagataaaaataagtactgaattttgctaaatattattaaatatgtcaaaacaactggaaaacgaaatccttgggggtaatcaaataatgttaactgcctaaaattatcattaatcgttcttatttacagaatacacaccttctggcaggagaagggcttaggagtcacacctgccaacagacttccagttagcacctttgatactagcagatgttctgtttttatggcaaggaaggccacatagtcttttattctgttataggaaagtgcagtcataacatgataaataggttctttatgctagaacacacagcagttctgaaaccattttaaaacttgctttatctcgagccccttaatttggaagctcttcaaaaacaaaagataaactttcttgatagaaagactcctcattgccatataacacctgaccataaaaagaaaaacaaaaaccaaagaccttgtttgtcaaagctttttaaatgttttaacctgtggcttatatagggaaacattatttttggagaggaaaaatttgaatttcttttttgttccaaaagatttttaaagcctgtcttgaagttatattctatttgtttaaagtttactatcttttgaaataaaataggctattatttgaaattatatgcatctcaaaacattttctggcatttcatttttaatctttaatagataaaaataaaaagatgttgattttaaaagctaattacagttcttgagtcctccaaggtacctacccatggagagaatattaatgcatatagctaaaatcctgactaaagaaaccttgaaggatttgaattctgtaattgttctcaaactgaatctgagagacccagaccttttcaaagttcagactgaaaaatccctttgcccaccctaacccacccctcctccttccctgtgcttctatattaattgtgaattttttacacttataatgcctctattaccatacaactgctcttcttatttaattgtatttgtgtgtttttctgtgtgtgcacattctgtcatccattaaaatgccgaatctgcagcaatggaaaaaaaactatctcaactcttcttctcct

SEQ ID NO: 280 - DNA, 4046 bp, Homo sapiens
gatttttaaagcctgtcttgaagttatattctatttgtttaaagtttactatcttttgaaataaaataggctattatttgaaattatatgcatctcaaaacattttctggcatttcatttttaatctttaatagataaaaataaaaagatgttgattttaaaagctaattacagttcttgagtcctccaaggtacctacccatggagagaatattaatgcatatagctaaaatcctgactaaagaaaccttgaaggatttgaattctgtaattgttctcaaactgaatctgagagacccagaccttttcaaagttcagactgaaaaatccctttgcccaccctaacccacccctcctccttccctgtgcttctatattaattgtgaattttttacacttataatgcctctattaccatacaactgctcttcttatttaattgtatttgtgtgtttttctgtgtgtgcacattctgtcatccattaaaatgccgaatctgcagcaatggaaaaaaaactatctcaactcttcttctccttccatactgaagcaattcccatgaatttgtatgcatcccttcctctaccctgtctttgaaatgttggtagctgcagggttcggtaatatttcttactttacacatgttgacttcaaacttccaacattcatagttctcaccctgactctagtctcttaaagagacttaaagagcctccccacttaaagagtggacaatgtagaaatgaggaaacctgagggcaaagctaatgggatgtttacaacacctactacttctaaatttagtttggtacattattaactataattttgtggccaatttaaatttaaactgttttcttttaatatcccagttccattatccattctgtgttagcttaatattgctcaaatatcatttttgtgggcctttgtcaatagaaattaattctgtctctcttggattgcaagttctgtgctgaatagtgagggtctattcccaagcagcttccattctttactgggaacgtcaagaatgtggatgctcataattacaatttctaagtgctcttagtaagttgttttaatgattctagaccttgctcagaggtggcatttgtcaattctaagactcatttaccttttttctgtagactccactcttcctgcccaagccctaaccacagacagtgattataaatgattttgacagggatagatcttacctcttgagtctgtaataggcattggtttcatggttaggaatgttgtttctactggccactttctaatttaattttaagtggaaacatgttaaaatcaagttgttgcatttggtgaaaaaatattaaggtagctatgttaaaacagaataaaaagaaaacacgaatacaaactaaagatagaatcaacattagatatcagtaaagtggaaaataatggcatacattttccagagtaaactgcatataatagaaagcatgaaaggaaatacataatcattttaaaagtttgaattataatttttctcttcacacatttatttatatttttgggtaataaacaatgactttttggttcttcatccaagttactgaagacctgaattaagtcagctgttgttgagtgggcaactgtagttgatttcctctgagctggccttgccatttatttggaagtacaattccaggaccccgcatgtaccaaaactcatgtatactcaagtcccacatttccccatggaacctgcatgtaggaaaagtcagctctccatatatatatgggtttcgcatcctgcaaatactgtattttccatatgtttggttgaaaaaaatctgtgcataaatggacccaggaagtttggttgagaaaaatctgtgcatatgtgaacccatgcagttcagacctaagttatttaaggatcaactgtattagcttttgttatattcgtttccaataatatattttttgttcttttcttctaggcatttagagaagaaattgcaccaatcaactttaaagttaaaacggtgaatgatttatccagtcagctgtctccacttgacctgcatccctctctaaagatgtctcgccagctagatgaccttaatatgcgatggaaacttttacaggtatcagcttattccccttcataatgcaggcttacaccttgggtggtctttaaaccctacctcactatattaccactcaccgttttctctttctttgctgatggtatttgataatgaatttagcatgtgatgacatcaggtatttgtctttcagtatcttgaacctaaaggcctcatttatttatagagtttaatttaattttttgatgtactattcatatgatatttgtagaaaattgcaaaaggttaaataaatcacagtaattgaaacctgtggtaggtcacagaaacatttttcacataatggctaataaaggagtcatttttcttactttcatcatgtattttttttttcattttgaaaaatcaggaaagtctctattgtttttcttctaactggttgctatttaaatatcttccttattttttccagatagcacatttataccagtggtgtttacctttagttcttagattttagctaatgcagttggtttaatgactctagaccttatttaaatatgcaattttgatgtagcacataaaaacatttgagagatatattttatctataataggtttgctgaattaattcaaatatcaaagcactcaatggttcatattttcttaatgaaattgaagaagtaagaaattagtgtacaatattttacaatcttagtctttgcaaagagtgttaataacctaggattagtaaagcaaaatctgttaaatttatgtgtttttctagtggatggaacatagaaatatttgttctttattctttttttttcttctgctctgtttctctaattcattatcttcatgtgatgattcttatggtccatcttgatttacttcccattctatttctgttatcaccatttccgaagattagaagtcggggaatatgttatacttgaaagaagatatgtattctgtcatccttatctatgatcctggtaacctctagagctcagatgttagttgctggttggaaaagaagagaaaaatctatgctggtgggcaacactgttgaattgcaggagtaatattttctttactcataaagtgtggcatttgaaggcttttaggccttaatgaacaaagtgcatactaatgcaatttaaatagctagccaggaggaactagtgctgtccagggaatcagacatacacagtttcatttaaggacagctgcaaatgagattgtccctctaagtggaacagtaactagcattacatgaccaaggctagaaaaaggaaatggaaatgtcagtaggctgtgtgcagttgttattgatttgcatttagtttctcagtttagtaaccctttacattttcataatgcagagaactaactatagaatgtgtatttttaaaaggctaggcatgggggctcttgcctgtaatcccaacattttgtgaggctgaggtgagagggttgcttgaggtcagaagtttgagaccagcctgggcaacataggaagagcctgtctctacaaaataaaaattaaaaaattacatatgtggtgtggtgtgcgtctgtagtcttagctacttgagagactgaggtgggaggatcacttgaggctaggagttcaaggttacagtgagctatgtttgtgccaccgcactccagcctgggcaacagagtgagaccctgtctttaaaaataaaacaaaaacaaagatgtggataaaagatgtagagtgtccaacctgggcagcatagtgagaccttgtctctaccaaaaaaaaaaaaaaaaattaacccggcatgattgcacatgcgtgtagtcccagctacctgggaggctaaggtgggaggattgcatgagcccaggaggtcgaggctgcagtaagccataatcgtgccactgaactccagcctgggcaacagagtgagactctgtctttac

SEQ ID NO: 281 - DNA, 4047 bp, Homo sapiens
cccacccctacctcaactccatacagtttttctgtttcacaaaccttagaccttaggtagttaatctttggtatacgccttcctggaatatactgtgtacctagatgccaggacacatttttaaagtccagataccatcaatgttgatgaagtaaataggtttgctgtatacttattagattattaagtattccagatttctaaagctcagtttttcaaaatgtaaagctatgtaccaagaccaaatgaaagaggaatttacaaaataattgagactgtctttacagttctaactatcagttatctttaatattgatgaaatgctatactttcacctagcaatcactctcatagtggaaatcaagcacatattcttttggaagtgaaatattgtgaaatttatacacatttttgtaaaagtcaaatacatggccttgtattatctaacactgagaatccaaggaggtagaagttattcaaatcaaaacaattattaaaatgagtggggaagtgtaaacaaagtcccaattaatacatttaataattgttatcctttgctgcttggaatctttggctttattatatttcttggacttcagccatggttataaaagaagcctgtttagttaggcacaaaataaaaactgacctattagcctggtgccaacactgaaatgaggttggctctaatgagaaatgtaacatacctacttcctcattttcatccctgtttatactttggtgggcatagattgagaacagagtgcttgccttttataaagagaggaggaattgttgagtagaagaattgctcagctagtgttcagaaattgagatcacatctgagctcgaccgtttatttactggctgtcactctttgggcaagttattttatctctacacatttagttcctcatctatcaaatggaactttaacgtgtatcttgctggcttccttaccgaaaacatatatttgaaaatgcttggcaaagtttagaatgctgaatagttgtaagatattaatgtgacatgaaattgagaaaaaaagtattggtgacaactggctacgtgaggatctgatgatatttgcaaagtatgaaaattccaagtattatttgaatttttatatttgttcatttagcaaaattcttttatggcactaaattcacatgtactattcttcttaaataagtcttaaaataattggttaatgtaggaataatatattttttataagtaagaagtaactagaattgtaaaaaaaaaaaaaaaaaaagtacctcaatttaaaaaccccataaaatctcagtcatagtaaggtctagtgcaaaagtaggagactgggctctctgtatgtttcagatgaaagtaagaaattgggatttttctgcctagacgattgccttggttcttcacaactttttgcctatttttaaattccttctttttaaatgttatagaattgaatttacttaaatgccatctgtactcaatagctactcctgtgactacgatgcaaagtaaacaatgttattagtcatctggaaaattcggtcttgaaaaatctaatttttaatctggatataccaggtaaaattaattttggttttagctttatcaaaaatatatatggagtacagtttccagatggcactaaggtttaaactgtagtatttataagcaacaccatttgaaagtttaaaagtatttttatcaacaggttagattagttggcattagaccttgaacctgtattgtttcttgttttacttcaaatgaatccttaaagccattttttgtttggcccagtggatctcataattataggaatccagctcagaaaccagagcagttcattgaatttgctataaaatgttcagttgttttgcattaaggtgtaaggctttttggtttccaacgtttccaataatctccctttgtttcctcagcgtcagtccagctgccgtggcaaagatccatttcacataataaagtgccctattacatcaagtaagttgattttaattctcctttatgataccaagaaaatcatgttttattgataacttaagaggcttctctccccataacttttaaaaatagaattcagtcctattatctgaaagaaactgtgatatagttaatattaaaaagaaactacttttaacatgagaattatatttttcatgtatcagattagggatataggtgtgtttagctgatatattttaaagtagagatttaaatatttggagacagacaataagctatgatggccatactgtattccagcctggacaacaaagcaagatccagtctctaaaaagtaaaaaaaaaaaaaattggagaaaaatgacagaatttcaaaatactcttgacataatgatatttgtcaaattgtacaaattctaaaccatttttcttcctctaagaaaatccatataaaaatgtcttatactcttgtcattttattccaccaataagaaataatgatttatcatgaaaaagtgaaatattgtcaagtttttctttgtcttatagaagttatctgcattattagcataggctcatcattctttgattctgttgtccagttagtttctccttcttgcatactgtttcttcttcttatatgacattttataagttttgtataatttacacaggctcttagtaggcgttgatccttggcttagggctatatattgtcatggaacagaatgataaaattctacttctatagtcccttggagtgtaacttagtaaagatattaatttacaacgtgctctagtgatgagtcatagttgaccctattttatgtgtcagacgaacagcatcataatcatgacaacacttacttattgtcaggagacagctctgtctcaggttagctgtgtgacctcaggtaagtcagatgaagatctctgggccaagtttcctttttatcatttctaacatggggtgtggtatctccaaaatctatacaaatgctaataatctgctcttccagtatacttcctgaaaacgttgtgtgaagtccatgttggtgaaatagtcttttcttataattttttattacagtctgagatgtaagctcagggtaaaaaacaggtttgcataatatataataaatataataagcaatatacgttacattagcttatgggagtttaatatttttatcagtgtataacctacaatgcactgagttgtgaactgagttgagaacaaggtattaaagcaattgattggtgtcaaatttgcccaagtaagaatggaaagaggtcagacgctggttaagttggcatgtctctagtgaaagaagatgtgattatctaactgaaaatgtttaaaactgtttacatttttattgtacactataacaataataatagtaatagtattagagaactttaatttgcttggttgaatattgacttgaatttaatcttacaaatttagatataaatctgatgtactgtggtaggcaaaataataactgctcccaacccctgaaagatgctcacatcataatccctggaacctgtgaaaatgttaggttacaaagcaagggagaattaaggtcgtaaatggaattaaggttgcaaatcaactgacctttaattagggagattattctggattatcctgatgggcttaatgtaatcccaggggcctttaaaagtggcaggggaggcagagatttgagaatgctagctactagcttggaaggtaaaggaagcagacatgatccttaaatgcaggcagcttctagaagctggaaaaggcaaagaaatgggattctctcttagaacctccagagaaggaattcagccctgccaactttgattttatcccagggagacatttttgtaacagcaatagaaaattaatgcatgtactataaaaaaatcaagaagttcacgcaaattaattgaaattaattaatttattgaattgacttagagtcttttatcatctgatttttttaaaaatgcaaactggatctagtttttgggttttactaaataaaaaaaattaaatat

SEQ ID NO: 282 - DNA, 4067 bp, Homo sapiens
atactgtgtacctagatgccaggacacatttttaaagtccagataccatcaatgttgatgaagtaaataggtttgctgtatacttattagattattaagtattccagatttctaaagctcagtttttcaaaatgtaaagctatgtaccaagaccaaatgaaagaggaatttacaaaataattgagactgtctttacagttctaactatcagttatctttaatattgatgaaatgctatactttcacctagcaatcactctcatagtggaaatcaagcacatattcttttggaagtgaaatattgtgaaatttatacacatttttgtaaaagtcaaatacatggccttgtattatctaacactgagaatccaaggaggtagaagttattcaaatcaaaacaattattaaaatgagtggggaagtgtaaacaaagtcccaattaatacatttaataattgttatcctttgctgcttggaatctttggctttattatatttcttggacttcagccatggttataaaagaagcctgtttagttaggcacaaaataaaaactgacctattagcctggtgccaacactgaaatgaggttggctctaatgagaaatgtaacatacctacttcctcattttcatccctgtttatactttggtgggcatagattgagaacagagtgcttgccttttataaagagaggaggaattgttgagtagaagaattgctcagctagtgttcagaaattgagatcacatctgagctcgaccgtttatttactggctgtcactctttgggcaagttattttatctctacacatttagttcctcatctatcaaatggaactttaacgtgtatcttgctggcttccttaccgaaaacatatatttgaaaatgcttggcaaagtttagaatgctgaatagttgtaagatattaatgtgacatgaaattgagaaaaaaagtattggtgacaactggctacgtgaggatctgatgatatttgcaaagtatgaaaattccaagtattatttgaatttttatatttgttcatttagcaaaattcttttatggcactaaattcacatgtactattcttcttaaataagtcttaaaataattggttaatgtaggaataatatattttttataagtaagaagtaactagaattgtaaaaaaaaaaaaaaaaaaagtacctcaatttaaaaaccccataaaatctcagtcatagtaaggtctagtgcaaaagtaggagactgggctctctgtatgtttcagatgaaagtaagaaattgggatttttctgcctagacgattgccttggttcttcacaactttttgcctatttttaaattccttctttttaaatgttatagaattgaatttacttaaatgccatctgtactcaatagctactcctgtgactacgatgcaaagtaaacaatgttattagtcatctggaaaattcggtcttgaaaaatctaatttttaatctggatataccaggtaaaattaattttggttttagctttatcaaaaatatatatggagtacagtttccagatggcactaaggtttaaactgtagtatttataagcaacaccatttgaaagtttaaaagtatttttatcaacaggttagattagttggcattagaccttgaacctgtattgtttcttgttttacttcaaatgaatccttaaagccattttttgtttggcccagtggatctcataattataggaatccagctcagaaaccagagcagttcattgaatttgctataaaatgttcagttgttttgcattaaggtgtaaggctttttggtttccaacgtttccaataatctccctttgtttcctcagcgtcagtccagctgccgtggcaaagatccatttcacataataaagtgccctattacatcaagtaagttgattttaattctcctttatgataccaagaaaatcatgttttattgataacttaagaggcttctctccccataacttttaaaaatagaattcagtcctattatctgaaagaaactgtgatatagttaatattaaaaagaaactacttttaacatgagaattatatttttcatgtatcagattagggatataggtgtgtttagctgatatattttaaagtagagatttaaatatttggagacagacaataagctatgatggccatactgtattccagcctggacaacaaagcaagatccagtctctaaaaagtaaaaaaaaaaaaaattggagaaaaatgacagaatttcaaaatactcttgacataatgatatttgtcaaattgtacaaattctaaaccatttttcttcctctaagaaaatccatataaaaatgtcttatactcttgtcattttattccaccaataagaaataatgatttatcatgaaaaagtgaaatattgtcaagtttttctttgtcttatagaagttatctgcattattagcataggctcatcattctttgattctgttgtccagttagtttctccttcttgcatactgtttcttcttcttatatgacattttataagttttgtataatttacacaggctcttagtaggcgttgatccttggcttagggctatatattgtcatggaacagaatgataaaattctacttctatagtcccttggagtgtaacttagtaaagatattaatttacaacgtgctctagtgatgagtcatagttgaccctattttatgtgtcagacgaacagcatcataatcatgacaacacttacttattgtcaggagacagctctgtctcaggttagctgtgtgacctcaggtaagtcagatgaagatctctgggccaagtttcctttttatcatttctaacatggggtgtggtatctccaaaatctatacaaatgctaataatctgctcttccagtatacttcctgaaaacgttgtgtgaagtccatgttggtgaaatagtcttttcttataattttttattacagtctgagatgtaagctcagggtaaaaaacaggtttgcataatatataataaatataataagcaatatacgttacattagcttatgggagtttaatatttttatcagtgtataacctacaatgcactgagttgtgaactgagttgagaacaaggtattaaagcaattgattggtgtcaaatttgcccaagtaagaatggaaagaggtcagacgctggttaagttggcatgtctctagtgaaagaagatgtgattatctaactgaaaatgtttaaaactgtttacatttttattgtacactataacaataataatagtaatagtattagagaactttaatttgcttggttgaatattgacttgaatttaatcttacaaatttagatataaatctgatgtactgtggtaggcaaaataataactgctcccaacccctgaaagatgctcacatcataatccctggaacctgtgaaaatgttaggttacaaagcaagggagaattaaggtcgtaaatggaattaaggttgcaaatcaactgacctttaattagggagattattctggattatcctgatgggcttaatgtaatcccaggggcctttaaaagtggcaggggaggcagagatttgagaatgctagctactagcttggaaggtaaaggaagcagacatgatccttaaatgcaggcagcttctagaagctggaaaaggcaaagaaatgggattctctcttagaacctccagagaaggaattcagccctgccaactttgattttatcccagggagacatttttgtaacagcaatagaaaattaatgcatgtactataaaaaaatcaagaagttcacgcaaattaattgaaattaattaatttattgaattgacttagagtcttttatcatctgatttttttaaaaatgcaaactggatctagtttttgggttttactaaataaaaaaaattaaatatcttgctttatgtttatatcatgattatctgtgtggtttgggacttttaaagtccatccttaattttagctcttttttaaaaatgaatttctatatgtttaggttaatta

SEQ ID NO: 283 - DNA, 4036 bp, Homo sapiens
ctgtagtatttataagcaacaccatttgaaagtttaaaagtatttttatcaacaggttagattagttggcattagaccttgaacctgtattgtttcttgttttacttcaaatgaatccttaaagccattttttgtttggcccagtggatctcataattataggaatccagctcagaaaccagagcagttcattgaatttgctataaaatgttcagttgttttgcattaaggtgtaaggctttttggtttccaacgtttccaataatctccctttgtttcctcagcgtcagtccagctgccgtggcaaagatccatttcacataataaagtgccctattacatcaagtaagttgattttaattctcctttatgataccaagaaaatcatgttttattgataacttaagaggcttctctccccataacttttaaaaatagaattcagtcctattatctgaaagaaactgtgatatagttaatattaaaaagaaactacttttaacatgagaattatatttttcatgtatcagattagggatataggtgtgtttagctgatatattttaaagtagagatttaaatatttggagacagacaataagctatgatggccatactgtattccagcctggacaacaaagcaagatccagtctctaaaaagtaaaaaaaaaaaaaattggagaaaaatgacagaatttcaaaatactcttgacataatgatatttgtcaaattgtacaaattctaaaccatttttcttcctctaagaaaatccatataaaaatgtcttatactcttgtcattttattccaccaataagaaataatgatttatcatgaaaaagtgaaatattgtcaagtttttctttgtcttatagaagttatctgcattattagcataggctcatcattctttgattctgttgtccagttagtttctccttcttgcatactgtttcttcttcttatatgacattttataagttttgtataatttacacaggctcttagtaggcgttgatccttggcttagggctatatattgtcatggaacagaatgataaaattctacttctatagtcccttggagtgtaacttagtaaagatattaatttacaacgtgctctagtgatgagtcatagttgaccctattttatgtgtcagacgaacagcatcataatcatgacaacacttacttattgtcaggagacagctctgtctcaggttagctgtgtgacctcaggtaagtcagatgaagatctctgggccaagtttcctttttatcatttctaacatggggtgtggtatctccaaaatctatacaaatgctaataatctgctcttccagtatacttcctgaaaacgttgtgtgaagtccatgttggtgaaatagtcttttcttataattttttattacagtctgagatgtaagctcagggtaaaaaacaggtttgcataatatataataaatataataagcaatatacgttacattagcttatgggagtttaatatttttatcagtgtataacctacaatgcactgagttgtgaactgagttgagaacaaggtattaaagcaattgattggtgtcaaatttgcccaagtaagaatggaaagaggtcagacgctggttaagttggcatgtctctagtgaaagaagatgtgattatctaactgaaaatgtttaaaactgtttacatttttattgtacactataacaataataatagtaatagtattagagaactttaatttgcttggttgaatattgacttgaatttaatcttacaaatttagatataaatctgatgtactgtggtaggcaaaataataactgctcccaacccctgaaagatgctcacatcataatccctggaacctgtgaaaatgttaggttacaaagcaagggagaattaaggtcgtaaatggaattaaggttgcaaatcaactgacctttaattagggagattattctggattatcctgatgggcttaatgtaatcccaggggcctttaaaagtggcaggggaggcagagatttgagaatgctagctactagcttggaaggtaaaggaagcagacatgatccttaaatgcaggcagcttctagaagctggaaaaggcaaagaaatgggattctctcttagaacctccagagaaggaattcagccctgccaactttgattttatcccagggagacatttttgtaacagcaatagaaaattaatgcatgtactataaaaaaatcaagaagttcacgcaaattaattgaaattaattaatttattgaattgacttagagtcttttatcatctgatttttttaaaaatgcaaactggatctagtttttgggttttactaaataaaaaaaattaaatatcttgctttatgtttatatcatgattatctgtgtggtttgggacttttaaagtccatccttaattttagctcttttttaaaaatgaatttctatatgtttaggttaattatatatgactgagaattgtctaaatcagaatttctctaattcaaaatgtttataattttggaaggatctggtaggattgtattcttgttcttgtggggcagagttcttatggggcagattggtagaataaaagttagttttacctggcttcccattggctagagcactattaccagcactggaaaatagatataatataatgatggccactattttaaataataacgtttaggactgtagcatttaaaaaaatcttctccatcaccagtaaaagatcagattgtttaaaatatatgtagttttagtgttaaatgtcttttaagtcttccaaatttttagaaatgtgctcatttgtatatagcaaattcccattttcacaaaacttgtttaaccaggatctttcattgtgtaatttaacagtttatttcctcatgaagaaggaacatcaaattctgaaggtagagttataaaagccagtatttatgtgtgaagaattgttatgaaaacaaaatttaattcccaaattaataaccaagcaaatggagaatgaaaaagcttttaatatacacttccctttgcgtggcttcaaaagtagaagaaaaatgtttaaaacaaattttgcatgattgccatgcaatgagaatttcctggagcaaattagaatgtatatggctaacaaaaaataatattcaggtagaaatattcaacgtttttggtgtttaagtatatcatctttgtattcactgttagaatatggccagaaagttgaaaggagactaggaagggcaaattatttttatgtcatattttaattttatagatcacttaaagcccactttgatggcttcccactgcatttctgtctctctaggtaattccttattaatattttgaagtgcactgcggtggctccatggctcatgtgtttgtagaaaatgaaagaatataaatctgaactgaaagagtctatatagtataaacccctctatttgttgatatcttaagttaaaactagtctatatagtataaatccctctatttgttaatatcttaagttaaaactagtctatatagcataaacctctctatttgttaatatcttaagttaaaattaacatttgaaaattttatttgcttcctctaaggtagactttctgaaactgatctagttatttcttttttcctagtatagtgcaatgagagctcattgtattcagggtttaagaacatttaaaatggggccgggtgcagtggctcatgcttataatcctaatgcttgggaggctgaggcgggtggattgcttgcccccaggagttcaagaccagcctgagcaacatgacaaaaccccatctctacaaaaaattagctgggcatggtaacatgcgcctatagtcccagcagtcaggaggctgaggtgggaggatcacttgagcccgggaggtcaagactgcagtgagccatgatcacaccactgcactacagtctgggcaacagagtgaaactctgtctccttaaaaaataataataataataataaataaagag

SEQ ID NO: 284 - DNA, 4042 bp, Homo sapiens
agttggcattagaccttgaacctgtattgtttcttgttttacttcaaatgaatccttaaagccattttttgtttggcccagtggatctcataattataggaatccagctcagaaaccagagcagttcattgaatttgctataaaatgttcagttgttttgcattaaggtgtaaggctttttggtttccaacgtttccaataatctccctttgtttcctcagcgtcagtccagctgccgtggcaaagatccatttcacataataaagtgccctattacatcaagtaagttgattttaattctcctttatgataccaagaaaatcatgttttattgataacttaagaggcttctctccccataacttttaaaaatagaattcagtcctattatctgaaagaaactgtgatatagttaatattaaaaagaaactacttttaacatgagaattatatttttcatgtatcagattagggatataggtgtgtttagctgatatattttaaagtagagatttaaatatttggagacagacaataagctatgatggccatactgtattccagcctggacaacaaagcaagatccagtctctaaaaagtaaaaaaaaaaaaaattggagaaaaatgacagaatttcaaaatactcttgacataatgatatttgtcaaattgtacaaattctaaaccatttttcttcctctaagaaaatccatataaaaatgtcttatactcttgtcattttattccaccaataagaaataatgatttatcatgaaaaagtgaaatattgtcaagtttttctttgtcttatagaagttatctgcattattagcataggctcatcattctttgattctgttgtccagttagtttctccttcttgcatactgtttcttcttcttatatgacattttataagttttgtataatttacacaggctcttagtaggcgttgatccttggcttagggctatatattgtcatggaacagaatgataaaattctacttctatagtcccttggagtgtaacttagtaaagatattaatttacaacgtgctctagtgatgagtcatagttgaccctattttatgtgtcagacgaacagcatcataatcatgacaacacttacttattgtcaggagacagctctgtctcaggttagctgtgtgacctcaggtaagtcagatgaagatctctgggccaagtttcctttttatcatttctaacatggggtgtggtatctccaaaatctatacaaatgctaataatctgctcttccagtatacttcctgaaaacgttgtgtgaagtccatgttggtgaaatagtcttttcttataattttttattacagtctgagatgtaagctcagggtaaaaaacaggtttgcataatatataataaatataataagcaatatacgttacattagcttatgggagtttaatatttttatcagtgtataacctacaatgcactgagttgtgaactgagttgagaacaaggtattaaagcaattgattggtgtcaaatttgcccaagtaagaatggaaagaggtcagacgctggttaagttggcatgtctctagtgaaagaagatgtgattatctaactgaaaatgtttaaaactgtttacatttttattgtacactataacaataataatagtaatagtattagagaactttaatttgcttggttgaatattgacttgaatttaatcttacaaatttagatataaatctgatgtactgtggtaggcaaaataataactgctcccaacccctgaaagatgctcacatcataatccctggaacctgtgaaaatgttaggttacaaagcaagggagaattaaggtcgtaaatggaattaaggttgcaaatcaactgacctttaattagggagattattctggattatcctgatgggcttaatgtaatcccaggggcctttaaaagtggcaggggaggcagagatttgagaatgctagctactagcttggaaggtaaaggaagcagacatgatccttaaatgcaggcagcttctagaagctggaaaaggcaaagaaatgggattctctcttagaacctccagagaaggaattcagccctgccaactttgattttatcccagggagacatttttgtaacagcaatagaaaattaatgcatgtactataaaaaaatcaagaagttcacgcaaattaattgaaattaattaatttattgaattgacttagagtcttttatcatctgatttttttaaaaatgcaaactggatctagtttttgggttttactaaataaaaaaaattaaatatcttgctttatgtttatatcatgattatctgtgtggtttgggacttttaaagtccatccttaattttagctcttttttaaaaatgaatttctatatgtttaggttaattatatatgactgagaattgtctaaatcagaatttctctaattcaaaatgtttataattttggaaggatctggtaggattgtattcttgttcttgtggggcagagttcttatggggcagattggtagaataaaagttagttttacctggcttcccattggctagagcactattaccagcactggaaaatagatataatataatgatggccactattttaaataataacgtttaggactgtagcatttaaaaaaatcttctccatcaccagtaaaagatcagattgtttaaaatatatgtagttttagtgttaaatgtcttttaagtcttccaaatttttagaaatgtgctcatttgtatatagcaaattcccattttcacaaaacttgtttaaccaggatctttcattgtgtaatttaacagtttatttcctcatgaagaaggaacatcaaattctgaaggtagagttataaaagccagtatttatgtgtgaagaattgttatgaaaacaaaatttaattcccaaattaataaccaagcaaatggagaatgaaaaagcttttaatatacacttccctttgcgtggcttcaaaagtagaagaaaaatgtttaaaacaaattttgcatgattgccatgcaatgagaatttcctggagcaaattagaatgtatatggctaacaaaaaataatattcaggtagaaatattcaacgtttttggtgtttaagtatatcatctttgtattcactgttagaatatggccagaaagttgaaaggagactaggaagggcaaattatttttatgtcatattttaattttatagatcacttaaagcccactttgatggcttcccactgcatttctgtctctctaggtaattccttattaatattttgaagtgcactgcggtggctccatggctcatgtgtttgtagaaaatgaaagaatataaatctgaactgaaagagtctatatagtataaacccctctatttgttgatatcttaagttaaaactagtctatatagtataaatccctctatttgttaatatcttaagttaaaactagtctatatagcataaacctctctatttgttaatatcttaagttaaaattaacatttgaaaattttatttgcttcctctaaggtagactttctgaaactgatctagttatttcttttttcctagtatagtgcaatgagagctcattgtattcagggtttaagaacatttaaaatggggccgggtgcagtggctcatgcttataatcctaatgcttgggaggctgaggcgggtggattgcttgcccccaggagttcaagaccagcctgagcaacatgacaaaaccccatctctacaaaaaattagctgggcatggtaacatgcgcctatagtcccagcagtcaggaggctgaggtgggaggatcacttgagcccgggaggtcaagactgcagtgagccatgatcacaccactgcactacagtctgggcaacagagtgaaactctgtctccttaaaaaataataataataataataaataaagagagagagaaaaagaaaatttaaaatggttcttgctgccttcacaatatacaaaaatctgccataaaagcc

SEQ ID NO: 285 - DNA, 4046 bp, Homo sapiens
tattaatttacaacgtgctctagtgatgagtcatagttgaccctattttatgtgtcagacgaacagcatcataatcatgacaacacttacttattgtcaggagacagctctgtctcaggttagctgtgtgacctcaggtaagtcagatgaagatctctgggccaagtttcctttttatcatttctaacatggggtgtggtatctccaaaatctatacaaatgctaataatctgctcttccagtatacttcctgaaaacgttgtgtgaagtccatgttggtgaaatagtcttttcttataattttttattacagtctgagatgtaagctcagggtaaaaaacaggtttgcataatatataataaatataataagcaatatacgttacattagcttatgggagtttaatatttttatcagtgtataacctacaatgcactgagttgtgaactgagttgagaacaaggtattaaagcaattgattggtgtcaaatttgcccaagtaagaatggaaagaggtcagacgctggttaagttggcatgtctctagtgaaagaagatgtgattatctaactgaaaatgtttaaaactgtttacatttttattgtacactataacaataataatagtaatagtattagagaactttaatttgcttggttgaatattgacttgaatttaatcttacaaatttagatataaatctgatgtactgtggtaggcaaaataataactgctcccaacccctgaaagatgctcacatcataatccctggaacctgtgaaaatgttaggttacaaagcaagggagaattaaggtcgtaaatggaattaaggttgcaaatcaactgacctttaattagggagattattctggattatcctgatgggcttaatgtaatcccaggggcctttaaaagtggcaggggaggcagagatttgagaatgctagctactagcttggaaggtaaaggaagcagacatgatccttaaatgcaggcagcttctagaagctggaaaaggcaaagaaatgggattctctcttagaacctccagagaaggaattcagccctgccaactttgattttatcccagggagacatttttgtaacagcaatagaaaattaatgcatgtactataaaaaaatcaagaagttcacgcaaattaattgaaattaattaatttattgaattgacttagagtcttttatcatctgatttttttaaaaatgcaaactggatctagtttttgggttttactaaataaaaaaaattaaatatcttgctttatgtttatatcatgattatctgtgtggtttgggacttttaaagtccatccttaattttagctcttttttaaaaatgaatttctatatgtttaggttaattatatatgactgagaattgtctaaatcagaatttctctaattcaaaatgtttataattttggaaggatctggtaggattgtattcttgttcttgtggggcagagttcttatggggcagattggtagaataaaagttagttttacctggcttcccattggctagagcactattaccagcactggaaaatagatataatataatgatggccactattttaaataataacgtttaggactgtagcatttaaaaaaatcttctccatcaccagtaaaagatcagattgtttaaaatatatgtagttttagtgttaaatgtcttttaagtcttccaaatttttagaaatgtgctcatttgtatatagcaaattcccattttcacaaaacttgtttaaccaggatctttcattgtgtaatttaacagtttatttcctcatgaagaaggaacatcaaattctgaaggtagagttataaaagccagtatttatgtgtgaagaattgttatgaaaacaaaatttaattcccaaattaataaccaagcaaatggagaatgaaaaagcttttaatatacacttccctttgcgtggcttcaaaagtagaagaaaaatgtttaaaacaaattttgcatgattgccatgcaatgagaatttcctggagcaaattagaatgtatatggctaacaaaaaataatattcaggtagaaatattcaacgtttttggtgtttaagtatatcatctttgtattcactgttagaatatggccagaaagttgaaaggagactaggaagggcaaattatttttatgtcatattttaattttatagatcacttaaagcccactttgatggcttcccactgcatttctgtctctctaggtaattccttattaatattttgaagtgcactgcggtggctccatggctcatgtgtttgtagaaaatgaaagaatataaatctgaactgaaagagtctatatagtataaacccctctatttgttgatatcttaagttaaaactagtctatatagtataaatccctctatttgttaatatcttaagttaaaactagtctatatagcataaacctctctatttgttaatatcttaagttaaaattaacatttgaaaattttatttgcttcctctaaggtagactttctgaaactgatctagttatttcttttttcctagtatagtgcaatgagagctcattgtattcagggtttaagaacatttaaaatggggccgggtgcagtggctcatgcttataatcctaatgcttgggaggctgaggcgggtggattgcttgcccccaggagttcaagaccagcctgagcaacatgacaaaaccccatctctacaaaaaattagctgggcatggtaacatgcgcctatagtcccagcagtcaggaggctgaggtgggaggatcacttgagcccgggaggtcaagactgcagtgagccatgatcacaccactgcactacagtctgggcaacagagtgaaactctgtctccttaaaaaataataataataataataaataaagagagagagaaaaagaaaatttaaaatggttcttgctgccttcacaatatacaaaaatctgccataaaagccagatatctctcattgtaaatttttggttatgtattttgcacaagttgttcatttcctcagataaaagtcaacttccagggaatatgaggaataagaggaatgaaagctttgggttcggttgaactttcttaatgcatcacattaaccatgtaaaattcaccatttctcagtttgccacagaaataataataacatataataatgataaatagttgctgtgggaagtaataatgatcattgtaataaattacatttttgaacagtcatttatttgccaggtgttgtgctgaatcttgtgcatagatgatctcttttaattctctcattagccaagtgaagtataggtactataattacccccatttacacataagtcttaatgaattatcaataactgcattaaaagtaattaataagcacgcttacagcttgcttgagattacacagctggtaaatagaagagctagtgttcaaacccagggattgtctacagctcctgaactcctgatcactatgcggtgctgtgtcctggccccaatattagttgagtcagaggacggaagtttttagtcccatggaaactttgaataggatgaaggattatatttaggaaggaggatagtagtggagaaagtatgagcaaacatcctttctttcataccatagacggttaccatttactatgcacctcctgtgtgccagcaactgagtccagctgtccaaggacaaagcccatgctttttccagtactccacactgccgttgtataggcttttccataggctaatttctacaggaggatctattttctagatgtttaaagcagtttcacactgtggtctggtaatggacaaaggtgctttttcatagataggaagatgtcattcccacagtgcttgccagttggaccttgagaggaactctgaggtggggaaacacactctttggccttcctctatctttccccattcacatgatctgaagatttctgtcaactggtagatttaagtatctgcgagtaagatggccaacaaagctggcttat

SEQ ID NO: 286 - DNA, 4093 bp, Homo sapiens
aggaaaaaagatatctatactttataaagattaaatttttaaaactgccattgcaattagcaaaagtacagaagtaataatgtttaaaattgtaaaataaatagaaatatgctgattataaagtaaaataatacagtaaaagatttcatataaccatatagaaaaaaatagaagtaattaatcccttcttttaaaaatacataaaagaaagagataaagtagtaattttttttaataaaaagctaaaagctacaaatccagcttttaaaagcaaacttaaaggatacaatgatcccctcaactgttgtgggaacatagtcctggtgttaacaccttcagatgggggcatacaaggctccccagggccaatgcaacaacaaatgacctacaggaatttggctgatggtctgaatctccccagtttgagagtcacggagatgagggtagggttgggtgggaggtggggttccctatgaattctgggctcatgtagaaatattatcaagctagcagatcccctgggtttactgagtatttgcatgtttatatttccaagcaatttagtaccctcaagacaattatcacctgtccctcccctcgcacgtagacacatcagttttgatcattaattctactactttatttaaaaacaaacacaaataaactttgtcttattgttttgtaacaaatgttctagtagtcatacatgcaatattgacatcttatattttggggtgtatggtatggtagcctatttctatatagtcctttccatgtttgtatctttaaatctactcttgagtgtgaaattactttaagtgtattttgtttcagagacagggtctcactctgttgcccaggccagagtgcagtggtgcaaccatggctcattgcagtcttatactcctggcctcaagtgaacctcctgcctcagcctcctgagtagctgggactacaggtacatgccaccatgcccagctaattggactttttttagagatggagtcttgctatgttgcccaggctggtctcaaactcctgacctgaagcagtcctcctgctttggcctccccaaatgctgggattacagacatgagccactgtgcccagcttaaatgcattttatagtcaaatcctacggaattattcattatttacaatgttgtcttcctgcctcctgtcttcattatcatgagatactaatggcattttttaaggaagactctaaacttttgcagtacctattatcaaataggatcatatatcttatttgaattttggacagaattttttttttcttgaaattctgacctccacgcttcttttctcttaagttaatttttgtttctaaaagtatatctttggatttcctgcctttaaaagcttagaggacagtagacagtgtttgcgagtggatgaggaagttgaatataacctgaggaatatataagttattcctgcagctttctcacccactacctccatcctctccccaggggcttttccacacagacacacacacacccacacccacacccacacacacacaagcacgtgcacagagtgagaatcaatgttactgatgggggtactccacattcttcctatattctagtcttgggtgaaacaaggactgaaaagattataaattccaaagtaagtacaccacctctcagatctttaagaaggtgttactcaaataaatgttgtcatatcagattgccaacatttgttttcactcttcatactttaggcagttgaatgcaaaatcgattagttgggagctcgtgcttgattgctatatatatgtaacttctataagtgtacataaagtaaatgttaacagaacctgtattttgcctgtgtcaacttccttttctggagacttctggttttctcatagtacctcccaccttctaatacactgtataacttacttacagtgtttgtcgtctcttatttttccccatcctgaggcatggccactccacttggcaccatggagttcattgctaataattataggaccagtttgagtgcaggagaaaagttggaagccaaacagaagtggctggagtggtgaatgggacacgaggaagtagatatggtacagtactcattggtgaattttgcctgtgaaggagagaaaaaaggtgataactagcagaaaatgtagatttgaggtaggggtgtgtgtgtgtgtgtgtttaaggatggcacgtctgtaaacatttatattctacaaaggatagtcttcttgagagaggggttgacagtgcagcacaggaaatttttaagaaatcattgggaagaattggcctttaataagaagggggacaatttctcagttaaaggggagataggataacagactggcagttggagggaagtttcctgagttggtggtggagagagaaaggagtcctcatctagtagtatttaggttttcaatgaagcgtgagataaagtaaaatgatattaaggcagagaaataaaccagtttggggagagagatagcagtagtgaatttctgttttggagtttgggaaagcaagtttattagggaatatagtgcagttgccaggagttggacatttgaggtttgaaatcacatattttaaagtaaattgagtctgtctgttgagtgattttctccagttgtttttatccacagctgctcaggtccagagtaggcaagtaattgagctgatccaggcctgggatttgcaaggggtgagagagaagcaagggagatgaggttatttgtaatgattctaatgatagaccatggactcaaatttggacagattcatcaagaaatattttaaaaccttaattatgcaaatatacttccatatcaagagcttagcttaaaatgagactatctctgtttaaatcccatttctattacttactataggacctcagacaagctatctaagcactctctgccctagttttttccatctgtaagatggagacaatattgtcacccaagtcatagaattgtaatccaaatagaatttacacatagaaaaagtttatccaaaaaagtttacttggtacaaatcgagcactcaaatagcatgttattactgtgattaatatacatcctgacctagtatattttactttgcacagcaaagaagaaatatttttttctttgattgtcttatctcagagcaatatacatagttcttgtccccacatttgtatttttacttatctttagttttgttctgttatatgcctttataattataattggaatggaatgatatataacaaacctcacaaaatccagttataagcataaaattggatagctagtaacaaataagtatatttgggtaagtgttagtttttggagaaacaagttgccttctgatcatcctttaaggtttcatggaaaaatatgagaccactctaatgaggacaaatgggtttaagaagtatcttccacagagcagtcatttgcccagaaatcaagattttaccagcctatcaaaagtgcatgtcctttgctgttggttcattgtgttacatgttaggcagtattgcagcacaactttttttgttttatttgttggtgctacagtcttatattatttgtgttttactttctgtggcttatcagtgttatattgttatgaataataatagataggtggaaggatatactacttcttaaccttattggcttaatattttaataatgtccataaaatgcagagattatatgttatcccagctggggctcttcagagtaagggggcacttttaataattataccaggatgctgatatgtaattcctgtatacagtctagtataaagcaggatttatactgcttgaaggatagttttcaaaataggcaaaaatcttaactcttatacaaatacaaaaagagcatgtttcatttaactcatagtaagggaaccagtaagaagttataataggttccaaagagaatacaaaatgtcacatatttatagtgagattagggatgctaaaatgaatttacctctggatgcaaagctgacaaactggtcaatatccacaggacaataatcaattgcattccactgggcac

SEQ ID NO: 287 - DNA, 4084 bp, Homo sapiens
aaaataaatagaaatatgctgattataaagtaaaataatacagtaaaagatttcatataaccatatagaaaaaaatagaagtaattaatcccttcttttaaaaatacataaaagaaagagataaagtagtaattttttttaataaaaagctaaaagctacaaatccagcttttaaaagcaaacttaaaggatacaatgatcccctcaactgttgtgggaacatagtcctggtgttaacaccttcagatgggggcatacaaggctccccagggccaatgcaacaacaaatgacctacaggaatttggctgatggtctgaatctccccagtttgagagtcacggagatgagggtagggttgggtgggaggtggggttccctatgaattctgggctcatgtagaaatattatcaagctagcagatcccctgggtttactgagtatttgcatgtttatatttccaagcaatttagtaccctcaagacaattatcacctgtccctcccctcgcacgtagacacatcagttttgatcattaattctactactttatttaaaaacaaacacaaataaactttgtcttattgttttgtaacaaatgttctagtagtcatacatgcaatattgacatcttatattttggggtgtatggtatggtagcctatttctatatagtcctttccatgtttgtatctttaaatctactcttgagtgtgaaattactttaagtgtattttgtttcagagacagggtctcactctgttgcccaggccagagtgcagtggtgcaaccatggctcattgcagtcttatactcctggcctcaagtgaacctcctgcctcagcctcctgagtagctgggactacaggtacatgccaccatgcccagctaattggactttttttagagatggagtcttgctatgttgcccaggctggtctcaaactcctgacctgaagcagtcctcctgctttggcctccccaaatgctgggattacagacatgagccactgtgcccagcttaaatgcattttatagtcaaatcctacggaattattcattatttacaatgttgtcttcctgcctcctgtcttcattatcatgagatactaatggcattttttaaggaagactctaaacttttgcagtacctattatcaaataggatcatatatcttatttgaattttggacagaattttttttttcttgaaattctgacctccacgcttcttttctcttaagttaatttttgtttctaaaagtatatctttggatttcctgcctttaaaagcttagaggacagtagacagtgtttgcgagtggatgaggaagttgaatataacctgaggaatatataagttattcctgcagctttctcacccactacctccatcctctccccaggggcttttccacacagacacacacacacccacacccacacccacacacacacaagcacgtgcacagagtgagaatcaatgttactgatgggggtactccacattcttcctatattctagtcttgggtgaaacaaggactgaaaagattataaattccaaagtaagtacaccacctctcagatctttaagaaggtgttactcaaataaatgttgtcatatcagattgccaacatttgttttcactcttcatactttaggcagttgaatgcaaaatcgattagttgggagctcgtgcttgattgctatatatatgtaacttctataagtgtacataaagtaaatgttaacagaacctgtattttgcctgtgtcaacttccttttctggagacttctggttttctcatagtacctcccaccttctaatacactgtataacttacttacagtgtttgtcgtctcttatttttccccatcctgaggcatggccactccacttggcaccatggagttcattgctaataattataggaccagtttgagtgcaggagaaaagttggaagccaaacagaagtggctggagtggtgaatgggacacgaggaagtagatatggtacagtactcattggtgaattttgcctgtgaaggagagaaaaaaggtgataactagcagaaaatgtagatttgaggtaggggtgtgtgtgtgtgtgtgtttaaggatggcacgtctgtaaacatttatattctacaaaggatagtcttcttgagagaggggttgacagtgcagcacaggaaatttttaagaaatcattgggaagaattggcctttaataagaagggggacaatttctcagttaaaggggagataggataacagactggcagttggagggaagtttcctgagttggtggtggagagagaaaggagtcctcatctagtagtatttaggttttcaatgaagcgtgagataaagtaaaatgatattaaggcagagaaataaaccagtttggggagagagatagcagtagtgaatttctgttttggagtttgggaaagcaagtttattagggaatatagtgcagttgccaggagttggacatttgaggtttgaaatcacatattttaaagtaaattgagtctgtctgttgagtgattttctccagttgtttttatccacagctgctcaggtccagagtaggcaagtaattgagctgatccaggcctgggatttgcaaggggtgagagagaagcaagggagatgaggttatttgtaatgattctaatgatagaccatggactcaaatttggacagattcatcaagaaatattttaaaaccttaattatgcaaatatacttccatatcaagagcttagcttaaaatgagactatctctgtttaaatcccatttctattacttactataggacctcagacaagctatctaagcactctctgccctagttttttccatctgtaagatggagacaatattgtcacccaagtcatagaattgtaatccaaatagaatttacacatagaaaaagtttatccaaaaaagtttacttggtacaaatcgagcactcaaatagcatgttattactgtgattaatatacatcctgacctagtatattttactttgcacagcaaagaagaaatatttttttctttgattgtcttatctcagagcaatatacatagttcttgtccccacatttgtatttttacttatctttagttttgttctgttatatgcctttataattataattggaatggaatgatatataacaaacctcacaaaatccagttataagcataaaattggatagctagtaacaaataagtatatttgggtaagtgttagtttttggagaaacaagttgccttctgatcatcctttaaggtttcatggaaaaatatgagaccactctaatgaggacaaatgggtttaagaagtatcttccacagagcagtcatttgcccagaaatcaagattttaccagcctatcaaaagtgcatgtcctttgctgttggttcattgtgttacatgttaggcagtattgcagcacaactttttttgttttatttgttggtgctacagtcttatattatttgtgttttactttctgtggcttatcagtgttatattgttatgaataataatagataggtggaaggatatactacttcttaaccttattggcttaatattttaataatgtccataaaatgcagagattatatgttatcccagctggggctcttcagagtaagggggcacttttaataattataccaggatgctgatatgtaattcctgtatacagtctagtataaagcaggatttatactgcttgaaggatagttttcaaaataggcaaaaatcttaactcttatacaaatacaaaaagagcatgtttcatttaactcatagtaagggaaccagtaagaagttataataggttccaaagagaatacaaaatgtcacatatttatagtgagattagggatgctaaaatgaatttacctctggatgcaaagctgacaaactggtcaatatccacaggacaataatcaattgcattccactgggcacaatttgcatttatatggacagaaatcatttgcattactatctgttttcttcagtttgcagagtttaaaatagctcagagataat

SEQ ID NO: 288 - DNA, 4078 bp, Homo sapiens
acatagtcctggtgttaacaccttcagatgggggcatacaaggctccccagggccaatgcaacaacaaatgacctacaggaatttggctgatggtctgaatctccccagtttgagagtcacggagatgagggtagggttgggtgggaggtggggttccctatgaattctgggctcatgtagaaatattatcaagctagcagatcccctgggtttactgagtatttgcatgtttatatttccaagcaatttagtaccctcaagacaattatcacctgtccctcccctcgcacgtagacacatcagttttgatcattaattctactactttatttaaaaacaaacacaaataaactttgtcttattgttttgtaacaaatgttctagtagtcatacatgcaatattgacatcttatattttggggtgtatggtatggtagcctatttctatatagtcctttccatgtttgtatctttaaatctactcttgagtgtgaaattactttaagtgtattttgtttcagagacagggtctcactctgttgcccaggccagagtgcagtggtgcaaccatggctcattgcagtcttatactcctggcctcaagtgaacctcctgcctcagcctcctgagtagctgggactacaggtacatgccaccatgcccagctaattggactttttttagagatggagtcttgctatgttgcccaggctggtctcaaactcctgacctgaagcagtcctcctgctttggcctccccaaatgctgggattacagacatgagccactgtgcccagcttaaatgcattttatagtcaaatcctacggaattattcattatttacaatgttgtcttcctgcctcctgtcttcattatcatgagatactaatggcattttttaaggaagactctaaacttttgcagtacctattatcaaataggatcatatatcttatttgaattttggacagaattttttttttcttgaaattctgacctccacgcttcttttctcttaagttaatttttgtttctaaaagtatatctttggatttcctgcctttaaaagcttagaggacagtagacagtgtttgcgagtggatgaggaagttgaatataacctgaggaatatataagttattcctgcagctttctcacccactacctccatcctctccccaggggcttttccacacagacacacacacacccacacccacacccacacacacacaagcacgtgcacagagtgagaatcaatgttactgatgggggtactccacattcttcctatattctagtcttgggtgaaacaaggactgaaaagattataaattccaaagtaagtacaccacctctcagatctttaagaaggtgttactcaaataaatgttgtcatatcagattgccaacatttgttttcactcttcatactttaggcagttgaatgcaaaatcgattagttgggagctcgtgcttgattgctatatatatgtaacttctataagtgtacataaagtaaatgttaacagaacctgtattttgcctgtgtcaacttccttttctggagacttctggttttctcatagtacctcccaccttctaatacactgtataacttacttacagtgtttgtcgtctcttatttttccccatcctgaggcatggccactccacttggcaccatggagttcattgctaataattataggaccagtttgagtgcaggagaaaagttggaagccaaacagaagtggctggagtggtgaatgggacacgaggaagtagatatggtacagtactcattggtgaattttgcctgtgaaggagagaaaaaaggtgataactagcagaaaatgtagatttgaggtaggggtgtgtgtgtgtgtgtgtttaaggatggcacgtctgtaaacatttatattctacaaaggatagtcttcttgagagaggggttgacagtgcagcacaggaaatttttaagaaatcattgggaagaattggcctttaataagaagggggacaatttctcagttaaaggggagataggataacagactggcagttggagggaagtttcctgagttggtggtggagagagaaaggagtcctcatctagtagtatttaggttttcaatgaagcgtgagataaagtaaaatgatattaaggcagagaaataaaccagtttggggagagagatagcagtagtgaatttctgttttggagtttgggaaagcaagtttattagggaatatagtgcagttgccaggagttggacatttgaggtttgaaatcacatattttaaagtaaattgagtctgtctgttgagtgattttctccagttgtttttatccacagctgctcaggtccagagtaggcaagtaattgagctgatccaggcctgggatttgcaaggggtgagagagaagcaagggagatgaggttatttgtaatgattctaatgatagaccatggactcaaatttggacagattcatcaagaaatattttaaaaccttaattatgcaaatatacttccatatcaagagcttagcttaaaatgagactatctctgtttaaatcccatttctattacttactataggacctcagacaagctatctaagcactctctgccctagttttttccatctgtaagatggagacaatattgtcacccaagtcatagaattgtaatccaaatagaatttacacatagaaaaagtttatccaaaaaagtttacttggtacaaatcgagcactcaaatagcatgttattactgtgattaatatacatcctgacctagtatattttactttgcacagcaaagaagaaatatttttttctttgattgtcttatctcagagcaatatacatagttcttgtccccacatttgtatttttacttatctttagttttgttctgttatatgcctttataattataattggaatggaatgatatataacaaacctcacaaaatccagttataagcataaaattggatagctagtaacaaataagtatatttgggtaagtgttagtttttggagaaacaagttgccttctgatcatcctttaaggtttcatggaaaaatatgagaccactctaatgaggacaaatgggtttaagaagtatcttccacagagcagtcatttgcccagaaatcaagattttaccagcctatcaaaagtgcatgtcctttgctgttggttcattgtgttacatgttaggcagtattgcagcacaactttttttgttttatttgttggtgctacagtcttatattatttgtgttttactttctgtggcttatcagtgttatattgttatgaataataatagataggtggaaggatatactacttcttaaccttattggcttaatattttaataatgtccataaaatgcagagattatatgttatcccagctggggctcttcagagtaagggggcacttttaataattataccaggatgctgatatgtaattcctgtatacagtctagtataaagcaggatttatactgcttgaaggatagttttcaaaataggcaaaaatcttaactcttatacaaatacaaaaagagcatgtttcatttaactcatagtaagggaaccagtaagaagttataataggttccaaagagaatacaaaatgtcacatatttatagtgagattagggatgctaaaatgaatttacctctggatgcaaagctgacaaactggtcaatatccacaggacaataatcaattgcattccactgggcacaatttgcatttatatggacagaaatcatttgcattactatctgttttcttcagtttgcagagtttaaaatagctcagagataatttaagctttgcaggatacccactcattttttgcccacaacaaagaccttcacaatttttccctgcacaggcaaaactggatggctggccagcctagttacatgtcacatgttctcactattgtttgcttcatatgattttgtacttaactgttaattgctactttgttttttgttttgttttgtttttttttttttaattttattcttggata

SEQ ID NO: 289 - DNA, 4035 bp, Homo sapiens
attctgggctcatgtagaaatattatcaagctagcagatcccctgggtttactgagtatttgcatgtttatatttccaagcaatttagtaccctcaagacaattatcacctgtccctcccctcgcacgtagacacatcagttttgatcattaattctactactttatttaaaaacaaacacaaataaactttgtcttattgttttgtaacaaatgttctagtagtcatacatgcaatattgacatcttatattttggggtgtatggtatggtagcctatttctatatagtcctttccatgtttgtatctttaaatctactcttgagtgtgaaattactttaagtgtattttgtttcagagacagggtctcactctgttgcccaggccagagtgcagtggtgcaaccatggctcattgcagtcttatactcctggcctcaagtgaacctcctgcctcagcctcctgagtagctgggactacaggtacatgccaccatgcccagctaattggactttttttagagatggagtcttgctatgttgcccaggctggtctcaaactcctgacctgaagcagtcctcctgctttggcctccccaaatgctgggattacagacatgagccactgtgcccagcttaaatgcattttatagtcaaatcctacggaattattcattatttacaatgttgtcttcctgcctcctgtcttcattatcatgagatactaatggcattttttaaggaagactctaaacttttgcagtacctattatcaaataggatcatatatcttatttgaattttggacagaattttttttttcttgaaattctgacctccacgcttcttttctcttaagttaatttttgtttctaaaagtatatctttggatttcctgcctttaaaagcttagaggacagtagacagtgtttgcgagtggatgaggaagttgaatataacctgaggaatatataagttattcctgcagctttctcacccactacctccatcctctccccaggggcttttccacacagacacacacacacccacacccacacccacacacacacaagcacgtgcacagagtgagaatcaatgttactgatgggggtactccacattcttcctatattctagtcttgggtgaaacaaggactgaaaagattataaattccaaagtaagtacaccacctctcagatctttaagaaggtgttactcaaataaatgttgtcatatcagattgccaacatttgttttcactcttcatactttaggcagttgaatgcaaaatcgattagttgggagctcgtgcttgattgctatatatatgtaacttctataagtgtacataaagtaaatgttaacagaacctgtattttgcctgtgtcaacttccttttctggagacttctggttttctcatagtacctcccaccttctaatacactgtataacttacttacagtgtttgtcgtctcttatttttccccatcctgaggcatggccactccacttggcaccatggagttcattgctaataattataggaccagtttgagtgcaggagaaaagttggaagccaaacagaagtggctggagtggtgaatgggacacgaggaagtagatatggtacagtactcattggtgaattttgcctgtgaaggagagaaaaaaggtgataactagcagaaaatgtagatttgaggtaggggtgtgtgtgtgtgtgtgtttaaggatggcacgtctgtaaacatttatattctacaaaggatagtcttcttgagagaggggttgacagtgcagcacaggaaatttttaagaaatcattgggaagaattggcctttaataagaagggggacaatttctcagttaaaggggagataggataacagactggcagttggagggaagtttcctgagttggtggtggagagagaaaggagtcctcatctagtagtatttaggttttcaatgaagcgtgagataaagtaaaatgatattaaggcagagaaataaaccagtttggggagagagatagcagtagtgaatttctgttttggagtttgggaaagcaagtttattagggaatatagtgcagttgccaggagttggacatttgaggtttgaaatcacatattttaaagtaaattgagtctgtctgttgagtgattttctccagttgtttttatccacagctgctcaggtccagagtaggcaagtaattgagctgatccaggcctgggatttgcaaggggtgagagagaagcaagggagatgaggttatttgtaatgattctaatgatagaccatggactcaaatttggacagattcatcaagaaatattttaaaaccttaattatgcaaatatacttccatatcaagagcttagcttaaaatgagactatctctgtttaaatcccatttctattacttactataggacctcagacaagctatctaagcactctctgccctagttttttccatctgtaagatggagacaatattgtcacccaagtcatagaattgtaatccaaatagaatttacacatagaaaaagtttatccaaaaaagtttacttggtacaaatcgagcactcaaatagcatgttattactgtgattaatatacatcctgacctagtatattttactttgcacagcaaagaagaaatatttttttctttgattgtcttatctcagagcaatatacatagttcttgtccccacatttgtatttttacttatctttagttttgttctgttatatgcctttataattataattggaatggaatgatatataacaaacctcacaaaatccagttataagcataaaattggatagctagtaacaaataagtatatttgggtaagtgttagtttttggagaaacaagttgccttctgatcatcctttaaggtttcatggaaaaatatgagaccactctaatgaggacaaatgggtttaagaagtatcttccacagagcagtcatttgcccagaaatcaagattttaccagcctatcaaaagtgcatgtcctttgctgttggttcattgtgttacatgttaggcagtattgcagcacaactttttttgttttatttgttggtgctacagtcttatattatttgtgttttactttctgtggcttatcagtgttatattgttatgaataataatagataggtggaaggatatactacttcttaaccttattggcttaatattttaataatgtccataaaatgcagagattatatgttatcccagctggggctcttcagagtaagggggcacttttaataattataccaggatgctgatatgtaattcctgtatacagtctagtataaagcaggatttatactgcttgaaggatagttttcaaaataggcaaaaatcttaactcttatacaaatacaaaaagagcatgtttcatttaactcatagtaagggaaccagtaagaagttataataggttccaaagagaatacaaaatgtcacatatttatagtgagattagggatgctaaaatgaatttacctctggatgcaaagctgacaaactggtcaatatccacaggacaataatcaattgcattccactgggcacaatttgcatttatatggacagaaatcatttgcattactatctgttttcttcagtttgcagagtttaaaatagctcagagataatttaagctttgcaggatacccactcattttttgcccacaacaaagaccttcacaatttttccctgcacaggcaaaactggatggctggccagcctagttacatgtcacatgttctcactattgtttgcttcatatgattttgtacttaactgttaattgctactttgttttttgttttgttttgtttttttttttttaattttattcttggatagattcccatggctgttgccttttaaagagaggatttttagtaataaaatcataattttattttagagcttatcaagctgcacaatatgaagtcccactccctgttcatatttgagattaat

SEQ ID NO: 290 - DNA, 4045 bp, Homo sapiens
agctgggactacaggtacatgccaccatgcccagctaattggactttttttagagatggagtcttgctatgttgcccaggctggtctcaaactcctgacctgaagcagtcctcctgctttggcctccccaaatgctgggattacagacatgagccactgtgcccagcttaaatgcattttatagtcaaatcctacggaattattcattatttacaatgttgtcttcctgcctcctgtcttcattatcatgagatactaatggcattttttaaggaagactctaaacttttgcagtacctattatcaaataggatcatatatcttatttgaattttggacagaattttttttttcttgaaattctgacctccacgcttcttttctcttaagttaatttttgtttctaaaagtatatctttggatttcctgcctttaaaagcttagaggacagtagacagtgtttgcgagtggatgaggaagttgaatataacctgaggaatatataagttattcctgcagctttctcacccactacctccatcctctccccaggggcttttccacacagacacacacacacccacacccacacccacacacacacaagcacgtgcacagagtgagaatcaatgttactgatgggggtactccacattcttcctatattctagtcttgggtgaaacaaggactgaaaagattataaattccaaagtaagtacaccacctctcagatctttaagaaggtgttactcaaataaatgttgtcatatcagattgccaacatttgttttcactcttcatactttaggcagttgaatgcaaaatcgattagttgggagctcgtgcttgattgctatatatatgtaacttctataagtgtacataaagtaaatgttaacagaacctgtattttgcctgtgtcaacttccttttctggagacttctggttttctcatagtacctcccaccttctaatacactgtataacttacttacagtgtttgtcgtctcttatttttccccatcctgaggcatggccactccacttggcaccatggagttcattgctaataattataggaccagtttgagtgcaggagaaaagttggaagccaaacagaagtggctggagtggtgaatgggacacgaggaagtagatatggtacagtactcattggtgaattttgcctgtgaaggagagaaaaaaggtgataactagcagaaaatgtagatttgaggtaggggtgtgtgtgtgtgtgtgtttaaggatggcacgtctgtaaacatttatattctacaaaggatagtcttcttgagagaggggttgacagtgcagcacaggaaatttttaagaaatcattgggaagaattggcctttaataagaagggggacaatttctcagttaaaggggagataggataacagactggcagttggagggaagtttcctgagttggtggtggagagagaaaggagtcctcatctagtagtatttaggttttcaatgaagcgtgagataaagtaaaatgatattaaggcagagaaataaaccagtttggggagagagatagcagtagtgaatttctgttttggagtttgggaaagcaagtttattagggaatatagtgcagttgccaggagttggacatttgaggtttgaaatcacatattttaaagtaaattgagtctgtctgttgagtgattttctccagttgtttttatccacagctgctcaggtccagagtaggcaagtaattgagctgatccaggcctgggatttgcaaggggtgagagagaagcaagggagatgaggttatttgtaatgattctaatgatagaccatggactcaaatttggacagattcatcaagaaatattttaaaaccttaattatgcaaatatacttccatatcaagagcttagcttaaaatgagactatctctgtttaaatcccatttctattacttactataggacctcagacaagctatctaagcactctctgccctagttttttccatctgtaagatggagacaatattgtcacccaagtcatagaattgtaatccaaatagaatttacacatagaaaaagtttatccaaaaaagtttacttggtacaaatcgagcactcaaatagcatgttattactgtgattaatatacatcctgacctagtatattttactttgcacagcaaagaagaaatatttttttctttgattgtcttatctcagagcaatatacatagttcttgtccccacatttgtatttttacttatctttagttttgttctgttatatgcctttataattataattggaatggaatgatatataacaaacctcacaaaatccagttataagcataaaattggatagctagtaacaaataagtatatttgggtaagtgttagtttttggagaaacaagttgccttctgatcatcctttaaggtttcatggaaaaatatgagaccactctaatgaggacaaatgggtttaagaagtatcttccacagagcagtcatttgcccagaaatcaagattttaccagcctatcaaaagtgcatgtcctttgctgttggttcattgtgttacatgttaggcagtattgcagcacaactttttttgttttatttgttggtgctacagtcttatattatttgtgttttactttctgtggcttatcagtgttatattgttatgaataataatagataggtggaaggatatactacttcttaaccttattggcttaatattttaataatgtccataaaatgcagagattatatgttatcccagctggggctcttcagagtaagggggcacttttaataattataccaggatgctgatatgtaattcctgtatacagtctagtataaagcaggatttatactgcttgaaggatagttttcaaaataggcaaaaatcttaactcttatacaaatacaaaaagagcatgtttcatttaactcatagtaagggaaccagtaagaagttataataggttccaaagagaatacaaaatgtcacatatttatagtgagattagggatgctaaaatgaatttacctctggatgcaaagctgacaaactggtcaatatccacaggacaataatcaattgcattccactgggcacaatttgcatttatatggacagaaatcatttgcattactatctgttttcttcagtttgcagagtttaaaatagctcagagataatttaagctttgcaggatacccactcattttttgcccacaacaaagaccttcacaatttttccctgcacaggcaaaactggatggctggccagcctagttacatgtcacatgttctcactattgtttgcttcatatgattttgtacttaactgttaattgctactttgttttttgttttgttttgtttttttttttttaattttattcttggatagattcccatggctgttgccttttaaagagaggatttttagtaataaaatcataattttattttagagcttatcaagctgcacaatatgaagtcccactccctgttcatatttgagattaattagaacccaagctgttgttattttgggggaaaatgctacttttattctgttttggttgcctactctgggagaacttcaggcattttggcaagaggagctgagctatctgcagctgttcaaatactttaagcctttgggttcattgtggattttgctttaaccctctcccccgacttaaaaaaaaaacagcagccaactgcattgcctgttttttttatttctgttgtttggtaagcagcagttatacttttgtaaccagaggctgtatttattttctgtgttggcagttctgcctaatgaatcaactggtattgaattcacaaagggagatgcccgttccctccctccatctgtttgccaaatgtgtgtgttccgtcagctctcagtagtggtttcactaaaaagagccattagcaagaggtgttcaccttgaattcttagtcctccgcctgactgagaaatagtggtattttcctct

SEQ ID NO: 291 - DNA, 4046 bp, Homo sapiens
aaagcaagtttattagggaatatagtgcagttgccaggagttggacatttgaggtttgaaatcacatattttaaagtaaattgagtctgtctgttgagtgattttctccagttgtttttatccacagctgctcaggtccagagtaggcaagtaattgagctgatccaggcctgggatttgcaaggggtgagagagaagcaagggagatgaggttatttgtaatgattctaatgatagaccatggactcaaatttggacagattcatcaagaaatattttaaaaccttaattatgcaaatatacttccatatcaagagcttagcttaaaatgagactatctctgtttaaatcccatttctattacttactataggacctcagacaagctatctaagcactctctgccctagttttttccatctgtaagatggagacaatattgtcacccaagtcatagaattgtaatccaaatagaatttacacatagaaaaagtttatccaaaaaagtttacttggtacaaatcgagcactcaaatagcatgttattactgtgattaatatacatcctgacctagtatattttactttgcacagcaaagaagaaatatttttttctttgattgtcttatctcagagcaatatacatagttcttgtccccacatttgtatttttacttatctttagttttgttctgttatatgcctttataattataattggaatggaatgatatataacaaacctcacaaaatccagttataagcataaaattggatagctagtaacaaataagtatatttgggtaagtgttagtttttggagaaacaagttgccttctgatcatcctttaaggtttcatggaaaaatatgagaccactctaatgaggacaaatgggtttaagaagtatcttccacagagcagtcatttgcccagaaatcaagattttaccagcctatcaaaagtgcatgtcctttgctgttggttcattgtgttacatgttaggcagtattgcagcacaactttttttgttttatttgttggtgctacagtcttatattatttgtgttttactttctgtggcttatcagtgttatattgttatgaataataatagataggtggaaggatatactacttcttaaccttattggcttaatattttaataatgtccataaaatgcagagattatatgttatcccagctggggctcttcagagtaagggggcacttttaataattataccaggatgctgatatgtaattcctgtatacagtctagtataaagcaggatttatactgcttgaaggatagttttcaaaataggcaaaaatcttaactcttatacaaatacaaaaagagcatgtttcatttaactcatagtaagggaaccagtaagaagttataataggttccaaagagaatacaaaatgtcacatatttatagtgagattagggatgctaaaatgaatttacctctggatgcaaagctgacaaactggtcaatatccacaggacaataatcaattgcattccactgggcacaatttgcatttatatggacagaaatcatttgcattactatctgttttcttcagtttgcagagtttaaaatagctcagagataatttaagctttgcaggatacccactcattttttgcccacaacaaagaccttcacaatttttccctgcacaggcaaaactggatggctggccagcctagttacatgtcacatgttctcactattgtttgcttcatatgattttgtacttaactgttaattgctactttgttttttgttttgttttgtttttttttttttaattttattcttggatagattcccatggctgttgccttttaaagagaggatttttagtaataaaatcataattttattttagagcttatcaagctgcacaatatgaagtcccactccctgttcatatttgagattaattagaacccaagctgttgttattttgggggaaaatgctacttttattctgttttggttgcctactctgggagaacttcaggcattttggcaagaggagctgagctatctgcagctgttcaaatactttaagcctttgggttcattgtggattttgctttaaccctctcccccgacttaaaaaaaaaacagcagccaactgcattgcctgttttttttatttctgttgtttggtaagcagcagttatacttttgtaaccagaggctgtatttattttctgtgttggcagttctgcctaatgaatcaactggtattgaattcacaaagggagatgcccgttccctccctccatctgtttgccaaatgtgtgtgttccgtcagctctcagtagtggtttcactaaaaagagccattagcaagaggtgttcaccttgaattcttagtcctccgcctgactgagaaatagtggtattttcctcttgtgattccgtaggggttgtgtgaggtgaagacccacacctgtaattccagagaaagcatatttgttgtttaagtataacgtctggctctacattaccgatggctttagtttggttcttgagccttggtttgctccatcatgatgggatgtctgtctctggacagtactgttgtcgtggggattgaaattccctgaaagagaagacaagagatcaatgaaccctagtaggttctctcagactgggagcccatgatgccttactggaattgcattacctcctcagcaaatccttccatatttgttggtaatagggaggaaattctttttgagactctgcatttctgtaaagctctgagcctaatgatgaatagtaagaatttaggtcaaacaacttcagtacccggctccatggtcttttgagcaatttgtagtatcactaccatcaaaccgaaagggtggaatggttttgttggtgttcagtagtggaccatgaagtagaagtatttgtctctgcattggagtcaagaatctgggtagaggagcccgacaactttccatctctttccaagacagatcttcacattgtagttacattattttgtttgagatcttggaatttccaggatacatacccaattgctaatatttccgggatacgtacccaactgcaaatacacactttaaatatttttcaaaggtaagtatgagttatttggggtttttgttacctgtgtatatataacagtgatgatattcttttcccagtgacatgccccagtttttgatatattacataggcttgaaaaataatttctcttgaatttgattttatgaatgttgtaatatcactctcttaggtactatgctggttcatttagtttactaaatagttttataagaactaggtgtcatttaagaagtctttggagcactattaaatgttatgaatctaccctgacctagataaggggcagttaactctttttaaatgtaaggccactgacccaccaaagtcatgaactgtttacctaagaaacttaattgaagcattccatttatgttttaacctcaatttattaccccaaaacttccatctaacatatgaattagttttgaaatttacagaaaaagagaaagtataaaacttgcttttaaagtgaagaacatgaggaaaacaatttaatacatatagaaaataataatactggttaatgagaggaagctgagaagaggaacacagagtctaagtggcaagagacacttgcctgaggggagtggggaatccagatacacatgaagagaagaaagggtagatttgcactgaggaaagttcgactcaaggtagaagaggagggaggctctgtagattgtgggatgatgttattcagagttaaacttgtttctgcaatctttggaaatatgacgagacttttaaggtgtagtgactcccacagcactacttctgctgttggaggattcgttctgaatgataatctacatctgtttaacagatatgggtttattctggagcctgcattgatctggccacatcaagccaggaccgaagggttcatgacagtcacattttatatctaggttttaa

SEQ ID NO: 292 - DNA, 4050 bp, Homo sapiens
aatatttttttctttgattgtcttatctcagagcaatatacatagttcttgtccccacatttgtatttttacttatctttagttttgttctgttatatgcctttataattataattggaatggaatgatatataacaaacctcacaaaatccagttataagcataaaattggatagctagtaacaaataagtatatttgggtaagtgttagtttttggagaaacaagttgccttctgatcatcctttaaggtttcatggaaaaatatgagaccactctaatgaggacaaatgggtttaagaagtatcttccacagagcagtcatttgcccagaaatcaagattttaccagcctatcaaaagtgcatgtcctttgctgttggttcattgtgttacatgttaggcagtattgcagcacaactttttttgttttatttgttggtgctacagtcttatattatttgtgttttactttctgtggcttatcagtgttatattgttatgaataataatagataggtggaaggatatactacttcttaaccttattggcttaatattttaataatgtccataaaatgcagagattatatgttatcccagctggggctcttcagagtaagggggcacttttaataattataccaggatgctgatatgtaattcctgtatacagtctagtataaagcaggatttatactgcttgaaggatagttttcaaaataggcaaaaatcttaactcttatacaaatacaaaaagagcatgtttcatttaactcatagtaagggaaccagtaagaagttataataggttccaaagagaatacaaaatgtcacatatttatagtgagattagggatgctaaaatgaatttacctctggatgcaaagctgacaaactggtcaatatccacaggacaataatcaattgcattccactgggcacaatttgcatttatatggacagaaatcatttgcattactatctgttttcttcagtttgcagagtttaaaatagctcagagataatttaagctttgcaggatacccactcattttttgcccacaacaaagaccttcacaatttttccctgcacaggcaaaactggatggctggccagcctagttacatgtcacatgttctcactattgtttgcttcatatgattttgtacttaactgttaattgctactttgttttttgttttgttttgtttttttttttttaattttattcttggatagattcccatggctgttgccttttaaagagaggatttttagtaataaaatcataattttattttagagcttatcaagctgcacaatatgaagtcccactccctgttcatatttgagattaattagaacccaagctgttgttattttgggggaaaatgctacttttattctgttttggttgcctactctgggagaacttcaggcattttggcaagaggagctgagctatctgcagctgttcaaatactttaagcctttgggttcattgtggattttgctttaaccctctcccccgacttaaaaaaaaaacagcagccaactgcattgcctgttttttttatttctgttgtttggtaagcagcagttatacttttgtaaccagaggctgtatttattttctgtgttggcagttctgcctaatgaatcaactggtattgaattcacaaagggagatgcccgttccctccctccatctgtttgccaaatgtgtgtgttccgtcagctctcagtagtggtttcactaaaaagagccattagcaagaggtgttcaccttgaattcttagtcctccgcctgactgagaaatagtggtattttcctcttgtgattccgtaggggttgtgtgaggtgaagacccacacctgtaattccagagaaagcatatttgttgtttaagtataacgtctggctctacattaccgatggctttagtttggttcttgagccttggtttgctccatcatgatgggatgtctgtctctggacagtactgttgtcgtggggattgaaattccctgaaagagaagacaagagatcaatgaaccctagtaggttctctcagactgggagcccatgatgccttactggaattgcattacctcctcagcaaatccttccatatttgttggtaatagggaggaaattctttttgagactctgcatttctgtaaagctctgagcctaatgatgaatagtaagaatttaggtcaaacaacttcagtacccggctccatggtcttttgagcaatttgtagtatcactaccatcaaaccgaaagggtggaatggttttgttggtgttcagtagtggaccatgaagtagaagtatttgtctctgcattggagtcaagaatctgggtagaggagcccgacaactttccatctctttccaagacagatcttcacattgtagttacattattttgtttgagatcttggaatttccaggatacatacccaattgctaatatttccgggatacgtacccaactgcaaatacacactttaaatatttttcaaaggtaagtatgagttatttggggtttttgttacctgtgtatatataacagtgatgatattcttttcccagtgacatgccccagtttttgatatattacataggcttgaaaaataatttctcttgaatttgattttatgaatgttgtaatatcactctcttaggtactatgctggttcatttagtttactaaatagttttataagaactaggtgtcatttaagaagtctttggagcactattaaatgttatgaatctaccctgacctagataaggggcagttaactctttttaaatgtaaggccactgacccaccaaagtcatgaactgtttacctaagaaacttaattgaagcattccatttatgttttaacctcaatttattaccccaaaacttccatctaacatatgaattagttttgaaatttacagaaaaagagaaagtataaaacttgcttttaaagtgaagaacatgaggaaaacaatttaatacatatagaaaataataatactggttaatgagaggaagctgagaagaggaacacagagtctaagtggcaagagacacttgcctgaggggagtggggaatccagatacacatgaagagaagaaagggtagatttgcactgaggaaagttcgactcaaggtagaagaggagggaggctctgtagattgtgggatgatgttattcagagttaaacttgtttctgcaatctttggaaatatgacgagacttttaaggtgtagtgactcccacagcactacttctgctgttggaggattcgttctgaatgataatctacatctgtttaacagatatgggtttattctggagcctgcattgatctggccacatcaagccaggaccgaagggttcatgacagtcacattttatatctaggttttaatttgtagtttcagttctgtttgaaataggcaaagcaaagatttcatttgtgtttttacaatgtagttgctcaaatgaaatttattattaaaaaatttttataaaaaacttttgtatagagatgaggtctcgctatgttgccaagctggtctcaaactcctgggctcccacctcaggctcccaaagtgttgggattatagatgtgaggcaccacacctggctaaaatttattattaatattttttatttttttgagacagtgtctcactctgtcacccaggctacagtgcagtgaaacgatctcggctcactgcaacctccacctcccagcttcaagcaattctcatgcctcaccctcctgagtagctaggactacaggcacccaccaccatacctggctaatttttgtatttttagtagcgatgggatttcatcatattggccaggcttgtctcaatctcctgacctcaagtgatccacctgcctcggcctcccaaagtgctgggattacaggaagagccactgcccctggccaatgtttcaaatgttaagtaacaattgggcattgggtttctgaatggttgataatgaggataattttgcatgta

SEQ ID NO: 293 - DNA, 4049 bp, Homo sapiens
gaatttgattttatgaatgttgtaatatcactctcttaggtactatgctggttcatttagtttactaaatagttttataagaactaggtgtcatttaagaagtctttggagcactattaaatgttatgaatctaccctgacctagataaggggcagttaactctttttaaatgtaaggccactgacccaccaaagtcatgaactgtttacctaagaaacttaattgaagcattccatttatgttttaacctcaatttattaccccaaaacttccatctaacatatgaattagttttgaaatttacagaaaaagagaaagtataaaacttgcttttaaagtgaagaacatgaggaaaacaatttaatacatatagaaaataataatactggttaatgagaggaagctgagaagaggaacacagagtctaagtggcaagagacacttgcctgaggggagtggggaatccagatacacatgaagagaagaaagggtagatttgcactgaggaaagttcgactcaaggtagaagaggagggaggctctgtagattgtgggatgatgttattcagagttaaacttgtttctgcaatctttggaaatatgacgagacttttaaggtgtagtgactcccacagcactacttctgctgttggaggattcgttctgaatgataatctacatctgtttaacagatatgggtttattctggagcctgcattgatctggccacatcaagccaggaccgaagggttcatgacagtcacattttatatctaggttttaatttgtagtttcagttctgtttgaaataggcaaagcaaagatttcatttgtgtttttacaatgtagttgctcaaatgaaatttattattaaaaaatttttataaaaaacttttgtatagagatgaggtctcgctatgttgccaagctggtctcaaactcctgggctcccacctcaggctcccaaagtgttgggattatagatgtgaggcaccacacctggctaaaatttattattaatattttttatttttttgagacagtgtctcactctgtcacccaggctacagtgcagtgaaacgatctcggctcactgcaacctccacctcccagcttcaagcaattctcatgcctcaccctcctgagtagctaggactacaggcacccaccaccatacctggctaatttttgtatttttagtagcgatgggatttcatcatattggccaggcttgtctcaatctcctgacctcaagtgatccacctgcctcggcctcccaaagtgctgggattacaggaagagccactgcccctggccaatgtttcaaatgttaagtaacaattgggcattgggtttctgaatggttgataatgaggataattttgcatgtatttttaaaaatttgaaaaaaatcatttctacttgggtatttcgtttttggcctatatgaagttttttgattttttgtttatttttaaaattttaccttttttttccagccatcaaacacagaccacctgttgggaccatcctaaaatgaccgaactctttcaatcccttggtaagtgttattaatagtaataaattaacctaaacaactgagaaccggtttttttttttttttttttttttttttttttttttttaaggtggattctcgctgttgcccaggctggagtgcagtggcatgatctcggctcactgcaacctctgcctcccggattcaagcaattctcctgccttaggctcctgagtagctgggactacaggcgcccgccgccactcccagctaatttttcgtattttaatagagacagggttttactgtgttgcccaggctggtctcgaactcctgagctcaggcaatccacccgcctcggcctcccaaagtgctcccgtgagccactgtgcccggccgagaactgtatattgttaaataggagctaatcaccagcctttcttacatggcatattaatgttaaaagaatcatgtcattgacatttaaaagtagttaaatttctaagggcaatgcagtaaacaggtattgcctttcttaggagaattgtgtggtttgaaatcatgtgagccaaaaagagttgatttacagggaggaatgtaattgtagtttttacctccttcgtattgagtcatcttaaccttcagctttgcacgcaaaaaatatatatagatatacaattacaatatagccaactttaatccactgccttaaatttgcttttggctcactttttatttagtacgtgccatcaaattagctcacctagtttaaatttgtctaaattgttaaaagctaaattcatttttatataaaaatgcaagaaaacacagacgagaattccggttttgttttaatttctagtgcaatgtggctttcaacttattgtttaacctacttcctctggttggtccagcggtttttttaagttttctctttgggtagctaaggagatgctggagggaaaaacagcacccgaagcctccctctcccatttcaataaaaaggatgcccccttttttaatctctttaaatgttgggcttctgtgtgagtgtttttttttttggtgggtgaaggggcctgcaaaagttggacaaacaaaagacatagaactggtttgcttagtttgtaaaatgagggggcaaattttgatgatatctgagttttcttttaactctactaatctctgatactctgtctttaggggacaaagaaagaaattacaatatctattgtttccaaagagttgagtattggttgtaggatcatttgaaccagatctgcaaaagggcaggaaaaccaaatcaatcaggatgggaggagcatagaaataagatgagctccatgaatagtgaactggacagtgtggttggaagaaaatgaagtgtccttggggaagatgcccctggaggaaaatctcctttattgggaaaaaaaggaagggccctctgcctactgtgcagtgcatttaataagccatgtgacagctgtgctttctcttcatcaccttcctctttttcctaccaaagggctgaaaggggtggtaccttttctcacccatcataagggtcatggtgaccctcctataacaaaagacaggtcaaccagaaaagcacaagaaatttacttaatcaaagttttacctgacatgagaaccttcagaagactcaaagaaaacagggaaaagtgtctgtttttacacttagattgagtgaggaatggatgactgcattgaattgtgattggatgaaagggtataatttaatgataatagactgagaagggaattccagcaaggcctatctattcagattcttcttggcttctccctgcagcatattcctttcctctagggacaggatacctgtcacaggagaatcttcaggagagaagggagaaggtgacagtgaacttgctagattttatggcttgctttggggaagagaagttctagttttcatgacccaccttggggaaggggaattctggtttctatttatcactttggaaggagaaagagggtcaggagacaagagacccagaggtcagagagaccttactactgaggccttccagtctccttcatttcaaagtactcaacccaccatgttctgagccctgacacctgttgaaaatactttcttagaattttctctgtagcactgctttgagatgtatctcaacatggtgctaatgatcatttaacttttttcttaaatacgtgttggggaatttgggagaagactttttatttcaggcaaacataatattttttcatcatccaaagtaaccaaatacattctgggcattcaatatatattcaataataagcctatcttcaaattgtttctttttctatttcagctgacctgaataatgtacgtttttctgcctaccgtacagcaatcaaaatccgaagactacaaaaagcactatgttgtgagttattctaccaaagttaatcaatctgttacttgaattgcgttttttttttttccaagaggaagataaatgaagaggatggagtgtt

SEQ ID NO: 294 - DNA, 4044 bp, Homo sapiens
ttaaggtgtagtgactcccacagcactacttctgctgttggaggattcgttctgaatgataatctacatctgtttaacagatatgggtttattctggagcctgcattgatctggccacatcaagccaggaccgaagggttcatgacagtcacattttatatctaggttttaatttgtagtttcagttctgtttgaaataggcaaagcaaagatttcatttgtgtttttacaatgtagttgctcaaatgaaatttattattaaaaaatttttataaaaaacttttgtatagagatgaggtctcgctatgttgccaagctggtctcaaactcctgggctcccacctcaggctcccaaagtgttgggattatagatgtgaggcaccacacctggctaaaatttattattaatattttttatttttttgagacagtgtctcactctgtcacccaggctacagtgcagtgaaacgatctcggctcactgcaacctccacctcccagcttcaagcaattctcatgcctcaccctcctgagtagctaggactacaggcacccaccaccatacctggctaatttttgtatttttagtagcgatgggatttcatcatattggccaggcttgtctcaatctcctgacctcaagtgatccacctgcctcggcctcccaaagtgctgggattacaggaagagccactgcccctggccaatgtttcaaatgttaagtaacaattgggcattgggtttctgaatggttgataatgaggataattttgcatgtatttttaaaaatttgaaaaaaatcatttctacttgggtatttcgtttttggcctatatgaagttttttgattttttgtttatttttaaaattttaccttttttttccagccatcaaacacagaccacctgttgggaccatcctaaaatgaccgaactctttcaatcccttggtaagtgttattaatagtaataaattaacctaaacaactgagaaccggtttttttttttttttttttttttttttttttttttttaaggtggattctcgctgttgcccaggctggagtgcagtggcatgatctcggctcactgcaacctctgcctcccggattcaagcaattctcctgccttaggctcctgagtagctgggactacaggcgcccgccgccactcccagctaatttttcgtattttaatagagacagggttttactgtgttgcccaggctggtctcgaactcctgagctcaggcaatccacccgcctcggcctcccaaagtgctcccgtgagccactgtgcccggccgagaactgtatattgttaaataggagctaatcaccagcctttcttacatggcatattaatgttaaaagaatcatgtcattgacatttaaaagtagttaaatttctaagggcaatgcagtaaacaggtattgcctttcttaggagaattgtgtggtttgaaatcatgtgagccaaaaagagttgatttacagggaggaatgtaattgtagtttttacctccttcgtattgagtcatcttaaccttcagctttgcacgcaaaaaatatatatagatatacaattacaatatagccaactttaatccactgccttaaatttgcttttggctcactttttatttagtacgtgccatcaaattagctcacctagtttaaatttgtctaaattgttaaaagctaaattcatttttatataaaaatgcaagaaaacacagacgagaattccggttttgttttaatttctagtgcaatgtggctttcaacttattgtttaacctacttcctctggttggtccagcggtttttttaagttttctctttgggtagctaaggagatgctggagggaaaaacagcacccgaagcctccctctcccatttcaataaaaaggatgcccccttttttaatctctttaaatgttgggcttctgtgtgagtgtttttttttttggtgggtgaaggggcctgcaaaagttggacaaacaaaagacatagaactggtttgcttagtttgtaaaatgagggggcaaattttgatgatatctgagttttcttttaactctactaatctctgatactctgtctttaggggacaaagaaagaaattacaatatctattgtttccaaagagttgagtattggttgtaggatcatttgaaccagatctgcaaaagggcaggaaaaccaaatcaatcaggatgggaggagcatagaaataagatgagctccatgaatagtgaactggacagtgtggttggaagaaaatgaagtgtccttggggaagatgcccctggaggaaaatctcctttattgggaaaaaaaggaagggccctctgcctactgtgcagtgcatttaataagccatgtgacagctgtgctttctcttcatcaccttcctctttttcctaccaaagggctgaaaggggtggtaccttttctcacccatcataagggtcatggtgaccctcctataacaaaagacaggtcaaccagaaaagcacaagaaatttacttaatcaaagttttacctgacatgagaaccttcagaagactcaaagaaaacagggaaaagtgtctgtttttacacttagattgagtgaggaatggatgactgcattgaattgtgattggatgaaagggtataatttaatgataatagactgagaagggaattccagcaaggcctatctattcagattcttcttggcttctccctgcagcatattcctttcctctagggacaggatacctgtcacaggagaatcttcaggagagaagggagaaggtgacagtgaacttgctagattttatggcttgctttggggaagagaagttctagttttcatgacccaccttggggaaggggaattctggtttctatttatcactttggaaggagaaagagggtcaggagacaagagacccagaggtcagagagaccttactactgaggccttccagtctccttcatttcaaagtactcaacccaccatgttctgagccctgacacctgttgaaaatactttcttagaattttctctgtagcactgctttgagatgtatctcaacatggtgctaatgatcatttaacttttttcttaaatacgtgttggggaatttgggagaagactttttatttcaggcaaacataatattttttcatcatccaaagtaaccaaatacattctgggcattcaatatatattcaataataagcctatcttcaaattgtttctttttctatttcagctgacctgaataatgtacgtttttctgcctaccgtacagcaatcaaaatccgaagactacaaaaagcactatgttgtgagttattctaccaaagttaatcaatctgttacttgaattgcgttttttttttttccaagaggaagataaatgaagaggatggagtgtttgccaagttaatctggtcttcagtgtacctcactcaaggagttggttttgtttctataaatgttttattacttgccccatcagtgtgcagtactgaacacatgccattcttacttggagaacaaaattaaccaaaacacaggagtaatgtaaaaagctttttcaaaaattgtgctgccacccaatttaaaaggattaaatcaaagaaagtattaagtcatgtgttttcagtaccttttgcccatttggcaatgtagagttccagtttgtctcaataccactatatataaagaaacactaaaaaatcacattcctgatctaaatttgaactggcaccttaacaagtgagataaaaggctctattttcttttaaatatatcttgagacatttagtattatcaatgcatttttcctgtggaggatgtgttcagagtggaattctgtggcagtcctttcatcaaaaggatatttcctcccgcaaaataacctaaaattaagtagcagtgtgaatacttagcatatagatttatgctatctggattctatttgtggttgtagttctaatgattgagtctaccctaggccttgtcagatagttgatgtggaaag

SEQ ID NO: 295 - DNA, 4042 bp, Homo sapiens
aaccttcagaagactcaaagaaaacagggaaaagtgtctgtttttacacttagattgagtgaggaatggatgactgcattgaattgtgattggatgaaagggtataatttaatgataatagactgagaagggaattccagcaaggcctatctattcagattcttcttggcttctccctgcagcatattcctttcctctagggacaggatacctgtcacaggagaatcttcaggagagaagggagaaggtgacagtgaacttgctagattttatggcttgctttggggaagagaagttctagttttcatgacccaccttggggaaggggaattctggtttctatttatcactttggaaggagaaagagggtcaggagacaagagacccagaggtcagagagaccttactactgaggccttccagtctccttcatttcaaagtactcaacccaccatgttctgagccctgacacctgttgaaaatactttcttagaattttctctgtagcactgctttgagatgtatctcaacatggtgctaatgatcatttaacttttttcttaaatacgtgttggggaatttgggagaagactttttatttcaggcaaacataatattttttcatcatccaaagtaaccaaatacattctgggcattcaatatatattcaataataagcctatcttcaaattgtttctttttctatttcagctgacctgaataatgtacgtttttctgcctaccgtacagcaatcaaaatccgaagactacaaaaagcactatgttgtgagttattctaccaaagttaatcaatctgttacttgaattgcgttttttttttttccaagaggaagataaatgaagaggatggagtgtttgccaagttaatctggtcttcagtgtacctcactcaaggagttggttttgtttctataaatgttttattacttgccccatcagtgtgcagtactgaacacatgccattcttacttggagaacaaaattaaccaaaacacaggagtaatgtaaaaagctttttcaaaaattgtgctgccacccaatttaaaaggattaaatcaaagaaagtattaagtcatgtgttttcagtaccttttgcccatttggcaatgtagagttccagtttgtctcaataccactatatataaagaaacactaaaaaatcacattcctgatctaaatttgaactggcaccttaacaagtgagataaaaggctctattttcttttaaatatatcttgagacatttagtattatcaatgcatttttcctgtggaggatgtgttcagagtggaattctgtggcagtcctttcatcaaaaggatatttcctcccgcaaaataacctaaaattaagtagcagtgtgaatacttagcatatagatttatgctatctggattctatttgtggttgtagttctaatgattgagtctaccctaggccttgtcagatagttgatgtggaaagtgatatttacctgttcttttaagatagggtaaattgaaaagtttcaagtattcttctttgctaccttttgttaactgttaatatacgtctaggcagttcagtgatgctttgaaaattatgctttgaaaaatgatatgttaaggttgaaaaatctgctccttgaaagtcaatagaagttagcaataaattttaagctggctgcacgaagaattgaggaaagagaggtataatgtcattgagaaaaaatagcaatgcaaagcttgaaaataggaaaagcttaagctatgtatggaagagaagtctacagggctgaaagacacctccagatgaggcaatgcaaggaagaatgagatgaccttgacttttgcataatccacagagcctcaaagataattagcaggtggtagtagttgcagcaagtgttgcagaattacccggacaaagaaaagaaagccaccacgctctggctactgatcagtatgttgagcgaaaagagaataggaagtaaattacgaacacacaaaagggatgtttggtctgcgcaggagtccatggtgacagcagttttgaaagaggctcagctgcacatccaggatccagttgatgggtctggaagttcttctcaggcctgatgagctataaaatgaggacaaatgactcagccacaaaatttccattgacagaagactgctttttgtcattatgaacatggtcccagttttcgacaacacttatgggtggataagcatattaacacatttggtgttttcttctcttggttctttggattcctgaagaaaaaaaccccctcctcagctcttcccctcaaacctgagaggaacagaagggacgcttctccaacttctaaactaaacgagattggtaatgacaattaaacaactaaatgacagttagaaaagggctagattgtattggatttcaagtatatgaggtgcttttttcagagccaactgaccttcacttttcctacagccttctcccactgccctccagccaaggcctctgggccactcctggagctcatcagtttattattaatctgcttcttcctctcccttcctttcagtttactagaaataccctgaccctttctctgcactggcttgtaacccttttttcctcccaaatactgttaaagatttacctcttttggaaacatttacaagctaatcctacccgtctccacattttttcccagtagtttatgattgcctgtaatagcaggttctctcaccttagtgacaagtgcttgcctttgtgtgctcgaataatgtttggtggattgccccatctccactgtgaactactttaggtcatggctgtctctcattatgtgcaaatctccacccagcataaggcagagggcagtgtcattgttcattcatttgttgggctccaagattgtgcaggagataaaacactataaagagacttgattctcacactgaaggaactcatatttcgagaacgttgcacatggacccaatgccctgcttacaaaagattcctgctgccctcagaatggaatggtctttgcctggctcacctctctgtccacctccttccctctgctccaccggggcatcaccatttcatcatccacttagtgatagaaatggcaaactctgtattccattcctcctgcctaaaaagcacttgtcttagctctttgtataggttgatgcaaaaataattgcagtttttgccgttaaaagtaagttagggtatttcattaaaagtaatggcaaaaacctcaattacttttgcaccaacttaatccttctgttcttcccttggctgggacactcattcctgtaggtctcaatgttgtcgatcacctctcttttaatgaggttttctatggctcctcatagaactgttcttttccttacatgacacttctggtgcttggtttaggcactaaggcagagtgtcaatggtaatttttaatattctgtttattagttattgtttgcttctccatcatgggatggatgagtctgtgttcgtctctacttaggacctcatacaatttctggcacagagcaggggttgcttaggacacactgagtgaatgatttgagtttgaaggttatatagcagtactccagaagatgtgtccaaggagatttatagcagtacttttcatagtaaaactcattcagttttggcatatttataaatataatacagcaacaaaaatcaatgagctagtaatcagcatcaacatgatttaatcttagaactataaaattaaatgaaaaaattaaatggcagaaaaaaaatgtgtaccactctgttccatttatatgtagttcaaacccatgcaaaactaatgctatatacacttttaaaaactgaaagtgaaatacaaaggttaatggttaccccataattgtaagaggatgtaattaggcaggattcaaggagcttccaagatagtggtaacattctgtttttttcagctgtgtgatggactaatgggtatttgttctattattttcttttagaccacacatatgtattttctgttttc

SEQ ID NO: 296 - DNA, 4047 bp, Homo sapiens
tgctttagggaatatctaagaaagaccaaagggcagagaacagagaatgggtaaatagttcaggtgaaggatgatcaaagctgagctggctgggagttgtaggaggggagatcagggtctggatttttaaggctgcctgaggaagaactgatgactcggggtattgggtagttggtaaattgtggcaggtagaagaaggaaggatgttaggatatttcacggtttgcagactggatttcatcatgacaagaaggccaggcctttatggggagaggttcctgaaagagaattatatagctcttgtagggatcagagcaatgggacatgggtcaagtgttgaggcaggagatcagcaggagaaaagagaatctggagccatccaaagagaagcaataatagaagtaagaggagtgagtgagggcctcaggctcacagaatgaaatgccagatgtgaaaccttgagctctgcctatatttctggggaagagaagataggggaaatgctaataataataataataataataataaaataaaaaaataaagaatggccacatagcttgacacctggagaagtgtcactgaagcccaagattggatgcttaacagtgttcattgttttgcagaacaggagaatgatgatgcatttctattccatcccctgtgccttgtatgtgggattaaagaaaaagtcagaaagttggatagaaaatgattatgctgtttgtttcatttaccacatgactgagctgtcatttgtctccctttgaaatgagaaaatcttaatcataattttctgtgatttaaatgtagtcagttctttaaaggtacctaaatgtgacacacttcaggaagatttacgcttgacttaggcactaagacaaagtgtcagagtaaatcactaaaaattgaagacatgatagtctgtgggatgtggcaaattagtgtcacagctacagagtgtataaccagggagacttcagaaagaaatgcaaggacagcctgatgcaggaaatgggctttttggaatttggtctgttgtcacctgatgccatgtggggatccaatagcagtgctgtgttactggcataattaatgttggaattcagaaaacttacagccttttggccatatttgaatatgttccttggtgtctgtggggagctgtagttccctagctactgccctttattaaacactttcctttgtcaggcactttgcttctgccctctagaggtttacaattgaaaactgtgtacagttgacccttgacacccaaaacttaacatgttaacagtcaattaacacatatttgatatgctatgtaatatatactcttattctacaacaaagtaagctagagaaaagaaaattttaagaaaatagtaaaagacaaaatatatttaatattcactaattggaagtgatcatcataaagggtcttcatccttgttgacttcatgttgattaatctgagggggaggaagaagaggagcagttggtgttgctgtctcaggggtaacagaggcagaaagggtagaggagaaaagagaggcaggcacgttcagtgcttaactttaattgaaaaaactccacgtgtaggtggaccctcacagttcaaactggcgctgttcaagcgtcaactgtacagggcaaagaaatgaggtaagaattacagtgaaaattccagatggttcttagtttttttctgacaccttctctaactcatatgaagcttatttgacttatttttgttattagcttaagtttaccaatgatacatttggcatctgaaggaaatggattggttcgttatccagacttgtatgttttatgtttatctctttaaaaaaaaaaaaagtcttccctgttgagttgtttttgaaatcattttactctgtatgggtttaaagcagttcttttaatttgtagataacttaaaaaataaataattctgtgttactcagacagctagcatggacacatttcatacatgtctttaaaaattcaaaattattagttattcagtggttacaaatggataaatacaaaggaagctatttgttcattttagttaactgtcaaaatatgtcatattttttgagagaacagtttttgcatcaggcgaagagaaagaagttggttttatatgtatataaccttattttttctctttgcctcttatttttcatgctaaaagttaaatatataacatatgtgtatatataaccaactattttctctttgcctcttatttttttaatgccaaaaagttaaaaaataagaaaaaataagattagagttcttctagtctaatttttttatgctaaaaggttaaatacagagacagagaaagaattttataaaaactgatgtctatgagcagaccttaaattaatgtggactctaattttccttactcagatgtttagatttagaagagtcatctccacactcaataaatgtatagatagatacatggtagtttgataatctgctttgtctctttgttttcagttagtgaatgaaagacttaaaattgattaaattaaaaaaaaatttgtcgttttcatctaaactcctccttcgggcctttgcgggcctccccttgggcagtgtgtgcctggaccatgcatttctcctgtctgtttcactgccggcaaacaccactcgtgtgtaagtcacgcatcacccacactgcagtccaccattccttagagcctctgggcttgagtgaattcttgccttttctcaagtacttctctaaacctggaattctttcctcacttcatgtggatctcttgtattttatccatttttcaaagcccatttcaaatcgcacctctccagggagccttttccagttgtctttcctctcctagaagtagtagctctagcagaaatttgcgtattcctctcatagggcatgtttactcctccttttagtaaagccatcagtatgtctttgagagcaggggctctgccttcacctcctgtgcacaccctcctggctctagccccagccatgcctaccatagatgttgtacacatgaagagtaaggatgggaacaaatttgtgaagaccaatggatgtgggggctgtctagtacttcttcttagctacaggtcacctctgtgtctagagtactgactgctctagtacttcttcttagctacaggtcacctctgtgtcagagcatcatcggaagtaaaccaggttagggccagtttgtgacaatcttatagatcgggcttgattcagcaggcagtggagagctgttatttttctataaaacctgttttttaatatggagcatcttcagtaaattttgtatgtaatgatgtacatgataaaagactgtttaagaacaattagtttggctgtgatacaaagaatgaagagagcagtgcacaggctgcttgcaggagttaagatgaggagagcagtgtaatatttgagatgcgctgccatttggagtagattgagagatttatgccttgctacatttaaaagcaaaaagagcctggcaaagggaaagccagaaaaagaaagtaggaataattaatattccaaagagcaaaaaatgagataagattgggaagcaacagagttcagattcaaaagtatgaaagtgtggtaaaatgtaagaatagaaatgtgtttgtttctttaaaagctgaaatttagctaaaaaggatagattcttaaattgaagaatcaagctaaatacttgagactagaaatgcctttgttgtgatgttgttatgtaatgtaatgtaatgtaatgactgtaaacattccttcttctctcctggttagtggatctcttagagttgagtacaacaaatgaaattttcaaacagcacaagttgaaccaaaatgaccagctcctcagtgttccagatgtcatcaactgtctgacaacaacttatgatggacttgagcaaatgcataaggacctggtcaacgttccactctgtgttgatatgtgtctcaattggttgctcaatgtctatgacacgtaagtttatattttttctcattaa

SEQ ID NO: 297 - DNA, 4044 bp, Homo sapiens
aagagaatctggagccatccaaagagaagcaataatagaagtaagaggagtgagtgagggcctcaggctcacagaatgaaatgccagatgtgaaaccttgagctctgcctatatttctggggaagagaagataggggaaatgctaataataataataataataataataaaataaaaaaataaagaatggccacatagcttgacacctggagaagtgtcactgaagcccaagattggatgcttaacagtgttcattgttttgcagaacaggagaatgatgatgcatttctattccatcccctgtgccttgtatgtgggattaaagaaaaagtcagaaagttggatagaaaatgattatgctgtttgtttcatttaccacatgactgagctgtcatttgtctccctttgaaatgagaaaatcttaatcataattttctgtgatttaaatgtagtcagttctttaaaggtacctaaatgtgacacacttcaggaagatttacgcttgacttaggcactaagacaaagtgtcagagtaaatcactaaaaattgaagacatgatagtctgtgggatgtggcaaattagtgtcacagctacagagtgtataaccagggagacttcagaaagaaatgcaaggacagcctgatgcaggaaatgggctttttggaatttggtctgttgtcacctgatgccatgtggggatccaatagcagtgctgtgttactggcataattaatgttggaattcagaaaacttacagccttttggccatatttgaatatgttccttggtgtctgtggggagctgtagttccctagctactgccctttattaaacactttcctttgtcaggcactttgcttctgccctctagaggtttacaattgaaaactgtgtacagttgacccttgacacccaaaacttaacatgttaacagtcaattaacacatatttgatatgctatgtaatatatactcttattctacaacaaagtaagctagagaaaagaaaattttaagaaaatagtaaaagacaaaatatatttaatattcactaattggaagtgatcatcataaagggtcttcatccttgttgacttcatgttgattaatctgagggggaggaagaagaggagcagttggtgttgctgtctcaggggtaacagaggcagaaagggtagaggagaaaagagaggcaggcacgttcagtgcttaactttaattgaaaaaactccacgtgtaggtggaccctcacagttcaaactggcgctgttcaagcgtcaactgtacagggcaaagaaatgaggtaagaattacagtgaaaattccagatggttcttagtttttttctgacaccttctctaactcatatgaagcttatttgacttatttttgttattagcttaagtttaccaatgatacatttggcatctgaaggaaatggattggttcgttatccagacttgtatgttttatgtttatctctttaaaaaaaaaaaaagtcttccctgttgagttgtttttgaaatcattttactctgtatgggtttaaagcagttcttttaatttgtagataacttaaaaaataaataattctgtgttactcagacagctagcatggacacatttcatacatgtctttaaaaattcaaaattattagttattcagtggttacaaatggataaatacaaaggaagctatttgttcattttagttaactgtcaaaatatgtcatattttttgagagaacagtttttgcatcaggcgaagagaaagaagttggttttatatgtatataaccttattttttctctttgcctcttatttttcatgctaaaagttaaatatataacatatgtgtatatataaccaactattttctctttgcctcttatttttttaatgccaaaaagttaaaaaataagaaaaaataagattagagttcttctagtctaatttttttatgctaaaaggttaaatacagagacagagaaagaattttataaaaactgatgtctatgagcagaccttaaattaatgtggactctaattttccttactcagatgtttagatttagaagagtcatctccacactcaataaatgtatagatagatacatggtagtttgataatctgctttgtctctttgttttcagttagtgaatgaaagacttaaaattgattaaattaaaaaaaaatttgtcgttttcatctaaactcctccttcgggcctttgcgggcctccccttgggcagtgtgtgcctggaccatgcatttctcctgtctgtttcactgccggcaaacaccactcgtgtgtaagtcacgcatcacccacactgcagtccaccattccttagagcctctgggcttgagtgaattcttgccttttctcaagtacttctctaaacctggaattctttcctcacttcatgtggatctcttgtattttatccatttttcaaagcccatttcaaatcgcacctctccagggagccttttccagttgtctttcctctcctagaagtagtagctctagcagaaatttgcgtattcctctcatagggcatgtttactcctccttttagtaaagccatcagtatgtctttgagagcaggggctctgccttcacctcctgtgcacaccctcctggctctagccccagccatgcctaccatagatgttgtacacatgaagagtaaggatgggaacaaatttgtgaagaccaatggatgtgggggctgtctagtacttcttcttagctacaggtcacctctgtgtctagagtactgactgctctagtacttcttcttagctacaggtcacctctgtgtcagagcatcatcggaagtaaaccaggttagggccagtttgtgacaatcttatagatcgggcttgattcagcaggcagtggagagctgttatttttctataaaacctgttttttaatatggagcatcttcagtaaattttgtatgtaatgatgtacatgataaaagactgtttaagaacaattagtttggctgtgatacaaagaatgaagagagcagtgcacaggctgcttgcaggagttaagatgaggagagcagtgtaatatttgagatgcgctgccatttggagtagattgagagatttatgccttgctacatttaaaagcaaaaagagcctggcaaagggaaagccagaaaaagaaagtaggaataattaatattccaaagagcaaaaaatgagataagattgggaagcaacagagttcagattcaaaagtatgaaagtgtggtaaaatgtaagaatagaaatgtgtttgtttctttaaaagctgaaatttagctaaaaaggatagattcttaaattgaagaatcaagctaaatacttgagactagaaatgcctttgttgtgatgttgttatgtaatgtaatgtaatgtaatgactgtaaacattccttcttctctcctggttagtggatctcttagagttgagtacaacaaatgaaattttcaaacagcacaagttgaaccaaaatgaccagctcctcagtgttccagatgtcatcaactgtctgacaacaacttatgatggacttgagcaaatgcataaggacctggtcaacgttccactctgtgttgatatgtgtctcaattggttgctcaatgtctatgacacgtaagtttatattttttctcattaaaatacgatcactgaatgaaatatgttaatagaaaatgtctgatttttaagtgaattttttaataagtgctttcaaattactttcccagtggaaatatttatgtttgttgttgaaactgaatgattttacaaatcattgagcttcttaacaaacaatagaacagaaaagaatgtacatctttcattttaaaatgttgcttcaatttacaaagactgtcaaatttatagtattctttgccaaaatgctaggggaaacaatatagctaagtcctactttcttcttgtttcataatgtctcacagtatttcttttttcaaaataaaaaatcttctgtttattgttatgaattacagtaattt

SEQ ID NO: 298 - DNA, 4049 bp, Homo sapiens
ctttgatttacagctattttttcctgaagttatcctcatgttctattaatagctattcttttacttccttccaaataatgcccaaatgtattcatcaagctgtctattttctttggtttagggaattgagttacttttttggatcataaattgacagaaaggctgtaatacttataaaatatacacatataaatctcacactcataggtatcttatctcaaataaataagtgccctgtgtatggagaggaaatctgtagaaaatattgctgaattataatggaggaagtgcccacatcacattatagctttaaccaggaaaaagaaatctccccaagaaaatttgtgagacatcatttattactattatcaacttattcactcaacaaattaatattgaacattttgcaggtgtcaggccctcttgtcaaagataagcaaaaccagacactagttaaagtggtaaggacagattttaatcaataatatactgattatgcacatgtatttctgtttgtacagaggtgactgggtgttttcagaagggaatagactggggaaacaaaagagggacttgagcagaggcaaggaagtgaaaaatgacaaagcattggtcagcatcagttccatcagaccagctgtgtctgtgagctggcaattgtcagagttaggattctaccattccagagagagactgggagacaggggtcctatccttcctgatgattacatttcaaagaaatggttttcagatccttgagaaagacactcctgagttgttggagatacatccacatctcaaagggacagaggaaggattccccattgtaaaccctttccagtaaatgccctaagaaagagtgagcagggacctgtcttcaggtgttggctagagtgaacagtaaattcttttggcagtctggagtttgtttttcaggcagacgctttaaggggtcagacgccttaataatcccttttttaagggtcatcctagggatgtggtcttgaactgttataaattatgttcatgtttgtttaagtcttttaatggagaagtgggtggacagggatggacaaaatgatttgtgctgaaaatttgcagcttttataggccaaggcttcagtagacaacagagcttacaggaggccaactcaaatttggtcaaggagagaatccttgtcagtaatttcagctctgatagtgtatcagagtatacccagaaagataagattgtggacttcctgctactctccctttaggaggaagaatgtgtgagaatgaacaaggaaacgaataaatggggttgttatacattgcagtaagtgcctttaaggaaatgaatggataatgagatagaatgattagaagagacattttagataaagaaatcagtaaggtttgtctgagttgacatttgagttgagaccaaagtttgagaaagattcagccctgtaaagaactagtagaagcatgtttcagaaagaagaaacagaacatatagtggtctgagttgggaaaaaggttagcgtgattgggctgcagaaagtgaagcctgttccccaaggggcgcatggaaaggagcactggttacacaactggaagtgcccagtgcaaaatgaaactggggggccccttgtttaacaattattaagacttccgagttggcaacatcagaggagtaaatgaagttcaaagcccttctgattgtagggccctgtacaactgcataagtgcaatagttcaaagcccttctgattgtagggccctgtacaactgcataagtgcaatatctttgaagctcaccctgaggctgggaaagaggtgggtgtaaccagggaacagaaagaaaccaggacaaatttgacaaaagagagacaatagtaggagatggaattaaaaagaaaggcaactatcagattgtatagaaccctggggatcattgtaaggaatttggattgggggaaaatatcatagtaatatttacatgaatagctattatagaagtttagaaaactgattataaaatgctagtatcaaaatatcataaagtaaatatatgttgttatagtaaagatatataaaattactatttttcttggtcttgaacatataataattcttaatggctttacaaaatacctaaacaatttgaaacccacatatcttcaacagttgtcatgcagtaggtgcatacttaagaatcactgatacacatatgaattccactctccaactaccaattttaaatgaaatctgtaagttacccaaaactgttcttgttgcatagtctttcaaaagtcactgtttatcatttccaagattgcagcttatcctgcattatacaaggatagcttcatttttcaagacatcctttgcccatttctgaggctttgtagtgatcttatcaacagcctacttataaatcatctgtatgacaggtcactttctgcatttgaccctacaactttttgtaaaataactagaaatatatgtaaattgaatctttaaaaagatacttgcatttaatagcaatgaatgatctgattgctattattgtagcattaatgtctttccattcattctctgaagccacagagaaagatgcatctctttacaactaaactaatcagacctattccaactggaccccattttactattggaattgttcttatattcattcccttcatgtgtaatctttgtgcaataattaagtcaccattagcttgaagaaacctttgcttgctcactcttgtgcctaaaccaggtatcaagtctggacatatttctctctcattcgaaatacaaattttagatgtactatattctcaatgtagaaaacaggaaaaatataaatgcaagtattcagaaatcattgctttctgaaatttctttctgttcacccacattctttacatttgctctactcttttaagttttatttatggttcatccatcttttactcaacatttcctaaagtcgtttcatgtctgccttagaaaatgaactcaagtgtgaatttgtttggtacagtgataataagcaacacttgagtgttaaatggatcagaccttcccatatggaccttgatgtttgcattcctcagactgcatctccctttttagttaagaagatgctccagtcaccttactgacttcatctctttccttttcaaagtcctttacagctgactctgaatgtttctatttttaagagctttctgcaatttagaaaccttattttaaatccacaaagcaccctaaatattttgccaatatatctgcttatgatttatggtaatgttttcctttagctgtaagaagactaatggtatatgaatgaactatcatgactcatgaaagtattttatgatattgataatttatatatgtatatataaattatctgaagaaatgtagcagaatttttatttctctaggaaatgattttttgtcttatttccccctactattctataatccaaatttgtacatttaagaattctttcattaggcttaataagagttgatcttcaagagacagcatgacacagatgatatttaatgcctgtcatcattctgtctccatatgtccaaatcccaccttctcacaaaaacagctcaactcccactttgtgtgtgaaatctctcccagctcctccagttttaccctcatcaaagcacttagttcaggggcctctgccaatagcctctactttaccaattaggatttgattctatgttcccttgtatcattttctaactgtggtgtttttgtcttctcaattatctttttacctccttgaggactgggatgacttttatacttttctccctgtgttagttaaatttgcctcataaaagccagatgagctcgtatctgactttataaatactagttatagaatattaaagctggaattaaagctctaagagatcatctaacttatctttattttgaagaaaaaactaagtcttagagaaggtaagtgatttgtgcaaagttaatggtatggatttagtgacttaactccattagggaaatacac

SEQ ID NO: 299 - DNA, 4040 bp, Homo sapiens
agaaatctccccaagaaaatttgtgagacatcatttattactattatcaacttattcactcaacaaattaatattgaacattttgcaggtgtcaggccctcttgtcaaagataagcaaaaccagacactagttaaagtggtaaggacagattttaatcaataatatactgattatgcacatgtatttctgtttgtacagaggtgactgggtgttttcagaagggaatagactggggaaacaaaagagggacttgagcagaggcaaggaagtgaaaaatgacaaagcattggtcagcatcagttccatcagaccagctgtgtctgtgagctggcaattgtcagagttaggattctaccattccagagagagactgggagacaggggtcctatccttcctgatgattacatttcaaagaaatggttttcagatccttgagaaagacactcctgagttgttggagatacatccacatctcaaagggacagaggaaggattccccattgtaaaccctttccagtaaatgccctaagaaagagtgagcagggacctgtcttcaggtgttggctagagtgaacagtaaattcttttggcagtctggagtttgtttttcaggcagacgctttaaggggtcagacgccttaataatcccttttttaagggtcatcctagggatgtggtcttgaactgttataaattatgttcatgtttgtttaagtcttttaatggagaagtgggtggacagggatggacaaaatgatttgtgctgaaaatttgcagcttttataggccaaggcttcagtagacaacagagcttacaggaggccaactcaaatttggtcaaggagagaatccttgtcagtaatttcagctctgatagtgtatcagagtatacccagaaagataagattgtggacttcctgctactctccctttaggaggaagaatgtgtgagaatgaacaaggaaacgaataaatggggttgttatacattgcagtaagtgcctttaaggaaatgaatggataatgagatagaatgattagaagagacattttagataaagaaatcagtaaggtttgtctgagttgacatttgagttgagaccaaagtttgagaaagattcagccctgtaaagaactagtagaagcatgtttcagaaagaagaaacagaacatatagtggtctgagttgggaaaaaggttagcgtgattgggctgcagaaagtgaagcctgttccccaaggggcgcatggaaaggagcactggttacacaactggaagtgcccagtgcaaaatgaaactggggggccccttgtttaacaattattaagacttccgagttggcaacatcagaggagtaaatgaagttcaaagcccttctgattgtagggccctgtacaactgcataagtgcaatagttcaaagcccttctgattgtagggccctgtacaactgcataagtgcaatatctttgaagctcaccctgaggctgggaaagaggtgggtgtaaccagggaacagaaagaaaccaggacaaatttgacaaaagagagacaatagtaggagatggaattaaaaagaaaggcaactatcagattgtatagaaccctggggatcattgtaaggaatttggattgggggaaaatatcatagtaatatttacatgaatagctattatagaagtttagaaaactgattataaaatgctagtatcaaaatatcataaagtaaatatatgttgttatagtaaagatatataaaattactatttttcttggtcttgaacatataataattcttaatggctttacaaaatacctaaacaatttgaaacccacatatcttcaacagttgtcatgcagtaggtgcatacttaagaatcactgatacacatatgaattccactctccaactaccaattttaaatgaaatctgtaagttacccaaaactgttcttgttgcatagtctttcaaaagtcactgtttatcatttccaagattgcagcttatcctgcattatacaaggatagcttcatttttcaagacatcctttgcccatttctgaggctttgtagtgatcttatcaacagcctacttataaatcatctgtatgacaggtcactttctgcatttgaccctacaactttttgtaaaataactagaaatatatgtaaattgaatctttaaaaagatacttgcatttaatagcaatgaatgatctgattgctattattgtagcattaatgtctttccattcattctctgaagccacagagaaagatgcatctctttacaactaaactaatcagacctattccaactggaccccattttactattggaattgttcttatattcattcccttcatgtgtaatctttgtgcaataattaagtcaccattagcttgaagaaacctttgcttgctcactcttgtgcctaaaccaggtatcaagtctggacatatttctctctcattcgaaatacaaattttagatgtactatattctcaatgtagaaaacaggaaaaatataaatgcaagtattcagaaatcattgctttctgaaatttctttctgttcacccacattctttacatttgctctactcttttaagttttatttatggttcatccatcttttactcaacatttcctaaagtcgtttcatgtctgccttagaaaatgaactcaagtgtgaatttgtttggtacagtgataataagcaacacttgagtgttaaatggatcagaccttcccatatggaccttgatgtttgcattcctcagactgcatctccctttttagttaagaagatgctccagtcaccttactgacttcatctctttccttttcaaagtcctttacagctgactctgaatgtttctatttttaagagctttctgcaatttagaaaccttattttaaatccacaaagcaccctaaatattttgccaatatatctgcttatgatttatggtaatgttttcctttagctgtaagaagactaatggtatatgaatgaactatcatgactcatgaaagtattttatgatattgataatttatatatgtatatataaattatctgaagaaatgtagcagaatttttatttctctaggaaatgattttttgtcttatttccccctactattctataatccaaatttgtacatttaagaattctttcattaggcttaataagagttgatcttcaagagacagcatgacacagatgatatttaatgcctgtcatcattctgtctccatatgtccaaatcccaccttctcacaaaaacagctcaactcccactttgtgtgtgaaatctctcccagctcctccagttttaccctcatcaaagcacttagttcaggggcctctgccaatagcctctactttaccaattaggatttgattctatgttcccttgtatcattttctaactgtggtgtttttgtcttctcaattatctttttacctccttgaggactgggatgacttttatacttttctccctgtgttagttaaatttgcctcataaaagccagatgagctcgtatctgactttataaatactagttatagaatattaaagctggaattaaagctctaagagatcatctaacttatctttattttgaagaaaaaactaagtcttagagaaggtaagtgatttgtgcaaagttaatggtatggatttagtgacttaactccattagggaaatacacacacacacacgcagttagcacattggaaaataggggtttgtgtatatccttgctggaatattatgtttgttgaatacccttttacataccaggcattttgctaggagttggaaatagagagaaaatttcatgaaggagaaaaaatacctctatgtggagaaattcaacaagactgtaatattttttagaatgattaagcttatgaatcaagagagtagtcaatttttttttgtattatccatgcattaaacctttgaattcagggattatcattttttaaataaatagttatatcttatattaaagatgttca

SEQ ID NO: 300 - DNA, 4063 bp, Homo sapiens
atgattacatttcaaagaaatggttttcagatccttgagaaagacactcctgagttgttggagatacatccacatctcaaagggacagaggaaggattccccattgtaaaccctttccagtaaatgccctaagaaagagtgagcagggacctgtcttcaggtgttggctagagtgaacagtaaattcttttggcagtctggagtttgtttttcaggcagacgctttaaggggtcagacgccttaataatcccttttttaagggtcatcctagggatgtggtcttgaactgttataaattatgttcatgtttgtttaagtcttttaatggagaagtgggtggacagggatggacaaaatgatttgtgctgaaaatttgcagcttttataggccaaggcttcagtagacaacagagcttacaggaggccaactcaaatttggtcaaggagagaatccttgtcagtaatttcagctctgatagtgtatcagagtatacccagaaagataagattgtggacttcctgctactctccctttaggaggaagaatgtgtgagaatgaacaaggaaacgaataaatggggttgttatacattgcagtaagtgcctttaaggaaatgaatggataatgagatagaatgattagaagagacattttagataaagaaatcagtaaggtttgtctgagttgacatttgagttgagaccaaagtttgagaaagattcagccctgtaaagaactagtagaagcatgtttcagaaagaagaaacagaacatatagtggtctgagttgggaaaaaggttagcgtgattgggctgcagaaagtgaagcctgttccccaaggggcgcatggaaaggagcactggttacacaactggaagtgcccagtgcaaaatgaaactggggggccccttgtttaacaattattaagacttccgagttggcaacatcagaggagtaaatgaagttcaaagcccttctgattgtagggccctgtacaactgcataagtgcaatagttcaaagcccttctgattgtagggccctgtacaactgcataagtgcaatatctttgaagctcaccctgaggctgggaaagaggtgggtgtaaccagggaacagaaagaaaccaggacaaatttgacaaaagagagacaatagtaggagatggaattaaaaagaaaggcaactatcagattgtatagaaccctggggatcattgtaaggaatttggattgggggaaaatatcatagtaatatttacatgaatagctattatagaagtttagaaaactgattataaaatgctagtatcaaaatatcataaagtaaatatatgttgttatagtaaagatatataaaattactatttttcttggtcttgaacatataataattcttaatggctttacaaaatacctaaacaatttgaaacccacatatcttcaacagttgtcatgcagtaggtgcatacttaagaatcactgatacacatatgaattccactctccaactaccaattttaaatgaaatctgtaagttacccaaaactgttcttgttgcatagtctttcaaaagtcactgtttatcatttccaagattgcagcttatcctgcattatacaaggatagcttcatttttcaagacatcctttgcccatttctgaggctttgtagtgatcttatcaacagcctacttataaatcatctgtatgacaggtcactttctgcatttgaccctacaactttttgtaaaataactagaaatatatgtaaattgaatctttaaaaagatacttgcatttaatagcaatgaatgatctgattgctattattgtagcattaatgtctttccattcattctctgaagccacagagaaagatgcatctctttacaactaaactaatcagacctattccaactggaccccattttactattggaattgttcttatattcattcccttcatgtgtaatctttgtgcaataattaagtcaccattagcttgaagaaacctttgcttgctcactcttgtgcctaaaccaggtatcaagtctggacatatttctctctcattcgaaatacaaattttagatgtactatattctcaatgtagaaaacaggaaaaatataaatgcaagtattcagaaatcattgctttctgaaatttctttctgttcacccacattctttacatttgctctactcttttaagttttatttatggttcatccatcttttactcaacatttcctaaagtcgtttcatgtctgccttagaaaatgaactcaagtgtgaatttgtttggtacagtgataataagcaacacttgagtgttaaatggatcagaccttcccatatggaccttgatgtttgcattcctcagactgcatctccctttttagttaagaagatgctccagtcaccttactgacttcatctctttccttttcaaagtcctttacagctgactctgaatgtttctatttttaagagctttctgcaatttagaaaccttattttaaatccacaaagcaccctaaatattttgccaatatatctgcttatgatttatggtaatgttttcctttagctgtaagaagactaatggtatatgaatgaactatcatgactcatgaaagtattttatgatattgataatttatatatgtatatataaattatctgaagaaatgtagcagaatttttatttctctaggaaatgattttttgtcttatttccccctactattctataatccaaatttgtacatttaagaattctttcattaggcttaataagagttgatcttcaagagacagcatgacacagatgatatttaatgcctgtcatcattctgtctccatatgtccaaatcccaccttctcacaaaaacagctcaactcccactttgtgtgtgaaatctctcccagctcctccagttttaccctcatcaaagcacttagttcaggggcctctgccaatagcctctactttaccaattaggatttgattctatgttcccttgtatcattttctaactgtggtgtttttgtcttctcaattatctttttacctccttgaggactgggatgacttttatacttttctccctgtgttagttaaatttgcctcataaaagccagatgagctcgtatctgactttataaatactagttatagaatattaaagctggaattaaagctctaagagatcatctaacttatctttattttgaagaaaaaactaagtcttagagaaggtaagtgatttgtgcaaagttaatggtatggatttagtgacttaactccattagggaaatacacacacacacacgcagttagcacattggaaaataggggtttgtgtatatccttgctggaatattatgtttgttgaatacccttttacataccaggcattttgctaggagttggaaatagagagaaaatttcatgaaggagaaaaaatacctctatgtggagaaattcaacaagactgtaatattttttagaatgattaagcttatgaatcaagagagtagtcaatttttttttgtattatccatgcattaaacctttgaattcagggattatcattttttaaataaatagttatatcttatattaaagatgttcagatttaaatttcttttttatttatgatgatttaatttcatcgtgaaaattaccctactcagatcttctttaaaatcatctttgttgtaagtaaccaaaatttaattcaaattagaaacattttcatatgttgttagagcatataaaagatagtgtgtggttttgttttttgagatgagatctagtctgttagtgaatttcaagtgtattatctgtagccacaagctgtacattaggtctccagaatttattcatcatataactgaaagtttataccctttgaccagtctcttctcttttcctccaccccccagcccctggtaactaccattctactctgtgctactatgagcttgacttttttttttaaaggtcccacatataagtgagatcatgcagtatttgtctttctgtatctgggtt

SEQ ID NO: 301 - DNA, 4055 bp, Homo sapiens
ccttaataatcccttttttaagggtcatcctagggatgtggtcttgaactgttataaattatgttcatgtttgtttaagtcttttaatggagaagtgggtggacagggatggacaaaatgatttgtgctgaaaatttgcagcttttataggccaaggcttcagtagacaacagagcttacaggaggccaactcaaatttggtcaaggagagaatccttgtcagtaatttcagctctgatagtgtatcagagtatacccagaaagataagattgtggacttcctgctactctccctttaggaggaagaatgtgtgagaatgaacaaggaaacgaataaatggggttgttatacattgcagtaagtgcctttaaggaaatgaatggataatgagatagaatgattagaagagacattttagataaagaaatcagtaaggtttgtctgagttgacatttgagttgagaccaaagtttgagaaagattcagccctgtaaagaactagtagaagcatgtttcagaaagaagaaacagaacatatagtggtctgagttgggaaaaaggttagcgtgattgggctgcagaaagtgaagcctgttccccaaggggcgcatggaaaggagcactggttacacaactggaagtgcccagtgcaaaatgaaactggggggccccttgtttaacaattattaagacttccgagttggcaacatcagaggagtaaatgaagttcaaagcccttctgattgtagggccctgtacaactgcataagtgcaatagttcaaagcccttctgattgtagggccctgtacaactgcataagtgcaatatctttgaagctcaccctgaggctgggaaagaggtgggtgtaaccagggaacagaaagaaaccaggacaaatttgacaaaagagagacaatagtaggagatggaattaaaaagaaaggcaactatcagattgtatagaaccctggggatcattgtaaggaatttggattgggggaaaatatcatagtaatatttacatgaatagctattatagaagtttagaaaactgattataaaatgctagtatcaaaatatcataaagtaaatatatgttgttatagtaaagatatataaaattactatttttcttggtcttgaacatataataattcttaatggctttacaaaatacctaaacaatttgaaacccacatatcttcaacagttgtcatgcagtaggtgcatacttaagaatcactgatacacatatgaattccactctccaactaccaattttaaatgaaatctgtaagttacccaaaactgttcttgttgcatagtctttcaaaagtcactgtttatcatttccaagattgcagcttatcctgcattatacaaggatagcttcatttttcaagacatcctttgcccatttctgaggctttgtagtgatcttatcaacagcctacttataaatcatctgtatgacaggtcactttctgcatttgaccctacaactttttgtaaaataactagaaatatatgtaaattgaatctttaaaaagatacttgcatttaatagcaatgaatgatctgattgctattattgtagcattaatgtctttccattcattctctgaagccacagagaaagatgcatctctttacaactaaactaatcagacctattccaactggaccccattttactattggaattgttcttatattcattcccttcatgtgtaatctttgtgcaataattaagtcaccattagcttgaagaaacctttgcttgctcactcttgtgcctaaaccaggtatcaagtctggacatatttctctctcattcgaaatacaaattttagatgtactatattctcaatgtagaaaacaggaaaaatataaatgcaagtattcagaaatcattgctttctgaaatttctttctgttcacccacattctttacatttgctctactcttttaagttttatttatggttcatccatcttttactcaacatttcctaaagtcgtttcatgtctgccttagaaaatgaactcaagtgtgaatttgtttggtacagtgataataagcaacacttgagtgttaaatggatcagaccttcccatatggaccttgatgtttgcattcctcagactgcatctccctttttagttaagaagatgctccagtcaccttactgacttcatctctttccttttcaaagtcctttacagctgactctgaatgtttctatttttaagagctttctgcaatttagaaaccttattttaaatccacaaagcaccctaaatattttgccaatatatctgcttatgatttatggtaatgttttcctttagctgtaagaagactaatggtatatgaatgaactatcatgactcatgaaagtattttatgatattgataatttatatatgtatatataaattatctgaagaaatgtagcagaatttttatttctctaggaaatgattttttgtcttatttccccctactattctataatccaaatttgtacatttaagaattctttcattaggcttaataagagttgatcttcaagagacagcatgacacagatgatatttaatgcctgtcatcattctgtctccatatgtccaaatcccaccttctcacaaaaacagctcaactcccactttgtgtgtgaaatctctcccagctcctccagttttaccctcatcaaagcacttagttcaggggcctctgccaatagcctctactttaccaattaggatttgattctatgttcccttgtatcattttctaactgtggtgtttttgtcttctcaattatctttttacctccttgaggactgggatgacttttatacttttctccctgtgttagttaaatttgcctcataaaagccagatgagctcgtatctgactttataaatactagttatagaatattaaagctggaattaaagctctaagagatcatctaacttatctttattttgaagaaaaaactaagtcttagagaaggtaagtgatttgtgcaaagttaatggtatggatttagtgacttaactccattagggaaatacacacacacacacgcagttagcacattggaaaataggggtttgtgtatatccttgctggaatattatgtttgttgaatacccttttacataccaggcattttgctaggagttggaaatagagagaaaatttcatgaaggagaaaaaatacctctatgtggagaaattcaacaagactgtaatattttttagaatgattaagcttatgaatcaagagagtagtcaatttttttttgtattatccatgcattaaacctttgaattcagggattatcattttttaaataaatagttatatcttatattaaagatgttcagatttaaatttcttttttatttatgatgatttaatttcatcgtgaaaattaccctactcagatcttctttaaaatcatctttgttgtaagtaaccaaaatttaattcaaattagaaacattttcatatgttgttagagcatataaaagatagtgtgtggttttgttttttgagatgagatctagtctgttagtgaatttcaagtgtattatctgtagccacaagctgtacattaggtctccagaatttattcatcatataactgaaagtttataccctttgaccagtctcttctcttttcctccaccccccagcccctggtaactaccattctactctgtgctactatgagcttgacttttttttttaaaggtcccacatataagtgagatcatgcagtatttgtctttctgtatctgggttatttcacttagtataatgtcctccaggctcatctaagttattgcaaatgacagaattcccttctttttttatgactggatatatttcactgtgttttctttatccatttttctgttgtaggatacttagtttgattccatatcttggctattgtgaataatgctacagtgcacataggagtataaataccttttggagataatgattttattttctttggatatgtaccca

SEQ ID NO: 302 - DNA, 4045 bp, Homo sapiens
tgtgagaatgaacaaggaaacgaataaatggggttgttatacattgcagtaagtgcctttaaggaaatgaatggataatgagatagaatgattagaagagacattttagataaagaaatcagtaaggtttgtctgagttgacatttgagttgagaccaaagtttgagaaagattcagccctgtaaagaactagtagaagcatgtttcagaaagaagaaacagaacatatagtggtctgagttgggaaaaaggttagcgtgattgggctgcagaaagtgaagcctgttccccaaggggcgcatggaaaggagcactggttacacaactggaagtgcccagtgcaaaatgaaactggggggccccttgtttaacaattattaagacttccgagttggcaacatcagaggagtaaatgaagttcaaagcccttctgattgtagggccctgtacaactgcataagtgcaatagttcaaagcccttctgattgtagggccctgtacaactgcataagtgcaatatctttgaagctcaccctgaggctgggaaagaggtgggtgtaaccagggaacagaaagaaaccaggacaaatttgacaaaagagagacaatagtaggagatggaattaaaaagaaaggcaactatcagattgtatagaaccctggggatcattgtaaggaatttggattgggggaaaatatcatagtaatatttacatgaatagctattatagaagtttagaaaactgattataaaatgctagtatcaaaatatcataaagtaaatatatgttgttatagtaaagatatataaaattactatttttcttggtcttgaacatataataattcttaatggctttacaaaatacctaaacaatttgaaacccacatatcttcaacagttgtcatgcagtaggtgcatacttaagaatcactgatacacatatgaattccactctccaactaccaattttaaatgaaatctgtaagttacccaaaactgttcttgttgcatagtctttcaaaagtcactgtttatcatttccaagattgcagcttatcctgcattatacaaggatagcttcatttttcaagacatcctttgcccatttctgaggctttgtagtgatcttatcaacagcctacttataaatcatctgtatgacaggtcactttctgcatttgaccctacaactttttgtaaaataactagaaatatatgtaaattgaatctttaaaaagatacttgcatttaatagcaatgaatgatctgattgctattattgtagcattaatgtctttccattcattctctgaagccacagagaaagatgcatctctttacaactaaactaatcagacctattccaactggaccccattttactattggaattgttcttatattcattcccttcatgtgtaatctttgtgcaataattaagtcaccattagcttgaagaaacctttgcttgctcactcttgtgcctaaaccaggtatcaagtctggacatatttctctctcattcgaaatacaaattttagatgtactatattctcaatgtagaaaacaggaaaaatataaatgcaagtattcagaaatcattgctttctgaaatttctttctgttcacccacattctttacatttgctctactcttttaagttttatttatggttcatccatcttttactcaacatttcctaaagtcgtttcatgtctgccttagaaaatgaactcaagtgtgaatttgtttggtacagtgataataagcaacacttgagtgttaaatggatcagaccttcccatatggaccttgatgtttgcattcctcagactgcatctccctttttagttaagaagatgctccagtcaccttactgacttcatctctttccttttcaaagtcctttacagctgactctgaatgtttctatttttaagagctttctgcaatttagaaaccttattttaaatccacaaagcaccctaaatattttgccaatatatctgcttatgatttatggtaatgttttcctttagctgtaagaagactaatggtatatgaatgaactatcatgactcatgaaagtattttatgatattgataatttatatatgtatatataaattatctgaagaaatgtagcagaatttttatttctctaggaaatgattttttgtcttatttccccctactattctataatccaaatttgtacatttaagaattctttcattaggcttaataagagttgatcttcaagagacagcatgacacagatgatatttaatgcctgtcatcattctgtctccatatgtccaaatcccaccttctcacaaaaacagctcaactcccactttgtgtgtgaaatctctcccagctcctccagttttaccctcatcaaagcacttagttcaggggcctctgccaatagcctctactttaccaattaggatttgattctatgttcccttgtatcattttctaactgtggtgtttttgtcttctcaattatctttttacctccttgaggactgggatgacttttatacttttctccctgtgttagttaaatttgcctcataaaagccagatgagctcgtatctgactttataaatactagttatagaatattaaagctggaattaaagctctaagagatcatctaacttatctttattttgaagaaaaaactaagtcttagagaaggtaagtgatttgtgcaaagttaatggtatggatttagtgacttaactccattagggaaatacacacacacacacgcagttagcacattggaaaataggggtttgtgtatatccttgctggaatattatgtttgttgaatacccttttacataccaggcattttgctaggagttggaaatagagagaaaatttcatgaaggagaaaaaatacctctatgtggagaaattcaacaagactgtaatattttttagaatgattaagcttatgaatcaagagagtagtcaatttttttttgtattatccatgcattaaacctttgaattcagggattatcattttttaaataaatagttatatcttatattaaagatgttcagatttaaatttcttttttatttatgatgatttaatttcatcgtgaaaattaccctactcagatcttctttaaaatcatctttgttgtaagtaaccaaaatttaattcaaattagaaacattttcatatgttgttagagcatataaaagatagtgtgtggttttgttttttgagatgagatctagtctgttagtgaatttcaagtgtattatctgtagccacaagctgtacattaggtctccagaatttattcatcatataactgaaagtttataccctttgaccagtctcttctcttttcctccaccccccagcccctggtaactaccattctactctgtgctactatgagcttgacttttttttttaaaggtcccacatataagtgagatcatgcagtatttgtctttctgtatctgggttatttcacttagtataatgtcctccaggctcatctaagttattgcaaatgacagaattcccttctttttttatgactggatatatttcactgtgttttctttatccatttttctgttgtaggatacttagtttgattccatatcttggctattgtgaataatgctacagtgcacataggagtataaataccttttggagataatgattttattttctttggatatgtacccagaagtgggattactggatgatatgatagttctatttttaattttttaaagaacctttagattgtttttcataatgactgaaccaaagatagttctttaagttggagagttcttctttaaatttcacatgatttataaaagttcatacaattgctgacagtgagagagaagtggatagggttaaatactaaggataatggaaaatgtttagaatagctactagggtcaatcttgagtcacacagagatgagtaaactgattgctaccttgccactagagtgcagctgaggttaattgacaa

SEQ ID NO: 303 - DNA, 4047 bp, Homo sapiens
ggataatggaaaatgtttagaatagctactagggtcaatcttgagtcacacagagatgagtaaactgattgctaccttgccactagagtgcagctgaggttaattgacaaggatttgtagtttgtgactccatcattgctcagcagctttggaattaaaagatgaaaagtatatttgaaggccaagggagtgaaaaattccaaggtgttaatgatactgtggttgatttgaggtatcctcatgctgaagaaatcccaaggtgggataaagggctagacgtcaagatgatggggaaagaagaggtttatttataatataagaagtgagaagaagagtcagaagattccagtcagtgaaagattttttcaagttagagattttggactaaaagtggttttaagttatgatgaggcctggggtatggccataccccaatgtgtgactgaagtgggacatagaaggttctagaaatgagatggcttttagaaggtcatcactgcatttctagaagtgaagtgacagatgatagccctgtctggcgttgtgccatcaaaggagaggggaagggcacattggctttagtagatgaagctaaggggaaaagggtgtgtaggagaggaaaaaaatatcttcttcccatcttagtttcatagttgaggctcctgtaacaaaagacagattaacaagagaaaagcatacgaattgatttaatataaattttacattatatggaagccttcatcaggaagagaagacccaaagaaacggaagcctgtgtatttttatgcttaggtttgatgaagagtggacagttgcgtagaagtatgattgaataagaagatacgacctaatgctaatgaactaggcgaacttagcaaggcctgtttgttcagattcttttctgtgtccttctgttttcagtgataaggatgtttcttccctccaggaataaggagggcacctctcaaataagggtcttatgaccctttagggaagaaggatgggagaaggtcagagagatcttgctacgtctgctgttttctcaactgccaatgtgccatatttggaggtagtgtgtcctgaacccttgccaagtgtaaacatccttttctcttggttgttatgaaaaagagattatacagccacaaatgaaaaagatgttataggaaatggcattatcatgggagcttcgggattgattcaaggagataggttgaaatactaattatgaacaaaatgtaaggtaatgtgtaaaagaacacagaatccactgtaatggagaaagaaaggtagatagataggctgtatgcatatagtgaggtacagtaaccccatccatggagagaaaatgtgaaatagagcaaggtaatggaggaaatagtaaaaggaaagaaggaggaaataagcaaggaaaggttagccaggatagaaaggtagtttgagagacatgttagctgagggagaagagacaggatatttgcaaaattttgtagcttgaaaggtcaacagcatcagctacttccagcatttcaattgcaagggtagattcattgtcaatgtcatagtttagttgctgagctttacataggactagtttgtactggtaactttgatgagtttagtgagaagaggcaacaacaggaaaaaaatacctcaatgagaaacagcttattaaattaataccactcaaaacagatttatattgcaggttttaagcaaatacagttgttttaaaagcaagaggttcaactgtattcttgttgatattgattaatatgtagggaaataaaccaaaattacatgttttccatgagaagaatcatattttcagtgagaagaattacaattttctagtaaaaaatatcgaatttctgttttaaaagataaattgtgccttttttttatgaactatatgccattggcaaaaataaaacacacacacacacaaaacacccgaaaagaacaaagaaaaaaatctagaagcagttgttttgatcaatcctttccacccctgccagcatcaatgtacttcgtaagactataaaaatcaaatattttaaaaatgctgattcattctttggaaagctctaccttgagttagggtagtttgttttttggcagtcttgtctcttcagatgtgatgtggggtgtttgccaatatactgaaaacgcagcatcacggctgtttctctgacctcagcatcctgaagtggtgtttcagctcctgctctccttacatcgttttaccagtaggtccagtgcatttagatttgtcattagcttttaaggtgaggtttgggcaaaatccattttattttggatgacttatcatcccactgattcttgactccttggtaattctgctaatgctaatttttttagcttcatatattttcattagggcttgaaagtctctgagcttttcttactgattgcatcctatccatggcattcaaatgtgtctgaatttcaacttgttgaaatcattgaaacttaaataaaaactgagaggttgttttatagttaaaaaaaaaaaacctgttaagaatatctttaaaataagtcttgtgataatgaaatgtaccgcttagcagtatgcatgtaccagttgggactactggtttctatatttaagaagtaactcttgctaatgagggtgctgttcaacaatgattttagcacttgtgcatgatccaaatgataatgtttaattattctgtttgcgtgccaagtgactttttttatataaccttgatttgcctctttgtaagcctttgttttcctctgtatgtaacttattcatatttgtaattaacaatttaaatccactgtttggagcattaaggaattagttaatactgatatctcaagttaagaagtgactccccaaaaaaaagttgtggggagaattaaaacaaatattttctgttttgttttgtttctttatttgtggttctttatcttgttttgtttaaattgtttggtaattagaagttatttacgggatttaggttatttggtagcattgtaaatagcttcctttcatgtgttgctttgccggtctttggggataataataagagtcctttgagctgacctagtaaagccgtttattcaaggatcacttgattatgaatactgggggaagggggttagcttttctacattctagattcttctataccttatccttgctgcttcttgtgatacatattagtgaaaagggaactttcagccatgtattaatgcttttgaagttcagtagtgcatagatttcagcataaagtaagattatacagtttgcaatatgaacagggacatatagaaggatacacatgcattcatatagagatatacaaactcaagcaaaagatagagtaactctaaattatgttccatgtgatgtatctatatttgttctctgtcaaggataaaatggaagaaaattgaaaatttcctaactgtattttggttggtaaaatacaatctcaaaagtaaaaaattatttgatttcgccttaaaagtgattttgtttagggtttttctttagggttttgctacagatagatgtatcacagggtacattttataattcagtgatactttccatattttatttattcatttatattagttggtggggaacaagtaaaaaattgattaattcttattatacaggtaagttttcattgttttacggctacttaatagcagtacagtggagtaaagcacattttcagaattcacatgcccacttatctgtgtaggttcagttctaaaatgtttttcacagtgagtcactgtcattagctttccaaaaatgacaatttcaaggacagccctaatttgtacatgtgaatttttatgtgcttgttgaaaatcagtccagaggcatctggggaagatggtggtagcatggcatcagagtttttttgttgttgttgttttatttttttatttttatttttatttatttatttatttatttttttgaaatggagtttcgctcttgttgtccaagctggaagcaatggcgcaatcttggct

SEQ ID NO: 304 - DNA, 4057 bp, Homo sapiens
gcacattggctttagtagatgaagctaaggggaaaagggtgtgtaggagaggaaaaaaatatcttcttcccatcttagtttcatagttgaggctcctgtaacaaaagacagattaacaagagaaaagcatacgaattgatttaatataaattttacattatatggaagccttcatcaggaagagaagacccaaagaaacggaagcctgtgtatttttatgcttaggtttgatgaagagtggacagttgcgtagaagtatgattgaataagaagatacgacctaatgctaatgaactaggcgaacttagcaaggcctgtttgttcagattcttttctgtgtccttctgttttcagtgataaggatgtttcttccctccaggaataaggagggcacctctcaaataagggtcttatgaccctttagggaagaaggatgggagaaggtcagagagatcttgctacgtctgctgttttctcaactgccaatgtgccatatttggaggtagtgtgtcctgaacccttgccaagtgtaaacatccttttctcttggttgttatgaaaaagagattatacagccacaaatgaaaaagatgttataggaaatggcattatcatgggagcttcgggattgattcaaggagataggttgaaatactaattatgaacaaaatgtaaggtaatgtgtaaaagaacacagaatccactgtaatggagaaagaaaggtagatagataggctgtatgcatatagtgaggtacagtaaccccatccatggagagaaaatgtgaaatagagcaaggtaatggaggaaatagtaaaaggaaagaaggaggaaataagcaaggaaaggttagccaggatagaaaggtagtttgagagacatgttagctgagggagaagagacaggatatttgcaaaattttgtagcttgaaaggtcaacagcatcagctacttccagcatttcaattgcaagggtagattcattgtcaatgtcatagtttagttgctgagctttacataggactagtttgtactggtaactttgatgagtttagtgagaagaggcaacaacaggaaaaaaatacctcaatgagaaacagcttattaaattaataccactcaaaacagatttatattgcaggttttaagcaaatacagttgttttaaaagcaagaggttcaactgtattcttgttgatattgattaatatgtagggaaataaaccaaaattacatgttttccatgagaagaatcatattttcagtgagaagaattacaattttctagtaaaaaatatcgaatttctgttttaaaagataaattgtgccttttttttatgaactatatgccattggcaaaaataaaacacacacacacacaaaacacccgaaaagaacaaagaaaaaaatctagaagcagttgttttgatcaatcctttccacccctgccagcatcaatgtacttcgtaagactataaaaatcaaatattttaaaaatgctgattcattctttggaaagctctaccttgagttagggtagtttgttttttggcagtcttgtctcttcagatgtgatgtggggtgtttgccaatatactgaaaacgcagcatcacggctgtttctctgacctcagcatcctgaagtggtgtttcagctcctgctctccttacatcgttttaccagtaggtccagtgcatttagatttgtcattagcttttaaggtgaggtttgggcaaaatccattttattttggatgacttatcatcccactgattcttgactccttggtaattctgctaatgctaatttttttagcttcatatattttcattagggcttgaaagtctctgagcttttcttactgattgcatcctatccatggcattcaaatgtgtctgaatttcaacttgttgaaatcattgaaacttaaataaaaactgagaggttgttttatagttaaaaaaaaaaaacctgttaagaatatctttaaaataagtcttgtgataatgaaatgtaccgcttagcagtatgcatgtaccagttgggactactggtttctatatttaagaagtaactcttgctaatgagggtgctgttcaacaatgattttagcacttgtgcatgatccaaatgataatgtttaattattctgtttgcgtgccaagtgactttttttatataaccttgatttgcctctttgtaagcctttgttttcctctgtatgtaacttattcatatttgtaattaacaatttaaatccactgtttggagcattaaggaattagttaatactgatatctcaagttaagaagtgactccccaaaaaaaagttgtggggagaattaaaacaaatattttctgttttgttttgtttctttatttgtggttctttatcttgttttgtttaaattgtttggtaattagaagttatttacgggatttaggttatttggtagcattgtaaatagcttcctttcatgtgttgctttgccggtctttggggataataataagagtcctttgagctgacctagtaaagccgtttattcaaggatcacttgattatgaatactgggggaagggggttagcttttctacattctagattcttctataccttatccttgctgcttcttgtgatacatattagtgaaaagggaactttcagccatgtattaatgcttttgaagttcagtagtgcatagatttcagcataaagtaagattatacagtttgcaatatgaacagggacatatagaaggatacacatgcattcatatagagatatacaaactcaagcaaaagatagagtaactctaaattatgttccatgtgatgtatctatatttgttctctgtcaaggataaaatggaagaaaattgaaaatttcctaactgtattttggttggtaaaatacaatctcaaaagtaaaaaattatttgatttcgccttaaaagtgattttgtttagggtttttctttagggttttgctacagatagatgtatcacagggtacattttataattcagtgatactttccatattttatttattcatttatattagttggtggggaacaagtaaaaaattgattaattcttattatacaggtaagttttcattgttttacggctacttaatagcagtacagtggagtaaagcacattttcagaattcacatgcccacttatctgtgtaggttcagttctaaaatgtttttcacagtgagtcactgtcattagctttccaaaaatgacaatttcaaggacagccctaatttgtacatgtgaatttttatgtgcttgttgaaaatcagtccagaggcatctggggaagatggtggtagcatggcatcagagtttttttgttgttgttgttttatttttttatttttatttttatttatttatttatttatttttttgaaatggagtttcgctcttgttgtccaagctggaagcaatggcgcaatcttggctcactgcaacctctgcctcccgggttcaagtgattctcctgccttagcctcctgagtagctgggattccaggcatgtgccaccacgcccagctaatttttgcatttttagtagagacggggtttcaccttgttagccaggatgatctcgatctcctgacctcgtgatccgcccgcctcggcctccccaaagtgctgggattacaggcatgggccaccacacctggcccagagtttttccatgtcttttgcctttgccattttccttccattggtaaagcagttacatttataaagagacatttgtaaagagaataactagacagcaaaactaaaacgtacaatgtttgcaaccaaactagatgacaagagagatccaaaataaatccaggtggcgataagccaccaccagccacaaaacgtacaagacatcactgcctgtatgagaggaaagacaaggaagtgagggtgcctaagaaccagatagcccccaaaataggcaacagatatttaatggaaagctggcttgagagcagagctaaacctggaagggttttgccatgcgcagaggctagggtaa

SEQ ID NO: 305 - DNA, 4023 bp, Homo sapiens
aaaggtagtttgagagacatgttagctgagggagaagagacaggatatttgcaaaattttgtagcttgaaaggtcaacagcatcagctacttccagcatttcaattgcaagggtagattcattgtcaatgtcatagtttagttgctgagctttacataggactagtttgtactggtaactttgatgagtttagtgagaagaggcaacaacaggaaaaaaatacctcaatgagaaacagcttattaaattaataccactcaaaacagatttatattgcaggttttaagcaaatacagttgttttaaaagcaagaggttcaactgtattcttgttgatattgattaatatgtagggaaataaaccaaaattacatgttttccatgagaagaatcatattttcagtgagaagaattacaattttctagtaaaaaatatcgaatttctgttttaaaagataaattgtgccttttttttatgaactatatgccattggcaaaaataaaacacacacacacacaaaacacccgaaaagaacaaagaaaaaaatctagaagcagttgttttgatcaatcctttccacccctgccagcatcaatgtacttcgtaagactataaaaatcaaatattttaaaaatgctgattcattctttggaaagctctaccttgagttagggtagtttgttttttggcagtcttgtctcttcagatgtgatgtggggtgtttgccaatatactgaaaacgcagcatcacggctgtttctctgacctcagcatcctgaagtggtgtttcagctcctgctctccttacatcgttttaccagtaggtccagtgcatttagatttgtcattagcttttaaggtgaggtttgggcaaaatccattttattttggatgacttatcatcccactgattcttgactccttggtaattctgctaatgctaatttttttagcttcatatattttcattagggcttgaaagtctctgagcttttcttactgattgcatcctatccatggcattcaaatgtgtctgaatttcaacttgttgaaatcattgaaacttaaataaaaactgagaggttgttttatagttaaaaaaaaaaaacctgttaagaatatctttaaaataagtcttgtgataatgaaatgtaccgcttagcagtatgcatgtaccagttgggactactggtttctatatttaagaagtaactcttgctaatgagggtgctgttcaacaatgattttagcacttgtgcatgatccaaatgataatgtttaattattctgtttgcgtgccaagtgactttttttatataaccttgatttgcctctttgtaagcctttgttttcctctgtatgtaacttattcatatttgtaattaacaatttaaatccactgtttggagcattaaggaattagttaatactgatatctcaagttaagaagtgactccccaaaaaaaagttgtggggagaattaaaacaaatattttctgttttgttttgtttctttatttgtggttctttatcttgttttgtttaaattgtttggtaattagaagttatttacgggatttaggttatttggtagcattgtaaatagcttcctttcatgtgttgctttgccggtctttggggataataataagagtcctttgagctgacctagtaaagccgtttattcaaggatcacttgattatgaatactgggggaagggggttagcttttctacattctagattcttctataccttatccttgctgcttcttgtgatacatattagtgaaaagggaactttcagccatgtattaatgcttttgaagttcagtagtgcatagatttcagcataaagtaagattatacagtttgcaatatgaacagggacatatagaaggatacacatgcattcatatagagatatacaaactcaagcaaaagatagagtaactctaaattatgttccatgtgatgtatctatatttgttctctgtcaaggataaaatggaagaaaattgaaaatttcctaactgtattttggttggtaaaatacaatctcaaaagtaaaaaattatttgatttcgccttaaaagtgattttgtttagggtttttctttagggttttgctacagatagatgtatcacagggtacattttataattcagtgatactttccatattttatttattcatttatattagttggtggggaacaagtaaaaaattgattaattcttattatacaggtaagttttcattgttttacggctacttaatagcagtacagtggagtaaagcacattttcagaattcacatgcccacttatctgtgtaggttcagttctaaaatgtttttcacagtgagtcactgtcattagctttccaaaaatgacaatttcaaggacagccctaatttgtacatgtgaatttttatgtgcttgttgaaaatcagtccagaggcatctggggaagatggtggtagcatggcatcagagtttttttgttgttgttgttttatttttttatttttatttttatttatttatttatttatttttttgaaatggagtttcgctcttgttgtccaagctggaagcaatggcgcaatcttggctcactgcaacctctgcctcccgggttcaagtgattctcctgccttagcctcctgagtagctgggattccaggcatgtgccaccacgcccagctaatttttgcatttttagtagagacggggtttcaccttgttagccaggatgatctcgatctcctgacctcgtgatccgcccgcctcggcctccccaaagtgctgggattacaggcatgggccaccacacctggcccagagtttttccatgtcttttgcctttgccattttccttccattggtaaagcagttacatttataaagagacatttgtaaagagaataactagacagcaaaactaaaacgtacaatgtttgcaaccaaactagatgacaagagagatccaaaataaatccaggtggcgataagccaccaccagccacaaaacgtacaagacatcactgcctgtatgagaggaaagacaaggaagtgagggtgcctaagaaccagatagcccccaaaataggcaacagatatttaatggaaagctggcttgagagcagagctaaacctggaagggttttgccatgcgcagaggctagggtaaaaaaggtgtgacatttctagaatgctcttgcctgctgtgagctctcagactggacccatcagggcttccttctagaaagaaggtctcatgctgagcaaaacttctgggaatagaatcaatatggagcatctcaaggcaacagaaatgaaaggagaaggcctagtccaaactgttcctacgtgctggtagagggtatgggggaacaggaccaggaagtctcaaactcaagtactgctatgaatggaatgtttatgtcccccaaaaattcatgggttgaaatctaatccctagtgtgatagtgttaggagatggggccttggaagtgattaggtcatgaggatggagctgtcataaatgaaattagtacattcataaaagtgaccccagagagctctctcttcccttccaccatgggaggacgcagtgagaagacggctgtgtatgacccaggaagcagactcactggaccacagatctaccaatcctttgatcttggacttgccagtctccagaactgtgagagataaatctctgctgttttatttaagccactcagtctatagtattctgttatagcagactgaatagattgagacacatgctgtaattgtaaataccacacaaaagcaaaagaagaggaatctctgtgaagttagaaaagctctcctcaacctcattttgttataaaagtttaggaaaattaattatacaaccaaaaaaatgagcaacaaaagtatcaagaccaaatctcatataaaggaattttaagaaaaagagataaggaacaaaattatatcactacaaataaagcatgccagtgtaactact

SEQ ID NO: 306 - DNA, 4072 bp, Homo sapiens
aactgtattcttgttgatattgattaatatgtagggaaataaaccaaaattacatgttttccatgagaagaatcatattttcagtgagaagaattacaattttctagtaaaaaatatcgaatttctgttttaaaagataaattgtgccttttttttatgaactatatgccattggcaaaaataaaacacacacacacacaaaacacccgaaaagaacaaagaaaaaaatctagaagcagttgttttgatcaatcctttccacccctgccagcatcaatgtacttcgtaagactataaaaatcaaatattttaaaaatgctgattcattctttggaaagctctaccttgagttagggtagtttgttttttggcagtcttgtctcttcagatgtgatgtggggtgtttgccaatatactgaaaacgcagcatcacggctgtttctctgacctcagcatcctgaagtggtgtttcagctcctgctctccttacatcgttttaccagtaggtccagtgcatttagatttgtcattagcttttaaggtgaggtttgggcaaaatccattttattttggatgacttatcatcccactgattcttgactccttggtaattctgctaatgctaatttttttagcttcatatattttcattagggcttgaaagtctctgagcttttcttactgattgcatcctatccatggcattcaaatgtgtctgaatttcaacttgttgaaatcattgaaacttaaataaaaactgagaggttgttttatagttaaaaaaaaaaaacctgttaagaatatctttaaaataagtcttgtgataatgaaatgtaccgcttagcagtatgcatgtaccagttgggactactggtttctatatttaagaagtaactcttgctaatgagggtgctgttcaacaatgattttagcacttgtgcatgatccaaatgataatgtttaattattctgtttgcgtgccaagtgactttttttatataaccttgatttgcctctttgtaagcctttgttttcctctgtatgtaacttattcatatttgtaattaacaatttaaatccactgtttggagcattaaggaattagttaatactgatatctcaagttaagaagtgactccccaaaaaaaagttgtggggagaattaaaacaaatattttctgttttgttttgtttctttatttgtggttctttatcttgttttgtttaaattgtttggtaattagaagttatttacgggatttaggttatttggtagcattgtaaatagcttcctttcatgtgttgctttgccggtctttggggataataataagagtcctttgagctgacctagtaaagccgtttattcaaggatcacttgattatgaatactgggggaagggggttagcttttctacattctagattcttctataccttatccttgctgcttcttgtgatacatattagtgaaaagggaactttcagccatgtattaatgcttttgaagttcagtagtgcatagatttcagcataaagtaagattatacagtttgcaatatgaacagggacatatagaaggatacacatgcattcatatagagatatacaaactcaagcaaaagatagagtaactctaaattatgttccatgtgatgtatctatatttgttctctgtcaaggataaaatggaagaaaattgaaaatttcctaactgtattttggttggtaaaatacaatctcaaaagtaaaaaattatttgatttcgccttaaaagtgattttgtttagggtttttctttagggttttgctacagatagatgtatcacagggtacattttataattcagtgatactttccatattttatttattcatttatattagttggtggggaacaagtaaaaaattgattaattcttattatacaggtaagttttcattgttttacggctacttaatagcagtacagtggagtaaagcacattttcagaattcacatgcccacttatctgtgtaggttcagttctaaaatgtttttcacagtgagtcactgtcattagctttccaaaaatgacaatttcaaggacagccctaatttgtacatgtgaatttttatgtgcttgttgaaaatcagtccagaggcatctggggaagatggtggtagcatggcatcagagtttttttgttgttgttgttttatttttttatttttatttttatttatttatttatttatttttttgaaatggagtttcgctcttgttgtccaagctggaagcaatggcgcaatcttggctcactgcaacctctgcctcccgggttcaagtgattctcctgccttagcctcctgagtagctgggattccaggcatgtgccaccacgcccagctaatttttgcatttttagtagagacggggtttcaccttgttagccaggatgatctcgatctcctgacctcgtgatccgcccgcctcggcctccccaaagtgctgggattacaggcatgggccaccacacctggcccagagtttttccatgtcttttgcctttgccattttccttccattggtaaagcagttacatttataaagagacatttgtaaagagaataactagacagcaaaactaaaacgtacaatgtttgcaaccaaactagatgacaagagagatccaaaataaatccaggtggcgataagccaccaccagccacaaaacgtacaagacatcactgcctgtatgagaggaaagacaaggaagtgagggtgcctaagaaccagatagcccccaaaataggcaacagatatttaatggaaagctggcttgagagcagagctaaacctggaagggttttgccatgcgcagaggctagggtaaaaaaggtgtgacatttctagaatgctcttgcctgctgtgagctctcagactggacccatcagggcttccttctagaaagaaggtctcatgctgagcaaaacttctgggaatagaatcaatatggagcatctcaaggcaacagaaatgaaaggagaaggcctagtccaaactgttcctacgtgctggtagagggtatgggggaacaggaccaggaagtctcaaactcaagtactgctatgaatggaatgtttatgtcccccaaaaattcatgggttgaaatctaatccctagtgtgatagtgttaggagatggggccttggaagtgattaggtcatgaggatggagctgtcataaatgaaattagtacattcataaaagtgaccccagagagctctctcttcccttccaccatgggaggacgcagtgagaagacggctgtgtatgacccaggaagcagactcactggaccacagatctaccaatcctttgatcttggacttgccagtctccagaactgtgagagataaatctctgctgttttatttaagccactcagtctatagtattctgttatagcagactgaatagattgagacacatgctgtaattgtaaataccacacaaaagcaaaagaagaggaatctctgtgaagttagaaaagctctcctcaacctcattttgttataaaagtttaggaaaattaattatacaaccaaaaaaatgagcaacaaaagtatcaagaccaaatctcatataaaggaattttaagaaaaagagataaggaacaaaattatatcactacaaataaagcatgccagtgtaactactttatgaatgggaggaaaatggaaaagtaaatctatattttaatgttttcactaatcatgtgggtggtagtattggtattagtgttctaagactattgtgtacgtaatatgataaaaagcaaatgaataattatgggattgtctaggtctatcatctcttgtgtccttgagaaccagatttttggttttgaaaaaaggagatagaggtgtattagaaaacaagttaagttaaatcagaaatttgaattggaatcatcaatgtaacttcaagagaaattttaccttcaaatgcatatttcccagctctgtgcaaagaaaaagcctgttaacactgaaaaggcctaaaaggtgtgcttggaacatcttgt

SEQ ID NO: 307 - DNA, 4046 bp, Homo sapiens
attgaaacttaaataaaaactgagaggttgttttatagttaaaaaaaaaaaacctgttaagaatatctttaaaataagtcttgtgataatgaaatgtaccgcttagcagtatgcatgtaccagttgggactactggtttctatatttaagaagtaactcttgctaatgagggtgctgttcaacaatgattttagcacttgtgcatgatccaaatgataatgtttaattattctgtttgcgtgccaagtgactttttttatataaccttgatttgcctctttgtaagcctttgttttcctctgtatgtaacttattcatatttgtaattaacaatttaaatccactgtttggagcattaaggaattagttaatactgatatctcaagttaagaagtgactccccaaaaaaaagttgtggggagaattaaaacaaatattttctgttttgttttgtttctttatttgtggttctttatcttgttttgtttaaattgtttggtaattagaagttatttacgggatttaggttatttggtagcattgtaaatagcttcctttcatgtgttgctttgccggtctttggggataataataagagtcctttgagctgacctagtaaagccgtttattcaaggatcacttgattatgaatactgggggaagggggttagcttttctacattctagattcttctataccttatccttgctgcttcttgtgatacatattagtgaaaagggaactttcagccatgtattaatgcttttgaagttcagtagtgcatagatttcagcataaagtaagattatacagtttgcaatatgaacagggacatatagaaggatacacatgcattcatatagagatatacaaactcaagcaaaagatagagtaactctaaattatgttccatgtgatgtatctatatttgttctctgtcaaggataaaatggaagaaaattgaaaatttcctaactgtattttggttggtaaaatacaatctcaaaagtaaaaaattatttgatttcgccttaaaagtgattttgtttagggtttttctttagggttttgctacagatagatgtatcacagggtacattttataattcagtgatactttccatattttatttattcatttatattagttggtggggaacaagtaaaaaattgattaattcttattatacaggtaagttttcattgttttacggctacttaatagcagtacagtggagtaaagcacattttcagaattcacatgcccacttatctgtgtaggttcagttctaaaatgtttttcacagtgagtcactgtcattagctttccaaaaatgacaatttcaaggacagccctaatttgtacatgtgaatttttatgtgcttgttgaaaatcagtccagaggcatctggggaagatggtggtagcatggcatcagagtttttttgttgttgttgttttatttttttatttttatttttatttatttatttatttatttttttgaaatggagtttcgctcttgttgtccaagctggaagcaatggcgcaatcttggctcactgcaacctctgcctcccgggttcaagtgattctcctgccttagcctcctgagtagctgggattccaggcatgtgccaccacgcccagctaatttttgcatttttagtagagacggggtttcaccttgttagccaggatgatctcgatctcctgacctcgtgatccgcccgcctcggcctccccaaagtgctgggattacaggcatgggccaccacacctggcccagagtttttccatgtcttttgcctttgccattttccttccattggtaaagcagttacatttataaagagacatttgtaaagagaataactagacagcaaaactaaaacgtacaatgtttgcaaccaaactagatgacaagagagatccaaaataaatccaggtggcgataagccaccaccagccacaaaacgtacaagacatcactgcctgtatgagaggaaagacaaggaagtgagggtgcctaagaaccagatagcccccaaaataggcaacagatatttaatggaaagctggcttgagagcagagctaaacctggaagggttttgccatgcgcagaggctagggtaaaaaaggtgtgacatttctagaatgctcttgcctgctgtgagctctcagactggacccatcagggcttccttctagaaagaaggtctcatgctgagcaaaacttctgggaatagaatcaatatggagcatctcaaggcaacagaaatgaaaggagaaggcctagtccaaactgttcctacgtgctggtagagggtatgggggaacaggaccaggaagtctcaaactcaagtactgctatgaatggaatgtttatgtcccccaaaaattcatgggttgaaatctaatccctagtgtgatagtgttaggagatggggccttggaagtgattaggtcatgaggatggagctgtcataaatgaaattagtacattcataaaagtgaccccagagagctctctcttcccttccaccatgggaggacgcagtgagaagacggctgtgtatgacccaggaagcagactcactggaccacagatctaccaatcctttgatcttggacttgccagtctccagaactgtgagagataaatctctgctgttttatttaagccactcagtctatagtattctgttatagcagactgaatagattgagacacatgctgtaattgtaaataccacacaaaagcaaaagaagaggaatctctgtgaagttagaaaagctctcctcaacctcattttgttataaaagtttaggaaaattaattatacaaccaaaaaaatgagcaacaaaagtatcaagaccaaatctcatataaaggaattttaagaaaaagagataaggaacaaaattatatcactacaaataaagcatgccagtgtaactactttatgaatgggaggaaaatggaaaagtaaatctatattttaatgttttcactaatcatgtgggtggtagtattggtattagtgttctaagactattgtgtacgtaatatgataaaaagcaaatgaataattatgggattgtctaggtctatcatctcttgtgtccttgagaaccagatttttggttttgaaaaaaggagatagaggtgtattagaaaacaagttaagttaaatcagaaatttgaattggaatcatcaatgtaacttcaagagaaattttaccttcaaatgcatatttcccagctctgtgcaaagaaaaagcctgttaacactgaaaaggcctaaaaggtgtgcttggaacatcttgtaatagtagctaataaggaagctgttgaagactgttagagtcacattaaaagttgccaactgaacttgaccttcaataatgagaattgcaatagattgaaacccatcaaatacattaaaatctcatgatatttaaaatgaacaaaagcattgatcatctttggaaaataataggaaaccatttcatgatactgaaaattagtcaacacagtaaaatatttatcctgacttttctaaatgaactgtaccacagagtacctaaatgttagacatggtgatgtttctttataaaagtatgtattaggcagggctgtctagagggtcagaactaataggatagatgtatatatgaatgggagtttattaaggagtattgactcacatgatcacaaggtgaagtcccacagtaggctgtctgcaagctgaagagcaaggaagccagtttgagtacccaaacctcaaaagtagagaagccgacagtgcagccttcagtctgtggccgaaggcccaagagcccctggcaaaccactggtctaacagtccaaaagttgaagaacttggagtttatgttcgagggcaggaagcttccagcacggaaaaagatgaaggccagaagactcagcaagtctgctcttccatcttctcctgcctgctttgttctagccatactggcaagtgattagatggtgcccactgattagatggtacccaccg

SEQ ID NO: 308 - DNA, 4101 bp, Homo sapiens
tttttttccttttctgcctggtaagagctgaatactctcaaaccgtcagatcttataacaacccttttttctccacagggtttccttgaattctttttcttttcatgaatacctttttcttctgcacttttgctttgcatttgggaagccctatatccatataactgcagatcattatgtagttaatattcagttattcaggaaaagatgggtcattgtgaatctgatggcaaagcctggtgatagcatggggctggcaccttgttgcaggttgtttgttttgtcagtgtaaaaactgatgaattttaaatgataagtagctgcggcttaatcatgtctcatctctgctttgcaagccaagagaatcaaaagttcccttaattattgactagaagcagacatgttttgatagaaggggaatggatagaaagtggcaaaactatataagggttaactcagaacttagttgttttcaaaaatagtttggtttttgtttttgtttttttcaatttttggttgggtgcagtggctcacacctgtaatcccagcactttgggaatctgaggcaggtgaatcacttgaggtcaggagtttgagaccagcctggccaacatggtgaaaccccgtctactaaaaatacaaaaattagctgggtgtggtggtgcgcacctgtagtcccagctactcaggaggctgaggcacgagaatcggctgaacttgggaggcagaggttgcagtgagctgagatcgtgccattgcatgccagcttgggcaacagagcgagactctgtctcaaaaaaataaaaaaagtttctgtctgcaaaacaagtttctgtgagtcctgggcatgcatgttgtgaaggaaaagctgaagggcagggacagggagcaggcagcaggtaagcaaatatacttatcattcagtgtctgtgattacaagaaagtttctctctccttctccccttctcctcctccgccgcctcctcctcctcctcctcctcctcctcctcctcctctctctctctctctctctctttctgtctctaagaggagggagtgaggtataatgagtggtaggttgagcagccaagttggagccagaggatcatgggcttcattaagttctgtgcaggtaatgtaaatattttaaatgcatcttcggaaggatcacagttgatatctgtattgtaaatagaaactagaattgtgatatacagtagaaaactggggcttggagaacaatagttcatgggataggatgatggggtgggtggggttgggatagtgttagtccatatcaccctaaatgattatcaaactaatcatttagaaatacctaagggaacagtgacattttataccactattaaaaatgtagttcaggtaaaataattatatgtctgcatagttgggaaaggacaaagaaattgacagtattccttcccaaacagagcaccaatgtggccctgctctttctctcttatttattgtcttacctttttccccactagaatatatgctggcttgtgtgtagccagcatcggctctatgactaatttccattaacacagcttggttaaaaccattgtggttaaaaccacaatactctgtcatcactatattaatagcaaattgaaaatttttttagtgataagaaccagccaatagtttggaaaaattagtttggaaaaatttcaaaactaattatactttttggcccaagttttaaaatattggggaaatgaactaggtatggtttattttcaacagagaatgaaaaagtataaacatatcactggatatatttagtgatgagttcttattgccaagtgttttcatgagactgctttatttcaaaaatgcataaaactaccaaaactgttgacatttaattgcatcaatttacatcggctctgattttgttatagatagttattgccttccattttactgagagaagtgtaattgttttcaaccttatagacaacatctggggaagatgtacgagacttcacaaaggtacttaagaacaagttcaggtcgaagaagtactttgccaaacaccctcgacttggttacctgcctgtccagacagttcttgaaggtgacaacttagagacgtaagtttgattttaatattaaatctagtgtgaacatttatatctgatgttgtcttttttatgttagtaacacaagagaaattgtttaataccaactgcattttagaggaggtaaattaaacttggaatcagtcttcacaacatgaatttttacaattcacttttgacaatgtcacagccaaaatttcaattttaaccttgcacatgtccttaaattttaaaaatatgtattaatatgtcaaccttaatacacactggtcatctcttttgttggtcatctcttttctttttaaaaacacttaaagtgtggcattatatagtctttcattatttattttcctttttttccccttatggggggtgttttactatttctcagagtatgttttatactctttttgcatctctttaatataaatttattaataatacttaatctgttgattcagatatttatgctaaaattctaaagtatcacattatgattctaatctattttttattgaaaatgaagacagcaaactgagatagctttatatattacataaaatagaaaaaatttattcaaagtgtataatttgagttggttagcatacatgaaagtttcaagatggtgaaattaccatgtgattataaagcaaagggaataagaatttatggcctgaagtgaaaagaaaaaaaatgtttttcaatgacccagaaaaaatgcaaagaagtaattttaagatactaaacaattatgtgttaagatccaaatagatagattttaaatctttgaattgctttttcatatgtcaggataaatattcctgctaaggccattttcttgtggttgaatcttggggaaaatgaacttttattactaatcatcaacagagtgcccagttgtatagcataatgaagttctagtcagagaaagacaccgtctcagatgactagagaagagaaactcaaaagtgtgaagttttctactttataaaaaatagagaaaattgtagtaagaagtataaaaaatgtcaagtgcaatttttgtgaaatgaaactttagccttcagattcatagttcattttattttgtacatgatagaaaatcaggaagtagtaatattttagtgctttgtgatagtcaatgtctcaaacatgtcaaaatagaagaatacagtatttggtctgcagaccaaaatagatttttttaaatccctgtagacctcaaactttgctaaatttatgtaccagtttatctcttttatttgtggaatggctaagaaatagaagaaagaacacagccaaagcataggagatacctttttccctctataggtaatgtcgtgtgtgtgtaaacagaaagaaatacaatgcaaatgcatatttagataggtccatgtataacacatacacatacaaaaggtaagaaaaaatttcaactgtgtgattactgtgcttgatatcaaactgtgtacacttaagatatattctttccacttgatatcaaactgtgtacaattaagatctgtgtctttctaaacattcttttgcatagtacaatttagaaaaagttttaataaagcaatttcaattgaaagagagctgttcgaatacattcaggaacagtagacttttggtcctctttttgatttgtgggtatgcttttgtcctttccttcaaaaggttgtgtgataatagattcttatttgtcttagtatctaatatatgtttaactgtgctgatgccttaggataaagacaaaattgtactttttttgtatcccatccagttaacctttggaatggataattctgaggcacagaattattacttggtgctttaatttacgggataatttgataggtttgaactaagcgatgtgccttttaatcttttgctaaaccattggcattttgcatcacaaatatctacacgctttacaggaatcatgcagatagatgcatattttatactcctttaaaacatttttaatttg

SEQ ID NO: 309 - DNA, 4047 bp, Homo sapiens
agaccagcctggccaacatggtgaaaccccgtctactaaaaatacaaaaattagctgggtgtggtggtgcgcacctgtagtcccagctactcaggaggctgaggcacgagaatcggctgaacttgggaggcagaggttgcagtgagctgagatcgtgccattgcatgccagcttgggcaacagagcgagactctgtctcaaaaaaataaaaaaagtttctgtctgcaaaacaagtttctgtgagtcctgggcatgcatgttgtgaaggaaaagctgaagggcagggacagggagcaggcagcaggtaagcaaatatacttatcattcagtgtctgtgattacaagaaagtttctctctccttctccccttctcctcctccgccgcctcctcctcctcctcctcctcctcctcctcctcctctctctctctctctctctctttctgtctctaagaggagggagtgaggtataatgagtggtaggttgagcagccaagttggagccagaggatcatgggcttcattaagttctgtgcaggtaatgtaaatattttaaatgcatcttcggaaggatcacagttgatatctgtattgtaaatagaaactagaattgtgatatacagtagaaaactggggcttggagaacaatagttcatgggataggatgatggggtgggtggggttgggatagtgttagtccatatcaccctaaatgattatcaaactaatcatttagaaatacctaagggaacagtgacattttataccactattaaaaatgtagttcaggtaaaataattatatgtctgcatagttgggaaaggacaaagaaattgacagtattccttcccaaacagagcaccaatgtggccctgctctttctctcttatttattgtcttacctttttccccactagaatatatgctggcttgtgtgtagccagcatcggctctatgactaatttccattaacacagcttggttaaaaccattgtggttaaaaccacaatactctgtcatcactatattaatagcaaattgaaaatttttttagtgataagaaccagccaatagtttggaaaaattagtttggaaaaatttcaaaactaattatactttttggcccaagttttaaaatattggggaaatgaactaggtatggtttattttcaacagagaatgaaaaagtataaacatatcactggatatatttagtgatgagttcttattgccaagtgttttcatgagactgctttatttcaaaaatgcataaaactaccaaaactgttgacatttaattgcatcaatttacatcggctctgattttgttatagatagttattgccttccattttactgagagaagtgtaattgttttcaaccttatagacaacatctggggaagatgtacgagacttcacaaaggtacttaagaacaagttcaggtcgaagaagtactttgccaaacaccctcgacttggttacctgcctgtccagacagttcttgaaggtgacaacttagagacgtaagtttgattttaatattaaatctagtgtgaacatttatatctgatgttgtcttttttatgttagtaacacaagagaaattgtttaataccaactgcattttagaggaggtaaattaaacttggaatcagtcttcacaacatgaatttttacaattcacttttgacaatgtcacagccaaaatttcaattttaaccttgcacatgtccttaaattttaaaaatatgtattaatatgtcaaccttaatacacactggtcatctcttttgttggtcatctcttttctttttaaaaacacttaaagtgtggcattatatagtctttcattatttattttcctttttttccccttatggggggtgttttactatttctcagagtatgttttatactctttttgcatctctttaatataaatttattaataatacttaatctgttgattcagatatttatgctaaaattctaaagtatcacattatgattctaatctattttttattgaaaatgaagacagcaaactgagatagctttatatattacataaaatagaaaaaatttattcaaagtgtataatttgagttggttagcatacatgaaagtttcaagatggtgaaattaccatgtgattataaagcaaagggaataagaatttatggcctgaagtgaaaagaaaaaaaatgtttttcaatgacccagaaaaaatgcaaagaagtaattttaagatactaaacaattatgtgttaagatccaaatagatagattttaaatctttgaattgctttttcatatgtcaggataaatattcctgctaaggccattttcttgtggttgaatcttggggaaaatgaacttttattactaatcatcaacagagtgcccagttgtatagcataatgaagttctagtcagagaaagacaccgtctcagatgactagagaagagaaactcaaaagtgtgaagttttctactttataaaaaatagagaaaattgtagtaagaagtataaaaaatgtcaagtgcaatttttgtgaaatgaaactttagccttcagattcatagttcattttattttgtacatgatagaaaatcaggaagtagtaatattttagtgctttgtgatagtcaatgtctcaaacatgtcaaaatagaagaatacagtatttggtctgcagaccaaaatagatttttttaaatccctgtagacctcaaactttgctaaatttatgtaccagtttatctcttttatttgtggaatggctaagaaatagaagaaagaacacagccaaagcataggagatacctttttccctctataggtaatgtcgtgtgtgtgtaaacagaaagaaatacaatgcaaatgcatatttagataggtccatgtataacacatacacatacaaaaggtaagaaaaaatttcaactgtgtgattactgtgcttgatatcaaactgtgtacacttaagatatattctttccacttgatatcaaactgtgtacaattaagatctgtgtctttctaaacattcttttgcatagtacaatttagaaaaagttttaataaagcaatttcaattgaaagagagctgttcgaatacattcaggaacagtagacttttggtcctctttttgatttgtgggtatgcttttgtcctttccttcaaaaggttgtgtgataatagattcttatttgtcttagtatctaatatatgtttaactgtgctgatgccttaggataaagacaaaattgtactttttttgtatcccatccagttaacctttggaatggataattctgaggcacagaattattacttggtgctttaatttacgggataatttgataggtttgaactaagcgatgtgccttttaatcttttgctaaaccattggcattttgcatcacaaatatctacacgctttacaggaatcatgcagatagatgcatattttatactcctttaaaacatttttaatttgcctttcaatgtcaaaataatcattggtgtcagtcatcctattctgagtgactctattaggtaaaaattaacagaaaagcatgccaaataattttgtgctgtgattttggggtgtaattctgaaaatgcctcgcctcaattcattcaattgaaaatgaatttatgagcattttttgtgagaggaaaacaagagaaaaaaaggaagaagtgtaagcttgcatcagatgcaccaagatcctttttggacagatttatgaactactagatatagtgggcaggttttctttttttaatcctagaccaagctctcgggatttgatatagttcacttttcggctgagccctttctagtacagggccgcttaatcttctggtgtaacaatttatgtgagtgggtaataaaaaagtttgattttgtttattctcctatttgtgggaggagaacattggagaaaaaccagcgaagtggcaaatgtgttgaagttatttatgaagctaattagaattttcttttgcttctttctttttcatccttgcaaaat

SEQ ID NO: 310 - DNA, 4056 bp, Homo sapiens
agtcaagcaatttgacagagctttcccaaggttgattaagacaaaaaaaatacacacttttcttctatttgaagttcgtggcatatgttttgctacacttgaattttggaaataatctcttaagcagttactgtttttagaaagtatatagcatatcattcacctgacatttaacatattcagggttaatgaagaacagtgacgtggaaatagtattgactaatactatgttgttttattgttattgtatctattttacacatatgtaaattaagtttactgacagtatagatattctgacaaacagtctggataaatgcctggttctgcagtgagaacacatggacacaggaaggggaacatcacacaccggagactgttgtggggtggggggaggggagagggatagcattaggagatatacctaatgctaaatgatgagttaatgggtgcagcacaccaacatggcacatgtatacatatgtaacaaacctgcatgttgtgcacatgtaccctaaaacttaaagtataataataataaaagaaaaaataaataaataaataaataaataaatgcctggttctgaaaatagatctgaagagtcttagtttttcatcccaataagataatgttcaaaagtctttgctgtgcaggcatcaacctgcacttcactataggagatgaagagaaaagtaggcattatagatacctactttctttgtctaagtaggtatgtataatagaaataggagaatcaaggagttttggaataattttgtttcaaacactgttagcttttgcagacttttatttaattaaatagctaattttctttgtactgtaaatgttctacattcatttactctccttcctcctcaaaaagctagggttggaactagcttttaattaggatcagttgttttcaaaagtatttcatggagacttgggaattcttcctaggcagtatatgacatccccagcattaagagtgacactgaatgatctggctccagacacaagcccctgagtcaagcagaacaagtttttttgcatcgattcatagtttaaacttctaaaaaacttttttttgaagaaaatgtatcatgatctcaggaagttgccttcagtgttatttatgatgtgacatttttggtgggatctaggggtggtatctaggttgcatgtttgttcaatgtgtgtgtgaggttgaggtattttgggtacatctgggtttggatgtttacatttaaaattacatgaagaacagaaaagtctaattttattgcacctctgccatcaacatataatgtagtgtttcatttttaacttcatctttctaaccaagtttcttctctaggaaaaacaaaaatatgattgcatcccccttggtatattatagaatggtatctttacattattctataattttgagttatttttgagcattctggttttttccccagtatgactgtttaaagatgtgtttgctatccttgaacaaatatcctgtaatatctgtgaaaaggcccctgcagactcttgaatacacggcgacttctctagaatacactgtgacttctgttacttttgatttccccatggtggctctcagggcaaccacatatatgagcggaagataattgagaatctccccacacccccactgcttttgtcttaaattgctctaaagtgtttgttctgtgacttttgtctccctctcccctctttgcagtcctatcacactcatcagtatgtggccagagcactatgagtgagtattcatagcccacgtgcaggagaggtgttctgatcagtggtactagcatgggggtcttactaaactcttggtctaaaataatacttctgtgttccgggtaacaatcctagtggtctgtttgcatggcagattcattacttaagtaacctaacatttctaatagtaacacctatcaatatttgggcataaaattattgctttgtttttttcttttaaagcccctcacaatctcctcaactgtttcatgatgacacccattcaagaatagaacaatatgccacacggtaagaaactttgatcagagccctccactgcactgccacccagaatgtatctatgtctaattaatctaatatcattaatataccttgatttaagaaatgcagttttgcaggagttatgattccattatatttggaatttgggctctcatattttcatgacacagtttgcactttaccaaacacctgctatatattctatgaaaagtaaacctaaccaggatgtgattctccagctaatgagaatccaaacactgtacaagcaggatttagatggtgtaaccaagtttcagtaaatgaaagtgggattgcaggtattctcaggagatggtgcacatgtgaattacaatatgtaattaaatttatgctaatgctttaggataggggtttattttagagtctctaaataatatataggctggtcttgatggtgtgcacagactttcagaaaagtggtatatactaggtgtctgtgattctagtaagtagctttgcctagaaaggttaattcaagcatcataaaaatggtaacatttgaactgggtctaggccaactagaatttctaggggaaagtcttggactaatggaataatatactcaaaagcattgagctgggaaagggcatggtttgtttactgaactgcaggtaggggaaagagaaatagatgagaaagtgaaggacacagaagttgaggtctgataatgaaaaacccagccactgaagagttggatcatgtccttagttgaagggaagtcatggagagtttttgttatgagaggaacatcattttatttgtttgagaatgtcacgctcacttagatgtagaccaactagagggttaaggaaagcctaggtctgggagctcaattagaagattaggtcagttaggagactttacaacatggcgtaagataaaggcctacaggcattaaggcagtggtgatagaaaggtagctcaacatgaaacgttttagttttacagtcgtgttaggagatttggatctttctatgttttgtcagaattttgacaatttaaaaatgattaaggatgtacgtccaattgaccatgtcctatatggccatgttgtctaacctccttatttttattttgcagactggcccagatggaaaggactaatgggtcttttctcactgatagcagctccaccacaggaagtgtgtaagtaaatcatgaaattagtgctgcctgggaaggctagttcttgtattatggctgtcagaaacaatcttcactgatgtggctctgaatcttgatcccaatcaaaattattaagtgtggttccaaaaatttctacgtagattttatgctttcaaaccatgatagtataaactcaatatgtttatttactttgtttcatataagttaatgaaaaaaatcttacatttgtcaacttatataccccacgaaaatcagattgttttatttaggataacaggtgtatatattcattccatttgtcttatatttcttattaatttaacaaaggtaatttgacagaatatgtgccctttctgtgaaatcctctttcttccactagctaacattttttccataatatctgcatttagcacctctgacccacacatacttagatatatactcctacccttcattgaaaactgttaactcctctgccaatattttattttattagcaactaagaaaagcctcattgactttagaatactaaaaagatattatatactaaaaagctttctagccaattagtttatttctgatttccccatatgtgtatattccacttggttgtggaactttctcagcaaatattttatcactgattatcccactattgtgtgtactcttacttttggaactttttattcttttttttgtgccctggaattcacatttttaatcctgaataatatctaaaagactaatactgtcaagcttatgtgactaacaaagctctattgtggtttggatctgatgggaatctgtaaagtaga

SEQ ID NO: 311 - DNA, 4048 bp, Homo sapiens
ttgttcaatgtgtgtgtgaggttgaggtattttgggtacatctgggtttggatgtttacatttaaaattacatgaagaacagaaaagtctaattttattgcacctctgccatcaacatataatgtagtgtttcatttttaacttcatctttctaaccaagtttcttctctaggaaaaacaaaaatatgattgcatcccccttggtatattatagaatggtatctttacattattctataattttgagttatttttgagcattctggttttttccccagtatgactgtttaaagatgtgtttgctatccttgaacaaatatcctgtaatatctgtgaaaaggcccctgcagactcttgaatacacggcgacttctctagaatacactgtgacttctgttacttttgatttccccatggtggctctcagggcaaccacatatatgagcggaagataattgagaatctccccacacccccactgcttttgtcttaaattgctctaaagtgtttgttctgtgacttttgtctccctctcccctctttgcagtcctatcacactcatcagtatgtggccagagcactatgagtgagtattcatagcccacgtgcaggagaggtgttctgatcagtggtactagcatgggggtcttactaaactcttggtctaaaataatacttctgtgttccgggtaacaatcctagtggtctgtttgcatggcagattcattacttaagtaacctaacatttctaatagtaacacctatcaatatttgggcataaaattattgctttgtttttttcttttaaagcccctcacaatctcctcaactgtttcatgatgacacccattcaagaatagaacaatatgccacacggtaagaaactttgatcagagccctccactgcactgccacccagaatgtatctatgtctaattaatctaatatcattaatataccttgatttaagaaatgcagttttgcaggagttatgattccattatatttggaatttgggctctcatattttcatgacacagtttgcactttaccaaacacctgctatatattctatgaaaagtaaacctaaccaggatgtgattctccagctaatgagaatccaaacactgtacaagcaggatttagatggtgtaaccaagtttcagtaaatgaaagtgggattgcaggtattctcaggagatggtgcacatgtgaattacaatatgtaattaaatttatgctaatgctttaggataggggtttattttagagtctctaaataatatataggctggtcttgatggtgtgcacagactttcagaaaagtggtatatactaggtgtctgtgattctagtaagtagctttgcctagaaaggttaattcaagcatcataaaaatggtaacatttgaactgggtctaggccaactagaatttctaggggaaagtcttggactaatggaataatatactcaaaagcattgagctgggaaagggcatggtttgtttactgaactgcaggtaggggaaagagaaatagatgagaaagtgaaggacacagaagttgaggtctgataatgaaaaacccagccactgaagagttggatcatgtccttagttgaagggaagtcatggagagtttttgttatgagaggaacatcattttatttgtttgagaatgtcacgctcacttagatgtagaccaactagagggttaaggaaagcctaggtctgggagctcaattagaagattaggtcagttaggagactttacaacatggcgtaagataaaggcctacaggcattaaggcagtggtgatagaaaggtagctcaacatgaaacgttttagttttacagtcgtgttaggagatttggatctttctatgttttgtcagaattttgacaatttaaaaatgattaaggatgtacgtccaattgaccatgtcctatatggccatgttgtctaacctccttatttttattttgcagactggcccagatggaaaggactaatgggtcttttctcactgatagcagctccaccacaggaagtgtgtaagtaaatcatgaaattagtgctgcctgggaaggctagttcttgtattatggctgtcagaaacaatcttcactgatgtggctctgaatcttgatcccaatcaaaattattaagtgtggttccaaaaatttctacgtagattttatgctttcaaaccatgatagtataaactcaatatgtttatttactttgtttcatataagttaatgaaaaaaatcttacatttgtcaacttatataccccacgaaaatcagattgttttatttaggataacaggtgtatatattcattccatttgtcttatatttcttattaatttaacaaaggtaatttgacagaatatgtgccctttctgtgaaatcctctttcttccactagctaacattttttccataatatctgcatttagcacctctgacccacacatacttagatatatactcctacccttcattgaaaactgttaactcctctgccaatattttattttattagcaactaagaaaagcctcattgactttagaatactaaaaagatattatatactaaaaagctttctagccaattagtttatttctgatttccccatatgtgtatattccacttggttgtggaactttctcagcaaatattttatcactgattatcccactattgtgtgtactcttacttttggaactttttattcttttttttgtgccctggaattcacatttttaatcctgaataatatctaaaagactaatactgtcaagcttatgtgactaacaaagctctattgtggtttggatctgatgggaatctgtaaagtagacagaaaagttgtcaaacatagtagttgggtgttttcactaaaaaaaaaaaaaaactatggagagtgctaggttaaaatacttaaagtgctcaaatatagaatattctctttccatattttctaaaacttgttttatttattatggttataaataaaagttatcaggaggtttttcaatttcaaatttcaaagattgcatcttaatacttgacagtaatgtagtagagatttatacattatcattcatgtactatgagtgtgaaacaattcccaaatcaaaataaaggtgtattcataatgtttgtttcatatttaacctactggtgtgcatttcatgtaaagtagttaagtatcttgaatctttcctaaatcaacaaatttcctcaaggctgaccatagccaaagcgttaaaggaaataaaagataataattcagaacaaaatcttacttctttaaaatgttttgtcatgccctgtgaacacagtaaaggtaatgctcaaatttagtatattgtatcttaaaataggaataaatactattttcagatttagcactgtttcagaaaagattaacattttttaaaaagaaaagaaaaaagtcagaagattaacagtcagatacattttaatatactgtcattatatatattaactcattcacccatccaacagacagttgttattaatatatacctaccatgtaatggtatgctggagccaattgtgagagctgattgttacattttcaggatgtttgtaagctgttaaacagagcctttttaaaaataatttatatacatgtatatacagttacaattaaataaattagattaaaacaaaaacaaaagtaattctcaaaactcatcacaccctaatgattttacttcatttcactaatatctatgcccttgggattatttattataaacttgtccatcctgcaacccacaggccacatgtggcccaggacagctttgaatgcagcccaacacaaattcataaactttctgaaaacattataagatttgtctgtgatttgttttttgttttttgttttttgttttttttttgcttttttagctcatcagctatcattagtgttagtgtatttaatgtgtggcccaagaaaattcttattctttcaatgtggttcctggaagccaaaagattgaatactcc

SEQ ID NO: 312 - DNA, 4400 bp, Homo sapiens
tagtgttagtgtatttaatgtgtggcccaagaaaattcttattctttcaatgtggttcctggaagccaaaagattgaatactcctgattcattatctctgtcaggtggtgtacaaatgtgtatcttttcccagttccacattcagtgaagtcatgaacttgaaattggccatgatcaaaaagtatttaaatcacagaagttgcaaatgccacaaatcaaggtctttttctcttggagaacctgttaaacatttaccaactcacgaccgccatgcacccaatactgcaataggtctatagatgcagatactgtctccatgaatcttataggctagaaaggaaatagataagtagtcctaccagaagaacatgatgaaggcatttgtggtaaacagaatgatggccccccaaagatgtccacatcctaatccctgaagcctatgaatatactactttacttggcaaaagggactttgccacaggtttttaattaaggaccttgaaatagagagattatcctggataatccagatggccccagtgtaatcccaagggtcctcataaagggtaggaaggagagccagagtcagagaaggagacgtagcaatggaggcagaggtcagagagagatctgcagatgctgctgtgttggctttgaaaatgaggaatgcaggtgacctcaaggtgctagatgatgcaaggaaacaaataatctcctatgaaccctaggatgggcattattatgagtcctattttataaacaaggaagctgacatccagaaagataaatgacatgtccctgatcacccatatatctattacaattagatacatgagtacgttcgattgactctggacaatttaaaaggaaattgatgttacgaatactacatatctttgaaggaaaaattgagcagtgacatctcaggacaggataggactcatgacggttctggggaatctcagaagtgggaacgcaaggacaattccttgggccatggctatcaggacgtctcactccatctgccatctgcccttgggtgacactggaaagaaagaatggggaggctgactgtggtttacacaggcattgcagtttgcaaatctgaaacctagaacagaacaatccttaaaagaaagaaaatcattatttttatttatgtcttgtctactttcaaaagttcattgaatgaatcacagtttttttgtcatctgatatgtactaattttgtaatctagatagtgtttactatgtgtgacttaactgtagtataattatattccatctaatgatatttccttggtgcaaacctattatttttgcaacattttctattttagcccaagacatacgattgatgtttaatgtccctgatctggtacctcatgttctatctgcatttaaagagtttgttattggtttttactatatgtaattaagaactagaatgtatctatttttatattcaacatttagacctaataatctgtgaaaaacacttaagactaaaattgtatgttttatataaatgattgttaaattcttatttttgtgaaaactgccttaactctcttccagataccataatgaaagaatgcaatgatagtggggatgataattataataatgtgttaaactctatcagcttccccagagaagtgaatctatatgtatgttgacaacaaaaatacatctcaaatctaattttggctggtttcactatggatagtcagtctccaaatctttaaaacaaaaatttacttggtattaatattaagcactgaagttaatccatgaggtcaggtgctgtagtaaatgttctgagggcataatggtggcttgtgatcttggaggaactctacgccaggatctgtggtcaaatcatggccacaagatcagccacatagcttaaagggatccaagttttcttttaattcttgttgtccttatattagttcttattttaagtcttttctttccatatttattattttcttttaggtatgttattgataggtatcatagaactaattttttgtttgtttgttttgtttgttgttttgttttgtttttgagacagagtctcactctgtcgcccaggctggagtgcagtggcacaatctcagctcactgcaaccttggcttcccgggttcaagtgattctcctgcctcagcctcccgagtagctgggattataggtgcccaccaccaagcccaactaatttttgtatttttagtagagatggggtttcaccatgttggtcaggctggtctcaagctcctgacctcaagtgatctgcccatctcgacctcccaaagtgctgggattacaggcgtgagccaccgtgcccagccaactaattgtttttttaactaatattagaataagtttacctctatttttatcgtaacacctgagattaccatctactttagttccattttgcattatccttgctcattctttctttcatatgctatgtggacaaagtgctttgcctgtacacttgaatgacctgcctggtcatatggatggataggttaggactgtagatattgctccattgtctttggacatttaatattatggaaaataggaagctaaacctttttccaccgctgaacatgatttactgttttattttgatttctggcagattgcttgtgatactttatctttaaaatacagacattttccagggatacatatgaatgtgcttcttttgttattattatttttgggtactctgtctttatagtttctatactcagatctttttcatcctgagaaatgagaaatatttacaggatgttctactgaactcttattttgctgttttattttatatctatctactatatctttacgctttgtccatttgtcctatccatatgttagagctgctcttttgtcatgttttatcacctctctcttcacatgaacttggtgaggtgcctccaggcatcgctgactttgcattgtgtaattcactgcagctcattggtgtcctggtggtgttgagacattagtcttacagcttgcttctgccccggataacacagctaggtttagggtgttggccatttacttcctatgaggaaaatatacacatacacagacccatatctccctgccagtctgtttgatttagctacatgggaaactgaggagcttttggattgctttcaaatgctgctctctgcagtggtgcagtacccatactctcttcttctcgtccttctaaacccaggaacaagcatggggttcttgcagaggttccttcattcatttcccagtgatgctgcgttttctcaggaaagggaatcaaaggataatgccgcagcttacttcaatccttaacccactggtgttccttatttccagttgctaactgtgttgtaagggtcccaccccatcctcttttaaaatttatttgataaaagcaagaaggtcaggttaggtacttattattatattgtggccttaaccaaagtatatgacctttatttaaatatatatatactcacatacacacatgttcatatctatatctatatatttctagagggagagaaaaagagagggggtttattgatgaagaaagcaaaataaatcaacaagtggcacatctgaacttttgctttggctgtttgacaagcataataccagaacgttcagttttctcaattgcttcatctagctctctgatctcaatgcttaggataaaccttttctaggaattcaccaactgtctgatacaatttcaagtcccttccttgttagagtaaactgcagtaacaccaagatgaattttcaaaccagaattacaagtaccagaggtcttccccagcatcaagtgttactcatcagctcaagggcacaggtaatctcaaggctctggtgaagctgagagaggcccaggactgccagcaccacacaccaggttctttctggctgcaacaggatgctgtctgactccagagtaacagaagaagtctctaagggatgttcgcagcccccatcgcttacacaggaaggagctgcttcagtcatgagatagccccatttgacactctgatagctacataactgacatgaggttttcctgctgccctatcctgtaaagccatcgatttccaggacttgtttaccaaaagccatcaaaacggaccacgtgccatctgctaatggactgccctgctagtattagccaggagattggtatttgcacatttataagatctcactggatctctcttgttgaaagaagataagaaattccgagtctgctagaaagcattttcttgccataaatatatcaactttgttagacattcacttatgtcagttactaattcaaccacgttactgctatgtctagttcattagacaggtagtt

SEQ ID NO: 313 - DNA, 4047 bp, Homo sapiens
gtacgttcgattgactctggacaatttaaaaggaaattgatgttacgaatactacatatctttgaaggaaaaattgagcagtgacatctcaggacaggataggactcatgacggttctggggaatctcagaagtgggaacgcaaggacaattccttgggccatggctatcaggacgtctcactccatctgccatctgcccttgggtgacactggaaagaaagaatggggaggctgactgtggtttacacaggcattgcagtttgcaaatctgaaacctagaacagaacaatccttaaaagaaagaaaatcattatttttatttatgtcttgtctactttcaaaagttcattgaatgaatcacagtttttttgtcatctgatatgtactaattttgtaatctagatagtgtttactatgtgtgacttaactgtagtataattatattccatctaatgatatttccttggtgcaaacctattatttttgcaacattttctattttagcccaagacatacgattgatgtttaatgtccctgatctggtacctcatgttctatctgcatttaaagagtttgttattggtttttactatatgtaattaagaactagaatgtatctatttttatattcaacatttagacctaataatctgtgaaaaacacttaagactaaaattgtatgttttatataaatgattgttaaattcttatttttgtgaaaactgccttaactctcttccagataccataatgaaagaatgcaatgatagtggggatgataattataataatgtgttaaactctatcagcttccccagagaagtgaatctatatgtatgttgacaacaaaaatacatctcaaatctaattttggctggtttcactatggatagtcagtctccaaatctttaaaacaaaaatttacttggtattaatattaagcactgaagttaatccatgaggtcaggtgctgtagtaaatgttctgagggcataatggtggcttgtgatcttggaggaactctacgccaggatctgtggtcaaatcatggccacaagatcagccacatagcttaaagggatccaagttttcttttaattcttgttgtccttatattagttcttattttaagtcttttctttccatatttattattttcttttaggtatgttattgataggtatcatagaactaattttttgtttgtttgttttgtttgttgttttgttttgtttttgagacagagtctcactctgtcgcccaggctggagtgcagtggcacaatctcagctcactgcaaccttggcttcccgggttcaagtgattctcctgcctcagcctcccgagtagctgggattataggtgcccaccaccaagcccaactaatttttgtatttttagtagagatggggtttcaccatgttggtcaggctggtctcaagctcctgacctcaagtgatctgcccatctcgacctcccaaagtgctgggattacaggcgtgagccaccgtgcccagccaactaattgtttttttaactaatattagaataagtttacctctatttttatcgtaacacctgagattaccatctactttagttccattttgcattatccttgctcattctttctttcatatgctatgtggacaaagtgctttgcctgtacacttgaatgacctgcctggtcatatggatggataggttaggactgtagatattgctccattgtctttggacatttaatattatggaaaataggaagctaaacctttttccaccgctgaacatgatttactgttttattttgatttctggcagattgcttgtgatactttatctttaaaatacagacattttccagggatacatatgaatgtgcttcttttgttattattatttttgggtactctgtctttatagtttctatactcagatctttttcatcctgagaaatgagaaatatttacaggatgttctactgaactcttattttgctgttttattttatatctatctactatatctttacgctttgtccatttgtcctatccatatgttagagctgctcttttgtcatgttttatcacctctctcttcacatgaacttggtgaggtgcctccaggcatcgctgactttgcattgtgtaattcactgcagctcattggtgtcctggtggtgttgagacattagtcttacagcttgcttctgccccggataacacagctaggtttagggtgttggccatttacttcctatgaggaaaatatacacatacacagacccatatctccctgccagtctgtttgatttagctacatgggaaactgaggagcttttggattgctttcaaatgctgctctctgcagtggtgcagtacccatactctcttcttctcgtccttctaaacccaggaacaagcatggggttcttgcagaggttccttcattcatttcccagtgatgctgcgttttctcaggaaagggaatcaaaggataatgccgcagcttacttcaatccttaacccactggtgttccttatttccagttgctaactgtgttgtaagggtcccaccccatcctcttttaaaatttatttgataaaagcaagaaggtcaggttaggtacttattattatattgtggccttaaccaaagtatatgacctttatttaaatatatatatactcacatacacacatgttcatatctatatctatatatttctagagggagagaaaaagagagggggtttattgatgaagaaagcaaaataaatcaacaagtggcacatctgaacttttgctttggctgtttgacaagcataataccagaacgttcagttttctcaattgcttcatctagctctctgatctcaatgcttaggataaaccttttctaggaattcaccaactgtctgatacaatttcaagtcccttccttgttagagtaaactgcagtaacaccaagatgaattttcaaaccagaattacaagtaccagaggtcttccccagcatcaagtgttactcatcagctcaagggcacaggtaatctcaaggctctggtgaagctgagagaggcccaggactgccagcaccacacaccaggttctttctggctgcaacaggatgctgtctgactccagagtaacagaagaagtctctaagggatgttcgcagcccccatcgcttacacaggaaggagctgcttcagtcatgagatagccccatttgacactctgatagctacataactgacatgaggttttcctgctgccctatcctgtaaagccatcgatttccaggacttgtttaccaaaagccatcaaaacggaccacgtgccatctgctaatggactgccctgctagtattagccaggagattggtatttgcacatttataagatctcactggatctctcttgttgaaagaagataagaaattccgagtctgctagaaagcattttcttgccataaatatatcaactttgttagacattcacttatgtcagttactaattcaaccacgttactgctatgtctagttcattagacaggtagttagataagtgggagaacccacatgcattaaatgtagtttcttgttctaatgcagagtgatcaaccctaaaaatgacctgctaataatataaagtaaaatatctgtagagacattataaatatctacaattataatttgtgctgagctatttaaataaaagaacataaggattataaaccttgtcatatgggttacaaagcatttcaaagttactttcaacgaaattctaaagacagtgaagtcagatgattcttaattcagtagtcttttaatcaactctttaggcatggagtaattgattttgtctacagtagcttttatactaaatgctgttccttatttttgttttttctgctgagtaagatatcccttctgaagtttatgagatagagctgttagatgaaagagaagcctgaaatgttgactcatgtaatatccatgctctgctagatgaacttcttcctagagttttaaaagggaggt

SEQ ID NO: 314 - DNA, 4030 bp, Homo sapiens
aattcttatttttgtgaaaactgccttaactctcttccagataccataatgaaagaatgcaatgatagtggggatgataattataataatgtgttaaactctatcagcttccccagagaagtgaatctatatgtatgttgacaacaaaaatacatctcaaatctaattttggctggtttcactatggatagtcagtctccaaatctttaaaacaaaaatttacttggtattaatattaagcactgaagttaatccatgaggtcaggtgctgtagtaaatgttctgagggcataatggtggcttgtgatcttggaggaactctacgccaggatctgtggtcaaatcatggccacaagatcagccacatagcttaaagggatccaagttttcttttaattcttgttgtccttatattagttcttattttaagtcttttctttccatatttattattttcttttaggtatgttattgataggtatcatagaactaattttttgtttgtttgttttgtttgttgttttgttttgtttttgagacagagtctcactctgtcgcccaggctggagtgcagtggcacaatctcagctcactgcaaccttggcttcccgggttcaagtgattctcctgcctcagcctcccgagtagctgggattataggtgcccaccaccaagcccaactaatttttgtatttttagtagagatggggtttcaccatgttggtcaggctggtctcaagctcctgacctcaagtgatctgcccatctcgacctcccaaagtgctgggattacaggcgtgagccaccgtgcccagccaactaattgtttttttaactaatattagaataagtttacctctatttttatcgtaacacctgagattaccatctactttagttccattttgcattatccttgctcattctttctttcatatgctatgtggacaaagtgctttgcctgtacacttgaatgacctgcctggtcatatggatggataggttaggactgtagatattgctccattgtctttggacatttaatattatggaaaataggaagctaaacctttttccaccgctgaacatgatttactgttttattttgatttctggcagattgcttgtgatactttatctttaaaatacagacattttccagggatacatatgaatgtgcttcttttgttattattatttttgggtactctgtctttatagtttctatactcagatctttttcatcctgagaaatgagaaatatttacaggatgttctactgaactcttattttgctgttttattttatatctatctactatatctttacgctttgtccatttgtcctatccatatgttagagctgctcttttgtcatgttttatcacctctctcttcacatgaacttggtgaggtgcctccaggcatcgctgactttgcattgtgtaattcactgcagctcattggtgtcctggtggtgttgagacattagtcttacagcttgcttctgccccggataacacagctaggtttagggtgttggccatttacttcctatgaggaaaatatacacatacacagacccatatctccctgccagtctgtttgatttagctacatgggaaactgaggagcttttggattgctttcaaatgctgctctctgcagtggtgcagtacccatactctcttcttctcgtccttctaaacccaggaacaagcatggggttcttgcagaggttccttcattcatttcccagtgatgctgcgttttctcaggaaagggaatcaaaggataatgccgcagcttacttcaatccttaacccactggtgttccttatttccagttgctaactgtgttgtaagggtcccaccccatcctcttttaaaatttatttgataaaagcaagaaggtcaggttaggtacttattattatattgtggccttaaccaaagtatatgacctttatttaaatatatatatactcacatacacacatgttcatatctatatctatatatttctagagggagagaaaaagagagggggtttattgatgaagaaagcaaaataaatcaacaagtggcacatctgaacttttgctttggctgtttgacaagcataataccagaacgttcagttttctcaattgcttcatctagctctctgatctcaatgcttaggataaaccttttctaggaattcaccaactgtctgatacaatttcaagtcccttccttgttagagtaaactgcagtaacaccaagatgaattttcaaaccagaattacaagtaccagaggtcttccccagcatcaagtgttactcatcagctcaagggcacaggtaatctcaaggctctggtgaagctgagagaggcccaggactgccagcaccacacaccaggttctttctggctgcaacaggatgctgtctgactccagagtaacagaagaagtctctaagggatgttcgcagcccccatcgcttacacaggaaggagctgcttcagtcatgagatagccccatttgacactctgatagctacataactgacatgaggttttcctgctgccctatcctgtaaagccatcgatttccaggacttgtttaccaaaagccatcaaaacggaccacgtgccatctgctaatggactgccctgctagtattagccaggagattggtatttgcacatttataagatctcactggatctctcttgttgaaagaagataagaaattccgagtctgctagaaagcattttcttgccataaatatatcaactttgttagacattcacttatgtcagttactaattcaaccacgttactgctatgtctagttcattagacaggtagttagataagtgggagaacccacatgcattaaatgtagtttcttgttctaatgcagagtgatcaaccctaaaaatgacctgctaataatataaagtaaaatatctgtagagacattataaatatctacaattataatttgtgctgagctatttaaataaaagaacataaggattataaaccttgtcatatgggttacaaagcatttcaaagttactttcaacgaaattctaaagacagtgaagtcagatgattcttaattcagtagtcttttaatcaactctttaggcatggagtaattgattttgtctacagtagcttttatactaaatgctgttccttatttttgttttttctgctgagtaagatatcccttctgaagtttatgagatagagctgttagatgaaagagaagcctgaaatgttgactcatgtaatatccatgctctgctagatgaacttcttcctagagttttaaaagggaggtcatggagacactgagctctaagacaaacttggcccagccactatcctgtccatcattatttctacttcctttatgtccaaaaacatcaccatccagatgtgagcctctgggtctgtttcctttgtcttgctagggaagacgagcacgccctcatccagcagtattgccaaacactcggaggagagtccccagtgagccagccgcagagcccagctcagatcctgaagtcagtagagagggaagaacgtggagaactggagaggatcattgctgacctggaggaagaacaaaggtgtgctaggcctgggagaaggaaatatgtcatcctttcttttgtatgaatttcactgtagcccccatttattctctttttcaagactattgtctaagaaatctcagtggagtgaaaattttagaggctattaacaaactgggatgctggctgcaatacagcagcatttgggggttcattgatgatgtctactgggacacttgcttaaaactacaattttattcctgcatgctcatcctgctattaatacacatttttatataagaggaactagcatgagctaaatttgaacctcacagacgattttggagagacgataatgcacgtggtagtcattctgtttctccctctttctgtattagaaatctacaggtggagtatgagcagctgaagg

SEQ ID NO: 315 - DNA, 4047 bp, Homo sapiens
gggtgttggccatttacttcctatgaggaaaatatacacatacacagacccatatctccctgccagtctgtttgatttagctacatgggaaactgaggagcttttggattgctttcaaatgctgctctctgcagtggtgcagtacccatactctcttcttctcgtccttctaaacccaggaacaagcatggggttcttgcagaggttccttcattcatttcccagtgatgctgcgttttctcaggaaagggaatcaaaggataatgccgcagcttacttcaatccttaacccactggtgttccttatttccagttgctaactgtgttgtaagggtcccaccccatcctcttttaaaatttatttgataaaagcaagaaggtcaggttaggtacttattattatattgtggccttaaccaaagtatatgacctttatttaaatatatatatactcacatacacacatgttcatatctatatctatatatttctagagggagagaaaaagagagggggtttattgatgaagaaagcaaaataaatcaacaagtggcacatctgaacttttgctttggctgtttgacaagcataataccagaacgttcagttttctcaattgcttcatctagctctctgatctcaatgcttaggataaaccttttctaggaattcaccaactgtctgatacaatttcaagtcccttccttgttagagtaaactgcagtaacaccaagatgaattttcaaaccagaattacaagtaccagaggtcttccccagcatcaagtgttactcatcagctcaagggcacaggtaatctcaaggctctggtgaagctgagagaggcccaggactgccagcaccacacaccaggttctttctggctgcaacaggatgctgtctgactccagagtaacagaagaagtctctaagggatgttcgcagcccccatcgcttacacaggaaggagctgcttcagtcatgagatagccccatttgacactctgatagctacataactgacatgaggttttcctgctgccctatcctgtaaagccatcgatttccaggacttgtttaccaaaagccatcaaaacggaccacgtgccatctgctaatggactgccctgctagtattagccaggagattggtatttgcacatttataagatctcactggatctctcttgttgaaagaagataagaaattccgagtctgctagaaagcattttcttgccataaatatatcaactttgttagacattcacttatgtcagttactaattcaaccacgttactgctatgtctagttcattagacaggtagttagataagtgggagaacccacatgcattaaatgtagtttcttgttctaatgcagagtgatcaaccctaaaaatgacctgctaataatataaagtaaaatatctgtagagacattataaatatctacaattataatttgtgctgagctatttaaataaaagaacataaggattataaaccttgtcatatgggttacaaagcatttcaaagttactttcaacgaaattctaaagacagtgaagtcagatgattcttaattcagtagtcttttaatcaactctttaggcatggagtaattgattttgtctacagtagcttttatactaaatgctgttccttatttttgttttttctgctgagtaagatatcccttctgaagtttatgagatagagctgttagatgaaagagaagcctgaaatgttgactcatgtaatatccatgctctgctagatgaacttcttcctagagttttaaaagggaggtcatggagacactgagctctaagacaaacttggcccagccactatcctgtccatcattatttctacttcctttatgtccaaaaacatcaccatccagatgtgagcctctgggtctgtttcctttgtcttgctagggaagacgagcacgccctcatccagcagtattgccaaacactcggaggagagtccccagtgagccagccgcagagcccagctcagatcctgaagtcagtagagagggaagaacgtggagaactggagaggatcattgctgacctggaggaagaacaaaggtgtgctaggcctgggagaaggaaatatgtcatcctttcttttgtatgaatttcactgtagcccccatttattctctttttcaagactattgtctaagaaatctcagtggagtgaaaattttagaggctattaacaaactgggatgctggctgcaatacagcagcatttgggggttcattgatgatgtctactgggacacttgcttaaaactacaattttattcctgcatgctcatcctgctattaatacacatttttatataagaggaactagcatgagctaaatttgaacctcacagacgattttggagagacgataatgcacgtggtagtcattctgtttctccctctttctgtattagaaatctacaggtggagtatgagcagctgaaggaccagcacctccgaagggggctccctgtcggttcaccgccagagtcgattatatctccccatcacacgtctgaggattcagaacttatagcagaagcaaaactcctcaggcagcacaaaggtcggctggaggctaggatgcagattttagaagatcacaataaacagctggagtctcagctccaccgcctccgacagctgctggagcaggtagggtgtgtagaattcagcgtcacacctccccaggccatctgtccactgccctgggagatgatggtccaggtgtcaggagaggcagagaagtccactttcaatttcttacctccgtagttaattcagactggcttagaaatttccttttacatgtaagcatataaatcctcattggcacacaaaaatgtgtttgcccagcttacaatggaatttcccagtcttctttaacaatgaagtccgcctcagctctgaactgtttgagagaaaatatcctatgacatatatcttcctaaattatacatgggaagcatctgtattaaggaacagcaagagacctgaaatcggcattctaaagctttcttccagtgagacaagaatgctgactccaagaatcattattttctattctcaagaaattgagttaaagatggttattaatttgctactattatttcctaacactggaccatgttttatgggagttgcttgcaagctttctggatgataagaaatacaatttacattaagatgaatacatgcatgtatggagaatacaaaataatacttgcctttatagagaaatgccagctcttattttctattttccctttcttcctccctccctttcttccttctgtttttctttcttaatgctggtcaggacctactaaattgattctataactcatcggtgggttattgcattcagttttgaaaaacactgttctttgagatataaaagaagcatcaatacagtttctgcctttctggtgcctgccatcttgttagagatcacagcaagatactttcatatgtgaagacacagcacactgtagggaattaagtgcttgatggcacatagtagttaggaataggagtgatgtctcagaagtagtgatggagagacctttgcagcaggtgcagagagcgtagagtcccagcacaggggccaagagctcctctctcttgaagaatccctgacatcaacatgcatgtcatctttagtctttttctctagcctgtgctgtgtggagctcctatgtgatataataggagtgcctttctccagaaatgatttattgactcaaagcaggaacaactttctctccagtgattctctcaaattttagaaaactgccttttcacagttgctctcagtctttttaacttaccagaataattcaaaacagtgtcatttctgccttacctacacagaaatttgtgtaggcaattcataatttgaccatacacttttctctatgtctctcagtgtttcagaatttgggtgaggctgttcaatggaaggcttacttcagggcctctcaatcccacaatttgg

SEQ ID NO: 316 - DNA, 4115 bp, Homo sapiens
tcatatctatatctatatatttctagagggagagaaaaagagagggggtttattgatgaagaaagcaaaataaatcaacaagtggcacatctgaacttttgctttggctgtttgacaagcataataccagaacgttcagttttctcaattgcttcatctagctctctgatctcaatgcttaggataaaccttttctaggaattcaccaactgtctgatacaatttcaagtcccttccttgttagagtaaactgcagtaacaccaagatgaattttcaaaccagaattacaagtaccagaggtcttccccagcatcaagtgttactcatcagctcaagggcacaggtaatctcaaggctctggtgaagctgagagaggcccaggactgccagcaccacacaccaggttctttctggctgcaacaggatgctgtctgactccagagtaacagaagaagtctctaagggatgttcgcagcccccatcgcttacacaggaaggagctgcttcagtcatgagatagccccatttgacactctgatagctacataactgacatgaggttttcctgctgccctatcctgtaaagccatcgatttccaggacttgtttaccaaaagccatcaaaacggaccacgtgccatctgctaatggactgccctgctagtattagccaggagattggtatttgcacatttataagatctcactggatctctcttgttgaaagaagataagaaattccgagtctgctagaaagcattttcttgccataaatatatcaactttgttagacattcacttatgtcagttactaattcaaccacgttactgctatgtctagttcattagacaggtagttagataagtgggagaacccacatgcattaaatgtagtttcttgttctaatgcagagtgatcaaccctaaaaatgacctgctaataatataaagtaaaatatctgtagagacattataaatatctacaattataatttgtgctgagctatttaaataaaagaacataaggattataaaccttgtcatatgggttacaaagcatttcaaagttactttcaacgaaattctaaagacagtgaagtcagatgattcttaattcagtagtcttttaatcaactctttaggcatggagtaattgattttgtctacagtagcttttatactaaatgctgttccttatttttgttttttctgctgagtaagatatcccttctgaagtttatgagatagagctgttagatgaaagagaagcctgaaatgttgactcatgtaatatccatgctctgctagatgaacttcttcctagagttttaaaagggaggtcatggagacactgagctctaagacaaacttggcccagccactatcctgtccatcattatttctacttcctttatgtccaaaaacatcaccatccagatgtgagcctctgggtctgtttcctttgtcttgctagggaagacgagcacgccctcatccagcagtattgccaaacactcggaggagagtccccagtgagccagccgcagagcccagctcagatcctgaagtcagtagagagggaagaacgtggagaactggagaggatcattgctgacctggaggaagaacaaaggtgtgctaggcctgggagaaggaaatatgtcatcctttcttttgtatgaatttcactgtagcccccatttattctctttttcaagactattgtctaagaaatctcagtggagtgaaaattttagaggctattaacaaactgggatgctggctgcaatacagcagcatttgggggttcattgatgatgtctactgggacacttgcttaaaactacaattttattcctgcatgctcatcctgctattaatacacatttttatataagaggaactagcatgagctaaatttgaacctcacagacgattttggagagacgataatgcacgtggtagtcattctgtttctccctctttctgtattagaaatctacaggtggagtatgagcagctgaaggaccagcacctccgaagggggctccctgtcggttcaccgccagagtcgattatatctccccatcacacgtctgaggattcagaacttatagcagaagcaaaactcctcaggcagcacaaaggtcggctggaggctaggatgcagattttagaagatcacaataaacagctggagtctcagctccaccgcctccgacagctgctggagcaggtagggtgtgtagaattcagcgtcacacctccccaggccatctgtccactgccctgggagatgatggtccaggtgtcaggagaggcagagaagtccactttcaatttcttacctccgtagttaattcagactggcttagaaatttccttttacatgtaagcatataaatcctcattggcacacaaaaatgtgtttgcccagcttacaatggaatttcccagtcttctttaacaatgaagtccgcctcagctctgaactgtttgagagaaaatatcctatgacatatatcttcctaaattatacatgggaagcatctgtattaaggaacagcaagagacctgaaatcggcattctaaagctttcttccagtgagacaagaatgctgactccaagaatcattattttctattctcaagaaattgagttaaagatggttattaatttgctactattatttcctaacactggaccatgttttatgggagttgcttgcaagctttctggatgataagaaatacaatttacattaagatgaatacatgcatgtatggagaatacaaaataatacttgcctttatagagaaatgccagctcttattttctattttccctttcttcctccctccctttcttccttctgtttttctttcttaatgctggtcaggacctactaaattgattctataactcatcggtgggttattgcattcagttttgaaaaacactgttctttgagatataaaagaagcatcaatacagtttctgcctttctggtgcctgccatcttgttagagatcacagcaagatactttcatatgtgaagacacagcacactgtagggaattaagtgcttgatggcacatagtagttaggaataggagtgatgtctcagaagtagtgatggagagacctttgcagcaggtgcagagagcgtagagtcccagcacaggggccaagagctcctctctcttgaagaatccctgacatcaacatgcatgtcatctttagtctttttctctagcctgtgctgtgtggagctcctatgtgatataataggagtgcctttctccagaaatgatttattgactcaaagcaggaacaactttctctccagtgattctctcaaattttagaaaactgccttttcacagttgctctcagtctttttaacttaccagaataattcaaaacagtgtcatttctgccttacctacacagaaatttgtgtaggcaattcataatttgaccatacacttttctctatgtctctcagtgtttcagaatttgggtgaggctgttcaatggaaggcttacttcagggcctctcaatcccacaatttggaaagtaagagtttcccaagagtgacccaagacgtgggtttcttgaagcccttcggaatgtttgagtcttacttagtgccagccacatacattgaaaacgttacatttttcattccgcgaacttgaagtttccaaatggtgctgtgtaagggatggattttctcttgcaatctcttgtttagaatatgaagtgttagtgttaacaacttagtgcataggtggaattgctacagaaggaagctgtgctcaaaacctttatttgccatggctggttgatgcccacaggagagcaaaaggcttttctgttcacccttgccttcccctactccctccatcccattagacagtgctgcctgatggctcatgtgccttgagaatcacatagcaatgcttttagagatagctaatatccaaatggcttctatatccaagactgcagagctcttatctcttctaaacaatttaggatgatgaatgctagaagtagatggaaaattcaactctaatagtaaaaactagcagaactaccaggcttca

SEQ ID NO: 317 - DNA, 4055 bp, Homo sapiens
ccagaacgttcagttttctcaattgcttcatctagctctctgatctcaatgcttaggataaaccttttctaggaattcaccaactgtctgatacaatttcaagtcccttccttgttagagtaaactgcagtaacaccaagatgaattttcaaaccagaattacaagtaccagaggtcttccccagcatcaagtgttactcatcagctcaagggcacaggtaatctcaaggctctggtgaagctgagagaggcccaggactgccagcaccacacaccaggttctttctggctgcaacaggatgctgtctgactccagagtaacagaagaagtctctaagggatgttcgcagcccccatcgcttacacaggaaggagctgcttcagtcatgagatagccccatttgacactctgatagctacataactgacatgaggttttcctgctgccctatcctgtaaagccatcgatttccaggacttgtttaccaaaagccatcaaaacggaccacgtgccatctgctaatggactgccctgctagtattagccaggagattggtatttgcacatttataagatctcactggatctctcttgttgaaagaagataagaaattccgagtctgctagaaagcattttcttgccataaatatatcaactttgttagacattcacttatgtcagttactaattcaaccacgttactgctatgtctagttcattagacaggtagttagataagtgggagaacccacatgcattaaatgtagtttcttgttctaatgcagagtgatcaaccctaaaaatgacctgctaataatataaagtaaaatatctgtagagacattataaatatctacaattataatttgtgctgagctatttaaataaaagaacataaggattataaaccttgtcatatgggttacaaagcatttcaaagttactttcaacgaaattctaaagacagtgaagtcagatgattcttaattcagtagtcttttaatcaactctttaggcatggagtaattgattttgtctacagtagcttttatactaaatgctgttccttatttttgttttttctgctgagtaagatatcccttctgaagtttatgagatagagctgttagatgaaagagaagcctgaaatgttgactcatgtaatatccatgctctgctagatgaacttcttcctagagttttaaaagggaggtcatggagacactgagctctaagacaaacttggcccagccactatcctgtccatcattatttctacttcctttatgtccaaaaacatcaccatccagatgtgagcctctgggtctgtttcctttgtcttgctagggaagacgagcacgccctcatccagcagtattgccaaacactcggaggagagtccccagtgagccagccgcagagcccagctcagatcctgaagtcagtagagagggaagaacgtggagaactggagaggatcattgctgacctggaggaagaacaaaggtgtgctaggcctgggagaaggaaatatgtcatcctttcttttgtatgaatttcactgtagcccccatttattctctttttcaagactattgtctaagaaatctcagtggagtgaaaattttagaggctattaacaaactgggatgctggctgcaatacagcagcatttgggggttcattgatgatgtctactgggacacttgcttaaaactacaattttattcctgcatgctcatcctgctattaatacacatttttatataagaggaactagcatgagctaaatttgaacctcacagacgattttggagagacgataatgcacgtggtagtcattctgtttctccctctttctgtattagaaatctacaggtggagtatgagcagctgaaggaccagcacctccgaagggggctccctgtcggttcaccgccagagtcgattatatctccccatcacacgtctgaggattcagaacttatagcagaagcaaaactcctcaggcagcacaaaggtcggctggaggctaggatgcagattttagaagatcacaataaacagctggagtctcagctccaccgcctccgacagctgctggagcaggtagggtgtgtagaattcagcgtcacacctccccaggccatctgtccactgccctgggagatgatggtccaggtgtcaggagaggcagagaagtccactttcaatttcttacctccgtagttaattcagactggcttagaaatttccttttacatgtaagcatataaatcctcattggcacacaaaaatgtgtttgcccagcttacaatggaatttcccagtcttctttaacaatgaagtccgcctcagctctgaactgtttgagagaaaatatcctatgacatatatcttcctaaattatacatgggaagcatctgtattaaggaacagcaagagacctgaaatcggcattctaaagctttcttccagtgagacaagaatgctgactccaagaatcattattttctattctcaagaaattgagttaaagatggttattaatttgctactattatttcctaacactggaccatgttttatgggagttgcttgcaagctttctggatgataagaaatacaatttacattaagatgaatacatgcatgtatggagaatacaaaataatacttgcctttatagagaaatgccagctcttattttctattttccctttcttcctccctccctttcttccttctgtttttctttcttaatgctggtcaggacctactaaattgattctataactcatcggtgggttattgcattcagttttgaaaaacactgttctttgagatataaaagaagcatcaatacagtttctgcctttctggtgcctgccatcttgttagagatcacagcaagatactttcatatgtgaagacacagcacactgtagggaattaagtgcttgatggcacatagtagttaggaataggagtgatgtctcagaagtagtgatggagagacctttgcagcaggtgcagagagcgtagagtcccagcacaggggccaagagctcctctctcttgaagaatccctgacatcaacatgcatgtcatctttagtctttttctctagcctgtgctgtgtggagctcctatgtgatataataggagtgcctttctccagaaatgatttattgactcaaagcaggaacaactttctctccagtgattctctcaaattttagaaaactgccttttcacagttgctctcagtctttttaacttaccagaataattcaaaacagtgtcatttctgccttacctacacagaaatttgtgtaggcaattcataatttgaccatacacttttctctatgtctctcagtgtttcagaatttgggtgaggctgttcaatggaaggcttacttcagggcctctcaatcccacaatttggaaagtaagagtttcccaagagtgacccaagacgtgggtttcttgaagcccttcggaatgtttgagtcttacttagtgccagccacatacattgaaaacgttacatttttcattccgcgaacttgaagtttccaaatggtgctgtgtaagggatggattttctcttgcaatctcttgtttagaatatgaagtgttagtgttaacaacttagtgcataggtggaattgctacagaaggaagctgtgctcaaaacctttatttgccatggctggttgatgcccacaggagagcaaaaggcttttctgttcacccttgccttcccctactccctccatcccattagacagtgctgcctgatggctcatgtgccttgagaatcacatagcaatgcttttagagatagctaatatccaaatggcttctatatccaagactgcagagctcttatctcttctaaacaatttaggatgatgaatgctagaagtagatggaaaattcaactctaatagtaaaaactagcagaactaccaggcttcaactaatatagatttaatggaaaaatctgcatgaaaaacttgtaacatctgcattccctatatgatg

SEQ ID NO: 318 - DNA, 4045 bp, Homo sapiens
ggatctctcttgttgaaagaagataagaaattccgagtctgctagaaagcattttcttgccataaatatatcaactttgttagacattcacttatgtcagttactaattcaaccacgttactgctatgtctagttcattagacaggtagttagataagtgggagaacccacatgcattaaatgtagtttcttgttctaatgcagagtgatcaaccctaaaaatgacctgctaataatataaagtaaaatatctgtagagacattataaatatctacaattataatttgtgctgagctatttaaataaaagaacataaggattataaaccttgtcatatgggttacaaagcatttcaaagttactttcaacgaaattctaaagacagtgaagtcagatgattcttaattcagtagtcttttaatcaactctttaggcatggagtaattgattttgtctacagtagcttttatactaaatgctgttccttatttttgttttttctgctgagtaagatatcccttctgaagtttatgagatagagctgttagatgaaagagaagcctgaaatgttgactcatgtaatatccatgctctgctagatgaacttcttcctagagttttaaaagggaggtcatggagacactgagctctaagacaaacttggcccagccactatcctgtccatcattatttctacttcctttatgtccaaaaacatcaccatccagatgtgagcctctgggtctgtttcctttgtcttgctagggaagacgagcacgccctcatccagcagtattgccaaacactcggaggagagtccccagtgagccagccgcagagcccagctcagatcctgaagtcagtagagagggaagaacgtggagaactggagaggatcattgctgacctggaggaagaacaaaggtgtgctaggcctgggagaaggaaatatgtcatcctttcttttgtatgaatttcactgtagcccccatttattctctttttcaagactattgtctaagaaatctcagtggagtgaaaattttagaggctattaacaaactgggatgctggctgcaatacagcagcatttgggggttcattgatgatgtctactgggacacttgcttaaaactacaattttattcctgcatgctcatcctgctattaatacacatttttatataagaggaactagcatgagctaaatttgaacctcacagacgattttggagagacgataatgcacgtggtagtcattctgtttctccctctttctgtattagaaatctacaggtggagtatgagcagctgaaggaccagcacctccgaagggggctccctgtcggttcaccgccagagtcgattatatctccccatcacacgtctgaggattcagaacttatagcagaagcaaaactcctcaggcagcacaaaggtcggctggaggctaggatgcagattttagaagatcacaataaacagctggagtctcagctccaccgcctccgacagctgctggagcaggtagggtgtgtagaattcagcgtcacacctccccaggccatctgtccactgccctgggagatgatggtccaggtgtcaggagaggcagagaagtccactttcaatttcttacctccgtagttaattcagactggcttagaaatttccttttacatgtaagcatataaatcctcattggcacacaaaaatgtgtttgcccagcttacaatggaatttcccagtcttctttaacaatgaagtccgcctcagctctgaactgtttgagagaaaatatcctatgacatatatcttcctaaattatacatgggaagcatctgtattaaggaacagcaagagacctgaaatcggcattctaaagctttcttccagtgagacaagaatgctgactccaagaatcattattttctattctcaagaaattgagttaaagatggttattaatttgctactattatttcctaacactggaccatgttttatgggagttgcttgcaagctttctggatgataagaaatacaatttacattaagatgaatacatgcatgtatggagaatacaaaataatacttgcctttatagagaaatgccagctcttattttctattttccctttcttcctccctccctttcttccttctgtttttctttcttaatgctggtcaggacctactaaattgattctataactcatcggtgggttattgcattcagttttgaaaaacactgttctttgagatataaaagaagcatcaatacagtttctgcctttctggtgcctgccatcttgttagagatcacagcaagatactttcatatgtgaagacacagcacactgtagggaattaagtgcttgatggcacatagtagttaggaataggagtgatgtctcagaagtagtgatggagagacctttgcagcaggtgcagagagcgtagagtcccagcacaggggccaagagctcctctctcttgaagaatccctgacatcaacatgcatgtcatctttagtctttttctctagcctgtgctgtgtggagctcctatgtgatataataggagtgcctttctccagaaatgatttattgactcaaagcaggaacaactttctctccagtgattctctcaaattttagaaaactgccttttcacagttgctctcagtctttttaacttaccagaataattcaaaacagtgtcatttctgccttacctacacagaaatttgtgtaggcaattcataatttgaccatacacttttctctatgtctctcagtgtttcagaatttgggtgaggctgttcaatggaaggcttacttcagggcctctcaatcccacaatttggaaagtaagagtttcccaagagtgacccaagacgtgggtttcttgaagcccttcggaatgtttgagtcttacttagtgccagccacatacattgaaaacgttacatttttcattccgcgaacttgaagtttccaaatggtgctgtgtaagggatggattttctcttgcaatctcttgtttagaatatgaagtgttagtgttaacaacttagtgcataggtggaattgctacagaaggaagctgtgctcaaaacctttatttgccatggctggttgatgcccacaggagagcaaaaggcttttctgttcacccttgccttcccctactccctccatcccattagacagtgctgcctgatggctcatgtgccttgagaatcacatagcaatgcttttagagatagctaatatccaaatggcttctatatccaagactgcagagctcttatctcttctaaacaatttaggatgatgaatgctagaagtagatggaaaattcaactctaatagtaaaaactagcagaactaccaggcttcaactaatatagatttaatggaaaaatctgcatgaaaaacttgtaacatctgcattccctatatgatggctcacactttctaatttgaccatatatttgtcagcgtatccatattgaagatttgcgtgagtgcctttacgaagtatttactaagtgtcaggctgttctaaccattttagaaatagtcattcttcactcccctcacaaaactctataacacagcactattattaccctccccattttacaaataaagaactgaaagcatggaaggttctacagttttcccagaattacacagcttatgagtggcagagtgggaattagaatccaggcaatctgaatccataatcatgcttctaatcactctctcaatattgccttggagtatgagctgattttgaaattggataaatttactgtattagaaacccagtgctgatgtttaaaatatgagtgaactatgcttatgaattcacttaacattaaaacaacagaaaaattgagggataaaaatggtgttgataaatgagtctggcagcataaccaagtggattcttcaaggtgtccaagcggaaagagaaggaccaaagcccccaccaagctgatgctaaaatgtatggaaaacatctgaaggcaaa

SEQ ID NO: 319 - DNA, 4053 bp, Homo sapiens
ttctataactcatcggtgggttattgcattcagttttgaaaaacactgttctttgagatataaaagaagcatcaatacagtttctgcctttctggtgcctgccatcttgttagagatcacagcaagatactttcatatgtgaagacacagcacactgtagggaattaagtgcttgatggcacatagtagttaggaataggagtgatgtctcagaagtagtgatggagagacctttgcagcaggtgcagagagcgtagagtcccagcacaggggccaagagctcctctctcttgaagaatccctgacatcaacatgcatgtcatctttagtctttttctctagcctgtgctgtgtggagctcctatgtgatataataggagtgcctttctccagaaatgatttattgactcaaagcaggaacaactttctctccagtgattctctcaaattttagaaaactgccttttcacagttgctctcagtctttttaacttaccagaataattcaaaacagtgtcatttctgccttacctacacagaaatttgtgtaggcaattcataatttgaccatacacttttctctatgtctctcagtgtttcagaatttgggtgaggctgttcaatggaaggcttacttcagggcctctcaatcccacaatttggaaagtaagagtttcccaagagtgacccaagacgtgggtttcttgaagcccttcggaatgtttgagtcttacttagtgccagccacatacattgaaaacgttacatttttcattccgcgaacttgaagtttccaaatggtgctgtgtaagggatggattttctcttgcaatctcttgtttagaatatgaagtgttagtgttaacaacttagtgcataggtggaattgctacagaaggaagctgtgctcaaaacctttatttgccatggctggttgatgcccacaggagagcaaaaggcttttctgttcacccttgccttcccctactccctccatcccattagacagtgctgcctgatggctcatgtgccttgagaatcacatagcaatgcttttagagatagctaatatccaaatggcttctatatccaagactgcagagctcttatctcttctaaacaatttaggatgatgaatgctagaagtagatggaaaattcaactctaatagtaaaaactagcagaactaccaggcttcaactaatatagatttaatggaaaaatctgcatgaaaaacttgtaacatctgcattccctatatgatggctcacactttctaatttgaccatatatttgtcagcgtatccatattgaagatttgcgtgagtgcctttacgaagtatttactaagtgtcaggctgttctaaccattttagaaatagtcattcttcactcccctcacaaaactctataacacagcactattattaccctccccattttacaaataaagaactgaaagcatggaaggttctacagttttcccagaattacacagcttatgagtggcagagtgggaattagaatccaggcaatctgaatccataatcatgcttctaatcactctctcaatattgccttggagtatgagctgattttgaaattggataaatttactgtattagaaacccagtgctgatgtttaaaatatgagtgaactatgcttatgaattcacttaacattaaaacaacagaaaaattgagggataaaaatggtgttgataaatgagtctggcagcataaccaagtggattcttcaaggtgtccaagcggaaagagaaggaccaaagcccccaccaagctgatgctaaaatgtatggaaaacatctgaaggcaaagacttctatatgatttaattatccatggtgagggcggggaagttaaaaaggaaatgtttttccttatgattatttgaatcctttctctgctttaacctctgaatgtggttccagcctgaatctgattcccgaatcaatggtgtttccccatgggcttctcctcagcattctgcactgagctactcgcttgatccagatgcctccggcccacagttccaccaggcaggtcggtgtccccagcacacagctcctctgctgagtctgctttgtgctttgccattagtttgtgtttcctgttaagtaacattcctacacactggtgccttaggaagtaaaagagttttttgtatttggtcttaaataggtgcaaatccatttcaacaatatcaaaaagcaaacattttcaaataagctataatacacttgtttatataatctgtagaagtggattgaagtttggatgaaaaagcctcctctgccctttagaatgagcaagaaattaaattatttgcttatgaatgatttttttagtacactttctgtctctaaaatgttacattggtgcatattcaggactaataatattacaccaaacattatggttgtatctgccaaggtgtggaaactcatttattcacttttcttcgtcctagtccacttagacattgtcttgcctgtcccatcagaggcagcggtcccacgcagcctgtccttggtcacaatggggacctgtcactgatgctaggaaggactcagtaaactaggtgttaaccaatgacattttgttatcaattaaattaaaattctagaattttactgagaacgatatattgtaaccaaattaatttcttggtgggatatcttttggtacattaaccagaaaaaaattaaaatattagctggatgcagtggctcccgcctgtaatcccagctctttgggaggccatggtgaaaccccatctctactaaaaatacaaaaattagccaggcgtggtggagcactcctgtagtcccagctactcgggaggctgaggcaggagaattgctggaacctgggaggcggaggttgcagtgagccgagatcgcaccaatgcactccagcctggtgacggaggctccatctcaaaaaatatatatattaaaatattaagattattttcatattttttaaataagagaactatcttgactatggattataggataaaaaacacatcctagtgaaaagtatcttaaataagatgcctttacttttgtggcaggataagctggcctaagctgaagtctccaaaaagaaaggaggacagaaaaagaaattggtgaaattttttttgtatgaaaacatacctgtggtgcaaaaataatagatttctcattcaaacactgaaataataagaccatattacttgtttttcagtctcatatttttcagtcccctggtgtgtggattctttctacacaaacaaacagctagtacgtgtcaattatgtaaaattatattaccaacactcaagcaaaaatgttttgggtatattcccctaaaattgtcctttgcaatgggaaatcttttcacattgatatttagaggctggttggagtatttcctcctgaatttgggttttagtggaaggctagacattaatttgagaagctttgttgttctctttatttgctgtcacagcgggagaggacctgctggccccaccgcacgacaccagcacggatctcacggaggtcatggagcagattcacagcacgtttccatcttgctgccgtgagtatgaaagattgcagcaccacagctgcacgtgttccttccctttctctttttctgcatgcggcccttcgccttcttccttaagataacaaaaaccttattacaaacaggactgaatattatttgaaaataaggcaaacattatataagaaaatgaagctcaacctagatactatcaagtaacgggggtacagtcgcaacgcaattctgctctttgagatttttcaatatgcctgatgggtgataaaatgaaagcaaataaaataataagtctggttttaagaagaaattatcctcttcgatgcaagctatcataaggaacacatcttagttcaaagaagagctttcagtggcatgccaaacaaggcatggaaacagcctttctagtgtaattccctctcttttcttcaaacattgttctccaatgtcatcagactc

SEQ ID NO: 320 - DNA, 4046 bp, Homo sapiens
atccaggcaatctgaatccataatcatgcttctaatcactctctcaatattgccttggagtatgagctgattttgaaattggataaatttactgtattagaaacccagtgctgatgtttaaaatatgagtgaactatgcttatgaattcacttaacattaaaacaacagaaaaattgagggataaaaatggtgttgataaatgagtctggcagcataaccaagtggattcttcaaggtgtccaagcggaaagagaaggaccaaagcccccaccaagctgatgctaaaatgtatggaaaacatctgaaggcaaagacttctatatgatttaattatccatggtgagggcggggaagttaaaaaggaaatgtttttccttatgattatttgaatcctttctctgctttaacctctgaatgtggttccagcctgaatctgattcccgaatcaatggtgtttccccatgggcttctcctcagcattctgcactgagctactcgcttgatccagatgcctccggcccacagttccaccaggcaggtcggtgtccccagcacacagctcctctgctgagtctgctttgtgctttgccattagtttgtgtttcctgttaagtaacattcctacacactggtgccttaggaagtaaaagagttttttgtatttggtcttaaataggtgcaaatccatttcaacaatatcaaaaagcaaacattttcaaataagctataatacacttgtttatataatctgtagaagtggattgaagtttggatgaaaaagcctcctctgccctttagaatgagcaagaaattaaattatttgcttatgaatgatttttttagtacactttctgtctctaaaatgttacattggtgcatattcaggactaataatattacaccaaacattatggttgtatctgccaaggtgtggaaactcatttattcacttttcttcgtcctagtccacttagacattgtcttgcctgtcccatcagaggcagcggtcccacgcagcctgtccttggtcacaatggggacctgtcactgatgctaggaaggactcagtaaactaggtgttaaccaatgacattttgttatcaattaaattaaaattctagaattttactgagaacgatatattgtaaccaaattaatttcttggtgggatatcttttggtacattaaccagaaaaaaattaaaatattagctggatgcagtggctcccgcctgtaatcccagctctttgggaggccatggtgaaaccccatctctactaaaaatacaaaaattagccaggcgtggtggagcactcctgtagtcccagctactcgggaggctgaggcaggagaattgctggaacctgggaggcggaggttgcagtgagccgagatcgcaccaatgcactccagcctggtgacggaggctccatctcaaaaaatatatatattaaaatattaagattattttcatattttttaaataagagaactatcttgactatggattataggataaaaaacacatcctagtgaaaagtatcttaaataagatgcctttacttttgtggcaggataagctggcctaagctgaagtctccaaaaagaaaggaggacagaaaaagaaattggtgaaattttttttgtatgaaaacatacctgtggtgcaaaaataatagatttctcattcaaacactgaaataataagaccatattacttgtttttcagtctcatatttttcagtcccctggtgtgtggattctttctacacaaacaaacagctagtacgtgtcaattatgtaaaattatattaccaacactcaagcaaaaatgttttgggtatattcccctaaaattgtcctttgcaatgggaaatcttttcacattgatatttagaggctggttggagtatttcctcctgaatttgggttttagtggaaggctagacattaatttgagaagctttgttgttctctttatttgctgtcacagcgggagaggacctgctggccccaccgcacgacaccagcacggatctcacggaggtcatggagcagattcacagcacgtttccatcttgctgccgtgagtatgaaagattgcagcaccacagctgcacgtgttccttccctttctctttttctgcatgcggcccttcgccttcttccttaagataacaaaaaccttattacaaacaggactgaatattatttgaaaataaggcaaacattatataagaaaatgaagctcaacctagatactatcaagtaacgggggtacagtcgcaacgcaattctgctctttgagatttttcaatatgcctgatgggtgataaaatgaaagcaaataaaataataagtctggttttaagaagaaattatcctcttcgatgcaagctatcataaggaacacatcttagttcaaagaagagctttcagtggcatgccaaacaaggcatggaaacagcctttctagtgtaattccctctcttttcttcaaacattgttctccaatgtcatcagactccagtgcagaaagggattgttttcagattttccctttttattcccgctggtttcttttctcatggaataaaatagtcattgtataaaggccaaacaatttaagtcatcatagattaggatcctgtgaagtttccatctgaacaaccaagagccagaaaataaccaaattcctggggaaattatataataattcttacttattcattttttccaagtgttttgtcttcagcaccttgccaccttgcaattttggctgagctctcacctaaaacacttctggtgtttctagcagaatatatacatacaagtaaactgtatatatgtatacatatatatacacacacacatacaaatatataaatgcatataaattacttagtactataattatattttaaataatctttgacaggatttgaagacattatttgtaattttagagagatttactctcaaactgattttaaatccagggcagtcactaaaataagaattcatgtaaagcatagcctcttattttacccttgtctgtcatctccttagaaaatgccatcccaggctgggcacggtggctcacacctataatcccagcactttgggagggcgaggcaggtggatcatgagatcaggagttcgagaccagtctgaccaacatggtgaaaccctgtcgctactaaaaatacaaaaagtagccgggcatggtggcatgcacttgtaatcccagcaactcaggaggttgaggcaggagaatcgcttgaacctgggaggtagaggttgcaatgagccgagatcgtgccaccgcactccagcctgggagacagcgtgagacttcctctccaaaaaaaaaaaaaaaaaaaaaaaagccatccgaaatgatgaaaaagagattatcaattatcaggagtgtaggtaaataagatatattgacttcatttaaagattattatttactgtatagaactttgtaatttttaaaataccatcattagcagaatgtgaaaacagctatttaaaatatatttctggcccaggtgcggtggctcatgcctgtaattccagcattttggcaggctgaggcaggtggatcacttgaggtcaggagtttgagaccagcctgattaacatggcaaaaccctatctctactaaaaataccaaaaaaattttccaggtatggtggcacaagcctgtagttgtagtcctacctacttgggaggctgaggcatgagaatcgcttgaacctgggaggctgaagttgcagtgagttgagatcatgccactgcacttcagcctgggcaacagagactctatctcaaaacaacaacaacaacaaaataaatgaataaataaaacatatatttctttgtgaattttcaggaatatttgcctgaagattatattatggtttccaccagcacatgaatatatctatttgtgttttgccagtgtttcccaggttttcatttgtagatctactataatgcttctcaaagtttgcagaatcacatttacactacatca

SEQ ID NO: 321 - DNA, 4044 bp, Homo sapiens
ttcaagaattcaagcacatccatgtatgaaatgatgaaaagtgtattttagaatcctttgaaatctccatgttttaatttttggcttctgaaagttctgctattcatattttttctctggtattatatacaagacagggacagctttccataaaaataaaagctgtattgacttatttataaaattgatacatattttcatattctgcctgtaattattaaaccttttaaaaattgatgcaaaatagaaatcagcgtgggaggtagactcagtgcccagtgcatgtgtctttctctctcttttttttttttttctgagacagagactcactctgttgcccaggctggagttcaatggcacgatctcaggtctgtataacctccacctcccaggctcaagcaattctcatgcctcagcctcccaagtagctgggactacaggcacatgccaccacgcccaactaatttttgtatttttagtagagatcgggtttcaccatgttggccaggctggtctcaaactcctggcctcaagtgacccacccaccctggcctcccaaaccgctgggattacacgcgtgagccaccacacccggccccaatacatgtttctgacttgagtgaatgattacattttctagctgggaaggtttccttgtagcattcctagatagtactcagaacgttttgtaggattcatttgttcttttgtccctttaaagttgctcagccagcaaatattttaataagcctttgtgattcccaaagcttaccaaccacctttggagaatttatctaaacaaatcggattggcaccctcccaatgccaagccaatcccttgagcccctgtaactaatgagaactttaaaaatgcttgtcgccagcatacaatgaattgatcttcatgttaatcttgacttttgatcctttgtggattaaaaattagcatggccccaaatgaatttccactcttggcaatcttggaattaaaatgaaactctgtattcataaatcctaattgtgtgaattgcctattttaacatgaccgttttttaactgtgtctacacattgttgcacataacactttagaactcctttgtctgaattaatatcccagttggtcctgatagcatccttgaattatggccttttaaagtctttttaaaattatttatgttgagtcttagagcagagaagcagacatttccttcacttcctggcaaggagttaaggaaaggggtttaaatgtactgccaattaacaagtgtacttactaaaattcccactgactgcagtaactatttttattttttggtataaattttttttgtccattttttacttatgtccttcaaatgtatgaaatactggcagtaagccaactaatttttgctgatagaccaagaaatgctttcaaaattatttttgacccacaggcatatttttactatgaattgcctatgtttattaagcttgaatggcattcatcaaaaacccaaaacccactgcaatgcagtgatttcctttttaaaatatttttgtgtgatttgttcaggcaaatacccatagccttttatttgataaaaggctgtaaggttaaaagtattggtttagagcaaaatggattagacttctgtctagggtttggctatttgttatatttgttacttgcaagagaagcataactctgtctgttttaaaaagagtgtgtaaacctatggtgtacttaataataattcaactcagctatcccttggacactgtggaggtccactcttttctcctggatgtaacttacagatctgttagaactaggcttcttttagcctgatttctcccccaaataccgggcctcacactttccctccagacgttataggaagggtactcttcatgcctgctctttttttctcacatagctcccagcacacagcacatggtcactgatgtcctttctcccactcagcatagaacagtgagagatggaaggagtgcagcatgctagatgactagggacaacttttatttgaccaagaacagattgttgccattactgggggacagatctcctcttttccccccagcattgagaacgagatgatcatgtagcaaaagaggggacgaaaagcagatgccttagagaagagatggcagtggctgcccttgcaaagcccgccagatcgtcttcactgttatgggctctggaaccaaaaaggaattgagctatctgtgtggaaaggagaattagatgccatattctaacttctccgttgttcctaactgggcccatccaagggactattattatcccaagtgtccagaaggacactgaggattaggccagcactttccttgatgcaagtacttggccaccattttcctgggcgttagggtccagggtgtgtcaagggtgggtcaagagaggcagaaaccaaagacttatgccttcagtggtcccttggtcagaattagtactcagcaaagtaagtagaacatgctctgttctgatacataaaccaaatacacagtatgatttaaataggaaatgagattttttgcaagactaagtgctcagtgaatgctttagtgtatgcactaaatcttaaatcacatgggatatgagaaactaaccaggaaaactagccctcattgaagcattaagccaggaaaaaaaaaatgtgtttcttgtttttcctattagcatccatttaacaactgggctattattaccctatgtagagtgatactttccacgcatttgcatgcctgagagttggaaccaacaaagtaacaggactgccattaagtgatttcttttgttttctctttcagcaaatgttcccagcaggccacaggtaagagttaatggcttggttggctctatgttactgatcccaacctagagtaagcagattatccacgactgattttattcctactttattctccatgtaaataagtaaacttacttgacatttaaatgttagttgattctgtacaacagtttgtcagtctgggagtggggggtggctcccaagccacagataccaaaaataccatgtgtttgatcctttgtgttctaacagctttttaatggcatcttatgtgctacataaagtcactctagatagatttgaccaccactgctctctcaaatgtctacttaaggtggctatcacagaacattgacctaaaaaaaaaatgactggtaccacagaggtggttttgttactttgcaggggaaaatatttcaattttttacttaaaaattttgctgagaactgttggcagctgtacccttatgccttttagtattttctataaaccaaaaagtgtatgagacaggtttactttgccaaggttgaggacacacctgggaaaaagagagataaatttcattaggatttgtagcctgttttgttttgtttttttgttttgttttgttttttgtttttgttttttcccaaaaaggattttgagggcttcacagaaacgaaagagcaggcaggagggggtggaggaacagtcaattatgcatttgtcttatgctcagtaaatctgcgttttatataattaagataaggtatgcctagagtagaagaagcagtcaagtacacatttttctcagggtgggaggagagatgacttctagtcctgcctttgtcctgtaaagataagctgttaattcacattgtcagggtgaaattcaacaaaactctgttttagggtaaagatttggggacccttagaaatttccttgtgagcaatttgtgagggaggtcactggccttctatctttgcaagtagctgcttaggaaggtagtttttgtgtgactcagttcccacttttaatttttccctttagcatagtgagttagggatcctgagattttgttttccattcacattttcttatcacatacttttagtaataatgtgccacaaagccacagcagctttggagaacattttctttcatgaacttgtttactaatctttttgaaacaatgagccttctgaatgattgtcttattggcaagaga

SEQ ID NO: 322 - DNA, 4038 bp, Homo sapiens
gctattcatattttttctctggtattatatacaagacagggacagctttccataaaaataaaagctgtattgacttatttataaaattgatacatattttcatattctgcctgtaattattaaaccttttaaaaattgatgcaaaatagaaatcagcgtgggaggtagactcagtgcccagtgcatgtgtctttctctctcttttttttttttttctgagacagagactcactctgttgcccaggctggagttcaatggcacgatctcaggtctgtataacctccacctcccaggctcaagcaattctcatgcctcagcctcccaagtagctgggactacaggcacatgccaccacgcccaactaatttttgtatttttagtagagatcgggtttcaccatgttggccaggctggtctcaaactcctggcctcaagtgacccacccaccctggcctcccaaaccgctgggattacacgcgtgagccaccacacccggccccaatacatgtttctgacttgagtgaatgattacattttctagctgggaaggtttccttgtagcattcctagatagtactcagaacgttttgtaggattcatttgttcttttgtccctttaaagttgctcagccagcaaatattttaataagcctttgtgattcccaaagcttaccaaccacctttggagaatttatctaaacaaatcggattggcaccctcccaatgccaagccaatcccttgagcccctgtaactaatgagaactttaaaaatgcttgtcgccagcatacaatgaattgatcttcatgttaatcttgacttttgatcctttgtggattaaaaattagcatggccccaaatgaatttccactcttggcaatcttggaattaaaatgaaactctgtattcataaatcctaattgtgtgaattgcctattttaacatgaccgttttttaactgtgtctacacattgttgcacataacactttagaactcctttgtctgaattaatatcccagttggtcctgatagcatccttgaattatggccttttaaagtctttttaaaattatttatgttgagtcttagagcagagaagcagacatttccttcacttcctggcaaggagttaaggaaaggggtttaaatgtactgccaattaacaagtgtacttactaaaattcccactgactgcagtaactatttttattttttggtataaattttttttgtccattttttacttatgtccttcaaatgtatgaaatactggcagtaagccaactaatttttgctgatagaccaagaaatgctttcaaaattatttttgacccacaggcatatttttactatgaattgcctatgtttattaagcttgaatggcattcatcaaaaacccaaaacccactgcaatgcagtgatttcctttttaaaatatttttgtgtgatttgttcaggcaaatacccatagccttttatttgataaaaggctgtaaggttaaaagtattggtttagagcaaaatggattagacttctgtctagggtttggctatttgttatatttgttacttgcaagagaagcataactctgtctgttttaaaaagagtgtgtaaacctatggtgtacttaataataattcaactcagctatcccttggacactgtggaggtccactcttttctcctggatgtaacttacagatctgttagaactaggcttcttttagcctgatttctcccccaaataccgggcctcacactttccctccagacgttataggaagggtactcttcatgcctgctctttttttctcacatagctcccagcacacagcacatggtcactgatgtcctttctcccactcagcatagaacagtgagagatggaaggagtgcagcatgctagatgactagggacaacttttatttgaccaagaacagattgttgccattactgggggacagatctcctcttttccccccagcattgagaacgagatgatcatgtagcaaaagaggggacgaaaagcagatgccttagagaagagatggcagtggctgcccttgcaaagcccgccagatcgtcttcactgttatgggctctggaaccaaaaaggaattgagctatctgtgtggaaaggagaattagatgccatattctaacttctccgttgttcctaactgggcccatccaagggactattattatcccaagtgtccagaaggacactgaggattaggccagcactttccttgatgcaagtacttggccaccattttcctgggcgttagggtccagggtgtgtcaagggtgggtcaagagaggcagaaaccaaagacttatgccttcagtggtcccttggtcagaattagtactcagcaaagtaagtagaacatgctctgttctgatacataaaccaaatacacagtatgatttaaataggaaatgagattttttgcaagactaagtgctcagtgaatgctttagtgtatgcactaaatcttaaatcacatgggatatgagaaactaaccaggaaaactagccctcattgaagcattaagccaggaaaaaaaaaatgtgtttcttgtttttcctattagcatccatttaacaactgggctattattaccctatgtagagtgatactttccacgcatttgcatgcctgagagttggaaccaacaaagtaacaggactgccattaagtgatttcttttgttttctctttcagcaaatgttcccagcaggccacaggtaagagttaatggcttggttggctctatgttactgatcccaacctagagtaagcagattatccacgactgattttattcctactttattctccatgtaaataagtaaacttacttgacatttaaatgttagttgattctgtacaacagtttgtcagtctgggagtggggggtggctcccaagccacagataccaaaaataccatgtgtttgatcctttgtgttctaacagctttttaatggcatcttatgtgctacataaagtcactctagatagatttgaccaccactgctctctcaaatgtctacttaaggtggctatcacagaacattgacctaaaaaaaaaatgactggtaccacagaggtggttttgttactttgcaggggaaaatatttcaattttttacttaaaaattttgctgagaactgttggcagctgtacccttatgccttttagtattttctataaaccaaaaagtgtatgagacaggtttactttgccaaggttgaggacacacctgggaaaaagagagataaatttcattaggatttgtagcctgttttgttttgtttttttgttttgttttgttttttgtttttgttttttcccaaaaaggattttgagggcttcacagaaacgaaagagcaggcaggagggggtggaggaacagtcaattatgcatttgtcttatgctcagtaaatctgcgttttatataattaagataaggtatgcctagagtagaagaagcagtcaagtacacatttttctcagggtgggaggagagatgacttctagtcctgcctttgtcctgtaaagataagctgttaattcacattgtcagggtgaaattcaacaaaactctgttttagggtaaagatttggggacccttagaaatttccttgtgagcaatttgtgagggaggtcactggccttctatctttgcaagtagctgcttaggaaggtagtttttgtgtgactcagttcccacttttaatttttccctttagcatagtgagttagggatcctgagattttgttttccattcacattttcttatcacatacttttagtaataatgtgccacaaagccacagcagctttggagaacattttctttcatgaacttgtttactaatctttttgaaacaatgagccttctgaatgattgtcttattggcaagagaggctgggatcttaactaaaagacaagggtatgtgaagtaggctaggggtgtggtgagctgtgggtgttctctcctgcttgcttctgttgtct

SEQ ID NO: 323 - DNA, 4052 bp, Homo sapiens
tagagcagagaagcagacatttccttcacttcctggcaaggagttaaggaaaggggtttaaatgtactgccaattaacaagtgtacttactaaaattcccactgactgcagtaactatttttattttttggtataaattttttttgtccattttttacttatgtccttcaaatgtatgaaatactggcagtaagccaactaatttttgctgatagaccaagaaatgctttcaaaattatttttgacccacaggcatatttttactatgaattgcctatgtttattaagcttgaatggcattcatcaaaaacccaaaacccactgcaatgcagtgatttcctttttaaaatatttttgtgtgatttgttcaggcaaatacccatagccttttatttgataaaaggctgtaaggttaaaagtattggtttagagcaaaatggattagacttctgtctagggtttggctatttgttatatttgttacttgcaagagaagcataactctgtctgttttaaaaagagtgtgtaaacctatggtgtacttaataataattcaactcagctatcccttggacactgtggaggtccactcttttctcctggatgtaacttacagatctgttagaactaggcttcttttagcctgatttctcccccaaataccgggcctcacactttccctccagacgttataggaagggtactcttcatgcctgctctttttttctcacatagctcccagcacacagcacatggtcactgatgtcctttctcccactcagcatagaacagtgagagatggaaggagtgcagcatgctagatgactagggacaacttttatttgaccaagaacagattgttgccattactgggggacagatctcctcttttccccccagcattgagaacgagatgatcatgtagcaaaagaggggacgaaaagcagatgccttagagaagagatggcagtggctgcccttgcaaagcccgccagatcgtcttcactgttatgggctctggaaccaaaaaggaattgagctatctgtgtggaaaggagaattagatgccatattctaacttctccgttgttcctaactgggcccatccaagggactattattatcccaagtgtccagaaggacactgaggattaggccagcactttccttgatgcaagtacttggccaccattttcctgggcgttagggtccagggtgtgtcaagggtgggtcaagagaggcagaaaccaaagacttatgccttcagtggtcccttggtcagaattagtactcagcaaagtaagtagaacatgctctgttctgatacataaaccaaatacacagtatgatttaaataggaaatgagattttttgcaagactaagtgctcagtgaatgctttagtgtatgcactaaatcttaaatcacatgggatatgagaaactaaccaggaaaactagccctcattgaagcattaagccaggaaaaaaaaaatgtgtttcttgtttttcctattagcatccatttaacaactgggctattattaccctatgtagagtgatactttccacgcatttgcatgcctgagagttggaaccaacaaagtaacaggactgccattaagtgatttcttttgttttctctttcagcaaatgttcccagcaggccacaggtaagagttaatggcttggttggctctatgttactgatcccaacctagagtaagcagattatccacgactgattttattcctactttattctccatgtaaataagtaaacttacttgacatttaaatgttagttgattctgtacaacagtttgtcagtctgggagtggggggtggctcccaagccacagataccaaaaataccatgtgtttgatcctttgtgttctaacagctttttaatggcatcttatgtgctacataaagtcactctagatagatttgaccaccactgctctctcaaatgtctacttaaggtggctatcacagaacattgacctaaaaaaaaaatgactggtaccacagaggtggttttgttactttgcaggggaaaatatttcaattttttacttaaaaattttgctgagaactgttggcagctgtacccttatgccttttagtattttctataaaccaaaaagtgtatgagacaggtttactttgccaaggttgaggacacacctgggaaaaagagagataaatttcattaggatttgtagcctgttttgttttgtttttttgttttgttttgttttttgtttttgttttttcccaaaaaggattttgagggcttcacagaaacgaaagagcaggcaggagggggtggaggaacagtcaattatgcatttgtcttatgctcagtaaatctgcgttttatataattaagataaggtatgcctagagtagaagaagcagtcaagtacacatttttctcagggtgggaggagagatgacttctagtcctgcctttgtcctgtaaagataagctgttaattcacattgtcagggtgaaattcaacaaaactctgttttagggtaaagatttggggacccttagaaatttccttgtgagcaatttgtgagggaggtcactggccttctatctttgcaagtagctgcttaggaaggtagtttttgtgtgactcagttcccacttttaatttttccctttagcatagtgagttagggatcctgagattttgttttccattcacattttcttatcacatacttttagtaataatgtgccacaaagccacagcagctttggagaacattttctttcatgaacttgtttactaatctttttgaaacaatgagccttctgaatgattgtcttattggcaagagaggctgggatcttaactaaaagacaagggtatgtgaagtaggctaggggtgtggtgagctgtgggtgttctctcctgcttgcttctgttgtctaagtgaattggaagccgggactttagcagggagtgaggttggggaggaggtgtcagaagtgcgaggagagactggaggatgtgtgatagcttcttggagaatagaagagcagatggcctgggaaatagagtgtgactataagcagcattaaaggtgccactcatgaatttaacatgaggccattctgcagggttgtaagttgccctctaggcatattcacgttcatgagcacaggcaccagaatgggctgagtattggcatttaaaaagttgaagttggggtttgacaaagtgagtacagtgattcaagggaagaggcaaagaagtgattataatgattgaaccagatgcttaagctcagtagtgaaaggaatgaggaaatgtccagtgtgggagacagaaataaagatgggaggatcaatggatcctattgtcaaaggatggataaatttgcagttgtaggggaagtaagctgtggaggtagaggtggttgtcagaagctaggttgaatgatactgaaattagaggggttgcaagtattggtaatggtccatatttggacctttgtgtgaatggctaagaaggttggaggacaggaccattggaggaaaagagcctaaagaaccaagaagccagagtgctggaagaatcatctccatgggtgttgaaatcactaacatttaaaaatggctttagagtaggggactttgagccattttttacttcaagaagtgaaggaacatgacctacggagtcagtagatgactgcataatggagtcatatagtctgatgatatgagattcaaagctgggtgtttttagggagaggagaaagaagataccccagaggccccaatgaggaccaaggaagactcatgcagtgtatgaggaatgggggagaatggggaggggaagtgctgtgtgagagggttatgagggaagctgtgtcttcaggtagatgcagatattgattagagcaagtagatgcaggcagcattcagagaagggtttgggaacatgggttttgcggatcacaggccacatgacctataggacaggtttcaagagctaggaagagtgaggcatagggtcacaaaaaggg

SEQ ID NO: 324 - DNA, 4052 bp, Homo sapiens
gcacacagcacatggtcactgatgtcctttctcccactcagcatagaacagtgagagatggaaggagtgcagcatgctagatgactagggacaacttttatttgaccaagaacagattgttgccattactgggggacagatctcctcttttccccccagcattgagaacgagatgatcatgtagcaaaagaggggacgaaaagcagatgccttagagaagagatggcagtggctgcccttgcaaagcccgccagatcgtcttcactgttatgggctctggaaccaaaaaggaattgagctatctgtgtggaaaggagaattagatgccatattctaacttctccgttgttcctaactgggcccatccaagggactattattatcccaagtgtccagaaggacactgaggattaggccagcactttccttgatgcaagtacttggccaccattttcctgggcgttagggtccagggtgtgtcaagggtgggtcaagagaggcagaaaccaaagacttatgccttcagtggtcccttggtcagaattagtactcagcaaagtaagtagaacatgctctgttctgatacataaaccaaatacacagtatgatttaaataggaaatgagattttttgcaagactaagtgctcagtgaatgctttagtgtatgcactaaatcttaaatcacatgggatatgagaaactaaccaggaaaactagccctcattgaagcattaagccaggaaaaaaaaaatgtgtttcttgtttttcctattagcatccatttaacaactgggctattattaccctatgtagagtgatactttccacgcatttgcatgcctgagagttggaaccaacaaagtaacaggactgccattaagtgatttcttttgttttctctttcagcaaatgttcccagcaggccacaggtaagagttaatggcttggttggctctatgttactgatcccaacctagagtaagcagattatccacgactgattttattcctactttattctccatgtaaataagtaaacttacttgacatttaaatgttagttgattctgtacaacagtttgtcagtctgggagtggggggtggctcccaagccacagataccaaaaataccatgtgtttgatcctttgtgttctaacagctttttaatggcatcttatgtgctacataaagtcactctagatagatttgaccaccactgctctctcaaatgtctacttaaggtggctatcacagaacattgacctaaaaaaaaaatgactggtaccacagaggtggttttgttactttgcaggggaaaatatttcaattttttacttaaaaattttgctgagaactgttggcagctgtacccttatgccttttagtattttctataaaccaaaaagtgtatgagacaggtttactttgccaaggttgaggacacacctgggaaaaagagagataaatttcattaggatttgtagcctgttttgttttgtttttttgttttgttttgttttttgtttttgttttttcccaaaaaggattttgagggcttcacagaaacgaaagagcaggcaggagggggtggaggaacagtcaattatgcatttgtcttatgctcagtaaatctgcgttttatataattaagataaggtatgcctagagtagaagaagcagtcaagtacacatttttctcagggtgggaggagagatgacttctagtcctgcctttgtcctgtaaagataagctgttaattcacattgtcagggtgaaattcaacaaaactctgttttagggtaaagatttggggacccttagaaatttccttgtgagcaatttgtgagggaggtcactggccttctatctttgcaagtagctgcttaggaaggtagtttttgtgtgactcagttcccacttttaatttttccctttagcatagtgagttagggatcctgagattttgttttccattcacattttcttatcacatacttttagtaataatgtgccacaaagccacagcagctttggagaacattttctttcatgaacttgtttactaatctttttgaaacaatgagccttctgaatgattgtcttattggcaagagaggctgggatcttaactaaaagacaagggtatgtgaagtaggctaggggtgtggtgagctgtgggtgttctctcctgcttgcttctgttgtctaagtgaattggaagccgggactttagcagggagtgaggttggggaggaggtgtcagaagtgcgaggagagactggaggatgtgtgatagcttcttggagaatagaagagcagatggcctgggaaatagagtgtgactataagcagcattaaaggtgccactcatgaatttaacatgaggccattctgcagggttgtaagttgccctctaggcatattcacgttcatgagcacaggcaccagaatgggctgagtattggcatttaaaaagttgaagttggggtttgacaaagtgagtacagtgattcaagggaagaggcaaagaagtgattataatgattgaaccagatgcttaagctcagtagtgaaaggaatgaggaaatgtccagtgtgggagacagaaataaagatgggaggatcaatggatcctattgtcaaaggatggataaatttgcagttgtaggggaagtaagctgtggaggtagaggtggttgtcagaagctaggttgaatgatactgaaattagaggggttgcaagtattggtaatggtccatatttggacctttgtgtgaatggctaagaaggttggaggacaggaccattggaggaaaagagcctaaagaaccaagaagccagagtgctggaagaatcatctccatgggtgttgaaatcactaacatttaaaaatggctttagagtaggggactttgagccattttttacttcaagaagtgaaggaacatgacctacggagtcagtagatgactgcataatggagtcatatagtctgatgatatgagattcaaagctgggtgtttttagggagaggagaaagaagataccccagaggccccaatgaggaccaaggaagactcatgcagtgtatgaggaatgggggagaatggggaggggaagtgctgtgtgagagggttatgagggaagctgtgtcttcaggtagatgcagatattgattagagcaagtagatgcaggcagcattcagagaagggtttgggaacatgggttttgcggatcacaggccacatgacctataggacaggtttcaagagctaggaagagtgaggcatagggtcacaaaaaggggtatgcagatctctatatgactagaatacaggtgatggaagggcaaccaggagtctagagctttttagggtggcccattaaaattagggataaagggtacaaagaggttagtcctgatggtccccaggtggaatgaggctgtgagtgacaaaggcaaggagggaagagagaatcttttaaaatcctcagatataatacaagtgctcagaatttaaagcagaaaattatctgaggaggccttctcctcctactctgtttctagattttagaaattgagtttacaaagagctaaatggttcccagttgtacagcaacttagtggatggagcaaacatgtaactcaatacaagaggcccctttcccattttcttccttccctttccatgtgttttttcctgctcttctcttttcttcattttttcatgtcttgggtcgaatggaaattcatgaaaagtatatattttcacctggagggttgggctaatatttacatagcatgatcttaaatttttagaattctgacacctaaaatgagcagtattgtgtgtccaattaatagacacatctcattctcaaggataatggagtatataggcacaattcaaaaatcctcttggctttatatttaacatgaatcagcgccagagtttcagttatcaatattaatatgtaacaaaatgttcctttctcatatggggttaatctctccccttctctgtcctcaaaccacttctttgaatt

SEQ ID NO: 325 - DNA, 4046 bp, Homo sapiens
cattactgggggacagatctcctcttttccccccagcattgagaacgagatgatcatgtagcaaaagaggggacgaaaagcagatgccttagagaagagatggcagtggctgcccttgcaaagcccgccagatcgtcttcactgttatgggctctggaaccaaaaaggaattgagctatctgtgtggaaaggagaattagatgccatattctaacttctccgttgttcctaactgggcccatccaagggactattattatcccaagtgtccagaaggacactgaggattaggccagcactttccttgatgcaagtacttggccaccattttcctgggcgttagggtccagggtgtgtcaagggtgggtcaagagaggcagaaaccaaagacttatgccttcagtggtcccttggtcagaattagtactcagcaaagtaagtagaacatgctctgttctgatacataaaccaaatacacagtatgatttaaataggaaatgagattttttgcaagactaagtgctcagtgaatgctttagtgtatgcactaaatcttaaatcacatgggatatgagaaactaaccaggaaaactagccctcattgaagcattaagccaggaaaaaaaaaatgtgtttcttgtttttcctattagcatccatttaacaactgggctattattaccctatgtagagtgatactttccacgcatttgcatgcctgagagttggaaccaacaaagtaacaggactgccattaagtgatttcttttgttttctctttcagcaaatgttcccagcaggccacaggtaagagttaatggcttggttggctctatgttactgatcccaacctagagtaagcagattatccacgactgattttattcctactttattctccatgtaaataagtaaacttacttgacatttaaatgttagttgattctgtacaacagtttgtcagtctgggagtggggggtggctcccaagccacagataccaaaaataccatgtgtttgatcctttgtgttctaacagctttttaatggcatcttatgtgctacataaagtcactctagatagatttgaccaccactgctctctcaaatgtctacttaaggtggctatcacagaacattgacctaaaaaaaaaatgactggtaccacagaggtggttttgttactttgcaggggaaaatatttcaattttttacttaaaaattttgctgagaactgttggcagctgtacccttatgccttttagtattttctataaaccaaaaagtgtatgagacaggtttactttgccaaggttgaggacacacctgggaaaaagagagataaatttcattaggatttgtagcctgttttgttttgtttttttgttttgttttgttttttgtttttgttttttcccaaaaaggattttgagggcttcacagaaacgaaagagcaggcaggagggggtggaggaacagtcaattatgcatttgtcttatgctcagtaaatctgcgttttatataattaagataaggtatgcctagagtagaagaagcagtcaagtacacatttttctcagggtgggaggagagatgacttctagtcctgcctttgtcctgtaaagataagctgttaattcacattgtcagggtgaaattcaacaaaactctgttttagggtaaagatttggggacccttagaaatttccttgtgagcaatttgtgagggaggtcactggccttctatctttgcaagtagctgcttaggaaggtagtttttgtgtgactcagttcccacttttaatttttccctttagcatagtgagttagggatcctgagattttgttttccattcacattttcttatcacatacttttagtaataatgtgccacaaagccacagcagctttggagaacattttctttcatgaacttgtttactaatctttttgaaacaatgagccttctgaatgattgtcttattggcaagagaggctgggatcttaactaaaagacaagggtatgtgaagtaggctaggggtgtggtgagctgtgggtgttctctcctgcttgcttctgttgtctaagtgaattggaagccgggactttagcagggagtgaggttggggaggaggtgtcagaagtgcgaggagagactggaggatgtgtgatagcttcttggagaatagaagagcagatggcctgggaaatagagtgtgactataagcagcattaaaggtgccactcatgaatttaacatgaggccattctgcagggttgtaagttgccctctaggcatattcacgttcatgagcacaggcaccagaatgggctgagtattggcatttaaaaagttgaagttggggtttgacaaagtgagtacagtgattcaagggaagaggcaaagaagtgattataatgattgaaccagatgcttaagctcagtagtgaaaggaatgaggaaatgtccagtgtgggagacagaaataaagatgggaggatcaatggatcctattgtcaaaggatggataaatttgcagttgtaggggaagtaagctgtggaggtagaggtggttgtcagaagctaggttgaatgatactgaaattagaggggttgcaagtattggtaatggtccatatttggacctttgtgtgaatggctaagaaggttggaggacaggaccattggaggaaaagagcctaaagaaccaagaagccagagtgctggaagaatcatctccatgggtgttgaaatcactaacatttaaaaatggctttagagtaggggactttgagccattttttacttcaagaagtgaaggaacatgacctacggagtcagtagatgactgcataatggagtcatatagtctgatgatatgagattcaaagctgggtgtttttagggagaggagaaagaagataccccagaggccccaatgaggaccaaggaagactcatgcagtgtatgaggaatgggggagaatggggaggggaagtgctgtgtgagagggttatgagggaagctgtgtcttcaggtagatgcagatattgattagagcaagtagatgcaggcagcattcagagaagggtttgggaacatgggttttgcggatcacaggccacatgacctataggacaggtttcaagagctaggaagagtgaggcatagggtcacaaaaaggggtatgcagatctctatatgactagaatacaggtgatggaagggcaaccaggagtctagagctttttagggtggcccattaaaattagggataaagggtacaaagaggttagtcctgatggtccccaggtggaatgaggctgtgagtgacaaaggcaaggagggaagagagaatcttttaaaatcctcagatataatacaagtgctcagaatttaaagcagaaaattatctgaggaggccttctcctcctactctgtttctagattttagaaattgagtttacaaagagctaaatggttcccagttgtacagcaacttagtggatggagcaaacatgtaactcaatacaagaggcccctttcccattttcttccttccctttccatgtgttttttcctgctcttctcttttcttcattttttcatgtcttgggtcgaatggaaattcatgaaaagtatatattttcacctggagggttgggctaatatttacatagcatgatcttaaatttttagaattctgacacctaaaatgagcagtattgtgtgtccaattaatagacacatctcattctcaaggataatggagtatataggcacaattcaaaaatcctcttggctttatatttaacatgaatcagcgccagagtttcagttatcaatattaatatgtaacaaaatgttcctttctcatatggggttaatctctccccttctctgtcctcaaaccacttctttgaatttactgtggccggcacttacctcatattacaattgaatgaggctgcctggctgagatatcttccacacctgcttcacaggagggcctcccctcagtacaatgcctggaacccatcagt

SEQ ID NO: 326 - DNA, 4045 bp, Homo sapiens
cttgcaaagcccgccagatcgtcttcactgttatgggctctggaaccaaaaaggaattgagctatctgtgtggaaaggagaattagatgccatattctaacttctccgttgttcctaactgggcccatccaagggactattattatcccaagtgtccagaaggacactgaggattaggccagcactttccttgatgcaagtacttggccaccattttcctgggcgttagggtccagggtgtgtcaagggtgggtcaagagaggcagaaaccaaagacttatgccttcagtggtcccttggtcagaattagtactcagcaaagtaagtagaacatgctctgttctgatacataaaccaaatacacagtatgatttaaataggaaatgagattttttgcaagactaagtgctcagtgaatgctttagtgtatgcactaaatcttaaatcacatgggatatgagaaactaaccaggaaaactagccctcattgaagcattaagccaggaaaaaaaaaatgtgtttcttgtttttcctattagcatccatttaacaactgggctattattaccctatgtagagtgatactttccacgcatttgcatgcctgagagttggaaccaacaaagtaacaggactgccattaagtgatttcttttgttttctctttcagcaaatgttcccagcaggccacaggtaagagttaatggcttggttggctctatgttactgatcccaacctagagtaagcagattatccacgactgattttattcctactttattctccatgtaaataagtaaacttacttgacatttaaatgttagttgattctgtacaacagtttgtcagtctgggagtggggggtggctcccaagccacagataccaaaaataccatgtgtttgatcctttgtgttctaacagctttttaatggcatcttatgtgctacataaagtcactctagatagatttgaccaccactgctctctcaaatgtctacttaaggtggctatcacagaacattgacctaaaaaaaaaatgactggtaccacagaggtggttttgttactttgcaggggaaaatatttcaattttttacttaaaaattttgctgagaactgttggcagctgtacccttatgccttttagtattttctataaaccaaaaagtgtatgagacaggtttactttgccaaggttgaggacacacctgggaaaaagagagataaatttcattaggatttgtagcctgttttgttttgtttttttgttttgttttgttttttgtttttgttttttcccaaaaaggattttgagggcttcacagaaacgaaagagcaggcaggagggggtggaggaacagtcaattatgcatttgtcttatgctcagtaaatctgcgttttatataattaagataaggtatgcctagagtagaagaagcagtcaagtacacatttttctcagggtgggaggagagatgacttctagtcctgcctttgtcctgtaaagataagctgttaattcacattgtcagggtgaaattcaacaaaactctgttttagggtaaagatttggggacccttagaaatttccttgtgagcaatttgtgagggaggtcactggccttctatctttgcaagtagctgcttaggaaggtagtttttgtgtgactcagttcccacttttaatttttccctttagcatagtgagttagggatcctgagattttgttttccattcacattttcttatcacatacttttagtaataatgtgccacaaagccacagcagctttggagaacattttctttcatgaacttgtttactaatctttttgaaacaatgagccttctgaatgattgtcttattggcaagagaggctgggatcttaactaaaagacaagggtatgtgaagtaggctaggggtgtggtgagctgtgggtgttctctcctgcttgcttctgttgtctaagtgaattggaagccgggactttagcagggagtgaggttggggaggaggtgtcagaagtgcgaggagagactggaggatgtgtgatagcttcttggagaatagaagagcagatggcctgggaaatagagtgtgactataagcagcattaaaggtgccactcatgaatttaacatgaggccattctgcagggttgtaagttgccctctaggcatattcacgttcatgagcacaggcaccagaatgggctgagtattggcatttaaaaagttgaagttggggtttgacaaagtgagtacagtgattcaagggaagaggcaaagaagtgattataatgattgaaccagatgcttaagctcagtagtgaaaggaatgaggaaatgtccagtgtgggagacagaaataaagatgggaggatcaatggatcctattgtcaaaggatggataaatttgcagttgtaggggaagtaagctgtggaggtagaggtggttgtcagaagctaggttgaatgatactgaaattagaggggttgcaagtattggtaatggtccatatttggacctttgtgtgaatggctaagaaggttggaggacaggaccattggaggaaaagagcctaaagaaccaagaagccagagtgctggaagaatcatctccatgggtgttgaaatcactaacatttaaaaatggctttagagtaggggactttgagccattttttacttcaagaagtgaaggaacatgacctacggagtcagtagatgactgcataatggagtcatatagtctgatgatatgagattcaaagctgggtgtttttagggagaggagaaagaagataccccagaggccccaatgaggaccaaggaagactcatgcagtgtatgaggaatgggggagaatggggaggggaagtgctgtgtgagagggttatgagggaagctgtgtcttcaggtagatgcagatattgattagagcaagtagatgcaggcagcattcagagaagggtttgggaacatgggttttgcggatcacaggccacatgacctataggacaggtttcaagagctaggaagagtgaggcatagggtcacaaaaaggggtatgcagatctctatatgactagaatacaggtgatggaagggcaaccaggagtctagagctttttagggtggcccattaaaattagggataaagggtacaaagaggttagtcctgatggtccccaggtggaatgaggctgtgagtgacaaaggcaaggagggaagagagaatcttttaaaatcctcagatataatacaagtgctcagaatttaaagcagaaaattatctgaggaggccttctcctcctactctgtttctagattttagaaattgagtttacaaagagctaaatggttcccagttgtacagcaacttagtggatggagcaaacatgtaactcaatacaagaggcccctttcccattttcttccttccctttccatgtgttttttcctgctcttctcttttcttcattttttcatgtcttgggtcgaatggaaattcatgaaaagtatatattttcacctggagggttgggctaatatttacatagcatgatcttaaatttttagaattctgacacctaaaatgagcagtattgtgtgtccaattaatagacacatctcattctcaaggataatggagtatataggcacaattcaaaaatcctcttggctttatatttaacatgaatcagcgccagagtttcagttatcaatattaatatgtaacaaaatgttcctttctcatatggggttaatctctccccttctctgtcctcaaaccacttctttgaatttactgtggccggcacttacctcatattacaattgaatgaggctgcctggctgagatatcttccacacctgcttcacaggagggcctcccctcagtacaatgcctggaacccatcagtgtttgctgaatttttgctccctctaacatggcaatcaaatgttcaaaatggagaagcaagtgtctgaagaatccaaatttgaatagtcatggagaatgggctctaggccagag

SEQ ID NO: 327 - DNA, 4049 bp, Homo sapiens
atggctaagaaggttggaggacaggaccattggaggaaaagagcctaaagaaccaagaagccagagtgctggaagaatcatctccatgggtgttgaaatcactaacatttaaaaatggctttagagtaggggactttgagccattttttacttcaagaagtgaaggaacatgacctacggagtcagtagatgactgcataatggagtcatatagtctgatgatatgagattcaaagctgggtgtttttagggagaggagaaagaagataccccagaggccccaatgaggaccaaggaagactcatgcagtgtatgaggaatgggggagaatggggaggggaagtgctgtgtgagagggttatgagggaagctgtgtcttcaggtagatgcagatattgattagagcaagtagatgcaggcagcattcagagaagggtttgggaacatgggttttgcggatcacaggccacatgacctataggacaggtttcaagagctaggaagagtgaggcatagggtcacaaaaaggggtatgcagatctctatatgactagaatacaggtgatggaagggcaaccaggagtctagagctttttagggtggcccattaaaattagggataaagggtacaaagaggttagtcctgatggtccccaggtggaatgaggctgtgagtgacaaaggcaaggagggaagagagaatcttttaaaatcctcagatataatacaagtgctcagaatttaaagcagaaaattatctgaggaggccttctcctcctactctgtttctagattttagaaattgagtttacaaagagctaaatggttcccagttgtacagcaacttagtggatggagcaaacatgtaactcaatacaagaggcccctttcccattttcttccttccctttccatgtgttttttcctgctcttctcttttcttcattttttcatgtcttgggtcgaatggaaattcatgaaaagtatatattttcacctggagggttgggctaatatttacatagcatgatcttaaatttttagaattctgacacctaaaatgagcagtattgtgtgtccaattaatagacacatctcattctcaaggataatggagtatataggcacaattcaaaaatcctcttggctttatatttaacatgaatcagcgccagagtttcagttatcaatattaatatgtaacaaaatgttcctttctcatatggggttaatctctccccttctctgtcctcaaaccacttctttgaatttactgtggccggcacttacctcatattacaattgaatgaggctgcctggctgagatatcttccacacctgcttcacaggagggcctcccctcagtacaatgcctggaacccatcagtgtttgctgaatttttgctccctctaacatggcaatcaaatgttcaaaatggagaagcaagtgtctgaagaatccaaatttgaatagtcatggagaatgggctctaggccagagtcaaatgagtttgctgctttcagcatacctgggaaaaggaggggctccgtgggcagtttttccagtggcttcattaggaacatgcttccagggagcaggataaagtcccccataaaataaggtgtaaagacagatggaatatctttcctgagggtccagaaaggccttttatgatttatgaggcatggaccagtttggatgatttcattttagcactttttttttatttttttctaatttcaaaatccttttagaagaccaaatgtttgaccttcccttcaaaaggttgataccacttccatgagtgtggcctggatttatattgtctctgacctgggacatttaactttaactggcaccactaaacacccttgggttatgattcctgccttgccttcctcttctctggactccagcttgggatcaagatggttggcattgttagggtaccccctctacagatgacctcccacagtcccccaggaagacatgggatattttcaccagcctcattcgctcaccattggtaccttcagcagaaagaaatgaagtcctctccattttaactttgcttccagcctggccaagagaaaagactttcagacttccctctaaatcagctgcagtgatagaaagcagactaggtaacttcagcatgagagggagggacctcattgcaggaagcaaaagtcacagtagagttaagactcttgaaagaagcacttttattttcttgaagaattgacagatctctgcttcctgtaatgttttgtgcaaatttctgacagtgctattttcccttcccataggcaatgtgaagtattcatccggccaaccaatgtttcctgacgtacagtgttgcccttttcagcaaatgccaattccaagttccattaaatcagaagctccatggctccttggcccacgatgttgagtgctgactgtgtgttctactgaaagagtaaaacactgactatccaaagagaaatggatattttgtttttataataaccatatattattgttttcttcttccctttctatgcaagtgtaaattaatgaacagagaggtatttggaaatggtaatacatttgtcacggatttgtataatgtatacagcattgggaaagtgggtgggggctttctaatatgataccgtctttttaataactatgacaaagcttacataagaattagaagaccactttacatttttacattccttctgctgttcatattaaccttgcacaattacttcattttttctttgactcttttaccacaatgttttggttatttataatttatcagccatatgtttatcagccatataaccaactagatcccaaatagatccatgtatttgtttccgtgatttggccacattaataaattcataaatttcaatcaaatatcttatatatacacacatatggtttaagctacagccctgtgtatgccgtttaactttatttgacgttgcccacttacttctttgctgaccacttggataaccgtaataaaaatcctataagcctaaatggcatttcttttgggatatttttcctgcattttattccctttttatataagtaggaattaattatttattttatgtcttaatctatttgataaagaagactacattataataatctcaaagatcatattaccaaaggttgcccacttgagcatattttcattttgacacagaaacaaaatttagtacaacctttcctagttcccatgtcttgattttcatcattacatgcacagcagacctttacctattgtgataccagaacacatcattgtctttggttcccttcaaagagaattttattgttgttttgtattttcaagtccttaatagttcttgaaactcctagttgttttcttgttgaaagcagacacacatttagtgcacggcttattttacctttcgggtgaaagatcagatgtttttatacccttcacttgatcaatatatttggaaagaatgtttatcaaaagtctatgtcactgcttctacagaagaatgaaattaatgcttaggtgatggtacctccacctacatctttttgagtgcattcaattatgtattttggtttagcttctgatttaacatttaattgattcagtttaaacatgttacttaattagcaaatgtagaggaaccaaaaaaaggtgaaaataatatgttttgattcaaacctaaagacataaaaacataaagacattttaactttgggttctctttagctgggatctggccagaaggaggcttaaagttagaaattgctattattttagaataggttgggtgggttggggggcaagggtgtctatttgcagcagagatattttgaaaagaagaaaattgttttatataaaaaggaaagccatgaccacctttctacctcagatccatcttcatccattgcattggaaactgctttatgctgctgcagtctgcaaagtctagagcttttatcaggccatgtcatacccaagaaagcacctatttaaagaaaaaacaattccctg

SEQ ID NO: 328 - DNA, 4087 bp, Homo sapiens
tttatattgtctctgacctgggacatttaactttaactggcaccactaaacacccttgggttatgattcctgccttgccttcctcttctctggactccagcttgggatcaagatggttggcattgttagggtaccccctctacagatgacctcccacagtcccccaggaagacatgggatattttcaccagcctcattcgctcaccattggtaccttcagcagaaagaaatgaagtcctctccattttaactttgcttccagcctggccaagagaaaagactttcagacttccctctaaatcagctgcagtgatagaaagcagactaggtaacttcagcatgagagggagggacctcattgcaggaagcaaaagtcacagtagagttaagactcttgaaagaagcacttttattttcttgaagaattgacagatctctgcttcctgtaatgttttgtgcaaatttctgacagtgctattttcccttcccataggcaatgtgaagtattcatccggccaaccaatgtttcctgacgtacagtgttgcccttttcagcaaatgccaattccaagttccattaaatcagaagctccatggctccttggcccacgatgttgagtgctgactgtgtgttctactgaaagagtaaaacactgactatccaaagagaaatggatattttgtttttataataaccatatattattgttttcttcttccctttctatgcaagtgtaaattaatgaacagagaggtatttggaaatggtaatacatttgtcacggatttgtataatgtatacagcattgggaaagtgggtgggggctttctaatatgataccgtctttttaataactatgacaaagcttacataagaattagaagaccactttacatttttacattccttctgctgttcatattaaccttgcacaattacttcattttttctttgactcttttaccacaatgttttggttatttataatttatcagccatatgtttatcagccatataaccaactagatcccaaatagatccatgtatttgtttccgtgatttggccacattaataaattcataaatttcaatcaaatatcttatatatacacacatatggtttaagctacagccctgtgtatgccgtttaactttatttgacgttgcccacttacttctttgctgaccacttggataaccgtaataaaaatcctataagcctaaatggcatttcttttgggatatttttcctgcattttattccctttttatataagtaggaattaattatttattttatgtcttaatctatttgataaagaagactacattataataatctcaaagatcatattaccaaaggttgcccacttgagcatattttcattttgacacagaaacaaaatttagtacaacctttcctagttcccatgtcttgattttcatcattacatgcacagcagacctttacctattgtgataccagaacacatcattgtctttggttcccttcaaagagaattttattgttgttttgtattttcaagtccttaatagttcttgaaactcctagttgttttcttgttgaaagcagacacacatttagtgcacggcttattttacctttcgggtgaaagatcagatgtttttatacccttcacttgatcaatatatttggaaagaatgtttatcaaaagtctatgtcactgcttctacagaagaatgaaattaatgcttaggtgatggtacctccacctacatctttttgagtgcattcaattatgtattttggtttagcttctgatttaacatttaattgattcagtttaaacatgttacttaattagcaaatgtagaggaaccaaaaaaaggtgaaaataatatgttttgattcaaacctaaagacataaaaacataaagacattttaactttgggttctctttagctgggatctggccagaaggaggcttaaagttagaaattgctattattttagaataggttgggtgggttggggggcaagggtgtctatttgcagcagagatattttgaaaagaagaaaattgttttatataaaaaggaaagccatgaccacctttctacctcagatccatcttcatccattgcattggaaactgctttatgctgctgcagtctgcaaagtctagagcttttatcaggccatgtcatacccaagaaagcacctatttaaagaaaaaacaattccctgagctctcaactccaagttgtagatttggtgtcttccttgttcttactttaaaaagtcatgtgttaattttttttctgcctgtatttgtatgcaaaatgtcctctatctgctattaaagaaaagctacgtaaaacactacattgtaaccttctaagtaataataaataaaaagaaatatattgcagtaacaatgggaagtaagtatgtagttcttttgaaatatgtggtaaagaactaatcacagactatcatctaatctggttacatattgtatttttcatcctgaataaaagtaattttaacacaagatgactttgatattcttcagctggattcactgatagaatgtgagttttgaatgcacatttatgaaaacaagatatagagatagcctgtgtcctgatacatctacattttttcctgcagtttctctcatacacactaatacagtctcctgttgctctcattctctctctctccccatctcttacacatacatataattatatgattctcaatttattttccagatagaaggtttattgatagagaaaagtaatattggatgtaaaaatgtgtacataaaacctgttgagtgttttaataactagatgctgttgacattaagttcctttcaaatgtacttttagtttcatgctctcaaatactgtatgctttttatccgtacactggattttaaccactctagtaggtttaatcaatttctgaagccattcagtgggaaacaatgttgagaatcatgttgctttattctaaaattaaaagctgtctatgaactagaaaaatcatctaaaatataatttgttaaaataaagaaaactgatacattctgatgaacaaacattttaaacatcctgtgtaccactaagtaatgctgacattaagcattcctgaaaaaacacttgatttccagcaacttgttgactaggtagctgaaaatagaagtgcgaacaaatgaacaagttttgctttcatactgctgtggtttgaatgtgtcacccacagttcatgtgttgaaaatttaatccccgattccatagtgttgaggggttggacctttaagaagtgattggatcatgaggtcagaggtcatgaatggattaatgtcatcacagaagtgtgtttgctatctcaagtgggtttattaccaaagcacgttgggttctctcactttctcttgcatgttctctgccctgtcaccttccaccataggatgacgcagcaagacaggccttaccagatgctggcaccttgatattggacttcccaacctccagaacgctgagaaataaatttcttttctttgtaaattacccaatctgtggtattctgttatagcaacacaaaatagaataaagatgtatactgtgccttcaagttgttatatatcacatatatatataatatatatgttacaatcaaggcacagtatactatatatactgtgaaggcatagagatagatgatagatgatagatatagatagatagatagatagatagatagatagatagatagatgatagatagatgatagatagatatagatagatgatagatagatagatagatagagatagacagacagataatctttgtagtttgctcctgtgtatcttttctcccacccacattcactgtttcagtatgccagctttttcaaaggcctttctaaattcattagtggagaatttaatgataatacagtaaaccaccactaacgctactacttaaacctatgagtaggatccaaaagcttcactgacatacaatgtcagcttgtgtttttgtgaggttaattaagtaaccagaatgaggctgctacagacagcagg

SEQ ID NO: 329 - DNA, 42 bp, Homo sapiens
gcggcagggggaactggcccgcaaggccctggtgatccggct

SEQ ID NO: 330 - DNA, 46 bp, Homo sapiens
ttggccatcttgccagagtttcaagataatccaaaaactttaccaa

SEQ ID NO: 331 - DNA, 43 bp, Homo sapiens
tttcattaagtcataggtctcctttgagaatataatgaaaact

SEQ ID NO: 332 - DNA, 24 bp, Homo sapiens
aaaagaatataatatccagcctca

SEQ ID NO: 333 - DNA, 65 bp, Homo sapiens
ttgtgatggcagatcacaaaacacattattagtggtagctttgactgtgtcaccagcaaaaatca

SEQ ID NO: 334 - DNA, 48 bp, Homo sapiens
ctacttgggaatgagacataatcatctacttgtgacaacttagagcca

SEQ ID NO: 335 - DNA, 46 bp, Homo sapiens
cgccaggcagaacgtgctgattgacagagaccaggctgtgcactag

SEQ ID NO: 336 - DNA, 62 bp, Homo sapiens
gggagtagtggtggcagcaaagggacagagaggagacatgaatttgtaaagcccacttctag

SEQ ID NO: 337 - DNA, 46 bp, Homo sapiens
agaaaagctaacacaattttttgtatacattatcagttagtgctga

SEQ ID NO: 338 - DNA, 47 bp, Homo sapiens
agcattattcctacaagccttttccctttgcaaagtcaaatatacat

SEQ ID NO: 339 - DNA, 74 bp, Homo sapiens
aaaatcatttggtaattcaattaaatcatgcatccaaatttctaacttttattttattagaggcttcaccctta

SEQ ID NO: 340 - DNA, 46 bp, Homo sapiens
cccactcctcctttgtcttgatgaccttttcaagctcatcaagctg

SEQ ID NO: 341 - DNA, 49 bp, Homo sapiens
cctaaaaaccaagggaacagcaaacccagtgtgggccaagtgtgcagtg

SEQ ID NO: 342 - DNA, 23 bp, Homo sapiens
ttcatgtttttcagagatgattc

SEQ ID NO: 343 - DNA, 45 bp, Homo sapiens
catccgctcttccaaagtgtttaaccaggtagtttcaagatccaa

SEQ ID NO: 344 - DNA, 36 bp, Homo sapiens
atcaccttggctgcctatccttcacttctgcaacaa

SEQ ID NO: 345 - DNA, 40 bp, Homo sapiens
tttgcatagcatgctcagcctttgttaaccaacagataat

SEQ ID NO: 346 - DNA, 42 bp, Homo sapiens
cttccattgactaaggtgggagatgtatattaaggcacagaa

SEQ ID NO: 347 - DNA, 34 bp, Homo sapiens
gaatgcagatcggtggttgccaggggctgggagt

SEQ ID NO: 348 - DNA, 23 bp, Homo sapiens
gcacggttatcatgagttcataa

SEQ ID NO: 349 - DNA, 33 bp, Homo sapiens
ctttatttttcaaattctgtgccaatgtaaaaa

SEQ ID NO: 350 - DNA, 23 bp, Homo sapiens
aagggtttttcatataatgagga

SEQ ID NO: 351 - DNA, 49 bp, Homo sapiens
aggagaaagaaaaaatatcatatatcaaatgtatcacaaataagtctat

SEQ ID NO: 352 - DNA, 40 bp, Homo sapiens
acagtctgattcaaagaacaaaaatgaaactgtttttaga

SEQ ID NO: 353 - DNA, 101 bp, Homo sapiens
caaaagtggagaacatattcaaaggatagagtataaaatgttaaggtatttggcaaatagatagaaatagattagtgattgttcagaggggagggaattgg

SEQ ID NO: 354 - DNA, 50 bp, Homo sapiens
gttttaaaaaagtcacaatataagacataaaaaaagcattcatgacctac

SEQ ID NO: 355 - DNA, 23 bp, Homo sapiens
gaagaaaaatgaactgaccctgc

SEQ ID NO: 356 - DNA, 42 bp, Homo sapiens
ttttacgataactcagaaaaggtcagaatttcttcaccatgg

SEQ ID NO: 357 - DNA, 47 bp, Homo sapiens
cagaaatccaatcatgttctttcacaagaccagtgagagagagaatg

SEQ ID NO: 358 - DNA, 51 bp, Homo sapiens
acagatcaccttgtctgtttatacagcttcatgattcaaaaaaatactgaa

SEQ ID NO: 359 - DNA, 65 bp, Homo sapiens
ttccccaaaataaagaaggcattacaaattaaatagttaagaaaacgtgacgttgtagagtcccc

SEQ ID NO: 360 - DNA, 43 bp, Homo sapiens
cagggccccaagcttagagtttggtctcaattacatacagcaa

SEQ ID NO: 361 - DNA, 45 bp, Homo sapiens
atactttaaaatcctttgtaaaatcctttacaagccttgcccttg

SEQ ID NO: 362 - DNA, 46 bp, Homo sapiens
cagcagttcccgtaagttgaagttcagaccaatcattgtccagtag

SEQ ID NO: 363 - DNA, 35 bp, Homo sapiens
aaattgaatattccttataaattatactaaaccac

SEQ ID NO: 364 - DNA, 47 bp, Homo sapiens
aatgacaactgctgatatgaaaagtggtaaatcgttaaggctagtat

SEQ ID NO: 365 - DNA, 29 bp, Homo sapiens
ataatggatgcattcacttctaaggagat

SEQ ID NO: 366 - DNA, 48 bp, Homo sapiens
gaatatggatattggcaccaacaataatagtggagaaaaggatggaga

SEQ ID NO: 367 - DNA, 45 bp, Homo sapiens
cttaccttacaatggtcatactggagctgtaaggctggaacatct

SEQ ID NO: 368 - DNA, 68 bp, Homo sapiens
acacatcccaattttagaagacaggggagagaaggaagaaccaggaagggaaactgagaaagagctac

SEQ ID NO: 369 - DNA, 54 bp, Homo sapiens
agaatgagagagagagaaggagtgctcagagggagctgcagttcaagtagagaa

SEQ ID NO: 370 - DNA, 54 bp, Homo sapiens
ttccagaataaaagggcaaaacaattctctaaggaggtataaatggtcagctag

SEQ ID NO: 371 - DNA, 40 bp, Homo sapiens
cggcaggatgaccagcagctgcgtgggcaaatgaggcaag

SEQ ID NO: 372 - DNA, 48 bp, Homo sapiens
caggaattctgatctggtactgagaacagccaggggaggctggcagca

SEQ ID NO: 373 - DNA, 71 bp, Homo sapiens
tcctggtatgaggttgtgagctatacagtcataggaaagctaagaaaatgaaaacctgtacagagaagcag

SEQ ID NO: 374 - DNA, 27 bp, Homo sapiens
tatttcttgccacatgactgcccatct

SEQ ID NO: 375 - DNA, 35 bp, Homo sapiens
gactaccttccacaaatagtaaatgcaagttatta

SEQ ID NO: 376 - DNA, 29 bp, Homo sapiens
tcaatacagatatgataaagatggcatag

SEQ ID NO: 377 - DNA, 41 bp, Homo sapiens
taagtgtaaaaaattcacaattaatatagaagcacagggaa

SEQ ID NO: 378 - DNA, 48 bp, Homo sapiens
gaggaagaaaaatggtttagaatttgtacaatttgacaaatatcatta

SEQ ID NO: 379 - DNA, 39 bp, Homo sapiens
ataacaacagcttgggttctaattaatctcaaatatgaa

SEQ ID NO: 380 - DNA, 45 bp, Homo sapiens
gctgtacggtaggcagaaaaacgtacattattcaggtcagctgaa

SEQ ID NO: 381 - DNA, 41 bp, Homo sapiens
agtggcccagaggccttggctggagggcagtgggagaaggc

SEQ ID NO: 382 - DNA, 31 bp, Homo sapiens
gcaccagaagtgtcatgtaaggaaaagaaca

SEQ ID NO: 383 - DNA, 45 bp, Homo sapiens
acttaatgttccttgaacaccatctacaccttaattctcacacag

SEQ ID NO: 384 - DNA, 41 bp, Homo sapiens
agaaggaagattgtgaaattaagaccttttaatctggtaag

SEQ ID NO: 385 - DNA, 46 bp, Homo sapiens
gaaacaactctggcagacatcatagttaaaatgcttaaggcttcta

SEQ ID NO: 386 - DNA, 47 bp, Homo sapiens
gactttgaaaaggaaagagatgaagtcagtaaggtgactggagcatc

SEQ ID NO: 387 - DNA, 47 bp, Homo sapiens
ctctaagttgtcaccttcaagaactgtctggacaggcaggtaaccaa

SEQ ID NO: 388 - DNA, 46 bp, Homo sapiens
tgctatcagtgagaaaagacccattagtcctttccatctgggccag

SEQ ID NO: 389 - DNA, 45 bp, Homo sapiens
cacatagtaaacactatctagattacaaaattagtacatatcaga

SEQ ID NO: 390 - DNA, 55 bp, Homo sapiens
ttcctagaaaaggtttatcctaagcattgagatcagagagctagatgaagcaatt

SEQ ID NO: 391 - DNA, 64 bp, Homo sapiens
ctctctactgacttcaggatctgagctgggctctgcggctggctcactggggactctcctccga

SEQ ID NO: 392 - DNA, 45 bp, Homo sapiens
gacctccgtgagatccgtgctggtgtcgtgcggtggggccagcag

SEQ ID NO: 393 - DNA, 37 bp, Homo sapiens
ttttgaaagcatttcttggtctatcagcaaaaattag

SEQ ID NO: 394 - DNA, 35 bp, Homo sapiens
agtttctcatatcccatgtgatttaagatttagtg

SEQ ID NO: 395 - DNA, 42 bp, Homo sapiens
aaaataatagcaatttctaactttaagcctccttctggccag

SEQ ID NO: 396 - DNA, 4042 bp, Homo sapiens
ataaaaattagccaggcatggtggcaaacacctgtaatcccagctactcaggaggctgaggcaggggaattgattgaactcaggaggtaaaggttgcagtgggccaagatcgctgccactgcactccagccttgacgaccgagtgggtgagactccatctcaaaaaaaaaaaaaaaaaaaagagagagagagagagttggatataaaggattggatcatcaatctgacagattttatgagagtctaaaaaacttttttcattttttataggctctactactgctaaaaatttatggattattatatgattacattctttcattcaagtacataactataaaggatttgctaaattcttaagtgtattttattatattcaagaatcaaaaactttgttcagaagaatgtctataaaagtttatcatggaaaattaagtttgcccagggaaaaattctctttcctggaaagaactacagtgtatcactttggagcagtaagtctaatgcttttcttcactattggtcttagccaagatctccacttctatgctacccaaagcctttattcacccataaaagagaaaagtcaactgtttacacactactttattccatttgcccattatcagtaacacttcttcactataatgtttcacttgccactctcctcaaggtgatttttcaaatttttctcttcttgataatgaaaatcccttacaggttgcaaagatacagcagaaaaggtgatcagagtacagaggaaaatggggagaaagaagaataacagaaggctatttaaatagtgatagccactgaggttacttgccattaatggccagaggaatttgagtacacttaaggcaaaggatgactccttctaattgccaaatgcagaatctttggttctcaggagacagaatcaaagtttcaccacgaacaatgcatcccagtgtgaccctccgtcttccacacctataaaatggagggaacaccatcttcacagaaggctaggtgagaaactgagaatcaatgaatgagatgttgctttagaagcttcaagccctatacaaatgcaatttattgttacctctgccctagatttcccttccctcaaatgatattctgtaaaagccagatgttcttactgaaaccaatccagtcaagtcgatattcactaactctcccttcagaacgcttccggctgtcatatggaccaccaagcaagagtgtatgaaataaacataaggtgtttaaaaaataaacataaggtgacagccttaaagacaaaactaatgtttcaattttttaagattttaggaattatacaatgaatatatgtatataatttttattttgtactatattttatgtatatagcacatatatatccaacagtgtgcattatgatggaaatgctgtgtaatgcaaacactattcattaatttactataggaaccaaaacctaggaacgattgagatagtagaaaaggaagccaagcggacaagagtttgctgctctgcttgaaacacagtaaaagaaaacggtgagtgccaagaactgccatttacactcggaagcgctccagggaaggttaatactactgtgattaatactgtttacagagccaataaattttaggtaaacacccaaaggagagttaaagagttgtctcatcggtcccataaaggctggtaaaaggggcggggaatggttccacgccaaccctgtccgtcaccgcagaactacccacaagcttcgcattcctccacctctcccctgaccctgagctatccgcaggctgcgtctcccacgcccaccgccaacgaaccgggagggcccagatcgacttcctgaggccggtgcaacttacaaaggaatggatgcggtcgctgccgcccggccgggcggccgggagggtcggctcagacctagggaatccggcctcccccgagctccgcgcgctctggccgcggcgaccgctgcactgaccctcccaaccgcggcagggggaactggcccgcaaggccctggtgatccggctgacctgaaggctgggaaagaggaggccctgtcctgaacacctcagagagcggggccgtggagttagaacccgagctctgcagttccttgtaaaataaagtgctggtcccacagctctctcggaggtcgggcaacgttttctccctcctcctcgaaaaacgcactggaatgagtccctttcataatctgaggcttggaggaaaaaatcctttgaacaacctgccatctgaaagttgcacagccttcaattggtgctttgttggtttttaagtggccttgagcaaccacagcctcggaccccgggccaaagcggggcatgaattaccttgtcagttgcagcaagagatccccagagtccggaaaaggagagccggcgactgcgcgggactacacaccaatggggcgcccccctcctcctgtcccctcagtctctccagggccgctgccagggagcttggcgatcgcgccacactctccggagccccacccttgggagcagcaaccacccagaggtcaagcacgttccccgccgggcggctggctgggaagcgctccgctggccgccgaccacacagccaccctctgcccaccctctcctgtggacaccgccggagccccgccttccccgggcccgggtgtctgtgacagactctcctaagaggccacgtcccctcttgcaaatcactggcccagcgccctgcaccgcgcgatgcacggagggcgactctgtcaccccggcggggaggaagattaggggagcagggaggcagcacagagctggtcagataagtttggatcgttcacaactagtacggatcccaaggacctccacgcccgagctctccacgcctccggcattctctctcgcaccgcggggagctaaactgaggccccgaggaaagggcacgcaaaagttactcccatcttcgactctgggacttgggaagcagctcgggacgccgatcccaggcggaagaaccacagaaagagccatcctcctcccggcccccgccccattccctcgggggctgtagtcacattaccagcccgaggcttcaataatgcatgggcttacctgctgcccgcgggcctcctcgcctgccggtcgccaccgccgcaccccgagctggccaagggctcctctaggagtttgacacggagtaaccgcgggggtgtgtgcgagtgttagtttggtggtgcgatgtatttaaaaaaaaaaataaagcttggagaagcagacacgaaccgaaattttaaaaaaagaaagaaagaaagagaaattgacacccgactgaaaacgccccttacttgtgcaatcttcctgcctggtagttccgccaaaaacaaaacagtcaaagcgcaaacctggaaggggcgcgcaggcaccaactttgccaaacgctacagagttttccgtttgcagaaatgacccaaaagaaggggggcgccgctccccgtgattccccaatcggcttctggagccagaggctcctcctcgcccctcggcgggagaaagcccgcggccggctgctgctgcccgcttccctgctccgaggaaaaacgactccacaactttgtgcgcgagagaggctcgctccttcggcggctcctcctcctcctccccgctgcgggcctgcccctttgttggagccgagcgctggaggcggaggagggagggtggggcgcaggaccgctgggtcgcgcgttgccgcccccaccccccgggaaggggctcgcctccgggcagccaggggtccgctctccagatgagaagggtgcagatcagcgccagccctccggcccgcgcctctgcagcgctccggctccccctcggcgctctcgccccgccgccgccggcccagcaactttgttccggaagatcagccccactacgttcccgggtcagcgtctgccgggcctcggcggtcaccgcggccaccgcgtcgggaacttggcgccccaagtcacctgactgcgcgccccgtcaatcagcgccggccc

SEQ ID NO: 397 - DNA, 4046 bp, Homo sapiens
ctaatttagttacctctactgagatcatgtatgatctgttcagatgtgctagagtaaagaaacagaataataggtttaaacaactatttcctaaagctatttgaccataacatccttttgtgaattacacattaacaatcctagaacttttgatcttttcgaaatactttgggaaataatgatctaaccaattcctaatattagattttcatggtgtttacaatgttttctattataaatgatactgtgatcaatttcttgagtgtacctttttatgtattgcctagggaaaaactctagaaacagaattactcagttaattgatatgcatgtgttaaaaacatgttatcatttttgccaaattgttctccagcaatattttaggttcatcagcctttttaaaagataattttaaattaaaatagtttgggagtttatatgttcattatatatacacggtatttctgaaattagataattactcttttatggacacggctaaagtacaagttataaatatcaaaggtcttactagaatgaaggctgactcagaaaactatttaggaatatacctcctcacaatttatagaaaatgactagtatggagacattaaatcgtctctcttccattttcctctgttatatttacatatgtctgaatatgtattccgtactcctaagatgatattaataatcccttacatttttgtagtaccttataccactaaaacatttaaaacaaaaagaattttacaggaagagaacatcctcaaagcatattttaaaacaagatattaagctataccttcaaaagacccgtcaagctacacaatagttgctacatatttacagccaaatctgtaataactaaaatctttatcaatcaaccaacaccggtatcatggaggaaaatgtgtattttaagacagttaatttagatcttattttcactgtgtatttctacagtttcacataataagaaacaagctcctaacagaacataaagatggttcacacagcaaaaacaggctttgggttccttttttgtctttaaagtgacactggatgtaattttatacctcaaagtaacttttcaaagttacttaagtatagtgttcacactcagggtggagttctgtgtaattttcaaggctgagaagtgttctgcctgttcaaaaatatctcccctttgagtttgtctcagaatcatatttgaagctttttaaaaatacagaaatttttattcaatgggtctggaatggagccaatgcatctgcgttttttaaaactccccagttgattcatctgtacagccagagtcaaaaagcactcggttatataaaaagattggaggagggggtggtatcctgaggaccccaatttaactgttcgtgtgaaaaccatgaatctgtctgagtctggtttattagattacctaggtgaaaattttaccttgagaaggctcataagatatttcaaggtaggacacctgttggcctatcaatggctatgaacagggatgggggtgaggatatatggtaatgaaatcaaactgtgaaagatctttcctgccagaaactgtggcacttcctacattaagcatataatcccttcaatttccagaaaatagaaagagaaatgttcggtcgtattttattttaatggagtagtcttccaaatgaacaacctttagctacaagcagcagtttcactaagcacaaaattgggttgagaaaggataggacactcagagatattataccttttacatataccttttacaaaattatagtcatttgtcagaattcagtttcttaaaagaacttcacctccaagaagttcttgcaagaacaatgcaaatcaatccaagaaacataggttttctaaatacataaaaatccatagctttcttgagcttcctttacctaccagatctggacttaatgatatcactgaattcgttctgcccattgtcaggactggcttcatgttctccatacttggccatcttgccagagtttcaagataatccaaaaactttaccaagtcctctttctaaggctttcaacttcctacgatggttcagcttgacatcaatacctaaaaggaaaagggaaagtactgacttgaaaaaatgtatttatatattttatatagttattcgtagtaactattcattcaccaaatatttattgagtgcctaccacgtgtaaagcaccaagccaggcaatggtgttatgactatgaacaagagacatagcctctgccattacggcgcttatgcacactaagcaattaattacataatgaattatttcattacaatactgacagactacaaatcatacaaaggagaagcacagagtattaagagcacacagcagaggagtctgacctgccctgggcaattagagaaggctttcttgaagagacatttgagccaagcctttaaagatgacaagaatttaattagccaaaaagggaaacagaaagagaaaaggtaagagcttcctatgtgaagtggcagaaagaatcatggagcagtcaaagaatggagcacaagccagtgtttctggaaagaagacagccaagagacaagtgtacctgttgaaccaggtgaagaagctgggcaggaccagggataggaccatggagaacaggtcaagggtttgtgtctttatctgaagagcaatggggagccagtagatggttcgaaggagggaaccaacatggtcaaattggcctttttaaaagatcgtcaagggacgggcacggtggctcatgcctgtaatcccagcactttgggaggccgaggcaggtggatcacgaggtcaggagttcgagaccagcctggccagcacagtgaaaccctgtctctactaaaaatacaaaaaaaaaaaaaaaattagccaggcatggtggtgtgcacctgtaatcccagctactcaggaggctaatgcaggagaattgcttgaacctgggaggtggaagttgcagtgagctgagatcacgccactgcactccaccctgggcaacgagagtgagactccatctcaaaaaaaaaaaaaaaaaaaaaaaaaaaaagacgattgtggcttgtaggtagaccacagtaatatgtggggaaccagtgaagactatggcagaatatagcaaaatgcaaattaaggaacctagctcatgggtatatgaatgctgaatgaaaatttcttgcaactcttctgtatgtctgagaattttttcatagtaatatgttggggaaaaattcctaatcttaaccaagtgatcaaaattcacataaccaatcatggggcatcatgcaattgaatggaaaatcaccacatcatctacacaatatccttgccaagatgttgaacgtgaatcttctcatgagcagacaaatctagactgtggctagttttcaaaagaaatggcctggtttcttcaaaactgtcagcgtcttgaaaaccaaaattacctgggagagggggagctttgtgaattaaaggagactaaatagacatgacaatgaaatgtaatctttgattgaattcagaattttaaaataaaacatttgaggatcatttgaaaaatctgaatttggactatgtattagacaatattattgtatcaatgttaaatttctttaacattaattatggtattgttgcaggagaatgtctttgattgtaagagacatgtggtgaaatatttagcaatgaagtgtgatggtatcttcaacttaagttcaaacagaatagcatatatctgtctatactgatataggtatatttaggttgatatatgtatgtagatgtatatatgcatacacacagacagacagaaaaatgcagtaagtattgtaaaataagtgggaaaactaggccgggcaaggtggctcacgcctgtaatcccagcactttgggaagccaaggcaggtgcatcacctgagttcaggagttcgagaccagcctggccaacatggtgaaaccccatctctacttaaaaaaaaatacaaaaattagctgggtgtggtggcaggtgcc

SEQ ID NO: 398 - DNA, 4043 bp, Homo sapiens
ttgcctttatctgagacaagcaagactgtgggatcagctttggggtttacgggagatcaggagttcagattttcagatctgaacatagaagatgtgaagtaaacaactggaaatgcaagtatgcagttcagaggaagaggtctgggctagagatagaaatttgagccagcattcagatagtatttaaaccaggatactggtgagatgacaaacggcaacagtggggacagagaggaggtccaaggactgggtcctgggccctccaacgttaagaggaagaatcagcaaaagataatgggtgggaaaccaggagcgtgtggggtgtcctagaagccaaatgaagaaagagtcatggaggagggagtgatcagcagtgttgatgctattgagaggtggaataaggtaaggactgagaacaggctactggatttagcaacaaggaggtccctaataactttgacaagagcagttttactggactggtagggggtctgcctgatttgagtggtcttaagagggaatgaaaggagacgaactgcaaatgttggtacatacaatctttgaggagctctttcataaaggggaccagaggaatggcgtggtagctacagagacaggtgggatcaaagtaaagttttgctagaagaaaaacaatagcatgtttgtaagcggatccactaaaggggaaatcatagggatgcagaagagagaagggaggtgactttgagtaagtaaaggaggatgggtacaatgtacacggttagggtggccttgggtgggttctggttgaggatagatgtggtattgaagtttctggattcctctttggtttgcttcaattttcttagggcaagagtaggcaaagtcagccgggcatggtggctcacacctgtaatcccaacacttcgggaggctgaggtggatggattgcttgagcccaggagtttgagaccagcctgggcaacatggtgaaacctcttatctacaaaaaaaaatacaaaaattagccaggcgtggtggcacatgcctatagccccagctacccgagggtgggaggattgctggagcccaggaggcggaggttgcagtgagccatgctagtaccgaaaaaatgggacgcttaaattcagatgacagaggggctgccaccataaacaatgacctggtctagccagaatatacccaccacactgggagacaagatcactagaaagagaacttagagaaattaagaggacagagtattagaaggatcatcaatgtttacacccaaatcactaaaacaagagtaacttttagagagagtgacagagctaaactcactgagaaatgagagtgagcggtggagggagggagtgacatctcaccaattaggttgagttggtgatgcaatccgatggcaggagattgcagctggggaatctggtctgaatgcggaatgaggagcaaagggccattatctctctctcctgtagtaggagagggctgggagaaaagaacccacacaaaaggcagtcacaacaaacatgtctacactttgacaaagaaatttcttttgatgtcagaaaaaataaagcactgtgatatccattccacctgagcttgatgaagcccaagtttcattaattaaaaaaaaaaaaaactgaggcagactgttaattagtaatctatgtctgattatttgccacttttagcaacaaaagggaaatattcatcaacaaataaaaatacattatatgcaaaactgggtcaaacattatcagaaattttgcccttcaaactttgtgtcttctcaacctaattctagcaatcaggtcttttgtttgagtggctttaaggcagtagaagtaaagtaaggaccagaatttgagttacagcaaaagtgtgagaccctcagttcgtgccagcgtattggactgccaatctaatttcagaaaaaaagaaacattatgaagacataaccctataatatgtcactcttcctctaacaagacttaacttttcattaagtcataggtctcctttgagaatataatgaaaactgtggaccctttttctaagaaaatatgcagaaacacaagtgtaaaaacttctgcacatattgcaggatttattgttaacctcttctctccctccccaaacacccagtcaggctaggtagagtaatatctgcaagggggcttcctatgcccttgggagataaatacagtcaacaactgcggcatcaactaataatatctactaaaaaatattacaaatcaaaaaccacttcttaattcttcatcttccgctgccgtcatctaccatccagatgctcattttagggtcagtcaaaaatatctcagaaaatacaaagataaataaaatatgcaacagttcttgatttttttttttttcaacagagtcacactctgccacccaggctggagtgcagtgatgtgatattgactcaccgcagcctccacctcccaggttcaaattattcccatgccttagcctcctgagtagctgggactacaggtgcgcgaccccatgcccaggtaattttttttttttttgtatttttagtagaggtagggtttcactatgttggccaggctggtcttgaactcctgacctcaggtgatccgcccgcctcggcctttcaaagtgctgggattccaggcatgatccaccacacccggcctcttgaatttttaacattatcttgcaaagagctcaaaaaatgactcaggaaagtactcaagactccagctgccagttttcaagggcagaccccagcccaagccagtctcatacatgtaagagaaatatatatattacatatttttcccagatatctccaggcacctcaaaactcaatctagaacttcacttactatccccttatgcactgccctctccacaaaacctagaaagaaaggcttcatttgcgagtgttaaagtcaaaaaccaggcttctctctccatcccatccaccacccatcatctgaagaccaccaccatgtcctatcaggtctgcctcctacctaaagcttctaaactctcccctctcctccttcccagctacctcaatctcagttttggcttcaatacctcttatcctctaactgtgacagccacccaaaggtcctccagaaccccaggcttgcctcatccagcacacaccccacaccatccatgctccacgtggcttctagagcaccactcagaagagcaaatctgatcagatcagccctctgctcacaagctttcagaggaagcaaggccttcccaaaccaggagtgagagagaggaggccatctcaagtaaccaaaaacacagagaaaagggaaaataaaacagaaagtatgtaacctgatattacagctacggtttgtggtgtgtggtgtgtgcagggtgtgaggtatgtatgtgtcagggaagtagttcggtgaatactgctcctagaaattggaagctttttttatttaatatgtcatatctttcagacatagaaatagacaataataggcaaaagaaaatggtacaaggtccatgactgcagtgaatctcctatccagatctgcctttcaggcaaggcaatgcacaaattcattcccccagcagctgagggctcatagctgagcatccgtccaggaactgcccttggccaagttaccttgcccagattttcacctcacctccttcccagggtcagccaaaagcctactggtcaaggcaaaggtccccaggctcaacacattgcctcaagttgggaaatctctgaagggccatcccagcaccagcattccctatggatccaatggtggccctgctgtaactcaactacacttcagcttttccctggcccagtccttcttccctcatttctttcattaacaggaattgttctcaagtgcacacaaatctctgtctcaaatcctacttccaaggaactgggcttaagacagtcatcactcagttcacaaatcagcattatttcatattaatttaagattctatttctattttcattgaggaattaaatattatagataaaa

SEQ ID NO: 399 - DNA, 4024 bp, Homo sapiens
aatcccttatccacaatgccaggatctgaaaagctctggaaaccaaaggctttttccataacccatttggcagcaaaacgtgacctgaactgacctgaggctatttataaccctgtttgtgttccacttagtgtaaatattcatacattttctgcagaatgatgaagatattggatgatagggtactgtcccaaactcctctggaggctttatgtaacatagggcatatgggccatagcctttctgaaatgggaaaaagaaaaatcataaattctgaagcatatctggtcccaaggatttggataagggatggggagttttaccatgaaggaggttcgctggccaacccaagagcagctttttgtgctagactttcagctacatttcccatcaacaagttgtcacgatgtctgagcacagcaacagctccgccctgaagaggtcagcatccaggtcctgggtctgggctggccagctctagggagtggatggggttaggagctaaaaggctgagcagacagggaatgcggaaaccaggcctgcgccctacttcacttgcactcagacaacccaagccatcaagcacattcttatgacttgtgtagtcattttttttttctagattttcaaagtgaatcttagtttttattcccaacgctggctccctctagtctgggcaaactgccatttaatcacaagggccactcaaaggttgttttttctctttttttaagctgttgaaaacattaagctaaataagtgaatattctccagcctccctctctgagcccctccctacctttctcatccattaaaacagcactccatttcattacaaatattctactcctagtgtattaaagacataacatgtatattataaaaagtaaatatgaatattaatgaaacagaagcatgaggaaaagggaaaattttaagaactgaatcaatgtaacattctctttgtagcatcacctgtagacctagacaagcaaggaccttgccttaaatcctgacttttagagggcctcactctaccctcttccatccccatctctcccccagaaatagagaaatcagaggaccaaggggatatgcaagtcctaaagcacggtctagaggcacagggtcctagtactcactgctcaaatgagcactgggctctttcccaagcaagggtggaccacactactgtttgcaagtggggaagagtgggagaccatgggtgcttggccaactgaccacaaacttgggtgcaaagcccttcccagtgccaaatggagccagcatgggcagacaaaggggaaagtctgcaaactggagccagggggcagctctctccaccaccatgttctgtcatagaatctgaggacttggaaaattccaaactcaaacttggcccatgaaattgtgatcaaagcatatgtatatttattattatccattctcctttctattttcttttctttttttttttttcagtatcagaaacctgctcttctcctccatccccacagttctagctcagcacaagccatatttctcaacctcccttgcagcaagatgagtccacgtggctaagcagcagccagtgggatgtgaaaagaaatcaggaatgcaacctgagggccatgcacgttttaaaaaattgcttattttttacttctcttttctctttccttggactagaacttgacatagtgttgaggggcaagcctcatcaagaaaatggaacaacactttggaaaggcagaacaagagagaaggaaccaggatccctgagagaccatatgaagcggagccaccttcccaccctccatcacccaccaactctgaactgtaaggagagaaagaaataaactctgattttatttgagccactgtattttgaggtttctttggtacacccctggagcctctctgtaactaatacatttgcaaatgatctacataaactggctggaaattagttgtatgaatccactatggtgacttcagccaaaagaatataatatccagcctcagcaagtaaaataaaataaaatgggagaggagagctactgtgtgatgcagttattttttcaagaattctaccagaaaatcatatcaaatatataaacatggaagagaaaaactaaaagaattccacaggacaattagccatgaaaaggcttagtctatcctagaatgtcttgttattaaatataaagaagcagaaaaagggaaattctgtatatatttaagaaacaaaaacaaatcttcctagtgcaatatgattaaaactatttttacatgcttattttaaaagactggaaagaaataaacccacattataataattatttgtatggaggtaacggcttacatttcttgagtgcttctatgttccaaattgctttttttttttttttgagatggagtcttgctctgtcacccaggctggagtgcagtggcgcaatctcggctcactgcaagctccgcctcctgggttcacaccattctcctgcctcagccttccgagtagctgggactacaggcgcctgccatcaggccggctaattttttgtatttttagtagagacggggtttcaccgtgttagccaggatggtctcgatctcctgacctcgtgatccacccgtctcggcctcccaaagtgctgggattacaggcatgagccaccgcgcctggccccaaattgctttatatatgttaattcacttactttttacaacacgaggaggttgatgctattactatctctactttactcaggcacagagcagctaagccatttgtccaggttcacagagctagcaggtggccatgcttacacccacagcacctgatactgtctgaaccattccctaaagtatttctacagaagagtactaataagatttttaaatcctgcaggatttttcttattattcttttcaaatattgtgtaatctaataccatgccatccttgatatctaactcattttagagataaaaatgcttaccctaaataccatcatataatctatatttctataaccccaacagcaatattgcaggttagaatccaagtgtgcagaatatttgtgaagatcagtgtagataatactgaaatgacagtgatgaggaagaaggtactagaacacagcccttcccgagcacagctcgcacaattaagcattaacaattaggttttctggagcttagaaagtgatcagtgtgaggtcatctagtccatactccttaccttacaaacaaatcaattaattgtgcagacagcttgagtgacatattcaaggtcacacagctggtgatctgcagagctaaaactggaacctagttcctctttgacactaagctaagctctttttttaaatagggcatccaggttttctagaatttagcaattaaagcagtgattttcaaattgtgttccaaaagacatgaaggaccctcagaagcctgggttgagctactcacctgccagtcccaccccccaaactctgctgtatagaaagccacatcctacctatcagcaatgcatcgtcacattcctaaaatgagcctccactggaagacttgtttgcagaaagacttccaaggcaaaaataaaaatcacataaccaagtgaagtattcgcatcgttactttccagagccccataacctgggaccttttagagtgcttagtaatctgaagaaagcttcttacgccagaattcttcccccaggaagatcctcatcatttcactaaatgggcattttcatgccaactaaaaatgtaatataatcacacaataaagggcaatcttagaagaggaaaggcagttggcaaccacgctgacaaatatctatactacactgacctcagtctgctcatttcatgactgcctgttgaaaacaacatcaagtgatcgatctgtcgtgagcatctgggaaacacagtcaaaggctgacatgcagctaatcaatcgggacaataaagatcaacaaagattgaactgatatttttctcagggattgcac

SEQ ID NO: 400 - DNA, 4065 bp, Homo sapiens
gcttgtctgcctcccagcagcctatcacgtaacttggcaccagcagagagaaataaatgacagtgaacgaaccaagagataaatggacaaattaaatggatgcaggggcactaattaactactcaattgttggagatttggaatagcgccaaggttacagctccttaactcatttacagtttaatttctaccccatatgactttcatacaacagacacttttcggtaaatctttttccatcacggagaagtgatggaataactttcatagcgtatcattagacactggacccaatccattcatattcaacaaacacgcattaagtgccaagttctgtgccaggctctgaggctgacagtggtcctatcctagatgatttacaaggttagtaagcaaaataaatcatatttagaaaatgtttttaatgactgaccttgttagattctttacatgtaactatcttatttcatgacattatttagaaaaaacgtcttttaaaaacttcctaggtcacccagaggacaaaataatttagaatctgttaactcagtaattttcacactaattattggcggagagtcatgcctcggcttcctttcaatgaacaggtggacaaaatttaagtagccacattctcaatgagtctttacctgcctgtgactgtctgccgtctccgtttgtggattcagatctcacttccatttctcgtcggctcagcgtgtcctccaaatgtagttaagactcccaaaccaacagtgcatgatttctgaagtcacaaagggatgtgtacccctcggctggagaatgtgctttgatggagtcaaattgaaaaacagggccaaacagtatgggaaccgtggatagatgagttcctccccaactgcccggaccagaatggtcacattcctgcctctgtgaatagcccaatcctggtctgctctgtctgagcctctgccaggtgtggagcctgtcgccttaaaatctgaagacgtgtgacaacacttatctgcctaggaacagcaaggtatgcatttctacaaacaccactgttgaaactgcttggtatacagagaagccaagcacttcctctcttctcaggttttccttagattcaagccaaatagaaatctgagtgaggaaaaatgttaaggaatttagctttagaaaaatttgtttttatgtttctaactcttgcaagagagcttgttctcatcaattttataacctatttttcaacctacatactccagactaattcctaatgcttttagggatccatccattaatgcactaaataatacatgccctcaaactaagaggtaaaccatgccccttcaatcaggataagaaatactactgagtgaaatgcagactgcatctttctgccaattttaatccacagccctctgctcacttcactcccaatcaccggcctcaatcaggctttctgtgggccaagttctgccagcttagagcctgcacacagctctgccttcagccagtgccctccaccaccttgaactatggacttgaatagattcctcaagaaggccttccctgaccactcaaactatcactcattccaggtccctatgaagtccccgagtgatttgccatgacagcactgcagaatgtctaccctctaagcagttaaacaactatttgtatgctctgcaatttgatgtctggttctcgtactagtctacacactcaagaggccagatgccatcatagagctcatcagttttgtcaactacacccagtgcagtgcctgccatatggggcattcacccaagactactttccatttaaaattgttgtctcttttgaaacactctgtggcacactgctgccactgctgaggtttaaggaaacaaatactcattttaagccatcatctttatcaggggttattaccaggcagggggtccatgaacttggacaggaaaagcaattagatcttttcactgacctctaacagaaatttgcatttccttccattgtgatggcagatcacaaaacacattattagtggtagctttgactgtgtcaccagcaaaaatcataaccattttcacatcaccttacaactctagcaggtatcttgaaaataccatttggctcgttgttatttcagaagagtagagaggttagagatgctagaagttcttactgaacacactaatgaaacagcaaatactactctctcacagactttttcagtattttggtaactgtatgcatggaataccatgtactctattttatgcatttaaaaatatttgtcaggctgggtgcggtgcctcatatctgtaatcccagcactttgggaggccgaggcaggcggatcacaaggtcaagagatcgagaccatcctggccaacatggtgaaatcttgtctttactaaaaatacaaaaattagctgggcatgatggcgtgcgcctgtagtcccagctactcgggagtctgaggcaggagaatcgcttgaacccgagaggtagaagttgcagtgagccgagatcgcccccctacactccagcctgggtgacagagtgagactccatctcaaaaaaaaaaaaaaaaggccaggtgcggtggctcacacctgtaatcctagcacttttgcaggccgaggcagggggattacctgaggtcaggacttcaagatcaggctggccaacatggtgtaactccgtctctaccaaaaatacaaaaaattagctgggtacagtggcttgcaactgtaatcccagctacttgggagactgaggcaggaaaatcgcttgaacctgggaggcagaggttgcagggagccaagatcgcaccactgcactccaggctgggcaacagagtgagactttgtctcaaaaaaaaatttgtctggcttcactaaactgccaaaggagtctatgggggcaatgaaggggggatgaagataaagaataaaaaccctgatctattaacagatcactatcatgagatataaacatctgatgcaccaagaaacaattatattttgttctgaatgaatgtatttttactcattgtaaaaggaaataatatttccttaaaaagactttgcaaaataaacaaaattaataaattaagatactatttttaaaacaaataaagatatttatttccttggttttaatacaaaacaactctaaaagaagaaattcccaagagacattaacaagtttaagagttacttaacagctcaactattagacacccctgacactcctaagaatattcttgatttgatgaaacttctggtaacacctggaagcttaaagtcattttcctttgtttcatcacctctctaaaaagttatcgttcctttgttaagatgctagataagcccagttctaaccaaccctttgaattactcatgtctgggtactcccatgtgtatgcactacgcatatcttaataaacatgtttgtttttcttttgtttaaaaaaaaaaaaggaaagaaacttctctcccttttttctagaaagactcatccttgaaccatcaaggccctgggcttgcaaagggaggatagcagacaggtggggttgcgatagtagacaggtggggttgcggaatgtattacactccgatttccctcacagtgttgtcctagttctagcctagcagttggaaattcagccccatctaacttccgttgttttttgtttcgttttgctttgttttgttttgttttgtgttttgagacggagtttcgcccttgttgcccaggctggagtgcaatggtgtgatctcggctcactgcaacctccacctcccgggttcaagtgattctcccgcctcagcctcacgagttgctaggattccaggtacccgccaccatgcccagctaatttttgttatttttagtagagacggggttttgccatgttggccaggctggtctcgaactcctgacctcaggagatccacccactcggcctcccaaagcgctgggattacaggcatgagccaccatgagcagcccagtccccttacttctgtaacaactctgtgaatatatgcacataaccaccggaaagag

SEQ ID NO: 401 - DNA, 4048 bp, Homo sapiens
taaatcgaagccgccatcatcaaagagcttagaaaatattccaggctgggcgcaatggctcatgcctataatcccagcactttaggaagctgaggcgggtggatcacctgaggtcaggagttcgagaccagcctggccaacatggtaagactccatctctactaaaactacaaaaattagccaggcgtggtggcgtgtgcctgtaatcccagctattcaggagggtgaggcatgggaatcacttgaaccagggaggcagaggttgcagtgggctgagatcacaccactgcactctagcctgggagacagagcaagactccatctcaaaataataataataataacaataaagtattccaaaccacacggagccagacctcagacatagatcttaaatagctgccaataaaagcagggaaatcatatttaagtattggtttcattttctaatgtggaaacagacaaagacacctacttggaatgatgaattaaaaagaaaactcctagaagttgtatttcaggattaaattataacctttctcaagaaagctgcatgcaagtagtgagattaaaagggagacaataatcgcaccaaagcccttaatgaggaggtaaagagaggtagtaataggggcacacagcttctccctctaccaggagatagaaggagtagatagaaggagtgtgctaagaggggagaattcagggtttcctcccagggtggccctcctctcacatgtgtgtgtgtgtgtgtgtgtgtgtggtgtgtgtgtgtgtgtctgtgtgtgtgtgtctgtgtgtgtgtgtctctgtgtgtgagtctgtgtgtgtgtgtctgtgtgtgttgtgtgtggcagggtttctcactggcagtgttgcttctaaacagaagtggcagctgtctggaacccagtgggtgaggcctccagtggctgacagcgatctgcaggagaacagaaaaacactacatggaagccaagtgatgccaccacttggtagaaacagggtccaatctgccagggccacaggcgcaaccctacatgactggctgcttaaagcagtcatccctgggatggcccttccagcttagaacttctcactgtagtggcaggaatgaaggccaagagttcttcagggaggcaagaattgtcatttaaggcaacagtgaacgaaattgataaaaacaacccaaatacttcaaaaagaaaggaattttaaaatattactttaaaaaaaaaagaaagagggagtaatttttctggactgtctccataatctgtttttataaatcaggtggcaacctgctgggctgtggaacaaaggtcagcaagtgagttttctcgaagcacacttgctgtcatagtaaggaaaatttttctagtttctagtgagctctagaactttcaagcttcatgggaaggtgtgaagaagagacacctagaaattattctttggtgttggcaggaaaaaaaatgtgtccaagtgtcctacagggccaccagcctatgaaccccaatgtggtcttcataatattttgttccttggtcacctacagtcacaatctctacctcagaaaacttgtgccactgcctgtcttctggctggctctccacaggtgagtgtgctgacgtccccaagccctgaaggttgtttactgtcattcagcttgcccgtggcgatgtcggagtctggattgaagttcccaccatatcaggatcaccctccatgaggcaacactttccctacctacaacctgtcttccactggccaccacctgccgcagcccagcagacacacctgtaggcatctcagccctgatcacagcatctgtgtgcttcctcttgcaaatgcccacatgcaaatctgaggatgttggccactcagaagatgtgggtattaacatgtgtgagtcatctgtagatcctgccgcagctggtaccacacaaagatagtcctgtctaaactatgggcacacccacccactctcatgtgtcctatctctacttgggaatgagacataatcatctacttgtgacaacttagagccaagagtgaggagacaatgaagaatataggtgttcattagacagaactgatgctgaggaactgaccagaggtatttcaaatcagctccagggtttccaagatgatataaagacagttccaggatgatattaagaggtggtcaggtaagaactagagaattcaagtcacaattatcacttgagagtttatttatgagccacgagattcagcagtgggttcacagtgccagagttcctggaaagagcatttgagagagccaggcagctgataggtttaagcagtgcctactctgttccatgcagtacagcagtgaaagagccggttcccaggccaggcaaggcaagtgctatagatggagagttgagggacctgccatatcattgcctcaggaatcgggttcaactacggaggcaggtcagagcatgccaaaaaggggaaaggagaagtcagaggctgaggaaacaggtgggagtgagtgctgcagaggcaagacaggcacaaacaacctgttattaaaatgctctacagagttgcaaaggagcgggtggcagatgggaggagggaactcagaaacaatgtcagaaggtacaaaggagaaagggcgatccagaaataagacaagaacaaagctgggctctcttattccaggacagtggtcaacaagccattcctgagtttgcaagtcaggaccacttatgtgccatttcacattaaacttcactttccatgaaatttttctctgccagagaatgtccagtagtaaatctgtctatctataaaagtataaataaattaaacatggcaaagttggttttaaataaggaatgttagactaccgtaactttctggaggttgtcaatgaactatagtactggaactacggatgttcctacttgatcatcaggatataatttggtctgtattcacttttagagatctctgaacttcaaagttcgttcaatttattttcactgatgccttcaaaattcttaaaagttaagttgtgtcaatatttcaactctcacttgaaaaatgaggttattgaggtttcaggacacaaagtaaaacaccaaattcgtgctgtgagtggatttaaacctcagggccagctcccagctattgagccgttccttcagccatagcatgcatcttgcaaagcagctccctggctttcgagagcattgcctgaaccaacatgaagcctagagatgtcaaagttatgtttatgaaagtaaatgatactatgcaatacctcctgtcttcctcagtcatagccaaacagcaaatgaagccaagaggaaatacatgttcctcaatagcagtaaggttccaggtatcaggtggcggcagcagctgctgaaagcctgttccacttcacccctcccctagaaccccaaactcgggcacaaacccacgcctcaaactcttgaggctgcccggattatgagtctttcggcgacagatgacagagtgacgcaacactaccactcccgggggcgctaaaatcatagccttgacggaacaggaaggtggttactcttcacagaagctactaatctgctgcccccaccctgcctcaccacccccaccccccccaaacacacaccggaaagagggaggaggaaaaggaaatgaaagcaagtgactctagggtctggatttcatatgcaagaatagccagcaacaggtgcagcattccggtgaaattaagacactcaaagcaccatttgcctccacagcataaagagcccaggcacagaaacccaacattaggcaatgatgtcagaagtgcaaatcatcatcattctctagccagcagcaattttgtagggaaaaaaataaaagggcatttgtctgttgatacataatttcttttaatttaggagtcctctcttaaaatagtttgaaaataatcttagcatcgatcatcaatgtacttttttaatacctagtgactatcacagtgcctagcacatagtaggtgggtggataaatatttact

SEQ ID NO: 402 - DNA, 4046 bp, Homo sapiens
cagtgttttataaaaacagggttgatcatgactctctgcaagattattttttggtgaagaaatcagagactcactgatggaagaaccaagaaatactaataagggcatgctgaagcacagtgtaaatcaacagtgccctgtcttttaacttccagtaaataagacactgacttgtaaccagagacagagtaggtctgggagccagccgactctgtgggttctgaggcagagccacacacagggagcagccccacaacagtgttcacagtgactatacagaaaagaaactgttaataatggcactccggtagaaaaaatagcaacaatccatgcctcactcttgccacctgcattcatacacacagactctcaggctagcatcaaggctctgaattcaaagatcatatagggttatgtatatatatgtaatcactccaaactttgataagtggcacagattttaacttaatagatttatgggaaatacatggtgatagaatatgataaactcaactctgtaacaagcacatgtatattcctgcacacagaaagaaatgttacttggtacaggccgggcaccgtggctcacacctgtaatcccagcactttgggaggctgaggcaggtagatcacttgaggccaggaggtcaagaccagcctggccaacatgatgaaaccctttctctattgaaatacaaaaattagccaggtgtggtggtgcacgcttgtaatctcagctactggggaggctgaggcacgagaatcacttgaacccagaaggtagaggttgcagtgagctgagatcacaccattgcactccagcctgggtgacagagcaagactctgtcccaaaaacaaacaaacaaaaaaagaagtgacttggtatagaaaaatatataatagtcacagatttgaaatactatagctttggtcactccatttattgtgacaaacagggtgcatatttttctaatctgtagcttagagcacagtattattaatatactgtactattaactatgatttattcatttctataaaccaagtaataaagttagaccatttttactttggtaaattcttcagttctctagaagtgaaatcttggtaaaagaatttaaccacaggcacctatagcaattttatacataattctttaatttgcaaattaccagtagtaactaaactatttttttctaagcaataaaaagtaaagaacataatgctataaatgtttaggatacaataatcattctagaaaaattctagaaatctttctagaaaaattcaaatcagaatgacactgggaagcctgggcatggtagctcacacctataatcccagcactttgggaggccgaggagggcggattgcttgagtccaggagttcaagatcagcctgggcaacatagtgaggcctctgtctctacaaaaaactttttttttttttttgagacagagtgtcgctctgtcaccaggctggagtgcagtggcatgatctcagttcactgcaactcacgcctcccgagttcaagcgattctcctgcctcagcctcctgagtagctgggattacaggcacacgccaccacacccagctaattgttatatttttagtagacaccaggtttcaccatgttggccaggctggtatcgaactcctgacctcgtgatctacccacctcggcctcccaaagtgctgggattacaggcgtgagccacccggcccgacccaaaaaacttttttaaaaaaagcaactgggaatagtggtgcacacctgtagtcccagctacttgggaggatgaggtgggaggactgcctgagtcccagagttcaagactgcaggaagctgtgatcgtgccactgcattcagcctgggtgacagagtgaaaccctgtctcaaaaaaaagaaaagaaaaatgacagtgggtatcaaaaacccattacaacttataaaaaggctgctaccctatgtgggggggaagaaaacatgccataaaacgccaggcagaacgtgctgattgacagagaccaggctgtgcactagaccagaagagtggtgccctgaaacaaagaggtggagctaggaagcaaggactccaacatctaaggccttcaatggatacattccaaccagcaagcaacacccaggcagccgcctggcagggcaaggctagattccaccaacgaggtgaatcccccctaaaaatgaatcagagtcacagctttatcaaaggtcaaagtgaaacactgagaatcagtagccaggcaaaagcaaacaagggtacagatatatagcaatcaaagacaactcaaacaaggccacatatccaaacaaagagcctggaaaacaaaaagtcaccatgacacccaaccaccaggaaactgtgaaatgatcttgagattgataataatgaaattagaacaccctttaagcttaaggaaagaaatccagaaatgaaaggtatagcccagatcacttttagatctgtgctagatagctaatatgcatttccctagccataatcaaatattctaacatgcttataaacgctgagttattaatgtttacacacttgcataaatatcatttagctcttataaccataaaatgccccccagtctcatctgttaatagttctaaaaggatcacagcgcttaggatatggctgacgcatttagcaaacataatccaaatgttaattctagataaccaactaaagaatagagtccatctgggacatgtattttacgtaaaatattttcaaaaaacattcaagtgtgatgatgttagcatagtgcactactagaagtctcatactatgtagctactgcccaaaagaagtaaaaactccttgtttaactatgggagaaaacatggaaaggatagttcatcaagattgaggaattccagtattttttaagtatttccttttagttactttttttttttttttttttgagatggagtctcactctgtcacccaggctggagtgcagaggcacaatctcagctcactgcaacctccgcctcccaggttcaagtgattctcctgcctcagtcacccaagtacctgggattacaggcgcaggccaccacacccagttaatttttgtatttttaaggctgggcgcggtagctcacaactgtaatcccagcactttgggaggcaggggcgggcggatcccgaggtcaggagattaagaccagcctgaccaacatggtgaaacctcatctctactaaaaatacaaaaattagctgggtgtggtggcacgtgcctgcagtcccagctactctgggagctgaggcaagagaatcacttgagcccgggaggcggaggttgcaatgagccgagatcacgccactgcactccagcctggtgacagagtgagactccacctaaaaaaaaaaaaaattgtgtttttagtagagatggggtttcaccatattggccaggctggtctcaaactcctgacctcaagttatccgcccgccttggcctcccaaagtgctgggattacaggagtgagccaccgtgcagggcatcttttagttacattttaacatccatgctctttttgtctctactgattcattttttaattttgttttgttatacatatttttgtaagccactgaacctagaacaaagtatggagttattaacaaatgtaaaatatttaccttattccatgaactaaactaaaattattcaaccaaaaataaaaaactaaaagaagattgaggcattccatagcgttatcctattcttggtttctttgctttctctccatcacgggagttgagagtacccaattatataaatcaaataaaagaaagtaagaagaaaaatctataaatgccatatgatctgccaagaagtactttattttatagtaagaagatgcagtgtaagcaaatggataacacatacacccacggtaattcaaaggctctccatcccaggacctgttcacaaatgcagacctttgaaaatattctgcaagcactgagtggctaatatttgtgtaatttgaagaaaaga

SEQ ID NO: 403 - DNA, 4062 bp, Homo sapiens
gtaaccattaagactagaagtagtatataatgtttcccaaagagtagaagaagaaaagggggtaaagggaaacctaccgatacaaaaagagataagaaagtaaaaaaaaaaaaaaccacagaaaaaataagaaaaatgagcagctcacactatgcggtaaaaatgaacctaaatatataaataatcataatcaatgttaatggactaaattcttcaattaaaagatcaagattagcagaacacaaaatctagctctaatctgttctcaggatattcctaaaacaaaagccttggaagagtttccctccaatcccctgcttccatgctactactatattgtctaggactgtatttcatttctatcttgattttcttttaatctcacaaattggacattattgttgctttgacttatccaaaagttaatcattttctttattctgtgtctgttcttgcatgttagacccacccaccttctgggatgcacttcccccacttccctccctgaattcatctcccattactccccccactcaggtcactgcagccactgccctctccgatgccaagtgcctcctctgctcttgtctgatgtattttccttcagtgtgtgtacatttctatatactacacaactttattattgtcttgtctccctctgttggaacataagctccacgagaactaagatttttgcctgttttgttctctgctgtataccctgtgtctagcacataaaaggcaccccacacgtatttgttgaatcaattaattaataaatggaatggtatattggctaaaattctacagtttcttgataaaatcccttaaccaactaaaaacctagggcaacctcctttaacctcataaaaagtgtaccaaaaaagctacaaaaactatcattcttatggtaaaacactaaaagcactccttttattatcaacaacaaaaattctgcccactatcaccaattcaaatcaacattgcattgaaggacaaggcacaatagagaacaaaaaagaaaacagaagaaataaaaggatcataattctaggacattctaatccctcctcctccaagaaacctacaatctagagacaaacttactaaaatttgtaagaactgattaagtttccagatataagacgtagaaaagtctattgcacttttatataccagcaaaaaaacatagaggaagtgaaatttgagaaaagtaatcatttacaacaataaaatataacaaattttgcctttggcatttaaatccctgatccatgtagaaattattattttttttttagtgtggtgaagtaaagatccaatacatttatttatatatgggtaatcaattgtccaaatcatctattaatctgcaatgtcagctcaagcgtatatcagattttcctgtgtaatggagcaatttctgagttcttaattttattaggttgaaccatatgaaaacaccattcttatatagcaaaaacactcacatgtcggcaatttcatatggttcagcttatattggtgtgtatattgatagtactgcatagtcttaattaatatagcttcatagttttggtttctttttggaaagtatttcagcctgattcttcctcagaagtctactggctattcttgggcctcgtcttttatataattagaatctgttcacaagtttcattaaagacaatttggctatttttaattgggaatgcattgaatttacagagttttactttcagtttgagaagaaaagctaacacaattttttgtatacattatcagttagtgctgaatgagtggggttgaactttgtgaattatttcatattttttaaattcataaatatgcaggagaaactatggaccttgtattgcagcatttaagtcctaaggaaataaaaacctgatgggtagttttcttccatgatatttcttttcttaaggttttggtagaacatgtgcagaaaggagagcagtggcactggagaaggggcttcagggagtagtggtggcagcaaagggacagagaggagacatgaatttgtaaagcccacttctagatagagtaatgtctcacttatgtcggtggaggacagcattaaaggcgagtccatctgtccagctggtggtgaagttgaggacgttgacttggctgtagggcctggtggtctgacgcacccagctgagcaggatcttctcactgttcgtctgctgcaggtccgacatgacatccttcatgacatctttcacctatgtaagagaaaccaggcctgtccataactaatacttcagtaatttacttcaacttacttcaatgaagtccttgaaaaagcaatattgcactaattaaccattatggatcaggtaactggcattcattttacttcagatttttctgtagacactagagcaatacattttaacagtgattattttgggggactagaatttgaggtgatttttacctcacttttatacattactgtgttttctatatcttaagcaatacttgtactatgtttggttacaatgaacataactttcacagtcatagaaagtcatatttaactctatgtgtttacaaagaccttttcaattaaattttattttctacaaaaatgagaaaggaaaaacttttgagtgactacaaaataaagtatctttcctgactgcaatcacgattatactctagaactaacattttatagtattattctaaattagtaaatatgttttaagaaagtgctcaaagaatgacatagatctatctaagggacacaggagccaatttaaggggctcacactggccaaatctaggatgacttgaacactgaaatgagtactagtaaaagatcataaacctatgcaaatgtccatgaatctatactgatacataaatgaataaatgaatggagagagagataagatagagaaacaagaaacaaggggaagctcttctttacaagtagaacaccaactaatgtagaaggattaatgaaattagaaaatcattatctatcaagcatcataataatagctggtccaggcaaaaattatgaacgggtgctaaaagtttgataaaaactaaatatttatacagtctcaaagtatatccccacccgatacttttaataacaaagggtagtcaatttacagggaagaaacttggtaaataccaccttagccaaacaatcaaagttaacactgccagaaaaagaacagatatcacctatccccgatatgatgcactaagaagaactcacgtcacttttgtgacgtccctgccaaaagtgaacaacctgaacttaatcataaggaaagctcagccaagcccaagcccactgagagagacattctacaaaataactagccagcactcttcaaaaatatcaatatcatgaaatacaaagactcaaaaacttccagattaaagaggactaaagagacatgaaaaataaatgtaatgcatgatctcagattttcttttgctactaaggatattattgggacaactgacaaaatcttaagatctgtagattacataattgtattatttcaatgttattttcttgattttaataattatatactaagttttcatatttaataatcaataattggcattttaaatatcaatattttacatctcatattattataccaatatgctattgtgtttacataagagagttcttgtttttaggagaatgccatggcgttagaaaatacacactaaatattttaggcagactgagagagagtacaaatgaaatatagacaactggtaacatttaggaaatgtgagtgaaaggtacttgggaattctttgaactattcctgcaacttttctagatgtgaaattatgtccctttttaaaatttaacataagaaaggtaggtacttttttccctatgccaggaaaatagggcattttgtcagcctcttccattgaaaattgttatgagttgaattatgttctctaaaattaatatgttgaagtcctaaccctcagtacttcagagaggggctctatttggaaataaggtcattgcagatgtca

SEQ ID NO: 404 - DNA, 4046 bp, Homo sapiens
aagagatcaggtctgaaaaccatgcaaataaaatgcaatgaagatgaaatatgtggaaacaaagtaggcattgttataatctaatacattttagttttagattatttttatttgtgaggtttttttgagtttatttttatatcccaaaggcttgtcaaatacatacttgaaattaattcacaaatatgaaaataacagataatactttccaagggtcttgtattagctaaataggactgctattttctgtggtaaccattaagactagaagtagtatataatgtttcccaaagagtagaagaagaaaagggggtaaagggaaacctaccgatacaaaaagagataagaaagtaaaaaaaaaaaaaaccacagaaaaaataagaaaaatgagcagctcacactatgcggtaaaaatgaacctaaatatataaataatcataatcaatgttaatggactaaattcttcaattaaaagatcaagattagcagaacacaaaatctagctctaatctgttctcaggatattcctaaaacaaaagccttggaagagtttccctccaatcccctgcttccatgctactactatattgtctaggactgtatttcatttctatcttgattttcttttaatctcacaaattggacattattgttgctttgacttatccaaaagttaatcattttctttattctgtgtctgttcttgcatgttagacccacccaccttctgggatgcacttcccccacttccctccctgaattcatctcccattactccccccactcaggtcactgcagccactgccctctccgatgccaagtgcctcctctgctcttgtctgatgtattttccttcagtgtgtgtacatttctatatactacacaactttattattgtcttgtctccctctgttggaacataagctccacgagaactaagatttttgcctgttttgttctctgctgtataccctgtgtctagcacataaaaggcaccccacacgtatttgttgaatcaattaattaataaatggaatggtatattggctaaaattctacagtttcttgataaaatcccttaaccaactaaaaacctagggcaacctcctttaacctcataaaaagtgtaccaaaaaagctacaaaaactatcattcttatggtaaaacactaaaagcactccttttattatcaacaacaaaaattctgcccactatcaccaattcaaatcaacattgcattgaaggacaaggcacaatagagaacaaaaaagaaaacagaagaaataaaaggatcataattctaggacattctaatccctcctcctccaagaaacctacaatctagagacaaacttactaaaatttgtaagaactgattaagtttccagatataagacgtagaaaagtctattgcacttttatataccagcaaaaaaacatagaggaagtgaaatttgagaaaagtaatcatttacaacaataaaatataacaaattttgcctttggcatttaaatccctgatccatgtagaaattattattttttttttagtgtggtgaagtaaagatccaatacatttatttatatatgggtaatcaattgtccaaatcatctattaatctgcaatgtcagctcaagcgtatatcagattttcctgtgtaatggagcaatttctgagttcttaattttattaggttgaaccatatgaaaacaccattcttatatagcaaaaacactcacatgtcggcaatttcatatggttcagcttatattggtgtgtatattgatagtactgcatagtcttaattaatatagcttcatagttttggtttctttttggaaagtatttcagcctgattcttcctcagaagtctactggctattcttgggcctcgtcttttatataattagaatctgttcacaagtttcattaaagacaatttggctatttttaattgggaatgcattgaatttacagagttttactttcagtttgagaagaaaagctaacacaattttttgtatacattatcagttagtgctgaatgagtggggttgaactttgtgaattatttcatattttttaaattcataaatatgcaggagaaactatggaccttgtattgcagcatttaagtcctaaggaaataaaaacctgatgggtagttttcttccatgatatttcttttcttaaggttttggtagaacatgtgcagaaaggagagcagtggcactggagaaggggcttcagggagtagtggtggcagcaaagggacagagaggagacatgaatttgtaaagcccacttctagatagagtaatgtctcacttatgtcggtggaggacagcattaaaggcgagtccatctgtccagctggtggtgaagttgaggacgttgacttggctgtagggcctggtggtctgacgcacccagctgagcaggatcttctcactgttcgtctgctgcaggtccgacatgacatccttcatgacatctttcacctatgtaagagaaaccaggcctgtccataactaatacttcagtaatttacttcaacttacttcaatgaagtccttgaaaaagcaatattgcactaattaaccattatggatcaggtaactggcattcattttacttcagatttttctgtagacactagagcaatacattttaacagtgattattttgggggactagaatttgaggtgatttttacctcacttttatacattactgtgttttctatatcttaagcaatacttgtactatgtttggttacaatgaacataactttcacagtcatagaaagtcatatttaactctatgtgtttacaaagaccttttcaattaaattttattttctacaaaaatgagaaaggaaaaacttttgagtgactacaaaataaagtatctttcctgactgcaatcacgattatactctagaactaacattttatagtattattctaaattagtaaatatgttttaagaaagtgctcaaagaatgacatagatctatctaagggacacaggagccaatttaaggggctcacactggccaaatctaggatgacttgaacactgaaatgagtactagtaaaagatcataaacctatgcaaatgtccatgaatctatactgatacataaatgaataaatgaatggagagagagataagatagagaaacaagaaacaaggggaagctcttctttacaagtagaacaccaactaatgtagaaggattaatgaaattagaaaatcattatctatcaagcatcataataatagctggtccaggcaaaaattatgaacgggtgctaaaagtttgataaaaactaaatatttatacagtctcaaagtatatccccacccgatacttttaataacaaagggtagtcaatttacagggaagaaacttggtaaataccaccttagccaaacaatcaaagttaacactgccagaaaaagaacagatatcacctatccccgatatgatgcactaagaagaactcacgtcacttttgtgacgtccctgccaaaagtgaacaacctgaacttaatcataaggaaagctcagccaagcccaagcccactgagagagacattctacaaaataactagccagcactcttcaaaaatatcaatatcatgaaatacaaagactcaaaaacttccagattaaagaggactaaagagacatgaaaaataaatgtaatgcatgatctcagattttcttttgctactaaggatattattgggacaactgacaaaatcttaagatctgtagattacataattgtattatttcaatgttattttcttgattttaataattatatactaagttttcatatttaataatcaataattggcattttaaatatcaatattttacatctcatattattataccaatatgctattgtgtttacataagagagttcttgtttttaggagaatgccatggcgttagaaaatacacactaaatattttaggcagactgagagagagtacaaatgaaatatagacaactggtaacattt

SEQ ID NO: 405 - DNA, 4047 bp, Homo sapiens
tgtcattatgcacaaggaagctggggactgcaaccagccccatccattcaccccaagagctgaagtaaaggaatcaatacctgggtactcctgtagcccacacactgtagaaccccaactgagaagtacaatcaaaggtaggtttttctacccttctggataaagaatgagaaaggacatgaagaacaagggcaatatgtaattgggtctcagaccacaggtccctcaggattatccaactttacagcactcttacctgtaactggtcttctaggatagctgtagcactctcaccactgttttcatcaacaatgaccaccatgtgagttagtgaatttactttcacctgttcagcctcaagatcactttgcaaactctagagaaaaaaattaagataaaccattatttctactttcacatttacctatttaaaacgcactcagttgtcaatagtaattaaggacagttaatgaggcatcatatttaaatttccaatcattaccctaactgttctactaatgaaactaatcctattatacatctttacattccattatcaacaaaggcagtttgaggatgcagtgttataacagactgcaaatggagatatcaccacttttattcaagttctggccctccctcagaatttatagcataaaggagttgagtgtccatactaggaattaatacaaaaatgtagaagtggtaaagcaaaaaagtccagagcttaaataaaccaagtcagagatcattttatctagtgtaggacagtataaagagataagtagaatgctacacgatagtcaaaagttactctgattagctacccaataaagcagttaaagaagtatggacaccttagattctctcgccttttccatgggaagagcatagtcattggatacatgtgtatagaaaatttataggctgggcatggtggctcacacctgtaatcccagcactttgggaacccaaggcaggcggatcacttgaggtcaggagttcaagaccagcctggccaacatggtgaaaccctgactttactaaaaatacaaaaaatacaaaaaattagctgggtgtggtggcacacgcctgtagtcccagctacttgggagactgaggtgggagaatcacttgaacccaggaggcagagggtgcagtgagctgagattttgccattgccctccagcctgggtgacagagcaagactccatctcaaaaaaaagaaagaaagaaagaaaatttatttaaatactatcaatagtgttctcaaatgcttctcagagttgtgtttaatgtattcctaaagttttacatattagttacctcaatgtttcactgatcaataaaagtcttcaatttacagagagcatattttattctatctttccttatcttgactatgaaaagtttatctcctagacttgtgaccaaattaaattgcccacccaattttggttcctaacttaatgcctgacgctttcctgaatcatagacgaagaatttgctcttcacccacacaccatgtgaacgccaacatgcttgggttcttagccacttagagggccaaaagaacccttctccagttgtatgaaagctatgtactttcaaaagaaaactgcacatcacatataaaattttaccgtgcccttttatccctggctcagaaaagtctcatctctatcaattccaccctgtgagctgctaaatgaagacaaccctgaagaagtgtcccaacttcatgttaacgatagatgtcatcagcctctgagatgctaagtgctgctctttcatatttgataaggtatcgaagaaatatgagacagatttactttatgttcttctagcagcttttgtagagattttacatcatcatccagggggcaagtttccatcttctgaatgcgctcctctgtgagtgttaaccaggcggagagctgctgcagttgcttcttctgcagttccatcagcacatcgtgcagcctgtccgtggggaacacagcattattcctacaagccttttccctttgcaaagtcaaatatacattctgggcaccggagatacagggcaagggaagacacccttgtctaaacattcaaggtagcatttagtctttaaatatagaagccaggaaagtaaacttttattttgtcctaaatggagttcattaaatgcagacaaagaatgcaaaaagcagcaccctgtattcatatcagaatcattgtttcttcaatcaggaattcctgcttattaaataggtggaagtggcaatgaatgcagtttgctccttaagacacaatacatgaaataaaataaaccatgagaaagctttaaaataaaagtcacaaaatggaaaagtagatcaatactccatagtcctgtcttcacaccaagttaatgtttagctaatcttaacattgcaaataagtaactgcccctatgaaatgtcttttcctttttttggagacagtctcactttgttacccaggctggagtgcagtggctgaatctcagctcactgcaatctctgtctcctgagttcaagcgatcctcatacctcaacctcccaagtagctaggattacaggcatggcccaccatgcccagctaatttttgtatttttagtagagacggagtttcgccatgtcgcccaggctggtctcaaactcctggcctcaagtgatccatccgcgttggcctcccaagtgctgggattacaggcatgagccaccatgcctatcctctttttcctttttgttaaattctgtattccaacttttatcttttggtgtggctaacacatcaaaggggaaacaaagatcatgcagaattccagcaatattacccgtagaaaagagtcttacttttccaaggcaagttctgtaatcatctcgctttcacagacatgcagacatctactagagctcaactgtgcaaagcagcctgtggaattaagtgcatttcttggctttccactcaccgggactgtctgtccatactctccaccctaagagcctcccatctagcattcagcagggtcatctgttcctgaatctcaaattcttcttcgtctgacagagttccttgtgttatcagttggttgcctgcctgcaggacgctgcccacactgctctggtgtgcagtcagttccatcataaaagcctagaaagggacattgttataatttgtgagctactcagtgcaaaaaaaaaaaaggaagactgaacaaattgctaatgcctaacctaaatgtcagtgatgcagaaaaaggtagcctagtagagcgcaaataaaatagacattgaccacattttttaatctctgaaaataggaataaacacctgccataagttaaaagagaaatagctcaaagcaagcaatgatgcatctgataataccagctattttaaagtaaatgctgactatgctactcatagatcatgaacatggaattctaaataaataaaataaaaggctgggtgtggtggctcacacctataatcccagcattttgggaggctgaggcaggtggatcacctaggccaggagttcaagaccagcctggacaacaaggtgaaaccccgtctctaactaaaaacacaaaaaattagccgggcgtggtggcacatgtttgcagtcccagctacttgggaggctgatgcaggagaatcacttgaagccaggaggtagaagttgcagtgagccaagattgtgccactgcactccagcctgggtgacagagtaagactctgttaaaaaaaaaaaaattataaatatatatatatacacacacatatacatatacatatataatatataaatagattatatataaaaatatttatatattttatttatatatatttatttatatattttatttatatataaaataaaatatatatttatttttatttatatatatttatatataaatatatatttatttattatatatataaatatatatataaaataaaataccatactcacccaagaggaactgtttaagagatattaccacttatattattttctatccaaaa

SEQ ID NO: 406 - DNA, 4074 bp, Homo sapiens
tcccctgcactttctgacaataaaaactggggaagctatattcaaagactgaggaggtcactgtcgagttgtgacagtgaaagaaagaataaaaagacagtcatggacaatcatatccttccaaggagaataatgggaaaggaagaaagaaagcttcgatcacaaagttctcccaattgaacacaggataaataaaatcatccaagaaaatttggatgcttagctagtgccaagtagaatattcagaagacaggggcagtgagtggttcagtagttgacttttcataataataatacttattatgtctagatttgcctatgattaatgattagtacaaaataggcaccaagtagaaaatatagtatgtgcaatattggatttgaacaatttctctatctcttctcactttttcttagcttcaatatccacatggatctgtctcttctttgggggaggaggaggaggcagttcctgcttagatttttttgtaattgcttgttctcttacacgaacagtctccaaaaggtccttctgaggaatctgagacatccccagctttgctacagcctgagtcacctgaaataaaagccatccaaaatttcaatgtttataacagcttcattgagatgtaattcacatgctataaaattctttctttgaaatacacaatttaatggttattagcacatttatacagttgtataatcatcctcacagtctgtctccagaacattttatcaccccaaaaagaaatcccatagccataaaccaacactccccattccccactcccaccagtggcaaccatgcatttactttctatctctgtggattttccccttgtggacatttcctatgaatggaatcatagcgtatataatcttgcgattggcttcttatacttagcatagtgttttcaaggttcatctatgttgtagcatgtgtcaatacttcgttcttttgtattatcagataatattgtatgcatacaccacattttgtttatccattcatctgtgtatggatatttgagttgttccactttttggctattataaataatgctgctaagaatatctgtctacaaaccaatgttttatgtttgactaattcattaaaatatttttaagattaataagattacttaagatttaagatgttaagattatttattggctaagtataatcagttactataaattaaattataggatattaagataatctattaaaacttactttagaaaactgaaggtgattttcacatgtcaatttttcatcaggtgtaaggaaacaactttttagtttatttcatacaaattaaaactaacctgaacatttaaattttaaatgtttacttcatggcacaacatatgatccaaatcaaaaagtacctggttggaggaatcttctagtctctgaaccaaagaatcccatctttgagtcagttcctctgagtcactgttgatcttcttagatgccttggaattatcaagtaattgtcccacatcctggccaatctcactcagctgatccaatgtttgacgcttcatttccatgtcttccttcaaaatctagtatttcagatatttattagatgactctttttaacaggactttgtctttctgttccccagccaaaaattttaaacatgtatcttttatagtaaaatgtacatgctttgcagttcactatgctaaaaggtaagactcgtggttccagattgttacagggcagcagtctaatgctaggtaatgagctgtaatctgcattcactaaattctactaaccattagctataaaacattaagatatcataggcttacaacacagatgctgacaaccccatcacttacagccagacgtcgaacactgacacttagttccttttggtctttgaagttgcttgtctggactttatttaaagcctcttctttttcggttaaccaagctttcaacaagcactacaagtaataacaaaagttgaactttatctgcaaaatcatttggtaattcaattaaatcatgcatccaaatttctaacttttattttattagaggcttcacccttacatggggataagaaggccttcaaacacctaagtctgaggcacaaatgacccagaaagatacctttctttaaaatattatccttctcagatttgtaacagaacaatcagacattagcctcatacctagggaactaaacctaattctcaaggagataggtggagggaaaagggaaaatccaactatgcaagtctccaaaggaattacattacaacttcctagaggcagaagtaagctcggagattgtcttgtcccagcccctcattttagaaaggaaggaaagagaagtcaagttacatgtcccagatcacttggatagttaatggcagagctgggtccagggtccacaccccaaaaccagtgttttccatggcatcatgtaggaaatccacactagcattcaaggttcaacagcaattatgattaaaggagggagtctgaagagcacccaaagcccatataaagatttttcaacttcattggacaacaatgtgtgttttctaagcagaggatattcagtcatgtagagagataatcctgaagaagggatggaaaacaaccgtagctacattgtgataatttctcccaaaatgtagcatttagggtggaaacccttttctatttagtagggaggaaaacaacttggttctgtatttgcaacggaatcaattctttctcagcaattttatttatgaattaaatatttaacaactattccttgcctctatatttcaccccccaatggatactgtcctcagtctagtgaggctggtaagatatgcacataaataatgatgccatcagacagaacatgtagacagtacacacacacacacaaaaggtatagttaaaatgtcagatcattatagaacacgatgaaaggtcagtttaaaacctaaagtggtacaagtgactgaaatactagcactctatttttaaactgttttttatcatcaaattaaaattatttccaaatttgcaattactttactggatagaagagtaacacaatggttttctctagcaatcgatgtcttctactgcaattattactattactattatttttattttttgagacagagtctcactctgtcacccagactggagtgcagtggtgccatctcggatcactgcaacctctgcttcctgggttcaagcaattctcctgcctccatagcctcctgagtggctgggattacaggtgcccactgcaggcctggctaattttttgcatttttagtagagacaggtttcaacatgttggtctgacctcaagtgatctgcccgcctcggcctcccaaagtgctgggattacaagcgtgatccaccgcgcccagcctttctactgtcattattgaagtaaaattttaactattctgagactttttggcctaaatacaaggttcacaataaacataaatatttataaagtgaaatgtaaatatttgtaacatgaaatgtaaacatttcataaatcagaatcaggtcccttttgtgattcctaataagaaaaatctgaccacagattgagggcggggggggaagtagtcattaacaatttatatttggacaaattctgcaactatctgccaccatatttagtaagccacaaaacatcacacacttgagttttttcccctgaagagaatatagttgcttcttatagatggaaatgaaatgcatttaaaagaatcaaaatggacactgagagatgtgggaatagagtatttgcttttttttttttttttttgagagggagtctcgctcttgtctcccaggctggagtgcagtggcacagtctcggctcactgcaacctctgcctcctgggttccagcaattctcctgcctcagcctcctgagtagctgggattacaggcacccaccgccacacctggcttatttttatatttttagtggagacggggtttcactatgttggccgggctagtcttgaactcctgacttcaagtgatccacctgcctcagcctcccaaagtg

SEQ ID NO: 407 - DNA, 4046 bp, Homo sapiens
atgatgaaatgtctctctgaagatggaacaacaatgtcccttttgttccatataatctcctcttccttaacagctacacaaagaataaaagaaaacaaagatcccttcaaccagtcttgctgtaagctccaccgtgtagacaaacccaggtccagagtggaggagattatatggaaatactgccaccatgctgcccaggtaccctgagaaataatgactgaacagccagctggaacagtgtctacctcagtcactaatgtaaaaatatcacagaagtaacacttgcgtggaaaggaagtgagttctcttgaagcacaaagaggtgaaaccaactagcagcaaaagttaaactgcctactgatccttgtcaaaagtgaaagcacagcttgtaccaataagtggagaaagaggtaccctcaaagacatatttcacataactgaattcaaggaacaaagacatgctgtccagatgcactttcagaagaaaggcaatacgacacatttgcctagcatgcacacatacagacacttccagtcatcacacaatctacaattgctgaagttaggctgggttacatgtggagcatttcacacaatgctcaatgcatttcacaaaataatgcacaatgcaacacagttcctaactcaaatggcagctaggaagtaaatagtgtaacgtaggagggatgagctttcaaaatctttaacagtgaaccttccaaaaccaagtgtattccaaaagtaagaactctaaaatttttctgaatctgacagtggaatatgatttcttttaaaagacagtatgagactgccaaaactttaactattttgaggaaacagaagtaagggatcattcattttgatcctcctagcaatgatattaagtggcctcctcaaccaaaggaagaaattgcacctgtttctcaaaaaaaaaaaaaaaaaaaatctttaaaaatcattatatccaggtcaggtacaatggctgacacctgttatccctggtattttgggaggctaacatctgttattttgcctaacacctgttattttgggaggctgttatatcacctgttataatggcttacacctgttattttgggaggctgaggtgggaagatcacttgagcccaggagttctagaccagcgtgggcaacatagctagaccctggctctactaaaaataaaaaaccagccaggcatggtggtgcatgcctgtagtcccagctactcagtaggctgaggcagaaggaccactgaaacccaggaggtcaagactgcagctatgattgcaccactgctctccagcctgggtgacagagtgagatcctgtagctacaaaaaaaaaaattattattatatcctactgacacaattttagagaatgtgaaacttgcttgtatgtttacaaaaaggtgtgaatctggaaaagaatctgaatacagaagactttaagactttgaacaatacaggcacaaaggaaaatggagaaggttggtgcaaagcaagcaagtgtactcaagttctaaatgttgggagtcatgtttacattaaggcaaactgagacaggagattttaaaattgttgggtttaccattctctagatgttgttgacgatcctctacagcctcttgtacagcttggtagcggcccagaaagctatcgaagccccgctggacaaaatctggggcagaaggctgagacatcagggccgagcagcttgcacgagccatttcaattttggggtgaaggccaagaagatttgtcaattcccgctaaggaagagaaaatacggtcacacaactcactgaagatgaacatcctcacaggaagttaatcagggcagcattaacttaaagttcatgatacgagaagccctccttaactctggaactgcacatagaattcctccactttccagaccgttggctccttacctgacaggaatccttcaagcttggcaaggactgccgggaagattcagaaatggaagtgtgttttacccactcctcctttgtcttgatgaccttttcaagctcatcaagctgcttgaaataagcatttatatcttcctgtagctgaatctttctttctagatcttccaaatgttgagatacattcttccattctgatgaaaccttctccagaacattttttatttcttcagtaggaaggccttctatgcagacatgaaaaacaagcaaacagtctatatattacaaaatgtgtcttgaatttattctgaacattctaacactcagaatagtgaggcaatgtcacacataatgatcactttcttaagtcccttttaatacaacaacaaaaatttataatgatgcacttaaaaataatgatgtttatttcaattccttgaacaaagaagaaagacattttaaaataacgattcaggcacatcagtagaacttcagccactgccttttctagataatatatgtttccatccatgccatgcttctactctgctagtttatcacctgaaccagtgaaataagatcaactaccttgatctgtctaggcccgacttcagaaagaagaccctttgtcctaagaaaaaaagaaagctggctagaaaaactaggaggcagctcaggtcttggtgaccaaagcacagtgtcatataaattaaaaaatgaatggcgaggatgccttatgctgggaagcaacctggtgagtgcaggaatattaagccagcagccaggctctagaagcatcagcaagcccactggagaccttgcacataaataagcaaataccaaaagactgaggcagcaataagatgatctactttagaaacacatcagggaaaacaatgccaccatttttattactgaaatcttatcattttatttgtccgatatttttgaaaagtagagaatgttcctaaaaataataaagtcatatataataataggttttatcatagtccttcccttaatctaaaataccttcaaatcctctaaaatgactatgaaaaagtatgggaaatcttcaaaggaatctttctattcggaggaaaacatgcataccaaaaggatggcttcacatttttattgagtaggaaagcaataaaacaatcctgctttataaacatatatgatcaaaatccaggataatgagagcttgaactaaaaaacaaaggcataaaaacaaaaagtcatgtatgatccacagacaatgcaactttgaaaatttttataatacactgtgtctactgaaaatcataaatgagggcatatcatgctgtcatttgaatgtgtcacctatgtcaattgcagaagttcactgttcaccaccatctctcaggtaagagaatatgagacataagcaaagcattcacaccacaagccatgctgcattacccctgttaatggggagagtatacaaaacaaatcaccattttcctaacaatatgaacaatggagatatgggtcatgcccctgccccatcatttctattctaggcaggcaaaggaatagtaacaccagccacatcatctttatgttggacaattcatactaatcaaggaagaaaattaagtaggtaaataaaatttctgagatggaaaattaccactactcatctagaaaactggaaagaggtgctcacttcaagaacaagggcggttaaaacaacttcagttattttttcactgacaatgtcttacaagccattcattttgcctctttaaaccaattttaaacatctgaatctccctttctctaatcctgagatattgctggttacagtgatgcccggtaatgattcaaacacaatttacatcttataaaaggaaaactgcacattgtctttaaaaatagttgttttactcccagagatccagagtttaaaattttctatttctataaaacacagagttcttagaaggtgactagtcaaaaggcaaaatcaacagaagatcactttattaattgtctaaaagggagaacatagaacacattcctgccactcagtctcacttgactttacacttctcagtctatcactattggaatcaagggaaacgttt

SEQ ID NO: 408 - DNA, 4049 bp, Homo sapiens
agagatatatccaaatctaaatctcctattgctaatttcatttcattcgttgaaaaatattgattggatgccttctctgtgccaggcattgctctagttatgagtacatcttggcatacatcggtgaataagaaatttaaaaaagacaaagatccctgactgatggggaaaaaaaaaaaaaaagaccaaggtaaggagtcactggaggataggaagccttgcagggagagagtgtgattggttcattctccacccagaactttcctattaaaataccaggtgacctggaaactctgcttctccatctttctcacaggcagaatgttaaaatctgacactgacttctattgacattgactctctccttatacatcctcacatttatcctttcctcttaaactttatcactgctgcatctgtcaacattttcaggtgtagtgaaggatcctgtttctgaattttcatgtccctggaacgatttgccttcccactctgacactgtcaatggcctatctctgacttttgacttcaaatgtcaaaaacctgcaaaaagtagtttcatgtattcagcaatttactactacctgggctatttctaccaccccaaccaagttactactataatctaatcaacagtctgtatttcacacaggccctccatgcctgaaacattattttgaccatttttaagcaattttctcttatcttcaaggtccagtttactctacttttgactttgcttccaggcaaaaggaaataaatgtgctctctagcacattaaaagtacatctttgataagtcccaacttaaatacataataaatggggatctagaaagaatgtaaaatatttaaataataaatacgtgaatcttataagataattactatttaccccgtaataaacttaaactcccagtggcctctggatttacctcaaaagctctgagtgtgagagcaatttcctcaagcaaatgtagatctttggaaaccaagacctttagcttgttccactttccttgcacatcatcaaattcttgcttatataatttttctacatcaggatgaacatttttctccagagcctttgtttcttctgcaagtttatgtaatgcaggtttctgattctcaaggatttcatcaagggtctggaaaaagttttaaaagattaaaaatatgcacaaaaatgtgtctgcacagatatagtaaaatgggctatataaagtcaaaagtcactttaaaatgcattagaaagcatttttatctaaaaagaacagtgggtgggagtgtgaattagttcaaccactgtggaagacagtgtggtgattcctcaaagacctaaaaccagaaatgccatttgacccagcaatctcactgggtatatacccaaaggaatacaaatcattctgttataaagatatatgcacactatgttcattgcagcacaattcacaatagcaaggacaaggaatcaacccaaatgcccatcaatgatagactacttaaagaaaatgtggtacatatcaaccatggaatactatgcagccataaaaaggaacaagatcatgtcctttgcaggtatatggatggagctggaagccattatcctcggcaaactaattcagaaacaacaaaaaaaaataccgcatattctcacttataagtgggagctgaataatgagaacatacggacacatggtggggaaaaacacacactggggtctgttggagggtggggcatggtgggagggaaagcatcaggaagaagagctaatggatgctgggcttaatacgtagtgcagcaaactaccatgacacacgtttacccatttaacaaacctgcacatcctgcacaagtacccctgaacttaaaataaaagttggaaatcaaaaaacaaaacaaaacaaaacatgaaaaactcatgaaaaaaataggcataatcataaaaattaaagctttttcttcatgagttgtgtgtgggcaatacagtgtattctcaaccctaaaaaccaagggaacagcaaacccagtgtgggccaagtgtgcagtgctcaatggctgctctccttttcatctaatagcacagagccataaggctactcaactaaatgacctcggaaacattcctattcgatgcagaaaaaagtatacatcaacacgtcaactgatagtcctcatttcataaagatattttagcagattttatgaacaggttgagaattttaagctaatcacagcagaaggagaaaatatgcttttcttctatgaaaaaatttttaataactgtactttcttttatgtgaggtcaaactaaccctcaaatcataaacacatttttgcaccaatgatgaacaaaactgaccaactttttttttaatctctgaaaaaacatttcaaaatatgtaagaggagatattagaagaagcgctagagttctaacatggaagatatatgttacctttttttcttgcagggccttctccaccttggcaagatcattaaggacattcagagacacctgggccttattttctgaatcatttagcacatctttcagtgttttcaatgtttccagatatgcatgtccaggttggcccttcagttctgtttatttaaaaatatttagtttgaaaaaatcatattaggaaccaatattattacatagaccattatcctaaatgaattccaatacatggcaaaggagaccccatgattaaaatgtaaaagggtctctgttaattaacaacatagatcattccattggcatttctgagagtcagacagtgacttcattcctgcggatgttgacgtttgaaatattaactaacccactataatttttcttcatttcttcatgatgaaatgtctctctgaagatggaacaacaatgtcccttttgttccatataatctcctcttccttaacagctacacaaagaataaaagaaaacaaagatcccttcaaccagtcttgctgtaagctccaccgtgtagacaaacccaggtccagagtggaggagattatatggaaatactgccaccatgctgcccaggtaccctgagaaataatgactgaacagccagctggaacagtgtctacctcagtcactaatgtaaaaatatcacagaagtaacacttgcgtggaaaggaagtgagttctcttgaagcacaaagaggtgaaaccaactagcagcaaaagttaaactgcctactgatccttgtcaaaagtgaaagcacagcttgtaccaataagtggagaaagaggtaccctcaaagacatatttcacataactgaattcaaggaacaaagacatgctgtccagatgcactttcagaagaaaggcaatacgacacatttgcctagcatgcacacatacagacacttccagtcatcacacaatctacaattgctgaagttaggctgggttacatgtggagcatttcacacaatgctcaatgcatttcacaaaataatgcacaatgcaacacagttcctaactcaaatggcagctaggaagtaaatagtgtaacgtaggagggatgagctttcaaaatctttaacagtgaaccttccaaaaccaagtgtattccaaaagtaagaactctaaaatttttctgaatctgacagtggaatatgatttcttttaaaagacagtatgagactgccaaaactttaactattttgaggaaacagaagtaagggatcattcattttgatcctcctagcaatgatattaagtggcctcctcaaccaaaggaagaaattgcacctgtttctcaaaaaaaaaaaaaaaaaaaatctttaaaaatcattatatccaggtcaggtacaatggctgacacctgttatccctggtattttgggaggctaacatctgttattttgcctaacacctgttattttgggaggctgttatatcacctgttataatggcttacacctgttattttgggaggctgaggtgggaagatcacttgagcccaggagttctagaccagcgtgggcaacatagctagaccctggctctactaaaaataaaaaaccagcca

SEQ ID NO: 409 - DNA, 4023 bp, Homo sapiens
ggaccccacattccccgttactgatttttcctccttagcttctagcatcaaatttaacccttccagaatggtagtcatcatttcacctacacccacagaagcttctccttcgttattgcagtaaatgacaccacaattcacacaaagtggaagctttgtaaaaatcctgagtcatccttgaccattcactttttcttctatcacacatccaattctttccttaggtctcttctttattttcaaacctaatatttctcatgccctccatcactacttcgttaagcctccctagtgtatgggtccatcctctctctccaagcctgcagtaaccttataagaattctttctgttttcattcctgccttcccagagcaaactattcacatgaaaaccagagagaggccgagtgcaatggcccatgcctgtgatctccacgctttgggaggctgaggcaggaggattgcttgaggtcagcagcatctgaccagactggcatctggtctcaaactgctgacctcaagccatccttttgcctcagcctctaagaaccccatctctacaatttttgttttttttttaagacaggatctggctctttcgcccaggctggagtgcagtggtgcagtctcagctcactgcaacctccatcccctgggctcaagccatcctcccacctcagcctcctaagtagctgggactataggcgcacaccaccatgcccggctaatttttgtattttttatagagataaggttttgccatgttgcccaggctggtctcaaactcctgagctcaggcaatccacccacctcagcctcccaaagtactgggattacaagcatgcaccactgcatctggctcaaaaatatttctaaaattatctaggcatagtggtgaacatctatagttccagctacccaggaggcaggaggactgcttgagcccaggagttcaaggctgcagtaagctaggattgtgccactgcactccagcctgggtgatacaacaagatactgttgctaaaaaaaaggaaacaaaacaaaaagccagagtgaccttaaaagatctatatcacatgtcacttccctgttcaaaaccttccaattgctttctgtgtaatatcatacttgaaataaatcccaagtcctttcctccaaggccatagctaatccatcctctgcctacctctaacctcaaatattcccattctccaactcactaactcctctctgttttattccagctacactgccttcattctttattaaacagaccaagttcattcccaccacagagttttaaagcctgctattctccacgcctgaatgttcttatctgaaccttacaaggctcatctcttactttactcagttctttattcaaacatccccatctcagaaagtccttccctgaccatcctatttgaaataacccacctagccctaactccttgctactcctccatgatattattcattatccatctgcctcactagaatgtaagctccttaagaggagtttcttcttccttgttcaatgctgtacctgcagtgcctagaatgatgcttgacaggtggcaactgattaagaaatatttgctaagtaaataaatggtcccactcaaatgtcttaggggtaaagcaagtgtcataaatgtgtttcaagccagatttaagacaagaatggataagccctgagccaaactggacaatcagcaccctctcttaatttaaaaaatgatgcctttttttttggccccagctcactacccatgctggagttattctagaccatcgtttttcaaactggatgggtcataatacatttagtcagctgagagaagctacagtctacatctcctgaaaaccgtaggtagtaaagttgaaaaactcacctccttgctaagtttctccagttgagtttggtagtcacctagtcttgtctgcacccaagtttttattccagcaactggaccacttcgaagattagtctctatttccttcatgtttttcagagatgattcaattgtttctatttcattaacaaatgcctaaacacataaaagatgcatgttgagttcattactatataagtggatgccataattatagtttgtctgcttatctccctgcaaatattacacaagcagactgcttaagagtcagtacttctaactacttaagaaatattgtgccttaagaaactcatttcacctgggtgcttgatatagccatctgccaaattagactggaaatacttgactctcagaagggaatagccttttaattaatgtagagaagcctgatgatttcaccaaatataaactgcatgcactattactagcaaattcatttcttgttttttgtttttttaacactttaagttctagggtacacgtgcacaacatggagtcattgtatattgcttttcttgtgccacatggtgaggatttaagaaaaacatacttaaatgaatttgatgaacagacacttctcaaattcatttgttaaatatgtttttcttaaatcctcaccatgtggcacaagaaatgcaatatacaatgactcctaatgaaccaaaattgttcttgttctctattctataacctctcaaaattctataaccacgtccagaaataaaaacttgaagaatctgtcattcttttattagctataaagtcataaaagctttatgatgaaagatattttatctagatgtaatgctatgctatattctcacaattttaataatagcagcaaataacatagaaaaagaacaaaatgttatttatgacaagttccccagatcagcagaactcacagagcactggtctaactgcctctgtagacctgcgtcgtctccttgggcagcctgctgtttcattaagaagtctttcacgccatccatccacttctcaatgactgttgaatcggcctaatcgaacatgataacagagggggatattacttcgtgacgttcagcctactacatctcaagatctaccgccactggaacaaaggaactttttaaagctccgatagcatcgctttcatttatgttatttctttttctaaaccttccaaatttgaaaatgattattttcttcattcttgactaaaatcctcaagagatgacaggttagtaaccactctaaaaatttccaaacgctagctctttttgcttaaatgcaagcaatagttatgatttaaaatgcaaattacagggaaaaaatgcatttctaggttttatcagctataaaatattttgctctgatataatttagaacaatttttctctaaagttagtaactcagagcaggaataaacaaatagcacggtagagggaatacaatagatggttctcatttctgcttttggatgcctttttatctgagaactcaagacagtccccgttcagctccaatatttcatccaacatttattaagcacctactatatatataaaatccagctactgtgtatggcgataggggttcaaagacaaatgtgaaagcaaacattttgcaaagagaaagagactttagagagaaggtaacattggaaccaggccttaaagaatgcaaataagggccaggtacggtggctcacgcttgtaatcccagcactttaggaggcccaggctacggatcacgaggtcaagagatcaagaccatcctggccaacaaggtgaaaccccgtctctattaaaaatacaaaaattagctgggggcgtggtggggcacctgtagtcccagctactcggggtggcttaggcaggagaatagcttgaaactgggaagcagaggttgcagtgagccaagatggcaccactacactccagcctggcgacagagcaagactctgtctcaaaaaaaaaaaaaaaatgcaagtaagtagatgcaattttagcttttgagctccaataccaaaatcattgtcatttctttccataggtgggcaactgccatgtttttctctggtcttctactgattacatgttcccaattccttccatgatgtctgt

SEQ ID NO: 410 - DNA, 4045 bp, Homo sapiens
aaacaagtaattatattttctaaaaatctacctaagtaacaggaccaaaagttaagtaaattactaattcacaaaaatatccatcatgggattaaaaaatgcataaaattgagaaattagcacaagtgatatatgatataatttcacaaaaataatttcaactattattaattatgggagggtgaggcaggaggatcacttgagcccaagagttcaaggctgcagtgagctgtcataccactggactccagcctgggcaacagagcgagactatgtctctaaacaataaataaatgaataataaaaagttaaaaataattattaattatatggggaaatgctcatgacacaaagttcaaaggcagagaacagtactatacaagcaaaatgatctcaacttttattaattatattactaaaaataagtagtcattttcctacaatatatgcagaataagaggcattgttttatatacacactttttatatacataaatctaattaaccatatgggctaaatagcattcccagtttacagattggaaaattgaagctcagaaaggttaaattacttgcctacatacacacagtcaaaagaagagctaagattccaacatggctctaaagctttaagactccaaagcctggccaagtgcgatggctcacacctctaatcctagcacattgggaggccgaagcgggtggatcacctgatgtcaggagttcgagcccagcctggccgacatggtaaaaccccatctctactaaaaatacaaaattagctggggtagtggcacacgcctgtgatcccagctactcaggaggctgaggcatgagaattgcttgaactcaggaggtggaggttgcagtgagccaaaatcatgcaattgcactccagcctgggcaacatagcaagattccatctcaaataaaaagataaataagtaaataaaagactccaaagcctttgatccaatatactaccttctagtatgcatacataaaagataataattaggaagaaatctacaaactgttttaaaatgtttatcttagagtttgctttatacttttctttattttccatatttcaagaatatatacgtattcactcttacattaggaaaaaaattaagcttttcatatttttcattcactctgtctctcactctgctatatttgagaagtgacatcttttctctagcagagcatccgtctcctggaatgtaagtgccacattttactcatttctgacctttaatccagttgtccactcagttcccacatggtaccatgacatttttaaaagcctatctacccccttcccttttcttttttgttaagcaaacctaccctctttgcactgtatttcatttaagaaacggttattaagttaacatgtgctacacactgtgctgggaactgaggaataacaaagcatcgggtacatttcttggcctcaaggagttcaaatccaggcttgaagacaagctcctacgacaagatcccatggctcaaccactgtcttaacttctagcatctgaaggtaagagacaggaatcccctataaactgtcagtgctgtgtttagtgagtaaaaataacttgttgatgaaacaagagagcagttgtcctaataacatatggcagagctttgtccagggcctactaaaataaactggaaaaccactagagtgcttcaacatgtctaaaatgtaagatgtcaaacagctaaccacgtcttgaggctgatataatgggtcaccaataatctaaatacacatgattgtataaacacttcaggctatggaagaaaatgcaagtgacattgaaaaccactgaggaagcaaatgcatttgcctgcgtaaagcattacattcctcattgtaatacacgtgtggcctcatcacagcaaagagaaatgccgtggagatcacgggttccaacctccagggcttcgttgacagcatccgtcttctcaggcaggacctctgtgctcttcatccgctcttccaaagtgtttaaccaggtagtttcaagatccaaatagtgaagcagttcaatccaacaagaccagacctcctaaagcatgaaaaattttaaattagacaaaaagccatttcacacatcgtatctctagtactacacattctctttaatcgctaataatttcatttggatgtgagtatacctaggaattcagaactgatggagttgaaacttcaaaaaaataaaataaaatcggccaggcgtggtggctcacgcctgtaatcccagcactttgggaggctgaagcaggcagatcatgaggtcaggagattaagaccatcctggctaacacggtgaaaccctgtctctactaaaaatatatatatatatataaaaatattagccgggtgtggtggcggatgcctgtagtcccagctactctggaggaggcaggagaatggcgtgaacccgggaggcggaggttgcggtgagctgagattgcaccactgcattccagcctgggcaacagagcaagactccatctcaaataaaataaaataaaataatcaacaaaatcatatgagaccagttggtgaagggtggggagcaaagagtgggcaagaggctgcctcactctttaaaataaattccatgatctgatttaaatgtcaaaaatagaactatataattagtaagaaaaacaggagagaaacattatttagtttgttttttaaagaccaagtgcggtggttcacacctgtaatctcagcattttgggaggccaaggcaggtggatcacatgaggtcaggagttcaagaccagcctggccaacatggtgaaaccccatctctactaaaaatacaaaaactagctgggcatggtggcaggcacctgtaatcccagctactcgggaggctgaggcaggagaatcacttgaacctgggaggcagaggttacagtaagcccaggccacgccactgccctccagcctgggtaacaagagtgaaactccatctcaaaaaaaaaaaaaaaaaaaaaaaaaaagtttggtttttgaacaaaatgaaaaaattgctcccaattgtaaatttttaaaaaataatttcatagaaaattgaaatctcctgggccccacccaattccaacttggagctaactgatgtaaaagtttgcaatgtagccttcccaacttttttctaaattcatgaggacatgtcaatataagagagccacattttaccaaaactggagttatactgttcttactgtgttggttttgatcactcattcccctctgaggtttccagagcagggacccaggggttgtgtagtgggtggaaacatttataaatttataatcccttattataagaggaacttatttgagtggtaagtttaggagaaagaactcagctggatgcctcctgggcttgtcgtcttgaatgtactgaatgagtggaggcatcttctggtttacataaatgagtgaaggcacctgccggtccactctccatatgaagtatgcttaccagatcaaggagcagtacatttttctacaaagggccagccagtaaatattttaggttttgggaggacacatttgcttcctatcacagattcttcttggaggggggtatgtgttgtacaacccttgagaaatgtataaactattctcagttaaccaggtatccaaaaccaaactacaagttagatttaaaccctcagccagtccgggtgcagtggctaatgcctttaatcccaggactttggtaggccaaggcaggaggatggcttgagcccaagagttccagaccaacttgggcaacatagcaagacccccatctctacaaaaaaaatttaaaaataattagccaggtgtggcattgcaaggctggagtcatagctactcaggaagcgggggcaggaaggtcacttgagcccaggagtttgaggttacagtgagctgtgatcataccactgcactccagcataggtgacagagcaagaccctgtctcaaacaaaacaaaacaaaatcctcagccataattttccagc

SEQ ID NO: 411 - DNA, 4036 bp, Homo sapiens
ctactaaaaatatgaaaattagccaggcatggtgacaggcacctgtcatctcagctactgaggaggctgaggcacgagaattgcttgagccggggaggcagaggttgcagtgagctgagatcacgccactgcactctagcctgggtgacagagcgagactctgtctcaaaaaaccaataaaggtctaggagataaatcatttcaagctaagaccctccatgcaaactgaatagcatgacatataagatcttatgggacctcattttccaatccttcccctggtcattgaaccctcctctcctttcaatcctttgcagatctctcacacgacgatgctatttatgcctcccacctctgctgttttacttcttctgcctagaaggccctccctagaagaaatttatagaaaattgctataaatgctttaaaactcagcttcggcatgcttcctctgtgacacttaaattccacagcgcatcatatctgcctctgtgacactttatctttttaatgatgttttctttcatcattttcttcttcttagtctttgagttcctaatcatacttgtatcttcagtgctaaacatagagctcaataaatatcgatcaagtcattaatcaatcattggcaaaattcagcaatatgcttagagaataagttctaagataacttgctttcataagaaatagatactttaagtgtttactatgaatagtcaaggcatgcacattttccaaacactattgcatttaatcctcatgacagtcctctgtggtgatatcatagttctcatttccagaggaagacactttggccagagagttctgtgctctttccaagttcgtacagcataatattgagagcataagacagtatgatcacttactttctatgagatcttggacaagttacttaacctcgcctctcttagcctcagtttctaaagctgtacaaggcttaacagtcccctaagaggtgagtcatgactcctaaacaaggcaatgtgtgcaaggtgccagatactctctctgccatgtggtaatctctcaaccaaaacgtactaattattatttgtctcttaccaaaacacacaaaataatagattttttaaatgaaaagcaactgtaggtcacatgatacttgaatattttaggttgcataataatactggacctgataaagtattagattggcctttcacaaaatgatagcttatcactaaaataatacttcatcaacagagttaaaattaacagaaaaaaaaatcgtggagtttttaaccctaaactaccaacaagaaacaaacaaacaaaaaagatcattaatgacggaatatatgaaacaaagtagaaatcattcataaatcttgactgtctcagaaaataatgtcaaataattttaaatatggaaagtgtctatagtgttgggcattatattccaattgcaaaacaaatttgcaactggaagatgcccaaataaaatctgagtcactgtaacataatctgacataaaaattaataatactatattatattatattatattacatagatgaagaactttattattggcaaagcatgaatagaacacaacatttgacaccaaaataacttagtgagacgtattactaaggtaggctcaatcaggaaataagcaaagggaaggtctgatcttgaacccagaccttcaaacctgaaacctggagtttcagttatttcaactactttaaattcccatcataatcaccatatcataataagcagttgtaaataaaaggaataaaggtgtttggtttttacatatgtagcatttgagtagaaaagtgagactttatggacagcctaaaaatacaggaagggagaacgtgggcagtggaggtcttaaatgtcagtaaaattcctattataatgtcaaacaataaaagaactcattagattgcatcttaaaagattctatccaaaatatgttcactcctgtgcctgcaaacaatcatagctaaatcaccttggctgcctatccttcacttctgcaacaattgcatcccagcgttggtttaaacctgccagtttttctttcaagaagcttccatctgcctgggagagtttctgcacaatcccatccccagttcggtttagtgctgcaaaactgggctggtggctgctgatgcccacctcaagttcctgtaacagagcacaactcaagattagtttcactaataagtaaatgattctgatgcaatgaatccacccaagtattgtggtatcaatttaagtgtgaaagaaacaaactcctggaaagatattttatgttagaaaaaaaaggcattttaaaacaatttaattacatttcaatgaacatgctaaatgaaatttattttgaaatctaacccaccttcatgaatgtcatcaggcaaaatacaaggaaatagggcagcttaataactaaaatgaataacagctgtttacattaaagcataagcatcaatcatgtttgatgaaaatgaattgctcatcttctttcaagcaagtgcttgaaggcattgctttaaaaaattatataccccaataaatccttatatccttgtgtcctaccacatacaagtaaacctaaatgcacattttactaagatattgcttcactggttgatatggtttggttgtgtccccacccaaatctcatcttgaattgtacctcccataatccccacatgccaagggagggacccagtgggaggtaactgaatcacaggggtggttaccctcgtgttgttctagtgagagtgatctgatggttttataagggacttttcccccactttgctcagcacttctctctcctgccgccatatgaagaaggacatgtttctttccccttccaccatgactggacgtttcctgtggcctcctcagccatgctgaactatgagtcaattaaacctctttcctttataaattacccagtctcaggtatgtctttattagcagcatgagaacagactaatacactggtctacaaatgtttaagtaacagattgaatgaatattttcaagtcaaatttaaacacttatctgtaactccaaaaataagaaaaatgcattaacacatttatttatttatttatttatttattgacacagtattgctctgtcacccaggctggagtgcagtggcacgatcttggctcactgcaacctctgcctcccaggttcaagcaattctcctgcctcagcctcctgagtagctgggactgcaggtgcgttccaccatgcccggctaattttttgtatttttagtagagatgggttttcaccatgttagccaggatggtctcgatctcctgacctcataatccgcccacctcagcctcccaaaatgctgggattacaagtgtgaggcaccgcgcccggccacattaacacatttataagaaaaacaaatgaattatctttaaattgtcatgtccttctaaataaaatacatttaaaaaacttaataaaagagaaaatatttttatcaatggtagaattgaaattgcgtgtgctttctaccattatttttaaagacctattgttatcagaactaactttgtgttatattttcccaagactgaattagacttacatgagcagctgccctgctgtcgctccagaataatttactttatgataattatcaatgatacaaagaaaaatgagatgcctaagtgtttaagtacaaaaaacagaggtgaggcatgcaaatattttttctgttcttggtatagtcttaggcataacagtttacaaattttattctaaatataaaattgtttaaataaaattgtttttcacattagccaccaaggagtatttttatttaaatttctttgaaatcctgattgaaaattgtgattgaccaatttcttaaacttttataactggtaacaagaattggaacaaaaattacaaattgtccattgacttctgaaaaattaatatattttgtccctacttctgaaatctgtcttaacaggcatacactaaccatatgtgcagt

SEQ ID NO: 412 - DNA, 4040 bp, Homo sapiens
agtatataatgtataaatcccctaggccaaagagttctgtataaaataaaaagtattcttctagaatatatgcctctgtctatgacagataaaaaatataaacattagtaagctttagtaaaatttgccccatttggacatacttgaaagtaaagcagttacatgatcccacatctctgacaacaaaatcaataaatatgagaaatgtgtgatagtaactttacacacaccttattccatgtcatatttacagtccttaagctttctgaaattttatccctttcaggtaaactcagacttttatctgaaagcatctccaattcagttctattcagccatttgagtttttcagcatgtacttccatttcttgagttaagtcctggagaagttaaaagataggtgtggttagaaggtagtcagataagggaaaattcaagaactgtattagaaacctttttggtattattacaaatgtaactttctaatttgttaagtgaaaaaataaacttataagaagcttaagctcatgctaacaaatgataactaggaagggagtgagcacatgccttctgtgtgtatttttgcactcctgtgcacaaacgggctctctggtactcactgtctcttaaccgggtcatatattatttttacactgctaatttaacattctgttcttatctcctccttgctactccatcctaatatactgttccaccttttctaactctcctcaaattgtttacaaaagagacattcccaaaaaaaccactgaaatttttaggtaaaaaaggaagcttgttagatattgtcacattttaaaaagaaaacttaatatatgttccacaaaatatttttcatcattattcaatgtttctttctcaaaatgcttcaatcatactcctttatagacaaaatctctgaattagtaagtaacctttcacacacacttatgcttgtacatgtatgaatacacactcataatttcttttttttttttttttttgagacggagtctcgctctgtcagccaggctggagtgcagtggcacgatctcggctcactgcaacctctgcctcctgggttcatgccattctcctgcttcagcctcccgagtagctgagactacatgcgcctgccaccacggccagctaatttttttttgtatttttatagagatggggtttcaccatgttagccagatggtctcgatctcatgaccttgtgatccacccgcctcggcctcccaaagtgctgggattacaggcgtgagccaccacacccagcccacaatttctttttttaaaaaaaaatgtgagcacattatgctgagtgttctgcaacaagtattttaattcttaacacaaaaaataaatatttatgaatacaaaatttatggatatttggatatatttatacatctatatatgtatgaatttttatagattatatacatatacaactataaacaatacttgttagttgcaaaccaacaaagaaaatctgattaatacaaccatgacactaaacctattgcaagctgcattttgttcctcagcaagtcactctgataattactgattatctataaagttgagttttgcagctttatagacaataatcagtaattttcttccaaatctaaaaacaaaaaacgatatttcatagccctattgtattttaaaatgataaggtcagtttacaatatcctaaaaacctttggtctaatactgacaccataatagtttgttctttttacataagtgaagtttaagctctgcaagaccaaaattataactgctctttaaaaaataaaagatattcctctttcaggttcaccacatttaccaaaaagtacaaagtttcttttcccttttcttcttgagacacgcagtatgtgactctgaagtataatgttcgggcaccaaaaggcatatagacagaaataaacaacttactcttaattcttgcaggttttctcccaattcggtggttgatctcttttgcatagcatgctcagcctttgttaaccaacagataatctcatctagctgatgcctgtacttcatcacctgcttactttctccttttagcctaaaagaatatattatttaaaaatattgaggaaaaactgtccaattaagcagaaccttacatatttgctttgaatatcctgactaaatatttcccaaaataaataatttctaataattattttaatatatattttaagtgaaacaatgtatatattctacaatataaagattgcttaataatagaccaagaagcttttttccttagttaaattcaaaaacattgaaactaaagaatattatcttccctcatcataaaaagttatgtagaaattgaatacaaaagccttttttacagttagataccactccgcaacataatggaaattttttaaaacatgaaaaatgtctttatctaaaataatagggaaaaagcataattctctttgagtgtttcacgaatattgaaaggaatcattatatgacatgttatcacattaggtggtaactattactctgctttattcatagaacagaaagaataagaacaaagcaaggtatcaagaatgggagaatcttacaagtattagggaagacaagaaacatgtgaatttggcttgtttattaaaataactattatatttgaatagagcactgttacaaaaagagatatagaaaaaaacaaagcaaaaattttaaatgatgcaaggaaaacagtcaaatgaatataaaaaaggaactgcctcaattagatctttatagtgttataagaataacatttataagaatataaaccatctgtcagaagagaggaatatgattagaactcatatgacaaataagattatgtgttttttaaaaggatttgaaagctattaaaagcctggtggtatctttatttttatagctgctataattaactgctggtttaaaaactgaatgcaatttttaaataaattgtattgtatcattcctaataagaatttatgtttttgcagctaggagttttcatttttaatcacaaaagttctcacataatcgtgcaatacatgtaataaaatattagataatacttctatatttaataaacagtcaatatttgatgtataatgtttaaaaaaatgaaaatcactacaaaatcataatttttaagtatccatcaagaaagaatgctcctttaagattaaaaataaataaatacagcaacagcactaattactaagactaaaacaagtaatctaccctccatagtgaaaagtatttaacttaaatgacaactttggaaacacccaaaatactattataggcctttgtttctaaaaaagagttgaaatttcacgtccaatgtttcaagatcatgactaatttagtactttcaaaacagaactatgaagaaaactagcattataaagtgatttcaataagatatatttgagtcacccaatattttcatctgcaaattagctaaatataatctacattttaaatattatccccaagagtaaaaacaaattataaattcatgttctaacagaagaaacaattgctcactaaggaataacccactgggcatggtggctcacggctgtaatcccagcactttgagagactgaggcaggaggatcacttgagcctaggagttcgagaccagcctggacaacatggcaagaccttatttttacaaacaatttaaaaatcagctgggtgtggtagcacacacttgcagccccaactactcagaagactagggtgagaggattgcttgagcccaggggctcaaggatgcagtgagctacgattgcaccattgcactccagcctgggtatcagaacaagaccttgtctccaaaaaagggaagaaataactctgcaggttgctgaactatgcaaatacttaactacaggcactcaatacaaaaacaaattgaactgtgtgataattctcaattactttgttaacaacatatatacaatctacccaaaatggtcccaatttaatatagactacca

SEQ ID NO: 413 - DNA, 4042 bp, Homo sapiens
ctggctctaccttcactctccattgcaatcttgtttgagcccctaactccactgacattgctatcaaaaacaccaaccagtccttagctgtcctgacccctgtgcaccagttaatgccgtccactccccctcccttgaattctgttattactctgcaattctggctttcctcctacctctctggctggctctcctgaatttccttcaccaactccttttcctctgcccatccatcaaataccaatatccttcagggcagctgtgttgctcttcttgcccttcaccctgggctctccctgagtcctggtttccaaagatttcaggaatcaaatggagttttgagaggctaaagactgcccaaaacatatcttcagtccagccctctctgtgaactagatattcagatatgtccacatctgaattccttatccctatcttccctgacacccgtttcataaactcttctgaagattctaactcatctttctatatcaattcttaggatcacttcatctatctccgtagtgaagctatagcaatatttcaaaaacatgactttcctctgcttaaaacccatcaatagctgcccactaccctcaaagtggtagattgtttgcaacatggagctcaaattccttgtgatgcacagtgagtcctccaggatctcatctctgagaacatccctcagccttccattctacagtgggctacttcctggacctatatacactgtgctcattctctgtctcttctagacactttcatttgccacttctctctacactgcactttccctcattcttcacccgaccaatacttattcatccttcgtaaattaaccagaatgtgatcttttcaacaaaaccttccacagctacccctcaaagccaagcaggtgctccacctttatgtacccatcactacctggatgttataattggttgtctgctggtctcatccatgataagctctttgagttagaaggaatgccacactctttaatgcattcctatctcttaaaatgatacctggcagaaagtgagactccaataaaaacctattgagtgaatgaatgactgtatgaatgaatgaaataaaccatgttagaatttcccaaattatgtttgttgagattttctgcacaatgagcattgttggtcttagacattcataattcaccaaagtgaattatattaaaatttacatgaaattctgcaataaccaaagctctagctttgtctgacatagtgcacccaaattaacaactgtgcccttttctgcagaatacccactgataccctttgtgttaaataaatatgtgtgctccgactgaatatggacaacctttctggcaagtgacacaggacctaacatgtctggaaaggagtgtaggggagagagagcagtggatattgtaggagagatcacaggacgccaggccatgagaagcctcataagccaaaaaagcattttggctttcaccctgagcaagatagaaaaccattggtggactttgctcagataagtcacttgatctgaattatgttttaaccaatcatattggctgctttgtctagaacagaataacaaagggcaaaggaagaagcaggggagatgagtggggcagcctttgtagtcatcaagacaagagatgatggcaggcttgaaacaagttagtggcaatgggggttgtaagaagcagtcaaatgtatgatattttttgacctaagaaaagtcgaaagaattgtagaggaaatatctatgtgccctctgacatctacaactgtcaaacttctgctacatttgccttatcacacatagccatctggctatccaataaaccatccatccagtagatacgtattttgaaggaaaagctgctaatggtgactgaggtatagtttttggtttgggggttttctttgtttctttttgtgatagaattcatataccataggattgactccaatatttctgacttaagtaataataagatgaaacttccattgactaaggtgggagatgtatattaaggcacagaagggagagggatatcaaaagctcgattgtgtatgttagtttgaggtgcctattagacatttaaggagagatgttgagcaggtagttgcatacacaagtttagagtatggagaaaggtccagaccagagatacacatgtgtgaatcacagtgactcaacaggcagtgattcccaatcagagagaccagatcaataaagcacctgcatcattagctataggataatggctaccatttaaagaggatgagagagaaaatgactgatatggagtccatccaaaccaaggacagagacatatccattcaatgtcctatacagacgtcatactctgaaatggtgtgtaccaggtcaaacaaaaaagatatctatgactttatctacttttaaccgtttcaatggcaaaaaaaaaataatggtaggagggaaagatattagttgtatttgtagtcacatgccattacatttcactggaacctagtaaatatatatttaatgaaaaaaatcattgaaaataaacatacatgtgtgaaaagtcatgtgcaaaatcaggatgctattttctttatttatttcttttttttttttttgagacagggtctccctgtctcacccaggctggggtccagtggtgtgactgcagctcactgcaacctccacctcccaggtataggcaattctcgtgcctcggcctcccaagtagctgcgattacaggcgtgtgccactacgcctggcaaatttttctatctttagtagagatggggtttcactgtgttggccaggctggtctcaaactcctggactcatgtgattccccccatctcggcctctcaaagtgttgggattacaggtatgagccaacacacccggctcagaatgctattttaaggtcttcattttcagaatatcatcactggaattttcttactaattccaacatatattcattatttaatgtagtatataatgtataaatcccctaggccaaagagttctgtataaaataaaaagtattcttctagaatatatgcctctgtctatgacagataaaaaatataaacattagtaagctttagtaaaatttgccccatttggacatacttgaaagtaaagcagttacatgatcccacatctctgacaacaaaatcaataaatatgagaaatgtgtgatagtaactttacacacaccttattccatgtcatatttacagtccttaagctttctgaaattttatccctttcaggtaaactcagacttttatctgaaagcatctccaattcagttctattcagccatttgagtttttcagcatgtacttccatttcttgagttaagtcctggagaagttaaaagataggtgtggttagaaggtagtcagataagggaaaattcaagaactgtattagaaacctttttggtattattacaaatgtaactttctaatttgttaagtgaaaaaataaacttataagaagcttaagctcatgctaacaaatgataactaggaagggagtgagcacatgccttctgtgtgtatttttgcactcctgtgcacaaacgggctctctggtactcactgtctcttaaccgggtcatatattatttttacactgctaatttaacattctgttcttatctcctccttgctactccatcctaatatactgttccaccttttctaactctcctcaaattgtttacaaaagagacattcccaaaaaaaccactgaaatttttaggtaaaaaaggaagcttgttagatattgtcacattttaaaaagaaaacttaatatatgttccacaaaatatttttcatcattattcaatgtttctttctcaaaatgcttcaatcatactcctttatagacaaaatctctgaattagtaagtaacctttcacacacacttatgcttgtacatgtatgaatacacactcataatttcttttttttttttttttttgagacggagtctcgctctgtcagccaggctggagtgcagtgg

SEQ ID NO: 414 - DNA, 4034 bp, Homo sapiens
tttttaaacaacttaataaatgaattaatggaaaatttttctagttaggtaaatacggataactatcactcacaaaagcaaaagctatttgagggtcctcaataatttttacaagtgtaaaggggtcctgagagcaaagtgttgaggtgctggtaatgctgtagaacaataagaacccattacacacagccagtgtcagtgtaaactgggccaagtaatccagacagcaccctaatggcagctagtgaagtagaaggcacccatatgctaaacccagtgattccatcactagatatacaccctacagaatatctcacacatccttctgccccatcttcactttaactttttttgtagataaaaaaaattcattgttttaattcatcaaatacctattaagaacctattatgtgtaaggggctattctagacgctgcaggcatgagagtgtgcaagacaaagtttgggctggagtgcaatggtacggtcttgggtcactgcaacctccacctcctgggttcaggcgattctcctgcctcagcttcccaagtagctgggattacaggcgcccgccaccacgcccagctaatttttgtatttttagtagaaacagagtttcaccatgttggccaggctggtctcgaactcctgacctcaggtgatccacccgccttggcctcccaaagcactgggattacaggcatgagccaccgtgccctgccagagcttgcattctatcaggaaaatggatgtgtgttatgaagtaaaatcaatacaagaagacagagacagggtgtatctgagatattgtgggcaagaaagggctattctagaaagggatatctgaaggagaactaaaggaagtgagtatgtgaaacatgaaaatatctaagagaagaacatttggggaagacaagaagaaggaacaccaagcacaaagaccagaaatgattacgttcttggcatgtttgaaacagcaagaagaccagtgtatttgaaacagaatgaacaaagggaaaagtagtaagaaatgtgattaaagagacaggcagatatgcatggtgttctggactaaggccagactttggaactcatttatgtggatggaagtgattaaaagactgtgaacaaagaaacgacacaatcaaactcgtttaaaagaatcactctatctgctatcagaggaataggtcatggagaagtactgaggcaagaataaaatcaggattatgagttaggagcatattccaataatctagatagaaagataagggtgttcaagaccacggaagtaggtggaatggaacatggaaatgatgctacttgctgatggattgaatattaattccagagaagagttgaggttgactacaagtttattggcctaaggactgggtgaatcatctaaaaaaaaatgtctacagttctgggactggtaagcataggtagaaaagagaatttagaggattgtagtatatccaatgttatgtaatactgtacatcagtttaaatgagtagactagagctacatgcttcaaaaggtatggcaataaggatgatctagtagctatcagagaaagaggatacgtaagcagcccagagaatatgggatcctatgcataagtggaggagctggtcttaggaaaagagataataaccctttcactgaataggaaggaagtgtgtaaagtatatgggtacagccgcaggtagcttgatggattctctggtgggaaaacgaaaaaggttttttttttcttttgaaaatgagatgaggtcactagttgagaaatgagtaccaaggagtactcagaagaaagtacggtaggactgtctcttagcgctgagtgcttatttgaaatgaatagtcatagctctgaaatgagtacagtcggcaaggtgttggcaaggatgaacctcaaaaacattatgctaagtaaaagaagcatcgtatgactccatttatatgaaatatccagaatagagaaatccatggaaacagaatgcagatcggtggttgccaggggctgggagtaggagggaatgggaagaaactgcttaatgagtaagaggttttagtttggagtgatagaaatattttggaactagatagaaatagtggttgtacaacattgtgaatgcattaaatgtcaccaaattgttcactttaaaatggttaattttattttctaaataaaatgttaaaaagaaggaactgaattaaaacactgcgtaggaggagagagacatactaagattagcttcaggtctcaggcctatcccaaggacgaatatcctgttaaaaatgagccatccacctaatggaagttgtagctttgctgttagctttttatacttctaaatatgtattcaaattttccctgctcctttaccatatagaggttttaaaaagtaagataacccatgacgattttataaaatgcatcaaattctttccctatgattatggagttgagcctgtatttgcaaagcagcagtacccaaatgtcaactcaagtgttctgaatattaatcaagaaacttgatcaggccccaggtactttttgtgcaaatttccagaaatacaagtaataaaaaacacaaacttggtcctcaattagcttgcaatctcgaaaaatgaaaaaaaatatattgtctgtcatcacttttttcaaaacttgaggggaggaggaggaagagaaggaaaagaaaagaaaaataagaggaataagagaaataaaaagaaccctcccaaaaaaaagaggtagaagaggtagaggtggaggacgagagaagaggtagaaagtagaaggtggacatggaagtcaaggaggaggagaaggacaagggagaagaaaaaagcggggaggagcaataaaaagaatcagcagaagcagctgtcagggagtgagtggacagttagagttggtcacatttgcggttttgccaggtgactcaacagaggaagagcagggcatgatggttcagaaaacttgcaaggcagtggcaacagtggctatggggcaggagcctgcgatctaatctggataaagagagaaggaaatagtgagaaaacattcttctttctccacatccaagtgagaagtatttgtctcctaggttggagaatgcttctaaatatccatcccccacctgcttcccaggatatctaagccttttgttctcagtcatgatcagggtctaattacatatgttaaccaagctcatgttaacacaacaagttatagctgatttcctgaaaagctgcctggacccagaaaactagtccccagtttttgcacctagcctctcatcttcccttcggcaggacctgtggatgcccaggtagcactggagtccagagaaaggccagccttatctgccgcgagaacaaatgccttacccacactgggcagccaaatgtgtcttgggtttaaagaagatgttctttccaaatcattgaaagtagattaaataaagaaaatggcacgacgtttctaagtctttctaattcatgtatgaggctcatatcacaaaattttacatactgattttttaaaaaactttgttaaagataaacatatcttaccagcaatccttgtctgtgaaacagaactgggctcctggatgcattccttcagggtggtaggcacctctctgcaaatctaccgcatcaggacaaacagaaagagaagaatactacgtaaataaagatgactgtagttcaaaagaagaggtgttattctgaatggcagctctgctacttttcttcccctaacgacctaaacttctggctctaccttcactctccattgcaatcttgtttgagcccctaactccactgacattgctatcaaaaacaccaaccagtccttagctgtcctgacccctgtgcaccagttaatgccgtccactccccctcccttgaattctgttattactctgcaattctggctttcctcctacctctctggctggctctcctgaatttccttcaccaactccttttcctctgcccatccatcaaataccaat

SEQ ID NO: 415 - DNA, 4023 bp, Homo sapiens
aggaactaaaaatagaaattaacattcaccagggaccagaagaggagggaaagatgtcacaaaggggatgacattttagctgctgcgtagaattgcacctgggaagaaaaggccaagagaaataaaataatgcaaataaaggtaagaagactaggaaatgtcaggatattttaaggaataacagcataattacaggccgggctgagggctgaagtgagaaaaggggtagtggcagcagattgtgacaatccctaggtgtcactcttgagaatttagacttcgtttgctattggtagtacattcccactaagaagggtttgtagaacctagatgcttctgagctagaatgcaaaccccaagcaaggatctttgtttgctattgttttgtatgtttattttttgttgttgttttctctcatttataactaaagtatccccaaattaatgccagtcacataagcacatagtagttgctcaataaatatttgtggactgaattttgggttgagttaaaagacacagtaagacctgattttagagaataaagtataatgagagaaaggatttgcattcttgtgagttcctttaacctttttttattcctctaaaagaaagcctaagttaagagaagaaaacccaatgtgtaagtaattacttaagagtcgtgatgttaataattaaggacttcataaggttattgtaacaatgttcacaaaacataaaaacaagggaaagctacatttctgtataaataaagagtaacaaatattaaacactattactttctagttgaataatctttgaaaatgtgtttgtgtgtgtgtgtgtgtgtgtgtgtgtgtgtgtcaccatttgcagggaaagtggatgataatacataactttttttaaaaaacttacatttttctgtaattgctgttctcatatctgaactggaagctttatttttcaaattctgtgccaatgtaaaaacataatccagctgaggatggcgctgttctaagtcagcctttgtaatctgttaagtagaaatgattattcggataggttaataagccatatgagaagaataataagcaaaacagttgtgctgacatcaaagttgtcgttgttttcctcctctatggcatagtgaagcatcagcaacgtggcagaaaatgagtgcatgatttaaagtcaaggatcctgcattcaaatctcagttcttccatttagcacctgagtcaccaggcaaggagctttacctctctgtgtttttgttttcacaaaaaagaaataataaaatactgacagctcaattacatccagtctgaggacattaaacaaagaaaatcccttcaaaagctgaaaaatgccctgaaaacattagcagttattgctgctgatgatgacttgcatatctgttctgtgtcaggtacgaacacaaactaatgtcatagggttgggggtgacacagaaaagtgctaagaggaataactataaattaaatcctcttagacacgaaaaactgctgctgtagatggtttgtctctcagtgctaataaatatgggagaaatggtaacaacatcaggaaaatcatgtgttttcagtacagaactaatgacagtcatagagactagaaagcaatttacaaaaaatacaaatagtggcaaatgactttttcccagtccttcctctttacaaattcacccgttttgtagattccagctactcctttggtgtcaaatattacttctaaatggattgctcacaactttcaatcctaaatcccagggcacatggtaatgaatactgatcacttccttctaaatggcataaggactccccaccacaacacgtctgaaactaaatcactcaaaccctcattcacactcaatttcttctattccttatttctgctaattgcaacagcatcatcttagtcatttcagaaagggctctttgccttgatttatgcatttcttgcctccaatccatcctagtcttctactaaagcagagcacggttatcatgagttcataaacacaattttaaaaagaaaaagaaatgggaaggaagatgtttaccaattgcttacagactaaaaatccaaagggctttgcacagcctgcaggctccttcacaaagggaatttgagctgcttttcctgccttgtttcacactgtatttcttaattgcacaaatgttggccctactgtcctttgtgcctcctgtaccacatgactttattcactctgttccctataccaggaatgtcaccactttgtcccagatgccaaaatcccacacagtttgctttccatcactggagaagtgatccccttcctcatcctggctcccccaacaggttgcctgtacttctcctgaggcttttattagactcttgccttgctacagtaatttgtcaactcatatgcactcagtgcctctgcctcggtgtggacttatttgtaatgtggggataaaaacagtacctatctcacaagactattaaagaattgaatgagataacgtgtacaatacttagaaaaatgaccagcacacatgaagcacttaataaaatttagcaagagctgttattattatttcattgtagtttcccaatttctacctagaatattcttgtcagtatccttgtaccactcacagcccagaacttagcacacactaaatagggaaaaagaatttttacaaatgaatattagatggtacatgtatagtagtaaagttataggagatattcacttttaaaatcagaaattaatctcattatgaaatataagttgcaaaggcactttaggagattatcctacatcacacaacaggcatgaaatgctaacgccagcttatatttatactaatgtgcctagctttacggtatcagttttagattttaaaaatgcactgggtctttagtttaagtcagtaaacctgatcatatcacaacagtataaatgcaagaaaagctctatgctttgtagttagccctgaatggttgtttgacagatacagaattttttaaacctcattctctcatagtttaggataaacaaaagggattcaaacagatctggtctacctctgggttgtggcgtttccatgacaagcttttacactatgcacctactttcattcgggaaacggtcttattgatctcttctacatccccaacagtgacaatgttggacttcagcatctggtcgattaataccagccagtcggctagttctgttatagttttatcaagatcagcaggaattgaaatttccgaagtacgatgagactgaacaggaatatctgacgcagatgatactagcaccaccttttggacattaggatgagctgaaatgaaaaatgtagcaaaagagaaattaatcaacaggatgttttaattatggtggtgtcatggtgacacgtgtatgtgtatttaaataaaatttagtttaagtaaaaaaaattctaagaggttattttttcatactgaaatggctatggtattacctgtaatatccatatgtctttggtagctatcaagccaacaaaacagttttgcaacattctataacataatcagcactgacactgagaaaaattaaaagtacaaatgtgggagaactggaagtattattttattttggcaagatgattttaattataaagccaacttattcataattttttatttttttcatttaactttataatgtgagcatattttattcttagtaaacacaattatgaatacctatgtaataacctatacccatattcacttttatttaacccttggatatttagattgctcctgaaattttattttaattttttaaaaaacttgcaaagaatatcttttcatgtagagtattttgcacatttctgatctctatcttagcatagatttcccaagtagaattactgagtcagaaaatacaaaaaaaagtatgtatttaatattcattgccaaattgattggttttgatacaataagtagttgaattagtaattaaaactatctgtaacct

SEQ ID NO: 416 - DNA, 4033 bp, Homo sapiens
agctatcaacaaggctgttcaggccttaagttatacttacatgtcatcattctttaaaacttgctcaatgagacaatctgtttcattctgtcttagctgtttaaataaattgcttaagttttaaacttaaggaagagaggccaaatctatcataatgttctcttgtcagttaaaaagttacataaagtacttatgaccaattctattactaatagaatcctttaacagtaaacaaatgaaaccaaagacatcaagcgagagtaaatatcacaggtttatcataagaaataggcaaattatcccattcattgtgagttaagccctaaaacgaggttactattggtagcaatacattccccctgggaagggtttttcatataatgaggagtgatgaaggttatagaacctctacacacacagaaatatttatatatagagagaaaatagagtgtgtacattcaatgggaaagggaagatatttaggagaagtcttgtaaaacaaaaaaacaaacacctgaaagaagttttggacaaaaagagaggtgatggaaaaaataataattaaaagaaaacatcaagatgatagaaaaagcaaactggaaatggcttgtcaatagtttggtatcactagagcagaggagctcccctgtgatgtgagggaaaccagctcactccaaagttccataataggcacaatccatccattcataaaaagagaaaagaaggaaaatgatgtatttagtaaaaataagccaacactgttagacattaaaagttcttttctaatgtatctcctataataaccctgttgctaccatgactattttgaaatcaaaacatactttttacagggagagtagctgactttcttcccttgacaaatattaggatttatccttccagtttatattttgtcacaaatatttattaggtagttaatttgtattggcactgttaaaggcccaagggcagaaagacggatattcacaatctatggaagagagagacaattaaagtagttgtaagatctataataaagcaatggggggaaaggccatagaaggaactaaaaatagaaattaacattcaccagggaccagaagaggagggaaagatgtcacaaaggggatgacattttagctgctgcgtagaattgcacctgggaagaaaaggccaagagaaataaaataatgcaaataaaggtaagaagactaggaaatgtcaggatattttaaggaataacagcataattacaggccgggctgagggctgaagtgagaaaaggggtagtggcagcagattgtgacaatccctaggtgtcactcttgagaatttagacttcgtttgctattggtagtacattcccactaagaagggtttgtagaacctagatgcttctgagctagaatgcaaaccccaagcaaggatctttgtttgctattgttttgtatgtttattttttgttgttgttttctctcatttataactaaagtatccccaaattaatgccagtcacataagcacatagtagttgctcaataaatatttgtggactgaattttgggttgagttaaaagacacagtaagacctgattttagagaataaagtataatgagagaaaggatttgcattcttgtgagttcctttaacctttttttattcctctaaaagaaagcctaagttaagagaagaaaacccaatgtgtaagtaattacttaagagtcgtgatgttaataattaaggacttcataaggttattgtaacaatgttcacaaaacataaaaacaagggaaagctacatttctgtataaataaagagtaacaaatattaaacactattactttctagttgaataatctttgaaaatgtgtttgtgtgtgtgtgtgtgtgtgtgtgtgtgtgtgtcaccatttgcagggaaagtggatgataatacataactttttttaaaaaacttacatttttctgtaattgctgttctcatatctgaactggaagctttatttttcaaattctgtgccaatgtaaaaacataatccagctgaggatggcgctgttctaagtcagcctttgtaatctgttaagtagaaatgattattcggataggttaataagccatatgagaagaataataagcaaaacagttgtgctgacatcaaagttgtcgttgttttcctcctctatggcatagtgaagcatcagcaacgtggcagaaaatgagtgcatgatttaaagtcaaggatcctgcattcaaatctcagttcttccatttagcacctgagtcaccaggcaaggagctttacctctctgtgtttttgttttcacaaaaaagaaataataaaatactgacagctcaattacatccagtctgaggacattaaacaaagaaaatcccttcaaaagctgaaaaatgccctgaaaacattagcagttattgctgctgatgatgacttgcatatctgttctgtgtcaggtacgaacacaaactaatgtcatagggttgggggtgacacagaaaagtgctaagaggaataactataaattaaatcctcttagacacgaaaaactgctgctgtagatggtttgtctctcagtgctaataaatatgggagaaatggtaacaacatcaggaaaatcatgtgttttcagtacagaactaatgacagtcatagagactagaaagcaatttacaaaaaatacaaatagtggcaaatgactttttcccagtccttcctctttacaaattcacccgttttgtagattccagctactcctttggtgtcaaatattacttctaaatggattgctcacaactttcaatcctaaatcccagggcacatggtaatgaatactgatcacttccttctaaatggcataaggactccccaccacaacacgtctgaaactaaatcactcaaaccctcattcacactcaatttcttctattccttatttctgctaattgcaacagcatcatcttagtcatttcagaaagggctctttgccttgatttatgcatttcttgcctccaatccatcctagtcttctactaaagcagagcacggttatcatgagttcataaacacaattttaaaaagaaaaagaaatgggaaggaagatgtttaccaattgcttacagactaaaaatccaaagggctttgcacagcctgcaggctccttcacaaagggaatttgagctgcttttcctgccttgtttcacactgtatttcttaattgcacaaatgttggccctactgtcctttgtgcctcctgtaccacatgactttattcactctgttccctataccaggaatgtcaccactttgtcccagatgccaaaatcccacacagtttgctttccatcactggagaagtgatccccttcctcatcctggctcccccaacaggttgcctgtacttctcctgaggcttttattagactcttgccttgctacagtaatttgtcaactcatatgcactcagtgcctctgcctcggtgtggacttatttgtaatgtggggataaaaacagtacctatctcacaagactattaaagaattgaatgagataacgtgtacaatacttagaaaaatgaccagcacacatgaagcacttaataaaatttagcaagagctgttattattatttcattgtagtttcccaatttctacctagaatattcttgtcagtatccttgtaccactcacagcccagaacttagcacacactaaatagggaaaaagaatttttacaaatgaatattagatggtacatgtatagtagtaaagttataggagatattcacttttaaaatcagaaattaatctcattatgaaatataagttgcaaaggcactttaggagattatcctacatcacacaacaggcatgaaatgctaacgccagcttatatttatactaatgtgcctagctttacggtatcagttttagattttaaaaatgcactgggtctttagtttaagtcagtaaacctgatcatatcacaacagtataaatgcaagaaaagctcta

SEQ ID NO: 417 - DNA, 4023 bp, Homo sapiens
agcattataaaagaaaaaaaaatcccaacatgtaaccctcaggagaaagaaaaaatatcatatatcaaatgtatcacaaataagtctataaacagaagaaggcaagctgataaacacattttgaaggaattttaatatacatctgccatcctatacaattgatatatttctgaaacggtgtttgagaaaaaaaaatcttgaactcttattttcagtgctctaaaacaactcccaaaaaaatatctactattataaactgatactgccaaacaattataaagaaaatactgttctatttaattttgtatttacagttgtatttatagacctggtttgatgaaggtagggtttaacagtacttcatgacagaactttaagacagagagatagtcacctgttaccctcaaaggagaattttctaaggcagtcttgattttagaagaaactgaactgtgtaagaatttttttttgcatttgttttactgtagcaggaaaactctctaaaaggaattttatatattcaagttcaagagaaatgctaaaagtaaaagagactcatgaactgtgcacccagcagctcttcatcataaaaattccatactggctcttgtccttcctcttttattattgttcattcctttcactcattatcaccttctctctctttctatttctcctcaagctttctctcttctcctttctctatttttaacaaggttttaaggacagacagatctaaggaaactttttttttttttttttttgagagagagtcttgctctgtcgcccaggctggagtgcagtggcacgatcctggctttcagctcgctgcaacctccgcccccaggtacaagtgattctcctgcctcagcctcccatgtagctgggactataggtgtgtgccaccacacccggctacttttgtatttttagtagagagagggtttccccatgttggccaggtctcgaactcctgacctcgtgatctgtctgcctcggcctcccaaagtgttgggattacaggcatgagccaacgcacccggctggaaacttaaattttttattaatcacttcagagttagttcataatcttgaactgaggtactaataaacaataacttagaatatccgcaagaacctgctgataataagtaggtagaatgttaaaaccacgctgctgaaagatgctttggatatcagacaaaaagaaaggctatagttaagtaccaggcccaagaggaacgtaactacaagataacattccagctgagttatcatggaacactttggcaaagttcttgggataatatatggttatagtgaaacataaaagctatcaactggctgggtgcagtggctgacacctgtaatcccagcactttgggaggccgaggcaggtggatcacctgaagccagaagttcaagaccagcctggccaacatggtgaaaccctgtctctactaaaaatataaaaattagctgggcatggtggcaggtgcctgtaatcccagctacttgggaggctgaggcaggagaatcgctggatcccaggaggcagaggttgcagtgagtcaagattgcaccattgcatccagcctgggcaacaagagtgaaactccatctcaaaaaacaaaaaagctatcaacaaggctgttcaggccttaagttatacttacatgtcatcattctttaaaacttgctcaatgagacaatctgtttcattctgtcttagctgtttaaataaattgcttaagttttaaacttaaggaagagaggccaaatctatcataatgttctcttgtcagttaaaaagttacataaagtacttatgaccaattctattactaatagaatcctttaacagtaaacaaatgaaaccaaagacatcaagcgagagtaaatatcacaggtttatcataagaaataggcaaattatcccattcattgtgagttaagccctaaaacgaggttactattggtagcaatacattccccctgggaagggtttttcatataatgaggagtgatgaaggttatagaacctctacacacacagaaatatttatatatagagagaaaatagagtgtgtacattcaatgggaaagggaagatatttaggagaagtcttgtaaaacaaaaaaacaaacacctgaaagaagttttggacaaaaagagaggtgatggaaaaaataataattaaaagaaaacatcaagatgatagaaaaagcaaactggaaatggcttgtcaatagtttggtatcactagagcagaggagctcccctgtgatgtgagggaaaccagctcactccaaagttccataataggcacaatccatccattcataaaaagagaaaagaaggaaaatgatgtatttagtaaaaataagccaacactgttagacattaaaagttcttttctaatgtatctcctataataaccctgttgctaccatgactattttgaaatcaaaacatactttttacagggagagtagctgactttcttcccttgacaaatattaggatttatccttccagtttatattttgtcacaaatatttattaggtagttaatttgtattggcactgttaaaggcccaagggcagaaagacggatattcacaatctatggaagagagagacaattaaagtagttgtaagatctataataaagcaatggggggaaaggccatagaaggaactaaaaatagaaattaacattcaccagggaccagaagaggagggaaagatgtcacaaaggggatgacattttagctgctgcgtagaattgcacctgggaagaaaaggccaagagaaataaaataatgcaaataaaggtaagaagactaggaaatgtcaggatattttaaggaataacagcataattacaggccgggctgagggctgaagtgagaaaaggggtagtggcagcagattgtgacaatccctaggtgtcactcttgagaatttagacttcgtttgctattggtagtacattcccactaagaagggtttgtagaacctagatgcttctgagctagaatgcaaaccccaagcaaggatctttgtttgctattgttttgtatgtttattttttgttgttgttttctctcatttataactaaagtatccccaaattaatgccagtcacataagcacatagtagttgctcaataaatatttgtggactgaattttgggttgagttaaaagacacagtaagacctgattttagagaataaagtataatgagagaaaggatttgcattcttgtgagttcctttaacctttttttattcctctaaaagaaagcctaagttaagagaagaaaacccaatgtgtaagtaattacttaagagtcgtgatgttaataattaaggacttcataaggttattgtaacaatgttcacaaaacataaaaacaagggaaagctacatttctgtataaataaagagtaacaaatattaaacactattactttctagttgaataatctttgaaaatgtgtttgtgtgtgtgtgtgtgtgtgtgtgtgtgtgtgtcaccatttgcagggaaagtggatgataatacataactttttttaaaaaacttacatttttctgtaattgctgttctcatatctgaactggaagctttatttttcaaattctgtgccaatgtaaaaacataatccagctgaggatggcgctgttctaagtcagcctttgtaatctgttaagtagaaatgattattcggataggttaataagccatatgagaagaataataagcaaaacagttgtgctgacatcaaagttgtcgttgttttcctcctctatggcatagtgaagcatcagcaacgtggcagaaaatgagtgcatgatttaaagtcaaggatcctgcattcaaatctcagttcttccatttagcacctgagtcaccaggcaaggagctttacctctctgtgtttttgttttcacaaaaaagaaataataaaatactgacagctcaattacatccagtctgaggacattaaacaa

SEQ ID NO: 418 - DNA, 4049 bp, Homo sapiens
tgaatttgtccactggcattggttctttgacatagtttttcagcctctgagagtctctggatcaaggtactcaccatgaaatctaaatgacaactgaaacctttaatataatgctttttgtagcaattgggaagattttaaatcagcctaaggtttcagaagaaaagaatcacactgctgattaaaaaataatgttctaatatgataactgaaacactgacatcacttttaattgtattcctctagttaaggggccaggggcttcactattacttgggagtcatttggtggaaacagtcagcagtatcacaaacacacagaatgatccagaaatgcatataactggccacttgcttttaaaactgtaaccaagtaaagtctgcatttgtggagaataaaaacatacttccacattttcgattgttttctacatatactttcttaaattcttcacaaatatacacttccatcttaggctagctgaagggcaaataaatgttataccaaactataacctcacaactaaaacctccaattcaagaatattttataattttatacagagaatcttaaaagcacttttaaaaataccatagttgttcaatattatcaactctataactgaactgatgacaaaaaagatgtctgctattacgaaattgataaaacagtttggttaaaaagtcattaaaggaaactaaacttacttatctgatttgttcactatagtagtcctcaaatgaaagtcttggaaaaacttattaataaaaataaccttcagggtaagtaagtaatatggtttggatttgtgtccccacccaaatctcatgtccaatcgaaggaggagcctggtgggaggtgactggatcatggggatgaatttcccctgtgctgttcttgtgatagtgagttctcacaagatcagatggtttaacagtgtgtgacacttgggaggccaaagtgagcagattacttgagctcaggaattgcagacaagcctgggcaacatggcggaaccccgtctctacagaaaatacaaaaattagctgggcatggtggtgcacgcctgtcatcccagctacttggaaggctgaggcaagaatcgctggaacccaagaggtggctgttgcaatgagctgagatagtgccactgcattccagcctgggcggcagagtgagacaatgtctccaataaataaataaaatgtgtggcacttctcccttctatctctctctgtcttgctgccttgtaaagaaggtgcctgcttcccctttgccttccaccatgattttaagtttcctggtacctcccagtcatgcttcactacagtagccctcaaatgaactgtgagtcaattaaatctcctttcttcataaattactcagtctcaggtagttatttatagcaatgtgagaacagactaatacagtacagaagggagcaaaagagggttcctggaatcttgaaagtgttctctttctagatgctgatttgagggtgtgtttcacttgcaaaaagtcagtgagctataaatctcggagacatgcatattcttacttgttatgcctccagaaatttttcgaaaaaaatcttccagatcaaattcttcatataaatttcattagacactctaagaacttaggaaaaaacatggcagggtcctattgttaagaattacagtgaacaatagaaaaaaagtatatccaacaaaacaatactgccaaaaaatatctgatgagtcttacttggttatcagaaatttgtttggtgagtggatcccgtcgggcttgctgaagaatatagagtcgagcctcatattttctcatcagttcttcagtctcctccctatggtcatcccactgaagactgtcaataatcatgtcctcaagctgctgctgtcttagctcaacgccatgctgggtgccatcccactggttcttgaccctttccactgagggtagcattataaaagaaaaaaaaatcccaacatgtaaccctcaggagaaagaaaaaatatcatatatcaaatgtatcacaaataagtctataaacagaagaaggcaagctgataaacacattttgaaggaattttaatatacatctgccatcctatacaattgatatatttctgaaacggtgtttgagaaaaaaaaatcttgaactcttattttcagtgctctaaaacaactcccaaaaaaatatctactattataaactgatactgccaaacaattataaagaaaatactgttctatttaattttgtatttacagttgtatttatagacctggtttgatgaaggtagggtttaacagtacttcatgacagaactttaagacagagagatagtcacctgttaccctcaaaggagaattttctaaggcagtcttgattttagaagaaactgaactgtgtaagaatttttttttgcatttgttttactgtagcaggaaaactctctaaaaggaattttatatattcaagttcaagagaaatgctaaaagtaaaagagactcatgaactgtgcacccagcagctcttcatcataaaaattccatactggctcttgtccttcctcttttattattgttcattcctttcactcattatcaccttctctctctttctatttctcctcaagctttctctcttctcctttctctatttttaacaaggttttaaggacagacagatctaaggaaactttttttttttttttttttgagagagagtcttgctctgtcgcccaggctggagtgcagtggcacgatcctggctttcagctcgctgcaacctccgcccccaggtacaagtgattctcctgcctcagcctcccatgtagctgggactataggtgtgtgccaccacacccggctacttttgtatttttagtagagagagggtttccccatgttggccaggtctcgaactcctgacctcgtgatctgtctgcctcggcctcccaaagtgttgggattacaggcatgagccaacgcacccggctggaaacttaaattttttattaatcacttcagagttagttcataatcttgaactgaggtactaataaacaataacttagaatatccgcaagaacctgctgataataagtaggtagaatgttaaaaccacgctgctgaaagatgctttggatatcagacaaaaagaaaggctatagttaagtaccaggcccaagaggaacgtaactacaagataacattccagctgagttatcatggaacactttggcaaagttcttgggataatatatggttatagtgaaacataaaagctatcaactggctgggtgcagtggctgacacctgtaatcccagcactttgggaggccgaggcaggtggatcacctgaagccagaagttcaagaccagcctggccaacatggtgaaaccctgtctctactaaaaatataaaaattagctgggcatggtggcaggtgcctgtaatcccagctacttgggaggctgaggcaggagaatcgctggatcccaggaggcagaggttgcagtgagtcaagattgcaccattgcatccagcctgggcaacaagagtgaaactccatctcaaaaaacaaaaaagctatcaacaaggctgttcaggccttaagttatacttacatgtcatcattctttaaaacttgctcaatgagacaatctgtttcattctgtcttagctgtttaaataaattgcttaagttttaaacttaaggaagagaggccaaatctatcataatgttctcttgtcagttaaaaagttacataaagtacttatgaccaattctattactaatagaatcctttaacagtaaacaaatgaaaccaaagacatcaagcgagagtaaatatcacaggtttatcataagaaataggcaaattatcccattcattgtgagttaagccctaaaacgaggttactattggtagcaatacattccccctgggaagggtttttcatataatgaggagtgatgaaggttatagaacctctacacacacagaaatatttatatatagagagaaaatagagtgtg

SEQ ID NO: 419 - DNA, 4040 bp, Homo sapiens
atagatgcagcaaaccaccacatttacctatgtcataaacctgcatgtcctgcacatgtatcctggaacataaaataaaataaaataaaatatttttttaaataaataattgtgtctttttaaattccgtatcttttcttcccaggatggttggacttttgctttggcagaaaatgcttaattgcaaggtaaattcagcaactgtgataattctgcaaaccaaggaaactgcattttttaagaaatttcatctgttaataaaattttagaatatctatactgcactcagaaaagcagacaaagaagtattttatcattaattaaagtagaaagagttagaaatgactatggacaaacaactgataatgactcaaccttctgctaatttaaccccagaaagtactgtgcatttgactaaaggaagtggacttatcagaaagacattatatgaaagagcatatgatgacactttgggcatctttttcttaagcatatactacctaccaagaacttttacacataacttttgatatcacaataaccccacatattagacatgttctccactttagaatcaaggaaatggtgactcggtgagttgaaataacttcctataggttagcacagaaggcaagtgcctaagatgggcttttaaccaaggattgccccatataccttacactcagtgctttctgttctgcctgtacaaacctagaaataccttaacataggcaaggtaaaatgcgataaggacaaggagaaaaacacagagtaattagtgatttctaagaaactatttatagcacacagttatactgtctcatttcctttacaatacttcagtgtagataactatgtgtgtatatacatgagtgtgcatatatatacatacctgtatatacatgcatgtgcaaacacgtctatacacacagttatatgtgtgtgtatatgtgtgtgtataaacacacacatatatgtgtatgtatatatacatgtgtgttacacaggtgtgtatacgtgtgtgtgtgtatgtatatatatatatatatatatatatatatatatatatatatatatatatatatataatgttatttttgccctggagtgccaaaatatatacagctaaaatagcattttagacccaaatcaggcatccacactgactgtgctataaacacatttcaacaatcactatctcaactggcactagaaaatttgttaattagcattaagagatggaaggaaaaaaagtgataagtaaaaaaagtagtggtcaggatatatagattagttagaaacattagagacaggcctacttttcaaagaatccaaaaaatcaggattcagttgcgtttcagaagtaatattatttttgaacattagaaaactaatattatgaaagtaactatattaattactacccctgaacagggtctggggaagcaatcaaacacattaatatttctgcagcaaggaaaaaggctattcatactaaccagaataaataaagactttaataaagagctgcatggtaattcaaagatttctgttatcaaagctgtttttagattttggcattgtagataagggattgtggacttataattgtgaatagctaaattatttaggctaactgcaattcatacaaaacatttcctttgaaagctgatattgaacttcacacattatgctgcacagtattccatgtgcaaatataacaacccttcacccctccagaatttggctgacaatgatgtatataaagaacaggctggaagataagagggcagccatggtaaaaaggcctctcagcagccattagacggggtgtgatggccacgtactggagtgcattacattatgcataaaaaaggccccgtatctttcatctgatatggcttctaaactcaacacagataagaatcagtaagcggaattacagacagaactgagaggcgggtacacaaagcagtcaccaagaatgtcagcaacggctgacagtctgattcaaagaacaaaaatgaaactgtttttagagacaataagagcctggcttgccagtcaagcttgaattccaatcccaactctgccattataagctgtgtagtcttgagtaattccttaacttctctgtacttcagtttattcattaacataggactgatgaaaatgctacctctctcctgcagttgttgtgaagattaaatgaaatgatgtgtgtgaagaggtcagtacagtgcctgacaatgagacgacactcaaaatttatacgcacaaaacaaagccccaaatctcacaaagtatagcagcctgaataaatttactgccaattcttcagaactcacagcatgaagagcattaccatttagtatagaaaaatatcatcctgactgtgttgcatgactttgaacatgtcacttaacttctctgagcctgagaatattagattagaccatgtattctcaacacaggtaataaatggttatttcttttcagggggagggtgaaaaaatgtattctttttatgtataaagcacaaccatacagtacacagtatatcatggtattaaaatttcatgggaagatgagtctacacaggctccttagggaagcgataatgtaaagaaaggttgagaaacactggttcagaagaactctaaggtcactcgtatccattaaagttccttaattctatctttgcaacaatactaccaagaattcagaaaaaagttaaatatacattcacaagctttaagaaggcaaagaaagatttatatattctacaaagatgtccatttaaaatagttaaaaattgtaaagttcactgggtttaaaagagaaaactctctttacatatagaagccctagttatcattcacgaagggatcctatgagccagttttgctctgttttccctgttttatagataacaatatatctaaatcatgtctaaatattaatataattacttatttccaccccccggaaaatgcagagagaaaacacaataaggacaaccacttgtaactacaaagaaactggaacattgtaattgtcttagctatgataaacgaaaaatcaccttgcaatataattcatttttaattgcctcttccatctaatccaactactgctgtaggctgtcttaaaatatttacaaagtaaaagcaaaaaaaaaaaataagaagaagaattggaggtgctaaataaagcaggccacacattcctaacggataaattttttgttaagtttacaaggaaaacaaagtcctaactcttatacatggaatttttggaaacacaaagacagagcatatttaaggactatatctcttttttttatgttagctatattatgcaaataatttttattcatcgtacttactgtaatacgtatatgttttcatccacagttcctgcaacataactcccataacacttgttatagccttttgttctaatattggggtgcctcagggctcagaagcaggcctcagaaaacaatctctctctgtgaccttctcctgccctttcacctccttctttctctcctgaaggcaggagtcttcccctacctttctgtcttggagatggccataaagaaattctctaacctgctttgtctgattgtaggtcttttcttttttttaattattattattatactttaagttttagggtacatgtgcacaacgtgcaggtttgttacatatgtatacatgtgccatgtcggtgtgctgcacccattgactcacatttaacattaggtatatctcctaatgctatctcttaaggttaaagctgtttttaattcaccttcttccctgcctgagttatgatatccttactaaatccaaataacctattataataaaagagaaaagttgtagtaaaatgttagaaagaccaatattatagccactctgctttaaccacttgtgaagttttgtctttgctaacccagtcttattttctccagtatccaaggtatatctaacaacacattcaacctcacattgtgccatcataaccctctt

SEQ ID NO: 420 - DNA, 4101 bp, Homo sapiens
ctaaaatttacataagattaatgtgccattcactattaagatactgcaaagtaccagagaggtaacaggtcttaatgaatgtagtagttttgcatcatattttctccaaacatttcactagcccatctcagaagacaagattgtgtcaattgcaaaagaaactatgtactaaaactaaaacctgttttagatttttaaacaaaatgtaattatgcaattcactttaacagctttcacaatcagttactaagaaagggaatctttccttgataagaacctgaaagattagtttttagagcctgagaaacagtagaactgtcagacacccgagatccttattttcaatcactcagttaccttacagagcttctgataccgaggagaagaaactgccatcctttgtaagcgatgcaacaaaaccacaactttctgcagagacgttctcaccacagccatcattttaagtttaccacacttctggagacacctcagaatttgcattataaatgaagagcaacgatcatttcctcccggtcactggacaatgatttgtcagttctctgagcatgctcgtttccaggaaagcatttgaaagatacagggggttaggttctaggaaaaaggaggctggtattccttcaacttctcaatttaaaaaacacagacaaacgccacagagaaagccccccagcagatgctcacaggcagcacttgctcagcccggcatggccagaaatgaaggaagttgtcgagcagccaagcgctgccggctgcgggagaggagtgcgctcagtagccaaagaggatattaagtgaaacattaaagctgcagatagaaagcggacatcccctgggaacagggattcaacatatcactgccaccaccacggtgcatgccctgtagctggtttctattaagagagaacagagcattcaccgtctctaaagagggatatgttcactacccaataaatgcagctctagctgtgctctgtgaattagtgaacaggagaccctgttataaatcttgagaagagcagaagggtacacctgactctgatgacaacagcccatacattaagtgctaaaaaatcacccccagacagatctcagcccaaaatcacctaaaacaaaacaaaacaacaaaaataaagcaaaacaaaaaatacttgcaggggttatatgactaagacaccctaaaagcagagcgatccagtggattctcatctgcctgcctagaaggaaagccattagaaatggaataggttaggatttgtctaattaaacagctaagtgaataaaaaattaaaagtctgtaattgactactgaacattccaaattgccacatttccccttagacagcatcttcatgatctcattgtatttgccataaagctgttttaattttatgaataggaaatatgaggccataattatatcatataaaaatccagtacataattttggggttctatgtgtatatatatacacacacttgagacatattctctactgcagcctgaacatcattgcaaatatcaactggggtaaagtactatcaggagatgtgcaaaataaccctggatgattaaatgactgggtcaaagagcacagccagaaatagaacccagatgttgctcattatcagtgtcctgctcaaactggtaaccgggctaatgctgcaatttcacctctgtctaatgttgtcatgattctttaaaagaaatgcagtattttcaagtatttgtttttcctcctttacttcatttgcctttcttagtccttcatgttacaacgatttaaagtcctatattgtgtcttacagaacggtgtttatcaagcagtgctttgccgactttattgggtcttatagaactgtgttcatcaggcagtgttctgtggacttctgcctgtatcttttttccctgcaggtccatactgagaatctacactgcctccctctggtgaggctaacaatgtcaccatatctgtgtaaagccaaaagtggagaacatattcaaaggatagagtataaaatgttaaggtatttggcaaatagatagaaatagattagtgattgttcagaggggagggaattggcggggaggaatgggaaattgctagtaaagggaaggggtttctttctgaggtaatgaaaatgttctaacttgattgtggtgatggtcgtacaatcgtgaatagactagaaacaaatgaattgtaaaatttaaatgaatgaactgtacagtatgtgaattatatgccaagaaagttgttattaaataagtatgaagctataattcctgtcctagaaccagcagatgaagtccccatgagataggcattcacccctcaaacacagtgctaagcatgcagctgggcacaggagaaaatctaaaacaatctataatcaaagtctgcatctatggaacaagacgatgaaaatgaggctaaaagcaaacataggagataaaagtgtaataatcctaaaacgtaaattattagagagcaaaaccagccacccatgacaacaccactccagaaaggcagcagaactcaggattttacccagcaaagaatcagagcatttcaattaattggtaatgccaaatgtaaagctgaaatttttaaatataattaaaagaataacaatcttttagaatatgaacatgcacattaagaataaatgcacttgaactaataaactagttggaagtcaataatgggctttcatacaaaagcaaaaaataaagtttctgcatctttggccaaatactcttatctgaatatagattcacagtgacaactgcataccaggcaattcctcctggatgttactccaatgcttcatttcaacaaagtcaaaacagatgaaatttgccatccccacacatttcccgctaacttgcaaccctgctctgacattttcttctatgttcccagtcttaggctctaacaccacttggcaatctgcctttccccttcctcagtctatgtatactattgagtcattagatctactacccctgccattgtctcctttctggtaattattacctgtagcctggatggctacatgagtatcctaacaggcctctcttctgtcactcttgtctagttcaagtccattcctcataccatcagctaaattcctataaagcaaaaatcccattgcatcactcttgttactatcctttatgacttctcttcattgccactggattaaaatataaatacttgcatggcatttaagaccctctatgagctggactgctcagttctcaaggagcttgtctctcctgcagggctccaaagaatcggcttttctcttgccaaaaggcttctgctggggaataaatcctaacagccttgcagcagggcaatgaaacatagatacataaatccaaatcatcatccatccttaaaagaatggcatgtatcatagcatactcccaaaagttaatcatcttccatgtgctttagacctatccttatcaaaattcacccaagattcaccttaaactgagcatagaataaactgctttatcttcctgaaatactcccatggccttggatctggttgtcataagacatgaagcaagtataaacagcgaatgtgtcagctaagtagttctacatacacatcctgtgcatgcagcaaagatacacggagctccttattccatcttccttagtgcacaaagactgtgcaccaccagcaccaccaccaccactgccaccaccatgccaccagaacttttctgttatgatttgccatgcttctgtacagtcattttctccaacaaacgtctctccatttccaaacaagtttctattttaaatgtctgtttactcatacaaaaggagaatcattaatatacaacaccataaaaaaattaaaattctcttgcctcagaaaaactcagtaaaaggtactaaatctctaacaatcttctatctataaggtgctgaaaataaaaccatggaacttttttaaaaatagaatggagagaacactttaaaattaagagcatttaataacaaagcaagggagtgaaaaatcatgcgaattaccgtaatgtgaaacattctaaacataa

SEQ ID NO: 421 - DNA, 4050 bp, Homo sapiens
caaatctataatttaattctagacagactgacttctactgtgaattatttttcatttttgcttgaaatattgtgtaattccctcatcaactaagtcataacataaaagtataacatttttgtcactcccataccaaactgacttacatccaaaagaaggctgtttcctttaaaagaggcattctgaagaattatgtccttattttaaagatacaaatattatgcaatttcttttttagaattcctttttggaaatgctgtctgtgtttgagtatctccaatattcacaaatatttttcctttgaaaatgaactaaattttggaaacagtcaaaaagatctggcatacatagctggcaatcaaaagggcaacttttttattaatataaaaatgtaaatgaatgaactttgtagacatttatgatggacaagtacccaatgttctctgaatacaatcagcatacttttgtgctccatgtctgaggcagaagaatagggtctggagacaggcagcctaaggccaagtcatggctgagttcttggaattgggccaaaaggaaaaccccatctctccatgcccaagtgagaagaggccagagactcccctctttacaaaatccctctaccctagcctacaaatgggaaatgcctctgattggttgcaggccaaagcttaccttcagcctctgattggtcgcaagccaaggcttcacttcagcctatgattggtcacaggccaatccttctttcatatagggtgttgtaaccaattggaggcctctaagggtacctaggggtgtcaccaaatttttttagtttaataaaatccctaaagcaaattgcaatcagggcttttgggccacctgctcaagcccattcccactctgtggagtgtacttttctttcaaaaaatctgtgctttcattgcttcattcttttgttgctttgtttgtgcattttgttcaattctttgttcattgcgccaagaacgtggacagctcccagtcaagactttgcattctggtaacaagtttactcattcagtctattcgcagagttttctgctctactaaaattctatctactcctcaagatccatattagtactaacacttctctgacattttaaattcagattttactgccccttcttctgtgttcaaacaacttctagttttattatactgtatttgttgcatcccattttagaaactacagtgactgggttctcagtatctgaaattcagacagttctgggatagaatatttgatcccacacaggtaaatcattcaacttgactaggtttccgtttatattctataacagggttatgattttcatctaacaacttcataaaatatttttaattggtattgcctattgtctgtgaggatacaagaaatcaggcattcaagctggtagtggttatgtaaacaggtgctaccttgcaagatggaaatccggcaataaatatcaaaagcttttcattggctgggcacggtggctcacacctgtaatcccagcactttaggaggctgaggcagggggatcacgaggtcaagagatcgagactatcatggccaacatggtgaaactccgtctctactaaaaatacaaaaattagctggaagtggtggtgcacgcctgtagtcccagctacttgggagactgaggcaggagaatcacttgaacctgggaggtggaagtagcagtgagctgagattactccactgcactccagcctggtgacagcaagactcttgtctaaaaaataaaaaaaaaaatttaaaaatttaaaaagcttttcattgttctggtccttttggtccagttatgctattctaataacgtaccctggacataatcaggatgcacttaatgatgtataaggatcatagaattatttatcatgagaacattggtaacaacctagttacctaaccatagtgggttccctgaataaattatggtgcagccactcaatagaattttatttacattgttttaaaaaagtcacaatataagacataaaaaaagcattcatgacctacaaagcattcacgatgtgtaaagtgtaaaaggaaggctataaaatcctagaataaagctacagagcaaattgcatttcccgtacttctatattacaaccaccctagcctgcaggatgccagggtaggtgcagctacactctagacttttaaaattctgaacccagagtaaatacacaatcagataatgttttcaactaaaaaagttcccccttttctctacctctttaactcttgcaacatttaccctgaagaaaaaggaaaattcttcattttataaaatttttgagccaagaatcaagaactttttttttccggctataattaatactagatttataccaagaatactaaattcggattttggggggtgagtttagactcaaaactgatggcaccaaaaagcataattcttaaaatgtatactttccagaagtacatttaaaattctcagtatttctttccatcctctactaagcaaccatgtttgtttttcctcctgtatcactcacagtaaagacgacttctttcctttgctttgtttagtttctggcaatggaataggattctttttaatatgaggttttatgtcaatcagcattatatcagtttctttgtgggttaactagatttttaggggccatctcagagcctaatctataatccagaaaaggcttcataaattgaggagcatcctacaggatcttctatcacaagccccactggtcaagggaagttttttcttgcatttcctcaagctgagactcagagaaaataacaaccccagggaaaatttcaaagatttattttctccttcactgttgaaagcaggagtttatggcatcttcgcagtggggtgaccagggtgcatctgaaccccagtgagtcaaagtctgcaggggcatgaatcctttggaaaaattctctgggcgactgtaatgtgaacatccttgttaagatgtaagggttacttcagagataaagataatgaagattatgatgccatcaccacaaccaagagacatgagactgtgctaggcatgtcaggtggatcatctcatttgatccacactcaatcaaggtgggagaataatcctaccaatagtggtaacggtaacaacagtagccaacccacatagcagatatgtgccaggctttgtttttaccattttatcaatattaacttatttaactcctacaacaaccttatgtgtgtgtgtgtgtgtgcatgtgcgtgtgtgtgtgtgtgtgtgtgtgtgtgtgtgtagattgagagagagagagagactaattccaaccctatcttctgaaaagggaactgaaacacagagatgtggaaggatttgccaaggttacataactggtaagtggcaaagccagaactgtttgaatttagtctcacgctagactcgtgtgaacgactaaaattcctcagaacaacatatttgtacttccttgtttcccatggaaaatgcaacactgcattttacatttatgctgcttagcacatatctctgatgcatgacagccattcaatacatgttctttgaattaaattttttaaaaatatatacatatttcttattttaaacaactcagtctgttaagttagttgactcctttcagtttctttcttagggagctattatgtccttttaaatataatgataaaaaactacatgtgggtatggagaactgggttcaatgaacacataatttaacgtttgtactgttaagaatcaaaccaaattaagttataaatcaaaaaccagaaccaactattttaatatggatggaaatgacccaatccatctttcttatcaaagtgcaaaatgaactcatttttaaaaatctttatttccttaacattatatagccaatacttgaacatcgaacatcgaaatagttttgaaaagaatatatttccttacttttaaacttctaggaaaacaagtacatagccacctgctcaaaactgtcaggaactttggaaggccgaggca

SEQ ID NO: 422 - DNA, 4023 bp, Homo sapiens
agctttcataaaggacaattttgttgctcatctctacaggaattagtaaaatataataaatgagggtatcaactctacatatttcatgctttgaaaagttgcaaacttttatagtaggcatgcctagcttttgcaaaaggaaaaaatgaatttttaaatgtgtttcagttaaatgtaaatgagctaaatgaatgaaagctgcagactcaataaatgtttattgccaggtaagttaaggcactttttttttttttttttgagacagtctcactctgttgcccaggctggagtgcagtggtacaatctcggttcactgcaaccttcgcctcccaggttcaagcaattctcctgcctcagcctccccagtagctgggactacaggcatgtgccaccacatccggctaattttttgcactttcagtagagacaaggtttcaccatgttagccaggatagtctcaatctcctgacctcatgatctgtccaccttggcctcccaaagtgctgggattacaggtgtgagccactgtgcctagccaaggcacttttaagccattttgcacttgtcaccatctgaagttgaaacatgaagaatccaaaaacaaaagcatttcaagttcttttatgatgctcaacagtaaagtatgcaagggctcaagtaatctgacaagcttttattagaatagggttgttgttacctataagacattttatcataaaaatattcaagcatacagaataattgaaaaaagagtaaaataaatacccatatactgacaaccagactcaacagctgttaagatgttaccatatgtgttttatctaaagagatacatttcattaattaatttttggaaccaccttcaagtaaatcatttactccaactatttgattcatttgatgtcaatagtccaaattagaaacatataaaatacactttggtagtacagtcccatgaaacccaaaaatggaatatatccatatcatcgcagtttggtcattgccactactaattaatcctataggattaactcttttaagcttctgtctcctgatcttgaaaaaatcaggaagctaaacttgagaatatccaaagtcaccataggttattaaatgttaccatttcaatacccacaggaaaactctactctcactgccctgtttgatctgcatatgaaactcggaaaaaccataagacacctggacgacagctggccagaagctgccccgtaccctaacccgcaaggatgtggacacatttctagaaatcactccagcttttaaagtaaggatgacatttggcataagtaaactattgaattattaagttgtctaatgaggtactgattctcaaccacatgcaacttcctgaaattttggtttatatgacataatttctccaatctttctctagcttcctatcaagcttactgctcagcttttagaaataagcataataggtcattaggcttccattagaagcaattacttcaaaatagagcaaatgttcccctttctttaccaccacaccgtataaggatcttccacaaagacaggccatgtaatgaagcaatctaggttttgtttcaagaattaatgcaaaacagcactcagtcattatggtcattaattcaggttattcactacctatcaaaatcacactctcaaaaaacatattatgcaaagccacttgagatttaccagaatgtttaattattattgaaattcaagaaagatcttccttcttcaagccttcccagcatctaagattactaatgtatagatttttaaaattatggctgccctaattctggattgaataaagacttcaaaatacttcatttgactagatgctgcagactcaggggctattagtcctgctctgaagacatggacccttttatgtagccccagtttgaatctaagttgtttggaaatagtatgattttactggcagagaatgtacctcaatatggaagctggctgtgtgccccaggaaagaagaaaaatgaactgaccctgcattgcagaaagacctaaggtggttagtattcaacattcttccgcctcagttgagacacacagaagtttgagttagtcactgttttcaaaacgcatttcagcagtgcatggtgagaaactcaaatgtaggtaaatattgtcattgattgttatttgttgtttttattcataggaaatttaatatttcgatttccataatactccagctctgcatagcaaattcataaacattaatacactggtcctataacagctttctaaaatatgtggaatgtaaattattcccactgtctagaagacaaaactgaggactgatatgtcacttgggtattacataagatcaaacaagtaaggaatcaaatctagatcttgtgattccaaattcagcatttttcccattatactttacttgtactgtattctaaataatttctattaaaagtacattactgtgcatattttatagatatgatttacatagcatttaacataagctgccctagatagtactaagaaaactcaaaactatcaaattctctaagataaagtagtaaatttatcacaatgaattagaattatatttccatgacttttacctaatcccatggtttcaaaatcttactgtcaatctaatattaaaaagagaaagtgttcagggttgcctagggctggggcagtgcggtgggaagaaataggaaatgactgctcatgagtgtgagggatttctttttaagaagagacaaaagtgctctaaaattagattatagtgatggctgcacaaccctgtgaacatgccaaaagcactgaattgtacattttaaaagtgacttttacatgaattatatatcaataagactattttgaaaagaaaaaaactaaagtcaaagtatatagaacttctgctttactgtactaatttttaaatctaaggaaaaattgaaatttggtttatttattcaatatttacaaatactgttttgtccacagaactagaaaacaaggtatagtcccaaattcaagagtttacaattcagaaggtcaaaaagaaataaatagctaattatagtaccaggcaaagttaaatacaagttccacaaaaataaatgcacataagatgtagtgaaagatactacagtaatctcctgggagcttaaatatggagtaccagtgggttgtgtgaccttgggcagcacaaaaaaaatatattaaagcactttaagagcaaagctctacatagatgttaaggcactgcttccctatttataaaataaggaaattggtcatttctacaatttccataaactctaatgttctacaaatctataatttaattctagacagactgacttctactgtgaattatttttcatttttgcttgaaatattgtgtaattccctcatcaactaagtcataacataaaagtataacatttttgtcactcccataccaaactgacttacatccaaaagaaggctgtttcctttaaaagaggcattctgaagaattatgtccttattttaaagatacaaatattatgcaatttcttttttagaattcctttttggaaatgctgtctgtgtttgagtatctccaatattcacaaatatttttcctttgaaaatgaactaaattttggaaacagtcaaaaagatctggcatacatagctggcaatcaaaagggcaacttttttattaatataaaaatgtaaatgaatgaactttgtagacatttatgatggacaagtacccaatgttctctgaatacaatcagcatacttttgtgctccatgtctgaggcagaagaatagggtctggagacaggcagcctaaggccaagtcatggctgagttcttggaattgggccaaaaggaaaaccccatctctccatgcccaagtgagaagaggccagagactcccctctttacaaaatccctctaccctagcctacaaatgggaaatgcctctgattggttgcaggccaaagcttaccttcagcctct

SEQ ID NO: 423 - DNA, 4042 bp, Homo sapiens
accttctagctcataggaaacactatactaatcatgcttgagattaccagtcaagtagtgaggaaatattttctgacaaattgcaaaatattattttttcaagtattttcagtttcctgggattgaataaaaccattttaaaagaatttatcataccgaagggaaggaaaagaatgaaaactagtctaacagataactaaaaacatgcagttaattcatcaaatagaatattagtgtagtgcagcccattaaatggtacttagattgcttttccttttgatgactactctggtgactatctgaaagaaattgtgtgttcactgagataatgtactcactacaaaacaatacatcattcaatgccacacttctgaggaaaaaatattttgtgaacaaaatggagaagcaggccgggcgcggtggctcacgcctgtaatcccagcactttgggaggccaaggcgggcggatcacgacgtcaggagatcgagatcattctggctaaaacggtgaaacgccgtctttactaaaaaaaatacaaaatattagccgggcgtggttgcaggtgcctgtagtcccagctactcaggaggctgaggcaggagaatggcgtgaacccgggaggcggagcttgcagtgcgccgagatcgcgccattgcacttcagcctgggtgacagagcaagactccgtctcaggaaaaaaaaaaaaaaaaaggagaagtagtgagttatatttcaagtttccttactccttaagaaatgtactatctgacggaataggtaaaataattataaatatatatgtccaatttattttgttaaatgcctcattgcacataagcaatgaagcactggcaaaatactaaattatgccaaatattattggttgtttaaaaacatactttaaaaaggtaaaagttgggccaggcatggtggctcatgcctgtaatcccagcactttgggaggccaaagcgggcagatcacctgaggttgagagttcaagaccagcctgaccaacatggagaaaccctgtctctactaaaaatacaaaattagccaggcatggtggtgcatgcctataatcccagctacttgagagaatgaggcaggagaatcgcttgaacccgggaggcggaggttgcagtgagccaagatcttgccattgcactccagcctaggcaacaagagcaaaactcagtctcaaaaaaaaaaaaaaagtaaaagtttacaatataaaaataagtctattcttacacagtatttctaacatttgtgaaaacaaatcacgggtatgctcttgctgttaagatgtaaaaattaaataagaccgcaggtatcagagaaaggagtttctgcagttcaagactgaggacaatattttacaaaattgtacatctctgctgtcaagaaagacaatttataaaggtctgagtcatgtttgctattatttcacttctcatatttctgaaattttcaggaaaaaaaagtagaaaaaaaactgcacctcaatctgtctgtaagtttctattacttacttcccagatcttcaatttgaggagatgtcccccatcttactgagactctccagccatattcacaaacgtttctcagcttttgatttctttttcagtgtcagtatatttataaaatatattttaacacttggatacaattatagaacagaatatagacaatatgaataaccaaaaaccaaatgttaaaaaaagaggatccattttcataacttagtgcagttgagacttaagttgttttcacataggatggaattaagaggaaactgggttttctcagtacaactttggttccctcaagatcatgtaaaagctagatggtccccacagaattcagaaagctttcggatatgcatgttctaataaatgtctttacatttttgatggaccctggcgcttcccaggtcccttacaagccaaggtatctgaaagactttttcttaacatccaaagggtagcaatgtcagtcttttacgataactcagaaaaggtcagaatttcttcaccatggaaaatttagcctccattccctctaaattaattttccttctttttctttctttccagagcattagtatgcctcagtgaagtatgacattattgtgttccgaatgccaagtggaataacttataaaactttttttaatagaaggaaatagaagatagagcccaaagccctcccaaatatgaaatgtgaaaagaagtaaatgagaggagaaccgatccacagtagacaaaatgaaataaaatattctacgctcttttgaaatgatgacaagcacctctctcaacatccttgattacctgttaagttaccacaattttccaatacatacgccaagctctcagcactccctgctactcctttccctcacaaaaccttttcttccttaattatgtatccccacaaattagtcatttttggaatttaaagaatgatgagccaagagtactttaagagctctctaaactaaaacttctttccaaactccctctctttcctccaatatttggaatataagctatacaataagatatcctaagatcagcattgctggagttggccaggtgaaattagtgaatgccagacaggaggttacttaggaatagttccaagtcatcttcaaaagaatagttacacacacacacacacacacacacacacacacacctctctctctcacacacacacactcactctctctttctctctctctctcttttggttttaccttcagcaatgcaacctcaaaaacttgtactccatcctcatactagaagggaatatcacttagcaggttcagctacagacaaggacagagaaggatctttccactgcaactgatatgacaccctctgctttgcctcaaccaaggtcaggggacatgaccgctaataccactgcatgtatgaagggaaggcaaagcagggaagagagaagaaccaaaaccaaaataataaaagtatcttctttcttcttcttttttttacatgcagatgaaaaaaaaatctgaaaagtcttcttggggtggttattgtgaaagagcagggctgaatgagggacaaggagggtgacagttgcagcacaggacacataagcagataaatactgaactcaagcctaatcttcaggactacaaaccgaggaaacatattaatggtatgcagagtaacttaaatatgcatataacaaactctccagctcaattctattcaataaatatttattaatgacctgttttgtatcaggatgatatggtttggctctgtgtccccatccaaatctcaccttgaattgtaataatccccacgtattgtgggaggtaactgaatcagggggaaaggtttttcccatgctgctctcataatagtgaataagtctcacgagatctgatggttttatgaaggggagttcccctcacacactctctggcccaccgccatgcaagacgtgactttgctcctcctttgccttccaccacgattgtgaggcctccccagccatgtggaactgtgagttaattaaacctctttcctttataaatcacccagtgtcaggtatgtctttattagcagggtgagaacaggctaatacacaggccctcagcaaagcatgaaaattaacaagactaagctctccttttgagtgttaatccttcctataatatatatgcttagtaactcccaatcagaatgccacttcattttttatttattttttgagatggagtctcgctctgtcacccaggctggagtgcagtggcgagatctcggctcactgcaagctccgcctcctgggttcatgccattctcctgcctcagcctcccgagtagctgggactacaggcacccaccaccacgcctggctaatttttttttgtatttttagtagagatggggtttcaccatgttagccaggatggtctcaatctcctgacctcatgatccgcctgcttcagcctcccaaagtgctgggattacaggcgtgagccactacgcccggccagaatg

SEQ ID NO: 424 - DNA, 4047 bp, Homo sapiens
cctcccacctcagcctccttgagtagccccattgccttctaaaaggattataagcaataactacaatttaatatatatcattctctcatacaagaaaaagaaaatacacataaagtatgtgtgcaacttccaaaattaattttaaataccactggtaactcagagcactatttagtaactttgattaattgaaaatcaattctgatgtaattttccaaacagatataccctagacctaactttttgctaagaaaatggatgttgtatcactatgaaattctacatacagtgacaaagacagaactatgacagacctatgttaagtgacttctttcactgttaaacaaaaattctaatgatttactacctgtgaatccctatttaaaggaagcatccaggccctagagataagcagtcccaagaggaataaaaccaatttcaccacattcaaaacaaaacactgcagtctgaaagaatgacaaaaaacatgaactattttttctatttaaatacatttcaaagaataaaaacagtatgaatacatcaacaaggatgacagatgctcaagagcttatcttccgagtataatgagcactgttttaaagaaaagtcccctgtacttcaaaattgtttcaaatgtttcaactagaaaatcattagtggtttttttaaaacagtgctctcattagataaaaagcttttcggagtttataaactacattaaccatttggggtatttcagaactaactaacatgttggaaaagaaaatttcctaaatactatcttgatatctagagctaccaaacactgaagctatacaaatacagcgtagtgtctaacaatgtctgatgcataaggttaaatatgtctcttctatgagccataattcctgaatcctcctattcactcaagttgtttaaaaggctcacgtaaagaagccataataaaactttttaaaaagatttttttaaaaattcagaaaaagaagaacattaaatcagaaagtggaggctatcgtaggcaattataattgagcacagggctcccagcaagtgtaaatgagcctggagctccctggctgccaaagctaacagaaaagcagaaattagttacatcattacccaatgtccattagggtggaggggaaaaggcaagatgttgaaacatatgccacgtacagaaaaacaccatttctttttttttttttaaacaacgtgtatgtgaatacaagtgcttgtataaaaatacataaaattttctggaaagctgtataagaaacagtggttattctgggtgtggtacttaggaagaatcccagggcaggagacgttgcacgttataacatgtatctactactatagttgctctttcaagaaacgtgcattatttcatagtgtaaaaatctatattagatttatatatagtttatattaaactataattttattttataatttagaagtataatataaatgaatgtaaaataataaagaagatagtacagggcagagtaacgtaagggccacataactacattagattctgaacatcacaatatgatagaaatcaagaagcacttggctgggcgcagtggctcacgcctgtaatcccagcactttggagggacgaggcagttagattgcttgagctcaggagtttgggagcagcctgggccacatggcaagaccctgtctctaccaaaaatacaaaaaactagccgggtgtggtggcatgcacctgtggtcccagctacttgggagaatgaggcaggaggatttcctgagcccaggcagcagaggttgcagtgagccaagatcacatcactgcacttcaggctgggtgtcaatgaagactccgtctcaaaaaacaaacaaacaaacaaacaaaaatcaagaaagaagcacgatttcaaccacctcatcacaaaatagttaccaataaaaaaaacctcaaggctactctgttacagtttgtaatcaaacttaaagatagctcaaagcagaaatccaatcatgttctttcacaagaccagtgagagagagaatgagagttcaagaaagagagaatgaacgaagaaaaaagaataaggaagatgtaaatgctatactgcaagcaactataatcccaatgtatagcactggagtgagctataaagatgactattacaatgtctgcaaatatgtattaaaatgtctggaaatatgaggaaaagaatacttctgctgctaaaatctatcttctttgttatcttcattatcaaaggaaaactttcttagagaaaccagcttaaaactattttttttttattatactttaagtcctgggatacatgtgcagaacgtgcaggattgttacataggtatacacatgtcatggcggtttgctgcgcctatcaacccatcatctacattagtaggtatttctcctaatgctctccctcccctagccccccaccccctgacaggccccagtgtgtgatgttcctctccctgtgtccatgtgttctcattgttcaactcccacttatgagtgagaacatgcagggtttggttttctgttcctgtgtgagtttgctgagaatgatggtttccagcttcatctatgtccttgcaagggacgtgaactcattttttatggctgcatagtactccatggtgtatatgtgccacattttctctaattacaagcataagaaagtatgaaacaaatcatgacggcttacacttcgatggaatagaaacttttattaaaaatttgcaacatactataccttaaaaatttccacttttaaaaatactatcactattacactcaattctagggtacttaaaattcatacatataaattataaataaacacccaaatacagtgtcaaaagtcaccacattcatatatttaaaaaaaataataattttctaagaagtcacagccaaaggaaagaatgactaggtttaaatatttcaataatgtgaattattaaattttttttaaaggcagcaggggggcctaggctgggcacgatggctcacacctgtactcccagaactttgggaggccaaggcaggcagatcacttgaagtcaggaattcaagaccagcctggccaaatggcataacgtcatctctactaaaaatacagaaattagccaggcgtggtggcatgcacctatagtcccagctactcaggaggctgaggtgggaggatctcatgaacccgagaggcagaagttgcagtgagctgatatcgtgtcactgcactccagcctgggtaacaaagtaagactccctctcaaaaaaaaaaaaaaaaaaaaaagaaaagaaaaaaaaaaaaaaagaaaaaaaaaggctagctgctaagtaatactgagaagtctatgaattcagaaaaggacattgcaggctgggcatggtggctcacgcccttaattctagcactttgggaggccaaggtgggcaaatcactgaagcctcagagttggagagcagccttggtaatgtggcgaaaccctgtatctacaaataataggaaaattagccagaggtggtggtgtgtgcctgtggtcccagctacttagtaggcagaggtgggaggatcgcttgagcccaggaggtcaaggctgtagtgagcccagatcatactacttggactctagcctgggtgacacagtaaaaccctgtctcatgtctccaaaaaaaaaaaaaaaaaaaaacacacaaataactggaggttttagattgttgattgcctttaaaaaccatttcatactaggtgacaatattcccatatatacacaaaagactaaaaacatattaacaggcctagcagttctactcaagaggaataaaaccacacaaaaacttgcacataaatgttcatagcagcattattcggaatagccaaaatatggaaacaacccaaatgcccatcgactgatgagtggacaaacaaaatgtagcctatccacacagtggaatattatttatcaatgaagagaaaggaaagtaccacaaaagctacaacatgaacaaaccttaaacacatgatc

SEQ ID NO: 425 - DNA, 4051 bp, Homo sapiens
gaatttctaaaaacgtaagagaaactcaaactctaaaagtagcattttggtatctacttaatataagcatggcatccagaatctataattaccttagggccaaggaatcatttccataatgggttatgtaaacccaaaataaaactctacatgcccccctaaccatctgaatggaccaatcctcttggccaagggcgttccagagttaacctgaaaaactagttcaggccaagatggaagagggggtcaacatgcctcattacacccctccagcattaacatcaacacagactttaagtctgatatgaaacatctgtaatctgttctctctgaagcctgctacttggaggcttccccagcaggataaaactttagtcttcacaaccccttattgtaacccagacattcttttctacattgaataattctttcaaccaataggcaatcagaaaattttcaaatctacctatgacctggaagcacccgtccctccattttgagttgtcccacccttccagatcgaaccaatgtaaatcttaaatgtattgattgatgtattatgtctccctaaaatgtataaaagcaggctgtaccccaactaccttgggtacatgtcctcaggacctcctgaggctgtgtcataggtgcatccttaaccctggcaaaataaactttttaaattaattgagaactgtctcagatattcttgggttcagagttattatcattggtaagaatgagttaggaaccctaagatacaatctagtgcacagtttgtactactaataactgatcttcctcaatttcaaaggaaaaaaatcttttatttcactttatttacttattaatctgaaataaatattctttgttcaggaacttctggtcttcaaatgaaactgataaccaaaagactgctggcattaaaaactatttcaactacaaaaattaaaaattagtatattttaggtttcaaaaacaatgaggatcacagttgagaagcagttcttttcaaaacattttaatttataatataaatattgggaccaagttggcagactttcatacaaacccctaataataacagttgttaaaacaagcatttatatagcaattttcatgagatcagagctttgaataaacaaacataaactgtactcctgattatatacctccctgctcaaatctgtaagttatgagatactctttaagggataaaaacttaacacatttttttctggcaatttctcaataaactctaaattcatgatcttagtacagaaatatataaattgaatgtacgatatcagtttaggaagacgtaaaatagagtttagacactgtaaagcttttggggttccttggtattatactaagggatacacttaatgtatcatgtttgggactggactttggcggtcctctctaatctactctttacaataattcaattccatctataatatacttgataagtatattccaatttctctttgcgcatctgacacagtggggaactacttctcattaacattagattccacaatttgttcttgatattaaggtggaggggggagatgtttccacgatatgtcttagcttcctcttgtatcacagaaccaacacattttcaaaagataatccttcctctatttgactataactatcatgatcccttggtttctctctctctctctgtctctcaatctctctctctctcaaaaccaaaaacactttgttcactgggccattttttcaaatcttaatgttgtctgcatcatctctggcacatgctggagcctttcctgggaatagcctccctctctcctgcccctgataatgcctcatggccctgtggccaagatactatcaacacattcttcagaattatctgcagacgctcttccctggaaagtctgctttggcatttcaaagctttgttaatgcccctcttccatatagaaactcccacagcaacatggcacagacagccctaacacaacacagatcaccttgtctgtttatacagcttcatgattcaaaaaaatactgaaaataaaagcaataagataagaaaaaaaaaaagtaagaagcaataagactgtgtatttgattgatcgggtgtggaaaggaagagaaacaatgtattcaagaatgatacctaaatttctggcttgggtaactgagcaagattaacaaacaagggaatatactaagggaaacagatttgagttttaaagggtctgttgaatcacgaacttgtatgtccagtgagcagttgcatataataatttagagctcagggagagttatgggatggagacaaagcaaatagattgttacagaagcctgggaagcctgggaagagtatatccagtgaaaatgaaagagatttaaggacagaaatctggaaaattagttaagtatggagcaaaggaaagtgaacaaagaaaaaaagtgaaaaaaatggccaaatgtagcaataaaattaagagtatatgacaaatcaagaggtgaggacacttgaaggagagtattgtcagtgtacaatgggacaggaagataaaattatgtaaaatctggggagaggtaagcagtaaggtcatcaaagatcttggcaatgcccatgctgttgtcactgatgcagaacatcattgccttccttttcttttatttttattattttattttattttttagaaacaaagtctcattctgtcccttaggctggagtgcagtggcaagatcatagttcactgcagccttgaagtcctgggcaatcctcccacctcagccacccaggtagctaggactacaggcatgagccattcctgactaactttttttaaaaaatttcttagagatcggggtctcgttatgttgctcatgctggtcttgaattcctggcctcaagcgatcctcccacctcagcctccttgagtagccccattgccttctaaaaggattataagcaataactacaatttaatatatatcattctctcatacaagaaaaagaaaatacacataaagtatgtgtgcaacttccaaaattaattttaaataccactggtaactcagagcactatttagtaactttgattaattgaaaatcaattctgatgtaattttccaaacagatataccctagacctaactttttgctaagaaaatggatgttgtatcactatgaaattctacatacagtgacaaagacagaactatgacagacctatgttaagtgacttctttcactgttaaacaaaaattctaatgatttactacctgtgaatccctatttaaaggaagcatccaggccctagagataagcagtcccaagaggaataaaaccaatttcaccacattcaaaacaaaacactgcagtctgaaagaatgacaaaaaacatgaactattttttctatttaaatacatttcaaagaataaaaacagtatgaatacatcaacaaggatgacagatgctcaagagcttatcttccgagtataatgagcactgttttaaagaaaagtcccctgtacttcaaaattgtttcaaatgtttcaactagaaaatcattagtggtttttttaaaacagtgctctcattagataaaaagcttttcggagtttataaactacattaaccatttggggtatttcagaactaactaacatgttggaaaagaaaatttcctaaatactatcttgatatctagagctaccaaacactgaagctatacaaatacagcgtagtgtctaacaatgtctgatgcataaggttaaatatgtctcttctatgagccataattcctgaatcctcctattcactcaagttgtttaaaaggctcacgtaaagaagccataataaaactttttaaaaagatttttttaaaaattcagaaaaagaagaacattaaatcagaaagtggaggctatcgtaggcaattataattgagcacagggctcccagcaagtgtaaatgagcctggagctccctggctgccaaagctaacagaaaagcagaaattagttacatcattacccaatgtccattag

SEQ ID NO: 426 - DNA, 4065 bp, Homo sapiens
aaatgatacaatttctttttagaaaaacactgtggaaaaatgtaactaaaacactgccagggaaaaaaatataaagtaggccctaaaaatatatgactaatatatagccaaatatataattccatatactttatattttatggctgtcataattatctccatttttagaacttcttgagattattatgatattaacagtttgtaaaactaaatcatattacatgtataataaaatatttattttcacttcttaatgagtcagataaaaatcattcatttggaataccctggtattttattcaaaaacccaattcagtttagaaaagtattgaacctatgtatgaagctcttatattttgcatctctggatccaaaatgacatgtaagcatcagccatttgaacaaatcagggagatttttccaatactaattttagagttaatttaaaatggcataagaggataaggattaggaatttttacttaacaagcatttagttctgtgcataaggtttctacataggcctacatagggttttgcttttccttcacatgtattgatttgcttcagcaattgtggattcatgcctcttattcatatatttccctgctttgcaaaagtaaatataaattagtcatacgtgattcaatattaagaagaaaaatttcccatcgattttgcctttttcaggaagatgatgaaaataattaactacattacaaatgcgacacgacagaaatatcatgaactcaattgtgcaggtaaagcaattttaaaaaacgtgtgcatgtttctagaagaatatagtgctgcaatttttgatccagtctcaggaccacctcagcaaaattaacaaatttttttttttttttgagatggtgtttcactcttgtccaggctggagtgcaatggcatggtctgggctcattgtaacctccaccgcccgggttcaagcgattctcctgcctcagcctctcaagtagctgggattacaggtgcctgcccccatgcctggctaatttttgtatttttagtagagatggggtttcaccatgttggccgggctggtcttgaactcctgacctcaggtgatctgcccgcctcagcctcccaaagtgctgggattacaggcatgaaccaccgtgcccggcccaattaacacaaatttttaacaaaacaaaactatttacaaaataaataaaaatctgaacaacatgactatccaatacaacctactctcttacaggaaaacgttaaactcttttcttcttgttttactcaaatgtaatattttaaaccttaacttatactttggatacttacagtctccttaaaatacattattttccattcctctctgatagaccataatctaaactttcacctttaaagtcccccctaccaacttccatgactctttctctagttttaaaatgataaccactcatgtatgttactttctagtctccatcattttctgatagagacatgagctgttgactacccagtacctttaagtttagccttgaacttttctctcatgcaccggtaggttttccaggacaatctattataaaatagtagatactactataaaatagtagctatatagatactataaaataacaataataactccaggaaaaatatcctgaagatcaggatgaaaggaagactgaagcagaggatttgggattctgataaactccatggaaaaataaaaagtttatgtaaactcagaaggagcaaaaaagtattaaattaggctcatggtcaaaatttctctgattatgtaaaatctatttgagaagcacatccaataatatattttacagtcagaaatataatctacccagggaaatcaatattaaaaaaccataccaatatttattcccccaattctagggaagactatatagtcaaaataaaacaaccgccctactggggaaaaaaaatctcctccttcttgggctggggagactgtgtcactattttgtaatttccccaaaataaagaaggcattacaaattaaatagttaagaaaacgtgacgttgtagagtcccctgagagagtagaggaggtggacagatttgtgacattttatctctagacgaactttcctgtcactagtacaaaacaggaggaatggagccatttgcagcacaacttatctgaacaaggggaaggcaagcacaaaacttctcaaaaatccctcaaaatgtattacttttgcctcttgggattagagttagaaaaacaaaagattgcaaacacaaaaaaagaagatattaaggtgacaatgaaatcagattatcagaaaatgaaaaagaaatggcttgaaataagatctaaacatgacaaggacaactaagacaaaaaattaggctttatacaacgaatataatctctgtggacccacactacatattaaatccacacctgttaattttgctggctcataatactgggtatttgtataagtagtctaaattaaaggaaaattagccataataaaaagagaagttcagaccacgcttttgcagctttttaactgggtcaaaattggccagcccaaacacagacagtaattaagaaaatatcatcatcttttcaaaaagggacatacactctatgccttgtttgagatctcattaacttggaataagttctagtcaaagacaaacaggttttacataccttactagattttaattatagctaaatatagttgctaatttcatattcatgtaaacacttgcattgcctgtgtcaagattcctcagcaatatttctgtgaactgaaaagcataaagtcaaccaatcactaatcaaccgctttattcatggcaatattattcgggtcttgagtattttttccttaataacgagttctactcaattgaatttctaaaaacgtaagagaaactcaaactctaaaagtagcattttggtatctacttaatataagcatggcatccagaatctataattaccttagggccaaggaatcatttccataatgggttatgtaaacccaaaataaaactctacatgcccccctaaccatctgaatggaccaatcctcttggccaagggcgttccagagttaacctgaaaaactagttcaggccaagatggaagagggggtcaacatgcctcattacacccctccagcattaacatcaacacagactttaagtctgatatgaaacatctgtaatctgttctctctgaagcctgctacttggaggcttccccagcaggataaaactttagtcttcacaaccccttattgtaacccagacattcttttctacattgaataattctttcaaccaataggcaatcagaaaattttcaaatctacctatgacctggaagcacccgtccctccattttgagttgtcccacccttccagatcgaaccaatgtaaatcttaaatgtattgattgatgtattatgtctccctaaaatgtataaaagcaggctgtaccccaactaccttgggtacatgtcctcaggacctcctgaggctgtgtcataggtgcatccttaaccctggcaaaataaactttttaaattaattgagaactgtctcagatattcttgggttcagagttattatcattggtaagaatgagttaggaaccctaagatacaatctagtgcacagtttgtactactaataactgatcttcctcaatttcaaaggaaaaaaatcttttatttcactttatttacttattaatctgaaataaatattctttgttcaggaacttctggtcttcaaatgaaactgataaccaaaagactgctggcattaaaaactatttcaactacaaaaattaaaaattagtatattttaggtttcaaaaacaatgaggatcacagttgagaagcagttcttttcaaaacattttaatttataatataaatattgggaccaagttggcagactttcatacaaacccctaataataacagttgttaaaacaagcatttatatagcaattttcatgagatcagagctttgaataaacaaacataaactgtactcctgatt

SEQ ID NO: 427 - DNA, 4043 bp, Homo sapiens
accagaacttctaactctgccaataaaatggcttgaagctgaggcaggttaggaacccctggtatctgacctagacttttaagactaatagcagcaattacaatacaaaagtccagctattgcccacaattactgcctctcagggggtctaagtaatgaattattcatgtaacatatgctctatacctttaaaggaagaaacagacaaatctatacaaaacaagctaacagacctctttatggtcataaagtttgtcacctgctgttaccagctgccataaggaagatattccttgccttccccgccccttctaagtggagagcaagctgagggagaaccgtcttttactctcaggaatttagatgcttaaccacatattaaagcgagaggtcgaagtccgccctgtgttacaagcctaatccttacattacagtagaggtgcagagagagattgggagaagcaactgcagccaggagggagcaaagagctaaattcttctctctccacattcatcccaccataacgttcctatcatcaaaaggcaagcagtgactgcaattgttttggaaaagcttccaaacttttcagatggcatgatgttgcatcttttccctctggcaattgtggtttgtaagaaaaagcccattattcttttaatgactcaatccagtcccgcttctacagtatttgtacttgcaatgatccatggggcattcacggtgaaagccactgagcacagctttttaaatattaataattgacttacataccaagtgagggaggacttcacccctttctgcctttctttttctttaaagactggaaattggaagaagattggtgtttggcatccaaaggctaaagagggcaggagcgcatacacgcatgtggaggttttctgttttaactataaatgtaaggtagtatttggcaggctagactccatctagattgtgccaggagccttcctatggaaaaaagagctacacgcacatttaataatccaagcattaaagcttcacagtgcatgcaagcactccatgtttaaaacagacacgctcagataaaaagcctgaggtcagatgtgccactgtcactgtgaagcgacttctgccacccacagctgagtccccaggcagagggctgtacagggcagtgcacggcaggcagtggctggacagataaacctgaggggtatggagaacagaacccatgcctacgaagtcagactttggcaccaatacccagtgttttttgctggatttttattttattttcattttcttttttttttctccaaagaagtttcagttaaattaccagctgacttgagtacaaagagtttcttctgatgtggaattctaaaagtgacaggcatcatgagaagccctcctgaccaaaggaagtaattgctaattagccctttacttgaaaaacatctttaaaggagacagcaaaattgaatattccttataaattatactaaaccaccaaagagtcaatagagcatctatctaaatgtatagtgaaaaaaaaggcaagaaagaaaggaaaaaagtacattcatgaagtttgctttctgcataccttttcaaattttgtcagcagttcccgtaagttgaagttcagaccaatcattgtccagtagcccttgaagcctacatctttccggcaaacttccttcagacaacagcgtttaacttctaaacaccgtatcttttctggctatactttaaaatcctttgtaaaatcctttacaagccttgcccttgagctatggtccatcagcagcagcggcagcttgcgctgggacattttagccaccccactgtgggtccgttttttcatggacttcggagttcgcaaggaatagacctgcttctgtatttcctggtagctgtgttccacgaggctggcatggtctcctctttctctgggaagtccaggattcccttctgctcacctcactaatgacctgcaggccacaactgttctctccagggccccaagcttagagtttggtctcaattacatacagcaaaaaaagaagctatatcctggaaacttgcatgagagaagaaaaaaaaaaagccaagtattaccaacttcctccattcagaccgatttcagaacgaaaaaaaaaaaatcctgggtaaagagccagttttcaaagagcatgacttatgtagagttcgaaggaggagtgtactcttagctgaagaaacaccaaaacacaggacaagaggccaccggttctcactctcccagacaccagcagcctgggttgctatggtaaccaccaagctagtttcagtccatttccctaggtcagcctggcctaagggatgctgtcaatgcaacagaactaaacttgttttaaaaggtgttctgtctgtccagagaaaagctctcgcagcaaatctagtcccttctgccggctttgtggcaggggagagcagcctcagtgggctctggcagctcccctggctgatctgacagcagtgtggtaatcaacttctctttccagcagttgtttattattttaatcagcatcctccctttccaccacccctcacccagtttgaagtgaaagctcactcccacttcctggaggcctgcctgccccaaaagtcagttctctatcttttacattgtctcaatcttgaatggatcacaggttccatgttccagttgggagccaacccatgaaaagaaaagggagtgaatgtacaaaacaatacaaatcacaaaaggaaatacgcgttgattaattttatttttcaaaaaggtgttagcaggcaactgatgaagaaaatagttttaaagtgtttcgatctctttgatgccgctgaaagtcattcagactgttttcttatagggaatttacttgtttctgacataaaacttaatgagagaaactactgtactcaaaatgtgagtaataactacattgaatgtgtcttccattttgatgttaaattactactggcactcagagaaacaccatcttccaggaagttttaagtgtcatcgctttaaagaaaaaaactccaatccaaattataaattctttgtagtgatattatggatatcattccaaggcaaatgtgattttgcttttgcattacatagctatacagtataccaataaagtataacagaaatgtccatttgaaacatgtttctctagttgtaggcagagtttcatcataaagatgcagtgcttataatggtgacactaccacaagtagaataatgtaaattttaatataagtaagtttactttttttgcatcagggcatagaccaaagtgggggggggaacccctaaaatcagaatatgcatctcctaaagggctaatgagttgcttaaatatcaataccgttagcacttatttaatcatgggtcgtaagagattccatttaaaaccagaaaaactaaaaatctatcagggaacagtatacaatgttggtattattttttggatttgcaaatcatttttctttctatttcattcctaacttattttcatatcagtatttaaatagcatgtgttttacatatgcccatctatacaaattttaacaagcttttaaaatattttcattattttttcataaaaacctgtatgtccccaggggcaaaatggctttatgagctttctagcagaacgtgtttcacctcaacgcacatttgatttcaaaaacaaatgtgttaatctaatgcttattcagaaattcacaggtaaaaataatctacagtttggatcaaaacagcactgacatcagcatgaagaccaaccatcagaactgtggtgaagaaacttacagagaaagtggccacagggaacctggtctgtaaagactctggggccacatgctgagatctttcaagagcagcaaataaactttttacataaatacaagacaaaagaaaccaccagcaccagcaccatcaccaccaccacacacacaaaaaaataaataaataaaaaagggagagaaaaagaacaatctttctcagctgggcaaacttccagct

SEQ ID NO: 428 - DNA, 4045 bp, Homo sapiens
cacataggtttttataaaactgcctaacacaaaaatacacatatatggagaacttcagactgagaattacatcaggactgtttctttgagttcgccttttgtctcaaaaataaataaataaataaatagataataataataataaaaatcccaaatcaagcctttgacaggaaaaagccagtagatatcttctactgtcaattcaactactaaaataggaataagacaaatactaagacatgggagttaaaaggggaaacatgctaatataaccagaacttctaactctgccaataaaatggcttgaagctgaggcaggttaggaacccctggtatctgacctagacttttaagactaatagcagcaattacaatacaaaagtccagctattgcccacaattactgcctctcagggggtctaagtaatgaattattcatgtaacatatgctctatacctttaaaggaagaaacagacaaatctatacaaaacaagctaacagacctctttatggtcataaagtttgtcacctgctgttaccagctgccataaggaagatattccttgccttccccgccccttctaagtggagagcaagctgagggagaaccgtcttttactctcaggaatttagatgcttaaccacatattaaagcgagaggtcgaagtccgccctgtgttacaagcctaatccttacattacagtagaggtgcagagagagattgggagaagcaactgcagccaggagggagcaaagagctaaattcttctctctccacattcatcccaccataacgttcctatcatcaaaaggcaagcagtgactgcaattgttttggaaaagcttccaaacttttcagatggcatgatgttgcatcttttccctctggcaattgtggtttgtaagaaaaagcccattattcttttaatgactcaatccagtcccgcttctacagtatttgtacttgcaatgatccatggggcattcacggtgaaagccactgagcacagctttttaaatattaataattgacttacataccaagtgagggaggacttcacccctttctgcctttctttttctttaaagactggaaattggaagaagattggtgtttggcatccaaaggctaaagagggcaggagcgcatacacgcatgtggaggttttctgttttaactataaatgtaaggtagtatttggcaggctagactccatctagattgtgccaggagccttcctatggaaaaaagagctacacgcacatttaataatccaagcattaaagcttcacagtgcatgcaagcactccatgtttaaaacagacacgctcagataaaaagcctgaggtcagatgtgccactgtcactgtgaagcgacttctgccacccacagctgagtccccaggcagagggctgtacagggcagtgcacggcaggcagtggctggacagataaacctgaggggtatggagaacagaacccatgcctacgaagtcagactttggcaccaatacccagtgttttttgctggatttttattttattttcattttcttttttttttctccaaagaagtttcagttaaattaccagctgacttgagtacaaagagtttcttctgatgtggaattctaaaagtgacaggcatcatgagaagccctcctgaccaaaggaagtaattgctaattagccctttacttgaaaaacatctttaaaggagacagcaaaattgaatattccttataaattatactaaaccaccaaagagtcaatagagcatctatctaaatgtatagtgaaaaaaaaggcaagaaagaaaggaaaaaagtacattcatgaagtttgctttctgcataccttttcaaattttgtcagcagttcccgtaagttgaagttcagaccaatcattgtccagtagcccttgaagcctacatctttccggcaaacttccttcagacaacagcgtttaacttctaaacaccgtatcttttctggctatactttaaaatcctttgtaaaatcctttacaagccttgcccttgagctatggtccatcagcagcagcggcagcttgcgctgggacattttagccaccccactgtgggtccgttttttcatggacttcggagttcgcaaggaatagacctgcttctgtatttcctggtagctgtgttccacgaggctggcatggtctcctctttctctgggaagtccaggattcccttctgctcacctcactaatgacctgcaggccacaactgttctctccagggccccaagcttagagtttggtctcaattacatacagcaaaaaaagaagctatatcctggaaacttgcatgagagaagaaaaaaaaaaagccaagtattaccaacttcctccattcagaccgatttcagaacgaaaaaaaaaaaatcctgggtaaagagccagttttcaaagagcatgacttatgtagagttcgaaggaggagtgtactcttagctgaagaaacaccaaaacacaggacaagaggccaccggttctcactctcccagacaccagcagcctgggttgctatggtaaccaccaagctagtttcagtccatttccctaggtcagcctggcctaagggatgctgtcaatgcaacagaactaaacttgttttaaaaggtgttctgtctgtccagagaaaagctctcgcagcaaatctagtcccttctgccggctttgtggcaggggagagcagcctcagtgggctctggcagctcccctggctgatctgacagcagtgtggtaatcaacttctctttccagcagttgtttattattttaatcagcatcctccctttccaccacccctcacccagtttgaagtgaaagctcactcccacttcctggaggcctgcctgccccaaaagtcagttctctatcttttacattgtctcaatcttgaatggatcacaggttccatgttccagttgggagccaacccatgaaaagaaaagggagtgaatgtacaaaacaatacaaatcacaaaaggaaatacgcgttgattaattttatttttcaaaaaggtgttagcaggcaactgatgaagaaaatagttttaaagtgtttcgatctctttgatgccgctgaaagtcattcagactgttttcttatagggaatttacttgtttctgacataaaacttaatgagagaaactactgtactcaaaatgtgagtaataactacattgaatgtgtcttccattttgatgttaaattactactggcactcagagaaacaccatcttccaggaagttttaagtgtcatcgctttaaagaaaaaaactccaatccaaattataaattctttgtagtgatattatggatatcattccaaggcaaatgtgattttgcttttgcattacatagctatacagtataccaataaagtataacagaaatgtccatttgaaacatgtttctctagttgtaggcagagtttcatcataaagatgcagtgcttataatggtgacactaccacaagtagaataatgtaaattttaatataagtaagtttactttttttgcatcagggcatagaccaaagtgggggggggaacccctaaaatcagaatatgcatctcctaaagggctaatgagttgcttaaatatcaataccgttagcacttatttaatcatgggtcgtaagagattccatttaaaaccagaaaaactaaaaatctatcagggaacagtatacaatgttggtattattttttggatttgcaaatcatttttctttctatttcattcctaacttattttcatatcagtatttaaatagcatgtgttttacatatgcccatctatacaaattttaacaagcttttaaaatattttcattattttttcataaaaacctgtatgtccccaggggcaaaatggctttatgagctttctagcagaacgtgtttcacctcaacgcacatttgatttcaaaaacaaatgtgttaatctaatgcttattcagaaattcacaggtaaaaataatctacagtttggatcaaa

SEQ ID NO: 429 - DNA, 4046 bp, Homo sapiens
caacatctcaatatatgagacagattttgtaagaatacgcaaaggattttattaacactttggaaagaatacattcatgtacgacaacttcctagaagtaaaatacggccaaagagatcaactttcacataggtttttataaaactgcctaacacaaaaatacacatatatggagaacttcagactgagaattacatcaggactgtttctttgagttcgccttttgtctcaaaaataaataaataaataaatagataataataataataaaaatcccaaatcaagcctttgacaggaaaaagccagtagatatcttctactgtcaattcaactactaaaataggaataagacaaatactaagacatgggagttaaaaggggaaacatgctaatataaccagaacttctaactctgccaataaaatggcttgaagctgaggcaggttaggaacccctggtatctgacctagacttttaagactaatagcagcaattacaatacaaaagtccagctattgcccacaattactgcctctcagggggtctaagtaatgaattattcatgtaacatatgctctatacctttaaaggaagaaacagacaaatctatacaaaacaagctaacagacctctttatggtcataaagtttgtcacctgctgttaccagctgccataaggaagatattccttgccttccccgccccttctaagtggagagcaagctgagggagaaccgtcttttactctcaggaatttagatgcttaaccacatattaaagcgagaggtcgaagtccgccctgtgttacaagcctaatccttacattacagtagaggtgcagagagagattgggagaagcaactgcagccaggagggagcaaagagctaaattcttctctctccacattcatcccaccataacgttcctatcatcaaaaggcaagcagtgactgcaattgttttggaaaagcttccaaacttttcagatggcatgatgttgcatcttttccctctggcaattgtggtttgtaagaaaaagcccattattcttttaatgactcaatccagtcccgcttctacagtatttgtacttgcaatgatccatggggcattcacggtgaaagccactgagcacagctttttaaatattaataattgacttacataccaagtgagggaggacttcacccctttctgcctttctttttctttaaagactggaaattggaagaagattggtgtttggcatccaaaggctaaagagggcaggagcgcatacacgcatgtggaggttttctgttttaactataaatgtaaggtagtatttggcaggctagactccatctagattgtgccaggagccttcctatggaaaaaagagctacacgcacatttaataatccaagcattaaagcttcacagtgcatgcaagcactccatgtttaaaacagacacgctcagataaaaagcctgaggtcagatgtgccactgtcactgtgaagcgacttctgccacccacagctgagtccccaggcagagggctgtacagggcagtgcacggcaggcagtggctggacagataaacctgaggggtatggagaacagaacccatgcctacgaagtcagactttggcaccaatacccagtgttttttgctggatttttattttattttcattttcttttttttttctccaaagaagtttcagttaaattaccagctgacttgagtacaaagagtttcttctgatgtggaattctaaaagtgacaggcatcatgagaagccctcctgaccaaaggaagtaattgctaattagccctttacttgaaaaacatctttaaaggagacagcaaaattgaatattccttataaattatactaaaccaccaaagagtcaatagagcatctatctaaatgtatagtgaaaaaaaaggcaagaaagaaaggaaaaaagtacattcatgaagtttgctttctgcataccttttcaaattttgtcagcagttcccgtaagttgaagttcagaccaatcattgtccagtagcccttgaagcctacatctttccggcaaacttccttcagacaacagcgtttaacttctaaacaccgtatcttttctggctatactttaaaatcctttgtaaaatcctttacaagccttgcccttgagctatggtccatcagcagcagcggcagcttgcgctgggacattttagccaccccactgtgggtccgttttttcatggacttcggagttcgcaaggaatagacctgcttctgtatttcctggtagctgtgttccacgaggctggcatggtctcctctttctctgggaagtccaggattcccttctgctcacctcactaatgacctgcaggccacaactgttctctccagggccccaagcttagagtttggtctcaattacatacagcaaaaaaagaagctatatcctggaaacttgcatgagagaagaaaaaaaaaaagccaagtattaccaacttcctccattcagaccgatttcagaacgaaaaaaaaaaaatcctgggtaaagagccagttttcaaagagcatgacttatgtagagttcgaaggaggagtgtactcttagctgaagaaacaccaaaacacaggacaagaggccaccggttctcactctcccagacaccagcagcctgggttgctatggtaaccaccaagctagtttcagtccatttccctaggtcagcctggcctaagggatgctgtcaatgcaacagaactaaacttgttttaaaaggtgttctgtctgtccagagaaaagctctcgcagcaaatctagtcccttctgccggctttgtggcaggggagagcagcctcagtgggctctggcagctcccctggctgatctgacagcagtgtggtaatcaacttctctttccagcagttgtttattattttaatcagcatcctccctttccaccacccctcacccagtttgaagtgaaagctcactcccacttcctggaggcctgcctgccccaaaagtcagttctctatcttttacattgtctcaatcttgaatggatcacaggttccatgttccagttgggagccaacccatgaaaagaaaagggagtgaatgtacaaaacaatacaaatcacaaaaggaaatacgcgttgattaattttatttttcaaaaaggtgttagcaggcaactgatgaagaaaatagttttaaagtgtttcgatctctttgatgccgctgaaagtcattcagactgttttcttatagggaatttacttgtttctgacataaaacttaatgagagaaactactgtactcaaaatgtgagtaataactacattgaatgtgtcttccattttgatgttaaattactactggcactcagagaaacaccatcttccaggaagttttaagtgtcatcgctttaaagaaaaaaactccaatccaaattataaattctttgtagtgatattatggatatcattccaaggcaaatgtgattttgcttttgcattacatagctatacagtataccaataaagtataacagaaatgtccatttgaaacatgtttctctagttgtaggcagagtttcatcataaagatgcagtgcttataatggtgacactaccacaagtagaataatgtaaattttaatataagtaagtttactttttttgcatcagggcatagaccaaagtgggggggggaacccctaaaatcagaatatgcatctcctaaagggctaatgagttgcttaaatatcaataccgttagcacttatttaatcatgggtcgtaagagattccatttaaaaccagaaaaactaaaaatctatcagggaacagtatacaatgttggtattattttttggatttgcaaatcatttttctttctatttcattcctaacttattttcatatcagtatttaaatagcatgtgttttacatatgcccatctatacaaattttaacaagcttttaaaatattttcattattttttcataaaaacctgtatgtccccaggggcaaaatg

SEQ ID NO: 430 - DNA, 4035 bp, Homo sapiens
cttctgcattatagcagtaggccttggtctttccctagaaatggcattattgctttgttgggggaaggtggttagttgtatttgagacgtgtgaggtactgatacttttccgtaattccagttttcctgccaataaaccaatgaagcaacatctcaatatatgagacagattttgtaagaatacgcaaaggattttattaacactttggaaagaatacattcatgtacgacaacttcctagaagtaaaatacggccaaagagatcaactttcacataggtttttataaaactgcctaacacaaaaatacacatatatggagaacttcagactgagaattacatcaggactgtttctttgagttcgccttttgtctcaaaaataaataaataaataaatagataataataataataaaaatcccaaatcaagcctttgacaggaaaaagccagtagatatcttctactgtcaattcaactactaaaataggaataagacaaatactaagacatgggagttaaaaggggaaacatgctaatataaccagaacttctaactctgccaataaaatggcttgaagctgaggcaggttaggaacccctggtatctgacctagacttttaagactaatagcagcaattacaatacaaaagtccagctattgcccacaattactgcctctcagggggtctaagtaatgaattattcatgtaacatatgctctatacctttaaaggaagaaacagacaaatctatacaaaacaagctaacagacctctttatggtcataaagtttgtcacctgctgttaccagctgccataaggaagatattccttgccttccccgccccttctaagtggagagcaagctgagggagaaccgtcttttactctcaggaatttagatgcttaaccacatattaaagcgagaggtcgaagtccgccctgtgttacaagcctaatccttacattacagtagaggtgcagagagagattgggagaagcaactgcagccaggagggagcaaagagctaaattcttctctctccacattcatcccaccataacgttcctatcatcaaaaggcaagcagtgactgcaattgttttggaaaagcttccaaacttttcagatggcatgatgttgcatcttttccctctggcaattgtggtttgtaagaaaaagcccattattcttttaatgactcaatccagtcccgcttctacagtatttgtacttgcaatgatccatggggcattcacggtgaaagccactgagcacagctttttaaatattaataattgacttacataccaagtgagggaggacttcacccctttctgcctttctttttctttaaagactggaaattggaagaagattggtgtttggcatccaaaggctaaagagggcaggagcgcatacacgcatgtggaggttttctgttttaactataaatgtaaggtagtatttggcaggctagactccatctagattgtgccaggagccttcctatggaaaaaagagctacacgcacatttaataatccaagcattaaagcttcacagtgcatgcaagcactccatgtttaaaacagacacgctcagataaaaagcctgaggtcagatgtgccactgtcactgtgaagcgacttctgccacccacagctgagtccccaggcagagggctgtacagggcagtgcacggcaggcagtggctggacagataaacctgaggggtatggagaacagaacccatgcctacgaagtcagactttggcaccaatacccagtgttttttgctggatttttattttattttcattttcttttttttttctccaaagaagtttcagttaaattaccagctgacttgagtacaaagagtttcttctgatgtggaattctaaaagtgacaggcatcatgagaagccctcctgaccaaaggaagtaattgctaattagccctttacttgaaaaacatctttaaaggagacagcaaaattgaatattccttataaattatactaaaccaccaaagagtcaatagagcatctatctaaatgtatagtgaaaaaaaaggcaagaaagaaaggaaaaaagtacattcatgaagtttgctttctgcataccttttcaaattttgtcagcagttcccgtaagttgaagttcagaccaatcattgtccagtagcccttgaagcctacatctttccggcaaacttccttcagacaacagcgtttaacttctaaacaccgtatcttttctggctatactttaaaatcctttgtaaaatcctttacaagccttgcccttgagctatggtccatcagcagcagcggcagcttgcgctgggacattttagccaccccactgtgggtccgttttttcatggacttcggagttcgcaaggaatagacctgcttctgtatttcctggtagctgtgttccacgaggctggcatggtctcctctttctctgggaagtccaggattcccttctgctcacctcactaatgacctgcaggccacaactgttctctccagggccccaagcttagagtttggtctcaattacatacagcaaaaaaagaagctatatcctggaaacttgcatgagagaagaaaaaaaaaaagccaagtattaccaacttcctccattcagaccgatttcagaacgaaaaaaaaaaaatcctgggtaaagagccagttttcaaagagcatgacttatgtagagttcgaaggaggagtgtactcttagctgaagaaacaccaaaacacaggacaagaggccaccggttctcactctcccagacaccagcagcctgggttgctatggtaaccaccaagctagtttcagtccatttccctaggtcagcctggcctaagggatgctgtcaatgcaacagaactaaacttgttttaaaaggtgttctgtctgtccagagaaaagctctcgcagcaaatctagtcccttctgccggctttgtggcaggggagagcagcctcagtgggctctggcagctcccctggctgatctgacagcagtgtggtaatcaacttctctttccagcagttgtttattattttaatcagcatcctccctttccaccacccctcacccagtttgaagtgaaagctcactcccacttcctggaggcctgcctgccccaaaagtcagttctctatcttttacattgtctcaatcttgaatggatcacaggttccatgttccagttgggagccaacccatgaaaagaaaagggagtgaatgtacaaaacaatacaaatcacaaaaggaaatacgcgttgattaattttatttttcaaaaaggtgttagcaggcaactgatgaagaaaatagttttaaagtgtttcgatctctttgatgccgctgaaagtcattcagactgttttcttatagggaatttacttgtttctgacataaaacttaatgagagaaactactgtactcaaaatgtgagtaataactacattgaatgtgtcttccattttgatgttaaattactactggcactcagagaaacaccatcttccaggaagttttaagtgtcatcgctttaaagaaaaaaactccaatccaaattataaattctttgtagtgatattatggatatcattccaaggcaaatgtgattttgcttttgcattacatagctatacagtataccaataaagtataacagaaatgtccatttgaaacatgtttctctagttgtaggcagagtttcatcataaagatgcagtgcttataatggtgacactaccacaagtagaataatgtaaattttaatataagtaagtttactttttttgcatcagggcatagaccaaagtgggggggggaacccctaaaatcagaatatgcatctcctaaagggctaatgagttgcttaaatatcaataccgttagcacttatttaatcatgggtcgtaagagattccatttaaaaccagaaaaactaaaaatctatcagggaacagtatacaatgttggtattattttttggatttgc

SEQ ID NO: 431 - DNA, 4047 bp, Homo sapiens
aatataggtaagactcgaggtgggtggatagcttgagcccaggagttcaaggtcagcctgagcaacacagcaagtccatgtctccaaaaaaaaaaaaaaagtaagacaacagagtagaaaacagtcaaattactaagtggaacaaactcagatagtgtgatgaaaactgaacaaacaaatcagatcgtgtaatcaaaactgaacaggtcagaaaacccagagaaaaattatcgcatttcaaatgtttaaaactacaagcctggggcacacagcttctcaacttctgacccatgtcaaagcagtccctgttaccctgaaagctcccaatttcttcccctgacacaagtccacccatgggccacacacatgcacacacattggtatataatctcatttccttctttcaacttaaactcatctgttaagtctcagtttaaatgtaatttctccaggagagacttcacaagtactgagattagggctatcattactcttataatttcatctacttttgcttaattatgcagttgtcattgaaaatgtccttgtctgtatcctcccattcggccataagatcaatgtcttctccatctatacacttagactagcacctggtacatacttcacaaatatttgctaagtagggaataaatgaggagactttgaaatgtgtttactatatcttattgaggacacatttgttttaaaatgagatatggcaaactgagcaatacaatatagcttcaaattgtaattataaaagatagagtcatgtgaaaggaggtaaatgccataaagtaattcagcattgagtggtttctctctgtgttgttatgataggaagcatctttgcccaaggagtcaccaagagaatggtactaagagaacggcactcacacacacagcagacacatacatcaaaaaatcccttagagaactacgattatcattaaccattcagtagcaggtctgaataaattaataaaaggcagcagtcactcaaaatgtcactgagctaaaattggccattacactatcctctgtgactattaaacaaaagaaatacagtacacaatgcaaatggcttaagtatgacagtatgttaatagtccctaaagtcatgagatacttcctttaggaagtactttcagggaaaaaaattaattaaaatcagcgtggcaaataaaactacctattggctggatctcagagaggtgtgttggtggactagtcaactttgaatgtgaactcttcccatagtcacccttgagcccatggccacaacttctcatcccttatcactttgttagatgattaggacctgcttgctggcaggcacatcttggtatggggtcatcctcccctggtaagaagttcttcctctttaggtaccactcgagttggcatggttccctccaattgggccttcctaatctgtaatgagctgtcatcttgtaggaacataatacttcctgcctgcaagagactcctagccttgccctttctggttctagaagactagaaatcagtacccaatgtaagaaattgcccatcctgcctgtgctgggaaactacaatcccagcatcacacatgctgagacaaggtgctcaaccacatgccaaacattcttatatgagtataacatgccaaacattcttatatccagtaaaaatcacaaaaccactggatgtctccaaaattcaaaaatatcaactaaaatatccctttcaatttaccttcacaaaaaaactgctgtcttaaagttatgctgaaggtctgctttcacctgggaattttaatgatctgaccagtctataactttccagattagccaccattggaaggcctgctgctcagctgttggcctcaactactaagcgtatcaggatttgagtctactagtccaacagtggaccctcgttttcttaaagcctgaaattccttcaggaatacagcaaaatcccctttctactgtggtcacctaaacttcagactgaacaatgacaactgctgatatgaaaagtggtaaatcgttaaggctagtattctctctagaaacaggttactaatactgaggaagagacaggactgagaattgagggtaaagggactctacctctgcgtgtagaatggctgttactcagcttctgaagggatcctgtggcttctgcattatagcagtaggccttggtctttccctagaaatggcattattgctttgttgggggaaggtggttagttgtatttgagacgtgtgaggtactgatacttttccgtaattccagttttcctgccaataaaccaatgaagcaacatctcaatatatgagacagattttgtaagaatacgcaaaggattttattaacactttggaaagaatacattcatgtacgacaacttcctagaagtaaaatacggccaaagagatcaactttcacataggtttttataaaactgcctaacacaaaaatacacatatatggagaacttcagactgagaattacatcaggactgtttctttgagttcgccttttgtctcaaaaataaataaataaataaatagataataataataataaaaatcccaaatcaagcctttgacaggaaaaagccagtagatatcttctactgtcaattcaactactaaaataggaataagacaaatactaagacatgggagttaaaaggggaaacatgctaatataaccagaacttctaactctgccaataaaatggcttgaagctgaggcaggttaggaacccctggtatctgacctagacttttaagactaatagcagcaattacaatacaaaagtccagctattgcccacaattactgcctctcagggggtctaagtaatgaattattcatgtaacatatgctctatacctttaaaggaagaaacagacaaatctatacaaaacaagctaacagacctctttatggtcataaagtttgtcacctgctgttaccagctgccataaggaagatattccttgccttccccgccccttctaagtggagagcaagctgagggagaaccgtcttttactctcaggaatttagatgcttaaccacatattaaagcgagaggtcgaagtccgccctgtgttacaagcctaatccttacattacagtagaggtgcagagagagattgggagaagcaactgcagccaggagggagcaaagagctaaattcttctctctccacattcatcccaccataacgttcctatcatcaaaaggcaagcagtgactgcaattgttttggaaaagcttccaaacttttcagatggcatgatgttgcatcttttccctctggcaattgtggtttgtaagaaaaagcccattattcttttaatgactcaatccagtcccgcttctacagtatttgtacttgcaatgatccatggggcattcacggtgaaagccactgagcacagctttttaaatattaataattgacttacataccaagtgagggaggacttcacccctttctgcctttctttttctttaaagactggaaattggaagaagattggtgtttggcatccaaaggctaaagagggcaggagcgcatacacgcatgtggaggttttctgttttaactataaatgtaaggtagtatttggcaggctagactccatctagattgtgccaggagccttcctatggaaaaaagagctacacgcacatttaataatccaagcattaaagcttcacagtgcatgcaagcactccatgtttaaaacagacacgctcagataaaaagcctgaggtcagatgtgccactgtcactgtgaagcgacttctgccacccacagctgagtccccaggcagagggctgtacagggcagtgcacggcaggcagtggctggacagataaacctgaggggtatggagaacagaacccatgcctacgaagtcagactttggcaccaatacccagtgttttttgctggatttttattttattttcattttcttttttttttctccaaagaagtttcagttaaattaccagctgacttgagtacaa

SEQ ID NO: 432 - DNA, 4029 bp, Homo sapiens
ttatgactaagaccccaaaagcaaatgcaaatgtagcaagaacaaaaataaataaatggcacctacttaaactaaaatgcttctgcacagcaaaagaaataatcaacagagcaaaaaaacaacccacagaatgagagaaaatatttgtaaacaatgcacccaacaaagaattgatatccagaatctcccaacaaagaattgatatccagaatctacaaggaactcaaattagcaagaacaaaaacaaataatcctactaaaaagtgggcaaatgacatgattagacatttctcaaaagaagatatacaactgggcaacaaacatatgaagaaacactcaatatcactaatcctcagggaaatgctggtaaaaccacaatgagataccaccttaccctgaccagaacggccattattaaaaagtcaaaaaacaatagatgtcaatgaggatgtggtgaaatggggatgcttaaacactggtgagaatgcaaattagtacaatctctaagcagattcctcaaagaactaaaagtacatccactatgtgatctagcaataccactgctaggtatctaccaaaaggaaaagaagtcattatgtcaaaaagacactggcactcgtatgtttatcacagcacaatccacaattgcaaagatttggaaccaacttaagtgtccatcaatccatgagtggataaggaacatgtggtatgtgtataccatgaaataccactcagccatagaaaagaatacaataatgtctttttcagcaacttgaatggagctggaggccattattctaaataaagtaactcaggaatggaaaaccaaacactacatgatctcacttacaagtgggagataagctatgggtatgcaaaggcatacacagtgatataatggacatatgagactcagaggtcggggaggttaccaaggcagtgagggataaaaaaaataaaactacaaaatgggtacaatgtacagtactcaagtgatgggtgcactaaaatctcagacttcaccgctatacaattcatccttgtaactaaaatcacctgtacccttaaagctactgaaattgtaaaacttttaaaaaataaataagtaaaaaataaaaatgaactggataaaactgtaaagttaaataacagtagatagacaggtccagtatataataagctaatgaaggaaggcacccccctggataggactcataaccttaatgtgaaggagagccatcttactgatgaggttgaaaacaattcttatttgatttgatacaacagagggctcttcactaactaataggggaaaaccaattgcattcagatgcacatggccaggtcgaatgtaataaaataaaatgtgtactctggaaaacagtctgcccttgatctcctggaaattgattatctcagggatgccaagatgacaggaaatgttaactgactcccagtgtgacaaggtctacgggacttagaacagggataaaggcatttacagataaagtaaaaagaaacttggaaatcaaaatataaaaagttgtgaatatggatattggcaccaacaataatagtggagaaaaggatggagaataaaaggtaaatggggctgggcgtggtggctcacgtctgtaatcccagcagtttgggaggccaaggcgagtgggtcacctgaggtcaggaatttgagaccagcctggccaacatgatgaaacctcgtctctactaaaaatacaaaaataagttgggtgtggtggcagccacctgtaatcccagctacttgggaggctgaggcaggagaatcacttaaacccaggaggtggaggttgcagtgagccaagatcgtgccactgcactccagcctgggcgacagagcaagactctgtctcaaaaaaaaaaaaaaaaaagtaaagggacacttgaattaatgaggaatgtagaagcatgtcctatatatagatcaggaagaagcagaaataagatgatgaaagattaggataatggatgcattcacttctaaggagatgttgttgaaagatggagaagcaatgcttaatgagtcacaatgaggctggcaattgtccctcttatccctgtgtgacagggctcccttttcagccagtgttttctggcaccacatttgatgtttatggctggtattcaggccgtttggtgtccatagcagttggtagagattcagaatattctcattggctgctaggtgaggaaaatgaggaaattaacctctattgaaaagagtttcaagcgaagtaggcaattaaggggaaacccaacatttagagagaaaagtgatggaaaagtttcgagaaatatttgagacataggagaatgtgttcacaatagaaggcagtataaggagcagattgtgcatgaaaggaatgagaggaaagaacagagaagtagggctgaacagtgtgctccacagtgatcactttcagtaggcaatgaaggagccaggagcctgggaggtggattgcctctacagatttgttatgagaacactcctcccactccttggggagggattttctcactaagcacactctggtctcttctccacccctgaaacagtccctgcaaaggtagagtgacgaatctgatctgtaaattcagggagaataattgggcatgcttagctcagcccatacggtccacttgacgacaggccatgaagatactgagttcttttctactcttccatgtatggtttctcacttgggaagccaccttgcccagtgactgctggtgattctgcctcattctggggtttggttgacagctccactcaccttcactctaagttaccacctccaacctggcctctatcagtaattaacatggcatttgagttctctattggccacatgatgaatgccccttgagcacactttgtttcatacttgttcagaatccagccagcaaagggggaagctgttttgggagaccttctcagaaatccccaacattaccgaccgagagaaaaacatagggtagagagaattcctgtgtattttaaattagtgccaaacaaagaggtaatcaatgagaataataatagctaacaattactgaacacataccacgtgccaccatttttggcaaatgcagaggctaaattaaataacaaactattttatcttttataaatatccaagtaataacaaacatgctattttaattttatcttattcattttttaaatataaaaataaagaagagatcatttacgcctttagctaaacttacctaatctagttaaaaatggcttttatccaaaagtcaggcaataacaaatgctgtctagcatgtggagaaaaaggaacccttgtgaactgttggtgggaatgtaagttaatataaacactatggagaacagtttggaggttccacaaaaaactaaaaatagggctaccatatgatccagcaatcccactgctggctatatacccaaaagaaaggaaatcagtatatcgcagaaatatctgcactcccatgtttgtggcagtactgttcacaatagccaagatttggaagcaacctaagtgttcatcaacagataaatggataaagaaaatgtatttatacaaaatggagtactattccaccattctgtcatttgcaacaatgtggatggaaggggagatcattatgttaagtgaaataaaccaggtgcagaaagacaaacattgactattctcagttattttggggatctaaaaatcaaaacaattgaactcatggagatagagtagaaggatggttaccagaggctgggaagggtagttggtggggcaggggggtgatggggaggaagtggtgatgattaataggtataaaacagttagaaagaatgaataagatccagtatttgatagcaaaacaagggtgattatagtcaataataacttagttgtacattttaaaataactaaaaaagtataattggattgtttgtaacacaaaagataaatgcttgaggggatagataccacattttccacgatg

SEQ ID NO: 433 - DNA, 4048 bp, Homo sapiens
gaacaagcgcactgaactgctttttacagaacattctactcaagaactgaagaatatacaatcctctcatcagcatatggaacattctccaaaatacataaggccacaaaacaagtctcaattaatttttaaaaatcaaaattatatcaagcatcttcatagaccaatgaagcagaatagagaacctagaaatacagccaaatacttacaaccaactgattttgacaaagcacacaaaaacataaattggaaaaaggacatgctattcaataaatgatgctgggaacactggaaagtcacatgtggaagaatgaaactgaattcctatttctcactatatacaaaaatcaactcaacatggattaaagacttaaatctaagacctgaaaccattaacaattttagaagaaattctaggaaaaactcttctgaaaattggcctaggcaaagaatttatgactaagaccccaaaagcaaatgcaaatgtagcaagaacaaaaataaataaatggcacctacttaaactaaaatgcttctgcacagcaaaagaaataatcaacagagcaaaaaaacaacccacagaatgagagaaaatatttgtaaacaatgcacccaacaaagaattgatatccagaatctcccaacaaagaattgatatccagaatctacaaggaactcaaattagcaagaacaaaaacaaataatcctactaaaaagtgggcaaatgacatgattagacatttctcaaaagaagatatacaactgggcaacaaacatatgaagaaacactcaatatcactaatcctcagggaaatgctggtaaaaccacaatgagataccaccttaccctgaccagaacggccattattaaaaagtcaaaaaacaatagatgtcaatgaggatgtggtgaaatggggatgcttaaacactggtgagaatgcaaattagtacaatctctaagcagattcctcaaagaactaaaagtacatccactatgtgatctagcaataccactgctaggtatctaccaaaaggaaaagaagtcattatgtcaaaaagacactggcactcgtatgtttatcacagcacaatccacaattgcaaagatttggaaccaacttaagtgtccatcaatccatgagtggataaggaacatgtggtatgtgtataccatgaaataccactcagccatagaaaagaatacaataatgtctttttcagcaacttgaatggagctggaggccattattctaaataaagtaactcaggaatggaaaaccaaacactacatgatctcacttacaagtgggagataagctatgggtatgcaaaggcatacacagtgatataatggacatatgagactcagaggtcggggaggttaccaaggcagtgagggataaaaaaaataaaactacaaaatgggtacaatgtacagtactcaagtgatgggtgcactaaaatctcagacttcaccgctatacaattcatccttgtaactaaaatcacctgtacccttaaagctactgaaattgtaaaacttttaaaaaataaataagtaaaaaataaaaatgaactggataaaactgtaaagttaaataacagtagatagacaggtccagtatataataagctaatgaaggaaggcacccccctggataggactcataaccttaatgtgaaggagagccatcttactgatgaggttgaaaacaattcttatttgatttgatacaacagagggctcttcactaactaataggggaaaaccaattgcattcagatgcacatggccaggtcgaatgtaataaaataaaatgtgtactctggaaaacagtctgcccttgatctcctggaaattgattatctcagggatgccaagatgacaggaaatgttaactgactcccagtgtgacaaggtctacgggacttagaacagggataaaggcatttacagataaagtaaaaagaaacttggaaatcaaaatataaaaagttgtgaatatggatattggcaccaacaataatagtggagaaaaggatggagaataaaaggtaaatggggctgggcgtggtggctcacgtctgtaatcccagcagtttgggaggccaaggcgagtgggtcacctgaggtcaggaatttgagaccagcctggccaacatgatgaaacctcgtctctactaaaaatacaaaaataagttgggtgtggtggcagccacctgtaatcccagctacttgggaggctgaggcaggagaatcacttaaacccaggaggtggaggttgcagtgagccaagatcgtgccactgcactccagcctgggcgacagagcaagactctgtctcaaaaaaaaaaaaaaaaaagtaaagggacacttgaattaatgaggaatgtagaagcatgtcctatatatagatcaggaagaagcagaaataagatgatgaaagattaggataatggatgcattcacttctaaggagatgttgttgaaagatggagaagcaatgcttaatgagtcacaatgaggctggcaattgtccctcttatccctgtgtgacagggctcccttttcagccagtgttttctggcaccacatttgatgtttatggctggtattcaggccgtttggtgtccatagcagttggtagagattcagaatattctcattggctgctaggtgaggaaaatgaggaaattaacctctattgaaaagagtttcaagcgaagtaggcaattaaggggaaacccaacatttagagagaaaagtgatggaaaagtttcgagaaatatttgagacataggagaatgtgttcacaatagaaggcagtataaggagcagattgtgcatgaaaggaatgagaggaaagaacagagaagtagggctgaacagtgtgctccacagtgatcactttcagtaggcaatgaaggagccaggagcctgggaggtggattgcctctacagatttgttatgagaacactcctcccactccttggggagggattttctcactaagcacactctggtctcttctccacccctgaaacagtccctgcaaaggtagagtgacgaatctgatctgtaaattcagggagaataattgggcatgcttagctcagcccatacggtccacttgacgacaggccatgaagatactgagttcttttctactcttccatgtatggtttctcacttgggaagccaccttgcccagtgactgctggtgattctgcctcattctggggtttggttgacagctccactcaccttcactctaagttaccacctccaacctggcctctatcagtaattaacatggcatttgagttctctattggccacatgatgaatgccccttgagcacactttgtttcatacttgttcagaatccagccagcaaagggggaagctgttttgggagaccttctcagaaatccccaacattaccgaccgagagaaaaacatagggtagagagaattcctgtgtattttaaattagtgccaaacaaagaggtaatcaatgagaataataatagctaacaattactgaacacataccacgtgccaccatttttggcaaatgcagaggctaaattaaataacaaactattttatcttttataaatatccaagtaataacaaacatgctattttaattttatcttattcattttttaaatataaaaataaagaagagatcatttacgcctttagctaaacttacctaatctagttaaaaatggcttttatccaaaagtcaggcaataacaaatgctgtctagcatgtggagaaaaaggaacccttgtgaactgttggtgggaatgtaagttaatataaacactatggagaacagtttggaggttccacaaaaaactaaaaatagggctaccatatgatccagcaatcccactgctggctatatacccaaaagaaaggaaatcagtatatcgcagaaatatctgcactcccatgtttgtggcagtactgttcacaatagccaagatttggaagcaacctaagtgttcatcaacagataaatggataaaga

SEQ ID NO: 434 - DNA, 4045 bp, Homo sapiens
agccaggacagactgagaggctgatacatactttatgtgctaaggccagaagaggaaaatcatttcatacctcaagatgtggatttcggtaaacactattagcatatggccataagcagcttgtattccttacagagcacatctattagaagagctttgtgttattctgtttcatccctaatactgtaacccacaaaaagggactactgtatgaataattaatagaagtaaaagttagaaaaagttaggagagaataggattttcttaaatcggtcattttaaatcttctattattattattatcttgcatatcatacatcaacagtgttttcctttttcttatcttggagctatttctctatcatattcctgcttcgagtagaaagaaaaaaaatacacccaaatggtaattttgataatctagtcacaagggttcaaaaagcaaataaataaatttcagggtcttatcattttgtattaaagcaacttattacataaatgacattttcctttaggagatgtgtgcattcgtgtttgtcatttttaaaatggaaatagaatcatagtgtcaccttaaaatgaccagatttagaatgagaactttcattacatgggaggagtgaaaaatacaataaaataagatgatatgtatatacaagaaaatgggcataaagagatattaaagaaatcaatggaaagtgaacaaggcacaaatttaatcacacaaggatctaaggattaatgtgtcagttgataacatttcagcatatcttttggctgatcagagtaaaagtatacatttgcataggaacagaaatttgagcagtataaaaatgtaatcaaagaaaaggcttggctcagaaaagtaaaacacataaaatgattttaaatagtatggtcttcatctgcattacttttttttttttttactacaagtccttatttttcacttttattaaacacaaacaagatagtttgtaattccttatgactcgatgccttttgaatttaagattaatttgtagtttaaaaattttctcaggtcgggtaaggtggctcatgcctgtaatcccagcactttgggaggccgaggaagacagatcacctgaggtcaggagttcgagaccagcctgaccaacatggtgaaatcccgtctctagtaaaaatacaaaaattagccgggcatggtggcatgcgcctgtagtcccagctacttgggaggctgaggcaggagaatctcttggacccaggaggtgaaggttgcagtgagctgagatcatgccactgcactccagcctgggcaacagagcgagactccatctaaaaaaaaaaatacaaaatacaaaattagctgggggtggttgcaggtgcctgtagtcccagctacttgggaggctgaggcaggagaatcacttgaacctgggaggcagaggttgcagtgagctgtgatcatgccactgcactccaacctgggtgacagagcaagactccatcttaaaaaaaaaaaacaaagttagttgggtgtgatggcaggcacctgtagtcccagctacttgggagactgaggcaggagaatcgcttgaacccaggaagcagaggctgcagtgagccgagatcatgccattgtactccagcctgggcaacaagagtgaaacttggtaaaacaaacaaacaaacaaacaaaaaacaaaaaaaacccaaaacctcaatatattatgattctaaaacctattagaaatttagataaacttcataataagctaaaagcaatattatacttcagatactggtagtgtttgaaaaaaatttagttaaatgtgaagataatacaaatggaaacaatgtatgcactttaaatgtctactggcaactaaaagcagacggtggtgggggggggaatcctgtgataattggttcaactctgatacttatctataattgtatttcaaatatctacctcactagaatttgaattaagcgactcactataggttatccacttaccttacaatggtcatactggagctgtaaggctggaacatctcctccaataggcatttgtttcttaagctcttcatctttcatattcagccatttgatcagttcttctaaggacatcagcaacctgttccacttctcagcgctggcctccaaatgggccctgttgagagataataataataataataaccacatttagaaatgcaaattacattcacaaaattatctaccttcctttagcataataatcttatctgaccaagtaatgtttacttccacaaaagagactgactccttgtaaatacatatatatatgtatttataatatactatatatacatatatatgtatgatatacatatatacaatacatatattacataagtatatatatttatacatatgtatacacacatatatccatttcctgtaagaaacagctattttgaataggctataatattcagaggatttattggtaataactatcaaaatttaaaacacagacctatacaaaacgaaggctttcaagaaggatgtccgtgatagaatgtacaattataaaccaagttttgatagtttatgtatagtatatacgcacatccaaatatatttttttctcattttatctctatacatggagagagagagaggaaaataaccactaagagcacagtaaatacctaattttagctatttttacgccatttaaggatttacaacagactcatagtatttttctttccaaaaaaaaaaaaaaaaaaaaaaaaaaaccactgactaattattattattatttttttttttgagacagagtattgctctgtcacccaggctggagtgcagtggcgcaatctcggctcactgcgacctctgcctcctgggttcaaactattctgctgcctcagcctcctgaatacagctggaattacaggcatgtgccaccatgcccggttaattttcgtatttttagtagagacgggatttcaccatgttgttcagcctggtctgaaactcctgacctcatgatccaccggccagggactcccaaagtgctgggattacaggtgtgagccaccgcgcctggtcttgattaacttttttaggaatggaaattactgatgtgttactttctcttgtaaccaaaaactccttctgttgtaaccaaaaagcagaacaatagcaatgtttacttcaaaaagttggaaaataatcaggcattgcttcgacaggatactatttggcttaaggttgaccaatgtctagtgacaaatgaccagtgtgaatagagaacagttgggcgaaagtcactgcagtactttatactctcatttaaaggtgaggtctttgtttcaataataatttctgcatttaacacagaaatgcaccttcagattcttagattatgaactccataatcacagatatgtttaggaaatacattttgatatggttaaggttccaataagagcaaaggcccttgagaataggagtataaatctatgcacatgttccttttttgctcttgttagggccctggtgaaagcccacttatccagcctcaggcccactggtgggctggatttgaaaatatggatcagtcagaaacaactccagcgactcaaggaatcgaactgggcttgactcaatcctgcatcatcccagagggcagactgtgaatgcgggcttatgccttaacttggggaaatggaattactgtgactgcccatgatctttgaggtttagaggtgtaacaaggcacacgtctgcctttcatcagcatatgctgattaaaaaacgctgtgtgaaataataaaaaaagtttaaatacagaacgaagttcaaagcattttgtaaatctctgagaacagtatgattagaaaatttattttcttgtatttatgatcagttctatttattccacaggtgctacaattgaactcattttacaaaactgtggttaacaaggtcctgattctgcttgagctccagcttttctgtgttcatattgattaactttaggccaaatatgtaattaccttt

SEQ ID NO: 435 - DNA, 4068 bp, Homo sapiens
tcctaagaaaatgatccagaaaagctacgaacacaaaagtgttcattataacattatttatgatttttaaaaaattgaaagaaacttaaatctccaacacctggaatatatttaggttctatgatatggccacaatagaggccattatgcaaccttgaaaagttattgtgataatgaccacatagcaatgtgaagaaataggcatgacatgtatctaagtgaaaaagatgacataaaaactctgcacccaagtaaaactatgcaaaaggtaaatatgcaaaaaggaaataatgcaaaatgaaaagggttgttatggtgataaaattatggccatgtttttattctttatttcataaactctgtaatatgttattattttcataattaaaaattatacttttaagaaaggaatgcccactagaattgagctcatttagcattgaataaattactgctttcaaagaacagcattatgaagaattacaaatgtgtttagaagcccattttttgtatttgtaacaattataaaactttccctttatattttgcttcaatgacttggggctatatttatttataaaatataatgcatgacaacatagtcactgaatgagagactccacatgtttaagcttctccctgcatttgttaagaatctcaactcaactagcattcaaaggtatcaaattcctacaacagagagaagcacaaacactggaagaatctagcaatatccagcacatacagctaaaaaaaaaaaaaagctatattttaaaagctatctcaacaattaaaggtatgccaattcattttcccttaaataaaaatctttcccattcttgagttgaaaatttaggcagtattaagatagagaaaagataacctctgaactgactacaatatcaaggcataaagtgccattgtgttatttaatttgcttacatttcaaatatgtcatgtaactgaaatgatttctagctctcgagacaagattattgcttacacttctatttcagttattacctttattaaacatttggctatttaaagtaggaatattttcaaaatgtaatattctttagaacgcaaatgaataaaaaagaattactgagaaataaagagacaaaaggaacattcacaccaaaggacatgttcccttgggtatagctctttcagtcaacattcaacttttatcgagcatccagagtaccaagcaaaaaaaaaaaaaagacatagaaaataagtcattgtgttagattctgataaatgctatagaaaaagaaagaagtagaaaagggtggggggggaagagagagagaatgagagagagagaaggagtgctcagagggagctgcagttcaagtagagaagttgagtaaagaaggggcattttgggcagagcagacaggctggcactgtgactgaaagctcagcaagggaccagtgtggccgaaaccagtgtgtcagagaaaaaacagcaagagaggaaatgagcaaggtgtgagtagggggtaggtcagatcaggcagggccttgcagaccattccgagagctgtggcttttcctctgaataagttaggaagcccctacagagtttgatttattttaataggaacactctggttgctggactgatacttccagagacagaggagtgtcacaggtggtagattcagattctatattttgaacagagaaccaacaggatttcctaacagactgaaaatgagagaaaggcaggactaaaggtgattattatttgttacctaagcaactgaaataatattcctaccaactgaaatgcagaacgctgggtagaacatgttataggggccaattcaggaagccagtttggtcatattaactgtgaggtgtttattacacactcaagtagagatgacatgtaaacggatatatctttgggagtgcttggcatatagatggcatttttaaacccaagaaggagtgaatacagagaaggtgacatggcctgacaagtgacacatcccaattttagaagacaggggagagaaggaagaaccaggaagggaaactgagaaagagctaccagtgacgtaagaaaaacatcaggagagtgcggtgttctagaagtcaagtagagtccgaggaacagttaataagtcagcaggaaaggtgaggtcttggaatgaacccctagtcaaagctcagccaacactaacaaacagagacatcacaaattacaacaaggggcatgtaactcagagtggggctcaggatggcttccttacctaaggagatggaaagatgcttgaagcaagttttaagaggcattcaatattgtgttacatgtgtcagaatatatatgttaatgttcttcgcaatgcaagcaggtctggctatgtgattgcagacctcagtgtaacagggccccttgtccaaatattactaagaatctcaagatggcagcagaagaacattaagccaagtgcagaaaccttgtaagagcagagccctgtgtgactgcatgggacacctgagaagctggccctaaatgcagggtagctgaattataacaaatagaggtattgctggtacagcaggcttctttagcttttggtttcaaaaaagcagttaactgcttactggagaatataagcagaaaaaaataaatgatgcaaacatgagacaaatctgctagaatgtaatttactcttttcccaacttgctttcaaagctaaatcagcatatatggatctgaagtcattacagaatgacagcaaaaaagggcagagcactcattaaatttgatagcactaataaaactacatgaaaaaggagacagaaaacaggcttactttccgttggtatgcagacaaaatttaaaaaaaaatctcctacatagtgccttgaaagttttggttaacatccctcaatgagcagttaatatacaaaattcattttggttccaccccagtgacataaaaaataatgcctgaatcagaataccaaatatcaatgttaaaaatgagacagaaattcttttgcttttcatagtaataaaatagtatccttccctgtacttttttttttttttttttgagacagagtttcactcttgtttcccaggctggagtgcaatggcgcgatctcggctcaccgcaacctcctcctcccgggttcaagcgattctcctgcctcagcctcccgagtagctgggattacaggcatgtgccgctatgcctgacaaattttgtatttttagtagagacggggtttctccatgttggtcaggctggtctagaattcctgacctcaggtgatccacccacctcagcctcccaaagtgctgggattacaggcatgagccactgcaccctgctttttatttatttatttttttttttgagacagagtttcgctcttgttgcccaggctggagtacaatgctgtgatcttggctcactgcaacctccacctcccaggttcaagcgattctcctgcctcagcctcccaagtagctgggattacaggtatacaccaccacacccagctgatttttttgattttttttttttagtagagatggggtttcaccatgttggtcaggctggtcttgaactcctgacctcaggtgatccactcacatcagcctcccaaagtgctaagattacaggcatgagccactgcacccggccccctgtactctttaaaatacatgcacacataaatgtattccttcatccagctaatatatgcaatacaggttgagtatctctaatccaaaatctaaaatacaccaaaatccaaacatttctgagtgtcaatattgttactcaaaggaaatgctcttaggagcattttgaatttcagattttctgattagggatggtcacctggtaagtgtaatgcaaatattcgaaaatatgaaaaaatctgaaatctaaatacttttggtcccaaatatttcactaagggatcctcaattagtacctattctaatgtggcactggattaggtgctgaacttgtattttcttctttcagtcttattctaagtatcatcacaaaaggaggtaagcagcacccc

SEQ ID NO: 436 - DNA, 4054 bp, Homo sapiens
cagcctgggcaactgggcgagactctgtctcaaaaaaaaaaaaaaaaaaagaaaaaagaaaagaaaaagaaaaagaaaaaaatggaattatgtgattctccaagataaagccaaaatatttcataagcagaaaactgtgttgcaagactcatatcagtttagattcttagaaagcaaagaaataaatgcagcggtttttttgtgaaccggtttcttccagaataaaagggcaaaacaattctctaaggaggtataaatggtcagctagatgacatcacacacactaatttcagacaaatataaatttcttcaactaatgtgtttaacaagccatggagagcttttctcctatccttctaggcatgactaacccaaacatcaaaccagttctcctcttcctctttgtggagagaaccttgactcaggtgtctgatattccaaaactgttttctaaatttctatacatctatgaagtactagtattttactgctaacaatacaaggatcactaataatagaacaaaaatgagaaatcacaggccagggtatggtaaagcttcactttcacacattgctggaggcaaaaaattggtttgatcatttgggaaagtaggctggcaatatatcaaaagtcattactatggtcatattgtgtgaaacaggaatttcacttttgggaatatatcctaagaaaatgatccagaaaagctacgaacacaaaagtgttcattataacattatttatgatttttaaaaaattgaaagaaacttaaatctccaacacctggaatatatttaggttctatgatatggccacaatagaggccattatgcaaccttgaaaagttattgtgataatgaccacatagcaatgtgaagaaataggcatgacatgtatctaagtgaaaaagatgacataaaaactctgcacccaagtaaaactatgcaaaaggtaaatatgcaaaaaggaaataatgcaaaatgaaaagggttgttatggtgataaaattatggccatgtttttattctttatttcataaactctgtaatatgttattattttcataattaaaaattatacttttaagaaaggaatgcccactagaattgagctcatttagcattgaataaattactgctttcaaagaacagcattatgaagaattacaaatgtgtttagaagcccattttttgtatttgtaacaattataaaactttccctttatattttgcttcaatgacttggggctatatttatttataaaatataatgcatgacaacatagtcactgaatgagagactccacatgtttaagcttctccctgcatttgttaagaatctcaactcaactagcattcaaaggtatcaaattcctacaacagagagaagcacaaacactggaagaatctagcaatatccagcacatacagctaaaaaaaaaaaaaagctatattttaaaagctatctcaacaattaaaggtatgccaattcattttcccttaaataaaaatctttcccattcttgagttgaaaatttaggcagtattaagatagagaaaagataacctctgaactgactacaatatcaaggcataaagtgccattgtgttatttaatttgcttacatttcaaatatgtcatgtaactgaaatgatttctagctctcgagacaagattattgcttacacttctatttcagttattacctttattaaacatttggctatttaaagtaggaatattttcaaaatgtaatattctttagaacgcaaatgaataaaaaagaattactgagaaataaagagacaaaaggaacattcacaccaaaggacatgttcccttgggtatagctctttcagtcaacattcaacttttatcgagcatccagagtaccaagcaaaaaaaaaaaaaagacatagaaaataagtcattgtgttagattctgataaatgctatagaaaaagaaagaagtagaaaagggtggggggggaagagagagagaatgagagagagagaaggagtgctcagagggagctgcagttcaagtagagaagttgagtaaagaaggggcattttgggcagagcagacaggctggcactgtgactgaaagctcagcaagggaccagtgtggccgaaaccagtgtgtcagagaaaaaacagcaagagaggaaatgagcaaggtgtgagtagggggtaggtcagatcaggcagggccttgcagaccattccgagagctgtggcttttcctctgaataagttaggaagcccctacagagtttgatttattttaataggaacactctggttgctggactgatacttccagagacagaggagtgtcacaggtggtagattcagattctatattttgaacagagaaccaacaggatttcctaacagactgaaaatgagagaaaggcaggactaaaggtgattattatttgttacctaagcaactgaaataatattcctaccaactgaaatgcagaacgctgggtagaacatgttataggggccaattcaggaagccagtttggtcatattaactgtgaggtgtttattacacactcaagtagagatgacatgtaaacggatatatctttgggagtgcttggcatatagatggcatttttaaacccaagaaggagtgaatacagagaaggtgacatggcctgacaagtgacacatcccaattttagaagacaggggagagaaggaagaaccaggaagggaaactgagaaagagctaccagtgacgtaagaaaaacatcaggagagtgcggtgttctagaagtcaagtagagtccgaggaacagttaataagtcagcaggaaaggtgaggtcttggaatgaacccctagtcaaagctcagccaacactaacaaacagagacatcacaaattacaacaaggggcatgtaactcagagtggggctcaggatggcttccttacctaaggagatggaaagatgcttgaagcaagttttaagaggcattcaatattgtgttacatgtgtcagaatatatatgttaatgttcttcgcaatgcaagcaggtctggctatgtgattgcagacctcagtgtaacagggccccttgtccaaatattactaagaatctcaagatggcagcagaagaacattaagccaagtgcagaaaccttgtaagagcagagccctgtgtgactgcatgggacacctgagaagctggccctaaatgcagggtagctgaattataacaaatagaggtattgctggtacagcaggcttctttagcttttggtttcaaaaaagcagttaactgcttactggagaatataagcagaaaaaaataaatgatgcaaacatgagacaaatctgctagaatgtaatttactcttttcccaacttgctttcaaagctaaatcagcatatatggatctgaagtcattacagaatgacagcaaaaaagggcagagcactcattaaatttgatagcactaataaaactacatgaaaaaggagacagaaaacaggcttactttccgttggtatgcagacaaaatttaaaaaaaaatctcctacatagtgccttgaaagttttggttaacatccctcaatgagcagttaatatacaaaattcattttggttccaccccagtgacataaaaaataatgcctgaatcagaataccaaatatcaatgttaaaaatgagacagaaattcttttgcttttcatagtaataaaatagtatccttccctgtacttttttttttttttttttgagacagagtttcactcttgtttcccaggctggagtgcaatggcgcgatctcggctcaccgcaacctcctcctcccgggttcaagcgattctcctgcctcagcctcccgagtagctgggattacaggcatgtgccgctatgcctgacaaattttgtatttttagtagagacggggtttctccatgttggtcaggctggtctagaattcctgacctcaggtgatccacccacctcagcctcccaaagtgctgggattacaggcatgagccactgcaccctgctttttattt

SEQ ID NO: 437 - DNA, 4054 bp, Homo sapiens
tgagtagctgggattacaggcaggtgtcaccacgcccagataattttttatatttttagtagagatggggtttctccatggtcaggctggtctcgaattcctgacctcaggtgatccgccttcctcggcctcccaaagtgctatgatcacaggcatgagccactgagcctggccttgcttcaaattttcaatagctctgctctttctcattagattctagcactcagtatatcttttggattaatgaatgagaaaatgaataaactggcataaaagaaaatgtggaacctcaggaggccattgttagaaggggatcaaggaaggaaaacacctgagaaatgggagcatttcatacaaagtaggtctgtggaagaaagcagcatggagcaactctgcagtagaaggaagtagtcttccccttccagcccccatagaagacattattatctcaagacaacatctgtgttgttttgctttcttaacaatctcattgaccctcactggtgaaagtcaaagaaatccacagggctcaccccttttgacccttcagggatccggctccagtgccacctgcaccaccagcatgagctgcagccttccctcacggggatccagcattcaccacactccctcaccatggcctctttgcaaacctgactctggtgccagactgagccctcatggaaggctgaaatttgtgccagagcaggtatagcggaaagccaataaatttttgtatgaatgaaggaggagatgttaaaaatactgttctgtggtaaagtaaaaccagacaaagatttgcagccaaagccttaggtacagtccagtccataccacacaggcacacccttactcatcctgtgctcatgggcccttacttgggtttgtcccttaaattctctgcgtgttaatcatctctctcattttactaacttcactggtgagacagtgaatgaaaagatattttgaaactattcagtgctgtagaataaaaaattactttttttaagagacagggtctcactctgttgcccaagctggtacaccatcaaagctcactgcagccttgaacttccgggctcaagtgatctttctgcctcagcctcttaagtagctaaactacagttgcatgccaccataccaggctaattaatttttttttaaatagggacagagtcttgctatgttgaccaggccagtcttgaactcctggcctcaagtgatcctcctgacttttcctcccaaagtactgggattacaggtgtgagcaccactcccagcccattactattaaaatcatgctaatctaaaattctaccatgtttctcagctcttgtctcagactgaatttctttccaaagcctctattcactcttacttgtagaggaaggttctagccattttacctagagctttggttgaccaatgccagaacaaagccctccgtttgcaggaacatctgaaagtagatgacttaactcttctaagggataaattatttaattatgaaaaaaatgggccaggtgcagtggctcaggctgggcacagtggctcatgcctgtagtaccagcactttgggaggctgaggcgggtggatcatgaggtcaggagttcgagaccagcctgatcaacatggtgaaatccccgtctctactaaaaatacaaaaattagctgggtgtggtggcaggcacctgtaatcccagctacttgggaggctgaggcaggagagtcatttggacccgggaggcggaggttgcagtgagccgagatcgagccattgcagtccagcctgggcaactgggcgagactctgtctcaaaaaaaaaaaaaaaaaaagaaaaaagaaaagaaaaagaaaaagaaaaaaatggaattatgtgattctccaagataaagccaaaatatttcataagcagaaaactgtgttgcaagactcatatcagtttagattcttagaaagcaaagaaataaatgcagcggtttttttgtgaaccggtttcttccagaataaaagggcaaaacaattctctaaggaggtataaatggtcagctagatgacatcacacacactaatttcagacaaatataaatttcttcaactaatgtgtttaacaagccatggagagcttttctcctatccttctaggcatgactaacccaaacatcaaaccagttctcctcttcctctttgtggagagaaccttgactcaggtgtctgatattccaaaactgttttctaaatttctatacatctatgaagtactagtattttactgctaacaatacaaggatcactaataatagaacaaaaatgagaaatcacaggccagggtatggtaaagcttcactttcacacattgctggaggcaaaaaattggtttgatcatttgggaaagtaggctggcaatatatcaaaagtcattactatggtcatattgtgtgaaacaggaatttcacttttgggaatatatcctaagaaaatgatccagaaaagctacgaacacaaaagtgttcattataacattatttatgatttttaaaaaattgaaagaaacttaaatctccaacacctggaatatatttaggttctatgatatggccacaatagaggccattatgcaaccttgaaaagttattgtgataatgaccacatagcaatgtgaagaaataggcatgacatgtatctaagtgaaaaagatgacataaaaactctgcacccaagtaaaactatgcaaaaggtaaatatgcaaaaaggaaataatgcaaaatgaaaagggttgttatggtgataaaattatggccatgtttttattctttatttcataaactctgtaatatgttattattttcataattaaaaattatacttttaagaaaggaatgcccactagaattgagctcatttagcattgaataaattactgctttcaaagaacagcattatgaagaattacaaatgtgtttagaagcccattttttgtatttgtaacaattataaaactttccctttatattttgcttcaatgacttggggctatatttatttataaaatataatgcatgacaacatagtcactgaatgagagactccacatgtttaagcttctccctgcatttgttaagaatctcaactcaactagcattcaaaggtatcaaattcctacaacagagagaagcacaaacactggaagaatctagcaatatccagcacatacagctaaaaaaaaaaaaaagctatattttaaaagctatctcaacaattaaaggtatgccaattcattttcccttaaataaaaatctttcccattcttgagttgaaaatttaggcagtattaagatagagaaaagataacctctgaactgactacaatatcaaggcataaagtgccattgtgttatttaatttgcttacatttcaaatatgtcatgtaactgaaatgatttctagctctcgagacaagattattgcttacacttctatttcagttattacctttattaaacatttggctatttaaagtaggaatattttcaaaatgtaatattctttagaacgcaaatgaataaaaaagaattactgagaaataaagagacaaaaggaacattcacaccaaaggacatgttcccttgggtatagctctttcagtcaacattcaacttttatcgagcatccagagtaccaagcaaaaaaaaaaaaaagacatagaaaataagtcattgtgttagattctgataaatgctatagaaaaagaaagaagtagaaaagggtggggggggaagagagagagaatgagagagagagaaggagtgctcagagggagctgcagttcaagtagagaagttgagtaaagaaggggcattttgggcagagcagacaggctggcactgtgactgaaagctcagcaagggaccagtgtggccgaaaccagtgtgtcagagaaaaaacagcaagagaggaaatgagcaaggtgtgagtagggggtaggtcagatcaggcagggccttgcagaccattccgagagctgtggcttttcctctgaataagttaggaagc

SEQ ID NO: 438 - DNA, 4040 bp, Homo sapiens
ctatacccactatactcaactatacatgcacaaatagactaaattaagtaatagctgggtttttctatgattattaataaaatatttaaattaagcaaaattgactgctccaggctgaaacagaaatgatattcaggcagcttaaataaaatagtagttgtagtaacagtaattctttaactggaataatttttaaagatgattcctgaggaaactggtggataaataatgcaatctcttttttaatctaaaaatatcacaagaagaggacaggtgttttctccatacatatgtatacaatgaattgtgtaattttctaaacacatttagaggtgagatagcctataaaattgttagcagttttatttagtgattgataccttagctttaaatcataaagtatgtttggtggggggtgcttgtgcatgtgcgtgcctgcctgcctgcatctgtatgtggtatggagagaggaagaccgacagaaggctccaactcccctgtgcagatctgacttttaaactgaactgaaggtaatgaacaggagagaaggcacaaatattccctaattccctctggaggtttgggggtaggggtgggtgaaggctgttgtcttgcacagcttcactgtgcagcagtgtggttcacacaggaattctgatctggtactgagaacagccaggggaggctggcagcacaagggagagaccagaaaacatggatgcaagtttaagaggctctagacattgagatcaaggaggagctaggaagttaggggccagatggccgtcagtgaacacagatagaggagataaaatcgaagggatgagtcaaaagccagccaaaatccagaggttaaggaagtcattgtcatagacgcatagggctctgttcttgcatctacctttcgttagctggatgactttggtcagcaccataatatcttcttggcctttgtgtttttatttttaaaaaaaatcatactgtatgatcggctcaactcattgggatagacaggagaatgaatatgaaagttgcttggaaagtacaaagaacaatgcaaaggatgagagattgttgtactgtgatactttctaacacatacaaactagggattaaaataaaaaaaaaaaacagttcaattgcattaaaaggaaaaagtatacattgacatgatacaaattaaatgaaattaagtatttccatattgctcaaacaaaagtcagggactactgacaaagttgtgaacttggtaaaatttctacaaggattcagataattttagttcagctaaaaatcatatttacttaatagccatttataagcagaaatctgagtagttgagttttccaaagagctacattttacccatttagccctatttttttatggttaccattttggaagaaaatttactaaaatataatataaattcctatgccttctcttaactgatttatattctgtcttcagaaatacacacaccataattcacagcttcagttttcttttactgttgaaagtcccaaagactacctcgttttgttttattttaggattcttgcatatctttttatcatttctttctcctcattgctgtcagacagctggagtcatttcttaccattaatctttgtccctgtcctgtcacttcattttgctacttacccatcactcaccggacatcaagttcatacagtcgcaccagtgtctacagcagaagttaatacctctgagaagtacttcagtggctttcccatgatctaagaaaaggatctgcactatgttttccatacaatctctatcctggctgctcagatcatttttttacactctttcagactctccatcaatgagggtaatcactaaaaaaagagggaagggccaagcttcagacacagacattggaaaacacagtgagagagaccacagggtgccagggaatcatggcagagagctcgggaagggaaagcgtccaggaagacacaaagccccagcagagccggcaggatgaccagcagctgcgtgggcaaatgaggcaagcgttggaaatcaggtcagaggacctacaggcagaaaactgggatgggcaatggggcaaaggcaaggaagaccactacctgcagaatgtagtgaggagcctggctcccagcaaacctcaagagtggagtgaagagaggcacaaggtggggccggatggaaaagctgaggacaaattgctgtgcagccttctgtgccaggtggaggagctcagatcccatggcatgcactacgggcagtttttatctccaggaaacctcatgccaggtttgtgctttaggtttatcattttaggatttatgttaatggagaaatgccaattaagaatatattgaaataggcctagcataagattggtatggaggaaactaatgtggaatggtcaattaatagtgatttttaaatacttaaaaatacatacaacagtataagataattagtaatggaaaaaatttaaaggaactggaagaaaaaaaggcattggagataaaaatcatggaggaaagtgttttctagaatggttacctaaaagaaaagaggtgactccatcttggtatgtccttatagcatggtacacatcacatactcacaaaatgcttattaaatagaaccgaaaaaaatcacttgatttcttcctgatctaacctctccaacattgagtacttcggcatcaaacaggataactaatgttcaaatgcttgctacttctaatagcagatgtacataagtcatggtaaacaacaaaagtataaaagctattatggatagttttcttcgatttatttttaacaagtaaaaccagccattgttatagaaaatagtatcaggaaaggaggcagtatgaaaattgctaatcataaacaaacaacaacaaaaaaaaccataaagttaaattgacatgacttctttttttcttgtccccccaaatgtagtattaaaaacatggagcttaaaacatcctgaatgtcacagtaaaataagaactcaaaaaccagtattttttttttctgtgtatctttctagacattttattagggatttgaaacatgtgtgcccaaatgacttcctcaccaacactatgaatgacgcatgactagaatgttcatgaaacttttttttaaattatacaatatcgttttaacccttaaatgactgaccactgagaagagtccagaataatgtggcgttttagtgatgtaacactttgtactgctttaaagtagctttttataaacttcgcaaagtcctagggaagaaaggagacaagaaaagctgactgaaggtagattttaaattggataagatgagacaagtgaacttcttatttttttccccaagcttaaaaaaacaaaactgtactagcaccttctttcttgttgtatgaagttacaatgttctgcctgactttccaggtcctctgtaggacctttccaggtcctctgaaccattcagcacatacaaccatctcatccccatctgccgtccaggcacaagactctggcaaccaggccaggctgtctactgactccccaaaatacagctgctctttccttatggctgagctgttctgctaaggattctgtccccagcatggccattcctctttcccgaacttaatcacttcctacctgtccatacccctaagactagctcaggaatcaacctctctccactctgaccctcagagtccttctctcctggaatgcccgcatcacttagaatcctcaggacacaactgagtgcatgactacggacacttttacattgcttgctttctcacgctctgtgctagttttgatctcccactaaattgaaacctcaggaacatgcgttatacttctttatccatcttggacagtgctcagctcatgcgtattctttcaaacactatgtaataagcacttactatgtgccagatagtattctaaatattacaaaatacagcagtgaaaaaaaaataaccctctgtcttcaaggagcttacatctacagggagtggaacg

SEQ ID NO: 439 - DNA, 4048 bp, Homo sapiens
taaacatattcaattactgtgtgaattattttaaaatcgaagaaaatgaaaataaaatgttgtttctattgaatagctacaaatactaattattacggaagtagtttaagatagtacactatggcagttaagagcatcaagttttgtgacataagccttagtttgtattttggctctgtcacatagaagacagtatgcctctaagcctctcagactctcagtttcctcatctgtagaatgggtggtaagtattcacccttcaaggaattattatgagaatgcaattaaacaaggtaggtaagtttcttggcacagtgtgtggcacatggtcagcacctgtgaaattctggcttgttgggaatgtctgcatttactaccatttttcactttccccttcctttatgggattggattcttcctccatttagcatgatattatgaagaaggtctgccaatcctagcagtccctgagtcccatgttactcgggccaagtcaaccagagccctctcctggaatattctggatctaaagaagggtgagcccttcctggtatgaggttgtgagctatacagtcataggaaagctaagaaaatgaaaacctgtacagagaagcagagaagaagacatggagaaaagccttctgggtggtattccagtccctgtggtcagctacgtctctaccgtggctcggttatggaggccaatgccttccccttcatgcctacacttagggaagctgtgtgcctgtcatttacaatgaatgaggctccaattaataaagttgttagtgaggaaaacaaaagccctgggagaaaacacccattagttttactagcccagttacttctattaactaatgtgtaatttgtcctcattttattacatacaagaaaataatgttgtaaccttaagttatatggagaatataaaagtaacttctactaaactatataataatttcaaatcttcactcatttaataactatgaaattgtatttgcataagtttgctaatactggcataaagtggactgacatagtggactgaatatgtcacttataaattcttcgttgtatcacaaaatatatgagattttacagggaagaaaaatagtcttaatacttggctttctaaaatatcaggaaatatttaaaaattaaacagtataccctgagttaaatattacataccatattatgtactaaatatacatagccatctgtcaaaggaccaaagaggaaaacattaacccatacatactttttcatctgaaaaattattattaactattcatcacatatacattcatacacaactatataaagttgtatatgcacatacacacatacacaactatacccactatactcaactatacatgcacaaatagactaaattaagtaatagctgggtttttctatgattattaataaaatatttaaattaagcaaaattgactgctccaggctgaaacagaaatgatattcaggcagcttaaataaaatagtagttgtagtaacagtaattctttaactggaataatttttaaagatgattcctgaggaaactggtggataaataatgcaatctcttttttaatctaaaaatatcacaagaagaggacaggtgttttctccatacatatgtatacaatgaattgtgtaattttctaaacacatttagaggtgagatagcctataaaattgttagcagttttatttagtgattgataccttagctttaaatcataaagtatgtttggtggggggtgcttgtgcatgtgcgtgcctgcctgcctgcatctgtatgtggtatggagagaggaagaccgacagaaggctccaactcccctgtgcagatctgacttttaaactgaactgaaggtaatgaacaggagagaaggcacaaatattccctaattccctctggaggtttgggggtaggggtgggtgaaggctgttgtcttgcacagcttcactgtgcagcagtgtggttcacacaggaattctgatctggtactgagaacagccaggggaggctggcagcacaagggagagaccagaaaacatggatgcaagtttaagaggctctagacattgagatcaaggaggagctaggaagttaggggccagatggccgtcagtgaacacagatagaggagataaaatcgaagggatgagtcaaaagccagccaaaatccagaggttaaggaagtcattgtcatagacgcatagggctctgttcttgcatctacctttcgttagctggatgactttggtcagcaccataatatcttcttggcctttgtgtttttatttttaaaaaaaatcatactgtatgatcggctcaactcattgggatagacaggagaatgaatatgaaagttgcttggaaagtacaaagaacaatgcaaaggatgagagattgttgtactgtgatactttctaacacatacaaactagggattaaaataaaaaaaaaaaacagttcaattgcattaaaaggaaaaagtatacattgacatgatacaaattaaatgaaattaagtatttccatattgctcaaacaaaagtcagggactactgacaaagttgtgaacttggtaaaatttctacaaggattcagataattttagttcagctaaaaatcatatttacttaatagccatttataagcagaaatctgagtagttgagttttccaaagagctacattttacccatttagccctatttttttatggttaccattttggaagaaaatttactaaaatataatataaattcctatgccttctcttaactgatttatattctgtcttcagaaatacacacaccataattcacagcttcagttttcttttactgttgaaagtcccaaagactacctcgttttgttttattttaggattcttgcatatctttttatcatttctttctcctcattgctgtcagacagctggagtcatttcttaccattaatctttgtccctgtcctgtcacttcattttgctacttacccatcactcaccggacatcaagttcatacagtcgcaccagtgtctacagcagaagttaatacctctgagaagtacttcagtggctttcccatgatctaagaaaaggatctgcactatgttttccatacaatctctatcctggctgctcagatcatttttttacactctttcagactctccatcaatgagggtaatcactaaaaaaagagggaagggccaagcttcagacacagacattggaaaacacagtgagagagaccacagggtgccagggaatcatggcagagagctcgggaagggaaagcgtccaggaagacacaaagccccagcagagccggcaggatgaccagcagctgcgtgggcaaatgaggcaagcgttggaaatcaggtcagaggacctacaggcagaaaactgggatgggcaatggggcaaaggcaaggaagaccactacctgcagaatgtagtgaggagcctggctcccagcaaacctcaagagtggagtgaagagaggcacaaggtggggccggatggaaaagctgaggacaaattgctgtgcagccttctgtgccaggtggaggagctcagatcccatggcatgcactacgggcagtttttatctccaggaaacctcatgccaggtttgtgctttaggtttatcattttaggatttatgttaatggagaaatgccaattaagaatatattgaaataggcctagcataagattggtatggaggaaactaatgtggaatggtcaattaatagtgatttttaaatacttaaaaatacatacaacagtataagataattagtaatggaaaaaatttaaaggaactggaagaaaaaaaggcattggagataaaaatcatggaggaaagtgttttctagaatggttacctaaaagaaaagaggtgactccatcttggtatgtccttatagcatggtacacatcacatactcacaaaatgcttattaaatagaaccgaaaaaaatcacttgatttcttcctgatctaacctctccaacatt

SEQ ID NO: 440 - DNA, 4071 bp, Homo sapiens
aggaagagcaaagagaccctggaacagacaaccagggcctcgctaagcaacctgagatctttccattttcttcattcaggaataatccctgaatttcctccaagtagtggcagttttgcgatttattcaagtgaattcctttgggctggacatcaacagatgggtcactgggggcaggcaggtggcaataaaaggaaagaggaaaagctgagaatgtttcaggaggaaaaaaacatctgttttgcctactactgtatcccgagtatctagaacaccccccttgtaaatggtaggcactcaaaacgtacttgttaaatgcataaatcaatctctgtacaatatctttaactagaaaaagaaaataaagaagaaaattctcccctttctctttcaagaatcaaaggacaggagttttagattcaaagtcttttatttcttgccacatgactgcccatctctccccaggctgcttcccagctaaacacagcccctagtgattgatcgagctacagagaagtctggagctttctacccatgctctgccattcttataagttaaatatggcttatgtttatgtactgccaaaataagtgatgagtttaattgaagaggagaattcatgcctttgctaggattatacttcttaaaaaatggcaaaacctctaattcttggaagattccagttttctactaagaacaacaacaatcacaaaacataagtacattataccacgctcaaagagtcttgtatcctccggtcctttatgtttaaatcagaaagtaatgtctcagatgctgattataataaaatacacacgtgtaaacgattgccatctttttatgaggcaaatgtgatttatgaatggctgtaacactgattagagaacataacagatggtaaacaattaattgaaaatgctatgtctatcaaacaaatctttatcatataattcttcatgaagactattgtttatttaaatgagattttattactacagtaggagttagcatgaaaaacattttccaaatttttacccaatcgatgggcttactcagctggctcgttgtattttagaaaagttgaagactagatgcattatattcatacagatattatagaactttaatttgtgaaaaatcacattactgctctgtagttaagaacaccggaaaagaaagtaacattatatttttctgcgctttttcatgcattacaactttactaatctaatttggacttgagaagctaatgaaattattgtcgtggtctataggcctgaaagcaattacttatacttcaaatttttatatgaaaattaaaaagacaaagtctaatattgcctagacaccttctccctcggtgttaggaaatcagtgaactgtttatgattccattatgcagcgtggtatttcagtgaagaaagagcaacaataaagaaaaaagcaaagagttataaacatattcaattactgtgtgaattattttaaaatcgaagaaaatgaaaataaaatgttgtttctattgaatagctacaaatactaattattacggaagtagtttaagatagtacactatggcagttaagagcatcaagttttgtgacataagccttagtttgtattttggctctgtcacatagaagacagtatgcctctaagcctctcagactctcagtttcctcatctgtagaatgggtggtaagtattcacccttcaaggaattattatgagaatgcaattaaacaaggtaggtaagtttcttggcacagtgtgtggcacatggtcagcacctgtgaaattctggcttgttgggaatgtctgcatttactaccatttttcactttccccttcctttatgggattggattcttcctccatttagcatgatattatgaagaaggtctgccaatcctagcagtccctgagtcccatgttactcgggccaagtcaaccagagccctctcctggaatattctggatctaaagaagggtgagcccttcctggtatgaggttgtgagctatacagtcataggaaagctaagaaaatgaaaacctgtacagagaagcagagaagaagacatggagaaaagccttctgggtggtattccagtccctgtggtcagctacgtctctaccgtggctcggttatggaggccaatgccttccccttcatgcctacacttagggaagctgtgtgcctgtcatttacaatgaatgaggctccaattaataaagttgttagtgaggaaaacaaaagccctgggagaaaacacccattagttttactagcccagttacttctattaactaatgtgtaatttgtcctcattttattacatacaagaaaataatgttgtaaccttaagttatatggagaatataaaagtaacttctactaaactatataataatttcaaatcttcactcatttaataactatgaaattgtatttgcataagtttgctaatactggcataaagtggactgacatagtggactgaatatgtcacttataaattcttcgttgtatcacaaaatatatgagattttacagggaagaaaaatagtcttaatacttggctttctaaaatatcaggaaatatttaaaaattaaacagtataccctgagttaaatattacataccatattatgtactaaatatacatagccatctgtcaaaggaccaaagaggaaaacattaacccatacatactttttcatctgaaaaattattattaactattcatcacatatacattcatacacaactatataaagttgtatatgcacatacacacatacacaactatacccactatactcaactatacatgcacaaatagactaaattaagtaatagctgggtttttctatgattattaataaaatatttaaattaagcaaaattgactgctccaggctgaaacagaaatgatattcaggcagcttaaataaaatagtagttgtagtaacagtaattctttaactggaataatttttaaagatgattcctgaggaaactggtggataaataatgcaatctcttttttaatctaaaaatatcacaagaagaggacaggtgttttctccatacatatgtatacaatgaattgtgtaattttctaaacacatttagaggtgagatagcctataaaattgttagcagttttatttagtgattgataccttagctttaaatcataaagtatgtttggtggggggtgcttgtgcatgtgcgtgcctgcctgcctgcatctgtatgtggtatggagagaggaagaccgacagaaggctccaactcccctgtgcagatctgacttttaaactgaactgaaggtaatgaacaggagagaaggcacaaatattccctaattccctctggaggtttgggggtaggggtgggtgaaggctgttgtcttgcacagcttcactgtgcagcagtgtggttcacacaggaattctgatctggtactgagaacagccaggggaggctggcagcacaagggagagaccagaaaacatggatgcaagtttaagaggctctagacattgagatcaaggaggagctaggaagttaggggccagatggccgtcagtgaacacagatagaggagataaaatcgaagggatgagtcaaaagccagccaaaatccagaggttaaggaagtcattgtcatagacgcatagggctctgttcttgcatctacctttcgttagctggatgactttggtcagcaccataatatcttcttggcctttgtgtttttatttttaaaaaaaatcatactgtatgatcggctcaactcattgggatagacaggagaatgaatatgaaagttgcttggaaagtacaaagaacaatgcaaaggatgagagattgttgtactgtgatactttctaacacatacaaactagggattaaaataaaaaaaaaaaacagttcaattgcattaaaaggaaaaagtatacattgacatgatacaaattaaatgaaattaagtatttccatattgctcaaacaaaagtcagggactactgacaaagttgtgaacttggtaaaatttctac

SEQ ID NO: 441 - DNA, 4027 bp, Homo sapiens
aattcgcccagtgttattgtttaataaacatttcccatatgtatggtgtttttttctcaattatgatatcaacatttgtaatctccattgtggcttttctacacttacgttttaaagcccaatgtcaagaatgttttctttccttccatattgattttatagtagccagtctagagattggtatgtcctcagtatataattacttaattgagttggacggaattgaatttttagtgctcctctttattgagaacattcaactttacacttttaagtggacatattttcacttcatttttcttcctccttctcacatctgtgtaaagcacttacaaaaaaactattgtgaaatagaaggatcaaccttacaaagtcatttcaggtatggtaattccaaataccttatttatactatttgcttttttgcatgtatctataatcttattgttttattctaccaaaagacgaaaaggaaatattaaaacaatcaagtaaagaaaaaaattcacaactggcatttttactgttggacaatttggtagaagaaaagattaggagattgcatgccagttccaatactaactagttacataatcctagatatattccttatctctttcaacctcagttaatacatagaaagctactggcacatgtgtggcacacagtaggttcttgaggaaggttactctttcattcctttttactattttataactagctctgggaggcttagatatctgtagagattttcacataagcaaaccaggttgattagccaataagaactcaaaggaaaagacttgacttgctctctctcaatatctctctctctttacccccctcctatttctctctctctttcctcatgaccaaaagatgtttctgattaaaatattgggaaatacattatttcctaattttctgataaagtgattaagatccatttaataactctgaaatgttcaatcagtgtttgagagggccctgaccatttcctactctgtacaataactgatgacaaccactcattatgagccagattacaagtacatcatcaagtgccacggctgattagtgcttctaattatgtccatttaataaattataaggatgacaataacaagaggctactcagagcagattcacctgttaatatgtagcctaaatctttcaatacagatatgataaagatggcatagattcatccatgctgccagtggacttctcaaattctttttttttctttttttaagaaaagagaacctagatatatttagggaacatcaagacctcaaaagtaaacagatttagggactaccttccacaaatagtaaatgcaagttattaagagaggggacacaaatgaaggggaactcagaatacaaaacacgctttggagggagctacatggcaccactgacctgaagtcaatagaggcagaactggagtctaaatacattcaaggtttactcttcttgtgaagtggccaaagtaaataagcccagagttgagtggaggaagaagcaggggccaaccactagacagacgcaactccaaggaaagaagcaggaagagcaaagagaccctggaacagacaaccagggcctcgctaagcaacctgagatctttccattttcttcattcaggaataatccctgaatttcctccaagtagtggcagttttgcgatttattcaagtgaattcctttgggctggacatcaacagatgggtcactgggggcaggcaggtggcaataaaaggaaagaggaaaagctgagaatgtttcaggaggaaaaaaacatctgttttgcctactactgtatcccgagtatctagaacaccccccttgtaaatggtaggcactcaaaacgtacttgttaaatgcataaatcaatctctgtacaatatctttaactagaaaaagaaaataaagaagaaaattctcccctttctctttcaagaatcaaaggacaggagttttagattcaaagtcttttatttcttgccacatgactgcccatctctccccaggctgcttcccagctaaacacagcccctagtgattgatcgagctacagagaagtctggagctttctacccatgctctgccattcttataagttaaatatggcttatgtttatgtactgccaaaataagtgatgagtttaattgaagaggagaattcatgcctttgctaggattatacttcttaaaaaatggcaaaacctctaattcttggaagattccagttttctactaagaacaacaacaatcacaaaacataagtacattataccacgctcaaagagtcttgtatcctccggtcctttatgtttaaatcagaaagtaatgtctcagatgctgattataataaaatacacacgtgtaaacgattgccatctttttatgaggcaaatgtgatttatgaatggctgtaacactgattagagaacataacagatggtaaacaattaattgaaaatgctatgtctatcaaacaaatctttatcatataattcttcatgaagactattgtttatttaaatgagattttattactacagtaggagttagcatgaaaaacattttccaaatttttacccaatcgatgggcttactcagctggctcgttgtattttagaaaagttgaagactagatgcattatattcatacagatattatagaactttaatttgtgaaaaatcacattactgctctgtagttaagaacaccggaaaagaaagtaacattatatttttctgcgctttttcatgcattacaactttactaatctaatttggacttgagaagctaatgaaattattgtcgtggtctataggcctgaaagcaattacttatacttcaaatttttatatgaaaattaaaaagacaaagtctaatattgcctagacaccttctccctcggtgttaggaaatcagtgaactgtttatgattccattatgcagcgtggtatttcagtgaagaaagagcaacaataaagaaaaaagcaaagagttataaacatattcaattactgtgtgaattattttaaaatcgaagaaaatgaaaataaaatgttgtttctattgaatagctacaaatactaattattacggaagtagtttaagatagtacactatggcagttaagagcatcaagttttgtgacataagccttagtttgtattttggctctgtcacatagaagacagtatgcctctaagcctctcagactctcagtttcctcatctgtagaatgggtggtaagtattcacccttcaaggaattattatgagaatgcaattaaacaaggtaggtaagtttcttggcacagtgtgtggcacatggtcagcacctgtgaaattctggcttgttgggaatgtctgcatttactaccatttttcactttccccttcctttatgggattggattcttcctccatttagcatgatattatgaagaaggtctgccaatcctagcagtccctgagtcccatgttactcgggccaagtcaaccagagccctctcctggaatattctggatctaaagaagggtgagcccttcctggtatgaggttgtgagctatacagtcataggaaagctaagaaaatgaaaacctgtacagagaagcagagaagaagacatggagaaaagccttctgggtggtattccagtccctgtggtcagctacgtctctaccgtggctcggttatggaggccaatgccttccccttcatgcctacacttagggaagctgtgtgcctgtcatttacaatgaatgaggctccaattaataaagttgttagtgaggaaaacaaaagccctgggagaaaacacccattagttttactagcccagttacttctattaactaatgtgtaatttgtcctcattttattacatacaagaaaataatgttgtaaccttaagttatatggagaatataaaagtaacttctactaaactatataataatttcaaatcttcactcatttaataactatgaaattgtatttgca

SEQ ID NO: 442 - DNA, 4035 bp, Homo sapiens
taagccaccgcacctagcctcttacttatacttttatatttatttatattatatatttatgtatcatgtattatgaatattattttatattcatatttcataatttttaaacaccaatttatttattgcattacaaagctatttaagggaccacagataactatcttttagaaagaagaaacaggaagaagacaaaggaagagaggaaaaaggaaagatcaatcctgatgttttctgtcatccaattacctttacttcttcaaatatgcaaattagtggcacagcatttatgccacgctctcctttataccatgaggaagaagactataatacacttccctagaatgcaggtgaaaaaccaaagctggaccaggaacagagactaggatttggaatcagtcctgctcccattttgcccattgcccctaggccagttacttgacctgcccagcccaattttatcaagtgcaaaccctattttctcatgctagaaaaatattttatttcaagagtctattttacctcaattcaattatgtaagaaggttgagcctctgtatatctcaaagaaatcttgatagtagaggaaaaaaaactcttcctttgagtgcttatgcaaagctattttttaaattttaaaaatgaaactatgtttctcccatgaaataatgatagatatttattagaattcgcccagtgttattgtttaataaacatttcccatatgtatggtgtttttttctcaattatgatatcaacatttgtaatctccattgtggcttttctacacttacgttttaaagcccaatgtcaagaatgttttctttccttccatattgattttatagtagccagtctagagattggtatgtcctcagtatataattacttaattgagttggacggaattgaatttttagtgctcctctttattgagaacattcaactttacacttttaagtggacatattttcacttcatttttcttcctccttctcacatctgtgtaaagcacttacaaaaaaactattgtgaaatagaaggatcaaccttacaaagtcatttcaggtatggtaattccaaataccttatttatactatttgcttttttgcatgtatctataatcttattgttttattctaccaaaagacgaaaaggaaatattaaaacaatcaagtaaagaaaaaaattcacaactggcatttttactgttggacaatttggtagaagaaaagattaggagattgcatgccagttccaatactaactagttacataatcctagatatattccttatctctttcaacctcagttaatacatagaaagctactggcacatgtgtggcacacagtaggttcttgaggaaggttactctttcattcctttttactattttataactagctctgggaggcttagatatctgtagagattttcacataagcaaaccaggttgattagccaataagaactcaaaggaaaagacttgacttgctctctctcaatatctctctctctttacccccctcctatttctctctctctttcctcatgaccaaaagatgtttctgattaaaatattgggaaatacattatttcctaattttctgataaagtgattaagatccatttaataactctgaaatgttcaatcagtgtttgagagggccctgaccatttcctactctgtacaataactgatgacaaccactcattatgagccagattacaagtacatcatcaagtgccacggctgattagtgcttctaattatgtccatttaataaattataaggatgacaataacaagaggctactcagagcagattcacctgttaatatgtagcctaaatctttcaatacagatatgataaagatggcatagattcatccatgctgccagtggacttctcaaattctttttttttctttttttaagaaaagagaacctagatatatttagggaacatcaagacctcaaaagtaaacagatttagggactaccttccacaaatagtaaatgcaagttattaagagaggggacacaaatgaaggggaactcagaatacaaaacacgctttggagggagctacatggcaccactgacctgaagtcaatagaggcagaactggagtctaaatacattcaaggtttactcttcttgtgaagtggccaaagtaaataagcccagagttgagtggaggaagaagcaggggccaaccactagacagacgcaactccaaggaaagaagcaggaagagcaaagagaccctggaacagacaaccagggcctcgctaagcaacctgagatctttccattttcttcattcaggaataatccctgaatttcctccaagtagtggcagttttgcgatttattcaagtgaattcctttgggctggacatcaacagatgggtcactgggggcaggcaggtggcaataaaaggaaagaggaaaagctgagaatgtttcaggaggaaaaaaacatctgttttgcctactactgtatcccgagtatctagaacaccccccttgtaaatggtaggcactcaaaacgtacttgttaaatgcataaatcaatctctgtacaatatctttaactagaaaaagaaaataaagaagaaaattctcccctttctctttcaagaatcaaaggacaggagttttagattcaaagtcttttatttcttgccacatgactgcccatctctccccaggctgcttcccagctaaacacagcccctagtgattgatcgagctacagagaagtctggagctttctacccatgctctgccattcttataagttaaatatggcttatgtttatgtactgccaaaataagtgatgagtttaattgaagaggagaattcatgcctttgctaggattatacttcttaaaaaatggcaaaacctctaattcttggaagattccagttttctactaagaacaacaacaatcacaaaacataagtacattataccacgctcaaagagtcttgtatcctccggtcctttatgtttaaatcagaaagtaatgtctcagatgctgattataataaaatacacacgtgtaaacgattgccatctttttatgaggcaaatgtgatttatgaatggctgtaacactgattagagaacataacagatggtaaacaattaattgaaaatgctatgtctatcaaacaaatctttatcatataattcttcatgaagactattgtttatttaaatgagattttattactacagtaggagttagcatgaaaaacattttccaaatttttacccaatcgatgggcttactcagctggctcgttgtattttagaaaagttgaagactagatgcattatattcatacagatattatagaactttaatttgtgaaaaatcacattactgctctgtagttaagaacaccggaaaagaaagtaacattatatttttctgcgctttttcatgcattacaactttactaatctaatttggacttgagaagctaatgaaattattgtcgtggtctataggcctgaaagcaattacttatacttcaaatttttatatgaaaattaaaaagacaaagtctaatattgcctagacaccttctccctcggtgttaggaaatcagtgaactgtttatgattccattatgcagcgtggtatttcagtgaagaaagagcaacaataaagaaaaaagcaaagagttataaacatattcaattactgtgtgaattattttaaaatcgaagaaaatgaaaataaaatgttgtttctattgaatagctacaaatactaattattacggaagtagtttaagatagtacactatggcagttaagagcatcaagttttgtgacataagccttagtttgtattttggctctgtcacatagaagacagtatgcctctaagcctctcagactctcagtttcctcatctgtagaatgggtggtaagtattcacccttcaaggaattattatgagaatgcaattaaacaaggtaggtaagtttcttggcacagtgtgtggcac

SEQ ID NO: 443 - DNA, 4029 bp, Homo sapiens
agttatgtgccacagtggccagctaattttttttttttttttttagggatgaggtctcactatgttacccaggctggtctcaaacttctggcctcatgtgatcctcccacctcagtctcccaaagggctaagattacaggcataagccaccgcacctagcctcttacttatacttttatatttatttatattatatatttatgtatcatgtattatgaatattattttatattcatatttcataatttttaaacaccaatttatttattgcattacaaagctatttaagggaccacagataactatcttttagaaagaagaaacaggaagaagacaaaggaagagaggaaaaaggaaagatcaatcctgatgttttctgtcatccaattacctttacttcttcaaatatgcaaattagtggcacagcatttatgccacgctctcctttataccatgaggaagaagactataatacacttccctagaatgcaggtgaaaaaccaaagctggaccaggaacagagactaggatttggaatcagtcctgctcccattttgcccattgcccctaggccagttacttgacctgcccagcccaattttatcaagtgcaaaccctattttctcatgctagaaaaatattttatttcaagagtctattttacctcaattcaattatgtaagaaggttgagcctctgtatatctcaaagaaatcttgatagtagaggaaaaaaaactcttcctttgagtgcttatgcaaagctattttttaaattttaaaaatgaaactatgtttctcccatgaaataatgatagatatttattagaattcgcccagtgttattgtttaataaacatttcccatatgtatggtgtttttttctcaattatgatatcaacatttgtaatctccattgtggcttttctacacttacgttttaaagcccaatgtcaagaatgttttctttccttccatattgattttatagtagccagtctagagattggtatgtcctcagtatataattacttaattgagttggacggaattgaatttttagtgctcctctttattgagaacattcaactttacacttttaagtggacatattttcacttcatttttcttcctccttctcacatctgtgtaaagcacttacaaaaaaactattgtgaaatagaaggatcaaccttacaaagtcatttcaggtatggtaattccaaataccttatttatactatttgcttttttgcatgtatctataatcttattgttttattctaccaaaagacgaaaaggaaatattaaaacaatcaagtaaagaaaaaaattcacaactggcatttttactgttggacaatttggtagaagaaaagattaggagattgcatgccagttccaatactaactagttacataatcctagatatattccttatctctttcaacctcagttaatacatagaaagctactggcacatgtgtggcacacagtaggttcttgaggaaggttactctttcattcctttttactattttataactagctctgggaggcttagatatctgtagagattttcacataagcaaaccaggttgattagccaataagaactcaaaggaaaagacttgacttgctctctctcaatatctctctctctttacccccctcctatttctctctctctttcctcatgaccaaaagatgtttctgattaaaatattgggaaatacattatttcctaattttctgataaagtgattaagatccatttaataactctgaaatgttcaatcagtgtttgagagggccctgaccatttcctactctgtacaataactgatgacaaccactcattatgagccagattacaagtacatcatcaagtgccacggctgattagtgcttctaattatgtccatttaataaattataaggatgacaataacaagaggctactcagagcagattcacctgttaatatgtagcctaaatctttcaatacagatatgataaagatggcatagattcatccatgctgccagtggacttctcaaattctttttttttctttttttaagaaaagagaacctagatatatttagggaacatcaagacctcaaaagtaaacagatttagggactaccttccacaaatagtaaatgcaagttattaagagaggggacacaaatgaaggggaactcagaatacaaaacacgctttggagggagctacatggcaccactgacctgaagtcaatagaggcagaactggagtctaaatacattcaaggtttactcttcttgtgaagtggccaaagtaaataagcccagagttgagtggaggaagaagcaggggccaaccactagacagacgcaactccaaggaaagaagcaggaagagcaaagagaccctggaacagacaaccagggcctcgctaagcaacctgagatctttccattttcttcattcaggaataatccctgaatttcctccaagtagtggcagttttgcgatttattcaagtgaattcctttgggctggacatcaacagatgggtcactgggggcaggcaggtggcaataaaaggaaagaggaaaagctgagaatgtttcaggaggaaaaaaacatctgttttgcctactactgtatcccgagtatctagaacaccccccttgtaaatggtaggcactcaaaacgtacttgttaaatgcataaatcaatctctgtacaatatctttaactagaaaaagaaaataaagaagaaaattctcccctttctctttcaagaatcaaaggacaggagttttagattcaaagtcttttatttcttgccacatgactgcccatctctccccaggctgcttcccagctaaacacagcccctagtgattgatcgagctacagagaagtctggagctttctacccatgctctgccattcttataagttaaatatggcttatgtttatgtactgccaaaataagtgatgagtttaattgaagaggagaattcatgcctttgctaggattatacttcttaaaaaatggcaaaacctctaattcttggaagattccagttttctactaagaacaacaacaatcacaaaacataagtacattataccacgctcaaagagtcttgtatcctccggtcctttatgtttaaatcagaaagtaatgtctcagatgctgattataataaaatacacacgtgtaaacgattgccatctttttatgaggcaaatgtgatttatgaatggctgtaacactgattagagaacataacagatggtaaacaattaattgaaaatgctatgtctatcaaacaaatctttatcatataattcttcatgaagactattgtttatttaaatgagattttattactacagtaggagttagcatgaaaaacattttccaaatttttacccaatcgatgggcttactcagctggctcgttgtattttagaaaagttgaagactagatgcattatattcatacagatattatagaactttaatttgtgaaaaatcacattactgctctgtagttaagaacaccggaaaagaaagtaacattatatttttctgcgctttttcatgcattacaactttactaatctaatttggacttgagaagctaatgaaattattgtcgtggtctataggcctgaaagcaattacttatacttcaaatttttatatgaaaattaaaaagacaaagtctaatattgcctagacaccttctccctcggtgttaggaaatcagtgaactgtttatgattccattatgcagcgtggtatttcagtgaagaaagagcaacaataaagaaaaaagcaaagagttataaacatattcaattactgtgtgaattattttaaaatcgaagaaaatgaaaataaaatgttgtttctattgaatagctacaaatactaattattacggaagtagtttaagatagtacactatggcagttaagagcatcaagttttgtgacataagccttagtttgtattttggctct

SEQ ID NO: 444 - DNA, 4041 bp, Homo sapiens
gtttcaattactgtgatttatttaaccttttgcaattttctacaaatatcatatgaatagtacatcaaaaaattaaattaaactctataaataaatgaggcctttaggttcaagatactgaaagacaaatacctgatgtcatcacatgctaaattcattatcaaataccatcagcaaagaaagagaaaacggtgagtggtaatatagtgaggtagggtttaaagaccacccaaggtgtaagcctgcattatgaaggggaataagctgatacctgtaaaagtttccatcgcatattaaggtcatctagctggcgagacatctttagagagggatgcaggtcaagtggagacagctgactggataaatcattcaccgttttaactttaaagttgattggtgcaatttcttctctaaatgcctagaagaaaagaacaaaaaatatattattggaaacgaatataacaaaagctaatacagttgatccttaaataacttaggtctgaactgcatgggttcacatatgcacagatttttctcaaccaaacttcctgggtccatttatgcacagatttttttcaaccaaacatatggaaaatacagtatttgcaggatgcgaaacccatatatatatggagagctgacttttcctacatgcaggttccatggggaaatgtgggacttgagtatacatgagttttggtacatgcggggtcctggaattgtacttccaaataaatggcaaggccagctcagaggaaatcaactacagttgcccactcaacaacagctgacttaattcaggtcttcagtaacttggatgaagaaccaaaaagtcattgtttattacccaaaaatataaataaatgtgtgaagagaaaaattataattcaaacttttaaaatgattatgtatttcctttcatgctttctattatatgcagtttactctggaaaatgtatgccattattttccactttactgatatctaatgttgattctatctttagtttgtattcgtgttttctttttattctgttttaacatagctaccttaatattttttcaccaaatgcaacaacttgattttaacatgtttccacttaaaattaaattagaaagtggccagtagaaacaacattcctaaccatgaaaccaatgcctattacagactcaagaggtaagatctatccctgtcaaaatcatttataatcactgtctgtggttagggcttgggcaggaagagtggagtctacagaaaaaaggtaaatgagtcttagaattgacaaatgccacctctgagcaaggtctagaatcattaaaacaacttactaagagcacttagaaattgtaattatgagcatccacattcttgacgttcccagtaaagaatggaagctgcttgggaatagaccctcactattcagcacagaacttgcaatccaagagagacagaattaatttctattgacaaaggcccacaaaaatgatatttgagcaatattaagctaacacagaatggataatggaactgggatattaaaagaaaacagtttaaatttaaattggccacaaaattatagttaataatgtaccaaactaaatttagaagtagtaggtgttgtaaacatcccattagctttgccctcaggtttcctcatttctacattgtccactctttaagtggggaggctctttaagtctctttaagagactagagtcagggtgagaactatgaatgttggaagtttgaagtcaacatgtgtaaagtaagaaatattaccgaaccctgcagctaccaacatttcaaagacagggtagaggaagggatgcatacaaattcatgggaattgcttcagtatggaaggagaagaagagttgagatagttttttttccattgctgcagattcggcattttaatggatgacagaatgtgcacacacagaaaaacacacaaatacaattaaataagaagagcagttgtatggtaatagaggcattataagtgtaaaaaattcacaattaatatagaagcacagggaaggaggaggggtgggttagggtgggcaaagggatttttcagtctgaactttgaaaaggtctgggtctctcagattcagtttgagaacaattacagaattcaaatccttcaaggtttctttagtcaggattttagctatatgcattaatattctctccatgggtaggtaccttggaggactcaagaactgtaattagcttttaaaatcaacatctttttatttttatctattaaagattaaaaatgaaatgccagaaaatgttttgagatgcatataatttcaaataatagcctattttatttcaaaagatagtaaactttaaacaaatagaatataacttcaagacaggctttaaaaatcttttggaacaaaaaagaaattcaaatttttcctctccaaaaataatgtttccctatataagccacaggttaaaacatttaaaaagctttgacaaacaaggtctttggtttttgtttttctttttatggtcaggtgttatatggcaatgaggagtctttctatcaagaaagtttatcttttgtttttgaagagcttccaaattaaggggctcgagataaagcaagttttaaaatggtttcagaactgctgtgtgttctagcataaagaacctatttatcatgttatgactgcactttcctataacagaataaaagactatgtggccttccttgccataaaaacagaacatctgctagtatcaaaggtgctaactggaagtctgttggcaggtgtgactcctaagcccttctcctgccagaaggtgtgtattctgtaaataagaacgattaatgataattttaggcagttaacattatttgattacccccaaggatttcgttttccagttgttttgacatatttaataatatttagcaaaattcagtacttatttttatctgactacactgtcaatgagatttggggtatactttaaaccatctcttatatctcttattgtctaaattttattaacttttttttcaggagatgttctagaatatgggaaccaaaggggaggtaaccataagtctaacatccatagctttgggcaattccttactacaaacagaatttatagctaaactaattcttcattaatatacaataagatacaatttatagatgagagttcccagtaaaagagtgtgcttttgattaaatctctatctccatccaccaatttacaagagataccgagtagagaggaacctggagactataccatatggacacaattctgcaaaatccaggctctgggaatcaatacaaaacaaacaattcagtgtctttaacaaataaactgaaaaggaaaaaggaagagaggggaaatctggggattaaaaatattttttaaaaataggtaaacctaatctacattgtctagagatgcacagttggataaaaaataaaaataaatgtaaattatcataaaagttgcattagttgttatttgggggcagggggttccaatgaaccccaatgagggtcatatggaaagcacctgtcctgactcctgatgggtggggttgcagcggcgttggctttgtaacaatcccttataacaatttatatacgtggctctctttatttgtgttatatttaacaagaaaacatttcttaaaaatccttcaaagacaatgatgctgaccatgattttttcaatgtgatcctgcagcgagtcaatgagtaagtctcccacgggcttccagccattccgcacggactctgcctccttcatgtcagcgtccaggtcatccatagctccctgcaggtctctgagtttctccaatgccttgtccacttgcttttgccaattgctagttacagcatttagactttcccatttttctttgacttcagaagactgtttgcgcatggctttggcaatcttttgggctctctcctcaggagttaattctgtgattaaaaaaaagaaaaagaataatttggatgtctgattatatattcttaatagccaag

SEQ ID NO: 445 - DNA, 4048 bp, Homo sapiens
ttttactggtgatggagaagatttttttaaatgctacagtcctaaacgttattatttaaaatagtggccatcattatattatatctattttccagtgctggtaatagtgctctagccaatgggaagccaggtaaaactaacttttattctaccaatctgccccataagaactctgccccacaagaacaagaatacaatcctaccagatccttccaaaattataaacattttgaattagagaaattctgatttagacaattctcagtcatatataattaacctaaacatatagaaattcatttttaaaaaagagctaaaattaaggatggactttaaaagtcccaaaccacacagataatcatgatataaacataaagcaagatatttaattttttttatttagtaaaacccaaaaactagatccagtttgcatttttaaaaaaatcagatgataaaagactctaagtcaattcaataaattaattaatttcaattaatttgcgtgaacttcttgatttttttatagtacatgcattaattttctattgctgttacaaaaatgtctccctgggataaaatcaaagttggcagggctgaattccttctctggaggttctaagagagaatcccatttctttgccttttccagcttctagaagctgcctgcatttaaggatcatgtctgcttcctttaccttccaagctagtagctagcattctcaaatctctgcctcccctgccacttttaaaggcccctgggattacattaagcccatcaggataatccagaataatctccctaattaaaggtcagttgatttgcaaccttaattccatttacgaccttaattctcccttgctttgtaacctaacattttcacaggttccagggattatgatgtgagcatctttcaggggttgggagcagttattattttgcctaccacagtacatcagatttatatctaaatttgtaagattaaattcaagtcaatattcaaccaagcaaattaaagttctctaatactattactattattattgttatagtgtacaataaaaatgtaaacagttttaaacattttcagttagataatcacatcttctttcactagagacatgccaacttaaccagcgtctgacctctttccattcttacttgggcaaatttgacaccaatcaattgctttaataccttgttctcaactcagttcacaactcagtgcattgtaggttatacactgataaaaatattaaactcccataagctaatgtaacgtatattgcttattatatttattatatattatgcaaacctgttttttaccctgagcttacatctcagactgtaataaaaaattataagaaaagactatttcaccaacatggacttcacacaacgttttcaggaagtatactggaagagcagattattagcatttgtatagattttggagataccacaccccatgttagaaatgataaaaaggaaacttggcccagagatcttcatctgacttacctgaggtcacacagctaacctgagacagagctgtctcctgacaataagtaagtgttgtcatgattatgatgctgttcgtctgacacataaaatagggtcaactatgactcatcactagagcacgttgtaaattaatatctttactaagttacactccaagggactatagaagtagaattttatcattctgttccatgacaatatatagccctaagccaaggatcaacgcctactaagagcctgtgtaaattatacaaaacttataaaatgtcatataagaagaagaaacagtatgcaagaaggagaaactaactggacaacagaatcaaagaatgatgagcctatgctaataatgcagataacttctataagacaaagaaaaacttgacaatatttcactttttcatgataaatcattatttcttattggtggaataaaatgacaagagtataagacatttttatatggattttcttagaggaagaaaaatggtttagaatttgtacaatttgacaaatatcattatgtcaagagtattttgaaattctgtcatttttctccaattttttttttttttactttttagagactggatcttgctttgttgtccaggctggaatacagtatggccatcatagcttattgtctgtctccaaatatttaaatctctactttaaaatatatcagctaaacacacctatatccctaatctgatacatgaaaaatataattctcatgttaaaagtagtttctttttaatattaactatatcacagtttctttcagataataggactgaattctatttttaaaagttatggggagagaagcctcttaagttatcaataaaacatgattttcttggtatcataaaggagaattaaaatcaacttacttgatgtaatagggcactttattatgtgaaatggatctttgccacggcagctggactgacgctgaggaaacaaagggagattattggaaacgttggaaaccaaaaagccttacaccttaatgcaaaacaactgaacattttatagcaaattcaatgaactgctctggtttctgagctggattcctataattatgagatccactgggccaaacaaaaaatggctttaaggattcatttgaagtaaaacaagaaacaatacaggttcaaggtctaatgccaactaatctaacctgttgataaaaatacttttaaactttcaaatggtgttgcttataaatactacagtttaaaccttagtgccatctggaaactgtactccatatatatttttgataaagctaaaaccaaaattaattttacctggtatatccagattaaaaattagatttttcaagaccgaattttccagatgactaataacattgtttactttgcatcgtagtcacaggagtagctattgagtacagatggcatttaagtaaattcaattctataacatttaaaaagaaggaatttaaaaataggcaaaaagttgtgaagaaccaaggcaatcgtctaggcagaaaaatcccaatttcttactttcatctgaaacatacagagagcccagtctcctacttttgcactagaccttactatgactgagattttatggggtttttaaattgaggtactttttttttttttttttttacaattctagttacttcttacttataaaaaatatattattcctacattaaccaattattttaagacttatttaagaagaatagtacatgtgaatttagtgccataaaagaattttgctaaatgaacaaatataaaaattcaaataatacttggaattttcatactttgcaaatatcatcagatcctcacgtagccagttgtcaccaatactttttttctcaatttcatgtcacattaatatcttacaactattcagcattctaaactttgccaagcattttcaaatatatgttttcggtaaggaagccagcaagatacacgttaaagttccatttgatagatgaggaactaaatgtgtagagataaaataacttgcccaaagagtgacagccagtaaataaacggtcgagctcagatgtgatctcaatttctgaacactagctgagcaattcttctactcaacaattcctcctctctttataaaaggcaagcactctgttctcaatctatgcccaccaaagtataaacagggatgaaaatgaggaagtaggtatgttacatttctcattagagccaacctcatttcagtgttggcaccaggctaataggtcagtttttattttgtgcctaactaaacaggcttcttttataaccatggctgaagtccaagaaatataataaagccaaagattccaagcagcaaaggataacaattattaaatgtattaattgggactttgtttacacttccccactcattttaataattgttttgatttgaataacttctacctccttggattctcagtgttagataatacaaggccatgtatttgacttttacaaaaatgtgtataaatttcacaatatttcactt

SEQ ID NO: 446 - DNA, 4039 bp, Homo sapiens
gatcaatgcaggctccagaataaacccatatctgttaaacagatgtagattatcattcagaacgaatcctccaacagcagaagtagtgctgtgggagtcactacaccttaaaagtctcgtcatatttccaaagattgcagaaacaagtttaactctgaataacatcatcccacaatctacagagcctccctcctcttctaccttgagtcgaactttcctcagtgcaaatctaccctttcttctcttcatgtgtatctggattccccactcccctcaggcaagtgtctcttgccacttagactctgtgttcctcttctcagcttcctctcattaaccagtattattattttctatatgtattaaattgttttcctcatgttcttcactttaaaagcaagttttatactttctctttttctgtaaatttcaaaactaattcatatgttagatggaagttttggggtaataaattgaggttaaaacataaatggaatgcttcaattaagtttcttaggtaaacagttcatgactttggtgggtcagtggccttacatttaaaaagagttaactgccccttatctaggtcagggtagattcataacatttaatagtgctccaaagacttcttaaatgacacctagttcttataaaactatttagtaaactaaatgaaccagcatagtacctaagagagtgatattacaacattcataaaatcaaattcaagagaaattatttttcaagcctatgtaatatatcaaaaactggggcatgtcactgggaaaagaatatcatcactgttatatatacacaggtaacaaaaaccccaaataactcatacttacctttgaaaaatatttaaagtgtgtatttgcagttgggtacgtatcccggaaatattagcaattgggtatgtatcctggaaattccaagatctcaaacaaaataatgtaactacaatgtgaagatctgtcttggaaagagatggaaagttgtcgggctcctctacccagattcttgactccaatgcagagacaaatacttctacttcatggtccactactgaacaccaacaaaaccattccaccctttcggtttgatggtagtgatactacaaattgctcaaaagaccatggagccgggtactgaagttgtttgacctaaattcttactattcatcattaggctcagagctttacagaaatgcagagtctcaaaaagaatttcctccctattaccaacaaatatggaaggatttgctgaggaggtaatgcaattccagtaaggcatcatgggctcccagtctgagagaacctactagggttcattgatctcttgtcttctctttcagggaatttcaatccccacgacaacagtactgtccagagacagacatcccatcatgatggagcaaaccaaggctcaagaaccaaactaaagccatcggtaatgtagagccagacgttatacttaaacaacaaatatgctttctctggaattacaggtgtgggtcttcacctcacacaacccctacggaatcacaagaggaaaataccactatttctcagtcaggcggaggactaagaattcaaggtgaacacctcttgctaatggctctttttagtgaaaccactactgagagctgacggaacacacacatttggcaaacagatggagggagggaacgggcatctccctttgtgaattcaataccagttgattcattaggcagaactgccaacacagaaaataaatacagcctctggttacaaaagtataactgctgcttaccaaacaacagaaataaaaaaaacaggcaatgcagttggctgctgttttttttttaagtcgggggagagggttaaagcaaaatccacaatgaacccaaaggcttaaagtatttgaacagctgcagatagctcagctcctcttgccaaaatgcctgaagttctcccagagtaggcaaccaaaacagaataaaagtagcattttcccccaaaataacaacagcttgggttctaattaatctcaaatatgaacagggagtgggacttcatattgtgcagcttgataagctctaaaataaaattatgattttattactaaaaatcctctctttaaaaggcaacagccatgggaatctatccaagaataaaattaaaaaaaaaaaaacaaaacaaaacaaaaaacaaagtagcaattaacagttaagtacaaaatcatatgaagcaaacaatagtgagaacatgtgacatgtaactaggctggccagccatccagttttgcctgtgcagggaaaaattgtgaaggtctttgttgtgggcaaaaaatgagtgggtatcctgcaaagcttaaattatctctgagctattttaaactctgcaaactgaagaaaacagatagtaatgcaaatgatttctgtccatataaatgcaaattgtgcccagtggaatgcaattgattattgtcctgtggatattgaccagtttgtcagctttgcatccagaggtaaattcattttagcatccctaatctcactataaatatgtgacattttgtattctctttggaacctattataacttcttactggttcccttactatgagttaaatgaaacatgctctttttgtatttgtataagagttaagatttttgcctattttgaaaactatccttcaagcagtataaatcctgctttatactagactgtatacaggaattacatatcagcatcctggtataattattaaaagtgcccccttactctgaagagccccagctgggataacatataatctctgcattttatggacattattaaaatattaagccaataaggttaagaagtagtatatccttccacctatctattattattcataacaatataacactgataagccacagaaagtaaaacacaaataatataagactgtagcaccaacaaataaaacaaaaaaagttgtgctgcaatactgcctaacatgtaacacaatgaaccaacagcaaaggacatgcacttttgataggctggtaaaatcttgatttctgggcaaatgactgctctgtggaagatacttcttaaacccatttgtcctcattagagtggtctcatatttttccatgaaaccttaaaggatgatcagaaggcaacttgtttctccaaaaactaacacttacccaaatatacttatttgttactagctatccaattttatgcttataactggattttgtgaggtttgttatatatcattccattccaattataattataaaggcatataacagaacaaaactaaagataagtaaaaatacaaatgtggggacaagaactatgtatattgctctgagataagacaatcaaagaaaaaaatatttcttctttgctgtgcaaagtaaaatatactaggtcaggatgtatattaatcacagtaataacatgctatttgagtgctcgatttgtaccaagtaaacttttttggataaactttttctatgtgtaaattctatttggattacaattctatgacttgggtgacaatattgtctccatcttacagatggaaaaaactagggcagagagtgcttagatagcttgtctgaggtcctatagtaagtaatagaaatgggatttaaacagagatagtctcattttaagctaagctcttgatatggaagtatatttgcataattaaggttttaaaatatttcttgatgaatctgtccaaatttgagtccatggtctatcattagaatcattacaaataacctcatctcccttgcttctctctcaccccttgcaaatcccaggcctggatcagctcaattacttgcctactctggacctgagcagctgtggataaaaacaactggagaaaatcactcaacagacagactcaatttactttaaaatatgtgatttcaaacctcaaatgtccaactcctggcaactgcactatattccctaataaacttgctttcccaaactccaaaacagaaattcactactgctatctctctccccaaactggttt

SEQ ID NO: 447 - DNA, 4045 bp, Homo sapiens
ttgtcactaaggtgagagaacctgctattacaggcaatcataaactactgggaaaaaatgtggagacgggtaggattagcttgtaaatgtttccaaaagaggtaaatctttaacagtatttgggaggaaaaaagggttacaagccagtgcagagaaagggtcagggtatttctagtaaactgaaaggaagggagaggaagaagcagattaataataaactgatgagctccaggagtggcccagaggccttggctggagggcagtgggagaaggctgtaggaaaagtgaaggtcagttggctctgaaaaaagcacctcatatacttgaaatccaatacaatctagcccttttctaactgtcatttagttgtttaattgtcattaccaatctcgtttagtttagaagttggagaagcgtcccttctgttcctctcaggtttgaggggaagagctgaggagggggtttttttcttcaggaatccaaagaaccaagagaagaaaacaccaaatgtgttaatatgcttatccacccataagtgttgtcgaaaactgggaccatgttcataatgacaaaaagcagtcttctgtcaatggaaattttgtggctgagtcatttgtcctcattttatagctcatcaggcctgagaagaacttccagacccatcaactggatcctggatgtgcagctgagcctctttcaaaactgctgtcaccatggactcctgcgcagaccaaacatcccttttgtgtgttcgtaatttacttcctattctcttttcgctcaacatactgatcagtagccagagcgtggtggctttcttttctttgtccgggtaattctgcaacacttgctgcaactactaccacctgctaattatctttgaggctctgtggattatgcaaaagtcaaggtcatctcattcttccttgcattgcctcatctggaggtgtctttcagccctgtagacttctcttccatacatagcttaagcttttcctattttcaagctttgcattgctattttttctcaatgacattatacctctctttcctcaattcttcgtgcagccagcttaaaatttattgctaacttctattgactttcaaggagcagatttttcaaccttaacatatcatttttcaaagcataattttcaaagcatcactgaactgcctagacgtatattaacagttaacaaaaggtagcaaagaagaatacttgaaacttttcaatttaccctatcttaaaagaacaggtaaatatcactttccacatcaactatctgacaaggcctagggtagactcaatcattagaactacaaccacaaatagaatccagatagcataaatctatatgctaagtattcacactgctacttaattttaggttattttgcgggaggaaatatccttttgatgaaaggactgccacagaattccactctgaacacatcctccacaggaaaaatgcattgataatactaaatgtctcaagatatatttaaaagaaaatagagccttttatctcacttgttaaggtgccagttcaaatttagatcaggaatgtgattttttagtgtttctttatatatagtggtattgagacaaactggaactctacattgccaaatgggcaaaaggtactgaaaacacatgacttaatactttctttgatttaatccttttaaattgggtggcagcacaatttttgaaaaagctttttacattactcctgtgttttggttaattttgttctccaagtaagaatggcatgtgttcagtactgcacactgatggggcaagtaataaaacatttatagaaacaaaaccaactccttgagtgaggtacactgaagaccagattaacttggcaaacactccatcctcttcatttatcttcctcttggaaaaaaaaaaaacgcaattcaagtaacagattgattaactttggtagaataactcacaacatagtgctttttgtagtcttcggattttgattgctgtacggtaggcagaaaaacgtacattattcaggtcagctgaaatagaaaaagaaacaatttgaagataggcttattattgaatatatattgaatgcccagaatgtatttggttactttggatgatgaaaaaatattatgtttgcctgaaataaaaagtcttctcccaaattccccaacacgtatttaagaaaaaagttaaatgatcattagcaccatgttgagatacatctcaaagcagtgctacagagaaaattctaagaaagtattttcaacaggtgtcagggctcagaacatggtgggttgagtactttgaaatgaaggagactggaaggcctcagtagtaaggtctctctgacctctgggtctcttgtctcctgaccctctttctccttccaaagtgataaatagaaaccagaattccccttccccaaggtgggtcatgaaaactagaacttctcttccccaaagcaagccataaaatctagcaagttcactgtcaccttctcccttctctcctgaagattctcctgtgacaggtatcctgtccctagaggaaaggaatatgctgcagggagaagccaagaagaatctgaatagataggccttgctggaattcccttctcagtctattatcattaaattataccctttcatccaatcacaattcaatgcagtcatccattcctcactcaatctaagtgtaaaaacagacacttttccctgttttctttgagtcttctgaaggttctcatgtcaggtaaaactttgattaagtaaatttcttgtgcttttctggttgacctgtcttttgttataggagggtcaccatgacccttatgatgggtgagaaaaggtaccacccctttcagccctttggtaggaaaaagaggaaggtgatgaagagaaagcacagctgtcacatggcttattaaatgcactgcacagtaggcagagggcccttcctttttttcccaataaaggagattttcctccaggggcatcttccccaaggacacttcattttcttccaaccacactgtccagttcactattcatggagctcatcttatttctatgctcctcccatcctgattgatttggttttcctgcccttttgcagatctggttcaaatgatcctacaaccaatactcaactctttggaaacaatagatattgtaatttctttctttgtcccctaaagacagagtatcagagattagtagagttaaaagaaaactcagatatcatcaaaatttgccccctcattttacaaactaagcaaaccagttctatgtcttttgtttgtccaacttttgcaggccccttcacccaccaaaaaaaaaaacactcacacagaagcccaacatttaaagagattaaaaaagggggcatcctttttattgaaatgggagagggaggcttcgggtgctgtttttccctccagcatctccttagctacccaaagagaaaacttaaaaaaaccgctggaccaaccagaggaagtaggttaaacaataagttgaaagccacattgcactagaaattaaaacaaaaccggaattctcgtctgtgttttcttgcatttttatataaaaatgaatttagcttttaacaatttagacaaatttaaactaggtgagctaatttgatggcacgtactaaataaaaagtgagccaaaagcaaatttaaggcagtggattaaagttggctatattgtaattgtatatctatatatattttttgcgtgcaaagctgaaggttaagatgactcaatacgaaggaggtaaaaactacaattacattcctccctgtaaatcaactctttttggctcacatgatttcaaaccacacaattctcctaagaaaggcaatacctgtttactgcattgcccttagaaatttaactacttttaaatgtcaatgacatgattcttttaacattaatatgccatgtaagaaaggctggtgattagctcctatttaacaatatacagttctcggccgggcacagtggctcacgggagcactttgggaggccg

SEQ ID NO: 448 - DNA, 4041 bp, Homo sapiens
ccacttctggccctatctctaaactcccacaatacagaaaatgcctcatggctccccattctataacgaaaaatatccaaacatgaaatacaacacaataagaacttgaggaaaaaaaccgaaaggaatttcaggaaaaatatgacgttcaaattgacctaaattaactttaaggaaatttctggatattggacaaaatagctaagctattccattcagactctataacttaatgttccttgaacaccatctacaccttaattctcacacagataactccttcccttcttatccccaattaactgccccatgcctaaatcccaggtgccttttatagcctggctcatatgcccactaatcaaggaagcctgccttcttcttcataatgagaggactctccccctcctcggaacatacttcccttttgcttttctgctattacctatcacataaagtttcaaaatcaaaatacaaaggaaaacagaaaatacatatgtgtggtctaaaagaaaataatagaacaaatacccattagtccatcacacagctgaaaaaaacagaatgttaccactatcttggaagctccttgaatcctgcctaattacatcctcttacaattatggggtaaccattaacctttgtatttcactttcagtttttaaaagtgtatatagcattagttttgcatgggtttgaactacatataaatggaacagagtggtacacattttttttctgccatttaattttttcatttaattttatagttctaagattaaatcatgttgatgctgattactagctcattgatttttgttgctgtattatatttataaatatgccaaaactgaatgagttttactatgaaaagtactgctataaatctccttggacacatcttctggagtactgctatataaccttcaaactcaaatcattcactcagtgtgtcctaagcaacccctgctctgtgccagaaattgtatgaggtcctaagtagagacgaacacagactcatccatcccatgatggagaagcaaacaataactaataaacagaatattaaaaattaccattgacactctgccttagtgcctaaaccaagcaccagaagtgtcatgtaaggaaaagaacagttctatgaggagccatagaaaacctcattaaaagagaggtgatcgacaacattgagacctacaggaatgagtgtcccagccaagggaagaacagaaggattaagttggtgcaaaagtaattgaggtttttgccattacttttaatgaaataccctaacttacttttaacggcaaaaactgcaattatttttgcatcaacctatacaaagagctaagacaagtgctttttaggcaggaggaatggaatacagagtttgccatttctatcactaagtggatgatgaaatggtgatgccccggtggagcagagggaaggaggtggacagagaggtgagccaggcaaagaccattccattctgagggcagcaggaatcttttgtaagcagggcattgggtccatgtgcaacgttctcgaaatatgagttccttcagtgtgagaatcaagtctctttatagtgttttatctcctgcacaatcttggagcccaacaaatgaatgaacaatgacactgccctctgccttatgctgggtggagatttgcacataatgagagacagccatgacctaaagtagttcacagtggagatggggcaatccaccaaacattattcgagcacacaaaggcaagcacttgtcactaaggtgagagaacctgctattacaggcaatcataaactactgggaaaaaatgtggagacgggtaggattagcttgtaaatgtttccaaaagaggtaaatctttaacagtatttgggaggaaaaaagggttacaagccagtgcagagaaagggtcagggtatttctagtaaactgaaaggaagggagaggaagaagcagattaataataaactgatgagctccaggagtggcccagaggccttggctggagggcagtgggagaaggctgtaggaaaagtgaaggtcagttggctctgaaaaaagcacctcatatacttgaaatccaatacaatctagcccttttctaactgtcatttagttgtttaattgtcattaccaatctcgtttagtttagaagttggagaagcgtcccttctgttcctctcaggtttgaggggaagagctgaggagggggtttttttcttcaggaatccaaagaaccaagagaagaaaacaccaaatgtgttaatatgcttatccacccataagtgttgtcgaaaactgggaccatgttcataatgacaaaaagcagtcttctgtcaatggaaattttgtggctgagtcatttgtcctcattttatagctcatcaggcctgagaagaacttccagacccatcaactggatcctggatgtgcagctgagcctctttcaaaactgctgtcaccatggactcctgcgcagaccaaacatcccttttgtgtgttcgtaatttacttcctattctcttttcgctcaacatactgatcagtagccagagcgtggtggctttcttttctttgtccgggtaattctgcaacacttgctgcaactactaccacctgctaattatctttgaggctctgtggattatgcaaaagtcaaggtcatctcattcttccttgcattgcctcatctggaggtgtctttcagccctgtagacttctcttccatacatagcttaagcttttcctattttcaagctttgcattgctattttttctcaatgacattatacctctctttcctcaattcttcgtgcagccagcttaaaatttattgctaacttctattgactttcaaggagcagatttttcaaccttaacatatcatttttcaaagcataattttcaaagcatcactgaactgcctagacgtatattaacagttaacaaaaggtagcaaagaagaatacttgaaacttttcaatttaccctatcttaaaagaacaggtaaatatcactttccacatcaactatctgacaaggcctagggtagactcaatcattagaactacaaccacaaatagaatccagatagcataaatctatatgctaagtattcacactgctacttaattttaggttattttgcgggaggaaatatccttttgatgaaaggactgccacagaattccactctgaacacatcctccacaggaaaaatgcattgataatactaaatgtctcaagatatatttaaaagaaaatagagccttttatctcacttgttaaggtgccagttcaaatttagatcaggaatgtgattttttagtgtttctttatatatagtggtattgagacaaactggaactctacattgccaaatgggcaaaaggtactgaaaacacatgacttaatactttctttgatttaatccttttaaattgggtggcagcacaatttttgaaaaagctttttacattactcctgtgttttggttaattttgttctccaagtaagaatggcatgtgttcagtactgcacactgatggggcaagtaataaaacatttatagaaacaaaaccaactccttgagtgaggtacactgaagaccagattaacttggcaaacactccatcctcttcatttatcttcctcttggaaaaaaaaaaaacgcaattcaagtaacagattgattaactttggtagaataactcacaacatagtgctttttgtagtcttcggattttgattgctgtacggtaggcagaaaaacgtacattattcaggtcagctgaaatagaaaaagaaacaatttgaagataggcttattattgaatatatattgaatgcccagaatgtatttggttactttggatgatgaaaaaatattatgtttgcctgaaataaaaagtcttctcccaaattccccaacacgtatttaagaaaaaagttaaatgatcattagcaccatgttgagatacatctcaaagcagtgctacagagaaaattctaagaaagtattttc

SEQ ID NO: 449 - DNA, 4031 bp, Homo sapiens
tgacactttgtcttagtgcctaagtcaagcgtaaatcttcctgaagtgtgtcacatttaggtacctttaaagaactgactacatttaaatcacagaaaattatgattaagattttctcatttcaaagggagacaaatgacagctcagtcatgtggtaaatgaaacaaacagcataatcattttctatccaactttctgactttttctttaatcccacatacaaggcacaggggatggaatagaaatgcatcatcattctcctgttctgcaaaacaatgaacactgttaagcatccaatcttgggcttcagtgacacttctccaggtgtcaagctatgtggccattctttatttttttattttattattattattattattattattagcatttcccctatcttctcttccccagaaatataggcagagctcaaggtttcacatctggcatttcattctgtgagcctgaggccctcactcactcctcttacttctattattgcttctctttggatggctccagattctcttttctcctgctgatctcctgcctcaacacttgacccatgtcccattgctctgatccctacaagagctatataattctctttcaggaacctctccccataaaggcctggccttcttgtcatgatgaaatccagtctgcaaaccgtgaaatatcctaacatccttccttcttctacctgccacaatttaccaactacccaataccccgagtcatcagttcttcctcaggcagccttaaaaatccagaccctgatctcccctcctacaactcccagccagctcagctttgatcatccttcacctgaactatttacccattctctgttctctgccctttggtctttcttagatattccctaaagcatacttccacttctggccctatctctaaactcccacaatacagaaaatgcctcatggctccccattctataacgaaaaatatccaaacatgaaatacaacacaataagaacttgaggaaaaaaaccgaaaggaatttcaggaaaaatatgacgttcaaattgacctaaattaactttaaggaaatttctggatattggacaaaatagctaagctattccattcagactctataacttaatgttccttgaacaccatctacaccttaattctcacacagataactccttcccttcttatccccaattaactgccccatgcctaaatcccaggtgccttttatagcctggctcatatgcccactaatcaaggaagcctgccttcttcttcataatgagaggactctccccctcctcggaacatacttcccttttgcttttctgctattacctatcacataaagtttcaaaatcaaaatacaaaggaaaacagaaaatacatatgtgtggtctaaaagaaaataatagaacaaatacccattagtccatcacacagctgaaaaaaacagaatgttaccactatcttggaagctccttgaatcctgcctaattacatcctcttacaattatggggtaaccattaacctttgtatttcactttcagtttttaaaagtgtatatagcattagttttgcatgggtttgaactacatataaatggaacagagtggtacacattttttttctgccatttaattttttcatttaattttatagttctaagattaaatcatgttgatgctgattactagctcattgatttttgttgctgtattatatttataaatatgccaaaactgaatgagttttactatgaaaagtactgctataaatctccttggacacatcttctggagtactgctatataaccttcaaactcaaatcattcactcagtgtgtcctaagcaacccctgctctgtgccagaaattgtatgaggtcctaagtagagacgaacacagactcatccatcccatgatggagaagcaaacaataactaataaacagaatattaaaaattaccattgacactctgccttagtgcctaaaccaagcaccagaagtgtcatgtaaggaaaagaacagttctatgaggagccatagaaaacctcattaaaagagaggtgatcgacaacattgagacctacaggaatgagtgtcccagccaagggaagaacagaaggattaagttggtgcaaaagtaattgaggtttttgccattacttttaatgaaataccctaacttacttttaacggcaaaaactgcaattatttttgcatcaacctatacaaagagctaagacaagtgctttttaggcaggaggaatggaatacagagtttgccatttctatcactaagtggatgatgaaatggtgatgccccggtggagcagagggaaggaggtggacagagaggtgagccaggcaaagaccattccattctgagggcagcaggaatcttttgtaagcagggcattgggtccatgtgcaacgttctcgaaatatgagttccttcagtgtgagaatcaagtctctttatagtgttttatctcctgcacaatcttggagcccaacaaatgaatgaacaatgacactgccctctgccttatgctgggtggagatttgcacataatgagagacagccatgacctaaagtagttcacagtggagatggggcaatccaccaaacattattcgagcacacaaaggcaagcacttgtcactaaggtgagagaacctgctattacaggcaatcataaactactgggaaaaaatgtggagacgggtaggattagcttgtaaatgtttccaaaagaggtaaatctttaacagtatttgggaggaaaaaagggttacaagccagtgcagagaaagggtcagggtatttctagtaaactgaaaggaagggagaggaagaagcagattaataataaactgatgagctccaggagtggcccagaggccttggctggagggcagtgggagaaggctgtaggaaaagtgaaggtcagttggctctgaaaaaagcacctcatatacttgaaatccaatacaatctagcccttttctaactgtcatttagttgtttaattgtcattaccaatctcgtttagtttagaagttggagaagcgtcccttctgttcctctcaggtttgaggggaagagctgaggagggggtttttttcttcaggaatccaaagaaccaagagaagaaaacaccaaatgtgttaatatgcttatccacccataagtgttgtcgaaaactgggaccatgttcataatgacaaaaagcagtcttctgtcaatggaaattttgtggctgagtcatttgtcctcattttatagctcatcaggcctgagaagaacttccagacccatcaactggatcctggatgtgcagctgagcctctttcaaaactgctgtcaccatggactcctgcgcagaccaaacatcccttttgtgtgttcgtaatttacttcctattctcttttcgctcaacatactgatcagtagccagagcgtggtggctttcttttctttgtccgggtaattctgcaacacttgctgcaactactaccacctgctaattatctttgaggctctgtggattatgcaaaagtcaaggtcatctcattcttccttgcattgcctcatctggaggtgtctttcagccctgtagacttctcttccatacatagcttaagcttttcctattttcaagctttgcattgctattttttctcaatgacattatacctctctttcctcaattcttcgtgcagccagcttaaaatttattgctaacttctattgactttcaaggagcagatttttcaaccttaacatatcatttttcaaagcataattttcaaagcatcactgaactgcctagacgtatattaacagttaacaaaaggtagcaaagaagaatacttgaaacttttcaatttaccctatcttaaaagaacaggtaaatatcactttccacatcaactatctgacaaggcctagggtagactcaatcattagaactacaaccacaaatagaatccagatagcataaatctatatgctaagtattc

SEQ ID NO: 450 - DNA, 4045 bp, Homo sapiens
acttaagctaataacaaaaataagtcaaataagcttcatatgagttagagaaggtgtcagaaaaaaactaagaaccatctggaattttcactgtaattcttacctcatttctttgccctgtacagttgacgcttgaacagcgccagtttgaactgtgagggtccacctacacgtggagttttttcaattaaagttaagcactgaacgtgcctgcctctcttttctcctctaccctttctgcctctgttacccctgagacagcaacaccaactgctcctcttcttcctccccctcagattaatcaacatgaagtcaacaaggatgaagaccctttatgatgatcacttccaattagtgaatattaaatatattttgtcttttactattttcttaaaattttcttttctctagcttactttgttgtagaataagagtatatattacatagcatatcaaatatgtgttaattgactgttaacatgttaagttttgggtgtcaagggtcaactgtacacagttttcaattgtaaacctctagagggcagaagcaaagtgcctgacaaaggaaagtgtttaataaagggcagtagctagggaactacagctccccacagacaccaaggaacatattcaaatatggccaaaaggctgtaagttttctgaattccaacattaattatgccagtaacacagcactgctattggatccccacatggcatcaggtgacaacagaccaaattccaaaaagcccatttcctgcatcaggctgtccttgcatttctttctgaagtctccctggttatacactctgtagctgtgacactaatttgccacatcccacagactatcatgtcttcaatttttagtgatttactctgacactttgtcttagtgcctaagtcaagcgtaaatcttcctgaagtgtgtcacatttaggtacctttaaagaactgactacatttaaatcacagaaaattatgattaagattttctcatttcaaagggagacaaatgacagctcagtcatgtggtaaatgaaacaaacagcataatcattttctatccaactttctgactttttctttaatcccacatacaaggcacaggggatggaatagaaatgcatcatcattctcctgttctgcaaaacaatgaacactgttaagcatccaatcttgggcttcagtgacacttctccaggtgtcaagctatgtggccattctttatttttttattttattattattattattattattattagcatttcccctatcttctcttccccagaaatataggcagagctcaaggtttcacatctggcatttcattctgtgagcctgaggccctcactcactcctcttacttctattattgcttctctttggatggctccagattctcttttctcctgctgatctcctgcctcaacacttgacccatgtcccattgctctgatccctacaagagctatataattctctttcaggaacctctccccataaaggcctggccttcttgtcatgatgaaatccagtctgcaaaccgtgaaatatcctaacatccttccttcttctacctgccacaatttaccaactacccaataccccgagtcatcagttcttcctcaggcagccttaaaaatccagaccctgatctcccctcctacaactcccagccagctcagctttgatcatccttcacctgaactatttacccattctctgttctctgccctttggtctttcttagatattccctaaagcatacttccacttctggccctatctctaaactcccacaatacagaaaatgcctcatggctccccattctataacgaaaaatatccaaacatgaaatacaacacaataagaacttgaggaaaaaaaccgaaaggaatttcaggaaaaatatgacgttcaaattgacctaaattaactttaaggaaatttctggatattggacaaaatagctaagctattccattcagactctataacttaatgttccttgaacaccatctacaccttaattctcacacagataactccttcccttcttatccccaattaactgccccatgcctaaatcccaggtgccttttatagcctggctcatatgcccactaatcaaggaagcctgccttcttcttcataatgagaggactctccccctcctcggaacatacttcccttttgcttttctgctattacctatcacataaagtttcaaaatcaaaatacaaaggaaaacagaaaatacatatgtgtggtctaaaagaaaataatagaacaaatacccattagtccatcacacagctgaaaaaaacagaatgttaccactatcttggaagctccttgaatcctgcctaattacatcctcttacaattatggggtaaccattaacctttgtatttcactttcagtttttaaaagtgtatatagcattagttttgcatgggtttgaactacatataaatggaacagagtggtacacattttttttctgccatttaattttttcatttaattttatagttctaagattaaatcatgttgatgctgattactagctcattgatttttgttgctgtattatatttataaatatgccaaaactgaatgagttttactatgaaaagtactgctataaatctccttggacacatcttctggagtactgctatataaccttcaaactcaaatcattcactcagtgtgtcctaagcaacccctgctctgtgccagaaattgtatgaggtcctaagtagagacgaacacagactcatccatcccatgatggagaagcaaacaataactaataaacagaatattaaaaattaccattgacactctgccttagtgcctaaaccaagcaccagaagtgtcatgtaaggaaaagaacagttctatgaggagccatagaaaacctcattaaaagagaggtgatcgacaacattgagacctacaggaatgagtgtcccagccaagggaagaacagaaggattaagttggtgcaaaagtaattgaggtttttgccattacttttaatgaaataccctaacttacttttaacggcaaaaactgcaattatttttgcatcaacctatacaaagagctaagacaagtgctttttaggcaggaggaatggaatacagagtttgccatttctatcactaagtggatgatgaaatggtgatgccccggtggagcagagggaaggaggtggacagagaggtgagccaggcaaagaccattccattctgagggcagcaggaatcttttgtaagcagggcattgggtccatgtgcaacgttctcgaaatatgagttccttcagtgtgagaatcaagtctctttatagtgttttatctcctgcacaatcttggagcccaacaaatgaatgaacaatgacactgccctctgccttatgctgggtggagatttgcacataatgagagacagccatgacctaaagtagttcacagtggagatggggcaatccaccaaacattattcgagcacacaaaggcaagcacttgtcactaaggtgagagaacctgctattacaggcaatcataaactactgggaaaaaatgtggagacgggtaggattagcttgtaaatgtttccaaaagaggtaaatctttaacagtatttgggaggaaaaaagggttacaagccagtgcagagaaagggtcagggtatttctagtaaactgaaaggaagggagaggaagaagcagattaataataaactgatgagctccaggagtggcccagaggccttggctggagggcagtgggagaaggctgtaggaaaagtgaaggtcagttggctctgaaaaaagcacctcatatacttgaaatccaatacaatctagcccttttctaactgtcatttagttgtttaattgtcattaccaatctcgtttagtttagaagttggagaagcgtcccttctgttcctctcaggtttgaggggaagagctgaggagggggtttttttcttcaggaatccaaagaaccaagagaagaaaacacc

SEQ ID NO: 451 - DNA, 4041 bp, Homo sapiens
tccattttcattttaggtttttattgtccattttcttatatgtttttaatacacaagtacagcacacttaaaacctataactaaaagtttacataaatatatgaatgtataaaagttaacaatttgtgctattttaaaaacataaatatttgtatcacgtaactttaattttaagcagtcttcttgccaaactatatttaatcattgattttattgatatttttactacttacactaattgatattcttccattctcaactatatgtactgaaggaagtttctgtacgcatattatgacatataaagtatgcaataaataagaaaggaaatcgtgcttagggattggtgcaatgtattttcaaagtactccctcaataggatagagtttataatttatattaaatcatatctaataaacttactgaacccttagtatgtaggtatatgacattcagaattaacctatgaagtgactaatacttaatattaaaataaacatagcccttctaagcagaatttctaaattaatataatcatttctcacaattacagaaacaccagtttcacattaaccctacagacagccatgctacaaactgtgtttctactttatattttttagaagtttcctaattatcacatgaaacagacaatgtttgcttcctttcaaaagcaggaaatttttactctctggacccagtcagacaatagacttgcagaggataacagaaggctttgtgaacgggctgagacaagtacatgaatgtggctaaggataaagtgatccctacagggaaaaatggtcaaaataatatgcattaaagcatgactcccactttactgtcacaacacaagaaaggaatatcatcaggaagacaactgatgctgtcaatcacccattcatcacaccatcaccagttacaaaggcttactgtgatcctgacattgctctgtgtactgttgggaccaagagaaaagcagaagacatgattcctaccccgatgaactcacacactagctgaggaaggtaagataggaatacaactagaaaacatatgagacaatcctttatgtatggaaatcaaacatcaagtacaagatcattgtggctgcctatcattagtgatttagtctaggtagtcattagtttcacaacatgtgacagagaagataaacccaaaatcagacatagaaggtatgtcatgccatgacagtcccaagtaggagaacatagagtatcacagagaaagcctgagcaaaggcacagaggcaggggtgtgagcatcggagataagacacattcaggcccggcgcggtggctcacgcctgtaatctcagcactttgggaggctgaggcaggtggatcacgaggtcaggaaattgagaccatcctggccaacatggtgaaaccctgtctctactaaacatacaaaaattagctgggcgtggtggcgcgtgcctgtaatcccagctactcgggagactgaggcaggaaaatcgcttgaaccagggagtcagaggttgcagtgagctgacatcatgccactgcactccagcctggcgacagagtgagactctgtctcaaacaaaaacaaaaacaaacaaataagatgcattcaggtgggtcagagacttgcatcaaggttaactggttgactgaactgtacaggttacgtgggaccagacaataaaggacactgatgtaaataagctacatggatgtgagagacaagagggagacagtaaaatatattagtgagtgacatagcccagtgttgacatatttagtctcctgatagttttcataggcaactctttaaactggtttaactataaagacatttactttataaaattataccatctttggaatagtggaacaaatgacactactgcaaatgaggttaatatttttggtagaaaaaaacacatttaaaccaagtactacagactattgctttatatcatgatttaaacacttttgatttccattaaatccagaaggaagattgtgaaattaagaccttttaatctggtaagatgactgaggctgcaaattcataaatgaaatcaattttatctttataaagtactttttacatatattagttcatttgcccttcataatcaccttttgtgtggtaagcagagtggatatttttatttcaatttttcagatgaaaaattaagatgccaatgttaagtagctgccaactcacacagcaaccagaaccaaaaatttgaattcttgtcatccatgacagatgaaaataaattttttttacaaagttcagaatatcaggaggtgggtacatgttaaaattggaaaaaaactgttcacttaaaataaagtactatgtttcctagatatagaaatatagtaagaataatcaaatgattatcaaaagactgaacactagttctttaattatgactaatatgcaataggtagataaattctcctgtctcaacgggcaaggttttcaattagtaaagagaaaagggcagaattaaagatccccaaatccttctactttgagaattctgtgatctgtgtgtgcatcactcattatcaagagctggctgaagctgaaaacaccagttctggctgtatcacatgccaggaaagaaggcagtcacgggtatatgattagtgagtgaatgtcaggacggctgaatgaatagaagtgttagaacaaggtaccattcctcagattcacagatgtatgagtctgtaatgtcctaattggagggtagatagtaatttctatctgattctcaaagaaaattattggttgaaaagagttaataactattatttagattaataaataaatcatggttgttagagaaacctgggcaaccagctctggccgtctgacattactgtcataagaataactgttttttccatagattaatccccaatactctctccaagatagaaagctacactgcatgggcaccattctgatccagcatggtctttgccatctttctttttcatagaagggaggttagtcctgaaagatttttttcctttaaaatgaaaaatgagaaatttcaagatactgtctttctaaatgagaaacagtggcaaattgtagcatttcccacatattcccatttgatggaggcaagtggaactgtgccaacatttaactccctagaatatgaatcacggcatttcacacactgcttcctcccaaccaagtggcactattccctttgggctgtccagtgaaaagagcatatgtgtgcattatgcactgaactgtgtcccctaaaatttacaggttaaggtcctaactcctagtacctcagaatgggactgtatttggagatagggtctttaaagatgtaattaagttaaaatgaggtcattagagtgggtcataatctgatatgactggtgtccttagaggaagaggagatgagcacacatcagacaaggaaaaaccatgtgaagacacagggagaagacgatcatctgcagaccagaaagagtggcttccataaagactcaacccagccgacaccttcatctcacactctcagtgtctagaactgttaggaaataaatttctcttgttgaagccattcagtctatcattctttgttatggcagccccagaaaaccaaaacagtgtgtcagagccatggacaatataaggcaactgaacctcttctccagttcttccttaaaatgtagttcaagatgtatacctctaccatattctataggactgaatggagttcctaagtattctatgaatttagcaattttcctgggatgtaaaagttaagttacaggttttgtagttaaaacacctttgaccaactattttggtgaatttactatgaaaaagcatcttctgaggattcaaattattgaagagcaacttaatggtggattaaggctaatggtaatattttaccctaggagaacttaaaatgtgcattaaaatgaaatgtattaaaaaatatcagacagagatatcgcaaatcccgtattcattatggtaactgagactcatgct

SEQ ID NO: 452 - DNA, 4046 bp, Homo sapiens
tgtccatccctgtccacccacttctccattaaaagacttaaacaaacatgaacataatttataacagttcaagaccacatccctaggatgacccttaaaaaagggattattaaggcgtctgaccccttaaagcgtctgcctgaaaaacaaactccagactgccaaaagaatttactgttcactctagccaacacctgaagacaggtccctgctcactctttcttagggcatttactggaaagggtttacaatggggaatccttcctctgtccctttgagatgtggatgtatctccaacaactcaggagtgtctttctcaaggatctgaaaaccatttctttgaaatgtaatcatcaggaaggataggacccctgtctcccagtctctctctggaatggtagaatcctaactctgacaattgccagctcacagacacagctggtctgatggaactgatgctgaccaatgctttgtcatttttcacttccttgcctctgctcaagtccctcttttgtttccccagtctattcccttctgaaaacacccagtcacctctgtacaaacagaaatacatgtgcataatcagtatattattgattaaaatctgtccttaccactttaactagtgtctggttttgcttatctttgacaagagggcctgacacctgcaaaatgttcaatattaatttgttgagtgaataagttgataatagtaataaatgatgtctcacaaattttcttggggagatttctttttcctggttaaagctataatgtgatgtgggcacttcctccattataattcagcaatattttctacagatttcctctccatacacagggcacttatttatttgagataagatacctatgagtgtgagatttatatgtgtatattttataagtattacagcctttctgtcaatttatgatccaaaaaagtaactcaattccctaaaccaaagaaaatagacagcttgatgaatacatttgggcattatttggaaggaagtaaaagaatagctattaatagaacatgaggataacttcaggaaaaaatagctgtaaatcaaaggaaaaacaagaacttatgtccaatactggtggggcttagtaaaattgaaactttaacaaagtgtgataataatgtaaattgggataaacctattttgaaaaaaacgttgacatcaagtattttgaccataaaaaatacccatattcattgactgaaataacctacttatagtgctttattctattgcaatgtagtttacataatatctggaatgagctaccctcacaaagatacttgtaagagtgttatttataacatcagaaaattgaaaataaactatatgtccaaatttcagggaatggttaggtaaactgtagtaattcactcaattaaaaattttgtgactaaaaaaaattacactgtgtgacgaaatggaatgtcgagtgaaaaatatcagggaaaaagatacataaatataaatataaatagaatcttaaaaccagagatatggaaaaattagaaggtagtttattcaggagctagagttaggaactatatttttaatatctccattttctgtattttgctaatatgaatatggtatttaactatgaaagcataaatatgtctaaaagaaacatgatttttcgttacatagtatcattttcagtgtaggtcagtatcagctcttaaaagaatttgctaccaaaaaagtttaaaatcaaaacacagatatttaaaaaagttaatatttttttctgcactaattaattcaacataaatgagtttacttaaaagaaaaaaaaaatcttcaaagtgatattttttcaaaaaagattaagtctaaataaataataaaattttagatactagttaattcaatggcaatgtattaaaaacaaaacagtgggttagtactcacaggtatacaatattccaccattgggtaatgtaatttgtgaccttttgctgttcgacccgaaaagaaacaactctggcagacatcatagttaaaatgcttaaggcttctatacctagagaaaacaaaagaaaatttattggcttgcattactatcatttagtctaaatttgtggtaagaaatttcattcatccgaattaccaaaaaataaaatataaaattttggagttcaagtctctgaaacatgcttctatctgtttatacatgagagggagacaaatatgcatgtcagaagatttcttttaatgtttgaatacgaatggaaaatgataggcaagaaaagaattatatctattaagttgaaacatcaaattttaaaatatcaattataccaccaataagaaatgaattttaaaattccctcacaaagatacagttttcaacaatgagcacttttatatttggtttaaattagtcactagaaaaaaaagaaatcaagaaatactgtgtaacaaaggaaaaactaaataaagccttgatcacaatgcatccttgaatggaaatggtgttttaaaatctctggcgtaagaatgacactgcacattgacttgtacttgcagaatcttatttacaaaagcaaaaccttagacgataagtttctatgggtctgagtggaaaacatcttctccgaaatctgttctgtcagaattgctggtagaactaagaacataaattatacccacatctacagaaaaaaaattaaatgatagaaccaacagaatgaaaatggaagcaaaatttaaaagttgtgtggctgtaaactactaagtactgagtagcttctaaaatgacctgaaaaatcacttgcaaatcaatcttaaggaaatcattctgcatatactacagccagcttacttttgccaaggaggctattggtttgaaacaatcacatacactaacgacatctcttggcttatcagcatggcttgacaggtatgactgacatcttctttctaaatgaaattttgttttctgctgaatactcccttggcagatagccattctctctttttcattggtaacatacccttgtactgttagcacattttagcaatgagccttgagaaaattactgtttcttagcctctcttgctgatgttggtgaccagtgcaataaaaaccaaagttattgggtgggggttctaattggaatttcaagggactgagttagctgggaagaggcatgctgcctcttcctccccactggaaaatggatctgacatccagaagagtcactttgttagcatgaagtgactttgaagatggaagccacatgttagggatgacagtgcatgaaaacagagctaagggcccaggtggtcacagagaacagtcttggattacctaccttcactctgtttacaagaaagaaaactaaagttctaatttatttatgcaactactattaaggaattgtgtatgattctaactgaaacaattcccagcttacaaaacattatgtaaatctaagatttcattaacattttatttggaagtaattagtgaaaaactctagcagtatttataaaagttcggggaaaatgaaatatatatatatatatcttgggtagaagcttgatagaaagacagtctgaatgaagttaagattattctataatagacatattcctctatctttatttctgtacttgtctttccattcattctctgaagccacagagaaagatgcatctctttacaactaaactaatcagacctattccaactggaccccattttactattggaattgttcttatattcattcccttcatgtgtaatctttgtgcaataattaagtcaccattagcttgaagaaacctttgcttgctcactcttgtgcctaaaccaggtatcaagtctggacatatttctctctcattcgaaatacaaattttagatgtactatattctcaatgtagaaaacaggaaaaatataaatgcaagtaaaagtaagacaatatatcacttaccatcttccaattttcaatatcctgacatattttaagttatagctagatttcttaaacaagttgtttgcacatattcgc

SEQ ID NO: 453 - DNA, 4047 bp, Homo sapiens
ctctcactgtcagcaattgtatgaacttttataaatcatgtgaaatttaaagaagaactctccaacttaaagaactatctttggttcagtcattatgaaaaacaatctaaaggttctttaaaaaattaaaaatagaactatcatatcatccagtaatcccacttctgggtacatatccaaagaaaataaaatcattatctccaaaaggtatttatactcctatgtgcactgtagcattattcacaatagccaagatatggaatcaaactaagtatcctacaacagaaaaatggataaagaaaacacagtgaaatatatccagtcataaaaaaagaagggaattctgtcatttgcaataacttagatgagcctggaggacattatactaagtgaaataacccagatacagaaagacaaatactgcatgatctcacttatatgtgggacctttaaaaaaaaaagtcaagctcatagtagcacagagtagaatggtagttaccaggggctggggggtggaggaaaagagaagagactggtcaaagggtataaactttcagttatatgatgaataaattctggagacctaatgtacagcttgtggctacagataatacacttgaaattcactaacagactagatctcatctcaaaaaacaaaaccacacactatcttttatatgctctaacaacatatgaaaatgtttctaatttgaattaaattttggttacttacaacaaagatgattttaaagaagatctgagtagggtaattttcacgatgaaattaaatcatcataaataaaaaagaaatttaaatctgaacatctttaatataagatataactatttatttaaaaaatgataatccctgaattcaaaggtttaatgcatggataatacaaaaaaaaattgactactctcttgattcataagcttaatcattctaaaaaatattacagtcttgttgaatttctccacatagaggtattttttctccttcatgaaattttctctctatttccaactcctagcaaaatgcctggtatgtaaaagggtattcaacaaacataatattccagcaaggatatacacaaacccctattttccaatgtgctaactgcgtgtgtgtgtgtgtatttccctaatggagttaagtcactaaatccataccattaactttgcacaaatcacttaccttctctaagacttagttttttcttcaaaataaagataagttagatgatctcttagagctttaattccagctttaatattctataactagtatttataaagtcagatacgagctcatctggcttttatgaggcaaatttaactaacacagggagaaaagtataaaagtcatcccagtcctcaaggaggtaaaaagataattgagaagacaaaaacaccacagttagaaaatgatacaagggaacatagaatcaaatcctaattggtaaagtagaggctattggcagaggcccctgaactaagtgctttgatgagggtaaaactggaggagctgggagagatttcacacacaaagtgggagttgagctgtttttgtgagaaggtgggatttggacatatggagacagaatgatgacaggcattaaatatcatctgtgtcatgctgtctcttgaagatcaactcttattaagcctaatgaaagaattcttaaatgtacaaatttggattatagaatagtagggggaaataagacaaaaaatcatttcctagagaaataaaaattctgctacatttcttcagataatttatatatacatatataaattatcaatatcataaaatactttcatgagtcatgatagttcattcatataccattagtcttcttacagctaaaggaaaacattaccataaatcataagcagatatattggcaaaatatttagggtgctttgtggatttaaaataaggtttctaaattgcagaaagctcttaaaaatagaaacattcagagtcagctgtaaaggactttgaaaaggaaagagatgaagtcagtaaggtgactggagcatcttcttaactaaaaagggagatgcagtctgaggaatgcaaacatcaaggtccatatgggaaggtctgatccatttaacactcaagtgttgcttattatcactgtaccaaacaaattcacacttgagttcattttctaaggcagacatgaaacgactttaggaaatgttgagtaaaagatggatgaaccataaataaaacttaaaagagtagagcaaatgtaaagaatgtgggtgaacagaaagaaatttcagaaagcaatgatttctgaatacttgcatttatatttttcctgttttctacattgagaatatagtacatctaaaatttgtatttcgaatgagagagaaatatgtccagacttgatacctggtttaggcacaagagtgagcaagcaaaggtttcttcaagctaatggtgacttaattattgcacaaagattacacatgaagggaatgaatataagaacaattccaatagtaaaatggggtccagttggaataggtctgattagtttagttgtaaagagatgcatctttctctgtggcttcagagaatgaatggaaagacattaatgctacaataatagcaatcagatcattcattgctattaaatgcaagtatctttttaaagattcaatttacatatatttctagttattttacaaaaagttgtagggtcaaatgcagaaagtgacctgtcatacagatgatttataagtaggctgttgataagatcactacaaagcctcagaaatgggcaaaggatgtcttgaaaaatgaagctatccttgtataatgcaggataagctgcaatcttggaaatgataaacagtgacttttgaaagactatgcaacaagaacagttttgggtaacttacagatttcatttaaaattggtagttggagagtggaattcatatgtgtatcagtgattcttaagtatgcacctactgcatgacaactgttgaagatatgtgggtttcaaattgtttaggtattttgtaaagccattaagaattattatatgttcaagaccaagaaaaatagtaattttatatatctttactataacaacatatatttactttatgatattttgatactagcattttataatcagttttctaaacttctataatagctattcatgtaaatattactatgatattttcccccaatccaaattccttacaatgatccccagggttctatacaatctgatagttgcctttctttttaattccatctcctactattgtctctcttttgtcaaatttgtcctggtttctttctgttccctggttacacccacctctttcccagcctcagggtgagcttcaaagatattgcacttatgcagttgtacagggccctacaatcagaagggctttgaactattgcacttatgcagttgtacagggccctacaatcagaagggctttgaacttcatttactcctctgatgttgccaactcggaagtcttaataattgttaaacaaggggccccccagtttcattttgcactgggcacttccagttgtgtaaccagtgctcctttccatgcgccccttggggaacaggcttcactttctgcagcccaatcacgctaacctttttcccaactcagaccactatatgttctgtttcttctttctgaaacatgcttctactagttctttacagggctgaatctttctcaaactttggtctcaactcaaatgtcaactcagacaaaccttactgatttctttatctaaaatgtctcttctaatcattctatctcattatccattcatttccttaaaggcacttactgcaatgtataacaaccccatttattcgtttccttgttcattctcacacattcttcctcctaaagggagagtagcaggaagtccacaatcttatctttctgggtatactctgatacactatcagagctgaaattactgacaaggattctctccttgaccaaatttgagttggcctcctgtaagct

SEQ ID NO: 454 - DNA, 4047 bp, Homo sapiens
attttgacattgaaaggcaaattaaaaatgttttaaaggagtataaaatatgcatctatctgcatgattcctgtaaagcgtgtagatatttgtgatgcaaaatgccaatggtttagcaaaagattaaaaggcacatcgcttagttcaaacctatcaaattatcccgtaaattaaagcaccaagtaataattctgtgcctcagaattatccattccaaaggttaactggatgggatacaaaaaaagtacaattttgtctttatcctaaggcatcagcacagttaaacatatattagatactaagacaaataagaatctattatcacacaaccttttgaaggaaaggacaaaagcatacccacaaatcaaaaagaggaccaaaagtctactgttcctgaatgtattcgaacagctctctttcaattgaaattgctttattaaaactttttctaaattgtactatgcaaaagaatgtttagaaagacacagatcttaattgtacacagtttgatatcaagtggaaagaatatatcttaagtgtacacagtttgatatcaagcacagtaatcacacagttgaaattttttcttaccttttgtatgtgtatgtgttatacatggacctatctaaatatgcatttgcattgtatttctttctgtttacacacacacgacattacctatagagggaaaaaggtatctcctatgctttggctgtgttctttcttctatttcttagccattccacaaataaaagagataaactggtacataaatttagcaaagtttgaggtctacagggatttaaaaaaatctattttggtctgcagaccaaatactgtattcttctattttgacatgtttgagacattgactatcacaaagcactaaaatattactacttcctgattttctatcatgtacaaaataaaatgaactatgaatctgaaggctaaagtttcatttcacaaaaattgcacttgacattttttatacttcttactacaattttctctattttttataaagtagaaaacttcacacttttgagtttctcttctctagtcatctgagacggtgtctttctctgactagaacttcattatgctatacaactgggcactctgttgatgattagtaataaaagttcattttccccaagattcaaccacaagaaaatggccttagcaggaatatttatcctgacatatgaaaaagcaattcaaagatttaaaatctatctatttggatcttaacacataattgtttagtatcttaaaattacttctttgcattttttctgggtcattgaaaaacattttttttcttttcacttcaggccataaattcttattccctttgctttataatcacatggtaatttcaccatcttgaaactttcatgtatgctaaccaactcaaattatacactttgaataaattttttctattttatgtaatatataaagctatctcagtttgctgtcttcattttcaataaaaaatagattagaatcataatgtgatactttagaattttagcataaatatctgaatcaacagattaagtattattaataaatttatattaaagagatgcaaaaagagtataaaacatactctgagaaatagtaaaacaccccccataaggggaaaaaaaggaaaataaataatgaaagactatataatgccacactttaagtgtttttaaaaagaaaagagatgaccaacaaaagagatgaccagtgtgtattaaggttgacatattaatacatatttttaaaatttaaggacatgtgcaaggttaaaattgaaattttggctgtgacattgtcaaaagtgaattgtaaaaattcatgttgtgaagactgattccaagtttaatttacctcctctaaaatgcagttggtattaaacaatttctcttgtgttactaacataaaaaagacaacatcagatataaatgttcacactagatttaatattaaaatcaaacttacgtctctaagttgtcaccttcaagaactgtctggacaggcaggtaaccaagtcgagggtgtttggcaaagtacttcttcgacctgaacttgttcttaagtacctttgtgaagtctcgtacatcttccccagatgttgtctataaggttgaaaacaattacacttctctcagtaaaatggaaggcaataactatctataacaaaatcagagccgatgtaaattgatgcaattaaatgtcaacagttttggtagttttatgcatttttgaaataaagcagtctcatgaaaacacttggcaataagaactcatcactaaatatatccagtgatatgtttatactttttcattctctgttgaaaataaaccatacctagttcatttccccaatattttaaaacttgggccaaaaagtataattagttttgaaatttttccaaactaatttttccaaactattggctggttcttatcactaaaaaaattttcaatttgctattaatatagtgatgacagagtattgtggttttaaccacaatggttttaaccaagctgtgttaatggaaattagtcatagagccgatgctggctacacacaagccagcatatattctagtggggaaaaaggtaagacaataaataagagagaaagagcagggccacattggtgctctgtttgggaaggaatactgtcaatttctttgtcctttcccaactatgcagacatataattattttacctgaactacatttttaatagtggtataaaatgtcactgttcccttaggtatttctaaatgattagtttgataatcatttagggtgatatggactaacactatcccaaccccacccaccccatcatcctatcccatgaactattgttctccaagccccagttttctactgtatatcacaattctagtttctatttacaatacagatatcaactgtgatccttccgaagatgcatttaaaatatttacattacctgcacagaacttaatgaagcccatgatcctctggctccaacttggctgctcaacctaccactcattatacctcactccctcctcttagagacagaaagagagagagagagagagagaggaggaggaggaggaggaggaggaggaggaggaggcggcggaggaggagaaggggagaaggagagagaaactttcttgtaatcacagacactgaatgataagtatatttgcttacctgctgcctgctccctgtccctgcccttcagcttttccttcacaacatgcatgcccaggactcacagaaacttgttttgcagacagaaactttttttatttttttgagacagagtctcgctctgttgcccaagctggcatgcaatggcacgatctcagctcactgcaacctctgcctcccaagttcagccgattctcgtgcctcagcctcctgagtagctgggactacaggtgcgcaccaccacacccagctaatttttgtatttttagtagacggggtttcaccatgttggccaggctggtctcaaactcctgacctcaagtgattcacctgcctcagattcccaaagtgctgggattacaggtgtgagccactgcacccaaccaaaaattgaaaaaaacaaaaacaaaaaccaaactatttttgaaaacaactaagttctgagttaacccttatatagttttgccactttctatccattccccttctatcaaaacatgtctgcttctagtcaataattaagggaacttttgattctcttggcttgcaaagcagagatgagacatgattaagccgcagctacttatcatttaaaattcatcagtttttacactgacaaaacaaacaacctgcaacaaggtgccagccccatgctatcaccaggctttgccatcagattcacaatgacccatcttttcctgaataactgaatattaactacataatgatctgcagttatatggatatagggcttcccaaatgcaaagcaaaagtgcagaagaaaaaggtattcatgaaaagaaaaagaattcaaggaaaccctgtgga

SEQ ID NO: 455 - DNA, 4046 bp, Homo sapiens
cttttggcttccaggaaccacattgaaagaataagaattttcttgggccacacattaaatacactaacactaatgatagctgatgagctaaaaaagcaaaaaaaaaacaaaaaacaaaaaacaaaaaacaaatcacagacaaatcttataatgttttcagaaagtttatgaatttgtgttgggctgcattcaaagctgtcctgggccacatgtggcctgtgggttgcaggatggacaagtttataataaataatcccaagggcatagatattagtgaaatgaagtaaaatcattagggtgtgatgagttttgagaattacttttgtttttgttttaatctaatttatttaattgtaactgtatatacatgtatataaattatttttaaaaaggctctgtttaacagcttacaaacatcctgaaaatgtaacaatcagctctcacaattggctccagcataccattacatggtaggtatatattaataacaactgtctgttggatgggtgaatgagttaatatatataatgacagtatattaaaatgtatctgactgttaatcttctgacttttttcttttctttttaaaaaatgttaatcttttctgaaacagtgctaaatctgaaaatagtatttattcctattttaagatacaatatactaaatttgagcattacctttactgtgttcacagggcatgacaaaacattttaaagaagtaagattttgttctgaattattatcttttatttcctttaacgctttggctatggtcagccttgaggaaatttgttgatttaggaaagattcaagatacttaactactttacatgaaatgcacaccagtaggttaaatatgaaacaaacattatgaatacacctttattttgatttgggaattgtttcacactcatagtacatgaatgataatgtataaatctctactacattactgtcaagtattaagatgcaatctttgaaatttgaaattgaaaaacctcctgataacttttatttataaccataataaataaaacaagttttagaaaatatggaaagagaatattctatatttgagcactttaagtattttaacctagcactctccatagtttttttttttttttagtgaaaacacccaactactatgtttgacaacttttctgtctactttacagattcccatcagatccaaaccacaatagagctttgttagtcacataagcttgacagtattagtcttttagatattattcaggattaaaaatgtgaattccagggcacaaaaaaaagaataaaaagttccaaaagtaagagtacacacaatagtgggataatcagtgataaaatatttgctgagaaagttccacaaccaagtggaatatacacatatggggaaatcagaaataaactaattggctagaaagctttttagtatataatatctttttagtattctaaagtcaatgaggcttttcttagttgctaataaaataaaatattggcagaggagttaacagttttcaatgaagggtaggagtatatatctaagtatgtgtgggtcagaggtgctaaatgcagatattatggaaaaaatgttagctagtggaagaaagaggatttcacagaaagggcacatattctgtcaaattacctttgttaaattaataagaaatataagacaaatggaatgaatatatacacctgttatcctaaataaaacaatctgattttcgtggggtatataagttgacaaatgtaagatttttttcattaacttatatgaaacaaagtaaataaacatattgagtttatactatcatggtttgaaagcataaaatctacgtagaaatttttggaaccacacttaataattttgattgggatcaagattcagagccacatcagtgaagattgtttctgacagccataatacaagaactagccttcccaggcagcactaatttcatgatttacttacacacttcctgtggtggagctgctatcagtgagaaaagacccattagtcctttccatctgggccagtctgcaaaataaaaataaggaggttagacaacatggccatataggacatggtcaattggacgtacatccttaatcatttttaaattgtcaaaattctgacaaaacatagaaagatccaaatctcctaacacgactgtaaaactaaaacgtttcatgttgagctacctttctatcaccactgccttaatgcctgtaggcctttatcttacgccatgttgtaaagtctcctaactgacctaatcttctaattgagctcccagacctaggctttccttaaccctctagttggtctacatctaagtgagcgtgacattctcaaacaaataaaatgatgttcctctcataacaaaaactctccatgacttcccttcaactaaggacatgatccaactcttcagtggctgggtttttcattatcagacctcaacttctgtgtccttcactttctcatctatttctctttcccctacctgcagttcagtaaacaaaccatgccctttcccagctcaatgcttttgagtatattattccattagtccaagactttcccctagaaattctagttggcctagacccagttcaaatgttaccatttttatgatgcttgaattaacctttctaggcaaagctacttactagaatcacagacacctagtatataccacttttctgaaagtctgtgcacaccatcaagaccagcctatatattatttagagactctaaaataaacccctatcctaaagcattagcataaatttaattacatattgtaattcacatgtgcaccatctcctgagaatacctgcaatcccactttcatttactgaaacttggttacaccatctaaatcctgcttgtacagtgtttggattctcattagctggagaatcacatcctggttaggtttacttttcatagaatatatagcaggtgtttggtaaagtgcaaactgtgtcatgaaaatatgagagcccaaattccaaatataatggaatcataactcctgcaaaactgcatttcttaaatcaaggtatattaatgatattagattaattagacatagatacattctgggtggcagtgcagtggagggctctgatcaaagtttcttaccgtgtggcatattgttctattcttgaatgggtgtcatcatgaaacagttgaggagattgtgaggggctttaaaagaaaaaaacaaagcaataattttatgcccaaatattgataggtgttactattagaaatgttaggttacttaagtaatgaatctgccatgcaaacagaccactaggattgttacccggaacacagaagtattattttagaccaagagtttagtaagacccccatgctagtaccactgatcagaacacctctcctgcacgtgggctatgaatactcactcatagtgctctggccacatactgatgagtgtgataggactgcaaagaggggagagggagacaaaagtcacagaacaaacactttagagcaatttaagacaaaagcagtgggggtgtggggagattctcaattatcttccgctcatatatgtggttgccctgagagccaccatggggaaatcaaaagtaacagaagtcacagtgtattctagagaagtcgccgtgtattcaagagtctgcaggggccttttcacagatattacaggatatttgttcaaggatagcaaacacatctttaaacagtcatactggggaaaaaaccagaatgctcaaaaataactcaaaattatagaataatgtaaagataccattctataatataccaagggggatgcaatcatatttttgtttttcctagagaagaaacttggttagaaagatgaagttaaaaatgaaacactacattatatgttgatggcagaggtgcaataaaattagacttttctgttcttcatgtaattttaaatgtaaacatccaaacccagatgtacccaaaatacctcaacctcacacacacattgaacaaacatgcaacc

SEQ ID NO: 456 - DNA, 4045 bp, Homo sapiens
gttcctgggtttagaaggacgagaagaagagagtatgggtactgcaccactgcagagagcagcatttgaaagcaatccaaaagctcctcagtttcccatgtagctaaatcaaacagactggcagggagatatgggtctgtgtatgtgtatattttcctcataggaagtaaatggccaacaccctaaacctagctgtgttatccggggcagaagcaagctgtaagactaatgtctcaacaccaccaggacaccaatgagctgcagtgaattacacaatgcaaagtcagcgatgcctggaggcacctcaccaagttcatgtgaagagagaggtgataaaacatgacaaaagagcagctctaacatatggataggacaaatggacaaagcgtaaagatatagtagatagatataaaataaaacagcaaaataagagttcagtagaacatcctgtaaatatttctcatttctcaggatgaaaaagatctgagtatagaaactataaagacagagtacccaaaaataataataacaaaagaagcacattcatatgtatccctggaaaatgtctgtattttaaagataaagtatcacaagcaatctgccagaaatcaaaataaaacagtaaatcatgttcagcggtggaaaaaggtttagcttcctattttccataatattaaatgtccaaagacaatggagcaatatctacagtcctaacctatccatccatatgaccaggcaggtcattcaagtgtacaggcaaagcactttgtccacatagcatatgaaagaaagaatgagcaaggataatgcaaaatggaactaaagtagatggtaatctcaggtgttacgataaaaatagaggtaaacttattctaatattagttaaaaaaacaattagttggctgggcacggtggctcacgcctgtaatcccagcactttgggaggtcgagatgggcagatcacttgaggtcaggagcttgagaccagcctgaccaacatggtgaaaccccatctctactaaaaatacaaaaattagttgggcttggtggtgggcacctataatcccagctactcgggaggctgaggcaggagaatcacttgaacccgggaagccaaggttgcagtgagctgagattgtgccactgcactccagcctgggcgacagagtgagactctgtctcaaaaacaaaacaaaacaacaaacaaaacaaacaaacaaaaaattagttctatgatacctatcaataacatacctaaaagaaaataataaatatggaaagaaaagacttaaaataagaactaatataaggacaacaagaattaaaagaaaacttggatccctttaagctatgtggctgatcttgtggccatgatttgaccacagatcctggcgtagagttcctccaagatcacaagccaccattatgccctcagaacatttactacagcacctgacctcatggattaacttcagtgcttaatattaataccaagtaaatttttgttttaaagatttggagactgactatccatagtgaaaccagccaaaattagatttgagatgtatttttgttgtcaacatacatatagattcacttctctggggaagctgatagagtttaacacattattataattatcatccccactatcattgcattctttcattatggtatctggaagagagttaaggcagttttcacaaaaataagaatttaacaatcatttatataaaacatacaattttagtcttaagtgtttttcacagattattaggtctaaatgttgaatataaaaatagatacattctagttcttaattacatatagtaaaaaccaataacaaactctttaaatgcagatagaacatgaggtaccagatcagggacattaaacatcaatcgtatgtcttgggctaaaatagaaaatgttgcaaaaataataggtttgcaccaaggaaatatcattagatggaatataattatactacagttaagtcacacatagtaaacactatctagattacaaaattagtacatatcagatgacaaaaaaactgtgattcattcaatgaacttttgaaagtagacaagacataaataaaaataatgattttctttcttttaaggattgttctgttctaggtttcagatttgcaaactgcaatgcctgtgtaaaccacagtcagcctccccattctttctttccagtgtcacccaagggcagatggcagatggagtgagacgtcctgatagccatggcccaaggaattgtccttgcgttcccacttctgagattccccagaaccgtcatgagtcctatcctgtcctgagatgtcactgctcaatttttccttcaaagatatgtagtattcgtaacatcaatttccttttaaattgtccagagtcaatcgaacgtactcatgtatctaattgtaatagatatatgggtgatcagggacatgtcatttatctttctggatgtcagcttccttgtttataaaataggactcataataatgcccatcctagggttcataggagattatttgtttccttgcatcatctagcaccttgaggtcacctgcattcctcattttcaaagccaacacagcagcatctgcagatctctctctgacctctgcctccattgctacgtctccttctctgactctggctctccttcctaccctttatgaggacccttgggattacactggggccatctggattatccaggataatctctctatttcaaggtccttaattaaaaacctgtggcaaagtcccttttgccaagtaaagtagtatattcataggcttcagggattaggatgtggacatctttggggggccatcattctgtttaccacaaatgccttcatcatgttcttctggtaggactacttatctatttcctttctagcctataagattcatggagacagtatctgcatctatagacctattgcagtattgggtgcatggcggtcgtgagttggtaaatgtttaacaggttctccaagagaaaaagaccttgatttgtggcatttgcaacttctgtgatttaaatactttttgatcatggccaatttcaagttcatgacttcactgaatgtggaactgggaaaagatacacatttgtacaccacctgacagagataatgaatcaggagtattcaatcttttggcttccaggaaccacattgaaagaataagaattttcttgggccacacattaaatacactaacactaatgatagctgatgagctaaaaaagcaaaaaaaaaacaaaaaacaaaaaacaaaaaacaaatcacagacaaatcttataatgttttcagaaagtttatgaatttgtgttgggctgcattcaaagctgtcctgggccacatgtggcctgtgggttgcaggatggacaagtttataataaataatcccaagggcatagatattagtgaaatgaagtaaaatcattagggtgtgatgagttttgagaattacttttgtttttgttttaatctaatttatttaattgtaactgtatatacatgtatataaattatttttaaaaaggctctgtttaacagcttacaaacatcctgaaaatgtaacaatcagctctcacaattggctccagcataccattacatggtaggtatatattaataacaactgtctgttggatgggtgaatgagttaatatatataatgacagtatattaaaatgtatctgactgttaatcttctgacttttttcttttctttttaaaaaatgttaatcttttctgaaacagtgctaaatctgaaaatagtatttattcctattttaagatacaatatactaaatttgagcattacctttactgtgttcacagggcatgacaaaacattttaaagaagtaagattttgttctgaattattatcttttatttcctttaacgctttggctatggtcagccttgaggaaatttgttgatttaggaaagattcaagatacttaactactttacatgaaatgcacaccagtaggttaaatatgaaa

SEQ ID NO: 457 - DNA, 4055 bp, Homo sapiens
ctccagctgtttattgtgatcttctaaaatctgcatcctagcctccagccgacctttgtgctgcctgaggagttttgcttctgctataagttctgaatcctcagacgtgtgatggggagatataatcgactctggcggtgaaccgacagggagcccccttcggaggtgctggtccttcagctgctcatactccacctgtagatttctaatacagaaagagggagaaacagaatgactaccacgtgcattatcgtctctccaaaatcgtctgtgaggttcaaatttagctcatgctagttcctcttatataaaaatgtgtattaatagcaggatgagcatgcaggaataaaattgtagttttaagcaagtgtcccagtagacatcatcaatgaacccccaaatgctgctgtattgcagccagcatcccagtttgttaatagcctctaaaattttcactccactgagatttcttagacaatagtcttgaaaaagagaataaatgggggctacagtgaaattcatacaaaagaaaggatgacatatttccttctcccaggcctagcacacctttgttcttcctccaggtcagcaatgatcctctccagttctccacgttcttccctctctactgacttcaggatctgagctgggctctgcggctggctcactggggactctcctccgagtgtttggcaatactgctggatgagggcgtgctcgtcttccctagcaagacaaaggaaacagacccagaggctcacatctggatggtgatgtttttggacataaaggaagtagaaataatgatggacaggatagtggctgggccaagtttgtcttagagctcagtgtctccatgacctcccttttaaaactctaggaagaagttcatctagcagagcatggatattacatgagtcaacatttcaggcttctctttcatctaacagctctatctcataaacttcagaagggatatcttactcagcagaaaaaacaaaaataaggaacagcatttagtataaaagctactgtagacaaaatcaattactccatgcctaaagagttgattaaaagactactgaattaagaatcatctgacttcactgtctttagaatttcgttgaaagtaactttgaaatgctttgtaacccatatgacaaggtttataatccttatgttcttttatttaaatagctcagcacaaattataattgtagatatttataatgtctctacagatattttactttatattattagcaggtcatttttagggttgatcactctgcattagaacaagaaactacatttaatgcatgtgggttctcccacttatctaactacctgtctaatgaactagacatagcagtaacgtggttgaattagtaactgacataagtgaatgtctaacaaagttgatatatttatggcaagaaaatgctttctagcagactcggaatttcttatcttctttcaacaagagagatccagtgagatcttataaatgtgcaaataccaatctcctggctaatactagcagggcagtccattagcagatggcacgtggtccgttttgatggcttttggtaaacaagtcctggaaatcgatggctttacaggatagggcagcaggaaaacctcatgtcagttatgtagctatcagagtgtcaaatggggctatctcatgactgaagcagctccttcctgtgtaagcgatgggggctgcgaacatcccttagagacttcttctgttactctggagtcagacagcatcctgttgcagccagaaagaacctggtgtgtggtgctggcagtcctgggcctctctcagcttcaccagagccttgagattacctgtgcccttgagctgatgagtaacacttgatgctggggaagacctctggtacttgtaattctggtttgaaaattcatcttggtgttactgcagtttactctaacaaggaagggacttgaaattgtatcagacagttggtgaattcctagaaaaggtttatcctaagcattgagatcagagagctagatgaagcaattgagaaaactgaacgttctggtattatgcttgtcaaacagccaaagcaaaagttcagatgtgccacttgttgatttattttgctttcttcatcaataaaccccctctctttttctctccctctagaaatatatagatatagatatgaacatgtgtgtatgtgagtatatatatatttaaataaaggtcatatactttggttaaggccacaatataataataagtacctaacctgaccttcttgcttttatcaaataaattttaaaagaggatggggtgggacccttacaacacagttagcaactggaaataaggaacaccagtgggttaaggattgaagtaagctgcggcattatcctttgattccctttcctgagaaaacgcagcatcactgggaaatgaatgaaggaacctctgcaagaaccccatgcttgttcctgggtttagaaggacgagaagaagagagtatgggtactgcaccactgcagagagcagcatttgaaagcaatccaaaagctcctcagtttcccatgtagctaaatcaaacagactggcagggagatatgggtctgtgtatgtgtatattttcctcataggaagtaaatggccaacaccctaaacctagctgtgttatccggggcagaagcaagctgtaagactaatgtctcaacaccaccaggacaccaatgagctgcagtgaattacacaatgcaaagtcagcgatgcctggaggcacctcaccaagttcatgtgaagagagaggtgataaaacatgacaaaagagcagctctaacatatggataggacaaatggacaaagcgtaaagatatagtagatagatataaaataaaacagcaaaataagagttcagtagaacatcctgtaaatatttctcatttctcaggatgaaaaagatctgagtatagaaactataaagacagagtacccaaaaataataataacaaaagaagcacattcatatgtatccctggaaaatgtctgtattttaaagataaagtatcacaagcaatctgccagaaatcaaaataaaacagtaaatcatgttcagcggtggaaaaaggtttagcttcctattttccataatattaaatgtccaaagacaatggagcaatatctacagtcctaacctatccatccatatgaccaggcaggtcattcaagtgtacaggcaaagcactttgtccacatagcatatgaaagaaagaatgagcaaggataatgcaaaatggaactaaagtagatggtaatctcaggtgttacgataaaaatagaggtaaacttattctaatattagttaaaaaaacaattagttggctgggcacggtggctcacgcctgtaatcccagcactttgggaggtcgagatgggcagatcacttgaggtcaggagcttgagaccagcctgaccaacatggtgaaaccccatctctactaaaaatacaaaaattagttgggcttggtggtgggcacctataatcccagctactcgggaggctgaggcaggagaatcacttgaacccgggaagccaaggttgcagtgagctgagattgtgccactgcactccagcctgggcgacagagtgagactctgtctcaaaaacaaaacaaaacaacaaacaaaacaaacaaacaaaaaattagttctatgatacctatcaataacatacctaaaagaaaataataaatatggaaagaaaagacttaaaataagaactaatataaggacaacaagaattaaaagaaaacttggatccctttaagctatgtggctgatcttgtggccatgatttgaccacagatcctggcgtagagttcctccaagatcacaagccaccattatgccctcagaacatttactacagcacctgacctcatggattaacttcagtgcttaatattaataccaagtaaatttttgttttaaagatttggagactgactatccatagtgaaaccagccaaaattagatttgagatgtatt

SEQ ID NO: 458 - DNA, 4064 bp, Homo sapiens
tccaaattgtgggattgagaggccctgaagtaagccttccattgaacagcctcacccaaattctgaaacactgagagacatagagaaaagtgtatggtcaaattatgaattgcctacacaaatttctgtgtaggtaaggcagaaatgacactgttttgaattattctggtaagttaaaaagactgagagcaactgtgaaaaggcagttttctaaaatttgagagaatcactggagagaaagttgttcctgctttgagtcaataaatcatttctggagaaaggcactcctattatatcacataggagctccacacagcacaggctagagaaaaagactaaagatgacatgcatgttgatgtcagggattcttcaagagagaggagctcttggcccctgtgctgggactctacgctctctgcacctgctgcaaaggtctctccatcactacttctgagacatcactcctattcctaactactatgtgccatcaagcacttaattccctacagtgtgctgtgtcttcacatatgaaagtatcttgctgtgatctctaacaagatggcaggcaccagaaaggcagaaactgtattgatgcttcttttatatctcaaagaacagtgtttttcaaaactgaatgcaataacccaccgatgagttatagaatcaatttagtaggtcctgaccagcattaagaaagaaaaacagaaggaagaaagggagggaggaagaaagggaaaatagaaaataagagctggcatttctctataaaggcaagtattattttgtattctccatacatgcatgtattcatcttaatgtaaattgtatttcttatcatccagaaagcttgcaagcaactcccataaaacatggtccagtgttaggaaataatagtagcaaattaataaccatctttaactcaatttcttgagaatagaaaataatgattcttggagtcagcattcttgtctcactggaagaaagctttagaatgccgatttcaggtctcttgctgttccttaatacagatgcttcccatgtataatttaggaagatatatgtcataggatattttctctcaaacagttcagagctgaggcggacttcattgttaaagaagactgggaaattccattgtaagctgggcaaacacatttttgtgtgccaatgaggatttatatgcttacatgtaaaaggaaatttctaagccagtctgaattaactacggaggtaagaaattgaaagtggacttctctgcctctcctgacacctggaccatcatctcccagggcagtggacagatggcctggggaggtgtgacgctgaattctacacaccctacctgctccagcagctgtcggaggcggtggagctgagactccagctgtttattgtgatcttctaaaatctgcatcctagcctccagccgacctttgtgctgcctgaggagttttgcttctgctataagttctgaatcctcagacgtgtgatggggagatataatcgactctggcggtgaaccgacagggagcccccttcggaggtgctggtccttcagctgctcatactccacctgtagatttctaatacagaaagagggagaaacagaatgactaccacgtgcattatcgtctctccaaaatcgtctgtgaggttcaaatttagctcatgctagttcctcttatataaaaatgtgtattaatagcaggatgagcatgcaggaataaaattgtagttttaagcaagtgtcccagtagacatcatcaatgaacccccaaatgctgctgtattgcagccagcatcccagtttgttaatagcctctaaaattttcactccactgagatttcttagacaatagtcttgaaaaagagaataaatgggggctacagtgaaattcatacaaaagaaaggatgacatatttccttctcccaggcctagcacacctttgttcttcctccaggtcagcaatgatcctctccagttctccacgttcttccctctctactgacttcaggatctgagctgggctctgcggctggctcactggggactctcctccgagtgtttggcaatactgctggatgagggcgtgctcgtcttccctagcaagacaaaggaaacagacccagaggctcacatctggatggtgatgtttttggacataaaggaagtagaaataatgatggacaggatagtggctgggccaagtttgtcttagagctcagtgtctccatgacctcccttttaaaactctaggaagaagttcatctagcagagcatggatattacatgagtcaacatttcaggcttctctttcatctaacagctctatctcataaacttcagaagggatatcttactcagcagaaaaaacaaaaataaggaacagcatttagtataaaagctactgtagacaaaatcaattactccatgcctaaagagttgattaaaagactactgaattaagaatcatctgacttcactgtctttagaatttcgttgaaagtaactttgaaatgctttgtaacccatatgacaaggtttataatccttatgttcttttatttaaatagctcagcacaaattataattgtagatatttataatgtctctacagatattttactttatattattagcaggtcatttttagggttgatcactctgcattagaacaagaaactacatttaatgcatgtgggttctcccacttatctaactacctgtctaatgaactagacatagcagtaacgtggttgaattagtaactgacataagtgaatgtctaacaaagttgatatatttatggcaagaaaatgctttctagcagactcggaatttcttatcttctttcaacaagagagatccagtgagatcttataaatgtgcaaataccaatctcctggctaatactagcagggcagtccattagcagatggcacgtggtccgttttgatggcttttggtaaacaagtcctggaaatcgatggctttacaggatagggcagcaggaaaacctcatgtcagttatgtagctatcagagtgtcaaatggggctatctcatgactgaagcagctccttcctgtgtaagcgatgggggctgcgaacatcccttagagacttcttctgttactctggagtcagacagcatcctgttgcagccagaaagaacctggtgtgtggtgctggcagtcctgggcctctctcagcttcaccagagccttgagattacctgtgcccttgagctgatgagtaacacttgatgctggggaagacctctggtacttgtaattctggtttgaaaattcatcttggtgttactgcagtttactctaacaaggaagggacttgaaattgtatcagacagttggtgaattcctagaaaaggtttatcctaagcattgagatcagagagctagatgaagcaattgagaaaactgaacgttctggtattatgcttgtcaaacagccaaagcaaaagttcagatgtgccacttgttgatttattttgctttcttcatcaataaaccccctctctttttctctccctctagaaatatatagatatagatatgaacatgtgtgtatgtgagtatatatatatttaaataaaggtcatatactttggttaaggccacaatataataataagtacctaacctgaccttcttgcttttatcaaataaattttaaaagaggatggggtgggacccttacaacacagttagcaactggaaataaggaacaccagtgggttaaggattgaagtaagctgcggcattatcctttgattccctttcctgagaaaacgcagcatcactgggaaatgaatgaaggaacctctgcaagaaccccatgcttgttcctgggtttagaaggacgagaagaagagagtatgggtactgcaccactgcagagagcagcatttgaaagcaatccaaaagctcctcagtttcccatgtagctaaatcaaacagactggcagggagatatgggtctgtgtatgtgtatattttcctcataggaagtaaatggccaacaccctaaacctagctgtgtt

SEQ ID NO: 459 - DNA, 4045 bp, Homo sapiens
agactgatgtagtgtaaatgtgattctgcaaactttgagaagcattatagtagatctacaaatgaaaacctgggaaacactggcaaaacacaaatagatatattcatgtgctggtggaaaccataatataatcttcaggcaaatattcctgaaaattcacaaagaaatatatgttttatttattcatttattttgttgttgttgttgttttgagatagagtctctgttgcccaggctgaagtgcagtggcatgatctcaactcactgcaacttcagcctcccaggttcaagcgattctcatgcctcagcctcccaagtaggtaggactacaactacaggcttgtgccaccatacctggaaaatttttttggtatttttagtagagatagggttttgccatgttaatcaggctggtctcaaactcctgacctcaagtgatccacctgcctcagcctgccaaaatgctggaattacaggcatgagccaccgcacctgggccagaaatatattttaaatagctgttttcacattctgctaatgatggtattttaaaaattacaaagttctatacagtaaataataatctttaaatgaagtcaatatatcttatttacctacactcctgataattgataatctctttttcatcatttcggatggcttttttttttttttttttttttttggagaggaagtctcacgctgtctcccaggctggagtgcggtggcacgatctcggctcattgcaacctctacctcccaggttcaagcgattctcctgcctcaacctcctgagttgctgggattacaagtgcatgccaccatgcccggctactttttgtatttttagtagcgacagggtttcaccatgttggtcagactggtctcgaactcctgatctcatgatccacctgcctcgccctcccaaagtgctgggattataggtgtgagccaccgtgcccagcctgggatggcattttctaaggagatgacagacaagggtaaaataagaggctatgctttacatgaattcttattttagtgactgccctggatttaaaatcagtttgagagtaaatctctctaaaattacaaataatgtcttcaaatcctgtcaaagattatttaaaatataattatagtactaagtaatttatatgcatttatatatttgtatgtgtgtgtgtatatatatgtatacatatatacagtttacttgtatgtatatattctgctagaaacaccagaagtgttttaggtgagagctcagccaaaattgcaaggtggcaaggtgctgaagacaaaacacttggaaaaaatgaataagtaagaattattatataatttccccaggaatttggttattttctggctcttggttgttcagatggaaacttcacaggatcctaatctatgatgacttaaattgtttggcctttatacaatgactattttattccatgagaaaagaaaccagcgggaataaaaagggaaaatctgaaaacaatccctttctgcactggagtctgatgacattggagaacaatgtttgaagaaaagagagggaattacactagaaaggctgtttccatgccttgtttggcatgccactgaaagctcttctttgaactaagatgtgttccttatgatagcttgcatcgaagaggataatttcttcttaaaaccagacttattattttatttgctttcattttatcacccatcaggcatattgaaaaatctcaaagagcagaattgcgttgcgactgtacccccgttacttgatagtatctaggttgagcttcattttcttatataatgtttgccttattttcaaataatattcagtcctgtttgtaataaggtttttgttatcttaaggaagaaggcgaagggccgcatgcagaaaaagagaaagggaaggaacacgtgcagctgtggtgctgcaatctttcatactcacggcagcaagatggaaacgtgctgtgaatctgctccatgacctccgtgagatccgtgctggtgtcgtgcggtggggccagcaggtcctctcccgctgtgacagcaaataaagagaacaacaaagcttctcaaattaatgtctagccttccactaaaacccaaattcaggaggaaatactccaaccagcctctaaatatcaatgtgaaaagatttcccattgcaaaggacaattttaggggaatatacccaaaacatttttgcttgagtgttggtaatataattttacataattgacacgtactagctgtttgtttgtgtagaaagaatccacacaccaggggactgaaaaatatgagactgaaaaacaagtaatatggtcttattatttcagtgtttgaatgagaaatctattatttttgcaccacaggtatgttttcatacaaaaaaaatttcaccaatttctttttctgtcctcctttctttttggagacttcagcttaggccagcttatcctgccacaaaagtaaaggcatcttatttaagatacttttcactaggatgtgttttttatcctataatccatagtcaagatagttctcttatttaaaaaatatgaaaataatcttaatattttaatatatatattttttgagatggagcctccgtcaccaggctggagtgcattggtgcgatctcggctcactgcaacctccgcctcccaggttccagcaattctcctgcctcagcctcccgagtagctgggactacaggagtgctccaccacgcctggctaatttttgtatttttagtagagatggggtttcaccatggcctcccaaagagctgggattacaggcgggagccactgcatccagctaatattttaatttttttctggttaatgtaccaaaagatatcccaccaagaaattaatttggttacaatatatcgttctcagtaaaattctagaattttaatttaattgataacaaaatgtcattggttaacacctagtttactgagtccttcctagcatcagtgacaggtccccattgtgaccaaggacaggctgcgtgggaccgctgcctctgatgggacaggcaagacaatgtctaagtggactaggacgaagaaaagtgaataaatgagtttccacaccttggcagatacaaccataatgtttggtgtaatattattagtcctgaatatgcaccaatgtaacattttagagacagaaagtgtactaaaaaaatcattcataagcaaataatttaatttcttgctcattctaaagggcagaggaggctttttcatccaaacttcaatccacttctacagattatataaacaagtgtattatagcttatttgaaaatgtttgctttttgatattgttgaaatggatttgcacctatttaagaccaaatacaaaaaactcttttacttcctaaggcaccagtgtgtaggaatgttacttaacaggaaacacaaactaatggcaaagcacaaagcagactcagcagaggagctgtgtgctggggacaccgacctgcctggtggaactgtgggccggaggcatctggatcaagcgagtagctcagtgcagaatgctgaggagaagcccatggggaaacaccattgattcgggaatcagattcaggctggaaccacattcagaggttaaagcagagaaaggattcaaataatcataaggaaaaacatttcctttttaacttccccgccctcaccatggataattaaatcatatagaagtctttgccttcagatgttttccatacattttagcatcagcttggtgggggctttggtccttctctttccgcttggacaccttgaagaatccacttggttatgctgccagactcatttatcaacaccatttttatccctcaatttttctgttgttttaatgttaagtgaattcataagcatagttcactcatattttaaacatcagcactgggtttctaatacagtaaatttatccaatttcaaaatcagctcatactccaaggcaatattgagagagtgattagaagcatgattatggattcagattgcc

SEQ ID NO: 460 - DNA, 4037 bp, Homo sapiens
aaaacaggctacaaatcctaatgaaatttatctctctttttcccaggtgtgtcctcaaccttggcaaagtaaacctgtctcatacactttttggtttatagaaaatactaaaaggcataagggtacagctgccaacagttctcagcaaaatttttaagtaaaaaattgaaatattttcccctgcaaagtaacaaaaccacctctgtggtaccagtcattttttttttaggtcaatgttctgtgatagccaccttaagtagacatttgagagagcagtggtggtcaaatctatctagagtgactttatgtagcacataagatgccattaaaaagctgttagaacacaaaggatcaaacacatggtatttttggtatctgtggcttgggagccaccccccactcccagactgacaaactgttgtacagaatcaactaacatttaaatgtcaagtaagtttacttatttacatggagaataaagtaggaataaaatcagtcgtggataatctgcttactctaggttgggatcagtaacatagagccaaccaagccattaactcttacctgtggcctgctgggaacatttgctgaaagagaaaacaaaagaaatcacttaatggcagtcctgttactttgttggttccaactctcaggcatgcaaatgcgtggaaagtatcactctacatagggtaataatagcccagttgttaaatggatgctaataggaaaaacaagaaacacattttttttttcctggcttaatgcttcaatgagggctagttttcctggttagtttctcatatcccatgtgatttaagatttagtgcatacactaaagcattcactgagcacttagtcttgcaaaaaatctcatttcctatttaaatcatactgtgtatttggtttatgtatcagaacagagcatgttctacttactttgctgagtactaattctgaccaagggaccactgaaggcataagtctttggtttctgcctctcttgacccacccttgacacaccctggaccctaacgcccaggaaaatggtggccaagtacttgcatcaaggaaagtgctggcctaatcctcagtgtccttctggacacttgggataataatagtcccttggatgggcccagttaggaacaacggagaagttagaatatggcatctaattctcctttccacacagatagctcaattcctttttggttccagagcccataacagtgaagacgatctggcgggctttgcaagggcagccactgccatctcttctctaaggcatctgcttttcgtcccctcttttgctacatgatcatctcgttctcaatgctggggggaaaagaggagatctgtcccccagtaatggcaacaatctgttcttggtcaaataaaagttgtccctagtcatctagcatgctgcactccttccatctctcactgttctatgctgagtgggagaaaggacatcagtgaccatgtgctgtgtgctgggagctatgtgagaaaaaaagagcaggcatgaagagtacccttcctataacgtctggagggaaagtgtgaggcccggtatttgggggagaaatcaggctaaaagaagcctagttctaacagatctgtaagttacatccaggagaaaagagtggacctccacagtgtccaagggatagctgagttgaattattattaagtacaccataggtttacacactctttttaaaacagacagagttatgcttctcttgcaagtaacaaatataacaaatagccaaaccctagacagaagtctaatccattttgctctaaaccaatacttttaaccttacagccttttatcaaataaaaggctatgggtatttgcctgaacaaatcacacaaaaatattttaaaaaggaaatcactgcattgcagtgggttttgggtttttgatgaatgccattcaagcttaataaacataggcaattcatagtaaaaatatgcctgtgggtcaaaaataattttgaaagcatttcttggtctatcagcaaaaattagttggcttactgccagtatttcatacatttgaaggacataagtaaaaaatggacaaaaaaaatttataccaaaaaataaaaatagttactgcagtcagtgggaattttagtaagtacacttgttaattggcagtacatttaaacccctttccttaactccttgccaggaagtgaaggaaatgtctgcttctctgctctaagactcaacataaataattttaaaaagactttaaaaggccataattcaaggatgctatcaggaccaactgggatattaattcagacaaaggagttctaaagtgttatgtgcaacaatgtgtagacacagttaaaaaacggtcatgttaaaataggcaattcacacaattaggatttatgaatacagagtttcattttaattccaagattgccaagagtggaaattcatttggggccatgctaatttttaatccacaaaggatcaaaagtcaagattaacatgaagatcaattcattgtatgctggcgacaagcatttttaaagttctcattagttacaggggctcaagggattggcttggcattgggagggtgccaatccgatttgtttagataaattctccaaaggtggttggtaagctttgggaatcacaaaggcttattaaaatatttgctggctgagcaactttaaagggacaaaagaacaaatgaatcctacaaaacgttctgagtactatctaggaatgctacaaggaaaccttcccagctagaaaatgtaatcattcactcaagtcagaaacatgtattggggccgggtgtggtggctcacgcgtgtaatcccagcggtttgggaggccagggtgggtgggtcacttgaggccaggagtttgagaccagcctggccaacatggtgaaacccgatctctactaaaaatacaaaaattagttgggcgtggtggcatgtgcctgtagtcccagctacttgggaggctgaggcatgagaattgcttgagcctgggaggtggaggttatacagacctgagatcgtgccattgaactccagcctgggcaacagagtgagtctctgtctcagaaaaaaaaaaaaaagagagagaaagacacatgcactgggcactgagtctacctcccacgctgatttctattttgcatcaatttttaaaaggtttaataattacaggcagaatatgaaaatatgtatcaattttataaataagtcaatacagcttttatttttatggaaagctgtccctgtcttgtatataataccagagaaaaaatatgaatagcagaactttcagaagccaaaaattaaaacatggagatttcaaaggattctaaaatacacttttcatcatttcatacatggatgtgcttgaattcttgaaaagaagacatgactagtaatgctcattcagaaaactatgactattataaatatttgtgaatgtgcatagttaacactatgaaaacatgaagccagctgctccaaaccaatacttttaaaccaacagctttttatcagatagaaggctaagggtattttacatacaaacatatttaaaaggaaatcattgcatttcagtaggttttgagtttttgacgaatgtgactcaagcttaataaacattaaggaatctcagggctccataaaccactctctgaacactgagaatgacattggtgaagaggggaccaatgcaggggagaggatgaatctctgtgatgtgggtcccattgaaggtactgtgtatactcctctcagaaaccaatatcaatgaacagctaacaagatccccaaccaataggaattttatacttgcctttaaagtgaggccataaaaagagatacatacatttacctgttacaattcatttttgctctaaattatgattatttatttttaataatgttctgttttaaaatgacatgggtccagcttttgtaaaatctggatgtcagagtatactttgagaaaaatttaagagtaaattctttaggaaa

SEQ ID NO: 461 - DNA, 4035 bp, Homo sapiens
acaaccacctctacctccacagcttacttcccctacaactgcaaatttatccatcctttgacaataggatccattgatcctcccatctttatttctgtctcccacactggacatttcctcattcctttcactactgagcttaagcatctggttcaatcattataatcacttctttgcctcttcccttgaatcactgtactcactttgtcaaaccccaacttcaactttttaaatgccaatactcagcccattctggtgcctgtgctcatgaacgtgaatatgcctagagggcaacttacaaccctgcagaatggcctcatgttaaattcatgagtggcacctttaatgctgcttatagtcacactctatttcccaggccatctgctcttctattctccaagaagctatcacacatcctccagtctctcctcgcacttctgacacctcctccccaacctcactccctgctaaagtcccggcttccaattcacttagacaacagaagcaagcaggagagaacacccacagctcaccacacccctagcctacttcacatacccttgtcttttagttaagatcccagcctctcttgccaataagacaatcattcagaaggctcattgtttcaaaaagattagtaaacaagttcatgaaagaaaatgttctccaaagctgctgtggctttgtggcacattattactaaaagtatgtgataagaaaatgtgaatggaaaacaaaatctcaggatccctaactcactatgctaaagggaaaaattaaaagtgggaactgagtcacacaaaaactaccttcctaagcagctacttgcaaagatagaaggccagtgacctccctcacaaattgctcacaaggaaatttctaagggtccccaaatctttaccctaaaacagagttttgttgaatttcaccctgacaatgtgaattaacagcttatctttacaggacaaaggcaggactagaagtcatctctcctcccaccctgagaaaaatgtgtacttgactgcttcttctactctaggcataccttatcttaattatataaaacgcagatttactgagcataagacaaatgcataattgactgttcctccaccccctcctgcctgctctttcgtttctgtgaagccctcaaaatcctttttgggaaaaaacaaaaacaaaaaacaaaacaaaacaaaaaaacaaaacaaaacaggctacaaatcctaatgaaatttatctctctttttcccaggtgtgtcctcaaccttggcaaagtaaacctgtctcatacactttttggtttatagaaaatactaaaaggcataagggtacagctgccaacagttctcagcaaaatttttaagtaaaaaattgaaatattttcccctgcaaagtaacaaaaccacctctgtggtaccagtcattttttttttaggtcaatgttctgtgatagccaccttaagtagacatttgagagagcagtggtggtcaaatctatctagagtgactttatgtagcacataagatgccattaaaaagctgttagaacacaaaggatcaaacacatggtatttttggtatctgtggcttgggagccaccccccactcccagactgacaaactgttgtacagaatcaactaacatttaaatgtcaagtaagtttacttatttacatggagaataaagtaggaataaaatcagtcgtggataatctgcttactctaggttgggatcagtaacatagagccaaccaagccattaactcttacctgtggcctgctgggaacatttgctgaaagagaaaacaaaagaaatcacttaatggcagtcctgttactttgttggttccaactctcaggcatgcaaatgcgtggaaagtatcactctacatagggtaataatagcccagttgttaaatggatgctaataggaaaaacaagaaacacattttttttttcctggcttaatgcttcaatgagggctagttttcctggttagtttctcatatcccatgtgatttaagatttagtgcatacactaaagcattcactgagcacttagtcttgcaaaaaatctcatttcctatttaaatcatactgtgtatttggtttatgtatcagaacagagcatgttctacttactttgctgagtactaattctgaccaagggaccactgaaggcataagtctttggtttctgcctctcttgacccacccttgacacaccctggaccctaacgcccaggaaaatggtggccaagtacttgcatcaaggaaagtgctggcctaatcctcagtgtccttctggacacttgggataataatagtcccttggatgggcccagttaggaacaacggagaagttagaatatggcatctaattctcctttccacacagatagctcaattcctttttggttccagagcccataacagtgaagacgatctggcgggctttgcaagggcagccactgccatctcttctctaaggcatctgcttttcgtcccctcttttgctacatgatcatctcgttctcaatgctggggggaaaagaggagatctgtcccccagtaatggcaacaatctgttcttggtcaaataaaagttgtccctagtcatctagcatgctgcactccttccatctctcactgttctatgctgagtgggagaaaggacatcagtgaccatgtgctgtgtgctgggagctatgtgagaaaaaaagagcaggcatgaagagtacccttcctataacgtctggagggaaagtgtgaggcccggtatttgggggagaaatcaggctaaaagaagcctagttctaacagatctgtaagttacatccaggagaaaagagtggacctccacagtgtccaagggatagctgagttgaattattattaagtacaccataggtttacacactctttttaaaacagacagagttatgcttctcttgcaagtaacaaatataacaaatagccaaaccctagacagaagtctaatccattttgctctaaaccaatacttttaaccttacagccttttatcaaataaaaggctatgggtatttgcctgaacaaatcacacaaaaatattttaaaaaggaaatcactgcattgcagtgggttttgggtttttgatgaatgccattcaagcttaataaacataggcaattcatagtaaaaatatgcctgtgggtcaaaaataattttgaaagcatttcttggtctatcagcaaaaattagttggcttactgccagtatttcatacatttgaaggacataagtaaaaaatggacaaaaaaaatttataccaaaaaataaaaatagttactgcagtcagtgggaattttagtaagtacacttgttaattggcagtacatttaaacccctttccttaactccttgccaggaagtgaaggaaatgtctgcttctctgctctaagactcaacataaataattttaaaaagactttaaaaggccataattcaaggatgctatcaggaccaactgggatattaattcagacaaaggagttctaaagtgttatgtgcaacaatgtgtagacacagttaaaaaacggtcatgttaaaataggcaattcacacaattaggatttatgaatacagagtttcattttaattccaagattgccaagagtggaaattcatttggggccatgctaatttttaatccacaaaggatcaaaagtcaagattaacatgaagatcaattcattgtatgctggcgacaagcatttttaaagttctcattagttacaggggctcaagggattggcttggcattgggagggtgccaatccgatttgtttagataaattctccaaaggtggttggtaagctttgggaatcacaaaggcttattaaaatatttgctggctgagcaactttaaagggacaaaagaacaaatgaatcctacaaaacgttctgagtactatctaggaatgctacaaggaaaccttcccagctagaaaatgtaatcattcactcaagtcagaaacatgtattggggc

SEQ ID NO: 462 - DNA, 4042 bp, Homo sapiens
actcataggtttaagtagtagcgttagtggtggtttactgtattatcattaaattctccactaatgaatttagaaaggcctttgaaaaagctggcatactgaaacagtgaatgtgggtgggagaaaagatacacaggagcaaactacaaagattatctgtctgtctatctctatctatctatctatctatcatctatctatatctatctatcatctatctatcatctatctatctatctatctatctatctatctatctatctatatctatcatctatcatctatctctatgccttcacagtatatatagtatactgtgccttgattgtaacatatatattatatatatatgtgatatataacaacttgaaggcacagtatacatctttattctattttgtgttgctataacagaataccacagattgggtaatttacaaagaaaagaaatttatttctcagcgttctggaggttgggaagtccaatatcaaggtgccagcatctggtaaggcctgtcttgctgcgtcatcctatggtggaaggtgacagggcagagaacatgcaagagaaagtgagagaacccaacgtgctttggtaataaacccacttgagatagcaaacacacttctgtgatgacattaatccattcatgacctctgacctcatgatccaatcacttcttaaaggtccaacccctcaacactatggaatcggggattaaattttcaacacatgaactgtgggtgacacattcaaaccacagcagtatgaaagcaaaacttgttcatttgttcgcacttctattttcagctacctagtcaacaagttgctggaaatcaagtgttttttcaggaatgcttaatgtcagcattacttagtggtacacaggatgtttaaaatgtttgttcatcagaatgtatcagttttctttattttaacaaattatattttagatgatttttctagttcatagacagcttttaattttagaataaagcaacatgattctcaacattgtttcccactgaatggcttcagaaattgattaaacctactagagtggttaaaatccagtgtacggataaaaagcatacagtatttgagagcatgaaactaaaagtacatttgaaaggaacttaatgtcaacagcatctagttattaaaacactcaacaggttttatgtacacatttttacatccaatattacttttctctatcaataaaccttctatctggaaaataaattgagaatcatataattatatgtatgtgtaagagatggggagagagagagaatgagagcaacaggagactgtattagtgtgtatgagagaaactgcaggaaaaaatgtagatgtatcaggacacaggctatctctatatcttgttttcataaatgtgcattcaaaactcacattctatcagtgaatccagctgaagaatatcaaagtcatcttgtgttaaaattacttttattcaggatgaaaaatacaatatgtaaccagattagatgatagtctgtgattagttctttaccacatatttcaaaagaactacatacttacttcccattgttactgcaatatatttctttttatttattattacttagaaggttacaatgtagtgttttacgtagcttttctttaatagcagatagaggacattttgcatacaaatacaggcagaaaaaaaattaacacatgactttttaaagtaagaacaaggaagacaccaaatctacaacttggagttgagagctcagggaattgttttttctttaaataggtgctttcttgggtatgacatggcctgataaaagctctagactttgcagactgcagcagcataaagcagtttccaatgcaatggatgaagatggatctgaggtagaaaggtggtcatggctttcctttttatataaaacaattttcttcttttcaaaatatctctgctgcaaatagacacccttgccccccaacccacccaacctattctaaaataatagcaatttctaactttaagcctccttctggccagatcccagctaaagagaacccaaagttaaaatgtctttatgtttttatgtctttaggtttgaatcaaaacatattattttcacctttttttggttcctctacatttgctaattaagtaacatgtttaaactgaatcaattaaatgttaaatcagaagctaaaccaaaatacataattgaatgcactcaaaaagatgtaggtggaggtaccatcacctaagcattaatttcattcttctgtagaagcagtgacatagacttttgataaacattctttccaaatatattgatcaagtgaagggtataaaaacatctgatctttcacccgaaaggtaaaataagccgtgcactaaatgtgtgtctgctttcaacaagaaaacaactaggagtttcaagaactattaaggacttgaaaatacaaaacaacaataaaattctctttgaagggaaccaaagacaatgatgtgttctggtatcacaataggtaaaggtctgctgtgcatgtaatgatgaaaatcaagacatgggaactaggaaaggttgtactaaattttgtttctgtgtcaaaatgaaaatatgctcaagtgggcaacctttggtaatatgatctttgagattattataatgtagtcttctttatcaaatagattaagacataaaataaataattaattcctacttatataaaaagggaataaaatgcaggaaaaatatcccaaaagaaatgccatttaggcttataggatttttattacggttatccaagtggtcagcaaagaagtaagtgggcaacgtcaaataaagttaaacggcatacacagggctgtagcttaaaccatatgtgtgtatatataagatatttgattgaaatttatgaatttattaatgtggccaaatcacggaaacaaatacatggatctatttgggatctagttggttatatggctgataaacatatggctgataaattataaataaccaaaacattgtggtaaaagagtcaaagaaaaaatgaagtaattgtgcaaggttaatatgaacagcagaaggaatgtaaaaatgtaaagtggtcttctaattcttatgtaagctttgtcatagttattaaaaagacggtatcatattagaaagcccccacccactttcccaatgctgtatacattatacaaatccgtgacaaatgtattaccatttccaaatacctctctgttcattaatttacacttgcatagaaagggaagaagaaaacaataatatatggttattataaaaacaaaatatccatttctctttggatagtcagtgttttactctttcagtagaacacacagtcagcactcaacatcgtgggccaaggagccatggagcttctgatttaatggaacttggaattggcatttgctgaaaagggcaacactgtacgtcaggaaacattggttggccggatgaatacttcacattgcctatgggaagggaaaatagcactgtcagaaatttgcacaaaacattacaggaagcagagatctgtcaattcttcaagaaaataaaagtgcttctttcaagagtcttaactctactgtgacttttgcttcctgcaatgaggtccctccctctcatgctgaagttacctagtctgctttctatcactgcagctgatttagagggaagtctgaaagtcttttctcttggccaggctggaagcaaagttaaaatggagaggacttcatttctttctgctgaaggtaccaatggtgagcgaatgaggctggtgaaaatatcccatgtcttcctgggggactgtgggaggtcatctgtagagggggtaccctaacaatgccaaccatcttgatcccaagctggagtccagagaagaggaaggcaaggcaggaatcataacccaagggtgtttagtggtgccagttaaagttaaatgtcccaggtcagagacaatataaatccaggccacactcatggaagtggtatcaaccttttgaagggaagg

SEQ ID NO: 463 - DNA, 15 bp, Homo sapiens
agggaaggttaatac

SEQ ID NO: 464 - DNA, 15 bp, Homo sapiens
cagggaaggttaata

SEQ ID NO: 465 - DNA, 15 bp, Homo sapiens
ccagggaaggttaat

SEQ ID NO: 466 - DNA, 15 bp, Homo sapiens
tccagggaaggttaa

SEQ ID NO: 467 - DNA, 15 bp, Homo sapiens
ctccagggaaggtta

SEQ ID NO: 468 - DNA, 15 bp, Homo sapiens
gctccagggaaggtt

SEQ ID NO: 469 - DNA, 15 bp, Homo sapiens
cgctccagggaaggt

SEQ ID NO: 470 - DNA, 15 bp, Homo sapiens
gcgctccagggaagg

SEQ ID NO: 471 - DNA, 15 bp, Homo sapiens
agcgctccagggaag

SEQ ID NO: 472 - DNA, 15 bp, Homo sapiens
aagcgctccagggaa

SEQ ID NO: 473 - DNA, 15 bp, Homo sapiens
gaagcgctccaggga

SEQ ID NO: 474 - DNA, 15 bp, Homo sapiens
ggaagcgctccaggg

SEQ ID NO: 475 - DNA, 15 bp, Homo sapiens
cggaagcgctccagg

SEQ ID NO: 476 - DNA, 15 bp, Homo sapiens
tcggaagcgctccag

SEQ ID NO: 477 - DNA, 15 bp, Homo sapiens
ctcggaagcgctcca

SEQ ID NO: 478 - DNA, 15 bp, Homo sapiens
actcggaagcgctcc

SEQ ID NO: 479 - DNA, 15 bp, Homo sapiens
cactcggaagcgctc

SEQ ID NO: 480 - DNA, 15 bp, Homo sapiens
acactcggaagcgct

SEQ ID NO: 481 - DNA, 15 bp, Homo sapiens
tacactcggaagcgc

SEQ ID NO: 482 - DNA, 15 bp, Homo sapiens
ttacactcggaagcg

SEQ ID NO: 483 - DNA, 15 bp, Homo sapiens
tttacactcggaagc

SEQ ID NO: 484 - DNA, 15 bp, Homo sapiens
atttacactcggaag

SEQ ID NO: 485 - DNA, 15 bp, Homo sapiens
catttacactcggaa

SEQ ID NO: 486 - DNA, 15 bp, Homo sapiens
ccatttacactcgga

SEQ ID NO: 487 - DNA, 15 bp, Homo sapiens
gccatttacactcgg

SEQ ID NO: 488 - DNA, 15 bp, Homo sapiens
tgccatttacactcg

SEQ ID NO: 489 - DNA, 15 bp, Homo sapiens
ctgccatttacactc

SEQ ID NO: 490 - DNA, 15 bp, Homo sapiens
actgccatttacact

SEQ ID NO: 491 - DNA, 15 bp, Homo sapiens
aactgccatttacac

SEQ ID NO: 492 - DNA, 15 bp, Homo sapiens
gaactgccatttaca

SEQ ID NO: 493 - DNA, 15 bp, Homo sapiens
agaactgccatttac

SEQ ID NO: 494 - DNA, 15 bp, Homo sapiens
aagaactgccattta

SEQ ID NO: 495 - DNA, 15 bp, Homo sapiens
caagaactgccattt

SEQ ID NO: 496 - DNA, 15 bp, Homo sapiens
ccaagaactgccatt

SEQ ID NO: 497 - DNA, 15 bp, Homo sapiens
gccaagaactgccat

SEQ ID NO: 498 - DNA, 15 bp, Homo sapiens
tgccaagaactgcca

SEQ ID NO: 499 - DNA, 15 bp, Homo sapiens
gtgccaagaactgcc

SEQ ID NO: 500 - DNA, 15 bp, Homo sapiens
agtgccaagaactgc

SEQ ID NO: 501 - DNA, 15 bp, Homo sapiens
gagtgccaagaactg

SEQ ID NO: 502 - DNA, 15 bp, Homo sapiens
tgagtgccaagaact

SEQ ID NO: 503 - DNA, 15 bp, Homo sapiens
gtgagtgccaagaac

SEQ ID NO: 504 - DNA, 15 bp, Homo sapiens
ggtgagtgccaagaa

SEQ ID NO: 505 - DNA, 15 bp, Homo sapiens
cggtgagtgccaaga

SEQ ID NO: 506 - DNA, 15 bp, Homo sapiens
acggtgagtgccaag

SEQ ID NO: 507 - DNA, 15 bp, Homo sapiens
aacggtgagtgccaa

SEQ ID NO: 508 - DNA, 15 bp, Homo sapiens
aaacggtgagtgcca

SEQ ID NO: 509 - DNA, 15 bp, Homo sapiens
aaaacggtgagtgcc

SEQ ID NO: 510 - DNA, 15 bp, Homo sapiens
gaaaacggtgagtgc

SEQ ID NO: 511 - DNA, 15 bp, Homo sapiens
agaaaacggtgagtg

SEQ ID NO: 512 - DNA, 15 bp, Homo sapiens
aagaaaacggtgagt

SEQ ID NO: 513 - DNA, 15 bp, Homo sapiens
aaagaaaacggtgag

SEQ ID NO: 514 - DNA, 15 bp, Homo sapiens
aaaagaaaacggtga

SEQ ID NO: 515 - DNA, 15 bp, Homo sapiens
taaaagaaaacggtg

SEQ ID NO: 516 - DNA, 15 bp, Homo sapiens
gtaaaagaaaacggt

SEQ ID NO: 517 - DNA, 15 bp, Homo sapiens
agtaaaagaaaacgg

SEQ ID NO: 518 - DNA, 15 bp, Homo sapiens
cagtaaaagaaaacg

SEQ ID NO: 519 - DNA, 15 bp, Homo sapiens
cacagtaaaagaaaa

SEQ ID NO: 520 - DNA, 15 bp, Homo sapiens
acacagtaaaagaaa

SEQ ID NO: 521 - DNA, 15 bp, Homo sapiens
aacacagtaaaagaa

SEQ ID NO: 522 - DNA, 15 bp, Homo sapiens
aaacacagtaaaaga

SEQ ID NO: 523 - DNA, 15 bp, Homo sapiens
gaaacacagtaaaag

SEQ ID NO: 524 - DNA, 15 bp, Homo sapiens
tgaaacacagtaaaa

SEQ ID NO: 525 - DNA, 15 bp, Homo sapiens
ttgaaacacagtaaa

SEQ ID NO: 526 - DNA, 15 bp, Homo sapiens
cttgaaacacagtaa

SEQ ID NO: 527 - DNA, 15 bp, Homo sapiens
gcttgaaacacagta

SEQ ID NO: 528 - DNA, 15 bp, Homo sapiens
tgcttgaaacacagt

SEQ ID NO: 529 - DNA, 15 bp, Homo sapiens
ctgcttgaaacacag

SEQ ID NO: 530 - DNA, 15 bp, Homo sapiens
tctgcttgaaacaca

SEQ ID NO: 531 - DNA, 15 bp, Homo sapiens
ctctgcttgaaacac

SEQ ID NO: 532 - DNA, 15 bp, Homo sapiens
gctctgcttgaaaca

SEQ ID NO: 533 - DNA, 15 bp, Homo sapiens
tgctctgcttgaaac

SEQ ID NO: 534 - DNA, 15 bp, Homo sapiens
ctgctctgcttgaaa

SEQ ID NO: 535 - DNA, 15 bp, Homo sapiens
gctgctctgcttgaa

SEQ ID NO: 536 - DNA, 15 bp, Homo sapiens
tgctgctctgcttga

SEQ ID NO: 537 - DNA, 15 bp, Homo sapiens
ttgctgctctgcttg

SEQ ID NO: 538 - DNA, 15 bp, Homo sapiens
tttgctgctctgctt

SEQ ID NO: 539 - DNA, 15 bp, Homo sapiens
gtttgctgctctgct

SEQ ID NO: 540 - DNA, 15 bp, Homo sapiens
agtttgctgctctgc

SEQ ID NO: 541 - DNA, 15 bp, Homo sapiens
gagtttgctgctctg

SEQ ID NO: 542 - DNA, 15 bp, Homo sapiens
agagtttgctgctct

SEQ ID NO: 543 - DNA, 15 bp, Homo sapiens
aagagtttgctgctc

SEQ ID NO: 544 - DNA, 15 bp, Homo sapiens
caagagtttgctgct

SEQ ID NO: 545 - DNA, 15 bp, Homo sapiens
acaagagtttgctgc

SEQ ID NO: 546 - DNA, 15 bp, Homo sapiens
gacaagagtttgctg

SEQ ID NO: 547 - DNA, 15 bp, Homo sapiens
ggacaagagtttgct

SEQ ID NO: 548 - DNA, 15 bp, Homo sapiens
cggacaagagtttgc

SEQ ID NO: 549 - DNA, 15 bp, Homo sapiens
gcggacaagagtttg

SEQ ID NO: 550 - DNA, 15 bp, Homo sapiens
agcggacaagagttt

SEQ ID NO: 551 - DNA, 15 bp, Homo sapiens
aagcggacaagagtt

SEQ ID NO: 552 - DNA, 15 bp, Homo sapiens
caagcggacaagagt

SEQ ID NO: 553 - DNA, 15 bp, Homo sapiens
ccaagcggacaagag

SEQ ID NO: 554 - DNA, 15 bp, Homo sapiens
gccaagcggacaaga

SEQ ID NO: 555 - DNA, 15 bp, Homo sapiens
agccaagcggacaag

SEQ ID NO: 556 - DNA, 15 bp, Homo sapiens
aagccaagcggacaa

SEQ ID NO: 557 - DNA, 15 bp, Homo sapiens
gaagccaagcggaca

SEQ ID NO: 558 - DNA, 15 bp, Homo sapiens
ggaagccaagcggac

SEQ ID NO: 559 - DNA, 15 bp, Homo sapiens
aggaagccaagcgga

SEQ ID NO: 560 - DNA, 15 bp, Homo sapiens
aaggaagccaagcgg

SEQ ID NO: 561 - DNA, 15 bp, Homo sapiens
aaaggaagccaagcg

SEQ ID NO: 562 - DNA, 15 bp, Homo sapiens
aaaaggaagccaagc

SEQ ID NO: 563 - DNA, 15 bp, Homo sapiens
gaaaaggaagccaag

SEQ ID NO: 564 - DNA, 15 bp, Homo sapiens
agaaaaggaagccaa

SEQ ID NO: 565 - DNA, 15 bp, Homo sapiens
tagaaaaggaagcca

SEQ ID NO: 566 - DNA, 15 bp, Homo sapiens
gtagaaaaggaagcc

SEQ ID NO: 567 - DNA, 15 bp, Homo sapiens
agtagaaaaggaagc

SEQ ID NO: 568 - DNA, 15 bp, Homo sapiens
tagtagaaaaggaag

SEQ ID NO: 569 - DNA, 15 bp, Homo sapiens
atagtagaaaaggaa

SEQ ID NO: 570 - DNA, 15 bp, Homo sapiens
gatagtagaaaagga

SEQ ID NO: 571 - DNA, 15 bp, Homo sapiens
agatagtagaaaagg

SEQ ID NO: 572 - DNA, 15 bp, Homo sapiens
gagatagtagaaaag

SEQ ID NO: 573 - DNA, 15 bp, Homo sapiens
tgagatagtagaaaa

SEQ ID NO: 574 - DNA, 15 bp, Homo sapiens
ttgagatagtagaaa

SEQ ID NO: 575 - DNA, 15 bp, Homo sapiens
attgagatagtagaa

SEQ ID NO: 576 - DNA, 15 bp, Homo sapiens
gattgagatagtaga

SEQ ID NO: 577 - DNA, 15 bp, Homo sapiens
cgattgagatagtag

SEQ ID NO: 578 - DNA, 15 bp, Homo sapiens
acgattgagatagta

SEQ ID NO: 579 - DNA, 15 bp, Homo sapiens
aacgattgagatagt

SEQ ID NO: 580 - DNA, 15 bp, Homo sapiens
gaacgattgagatag

SEQ ID NO: 581 - DNA, 15 bp, Homo sapiens
ggaacgattgagata

SEQ ID NO: 582 - DNA, 15 bp, Homo sapiens
aggaacgattgagat

SEQ ID NO: 583 - DNA, 15 bp, Homo sapiens
taggaacgattgaga

SEQ ID NO: 584 - DNA, 15 bp, Homo sapiens
ctaggaacgattgag

SEQ ID NO: 585 - DNA, 15 bp, Homo sapiens
cctaggaacgattga

SEQ ID NO: 586 - DNA, 15 bp, Homo sapiens
acctaggaacgattg

SEQ ID NO: 587 - DNA, 15 bp, Homo sapiens
aacctaggaacgatt

SEQ ID NO: 588 - DNA, 15 bp, Homo sapiens
aaacctaggaacgat

SEQ ID NO: 589 - DNA, 15 bp, Homo sapiens
aaaacctaggaacga

SEQ ID NO: 590 - DNA, 15 bp, Homo sapiens
caaaacctaggaacg

SEQ ID NO: 591 - DNA, 15 bp, Homo sapiens
ccaaaacctaggaac

SEQ ID NO: 592 - DNA, 15 bp, Homo sapiens
accaaaacctaggaa

SEQ ID NO: 593 - DNA, 15 bp, Homo sapiens
aaccaaaacctagga

SEQ ID NO: 594 - DNA, 15 bp, Homo sapiens
gaaccaaaacctagg

SEQ ID NO: 595 - DNA, 15 bp, Homo sapiens
ggaaccaaaacctag

SEQ ID NO: 596 - DNA, 15 bp, Homo sapiens
aggaaccaaaaccta

SEQ ID NO: 597 - DNA, 15 bp, Homo sapiens
taggaaccaaaacct

SEQ ID NO: 598 - DNA, 15 bp, Homo sapiens
ataggaaccaaaacc

SEQ ID NO: 599 - DNA, 15 bp, Homo sapiens
tataggaaccaaaac

SEQ ID NO: 600 - DNA, 15 bp, Homo sapiens
ctataggaaccaaaa

SEQ ID NO: 601 - DNA, 15 bp, Homo sapiens
actataggaaccaaa

SEQ ID NO: 602 - DNA, 15 bp, Homo sapiens
tactataggaaccaa

SEQ ID NO: 603 - DNA, 15 bp, Homo sapiens
ttactataggaacca

SEQ ID NO: 604 - DNA, 15 bp, Homo sapiens
tttactataggaacc

SEQ ID NO: 605 - DNA, 15 bp, Homo sapiens
atttactataggaac

SEQ ID NO: 606 - DNA, 15 bp, Homo sapiens
aatttactataggaa

SEQ ID NO: 607 - DNA, 15 bp, Homo sapiens
taatttactatagga

SEQ ID NO: 608 - DNA, 15 bp, Homo sapiens
ttaatttactatagg

SEQ ID NO: 609 - DNA, 15 bp, Homo sapiens
attaatttactatag

SEQ ID NO: 610 - DNA, 15 bp, Homo sapiens
cattaatttactata

SEQ ID NO: 611 - DNA, 15 bp, Homo sapiens
tcattaatttactat

SEQ ID NO: 612 - DNA, 15 bp, Homo sapiens
ttcattaatttacta

SEQ ID NO: 613 - DNA, 15 bp, Homo sapiens
attcattaatttact

SEQ ID NO: 614 - DNA, 15 bp, Homo sapiens
tattcattaatttac

SEQ ID NO: 615 - DNA, 15 bp, Homo sapiens
ctattcattaattta

SEQ ID NO: 616 - DNA, 15 bp, Homo sapiens
actattcattaattt

SEQ ID NO: 617 - DNA, 15 bp, Homo sapiens
cactattcattaatt

SEQ ID NO: 618 - DNA, 15 bp, Homo sapiens
acactattcattaat

SEQ ID NO: 619 - DNA, 15 bp, Homo sapiens
aacactattcattaa

SEQ ID NO: 620 - DNA, 15 bp, Homo sapiens
aaacactattcatta

SEQ ID NO: 621 - DNA, 15 bp, Homo sapiens
caaacactattcatt

SEQ ID NO: 622 - DNA, 15 bp, Homo sapiens
gcaaacactattcat

SEQ ID NO: 623 - DNA, 15 bp, Homo sapiens
tgcaaacactattca

SEQ ID NO: 624 - DNA, 15 bp, Homo sapiens
atgcaaacactattc

SEQ ID NO: 625 - DNA, 15 bp, Homo sapiens
aatgcaaacactatt

SEQ ID NO: 626 - DNA, 15 bp, Homo sapiens
taatgcaaacactat

SEQ ID NO: 627 - DNA, 15 bp, Homo sapiens
gtaatgcaaacacta

SEQ ID NO: 628 - DNA, 15 bp, Homo sapiens
tgtaatgcaaacact

SEQ ID NO: 629 - DNA, 15 bp, Homo sapiens
gtgtaatgcaaacac

SEQ ID NO: 630 - DNA, 15 bp, Homo sapiens
tgtgtaatgcaaaca

SEQ ID NO: 631 - DNA, 15 bp, Homo sapiens
ctgtgtaatgcaaac

SEQ ID NO: 632 - DNA, 15 bp, Homo sapiens
gctgtgtaatgcaaa

SEQ ID NO: 633 - DNA, 15 bp, Homo sapiens
tgctgtgtaatgcaa

SEQ ID NO: 634 - DNA, 15 bp, Homo sapiens
atgctgtgtaatgca

SEQ ID NO: 635 - DNA, 15 bp, Homo sapiens
aatgctgtgtaatgc

SEQ ID NO: 636 - DNA, 15 bp, Homo sapiens
aaatgctgtgtaatg

SEQ ID NO: 637 - DNA, 15 bp, Homo sapiens
gaaatgctgtgtaat

SEQ ID NO: 638 - DNA, 15 bp, Homo sapiens
ggaaatgctgtgtaa

SEQ ID NO: 639 - DNA, 15 bp, Homo sapiens
tggaaatgctgtgta

SEQ ID NO: 640 - DNA, 15 bp, Homo sapiens
atggaaatgctgtgt

SEQ ID NO: 641 - DNA, 15 bp, Homo sapiens
gatggaaatgctgtg

SEQ ID NO: 642 - DNA, 15 bp, Homo sapiens
tgatggaaatgctgt

SEQ ID NO: 643 - DNA, 15 bp, Homo sapiens
atgatggaaatgctg

SEQ ID NO: 644 - DNA, 15 bp, Homo sapiens
tatgatggaaatgct

SEQ ID NO: 645 - DNA, 15 bp, Homo sapiens
ttatgatggaaatgc

SEQ ID NO: 646 - DNA, 15 bp, Homo sapiens
attatgatggaaatg

SEQ ID NO: 647 - DNA, 15 bp, Homo sapiens
cattatgatggaaat

SEQ ID NO: 648 - DNA, 15 bp, Homo sapiens
gcattatgatggaaa

SEQ ID NO: 649 - DNA, 15 bp, Homo sapiens
tgcattatgatggaa

SEQ ID NO: 650 - DNA, 15 bp, Homo sapiens
gtgcattatgatgga

SEQ ID NO: 651 - DNA, 15 bp, Homo sapiens
tgtgcattatgatgg

SEQ ID NO: 652 - DNA, 15 bp, Homo sapiens
gtgtgcattatgatg

SEQ ID NO: 653 - DNA, 15 bp, Homo sapiens
agtgtgcattatgat

SEQ ID NO: 654 - DNA, 15 bp, Homo sapiens
cagtgtgcattatga

SEQ ID NO: 655 - DNA, 15 bp, Homo sapiens
acagtgtgcattatg

SEQ ID NO: 656 - DNA, 15 bp, Homo sapiens
aacagtgtgcattat

SEQ ID NO: 657 - DNA, 15 bp, Homo sapiens
caacagtgtgcatta

SEQ ID NO: 658 - DNA, 15 bp, Homo sapiens
ccaacagtgtgcatt

SEQ ID NO: 659 - DNA, 15 bp, Homo sapiens
tccaacagtgtgcat

SEQ ID NO: 660 - DNA, 15 bp, Homo sapiens
atccaacagtgtgca

SEQ ID NO: 661 - DNA, 15 bp, Homo sapiens
tatccaacagtgtgc

SEQ ID NO: 662 - DNA, 15 bp, Homo sapiens
atatccaacagtgtg

SEQ ID NO: 663 - DNA, 15 bp, Homo sapiens
tatatccaacagtgt

SEQ ID NO: 664 - DNA, 15 bp, Homo sapiens
atatatccaacagtg

SEQ ID NO: 665 - DNA, 15 bp, Homo sapiens
tatatatccaacagt

SEQ ID NO: 666 - DNA, 15 bp, Homo sapiens
atatatatccaacag

SEQ ID NO: 667 - DNA, 15 bp, Homo sapiens
catatatatccaaca

SEQ ID NO: 668 - DNA, 15 bp, Homo sapiens
acatatatatccaac

SEQ ID NO: 669 - DNA, 15 bp, Homo sapiens
cacatatatatccaa

SEQ ID NO: 670 - DNA, 15 bp, Homo sapiens
gcacatatatatcca

SEQ ID NO: 671 - DNA, 15 bp, Homo sapiens
agcacatatatatcc

SEQ ID NO: 672 - DNA, 15 bp, Homo sapiens
tagcacatatatatc

SEQ ID NO: 673 - DNA, 15 bp, Homo sapiens
atagcacatatatat

SEQ ID NO: 674 - DNA, 15 bp, Homo sapiens
tatagcacatatata

SEQ ID NO: 675 - DNA, 15 bp, Homo sapiens
atatagcacatatat

SEQ ID NO: 676 - DNA, 15 bp, Homo sapiens
tatatagcacatata

SEQ ID NO: 677 - DNA, 15 bp, Homo sapiens
gtatatagcacatat

SEQ ID NO: 678 - DNA, 15 bp, Homo sapiens
tgtatatagcacata

SEQ ID NO: 679 - DNA, 15 bp, Homo sapiens
atgtatatagcacat

SEQ ID NO: 680 - DNA, 15 bp, Homo sapiens
tatgtatatagcaca

SEQ ID NO: 681 - DNA, 15 bp, Homo sapiens
ttatgtatatagcac

SEQ ID NO: 682 - DNA, 15 bp, Homo sapiens
tttatgtatatagca

SEQ ID NO: 683 - DNA, 15 bp, Homo sapiens
ttttatgtatatagc

SEQ ID NO: 684 - DNA, 15 bp, Homo sapiens
attttatgtatatag

SEQ ID NO: 685 - DNA, 15 bp, Homo sapiens
tattttatgtatata

SEQ ID NO: 686 - DNA, 15 bp, Homo sapiens
atattttatgtatat

SEQ ID NO: 687 - DNA, 15 bp, Homo sapiens
tatattttatgtata

SEQ ID NO: 688 - DNA, 15 bp, Homo sapiens
ctatattttatgtat

SEQ ID NO: 689 - DNA, 15 bp, Homo sapiens
actatattttatgta

SEQ ID NO: 690 - DNA, 15 bp, Homo sapiens
tactatattttatgt

SEQ ID NO: 691 - DNA, 15 bp, Homo sapiens
gtactatattttatg

SEQ ID NO: 692 - DNA, 15 bp, Homo sapiens
tgtactatattttat

SEQ ID NO: 693 - DNA, 15 bp, Homo sapiens
ttgtactatatttta

SEQ ID NO: 694 - DNA, 15 bp, Homo sapiens
tttgtactatatttt

SEQ ID NO: 695 - DNA, 15 bp, Homo sapiens
ttttgtactatattt

SEQ ID NO: 696 - DNA, 15 bp, Homo sapiens
attttgtactatatt

SEQ ID NO: 697 - DNA, 15 bp, Homo sapiens
tattttgtactatat

SEQ ID NO: 698 - DNA, 15 bp, Homo sapiens
ttattttgtactata

SEQ ID NO: 699 - DNA, 15 bp, Homo sapiens
tttattttgtactat

SEQ ID NO: 700 - DNA, 15 bp, Homo sapiens
ttttattttgtacta

SEQ ID NO: 701 - DNA, 15 bp, Homo sapiens
tttttattttgtact

SEQ ID NO: 702 - DNA, 15 bp, Homo sapiens
atttttattttgtac

SEQ ID NO: 703 - DNA, 15 bp, Homo sapiens
aatttttattttgta

SEQ ID NO: 704 - DNA, 15 bp, Homo sapiens
taatttttattttgt

SEQ ID NO: 705 - DNA, 15 bp, Homo sapiens
ataatttttattttg

SEQ ID NO: 706 - DNA, 15 bp, Homo sapiens
tataatttttatttt

SEQ ID NO: 707 - DNA, 15 bp, Homo sapiens
atataatttttattt

SEQ ID NO: 708 - DNA, 15 bp, Homo sapiens
tatataatttttatt

SEQ ID NO: 709 - DNA, 15 bp, Homo sapiens
gtatataatttttat

SEQ ID NO: 710 - DNA, 15 bp, Homo sapiens
tgtatataattttta

SEQ ID NO: 711 - DNA, 15 bp, Homo sapiens
atgtatataattttt

SEQ ID NO: 712 - DNA, 15 bp, Homo sapiens
tatgtatataatttt

SEQ ID NO: 713 - DNA, 15 bp, Homo sapiens
atatgtatataattt

SEQ ID NO: 714 - DNA, 15 bp, Homo sapiens
tatatgtatataatt

SEQ ID NO: 715 - DNA, 15 bp, Homo sapiens
atatatgtatataat

SEQ ID NO: 716 - DNA, 15 bp, Homo sapiens
aatatatgtatataa

SEQ ID NO: 717 - DNA, 15 bp, Homo sapiens
gaatatatgtatata

SEQ ID NO: 718 - DNA, 15 bp, Homo sapiens
tgaatatatgtatat

SEQ ID NO: 719 - DNA, 15 bp, Homo sapiens
atgaatatatgtata

SEQ ID NO: 720 - DNA, 15 bp, Homo sapiens
aatgaatatatgtat

SEQ ID NO: 721 - DNA, 15 bp, Homo sapiens
caatgaatatatgta

SEQ ID NO: 722 - DNA, 15 bp, Homo sapiens
acaatgaatatatgt

SEQ ID NO: 723 - DNA, 15 bp, Homo sapiens
tacaatgaatatatg

SEQ ID NO: 724 - DNA, 15 bp, Homo sapiens
atacaatgaatatat

SEQ ID NO: 725 - DNA, 15 bp, Homo sapiens
tatacaatgaatata

SEQ ID NO: 726 - DNA, 15 bp, Homo sapiens
ttatacaatgaatat

SEQ ID NO: 727 - DNA, 15 bp, Homo sapiens
attatacaatgaata

SEQ ID NO: 728 - DNA, 15 bp, Homo sapiens
aattatacaatgaat

SEQ ID NO: 729 - DNA, 15 bp, Homo sapiens
gaattatacaatgaa

SEQ ID NO: 730 - DNA, 15 bp, Homo sapiens
ggaattatacaatga

SEQ ID NO: 731 - DNA, 15 bp, Homo sapiens
aggaattatacaatg

SEQ ID NO: 732 - DNA, 15 bp, Homo sapiens
taggaattatacaat

SEQ ID NO: 733 - DNA, 15 bp, Homo sapiens
ttaggaattatacaa

SEQ ID NO: 734 - DNA, 15 bp, Homo sapiens
tttaggaattataca

SEQ ID NO: 735 - DNA, 15 bp, Homo sapiens
ttttaggaattatac

SEQ ID NO: 736 - DNA, 15 bp, Homo sapiens
attttaggaattata

SEQ ID NO: 737 - DNA, 15 bp, Homo sapiens
gattttaggaattat

SEQ ID NO: 738 - DNA, 15 bp, Homo sapiens
agattttaggaatta

SEQ ID NO: 739 - DNA, 15 bp, Homo sapiens
aagattttaggaatt

SEQ ID NO: 740 - DNA, 15 bp, Homo sapiens
taagattttaggaat

SEQ ID NO: 741 - DNA, 15 bp, Homo sapiens
ttaagattttaggaa

SEQ ID NO: 742 - DNA, 15 bp, Homo sapiens
tttaagattttagga

SEQ ID NO: 743 - DNA, 15 bp, Homo sapiens
ttttaagattttagg

SEQ ID NO: 744 - DNA, 15 bp, Homo sapiens
tttttaagattttag

SEQ ID NO: 745 - DNA, 15 bp, Homo sapiens
ttttttaagatttta

SEQ ID NO: 746 - DNA, 15 bp, Homo sapiens
attttttaagatttt

SEQ ID NO: 747 - DNA, 15 bp, Homo sapiens
aattttttaagattt

SEQ ID NO: 748 - DNA, 15 bp, Homo sapiens
caattttttaagatt

SEQ ID NO: 749 - DNA, 15 bp, Homo sapiens
tcaattttttaagat

SEQ ID NO: 750 - DNA, 15 bp, Homo sapiens
ttcaattttttaaga

SEQ ID NO: 751 - DNA, 15 bp, Homo sapiens
tttcaattttttaag

SEQ ID NO: 752 - DNA, 15 bp, Homo sapiens
gtttcaattttttaa

SEQ ID NO: 753 - DNA, 15 bp, Homo sapiens
tgtttcaatttttta

SEQ ID NO: 754 - DNA, 15 bp, Homo sapiens
atgtttcaatttttt

SEQ ID NO: 755 - DNA, 15 bp, Homo sapiens
aatgtttcaattttt

SEQ ID NO: 756 - DNA, 15 bp, Homo sapiens
taatgtttcaatttt

SEQ ID NO: 757 - DNA, 15 bp, Homo sapiens
ctaatgtttcaattt

SEQ ID NO: 758 - DNA, 15 bp, Homo sapiens
actaatgtttcaatt

SEQ ID NO: 759 - DNA, 15 bp, Homo sapiens
aactaatgtttcaat

SEQ ID NO: 760 - DNA, 15 bp, Homo sapiens
aaactaatgtttcaa

SEQ ID NO: 761 - DNA, 15 bp, Homo sapiens
aaaactaatgtttca

SEQ ID NO: 762 - DNA, 15 bp, Homo sapiens
caaaactaatgtttc

SEQ ID NO: 763 - DNA, 15 bp, Homo sapiens
acaaaactaatgttt

SEQ ID NO: 764 - DNA, 15 bp, Homo sapiens
gacaaaactaatgtt

SEQ ID NO: 765 - DNA, 15 bp, Homo sapiens
agacaaaactaatgt

SEQ ID NO: 766 - DNA, 15 bp, Homo sapiens
aagacaaaactaatg

SEQ ID NO: 767 - DNA, 15 bp, Homo sapiens
aaagacaaaactaat

SEQ ID NO: 768 - DNA, 15 bp, Homo sapiens
taaagacaaaactaa

SEQ ID NO: 769 - DNA, 15 bp, Homo sapiens
ttaaagacaaaacta

SEQ ID NO: 770 - DNA, 15 bp, Homo sapiens
cttaaagacaaaact

SEQ ID NO: 771 - DNA, 15 bp, Homo sapiens
ccttaaagacaaaac

SEQ ID NO: 772 - DNA, 15 bp, Homo sapiens
gccttaaagacaaaa

SEQ ID NO: 773 - DNA, 15 bp, Homo sapiens
agccttaaagacaaa

SEQ ID NO: 774 - DNA, 15 bp, Homo sapiens
cagccttaaagacaa

SEQ ID NO: 775 - DNA, 15 bp, Homo sapiens
acagccttaaagaca

SEQ ID NO: 776 - DNA, 15 bp, Homo sapiens
gacagccttaaagac

SEQ ID NO: 777 - DNA, 15 bp, Homo sapiens
tgacagccttaaaga

SEQ ID NO: 778 - DNA, 15 bp, Homo sapiens
gtgacagccttaaag

SEQ ID NO: 779 - DNA, 15 bp, Homo sapiens
ggtgacagccttaaa

SEQ ID NO: 780 - DNA, 15 bp, Homo sapiens
aggtgacagccttaa

SEQ ID NO: 781 - DNA, 15 bp, Homo sapiens
aaggtgacagcctta

SEQ ID NO: 782 - DNA, 15 bp, Homo sapiens
taaggtgacagcctt

SEQ ID NO: 783 - DNA, 15 bp, Homo sapiens
ataaggtgacagcct

SEQ ID NO: 784 - DNA, 15 bp, Homo sapiens
cataaggtgacagcc

SEQ ID NO: 785 - DNA, 15 bp, Homo sapiens
acataaggtgacagc

SEQ ID NO: 786 - DNA, 15 bp, Homo sapiens
aacataaggtgacag

SEQ ID NO: 787 - DNA, 15 bp, Homo sapiens
aaacataaggtgaca

SEQ ID NO: 788 - DNA, 15 bp, Homo sapiens
taaacataaggtgac

SEQ ID NO: 789 - DNA, 15 bp, Homo sapiens
ataaacataaggtga

SEQ ID NO: 790 - DNA, 15 bp, Homo sapiens
aataaacataaggtg

SEQ ID NO: 791 - DNA, 15 bp, Homo sapiens
aaataaacataaggt

SEQ ID NO: 792 - DNA, 15 bp, Homo sapiens
aaaataaacataagg

SEQ ID NO: 793 - DNA, 15 bp, Homo sapiens
aaaaataaacataag

SEQ ID NO: 794 - DNA, 15 bp, Homo sapiens
aaaaaataaacataa

SEQ ID NO: 795 - DNA, 15 bp, Homo sapiens
taaaaaataaacata

SEQ ID NO: 796 - DNA, 15 bp, Homo sapiens
ttaaaaaataaacat

SEQ ID NO: 797 - DNA, 15 bp, Homo sapiens
tttaaaaaataaaca

SEQ ID NO: 798 - DNA, 15 bp, Homo sapiens
gtttaaaaaataaac

SEQ ID NO: 799 - DNA, 15 bp, Homo sapiens
tgtttaaaaaataaa

SEQ ID NO: 800 - DNA, 15 bp, Homo sapiens
gtgtttaaaaaataa

SEQ ID NO: 801 - DNA, 15 bp, Homo sapiens
ggtgtttaaaaaata

SEQ ID NO: 802 - DNA, 15 bp, Homo sapiens
aggtgtttaaaaaat

SEQ ID NO: 803 - DNA, 15 bp, Homo sapiens
aaggtgtttaaaaaa

SEQ ID NO: 804 - DNA, 15 bp, Homo sapiens
taaggtgtttaaaaa

SEQ ID NO: 805 - DNA, 15 bp, Homo sapiens
ataaggtgtttaaaa

SEQ ID NO: 806 - DNA, 15 bp, Homo sapiens
cataaggtgtttaaa

SEQ ID NO: 807 - DNA, 15 bp, Homo sapiens
acataaggtgtttaa

SEQ ID NO: 808 - DNA, 15 bp, Homo sapiens
aacataaggtgttta

SEQ ID NO: 809 - DNA, 15 bp, Homo sapiens
aaacataaggtgttt

SEQ ID NO: 810 - DNA, 15 bp, Homo sapiens
taaacataaggtgtt

SEQ ID NO: 811 - DNA, 15 bp, Homo sapiens
ataaacataaggtgt

SEQ ID NO: 812 - DNA, 15 bp, Homo sapiens
gaaataaacataagg

SEQ ID NO: 813 - DNA, 15 bp, Homo sapiens
tgaaataaacataag

SEQ ID NO: 814 - DNA, 15 bp, Homo sapiens
atgaaataaacataa

SEQ ID NO: 815 - DNA, 15 bp, Homo sapiens
tatgaaataaacata

SEQ ID NO: 816 - DNA, 15 bp, Homo sapiens
gtatgaaataaacat

SEQ ID NO: 817 - DNA, 15 bp, Homo sapiens
tgtatgaaataaaca

SEQ ID NO: 818 - DNA, 15 bp, Homo sapiens
gtgtatgaaataaac

SEQ ID NO: 819 - DNA, 15 bp, Homo sapiens
agtgtatgaaataaa

SEQ ID NO: 820 - DNA, 15 bp, Homo sapiens
gagtgtatgaaataa

SEQ ID NO: 821 - DNA, 15 bp, Homo sapiens
agagtgtatgaaata

SEQ ID NO: 822 - DNA, 15 bp, Homo sapiens
aagagtgtatgaaat

SEQ ID NO: 823 - DNA, 15 bp, Homo sapiens
caagagtgtatgaaa

SEQ ID NO: 824 - DNA, 15 bp, Homo sapiens
gcaagagtgtatgaa

SEQ ID NO: 825 - DNA, 15 bp, Homo sapiens
agcaagagtgtatga

SEQ ID NO: 826 - DNA, 15 bp, Homo sapiens
aagcaagagtgtatg

SEQ ID NO: 827 - DNA, 15 bp, Homo sapiens
caagcaagagtgtat

SEQ ID NO: 828 - DNA, 15 bp, Homo sapiens
ccaagcaagagtgta

SEQ ID NO: 829 - DNA, 15 bp, Homo sapiens
accaagcaagagtgt

SEQ ID NO: 830 - DNA, 15 bp, Homo sapiens
caccaagcaagagtg

SEQ ID NO: 831 - DNA, 15 bp, Homo sapiens
ccaccaagcaagagt

SEQ ID NO: 832 - DNA, 15 bp, Homo sapiens
accaccaagcaagag

SEQ ID NO: 833 - DNA, 15 bp, Homo sapiens
gaccaccaagcaaga

SEQ ID NO: 834 - DNA, 15 bp, Homo sapiens
ggaccaccaagcaag

SEQ ID NO: 835 - DNA, 15 bp, Homo sapiens
tggaccaccaagcaa

SEQ ID NO: 836 - DNA, 15 bp, Homo sapiens
atggaccaccaagca

SEQ ID NO: 837 - DNA, 15 bp, Homo sapiens
tatggaccaccaagc

SEQ ID NO: 838 - DNA, 15 bp, Homo sapiens
atatggaccaccaag

SEQ ID NO: 839 - DNA, 15 bp, Homo sapiens
catatggaccaccaa

SEQ ID NO: 840 - DNA, 15 bp, Homo sapiens
tcatatggaccacca

SEQ ID NO: 841 - DNA, 15 bp, Homo sapiens
gtcatatggaccacc

SEQ ID NO: 842 - DNA, 15 bp, Homo sapiens
tgtcatatggaccac

SEQ ID NO: 843 - DNA, 15 bp, Homo sapiens
ctgtcatatggacca

SEQ ID NO: 844 - DNA, 15 bp, Homo sapiens
gctgtcatatggacc

SEQ ID NO: 845 - DNA, 15 bp, Homo sapiens
ggctgtcatatggac

SEQ ID NO: 846 - DNA, 15 bp, Homo sapiens
cggctgtcatatgga

SEQ ID NO: 847 - DNA, 15 bp, Homo sapiens
ccggctgtcatatgg

SEQ ID NO: 848 - DNA, 15 bp, Homo sapiens
tccggctgtcatatg

SEQ ID NO: 849 - DNA, 15 bp, Homo sapiens
ttccggctgtcatat

SEQ ID NO: 850 - DNA, 15 bp, Homo sapiens
cttccggctgtcata

SEQ ID NO: 851 - DNA, 15 bp, Homo sapiens
gcttccggctgtcat

SEQ ID NO: 852 - DNA, 15 bp, Homo sapiens
cgcttccggctgtca

SEQ ID NO: 853 - DNA, 15 bp, Homo sapiens
acgcttccggctgtc

SEQ ID NO: 854 - DNA, 15 bp, Homo sapiens
aacgcttccggctgt

SEQ ID NO: 855 - DNA, 15 bp, Homo sapiens
gaacgcttccggctg

SEQ ID NO: 856 - DNA, 15 bp, Homo sapiens
agaacgcttccggct

SEQ ID NO: 857 - DNA, 15 bp, Homo sapiens
cagaacgcttccggc

SEQ ID NO: 858 - DNA, 15 bp, Homo sapiens
tcagaacgcttccgg

SEQ ID NO: 859 - DNA, 15 bp, Homo sapiens
ttcagaacgcttccg

SEQ ID NO: 860 - DNA, 15 bp, Homo sapiens
cttcagaacgcttcc

SEQ ID NO: 861 - DNA, 15 bp, Homo sapiens
ccttcagaacgcttc

SEQ ID NO: 862 - DNA, 15 bp, Homo sapiens
cccttcagaacgctt

SEQ ID NO: 863 - DNA, 15 bp, Homo sapiens
tcccttcagaacgct

SEQ ID NO: 864 - DNA, 15 bp, Homo sapiens
ctcccttcagaacgc

SEQ ID NO: 865 - DNA, 15 bp, Homo sapiens
tctcccttcagaacg

SEQ ID NO: 866 - DNA, 15 bp, Homo sapiens
ctctcccttcagaac

SEQ ID NO: 867 - DNA, 15 bp, Homo sapiens
actctcccttcagaa

SEQ ID NO: 868 - DNA, 15 bp, Homo sapiens
aactctcccttcaga

SEQ ID NO: 869 - DNA, 15 bp, Homo sapiens
taactctcccttcag

SEQ ID NO: 870 - DNA, 15 bp, Homo sapiens
ctaactctcccttca

SEQ ID NO: 871 - DNA, 15 bp, Homo sapiens
actaactctcccttc

SEQ ID NO: 872 - DNA, 15 bp, Homo sapiens
cactaactctccctt

SEQ ID NO: 873 - DNA, 15 bp, Homo sapiens
tcactaactctccct

SEQ ID NO: 874 - DNA, 15 bp, Homo sapiens
ttcactaactctccc

SEQ ID NO: 875 - DNA, 15 bp, Homo sapiens
attcactaactctcc

SEQ ID NO: 876 - DNA, 15 bp, Homo sapiens
tattcactaactctc

SEQ ID NO: 877 - DNA, 15 bp, Homo sapiens
atattcactaactct

SEQ ID NO: 878 - DNA, 15 bp, Homo sapiens
gatattcactaactc

SEQ ID NO: 879 - DNA, 15 bp, Homo sapiens
cgatattcactaact

SEQ ID NO: 880 - DNA, 15 bp, Homo sapiens
tcgatattcactaac

SEQ ID NO: 881 - DNA, 15 bp, Homo sapiens
gtcgatattcactaa

SEQ ID NO: 882 - DNA, 15 bp, Homo sapiens
agtcgatattcacta

SEQ ID NO: 883 - DNA, 15 bp, Homo sapiens
aagtcgatattcact

SEQ ID NO: 884 - DNA, 15 bp, Homo sapiens
caagtcgatattcac

SEQ ID NO: 885 - DNA, 15 bp, Homo sapiens
tcaagtcgatattca

SEQ ID NO: 886 - DNA, 15 bp, Homo sapiens
gtcaagtcgatattc

SEQ ID NO: 887 - DNA, 15 bp, Homo sapiens
agtcaagtcgatatt

SEQ ID NO: 888 - DNA, 15 bp, Homo sapiens
cagtcaagtcgatat

SEQ ID NO: 889 - DNA, 15 bp, Homo sapiens
ccagtcaagtcgata

SEQ ID NO: 890 - DNA, 15 bp, Homo sapiens
tccagtcaagtcgat

SEQ ID NO: 891 - DNA, 15 bp, Homo sapiens
atccagtcaagtcga

SEQ ID NO: 892 - DNA, 15 bp, Homo sapiens
aatccagtcaagtcg

SEQ ID NO: 893 - DNA, 15 bp, Homo sapiens
caatccagtcaagtc

SEQ ID NO: 894 - DNA, 15 bp, Homo sapiens
ccaatccagtcaagt

SEQ ID NO: 895 - DNA, 15 bp, Homo sapiens
accaatccagtcaag

SEQ ID NO: 896 - DNA, 15 bp, Homo sapiens
aaccaatccagtcaa

SEQ ID NO: 897 - DNA, 15 bp, Homo sapiens
aaaccaatccagtca

SEQ ID NO: 898 - DNA, 15 bp, Homo sapiens
gaaaccaatccagtc

SEQ ID NO: 899 - DNA, 15 bp, Homo sapiens
tgaaaccaatccagt

SEQ ID NO: 900 - DNA, 15 bp, Homo sapiens
ctgaaaccaatccag

SEQ ID NO: 901 - DNA, 15 bp, Homo sapiens
actgaaaccaatcca

SEQ ID NO: 902 - DNA, 15 bp, Homo sapiens
tactgaaaccaatcc

SEQ ID NO: 903 - DNA, 15 bp, Homo sapiens
ttactgaaaccaatc

SEQ ID NO: 904 - DNA, 15 bp, Homo sapiens
cttactgaaaccaat

SEQ ID NO: 905 - DNA, 15 bp, Homo sapiens
tcttactgaaaccaa

SEQ ID NO: 906 - DNA, 15 bp, Homo sapiens
ttcttactgaaacca

SEQ ID NO: 907 - DNA, 15 bp, Homo sapiens
gttcttactgaaacc

SEQ ID NO: 908 - DNA, 15 bp, Homo sapiens
tgttcttactgaaac

SEQ ID NO: 909 - DNA, 15 bp, Homo sapiens
atgttcttactgaaa

SEQ ID NO: 910 - DNA, 15 bp, Homo sapiens
gatgttcttactgaa

SEQ ID NO: 911 - DNA, 15 bp, Homo sapiens
agatgttcttactga

SEQ ID NO: 912 - DNA, 15 bp, Homo sapiens
cagatgttcttactg

SEQ ID NO: 913 - DNA, 15 bp, Homo sapiens
ccagatgttcttact

SEQ ID NO: 914 - DNA, 15 bp, Homo sapiens
gccagatgttcttac

SEQ ID NO: 915 - DNA, 15 bp, Homo sapiens
agccagatgttctta

SEQ ID NO: 916 - DNA, 15 bp, Homo sapiens
aagccagatgttctt

SEQ ID NO: 917 - DNA, 15 bp, Homo sapiens
aaagccagatgttct

SEQ ID NO: 918 - DNA, 15 bp, Homo sapiens
aaaagccagatgttc

SEQ ID NO: 919 - DNA, 15 bp, Homo sapiens
taaaagccagatgtt

SEQ ID NO: 920 - DNA, 15 bp, Homo sapiens
gtaaaagccagatgt

SEQ ID NO: 921 - DNA, 15 bp, Homo sapiens
tgtaaaagccagatg

SEQ ID NO: 922 - DNA, 15 bp, Homo sapiens
ctgtaaaagccagat

SEQ ID NO: 923 - DNA, 15 bp, Homo sapiens
tctgtaaaagccaga

SEQ ID NO: 924 - DNA, 15 bp, Homo sapiens
ttctgtaaaagccag

SEQ ID NO: 925 - DNA, 15 bp, Homo sapiens
attctgtaaaagcca

SEQ ID NO: 926 - DNA, 15 bp, Homo sapiens
tattctgtaaaagcc

SEQ ID NO: 927 - DNA, 15 bp, Homo sapiens
atattctgtaaaagc

SEQ ID NO: 928 - DNA, 15 bp, Homo sapiens
gatattctgtaaaag

SEQ ID NO: 929 - DNA, 15 bp, Homo sapiens
tgatattctgtaaaa

SEQ ID NO: 930 - DNA, 15 bp, Homo sapiens
atgatattctgtaaa

SEQ ID NO: 931 - DNA, 15 bp, Homo sapiens
aatgatattctgtaa

SEQ ID NO: 932 - DNA, 15 bp, Homo sapiens
aaatgatattctgta

SEQ ID NO: 933 - DNA, 15 bp, Homo sapiens
caaatgatattctgt

SEQ ID NO: 934 - DNA, 15 bp, Homo sapiens
tcaaatgatattctg

SEQ ID NO: 935 - DNA, 15 bp, Homo sapiens
ctcaaatgatattct

SEQ ID NO: 936 - DNA, 15 bp, Homo sapiens
cctcaaatgatattc

SEQ ID NO: 937 - DNA, 15 bp, Homo sapiens
ccctcaaatgatatt

SEQ ID NO: 938 - DNA, 15 bp, Homo sapiens
tccctcaaatgatat

SEQ ID NO: 939 - DNA, 15 bp, Homo sapiens
ttccctcaaatgata

SEQ ID NO: 940 - DNA, 15 bp, Homo sapiens
cttccctcaaatgat

SEQ ID NO: 941 - DNA, 15 bp, Homo sapiens
ccttccctcaaatga

SEQ ID NO: 942 - DNA, 15 bp, Homo sapiens
cccttccctcaaatg

SEQ ID NO: 943 - DNA, 15 bp, Homo sapiens
tcccttccctcaaat

SEQ ID NO: 944 - DNA, 15 bp, Homo sapiens
ttcccttccctcaaa

SEQ ID NO: 945 - DNA, 15 bp, Homo sapiens
tttcccttccctcaa

SEQ ID NO: 946 - DNA, 15 bp, Homo sapiens
atttcccttccctca

SEQ ID NO: 947 - DNA, 15 bp, Homo sapiens
gatttcccttccctc

SEQ ID NO: 948 - DNA, 15 bp, Homo sapiens
agatttcccttccct

SEQ ID NO: 949 - DNA, 15 bp, Homo sapiens
tagatttcccttccc

SEQ ID NO: 950 - DNA, 15 bp, Homo sapiens
ctagatttcccttcc

SEQ ID NO: 951 - DNA, 15 bp, Homo sapiens
cctagatttcccttc

SEQ ID NO: 952 - DNA, 15 bp, Homo sapiens
ccctagatttccctt

SEQ ID NO: 953 - DNA, 15 bp, Homo sapiens
gccctagatttccct

SEQ ID NO: 954 - DNA, 15 bp, Homo sapiens
tgccctagatttccc

SEQ ID NO: 955 - DNA, 15 bp, Homo sapiens
ctgccctagatttcc

SEQ ID NO: 956 - DNA, 15 bp, Homo sapiens
tctgccctagatttc

SEQ ID NO: 957 - DNA, 15 bp, Homo sapiens
ctctgccctagattt

SEQ ID NO: 958 - DNA, 15 bp, Homo sapiens
cctctgccctagatt

SEQ ID NO: 959 - DNA, 15 bp, Homo sapiens
acctctgccctagat

SEQ ID NO: 960 - DNA, 15 bp, Homo sapiens
tacctctgccctaga

SEQ ID NO: 961 - DNA, 15 bp, Homo sapiens
ttacctctgccctag

SEQ ID NO: 962 - DNA, 15 bp, Homo sapiens
gttacctctgcccta

SEQ ID NO: 963 - DNA, 15 bp, Homo sapiens
tgttacctctgccct

SEQ ID NO: 964 - DNA, 15 bp, Homo sapiens
ttgttacctctgccc

SEQ ID NO: 965 - DNA, 15 bp, Homo sapiens
attgttacctctgcc

SEQ ID NO: 966 - DNA, 15 bp, Homo sapiens
tattgttacctctgc

SEQ ID NO: 967 - DNA, 15 bp, Homo sapiens
ttattgttacctctg

SEQ ID NO: 968 - DNA, 15 bp, Homo sapiens
tttattgttacctct

SEQ ID NO: 969 - DNA, 15 bp, Homo sapiens
atttattgttacctc

SEQ ID NO: 970 - DNA, 15 bp, Homo sapiens
aatttattgttacct

SEQ ID NO: 971 - DNA, 15 bp, Homo sapiens
caatttattgttacc

SEQ ID NO: 972 - DNA, 15 bp, Homo sapiens
gcaatttattgttac

SEQ ID NO: 973 - DNA, 15 bp, Homo sapiens
tgcaatttattgtta

SEQ ID NO: 974 - DNA, 15 bp, Homo sapiens
atgcaatttattgtt

SEQ ID NO: 975 - DNA, 15 bp, Homo sapiens
aatgcaatttattgt

SEQ ID NO: 976 - DNA, 15 bp, Homo sapiens
aaatgcaatttattg

SEQ ID NO: 977 - DNA, 15 bp, Homo sapiens
caaatgcaatttatt

SEQ ID NO: 978 - DNA, 15 bp, Homo sapiens
acaaatgcaatttat

SEQ ID NO: 979 - DNA, 15 bp, Homo sapiens
tacaaatgcaattta

SEQ ID NO: 980 - DNA, 15 bp, Homo sapiens
atacaaatgcaattt

SEQ ID NO: 981 - DNA, 15 bp, Homo sapiens
tatacaaatgcaatt

SEQ ID NO: 982 - DNA, 15 bp, Homo sapiens
ctatacaaatgcaat

SEQ ID NO: 983 - DNA, 15 bp, Homo sapiens
cctatacaaatgcaa

SEQ ID NO: 984 - DNA, 15 bp, Homo sapiens
ccctatacaaatgca

SEQ ID NO: 985 - DNA, 15 bp, Homo sapiens
gccctatacaaatgc

SEQ ID NO: 986 - DNA, 15 bp, Homo sapiens
agccctatacaaatg

SEQ ID NO: 987 - DNA, 15 bp, Homo sapiens
aagccctatacaaat

SEQ ID NO: 988 - DNA, 15 bp, Homo sapiens
caagccctatacaaa

SEQ ID NO: 989 - DNA, 15 bp, Homo sapiens
tcaagccctatacaa

SEQ ID NO: 990 - DNA, 15 bp, Homo sapiens
ttcaagccctataca

SEQ ID NO: 991 - DNA, 15 bp, Homo sapiens
cttcaagccctatac

SEQ ID NO: 992 - DNA, 15 bp, Homo sapiens
gcttcaagccctata

SEQ ID NO: 993 - DNA, 15 bp, Homo sapiens
agcttcaagccctat

SEQ ID NO: 994 - DNA, 15 bp, Homo sapiens
aagcttcaagcccta

SEQ ID NO: 995 - DNA, 15 bp, Homo sapiens
gaagcttcaagccct

SEQ ID NO: 996 - DNA, 15 bp, Homo sapiens
agaagcttcaagccc

SEQ ID NO: 997 - DNA, 15 bp, Homo sapiens
tagaagcttcaagcc

SEQ ID NO: 998 - DNA, 15 bp, Homo sapiens
ttagaagcttcaagc

SEQ ID NO: 999 - DNA, 15 bp, Homo sapiens
tttagaagcttcaag

SEQ ID NO: 1000 - DNA, 15 bp, Homo sapiens
ctttagaagcttcaa

SEQ ID NO: 1001 - DNA, 15 bp, Homo sapiens
gctttagaagcttca

SEQ ID NO: 1002 - DNA, 15 bp, Homo sapiens
tgctttagaagcttc

SEQ ID NO: 1003 - DNA, 15 bp, Homo sapiens
ttgctttagaagctt

SEQ ID NO: 1004 - DNA, 15 bp, Homo sapiens
gttgctttagaagct

SEQ ID NO: 1005 - DNA, 15 bp, Homo sapiens
tgttgctttagaagc

SEQ ID NO: 1006 - DNA, 15 bp, Homo sapiens
atgttgctttagaag

SEQ ID NO: 1007 - DNA, 15 bp, Homo sapiens
gatgttgctttagaa

SEQ ID NO: 1008 - DNA, 15 bp, Homo sapiens
agatgttgctttaga

SEQ ID NO: 1009 - DNA, 15 bp, Homo sapiens
gagatgttgctttag

SEQ ID NO: 1010 - DNA, 15 bp, Homo sapiens
tgagatgttgcttta

SEQ ID NO: 1011 - DNA, 15 bp, Homo sapiens
atgagatgttgcttt

SEQ ID NO: 1012 - DNA, 15 bp, Homo sapiens
aatgagatgttgctt

SEQ ID NO: 1013 - DNA, 15 bp, Homo sapiens
gaatgagatgttgct

SEQ ID NO: 1014 - DNA, 15 bp, Homo sapiens
tgaatgagatgttgc

SEQ ID NO: 1015 - DNA, 15 bp, Homo sapiens
atgaatgagatgttg

SEQ ID NO: 1016 - DNA, 15 bp, Homo sapiens
aatgaatgagatgtt

SEQ ID NO: 1017 - DNA, 15 bp, Homo sapiens
caatgaatgagatgt

SEQ ID NO: 1018 - DNA, 15 bp, Homo sapiens
tcaatgaatgagatg

SEQ ID NO: 1019 - DNA, 15 bp, Homo sapiens
atcaatgaatgagat

SEQ ID NO: 1020 - DNA, 15 bp, Homo sapiens
aatcaatgaatgaga

SEQ ID NO: 1021 - DNA, 15 bp, Homo sapiens
gaatcaatgaatgag

SEQ ID NO: 1022 - DNA, 15 bp, Homo sapiens
agaatcaatgaatga

SEQ ID NO: 1023 - DNA, 15 bp, Homo sapiens
gagaatcaatgaatg

SEQ ID NO: 1024 - DNA, 15 bp, Homo sapiens
tgagaatcaatgaat

SEQ ID NO: 1025 - DNA, 15 bp, Homo sapiens
ctgagaatcaatgaa

SEQ ID NO: 1026 - DNA, 15 bp, Homo sapiens
actgagaatcaatga

SEQ ID NO: 1027 - DNA, 15 bp, Homo sapiens
aactgagaatcaatg

SEQ ID NO: 1028 - DNA, 15 bp, Homo sapiens
aaactgagaatcaat

SEQ ID NO: 1029 - DNA, 15 bp, Homo sapiens
gaaactgagaatcaa

SEQ ID NO: 1030 - DNA, 15 bp, Homo sapiens
agaaactgagaatca

SEQ ID NO: 1031 - DNA, 15 bp, Homo sapiens
gagaaactgagaatc

SEQ ID NO: 1032 - DNA, 15 bp, Homo sapiens
tgagaaactgagaat

SEQ ID NO: 1033 - DNA, 15 bp, Homo sapiens
gtgagaaactgagaa

SEQ ID NO: 1034 - DNA, 15 bp, Homo sapiens
ggtgagaaactgaga

SEQ ID NO: 1035 - DNA, 15 bp, Homo sapiens
aggtgagaaactgag

SEQ ID NO: 1036 - DNA, 15 bp, Homo sapiens
taggtgagaaactga

SEQ ID NO: 1037 - DNA, 15 bp, Homo sapiens
ctaggtgagaaactg

SEQ ID NO: 1038 - DNA, 15 bp, Homo sapiens
gctaggtgagaaact

SEQ ID NO: 1039 - DNA, 15 bp, Homo sapiens
ggctaggtgagaaac

SEQ ID NO: 1040 - DNA, 15 bp, Homo sapiens
aggctaggtgagaaa

SEQ ID NO: 1041 - DNA, 15 bp, Homo sapiens
aaggctaggtgagaa

SEQ ID NO: 1042 - DNA, 15 bp, Homo sapiens
gaaggctaggtgaga

SEQ ID NO: 1043 - DNA, 15 bp, Homo sapiens
agaaggctaggtgag

SEQ ID NO: 1044 - DNA, 15 bp, Homo sapiens
cagaaggctaggtga

SEQ ID NO: 1045 - DNA, 15 bp, Homo sapiens
acagaaggctaggtg

SEQ ID NO: 1046 - DNA, 15 bp, Homo sapiens
cacagaaggctaggt

SEQ ID NO: 1047 - DNA, 15 bp, Homo sapiens
tcacagaaggctagg

SEQ ID NO: 1048 - DNA, 15 bp, Homo sapiens
ttcacagaaggctag

SEQ ID NO: 1049 - DNA, 15 bp, Homo sapiens
cttcacagaaggcta

SEQ ID NO: 1050 - DNA, 15 bp, Homo sapiens
tcttcacagaaggct

SEQ ID NO: 1051 - DNA, 15 bp, Homo sapiens
atcttcacagaaggc

SEQ ID NO: 1052 - DNA, 15 bp, Homo sapiens
catcttcacagaagg

SEQ ID NO: 1053 - DNA, 15 bp, Homo sapiens
ccatcttcacagaag

SEQ ID NO: 1054 - DNA, 15 bp, Homo sapiens
accatcttcacagaa

SEQ ID NO: 1055 - DNA, 15 bp, Homo sapiens
caccatcttcacaga

SEQ ID NO: 1056 - DNA, 15 bp, Homo sapiens
acaccatcttcacag

SEQ ID NO: 1057 - DNA, 15 bp, Homo sapiens
aacaccatcttcaca

SEQ ID NO: 1058 - DNA, 15 bp, Homo sapiens
gaacaccatcttcac

SEQ ID NO: 1059 - DNA, 15 bp, Homo sapiens
ggaacaccatcttca

SEQ ID NO: 1060 - DNA, 15 bp, Homo sapiens
gggaacaccatcttc

SEQ ID NO: 1061 - DNA, 15 bp, Homo sapiens
agggaacaccatctt

SEQ ID NO: 1062 - DNA, 15 bp, Homo sapiens
gagggaacaccatct

SEQ ID NO: 1063 - DNA, 15 bp, Homo sapiens
ggagggaacaccatc

SEQ ID NO: 1064 - DNA, 15 bp, Homo sapiens
tggagggaacaccat

SEQ ID NO: 1065 - DNA, 15 bp, Homo sapiens
atggagggaacacca

SEQ ID NO: 1066 - DNA, 15 bp, Homo sapiens
aatggagggaacacc

SEQ ID NO: 1067 - DNA, 15 bp, Homo sapiens
aaatggagggaacac

SEQ ID NO: 1068 - DNA, 15 bp, Homo sapiens
aaaatggagggaaca

SEQ ID NO: 1069 - DNA, 15 bp, Homo sapiens
taaaatggagggaac

SEQ ID NO: 1070 - DNA, 15 bp, Homo sapiens
ataaaatggagggaa

SEQ ID NO: 1071 - DNA, 15 bp, Homo sapiens
tataaaatggaggga

SEQ ID NO: 1072 - DNA, 15 bp, Homo sapiens
ctataaaatggaggg

SEQ ID NO: 1073 - DNA, 15 bp, Homo sapiens
cctataaaatggagg

SEQ ID NO: 1074 - DNA, 15 bp, Homo sapiens
acctataaaatggag

SEQ ID NO: 1075 - DNA, 15 bp, Homo sapiens
cacctataaaatgga

SEQ ID NO: 1076 - DNA, 15 bp, Homo sapiens
acacctataaaatgg

SEQ ID NO: 1077 - DNA, 15 bp, Homo sapiens
cacacctataaaatg

SEQ ID NO: 1078 - DNA, 15 bp, Homo sapiens
ccacacctataaaat

SEQ ID NO: 1079 - DNA, 15 bp, Homo sapiens
tccacacctataaaa

SEQ ID NO: 1080 - DNA, 15 bp, Homo sapiens
ttccacacctataaa

SEQ ID NO: 1081 - DNA, 15 bp, Homo sapiens
cttccacacctataa

SEQ ID NO: 1082 - DNA, 15 bp, Homo sapiens
tcttccacacctata

SEQ ID NO: 1083 - DNA, 15 bp, Homo sapiens
gtcttccacacctat

SEQ ID NO: 1084 - DNA, 15 bp, Homo sapiens
cgtcttccacaccta

SEQ ID NO: 1085 - DNA, 15 bp, Homo sapiens
ccgtcttccacacct

SEQ ID NO: 1086 - DNA, 15 bp, Homo sapiens
tccgtcttccacacc

SEQ ID NO: 1087 - DNA, 15 bp, Homo sapiens
ctccgtcttccacac

SEQ ID NO: 1088 - DNA, 15 bp, Homo sapiens
cctccgtcttccaca

SEQ ID NO: 1089 - DNA, 15 bp, Homo sapiens
ccctccgtcttccac

SEQ ID NO: 1090 - DNA, 15 bp, Homo sapiens
accctccgtcttcca

SEQ ID NO: 1091 - DNA, 15 bp, Homo sapiens
gaccctccgtcttcc

SEQ ID NO: 1092 - DNA, 15 bp, Homo sapiens
tgaccctccgtcttc

SEQ ID NO: 1093 - DNA, 15 bp, Homo sapiens
gtgaccctccgtctt

SEQ ID NO: 1094 - DNA, 15 bp, Homo sapiens
tgtgaccctccgtct

SEQ ID NO: 1095 - DNA, 15 bp, Homo sapiens
gtgtgaccctccgtc

SEQ ID NO: 1096 - DNA, 15 bp, Homo sapiens
agtgtgaccctccgt

SEQ ID NO: 1097 - DNA, 15 bp, Homo sapiens
cagtgtgaccctccg

SEQ ID NO: 1098 - DNA, 15 bp, Homo sapiens
ccagtgtgaccctcc

SEQ ID NO: 1099 - DNA, 15 bp, Homo sapiens
cccagtgtgaccctc

SEQ ID NO: 1100 - DNA, 15 bp, Homo sapiens
tcccagtgtgaccct

SEQ ID NO: 1101 - DNA, 15 bp, Homo sapiens
atcccagtgtgaccc

SEQ ID NO: 1102 - DNA, 15 bp, Homo sapiens
catcccagtgtgacc

SEQ ID NO: 1103 - DNA, 15 bp, Homo sapiens
gcatcccagtgtgac

SEQ ID NO: 1104 - DNA, 15 bp, Homo sapiens
tgcatcccagtgtga

SEQ ID NO: 1105 - DNA, 15 bp, Homo sapiens
atgcatcccagtgtg

SEQ ID NO: 1106 - DNA, 15 bp, Homo sapiens
aatgcatcccagtgt

SEQ ID NO: 1107 - DNA, 15 bp, Homo sapiens
caatgcatcccagtg

SEQ ID NO: 1108 - DNA, 15 bp, Homo sapiens
acaatgcatcccagt

SEQ ID NO: 1109 - DNA, 15 bp, Homo sapiens
aacaatgcatcccag

SEQ ID NO: 1110 - DNA, 15 bp, Homo sapiens
gaacaatgcatccca

SEQ ID NO: 1111 - DNA, 15 bp, Homo sapiens
cgaacaatgcatccc

SEQ ID NO: 1112 - DNA, 15 bp, Homo sapiens
acgaacaatgcatcc

SEQ ID NO: 1113 - DNA, 15 bp, Homo sapiens
cacgaacaatgcatc

SEQ ID NO: 1114 - DNA, 15 bp, Homo sapiens
ccacgaacaatgcat

SEQ ID NO: 1115 - DNA, 15 bp, Homo sapiens
accacgaacaatgca

SEQ ID NO: 1116 - DNA, 15 bp, Homo sapiens
caccacgaacaatgc

SEQ ID NO: 1117 - DNA, 15 bp, Homo sapiens
tcaccacgaacaatg

SEQ ID NO: 1118 - DNA, 15 bp, Homo sapiens
ttcaccacgaacaat

SEQ ID NO: 1119 - DNA, 15 bp, Homo sapiens
tttcaccacgaacaa

SEQ ID NO: 1120 - DNA, 15 bp, Homo sapiens
gtttcaccacgaaca

SEQ ID NO: 1121 - DNA, 15 bp, Homo sapiens
agtttcaccacgaac

SEQ ID NO: 1122 - DNA, 15 bp, Homo sapiens
aagtttcaccacgaa

SEQ ID NO: 1123 - DNA, 15 bp, Homo sapiens
aaagtttcaccacga

SEQ ID NO: 1124 - DNA, 15 bp, Homo sapiens
caaagtttcaccacg

SEQ ID NO: 1125 - DNA, 15 bp, Homo sapiens
tcaaagtttcaccac

SEQ ID NO: 1126 - DNA, 15 bp, Homo sapiens
atcaaagtttcacca

SEQ ID NO: 1127 - DNA, 15 bp, Homo sapiens
aatcaaagtttcacc

SEQ ID NO: 1128 - DNA, 15 bp, Homo sapiens
gaatcaaagtttcac

SEQ ID NO: 1129 - DNA, 15 bp, Homo sapiens
agaatcaaagtttca

SEQ ID NO: 1130 - DNA, 15 bp, Homo sapiens
cagaatcaaagtttc

SEQ ID NO: 1131 - DNA, 15 bp, Homo sapiens
acagaatcaaagttt

SEQ ID NO: 1132 - DNA, 15 bp, Homo sapiens
gacagaatcaaagtt

SEQ ID NO: 1133 - DNA, 15 bp, Homo sapiens
agacagaatcaaagt

SEQ ID NO: 1134 - DNA, 15 bp, Homo sapiens
gagacagaatcaaag

SEQ ID NO: 1135 - DNA, 15 bp, Homo sapiens
ggagacagaatcaaa

SEQ ID NO: 1136 - DNA, 15 bp, Homo sapiens
aggagacagaatcaa

SEQ ID NO: 1137 - DNA, 15 bp, Homo sapiens
caggagacagaatca

SEQ ID NO: 1138 - DNA, 15 bp, Homo sapiens
tcaggagacagaatc

SEQ ID NO: 1139 - DNA, 15 bp, Homo sapiens
ctcaggagacagaat

SEQ ID NO: 1140 - DNA, 15 bp, Homo sapiens
tctcaggagacagaa

SEQ ID NO: 1141 - DNA, 15 bp, Homo sapiens
ttctcaggagacaga

SEQ ID NO: 1142 - DNA, 15 bp, Homo sapiens
gttctcaggagacag

SEQ ID NO: 1143 - DNA, 15 bp, Homo sapiens
ggttctcaggagaca

SEQ ID NO: 1144 - DNA, 15 bp, Homo sapiens
tggttctcaggagac

SEQ ID NO: 1145 - DNA, 15 bp, Homo sapiens
ttggttctcaggaga

SEQ ID NO: 1146 - DNA, 15 bp, Homo sapiens
tttggttctcaggag

SEQ ID NO: 1147 - DNA, 15 bp, Homo sapiens
ctttggttctcagga

SEQ ID NO: 1148 - DNA, 15 bp, Homo sapiens
tctttggttctcagg

SEQ ID NO: 1149 - DNA, 15 bp, Homo sapiens
atctttggttctcag

SEQ ID NO: 1150 - DNA, 15 bp, Homo sapiens
aatctttggttctca

SEQ ID NO: 1151 - DNA, 15 bp, Homo sapiens
gaatctttggttctc

SEQ ID NO: 1152 - DNA, 15 bp, Homo sapiens
agaatctttggttct

SEQ ID NO: 1153 - DNA, 15 bp, Homo sapiens
cagaatctttggttc

SEQ ID NO: 1154 - DNA, 15 bp, Homo sapiens
gcagaatctttggtt

SEQ ID NO: 1155 - DNA, 15 bp, Homo sapiens
tgcagaatctttggt

SEQ ID NO: 1156 - DNA, 15 bp, Homo sapiens
atgcagaatctttgg

SEQ ID NO: 1157 - DNA, 15 bp, Homo sapiens
aatgcagaatctttg

SEQ ID NO: 1158 - DNA, 15 bp, Homo sapiens
aaatgcagaatcttt

SEQ ID NO: 1159 - DNA, 15 bp, Homo sapiens
caaatgcagaatctt

SEQ ID NO: 1160 - DNA, 15 bp, Homo sapiens
ccaaatgcagaatct

SEQ ID NO: 1161 - DNA, 15 bp, Homo sapiens
gccaaatgcagaatc

SEQ ID NO: 1162 - DNA, 15 bp, Homo sapiens
tgccaaatgcagaat

SEQ ID NO: 1163 - DNA, 15 bp, Homo sapiens
ttgccaaatgcagaa

SEQ ID NO: 1164 - DNA, 15 bp, Homo sapiens
attgccaaatgcaga

SEQ ID NO: 1165 - DNA, 15 bp, Homo sapiens
aattgccaaatgcag

SEQ ID NO: 1166 - DNA, 15 bp, Homo sapiens
taattgccaaatgca

SEQ ID NO: 1167 - DNA, 15 bp, Homo sapiens
ctaattgccaaatgc

SEQ ID NO: 1168 - DNA, 15 bp, Homo sapiens
tctaattgccaaatg

SEQ ID NO: 1169 - DNA, 15 bp, Homo sapiens
ttctaattgccaaat

SEQ ID NO: 1170 - DNA, 15 bp, Homo sapiens
cttctaattgccaaa

SEQ ID NO: 1171 - DNA, 15 bp, Homo sapiens
ccttctaattgccaa

SEQ ID NO: 1172 - DNA, 15 bp, Homo sapiens
tccttctaattgcca

SEQ ID NO: 1173 - DNA, 15 bp, Homo sapiens
ctccttctaattgcc

SEQ ID NO: 1174 - DNA, 15 bp, Homo sapiens
actccttctaattgc

SEQ ID NO: 1175 - DNA, 15 bp, Homo sapiens
gactccttctaattg

SEQ ID NO: 1176 - DNA, 15 bp, Homo sapiens
tgactccttctaatt

SEQ ID NO: 1177 - DNA, 15 bp, Homo sapiens
atgactccttctaat

SEQ ID NO: 1178 - DNA, 15 bp, Homo sapiens
gatgactccttctaa

SEQ ID NO: 1179 - DNA, 15 bp, Homo sapiens
ggatgactccttcta

SEQ ID NO: 1180 - DNA, 15 bp, Homo sapiens
aggatgactccttct

SEQ ID NO: 1181 - DNA, 15 bp, Homo sapiens
aaggatgactccttc

SEQ ID NO: 1182 - DNA, 15 bp, Homo sapiens
aaaggatgactcctt

SEQ ID NO: 1183 - DNA, 15 bp, Homo sapiens
caaaggatgactcct

SEQ ID NO: 1184 - DNA, 15 bp, Homo sapiens
gcaaaggatgactcc

SEQ ID NO: 1185 - DNA, 15 bp, Homo sapiens
ggcaaaggatgactc

SEQ ID NO: 1186 - DNA, 15 bp, Homo sapiens
aggcaaaggatgact

SEQ ID NO: 1187 - DNA, 15 bp, Homo sapiens
aaggcaaaggatgac

SEQ ID NO: 1188 - DNA, 15 bp, Homo sapiens
taaggcaaaggatga

SEQ ID NO: 1189 - DNA, 15 bp, Homo sapiens
ttaaggcaaaggatg

SEQ ID NO: 1190 - DNA, 15 bp, Homo sapiens
cttaaggcaaaggat

SEQ ID NO: 1191 - DNA, 15 bp, Homo sapiens
acttaaggcaaagga

SEQ ID NO: 1192 - DNA, 15 bp, Homo sapiens
cacttaaggcaaagg

SEQ ID NO: 1193 - DNA, 15 bp, Homo sapiens
acacttaaggcaaag

SEQ ID NO: 1194 - DNA, 15 bp, Homo sapiens
tacacttaaggcaaa

SEQ ID NO: 1195 - DNA, 15 bp, Homo sapiens
gtacacttaaggcaa

SEQ ID NO: 1196 - DNA, 15 bp, Homo sapiens
agtacacttaaggca

SEQ ID NO: 1197 - DNA, 15 bp, Homo sapiens
gagtacacttaaggc

SEQ ID NO: 1198 - DNA, 15 bp, Homo sapiens
tgagtacacttaagg

SEQ ID NO: 1199 - DNA, 15 bp, Homo sapiens
ttgagtacacttaag

SEQ ID NO: 1200 - DNA, 15 bp, Homo sapiens
tttgagtacacttaa

SEQ ID NO: 1201 - DNA, 15 bp, Homo sapiens
atttgagtacactta

SEQ ID NO: 1202 - DNA, 15 bp, Homo sapiens
aatttgagtacactt

SEQ ID NO: 1203 - DNA, 15 bp, Homo sapiens
gaatttgagtacact

SEQ ID NO: 1204 - DNA, 15 bp, Homo sapiens
ggaatttgagtacac

SEQ ID NO: 1205 - DNA, 15 bp, Homo sapiens
aggaatttgagtaca

SEQ ID NO: 1206 - DNA, 15 bp, Homo sapiens
gaggaatttgagtac

SEQ ID NO: 1207 - DNA, 15 bp, Homo sapiens
agaggaatttgagta

SEQ ID NO: 1208 - DNA, 15 bp, Homo sapiens
cagaggaatttgagt

SEQ ID NO: 1209 - DNA, 15 bp, Homo sapiens
ccagaggaatttgag

SEQ ID NO: 1210 - DNA, 15 bp, Homo sapiens
gccagaggaatttga

SEQ ID NO: 1211 - DNA, 15 bp, Homo sapiens
ggccagaggaatttg

SEQ ID NO: 1212 - DNA, 15 bp, Homo sapiens
tggccagaggaattt

SEQ ID NO: 1213 - DNA, 15 bp, Homo sapiens
atggccagaggaatt

SEQ ID NO: 1214 - DNA, 15 bp, Homo sapiens
aatggccagaggaat

SEQ ID NO: 1215 - DNA, 15 bp, Homo sapiens
taatggccagaggaa

SEQ ID NO: 1216 - DNA, 15 bp, Homo sapiens
ttaatggccagagga

SEQ ID NO: 1217 - DNA, 15 bp, Homo sapiens
attaatggccagagg

SEQ ID NO: 1218 - DNA, 15 bp, Homo sapiens
cattaatggccagag

SEQ ID NO: 1219 - DNA, 15 bp, Homo sapiens
ccattaatggccaga

SEQ ID NO: 1220 - DNA, 15 bp, Homo sapiens
gccattaatggccag

SEQ ID NO: 1221 - DNA, 15 bp, Homo sapiens
tgccattaatggcca

SEQ ID NO: 1222 - DNA, 15 bp, Homo sapiens
ttgccattaatggcc

SEQ ID NO: 1223 - DNA, 15 bp, Homo sapiens
cttgccattaatggc

SEQ ID NO: 1224 - DNA, 15 bp, Homo sapiens
acttgccattaatgg

SEQ ID NO: 1225 - DNA, 15 bp, Homo sapiens
tacttgccattaatg

SEQ ID NO: 1226 - DNA, 15 bp, Homo sapiens
ttacttgccattaat

SEQ ID NO: 1227 - DNA, 15 bp, Homo sapiens
gttacttgccattaa

SEQ ID NO: 1228 - DNA, 15 bp, Homo sapiens
ggttacttgccatta

SEQ ID NO: 1229 - DNA, 15 bp, Homo sapiens
aggttacttgccatt

SEQ ID NO: 1230 - DNA, 15 bp, Homo sapiens
gaggttacttgccat

SEQ ID NO: 1231 - DNA, 15 bp, Homo sapiens
tgaggttacttgcca

SEQ ID NO: 1232 - DNA, 15 bp, Homo sapiens
ctgaggttacttgcc

SEQ ID NO: 1233 - DNA, 15 bp, Homo sapiens
actgaggttacttgc

SEQ ID NO: 1234 - DNA, 15 bp, Homo sapiens
cactgaggttacttg

SEQ ID NO: 1235 - DNA, 15 bp, Homo sapiens
ccactgaggttactt

SEQ ID NO: 1236 - DNA, 15 bp, Homo sapiens
gccactgaggttact

SEQ ID NO: 1237 - DNA, 15 bp, Homo sapiens
agccactgaggttac

SEQ ID NO: 1238 - DNA, 15 bp, Homo sapiens
tagccactgaggtta

SEQ ID NO: 1239 - DNA, 15 bp, Homo sapiens
atagccactgaggtt

SEQ ID NO: 1240 - DNA, 15 bp, Homo sapiens
gatagccactgaggt

SEQ ID NO: 1241 - DNA, 15 bp, Homo sapiens
tgatagccactgagg

SEQ ID NO: 1242 - DNA, 15 bp, Homo sapiens
gtgatagccactgag

SEQ ID NO: 1243 - DNA, 15 bp, Homo sapiens
agtgatagccactga

SEQ ID NO: 1244 - DNA, 15 bp, Homo sapiens
tagtgatagccactg

SEQ ID NO: 1245 - DNA, 15 bp, Homo sapiens
atagtgatagccact

SEQ ID NO: 1246 - DNA, 15 bp, Homo sapiens
aatagtgatagccac

SEQ ID NO: 1247 - DNA, 15 bp, Homo sapiens
aaatagtgatagcca

SEQ ID NO: 1248 - DNA, 15 bp, Homo sapiens
taaatagtgatagcc

SEQ ID NO: 1249 - DNA, 15 bp, Homo sapiens
ttaaatagtgatagc

SEQ ID NO: 1250 - DNA, 15 bp, Homo sapiens
tttaaatagtgatag

SEQ ID NO: 1251 - DNA, 15 bp, Homo sapiens
atttaaatagtgata

SEQ ID NO: 1252 - DNA, 15 bp, Homo sapiens
tatttaaatagtgat

SEQ ID NO: 1253 - DNA, 15 bp, Homo sapiens
ctatttaaatagtga

SEQ ID NO: 1254 - DNA, 15 bp, Homo sapiens
gctatttaaatagtg

SEQ ID NO: 1255 - DNA, 15 bp, Homo sapiens
ggctatttaaatagt

SEQ ID NO: 1256 - DNA, 15 bp, Homo sapiens
aggctatttaaatag

SEQ ID NO: 1257 - DNA, 15 bp, Homo sapiens
aaggctatttaaata

SEQ ID NO: 1258 - DNA, 15 bp, Homo sapiens
gaaggctatttaaat

SEQ ID NO: 1259 - DNA, 15 bp, Homo sapiens
agaaggctatttaaa

SEQ ID NO: 1260 - DNA, 15 bp, Homo sapiens
cagaaggctatttaa

SEQ ID NO: 1261 - DNA, 15 bp, Homo sapiens
acagaaggctattta

SEQ ID NO: 1262 - DNA, 15 bp, Homo sapiens
aacagaaggctattt

SEQ ID NO: 1263 - DNA, 15 bp, Homo sapiens
taacagaaggctatt

SEQ ID NO: 1264 - DNA, 15 bp, Homo sapiens
ataacagaaggctat

SEQ ID NO: 1265 - DNA, 15 bp, Homo sapiens
aataacagaaggcta

SEQ ID NO: 1266 - DNA, 15 bp, Homo sapiens
gaataacagaaggct

SEQ ID NO: 1267 - DNA, 15 bp, Homo sapiens
agaataacagaaggc

SEQ ID NO: 1268 - DNA, 15 bp, Homo sapiens
aagaataacagaagg

SEQ ID NO: 1269 - DNA, 15 bp, Homo sapiens
gaagaataacagaag

SEQ ID NO: 1270 - DNA, 15 bp, Homo sapiens
agaagaataacagaa

SEQ ID NO: 1271 - DNA, 15 bp, Homo sapiens
aagaagaataacaga

SEQ ID NO: 1272 - DNA, 15 bp, Homo sapiens
aaagaagaataacag

SEQ ID NO: 1273 - DNA, 15 bp, Homo sapiens
gaaagaagaataaca

SEQ ID NO: 1274 - DNA, 15 bp, Homo sapiens
agaaagaagaataac

SEQ ID NO: 1275 - DNA, 15 bp, Homo sapiens
gagaaagaagaataa

SEQ ID NO: 1276 - DNA, 15 bp, Homo sapiens
ggagaaagaagaata

SEQ ID NO: 1277 - DNA, 15 bp, Homo sapiens
gggagaaagaagaat

SEQ ID NO: 1278 - DNA, 15 bp, Homo sapiens
ggggagaaagaagaa

SEQ ID NO: 1279 - DNA, 15 bp, Homo sapiens
tggggagaaagaaga

SEQ ID NO: 1280 - DNA, 15 bp, Homo sapiens
atggggagaaagaag

SEQ ID NO: 1281 - DNA, 15 bp, Homo sapiens
aatggggagaaagaa

SEQ ID NO: 1282 - DNA, 15 bp, Homo sapiens
aaatggggagaaaga

SEQ ID NO: 1283 - DNA, 15 bp, Homo sapiens
aaaatggggagaaag

SEQ ID NO: 1284 - DNA, 15 bp, Homo sapiens
gaaaatggggagaaa

SEQ ID NO: 1285 - DNA, 15 bp, Homo sapiens
ggaaaatggggagaa

SEQ ID NO: 1286 - DNA, 15 bp, Homo sapiens
aggaaaatggggaga

SEQ ID NO: 1287 - DNA, 15 bp, Homo sapiens
gaggaaaatggggag

SEQ ID NO: 1288 - DNA, 15 bp, Homo sapiens
agaggaaaatgggga

SEQ ID NO: 1289 - DNA, 15 bp, Homo sapiens
cagaggaaaatgggg

SEQ ID NO: 1290 - DNA, 15 bp, Homo sapiens
acagaggaaaatggg

SEQ ID NO: 1291 - DNA, 15 bp, Homo sapiens
tacagaggaaaatgg

SEQ ID NO: 1292 - DNA, 15 bp, Homo sapiens
gtacagaggaaaatg

SEQ ID NO: 1293 - DNA, 15 bp, Homo sapiens
agtacagaggaaaat

SEQ ID NO: 1294 - DNA, 15 bp, Homo sapiens
gagtacagaggaaaa

SEQ ID NO: 1295 - DNA, 15 bp, Homo sapiens
agagtacagaggaaa

SEQ ID NO: 1296 - DNA, 15 bp, Homo sapiens
cagagtacagaggaa

SEQ ID NO: 1297 - DNA, 15 bp, Homo sapiens
tcagagtacagagga

SEQ ID NO: 1298 - DNA, 15 bp, Homo sapiens
atcagagtacagagg

SEQ ID NO: 1299 - DNA, 15 bp, Homo sapiens
gatcagagtacagag

SEQ ID NO: 1300 - DNA, 15 bp, Homo sapiens
tgatcagagtacaga

SEQ ID NO: 1301 - DNA, 15 bp, Homo sapiens
gtgatcagagtacag

SEQ ID NO: 1302 - DNA, 15 bp, Homo sapiens
ggtgatcagagtaca

SEQ ID NO: 1303 - DNA, 15 bp, Homo sapiens
aggtgatcagagtac

SEQ ID NO: 1304 - DNA, 15 bp, Homo sapiens
aaggtgatcagagta

SEQ ID NO: 1305 - DNA, 15 bp, Homo sapiens
aaaggtgatcagagt

SEQ ID NO: 1306 - DNA, 15 bp, Homo sapiens
aaaaggtgatcagag

SEQ ID NO: 1307 - DNA, 15 bp, Homo sapiens
gaaaaggtgatcaga

SEQ ID NO: 1308 - DNA, 15 bp, Homo sapiens
agaaaaggtgatcag

SEQ ID NO: 1309 - DNA, 15 bp, Homo sapiens
cagaaaaggtgatca

SEQ ID NO: 1310 - DNA, 15 bp, Homo sapiens
gcagaaaaggtgatc

SEQ ID NO: 1311 - DNA, 15 bp, Homo sapiens
agcagaaaaggtgat

SEQ ID NO: 1312 - DNA, 15 bp, Homo sapiens
cagcagaaaaggtga

SEQ ID NO: 1313 - DNA, 15 bp, Homo sapiens
acagcagaaaaggtg

SEQ ID NO: 1314 - DNA, 15 bp, Homo sapiens
tacagcagaaaaggt

SEQ ID NO: 1315 - DNA, 15 bp, Homo sapiens
atacagcagaaaagg

SEQ ID NO: 1316 - DNA, 15 bp, Homo sapiens
gatacagcagaaaag

SEQ ID NO: 1317 - DNA, 15 bp, Homo sapiens
agatacagcagaaaa

SEQ ID NO: 1318 - DNA, 15 bp, Homo sapiens
aagatacagcagaaa

SEQ ID NO: 1319 - DNA, 15 bp, Homo sapiens
aaagatacagcagaa

SEQ ID NO: 1320 - DNA, 15 bp, Homo sapiens
caaagatacagcaga

SEQ ID NO: 1321 - DNA, 15 bp, Homo sapiens
gcaaagatacagcag

SEQ ID NO: 1322 - DNA, 15 bp, Homo sapiens
tgcaaagatacagca

SEQ ID NO: 1323 - DNA, 15 bp, Homo sapiens
ttgcaaagatacagc

SEQ ID NO: 1324 - DNA, 15 bp, Homo sapiens
gttgcaaagatacag

SEQ ID NO: 1325 - DNA, 15 bp, Homo sapiens
ggttgcaaagataca

SEQ ID NO: 1326 - DNA, 15 bp, Homo sapiens
aggttgcaaagatac

SEQ ID NO: 1327 - DNA, 15 bp, Homo sapiens
caggttgcaaagata

SEQ ID NO: 1328 - DNA, 15 bp, Homo sapiens
acaggttgcaaagat

SEQ ID NO: 1329 - DNA, 15 bp, Homo sapiens
tacaggttgcaaaga

SEQ ID NO: 1330 - DNA, 15 bp, Homo sapiens
ttacaggttgcaaag

SEQ ID NO: 1331 - DNA, 15 bp, Homo sapiens
cttacaggttgcaaa

SEQ ID NO: 1332 - DNA, 15 bp, Homo sapiens
ccttacaggttgcaa

SEQ ID NO: 1333 - DNA, 15 bp, Homo sapiens
cccttacaggttgca

SEQ ID NO: 1334 - DNA, 15 bp, Homo sapiens
tcccttacaggttgc

SEQ ID NO: 1335 - DNA, 15 bp, Homo sapiens
atcccttacaggttg

SEQ ID NO: 1336 - DNA, 15 bp, Homo sapiens
aatcccttacaggtt

SEQ ID NO: 1337 - DNA, 15 bp, Homo sapiens
aaatcccttacaggt

SEQ ID NO: 1338 - DNA, 15 bp, Homo sapiens
aaaatcccttacagg

SEQ ID NO: 1339 - DNA, 15 bp, Homo sapiens
gaaaatcccttacag

SEQ ID NO: 1340 - DNA, 15 bp, Homo sapiens
tgaaaatcccttaca

SEQ ID NO: 1341 - DNA, 15 bp, Homo sapiens
atgaaaatcccttac

SEQ ID NO: 1342 - DNA, 15 bp, Homo sapiens
aatgaaaatccctta

SEQ ID NO: 1343 - DNA, 15 bp, Homo sapiens
taatgaaaatccctt

SEQ ID NO: 1344 - DNA, 15 bp, Homo sapiens
ataatgaaaatccct

SEQ ID NO: 1345 - DNA, 15 bp, Homo sapiens
gataatgaaaatccc

SEQ ID NO: 1346 - DNA, 15 bp, Homo sapiens
tgataatgaaaatcc

SEQ ID NO: 1347 - DNA, 15 bp, Homo sapiens
ttgataatgaaaatc

SEQ ID NO: 1348 - DNA, 15 bp, Homo sapiens
cttgataatgaaaat

SEQ ID NO: 1349 - DNA, 15 bp, Homo sapiens
tcttgataatgaaaa

SEQ ID NO: 1350 - DNA, 15 bp, Homo sapiens
ttcttgataatgaaa

SEQ ID NO: 1351 - DNA, 15 bp, Homo sapiens
cttcttgataatgaa

SEQ ID NO: 1352 - DNA, 15 bp, Homo sapiens
tcttcttgataatga

SEQ ID NO: 1353 - DNA, 15 bp, Homo sapiens
ctcttcttgataatg

SEQ ID NO: 1354 - DNA, 15 bp, Homo sapiens
tctcttcttgataat

SEQ ID NO: 1355 - DNA, 15 bp, Homo sapiens
ttctcttcttgataa

SEQ ID NO: 1356 - DNA, 15 bp, Homo sapiens
tttctcttcttgata

SEQ ID NO: 1357 - DNA, 15 bp, Homo sapiens
ttttctcttcttgat

SEQ ID NO: 1358 - DNA, 15 bp, Homo sapiens
tttttctcttcttga

SEQ ID NO: 1359 - DNA, 15 bp, Homo sapiens
atttttctcttcttg

SEQ ID NO: 1360 - DNA, 15 bp, Homo sapiens
aatttttctcttctt

SEQ ID NO: 1361 - DNA, 15 bp, Homo sapiens
aaatttttctcttct

SEQ ID NO: 1362 - DNA, 15 bp, Homo sapiens
caaatttttctcttc

SEQ ID NO: 1363 - DNA, 15 bp, Homo sapiens
tcaaatttttctctt

SEQ ID NO: 1364 - DNA, 15 bp, Homo sapiens
ttcaaatttttctct

SEQ ID NO: 1365 - DNA, 15 bp, Homo sapiens
tttcaaatttttctc

SEQ ID NO: 1366 - DNA, 15 bp, Homo sapiens
ttttcaaatttttct

SEQ ID NO: 1367 - DNA, 15 bp, Homo sapiens
tttttcaaatttttc

SEQ ID NO: 1368 - DNA, 15 bp, Homo sapiens
atttttcaaattttt

SEQ ID NO: 1369 - DNA, 15 bp, Homo sapiens
gatttttcaaatttt

SEQ ID NO: 1370 - DNA, 15 bp, Homo sapiens
tgatttttcaaattt

SEQ ID NO: 1371 - DNA, 15 bp, Homo sapiens
gtgatttttcaaatt

SEQ ID NO: 1372 - DNA, 15 bp, Homo sapiens
ggtgatttttcaaat

SEQ ID NO: 1373 - DNA, 15 bp, Homo sapiens
aggtgatttttcaaa

SEQ ID NO: 1374 - DNA, 15 bp, Homo sapiens
aaggtgatttttcaa

SEQ ID NO: 1375 - DNA, 15 bp, Homo sapiens
caaggtgatttttca

SEQ ID NO: 1376 - DNA, 15 bp, Homo sapiens
tcaaggtgatttttc

SEQ ID NO: 1377 - DNA, 15 bp, Homo sapiens
ctcaaggtgattttt

SEQ ID NO: 1378 - DNA, 15 bp, Homo sapiens
cctcaaggtgatttt

SEQ ID NO: 1379 - DNA, 15 bp, Homo sapiens
tcctcaaggtgattt

SEQ ID NO: 1380 - DNA, 15 bp, Homo sapiens
ctcctcaaggtgatt

SEQ ID NO: 1381 - DNA, 15 bp, Homo sapiens
tctcctcaaggtgat

SEQ ID NO: 1382 - DNA, 15 bp, Homo sapiens
ctctcctcaaggtga

SEQ ID NO: 1383 - DNA, 15 bp, Homo sapiens
actctcctcaaggtg

SEQ ID NO: 1384 - DNA, 15 bp, Homo sapiens
cactctcctcaaggt

SEQ ID NO: 1385 - DNA, 15 bp, Homo sapiens
ccactctcctcaagg

SEQ ID NO: 1386 - DNA, 15 bp, Homo sapiens
gccactctcctcaag

SEQ ID NO: 1387 - DNA, 15 bp, Homo sapiens
tgccactctcctcaa

SEQ ID NO: 1388 - DNA, 15 bp, Homo sapiens
ttgccactctcctca

SEQ ID NO: 1389 - DNA, 15 bp, Homo sapiens
cttgccactctcctc

SEQ ID NO: 1390 - DNA, 15 bp, Homo sapiens
acttgccactctcct

SEQ ID NO: 1391 - DNA, 15 bp, Homo sapiens
cacttgccactctcc

SEQ ID NO: 1392 - DNA, 15 bp, Homo sapiens
tcacttgccactctc

SEQ ID NO: 1393 - DNA, 15 bp, Homo sapiens
ttcacttgccactct

SEQ ID NO: 1394 - DNA, 15 bp, Homo sapiens
tttcacttgccactc

SEQ ID NO: 1395 - DNA, 15 bp, Homo sapiens
gtttcacttgccact

SEQ ID NO: 1396 - DNA, 15 bp, Homo sapiens
tgtttcacttgccac

SEQ ID NO: 1397 - DNA, 15 bp, Homo sapiens
atgtttcacttgcca

SEQ ID NO: 1398 - DNA, 15 bp, Homo sapiens
aatgtttcacttgcc

SEQ ID NO: 1399 - DNA, 15 bp, Homo sapiens
taatgtttcacttgc

SEQ ID NO: 1400 - DNA, 15 bp, Homo sapiens
ataatgtttcacttg

SEQ ID NO: 1401 - DNA, 15 bp, Homo sapiens
tataatgtttcactt

SEQ ID NO: 1402 - DNA, 15 bp, Homo sapiens
ctataatgtttcact

SEQ ID NO: 1403 - DNA, 15 bp, Homo sapiens
actataatgtttcac

SEQ ID NO: 1404 - DNA, 15 bp, Homo sapiens
cactataatgtttca

SEQ ID NO: 1405 - DNA, 15 bp, Homo sapiens
tcactataatgtttc

SEQ ID NO: 1406 - DNA, 15 bp, Homo sapiens
ttcactataatgttt

SEQ ID NO: 1407 - DNA, 15 bp, Homo sapiens
cttcactataatgtt

SEQ ID NO: 1408 - DNA, 15 bp, Homo sapiens
tcttcactataatgt

SEQ ID NO: 1409 - DNA, 15 bp, Homo sapiens
ttcttcactataatg

SEQ ID NO: 1410 - DNA, 15 bp, Homo sapiens
cttcttcactataat

SEQ ID NO: 1411 - DNA, 15 bp, Homo sapiens
acttcttcactataa

SEQ ID NO: 1412 - DNA, 15 bp, Homo sapiens
cacttcttcactata

SEQ ID NO: 1413 - DNA, 15 bp, Homo sapiens
acacttcttcactat

SEQ ID NO: 1414 - DNA, 15 bp, Homo sapiens
aacacttcttcacta

SEQ ID NO: 1415 - DNA, 15 bp, Homo sapiens
taacacttcttcact

SEQ ID NO: 1416 - DNA, 15 bp, Homo sapiens
gtaacacttcttcac

SEQ ID NO: 1417 - DNA, 15 bp, Homo sapiens
agtaacacttcttca

SEQ ID NO: 1418 - DNA, 15 bp, Homo sapiens
cagtaacacttcttc

SEQ ID NO: 1419 - DNA, 15 bp, Homo sapiens
tcagtaacacttctt

SEQ ID NO: 1420 - DNA, 15 bp, Homo sapiens
atcagtaacacttct

SEQ ID NO: 1421 - DNA, 15 bp, Homo sapiens
tatcagtaacacttc

SEQ ID NO: 1422 - DNA, 15 bp, Homo sapiens
ttatcagtaacactt

SEQ ID NO: 1423 - DNA, 15 bp, Homo sapiens
attatcagtaacact

SEQ ID NO: 1424 - DNA, 15 bp, Homo sapiens
cattatcagtaacac

SEQ ID NO: 1425 - DNA, 15 bp, Homo sapiens
ccattatcagtaaca

SEQ ID NO: 1426 - DNA, 15 bp, Homo sapiens
cccattatcagtaac

SEQ ID NO: 1427 - DNA, 15 bp, Homo sapiens
gcccattatcagtaa

SEQ ID NO: 1428 - DNA, 15 bp, Homo sapiens
tgcccattatcagta

SEQ ID NO: 1429 - DNA, 15 bp, Homo sapiens
ttgcccattatcagt

SEQ ID NO: 1430 - DNA, 15 bp, Homo sapiens
tttgcccattatcag

SEQ ID NO: 1431 - DNA, 15 bp, Homo sapiens
atttgcccattatca

SEQ ID NO: 1432 - DNA, 15 bp, Homo sapiens
catttgcccattatc

SEQ ID NO: 1433 - DNA, 15 bp, Homo sapiens
ccatttgcccattat

SEQ ID NO: 1434 - DNA, 15 bp, Homo sapiens
tccatttgcccatta

SEQ ID NO: 1435 - DNA, 15 bp, Homo sapiens
ttccatttgcccatt

SEQ ID NO: 1436 - DNA, 15 bp, Homo sapiens
attccatttgcccat

SEQ ID NO: 1437 - DNA, 15 bp, Homo sapiens
tattccatttgccca

SEQ ID NO: 1438 - DNA, 15 bp, Homo sapiens
ttattccatttgccc

SEQ ID NO: 1439 - DNA, 15 bp, Homo sapiens
tttattccatttgcc

SEQ ID NO: 1440 - DNA, 15 bp, Homo sapiens
ctttattccatttgc

SEQ ID NO: 1441 - DNA, 15 bp, Homo sapiens
actttattccatttg

SEQ ID NO: 1442 - DNA, 15 bp, Homo sapiens
tactttattccattt

SEQ ID NO: 1443 - DNA, 15 bp, Homo sapiens
ctactttattccatt

SEQ ID NO: 1444 - DNA, 15 bp, Homo sapiens
actactttattccat

SEQ ID NO: 1445 - DNA, 15 bp, Homo sapiens
cactactttattcca

SEQ ID NO: 1446 - DNA, 15 bp, Homo sapiens
acactactttattcc

SEQ ID NO: 1447 - DNA, 15 bp, Homo sapiens
cacactactttattc

SEQ ID NO: 1448 - DNA, 15 bp, Homo sapiens
acacactactttatt

SEQ ID NO: 1449 - DNA, 15 bp, Homo sapiens
tacacactactttat

SEQ ID NO: 1450 - DNA, 15 bp, Homo sapiens
ttacacactacttta

SEQ ID NO: 1451 - DNA, 15 bp, Homo sapiens
tttacacactacttt

SEQ ID NO: 1452 - DNA, 15 bp, Homo sapiens
gtttacacactactt

SEQ ID NO: 1453 - DNA, 15 bp, Homo sapiens
tgtttacacactact

SEQ ID NO: 1454 - DNA, 15 bp, Homo sapiens
ctgtttacacactac

SEQ ID NO: 1455 - DNA, 15 bp, Homo sapiens
actgtttacacacta

SEQ ID NO: 1456 - DNA, 15 bp, Homo sapiens
aactgtttacacact

SEQ ID NO: 1457 - DNA, 15 bp, Homo sapiens
caactgtttacacac

SEQ ID NO: 1458 - DNA, 15 bp, Homo sapiens
tcaactgtttacaca

SEQ ID NO: 1459 - DNA, 15 bp, Homo sapiens
gtcaactgtttacac

SEQ ID NO: 1460 - DNA, 15 bp, Homo sapiens
agtcaactgtttaca

SEQ ID NO: 1461 - DNA, 15 bp, Homo sapiens
aagtcaactgtttac

SEQ ID NO: 1462 - DNA, 15 bp, Homo sapiens
aaagtcaactgttta

SEQ ID NO: 1463 - DNA, 15 bp, Homo sapiens
aaaagtcaactgttt

SEQ ID NO: 1464 - DNA, 15 bp, Homo sapiens
gaaaagtcaactgtt

SEQ ID NO: 1465 - DNA, 15 bp, Homo sapiens
agaaaagtcaactgt

SEQ ID NO: 1466 - DNA, 15 bp, Homo sapiens
gagaaaagtcaactg

SEQ ID NO: 1467 - DNA, 15 bp, Homo sapiens
agagaaaagtcaact

SEQ ID NO: 1468 - DNA, 15 bp, Homo sapiens
aagagaaaagtcaac

SEQ ID NO: 1469 - DNA, 15 bp, Homo sapiens
aaagagaaaagtcaa

SEQ ID NO: 1470 - DNA, 15 bp, Homo sapiens
aaaagagaaaagtca

SEQ ID NO: 1471 - DNA, 15 bp, Homo sapiens
taaaagagaaaagtc

SEQ ID NO: 1472 - DNA, 15 bp, Homo sapiens
ataaaagagaaaagt

SEQ ID NO: 1473 - DNA, 15 bp, Homo sapiens
cataaaagagaaaag

SEQ ID NO: 1474 - DNA, 15 bp, Homo sapiens
ccataaaagagaaaa

SEQ ID NO: 1475 - DNA, 15 bp, Homo sapiens
cccataaaagagaaa

SEQ ID NO: 1476 - DNA, 15 bp, Homo sapiens
acccataaaagagaa

SEQ ID NO: 1477 - DNA, 15 bp, Homo sapiens
cacccataaaagaga

SEQ ID NO: 1478 - DNA, 15 bp, Homo sapiens
tcacccataaaagag

SEQ ID NO: 1479 - DNA, 15 bp, Homo sapiens
ttcacccataaaaga

SEQ ID NO: 1480 - DNA, 15 bp, Homo sapiens
attcacccataaaag

SEQ ID NO: 1481 - DNA, 15 bp, Homo sapiens
tattcacccataaaa

SEQ ID NO: 1482 - DNA, 15 bp, Homo sapiens
ttattcacccataaa

SEQ ID NO: 1483 - DNA, 15 bp, Homo sapiens
tttattcacccataa

SEQ ID NO: 1484 - DNA, 15 bp, Homo sapiens
ctttattcacccata

SEQ ID NO: 1485 - DNA, 15 bp, Homo sapiens
cctttattcacccat

SEQ ID NO: 1486 - DNA, 15 bp, Homo sapiens
gcctttattcaccca

SEQ ID NO: 1487 - DNA, 15 bp, Homo sapiens
agcctttattcaccc

SEQ ID NO: 1488 - DNA, 15 bp, Homo sapiens
aagcctttattcacc

SEQ ID NO: 1489 - DNA, 15 bp, Homo sapiens
aaagcctttattcac

SEQ ID NO: 1490 - DNA, 15 bp, Homo sapiens
caaagcctttattca

SEQ ID NO: 1491 - DNA, 15 bp, Homo sapiens
ccaaagcctttattc

SEQ ID NO: 1492 - DNA, 15 bp, Homo sapiens
cccaaagcctttatt

SEQ ID NO: 1493 - DNA, 15 bp, Homo sapiens
acccaaagcctttat

SEQ ID NO: 1494 - DNA, 15 bp, Homo sapiens
tacccaaagccttta

SEQ ID NO: 1495 - DNA, 15 bp, Homo sapiens
ctacccaaagccttt

SEQ ID NO: 1496 - DNA, 15 bp, Homo sapiens
gctacccaaagcctt

SEQ ID NO: 1497 - DNA, 15 bp, Homo sapiens
tgctacccaaagcct

SEQ ID NO: 1498 - DNA, 15 bp, Homo sapiens
atgctacccaaagcc

SEQ ID NO: 1499 - DNA, 15 bp, Homo sapiens
tatgctacccaaagc

SEQ ID NO: 1500 - DNA, 15 bp, Homo sapiens
ctatgctacccaaag

SEQ ID NO: 1501 - DNA, 15 bp, Homo sapiens
tctatgctacccaaa

SEQ ID NO: 1502 - DNA, 15 bp, Homo sapiens
ttctatgctacccaa

SEQ ID NO: 1503 - DNA, 15 bp, Homo sapiens
cttctatgctaccca

SEQ ID NO: 1504 - DNA, 15 bp, Homo sapiens
acttctatgctaccc

SEQ ID NO: 1505 - DNA, 15 bp, Homo sapiens
cacttctatgctacc

SEQ ID NO: 1506 - DNA, 15 bp, Homo sapiens
ccacttctatgctac

SEQ ID NO: 1507 - DNA, 15 bp, Homo sapiens
tccacttctatgcta

SEQ ID NO: 1508 - DNA, 15 bp, Homo sapiens
ctccacttctatgct

SEQ ID NO: 1509 - DNA, 15 bp, Homo sapiens
tctccacttctatgc

SEQ ID NO: 1510 - DNA, 15 bp, Homo sapiens
atctccacttctatg

SEQ ID NO: 1511 - DNA, 15 bp, Homo sapiens
gatctccacttctat

SEQ ID NO: 1512 - DNA, 15 bp, Homo sapiens
agatctccacttcta

SEQ ID NO: 1513 - DNA, 15 bp, Homo sapiens
aagatctccacttct

SEQ ID NO: 1514 - DNA, 15 bp, Homo sapiens
caagatctccacttc

SEQ ID NO: 1515 - DNA, 15 bp, Homo sapiens
ccaagatctccactt

SEQ ID NO: 1516 - DNA, 15 bp, Homo sapiens
gccaagatctccact

SEQ ID NO: 1517 - DNA, 15 bp, Homo sapiens
agccaagatctccac

SEQ ID NO: 1518 - DNA, 15 bp, Homo sapiens
tagccaagatctcca

SEQ ID NO: 1519 - DNA, 15 bp, Homo sapiens
ttagccaagatctcc

SEQ ID NO: 1520 - DNA, 15 bp, Homo sapiens
cttagccaagatctc

SEQ ID NO: 1521 - DNA, 15 bp, Homo sapiens
tcttagccaagatct

SEQ ID NO: 1522 - DNA, 15 bp, Homo sapiens
gtcttagccaagatc

SEQ ID NO: 1523 - DNA, 15 bp, Homo sapiens
ggtcttagccaagat

SEQ ID NO: 1524 - DNA, 15 bp, Homo sapiens
tggtcttagccaaga

SEQ ID NO: 1525 - DNA, 15 bp, Homo sapiens
ttggtcttagccaag

SEQ ID NO: 1526 - DNA, 15 bp, Homo sapiens
attggtcttagccaa

SEQ ID NO: 1527 - DNA, 15 bp, Homo sapiens
tattggtcttagcca

SEQ ID NO: 1528 - DNA, 15 bp, Homo sapiens
ctattggtcttagcc

SEQ ID NO: 1529 - DNA, 15 bp, Homo sapiens
actattggtcttagc

SEQ ID NO: 1530 - DNA, 15 bp, Homo sapiens
cactattggtcttag

SEQ ID NO: 1531 - DNA, 15 bp, Homo sapiens
tcactattggtctta

SEQ ID NO: 1532 - DNA, 15 bp, Homo sapiens
ttcactattggtctt

SEQ ID NO: 1533 - DNA, 15 bp, Homo sapiens
cttcactattggtct

SEQ ID NO: 1534 - DNA, 15 bp, Homo sapiens
tcttcactattggtc

SEQ ID NO: 1535 - DNA, 15 bp, Homo sapiens
ttcttcactattggt

SEQ ID NO: 1536 - DNA, 15 bp, Homo sapiens
tttcttcactattgg

SEQ ID NO: 1537 - DNA, 15 bp, Homo sapiens
ttttcttcactattg

SEQ ID NO: 1538 - DNA, 15 bp, Homo sapiens
cttttcttcactatt

SEQ ID NO: 1539 - DNA, 15 bp, Homo sapiens
gcttttcttcactat

SEQ ID NO: 1540 - DNA, 15 bp, Homo sapiens
tgcttttcttcacta

SEQ ID NO: 1541 - DNA, 15 bp, Homo sapiens
atgcttttcttcact

SEQ ID NO: 1542 - DNA, 15 bp, Homo sapiens
aatgcttttcttcac

SEQ ID NO: 1543 - DNA, 15 bp, Homo sapiens
taatgcttttcttca

SEQ ID NO: 1544 - DNA, 15 bp, Homo sapiens
ctaatgcttttcttc

SEQ ID NO: 1545 - DNA, 15 bp, Homo sapiens
tctaatgcttttctt

SEQ ID NO: 1546 - DNA, 15 bp, Homo sapiens
gtctaatgcttttct

SEQ ID NO: 1547 - DNA, 15 bp, Homo sapiens
agtctaatgcttttc

SEQ ID NO: 1548 - DNA, 15 bp, Homo sapiens
aagtctaatgctttt

SEQ ID NO: 1549 - DNA, 15 bp, Homo sapiens
taagtctaatgcttt

SEQ ID NO: 1550 - DNA, 15 bp, Homo sapiens
gtaagtctaatgctt

SEQ ID NO: 1551 - DNA, 15 bp, Homo sapiens
agtaagtctaatgct

SEQ ID NO: 1552 - DNA, 15 bp, Homo sapiens
cagtaagtctaatgc

SEQ ID NO: 1553 - DNA, 15 bp, Homo sapiens
gcagtaagtctaatg

SEQ ID NO: 1554 - DNA, 15 bp, Homo sapiens
agcagtaagtctaat

SEQ ID NO: 1555 - DNA, 15 bp, Homo sapiens
gagcagtaagtctaa

SEQ ID NO: 1556 - DNA, 15 bp, Homo sapiens
ggagcagtaagtcta

SEQ ID NO: 1557 - DNA, 15 bp, Homo sapiens
tggagcagtaagtct

SEQ ID NO: 1558 - DNA, 15 bp, Homo sapiens
ttggagcagtaagtc

SEQ ID NO: 1559 - DNA, 15 bp, Homo sapiens
tttggagcagtaagt

SEQ ID NO: 1560 - DNA, 15 bp, Homo sapiens
ctttggagcagtaag

SEQ ID NO: 1561 - DNA, 15 bp, Homo sapiens
actttggagcagtaa

SEQ ID NO: 1562 - DNA, 15 bp, Homo sapiens
cactttggagcagta

SEQ ID NO: 1563 - DNA, 15 bp, Homo sapiens
tcactttggagcagt

SEQ ID NO: 1564 - DNA, 15 bp, Homo sapiens
atcactttggagcag

SEQ ID NO: 1565 - DNA, 15 bp, Homo sapiens
tatcactttggagca

SEQ ID NO: 1566 - DNA, 15 bp, Homo sapiens
gtatcactttggagc

SEQ ID NO: 1567 - DNA, 15 bp, Homo sapiens
tgtatcactttggag

SEQ ID NO: 1568 - DNA, 15 bp, Homo sapiens
gtgtatcactttgga

SEQ ID NO: 1569 - DNA, 15 bp, Homo sapiens
agtgtatcactttgg

SEQ ID NO: 1570 - DNA, 15 bp, Homo sapiens
cagtgtatcactttg

SEQ ID NO: 1571 - DNA, 15 bp, Homo sapiens
acagtgtatcacttt

SEQ ID NO: 1572 - DNA, 15 bp, Homo sapiens
tacagtgtatcactt

SEQ ID NO: 1573 - DNA, 15 bp, Homo sapiens
ctacagtgtatcact

SEQ ID NO: 1574 - DNA, 15 bp, Homo sapiens
actacagtgtatcac

SEQ ID NO: 1575 - DNA, 15 bp, Homo sapiens
aactacagtgtatca

SEQ ID NO: 1576 - DNA, 15 bp, Homo sapiens
gaactacagtgtatc

SEQ ID NO: 1577 - DNA, 15 bp, Homo sapiens
agaactacagtgtat

SEQ ID NO: 1578 - DNA, 15 bp, Homo sapiens
aagaactacagtgta

SEQ ID NO: 1579 - DNA, 15 bp, Homo sapiens
aaagaactacagtgt

SEQ ID NO: 1580 - DNA, 15 bp, Homo sapiens
gaaagaactacagtg

SEQ ID NO: 1581 - DNA, 15 bp, Homo sapiens
ggaaagaactacagt

SEQ ID NO: 1582 - DNA, 15 bp, Homo sapiens
tggaaagaactacag

SEQ ID NO: 1583 - DNA, 15 bp, Homo sapiens
ctggaaagaactaca

SEQ ID NO: 1584 - DNA, 15 bp, Homo sapiens
cctggaaagaactac

SEQ ID NO: 1585 - DNA, 15 bp, Homo sapiens
tcctggaaagaacta

SEQ ID NO: 1586 - DNA, 15 bp, Homo sapiens
ttcctggaaagaact

SEQ ID NO: 1587 - DNA, 15 bp, Homo sapiens
tttcctggaaagaac

SEQ ID NO: 1588 - DNA, 15 bp, Homo sapiens
ctttcctggaaagaa

SEQ ID NO: 1589 - DNA, 15 bp, Homo sapiens
tctttcctggaaaga

SEQ ID NO: 1590 - DNA, 15 bp, Homo sapiens
ctctttcctggaaag

SEQ ID NO: 1591 - DNA, 15 bp, Homo sapiens
tctctttcctggaaa

SEQ ID NO: 1592 - DNA, 15 bp, Homo sapiens
ttctctttcctggaa

SEQ ID NO: 1593 - DNA, 15 bp, Homo sapiens
attctctttcctgga

SEQ ID NO: 1594 - DNA, 15 bp, Homo sapiens
aattctctttcctgg

SEQ ID NO: 1595 - DNA, 15 bp, Homo sapiens
aaattctctttcctg

SEQ ID NO: 1596 - DNA, 15 bp, Homo sapiens
aaaattctctttcct

SEQ ID NO: 1597 - DNA, 15 bp, Homo sapiens
aaaaattctctttcc

SEQ ID NO: 1598 - DNA, 15 bp, Homo sapiens
gaaaaattctctttc

SEQ ID NO: 1599 - DNA, 15 bp, Homo sapiens
ggaaaaattctcttt

SEQ ID NO: 1600 - DNA, 15 bp, Homo sapiens
gggaaaaattctctt

SEQ ID NO: 1601 - DNA, 15 bp, Homo sapiens
agggaaaaattctct

SEQ ID NO: 1602 - DNA, 15 bp, Homo sapiens
cagggaaaaattctc

SEQ ID NO: 1603 - DNA, 15 bp, Homo sapiens
ccagggaaaaattct

SEQ ID NO: 1604 - DNA, 15 bp, Homo sapiens
cccagggaaaaattc

SEQ ID NO: 1605 - DNA, 15 bp, Homo sapiens
gcccagggaaaaatt

SEQ ID NO: 1606 - DNA, 15 bp, Homo sapiens
tgcccagggaaaaat

SEQ ID NO: 1607 - DNA, 15 bp, Homo sapiens
ttgcccagggaaaaa

SEQ ID NO: 1608 - DNA, 15 bp, Homo sapiens
tttgcccagggaaaa

SEQ ID NO: 1609 - DNA, 15 bp, Homo sapiens
gtttgcccagggaaa

SEQ ID NO: 1610 - DNA, 15 bp, Homo sapiens
agtttgcccagggaa

SEQ ID NO: 1611 - DNA, 15 bp, Homo sapiens
aagtttgcccaggga

SEQ ID NO: 1612 - DNA, 15 bp, Homo sapiens
taagtttgcccaggg

SEQ ID NO: 1613 - DNA, 15 bp, Homo sapiens
ttaagtttgcccagg

SEQ ID NO: 1614 - DNA, 15 bp, Homo sapiens
attaagtttgcccag

SEQ ID NO: 1615 - DNA, 15 bp, Homo sapiens
aattaagtttgccca

SEQ ID NO: 1616 - DNA, 15 bp, Homo sapiens
aaattaagtttgccc

SEQ ID NO: 1617 - DNA, 15 bp, Homo sapiens
aaaattaagtttgcc

SEQ ID NO: 1618 - DNA, 15 bp, Homo sapiens
gaaaattaagtttgc

SEQ ID NO: 1619 - DNA, 15 bp, Homo sapiens
ggaaaattaagtttg

SEQ ID NO: 1620 - DNA, 15 bp, Homo sapiens
tggaaaattaagttt

SEQ ID NO: 1621 - DNA, 15 bp, Homo sapiens
atggaaaattaagtt

SEQ ID NO: 1622 - DNA, 15 bp, Homo sapiens
catggaaaattaagt

SEQ ID NO: 1623 - DNA, 15 bp, Homo sapiens
tcatggaaaattaag

SEQ ID NO: 1624 - DNA, 15 bp, Homo sapiens
atcatggaaaattaa

SEQ ID NO: 1625 - DNA, 15 bp, Homo sapiens
tatcatggaaaatta

SEQ ID NO: 1626 - DNA, 15 bp, Homo sapiens
ttatcatggaaaatt

SEQ ID NO: 1627 - DNA, 15 bp, Homo sapiens
tttatcatggaaaat

SEQ ID NO: 1628 - DNA, 15 bp, Homo sapiens
gtttatcatggaaaa

SEQ ID NO: 1629 - DNA, 15 bp, Homo sapiens
agtttatcatggaaa

SEQ ID NO: 1630 - DNA, 15 bp, Homo sapiens
aagtttatcatggaa

SEQ ID NO: 1631 - DNA, 15 bp, Homo sapiens
aaagtttatcatgga

SEQ ID NO: 1632 - DNA, 15 bp, Homo sapiens
aaaagtttatcatgg

SEQ ID NO: 1633 - DNA, 15 bp, Homo sapiens
taaaagtttatcatg

SEQ ID NO: 1634 - DNA, 15 bp, Homo sapiens
ataaaagtttatcat

SEQ ID NO: 1635 - DNA, 15 bp, Homo sapiens
tataaaagtttatca

SEQ ID NO: 1636 - DNA, 15 bp, Homo sapiens
ctataaaagtttatc

SEQ ID NO: 1637 - DNA, 15 bp, Homo sapiens
tctataaaagtttat

SEQ ID NO: 1638 - DNA, 15 bp, Homo sapiens
gtctataaaagttta

SEQ ID NO: 1639 - DNA, 15 bp, Homo sapiens
tgtctataaaagttt

SEQ ID NO: 1640 - DNA, 15 bp, Homo sapiens
atgtctataaaagtt

SEQ ID NO: 1641 - DNA, 15 bp, Homo sapiens
aatgtctataaaagt

SEQ ID NO: 1642 - DNA, 15 bp, Homo sapiens
gaatgtctataaaag

SEQ ID NO: 1643 - DNA, 15 bp, Homo sapiens
agaatgtctataaaa

SEQ ID NO: 1644 - DNA, 15 bp, Homo sapiens
aagaatgtctataaa

SEQ ID NO: 1645 - DNA, 15 bp, Homo sapiens
gaagaatgtctataa

SEQ ID NO: 1646 - DNA, 15 bp, Homo sapiens
agaagaatgtctata

SEQ ID NO: 1647 - DNA, 15 bp, Homo sapiens
cagaagaatgtctat

SEQ ID NO: 1648 - DNA, 15 bp, Homo sapiens
tcagaagaatgtcta

SEQ ID NO: 1649 - DNA, 15 bp, Homo sapiens
ttcagaagaatgtct

SEQ ID NO: 1650 - DNA, 15 bp, Homo sapiens
gttcagaagaatgtc

SEQ ID NO: 1651 - DNA, 15 bp, Homo sapiens
tgttcagaagaatgt

SEQ ID NO: 1652 - DNA, 15 bp, Homo sapiens
ttgttcagaagaatg

SEQ ID NO: 1653 - DNA, 15 bp, Homo sapiens
tttgttcagaagaat

SEQ ID NO: 1654 - DNA, 15 bp, Homo sapiens
ctttgttcagaagaa

SEQ ID NO: 1655 - DNA, 15 bp, Homo sapiens
actttgttcagaaga

SEQ ID NO: 1656 - DNA, 15 bp, Homo sapiens
aactttgttcagaag

SEQ ID NO: 1657 - DNA, 15 bp, Homo sapiens
aaactttgttcagaa

SEQ ID NO: 1658 - DNA, 15 bp, Homo sapiens
aaaactttgttcaga

SEQ ID NO: 1659 - DNA, 15 bp, Homo sapiens
aaaaactttgttcag

SEQ ID NO: 1660 - DNA, 15 bp, Homo sapiens
caaaaactttgttca

SEQ ID NO: 1661 - DNA, 15 bp, Homo sapiens
tcaaaaactttgttc

SEQ ID NO: 1662 - DNA, 15 bp, Homo sapiens
atcaaaaactttgtt

SEQ ID NO: 1663 - DNA, 15 bp, Homo sapiens
aatcaaaaactttgt

SEQ ID NO: 1664 - DNA, 15 bp, Homo sapiens
gaatcaaaaactttg

SEQ ID NO: 1665 - DNA, 15 bp, Homo sapiens
agaatcaaaaacttt

SEQ ID NO: 1666 - DNA, 15 bp, Homo sapiens
aagaatcaaaaactt

SEQ ID NO: 1667 - DNA, 15 bp, Homo sapiens
caagaatcaaaaact

SEQ ID NO: 1668 - DNA, 15 bp, Homo sapiens
tcaagaatcaaaaac

SEQ ID NO: 1669 - DNA, 15 bp, Homo sapiens
ttcaagaatcaaaaa

SEQ ID NO: 1670 - DNA, 15 bp, Homo sapiens
attcaagaatcaaaa

SEQ ID NO: 1671 - DNA, 15 bp, Homo sapiens
tattcaagaatcaaa

SEQ ID NO: 1672 - DNA, 15 bp, Homo sapiens
atattcaagaatcaa

SEQ ID NO: 1673 - DNA, 15 bp, Homo sapiens
tatattcaagaatca

SEQ ID NO: 1674 - DNA, 15 bp, Homo sapiens
ttatattcaagaatc

SEQ ID NO: 1675 - DNA, 15 bp, Homo sapiens
attatattcaagaat

SEQ ID NO: 1676 - DNA, 15 bp, Homo sapiens
tattatattcaagaa

SEQ ID NO: 1677 - DNA, 15 bp, Homo sapiens
ttattatattcaaga

SEQ ID NO: 1678 - DNA, 15 bp, Homo sapiens
tttattatattcaag

SEQ ID NO: 1679 - DNA, 15 bp, Homo sapiens
ttttattatattcaa

SEQ ID NO: 1680 - DNA, 15 bp, Homo sapiens
attttattatattca

SEQ ID NO: 1681 - DNA, 15 bp, Homo sapiens
tattttattatattc

SEQ ID NO: 1682 - DNA, 15 bp, Homo sapiens
gtattttattatatt

SEQ ID NO: 1683 - DNA, 15 bp, Homo sapiens
tgtattttattatat

SEQ ID NO: 1684 - DNA, 15 bp, Homo sapiens
agtgtattttattat

SEQ ID NO: 1685 - DNA, 15 bp, Homo sapiens
aagtgtattttatta

SEQ ID NO: 1686 - DNA, 15 bp, Homo sapiens
taagtgtattttatt

SEQ ID NO: 1687 - DNA, 15 bp, Homo sapiens
ttaagtgtattttat

SEQ ID NO: 1688 - DNA, 15 bp, Homo sapiens
cttaagtgtatttta

SEQ ID NO: 1689 - DNA, 15 bp, Homo sapiens
tcttaagtgtatttt

SEQ ID NO: 1690 - DNA, 15 bp, Homo sapiens
ttcttaagtgtattt

SEQ ID NO: 1691 - DNA, 15 bp, Homo sapiens
attcttaagtgtatt

SEQ ID NO: 1692 - DNA, 15 bp, Homo sapiens
aattcttaagtgtat

SEQ ID NO: 1693 - DNA, 15 bp, Homo sapiens
aaattcttaagtgta

SEQ ID NO: 1694 - DNA, 15 bp, Homo sapiens
taaattcttaagtgt

SEQ ID NO: 1695 - DNA, 15 bp, Homo sapiens
ctaaattcttaagtg

SEQ ID NO: 1696 - DNA, 15 bp, Homo sapiens
gctaaattcttaagt

SEQ ID NO: 1697 - DNA, 15 bp, Homo sapiens
tgctaaattcttaag

SEQ ID NO: 1698 - DNA, 15 bp, Homo sapiens
ttgctaaattcttaa

SEQ ID NO: 1699 - DNA, 15 bp, Homo sapiens
tttgctaaattctta

SEQ ID NO: 1700 - DNA, 15 bp, Homo sapiens
atttgctaaattctt

SEQ ID NO: 1701 - DNA, 15 bp, Homo sapiens
gatttgctaaattct

SEQ ID NO: 1702 - DNA, 15 bp, Homo sapiens
ggatttgctaaattc

SEQ ID NO: 1703 - DNA, 15 bp, Homo sapiens
aggatttgctaaatt

SEQ ID NO: 1704 - DNA, 15 bp, Homo sapiens
aaggatttgctaaat

SEQ ID NO: 1705 - DNA, 15 bp, Homo sapiens
aaaggatttgctaaa

SEQ ID NO: 1706 - DNA, 15 bp, Homo sapiens
taaaggatttgctaa

SEQ ID NO: 1707 - DNA, 15 bp, Homo sapiens
ataaaggatttgcta

SEQ ID NO: 1708 - DNA, 15 bp, Homo sapiens
tataaaggatttgct

SEQ ID NO: 1709 - DNA, 15 bp, Homo sapiens
ctataaaggatttgc

SEQ ID NO: 1710 - DNA, 15 bp, Homo sapiens
actataaaggatttg

SEQ ID NO: 1711 - DNA, 15 bp, Homo sapiens
aactataaaggattt

SEQ ID NO: 1712 - DNA, 15 bp, Homo sapiens
taactataaaggatt

SEQ ID NO: 1713 - DNA, 15 bp, Homo sapiens
ataactataaaggat

SEQ ID NO: 1714 - DNA, 15 bp, Homo sapiens
cataactataaagga

SEQ ID NO: 1715 - DNA, 15 bp, Homo sapiens
acataactataaagg

SEQ ID NO: 1716 - DNA, 15 bp, Homo sapiens
tacataactataaag

SEQ ID NO: 1717 - DNA, 15 bp, Homo sapiens
gtacataactataaa

SEQ ID NO: 1718 - DNA, 15 bp, Homo sapiens
agtacataactataa

SEQ ID NO: 1719 - DNA, 15 bp, Homo sapiens
aagtacataactata

SEQ ID NO: 1720 - DNA, 15 bp, Homo sapiens
caagtacataactat

SEQ ID NO: 1721 - DNA, 15 bp, Homo sapiens
tcaagtacataacta

SEQ ID NO: 1722 - DNA, 15 bp, Homo sapiens
ttcaagtacataact

SEQ ID NO: 1723 - DNA, 15 bp, Homo sapiens
attcaagtacataac

SEQ ID NO: 1724 - DNA, 15 bp, Homo sapiens
cattcaagtacataa

SEQ ID NO: 1725 - DNA, 15 bp, Homo sapiens
tcattcaagtacata

SEQ ID NO: 1726 - DNA, 15 bp, Homo sapiens
ttcattcaagtacat

SEQ ID NO: 1727 - DNA, 15 bp, Homo sapiens
tttcattcaagtaca

SEQ ID NO: 1728 - DNA, 15 bp, Homo sapiens
ctttcattcaagtac

SEQ ID NO: 1729 - DNA, 15 bp, Homo sapiens
tctttcattcaagta

SEQ ID NO: 1730 - DNA, 15 bp, Homo sapiens
ttctttcattcaagt

SEQ ID NO: 1731 - DNA, 15 bp, Homo sapiens
attctttcattcaag

SEQ ID NO: 1732 - DNA, 15 bp, Homo sapiens
cattctttcattcaa

SEQ ID NO: 1733 - DNA, 15 bp, Homo sapiens
acattctttcattca

SEQ ID NO: 1734 - DNA, 15 bp, Homo sapiens
tacattctttcattc

SEQ ID NO: 1735 - DNA, 15 bp, Homo sapiens
ttacattctttcatt

SEQ ID NO: 1736 - DNA, 15 bp, Homo sapiens
attacattctttcat

SEQ ID NO: 1737 - DNA, 15 bp, Homo sapiens
gattacattctttca

SEQ ID NO: 1738 - DNA, 15 bp, Homo sapiens
tgattacattctttc

SEQ ID NO: 1739 - DNA, 15 bp, Homo sapiens
atgattacattcttt

SEQ ID NO: 1740 - DNA, 15 bp, Homo sapiens
tatgattacattctt

SEQ ID NO: 1741 - DNA, 15 bp, Homo sapiens
atatgattacattct

SEQ ID NO: 1742 - DNA, 15 bp, Homo sapiens
tatatgattacattc

SEQ ID NO: 1743 - DNA, 15 bp, Homo sapiens
ttatatgattacatt

SEQ ID NO: 1744 - DNA, 15 bp, Homo sapiens
attatatgattacat

SEQ ID NO: 1745 - DNA, 15 bp, Homo sapiens
tattatatgattaca

SEQ ID NO: 1746 - DNA, 15 bp, Homo sapiens
ttattatatgattac

SEQ ID NO: 1747 - DNA, 15 bp, Homo sapiens
attattatatgatta

SEQ ID NO: 1748 - DNA, 15 bp, Homo sapiens
gattattatatgatt

SEQ ID NO: 1749 - DNA, 15 bp, Homo sapiens
ggattattatatgat

SEQ ID NO: 1750 - DNA, 15 bp, Homo sapiens
tggattattatatga

SEQ ID NO: 1751 - DNA, 15 bp, Homo sapiens
atggattattatatg

SEQ ID NO: 1752 - DNA, 15 bp, Homo sapiens
tatggattattatat

SEQ ID NO: 1753 - DNA, 15 bp, Homo sapiens
ttatggattattata

SEQ ID NO: 1754 - DNA, 15 bp, Homo sapiens
tttatggattattat

SEQ ID NO: 1755 - DNA, 15 bp, Homo sapiens
atttatggattatta

SEQ ID NO: 1756 - DNA, 15 bp, Homo sapiens
aatttatggattatt

SEQ ID NO: 1757 - DNA, 15 bp, Homo sapiens
aaatttatggattat

SEQ ID NO: 1758 - DNA, 15 bp, Homo sapiens
aaaatttatggatta

SEQ ID NO: 1759 - DNA, 15 bp, Homo sapiens
aaaaatttatggatt

SEQ ID NO: 1760 - DNA, 15 bp, Homo sapiens
taaaaatttatggat

SEQ ID NO: 1761 - DNA, 15 bp, Homo sapiens
ctaaaaatttatgga

SEQ ID NO: 1762 - DNA, 15 bp, Homo sapiens
gctaaaaatttatgg

SEQ ID NO: 1763 - DNA, 15 bp, Homo sapiens
tgctaaaaatttatg

SEQ ID NO: 1764 - DNA, 15 bp, Homo sapiens
ctgctaaaaatttat

SEQ ID NO: 1765 - DNA, 15 bp, Homo sapiens
actgctaaaaattta

SEQ ID NO: 1766 - DNA, 15 bp, Homo sapiens
tactgctaaaaattt

SEQ ID NO: 1767 - DNA, 15 bp, Homo sapiens
ctactgctaaaaatt

SEQ ID NO: 1768 - DNA, 15 bp, Homo sapiens
actactgctaaaaat

SEQ ID NO: 1769 - DNA, 15 bp, Homo sapiens
tactactgctaaaaa

SEQ ID NO: 1770 - DNA, 15 bp, Homo sapiens
ctactactgctaaaa

SEQ ID NO: 1771 - DNA, 15 bp, Homo sapiens
tctactactgctaaa

SEQ ID NO: 1772 - DNA, 15 bp, Homo sapiens
ctctactactgctaa

SEQ ID NO: 1773 - DNA, 15 bp, Homo sapiens
gctctactactgcta

SEQ ID NO: 1774 - DNA, 15 bp, Homo sapiens
ggctctactactgct

SEQ ID NO: 1775 - DNA, 15 bp, Homo sapiens
aggctctactactgc

SEQ ID NO: 1776 - DNA, 15 bp, Homo sapiens
taggctctactactg

SEQ ID NO: 1777 - DNA, 15 bp, Homo sapiens
ataggctctactact

SEQ ID NO: 1778 - DNA, 15 bp, Homo sapiens
tataggctctactac

SEQ ID NO: 1779 - DNA, 15 bp, Homo sapiens
ttataggctctacta

SEQ ID NO: 1780 - DNA, 15 bp, Homo sapiens
tttataggctctact

SEQ ID NO: 1781 - DNA, 15 bp, Homo sapiens
ttttataggctctac

SEQ ID NO: 1782 - DNA, 15 bp, Homo sapiens
tttttataggctcta

SEQ ID NO: 1783 - DNA, 15 bp, Homo sapiens
ttttttataggctct

SEQ ID NO: 1784 - DNA, 15 bp, Homo sapiens
attttttataggctc

SEQ ID NO: 1785 - DNA, 15 bp, Homo sapiens
cattttttataggct

SEQ ID NO: 1786 - DNA, 15 bp, Homo sapiens
tcattttttataggc

SEQ ID NO: 1787 - DNA, 15 bp, Homo sapiens
ttcattttttatagg

SEQ ID NO: 1788 - DNA, 15 bp, Homo sapiens
tttcattttttatag

SEQ ID NO: 1789 - DNA, 15 bp, Homo sapiens
ttttcattttttata

SEQ ID NO: 1790 - DNA, 15 bp, Homo sapiens
tttttcattttttat

SEQ ID NO: 1791 - DNA, 15 bp, Homo sapiens
ttttttcatttttta

SEQ ID NO: 1792 - DNA, 15 bp, Homo sapiens
cttttttcatttttt

SEQ ID NO: 1793 - DNA, 15 bp, Homo sapiens
acttttttcattttt

SEQ ID NO: 1794 - DNA, 15 bp, Homo sapiens
aacttttttcatttt

SEQ ID NO: 1795 - DNA, 15 bp, Homo sapiens
aaacttttttcattt

SEQ ID NO: 1796 - DNA, 15 bp, Homo sapiens
aaaacttttttcatt

SEQ ID NO: 1797 - DNA, 15 bp, Homo sapiens
aaaaacttttttcat

SEQ ID NO: 1798 - DNA, 15 bp, Homo sapiens
aaaaaacttttttca

SEQ ID NO: 1799 - DNA, 15 bp, Homo sapiens
taaaaaacttttttc

SEQ ID NO: 1800 - DNA, 15 bp, Homo sapiens
ctaaaaaactttttt

SEQ ID NO: 1801 - DNA, 15 bp, Homo sapiens
tctaaaaaacttttt

SEQ ID NO: 1802 - DNA, 15 bp, Homo sapiens
gtctaaaaaactttt

SEQ ID NO: 1803 - DNA, 15 bp, Homo sapiens
agtctaaaaaacttt

SEQ ID NO: 1804 - DNA, 15 bp, Homo sapiens
gagtctaaaaaactt

SEQ ID NO: 1805 - DNA, 15 bp, Homo sapiens
agagtctaaaaaact

SEQ ID NO: 1806 - DNA, 15 bp, Homo sapiens
gagagtctaaaaaac

SEQ ID NO: 1807 - DNA, 15 bp, Homo sapiens
tgagagtctaaaaaa

SEQ ID NO: 1808 - DNA, 15 bp, Homo sapiens
atgagagtctaaaaa

SEQ ID NO: 1809 - DNA, 15 bp, Homo sapiens
tatgagagtctaaaa

SEQ ID NO: 1810 - DNA, 15 bp, Homo sapiens
ttatgagagtctaaa

SEQ ID NO: 1811 - DNA, 15 bp, Homo sapiens
tttatgagagtctaa

SEQ ID NO: 1812 - DNA, 15 bp, Homo sapiens
ttttatgagagtcta

SEQ ID NO: 1813 - DNA, 15 bp, Homo sapiens
attttatgagagtct

SEQ ID NO: 1814 - DNA, 15 bp, Homo sapiens
gattttatgagagtc

SEQ ID NO: 1815 - DNA, 15 bp, Homo sapiens
agattttatgagagt

SEQ ID NO: 1816 - DNA, 15 bp, Homo sapiens
cagattttatgagag

SEQ ID NO: 1817 - DNA, 15 bp, Homo sapiens
acagattttatgaga

SEQ ID NO: 1818 - DNA, 15 bp, Homo sapiens
gacagattttatgag

SEQ ID NO: 1819 - DNA, 15 bp, Homo sapiens
tgacagattttatga

SEQ ID NO: 1820 - DNA, 15 bp, Homo sapiens
ctgacagattttatg

SEQ ID NO: 1821 - DNA, 15 bp, Homo sapiens
tctgacagattttat

SEQ ID NO: 1822 - DNA, 15 bp, Homo sapiens
atctgacagatttta

SEQ ID NO: 1823 - DNA, 15 bp, Homo sapiens
aatctgacagatttt

SEQ ID NO: 1824 - DNA, 15 bp, Homo sapiens
caatctgacagattt

SEQ ID NO: 1825 - DNA, 15 bp, Homo sapiens
tcaatctgacagatt

SEQ ID NO: 1826 - DNA, 15 bp, Homo sapiens
atcaatctgacagat

SEQ ID NO: 1827 - DNA, 15 bp, Homo sapiens
catcaatctgacaga

SEQ ID NO: 1828 - DNA, 15 bp, Homo sapiens
tcatcaatctgacag

SEQ ID NO: 1829 - DNA, 15 bp, Homo sapiens
atcatcaatctgaca

SEQ ID NO: 1830 - DNA, 15 bp, Homo sapiens
gatcatcaatctgac

SEQ ID NO: 1831 - DNA, 15 bp, Homo sapiens
ggatcatcaatctga

SEQ ID NO: 1832 - DNA, 15 bp, Homo sapiens
tggatcatcaatctg

SEQ ID NO: 1833 - DNA, 15 bp, Homo sapiens
ttggatcatcaatct

SEQ ID NO: 1834 - DNA, 15 bp, Homo sapiens
attggatcatcaatc

SEQ ID NO: 1835 - DNA, 15 bp, Homo sapiens
gattggatcatcaat

SEQ ID NO: 1836 - DNA, 15 bp, Homo sapiens
ggattggatcatcaa

SEQ ID NO: 1837 - DNA, 15 bp, Homo sapiens
aggattggatcatca

SEQ ID NO: 1838 - DNA, 15 bp, Homo sapiens
aaggattggatcatc

SEQ ID NO: 1839 - DNA, 15 bp, Homo sapiens
aaaggattggatcat

SEQ ID NO: 1840 - DNA, 15 bp, Homo sapiens
taaaggattggatca

SEQ ID NO: 1841 - DNA, 15 bp, Homo sapiens
ataaaggattggatc

SEQ ID NO: 1842 - DNA, 15 bp, Homo sapiens
tataaaggattggat

SEQ ID NO: 1843 - DNA, 15 bp, Homo sapiens
atataaaggattgga

SEQ ID NO: 1844 - DNA, 15 bp, Homo sapiens
gatataaaggattgg

SEQ ID NO: 1845 - DNA, 15 bp, Homo sapiens
ggatataaaggattg

SEQ ID NO: 1846 - DNA, 15 bp, Homo sapiens
tggatataaaggatt

SEQ ID NO: 1847 - DNA, 15 bp, Homo sapiens
ttggatataaaggat

SEQ ID NO: 1848 - DNA, 15 bp, Homo sapiens
gttggatataaagga

SEQ ID NO: 1849 - DNA, 15 bp, Homo sapiens
agttggatataaagg

SEQ ID NO: 1850 - DNA, 15 bp, Homo sapiens
gagttggatataaag

SEQ ID NO: 1851 - DNA, 15 bp, Homo sapiens
agagttggatataaa

SEQ ID NO: 1852 - DNA, 15 bp, Homo sapiens
gagagttggatataa

SEQ ID NO: 1853 - DNA, 15 bp, Homo sapiens
agagagttggatata

SEQ ID NO: 1854 - DNA, 15 bp, Homo sapiens
gagagagttggatat

SEQ ID NO: 1855 - DNA, 15 bp, Homo sapiens
agagagagttggata

SEQ ID NO: 1856 - DNA, 15 bp, Homo sapiens
gagagagagttggat

SEQ ID NO: 1857 - DNA, 15 bp, Homo sapiens
agagagagagttgga

SEQ ID NO: 1858 - DNA, 15 bp, Homo sapiens
gagagagagagttgg

SEQ ID NO: 1859 - DNA, 15 bp, Homo sapiens
agagagagagagttg

SEQ ID NO: 1860 - DNA, 15 bp, Homo sapiens
gagagagagagagtt

SEQ ID NO: 1861 - DNA, 15 bp, Homo sapiens
agagagagagagagt

SEQ ID NO: 1862 - DNA, 15 bp, Homo sapiens
gagagagagagagag

SEQ ID NO: 1863 - DNA, 15 bp, Homo sapiens
agagagagagagaga

SEQ ID NO: 1864 - DNA, 15 bp, Homo sapiens
aaaaagagagagaga

SEQ ID NO: 1865 - DNA, 15 bp, Homo sapiens
aaaaaagagagagag

SEQ ID NO: 1866 - DNA, 15 bp, Homo sapiens
aaaaaaagagagaga

SEQ ID NO: 1867 - DNA, 15 bp, Homo sapiens
aaaaaaaagagagag

SEQ ID NO: 1868 - DNA, 15 bp, Homo sapiens
aaaaaaaaagagaga

SEQ ID NO: 1869 - DNA, 15 bp, Homo sapiens
aaaaaaaaaagagag

SEQ ID NO: 1870 - DNA, 15 bp, Homo sapiens
aaaaaaaaaaagaga

SEQ ID NO: 1871 - DNA, 15 bp, Homo sapiens
aaaaaaaaaaaagag

SEQ ID NO: 1872 - DNA, 15 bp, Homo sapiens
aaaaaaaaaaaaaga

SEQ ID NO: 1873 - DNA, 15 bp, Homo sapiens
aaaaaaaaaaaaaag

SEQ ID NO: 1874 - DNA, 15 bp, Homo sapiens
aaaaaaaaaaaaaaa

SEQ ID NO: 1875 - DNA, 15 bp, Homo sapiens
caaaaaaaaaaaaaa

SEQ ID NO: 1876 - DNA, 15 bp, Homo sapiens
tcaaaaaaaaaaaaa

SEQ ID NO: 1877 - DNA, 15 bp, Homo sapiens
ctcaaaaaaaaaaaa

SEQ ID NO: 1878 - DNA, 15 bp, Homo sapiens
tctcaaaaaaaaaaa

SEQ ID NO: 1879 - DNA, 15 bp, Homo sapiens
ggtgagactccatct

SEQ ID NO: 1880 - DNA, 15 bp, Homo sapiens
gggtgagactccatc

SEQ ID NO: 1881 - DNA, 15 bp, Homo sapiens
tgggtgagactccat

SEQ ID NO: 1882 - DNA, 15 bp, Homo sapiens
gtgggtgagactcca

SEQ ID NO: 1883 - DNA, 15 bp, Homo sapiens
agtgggtgagactcc

SEQ ID NO: 1884 - DNA, 15 bp, Homo sapiens
gagtgggtgagactc

SEQ ID NO: 1885 - DNA, 15 bp, Homo sapiens
cgagtgggtgagact

SEQ ID NO: 1886 - DNA, 15 bp, Homo sapiens
ccgagtgggtgagac

SEQ ID NO: 1887 - DNA, 15 bp, Homo sapiens
accgagtgggtgaga

SEQ ID NO: 1888 - DNA, 15 bp, Homo sapiens
gaccgagtgggtgag

SEQ ID NO: 1889 - DNA, 15 bp, Homo sapiens
cgaccgagtgggtga

SEQ ID NO: 1890 - DNA, 15 bp, Homo sapiens
acgaccgagtgggtg

SEQ ID NO: 1891 - DNA, 15 bp, Homo sapiens
gacgaccgagtgggt

SEQ ID NO: 1892 - DNA, 15 bp, Homo sapiens
tgacgaccgagtggg

SEQ ID NO: 1893 - DNA, 15 bp, Homo sapiens
ttgacgaccgagtgg

SEQ ID NO: 1894 - DNA, 15 bp, Homo sapiens
cttgacgaccgagtg

SEQ ID NO: 1895 - DNA, 15 bp, Homo sapiens
ccttgacgaccgagt

SEQ ID NO: 1896 - DNA, 15 bp, Homo sapiens
gccttgacgaccgag

SEQ ID NO: 1897 - DNA, 15 bp, Homo sapiens
agccttgacgaccga

SEQ ID NO: 1898 - DNA, 15 bp, Homo sapiens
cagccttgacgaccg

SEQ ID NO: 1899 - DNA, 15 bp, Homo sapiens
ccagccttgacgacc

SEQ ID NO: 1900 - DNA, 15 bp, Homo sapiens
tccagccttgacgac

SEQ ID NO: 1901 - DNA, 15 bp, Homo sapiens
ctccagccttgacga

SEQ ID NO: 1902 - DNA, 15 bp, Homo sapiens
actccagccttgacg

SEQ ID NO: 1903 - DNA, 15 bp, Homo sapiens
cactccagccttgac

SEQ ID NO: 1904 - DNA, 15 bp, Homo sapiens
gcactccagccttga

SEQ ID NO: 1905 - DNA, 15 bp, Homo sapiens
tgcactccagccttg

SEQ ID NO: 1906 - DNA, 15 bp, Homo sapiens
ctgcactccagcctt

SEQ ID NO: 1907 - DNA, 15 bp, Homo sapiens
actgcactccagcct

SEQ ID NO: 1908 - DNA, 15 bp, Homo sapiens
cactgcactccagcc

SEQ ID NO: 1909 - DNA, 15 bp, Homo sapiens
ccactgcactccagc

SEQ ID NO: 1910 - DNA, 15 bp, Homo sapiens
gccactgcactccag

SEQ ID NO: 1911 - DNA, 15 bp, Homo sapiens
tgccactgcactcca

SEQ ID NO: 1912 - DNA, 15 bp, Homo sapiens
ctgccactgcactcc

SEQ ID NO: 1913 - DNA, 15 bp, Homo sapiens
gctgccactgcactc

SEQ ID NO: 1914 - DNA, 15 bp, Homo sapiens
cgctgccactgcact

SEQ ID NO: 1915 - DNA, 15 bp, Homo sapiens
tcgctgccactgcac

SEQ ID NO: 1916 - DNA, 15 bp, Homo sapiens
atcgctgccactgca

SEQ ID NO: 1917 - DNA, 15 bp, Homo sapiens
gatcgctgccactgc

SEQ ID NO: 1918 - DNA, 15 bp, Homo sapiens
agatcgctgccactg

SEQ ID NO: 1919 - DNA, 15 bp, Homo sapiens
aagatcgctgccact

SEQ ID NO: 1920 - DNA, 15 bp, Homo sapiens
caagatcgctgccac

SEQ ID NO: 1921 - DNA, 15 bp, Homo sapiens
ccaagatcgctgcca

SEQ ID NO: 1922 - DNA, 15 bp, Homo sapiens
gccaagatcgctgcc

SEQ ID NO: 1923 - DNA, 15 bp, Homo sapiens
ggccaagatcgctgc

SEQ ID NO: 1924 - DNA, 15 bp, Homo sapiens
gggccaagatcgctg

SEQ ID NO: 1925 - DNA, 15 bp, Homo sapiens
tgggccaagatcgct

SEQ ID NO: 1926 - DNA, 15 bp, Homo sapiens
gtgggccaagatcgc

SEQ ID NO: 1927 - DNA, 15 bp, Homo sapiens
agtgggccaagatcg

SEQ ID NO: 1928 - DNA, 15 bp, Homo sapiens
cagtgggccaagatc

SEQ ID NO: 1929 - DNA, 15 bp, Homo sapiens
gcagtgggccaagat

SEQ ID NO: 1930 - DNA, 15 bp, Homo sapiens
tgcagtgggccaaga

SEQ ID NO: 1931 - DNA, 15 bp, Homo sapiens
ttgcagtgggccaag

SEQ ID NO: 1932 - DNA, 15 bp, Homo sapiens
gttgcagtgggccaa

SEQ ID NO: 1933 - DNA, 15 bp, Homo sapiens
ggttgcagtgggcca

SEQ ID NO: 1934 - DNA, 15 bp, Homo sapiens
aggttgcagtgggcc

SEQ ID NO: 1935 - DNA, 15 bp, Homo sapiens
aaggttgcagtgggc

SEQ ID NO: 1936 - DNA, 15 bp, Homo sapiens
aaaggttgcagtggg

SEQ ID NO: 1937 - DNA, 15 bp, Homo sapiens
taaaggttgcagtgg

SEQ ID NO: 1938 - DNA, 15 bp, Homo sapiens
gtaaaggttgcagtg

SEQ ID NO: 1939 - DNA, 15 bp, Homo sapiens
ggtaaaggttgcagt

SEQ ID NO: 1940 - DNA, 15 bp, Homo sapiens
aggtaaaggttgcag

SEQ ID NO: 1941 - DNA, 15 bp, Homo sapiens
gaggtaaaggttgca

SEQ ID NO: 1942 - DNA, 15 bp, Homo sapiens
ggaggtaaaggttgc

SEQ ID NO: 1943 - DNA, 15 bp, Homo sapiens
aggaggtaaaggttg

SEQ ID NO: 1944 - DNA, 15 bp, Homo sapiens
caggaggtaaaggtt

SEQ ID NO: 1945 - DNA, 15 bp, Homo sapiens
tcaggaggtaaaggt

SEQ ID NO: 1946 - DNA, 15 bp, Homo sapiens
ctcaggaggtaaagg

SEQ ID NO: 1947 - DNA, 15 bp, Homo sapiens
actcaggaggtaaag

SEQ ID NO: 1948 - DNA, 15 bp, Homo sapiens
aactcaggaggtaaa

SEQ ID NO: 1949 - DNA, 15 bp, Homo sapiens
gaactcaggaggtaa

SEQ ID NO: 1950 - DNA, 15 bp, Homo sapiens
tgaactcaggaggta

SEQ ID NO: 1951 - DNA, 15 bp, Homo sapiens
ttgaactcaggaggt

SEQ ID NO: 1952 - DNA, 15 bp, Homo sapiens
attgaactcaggagg

SEQ ID NO: 1953 - DNA, 15 bp, Homo sapiens
gattgaactcaggag

SEQ ID NO: 1954 - DNA, 15 bp, Homo sapiens
tgattgaactcagga

SEQ ID NO: 1955 - DNA, 15 bp, Homo sapiens
ttgattgaactcagg

SEQ ID NO: 1956 - DNA, 15 bp, Homo sapiens
attgattgaactcag

SEQ ID NO: 1957 - DNA, 15 bp, Homo sapiens
aattgattgaactca

SEQ ID NO: 1958 - DNA, 15 bp, Homo sapiens
gaattgattgaactc

SEQ ID NO: 1959 - DNA, 15 bp, Homo sapiens
ggaattgattgaact

SEQ ID NO: 1960 - DNA, 15 bp, Homo sapiens
gggaattgattgaac

SEQ ID NO: 1961 - DNA, 15 bp, Homo sapiens
ggggaattgattgaa

SEQ ID NO: 1962 - DNA, 15 bp, Homo sapiens
aggggaattgattga

SEQ ID NO: 1963 - DNA, 15 bp, Homo sapiens
caggggaattgattg

SEQ ID NO: 1964 - DNA, 15 bp, Homo sapiens
gcaggggaattgatt

SEQ ID NO: 1965 - DNA, 15 bp, Homo sapiens
ggcaggggaattgat

SEQ ID NO: 1966 - DNA, 15 bp, Homo sapiens
aggcaggggaattga

SEQ ID NO: 1967 - DNA, 15 bp, Homo sapiens
gaggcaggggaattg

SEQ ID NO: 1968 - DNA, 15 bp, Homo sapiens
tgaggcaggggaatt

SEQ ID NO: 1969 - DNA, 15 bp, Homo sapiens
ctgaggcaggggaat

SEQ ID NO: 1970 - DNA, 15 bp, Homo sapiens
gctgaggcaggggaa

SEQ ID NO: 1971 - DNA, 15 bp, Homo sapiens
ggctgaggcagggga

SEQ ID NO: 1972 - DNA, 15 bp, Homo sapiens
aggctgaggcagggg

SEQ ID NO: 1973 - DNA, 15 bp, Homo sapiens
gaggctgaggcaggg

SEQ ID NO: 1974 - DNA, 15 bp, Homo sapiens
ggaggctgaggcagg

SEQ ID NO: 1975 - DNA, 15 bp, Homo sapiens
aggaggctgaggcag

SEQ ID NO: 1976 - DNA, 15 bp, Homo sapiens
gtaatcccagctact

SEQ ID NO: 1977 - DNA, 15 bp, Homo sapiens
tgtaatcccagctac

SEQ ID NO: 1978 - DNA, 15 bp, Homo sapiens
ctgtaatcccagcta

SEQ ID NO: 1979 - DNA, 15 bp, Homo sapiens
cctgtaatcccagct

SEQ ID NO: 1980 - DNA, 15 bp, Homo sapiens
acctgtaatcccagc

SEQ ID NO: 1981 - DNA, 15 bp, Homo sapiens
cacctgtaatcccag

SEQ ID NO: 1982 - DNA, 15 bp, Homo sapiens
acacctgtaatccca

SEQ ID NO: 1983 - DNA, 15 bp, Homo sapiens
aacacctgtaatccc

SEQ ID NO: 1984 - DNA, 15 bp, Homo sapiens
aaacacctgtaatcc

SEQ ID NO: 1985 - DNA, 15 bp, Homo sapiens
caaacacctgtaatc

SEQ ID NO: 1986 - DNA, 15 bp, Homo sapiens
gcaaacacctgtaat

SEQ ID NO: 1987 - DNA, 15 bp, Homo sapiens
ggcaaacacctgtaa

SEQ ID NO: 1988 - DNA, 15 bp, Homo sapiens
tggcaaacacctgta

SEQ ID NO: 1989 - DNA, 15 bp, Homo sapiens
gtggcaaacacctgt

SEQ ID NO: 1990 - DNA, 15 bp, Homo sapiens
ggtggcaaacacctg

SEQ ID NO: 1991 - DNA, 15 bp, Homo sapiens
tggtggcaaacacct

SEQ ID NO: 1992 - DNA, 15 bp, Homo sapiens
atggtggcaaacacc

SEQ ID NO: 1993 - DNA, 15 bp, Homo sapiens
catggtggcaaacac

SEQ ID NO: 1994 - DNA, 15 bp, Homo sapiens
gcatggtggcaaaca

SEQ ID NO: 1995 - DNA, 15 bp, Homo sapiens
ggcatggtggcaaac

SEQ ID NO: 1996 - DNA, 15 bp, Homo sapiens
aggcatggtggcaaa

SEQ ID NO: 1997 - DNA, 15 bp, Homo sapiens
caggcatggtggcaa

SEQ ID NO: 1998 - DNA, 15 bp, Homo sapiens
ccaggcatggtggca

SEQ ID NO: 1999 - DNA, 15 bp, Homo sapiens
gccaggcatggtggc

SEQ ID NO: 2000 - DNA, 15 bp, Homo sapiens
agccaggcatggtgg

SEQ ID NO: 2001 - DNA, 15 bp, Homo sapiens
tagccaggcatggtg

SEQ ID NO: 2002 - DNA, 15 bp, Homo sapiens
ttagccaggcatggt

SEQ ID NO: 2003 - DNA, 15 bp, Homo sapiens
aattagccaggcatg

SEQ ID NO: 2004 - DNA, 15 bp, Homo sapiens
aaattagccaggcat

SEQ ID NO: 2005 - DNA, 15 bp, Homo sapiens
aaaattagccaggca

SEQ ID NO: 2006 - DNA, 15 bp, Homo sapiens
aaaaattagccaggc

SEQ ID NO: 2007 - DNA, 15 bp, Homo sapiens
taaaaattagccagg

SEQ ID NO: 2008 - DNA, 15 bp, Homo sapiens
ataaaaattagccag

SEQ ID NO: 2009 - DNA, 15 bp, Homo sapiens
tataaaaattagcca

SEQ ID NO: 2010 - DNA, 15 bp, Homo sapiens
atataaaaattagcc

SEQ ID NO: 2011 - DNA, 15 bp, Homo sapiens
aatataaaaattagc

SEQ ID NO: 2012 - DNA, 15 bp, Homo sapiens
aaatataaaaattag

SEQ ID NO: 2013 - DNA, 15 bp, Homo sapiens
aaaatataaaaatta

SEQ ID NO: 2014 - DNA, 15 bp, Homo sapiens
aaaaatataaaaatt

SEQ ID NO: 2015 - DNA, 15 bp, Homo sapiens
ctaaaaatataaaaa

SEQ ID NO: 2016 - DNA, 15 bp, Homo sapiens
actaaaaatataaaa

SEQ ID NO: 2017 - DNA, 15 bp, Homo sapiens
tactaaaaatataaa

SEQ ID NO: 2018 - DNA, 15 bp, Homo sapiens
ctactaaaaatataa

SEQ ID NO: 2019 - DNA, 15 bp, Homo sapiens
tctactaaaaatata

SEQ ID NO: 2020 - DNA, 15 bp, Homo sapiens
ctctactaaaaatat

SEQ ID NO: 2021 - DNA, 15 bp, Homo sapiens
cctgtctctactaaa

SEQ ID NO: 2022 - DNA, 15 bp, Homo sapiens
ccctgtctctactaa

SEQ ID NO: 2023 - DNA, 15 bp, Homo sapiens
accctgtctctacta

SEQ ID NO: 2024 - DNA, 15 bp, Homo sapiens
aaccctgtctctact

SEQ ID NO: 2025 - DNA, 15 bp, Homo sapiens
aaaccctgtctctac

SEQ ID NO: 2026 - DNA, 15 bp, Homo sapiens
gaaaccctgtctcta

SEQ ID NO: 2027 - DNA, 15 bp, Homo sapiens
cgaaaccctgtctct

SEQ ID NO: 2028 - DNA, 15 bp, Homo sapiens
gcgaaaccctgtctc

SEQ ID NO: 2029 - DNA, 15 bp, Homo sapiens
ggcgaaaccctgtct

SEQ ID NO: 2030 - DNA, 15 bp, Homo sapiens
tggcgaaaccctgtc

SEQ ID NO: 2031 - DNA, 15 bp, Homo sapiens
atggcgaaaccctgt

SEQ ID NO: 2032 - DNA, 15 bp, Homo sapiens
catggcgaaaccctg

SEQ ID NO: 2033 - DNA, 15 bp, Homo sapiens
acatggcgaaaccct

SEQ ID NO: 2034 - DNA, 15 bp, Homo sapiens
aacatggcgaaaccc

SEQ ID NO: 2035 - DNA, 15 bp, Homo sapiens
caacatggcgaaacc

SEQ ID NO: 2036 - DNA, 15 bp, Homo sapiens
ccaacatggcgaaac

SEQ ID NO: 2037 - DNA, 15 bp, Homo sapiens
gccaacatggcgaaa

SEQ ID NO: 2038 - DNA, 15 bp, Homo sapiens
ggccaacatggcgaa

SEQ ID NO: 2039 - DNA, 15 bp, Homo sapiens
tggccaacatggcga

SEQ ID NO: 2040 - DNA, 15 bp, Homo sapiens
ctggccaacatggcg

SEQ ID NO: 2041 - DNA, 15 bp, Homo sapiens
ccagcctggccaaca

SEQ ID NO: 2042 - DNA, 15 bp, Homo sapiens
accagcctggccaac

SEQ ID NO: 2043 - DNA, 15 bp, Homo sapiens
gaccagcctggccaa

SEQ ID NO: 2044 - DNA, 15 bp, Homo sapiens
agaccagcctggcca

SEQ ID NO: 2045 - DNA, 15 bp, Homo sapiens
gagaccagcctggcc

SEQ ID NO: 2046 - DNA, 15 bp, Homo sapiens
tttgagaccagcctg

SEQ ID NO: 2047 - DNA, 15 bp, Homo sapiens
gtttgagaccagcct

SEQ ID NO: 2048 - DNA, 15 bp, Homo sapiens
agtttgagaccagcc

SEQ ID NO: 2049 - DNA, 15 bp, Homo sapiens
gagtttgagaccagc

SEQ ID NO: 2050 - DNA, 15 bp, Homo sapiens
agagtttgagaccag

SEQ ID NO: 2051 - DNA, 15 bp, Homo sapiens
aagagtttgagacca

SEQ ID NO: 2052 - DNA, 15 bp, Homo sapiens
caagagtttgagacc

SEQ ID NO: 2053 - DNA, 15 bp, Homo sapiens
tcaagagtttgagac

SEQ ID NO: 2054 - DNA, 15 bp, Homo sapiens
gtcaagagtttgaga

SEQ ID NO: 2055 - DNA, 15 bp, Homo sapiens
ggtcaagagtttgag

SEQ ID NO: 2056 - DNA, 15 bp, Homo sapiens
aggtcaagagtttga

SEQ ID NO: 2057 - DNA, 15 bp, Homo sapiens
gaggtcaagagtttg

SEQ ID NO: 2058 - DNA, 15 bp, Homo sapiens
tgaggtcaagagttt

SEQ ID NO: 2059 - DNA, 15 bp, Homo sapiens
ttgaggtcaagagtt

SEQ ID NO: 2060 - DNA, 15 bp, Homo sapiens
cttgaggtcaagagt

SEQ ID NO: 2061 - DNA, 15 bp, Homo sapiens
acttgaggtcaagag

SEQ ID NO: 2062 - DNA, 15 bp, Homo sapiens
cacttgaggtcaaga

SEQ ID NO: 2063 - DNA, 15 bp, Homo sapiens
acacttgaggtcaag

SEQ ID NO: 2064 - DNA, 15 bp, Homo sapiens
aacacttgaggtcaa

SEQ ID NO: 2065 - DNA, 15 bp, Homo sapiens
taacacttgaggtca

SEQ ID NO: 2066 - DNA, 15 bp, Homo sapiens
ctaacacttgaggtc

SEQ ID NO: 2067 - DNA, 15 bp, Homo sapiens
gctaacacttgaggt

SEQ ID NO: 2068 - DNA, 15 bp, Homo sapiens
ggctaacacttgagg

SEQ ID NO: 2069 - DNA, 15 bp, Homo sapiens
tggctaacacttgag

SEQ ID NO: 2070 - DNA, 15 bp, Homo sapiens
ctggctaacacttga

SEQ ID NO: 2071 - DNA, 15 bp, Homo sapiens
cctggctaacacttg

SEQ ID NO: 2072 - DNA, 15 bp, Homo sapiens
acctggctaacactt

SEQ ID NO: 2073 - DNA, 15 bp, Homo sapiens
aacctggctaacact

SEQ ID NO: 2074 - DNA, 15 bp, Homo sapiens
caacctggctaacac

SEQ ID NO: 2075 - DNA, 15 bp, Homo sapiens
ccaacctggctaaca

SEQ ID NO: 2076 - DNA, 15 bp, Homo sapiens
accaacctggctaac

SEQ ID NO: 2077 - DNA, 15 bp, Homo sapiens
gaccaacctggctaa

SEQ ID NO: 2078 - DNA, 15 bp, Homo sapiens
agaccaacctggcta

SEQ ID NO: 2079 - DNA, 15 bp, Homo sapiens
aagaccaacctggct

SEQ ID NO: 2080 - DNA, 15 bp, Homo sapiens
caagaccaacctggc

SEQ ID NO: 2081 - DNA, 15 bp, Homo sapiens
tcaagaccaacctgg

SEQ ID NO: 2082 - DNA, 15 bp, Homo sapiens
ttcaagaccaacctg

SEQ ID NO: 2083 - DNA, 15 bp, Homo sapiens
gttcaagaccaacct

SEQ ID NO: 2084 - DNA, 15 bp, Homo sapiens
agttcaagaccaacc

SEQ ID NO: 2085 - DNA, 15 bp, Homo sapiens
gagttcaagaccaac

SEQ ID NO: 2086 - DNA, 15 bp, Homo sapiens
agagttcaagaccaa

SEQ ID NO: 2087 - DNA, 15 bp, Homo sapiens
cagagttcaagacca

SEQ ID NO: 2088 - DNA, 15 bp, Homo sapiens
ccagagttcaagacc

SEQ ID NO: 2089 - DNA, 15 bp, Homo sapiens
tccagagttcaagac

SEQ ID NO: 2090 - DNA, 15 bp, Homo sapiens
gtccagagttcaaga

SEQ ID NO: 2091 - DNA, 15 bp, Homo sapiens
ggtccagagttcaag

SEQ ID NO: 2092 - DNA, 15 bp, Homo sapiens
aggtccagagttcaa

SEQ ID NO: 2093 - DNA, 15 bp, Homo sapiens
gaggtccagagttca

SEQ ID NO: 2094 - DNA, 15 bp, Homo sapiens
tgaggtccagagttc

SEQ ID NO: 2095 - DNA, 15 bp, Homo sapiens
ttgaggtccagagtt

SEQ ID NO: 2096 - DNA, 15 bp, Homo sapiens
cttgaggtccagagt

SEQ ID NO: 2097 - DNA, 15 bp, Homo sapiens
acttgaggtccagag

SEQ ID NO: 2098 - DNA, 15 bp, Homo sapiens
cacttgaggtccaga

SEQ ID NO: 2099 - DNA, 15 bp, Homo sapiens
tcacttgaggtccag

SEQ ID NO: 2100 - DNA, 15 bp, Homo sapiens
atcacttgaggtcca

SEQ ID NO: 2101 - DNA, 15 bp, Homo sapiens
gatcacttgaggtcc

SEQ ID NO: 2102 - DNA, 15 bp, Homo sapiens
aggcagatcacttga

SEQ ID NO: 2103 - DNA, 15 bp, Homo sapiens
caggcagatcacttg

SEQ ID NO: 2104 - DNA, 15 bp, Homo sapiens
gcaggcagatcactt

SEQ ID NO: 2105 - DNA, 15 bp, Homo sapiens
ggcaggcagatcact

SEQ ID NO: 2106 - DNA, 15 bp, Homo sapiens
aggcaggcagatcac

SEQ ID NO: 2107 - DNA, 15 bp, Homo sapiens
gaggcaggcagatca

SEQ ID NO: 2108 - DNA, 15 bp, Homo sapiens
tgaggcaggcagatc

SEQ ID NO: 2109 - DNA, 15 bp, Homo sapiens
ctgaggcaggcagat

SEQ ID NO: 2110 - DNA, 15 bp, Homo sapiens
gctgaggcaggcaga

SEQ ID NO: 2111 - DNA, 15 bp, Homo sapiens
ggctgaggcaggcag

SEQ ID NO: 2112 - DNA, 15 bp, Homo sapiens
aggctgaggcaggca

SEQ ID NO: 2113 - DNA, 15 bp, Homo sapiens
gaggctgaggcaggc

SEQ ID NO: 2114 - DNA, 15 bp, Homo sapiens
gggaggctgaggcag

SEQ ID NO: 2115 - DNA, 15 bp, Homo sapiens
tgggaggctgaggca

SEQ ID NO: 2116 - DNA, 15 bp, Homo sapiens
ttgggaggctgaggc

SEQ ID NO: 2117 - DNA, 15 bp, Homo sapiens
tttgggaggctgagg

SEQ ID NO: 2118 - DNA, 15 bp, Homo sapiens
ctttgggaggctgag

SEQ ID NO: 2119 - DNA, 15 bp, Homo sapiens
tctttgggaggctga

SEQ ID NO: 2120 - DNA, 15 bp, Homo sapiens
ctctttgggaggctg

SEQ ID NO: 2121 - DNA, 15 bp, Homo sapiens
gctctttgggaggct

SEQ ID NO: 2122 - DNA, 15 bp, Homo sapiens
gcctgtaatcccagc

SEQ ID NO: 2123 - DNA, 15 bp, Homo sapiens
tgcctgtaatcccag

SEQ ID NO: 2124 - DNA, 15 bp, Homo sapiens
atgcctgtaatccca

SEQ ID NO: 2125 - DNA, 15 bp, Homo sapiens
catgcctgtaatccc

SEQ ID NO: 2126 - DNA, 15 bp, Homo sapiens
tcatgcctgtaatcc

SEQ ID NO: 2127 - DNA, 15 bp, Homo sapiens
ctcatgcctgtaatc

SEQ ID NO: 2128 - DNA, 15 bp, Homo sapiens
gctcatgcctgtaat

SEQ ID NO: 2129 - DNA, 15 bp, Homo sapiens
ggctcatgcctgtaa

SEQ ID NO: 2130 - DNA, 15 bp, Homo sapiens
tggctcatgcctgta

SEQ ID NO: 2131 - DNA, 15 bp, Homo sapiens
gtggctcatgcctgt

SEQ ID NO: 2132 - DNA, 15 bp, Homo sapiens
ggtggctcatgcctg

SEQ ID NO: 2133 - DNA, 15 bp, Homo sapiens
tggtggctcatgcct

SEQ ID NO: 2134 - DNA, 15 bp, Homo sapiens
atggtggctcatgcc

SEQ ID NO: 2135 - DNA, 15 bp, Homo sapiens
catggtggctcatgc

SEQ ID NO: 2136 - DNA, 15 bp, Homo sapiens
gcatggtggctcatg

SEQ ID NO: 2137 - DNA, 15 bp, Homo sapiens
agcatggtggctcat

SEQ ID NO: 2138 - DNA, 15 bp, Homo sapiens
cagcatggtggctca

SEQ ID NO: 2139 - DNA, 15 bp, Homo sapiens
ccagcatggtggctc

SEQ ID NO: 2140 - DNA, 15 bp, Homo sapiens
cccagcatggtggct

SEQ ID NO: 2141 - DNA, 15 bp, Homo sapiens
gcccagcatggtggc

SEQ ID NO: 2142 - DNA, 15 bp, Homo sapiens
ggcccagcatggtgg

SEQ ID NO: 2143 - DNA, 15 bp, Homo sapiens
gggcccagcatggtg

SEQ ID NO: 2144 - DNA, 15 bp, Homo sapiens
tgggcccagcatggt

SEQ ID NO: 2145 - DNA, 15 bp, Homo sapiens
ttgggcccagcatgg

SEQ ID NO: 2146 - DNA, 15 bp, Homo sapiens
gttgggcccagcatg

SEQ ID NO: 2147 - DNA, 15 bp, Homo sapiens
agttgggcccagcat

SEQ ID NO: 2148 - DNA, 15 bp, Homo sapiens
gagttgggcccagca

SEQ ID NO: 2149 - DNA, 15 bp, Homo sapiens
agagttgggcccagc

SEQ ID NO: 2150 - DNA, 15 bp, Homo sapiens
gagagttgggcccag

SEQ ID NO: 2151 - DNA, 15 bp, Homo sapiens
agagagttgggccca

SEQ ID NO: 2152 - DNA, 15 bp, Homo sapiens
aagagagttgggccc

SEQ ID NO: 2153 - DNA, 15 bp, Homo sapiens
aaagagagttgggcc

SEQ ID NO: 2154 - DNA, 15 bp, Homo sapiens
aaaagagagttgggc

SEQ ID NO: 2155 - DNA, 15 bp, Homo sapiens
aaaaagagagttggg

SEQ ID NO: 2156 - DNA, 15 bp, Homo sapiens
caaaaagagagttgg

SEQ ID NO: 2157 - DNA, 15 bp, Homo sapiens
acaaaaagagagttg

SEQ ID NO: 2158 - DNA, 15 bp, Homo sapiens
gacaaaaagagagtt

SEQ ID NO: 2159 - DNA, 15 bp, Homo sapiens
tgacaaaaagagagt

SEQ ID NO: 2160 - DNA, 15 bp, Homo sapiens
atgacaaaaagagag

SEQ ID NO: 2161 - DNA, 15 bp, Homo sapiens
gatgacaaaaagaga

SEQ ID NO: 2162 - DNA, 15 bp, Homo sapiens
agatgacaaaaagag

SEQ ID NO: 2163 - DNA, 15 bp, Homo sapiens
gagatgacaaaaaga

SEQ ID NO: 2164 - DNA, 15 bp, Homo sapiens
ggagatgacaaaaag

SEQ ID NO: 2165 - DNA, 15 bp, Homo sapiens
cggagatgacaaaaa

SEQ ID NO: 2166 - DNA, 15 bp, Homo sapiens
gcggagatgacaaaa

SEQ ID NO: 2167 - DNA, 15 bp, Homo sapiens
agcggagatgacaaa

SEQ ID NO: 2168 - DNA, 15 bp, Homo sapiens
aagcggagatgacaa

SEQ ID NO: 2169 - DNA, 15 bp, Homo sapiens
taagcggagatgaca

SEQ ID NO: 2170 - DNA, 15 bp, Homo sapiens
ataagcggagatgac

SEQ ID NO: 2171 - DNA, 15 bp, Homo sapiens
tataagcggagatga

SEQ ID NO: 2172 - DNA, 15 bp, Homo sapiens
atataagcggagatg

SEQ ID NO: 2173 - DNA, 15 bp, Homo sapiens
tatataagcggagat

SEQ ID NO: 2174 - DNA, 15 bp, Homo sapiens
ttatataagcggaga

SEQ ID NO: 2175 - DNA, 15 bp, Homo sapiens
gttatataagcggag

SEQ ID NO: 2176 - DNA, 15 bp, Homo sapiens
agttatataagcgga

SEQ ID NO: 2177 - DNA, 15 bp, Homo sapiens
gagttatataagcgg

SEQ ID NO: 2178 - DNA, 15 bp, Homo sapiens
tgagttatataagcg

SEQ ID NO: 2179 - DNA, 15 bp, Homo sapiens
ctgagttatataagc

SEQ ID NO: 2180 - DNA, 15 bp, Homo sapiens
tctgagttatataag

SEQ ID NO: 2181 - DNA, 15 bp, Homo sapiens
ctctgagttatataa

SEQ ID NO: 2182 - DNA, 15 bp, Homo sapiens
cctctgagttatata

SEQ ID NO: 2183 - DNA, 15 bp, Homo sapiens
gcctctgagttatat

SEQ ID NO: 2184 - DNA, 15 bp, Homo sapiens
tgcctctgagttata

SEQ ID NO: 2185 - DNA, 15 bp, Homo sapiens
atgcctctgagttat

SEQ ID NO: 2186 - DNA, 15 bp, Homo sapiens
aatgcctctgagtta

SEQ ID NO: 2187 - DNA, 15 bp, Homo sapiens
aaatgcctctgagtt

SEQ ID NO: 2188 - DNA, 15 bp, Homo sapiens
gaaatgcctctgagt

SEQ ID NO: 2189 - DNA, 15 bp, Homo sapiens
tgaaatgcctctgag

SEQ ID NO: 2190 - DNA, 15 bp, Homo sapiens
ttgaaatgcctctga

SEQ ID NO: 2191 - DNA, 15 bp, Homo sapiens
cttgaaatgcctctg

SEQ ID NO: 2192 - DNA, 15 bp, Homo sapiens
gcttgaaatgcctct

SEQ ID NO: 2193 - DNA, 15 bp, Homo sapiens
agcttgaaatgcctc

SEQ ID NO: 2194 - DNA, 15 bp, Homo sapiens
gagcttgaaatgcct

SEQ ID NO: 2195 - DNA, 15 bp, Homo sapiens
agagcttgaaatgcc

SEQ ID NO: 2196 - DNA, 15 bp, Homo sapiens
cagagcttgaaatgc

SEQ ID NO: 2197 - DNA, 15 bp, Homo sapiens
gcagagcttgaaatg

SEQ ID NO: 2198 - DNA, 15 bp, Homo sapiens
tgcagagcttgaaat

SEQ ID NO: 2199 - DNA, 15 bp, Homo sapiens
ttgcagagcttgaaa

SEQ ID NO: 2200 - DNA, 15 bp, Homo sapiens
tttgcagagcttgaa

SEQ ID NO: 2201 - DNA, 15 bp, Homo sapiens
atttgcagagcttga

SEQ ID NO: 2202 - DNA, 15 bp, Homo sapiens
gatttgcagagcttg

SEQ ID NO: 2203 - DNA, 15 bp, Homo sapiens
ggatttgcagagctt

SEQ ID NO: 2204 - DNA, 15 bp, Homo sapiens
tggatttgcagagct

SEQ ID NO: 2205 - DNA, 15 bp, Homo sapiens
ttggatttgcagagc

SEQ ID NO: 2206 - DNA, 15 bp, Homo sapiens
tttggatttgcagag

SEQ ID NO: 2207 - DNA, 15 bp, Homo sapiens
atttggatttgcaga

SEQ ID NO: 2208 - DNA, 15 bp, Homo sapiens
gatttggatttgcag

SEQ ID NO: 2209 - DNA, 15 bp, Homo sapiens
tgatttggatttgca

SEQ ID NO: 2210 - DNA, 15 bp, Homo sapiens
gtgatttggatttgc

SEQ ID NO: 2211 - DNA, 15 bp, Homo sapiens
tgtgatttggatttg

SEQ ID NO: 2212 - DNA, 15 bp, Homo sapiens
atgtgatttggattt

SEQ ID NO: 2213 - DNA, 15 bp, Homo sapiens
aatgtgatttggatt

SEQ ID NO: 2214 - DNA, 15 bp, Homo sapiens
caatgtgatttggat

SEQ ID NO: 2215 - DNA, 15 bp, Homo sapiens
tcaatgtgatttgga

SEQ ID NO: 2216 - DNA, 15 bp, Homo sapiens
atcaatgtgatttgg

SEQ ID NO: 2217 - DNA, 15 bp, Homo sapiens
catcaatgtgatttg

SEQ ID NO: 2218 - DNA, 15 bp, Homo sapiens
tcatcaatgtgattt

SEQ ID NO: 2219 - DNA, 15 bp, Homo sapiens
atcatcaatgtgatt

SEQ ID NO: 2220 - DNA, 15 bp, Homo sapiens
aatcatcaatgtgat

SEQ ID NO: 2221 - DNA, 15 bp, Homo sapiens
gaatcatcaatgtga

SEQ ID NO: 2222 - DNA, 15 bp, Homo sapiens
ggaatcatcaatgtg

SEQ ID NO: 2223 - DNA, 15 bp, Homo sapiens
aggaatcatcaatgt

SEQ ID NO: 2224 - DNA, 15 bp, Homo sapiens
aaggaatcatcaatg

SEQ ID NO: 2225 - DNA, 15 bp, Homo sapiens
aaaggaatcatcaat

SEQ ID NO: 2226 - DNA, 15 bp, Homo sapiens
gaaaggaatcatcaa

SEQ ID NO: 2227 - DNA, 15 bp, Homo sapiens
agaaaggaatcatca

SEQ ID NO: 2228 - DNA, 15 bp, Homo sapiens
gagaaaggaatcatc

SEQ ID NO: 2229 - DNA, 15 bp, Homo sapiens
ggagaaaggaatcat

SEQ ID NO: 2230 - DNA, 15 bp, Homo sapiens
gggagaaaggaatca

SEQ ID NO: 2231 - DNA, 15 bp, Homo sapiens
tgggagaaaggaatc

SEQ ID NO: 2232 - DNA, 15 bp, Homo sapiens
ctgggagaaaggaat

SEQ ID NO: 2233 - DNA, 15 bp, Homo sapiens
gctgggagaaaggaa

SEQ ID NO: 2234 - DNA, 15 bp, Homo sapiens
ggctgggagaaagga

SEQ ID NO: 2235 - DNA, 15 bp, Homo sapiens
aggctgggagaaagg

SEQ ID NO: 2236 - DNA, 15 bp, Homo sapiens
caggctgggagaaag

SEQ ID NO: 2237 - DNA, 15 bp, Homo sapiens
gcaggctgggagaaa

SEQ ID NO: 2238 - DNA, 15 bp, Homo sapiens
agcaggctgggagaa

SEQ ID NO: 2239 - DNA, 15 bp, Homo sapiens
tagcaggctgggaga

SEQ ID NO: 2240 - DNA, 15 bp, Homo sapiens
atagcaggctgggag

SEQ ID NO: 2241 - DNA, 15 bp, Homo sapiens
gatagcaggctggga

SEQ ID NO: 2242 - DNA, 15 bp, Homo sapiens
ggatagcaggctggg

SEQ ID NO: 2243 - DNA, 15 bp, Homo sapiens
aggatagcaggctgg

SEQ ID NO: 2244 - DNA, 15 bp, Homo sapiens
gaggatagcaggctg

SEQ ID NO: 2245 - DNA, 15 bp, Homo sapiens
tgaggatagcaggct

SEQ ID NO: 2246 - DNA, 15 bp, Homo sapiens
ctgaggatagcaggc

SEQ ID NO: 2247 - DNA, 15 bp, Homo sapiens
actgaggatagcagg

SEQ ID NO: 2248 - DNA, 15 bp, Homo sapiens
cactgaggatagcag

SEQ ID NO: 2249 - DNA, 15 bp, Homo sapiens
acactgaggatagca

SEQ ID NO: 2250 - DNA, 15 bp, Homo sapiens
aacactgaggatagc

SEQ ID NO: 2251 - DNA, 15 bp, Homo sapiens
caacactgaggatag

SEQ ID NO: 2252 - DNA, 15 bp, Homo sapiens
gcaacactgaggata

SEQ ID NO: 2253 - DNA, 15 bp, Homo sapiens
ggcaacactgaggat

SEQ ID NO: 2254 - DNA, 15 bp, Homo sapiens
gggcaacactgagga

SEQ ID NO: 2255 - DNA, 15 bp, Homo sapiens
tgggcaacactgagg

SEQ ID NO: 2256 - DNA, 15 bp, Homo sapiens
ctgggcaacactgag

SEQ ID NO: 2257 - DNA, 15 bp, Homo sapiens
gctgggcaacactga

SEQ ID NO: 2258 - DNA, 15 bp, Homo sapiens
agctgggcaacactg

SEQ ID NO: 2259 - DNA, 15 bp, Homo sapiens
gagctgggcaacact

SEQ ID NO: 2260 - DNA, 15 bp, Homo sapiens
tgagctgggcaacac

SEQ ID NO: 2261 - DNA, 15 bp, Homo sapiens
ttgagctgggcaaca

SEQ ID NO: 2262 - DNA, 15 bp, Homo sapiens
attgagctgggcaac

SEQ ID NO: 2263 - DNA, 15 bp, Homo sapiens
cattgagctgggcaa

SEQ ID NO: 2264 - DNA, 15 bp, Homo sapiens
tcattgagctgggca

SEQ ID NO: 2265 - DNA, 15 bp, Homo sapiens
gtcattgagctgggc

SEQ ID NO: 2266 - DNA, 15 bp, Homo sapiens
agtcattgagctggg

SEQ ID NO: 2267 - DNA, 15 bp, Homo sapiens
gagtcattgagctgg

SEQ ID NO: 2268 - DNA, 15 bp, Homo sapiens
tgagtcattgagctg

SEQ ID NO: 2269 - DNA, 15 bp, Homo sapiens
gtgagtcattgagct

SEQ ID NO: 2270 - DNA, 15 bp, Homo sapiens
tgtgagtcattgagc

SEQ ID NO: 2271 - DNA, 15 bp, Homo sapiens
gtgtgagtcattgag

SEQ ID NO: 2272 - DNA, 15 bp, Homo sapiens
agtgtgagtcattga

SEQ ID NO: 2273 - DNA, 15 bp, Homo sapiens
aagtgtgagtcattg

SEQ ID NO: 2274 - DNA, 15 bp, Homo sapiens
gaagtgtgagtcatt

SEQ ID NO: 2275 - DNA, 15 bp, Homo sapiens
tgaagtgtgagtcat

SEQ ID NO: 2276 - DNA, 15 bp, Homo sapiens
gtgaagtgtgagtca

SEQ ID NO: 2277 - DNA, 15 bp, Homo sapiens
ggtgaagtgtgagtc

SEQ ID NO: 2278 - DNA, 15 bp, Homo sapiens
aggtgaagtgtgagt

SEQ ID NO: 2279 - DNA, 15 bp, Homo sapiens
taggtgaagtgtgag

SEQ ID NO: 2280 - DNA, 15 bp, Homo sapiens
ttaggtgaagtgtga

SEQ ID NO: 2281 - DNA, 15 bp, Homo sapiens
attaggtgaagtgtg

SEQ ID NO: 2282 - DNA, 15 bp, Homo sapiens
aattaggtgaagtgt

SEQ ID NO: 2283 - DNA, 15 bp, Homo sapiens
caattaggtgaagtg

SEQ ID NO: 2284 - DNA, 15 bp, Homo sapiens
gcaattaggtgaagt

SEQ ID NO: 2285 - DNA, 15 bp, Homo sapiens
ggcaattaggtgaag

SEQ ID NO: 2286 - DNA, 15 bp, Homo sapiens
aggcaattaggtgaa

SEQ ID NO: 2287 - DNA, 15 bp, Homo sapiens
taggcaattaggtga

SEQ ID NO: 2288 - DNA, 15 bp, Homo sapiens
ttaggcaattaggtg

SEQ ID NO: 2289 - DNA, 15 bp, Homo sapiens
cttaggcaattaggt

SEQ ID NO: 2290 - DNA, 15 bp, Homo sapiens
gcttaggcaattagg

SEQ ID NO: 2291 - DNA, 15 bp, Homo sapiens
ggcttaggcaattag

SEQ ID NO: 2292 - DNA, 15 bp, Homo sapiens
tggcttaggcaatta

SEQ ID NO: 2293 - DNA, 15 bp, Homo sapiens
ttggcttaggcaatt

SEQ ID NO: 2294 - DNA, 15 bp, Homo sapiens
tttggcttaggcaat

SEQ ID NO: 2295 - DNA, 15 bp, Homo sapiens
ttttggcttaggcaa

SEQ ID NO: 2296 - DNA, 15 bp, Homo sapiens
attttggcttaggca

SEQ ID NO: 2297 - DNA, 15 bp, Homo sapiens
aattttggcttaggc

SEQ ID NO: 2298 - DNA, 15 bp, Homo sapiens
caattttggcttagg

SEQ ID NO: 2299 - DNA, 15 bp, Homo sapiens
ccaattttggcttag

SEQ ID NO: 2300 - DNA, 15 bp, Homo sapiens
cccaattttggctta

SEQ ID NO: 2301 - DNA, 15 bp, Homo sapiens
ccccaattttggctt

SEQ ID NO: 2302 - DNA, 15 bp, Homo sapiens
tccccaattttggct

SEQ ID NO: 2303 - DNA, 15 bp, Homo sapiens
ctccccaattttggc

SEQ ID NO: 2304 - DNA, 15 bp, Homo sapiens
actccccaattttgg

SEQ ID NO: 2305 - DNA, 15 bp, Homo sapiens
gactccccaattttg

SEQ ID NO: 2306 - DNA, 15 bp, Homo sapiens
tgactccccaatttt

SEQ ID NO: 2307 - DNA, 15 bp, Homo sapiens
atgactccccaattt

SEQ ID NO: 2308 - DNA, 15 bp, Homo sapiens
aatgactccccaatt

SEQ ID NO: 2309 - DNA, 15 bp, Homo sapiens
aaatgactccccaat

SEQ ID NO: 2310 - DNA, 15 bp, Homo sapiens
aaaatgactccccaa

SEQ ID NO: 2311 - DNA, 15 bp, Homo sapiens
caaaatgactcccca

SEQ ID NO: 2312 - DNA, 15 bp, Homo sapiens
gcaaaatgactcccc

SEQ ID NO: 2313 - DNA, 15 bp, Homo sapiens
tgcaaaatgactccc

SEQ ID NO: 2314 - DNA, 15 bp, Homo sapiens
gtgcaaaatgactcc

SEQ ID NO: 2315 - DNA, 15 bp, Homo sapiens
tgtgcaaaatgactc

SEQ ID NO: 2316 - DNA, 15 bp, Homo sapiens
atgtgcaaaatgact

SEQ ID NO: 2317 - DNA, 15 bp, Homo sapiens
aatgtgcaaaatgac

SEQ ID NO: 2318 - DNA, 15 bp, Homo sapiens
aaatgtgcaaaatga

SEQ ID NO: 2319 - DNA, 15 bp, Homo sapiens
aaaatgtgcaaaatg

SEQ ID NO: 2320 - DNA, 15 bp, Homo sapiens
caaaatgtgcaaaat

SEQ ID NO: 2321 - DNA, 15 bp, Homo sapiens
gcaaaatgtgcaaaa

SEQ ID NO: 2322 - DNA, 15 bp, Homo sapiens
tgcaaaatgtgcaaa

SEQ ID NO: 2323 - DNA, 15 bp, Homo sapiens
gtgcaaaatgtgcaa

SEQ ID NO: 2324 - DNA, 15 bp, Homo sapiens
tgtgcaaaatgtgca

SEQ ID NO: 2325 - DNA, 15 bp, Homo sapiens
atgtgcaaaatgtgc

SEQ ID NO: 2326 - DNA, 15 bp, Homo sapiens
aatgtgcaaaatgtg

SEQ ID NO: 2327 - DNA, 15 bp, Homo sapiens
caatgtgcaaaatgt

SEQ ID NO: 2328 - DNA, 15 bp, Homo sapiens
ccaatgtgcaaaatg

SEQ ID NO: 2329 - DNA, 15 bp, Homo sapiens
tccaatgtgcaaaat

SEQ ID NO: 2330 - DNA, 15 bp, Homo sapiens
atccaatgtgcaaaa

SEQ ID NO: 2331 - DNA, 15 bp, Homo sapiens
tatccaatgtgcaaa

SEQ ID NO: 2332 - DNA, 15 bp, Homo sapiens
atatccaatgtgcaa

SEQ ID NO: 2333 - DNA, 15 bp, Homo sapiens
catatccaatgtgca

SEQ ID NO: 2334 - DNA, 15 bp, Homo sapiens
tcatatccaatgtgc

SEQ ID NO: 2335 - DNA, 15 bp, Homo sapiens
ttcatatccaatgtg

SEQ ID NO: 2336 - DNA, 15 bp, Homo sapiens
attcatatccaatgt

SEQ ID NO: 2337 - DNA, 15 bp, Homo sapiens
gattcatatccaatg

SEQ ID NO: 2338 - DNA, 15 bp, Homo sapiens
agattcatatccaat

SEQ ID NO: 2339 - DNA, 15 bp, Homo sapiens
gagattcatatccaa

SEQ ID NO: 2340 - DNA, 15 bp, Homo sapiens
agagattcatatcca

SEQ ID NO: 2341 - DNA, 15 bp, Homo sapiens
gagagattcatatcc

SEQ ID NO: 2342 - DNA, 15 bp, Homo sapiens
tgagagattcatatc

SEQ ID NO: 2343 - DNA, 15 bp, Homo sapiens
atgagagattcatat

SEQ ID NO: 2344 - DNA, 15 bp, Homo sapiens
tatgagagattcata

SEQ ID NO: 2345 - DNA, 15 bp, Homo sapiens
atatgagagattcat

SEQ ID NO: 2346 - DNA, 15 bp, Homo sapiens
gatatgagagattca

SEQ ID NO: 2347 - DNA, 15 bp, Homo sapiens
ggatatgagagattc

SEQ ID NO: 2348 - DNA, 15 bp, Homo sapiens
tggatatgagagatt

SEQ ID NO: 2349 - DNA, 15 bp, Homo sapiens
ttggatatgagagat

SEQ ID NO: 2350 - DNA, 15 bp, Homo sapiens
attggatatgagaga

SEQ ID NO: 2351 - DNA, 15 bp, Homo sapiens
gattggatatgagag

SEQ ID NO: 2352 - DNA, 15 bp, Homo sapiens
tgattggatatgaga

SEQ ID NO: 2353 - DNA, 15 bp, Homo sapiens
ttgattggatatgag

SEQ ID NO: 2354 - DNA, 15 bp, Homo sapiens
attgattggatatga

SEQ ID NO: 2355 - DNA, 15 bp, Homo sapiens
aattgattggatatg

SEQ ID NO: 2356 - DNA, 15 bp, Homo sapiens
gaattgattggatat

SEQ ID NO: 2357 - DNA, 15 bp, Homo sapiens
ggaattgattggata

SEQ ID NO: 2358 - DNA, 15 bp, Homo sapiens
gggaattgattggat

SEQ ID NO: 2359 - DNA, 15 bp, Homo sapiens
tgggaattgattgga

SEQ ID NO: 2360 - DNA, 15 bp, Homo sapiens
ttgggaattgattgg

SEQ ID NO: 2361 - DNA, 15 bp, Homo sapiens
tttgggaattgattg

SEQ ID NO: 2362 - DNA, 15 bp, Homo sapiens
atttgggaattgatt

SEQ ID NO: 2363 - DNA, 15 bp, Homo sapiens
gatttgggaattgat

SEQ ID NO: 2364 - DNA, 15 bp, Homo sapiens
ggatttgggaattga

SEQ ID NO: 2365 - DNA, 15 bp, Homo sapiens
aggatttgggaattg

SEQ ID NO: 2366 - DNA, 15 bp, Homo sapiens
taggatttgggaatt

SEQ ID NO: 2367 - DNA, 15 bp, Homo sapiens
ataggatttgggaat

SEQ ID NO: 2368 - DNA, 15 bp, Homo sapiens
aataggatttgggaa

SEQ ID NO: 2369 - DNA, 15 bp, Homo sapiens
caataggatttggga

SEQ ID NO: 2370 - DNA, 15 bp, Homo sapiens
tcaataggatttggg

SEQ ID NO: 2371 - DNA, 15 bp, Homo sapiens
gtcaataggatttgg

SEQ ID NO: 2372 - DNA, 15 bp, Homo sapiens
agtcaataggatttg

SEQ ID NO: 2373 - DNA, 15 bp, Homo sapiens
aagtcaataggattt

SEQ ID NO: 2374 - DNA, 15 bp, Homo sapiens
aaagtcaataggatt

SEQ ID NO: 2375 - DNA, 15 bp, Homo sapiens
gaaagtcaataggat

SEQ ID NO: 2376 - DNA, 15 bp, Homo sapiens
agaaagtcaatagga

SEQ ID NO: 2377 - DNA, 15 bp, Homo sapiens
aagaaagtcaatagg

SEQ ID NO: 2378 - DNA, 15 bp, Homo sapiens
aaagaaagtcaatag

SEQ ID NO: 2379 - DNA, 15 bp, Homo sapiens
caaagaaagtcaata

SEQ ID NO: 2380 - DNA, 15 bp, Homo sapiens
tcaaagaaagtcaat

SEQ ID NO: 2381 - DNA, 15 bp, Homo sapiens
atcaaagaaagtcaa

SEQ ID NO: 2382 - DNA, 15 bp, Homo sapiens
tatcaaagaaagtca

SEQ ID NO: 2383 - DNA, 15 bp, Homo sapiens
atatcaaagaaagtc

SEQ ID NO: 2384 - DNA, 15 bp, Homo sapiens
gatatcaaagaaagt

SEQ ID NO: 2385 - DNA, 15 bp, Homo sapiens
agatatcaaagaaag

SEQ ID NO: 2386 - DNA, 15 bp, Homo sapiens
tagatatcaaagaaa

SEQ ID NO: 2387 - DNA, 15 bp, Homo sapiens
ttagatatcaaagaa

SEQ ID NO: 2388 - DNA, 15 bp, Homo sapiens
tttagatatcaaaga

SEQ ID NO: 2389 - DNA, 15 bp, Homo sapiens
atttagatatcaaag

SEQ ID NO: 2390 - DNA, 15 bp, Homo sapiens
tatttagatatcaaa

SEQ ID NO: 2391 - DNA, 15 bp, Homo sapiens
atatttagatatcaa

SEQ ID NO: 2392 - DNA, 15 bp, Homo sapiens
gatatttagatatca

SEQ ID NO: 2393 - DNA, 15 bp, Homo sapiens
ggatatttagatatc

SEQ ID NO: 2394 - DNA, 15 bp, Homo sapiens
gggatatttagatat

SEQ ID NO: 2395 - DNA, 15 bp, Homo sapiens
tgggatatttagata

SEQ ID NO: 2396 - DNA, 15 bp, Homo sapiens
gtgggatatttagat

SEQ ID NO: 2397 - DNA, 15 bp, Homo sapiens
tgtgggatatttaga

SEQ ID NO: 2398 - DNA, 15 bp, Homo sapiens
atgtgggatatttag

SEQ ID NO: 2399 - DNA, 15 bp, Homo sapiens
tatgtgggatattta

SEQ ID NO: 2400 - DNA, 15 bp, Homo sapiens
atatgtgggatattt

SEQ ID NO: 2401 - DNA, 15 bp, Homo sapiens
aatatgtgggatatt

SEQ ID NO: 2402 - DNA, 15 bp, Homo sapiens
gaatatgtgggatat

SEQ ID NO: 2403 - DNA, 15 bp, Homo sapiens
tgaatatgtgggata

SEQ ID NO: 2404 - DNA, 15 bp, Homo sapiens
gtgaatatgtgggat

SEQ ID NO: 2405 - DNA, 15 bp, Homo sapiens
ggtgaatatgtggga

SEQ ID NO: 2406 - DNA, 15 bp, Homo sapiens
gggtgaatatgtggg

SEQ ID NO: 2407 - DNA, 15 bp, Homo sapiens
tgggtgaatatgtgg

SEQ ID NO: 2408 - DNA, 15 bp, Homo sapiens
atgggtgaatatgtg

SEQ ID NO: 2409 - DNA, 15 bp, Homo sapiens
aatgggtgaatatgt

SEQ ID NO: 2410 - DNA, 15 bp, Homo sapiens
aaatgggtgaatatg

SEQ ID NO: 2411 - DNA, 15 bp, Homo sapiens
gaaatgggtgaatat

SEQ ID NO: 2412 - DNA, 15 bp, Homo sapiens
agaaatgggtgaata

SEQ ID NO: 2413 - DNA, 15 bp, Homo sapiens
aagaaatgggtgaat

SEQ ID NO: 2414 - DNA, 15 bp, Homo sapiens
aaagaaatgggtgaa

SEQ ID NO: 2415 - DNA, 15 bp, Homo sapiens
gaaagaaatgggtga

SEQ ID NO: 2416 - DNA, 15 bp, Homo sapiens
agaaagaaatgggtg

SEQ ID NO: 2417 - DNA, 15 bp, Homo sapiens
tagaaagaaatgggt

SEQ ID NO: 2418 - DNA, 15 bp, Homo sapiens
atagaaagaaatggg

SEQ ID NO: 2419 - DNA, 15 bp, Homo sapiens
gatagaaagaaatgg

SEQ ID NO: 2420 - DNA, 15 bp, Homo sapiens
agatagaaagaaatg

SEQ ID NO: 2421 - DNA, 15 bp, Homo sapiens
tagatagaaagaaat

SEQ ID NO: 2422 - DNA, 15 bp, Homo sapiens
gtagatagaaagaaa

SEQ ID NO: 2423 - DNA, 15 bp, Homo sapiens
agtagatagaaagaa

SEQ ID NO: 2424 - DNA, 15 bp, Homo sapiens
gagtagatagaaaga

SEQ ID NO: 2425 - DNA, 15 bp, Homo sapiens
agagtagatagaaag

SEQ ID NO: 2426 - DNA, 15 bp, Homo sapiens
aagagtagatagaaa

SEQ ID NO: 2427 - DNA, 15 bp, Homo sapiens
caagagtagatagaa

SEQ ID NO: 2428 - DNA, 15 bp, Homo sapiens
acaagagtagataga

SEQ ID NO: 2429 - DNA, 15 bp, Homo sapiens
aacaagagtagatag

SEQ ID NO: 2430 - DNA, 15 bp, Homo sapiens
aaacaagagtagata

SEQ ID NO: 2431 - DNA, 15 bp, Homo sapiens
taaacaagagtagat

SEQ ID NO: 2432 - DNA, 15 bp, Homo sapiens
ctaaacaagagtaga

SEQ ID NO: 2433 - DNA, 15 bp, Homo sapiens
tctaaacaagagtag

SEQ ID NO: 2434 - DNA, 15 bp, Homo sapiens
gtctaaacaagagta

SEQ ID NO: 2435 - DNA, 15 bp, Homo sapiens
ggtctaaacaagagt

SEQ ID NO: 2436 - DNA, 15 bp, Homo sapiens
tggtctaaacaagag

SEQ ID NO: 2437 - DNA, 15 bp, Homo sapiens
gtggtctaaacaaga

SEQ ID NO: 2438 - DNA, 15 bp, Homo sapiens
tgtggtctaaacaag

SEQ ID NO: 2439 - DNA, 15 bp, Homo sapiens
gtgtggtctaaacaa

SEQ ID NO: 2440 - DNA, 15 bp, Homo sapiens
agtgtggtctaaaca

SEQ ID NO: 2441 - DNA, 15 bp, Homo sapiens
aagtgtggtctaaac

SEQ ID NO: 2442 - DNA, 15 bp, Homo sapiens
caagtgtggtctaaa

SEQ ID NO: 2443 - DNA, 15 bp, Homo sapiens
acaagtgtggtctaa

SEQ ID NO: 2444 - DNA, 15 bp, Homo sapiens
aacaagtgtggtcta

SEQ ID NO: 2445 - DNA, 15 bp, Homo sapiens
aaacaagtgtggtct

SEQ ID NO: 2446 - DNA, 15 bp, Homo sapiens
gaaacaagtgtggtc

SEQ ID NO: 2447 - DNA, 15 bp, Homo sapiens
ggaaacaagtgtggt

SEQ ID NO: 2448 - DNA, 15 bp, Homo sapiens
aggaaacaagtgtgg

SEQ ID NO: 2449 - DNA, 15 bp, Homo sapiens
caggaaacaagtgtg

SEQ ID NO: 2450 - DNA, 15 bp, Homo sapiens
gcaggaaacaagtgt

SEQ ID NO: 2451 - DNA, 15 bp, Homo sapiens
tgcaggaaacaagtg

SEQ ID NO: 2452 - DNA, 15 bp, Homo sapiens
atgcaggaaacaagt

SEQ ID NO: 2453 - DNA, 15 bp, Homo sapiens
tatgcaggaaacaag

SEQ ID NO: 2454 - DNA, 15 bp, Homo sapiens
atatgcaggaaacaa

SEQ ID NO: 2455 - DNA, 15 bp, Homo sapiens
tatatgcaggaaaca

SEQ ID NO: 2456 - DNA, 15 bp, Homo sapiens
ttatatgcaggaaac

SEQ ID NO: 2457 - DNA, 15 bp, Homo sapiens
attatatgcaggaaa

SEQ ID NO: 2458 - DNA, 15 bp, Homo sapiens
tattatatgcaggaa

SEQ ID NO: 2459 - DNA, 15 bp, Homo sapiens
atattatatgcagga

SEQ ID NO: 2460 - DNA, 15 bp, Homo sapiens
aatattatatgcagg

SEQ ID NO: 2461 - DNA, 15 bp, Homo sapiens
taatattatatgcag

SEQ ID NO: 2462 - DNA, 15 bp, Homo sapiens
gtaatattatatgca

SEQ ID NO: 2463 - DNA, 15 bp, Homo sapiens
tgtaatattatatgc

SEQ ID NO: 2464 - DNA, 15 bp, Homo sapiens
ttgtaatattatatg

SEQ ID NO: 2465 - DNA, 15 bp, Homo sapiens
attgtaatattatat

SEQ ID NO: 2466 - DNA, 15 bp, Homo sapiens
tattgtaatattata

SEQ ID NO: 2467 - DNA, 15 bp, Homo sapiens
ctattgtaatattat

SEQ ID NO: 2468 - DNA, 15 bp, Homo sapiens
tctattgtaatatta

SEQ ID NO: 2469 - DNA, 15 bp, Homo sapiens
ttctattgtaatatt

SEQ ID NO: 2470 - DNA, 15 bp, Homo sapiens
tttctattgtaatat

SEQ ID NO: 2471 - DNA, 15 bp, Homo sapiens
ctttctattgtaata

SEQ ID NO: 2472 - DNA, 15 bp, Homo sapiens
tctttctattgtaat

SEQ ID NO: 2473 - DNA, 15 bp, Homo sapiens
ttctttctattgtaa

SEQ ID NO: 2474 - DNA, 15 bp, Homo sapiens
attctttctattgta

SEQ ID NO: 2475 - DNA, 15 bp, Homo sapiens
tattctttctattgt

SEQ ID NO: 2476 - DNA, 15 bp, Homo sapiens
ctattctttctattg

SEQ ID NO: 2477 - DNA, 15 bp, Homo sapiens
gctattctttctatt

SEQ ID NO: 2478 - DNA, 15 bp, Homo sapiens
tgctattctttctat

SEQ ID NO: 2479 - DNA, 15 bp, Homo sapiens
gtgctattctttcta

SEQ ID NO: 2480 - DNA, 15 bp, Homo sapiens
tgtgctattctttct

SEQ ID NO: 2481 - DNA, 15 bp, Homo sapiens
ttgtgctattctttc

SEQ ID NO: 2482 - DNA, 15 bp, Homo sapiens
attgtgctattcttt

SEQ ID NO: 2483 - DNA, 15 bp, Homo sapiens
tattgtgctattctt

SEQ ID NO: 2484 - DNA, 15 bp, Homo sapiens
ttattgtgctattct

SEQ ID NO: 2485 - DNA, 15 bp, Homo sapiens
tttattgtgctattc

SEQ ID NO: 2486 - DNA, 15 bp, Homo sapiens
gtttattgtgctatt

SEQ ID NO: 2487 - DNA, 15 bp, Homo sapiens
tgtttattgtgctat

SEQ ID NO: 2488 - DNA, 15 bp, Homo sapiens
gtgtttattgtgcta

SEQ ID NO: 2489 - DNA, 15 bp, Homo sapiens
ggtgtttattgtgct

SEQ ID NO: 2490 - DNA, 15 bp, Homo sapiens
gggtgtttattgtgc

SEQ ID NO: 2491 - DNA, 15 bp, Homo sapiens
tgggtgtttattgtg

SEQ ID NO: 2492 - DNA, 15 bp, Homo sapiens
ctgggtgtttattgt

SEQ ID NO: 2493 - DNA, 15 bp, Homo sapiens
tctgggtgtttattg

SEQ ID NO: 2494 - DNA, 15 bp, Homo sapiens
atctgggtgtttatt

SEQ ID NO: 2495 - DNA, 15 bp, Homo sapiens
catctgggtgtttat

SEQ ID NO: 2496 - DNA, 15 bp, Homo sapiens
acatctgggtgttta

SEQ ID NO: 2497 - DNA, 15 bp, Homo sapiens
gacatctgggtgttt

SEQ ID NO: 2498 - DNA, 15 bp, Homo sapiens
ggacatctgggtgtt

SEQ ID NO: 2499 - DNA, 15 bp, Homo sapiens
aggacatctgggtgt

SEQ ID NO: 2500 - DNA, 15 bp, Homo sapiens
aaggacatctgggtg

SEQ ID NO: 2501 - DNA, 15 bp, Homo sapiens
aaaggacatctgggt

SEQ ID NO: 2502 - DNA, 15 bp, Homo sapiens
aaaaggacatctggg

SEQ ID NO: 2503 - DNA, 15 bp, Homo sapiens
aaaaaggacatctgg

SEQ ID NO: 2504 - DNA, 15 bp, Homo sapiens
taaaaaggacatctg

SEQ ID NO: 2505 - DNA, 15 bp, Homo sapiens
ataaaaaggacatct

SEQ ID NO: 2506 - DNA, 15 bp, Homo sapiens
aataaaaaggacatc

SEQ ID NO: 2507 - DNA, 15 bp, Homo sapiens
aaataaaaaggacat

SEQ ID NO: 2508 - DNA, 15 bp, Homo sapiens
aaaataaaaaggaca

SEQ ID NO: 2509 - DNA, 15 bp, Homo sapiens
taaaataaaaaggac

SEQ ID NO: 2510 - DNA, 15 bp, Homo sapiens
ataaaataaaaagga

SEQ ID NO: 2511 - DNA, 15 bp, Homo sapiens
aataaaataaaaagg

SEQ ID NO: 2512 - DNA, 15 bp, Homo sapiens
aaataaaataaaaag

SEQ ID NO: 2513 - DNA, 15 bp, Homo sapiens
aaaataaaataaaaa

SEQ ID NO: 2514 - DNA, 15 bp, Homo sapiens
taaaataaaataaaa

SEQ ID NO: 2515 - DNA, 15 bp, Homo sapiens
ataaaataaaataaa

SEQ ID NO: 2516 - DNA, 15 bp, Homo sapiens
aataaaataaaataa

SEQ ID NO: 2517 - DNA, 15 bp, Homo sapiens
aaataaaataaaata

SEQ ID NO: 2518 - DNA, 15 bp, Homo sapiens
aaaataaaataaaat

SEQ ID NO: 2519 - DNA, 15 bp, Homo sapiens
taataaaataaaata

SEQ ID NO: 2520 - DNA, 15 bp, Homo sapiens
ataataaaataaaat

SEQ ID NO: 2521 - DNA, 15 bp, Homo sapiens
aaataataaaataaa

SEQ ID NO: 2522 - DNA, 15 bp, Homo sapiens
taaataataaaataa

SEQ ID NO: 2523 - DNA, 15 bp, Homo sapiens
ttaaataataaaata

SEQ ID NO: 2524 - DNA, 15 bp, Homo sapiens
tttaaataataaaat

SEQ ID NO: 2525 - DNA, 15 bp, Homo sapiens
ttttaaataataaaa

SEQ ID NO: 2526 - DNA, 15 bp, Homo sapiens
attttaaataataaa

SEQ ID NO: 2527 - DNA, 15 bp, Homo sapiens
aattttaaataataa

SEQ ID NO: 2528 - DNA, 15 bp, Homo sapiens
aaattttaaataata

SEQ ID NO: 2529 - DNA, 15 bp, Homo sapiens
aaaattttaaataat

SEQ ID NO: 2530 - DNA, 15 bp, Homo sapiens
aaaaattttaaataa

SEQ ID NO: 2531 - DNA, 15 bp, Homo sapiens
taaaaattttaaata

SEQ ID NO: 2532 - DNA, 15 bp, Homo sapiens
ataaaaattttaaat

SEQ ID NO: 2533 - DNA, 15 bp, Homo sapiens
aataaaaattttaaa

SEQ ID NO: 2534 - DNA, 15 bp, Homo sapiens
aaataaaaattttaa

SEQ ID NO: 2535 - DNA, 15 bp, Homo sapiens
taaataaaaatttta

SEQ ID NO: 2536 - DNA, 15 bp, Homo sapiens
gtaaataaaaatttt

SEQ ID NO: 2537 - DNA, 15 bp, Homo sapiens
tgtaaataaaaattt

SEQ ID NO: 2538 - DNA, 15 bp, Homo sapiens
atgtaaataaaaatt

SEQ ID NO: 2539 - DNA, 15 bp, Homo sapiens
catgtaaataaaaat

SEQ ID NO: 2540 - DNA, 15 bp, Homo sapiens
ccatgtaaataaaaa

SEQ ID NO: 2541 - DNA, 15 bp, Homo sapiens
tccatgtaaataaaa

SEQ ID NO: 2542 - DNA, 15 bp, Homo sapiens
ctccatgtaaataaa

SEQ ID NO: 2543 - DNA, 15 bp, Homo sapiens
actccatgtaaataa

SEQ ID NO: 2544 - DNA, 15 bp, Homo sapiens
tactccatgtaaata

SEQ ID NO: 2545 - DNA, 15 bp, Homo sapiens
ctactccatgtaaat

SEQ ID NO: 2546 - DNA, 15 bp, Homo sapiens
tctactccatgtaaa

SEQ ID NO: 2547 - DNA, 15 bp, Homo sapiens
ctctactccatgtaa

SEQ ID NO: 2548 - DNA, 15 bp, Homo sapiens
tctctactccatgta

SEQ ID NO: 2549 - DNA, 15 bp, Homo sapiens
gtctctactccatgt

SEQ ID NO: 2550 - DNA, 15 bp, Homo sapiens
tgtctctactccatg

SEQ ID NO: 2551 - DNA, 15 bp, Homo sapiens
ttgtctctactccat

SEQ ID NO: 2552 - DNA, 15 bp, Homo sapiens
cttgtctctactcca

SEQ ID NO: 2553 - DNA, 15 bp, Homo sapiens
ccttgtctctactcc

SEQ ID NO: 2554 - DNA, 15 bp, Homo sapiens
accttgtctctactc

SEQ ID NO: 2555 - DNA, 15 bp, Homo sapiens
gaccttgtctctact

SEQ ID NO: 2556 - DNA, 15 bp, Homo sapiens
agaccttgtctctac

SEQ ID NO: 2557 - DNA, 15 bp, Homo sapiens
gagaccttgtctcta

SEQ ID NO: 2558 - DNA, 15 bp, Homo sapiens
tgagaccttgtctct

SEQ ID NO: 2559 - DNA, 15 bp, Homo sapiens
gtgagaccttgtctc

SEQ ID NO: 2560 - DNA, 15 bp, Homo sapiens
ggtgagaccttgtct

SEQ ID NO: 2561 - DNA, 15 bp, Homo sapiens
tggtgagaccttgtc

SEQ ID NO: 2562 - DNA, 15 bp, Homo sapiens
atggtgagaccttgt

SEQ ID NO: 2563 - DNA, 15 bp, Homo sapiens
catggtgagaccttg

SEQ ID NO: 2564 - DNA, 15 bp, Homo sapiens
acatggtgagacctt

SEQ ID NO: 2565 - DNA, 15 bp, Homo sapiens
aacatggtgagacct

SEQ ID NO: 2566 - DNA, 15 bp, Homo sapiens
caacatggtgagacc

SEQ ID NO: 2567 - DNA, 15 bp, Homo sapiens
gcaacatggtgagac

SEQ ID NO: 2568 - DNA, 15 bp, Homo sapiens
ggcaacatggtgaga

SEQ ID NO: 2569 - DNA, 15 bp, Homo sapiens
aggcaacatggtgag

SEQ ID NO: 2570 - DNA, 15 bp, Homo sapiens
taggcaacatggtga

SEQ ID NO: 2571 - DNA, 15 bp, Homo sapiens
ctaggcaacatggtg

SEQ ID NO: 2572 - DNA, 15 bp, Homo sapiens
cctaggcaacatggt

SEQ ID NO: 2573 - DNA, 15 bp, Homo sapiens
gcctaggcaacatgg

SEQ ID NO: 2574 - DNA, 15 bp, Homo sapiens
agcctaggcaacatg

SEQ ID NO: 2575 - DNA, 15 bp, Homo sapiens
cagcctaggcaacat

SEQ ID NO: 2576 - DNA, 15 bp, Homo sapiens
tcagcctaggcaaca

SEQ ID NO: 2577 - DNA, 15 bp, Homo sapiens
atcagcctaggcaac

SEQ ID NO: 2578 - DNA, 15 bp, Homo sapiens
gatcagcctaggcaa

SEQ ID NO: 2579 - DNA, 15 bp, Homo sapiens
agatcagcctaggca

SEQ ID NO: 2580 - DNA, 15 bp, Homo sapiens
gagatcagcctaggc

SEQ ID NO: 2581 - DNA, 15 bp, Homo sapiens
tgagatcagcctagg

SEQ ID NO: 2582 - DNA, 15 bp, Homo sapiens
ttgagatcagcctag

SEQ ID NO: 2583 - DNA, 15 bp, Homo sapiens
tttgagatcagccta

SEQ ID NO: 2584 - DNA, 15 bp, Homo sapiens
gtttgagatcagcct

SEQ ID NO: 2585 - DNA, 15 bp, Homo sapiens
agtttgagatcagcc

SEQ ID NO: 2586 - DNA, 15 bp, Homo sapiens
aagtttgagatcagc

SEQ ID NO: 2587 - DNA, 15 bp, Homo sapiens
gaagtttgagatcag

SEQ ID NO: 2588 - DNA, 15 bp, Homo sapiens
agaagtttgagatca

SEQ ID NO: 2589 - DNA, 15 bp, Homo sapiens
cagaagtttgagatc

SEQ ID NO: 2590 - DNA, 15 bp, Homo sapiens
ccagaagtttgagat

SEQ ID NO: 2591 - DNA, 15 bp, Homo sapiens
cccagaagtttgaga

SEQ ID NO: 2592 - DNA, 15 bp, Homo sapiens
gcccagaagtttgag

SEQ ID NO: 2593 - DNA, 15 bp, Homo sapiens
agcccagaagtttga

SEQ ID NO: 2594 - DNA, 15 bp, Homo sapiens
gagcccagaagtttg

SEQ ID NO: 2595 - DNA, 15 bp, Homo sapiens
tgagcccagaagttt

SEQ ID NO: 2596 - DNA, 15 bp, Homo sapiens
ttgagcccagaagtt

SEQ ID NO: 2597 - DNA, 15 bp, Homo sapiens
cttgagcccagaagt

SEQ ID NO: 2598 - DNA, 15 bp, Homo sapiens
acttgagcccagaag

SEQ ID NO: 2599 - DNA, 15 bp, Homo sapiens
tacttgagcccagaa

SEQ ID NO: 2600 - DNA, 15 bp, Homo sapiens
ttacttgagcccaga

SEQ ID NO: 2601 - DNA, 15 bp, Homo sapiens
attacttgagcccag

SEQ ID NO: 2602 - DNA, 15 bp, Homo sapiens
gattacttgagccca

SEQ ID NO: 2603 - DNA, 15 bp, Homo sapiens
ggattacttgagccc

SEQ ID NO: 2604 - DNA, 15 bp, Homo sapiens
aggattacttgagcc

SEQ ID NO: 2605 - DNA, 15 bp, Homo sapiens
gaggattacttgagc

SEQ ID NO: 2606 - DNA, 15 bp, Homo sapiens
agaggattacttgag

SEQ ID NO: 2607 - DNA, 15 bp, Homo sapiens
gagaggattacttga

SEQ ID NO: 2608 - DNA, 15 bp, Homo sapiens
cgagaggattacttg

SEQ ID NO: 2609 - DNA, 15 bp, Homo sapiens
gcgagaggattactt

SEQ ID NO: 2610 - DNA, 15 bp, Homo sapiens
agcgagaggattact

SEQ ID NO: 2611 - DNA, 15 bp, Homo sapiens
aagcgagaggattac

SEQ ID NO: 2612 - DNA, 15 bp, Homo sapiens
taagcgagaggatta

SEQ ID NO: 2613 - DNA, 15 bp, Homo sapiens
ttaagcgagaggatt

SEQ ID NO: 2614 - DNA, 15 bp, Homo sapiens
cttaagcgagaggat

SEQ ID NO: 2615 - DNA, 15 bp, Homo sapiens
gcttaagcgagagga

SEQ ID NO: 2616 - DNA, 15 bp, Homo sapiens
agcttaagcgagagg

SEQ ID NO: 2617 - DNA, 15 bp, Homo sapiens
aagcttaagcgagag

SEQ ID NO: 2618 - DNA, 15 bp, Homo sapiens
gaagcttaagcgaga

SEQ ID NO: 2619 - DNA, 15 bp, Homo sapiens
ggaagcttaagcgag

SEQ ID NO: 2620 - DNA, 15 bp, Homo sapiens
gggaagcttaagcga

SEQ ID NO: 2621 - DNA, 15 bp, Homo sapiens
tgggaagcttaagcg

SEQ ID NO: 2622 - DNA, 15 bp, Homo sapiens
ttgggaagcttaagc

SEQ ID NO: 2623 - DNA, 15 bp, Homo sapiens
tttgggaagcttaag

SEQ ID NO: 2624 - DNA, 15 bp, Homo sapiens
ctttgggaagcttaa

SEQ ID NO: 2625 - DNA, 15 bp, Homo sapiens
actttgggaagctta

SEQ ID NO: 2626 - DNA, 15 bp, Homo sapiens
tactttgggaagctt

SEQ ID NO: 2627 - DNA, 15 bp, Homo sapiens
gtactttgggaagct

SEQ ID NO: 2628 - DNA, 15 bp, Homo sapiens
agtactttgggaagc

SEQ ID NO: 2629 - DNA, 15 bp, Homo sapiens
cagtactttgggaag

SEQ ID NO: 2630 - DNA, 15 bp, Homo sapiens
ccagtactttgggaa

SEQ ID NO: 2631 - DNA, 15 bp, Homo sapiens
cacacctgtaatccc

SEQ ID NO: 2632 - DNA, 15 bp, Homo sapiens
tcacacctgtaatcc

SEQ ID NO: 2633 - DNA, 15 bp, Homo sapiens
ctcacacctgtaatc

SEQ ID NO: 2634 - DNA, 15 bp, Homo sapiens
gctcacacctgtaat

SEQ ID NO: 2635 - DNA, 15 bp, Homo sapiens
ggctcacacctgtaa

SEQ ID NO: 2636 - DNA, 15 bp, Homo sapiens
tggctcacacctgta

SEQ ID NO: 2637 - DNA, 15 bp, Homo sapiens
aggtggctcacacct

SEQ ID NO: 2638 - DNA, 15 bp, Homo sapiens
gaggtggctcacacc

SEQ ID NO: 2639 - DNA, 15 bp, Homo sapiens
cgaggtggctcacac

SEQ ID NO: 2640 - DNA, 15 bp, Homo sapiens
gcgaggtggctcaca

SEQ ID NO: 2641 - DNA, 15 bp, Homo sapiens
ggcgaggtggctcac

SEQ ID NO: 2642 - DNA, 15 bp, Homo sapiens
aggcgaggtggctca

SEQ ID NO: 2643 - DNA, 15 bp, Homo sapiens
taggcgaggtggctc

SEQ ID NO: 2644 - DNA, 15 bp, Homo sapiens
ctaggcgaggtggct

SEQ ID NO: 2645 - DNA, 15 bp, Homo sapiens
tctaggcgaggtggc

SEQ ID NO: 2646 - DNA, 15 bp, Homo sapiens
gtctaggcgaggtgg

SEQ ID NO: 2647 - DNA, 15 bp, Homo sapiens
ggtctaggcgaggtg

SEQ ID NO: 2648 - DNA, 15 bp, Homo sapiens
gggtctaggcgaggt

SEQ ID NO: 2649 - DNA, 15 bp, Homo sapiens
tgggtctaggcgagg

SEQ ID NO: 2650 - DNA, 15 bp, Homo sapiens
ctgggtctaggcgag

SEQ ID NO: 2651 - DNA, 15 bp, Homo sapiens
tctgggtctaggcga

SEQ ID NO: 2652 - DNA, 15 bp, Homo sapiens
atctgggtctaggcg

SEQ ID NO: 2653 - DNA, 15 bp, Homo sapiens
catctgggtctaggc

SEQ ID NO: 2654 - DNA, 15 bp, Homo sapiens
gcatctgggtctagg

SEQ ID NO: 2655 - DNA, 15 bp, Homo sapiens
ggcatctgggtctag

SEQ ID NO: 2656 - DNA, 15 bp, Homo sapiens
gggcatctgggtcta

SEQ ID NO: 2657 - DNA, 15 bp, Homo sapiens
agggcatctgggtct

SEQ ID NO: 2658 - DNA, 15 bp, Homo sapiens
aagggcatctgggtc

SEQ ID NO: 2659 - DNA, 15 bp, Homo sapiens
aaagggcatctgggt

SEQ ID NO: 2660 - DNA, 15 bp, Homo sapiens
taaagggcatctggg

SEQ ID NO: 2661 - DNA, 15 bp, Homo sapiens
ttaaagggcatctgg

SEQ ID NO: 2662 - DNA, 15 bp, Homo sapiens
gttaaagggcatctg

SEQ ID NO: 2663 - DNA, 15 bp, Homo sapiens
tgttaaagggcatct

SEQ ID NO: 2664 - DNA, 15 bp, Homo sapiens
ttgttaaagggcatc

SEQ ID NO: 2665 - DNA, 15 bp, Homo sapiens
cttgttaaagggcat

SEQ ID NO: 2666 - DNA, 15 bp, Homo sapiens
acttgttaaagggca

SEQ ID NO: 2667 - DNA, 15 bp, Homo sapiens
aacttgttaaagggc

SEQ ID NO: 2668 - DNA, 15 bp, Homo sapiens
aaacttgttaaaggg

SEQ ID NO: 2669 - DNA, 15 bp, Homo sapiens
aaaacttgttaaagg

SEQ ID NO: 2670 - DNA, 15 bp, Homo sapiens
gaaaacttgttaaag

SEQ ID NO: 2671 - DNA, 15 bp, Homo sapiens
ggaaaacttgttaaa

SEQ ID NO: 2672 - DNA, 15 bp, Homo sapiens
gggaaaacttgttaa

SEQ ID NO: 2673 - DNA, 15 bp, Homo sapiens
tgggaaaacttgtta

SEQ ID NO: 2674 - DNA, 15 bp, Homo sapiens
gtgggaaaacttgtt

SEQ ID NO: 2675 - DNA, 15 bp, Homo sapiens
agtgggaaaacttgt

SEQ ID NO: 2676 - DNA, 15 bp, Homo sapiens
aagtgggaaaacttg

SEQ ID NO: 2677 - DNA, 15 bp, Homo sapiens
taagtgggaaaactt

SEQ ID NO: 2678 - DNA, 15 bp, Homo sapiens
gtaagtgggaaaact

SEQ ID NO: 2679 - DNA, 15 bp, Homo sapiens
agtaagtgggaaaac

SEQ ID NO: 2680 - DNA, 15 bp, Homo sapiens
aagtaagtgggaaaa

SEQ ID NO: 2681 - DNA, 15 bp, Homo sapiens
aaagtaagtgggaaa

SEQ ID NO: 2682 - DNA, 15 bp, Homo sapiens
taaagtaagtgggaa

SEQ ID NO: 2683 - DNA, 15 bp, Homo sapiens
ataaagtaagtggga

SEQ ID NO: 2684 - DNA, 15 bp, Homo sapiens
aataaagtaagtggg

SEQ ID NO: 2685 - DNA, 15 bp, Homo sapiens
aaataaagtaagtgg

SEQ ID NO: 2686 - DNA, 15 bp, Homo sapiens
aaaataaagtaagtg

SEQ ID NO: 2687 - DNA, 15 bp, Homo sapiens
aaaaataaagtaagt

SEQ ID NO: 2688 - DNA, 15 bp, Homo sapiens
aaaaaataaagtaag

SEQ ID NO: 2689 - DNA, 15 bp, Homo sapiens
aaaaaaataaagtaa

SEQ ID NO: 2690 - DNA, 15 bp, Homo sapiens
aaaaaaaataaagta

SEQ ID NO: 2691 - DNA, 15 bp, Homo sapiens
caaaaaaaataaagt

SEQ ID NO: 2692 - DNA, 15 bp, Homo sapiens
tcaaaaaaaataaag

SEQ ID NO: 2693 - DNA, 15 bp, Homo sapiens
ctcaaaaaaaataaa

SEQ ID NO: 2694 - DNA, 15 bp, Homo sapiens
tctcaaaaaaaataa

SEQ ID NO: 2695 - DNA, 15 bp, Homo sapiens
atctcaaaaaaaata

SEQ ID NO: 2696 - DNA, 15 bp, Homo sapiens
catctcaaaaaaaat

SEQ ID NO: 2697 - DNA, 15 bp, Homo sapiens
ttccatctcaaaaaa

SEQ ID NO: 2698 - DNA, 15 bp, Homo sapiens
attccatctcaaaaa

SEQ ID NO: 2699 - DNA, 15 bp, Homo sapiens
aattccatctcaaaa

SEQ ID NO: 2700 - DNA, 15 bp, Homo sapiens
aaattccatctcaaa

SEQ ID NO: 2701 - DNA, 15 bp, Homo sapiens
aaaattccatctcaa

SEQ ID NO: 2702 - DNA, 15 bp, Homo sapiens
caaaattccatctca

SEQ ID NO: 2703 - DNA, 15 bp, Homo sapiens
gcaaaattccatctc

SEQ ID NO: 2704 - DNA, 15 bp, Homo sapiens
ggcaaaattccatct

SEQ ID NO: 2705 - DNA, 15 bp, Homo sapiens
gggcaaaattccatc

SEQ ID NO: 2706 - DNA, 15 bp, Homo sapiens
agggcaaaattccat

SEQ ID NO: 2707 - DNA, 15 bp, Homo sapiens
aagggcaaaattcca

SEQ ID NO: 2708 - DNA, 15 bp, Homo sapiens
caagggcaaaattcc

SEQ ID NO: 2709 - DNA, 15 bp, Homo sapiens
acaagggcaaaattc

SEQ ID NO: 2710 - DNA, 15 bp, Homo sapiens
gacaagggcaaaatt

SEQ ID NO: 2711 - DNA, 15 bp, Homo sapiens
tgacaagggcaaaat

SEQ ID NO: 2712 - DNA, 15 bp, Homo sapiens
gtgacaagggcaaaa

SEQ ID NO: 2713 - DNA, 15 bp, Homo sapiens
ggtgacaagggcaaa

SEQ ID NO: 2714 - DNA, 15 bp, Homo sapiens
gggtgacaagggcaa

SEQ ID NO: 2715 - DNA, 15 bp, Homo sapiens
tgggtgacaagggca

SEQ ID NO: 2716 - DNA, 15 bp, Homo sapiens
ctgggtgacaagggc

SEQ ID NO: 2717 - DNA, 15 bp, Homo sapiens
cctgggtgacaaggg

SEQ ID NO: 2718 - DNA, 15 bp, Homo sapiens
gcctgggtgacaagg

SEQ ID NO: 2719 - DNA, 15 bp, Homo sapiens
agcctgggtgacaag

SEQ ID NO: 2720 - DNA, 15 bp, Homo sapiens
cagcctgggtgacaa

SEQ ID NO: 2721 - DNA, 15 bp, Homo sapiens
tctccagcctgggtg

SEQ ID NO: 2722 - DNA, 15 bp, Homo sapiens
ctctccagcctgggt

SEQ ID NO: 2723 - DNA, 15 bp, Homo sapiens
actctccagcctggg

SEQ ID NO: 2724 - DNA, 15 bp, Homo sapiens
tactctccagcctgg

SEQ ID NO: 2725 - DNA, 15 bp, Homo sapiens
ttactctccagcctg

SEQ ID NO: 2726 - DNA, 15 bp, Homo sapiens
attactctccagcct

SEQ ID NO: 2727 - DNA, 15 bp, Homo sapiens
tattactctccagcc

SEQ ID NO: 2728 - DNA, 15 bp, Homo sapiens
ctattactctccagc

SEQ ID NO: 2729 - DNA, 15 bp, Homo sapiens
gctattactctccag

SEQ ID NO: 2730 - DNA, 15 bp, Homo sapiens
tgctattactctcca

SEQ ID NO: 2731 - DNA, 15 bp, Homo sapiens
gtgctattactctcc

SEQ ID NO: 2732 - DNA, 15 bp, Homo sapiens
tgtgctattactctc

SEQ ID NO: 2733 - DNA, 15 bp, Homo sapiens
ttgtgctattactct

SEQ ID NO: 2734 - DNA, 15 bp, Homo sapiens
attgtgctattactc

SEQ ID NO: 2735 - DNA, 15 bp, Homo sapiens
aattgtgctattact

SEQ ID NO: 2736 - DNA, 15 bp, Homo sapiens
aaattgtgctattac

SEQ ID NO: 2737 - DNA, 15 bp, Homo sapiens
gaaattgtgctatta

SEQ ID NO: 2738 - DNA, 15 bp, Homo sapiens
cgaaattgtgctatt

SEQ ID NO: 2739 - DNA, 15 bp, Homo sapiens
ccgaaattgtgctat

SEQ ID NO: 2740 - DNA, 15 bp, Homo sapiens
gccgaaattgtgcta

SEQ ID NO: 2741 - DNA, 15 bp, Homo sapiens
agccgaaattgtgct

SEQ ID NO: 2742 - DNA, 15 bp, Homo sapiens
gagccgaaattgtgc

SEQ ID NO: 2743 - DNA, 15 bp, Homo sapiens
tgagccgaaattgtg

SEQ ID NO: 2744 - DNA, 15 bp, Homo sapiens
gtgagccgaaattgt

SEQ ID NO: 2745 - DNA, 15 bp, Homo sapiens
agtgagccgaaattg

SEQ ID NO: 2746 - DNA, 15 bp, Homo sapiens
cagtgagccgaaatt

SEQ ID NO: 2747 - DNA, 15 bp, Homo sapiens
acagtgagccgaaat

SEQ ID NO: 2748 - DNA, 15 bp, Homo sapiens
tacagtgagccgaaa

SEQ ID NO: 2749 - DNA, 15 bp, Homo sapiens
ttacagtgagccgaa

SEQ ID NO: 2750 - DNA, 15 bp, Homo sapiens
gttacagtgagccga

SEQ ID NO: 2751 - DNA, 15 bp, Homo sapiens
ggttacagtgagccg

SEQ ID NO: 2752 - DNA, 15 bp, Homo sapiens
tggttacagtgagcc

SEQ ID NO: 2753 - DNA, 15 bp, Homo sapiens
gtggttacagtgagc

SEQ ID NO: 2754 - DNA, 15 bp, Homo sapiens
ggtggttacagtgag

SEQ ID NO: 2755 - DNA, 15 bp, Homo sapiens
cggtggttacagtga

SEQ ID NO: 2756 - DNA, 15 bp, Homo sapiens
gcggtggttacagtg

SEQ ID NO: 2757 - DNA, 15 bp, Homo sapiens
ggcggtggttacagt

SEQ ID NO: 2758 - DNA, 15 bp, Homo sapiens
aggcggtggttacag

SEQ ID NO: 2759 - DNA, 15 bp, Homo sapiens
gaggcggtggttaca

SEQ ID NO: 2760 - DNA, 15 bp, Homo sapiens
ggaggcggtggttac

SEQ ID NO: 2761 - DNA, 15 bp, Homo sapiens
aggaggcggtggtta

SEQ ID NO: 2762 - DNA, 15 bp, Homo sapiens
caggaggcggtggtt

SEQ ID NO: 2763 - DNA, 15 bp, Homo sapiens
ccaggaggcggtggt

SEQ ID NO: 2764 - DNA, 15 bp, Homo sapiens
tccaggaggcggtgg

SEQ ID NO: 2765 - DNA, 15 bp, Homo sapiens
atccaggaggcggtg

SEQ ID NO: 2766 - DNA, 15 bp, Homo sapiens
aatccaggaggcggt

SEQ ID NO: 2767 - DNA, 15 bp, Homo sapiens
gaatccaggaggcgg

SEQ ID NO: 2768 - DNA, 15 bp, Homo sapiens
tgaatccaggaggcg

SEQ ID NO: 2769 - DNA, 15 bp, Homo sapiens
ttgaatccaggaggc

SEQ ID NO: 2770 - DNA, 15 bp, Homo sapiens
cttgaatccaggagg

SEQ ID NO: 2771 - DNA, 15 bp, Homo sapiens
acttgaatccaggag

SEQ ID NO: 2772 - DNA, 15 bp, Homo sapiens
cacttgaatccagga

SEQ ID NO: 2773 - DNA, 15 bp, Homo sapiens
tcacttgaatccagg

SEQ ID NO: 2774 - DNA, 15 bp, Homo sapiens
atcacttgaatccag

SEQ ID NO: 2775 - DNA, 15 bp, Homo sapiens
aatcacttgaatcca

SEQ ID NO: 2776 - DNA, 15 bp, Homo sapiens
gaatcacttgaatcc

SEQ ID NO: 2777 - DNA, 15 bp, Homo sapiens
agaatcacttgaatc

SEQ ID NO: 2778 - DNA, 15 bp, Homo sapiens
gagaatcacttgaat

SEQ ID NO: 2779 - DNA, 15 bp, Homo sapiens
aggagaatcacttga

SEQ ID NO: 2780 - DNA, 15 bp, Homo sapiens
caggagaatcacttg

SEQ ID NO: 2781 - DNA, 15 bp, Homo sapiens
gcaggagaatcactt

SEQ ID NO: 2782 - DNA, 15 bp, Homo sapiens
ggcaggagaatcact

SEQ ID NO: 2783 - DNA, 15 bp, Homo sapiens
aggcaggagaatcac

SEQ ID NO: 2784 - DNA, 15 bp, Homo sapiens
gaggcaggagaatca

SEQ ID NO: 2785 - DNA, 15 bp, Homo sapiens
tgaggcaggagaatc

SEQ ID NO: 2786 - DNA, 15 bp, Homo sapiens
ctgaggcaggagaat

SEQ ID NO: 2787 - DNA, 15 bp, Homo sapiens
gctgaggcaggagaa

SEQ ID NO: 2788 - DNA, 15 bp, Homo sapiens
ggctgaggcaggaga

SEQ ID NO: 2789 - DNA, 15 bp, Homo sapiens
aggctgaggcaggag

SEQ ID NO: 2790 - DNA, 15 bp, Homo sapiens
gaggctgaggcagga

SEQ ID NO: 2791 - DNA, 15 bp, Homo sapiens
cttgggaggctgagg

SEQ ID NO: 2792 - DNA, 15 bp, Homo sapiens
acttgggaggctgag

SEQ ID NO: 2793 - DNA, 15 bp, Homo sapiens
tacttgggaggctga

SEQ ID NO: 2794 - DNA, 15 bp, Homo sapiens
ctacttgggaggctg

SEQ ID NO: 2795 - DNA, 15 bp, Homo sapiens
gctacttgggaggct

SEQ ID NO: 2796 - DNA, 15 bp, Homo sapiens
agctacttgggaggc

SEQ ID NO: 2797 - DNA, 15 bp, Homo sapiens
cagctacttgggagg

SEQ ID NO: 2798 - DNA, 15 bp, Homo sapiens
ccagctacttgggag

SEQ ID NO: 2799 - DNA, 15 bp, Homo sapiens
cccagctacttggga

SEQ ID NO: 2800 - DNA, 15 bp, Homo sapiens
tcccagctacttggg

SEQ ID NO: 2801 - DNA, 15 bp, Homo sapiens
atcccagctacttgg

SEQ ID NO: 2802 - DNA, 15 bp, Homo sapiens
aatcccagctacttg

SEQ ID NO: 2803 - DNA, 15 bp, Homo sapiens
taatcccagctactt

SEQ ID NO: 2804 - DNA, 15 bp, Homo sapiens
gtgcctgtaatccca

SEQ ID NO: 2805 - DNA, 15 bp, Homo sapiens
aggtgcctgtaatcc

SEQ ID NO: 2806 - DNA, 15 bp, Homo sapiens
caggtgcctgtaatc

SEQ ID NO: 2807 - DNA, 15 bp, Homo sapiens
gcaggtgcctgtaat

SEQ ID NO: 2808 - DNA, 15 bp, Homo sapiens
ggcaggtgcctgtaa

SEQ ID NO: 2809 - DNA, 15 bp, Homo sapiens
tggcaggtgcctgta

SEQ ID NO: 2810 - DNA, 15 bp, Homo sapiens
gtggcaggtgcctgt

SEQ ID NO: 2811 - DNA, 15 bp, Homo sapiens
ggtggcaggtgcctg

SEQ ID NO: 2812 - DNA, 15 bp, Homo sapiens
tggtggcaggtgcct

SEQ ID NO: 2813 - DNA, 15 bp, Homo sapiens
gtggtggcaggtgcc

SEQ ID NO: 2814 - DNA, 15 bp, Homo sapiens
tgtggtggcaggtgc

SEQ ID NO: 2815 - DNA, 15 bp, Homo sapiens
gtgtggtggcaggtg

SEQ ID NO: 2816 - DNA, 15 bp, Homo sapiens
ggtgtggtggcaggt

SEQ ID NO: 2817 - DNA, 15 bp, Homo sapiens
gggtgtggtggcagg

SEQ ID NO: 2818 - DNA, 15 bp, Homo sapiens
tgggtgtggtggcag

SEQ ID NO: 2819 - DNA, 15 bp, Homo sapiens
ctgggtgtggtggca

SEQ ID NO: 2820 - DNA, 15 bp, Homo sapiens
agctgggtgtggtgg

SEQ ID NO: 2821 - DNA, 15 bp, Homo sapiens
tagctgggtgtggtg

SEQ ID NO: 2822 - DNA, 15 bp, Homo sapiens
ttagctgggtgtggt

SEQ ID NO: 2823 - DNA, 15 bp, Homo sapiens
attagctgggtgtgg

SEQ ID NO: 2824 - DNA, 15 bp, Homo sapiens
aattagctgggtgtg

SEQ ID NO: 2825 - DNA, 15 bp, Homo sapiens
aaattagctgggtgt

SEQ ID NO: 2826 - DNA, 15 bp, Homo sapiens
aaaattagctgggtg

SEQ ID NO: 2827 - DNA, 15 bp, Homo sapiens
aaaaattagctgggt

SEQ ID NO: 2828 - DNA, 15 bp, Homo sapiens
aaaaaatacaaaaat

SEQ ID NO: 2829 - DNA, 15 bp, Homo sapiens
aaaaaaatacaaaaa

SEQ ID NO: 2830 - DNA, 15 bp, Homo sapiens
aaaaaaaatacaaaa

SEQ ID NO: 2831 - DNA, 15 bp, Homo sapiens
aaaaaaaaatacaaa

SEQ ID NO: 2832 - DNA, 15 bp, Homo sapiens
taaaaaaaaatacaa

SEQ ID NO: 2833 - DNA, 15 bp, Homo sapiens
ttaaaaaaaaataca

SEQ ID NO: 2834 - DNA, 15 bp, Homo sapiens
cttaaaaaaaaatac

SEQ ID NO: 2835 - DNA, 15 bp, Homo sapiens
acttaaaaaaaaata

SEQ ID NO: 2836 - DNA, 15 bp, Homo sapiens
tacttaaaaaaaaat

SEQ ID NO: 2837 - DNA, 15 bp, Homo sapiens
ctacttaaaaaaaaa

SEQ ID NO: 2838 - DNA, 15 bp, Homo sapiens
tctacttaaaaaaaa

SEQ ID NO: 2839 - DNA, 15 bp, Homo sapiens
ctctacttaaaaaaa

SEQ ID NO: 2840 - DNA, 15 bp, Homo sapiens
tctctacttaaaaaa

SEQ ID NO: 2841 - DNA, 15 bp, Homo sapiens
atctctacttaaaaa

SEQ ID NO: 2842 - DNA, 15 bp, Homo sapiens
catctctacttaaaa

SEQ ID NO: 2843 - DNA, 15 bp, Homo sapiens
ccatctctacttaaa

SEQ ID NO: 2844 - DNA, 15 bp, Homo sapiens
cccatctctacttaa

SEQ ID NO: 2845 - DNA, 15 bp, Homo sapiens
ccccatctctactta

SEQ ID NO: 2846 - DNA, 15 bp, Homo sapiens
accccatctctactt

SEQ ID NO: 2847 - DNA, 15 bp, Homo sapiens
aaccccatctctact

SEQ ID NO: 2848 - DNA, 15 bp, Homo sapiens
aaaccccatctctac

SEQ ID NO: 2849 - DNA, 15 bp, Homo sapiens
gaaaccccatctcta

SEQ ID NO: 2850 - DNA, 15 bp, Homo sapiens
tgaaaccccatctct

SEQ ID NO: 2851 - DNA, 15 bp, Homo sapiens
gtgaaaccccatctc

SEQ ID NO: 2852 - DNA, 15 bp, Homo sapiens
ggtgaaaccccatct

SEQ ID NO: 2853 - DNA, 15 bp, Homo sapiens
atggtgaaaccccat

SEQ ID NO: 2854 - DNA, 15 bp, Homo sapiens
catggtgaaacccca

SEQ ID NO: 2855 - DNA, 15 bp, Homo sapiens
acatggtgaaacccc

SEQ ID NO: 2856 - DNA, 15 bp, Homo sapiens
aacatggtgaaaccc

SEQ ID NO: 2857 - DNA, 15 bp, Homo sapiens
cctggccaacatggt

SEQ ID NO: 2858 - DNA, 15 bp, Homo sapiens
cgagaccagcctggc

SEQ ID NO: 2859 - DNA, 15 bp, Homo sapiens
tcgagaccagcctgg

SEQ ID NO: 2860 - DNA, 15 bp, Homo sapiens
ttcgagaccagcctg

SEQ ID NO: 2861 - DNA, 15 bp, Homo sapiens
gttcgagaccagcct

SEQ ID NO: 2862 - DNA, 15 bp, Homo sapiens
agttcgagaccagcc

SEQ ID NO: 2863 - DNA, 15 bp, Homo sapiens
gagttcgagaccagc

SEQ ID NO: 2864 - DNA, 15 bp, Homo sapiens
ggagttcgagaccag

SEQ ID NO: 2865 - DNA, 15 bp, Homo sapiens
aggagttcgagacca

SEQ ID NO: 2866 - DNA, 15 bp, Homo sapiens
caggagttcgagacc

SEQ ID NO: 2867 - DNA, 15 bp, Homo sapiens
tcaggagttcgagac

SEQ ID NO: 2868 - DNA, 15 bp, Homo sapiens
ttcaggagttcgaga

SEQ ID NO: 2869 - DNA, 15 bp, Homo sapiens
gttcaggagttcgag

SEQ ID NO: 2870 - DNA, 15 bp, Homo sapiens
agttcaggagttcga

SEQ ID NO: 2871 - DNA, 15 bp, Homo sapiens
gagttcaggagttcg

SEQ ID NO: 2872 - DNA, 15 bp, Homo sapiens
tgagttcaggagttc

SEQ ID NO: 2873 - DNA, 15 bp, Homo sapiens
ctgagttcaggagtt

SEQ ID NO: 2874 - DNA, 15 bp, Homo sapiens
cctgagttcaggagt

SEQ ID NO: 2875 - DNA, 15 bp, Homo sapiens
acctgagttcaggag

SEQ ID NO: 2876 - DNA, 15 bp, Homo sapiens
cacctgagttcagga

SEQ ID NO: 2877 - DNA, 15 bp, Homo sapiens
tcacctgagttcagg

SEQ ID NO: 2878 - DNA, 15 bp, Homo sapiens
atcacctgagttcag

SEQ ID NO: 2879 - DNA, 15 bp, Homo sapiens
catcacctgagttca

SEQ ID NO: 2880 - DNA, 15 bp, Homo sapiens
gcatcacctgagttc

SEQ ID NO: 2881 - DNA, 15 bp, Homo sapiens
tgcatcacctgagtt

SEQ ID NO: 2882 - DNA, 15 bp, Homo sapiens
gtgcatcacctgagt

SEQ ID NO: 2883 - DNA, 15 bp, Homo sapiens
ggtgcatcacctgag

SEQ ID NO: 2884 - DNA, 15 bp, Homo sapiens
aggtgcatcacctga

SEQ ID NO: 2885 - DNA, 15 bp, Homo sapiens
caggtgcatcacctg

SEQ ID NO: 2886 - DNA, 15 bp, Homo sapiens
gcaggtgcatcacct

SEQ ID NO: 2887 - DNA, 15 bp, Homo sapiens
ggcaggtgcatcacc

SEQ ID NO: 2888 - DNA, 15 bp, Homo sapiens
aggcaggtgcatcac

SEQ ID NO: 2889 - DNA, 15 bp, Homo sapiens
aaggcaggtgcatca

SEQ ID NO: 2890 - DNA, 15 bp, Homo sapiens
caaggcaggtgcatc

SEQ ID NO: 2891 - DNA, 15 bp, Homo sapiens
ccaaggcaggtgcat

SEQ ID NO: 2892 - DNA, 15 bp, Homo sapiens
gccaaggcaggtgca

SEQ ID NO: 2893 - DNA, 15 bp, Homo sapiens
agccaaggcaggtgc

SEQ ID NO: 2894 - DNA, 15 bp, Homo sapiens
aagccaaggcaggtg

SEQ ID NO: 2895 - DNA, 15 bp, Homo sapiens
gaagccaaggcaggt

SEQ ID NO: 2896 - DNA, 15 bp, Homo sapiens
ggaagccaaggcagg

SEQ ID NO: 2897 - DNA, 15 bp, Homo sapiens
gggaagccaaggcag

SEQ ID NO: 2898 - DNA, 15 bp, Homo sapiens
tgggaagccaaggca

SEQ ID NO: 2899 - DNA, 15 bp, Homo sapiens
ttgggaagccaaggc

SEQ ID NO: 2900 - DNA, 15 bp, Homo sapiens
tttgggaagccaagg

SEQ ID NO: 2901 - DNA, 15 bp, Homo sapiens
ctttgggaagccaag

SEQ ID NO: 2902 - DNA, 15 bp, Homo sapiens
actttgggaagccaa

SEQ ID NO: 2903 - DNA, 15 bp, Homo sapiens
cactttgggaagcca

SEQ ID NO: 2904 - DNA, 15 bp, Homo sapiens
gcactttgggaagcc

SEQ ID NO: 2905 - DNA, 15 bp, Homo sapiens
agcactttgggaagc

SEQ ID NO: 2906 - DNA, 15 bp, Homo sapiens
cagcactttgggaag

SEQ ID NO: 2907 - DNA, 15 bp, Homo sapiens
ccagcactttgggaa

SEQ ID NO: 2908 - DNA, 15 bp, Homo sapiens
aatcccagcactttg

SEQ ID NO: 2909 - DNA, 15 bp, Homo sapiens
taatcccagcacttt

SEQ ID NO: 2910 - DNA, 15 bp, Homo sapiens
gtaatcccagcactt

SEQ ID NO: 2911 - DNA, 15 bp, Homo sapiens
tgtaatcccagcact

SEQ ID NO: 2912 - DNA, 15 bp, Homo sapiens
ctgtaatcccagcac

SEQ ID NO: 2913 - DNA, 15 bp, Homo sapiens
cctgtaatcccagca

SEQ ID NO: 2914 - DNA, 15 bp, Homo sapiens
cgcctgtaatcccag

SEQ ID NO: 2915 - DNA, 15 bp, Homo sapiens
acgcctgtaatccca

SEQ ID NO: 2916 - DNA, 15 bp, Homo sapiens
cacgcctgtaatccc

SEQ ID NO: 2917 - DNA, 15 bp, Homo sapiens
tcacgcctgtaatcc

SEQ ID NO: 2918 - DNA, 15 bp, Homo sapiens
ctcacgcctgtaatc

SEQ ID NO: 2919 - DNA, 15 bp, Homo sapiens
gctcacgcctgtaat

SEQ ID NO: 2920 - DNA, 15 bp, Homo sapiens
ggctcacgcctgtaa

SEQ ID NO: 2921 - DNA, 15 bp, Homo sapiens
tggctcacgcctgta

SEQ ID NO: 2922 - DNA, 15 bp, Homo sapiens
gtggctcacgcctgt

SEQ ID NO: 2923 - DNA, 15 bp, Homo sapiens
ggtggctcacgcctg

SEQ ID NO: 2924 - DNA, 15 bp, Homo sapiens
aggtggctcacgcct

SEQ ID NO: 2925 - DNA, 15 bp, Homo sapiens
aaggtggctcacgcc

SEQ ID NO: 2926 - DNA, 15 bp, Homo sapiens
caaggtggctcacgc

SEQ ID NO: 2927 - DNA, 15 bp, Homo sapiens
gcaaggtggctcacg

SEQ ID NO: 2928 - DNA, 15 bp, Homo sapiens
ggcaaggtggctcac

SEQ ID NO: 2929 - DNA, 15 bp, Homo sapiens
gggcaaggtggctca

SEQ ID NO: 2930 - DNA, 15 bp, Homo sapiens
cgggcaaggtggctc

SEQ ID NO: 2931 - DNA, 15 bp, Homo sapiens
ccgggcaaggtggct

SEQ ID NO: 2932 - DNA, 15 bp, Homo sapiens
gccgggcaaggtggc

SEQ ID NO: 2933 - DNA, 15 bp, Homo sapiens
ggccgggcaaggtgg

SEQ ID NO: 2934 - DNA, 15 bp, Homo sapiens
aggccgggcaaggtg

SEQ ID NO: 2935 - DNA, 15 bp, Homo sapiens
taggccgggcaaggt

SEQ ID NO: 2936 - DNA, 15 bp, Homo sapiens
ctaggccgggcaagg

SEQ ID NO: 2937 - DNA, 15 bp, Homo sapiens
actaggccgggcaag

SEQ ID NO: 2938 - DNA, 15 bp, Homo sapiens
aactaggccgggcaa

SEQ ID NO: 2939 - DNA, 15 bp, Homo sapiens
aaactaggccgggca

SEQ ID NO: 2940 - DNA, 15 bp, Homo sapiens
aaaactaggccgggc

SEQ ID NO: 2941 - DNA, 15 bp, Homo sapiens
gaaaactaggccggg

SEQ ID NO: 2942 - DNA, 15 bp, Homo sapiens
ggaaaactaggccgg

SEQ ID NO: 2943 - DNA, 15 bp, Homo sapiens
gggaaaactaggccg

SEQ ID NO: 2944 - DNA, 15 bp, Homo sapiens
tgggaaaactaggcc

SEQ ID NO: 2945 - DNA, 15 bp, Homo sapiens
gtgggaaaactaggc

SEQ ID NO: 2946 - DNA, 15 bp, Homo sapiens
agtgggaaaactagg

SEQ ID NO: 2947 - DNA, 15 bp, Homo sapiens
aagtgggaaaactag

SEQ ID NO: 2948 - DNA, 15 bp, Homo sapiens
taagtgggaaaacta

SEQ ID NO: 2949 - DNA, 15 bp, Homo sapiens
ataagtgggaaaact

SEQ ID NO: 2950 - DNA, 15 bp, Homo sapiens
aataagtgggaaaac

SEQ ID NO: 2951 - DNA, 15 bp, Homo sapiens
aaataagtgggaaaa

SEQ ID NO: 2952 - DNA, 15 bp, Homo sapiens
aaaataagtgggaaa

SEQ ID NO: 2953 - DNA, 15 bp, Homo sapiens
taaaataagtgggaa

SEQ ID NO: 2954 - DNA, 15 bp, Homo sapiens
gtaaaataagtggga

SEQ ID NO: 2955 - DNA, 15 bp, Homo sapiens
tgtaaaataagtggg

SEQ ID NO: 2956 - DNA, 15 bp, Homo sapiens
ttgtaaaataagtgg

SEQ ID NO: 2957 - DNA, 15 bp, Homo sapiens
attgtaaaataagtg

SEQ ID NO: 2958 - DNA, 15 bp, Homo sapiens
tattgtaaaataagt

SEQ ID NO: 2959 - DNA, 15 bp, Homo sapiens
gtattgtaaaataag

SEQ ID NO: 2960 - DNA, 15 bp, Homo sapiens
agtattgtaaaataa

SEQ ID NO: 2961 - DNA, 15 bp, Homo sapiens
aagtattgtaaaata

SEQ ID NO: 2962 - DNA, 15 bp, Homo sapiens
taagtattgtaaaat

SEQ ID NO: 2963 - DNA, 15 bp, Homo sapiens
gtaagtattgtaaaa

SEQ ID NO: 2964 - DNA, 15 bp, Homo sapiens
agtaagtattgtaaa

SEQ ID NO: 2965 - DNA, 15 bp, Homo sapiens
cagtaagtattgtaa

SEQ ID NO: 2966 - DNA, 15 bp, Homo sapiens
gcagtaagtattgta

SEQ ID NO: 2967 - DNA, 15 bp, Homo sapiens
tgcagtaagtattgt

SEQ ID NO: 2968 - DNA, 15 bp, Homo sapiens
atgcagtaagtattg

SEQ ID NO: 2969 - DNA, 15 bp, Homo sapiens
aatgcagtaagtatt

SEQ ID NO: 2970 - DNA, 15 bp, Homo sapiens
aaatgcagtaagtat

SEQ ID NO: 2971 - DNA, 15 bp, Homo sapiens
aaaatgcagtaagta

SEQ ID NO: 2972 - DNA, 15 bp, Homo sapiens
aaaaatgcagtaagt

SEQ ID NO: 2973 - DNA, 15 bp, Homo sapiens
gaaaaatgcagtaag

SEQ ID NO: 2974 - DNA, 15 bp, Homo sapiens
agaaaaatgcagtaa

SEQ ID NO: 2975 - DNA, 15 bp, Homo sapiens
cagaaaaatgcagta

SEQ ID NO: 2976 - DNA, 15 bp, Homo sapiens
acagaaaaatgcagt

SEQ ID NO: 2977 - DNA, 15 bp, Homo sapiens
gacagaaaaatgcag

SEQ ID NO: 2978 - DNA, 15 bp, Homo sapiens
agacagaaaaatgca

SEQ ID NO: 2979 - DNA, 15 bp, Homo sapiens
cagacagaaaaatgc

SEQ ID NO: 2980 - DNA, 15 bp, Homo sapiens
acagacagaaaaatg

SEQ ID NO: 2981 - DNA, 15 bp, Homo sapiens
gacagacagaaaaat

SEQ ID NO: 2982 - DNA, 15 bp, Homo sapiens
agacagacagaaaaa

SEQ ID NO: 2983 - DNA, 15 bp, Homo sapiens
cagacagacagaaaa

SEQ ID NO: 2984 - DNA, 15 bp, Homo sapiens
acagacagacagaaa

SEQ ID NO: 2985 - DNA, 15 bp, Homo sapiens
cacagacagacagaa

SEQ ID NO: 2986 - DNA, 15 bp, Homo sapiens
acacagacagacaga

SEQ ID NO: 2987 - DNA, 15 bp, Homo sapiens
cacacagacagacag

SEQ ID NO: 2988 - DNA, 15 bp, Homo sapiens
acacacagacagaca

SEQ ID NO: 2989 - DNA, 15 bp, Homo sapiens
tacacacagacagac

SEQ ID NO: 2990 - DNA, 15 bp, Homo sapiens
atacacacagacaga

SEQ ID NO: 2991 - DNA, 15 bp, Homo sapiens
catacacacagacag

SEQ ID NO: 2992 - DNA, 15 bp, Homo sapiens
gcatacacacagaca

SEQ ID NO: 2993 - DNA, 15 bp, Homo sapiens
tgcatacacacagac

SEQ ID NO: 2994 - DNA, 15 bp, Homo sapiens
atgcatacacacaga

SEQ ID NO: 2995 - DNA, 15 bp, Homo sapiens
tatgcatacacacag

SEQ ID NO: 2996 - DNA, 15 bp, Homo sapiens
atatgcatacacaca

SEQ ID NO: 2997 - DNA, 15 bp, Homo sapiens
tatatgcatacacac

SEQ ID NO: 2998 - DNA, 15 bp, Homo sapiens
atatatgcatacaca

SEQ ID NO: 2999 - DNA, 15 bp, Homo sapiens
tatatatgcatacac

SEQ ID NO: 3000 - DNA, 15 bp, Homo sapiens
gtatatatgcataca

SEQ ID NO: 3001 - DNA, 15 bp, Homo sapiens
tgtatatatgcatac

SEQ ID NO: 3002 - DNA, 15 bp, Homo sapiens
atgtatatatgcata

SEQ ID NO: 3003 - DNA, 15 bp, Homo sapiens
gatgtatatatgcat

SEQ ID NO: 3004 - DNA, 15 bp, Homo sapiens
agatgtatatatgca

SEQ ID NO: 3005 - DNA, 15 bp, Homo sapiens
tagatgtatatatgc

SEQ ID NO: 3006 - DNA, 15 bp, Homo sapiens
gtagatgtatatatg

SEQ ID NO: 3007 - DNA, 15 bp, Homo sapiens
tgtagatgtatatat

SEQ ID NO: 3008 - DNA, 15 bp, Homo sapiens
atgtagatgtatata

SEQ ID NO: 3009 - DNA, 15 bp, Homo sapiens
tatgtagatgtatat

SEQ ID NO: 3010 - DNA, 15 bp, Homo sapiens
gtatgtagatgtata

SEQ ID NO: 3011 - DNA, 15 bp, Homo sapiens
tgtatgtagatgtat

SEQ ID NO: 3012 - DNA, 15 bp, Homo sapiens
atgtatgtagatgta

SEQ ID NO: 3013 - DNA, 15 bp, Homo sapiens
tatgtatgtagatgt

SEQ ID NO: 3014 - DNA, 15 bp, Homo sapiens
atatgtatgtagatg

SEQ ID NO: 3015 - DNA, 15 bp, Homo sapiens
tatatgtatgtagat

SEQ ID NO: 3016 - DNA, 15 bp, Homo sapiens
atatatgtatgtaga

SEQ ID NO: 3017 - DNA, 15 bp, Homo sapiens
gatatatgtatgtag

SEQ ID NO: 3018 - DNA, 15 bp, Homo sapiens
tgatatatgtatgta

SEQ ID NO: 3019 - DNA, 15 bp, Homo sapiens
ttgatatatgtatgt

SEQ ID NO: 3020 - DNA, 15 bp, Homo sapiens
gttgatatatgtatg

SEQ ID NO: 3021 - DNA, 15 bp, Homo sapiens
ggttgatatatgtat

SEQ ID NO: 3022 - DNA, 15 bp, Homo sapiens
aggttgatatatgta

SEQ ID NO: 3023 - DNA, 15 bp, Homo sapiens
taggttgatatatgt

SEQ ID NO: 3024 - DNA, 15 bp, Homo sapiens
ttaggttgatatatg

SEQ ID NO: 3025 - DNA, 15 bp, Homo sapiens
tttaggttgatatat

SEQ ID NO: 3026 - DNA, 15 bp, Homo sapiens
atttaggttgatata

SEQ ID NO: 3027 - DNA, 15 bp, Homo sapiens
tatttaggttgatat

SEQ ID NO: 3028 - DNA, 15 bp, Homo sapiens
atatttaggttgata

SEQ ID NO: 3029 - DNA, 15 bp, Homo sapiens
tatatttaggttgat

SEQ ID NO: 3030 - DNA, 15 bp, Homo sapiens
gtatatttaggttga

SEQ ID NO: 3031 - DNA, 15 bp, Homo sapiens
ggtatatttaggttg

SEQ ID NO: 3032 - DNA, 15 bp, Homo sapiens
aggtatatttaggtt

SEQ ID NO: 3033 - DNA, 15 bp, Homo sapiens
taggtatatttaggt

SEQ ID NO: 3034 - DNA, 15 bp, Homo sapiens
ataggtatatttagg

SEQ ID NO: 3035 - DNA, 15 bp, Homo sapiens
tataggtatatttag

SEQ ID NO: 3036 - DNA, 15 bp, Homo sapiens
atataggtatattta

SEQ ID NO: 3037 - DNA, 15 bp, Homo sapiens
gatataggtatattt

SEQ ID NO: 3038 - DNA, 15 bp, Homo sapiens
tgatataggtatatt

SEQ ID NO: 3039 - DNA, 15 bp, Homo sapiens
ctgatataggtatat

SEQ ID NO: 3040 - DNA, 15 bp, Homo sapiens
actgatataggtata

SEQ ID NO: 3041 - DNA, 15 bp, Homo sapiens
tactgatataggtat

SEQ ID NO: 3042 - DNA, 15 bp, Homo sapiens
atactgatataggta

SEQ ID NO: 3043 - DNA, 15 bp, Homo sapiens
tatactgatataggt

SEQ ID NO: 3044 - DNA, 15 bp, Homo sapiens
ctatactgatatagg

SEQ ID NO: 3045 - DNA, 15 bp, Homo sapiens
tctatactgatatag

SEQ ID NO: 3046 - DNA, 15 bp, Homo sapiens
gtctatactgatata

SEQ ID NO: 3047 - DNA, 15 bp, Homo sapiens
tgtctatactgatat

SEQ ID NO: 3048 - DNA, 15 bp, Homo sapiens
ctgtctatactgata

SEQ ID NO: 3049 - DNA, 15 bp, Homo sapiens
tctgtctatactgat

SEQ ID NO: 3050 - DNA, 15 bp, Homo sapiens
atctgtctatactga

SEQ ID NO: 3051 - DNA, 15 bp, Homo sapiens
tatctgtctatactg

SEQ ID NO: 3052 - DNA, 15 bp, Homo sapiens
atatctgtctatact

SEQ ID NO: 3053 - DNA, 15 bp, Homo sapiens
tatatctgtctatac

SEQ ID NO: 3054 - DNA, 15 bp, Homo sapiens
atatatctgtctata

SEQ ID NO: 3055 - DNA, 15 bp, Homo sapiens
catatatctgtctat

SEQ ID NO: 3056 - DNA, 15 bp, Homo sapiens
gcatatatctgtcta

SEQ ID NO: 3057 - DNA, 15 bp, Homo sapiens
agcatatatctgtct

SEQ ID NO: 3058 - DNA, 15 bp, Homo sapiens
tagcatatatctgtc

SEQ ID NO: 3059 - DNA, 15 bp, Homo sapiens
atagcatatatctgt

SEQ ID NO: 3060 - DNA, 15 bp, Homo sapiens
aatagcatatatctg

SEQ ID NO: 3061 - DNA, 15 bp, Homo sapiens
gaatagcatatatct

SEQ ID NO: 3062 - DNA, 15 bp, Homo sapiens
agaatagcatatatc

SEQ ID NO: 3063 - DNA, 15 bp, Homo sapiens
cagaatagcatatat

SEQ ID NO: 3064 - DNA, 15 bp, Homo sapiens
acagaatagcatata

SEQ ID NO: 3065 - DNA, 15 bp, Homo sapiens
aacagaatagcatat

SEQ ID NO: 3066 - DNA, 15 bp, Homo sapiens
aaacagaatagcata

SEQ ID NO: 3067 - DNA, 15 bp, Homo sapiens
caaacagaatagcat

SEQ ID NO: 3068 - DNA, 15 bp, Homo sapiens
tcaaacagaatagca

SEQ ID NO: 3069 - DNA, 15 bp, Homo sapiens
ttcaaacagaatagc

SEQ ID NO: 3070 - DNA, 15 bp, Homo sapiens
gttcaaacagaatag

SEQ ID NO: 3071 - DNA, 15 bp, Homo sapiens
agttcaaacagaata

SEQ ID NO: 3072 - DNA, 15 bp, Homo sapiens
aagttcaaacagaat

SEQ ID NO: 3073 - DNA, 15 bp, Homo sapiens
taagttcaaacagaa

SEQ ID NO: 3074 - DNA, 15 bp, Homo sapiens
ttaagttcaaacaga

SEQ ID NO: 3075 - DNA, 15 bp, Homo sapiens
cttaagttcaaacag

SEQ ID NO: 3076 - DNA, 15 bp, Homo sapiens
acttaagttcaaaca

SEQ ID NO: 3077 - DNA, 15 bp, Homo sapiens
aacttaagttcaaac

SEQ ID NO: 3078 - DNA, 15 bp, Homo sapiens
caacttaagttcaaa

SEQ ID NO: 3079 - DNA, 15 bp, Homo sapiens
tcaacttaagttcaa

SEQ ID NO: 3080 - DNA, 15 bp, Homo sapiens
ttcaacttaagttca

SEQ ID NO: 3081 - DNA, 15 bp, Homo sapiens
cttcaacttaagttc

SEQ ID NO: 3082 - DNA, 15 bp, Homo sapiens
tcttcaacttaagtt

SEQ ID NO: 3083 - DNA, 15 bp, Homo sapiens
atcttcaacttaagt

SEQ ID NO: 3084 - DNA, 15 bp, Homo sapiens
tatcttcaacttaag

SEQ ID NO: 3085 - DNA, 15 bp, Homo sapiens
gtatcttcaacttaa

SEQ ID NO: 3086 - DNA, 15 bp, Homo sapiens
ggtatcttcaactta

SEQ ID NO: 3087 - DNA, 15 bp, Homo sapiens
tggtatcttcaactt

SEQ ID NO: 3088 - DNA, 15 bp, Homo sapiens
atggtatcttcaact

SEQ ID NO: 3089 - DNA, 15 bp, Homo sapiens
gatggtatcttcaac

SEQ ID NO: 3090 - DNA, 15 bp, Homo sapiens
tgatggtatcttcaa

SEQ ID NO: 3091 - DNA, 15 bp, Homo sapiens
gtgatggtatcttca

SEQ ID NO: 3092 - DNA, 15 bp, Homo sapiens
tgtgatggtatcttc

SEQ ID NO: 3093 - DNA, 15 bp, Homo sapiens
gtgtgatggtatctt

SEQ ID NO: 3094 - DNA, 15 bp, Homo sapiens
agtgtgatggtatct

SEQ ID NO: 3095 - DNA, 15 bp, Homo sapiens
aagtgtgatggtatc

SEQ ID NO: 3096 - DNA, 15 bp, Homo sapiens
gaagtgtgatggtat

SEQ ID NO: 3097 - DNA, 15 bp, Homo sapiens
tgaagtgtgatggta

SEQ ID NO: 3098 - DNA, 15 bp, Homo sapiens
atgaagtgtgatggt

SEQ ID NO: 3099 - DNA, 15 bp, Homo sapiens
aatgaagtgtgatgg

SEQ ID NO: 3100 - DNA, 15 bp, Homo sapiens
caatgaagtgtgatg

SEQ ID NO: 3101 - DNA, 15 bp, Homo sapiens
gcaatgaagtgtgat

SEQ ID NO: 3102 - DNA, 15 bp, Homo sapiens
agcaatgaagtgtga

SEQ ID NO: 3103 - DNA, 15 bp, Homo sapiens
tagcaatgaagtgtg

SEQ ID NO: 3104 - DNA, 15 bp, Homo sapiens
ttagcaatgaagtgt

SEQ ID NO: 3105 - DNA, 15 bp, Homo sapiens
tttagcaatgaagtg

SEQ ID NO: 3106 - DNA, 15 bp, Homo sapiens
atttagcaatgaagt

SEQ ID NO: 3107 - DNA, 15 bp, Homo sapiens
tatttagcaatgaag

SEQ ID NO: 3108 - DNA, 15 bp, Homo sapiens
atatttagcaatgaa

SEQ ID NO: 3109 - DNA, 15 bp, Homo sapiens
aatatttagcaatga

SEQ ID NO: 3110 - DNA, 15 bp, Homo sapiens
aaatatttagcaatg

SEQ ID NO: 3111 - DNA, 15 bp, Homo sapiens
gaaatatttagcaat

SEQ ID NO: 3112 - DNA, 15 bp, Homo sapiens
tgaaatatttagcaa

SEQ ID NO: 3113 - DNA, 15 bp, Homo sapiens
gtgaaatatttagca

SEQ ID NO: 3114 - DNA, 15 bp, Homo sapiens
ggtgaaatatttagc

SEQ ID NO: 3115 - DNA, 15 bp, Homo sapiens
tggtgaaatatttag

SEQ ID NO: 3116 - DNA, 15 bp, Homo sapiens
gtggtgaaatattta

SEQ ID NO: 3117 - DNA, 15 bp, Homo sapiens
tgtggtgaaatattt

SEQ ID NO: 3118 - DNA, 15 bp, Homo sapiens
atgtggtgaaatatt

SEQ ID NO: 3119 - DNA, 15 bp, Homo sapiens
catgtggtgaaatat

SEQ ID NO: 3120 - DNA, 15 bp, Homo sapiens
acatgtggtgaaata

SEQ ID NO: 3121 - DNA, 15 bp, Homo sapiens
gacatgtggtgaaat

SEQ ID NO: 3122 - DNA, 15 bp, Homo sapiens
agacatgtggtgaaa

SEQ ID NO: 3123 - DNA, 15 bp, Homo sapiens
gagacatgtggtgaa

SEQ ID NO: 3124 - DNA, 15 bp, Homo sapiens
agagacatgtggtga

SEQ ID NO: 3125 - DNA, 15 bp, Homo sapiens
aagagacatgtggtg

SEQ ID NO: 3126 - DNA, 15 bp, Homo sapiens
taagagacatgtggt

SEQ ID NO: 3127 - DNA, 15 bp, Homo sapiens
gtaagagacatgtgg

SEQ ID NO: 3128 - DNA, 15 bp, Homo sapiens
tgtaagagacatgtg

SEQ ID NO: 3129 - DNA, 15 bp, Homo sapiens
ttgtaagagacatgt

SEQ ID NO: 3130 - DNA, 15 bp, Homo sapiens
attgtaagagacatg

SEQ ID NO: 3131 - DNA, 15 bp, Homo sapiens
gattgtaagagacat

SEQ ID NO: 3132 - DNA, 15 bp, Homo sapiens
tgattgtaagagaca

SEQ ID NO: 3133 - DNA, 15 bp, Homo sapiens
ttgattgtaagagac

SEQ ID NO: 3134 - DNA, 15 bp, Homo sapiens
tttgattgtaagaga

SEQ ID NO: 3135 - DNA, 15 bp, Homo sapiens
ctttgattgtaagag

SEQ ID NO: 3136 - DNA, 15 bp, Homo sapiens
tctttgattgtaaga

SEQ ID NO: 3137 - DNA, 15 bp, Homo sapiens
gtctttgattgtaag

SEQ ID NO: 3138 - DNA, 15 bp, Homo sapiens
tgtctttgattgtaa

SEQ ID NO: 3139 - DNA, 15 bp, Homo sapiens
atgtctttgattgta

SEQ ID NO: 3140 - DNA, 15 bp, Homo sapiens
aatgtctttgattgt

SEQ ID NO: 3141 - DNA, 15 bp, Homo sapiens
gaatgtctttgattg

SEQ ID NO: 3142 - DNA, 15 bp, Homo sapiens
agaatgtctttgatt

SEQ ID NO: 3143 - DNA, 15 bp, Homo sapiens
gagaatgtctttgat

SEQ ID NO: 3144 - DNA, 15 bp, Homo sapiens
ggagaatgtctttga

SEQ ID NO: 3145 - DNA, 15 bp, Homo sapiens
aggagaatgtctttg

SEQ ID NO: 3146 - DNA, 15 bp, Homo sapiens
caggagaatgtcttt

SEQ ID NO: 3147 - DNA, 15 bp, Homo sapiens
gcaggagaatgtctt

SEQ ID NO: 3148 - DNA, 15 bp, Homo sapiens
tgcaggagaatgtct

SEQ ID NO: 3149 - DNA, 15 bp, Homo sapiens
ttgcaggagaatgtc

SEQ ID NO: 3150 - DNA, 15 bp, Homo sapiens
gttgcaggagaatgt

SEQ ID NO: 3151 - DNA, 15 bp, Homo sapiens
tgttgcaggagaatg

SEQ ID NO: 3152 - DNA, 15 bp, Homo sapiens
ttgttgcaggagaat

SEQ ID NO: 3153 - DNA, 15 bp, Homo sapiens
attgttgcaggagaa

SEQ ID NO: 3154 - DNA, 15 bp, Homo sapiens
tattgttgcaggaga

SEQ ID NO: 3155 - DNA, 15 bp, Homo sapiens
gtattgttgcaggag

SEQ ID NO: 3156 - DNA, 15 bp, Homo sapiens
ggtattgttgcagga

SEQ ID NO: 3157 - DNA, 15 bp, Homo sapiens
tggtattgttgcagg

SEQ ID NO: 3158 - DNA, 15 bp, Homo sapiens
atggtattgttgcag

SEQ ID NO: 3159 - DNA, 15 bp, Homo sapiens
tatggtattgttgca

SEQ ID NO: 3160 - DNA, 15 bp, Homo sapiens
ttatggtattgttgc

SEQ ID NO: 3161 - DNA, 15 bp, Homo sapiens
attatggtattgttg

SEQ ID NO: 3162 - DNA, 15 bp, Homo sapiens
aattatggtattgtt

SEQ ID NO: 3163 - DNA, 15 bp, Homo sapiens
taattatggtattgt

SEQ ID NO: 3164 - DNA, 15 bp, Homo sapiens
ttaattatggtattg

SEQ ID NO: 3165 - DNA, 15 bp, Homo sapiens
attaattatggtatt

SEQ ID NO: 3166 - DNA, 15 bp, Homo sapiens
cattaattatggtat

SEQ ID NO: 3167 - DNA, 15 bp, Homo sapiens
acattaattatggta

SEQ ID NO: 3168 - DNA, 15 bp, Homo sapiens
aacattaattatggt

SEQ ID NO: 3169 - DNA, 15 bp, Homo sapiens
taacattaattatgg

SEQ ID NO: 3170 - DNA, 15 bp, Homo sapiens
ttaacattaattatg

SEQ ID NO: 3171 - DNA, 15 bp, Homo sapiens
tttaacattaattat

SEQ ID NO: 3172 - DNA, 15 bp, Homo sapiens
ctttaacattaatta

SEQ ID NO: 3173 - DNA, 15 bp, Homo sapiens
tctttaacattaatt

SEQ ID NO: 3174 - DNA, 15 bp, Homo sapiens
ttctttaacattaat

SEQ ID NO: 3175 - DNA, 15 bp, Homo sapiens
tttctttaacattaa

SEQ ID NO: 3176 - DNA, 15 bp, Homo sapiens
atttctttaacatta

SEQ ID NO: 3177 - DNA, 15 bp, Homo sapiens
aatttctttaacatt

SEQ ID NO: 3178 - DNA, 15 bp, Homo sapiens
aaatttctttaacat

SEQ ID NO: 3179 - DNA, 15 bp, Homo sapiens
taaatttctttaaca

SEQ ID NO: 3180 - DNA, 15 bp, Homo sapiens
ttaaatttctttaac

SEQ ID NO: 3181 - DNA, 15 bp, Homo sapiens
gttaaatttctttaa

SEQ ID NO: 3182 - DNA, 15 bp, Homo sapiens
tgttaaatttcttta

SEQ ID NO: 3183 - DNA, 15 bp, Homo sapiens
atgttaaatttcttt

SEQ ID NO: 3184 - DNA, 15 bp, Homo sapiens
aatgttaaatttctt

SEQ ID NO: 3185 - DNA, 15 bp, Homo sapiens
caatgttaaatttct

SEQ ID NO: 3186 - DNA, 15 bp, Homo sapiens
tcaatgttaaatttc

SEQ ID NO: 3187 - DNA, 15 bp, Homo sapiens
atcaatgttaaattt

SEQ ID NO: 3188 - DNA, 15 bp, Homo sapiens
tatcaatgttaaatt

SEQ ID NO: 3189 - DNA, 15 bp, Homo sapiens
gtatcaatgttaaat

SEQ ID NO: 3190 - DNA, 15 bp, Homo sapiens
tgtatcaatgttaaa

SEQ ID NO: 3191 - DNA, 15 bp, Homo sapiens
ttgtatcaatgttaa

SEQ ID NO: 3192 - DNA, 15 bp, Homo sapiens
attgtatcaatgtta

SEQ ID NO: 3193 - DNA, 15 bp, Homo sapiens
tattgtatcaatgtt

SEQ ID NO: 3194 - DNA, 15 bp, Homo sapiens
ttattgtatcaatgt

SEQ ID NO: 3195 - DNA, 15 bp, Homo sapiens
attattgtatcaatg

SEQ ID NO: 3196 - DNA, 15 bp, Homo sapiens
tattattgtatcaat

SEQ ID NO: 3197 - DNA, 15 bp, Homo sapiens
atattattgtatcaa

SEQ ID NO: 3198 - DNA, 15 bp, Homo sapiens
aatattattgtatca

SEQ ID NO: 3199 - DNA, 15 bp, Homo sapiens
caatattattgtatc

SEQ ID NO: 3200 - DNA, 15 bp, Homo sapiens
acaatattattgtat

SEQ ID NO: 3201 - DNA, 15 bp, Homo sapiens
gacaatattattgta

SEQ ID NO: 3202 - DNA, 15 bp, Homo sapiens
agacaatattattgt

SEQ ID NO: 3203 - DNA, 15 bp, Homo sapiens
tagacaatattattg

SEQ ID NO: 3204 - DNA, 15 bp, Homo sapiens
ttagacaatattatt

SEQ ID NO: 3205 - DNA, 15 bp, Homo sapiens
attagacaatattat

SEQ ID NO: 3206 - DNA, 15 bp, Homo sapiens
tattagacaatatta

SEQ ID NO: 3207 - DNA, 15 bp, Homo sapiens
gtattagacaatatt

SEQ ID NO: 3208 - DNA, 15 bp, Homo sapiens
tgtattagacaatat

SEQ ID NO: 3209 - DNA, 15 bp, Homo sapiens
atgtattagacaata

SEQ ID NO: 3210 - DNA, 15 bp, Homo sapiens
tatgtattagacaat

SEQ ID NO: 3211 - DNA, 15 bp, Homo sapiens
ctatgtattagacaa

SEQ ID NO: 3212 - DNA, 15 bp, Homo sapiens
actatgtattagaca

SEQ ID NO: 3213 - DNA, 15 bp, Homo sapiens
gactatgtattagac

SEQ ID NO: 3214 - DNA, 15 bp, Homo sapiens
ggactatgtattaga

SEQ ID NO: 3215 - DNA, 15 bp, Homo sapiens
tggactatgtattag

SEQ ID NO: 3216 - DNA, 15 bp, Homo sapiens
ttggactatgtatta

SEQ ID NO: 3217 - DNA, 15 bp, Homo sapiens
tttggactatgtatt

SEQ ID NO: 3218 - DNA, 15 bp, Homo sapiens
atttggactatgtat

SEQ ID NO: 3219 - DNA, 15 bp, Homo sapiens
aatttggactatgta

SEQ ID NO: 3220 - DNA, 15 bp, Homo sapiens
gaatttggactatgt

SEQ ID NO: 3221 - DNA, 15 bp, Homo sapiens
tgaatttggactatg

SEQ ID NO: 3222 - DNA, 15 bp, Homo sapiens
ctgaatttggactat

SEQ ID NO: 3223 - DNA, 15 bp, Homo sapiens
tctgaatttggacta

SEQ ID NO: 3224 - DNA, 15 bp, Homo sapiens
atctgaatttggact

SEQ ID NO: 3225 - DNA, 15 bp, Homo sapiens
aatctgaatttggac

SEQ ID NO: 3226 - DNA, 15 bp, Homo sapiens
aaatctgaatttgga

SEQ ID NO: 3227 - DNA, 15 bp, Homo sapiens
aaaatctgaatttgg

SEQ ID NO: 3228 - DNA, 15 bp, Homo sapiens
aaaaatctgaatttg

SEQ ID NO: 3229 - DNA, 15 bp, Homo sapiens
gaaaaatctgaattt

SEQ ID NO: 3230 - DNA, 15 bp, Homo sapiens
tgaaaaatctgaatt

SEQ ID NO: 3231 - DNA, 15 bp, Homo sapiens
ttgaaaaatctgaat

SEQ ID NO: 3232 - DNA, 15 bp, Homo sapiens
tttgaaaaatctgaa

SEQ ID NO: 3233 - DNA, 15 bp, Homo sapiens
atttgaaaaatctga

SEQ ID NO: 3234 - DNA, 15 bp, Homo sapiens
catttgaaaaatctg

SEQ ID NO: 3235 - DNA, 15 bp, Homo sapiens
tcatttgaaaaatct

SEQ ID NO: 3236 - DNA, 15 bp, Homo sapiens
atcatttgaaaaatc

SEQ ID NO: 3237 - DNA, 15 bp, Homo sapiens
gatcatttgaaaaat

SEQ ID NO: 3238 - DNA, 15 bp, Homo sapiens
ggatcatttgaaaaa

SEQ ID NO: 3239 - DNA, 15 bp, Homo sapiens
aggatcatttgaaaa

SEQ ID NO: 3240 - DNA, 15 bp, Homo sapiens
gaggatcatttgaaa

SEQ ID NO: 3241 - DNA, 15 bp, Homo sapiens
tgaggatcatttgaa

SEQ ID NO: 3242 - DNA, 15 bp, Homo sapiens
ttgaggatcatttga

SEQ ID NO: 3243 - DNA, 15 bp, Homo sapiens
tttgaggatcatttg

SEQ ID NO: 3244 - DNA, 15 bp, Homo sapiens
atttgaggatcattt

SEQ ID NO: 3245 - DNA, 15 bp, Homo sapiens
catttgaggatcatt

SEQ ID NO: 3246 - DNA, 15 bp, Homo sapiens
acatttgaggatcat

SEQ ID NO: 3247 - DNA, 15 bp, Homo sapiens
aacatttgaggatca

SEQ ID NO: 3248 - DNA, 15 bp, Homo sapiens
aaacatttgaggatc

SEQ ID NO: 3249 - DNA, 15 bp, Homo sapiens
aaaacatttgaggat

SEQ ID NO: 3250 - DNA, 15 bp, Homo sapiens
taaaacatttgagga

SEQ ID NO: 3251 - DNA, 15 bp, Homo sapiens
ataaaacatttgagg

SEQ ID NO: 3252 - DNA, 15 bp, Homo sapiens
aataaaacatttgag

SEQ ID NO: 3253 - DNA, 15 bp, Homo sapiens
aaataaaacatttga

SEQ ID NO: 3254 - DNA, 15 bp, Homo sapiens
aaaataaaacatttg

SEQ ID NO: 3255 - DNA, 15 bp, Homo sapiens
taaaataaaacattt

SEQ ID NO: 3256 - DNA, 15 bp, Homo sapiens
ttaaaataaaacatt

SEQ ID NO: 3257 - DNA, 15 bp, Homo sapiens
tttaaaataaaacat

SEQ ID NO: 3258 - DNA, 15 bp, Homo sapiens
ttttaaaataaaaca

SEQ ID NO: 3259 - DNA, 15 bp, Homo sapiens
attttaaaataaaac

SEQ ID NO: 3260 - DNA, 15 bp, Homo sapiens
aattttaaaataaaa

SEQ ID NO: 3261 - DNA, 15 bp, Homo sapiens
gaattttaaaataaa

SEQ ID NO: 3262 - DNA, 15 bp, Homo sapiens
agaattttaaaataa

SEQ ID NO: 3263 - DNA, 15 bp, Homo sapiens
cagaattttaaaata

SEQ ID NO: 3264 - DNA, 15 bp, Homo sapiens
tcagaattttaaaat

SEQ ID NO: 3265 - DNA, 15 bp, Homo sapiens
attcagaattttaaa

SEQ ID NO: 3266 - DNA, 15 bp, Homo sapiens
aattcagaattttaa

SEQ ID NO: 3267 - DNA, 15 bp, Homo sapiens
gaattcagaatttta

SEQ ID NO: 3268 - DNA, 15 bp, Homo sapiens
tgaattcagaatttt

SEQ ID NO: 3269 - DNA, 15 bp, Homo sapiens
ttgaattcagaattt

SEQ ID NO: 3270 - DNA, 15 bp, Homo sapiens
attgaattcagaatt

SEQ ID NO: 3271 - DNA, 15 bp, Homo sapiens
gattgaattcagaat

SEQ ID NO: 3272 - DNA, 15 bp, Homo sapiens
tgattgaattcagaa

SEQ ID NO: 3273 - DNA, 15 bp, Homo sapiens
ttgattgaattcaga

SEQ ID NO: 3274 - DNA, 15 bp, Homo sapiens
tttgattgaattcag

SEQ ID NO: 3275 - DNA, 15 bp, Homo sapiens
ctttgattgaattca

SEQ ID NO: 3276 - DNA, 15 bp, Homo sapiens
tctttgattgaattc

SEQ ID NO: 3277 - DNA, 15 bp, Homo sapiens
atctttgattgaatt

SEQ ID NO: 3278 - DNA, 15 bp, Homo sapiens
aatctttgattgaat

SEQ ID NO: 3279 - DNA, 15 bp, Homo sapiens
taatctttgattgaa

SEQ ID NO: 3280 - DNA, 15 bp, Homo sapiens
gtaatctttgattga

SEQ ID NO: 3281 - DNA, 15 bp, Homo sapiens
tgtaatctttgattg

SEQ ID NO: 3282 - DNA, 15 bp, Homo sapiens
atgtaatctttgatt

SEQ ID NO: 3283 - DNA, 15 bp, Homo sapiens
aatgtaatctttgat

SEQ ID NO: 3284 - DNA, 15 bp, Homo sapiens
aaatgtaatctttga

SEQ ID NO: 3285 - DNA, 15 bp, Homo sapiens
gaaatgtaatctttg

SEQ ID NO: 3286 - DNA, 15 bp, Homo sapiens
tgaaatgtaatcttt

SEQ ID NO: 3287 - DNA, 15 bp, Homo sapiens
atgaaatgtaatctt

SEQ ID NO: 3288 - DNA, 15 bp, Homo sapiens
aatgaaatgtaatct

SEQ ID NO: 3289 - DNA, 15 bp, Homo sapiens
caatgaaatgtaatc

SEQ ID NO: 3290 - DNA, 15 bp, Homo sapiens
acaatgaaatgtaat

SEQ ID NO: 3291 - DNA, 15 bp, Homo sapiens
gacaatgaaatgtaa

SEQ ID NO: 3292 - DNA, 15 bp, Homo sapiens
tgacaatgaaatgta

SEQ ID NO: 3293 - DNA, 15 bp, Homo sapiens
atgacaatgaaatgt

SEQ ID NO: 3294 - DNA, 15 bp, Homo sapiens
catgacaatgaaatg

SEQ ID NO: 3295 - DNA, 15 bp, Homo sapiens
acatgacaatgaaat

SEQ ID NO: 3296 - DNA, 15 bp, Homo sapiens
gacatgacaatgaaa

SEQ ID NO: 3297 - DNA, 15 bp, Homo sapiens
agacatgacaatgaa

SEQ ID NO: 3298 - DNA, 15 bp, Homo sapiens
tagacatgacaatga

SEQ ID NO: 3299 - DNA, 15 bp, Homo sapiens
atagacatgacaatg

SEQ ID NO: 3300 - DNA, 15 bp, Homo sapiens
aatagacatgacaat

SEQ ID NO: 3301 - DNA, 15 bp, Homo sapiens
aaatagacatgacaa

SEQ ID NO: 3302 - DNA, 15 bp, Homo sapiens
taaatagacatgaca

SEQ ID NO: 3303 - DNA, 15 bp, Homo sapiens
ctaaatagacatgac

SEQ ID NO: 3304 - DNA, 15 bp, Homo sapiens
actaaatagacatga

SEQ ID NO: 3305 - DNA, 15 bp, Homo sapiens
gactaaatagacatg

SEQ ID NO: 3306 - DNA, 15 bp, Homo sapiens
agactaaatagacat

SEQ ID NO: 3307 - DNA, 15 bp, Homo sapiens
gagactaaatagaca

SEQ ID NO: 3308 - DNA, 15 bp, Homo sapiens
ggagactaaatagac

SEQ ID NO: 3309 - DNA, 15 bp, Homo sapiens
aggagactaaataga

SEQ ID NO: 3310 - DNA, 15 bp, Homo sapiens
aaggagactaaatag

SEQ ID NO: 3311 - DNA, 15 bp, Homo sapiens
aaaggagactaaata

SEQ ID NO: 3312 - DNA, 15 bp, Homo sapiens
taaaggagactaaat

SEQ ID NO: 3313 - DNA, 15 bp, Homo sapiens
ttaaaggagactaaa

SEQ ID NO: 3314 - DNA, 15 bp, Homo sapiens
attaaaggagactaa

SEQ ID NO: 3315 - DNA, 15 bp, Homo sapiens
aattaaaggagacta

SEQ ID NO: 3316 - DNA, 15 bp, Homo sapiens
gaattaaaggagact

SEQ ID NO: 3317 - DNA, 15 bp, Homo sapiens
tgaattaaaggagac

SEQ ID NO: 3318 - DNA, 15 bp, Homo sapiens
gtgaattaaaggaga

SEQ ID NO: 3319 - DNA, 15 bp, Homo sapiens
tgtgaattaaaggag

SEQ ID NO: 3320 - DNA, 15 bp, Homo sapiens
ttgtgaattaaagga

SEQ ID NO: 3321 - DNA, 15 bp, Homo sapiens
tttgtgaattaaagg

SEQ ID NO: 3322 - DNA, 15 bp, Homo sapiens
ctttgtgaattaaag

SEQ ID NO: 3323 - DNA, 15 bp, Homo sapiens
gctttgtgaattaaa

SEQ ID NO: 3324 - DNA, 15 bp, Homo sapiens
agctttgtgaattaa

SEQ ID NO: 3325 - DNA, 15 bp, Homo sapiens
gagctttgtgaatta

SEQ ID NO: 3326 - DNA, 15 bp, Homo sapiens
ggagctttgtgaatt

SEQ ID NO: 3327 - DNA, 15 bp, Homo sapiens
gggagctttgtgaat

SEQ ID NO: 3328 - DNA, 15 bp, Homo sapiens
ggggagctttgtgaa

SEQ ID NO: 3329 - DNA, 15 bp, Homo sapiens
gggggagctttgtga

SEQ ID NO: 3330 - DNA, 15 bp, Homo sapiens
agggggagctttgtg

SEQ ID NO: 3331 - DNA, 15 bp, Homo sapiens
gagggggagctttgt

SEQ ID NO: 3332 - DNA, 15 bp, Homo sapiens
agagggggagctttg

SEQ ID NO: 3333 - DNA, 15 bp, Homo sapiens
gagagggggagcttt

SEQ ID NO: 3334 - DNA, 15 bp, Homo sapiens
ggagagggggagctt

SEQ ID NO: 3335 - DNA, 15 bp, Homo sapiens
gggagagggggagct

SEQ ID NO: 3336 - DNA, 15 bp, Homo sapiens
tgggagagggggagc

SEQ ID NO: 3337 - DNA, 15 bp, Homo sapiens
ctgggagagggggag

SEQ ID NO: 3338 - DNA, 15 bp, Homo sapiens
cctgggagaggggga

SEQ ID NO: 3339 - DNA, 15 bp, Homo sapiens
acctgggagaggggg

SEQ ID NO: 3340 - DNA, 15 bp, Homo sapiens
tacctgggagagggg

SEQ ID NO: 3341 - DNA, 15 bp, Homo sapiens
ttacctgggagaggg

SEQ ID NO: 3342 - DNA, 15 bp, Homo sapiens
attacctgggagagg

SEQ ID NO: 3343 - DNA, 15 bp, Homo sapiens
aattacctgggagag

SEQ ID NO: 3344 - DNA, 15 bp, Homo sapiens
aaattacctgggaga

SEQ ID NO: 3345 - DNA, 15 bp, Homo sapiens
aaaattacctgggag

SEQ ID NO: 3346 - DNA, 15 bp, Homo sapiens
caaaattacctggga

SEQ ID NO: 3347 - DNA, 15 bp, Homo sapiens
ccaaaattacctggg

SEQ ID NO: 3348 - DNA, 15 bp, Homo sapiens
accaaaattacctgg

SEQ ID NO: 3349 - DNA, 15 bp, Homo sapiens
aaccaaaattacctg

SEQ ID NO: 3350 - DNA, 15 bp, Homo sapiens
aaaccaaaattacct

SEQ ID NO: 3351 - DNA, 15 bp, Homo sapiens
aaaaccaaaattacc

SEQ ID NO: 3352 - DNA, 15 bp, Homo sapiens
gaaaaccaaaattac

SEQ ID NO: 3353 - DNA, 15 bp, Homo sapiens
tgaaaaccaaaatta

SEQ ID NO: 3354 - DNA, 15 bp, Homo sapiens
ttgaaaaccaaaatt

SEQ ID NO: 3355 - DNA, 15 bp, Homo sapiens
cttgaaaaccaaaat

SEQ ID NO: 3356 - DNA, 15 bp, Homo sapiens
tcttgaaaaccaaaa

SEQ ID NO: 3357 - DNA, 15 bp, Homo sapiens
gtcttgaaaaccaaa

SEQ ID NO: 3358 - DNA, 15 bp, Homo sapiens
cgtcttgaaaaccaa

SEQ ID NO: 3359 - DNA, 15 bp, Homo sapiens
gcgtcttgaaaacca

SEQ ID NO: 3360 - DNA, 15 bp, Homo sapiens
agcgtcttgaaaacc

SEQ ID NO: 3361 - DNA, 15 bp, Homo sapiens
cagcgtcttgaaaac

SEQ ID NO: 3362 - DNA, 15 bp, Homo sapiens
tcagcgtcttgaaaa

SEQ ID NO: 3363 - DNA, 15 bp, Homo sapiens
gtcagcgtcttgaaa

SEQ ID NO: 3364 - DNA, 15 bp, Homo sapiens
tgtcagcgtcttgaa

SEQ ID NO: 3365 - DNA, 15 bp, Homo sapiens
ctgtcagcgtcttga

SEQ ID NO: 3366 - DNA, 15 bp, Homo sapiens
actgtcagcgtcttg

SEQ ID NO: 3367 - DNA, 15 bp, Homo sapiens
aactgtcagcgtctt

SEQ ID NO: 3368 - DNA, 15 bp, Homo sapiens
aaactgtcagcgtct

SEQ ID NO: 3369 - DNA, 15 bp, Homo sapiens
aaaactgtcagcgtc

SEQ ID NO: 3370 - DNA, 15 bp, Homo sapiens
caaaactgtcagcgt

SEQ ID NO: 3371 - DNA, 15 bp, Homo sapiens
tcaaaactgtcagcg

SEQ ID NO: 3372 - DNA, 15 bp, Homo sapiens
ttcaaaactgtcagc

SEQ ID NO: 3373 - DNA, 15 bp, Homo sapiens
cttcaaaactgtcag

SEQ ID NO: 3374 - DNA, 15 bp, Homo sapiens
tcttcaaaactgtca

SEQ ID NO: 3375 - DNA, 15 bp, Homo sapiens
ttcttcaaaactgtc

SEQ ID NO: 3376 - DNA, 15 bp, Homo sapiens
tttcttcaaaactgt

SEQ ID NO: 3377 - DNA, 15 bp, Homo sapiens
gtttcttcaaaactg

SEQ ID NO: 3378 - DNA, 15 bp, Homo sapiens
ggtttcttcaaaact

SEQ ID NO: 3379 - DNA, 15 bp, Homo sapiens
tggtttcttcaaaac

SEQ ID NO: 3380 - DNA, 15 bp, Homo sapiens
ctggtttcttcaaaa

SEQ ID NO: 3381 - DNA, 15 bp, Homo sapiens
cctggtttcttcaaa

SEQ ID NO: 3382 - DNA, 15 bp, Homo sapiens
gcctggtttcttcaa

SEQ ID NO: 3383 - DNA, 15 bp, Homo sapiens
ggcctggtttcttca

SEQ ID NO: 3384 - DNA, 15 bp, Homo sapiens
tggcctggtttcttc

SEQ ID NO: 3385 - DNA, 15 bp, Homo sapiens
atggcctggtttctt

SEQ ID NO: 3386 - DNA, 15 bp, Homo sapiens
aatggcctggtttct

SEQ ID NO: 3387 - DNA, 15 bp, Homo sapiens
aaatggcctggtttc

SEQ ID NO: 3388 - DNA, 15 bp, Homo sapiens
gaaatggcctggttt

SEQ ID NO: 3389 - DNA, 15 bp, Homo sapiens
agaaatggcctggtt

SEQ ID NO: 3390 - DNA, 15 bp, Homo sapiens
aagaaatggcctggt

SEQ ID NO: 3391 - DNA, 15 bp, Homo sapiens
aaagaaatggcctgg

SEQ ID NO: 3392 - DNA, 15 bp, Homo sapiens
aaaagaaatggcctg

SEQ ID NO: 3393 - DNA, 15 bp, Homo sapiens
caaaagaaatggcct

SEQ ID NO: 3394 - DNA, 15 bp, Homo sapiens
tcaaaagaaatggcc

SEQ ID NO: 3395 - DNA, 15 bp, Homo sapiens
ttcaaaagaaatggc

SEQ ID NO: 3396 - DNA, 15 bp, Homo sapiens
tttcaaaagaaatgg

SEQ ID NO: 3397 - DNA, 15 bp, Homo sapiens
ttttcaaaagaaatg

SEQ ID NO: 3398 - DNA, 15 bp, Homo sapiens
gttttcaaaagaaat

SEQ ID NO: 3399 - DNA, 15 bp, Homo sapiens
agttttcaaaagaaa

SEQ ID NO: 3400 - DNA, 15 bp, Homo sapiens
tagttttcaaaagaa

SEQ ID NO: 3401 - DNA, 15 bp, Homo sapiens
ctagttttcaaaaga

SEQ ID NO: 3402 - DNA, 15 bp, Homo sapiens
gctagttttcaaaag

SEQ ID NO: 3403 - DNA, 15 bp, Homo sapiens
ggctagttttcaaaa

SEQ ID NO: 3404 - DNA, 15 bp, Homo sapiens
tggctagttttcaaa

SEQ ID NO: 3405 - DNA, 15 bp, Homo sapiens
gtggctagttttcaa

SEQ ID NO: 3406 - DNA, 15 bp, Homo sapiens
tgtggctagttttca

SEQ ID NO: 3407 - DNA, 15 bp, Homo sapiens
ctgtggctagttttc

SEQ ID NO: 3408 - DNA, 15 bp, Homo sapiens
actgtggctagtttt

SEQ ID NO: 3409 - DNA, 15 bp, Homo sapiens
gactgtggctagttt

SEQ ID NO: 3410 - DNA, 15 bp, Homo sapiens
agactgtggctagtt

SEQ ID NO: 3411 - DNA, 15 bp, Homo sapiens
tagactgtggctagt

SEQ ID NO: 3412 - DNA, 15 bp, Homo sapiens
ctagactgtggctag

SEQ ID NO: 3413 - DNA, 15 bp, Homo sapiens
tctagactgtggcta

SEQ ID NO: 3414 - DNA, 15 bp, Homo sapiens
atctagactgtggct

SEQ ID NO: 3415 - DNA, 15 bp, Homo sapiens
aatctagactgtggc

SEQ ID NO: 3416 - DNA, 15 bp, Homo sapiens
aaatctagactgtgg

SEQ ID NO: 3417 - DNA, 15 bp, Homo sapiens
caaatctagactgtg

SEQ ID NO: 3418 - DNA, 15 bp, Homo sapiens
acaaatctagactgt

SEQ ID NO: 3419 - DNA, 15 bp, Homo sapiens
gacaaatctagactg

SEQ ID NO: 3420 - DNA, 15 bp, Homo sapiens
agacaaatctagact

SEQ ID NO: 3421 - DNA, 15 bp, Homo sapiens
cagacaaatctagac

SEQ ID NO: 3422 - DNA, 15 bp, Homo sapiens
gcagacaaatctaga

SEQ ID NO: 3423 - DNA, 15 bp, Homo sapiens
agcagacaaatctag

SEQ ID NO: 3424 - DNA, 15 bp, Homo sapiens
gagcagacaaatcta

SEQ ID NO: 3425 - DNA, 15 bp, Homo sapiens
tgagcagacaaatct

SEQ ID NO: 3426 - DNA, 15 bp, Homo sapiens
atgagcagacaaatc

SEQ ID NO: 3427 - DNA, 15 bp, Homo sapiens
catgagcagacaaat

SEQ ID NO: 3428 - DNA, 15 bp, Homo sapiens
tcatgagcagacaaa

SEQ ID NO: 3429 - DNA, 15 bp, Homo sapiens
ctcatgagcagacaa

SEQ ID NO: 3430 - DNA, 15 bp, Homo sapiens
tctcatgagcagaca

SEQ ID NO: 3431 - DNA, 15 bp, Homo sapiens
ttctcatgagcagac

SEQ ID NO: 3432 - DNA, 15 bp, Homo sapiens
cttctcatgagcaga

SEQ ID NO: 3433 - DNA, 15 bp, Homo sapiens
tcttctcatgagcag

SEQ ID NO: 3434 - DNA, 15 bp, Homo sapiens
atcttctcatgagca

SEQ ID NO: 3435 - DNA, 15 bp, Homo sapiens
aatcttctcatgagc

SEQ ID NO: 3436 - DNA, 15 bp, Homo sapiens
gaatcttctcatgag

SEQ ID NO: 3437 - DNA, 15 bp, Homo sapiens
tgaatcttctcatga

SEQ ID NO: 3438 - DNA, 15 bp, Homo sapiens
gtgaatcttctcatg

SEQ ID NO: 3439 - DNA, 15 bp, Homo sapiens
cgtgaatcttctcat

SEQ ID NO: 3440 - DNA, 15 bp, Homo sapiens
acgtgaatcttctca

SEQ ID NO: 3441 - DNA, 15 bp, Homo sapiens
aacgtgaatcttctc

SEQ ID NO: 3442 - DNA, 15 bp, Homo sapiens
gaacgtgaatcttct

SEQ ID NO: 3443 - DNA, 15 bp, Homo sapiens
tgaacgtgaatcttc

SEQ ID NO: 3444 - DNA, 15 bp, Homo sapiens
ttgaacgtgaatctt

SEQ ID NO: 3445 - DNA, 15 bp, Homo sapiens
gttgaacgtgaatct

SEQ ID NO: 3446 - DNA, 15 bp, Homo sapiens
tgttgaacgtgaatc

SEQ ID NO: 3447 - DNA, 15 bp, Homo sapiens
atgttgaacgtgaat

SEQ ID NO: 3448 - DNA, 15 bp, Homo sapiens
gatgttgaacgtgaa

SEQ ID NO: 3449 - DNA, 15 bp, Homo sapiens
agatgttgaacgtga

SEQ ID NO: 3450 - DNA, 15 bp, Homo sapiens
aagatgttgaacgtg

SEQ ID NO: 3451 - DNA, 15 bp, Homo sapiens
caagatgttgaacgt

SEQ ID NO: 3452 - DNA, 15 bp, Homo sapiens
ccaagatgttgaacg

SEQ ID NO: 3453 - DNA, 15 bp, Homo sapiens
gccaagatgttgaac

SEQ ID NO: 3454 - DNA, 15 bp, Homo sapiens
tgccaagatgttgaa

SEQ ID NO: 3455 - DNA, 15 bp, Homo sapiens
ttgccaagatgttga

SEQ ID NO: 3456 - DNA, 15 bp, Homo sapiens
cttgccaagatgttg

SEQ ID NO: 3457 - DNA, 15 bp, Homo sapiens
ccttgccaagatgtt

SEQ ID NO: 3458 - DNA, 15 bp, Homo sapiens
tccttgccaagatgt

SEQ ID NO: 3459 - DNA, 15 bp, Homo sapiens
atccttgccaagatg

SEQ ID NO: 3460 - DNA, 15 bp, Homo sapiens
tatccttgccaagat

SEQ ID NO: 3461 - DNA, 15 bp, Homo sapiens
atatccttgccaaga

SEQ ID NO: 3462 - DNA, 15 bp, Homo sapiens
aatatccttgccaag

SEQ ID NO: 3463 - DNA, 15 bp, Homo sapiens
caatatccttgccaa

SEQ ID NO: 3464 - DNA, 15 bp, Homo sapiens
acaatatccttgcca

SEQ ID NO: 3465 - DNA, 15 bp, Homo sapiens
cacaatatccttgcc

SEQ ID NO: 3466 - DNA, 15 bp, Homo sapiens
acacaatatccttgc

SEQ ID NO: 3467 - DNA, 15 bp, Homo sapiens
tacacaatatccttg

SEQ ID NO: 3468 - DNA, 15 bp, Homo sapiens
ctacacaatatcctt

SEQ ID NO: 3469 - DNA, 15 bp, Homo sapiens
tctacacaatatcct

SEQ ID NO: 3470 - DNA, 15 bp, Homo sapiens
atctacacaatatcc

SEQ ID NO: 3471 - DNA, 15 bp, Homo sapiens
catctacacaatatc

SEQ ID NO: 3472 - DNA, 15 bp, Homo sapiens
tcatctacacaatat

SEQ ID NO: 3473 - DNA, 15 bp, Homo sapiens
atcatctacacaata

SEQ ID NO: 3474 - DNA, 15 bp, Homo sapiens
catcatctacacaat

SEQ ID NO: 3475 - DNA, 15 bp, Homo sapiens
acatcatctacacaa

SEQ ID NO: 3476 - DNA, 15 bp, Homo sapiens
cacatcatctacaca

SEQ ID NO: 3477 - DNA, 15 bp, Homo sapiens
ccacatcatctacac

SEQ ID NO: 3478 - DNA, 15 bp, Homo sapiens
accacatcatctaca

SEQ ID NO: 3479 - DNA, 15 bp, Homo sapiens
caccacatcatctac

SEQ ID NO: 3480 - DNA, 15 bp, Homo sapiens
tcaccacatcatcta

SEQ ID NO: 3481 - DNA, 15 bp, Homo sapiens
atcaccacatcatct

SEQ ID NO: 3482 - DNA, 15 bp, Homo sapiens
aatcaccacatcatc

SEQ ID NO: 3483 - DNA, 15 bp, Homo sapiens
aaatcaccacatcat

SEQ ID NO: 3484 - DNA, 15 bp, Homo sapiens
aaaatcaccacatca

SEQ ID NO: 3485 - DNA, 15 bp, Homo sapiens
gaaaatcaccacatc

SEQ ID NO: 3486 - DNA, 15 bp, Homo sapiens
ggaaaatcaccacat

SEQ ID NO: 3487 - DNA, 15 bp, Homo sapiens
tggaaaatcaccaca

SEQ ID NO: 3488 - DNA, 15 bp, Homo sapiens
atggaaaatcaccac

SEQ ID NO: 3489 - DNA, 15 bp, Homo sapiens
aatggaaaatcacca

SEQ ID NO: 3490 - DNA, 15 bp, Homo sapiens
gaatggaaaatcacc

SEQ ID NO: 3491 - DNA, 15 bp, Homo sapiens
tgaatggaaaatcac

SEQ ID NO: 3492 - DNA, 15 bp, Homo sapiens
ttgaatggaaaatca

SEQ ID NO: 3493 - DNA, 15 bp, Homo sapiens
attgaatggaaaatc

SEQ ID NO: 3494 - DNA, 15 bp, Homo sapiens
aattgaatggaaaat

SEQ ID NO: 3495 - DNA, 15 bp, Homo sapiens
caattgaatggaaaa

SEQ ID NO: 3496 - DNA, 15 bp, Homo sapiens
gcaattgaatggaaa

SEQ ID NO: 3497 - DNA, 15 bp, Homo sapiens
tgcaattgaatggaa

SEQ ID NO: 3498 - DNA, 15 bp, Homo sapiens
atgcaattgaatgga

SEQ ID NO: 3499 - DNA, 15 bp, Homo sapiens
catgcaattgaatgg

SEQ ID NO: 3500 - DNA, 15 bp, Homo sapiens
tcatgcaattgaatg

SEQ ID NO: 3501 - DNA, 15 bp, Homo sapiens
atcatgcaattgaat

SEQ ID NO: 3502 - DNA, 15 bp, Homo sapiens
catcatgcaattgaa

SEQ ID NO: 3503 - DNA, 15 bp, Homo sapiens
gcatcatgcaattga

SEQ ID NO: 3504 - DNA, 15 bp, Homo sapiens
ggcatcatgcaattg

SEQ ID NO: 3505 - DNA, 15 bp, Homo sapiens
gggcatcatgcaatt

SEQ ID NO: 3506 - DNA, 15 bp, Homo sapiens
ggggcatcatgcaat

SEQ ID NO: 3507 - DNA, 15 bp, Homo sapiens
tggggcatcatgcaa

SEQ ID NO: 3508 - DNA, 15 bp, Homo sapiens
atggggcatcatgca

SEQ ID NO: 3509 - DNA, 15 bp, Homo sapiens
catggggcatcatgc

SEQ ID NO: 3510 - DNA, 15 bp, Homo sapiens
tcatggggcatcatg

SEQ ID NO: 3511 - DNA, 15 bp, Homo sapiens
atcatggggcatcat

SEQ ID NO: 3512 - DNA, 15 bp, Homo sapiens
aatcatggggcatca

SEQ ID NO: 3513 - DNA, 15 bp, Homo sapiens
caatcatggggcatc

SEQ ID NO: 3514 - DNA, 15 bp, Homo sapiens
ccaatcatggggcat

SEQ ID NO: 3515 - DNA, 15 bp, Homo sapiens
accaatcatggggca

SEQ ID NO: 3516 - DNA, 15 bp, Homo sapiens
aaccaatcatggggc

SEQ ID NO: 3517 - DNA, 15 bp, Homo sapiens
taaccaatcatgggg

SEQ ID NO: 3518 - DNA, 15 bp, Homo sapiens
ataaccaatcatggg

SEQ ID NO: 3519 - DNA, 15 bp, Homo sapiens
cataaccaatcatgg

SEQ ID NO: 3520 - DNA, 15 bp, Homo sapiens
acataaccaatcatg

SEQ ID NO: 3521 - DNA, 15 bp, Homo sapiens
cacataaccaatcat

SEQ ID NO: 3522 - DNA, 15 bp, Homo sapiens
tcacataaccaatca

SEQ ID NO: 3523 - DNA, 15 bp, Homo sapiens
ttcacataaccaatc

SEQ ID NO: 3524 - DNA, 15 bp, Homo sapiens
attcacataaccaat

SEQ ID NO: 3525 - DNA, 15 bp, Homo sapiens
aattcacataaccaa

SEQ ID NO: 3526 - DNA, 15 bp, Homo sapiens
aaattcacataacca

SEQ ID NO: 3527 - DNA, 15 bp, Homo sapiens
aaaattcacataacc

SEQ ID NO: 3528 - DNA, 15 bp, Homo sapiens
caaaattcacataac

SEQ ID NO: 3529 - DNA, 15 bp, Homo sapiens
tcaaaattcacataa

SEQ ID NO: 3530 - DNA, 15 bp, Homo sapiens
atcaaaattcacata

SEQ ID NO: 3531 - DNA, 15 bp, Homo sapiens
gatcaaaattcacat

SEQ ID NO: 3532 - DNA, 15 bp, Homo sapiens
tgatcaaaattcaca

SEQ ID NO: 3533 - DNA, 15 bp, Homo sapiens
gtgatcaaaattcac

SEQ ID NO: 3534 - DNA, 15 bp, Homo sapiens
agtgatcaaaattca

SEQ ID NO: 3535 - DNA, 15 bp, Homo sapiens
aagtgatcaaaattc

SEQ ID NO: 3536 - DNA, 15 bp, Homo sapiens
caagtgatcaaaatt

SEQ ID NO: 3537 - DNA, 15 bp, Homo sapiens
ccaagtgatcaaaat

SEQ ID NO: 3538 - DNA, 15 bp, Homo sapiens
accaagtgatcaaaa

SEQ ID NO: 3539 - DNA, 15 bp, Homo sapiens
aaccaagtgatcaaa

SEQ ID NO: 3540 - DNA, 15 bp, Homo sapiens
taaccaagtgatcaa

SEQ ID NO: 3541 - DNA, 15 bp, Homo sapiens
ttaaccaagtgatca

SEQ ID NO: 3542 - DNA, 15 bp, Homo sapiens
cttaaccaagtgatc

SEQ ID NO: 3543 - DNA, 15 bp, Homo sapiens
tcttaaccaagtgat

SEQ ID NO: 3544 - DNA, 15 bp, Homo sapiens
atcttaaccaagtga

SEQ ID NO: 3545 - DNA, 15 bp, Homo sapiens
aatcttaaccaagtg

SEQ ID NO: 3546 - DNA, 15 bp, Homo sapiens
taatcttaaccaagt

SEQ ID NO: 3547 - DNA, 15 bp, Homo sapiens
ctaatcttaaccaag

SEQ ID NO: 3548 - DNA, 15 bp, Homo sapiens
cctaatcttaaccaa

SEQ ID NO: 3549 - DNA, 15 bp, Homo sapiens
tcctaatcttaacca

SEQ ID NO: 3550 - DNA, 15 bp, Homo sapiens
ttcctaatcttaacc

SEQ ID NO: 3551 - DNA, 15 bp, Homo sapiens
attcctaatcttaac

SEQ ID NO: 3552 - DNA, 15 bp, Homo sapiens
aattcctaatcttaa

SEQ ID NO: 3553 - DNA, 15 bp, Homo sapiens
aaattcctaatctta

SEQ ID NO: 3554 - DNA, 15 bp, Homo sapiens
aaaattcctaatctt

SEQ ID NO: 3555 - DNA, 15 bp, Homo sapiens
aaaaattcctaatct

SEQ ID NO: 3556 - DNA, 15 bp, Homo sapiens
gaaaaattcctaatc

SEQ ID NO: 3557 - DNA, 15 bp, Homo sapiens
ggaaaaattcctaat

SEQ ID NO: 3558 - DNA, 15 bp, Homo sapiens
gggaaaaattcctaa

SEQ ID NO: 3559 - DNA, 15 bp, Homo sapiens
ggggaaaaattccta

SEQ ID NO: 3560 - DNA, 15 bp, Homo sapiens
tggggaaaaattcct

SEQ ID NO: 3561 - DNA, 15 bp, Homo sapiens
ttggggaaaaattcc

SEQ ID NO: 3562 - DNA, 15 bp, Homo sapiens
gttggggaaaaattc

SEQ ID NO: 3563 - DNA, 15 bp, Homo sapiens
tgttggggaaaaatt

SEQ ID NO: 3564 - DNA, 15 bp, Homo sapiens
atgttggggaaaaat

SEQ ID NO: 3565 - DNA, 15 bp, Homo sapiens
tatgttggggaaaaa

SEQ ID NO: 3566 - DNA, 15 bp, Homo sapiens
atatgttggggaaaa

SEQ ID NO: 3567 - DNA, 15 bp, Homo sapiens
aatatgttggggaaa

SEQ ID NO: 3568 - DNA, 15 bp, Homo sapiens
taatatgttggggaa

SEQ ID NO: 3569 - DNA, 15 bp, Homo sapiens
gtaatatgttgggga

SEQ ID NO: 3570 - DNA, 15 bp, Homo sapiens
agtaatatgttgggg

SEQ ID NO: 3571 - DNA, 15 bp, Homo sapiens
tagtaatatgttggg

SEQ ID NO: 3572 - DNA, 15 bp, Homo sapiens
atagtaatatgttgg

SEQ ID NO: 3573 - DNA, 15 bp, Homo sapiens
catagtaatatgttg

SEQ ID NO: 3574 - DNA, 15 bp, Homo sapiens
tcatagtaatatgtt

SEQ ID NO: 3575 - DNA, 15 bp, Homo sapiens
ttcatagtaatatgt

SEQ ID NO: 3576 - DNA, 15 bp, Homo sapiens
tttcatagtaatatg

SEQ ID NO: 3577 - DNA, 15 bp, Homo sapiens
ttttcatagtaatat

SEQ ID NO: 3578 - DNA, 15 bp, Homo sapiens
tttttcatagtaata

SEQ ID NO: 3579 - DNA, 15 bp, Homo sapiens
ttttttcatagtaat

SEQ ID NO: 3580 - DNA, 15 bp, Homo sapiens
attttttcatagtaa

SEQ ID NO: 3581 - DNA, 15 bp, Homo sapiens
aattttttcatagta

SEQ ID NO: 3582 - DNA, 15 bp, Homo sapiens
gaattttttcatagt

SEQ ID NO: 3583 - DNA, 15 bp, Homo sapiens
agaattttttcatag

SEQ ID NO: 3584 - DNA, 15 bp, Homo sapiens
gagaattttttcata

SEQ ID NO: 3585 - DNA, 15 bp, Homo sapiens
tgagaattttttcat

SEQ ID NO: 3586 - DNA, 15 bp, Homo sapiens
ctgagaattttttca

SEQ ID NO: 3587 - DNA, 15 bp, Homo sapiens
tctgagaattttttc

SEQ ID NO: 3588 - DNA, 15 bp, Homo sapiens
gtctgagaatttttt

SEQ ID NO: 3589 - DNA, 15 bp, Homo sapiens
tgtctgagaattttt

SEQ ID NO: 3590 - DNA, 15 bp, Homo sapiens
atgtctgagaatttt

SEQ ID NO: 3591 - DNA, 15 bp, Homo sapiens
tatgtctgagaattt

SEQ ID NO: 3592 - DNA, 15 bp, Homo sapiens
gtatgtctgagaatt

SEQ ID NO: 3593 - DNA, 15 bp, Homo sapiens
tgtatgtctgagaat

SEQ ID NO: 3594 - DNA, 15 bp, Homo sapiens
ctgtatgtctgagaa

SEQ ID NO: 3595 - DNA, 15 bp, Homo sapiens
tctgtatgtctgaga

SEQ ID NO: 3596 - DNA, 15 bp, Homo sapiens
ttctgtatgtctgag

SEQ ID NO: 3597 - DNA, 15 bp, Homo sapiens
cttctgtatgtctga

SEQ ID NO: 3598 - DNA, 15 bp, Homo sapiens
tcttctgtatgtctg

SEQ ID NO: 3599 - DNA, 15 bp, Homo sapiens
ctcttctgtatgtct

SEQ ID NO: 3600 - DNA, 15 bp, Homo sapiens
actcttctgtatgtc

SEQ ID NO: 3601 - DNA, 15 bp, Homo sapiens
aactcttctgtatgt

SEQ ID NO: 3602 - DNA, 15 bp, Homo sapiens
caactcttctgtatg

SEQ ID NO: 3603 - DNA, 15 bp, Homo sapiens
gcaactcttctgtat

SEQ ID NO: 3604 - DNA, 15 bp, Homo sapiens
tgcaactcttctgta

SEQ ID NO: 3605 - DNA, 15 bp, Homo sapiens
ttgcaactcttctgt

SEQ ID NO: 3606 - DNA, 15 bp, Homo sapiens
cttgcaactcttctg

SEQ ID NO: 3607 - DNA, 15 bp, Homo sapiens
tcttgcaactcttct

SEQ ID NO: 3608 - DNA, 15 bp, Homo sapiens
ttcttgcaactcttc

SEQ ID NO: 3609 - DNA, 15 bp, Homo sapiens
tttcttgcaactctt

SEQ ID NO: 3610 - DNA, 15 bp, Homo sapiens
atttcttgcaactct

SEQ ID NO: 3611 - DNA, 15 bp, Homo sapiens
aatttcttgcaactc

SEQ ID NO: 3612 - DNA, 15 bp, Homo sapiens
aaatttcttgcaact

SEQ ID NO: 3613 - DNA, 15 bp, Homo sapiens
aaaatttcttgcaac

SEQ ID NO: 3614 - DNA, 15 bp, Homo sapiens
gaaaatttcttgcaa

SEQ ID NO: 3615 - DNA, 15 bp, Homo sapiens
tgaaaatttcttgca

SEQ ID NO: 3616 - DNA, 15 bp, Homo sapiens
atgaaaatttcttgc

SEQ ID NO: 3617 - DNA, 15 bp, Homo sapiens
aatgaaaatttcttg

SEQ ID NO: 3618 - DNA, 15 bp, Homo sapiens
gaatgaaaatttctt

SEQ ID NO: 3619 - DNA, 15 bp, Homo sapiens
tgaatgaaaatttct

SEQ ID NO: 3620 - DNA, 15 bp, Homo sapiens
ctgaatgaaaatttc

SEQ ID NO: 3621 - DNA, 15 bp, Homo sapiens
gctgaatgaaaattt

SEQ ID NO: 3622 - DNA, 15 bp, Homo sapiens
tgctgaatgaaaatt

SEQ ID NO: 3623 - DNA, 15 bp, Homo sapiens
atgctgaatgaaaat

SEQ ID NO: 3624 - DNA, 15 bp, Homo sapiens
aatgctgaatgaaaa

SEQ ID NO: 3625 - DNA, 15 bp, Homo sapiens
gaatgctgaatgaaa

SEQ ID NO: 3626 - DNA, 15 bp, Homo sapiens
tgaatgctgaatgaa

SEQ ID NO: 3627 - DNA, 15 bp, Homo sapiens
atgaatgctgaatga

SEQ ID NO: 3628 - DNA, 15 bp, Homo sapiens
tatgaatgctgaatg

SEQ ID NO: 3629 - DNA, 15 bp, Homo sapiens
atatgaatgctgaat

SEQ ID NO: 3630 - DNA, 15 bp, Homo sapiens
tatatgaatgctgaa

SEQ ID NO: 3631 - DNA, 15 bp, Homo sapiens
gtatatgaatgctga

SEQ ID NO: 3632 - DNA, 15 bp, Homo sapiens
ggtatatgaatgctg

SEQ ID NO: 3633 - DNA, 15 bp, Homo sapiens
gggtatatgaatgct

SEQ ID NO: 3634 - DNA, 15 bp, Homo sapiens
tgggtatatgaatgc

SEQ ID NO: 3635 - DNA, 15 bp, Homo sapiens
atgggtatatgaatg

SEQ ID NO: 3636 - DNA, 15 bp, Homo sapiens
catgggtatatgaat

SEQ ID NO: 3637 - DNA, 15 bp, Homo sapiens
tcatgggtatatgaa

SEQ ID NO: 3638 - DNA, 15 bp, Homo sapiens
ctcatgggtatatga

SEQ ID NO: 3639 - DNA, 15 bp, Homo sapiens
gctcatgggtatatg

SEQ ID NO: 3640 - DNA, 15 bp, Homo sapiens
agctcatgggtatat

SEQ ID NO: 3641 - DNA, 15 bp, Homo sapiens
tagctcatgggtata

SEQ ID NO: 3642 - DNA, 15 bp, Homo sapiens
ctagctcatgggtat

SEQ ID NO: 3643 - DNA, 15 bp, Homo sapiens
cctagctcatgggta

SEQ ID NO: 3644 - DNA, 15 bp, Homo sapiens
acctagctcatgggt

SEQ ID NO: 3645 - DNA, 15 bp, Homo sapiens
aacctagctcatggg

SEQ ID NO: 3646 - DNA, 15 bp, Homo sapiens
gaacctagctcatgg

SEQ ID NO: 3647 - DNA, 15 bp, Homo sapiens
ggaacctagctcatg

SEQ ID NO: 3648 - DNA, 15 bp, Homo sapiens
aggaacctagctcat

SEQ ID NO: 3649 - DNA, 15 bp, Homo sapiens
aaggaacctagctca

SEQ ID NO: 3650 - DNA, 15 bp, Homo sapiens
taaggaacctagctc

SEQ ID NO: 3651 - DNA, 15 bp, Homo sapiens
ttaaggaacctagct

SEQ ID NO: 3652 - DNA, 15 bp, Homo sapiens
attaaggaacctagc

SEQ ID NO: 3653 - DNA, 15 bp, Homo sapiens
aattaaggaacctag

SEQ ID NO: 3654 - DNA, 15 bp, Homo sapiens
aaattaaggaaccta

SEQ ID NO: 3655 - DNA, 15 bp, Homo sapiens
caaattaaggaacct

SEQ ID NO: 3656 - DNA, 15 bp, Homo sapiens
gcaaattaaggaacc

SEQ ID NO: 3657 - DNA, 15 bp, Homo sapiens
tgcaaattaaggaac

SEQ ID NO: 3658 - DNA, 15 bp, Homo sapiens
atgcaaattaaggaa

SEQ ID NO: 3659 - DNA, 15 bp, Homo sapiens
aatgcaaattaagga

SEQ ID NO: 3660 - DNA, 15 bp, Homo sapiens
aaatgcaaattaagg

SEQ ID NO: 3661 - DNA, 15 bp, Homo sapiens
aaaatgcaaattaag

SEQ ID NO: 3662 - DNA, 15 bp, Homo sapiens
caaaatgcaaattaa

SEQ ID NO: 3663 - DNA, 15 bp, Homo sapiens
gcaaaatgcaaatta

SEQ ID NO: 3664 - DNA, 15 bp, Homo sapiens
agcaaaatgcaaatt

SEQ ID NO: 3665 - DNA, 15 bp, Homo sapiens
tagcaaaatgcaaat

SEQ ID NO: 3666 - DNA, 15 bp, Homo sapiens
atagcaaaatgcaaa

SEQ ID NO: 3667 - DNA, 15 bp, Homo sapiens
tatagcaaaatgcaa

SEQ ID NO: 3668 - DNA, 15 bp, Homo sapiens
atatagcaaaatgca

SEQ ID NO: 3669 - DNA, 15 bp, Homo sapiens
aatatagcaaaatgc

SEQ ID NO: 3670 - DNA, 15 bp, Homo sapiens
gaatatagcaaaatg

SEQ ID NO: 3671 - DNA, 15 bp, Homo sapiens
agaatatagcaaaat

SEQ ID NO: 3672 - DNA, 15 bp, Homo sapiens
cagaatatagcaaaa

SEQ ID NO: 3673 - DNA, 15 bp, Homo sapiens
gcagaatatagcaaa

SEQ ID NO: 3674 - DNA, 15 bp, Homo sapiens
ggcagaatatagcaa

SEQ ID NO: 3675 - DNA, 15 bp, Homo sapiens
tggcagaatatagca

SEQ ID NO: 3676 - DNA, 15 bp, Homo sapiens
atggcagaatatagc

SEQ ID NO: 3677 - DNA, 15 bp, Homo sapiens
tatggcagaatatag

SEQ ID NO: 3678 - DNA, 15 bp, Homo sapiens
ctatggcagaatata

SEQ ID NO: 3679 - DNA, 15 bp, Homo sapiens
actatggcagaatat

SEQ ID NO: 3680 - DNA, 15 bp, Homo sapiens
gactatggcagaata

SEQ ID NO: 3681 - DNA, 15 bp, Homo sapiens
agactatggcagaat

SEQ ID NO: 3682 - DNA, 15 bp, Homo sapiens
aagactatggcagaa

SEQ ID NO: 3683 - DNA, 15 bp, Homo sapiens
gaagactatggcaga

SEQ ID NO: 3684 - DNA, 15 bp, Homo sapiens
tgaagactatggcag

SEQ ID NO: 3685 - DNA, 15 bp, Homo sapiens
gtgaagactatggca

SEQ ID NO: 3686 - DNA, 15 bp, Homo sapiens
agtgaagactatggc

SEQ ID NO: 3687 - DNA, 15 bp, Homo sapiens
cagtgaagactatgg

SEQ ID NO: 3688 - DNA, 15 bp, Homo sapiens
ccagtgaagactatg

SEQ ID NO: 3689 - DNA, 15 bp, Homo sapiens
accagtgaagactat

SEQ ID NO: 3690 - DNA, 15 bp, Homo sapiens
aaccagtgaagacta

SEQ ID NO: 3691 - DNA, 15 bp, Homo sapiens
gaaccagtgaagact

SEQ ID NO: 3692 - DNA, 15 bp, Homo sapiens
ggaaccagtgaagac

SEQ ID NO: 3693 - DNA, 15 bp, Homo sapiens
gggaaccagtgaaga

SEQ ID NO: 3694 - DNA, 15 bp, Homo sapiens
ggggaaccagtgaag

SEQ ID NO: 3695 - DNA, 15 bp, Homo sapiens
tggggaaccagtgaa

SEQ ID NO: 3696 - DNA, 15 bp, Homo sapiens
gtggggaaccagtga

SEQ ID NO: 3697 - DNA, 15 bp, Homo sapiens
tgtggggaaccagtg

SEQ ID NO: 3698 - DNA, 15 bp, Homo sapiens
atgtggggaaccagt

SEQ ID NO: 3699 - DNA, 15 bp, Homo sapiens
tatgtggggaaccag

SEQ ID NO: 3700 - DNA, 15 bp, Homo sapiens
atatgtggggaacca

SEQ ID NO: 3701 - DNA, 15 bp, Homo sapiens
aatatgtggggaacc

SEQ ID NO: 3702 - DNA, 15 bp, Homo sapiens
taatatgtggggaac

SEQ ID NO: 3703 - DNA, 15 bp, Homo sapiens
gtaatatgtggggaa

SEQ ID NO: 3704 - DNA, 15 bp, Homo sapiens
agtaatatgtgggga

SEQ ID NO: 3705 - DNA, 15 bp, Homo sapiens
cagtaatatgtgggg

SEQ ID NO: 3706 - DNA, 15 bp, Homo sapiens
acagtaatatgtggg

SEQ ID NO: 3707 - DNA, 15 bp, Homo sapiens
cacagtaatatgtgg

SEQ ID NO: 3708 - DNA, 15 bp, Homo sapiens
ccacagtaatatgtg

SEQ ID NO: 3709 - DNA, 15 bp, Homo sapiens
accacagtaatatgt

SEQ ID NO: 3710 - DNA, 15 bp, Homo sapiens
gaccacagtaatatg

SEQ ID NO: 3711 - DNA, 15 bp, Homo sapiens
agaccacagtaatat

SEQ ID NO: 3712 - DNA, 15 bp, Homo sapiens
tagaccacagtaata

SEQ ID NO: 3713 - DNA, 15 bp, Homo sapiens
gtagaccacagtaat

SEQ ID NO: 3714 - DNA, 15 bp, Homo sapiens
ggtagaccacagtaa

SEQ ID NO: 3715 - DNA, 15 bp, Homo sapiens
aggtagaccacagta

SEQ ID NO: 3716 - DNA, 15 bp, Homo sapiens
taggtagaccacagt

SEQ ID NO: 3717 - DNA, 15 bp, Homo sapiens
gtaggtagaccacag

SEQ ID NO: 3718 - DNA, 15 bp, Homo sapiens
tgtaggtagaccaca

SEQ ID NO: 3719 - DNA, 15 bp, Homo sapiens
ttgtaggtagaccac

SEQ ID NO: 3720 - DNA, 15 bp, Homo sapiens
cttgtaggtagacca

SEQ ID NO: 3721 - DNA, 15 bp, Homo sapiens
gcttgtaggtagacc

SEQ ID NO: 3722 - DNA, 15 bp, Homo sapiens
ggcttgtaggtagac

SEQ ID NO: 3723 - DNA, 15 bp, Homo sapiens
tggcttgtaggtaga

SEQ ID NO: 3724 - DNA, 15 bp, Homo sapiens
gtggcttgtaggtag

SEQ ID NO: 3725 - DNA, 15 bp, Homo sapiens
tgtggcttgtaggta

SEQ ID NO: 3726 - DNA, 15 bp, Homo sapiens
ttgtggcttgtaggt

SEQ ID NO: 3727 - DNA, 15 bp, Homo sapiens
attgtggcttgtagg

SEQ ID NO: 3728 - DNA, 15 bp, Homo sapiens
gattgtggcttgtag

SEQ ID NO: 3729 - DNA, 15 bp, Homo sapiens
cgattgtggcttgta

SEQ ID NO: 3730 - DNA, 15 bp, Homo sapiens
acgattgtggcttgt

SEQ ID NO: 3731 - DNA, 15 bp, Homo sapiens
gacgattgtggcttg

SEQ ID NO: 3732 - DNA, 15 bp, Homo sapiens
agacgattgtggctt

SEQ ID NO: 3733 - DNA, 15 bp, Homo sapiens
aagacgattgtggct

SEQ ID NO: 3734 - DNA, 15 bp, Homo sapiens
aaagacgattgtggc

SEQ ID NO: 3735 - DNA, 15 bp, Homo sapiens
aaaagacgattgtgg

SEQ ID NO: 3736 - DNA, 15 bp, Homo sapiens
aaaaagacgattgtg

SEQ ID NO: 3737 - DNA, 15 bp, Homo sapiens
aaaaaagacgattgt

SEQ ID NO: 3738 - DNA, 15 bp, Homo sapiens
aaaaaaagacgattg

SEQ ID NO: 3739 - DNA, 15 bp, Homo sapiens
aaaaaaaagacgatt

SEQ ID NO: 3740 - DNA, 15 bp, Homo sapiens
aaaaaaaaagacgat

SEQ ID NO: 3741 - DNA, 15 bp, Homo sapiens
aaaaaaaaaagacga

SEQ ID NO: 3742 - DNA, 15 bp, Homo sapiens
aaaaaaaaaaagacg

SEQ ID NO: 3743 - DNA, 15 bp, Homo sapiens
aaaaaaaaaaaagac

SEQ ID NO: 3744 - DNA, 15 bp, Homo sapiens
gagagtgagactcca

SEQ ID NO: 3745 - DNA, 15 bp, Homo sapiens
cgagagtgagactcc

SEQ ID NO: 3746 - DNA, 15 bp, Homo sapiens
acgagagtgagactc

SEQ ID NO: 3747 - DNA, 15 bp, Homo sapiens
aacgagagtgagact

SEQ ID NO: 3748 - DNA, 15 bp, Homo sapiens
caacgagagtgagac

SEQ ID NO: 3749 - DNA, 15 bp, Homo sapiens
gcaacgagagtgaga

SEQ ID NO: 3750 - DNA, 15 bp, Homo sapiens
ggcaacgagagtgag

SEQ ID NO: 3751 - DNA, 15 bp, Homo sapiens
gggcaacgagagtga

SEQ ID NO: 3752 - DNA, 15 bp, Homo sapiens
tgggcaacgagagtg

SEQ ID NO: 3753 - DNA, 15 bp, Homo sapiens
ctgggcaacgagagt

SEQ ID NO: 3754 - DNA, 15 bp, Homo sapiens
cctgggcaacgagag

SEQ ID NO: 3755 - DNA, 15 bp, Homo sapiens
ccctgggcaacgaga

SEQ ID NO: 3756 - DNA, 15 bp, Homo sapiens
accctgggcaacgag

SEQ ID NO: 3757 - DNA, 15 bp, Homo sapiens
caccctgggcaacga

SEQ ID NO: 3758 - DNA, 15 bp, Homo sapiens
ccaccctgggcaacg

SEQ ID NO: 3759 - DNA, 15 bp, Homo sapiens
tccaccctgggcaac

SEQ ID NO: 3760 - DNA, 15 bp, Homo sapiens
ctccaccctgggcaa

SEQ ID NO: 3761 - DNA, 15 bp, Homo sapiens
actccaccctgggca

SEQ ID NO: 3762 - DNA, 15 bp, Homo sapiens
cactccaccctgggc

SEQ ID NO: 3763 - DNA, 15 bp, Homo sapiens
gcactccaccctggg

SEQ ID NO: 3764 - DNA, 15 bp, Homo sapiens
tgcactccaccctgg

SEQ ID NO: 3765 - DNA, 15 bp, Homo sapiens
ctgcactccaccctg

SEQ ID NO: 3766 - DNA, 15 bp, Homo sapiens
actgcactccaccct

SEQ ID NO: 3767 - DNA, 15 bp, Homo sapiens
cactgcactccaccc

SEQ ID NO: 3768 - DNA, 15 bp, Homo sapiens
ccactgcactccacc

SEQ ID NO: 3769 - DNA, 15 bp, Homo sapiens
gccactgcactccac

SEQ ID NO: 3770 - DNA, 15 bp, Homo sapiens
cgccactgcactcca

SEQ ID NO: 3771 - DNA, 15 bp, Homo sapiens
acgccactgcactcc

SEQ ID NO: 3772 - DNA, 15 bp, Homo sapiens
cacgccactgcactc

SEQ ID NO: 3773 - DNA, 15 bp, Homo sapiens
tcacgccactgcact

SEQ ID NO: 3774 - DNA, 15 bp, Homo sapiens
atcacgccactgcac

SEQ ID NO: 3775 - DNA, 15 bp, Homo sapiens
gatcacgccactgca

SEQ ID NO: 3776 - DNA, 15 bp, Homo sapiens
agatcacgccactgc

SEQ ID NO: 3777 - DNA, 15 bp, Homo sapiens
gagatcacgccactg

SEQ ID NO: 3778 - DNA, 15 bp, Homo sapiens
tgagatcacgccact

SEQ ID NO: 3779 - DNA, 15 bp, Homo sapiens
ctgagatcacgccac

SEQ ID NO: 3780 - DNA, 15 bp, Homo sapiens
gctgagatcacgcca

SEQ ID NO: 3781 - DNA, 15 bp, Homo sapiens
agctgagatcacgcc

SEQ ID NO: 3782 - DNA, 15 bp, Homo sapiens
gagctgagatcacgc

SEQ ID NO: 3783 - DNA, 15 bp, Homo sapiens
tgagctgagatcacg

SEQ ID NO: 3784 - DNA, 15 bp, Homo sapiens
gtgagctgagatcac

SEQ ID NO: 3785 - DNA, 15 bp, Homo sapiens
agtgagctgagatca

SEQ ID NO: 3786 - DNA, 15 bp, Homo sapiens
cagtgagctgagatc

SEQ ID NO: 3787 - DNA, 15 bp, Homo sapiens
gcagtgagctgagat

SEQ ID NO: 3788 - DNA, 15 bp, Homo sapiens
tgcagtgagctgaga

SEQ ID NO: 3789 - DNA, 15 bp, Homo sapiens
ttgcagtgagctgag

SEQ ID NO: 3790 - DNA, 15 bp, Homo sapiens
gttgcagtgagctga

SEQ ID NO: 3791 - DNA, 15 bp, Homo sapiens
agttgcagtgagctg

SEQ ID NO: 3792 - DNA, 15 bp, Homo sapiens
aagttgcagtgagct

SEQ ID NO: 3793 - DNA, 15 bp, Homo sapiens
gaagttgcagtgagc

SEQ ID NO: 3794 - DNA, 15 bp, Homo sapiens
ggaagttgcagtgag

SEQ ID NO: 3795 - DNA, 15 bp, Homo sapiens
tggaagttgcagtga

SEQ ID NO: 3796 - DNA, 15 bp, Homo sapiens
gtggaagttgcagtg

SEQ ID NO: 3797 - DNA, 15 bp, Homo sapiens
ggtggaagttgcagt

SEQ ID NO: 3798 - DNA, 15 bp, Homo sapiens
aggtggaagttgcag

SEQ ID NO: 3799 - DNA, 15 bp, Homo sapiens
gaggtggaagttgca

SEQ ID NO: 3800 - DNA, 15 bp, Homo sapiens
ggaggtggaagttgc

SEQ ID NO: 3801 - DNA, 15 bp, Homo sapiens
gggaggtggaagttg

SEQ ID NO: 3802 - DNA, 15 bp, Homo sapiens
tgggaggtggaagtt

SEQ ID NO: 3803 - DNA, 15 bp, Homo sapiens
ctgggaggtggaagt

SEQ ID NO: 3804 - DNA, 15 bp, Homo sapiens
cctgggaggtggaag

SEQ ID NO: 3805 - DNA, 15 bp, Homo sapiens
acctgggaggtggaa

SEQ ID NO: 3806 - DNA, 15 bp, Homo sapiens
cttgaacctgggagg

SEQ ID NO: 3807 - DNA, 15 bp, Homo sapiens
gcttgaacctgggag

SEQ ID NO: 3808 - DNA, 15 bp, Homo sapiens
gaattgcttgaacct

SEQ ID NO: 3809 - DNA, 15 bp, Homo sapiens
agaattgcttgaacc

SEQ ID NO: 3810 - DNA, 15 bp, Homo sapiens
gagaattgcttgaac

SEQ ID NO: 3811 - DNA, 15 bp, Homo sapiens
ggagaattgcttgaa

SEQ ID NO: 3812 - DNA, 15 bp, Homo sapiens
aggagaattgcttga

SEQ ID NO: 3813 - DNA, 15 bp, Homo sapiens
caggagaattgcttg

SEQ ID NO: 3814 - DNA, 15 bp, Homo sapiens
gcaggagaattgctt

SEQ ID NO: 3815 - DNA, 15 bp, Homo sapiens
tgcaggagaattgct

SEQ ID NO: 3816 - DNA, 15 bp, Homo sapiens
atgcaggagaattgc

SEQ ID NO: 3817 - DNA, 15 bp, Homo sapiens
aatgcaggagaattg

SEQ ID NO: 3818 - DNA, 15 bp, Homo sapiens
taatgcaggagaatt

SEQ ID NO: 3819 - DNA, 15 bp, Homo sapiens
ctaatgcaggagaat

SEQ ID NO: 3820 - DNA, 15 bp, Homo sapiens
gctaatgcaggagaa

SEQ ID NO: 3821 - DNA, 15 bp, Homo sapiens
ggctaatgcaggaga

SEQ ID NO: 3822 - DNA, 15 bp, Homo sapiens
aggctaatgcaggag

SEQ ID NO: 3823 - DNA, 15 bp, Homo sapiens
gaggctaatgcagga

SEQ ID NO: 3824 - DNA, 15 bp, Homo sapiens
ggaggctaatgcagg

SEQ ID NO: 3825 - DNA, 15 bp, Homo sapiens
aggaggctaatgcag

SEQ ID NO: 3826 - DNA, 15 bp, Homo sapiens
caggaggctaatgca

SEQ ID NO: 3827 - DNA, 15 bp, Homo sapiens
tcaggaggctaatgc

SEQ ID NO: 3828 - DNA, 15 bp, Homo sapiens
ctcaggaggctaatg

SEQ ID NO: 3829 - DNA, 15 bp, Homo sapiens
actcaggaggctaat

SEQ ID NO: 3830 - DNA, 15 bp, Homo sapiens
gcacctgtaatccca

SEQ ID NO: 3831 - DNA, 15 bp, Homo sapiens
tgcacctgtaatccc

SEQ ID NO: 3832 - DNA, 15 bp, Homo sapiens
gtgcacctgtaatcc

SEQ ID NO: 3833 - DNA, 15 bp, Homo sapiens
tgtgcacctgtaatc

SEQ ID NO: 3834 - DNA, 15 bp, Homo sapiens
gtgtgcacctgtaat

SEQ ID NO: 3835 - DNA, 15 bp, Homo sapiens
ggtgtgcacctgtaa

SEQ ID NO: 3836 - DNA, 15 bp, Homo sapiens
tggtgtgcacctgta

SEQ ID NO: 3837 - DNA, 15 bp, Homo sapiens
gtggtgtgcacctgt

SEQ ID NO: 3838 - DNA, 15 bp, Homo sapiens
ggtggtgtgcacctg

SEQ ID NO: 3839 - DNA, 15 bp, Homo sapiens
tggtggtgtgcacct

SEQ ID NO: 3840 - DNA, 15 bp, Homo sapiens
atggtggtgtgcacc

SEQ ID NO: 3841 - DNA, 15 bp, Homo sapiens
catggtggtgtgcac

SEQ ID NO: 3842 - DNA, 15 bp, Homo sapiens
gcatggtggtgtgca

SEQ ID NO: 3843 - DNA, 15 bp, Homo sapiens
aggcatggtggtgtg

SEQ ID NO: 3844 - DNA, 15 bp, Homo sapiens
caggcatggtggtgt

SEQ ID NO: 3845 - DNA, 15 bp, Homo sapiens
ccaggcatggtggtg

SEQ ID NO: 3846 - DNA, 15 bp, Homo sapiens
gccaggcatggtggt

SEQ ID NO: 3847 - DNA, 15 bp, Homo sapiens
aaaaaattagccagg

SEQ ID NO: 3848 - DNA, 15 bp, Homo sapiens
aaaaaaattagccag

SEQ ID NO: 3849 - DNA, 15 bp, Homo sapiens
aaaaaaaattagcca

SEQ ID NO: 3850 - DNA, 15 bp, Homo sapiens
aaaaaaaaattagcc

SEQ ID NO: 3851 - DNA, 15 bp, Homo sapiens
aaaaaaaaaattagc

SEQ ID NO: 3852 - DNA, 15 bp, Homo sapiens
aaaaaaaaaaattag

SEQ ID NO: 3853 - DNA, 15 bp, Homo sapiens
aaaaaaaaaaaaatt

SEQ ID NO: 3854 - DNA, 15 bp, Homo sapiens
aaaaaaaaaaaaaat

SEQ ID NO: 3855 - DNA, 15 bp, Homo sapiens
taaaaatacaaaaaa

SEQ ID NO: 3856 - DNA, 15 bp, Homo sapiens
tgaaaccctgtctct

SEQ ID NO: 3857 - DNA, 15 bp, Homo sapiens
gtgaaaccctgtctc

SEQ ID NO: 3858 - DNA, 15 bp, Homo sapiens
agtgaaaccctgtct

SEQ ID NO: 3859 - DNA, 15 bp, Homo sapiens
cagtgaaaccctgtc

SEQ ID NO: 3860 - DNA, 15 bp, Homo sapiens
acagtgaaaccctgt

SEQ ID NO: 3861 - DNA, 15 bp, Homo sapiens
cacagtgaaaccctg

SEQ ID NO: 3862 - DNA, 15 bp, Homo sapiens
gcacagtgaaaccct

SEQ ID NO: 3863 - DNA, 15 bp, Homo sapiens
agcacagtgaaaccc

SEQ ID NO: 3864 - DNA, 15 bp, Homo sapiens
cagcacagtgaaacc

SEQ ID NO: 3865 - DNA, 15 bp, Homo sapiens
ccagcacagtgaaac

SEQ ID NO: 3866 - DNA, 15 bp, Homo sapiens
gccagcacagtgaaa

SEQ ID NO: 3867 - DNA, 15 bp, Homo sapiens
ggccagcacagtgaa

SEQ ID NO: 3868 - DNA, 15 bp, Homo sapiens
tggccagcacagtga

SEQ ID NO: 3869 - DNA, 15 bp, Homo sapiens
ctggccagcacagtg

SEQ ID NO: 3870 - DNA, 15 bp, Homo sapiens
cctggccagcacagt

SEQ ID NO: 3871 - DNA, 15 bp, Homo sapiens
gcctggccagcacag

SEQ ID NO: 3872 - DNA, 15 bp, Homo sapiens
agcctggccagcaca

SEQ ID NO: 3873 - DNA, 15 bp, Homo sapiens
cagcctggccagcac

SEQ ID NO: 3874 - DNA, 15 bp, Homo sapiens
ccagcctggccagca

SEQ ID NO: 3875 - DNA, 15 bp, Homo sapiens
accagcctggccagc

SEQ ID NO: 3876 - DNA, 15 bp, Homo sapiens
gaccagcctggccag

SEQ ID NO: 3877 - DNA, 15 bp, Homo sapiens
tcacgaggtcaggag

SEQ ID NO: 3878 - DNA, 15 bp, Homo sapiens
atcacgaggtcagga

SEQ ID NO: 3879 - DNA, 15 bp, Homo sapiens
gatcacgaggtcagg

SEQ ID NO: 3880 - DNA, 15 bp, Homo sapiens
ggatcacgaggtcag

SEQ ID NO: 3881 - DNA, 15 bp, Homo sapiens
aggtggatcacgagg

SEQ ID NO: 3882 - DNA, 15 bp, Homo sapiens
caggtggatcacgag

SEQ ID NO: 3883 - DNA, 15 bp, Homo sapiens
gcaggtggatcacga

SEQ ID NO: 3884 - DNA, 15 bp, Homo sapiens
ggcaggtggatcacg

SEQ ID NO: 3885 - DNA, 15 bp, Homo sapiens
cgaggcaggtggatc

SEQ ID NO: 3886 - DNA, 15 bp, Homo sapiens
ccgaggcaggtggat

SEQ ID NO: 3887 - DNA, 15 bp, Homo sapiens
gccgaggcaggtgga

SEQ ID NO: 3888 - DNA, 15 bp, Homo sapiens
ggccgaggcaggtgg

SEQ ID NO: 3889 - DNA, 15 bp, Homo sapiens
aggccgaggcaggtg

SEQ ID NO: 3890 - DNA, 15 bp, Homo sapiens
gaggccgaggcaggt

SEQ ID NO: 3891 - DNA, 15 bp, Homo sapiens
ggaggccgaggcagg

SEQ ID NO: 3892 - DNA, 15 bp, Homo sapiens
gggaggccgaggcag

SEQ ID NO: 3893 - DNA, 15 bp, Homo sapiens
tgggaggccgaggca

SEQ ID NO: 3894 - DNA, 15 bp, Homo sapiens
ttgggaggccgaggc

SEQ ID NO: 3895 - DNA, 15 bp, Homo sapiens
tttgggaggccgagg

SEQ ID NO: 3896 - DNA, 15 bp, Homo sapiens
gcactttgggaggcc

SEQ ID NO: 3897 - DNA, 15 bp, Homo sapiens
agcactttgggaggc

SEQ ID NO: 3898 - DNA, 15 bp, Homo sapiens
cggtggctcatgcct

SEQ ID NO: 3899 - DNA, 15 bp, Homo sapiens
acggtggctcatgcc

SEQ ID NO: 3900 - DNA, 15 bp, Homo sapiens
cacggtggctcatgc

SEQ ID NO: 3901 - DNA, 15 bp, Homo sapiens
gcacggtggctcatg

SEQ ID NO: 3902 - DNA, 15 bp, Homo sapiens
ggcacggtggctcat

SEQ ID NO: 3903 - DNA, 15 bp, Homo sapiens
gggcacggtggctca

SEQ ID NO: 3904 - DNA, 15 bp, Homo sapiens
cgggcacggtggctc

SEQ ID NO: 3905 - DNA, 15 bp, Homo sapiens
acgggcacggtggct

SEQ ID NO: 3906 - DNA, 15 bp, Homo sapiens
gacgggcacggtggc

SEQ ID NO: 3907 - DNA, 15 bp, Homo sapiens
ggacgggcacggtgg

SEQ ID NO: 3908 - DNA, 15 bp, Homo sapiens
gggacgggcacggtg

SEQ ID NO: 3909 - DNA, 15 bp, Homo sapiens
agggacgggcacggt

SEQ ID NO: 3910 - DNA, 15 bp, Homo sapiens
aagggacgggcacgg

SEQ ID NO: 3911 - DNA, 15 bp, Homo sapiens
caagggacgggcacg

SEQ ID NO: 3912 - DNA, 15 bp, Homo sapiens
tcaagggacgggcac

SEQ ID NO: 3913 - DNA, 15 bp, Homo sapiens
gtcaagggacgggca

SEQ ID NO: 3914 - DNA, 15 bp, Homo sapiens
cgtcaagggacgggc

SEQ ID NO: 3915 - DNA, 15 bp, Homo sapiens
tcgtcaagggacggg

SEQ ID NO: 3916 - DNA, 15 bp, Homo sapiens
atcgtcaagggacgg

SEQ ID NO: 3917 - DNA, 15 bp, Homo sapiens
gatcgtcaagggacg

SEQ ID NO: 3918 - DNA, 15 bp, Homo sapiens
agatcgtcaagggac

SEQ ID NO: 3919 - DNA, 15 bp, Homo sapiens
aagatcgtcaaggga

SEQ ID NO: 3920 - DNA, 15 bp, Homo sapiens
aaagatcgtcaaggg

SEQ ID NO: 3921 - DNA, 15 bp, Homo sapiens
aaaagatcgtcaagg

SEQ ID NO: 3922 - DNA, 15 bp, Homo sapiens
taaaagatcgtcaag

SEQ ID NO: 3923 - DNA, 15 bp, Homo sapiens
ttaaaagatcgtcaa

SEQ ID NO: 3924 - DNA, 15 bp, Homo sapiens
tttaaaagatcgtca

SEQ ID NO: 3925 - DNA, 15 bp, Homo sapiens
ttttaaaagatcgtc

SEQ ID NO: 3926 - DNA, 15 bp, Homo sapiens
tttttaaaagatcgt

SEQ ID NO: 3927 - DNA, 15 bp, Homo sapiens
ctttttaaaagatcg

SEQ ID NO: 3928 - DNA, 15 bp, Homo sapiens
cctttttaaaagatc

SEQ ID NO: 3929 - DNA, 15 bp, Homo sapiens
gcctttttaaaagat

SEQ ID NO: 3930 - DNA, 15 bp, Homo sapiens
ggcctttttaaaaga

SEQ ID NO: 3931 - DNA, 15 bp, Homo sapiens
tggcctttttaaaag

SEQ ID NO: 3932 - DNA, 15 bp, Homo sapiens
ttggcctttttaaaa

SEQ ID NO: 3933 - DNA, 15 bp, Homo sapiens
attggcctttttaaa

SEQ ID NO: 3934 - DNA, 15 bp, Homo sapiens
aattggcctttttaa

SEQ ID NO: 3935 - DNA, 15 bp, Homo sapiens
aaattggccttttta

SEQ ID NO: 3936 - DNA, 15 bp, Homo sapiens
caaattggccttttt

SEQ ID NO: 3937 - DNA, 15 bp, Homo sapiens
tcaaattggcctttt

SEQ ID NO: 3938 - DNA, 15 bp, Homo sapiens
gtcaaattggccttt

SEQ ID NO: 3939 - DNA, 15 bp, Homo sapiens
ggtcaaattggcctt

SEQ ID NO: 3940 - DNA, 15 bp, Homo sapiens
tggtcaaattggcct

SEQ ID NO: 3941 - DNA, 15 bp, Homo sapiens
atggtcaaattggcc

SEQ ID NO: 3942 - DNA, 15 bp, Homo sapiens
catggtcaaattggc

SEQ ID NO: 3943 - DNA, 15 bp, Homo sapiens
acatggtcaaattgg

SEQ ID NO: 3944 - DNA, 15 bp, Homo sapiens
aacatggtcaaattg

SEQ ID NO: 3945 - DNA, 15 bp, Homo sapiens
caacatggtcaaatt

SEQ ID NO: 3946 - DNA, 15 bp, Homo sapiens
ccaacatggtcaaat

SEQ ID NO: 3947 - DNA, 15 bp, Homo sapiens
accaacatggtcaaa

SEQ ID NO: 3948 - DNA, 15 bp, Homo sapiens
aaccaacatggtcaa

SEQ ID NO: 3949 - DNA, 15 bp, Homo sapiens
gaaccaacatggtca

SEQ ID NO: 3950 - DNA, 15 bp, Homo sapiens
ggaaccaacatggtc

SEQ ID NO: 3951 - DNA, 15 bp, Homo sapiens
gggaaccaacatggt

SEQ ID NO: 3952 - DNA, 15 bp, Homo sapiens
agggaaccaacatgg

SEQ ID NO: 3953 - DNA, 15 bp, Homo sapiens
gagggaaccaacatg

SEQ ID NO: 3954 - DNA, 15 bp, Homo sapiens
ggagggaaccaacat

SEQ ID NO: 3955 - DNA, 15 bp, Homo sapiens
aggagggaaccaaca

SEQ ID NO: 3956 - DNA, 15 bp, Homo sapiens
aaggagggaaccaac

SEQ ID NO: 3957 - DNA, 15 bp, Homo sapiens
gaaggagggaaccaa

SEQ ID NO: 3958 - DNA, 15 bp, Homo sapiens
cgaaggagggaacca

SEQ ID NO: 3959 - DNA, 15 bp, Homo sapiens
tcgaaggagggaacc

SEQ ID NO: 3960 - DNA, 15 bp, Homo sapiens
ttcgaaggagggaac

SEQ ID NO: 3961 - DNA, 15 bp, Homo sapiens
gttcgaaggagggaa

SEQ ID NO: 3962 - DNA, 15 bp, Homo sapiens
ggttcgaaggaggga

SEQ ID NO: 3963 - DNA, 15 bp, Homo sapiens
tggttcgaaggaggg

SEQ ID NO: 3964 - DNA, 15 bp, Homo sapiens
atggttcgaaggagg

SEQ ID NO: 3965 - DNA, 15 bp, Homo sapiens
gatggttcgaaggag

SEQ ID NO: 3966 - DNA, 15 bp, Homo sapiens
agatggttcgaagga

SEQ ID NO: 3967 - DNA, 15 bp, Homo sapiens
tagatggttcgaagg

SEQ ID NO: 3968 - DNA, 15 bp, Homo sapiens
gtagatggttcgaag

SEQ ID NO: 3969 - DNA, 15 bp, Homo sapiens
agtagatggttcgaa

SEQ ID NO: 3970 - DNA, 15 bp, Homo sapiens
cagtagatggttcga

SEQ ID NO: 3971 - DNA, 15 bp, Homo sapiens
ccagtagatggttcg

SEQ ID NO: 3972 - DNA, 15 bp, Homo sapiens
gccagtagatggttc

SEQ ID NO: 3973 - DNA, 15 bp, Homo sapiens
agccagtagatggtt

SEQ ID NO: 3974 - DNA, 15 bp, Homo sapiens
gagccagtagatggt

SEQ ID NO: 3975 - DNA, 15 bp, Homo sapiens
ggagccagtagatgg

SEQ ID NO: 3976 - DNA, 15 bp, Homo sapiens
gggagccagtagatg

SEQ ID NO: 3977 - DNA, 15 bp, Homo sapiens
ggggagccagtagat

SEQ ID NO: 3978 - DNA, 15 bp, Homo sapiens
tggggagccagtaga

SEQ ID NO: 3979 - DNA, 15 bp, Homo sapiens
atggggagccagtag

SEQ ID NO: 3980 - DNA, 15 bp, Homo sapiens
aatggggagccagta

SEQ ID NO: 3981 - DNA, 15 bp, Homo sapiens
caatggggagccagt

SEQ ID NO: 3982 - DNA, 15 bp, Homo sapiens
gcaatggggagccag

SEQ ID NO: 3983 - DNA, 15 bp, Homo sapiens
agcaatggggagcca

SEQ ID NO: 3984 - DNA, 15 bp, Homo sapiens
gagcaatggggagcc

SEQ ID NO: 3985 - DNA, 15 bp, Homo sapiens
agagcaatggggagc

SEQ ID NO: 3986 - DNA, 15 bp, Homo sapiens
aagagcaatggggag

SEQ ID NO: 3987 - DNA, 15 bp, Homo sapiens
gaagagcaatgggga

SEQ ID NO: 3988 - DNA, 15 bp, Homo sapiens
tgaagagcaatgggg

SEQ ID NO: 3989 - DNA, 15 bp, Homo sapiens
ctgaagagcaatggg

SEQ ID NO: 3990 - DNA, 15 bp, Homo sapiens
tctgaagagcaatgg

SEQ ID NO: 3991 - DNA, 15 bp, Homo sapiens
atctgaagagcaatg

SEQ ID NO: 3992 - DNA, 15 bp, Homo sapiens
tatctgaagagcaat

SEQ ID NO: 3993 - DNA, 15 bp, Homo sapiens
ttatctgaagagcaa

SEQ ID NO: 3994 - DNA, 15 bp, Homo sapiens
tttatctgaagagca

SEQ ID NO: 3995 - DNA, 15 bp, Homo sapiens
ctttatctgaagagc

SEQ ID NO: 3996 - DNA, 15 bp, Homo sapiens
tctttatctgaagag

SEQ ID NO: 3997 - DNA, 15 bp, Homo sapiens
gtctttatctgaaga

SEQ ID NO: 3998 - DNA, 15 bp, Homo sapiens
tgtctttatctgaag

SEQ ID NO: 3999 - DNA, 15 bp, Homo sapiens
gtgtctttatctgaa

SEQ ID NO: 4000 - DNA, 15 bp, Homo sapiens
tgtgtctttatctga

SEQ ID NO: 4001 - DNA, 15 bp, Homo sapiens
ttgtgtctttatctg

SEQ ID NO: 4002 - DNA, 15 bp, Homo sapiens
tttgtgtctttatct

SEQ ID NO: 4003 - DNA, 15 bp, Homo sapiens
gtttgtgtctttatc

SEQ ID NO: 4004 - DNA, 15 bp, Homo sapiens
ggtttgtgtctttat

SEQ ID NO: 4005 - DNA, 15 bp, Homo sapiens
gggtttgtgtcttta

SEQ ID NO: 4006 - DNA, 15 bp, Homo sapiens
agggtttgtgtcttt

SEQ ID NO: 4007 - DNA, 15 bp, Homo sapiens
aagggtttgtgtctt

SEQ ID NO: 4008 - DNA, 15 bp, Homo sapiens
caagggtttgtgtct

SEQ ID NO: 4009 - DNA, 15 bp, Homo sapiens
tcaagggtttgtgtc

SEQ ID NO: 4010 - DNA, 15 bp, Homo sapiens
gtcaagggtttgtgt

SEQ ID NO: 4011 - DNA, 15 bp, Homo sapiens
ggtcaagggtttgtg

SEQ ID NO: 4012 - DNA, 15 bp, Homo sapiens
aggtcaagggtttgt

SEQ ID NO: 4013 - DNA, 15 bp, Homo sapiens
caggtcaagggtttg

SEQ ID NO: 4014 - DNA, 15 bp, Homo sapiens
acaggtcaagggttt

SEQ ID NO: 4015 - DNA, 15 bp, Homo sapiens
aacaggtcaagggtt

SEQ ID NO: 4016 - DNA, 15 bp, Homo sapiens
gaacaggtcaagggt

SEQ ID NO: 4017 - DNA, 15 bp, Homo sapiens
agaacaggtcaaggg

SEQ ID NO: 4018 - DNA, 15 bp, Homo sapiens
gagaacaggtcaagg

SEQ ID NO: 4019 - DNA, 15 bp, Homo sapiens
ggagaacaggtcaag

SEQ ID NO: 4020 - DNA, 15 bp, Homo sapiens
tggagaacaggtcaa

SEQ ID NO: 4021 - DNA, 15 bp, Homo sapiens
atggagaacaggtca

SEQ ID NO: 4022 - DNA, 15 bp, Homo sapiens
catggagaacaggtc

SEQ ID NO: 4023 - DNA, 15 bp, Homo sapiens
ccatggagaacaggt

SEQ ID NO: 4024 - DNA, 15 bp, Homo sapiens
accatggagaacagg

SEQ ID NO: 4025 - DNA, 15 bp, Homo sapiens
gaccatggagaacag

SEQ ID NO: 4026 - DNA, 15 bp, Homo sapiens
ggaccatggagaaca

SEQ ID NO: 4027 - DNA, 15 bp, Homo sapiens
aggaccatggagaac

SEQ ID NO: 4028 - DNA, 15 bp, Homo sapiens
taggaccatggagaa

SEQ ID NO: 4029 - DNA, 15 bp, Homo sapiens
ataggaccatggaga

SEQ ID NO: 4030 - DNA, 15 bp, Homo sapiens
gataggaccatggag

SEQ ID NO: 4031 - DNA, 15 bp, Homo sapiens
ggataggaccatgga

SEQ ID NO: 4032 - DNA, 15 bp, Homo sapiens
gggataggaccatgg

SEQ ID NO: 4033 - DNA, 15 bp, Homo sapiens
agggataggaccatg

SEQ ID NO: 4034 - DNA, 15 bp, Homo sapiens
cagggataggaccat

SEQ ID NO: 4035 - DNA, 15 bp, Homo sapiens
ccagggataggacca

SEQ ID NO: 4036 - DNA, 15 bp, Homo sapiens
accagggataggacc

SEQ ID NO: 4037 - DNA, 15 bp, Homo sapiens
gaccagggataggac

SEQ ID NO: 4038 - DNA, 15 bp, Homo sapiens
ggaccagggatagga

SEQ ID NO: 4039 - DNA, 15 bp, Homo sapiens
aggaccagggatagg

SEQ ID NO: 4040 - DNA, 15 bp, Homo sapiens
caggaccagggatag

SEQ ID NO: 4041 - DNA, 15 bp, Homo sapiens
gcaggaccagggata

SEQ ID NO: 4042 - DNA, 15 bp, Homo sapiens
ggcaggaccagggat

SEQ ID NO: 4043 - DNA, 15 bp, Homo sapiens
gggcaggaccaggga

SEQ ID NO: 4044 - DNA, 15 bp, Homo sapiens
tgggcaggaccaggg

SEQ ID NO: 4045 - DNA, 15 bp, Homo sapiens
ctgggcaggaccagg

SEQ ID NO: 4046 - DNA, 15 bp, Homo sapiens
gctgggcaggaccag

SEQ ID NO: 4047 - DNA, 15 bp, Homo sapiens
agctgggcaggacca

SEQ ID NO: 4048 - DNA, 15 bp, Homo sapiens
aagctgggcaggacc

SEQ ID NO: 4049 - DNA, 15 bp, Homo sapiens
gaagctgggcaggac

SEQ ID NO: 4050 - DNA, 15 bp, Homo sapiens
agaagctgggcagga

SEQ ID NO: 4051 - DNA, 15 bp, Homo sapiens
aagaagctgggcagg

SEQ ID NO: 4052 - DNA, 15 bp, Homo sapiens
gaagaagctgggcag

SEQ ID NO: 4053 - DNA, 15 bp, Homo sapiens
tgaagaagctgggca

SEQ ID NO: 4054 - DNA, 15 bp, Homo sapiens
gtgaagaagctgggc

SEQ ID NO: 4055 - DNA, 15 bp, Homo sapiens
ggtgaagaagctggg

SEQ ID NO: 4056 - DNA, 15 bp, Homo sapiens
aggtgaagaagctgg

SEQ ID NO: 4057 - DNA, 15 bp, Homo sapiens
caggtgaagaagctg

SEQ ID NO: 4058 - DNA, 15 bp, Homo sapiens
ccaggtgaagaagct

SEQ ID NO: 4059 - DNA, 15 bp, Homo sapiens
accaggtgaagaagc

SEQ ID NO: 4060 - DNA, 15 bp, Homo sapiens
aaccaggtgaagaag

SEQ ID NO: 4061 - DNA, 15 bp, Homo sapiens
gaaccaggtgaagaa

SEQ ID NO: 4062 - DNA, 15 bp, Homo sapiens
tgaaccaggtgaaga

SEQ ID NO: 4063 - DNA, 15 bp, Homo sapiens
ttgaaccaggtgaag

SEQ ID NO: 4064 - DNA, 15 bp, Homo sapiens
gttgaaccaggtgaa

SEQ ID NO: 4065 - DNA, 15 bp, Homo sapiens
tgttgaaccaggtga

SEQ ID NO: 4066 - DNA, 15 bp, Homo sapiens
ctgttgaaccaggtg

SEQ ID NO: 4067 - DNA, 15 bp, Homo sapiens
cctgttgaaccaggt

SEQ ID NO: 4068 - DNA, 15 bp, Homo sapiens
acctgttgaaccagg

SEQ ID NO: 4069 - DNA, 15 bp, Homo sapiens
tacctgttgaaccag

SEQ ID NO: 4070 - DNA, 15 bp, Homo sapiens
gtacctgttgaacca

SEQ ID NO: 4071 - DNA, 15 bp, Homo sapiens
tgtacctgttgaacc

SEQ ID NO: 4072 - DNA, 15 bp, Homo sapiens
gtgtacctgttgaac

SEQ ID NO: 4073 - DNA, 15 bp, Homo sapiens
agtgtacctgttgaa

SEQ ID NO: 4074 - DNA, 15 bp, Homo sapiens
aagtgtacctgttga

SEQ ID NO: 4075 - DNA, 15 bp, Homo sapiens
caagtgtacctgttg

SEQ ID NO: 4076 - DNA, 15 bp, Homo sapiens
acaagtgtacctgtt

SEQ ID NO: 4077 - DNA, 15 bp, Homo sapiens
gacaagtgtacctgt

SEQ ID NO: 4078 - DNA, 15 bp, Homo sapiens
agacaagtgtacctg

SEQ ID NO: 4079 - DNA, 15 bp, Homo sapiens
gagacaagtgtacct

SEQ ID NO: 4080 - DNA, 15 bp, Homo sapiens
agagacaagtgtacc

SEQ ID NO: 4081 - DNA, 15 bp, Homo sapiens
aagagacaagtgtac

SEQ ID NO: 4082 - DNA, 15 bp, Homo sapiens
caagagacaagtgta

SEQ ID NO: 4083 - DNA, 15 bp, Homo sapiens
ccaagagacaagtgt

SEQ ID NO: 4084 - DNA, 15 bp, Homo sapiens
gccaagagacaagtg

SEQ ID NO: 4085 - DNA, 15 bp, Homo sapiens
agccaagagacaagt

SEQ ID NO: 4086 - DNA, 15 bp, Homo sapiens
cagccaagagacaag

SEQ ID NO: 4087 - DNA, 15 bp, Homo sapiens
acagccaagagacaa

SEQ ID NO: 4088 - DNA, 15 bp, Homo sapiens
gacagccaagagaca

SEQ ID NO: 4089 - DNA, 15 bp, Homo sapiens
agacagccaagagac

SEQ ID NO: 4090 - DNA, 15 bp, Homo sapiens
aagacagccaagaga

SEQ ID NO: 4091 - DNA, 15 bp, Homo sapiens
gaagacagccaagag

SEQ ID NO: 4092 - DNA, 15 bp, Homo sapiens
agaagacagccaaga

SEQ ID NO: 4093 - DNA, 15 bp, Homo sapiens
aagaagacagccaag

SEQ ID NO: 4094 - DNA, 15 bp, Homo sapiens
aaagaagacagccaa

SEQ ID NO: 4095 - DNA, 15 bp, Homo sapiens
gaaagaagacagcca

SEQ ID NO: 4096 - DNA, 15 bp, Homo sapiens
ggaaagaagacagcc

SEQ ID NO: 4097 - DNA, 15 bp, Homo sapiens
tggaaagaagacagc

SEQ ID NO: 4098 - DNA, 15 bp, Homo sapiens
ctggaaagaagacag

SEQ ID NO: 4099 - DNA, 15 bp, Homo sapiens
tctggaaagaagaca

SEQ ID NO: 4100 - DNA, 15 bp, Homo sapiens
ttctggaaagaagac

SEQ ID NO: 4101 - DNA, 15 bp, Homo sapiens
tttctggaaagaaga

SEQ ID NO: 4102 - DNA, 15 bp, Homo sapiens
gtttctggaaagaag

SEQ ID NO: 4103 - DNA, 15 bp, Homo sapiens
tgtttctggaaagaa

SEQ ID NO: 4104 - DNA, 15 bp, Homo sapiens
gtgtttctggaaaga

SEQ ID NO: 4105 - DNA, 15 bp, Homo sapiens
agtgtttctggaaag

SEQ ID NO: 4106 - DNA, 15 bp, Homo sapiens
cagtgtttctggaaa

SEQ ID NO: 4107 - DNA, 15 bp, Homo sapiens
ccagtgtttctggaa

SEQ ID NO: 4108 - DNA, 15 bp, Homo sapiens
gccagtgtttctgga

SEQ ID NO: 4109 - DNA, 15 bp, Homo sapiens
agccagtgtttctgg

SEQ ID NO: 4110 - DNA, 15 bp, Homo sapiens
aagccagtgtttctg

SEQ ID NO: 4111 - DNA, 15 bp, Homo sapiens
caagccagtgtttct

SEQ ID NO: 4112 - DNA, 15 bp, Homo sapiens
acaagccagtgtttc

SEQ ID NO: 4113 - DNA, 15 bp, Homo sapiens
cacaagccagtgttt

SEQ ID NO: 4114 - DNA, 15 bp, Homo sapiens
gcacaagccagtgtt

SEQ ID NO: 4115 - DNA, 15 bp, Homo sapiens
agcacaagccagtgt

SEQ ID NO: 4116 - DNA, 15 bp, Homo sapiens
gagcacaagccagtg

SEQ ID NO: 4117 - DNA, 15 bp, Homo sapiens
ggagcacaagccagt

SEQ ID NO: 4118 - DNA, 15 bp, Homo sapiens
tggagcacaagccag

SEQ ID NO: 4119 - DNA, 15 bp, Homo sapiens
atggagcacaagcca

SEQ ID NO: 4120 - DNA, 15 bp, Homo sapiens
aatggagcacaagcc

SEQ ID NO: 4121 - DNA, 15 bp, Homo sapiens
gaatggagcacaagc

SEQ ID NO: 4122 - DNA, 15 bp, Homo sapiens
agaatggagcacaag

SEQ ID NO: 4123 - DNA, 15 bp, Homo sapiens
aagaatggagcacaa

SEQ ID NO: 4124 - DNA, 15 bp, Homo sapiens
aaagaatggagcaca

SEQ ID NO: 4125 - DNA, 15 bp, Homo sapiens
caaagaatggagcac

SEQ ID NO: 4126 - DNA, 15 bp, Homo sapiens
tcaaagaatggagca

SEQ ID NO: 4127 - DNA, 15 bp, Homo sapiens
gtcaaagaatggagc

SEQ ID NO: 4128 - DNA, 15 bp, Homo sapiens
agtcaaagaatggag

SEQ ID NO: 4129 - DNA, 15 bp, Homo sapiens
cagtcaaagaatgga

SEQ ID NO: 4130 - DNA, 15 bp, Homo sapiens
gcagtcaaagaatgg

SEQ ID NO: 4131 - DNA, 15 bp, Homo sapiens
agcagtcaaagaatg

SEQ ID NO: 4132 - DNA, 15 bp, Homo sapiens
gagcagtcaaagaat

SEQ ID NO: 4133 - DNA, 15 bp, Homo sapiens
ggagcagtcaaagaa

SEQ ID NO: 4134 - DNA, 15 bp, Homo sapiens
tggagcagtcaaaga

SEQ ID NO: 4135 - DNA, 15 bp, Homo sapiens
atggagcagtcaaag

SEQ ID NO: 4136 - DNA, 15 bp, Homo sapiens
catggagcagtcaaa

SEQ ID NO: 4137 - DNA, 15 bp, Homo sapiens
tcatggagcagtcaa

SEQ ID NO: 4138 - DNA, 15 bp, Homo sapiens
atcatggagcagtca

SEQ ID NO: 4139 - DNA, 15 bp, Homo sapiens
aatcatggagcagtc

SEQ ID NO: 4140 - DNA, 15 bp, Homo sapiens
gaatcatggagcagt

SEQ ID NO: 4141 - DNA, 15 bp, Homo sapiens
agaatcatggagcag

SEQ ID NO: 4142 - DNA, 15 bp, Homo sapiens
aagaatcatggagca

SEQ ID NO: 4143 - DNA, 15 bp, Homo sapiens
aaagaatcatggagc

SEQ ID NO: 4144 - DNA, 15 bp, Homo sapiens
gaaagaatcatggag

SEQ ID NO: 4145 - DNA, 15 bp, Homo sapiens
agaaagaatcatgga

SEQ ID NO: 4146 - DNA, 15 bp, Homo sapiens
cagaaagaatcatgg

SEQ ID NO: 4147 - DNA, 15 bp, Homo sapiens
gcagaaagaatcatg

SEQ ID NO: 4148 - DNA, 15 bp, Homo sapiens
ggcagaaagaatcat

SEQ ID NO: 4149 - DNA, 15 bp, Homo sapiens
tggcagaaagaatca

SEQ ID NO: 4150 - DNA, 15 bp, Homo sapiens
gtggcagaaagaatc

SEQ ID NO: 4151 - DNA, 15 bp, Homo sapiens
agtggcagaaagaat

SEQ ID NO: 4152 - DNA, 15 bp, Homo sapiens
aagtggcagaaagaa

SEQ ID NO: 4153 - DNA, 15 bp, Homo sapiens
gaagtggcagaaaga

SEQ ID NO: 4154 - DNA, 15 bp, Homo sapiens
tgaagtggcagaaag

SEQ ID NO: 4155 - DNA, 15 bp, Homo sapiens
gtgaagtggcagaaa

SEQ ID NO: 4156 - DNA, 15 bp, Homo sapiens
tgtgaagtggcagaa

SEQ ID NO: 4157 - DNA, 15 bp, Homo sapiens
atgtgaagtggcaga

SEQ ID NO: 4158 - DNA, 15 bp, Homo sapiens
tatgtgaagtggcag

SEQ ID NO: 4159 - DNA, 15 bp, Homo sapiens
ctatgtgaagtggca

SEQ ID NO: 4160 - DNA, 15 bp, Homo sapiens
cctatgtgaagtggc

SEQ ID NO: 4161 - DNA, 15 bp, Homo sapiens
tcctatgtgaagtgg

SEQ ID NO: 4162 - DNA, 15 bp, Homo sapiens
ttcctatgtgaagtg

SEQ ID NO: 4163 - DNA, 15 bp, Homo sapiens
cttcctatgtgaagt

SEQ ID NO: 4164 - DNA, 15 bp, Homo sapiens
gcttcctatgtgaag

SEQ ID NO: 4165 - DNA, 15 bp, Homo sapiens
agcttcctatgtgaa

SEQ ID NO: 4166 - DNA, 15 bp, Homo sapiens
gagcttcctatgtga

SEQ ID NO: 4167 - DNA, 15 bp, Homo sapiens
agagcttcctatgtg

SEQ ID NO: 4168 - DNA, 15 bp, Homo sapiens
aagagcttcctatgt

SEQ ID NO: 4169 - DNA, 15 bp, Homo sapiens
taagagcttcctatg

SEQ ID NO: 4170 - DNA, 15 bp, Homo sapiens
gtaagagcttcctat

SEQ ID NO: 4171 - DNA, 15 bp, Homo sapiens
ggtaagagcttccta

SEQ ID NO: 4172 - DNA, 15 bp, Homo sapiens
aggtaagagcttcct

SEQ ID NO: 4173 - DNA, 15 bp, Homo sapiens
aaggtaagagcttcc

SEQ ID NO: 4174 - DNA, 15 bp, Homo sapiens
aaaggtaagagcttc

SEQ ID NO: 4175 - DNA, 15 bp, Homo sapiens
aaaaggtaagagctt

SEQ ID NO: 4176 - DNA, 15 bp, Homo sapiens
gaaaaggtaagagct

SEQ ID NO: 4177 - DNA, 15 bp, Homo sapiens
agaaaaggtaagagc

SEQ ID NO: 4178 - DNA, 15 bp, Homo sapiens
gagaaaaggtaagag

SEQ ID NO: 4179 - DNA, 15 bp, Homo sapiens
agagaaaaggtaaga

SEQ ID NO: 4180 - DNA, 15 bp, Homo sapiens
aagagaaaaggtaag

SEQ ID NO: 4181 - DNA, 15 bp, Homo sapiens
aaagagaaaaggtaa

SEQ ID NO: 4182 - DNA, 15 bp, Homo sapiens
gaaagagaaaaggta

SEQ ID NO: 4183 - DNA, 15 bp, Homo sapiens
agaaagagaaaaggt

SEQ ID NO: 4184 - DNA, 15 bp, Homo sapiens
cagaaagagaaaagg

SEQ ID NO: 4185 - DNA, 15 bp, Homo sapiens
acagaaagagaaaag

SEQ ID NO: 4186 - DNA, 15 bp, Homo sapiens
aacagaaagagaaaa

SEQ ID NO: 4187 - DNA, 15 bp, Homo sapiens
aaacagaaagagaaa

SEQ ID NO: 4188 - DNA, 15 bp, Homo sapiens
gaaacagaaagagaa

SEQ ID NO: 4189 - DNA, 15 bp, Homo sapiens
ggaaacagaaagaga

SEQ ID NO: 4190 - DNA, 15 bp, Homo sapiens
gggaaacagaaagag

SEQ ID NO: 4191 - DNA, 15 bp, Homo sapiens
agggaaacagaaaga

SEQ ID NO: 4192 - DNA, 15 bp, Homo sapiens
aagggaaacagaaag

SEQ ID NO: 4193 - DNA, 15 bp, Homo sapiens
aaagggaaacagaaa

SEQ ID NO: 4194 - DNA, 15 bp, Homo sapiens
aaaagggaaacagaa

SEQ ID NO: 4195 - DNA, 15 bp, Homo sapiens
aaaaagggaaacaga

SEQ ID NO: 4196 - DNA, 15 bp, Homo sapiens
caaaaagggaaacag

SEQ ID NO: 4197 - DNA, 15 bp, Homo sapiens
ccaaaaagggaaaca

SEQ ID NO: 4198 - DNA, 15 bp, Homo sapiens
gccaaaaagggaaac

SEQ ID NO: 4199 - DNA, 15 bp, Homo sapiens
agccaaaaagggaaa

SEQ ID NO: 4200 - DNA, 15 bp, Homo sapiens
tagccaaaaagggaa

SEQ ID NO: 4201 - DNA, 15 bp, Homo sapiens
ttagccaaaaaggga

SEQ ID NO: 4202 - DNA, 15 bp, Homo sapiens
attagccaaaaaggg

SEQ ID NO: 4203 - DNA, 15 bp, Homo sapiens
aattagccaaaaagg

SEQ ID NO: 4204 - DNA, 15 bp, Homo sapiens
taattagccaaaaag

SEQ ID NO: 4205 - DNA, 15 bp, Homo sapiens
ttaattagccaaaaa

SEQ ID NO: 4206 - DNA, 15 bp, Homo sapiens
tttaattagccaaaa

SEQ ID NO: 4207 - DNA, 15 bp, Homo sapiens
atttaattagccaaa

SEQ ID NO: 4208 - DNA, 15 bp, Homo sapiens
aatttaattagccaa

SEQ ID NO: 4209 - DNA, 15 bp, Homo sapiens
gaatttaattagcca

SEQ ID NO: 4210 - DNA, 15 bp, Homo sapiens
agaatttaattagcc

SEQ ID NO: 4211 - DNA, 15 bp, Homo sapiens
aagaatttaattagc

SEQ ID NO: 4212 - DNA, 15 bp, Homo sapiens
caagaatttaattag

SEQ ID NO: 4213 - DNA, 15 bp, Homo sapiens
acaagaatttaatta

SEQ ID NO: 4214 - DNA, 15 bp, Homo sapiens
gacaagaatttaatt

SEQ ID NO: 4215 - DNA, 15 bp, Homo sapiens
tgacaagaatttaat

SEQ ID NO: 4216 - DNA, 15 bp, Homo sapiens
atgacaagaatttaa

SEQ ID NO: 4217 - DNA, 15 bp, Homo sapiens
gatgacaagaattta

SEQ ID NO: 4218 - DNA, 15 bp, Homo sapiens
agatgacaagaattt

SEQ ID NO: 4219 - DNA, 15 bp, Homo sapiens
aagatgacaagaatt

SEQ ID NO: 4220 - DNA, 15 bp, Homo sapiens
aaagatgacaagaat

SEQ ID NO: 4221 - DNA, 15 bp, Homo sapiens
taaagatgacaagaa

SEQ ID NO: 4222 - DNA, 15 bp, Homo sapiens
ttaaagatgacaaga

SEQ ID NO: 4223 - DNA, 15 bp, Homo sapiens
tttaaagatgacaag

SEQ ID NO: 4224 - DNA, 15 bp, Homo sapiens
ctttaaagatgacaa

SEQ ID NO: 4225 - DNA, 15 bp, Homo sapiens
cctttaaagatgaca

SEQ ID NO: 4226 - DNA, 15 bp, Homo sapiens
gcctttaaagatgac

SEQ ID NO: 4227 - DNA, 15 bp, Homo sapiens
agcctttaaagatga

SEQ ID NO: 4228 - DNA, 15 bp, Homo sapiens
aagcctttaaagatg

SEQ ID NO: 4229 - DNA, 15 bp, Homo sapiens
caagcctttaaagat

SEQ ID NO: 4230 - DNA, 15 bp, Homo sapiens
ccaagcctttaaaga

SEQ ID NO: 4231 - DNA, 15 bp, Homo sapiens
gccaagcctttaaag

SEQ ID NO: 4232 - DNA, 15 bp, Homo sapiens
agccaagcctttaaa

SEQ ID NO: 4233 - DNA, 15 bp, Homo sapiens
gagccaagcctttaa

SEQ ID NO: 4234 - DNA, 15 bp, Homo sapiens
tgagccaagccttta

SEQ ID NO: 4235 - DNA, 15 bp, Homo sapiens
ttgagccaagccttt

SEQ ID NO: 4236 - DNA, 15 bp, Homo sapiens
tttgagccaagcctt

SEQ ID NO: 4237 - DNA, 15 bp, Homo sapiens
atttgagccaagcct

SEQ ID NO: 4238 - DNA, 15 bp, Homo sapiens
catttgagccaagcc

SEQ ID NO: 4239 - DNA, 15 bp, Homo sapiens
acatttgagccaagc

SEQ ID NO: 4240 - DNA, 15 bp, Homo sapiens
gacatttgagccaag

SEQ ID NO: 4241 - DNA, 15 bp, Homo sapiens
agacatttgagccaa

SEQ ID NO: 4242 - DNA, 15 bp, Homo sapiens
gagacatttgagcca

SEQ ID NO: 4243 - DNA, 15 bp, Homo sapiens
agagacatttgagcc

SEQ ID NO: 4244 - DNA, 15 bp, Homo sapiens
aagagacatttgagc

SEQ ID NO: 4245 - DNA, 15 bp, Homo sapiens
gaagagacatttgag

SEQ ID NO: 4246 - DNA, 15 bp, Homo sapiens
tgaagagacatttga

SEQ ID NO: 4247 - DNA, 15 bp, Homo sapiens
ttgaagagacatttg

SEQ ID NO: 4248 - DNA, 15 bp, Homo sapiens
cttgaagagacattt

SEQ ID NO: 4249 - DNA, 15 bp, Homo sapiens
tcttgaagagacatt

SEQ ID NO: 4250 - DNA, 15 bp, Homo sapiens
ttcttgaagagacat

SEQ ID NO: 4251 - DNA, 15 bp, Homo sapiens
tttcttgaagagaca

SEQ ID NO: 4252 - DNA, 15 bp, Homo sapiens
ctttcttgaagagac

SEQ ID NO: 4253 - DNA, 15 bp, Homo sapiens
gctttcttgaagaga

SEQ ID NO: 4254 - DNA, 15 bp, Homo sapiens
ggctttcttgaagag

SEQ ID NO: 4255 - DNA, 15 bp, Homo sapiens
aggctttcttgaaga

SEQ ID NO: 4256 - DNA, 15 bp, Homo sapiens
aaggctttcttgaag

SEQ ID NO: 4257 - DNA, 15 bp, Homo sapiens
gaaggctttcttgaa

SEQ ID NO: 4258 - DNA, 15 bp, Homo sapiens
agaaggctttcttga

SEQ ID NO: 4259 - DNA, 15 bp, Homo sapiens
gagaaggctttcttg

SEQ ID NO: 4260 - DNA, 15 bp, Homo sapiens
agagaaggctttctt

SEQ ID NO: 4261 - DNA, 15 bp, Homo sapiens
tagagaaggctttct

SEQ ID NO: 4262 - DNA, 15 bp, Homo sapiens
ttagagaaggctttc

SEQ ID NO: 4263 - DNA, 15 bp, Homo sapiens
attagagaaggcttt

SEQ ID NO: 4264 - DNA, 15 bp, Homo sapiens
aattagagaaggctt

SEQ ID NO: 4265 - DNA, 15 bp, Homo sapiens
caattagagaaggct

SEQ ID NO: 4266 - DNA, 15 bp, Homo sapiens
gcaattagagaaggc

SEQ ID NO: 4267 - DNA, 15 bp, Homo sapiens
ggcaattagagaagg

SEQ ID NO: 4268 - DNA, 15 bp, Homo sapiens
gggcaattagagaag

SEQ ID NO: 4269 - DNA, 15 bp, Homo sapiens
tgggcaattagagaa

SEQ ID NO: 4270 - DNA, 15 bp, Homo sapiens
ctgggcaattagaga

SEQ ID NO: 4271 - DNA, 15 bp, Homo sapiens
cctgggcaattagag

SEQ ID NO: 4272 - DNA, 15 bp, Homo sapiens
ccctgggcaattaga

SEQ ID NO: 4273 - DNA, 15 bp, Homo sapiens
gccctgggcaattag

SEQ ID NO: 4274 - DNA, 15 bp, Homo sapiens
tgccctgggcaatta

SEQ ID NO: 4275 - DNA, 15 bp, Homo sapiens
ctgccctgggcaatt

SEQ ID NO: 4276 - DNA, 15 bp, Homo sapiens
cctgccctgggcaat

SEQ ID NO: 4277 - DNA, 15 bp, Homo sapiens
acctgccctgggcaa

SEQ ID NO: 4278 - DNA, 15 bp, Homo sapiens
gacctgccctgggca

SEQ ID NO: 4279 - DNA, 15 bp, Homo sapiens
tgacctgccctgggc

SEQ ID NO: 4280 - DNA, 15 bp, Homo sapiens
ctgacctgccctggg

SEQ ID NO: 4281 - DNA, 15 bp, Homo sapiens
tctgacctgccctgg

SEQ ID NO: 4282 - DNA, 15 bp, Homo sapiens
gtctgacctgccctg

SEQ ID NO: 4283 - DNA, 15 bp, Homo sapiens
agtctgacctgccct

SEQ ID NO: 4284 - DNA, 15 bp, Homo sapiens
gagtctgacctgccc

SEQ ID NO: 4285 - DNA, 15 bp, Homo sapiens
ggagtctgacctgcc

SEQ ID NO: 4286 - DNA, 15 bp, Homo sapiens
aggagtctgacctgc

SEQ ID NO: 4287 - DNA, 15 bp, Homo sapiens
gaggagtctgacctg

SEQ ID NO: 4288 - DNA, 15 bp, Homo sapiens
agaggagtctgacct

SEQ ID NO: 4289 - DNA, 15 bp, Homo sapiens
cagaggagtctgacc

SEQ ID NO: 4290 - DNA, 15 bp, Homo sapiens
gcagaggagtctgac

SEQ ID NO: 4291 - DNA, 15 bp, Homo sapiens
agcagaggagtctga

SEQ ID NO: 4292 - DNA, 15 bp, Homo sapiens
cagcagaggagtctg

SEQ ID NO: 4293 - DNA, 15 bp, Homo sapiens
acagcagaggagtct

SEQ ID NO: 4294 - DNA, 15 bp, Homo sapiens
cacagcagaggagtc

SEQ ID NO: 4295 - DNA, 15 bp, Homo sapiens
acacagcagaggagt

SEQ ID NO: 4296 - DNA, 15 bp, Homo sapiens
cacacagcagaggag

SEQ ID NO: 4297 - DNA, 15 bp, Homo sapiens
gcacacagcagagga

SEQ ID NO: 4298 - DNA, 15 bp, Homo sapiens
agcacacagcagagg

SEQ ID NO: 4299 - DNA, 15 bp, Homo sapiens
gagcacacagcagag

SEQ ID NO: 4300 - DNA, 15 bp, Homo sapiens
agagcacacagcaga

SEQ ID NO: 4301 - DNA, 15 bp, Homo sapiens
aagagcacacagcag

SEQ ID NO: 4302 - DNA, 15 bp, Homo sapiens
taagagcacacagca

SEQ ID NO: 4303 - DNA, 15 bp, Homo sapiens
ttaagagcacacagc

SEQ ID NO: 4304 - DNA, 15 bp, Homo sapiens
attaagagcacacag

SEQ ID NO: 4305 - DNA, 15 bp, Homo sapiens
tattaagagcacaca

SEQ ID NO: 4306 - DNA, 15 bp, Homo sapiens
gtattaagagcacac

SEQ ID NO: 4307 - DNA, 15 bp, Homo sapiens
agtattaagagcaca

SEQ ID NO: 4308 - DNA, 15 bp, Homo sapiens
gagtattaagagcac

SEQ ID NO: 4309 - DNA, 15 bp, Homo sapiens
agagtattaagagca

SEQ ID NO: 4310 - DNA, 15 bp, Homo sapiens
cagagtattaagagc

SEQ ID NO: 4311 - DNA, 15 bp, Homo sapiens
acagagtattaagag

SEQ ID NO: 4312 - DNA, 15 bp, Homo sapiens
cacagagtattaaga

SEQ ID NO: 4313 - DNA, 15 bp, Homo sapiens
gcacagagtattaag

SEQ ID NO: 4314 - DNA, 15 bp, Homo sapiens
agcacagagtattaa

SEQ ID NO: 4315 - DNA, 15 bp, Homo sapiens
aagcacagagtatta

SEQ ID NO: 4316 - DNA, 15 bp, Homo sapiens
gaagcacagagtatt

SEQ ID NO: 4317 - DNA, 15 bp, Homo sapiens
agaagcacagagtat

SEQ ID NO: 4318 - DNA, 15 bp, Homo sapiens
gagaagcacagagta

SEQ ID NO: 4319 - DNA, 15 bp, Homo sapiens
ggagaagcacagagt

SEQ ID NO: 4320 - DNA, 15 bp, Homo sapiens
aggagaagcacagag

SEQ ID NO: 4321 - DNA, 15 bp, Homo sapiens
aaggagaagcacaga

SEQ ID NO: 4322 - DNA, 15 bp, Homo sapiens
aaaggagaagcacag

SEQ ID NO: 4323 - DNA, 15 bp, Homo sapiens
caaaggagaagcaca

SEQ ID NO: 4324 - DNA, 15 bp, Homo sapiens
acaaaggagaagcac

SEQ ID NO: 4325 - DNA, 15 bp, Homo sapiens
tacaaaggagaagca

SEQ ID NO: 4326 - DNA, 15 bp, Homo sapiens
atacaaaggagaagc

SEQ ID NO: 4327 - DNA, 15 bp, Homo sapiens
catacaaaggagaag

SEQ ID NO: 4328 - DNA, 15 bp, Homo sapiens
tcatacaaaggagaa

SEQ ID NO: 4329 - DNA, 15 bp, Homo sapiens
atcatacaaaggaga

SEQ ID NO: 4330 - DNA, 15 bp, Homo sapiens
aatcatacaaaggag

SEQ ID NO: 4331 - DNA, 15 bp, Homo sapiens
aaatcatacaaagga

SEQ ID NO: 4332 - DNA, 15 bp, Homo sapiens
caaatcatacaaagg

SEQ ID NO: 4333 - DNA, 15 bp, Homo sapiens
acaaatcatacaaag

SEQ ID NO: 4334 - DNA, 15 bp, Homo sapiens
tacaaatcatacaaa

SEQ ID NO: 4335 - DNA, 15 bp, Homo sapiens
ctacaaatcatacaa

SEQ ID NO: 4336 - DNA, 15 bp, Homo sapiens
actacaaatcataca

SEQ ID NO: 4337 - DNA, 15 bp, Homo sapiens
gactacaaatcatac

SEQ ID NO: 4338 - DNA, 15 bp, Homo sapiens
agactacaaatcata

SEQ ID NO: 4339 - DNA, 15 bp, Homo sapiens
cagactacaaatcat

SEQ ID NO: 4340 - DNA, 15 bp, Homo sapiens
acagactacaaatca

SEQ ID NO: 4341 - DNA, 15 bp, Homo sapiens
gacagactacaaatc

SEQ ID NO: 4342 - DNA, 15 bp, Homo sapiens
tgacagactacaaat

SEQ ID NO: 4343 - DNA, 15 bp, Homo sapiens
ctgacagactacaaa

SEQ ID NO: 4344 - DNA, 15 bp, Homo sapiens
actgacagactacaa

SEQ ID NO: 4345 - DNA, 15 bp, Homo sapiens
tactgacagactaca

SEQ ID NO: 4346 - DNA, 15 bp, Homo sapiens
atactgacagactac

SEQ ID NO: 4347 - DNA, 15 bp, Homo sapiens
aatactgacagacta

SEQ ID NO: 4348 - DNA, 15 bp, Homo sapiens
caatactgacagact

SEQ ID NO: 4349 - DNA, 15 bp, Homo sapiens
acaatactgacagac

SEQ ID NO: 4350 - DNA, 15 bp, Homo sapiens
tacaatactgacaga

SEQ ID NO: 4351 - DNA, 15 bp, Homo sapiens
ttacaatactgacag

SEQ ID NO: 4352 - DNA, 15 bp, Homo sapiens
attacaatactgaca

SEQ ID NO: 4353 - DNA, 15 bp, Homo sapiens
cattacaatactgac

SEQ ID NO: 4354 - DNA, 15 bp, Homo sapiens
tcattacaatactga

SEQ ID NO: 4355 - DNA, 15 bp, Homo sapiens
ttcattacaatactg

SEQ ID NO: 4356 - DNA, 15 bp, Homo sapiens
tttcattacaatact

SEQ ID NO: 4357 - DNA, 15 bp, Homo sapiens
atttcattacaatac

SEQ ID NO: 4358 - DNA, 15 bp, Homo sapiens
tatttcattacaata

SEQ ID NO: 4359 - DNA, 15 bp, Homo sapiens
ttatttcattacaat

SEQ ID NO: 4360 - DNA, 15 bp, Homo sapiens
attatttcattacaa

SEQ ID NO: 4361 - DNA, 15 bp, Homo sapiens
aattatttcattaca

SEQ ID NO: 4362 - DNA, 15 bp, Homo sapiens
gaattatttcattac

SEQ ID NO: 4363 - DNA, 15 bp, Homo sapiens
tgaattatttcatta

SEQ ID NO: 4364 - DNA, 15 bp, Homo sapiens
atgaattatttcatt

SEQ ID NO: 4365 - DNA, 15 bp, Homo sapiens
aatgaattatttcat

SEQ ID NO: 4366 - DNA, 15 bp, Homo sapiens
taatgaattatttca

SEQ ID NO: 4367 - DNA, 15 bp, Homo sapiens
ataatgaattatttc

SEQ ID NO: 4368 - DNA, 15 bp, Homo sapiens
cataatgaattattt

SEQ ID NO: 4369 - DNA, 15 bp, Homo sapiens
acataatgaattatt

SEQ ID NO: 4370 - DNA, 15 bp, Homo sapiens
tacataatgaattat

SEQ ID NO: 4371 - DNA, 15 bp, Homo sapiens
ttacataatgaatta

SEQ ID NO: 4372 - DNA, 15 bp, Homo sapiens
attacataatgaatt

SEQ ID NO: 4373 - DNA, 15 bp, Homo sapiens
aattacataatgaat

SEQ ID NO: 4374 - DNA, 15 bp, Homo sapiens
taattacataatgaa

SEQ ID NO: 4375 - DNA, 15 bp, Homo sapiens
ttaattacataatga

SEQ ID NO: 4376 - DNA, 15 bp, Homo sapiens
attaattacataatg

SEQ ID NO: 4377 - DNA, 15 bp, Homo sapiens
aattaattacataat

SEQ ID NO: 4378 - DNA, 15 bp, Homo sapiens
caattaattacataa

SEQ ID NO: 4379 - DNA, 15 bp, Homo sapiens
gcaattaattacata

SEQ ID NO: 4380 - DNA, 15 bp, Homo sapiens
agcaattaattacat

SEQ ID NO: 4381 - DNA, 15 bp, Homo sapiens
aagcaattaattaca

SEQ ID NO: 4382 - DNA, 15 bp, Homo sapiens
taagcaattaattac

SEQ ID NO: 4383 - DNA, 15 bp, Homo sapiens
ctaagcaattaatta

SEQ ID NO: 4384 - DNA, 15 bp, Homo sapiens
actaagcaattaatt

SEQ ID NO: 4385 - DNA, 15 bp, Homo sapiens
cactaagcaattaat

SEQ ID NO: 4386 - DNA, 15 bp, Homo sapiens
acactaagcaattaa

SEQ ID NO: 4387 - DNA, 15 bp, Homo sapiens
cacactaagcaatta

SEQ ID NO: 4388 - DNA, 15 bp, Homo sapiens
gcacactaagcaatt

SEQ ID NO: 4389 - DNA, 15 bp, Homo sapiens
tgcacactaagcaat

SEQ ID NO: 4390 - DNA, 15 bp, Homo sapiens
atgcacactaagcaa

SEQ ID NO: 4391 - DNA, 15 bp, Homo sapiens
tatgcacactaagca

SEQ ID NO: 4392 - DNA, 15 bp, Homo sapiens
ttatgcacactaagc

SEQ ID NO: 4393 - DNA, 15 bp, Homo sapiens
cttatgcacactaag

SEQ ID NO: 4394 - DNA, 15 bp, Homo sapiens
gcttatgcacactaa

SEQ ID NO: 4395 - DNA, 15 bp, Homo sapiens
cgcttatgcacacta

SEQ ID NO: 4396 - DNA, 15 bp, Homo sapiens
gcgcttatgcacact

SEQ ID NO: 4397 - DNA, 15 bp, Homo sapiens
ggcgcttatgcacac

SEQ ID NO: 4398 - DNA, 15 bp, Homo sapiens
cggcgcttatgcaca

SEQ ID NO: 4399 - DNA, 15 bp, Homo sapiens
acggcgcttatgcac

SEQ ID NO: 4400 - DNA, 15 bp, Homo sapiens
tacggcgcttatgca

SEQ ID NO: 4401 - DNA, 15 bp, Homo sapiens
ttacggcgcttatgc

SEQ ID NO: 4402 - DNA, 15 bp, Homo sapiens
attacggcgcttatg

SEQ ID NO: 4403 - DNA, 15 bp, Homo sapiens
cattacggcgcttat

SEQ ID NO: 4404 - DNA, 15 bp, Homo sapiens
ccattacggcgctta

SEQ ID NO: 4405 - DNA, 15 bp, Homo sapiens
gccattacggcgctt

SEQ ID NO: 4406 - DNA, 15 bp, Homo sapiens
tgccattacggcgct

SEQ ID NO: 4407 - DNA, 15 bp, Homo sapiens
ctgccattacggcgc

SEQ ID NO: 4408 - DNA, 15 bp, Homo sapiens
tctgccattacggcg

SEQ ID NO: 4409 - DNA, 15 bp, Homo sapiens
ctctgccattacggc

SEQ ID NO: 4410 - DNA, 15 bp, Homo sapiens
cctctgccattacgg

SEQ ID NO: 4411 - DNA, 15 bp, Homo sapiens
gcctctgccattacg

SEQ ID NO: 4412 - DNA, 15 bp, Homo sapiens
agcctctgccattac

SEQ ID NO: 4413 - DNA, 15 bp, Homo sapiens
tagcctctgccatta

SEQ ID NO: 4414 - DNA, 15 bp, Homo sapiens
atagcctctgccatt

SEQ ID NO: 4415 - DNA, 15 bp, Homo sapiens
catagcctctgccat

SEQ ID NO: 4416 - DNA, 15 bp, Homo sapiens
acatagcctctgcca

SEQ ID NO: 4417 - DNA, 15 bp, Homo sapiens
gacatagcctctgcc

SEQ ID NO: 4418 - DNA, 15 bp, Homo sapiens
agacatagcctctgc

SEQ ID NO: 4419 - DNA, 15 bp, Homo sapiens
gagacatagcctctg

SEQ ID NO: 4420 - DNA, 15 bp, Homo sapiens
agagacatagcctct

SEQ ID NO: 4421 - DNA, 15 bp, Homo sapiens
aagagacatagcctc

SEQ ID NO: 4422 - DNA, 15 bp, Homo sapiens
caagagacatagcct

SEQ ID NO: 4423 - DNA, 15 bp, Homo sapiens
acaagagacatagcc

SEQ ID NO: 4424 - DNA, 15 bp, Homo sapiens
aacaagagacatagc

SEQ ID NO: 4425 - DNA, 15 bp, Homo sapiens
gaacaagagacatag

SEQ ID NO: 4426 - DNA, 15 bp, Homo sapiens
tgaacaagagacata

SEQ ID NO: 4427 - DNA, 15 bp, Homo sapiens
atgaacaagagacat

SEQ ID NO: 4428 - DNA, 15 bp, Homo sapiens
tatgaacaagagaca

SEQ ID NO: 4429 - DNA, 15 bp, Homo sapiens
ctatgaacaagagac

SEQ ID NO: 4430 - DNA, 15 bp, Homo sapiens
actatgaacaagaga

SEQ ID NO: 4431 - DNA, 15 bp, Homo sapiens
gactatgaacaagag

SEQ ID NO: 4432 - DNA, 15 bp, Homo sapiens
tgactatgaacaaga

SEQ ID NO: 4433 - DNA, 15 bp, Homo sapiens
atgactatgaacaag

SEQ ID NO: 4434 - DNA, 15 bp, Homo sapiens
tatgactatgaacaa

SEQ ID NO: 4435 - DNA, 15 bp, Homo sapiens
ttatgactatgaaca

SEQ ID NO: 4436 - DNA, 15 bp, Homo sapiens
gttatgactatgaac

SEQ ID NO: 4437 - DNA, 15 bp, Homo sapiens
tgttatgactatgaa

SEQ ID NO: 4438 - DNA, 15 bp, Homo sapiens
gtgttatgactatga

SEQ ID NO: 4439 - DNA, 15 bp, Homo sapiens
ggtgttatgactatg

SEQ ID NO: 4440 - DNA, 15 bp, Homo sapiens
tggtgttatgactat

SEQ ID NO: 4441 - DNA, 15 bp, Homo sapiens
atggtgttatgacta

SEQ ID NO: 4442 - DNA, 15 bp, Homo sapiens
aatggtgttatgact

SEQ ID NO: 4443 - DNA, 15 bp, Homo sapiens
caatggtgttatgac

SEQ ID NO: 4444 - DNA, 15 bp, Homo sapiens
gcaatggtgttatga

SEQ ID NO: 4445 - DNA, 15 bp, Homo sapiens
ggcaatggtgttatg

SEQ ID NO: 4446 - DNA, 15 bp, Homo sapiens
aggcaatggtgttat

SEQ ID NO: 4447 - DNA, 15 bp, Homo sapiens
caggcaatggtgtta

SEQ ID NO: 4448 - DNA, 15 bp, Homo sapiens
ccaggcaatggtgtt

SEQ ID NO: 4449 - DNA, 15 bp, Homo sapiens
gccaggcaatggtgt

SEQ ID NO: 4450 - DNA, 15 bp, Homo sapiens
agccaggcaatggtg

SEQ ID NO: 4451 - DNA, 15 bp, Homo sapiens
aagccaggcaatggt

SEQ ID NO: 4452 - DNA, 15 bp, Homo sapiens
caagccaggcaatgg

SEQ ID NO: 4453 - DNA, 15 bp, Homo sapiens
ccaagccaggcaatg

SEQ ID NO: 4454 - DNA, 15 bp, Homo sapiens
accaagccaggcaat

SEQ ID NO: 4455 - DNA, 15 bp, Homo sapiens
caccaagccaggcaa

SEQ ID NO: 4456 - DNA, 15 bp, Homo sapiens
gcaccaagccaggca

SEQ ID NO: 4457 - DNA, 15 bp, Homo sapiens
agcaccaagccaggc

SEQ ID NO: 4458 - DNA, 15 bp, Homo sapiens
aagcaccaagccagg

SEQ ID NO: 4459 - DNA, 15 bp, Homo sapiens
aaagcaccaagccag

SEQ ID NO: 4460 - DNA, 15 bp, Homo sapiens
taaagcaccaagcca

SEQ ID NO: 4461 - DNA, 15 bp, Homo sapiens
gtaaagcaccaagcc

SEQ ID NO: 4462 - DNA, 15 bp, Homo sapiens
tgtaaagcaccaagc

SEQ ID NO: 4463 - DNA, 15 bp, Homo sapiens
gtgtaaagcaccaag

SEQ ID NO: 4464 - DNA, 15 bp, Homo sapiens
cgtgtaaagcaccaa

SEQ ID NO: 4465 - DNA, 15 bp, Homo sapiens
acgtgtaaagcacca

SEQ ID NO: 4466 - DNA, 15 bp, Homo sapiens
cacgtgtaaagcacc

SEQ ID NO: 4467 - DNA, 15 bp, Homo sapiens
ccacgtgtaaagcac

SEQ ID NO: 4468 - DNA, 15 bp, Homo sapiens
accacgtgtaaagca

SEQ ID NO: 4469 - DNA, 15 bp, Homo sapiens
taccacgtgtaaagc

SEQ ID NO: 4470 - DNA, 15 bp, Homo sapiens
ctaccacgtgtaaag

SEQ ID NO: 4471 - DNA, 15 bp, Homo sapiens
cctaccacgtgtaaa

SEQ ID NO: 4472 - DNA, 15 bp, Homo sapiens
gcctaccacgtgtaa

SEQ ID NO: 4473 - DNA, 15 bp, Homo sapiens
tgcctaccacgtgta

SEQ ID NO: 4474 - DNA, 15 bp, Homo sapiens
gtgcctaccacgtgt

SEQ ID NO: 4475 - DNA, 15 bp, Homo sapiens
agtgcctaccacgtg

SEQ ID NO: 4476 - DNA, 15 bp, Homo sapiens
gagtgcctaccacgt

SEQ ID NO: 4477 - DNA, 15 bp, Homo sapiens
tgagtgcctaccacg

SEQ ID NO: 4478 - DNA, 15 bp, Homo sapiens
ttgagtgcctaccac

SEQ ID NO: 4479 - DNA, 15 bp, Homo sapiens
attgagtgcctacca

SEQ ID NO: 4480 - DNA, 15 bp, Homo sapiens
tattgagtgcctacc

SEQ ID NO: 4481 - DNA, 15 bp, Homo sapiens
ttattgagtgcctac

SEQ ID NO: 4482 - DNA, 15 bp, Homo sapiens
tttattgagtgccta

SEQ ID NO: 4483 - DNA, 15 bp, Homo sapiens
atttattgagtgcct

SEQ ID NO: 4484 - DNA, 15 bp, Homo sapiens
tatttattgagtgcc

SEQ ID NO: 4485 - DNA, 15 bp, Homo sapiens
atatttattgagtgc

SEQ ID NO: 4486 - DNA, 15 bp, Homo sapiens
aatatttattgagtg

SEQ ID NO: 4487 - DNA, 15 bp, Homo sapiens
aaatatttattgagt

SEQ ID NO: 4488 - DNA, 15 bp, Homo sapiens
ccaaatatttattga

SEQ ID NO: 4489 - DNA, 15 bp, Homo sapiens
accaaatatttattg

SEQ ID NO: 4490 - DNA, 15 bp, Homo sapiens
caccaaatatttatt

SEQ ID NO: 4491 - DNA, 15 bp, Homo sapiens
tcaccaaatatttat

SEQ ID NO: 4492 - DNA, 15 bp, Homo sapiens
ttcaccaaatattta

SEQ ID NO: 4493 - DNA, 15 bp, Homo sapiens
attcaccaaatattt

SEQ ID NO: 4494 - DNA, 15 bp, Homo sapiens
cattcaccaaatatt

SEQ ID NO: 4495 - DNA, 15 bp, Homo sapiens
tcattcaccaaatat

SEQ ID NO: 4496 - DNA, 15 bp, Homo sapiens
ttcattcaccaaata

SEQ ID NO: 4497 - DNA, 15 bp, Homo sapiens
attcattcaccaaat

SEQ ID NO: 4498 - DNA, 15 bp, Homo sapiens
tattcattcaccaaa

SEQ ID NO: 4499 - DNA, 15 bp, Homo sapiens
ctattcattcaccaa

SEQ ID NO: 4500 - DNA, 15 bp, Homo sapiens
actattcattcacca

SEQ ID NO: 4501 - DNA, 15 bp, Homo sapiens
aactattcattcacc

SEQ ID NO: 4502 - DNA, 15 bp, Homo sapiens
taactattcattcac

SEQ ID NO: 4503 - DNA, 15 bp, Homo sapiens
gtaactattcattca

SEQ ID NO: 4504 - DNA, 15 bp, Homo sapiens
agtaactattcattc

SEQ ID NO: 4505 - DNA, 15 bp, Homo sapiens
tagtaactattcatt

SEQ ID NO: 4506 - DNA, 15 bp, Homo sapiens
gtagtaactattcat

SEQ ID NO: 4507 - DNA, 15 bp, Homo sapiens
cgtagtaactattca

SEQ ID NO: 4508 - DNA, 15 bp, Homo sapiens
tcgtagtaactattc

SEQ ID NO: 4509 - DNA, 15 bp, Homo sapiens
ttcgtagtaactatt

SEQ ID NO: 4510 - DNA, 15 bp, Homo sapiens
attcgtagtaactat

SEQ ID NO: 4511 - DNA, 15 bp, Homo sapiens
tattcgtagtaacta

SEQ ID NO: 4512 - DNA, 15 bp, Homo sapiens
ttattcgtagtaact

SEQ ID NO: 4513 - DNA, 15 bp, Homo sapiens
gttattcgtagtaac

SEQ ID NO: 4514 - DNA, 15 bp, Homo sapiens
agttattcgtagtaa

SEQ ID NO: 4515 - DNA, 15 bp, Homo sapiens
tagttattcgtagta

SEQ ID NO: 4516 - DNA, 15 bp, Homo sapiens
atagttattcgtagt

SEQ ID NO: 4517 - DNA, 15 bp, Homo sapiens
tatagttattcgtag

SEQ ID NO: 4518 - DNA, 15 bp, Homo sapiens
atatagttattcgta

SEQ ID NO: 4519 - DNA, 15 bp, Homo sapiens
tatatagttattcgt

SEQ ID NO: 4520 - DNA, 15 bp, Homo sapiens
ttatatagttattcg

SEQ ID NO: 4521 - DNA, 15 bp, Homo sapiens
tttatatagttattc

SEQ ID NO: 4522 - DNA, 15 bp, Homo sapiens
ttttatatagttatt

SEQ ID NO: 4523 - DNA, 15 bp, Homo sapiens
attttatatagttat

SEQ ID NO: 4524 - DNA, 15 bp, Homo sapiens
tattttatatagtta

SEQ ID NO: 4525 - DNA, 15 bp, Homo sapiens
atattttatatagtt

SEQ ID NO: 4526 - DNA, 15 bp, Homo sapiens
tatattttatatagt

SEQ ID NO: 4527 - DNA, 15 bp, Homo sapiens
atatattttatatag

SEQ ID NO: 4528 - DNA, 15 bp, Homo sapiens
tatatattttatata

SEQ ID NO: 4529 - DNA, 15 bp, Homo sapiens
ttatatattttatat

SEQ ID NO: 4530 - DNA, 15 bp, Homo sapiens
tttatatattttata

SEQ ID NO: 4531 - DNA, 15 bp, Homo sapiens
atttatatattttat

SEQ ID NO: 4532 - DNA, 15 bp, Homo sapiens
tatttatatatttta

SEQ ID NO: 4533 - DNA, 15 bp, Homo sapiens
gtatttatatatttt

SEQ ID NO: 4534 - DNA, 15 bp, Homo sapiens
tgtatttatatattt

SEQ ID NO: 4535 - DNA, 15 bp, Homo sapiens
atgtatttatatatt

SEQ ID NO: 4536 - DNA, 15 bp, Homo sapiens
aatgtatttatatat

SEQ ID NO: 4537 - DNA, 15 bp, Homo sapiens
aaatgtatttatata

SEQ ID NO: 4538 - DNA, 15 bp, Homo sapiens
aaaatgtatttatat

SEQ ID NO: 4539 - DNA, 15 bp, Homo sapiens
aaaaatgtatttata

SEQ ID NO: 4540 - DNA, 15 bp, Homo sapiens
aaaaaatgtatttat

SEQ ID NO: 4541 - DNA, 15 bp, Homo sapiens
gaaaaaatgtattta

SEQ ID NO: 4542 - DNA, 15 bp, Homo sapiens
tgaaaaaatgtattt

SEQ ID NO: 4543 - DNA, 15 bp, Homo sapiens
ttgaaaaaatgtatt

SEQ ID NO: 4544 - DNA, 15 bp, Homo sapiens
cttgaaaaaatgtat

SEQ ID NO: 4545 - DNA, 15 bp, Homo sapiens
acttgaaaaaatgta

SEQ ID NO: 4546 - DNA, 15 bp, Homo sapiens
gacttgaaaaaatgt

SEQ ID NO: 4547 - DNA, 15 bp, Homo sapiens
tgacttgaaaaaatg

SEQ ID NO: 4548 - DNA, 15 bp, Homo sapiens
ctgacttgaaaaaat

SEQ ID NO: 4549 - DNA, 15 bp, Homo sapiens
actgacttgaaaaaa

SEQ ID NO: 4550 - DNA, 15 bp, Homo sapiens
tactgacttgaaaaa

SEQ ID NO: 4551 - DNA, 15 bp, Homo sapiens
gtactgacttgaaaa

SEQ ID NO: 4552 - DNA, 15 bp, Homo sapiens
agtactgacttgaaa

SEQ ID NO: 4553 - DNA, 15 bp, Homo sapiens
aagtactgacttgaa

SEQ ID NO: 4554 - DNA, 15 bp, Homo sapiens
aaagtactgacttga

SEQ ID NO: 4555 - DNA, 15 bp, Homo sapiens
gaaagtactgacttg

SEQ ID NO: 4556 - DNA, 15 bp, Homo sapiens
ggaaagtactgactt

SEQ ID NO: 4557 - DNA, 15 bp, Homo sapiens
gggaaagtactgact

SEQ ID NO: 4558 - DNA, 15 bp, Homo sapiens
agggaaagtactgac

SEQ ID NO: 4559 - DNA, 15 bp, Homo sapiens
aagggaaagtactga

SEQ ID NO: 4560 - DNA, 15 bp, Homo sapiens
aaagggaaagtactg

SEQ ID NO: 4561 - DNA, 15 bp, Homo sapiens
aaaagggaaagtact

SEQ ID NO: 4562 - DNA, 15 bp, Homo sapiens
gaaaagggaaagtac

SEQ ID NO: 4563 - DNA, 15 bp, Homo sapiens
ggaaaagggaaagta

SEQ ID NO: 4564 - DNA, 15 bp, Homo sapiens
aggaaaagggaaagt

SEQ ID NO: 4565 - DNA, 15 bp, Homo sapiens
aaggaaaagggaaag

SEQ ID NO: 4566 - DNA, 15 bp, Homo sapiens
aaaggaaaagggaaa

SEQ ID NO: 4567 - DNA, 15 bp, Homo sapiens
aaaaggaaaagggaa

SEQ ID NO: 4568 - DNA, 15 bp, Homo sapiens
taaaaggaaaaggga

SEQ ID NO: 4569 - DNA, 15 bp, Homo sapiens
ctaaaaggaaaaggg

SEQ ID NO: 4570 - DNA, 15 bp, Homo sapiens
cctaaaaggaaaagg

SEQ ID NO: 4571 - DNA, 15 bp, Homo sapiens
acctaaaaggaaaag

SEQ ID NO: 4572 - DNA, 15 bp, Homo sapiens
tacctaaaaggaaaa

SEQ ID NO: 4573 - DNA, 15 bp, Homo sapiens
atacctaaaaggaaa

SEQ ID NO: 4574 - DNA, 15 bp, Homo sapiens
aatacctaaaaggaa

SEQ ID NO: 4575 - DNA, 15 bp, Homo sapiens
caatacctaaaagga

SEQ ID NO: 4576 - DNA, 15 bp, Homo sapiens
tcaatacctaaaagg

SEQ ID NO: 4577 - DNA, 15 bp, Homo sapiens
atcaatacctaaaag

SEQ ID NO: 4578 - DNA, 15 bp, Homo sapiens
catcaatacctaaaa

SEQ ID NO: 4579 - DNA, 15 bp, Homo sapiens
acatcaatacctaaa

SEQ ID NO: 4580 - DNA, 15 bp, Homo sapiens
gacatcaatacctaa

SEQ ID NO: 4581 - DNA, 15 bp, Homo sapiens
tgacatcaataccta

SEQ ID NO: 4582 - DNA, 15 bp, Homo sapiens
ttgacatcaatacct

SEQ ID NO: 4583 - DNA, 15 bp, Homo sapiens
cttgacatcaatacc

SEQ ID NO: 4584 - DNA, 15 bp, Homo sapiens
gcttgacatcaatac

SEQ ID NO: 4585 - DNA, 15 bp, Homo sapiens
agcttgacatcaata

SEQ ID NO: 4586 - DNA, 15 bp, Homo sapiens
cagcttgacatcaat

SEQ ID NO: 4587 - DNA, 15 bp, Homo sapiens
tcagcttgacatcaa

SEQ ID NO: 4588 - DNA, 15 bp, Homo sapiens
ttcagcttgacatca

SEQ ID NO: 4589 - DNA, 15 bp, Homo sapiens
gttcagcttgacatc

SEQ ID NO: 4590 - DNA, 15 bp, Homo sapiens
ggttcagcttgacat

SEQ ID NO: 4591 - DNA, 15 bp, Homo sapiens
tggttcagcttgaca

SEQ ID NO: 4592 - DNA, 15 bp, Homo sapiens
atggttcagcttgac

SEQ ID NO: 4593 - DNA, 15 bp, Homo sapiens
gatggttcagcttga

SEQ ID NO: 4594 - DNA, 15 bp, Homo sapiens
cgatggttcagcttg

SEQ ID NO: 4595 - DNA, 15 bp, Homo sapiens
acgatggttcagctt

SEQ ID NO: 4596 - DNA, 15 bp, Homo sapiens
tacgatggttcagct

SEQ ID NO: 4597 - DNA, 15 bp, Homo sapiens
ctacgatggttcagc

SEQ ID NO: 4598 - DNA, 15 bp, Homo sapiens
cctacgatggttcag

SEQ ID NO: 4599 - DNA, 15 bp, Homo sapiens
tcctacgatggttca

SEQ ID NO: 4600 - DNA, 15 bp, Homo sapiens
ttcctacgatggttc

SEQ ID NO: 4601 - DNA, 15 bp, Homo sapiens
cttcctacgatggtt

SEQ ID NO: 4602 - DNA, 15 bp, Homo sapiens
acttcctacgatggt

SEQ ID NO: 4603 - DNA, 15 bp, Homo sapiens
aacttcctacgatgg

SEQ ID NO: 4604 - DNA, 15 bp, Homo sapiens
caacttcctacgatg

SEQ ID NO: 4605 - DNA, 15 bp, Homo sapiens
tcaacttcctacgat

SEQ ID NO: 4606 - DNA, 15 bp, Homo sapiens
ttcaacttcctacga

SEQ ID NO: 4607 - DNA, 15 bp, Homo sapiens
tttcaacttcctacg

SEQ ID NO: 4608 - DNA, 15 bp, Homo sapiens
ctttcaacttcctac

SEQ ID NO: 4609 - DNA, 15 bp, Homo sapiens
gctttcaacttccta

SEQ ID NO: 4610 - DNA, 15 bp, Homo sapiens
ggctttcaacttcct

SEQ ID NO: 4611 - DNA, 15 bp, Homo sapiens
aggctttcaacttcc

SEQ ID NO: 4612 - DNA, 15 bp, Homo sapiens
aaggctttcaacttc

SEQ ID NO: 4613 - DNA, 15 bp, Homo sapiens
taaggctttcaactt

SEQ ID NO: 4614 - DNA, 15 bp, Homo sapiens
ctaaggctttcaact

SEQ ID NO: 4615 - DNA, 15 bp, Homo sapiens
tctaaggctttcaac

SEQ ID NO: 4616 - DNA, 15 bp, Homo sapiens
ttctaaggctttcaa

SEQ ID NO: 4617 - DNA, 15 bp, Homo sapiens
tttctaaggctttca

SEQ ID NO: 4618 - DNA, 15 bp, Homo sapiens
ctttctaaggctttc

SEQ ID NO: 4619 - DNA, 15 bp, Homo sapiens
tctttctaaggcttt

SEQ ID NO: 4620 - DNA, 15 bp, Homo sapiens
ctctttctaaggctt

SEQ ID NO: 4621 - DNA, 15 bp, Homo sapiens
cctctttctaaggct

SEQ ID NO: 4622 - DNA, 15 bp, Homo sapiens
tcctctttctaaggc

SEQ ID NO: 4623 - DNA, 15 bp, Homo sapiens
gtcctctttctaagg

SEQ ID NO: 4624 - DNA, 15 bp, Homo sapiens
agtcctctttctaag

SEQ ID NO: 4625 - DNA, 15 bp, Homo sapiens
aagtcctctttctaa

SEQ ID NO: 4626 - DNA, 15 bp, Homo sapiens
caagtcctctttcta

SEQ ID NO: 4627 - DNA, 15 bp, Homo sapiens
ccaagtcctctttct

SEQ ID NO: 4628 - DNA, 15 bp, Homo sapiens
accaagtcctctttc

SEQ ID NO: 4629 - DNA, 15 bp, Homo sapiens
taccaagtcctcttt

SEQ ID NO: 4630 - DNA, 15 bp, Homo sapiens
ttaccaagtcctctt

SEQ ID NO: 4631 - DNA, 15 bp, Homo sapiens
tttaccaagtcctct

SEQ ID NO: 4632 - DNA, 15 bp, Homo sapiens
ctttaccaagtcctc

SEQ ID NO: 4633 - DNA, 15 bp, Homo sapiens
actttaccaagtcct

SEQ ID NO: 4634 - DNA, 15 bp, Homo sapiens
aactttaccaagtcc

SEQ ID NO: 4635 - DNA, 15 bp, Homo sapiens
aaactttaccaagtc

SEQ ID NO: 4636 - DNA, 15 bp, Homo sapiens
aaaactttaccaagt

SEQ ID NO: 4637 - DNA, 15 bp, Homo sapiens
aaaaactttaccaag

SEQ ID NO: 4638 - DNA, 15 bp, Homo sapiens
caaaaactttaccaa

SEQ ID NO: 4639 - DNA, 15 bp, Homo sapiens
ccaaaaactttacca

SEQ ID NO: 4640 - DNA, 15 bp, Homo sapiens
tccaaaaactttacc

SEQ ID NO: 4641 - DNA, 15 bp, Homo sapiens
atccaaaaactttac

SEQ ID NO: 4642 - DNA, 15 bp, Homo sapiens
aatccaaaaacttta

SEQ ID NO: 4643 - DNA, 15 bp, Homo sapiens
taatccaaaaacttt

SEQ ID NO: 4644 - DNA, 15 bp, Homo sapiens
ataatccaaaaactt

SEQ ID NO: 4645 - DNA, 15 bp, Homo sapiens
gataatccaaaaact

SEQ ID NO: 4646 - DNA, 15 bp, Homo sapiens
agataatccaaaaac

SEQ ID NO: 4647 - DNA, 15 bp, Homo sapiens
aagataatccaaaaa

SEQ ID NO: 4648 - DNA, 15 bp, Homo sapiens
caagataatccaaaa

SEQ ID NO: 4649 - DNA, 15 bp, Homo sapiens
tcaagataatccaaa

SEQ ID NO: 4650 - DNA, 15 bp, Homo sapiens
ttcaagataatccaa

SEQ ID NO: 4651 - DNA, 15 bp, Homo sapiens
tttcaagataatcca

SEQ ID NO: 4652 - DNA, 15 bp, Homo sapiens
gtttcaagataatcc

SEQ ID NO: 4653 - DNA, 15 bp, Homo sapiens
agtttcaagataatc

SEQ ID NO: 4654 - DNA, 15 bp, Homo sapiens
gagtttcaagataat

SEQ ID NO: 4655 - DNA, 15 bp, Homo sapiens
agagtttcaagataa

SEQ ID NO: 4656 - DNA, 15 bp, Homo sapiens
cagagtttcaagata

SEQ ID NO: 4657 - DNA, 15 bp, Homo sapiens
ccagagtttcaagat

SEQ ID NO: 4658 - DNA, 15 bp, Homo sapiens
gccagagtttcaaga

SEQ ID NO: 4659 - DNA, 15 bp, Homo sapiens
tgccagagtttcaag

SEQ ID NO: 4660 - DNA, 15 bp, Homo sapiens
ttgccagagtttcaa

SEQ ID NO: 4661 - DNA, 15 bp, Homo sapiens
cttgccagagtttca

SEQ ID NO: 4662 - DNA, 15 bp, Homo sapiens
tcttgccagagtttc

SEQ ID NO: 4663 - DNA, 15 bp, Homo sapiens
atcttgccagagttt

SEQ ID NO: 4664 - DNA, 15 bp, Homo sapiens
catcttgccagagtt

SEQ ID NO: 4665 - DNA, 15 bp, Homo sapiens
ccatcttgccagagt

SEQ ID NO: 4666 - DNA, 15 bp, Homo sapiens
gccatcttgccagag

SEQ ID NO: 4667 - DNA, 15 bp, Homo sapiens
ggccatcttgccaga

SEQ ID NO: 4668 - DNA, 15 bp, Homo sapiens
tggccatcttgccag

SEQ ID NO: 4669 - DNA, 15 bp, Homo sapiens
ttggccatcttgcca

SEQ ID NO: 4670 - DNA, 15 bp, Homo sapiens
cttggccatcttgcc

SEQ ID NO: 4671 - DNA, 15 bp, Homo sapiens
acttggccatcttgc

SEQ ID NO: 4672 - DNA, 15 bp, Homo sapiens
tacttggccatcttg

SEQ ID NO: 4673 - DNA, 15 bp, Homo sapiens
atacttggccatctt

SEQ ID NO: 4674 - DNA, 15 bp, Homo sapiens
catacttggccatct

SEQ ID NO: 4675 - DNA, 15 bp, Homo sapiens
ccatacttggccatc

SEQ ID NO: 4676 - DNA, 15 bp, Homo sapiens
tccatacttggccat

SEQ ID NO: 4677 - DNA, 15 bp, Homo sapiens
ctccatacttggcca

SEQ ID NO: 4678 - DNA, 15 bp, Homo sapiens
tctccatacttggcc

SEQ ID NO: 4679 - DNA, 15 bp, Homo sapiens
ttctccatacttggc

SEQ ID NO: 4680 - DNA, 15 bp, Homo sapiens
gttctccatacttgg

SEQ ID NO: 4681 - DNA, 15 bp, Homo sapiens
tgttctccatacttg

SEQ ID NO: 4682 - DNA, 15 bp, Homo sapiens
atgttctccatactt

SEQ ID NO: 4683 - DNA, 15 bp, Homo sapiens
catgttctccatact

SEQ ID NO: 4684 - DNA, 15 bp, Homo sapiens
tcatgttctccatac

SEQ ID NO: 4685 - DNA, 15 bp, Homo sapiens
ttcatgttctccata

SEQ ID NO: 4686 - DNA, 15 bp, Homo sapiens
cttcatgttctccat

SEQ ID NO: 4687 - DNA, 15 bp, Homo sapiens
gcttcatgttctcca

SEQ ID NO: 4688 - DNA, 15 bp, Homo sapiens
ggcttcatgttctcc

SEQ ID NO: 4689 - DNA, 15 bp, Homo sapiens
tggcttcatgttctc

SEQ ID NO: 4690 - DNA, 15 bp, Homo sapiens
ctggcttcatgttct

SEQ ID NO: 4691 - DNA, 15 bp, Homo sapiens
actggcttcatgttc

SEQ ID NO: 4692 - DNA, 15 bp, Homo sapiens
gactggcttcatgtt

SEQ ID NO: 4693 - DNA, 15 bp, Homo sapiens
ggactggcttcatgt

SEQ ID NO: 4694 - DNA, 15 bp, Homo sapiens
aggactggcttcatg

SEQ ID NO: 4695 - DNA, 15 bp, Homo sapiens
caggactggcttcat

SEQ ID NO: 4696 - DNA, 15 bp, Homo sapiens
tcaggactggcttca

SEQ ID NO: 4697 - DNA, 15 bp, Homo sapiens
gtcaggactggcttc

SEQ ID NO: 4698 - DNA, 15 bp, Homo sapiens
tgtcaggactggctt

SEQ ID NO: 4699 - DNA, 15 bp, Homo sapiens
ttgtcaggactggct

SEQ ID NO: 4700 - DNA, 15 bp, Homo sapiens
attgtcaggactggc

SEQ ID NO: 4701 - DNA, 15 bp, Homo sapiens
cattgtcaggactgg

SEQ ID NO: 4702 - DNA, 15 bp, Homo sapiens
ccattgtcaggactg

SEQ ID NO: 4703 - DNA, 15 bp, Homo sapiens
cccattgtcaggact

SEQ ID NO: 4704 - DNA, 15 bp, Homo sapiens
gcccattgtcaggac

SEQ ID NO: 4705 - DNA, 15 bp, Homo sapiens
tgcccattgtcagga

SEQ ID NO: 4706 - DNA, 15 bp, Homo sapiens
ctgcccattgtcagg

SEQ ID NO: 4707 - DNA, 15 bp, Homo sapiens
tctgcccattgtcag

SEQ ID NO: 4708 - DNA, 15 bp, Homo sapiens
ttctgcccattgtca

SEQ ID NO: 4709 - DNA, 15 bp, Homo sapiens
gttctgcccattgtc

SEQ ID NO: 4710 - DNA, 15 bp, Homo sapiens
cgttctgcccattgt

SEQ ID NO: 4711 - DNA, 15 bp, Homo sapiens
tcgttctgcccattg

SEQ ID NO: 4712 - DNA, 15 bp, Homo sapiens
ttcgttctgcccatt

SEQ ID NO: 4713 - DNA, 15 bp, Homo sapiens
attcgttctgcccat

SEQ ID NO: 4714 - DNA, 15 bp, Homo sapiens
aattcgttctgccca

SEQ ID NO: 4715 - DNA, 15 bp, Homo sapiens
gaattcgttctgccc

SEQ ID NO: 4716 - DNA, 15 bp, Homo sapiens
tgaattcgttctgcc

SEQ ID NO: 4717 - DNA, 15 bp, Homo sapiens
ctgaattcgttctgc

SEQ ID NO: 4718 - DNA, 15 bp, Homo sapiens
actgaattcgttctg

SEQ ID NO: 4719 - DNA, 15 bp, Homo sapiens
cactgaattcgttct

SEQ ID NO: 4720 - DNA, 15 bp, Homo sapiens
tcactgaattcgttc

SEQ ID NO: 4721 - DNA, 15 bp, Homo sapiens
atcactgaattcgtt

SEQ ID NO: 4722 - DNA, 15 bp, Homo sapiens
tatcactgaattcgt

SEQ ID NO: 4723 - DNA, 15 bp, Homo sapiens
atatcactgaattcg

SEQ ID NO: 4724 - DNA, 15 bp, Homo sapiens
gatatcactgaattc

SEQ ID NO: 4725 - DNA, 15 bp, Homo sapiens
tgatatcactgaatt

SEQ ID NO: 4726 - DNA, 15 bp, Homo sapiens
atgatatcactgaat

SEQ ID NO: 4727 - DNA, 15 bp, Homo sapiens
aatgatatcactgaa

SEQ ID NO: 4728 - DNA, 15 bp, Homo sapiens
taatgatatcactga

SEQ ID NO: 4729 - DNA, 15 bp, Homo sapiens
ttaatgatatcactg

SEQ ID NO: 4730 - DNA, 15 bp, Homo sapiens
cttaatgatatcact

SEQ ID NO: 4731 - DNA, 15 bp, Homo sapiens
acttaatgatatcac

SEQ ID NO: 4732 - DNA, 15 bp, Homo sapiens
gacttaatgatatca

SEQ ID NO: 4733 - DNA, 15 bp, Homo sapiens
ggacttaatgatatc

SEQ ID NO: 4734 - DNA, 15 bp, Homo sapiens
tggacttaatgatat

SEQ ID NO: 4735 - DNA, 15 bp, Homo sapiens
ctggacttaatgata

SEQ ID NO: 4736 - DNA, 15 bp, Homo sapiens
tctggacttaatgat

SEQ ID NO: 4737 - DNA, 15 bp, Homo sapiens
atctggacttaatga

SEQ ID NO: 4738 - DNA, 15 bp, Homo sapiens
gatctggacttaatg

SEQ ID NO: 4739 - DNA, 15 bp, Homo sapiens
agatctggacttaat

SEQ ID NO: 4740 - DNA, 15 bp, Homo sapiens
cagatctggacttaa

SEQ ID NO: 4741 - DNA, 15 bp, Homo sapiens
ccagatctggactta

SEQ ID NO: 4742 - DNA, 15 bp, Homo sapiens
accagatctggactt

SEQ ID NO: 4743 - DNA, 15 bp, Homo sapiens
taccagatctggact

SEQ ID NO: 4744 - DNA, 15 bp, Homo sapiens
ctaccagatctggac

SEQ ID NO: 4745 - DNA, 15 bp, Homo sapiens
cctaccagatctgga

SEQ ID NO: 4746 - DNA, 15 bp, Homo sapiens
acctaccagatctgg

SEQ ID NO: 4747 - DNA, 15 bp, Homo sapiens
tacctaccagatctg

SEQ ID NO: 4748 - DNA, 15 bp, Homo sapiens
ttacctaccagatct

SEQ ID NO: 4749 - DNA, 15 bp, Homo sapiens
tttacctaccagatc

SEQ ID NO: 4750 - DNA, 15 bp, Homo sapiens
ctttacctaccagat

SEQ ID NO: 4751 - DNA, 15 bp, Homo sapiens
cctttacctaccaga

SEQ ID NO: 4752 - DNA, 15 bp, Homo sapiens
tcctttacctaccag

SEQ ID NO: 4753 - DNA, 15 bp, Homo sapiens
ttcctttacctacca

SEQ ID NO: 4754 - DNA, 15 bp, Homo sapiens
cttcctttacctacc

SEQ ID NO: 4755 - DNA, 15 bp, Homo sapiens
gcttcctttacctac

SEQ ID NO: 4756 - DNA, 15 bp, Homo sapiens
agcttcctttaccta

SEQ ID NO: 4757 - DNA, 15 bp, Homo sapiens
gagcttcctttacct

SEQ ID NO: 4758 - DNA, 15 bp, Homo sapiens
tgagcttcctttacc

SEQ ID NO: 4759 - DNA, 15 bp, Homo sapiens
ttgagcttcctttac

SEQ ID NO: 4760 - DNA, 15 bp, Homo sapiens
cttgagcttccttta

SEQ ID NO: 4761 - DNA, 15 bp, Homo sapiens
tcttgagcttccttt

SEQ ID NO: 4762 - DNA, 15 bp, Homo sapiens
ttcttgagcttcctt

SEQ ID NO: 4763 - DNA, 15 bp, Homo sapiens
tttcttgagcttcct

SEQ ID NO: 4764 - DNA, 15 bp, Homo sapiens
ctttcttgagcttcc

SEQ ID NO: 4765 - DNA, 15 bp, Homo sapiens
gctttcttgagcttc

SEQ ID NO: 4766 - DNA, 15 bp, Homo sapiens
agctttcttgagctt

SEQ ID NO: 4767 - DNA, 15 bp, Homo sapiens
tagctttcttgagct

SEQ ID NO: 4768 - DNA, 15 bp, Homo sapiens
atagctttcttgagc

SEQ ID NO: 4769 - DNA, 15 bp, Homo sapiens
catagctttcttgag

SEQ ID NO: 4770 - DNA, 15 bp, Homo sapiens
ccatagctttcttga

SEQ ID NO: 4771 - DNA, 15 bp, Homo sapiens
tccatagctttcttg

SEQ ID NO: 4772 - DNA, 15 bp, Homo sapiens
atccatagctttctt

SEQ ID NO: 4773 - DNA, 15 bp, Homo sapiens
aatccatagctttct

SEQ ID NO: 4774 - DNA, 15 bp, Homo sapiens
aaatccatagctttc

SEQ ID NO: 4775 - DNA, 15 bp, Homo sapiens
aaaatccatagcttt

SEQ ID NO: 4776 - DNA, 15 bp, Homo sapiens
aaaaatccatagctt

SEQ ID NO: 4777 - DNA, 15 bp, Homo sapiens
taaaaatccatagct

SEQ ID NO: 4778 - DNA, 15 bp, Homo sapiens
ataaaaatccatagc

SEQ ID NO: 4779 - DNA, 15 bp, Homo sapiens
cataaaaatccatag

SEQ ID NO: 4780 - DNA, 15 bp, Homo sapiens
acataaaaatccata

SEQ ID NO: 4781 - DNA, 15 bp, Homo sapiens
tacataaaaatccat

SEQ ID NO: 4782 - DNA, 15 bp, Homo sapiens
atacataaaaatcca

SEQ ID NO: 4783 - DNA, 15 bp, Homo sapiens
aatacataaaaatcc

SEQ ID NO: 4784 - DNA, 15 bp, Homo sapiens
aaatacataaaaatc

SEQ ID NO: 4785 - DNA, 15 bp, Homo sapiens
taaatacataaaaat

SEQ ID NO: 4786 - DNA, 15 bp, Homo sapiens
ctaaatacataaaaa

SEQ ID NO: 4787 - DNA, 15 bp, Homo sapiens
tctaaatacataaaa

SEQ ID NO: 4788 - DNA, 15 bp, Homo sapiens
ttctaaatacataaa

SEQ ID NO: 4789 - DNA, 15 bp, Homo sapiens
tttctaaatacataa

SEQ ID NO: 4790 - DNA, 15 bp, Homo sapiens
ttttctaaatacata

SEQ ID NO: 4791 - DNA, 15 bp, Homo sapiens
gttttctaaatacat

SEQ ID NO: 4792 - DNA, 15 bp, Homo sapiens
ggttttctaaataca

SEQ ID NO: 4793 - DNA, 15 bp, Homo sapiens
aggttttctaaatac

SEQ ID NO: 4794 - DNA, 15 bp, Homo sapiens
taggttttctaaata

SEQ ID NO: 4795 - DNA, 15 bp, Homo sapiens
ataggttttctaaat

SEQ ID NO: 4796 - DNA, 15 bp, Homo sapiens
cataggttttctaaa

SEQ ID NO: 4797 - DNA, 15 bp, Homo sapiens
acataggttttctaa

SEQ ID NO: 4798 - DNA, 15 bp, Homo sapiens
aacataggttttcta

SEQ ID NO: 4799 - DNA, 15 bp, Homo sapiens
aaacataggttttct

SEQ ID NO: 4800 - DNA, 15 bp, Homo sapiens
gaaacataggttttc

SEQ ID NO: 4801 - DNA, 15 bp, Homo sapiens
agaaacataggtttt

SEQ ID NO: 4802 - DNA, 15 bp, Homo sapiens
aagaaacataggttt

SEQ ID NO: 4803 - DNA, 15 bp, Homo sapiens
caagaaacataggtt

SEQ ID NO: 4804 - DNA, 15 bp, Homo sapiens
ccaagaaacataggt

SEQ ID NO: 4805 - DNA, 15 bp, Homo sapiens
tccaagaaacatagg

SEQ ID NO: 4806 - DNA, 15 bp, Homo sapiens
atccaagaaacatag

SEQ ID NO: 4807 - DNA, 15 bp, Homo sapiens
aatccaagaaacata

SEQ ID NO: 4808 - DNA, 15 bp, Homo sapiens
caatccaagaaacat

SEQ ID NO: 4809 - DNA, 15 bp, Homo sapiens
tcaatccaagaaaca

SEQ ID NO: 4810 - DNA, 15 bp, Homo sapiens
atcaatccaagaaac

SEQ ID NO: 4811 - DNA, 15 bp, Homo sapiens
aatcaatccaagaaa

SEQ ID NO: 4812 - DNA, 15 bp, Homo sapiens
aaatcaatccaagaa

SEQ ID NO: 4813 - DNA, 15 bp, Homo sapiens
caaatcaatccaaga

SEQ ID NO: 4814 - DNA, 15 bp, Homo sapiens
gcaaatcaatccaag

SEQ ID NO: 4815 - DNA, 15 bp, Homo sapiens
tgcaaatcaatccaa

SEQ ID NO: 4816 - DNA, 15 bp, Homo sapiens
atgcaaatcaatcca

SEQ ID NO: 4817 - DNA, 15 bp, Homo sapiens
aatgcaaatcaatcc

SEQ ID NO: 4818 - DNA, 15 bp, Homo sapiens
caatgcaaatcaatc

SEQ ID NO: 4819 - DNA, 15 bp, Homo sapiens
acaatgcaaatcaat

SEQ ID NO: 4820 - DNA, 15 bp, Homo sapiens
aacaatgcaaatcaa

SEQ ID NO: 4821 - DNA, 15 bp, Homo sapiens
gaacaatgcaaatca

SEQ ID NO: 4822 - DNA, 15 bp, Homo sapiens
agaacaatgcaaatc

SEQ ID NO: 4823 - DNA, 15 bp, Homo sapiens
aagaacaatgcaaat

SEQ ID NO: 4824 - DNA, 15 bp, Homo sapiens
caagaacaatgcaaa

SEQ ID NO: 4825 - DNA, 15 bp, Homo sapiens
gcaagaacaatgcaa

SEQ ID NO: 4826 - DNA, 15 bp, Homo sapiens
tgcaagaacaatgca

SEQ ID NO: 4827 - DNA, 15 bp, Homo sapiens
ttgcaagaacaatgc

SEQ ID NO: 4828 - DNA, 15 bp, Homo sapiens
cttgcaagaacaatg

SEQ ID NO: 4829 - DNA, 15 bp, Homo sapiens
tcttgcaagaacaat

SEQ ID NO: 4830 - DNA, 15 bp, Homo sapiens
ttcttgcaagaacaa

SEQ ID NO: 4831 - DNA, 15 bp, Homo sapiens
gttcttgcaagaaca

SEQ ID NO: 4832 - DNA, 15 bp, Homo sapiens
agttcttgcaagaac

SEQ ID NO: 4833 - DNA, 15 bp, Homo sapiens
aagttcttgcaagaa

SEQ ID NO: 4834 - DNA, 15 bp, Homo sapiens
gaagttcttgcaaga

SEQ ID NO: 4835 - DNA, 15 bp, Homo sapiens
agaagttcttgcaag

SEQ ID NO: 4836 - DNA, 15 bp, Homo sapiens
aagaagttcttgcaa

SEQ ID NO: 4837 - DNA, 15 bp, Homo sapiens
caagaagttcttgca

SEQ ID NO: 4838 - DNA, 15 bp, Homo sapiens
ccaagaagttcttgc

SEQ ID NO: 4839 - DNA, 15 bp, Homo sapiens
tccaagaagttcttg

SEQ ID NO: 4840 - DNA, 15 bp, Homo sapiens
ctccaagaagttctt

SEQ ID NO: 4841 - DNA, 15 bp, Homo sapiens
cctccaagaagttct

SEQ ID NO: 4842 - DNA, 15 bp, Homo sapiens
acctccaagaagttc

SEQ ID NO: 4843 - DNA, 15 bp, Homo sapiens
cacctccaagaagtt

SEQ ID NO: 4844 - DNA, 15 bp, Homo sapiens
tcacctccaagaagt

SEQ ID NO: 4845 - DNA, 15 bp, Homo sapiens
ttcacctccaagaag

SEQ ID NO: 4846 - DNA, 15 bp, Homo sapiens
cttcacctccaagaa

SEQ ID NO: 4847 - DNA, 15 bp, Homo sapiens
acttcacctccaaga

SEQ ID NO: 4848 - DNA, 15 bp, Homo sapiens
aacttcacctccaag

SEQ ID NO: 4849 - DNA, 15 bp, Homo sapiens
gaacttcacctccaa

SEQ ID NO: 4850 - DNA, 15 bp, Homo sapiens
agaacttcacctcca

SEQ ID NO: 4851 - DNA, 15 bp, Homo sapiens
aagaacttcacctcc

SEQ ID NO: 4852 - DNA, 15 bp, Homo sapiens
aaagaacttcacctc

SEQ ID NO: 4853 - DNA, 15 bp, Homo sapiens
aaaagaacttcacct

SEQ ID NO: 4854 - DNA, 15 bp, Homo sapiens
taaaagaacttcacc

SEQ ID NO: 4855 - DNA, 15 bp, Homo sapiens
ttaaaagaacttcac

SEQ ID NO: 4856 - DNA, 15 bp, Homo sapiens
cttaaaagaacttca

SEQ ID NO: 4857 - DNA, 15 bp, Homo sapiens
tcttaaaagaacttc

SEQ ID NO: 4858 - DNA, 15 bp, Homo sapiens
ttcttaaaagaactt

SEQ ID NO: 4859 - DNA, 15 bp, Homo sapiens
tttcttaaaagaact

SEQ ID NO: 4860 - DNA, 15 bp, Homo sapiens
gtttcttaaaagaac

SEQ ID NO: 4861 - DNA, 15 bp, Homo sapiens
agtttcttaaaagaa

SEQ ID NO: 4862 - DNA, 15 bp, Homo sapiens
cagtttcttaaaaga

SEQ ID NO: 4863 - DNA, 15 bp, Homo sapiens
tcagtttcttaaaag

SEQ ID NO: 4864 - DNA, 15 bp, Homo sapiens
ttcagtttcttaaaa

SEQ ID NO: 4865 - DNA, 15 bp, Homo sapiens
attcagtttcttaaa

SEQ ID NO: 4866 - DNA, 15 bp, Homo sapiens
aattcagtttcttaa

SEQ ID NO: 4867 - DNA, 15 bp, Homo sapiens
gaattcagtttctta

SEQ ID NO: 4868 - DNA, 15 bp, Homo sapiens
agaattcagtttctt

SEQ ID NO: 4869 - DNA, 15 bp, Homo sapiens
cagaattcagtttct

SEQ ID NO: 4870 - DNA, 15 bp, Homo sapiens
tcagaattcagtttc

SEQ ID NO: 4871 - DNA, 15 bp, Homo sapiens
gtcagaattcagttt

SEQ ID NO: 4872 - DNA, 15 bp, Homo sapiens
tgtcagaattcagtt

SEQ ID NO: 4873 - DNA, 15 bp, Homo sapiens
ttgtcagaattcagt

SEQ ID NO: 4874 - DNA, 15 bp, Homo sapiens
tttgtcagaattcag

SEQ ID NO: 4875 - DNA, 15 bp, Homo sapiens
atttgtcagaattca

SEQ ID NO: 4876 - DNA, 15 bp, Homo sapiens
catttgtcagaattc

SEQ ID NO: 4877 - DNA, 15 bp, Homo sapiens
tcatttgtcagaatt

SEQ ID NO: 4878 - DNA, 15 bp, Homo sapiens
gtcatttgtcagaat

SEQ ID NO: 4879 - DNA, 15 bp, Homo sapiens
agtcatttgtcagaa

SEQ ID NO: 4880 - DNA, 15 bp, Homo sapiens
tagtcatttgtcaga

SEQ ID NO: 4881 - DNA, 15 bp, Homo sapiens
atagtcatttgtcag

SEQ ID NO: 4882 - DNA, 15 bp, Homo sapiens
tatagtcatttgtca

SEQ ID NO: 4883 - DNA, 15 bp, Homo sapiens
ttatagtcatttgtc

SEQ ID NO: 4884 - DNA, 15 bp, Homo sapiens
attatagtcatttgt

SEQ ID NO: 4885 - DNA, 15 bp, Homo sapiens
aattatagtcatttg

SEQ ID NO: 4886 - DNA, 15 bp, Homo sapiens
aaattatagtcattt

SEQ ID NO: 4887 - DNA, 15 bp, Homo sapiens
aaaattatagtcatt

SEQ ID NO: 4888 - DNA, 15 bp, Homo sapiens
caaaattatagtcat

SEQ ID NO: 4889 - DNA, 15 bp, Homo sapiens
acaaaattatagtca

SEQ ID NO: 4890 - DNA, 15 bp, Homo sapiens
tacaaaattatagtc

SEQ ID NO: 4891 - DNA, 15 bp, Homo sapiens
ttacaaaattatagt

SEQ ID NO: 4892 - DNA, 15 bp, Homo sapiens
tttacaaaattatag

SEQ ID NO: 4893 - DNA, 15 bp, Homo sapiens
ttttacaaaattata

SEQ ID NO: 4894 - DNA, 15 bp, Homo sapiens
cttttacaaaattat

SEQ ID NO: 4895 - DNA, 15 bp, Homo sapiens
ccttttacaaaatta

SEQ ID NO: 4896 - DNA, 15 bp, Homo sapiens
accttttacaaaatt

SEQ ID NO: 4897 - DNA, 15 bp, Homo sapiens
taccttttacaaaat

SEQ ID NO: 4898 - DNA, 15 bp, Homo sapiens
ataccttttacaaaa

SEQ ID NO: 4899 - DNA, 15 bp, Homo sapiens
tataccttttacaaa

SEQ ID NO: 4900 - DNA, 15 bp, Homo sapiens
atataccttttacaa

SEQ ID NO: 4901 - DNA, 15 bp, Homo sapiens
catataccttttaca

SEQ ID NO: 4902 - DNA, 15 bp, Homo sapiens
acatataccttttac

SEQ ID NO: 4903 - DNA, 15 bp, Homo sapiens
tacatatacctttta

SEQ ID NO: 4904 - DNA, 15 bp, Homo sapiens
ttacatatacctttt

SEQ ID NO: 4905 - DNA, 15 bp, Homo sapiens
tttacatataccttt

SEQ ID NO: 4906 - DNA, 15 bp, Homo sapiens
ttttacatatacctt

SEQ ID NO: 4907 - DNA, 15 bp, Homo sapiens
cttttacatatacct

SEQ ID NO: 4908 - DNA, 15 bp, Homo sapiens
ccttttacatatacc

SEQ ID NO: 4909 - DNA, 15 bp, Homo sapiens
accttttacatatac

SEQ ID NO: 4910 - DNA, 15 bp, Homo sapiens
taccttttacatata

SEQ ID NO: 4911 - DNA, 15 bp, Homo sapiens
ataccttttacatat

SEQ ID NO: 4912 - DNA, 15 bp, Homo sapiens
tataccttttacata

SEQ ID NO: 4913 - DNA, 15 bp, Homo sapiens
ttataccttttacat

SEQ ID NO: 4914 - DNA, 15 bp, Homo sapiens
attataccttttaca

SEQ ID NO: 4915 - DNA, 15 bp, Homo sapiens
tattataccttttac

SEQ ID NO: 4916 - DNA, 15 bp, Homo sapiens
atattatacctttta

SEQ ID NO: 4917 - DNA, 15 bp, Homo sapiens
gatattatacctttt

SEQ ID NO: 4918 - DNA, 15 bp, Homo sapiens
agatattataccttt

SEQ ID NO: 4919 - DNA, 15 bp, Homo sapiens
gagatattatacctt

SEQ ID NO: 4920 - DNA, 15 bp, Homo sapiens
agagatattatacct

SEQ ID NO: 4921 - DNA, 15 bp, Homo sapiens
cagagatattatacc

SEQ ID NO: 4922 - DNA, 15 bp, Homo sapiens
tcagagatattatac

SEQ ID NO: 4923 - DNA, 15 bp, Homo sapiens
ctcagagatattata

SEQ ID NO: 4924 - DNA, 15 bp, Homo sapiens
actcagagatattat

SEQ ID NO: 4925 - DNA, 15 bp, Homo sapiens
cactcagagatatta

SEQ ID NO: 4926 - DNA, 15 bp, Homo sapiens
acactcagagatatt

SEQ ID NO: 4927 - DNA, 15 bp, Homo sapiens
gacactcagagatat

SEQ ID NO: 4928 - DNA, 15 bp, Homo sapiens
ggacactcagagata

SEQ ID NO: 4929 - DNA, 15 bp, Homo sapiens
aggacactcagagat

SEQ ID NO: 4930 - DNA, 15 bp, Homo sapiens
taggacactcagaga

SEQ ID NO: 4931 - DNA, 15 bp, Homo sapiens
ataggacactcagag

SEQ ID NO: 4932 - DNA, 15 bp, Homo sapiens
gataggacactcaga

SEQ ID NO: 4933 - DNA, 15 bp, Homo sapiens
ggataggacactcag

SEQ ID NO: 4934 - DNA, 15 bp, Homo sapiens
aggataggacactca

SEQ ID NO: 4935 - DNA, 15 bp, Homo sapiens
aaggataggacactc

SEQ ID NO: 4936 - DNA, 15 bp, Homo sapiens
aaaggataggacact

SEQ ID NO: 4937 - DNA, 15 bp, Homo sapiens
gaaaggataggacac

SEQ ID NO: 4938 - DNA, 15 bp, Homo sapiens
agaaaggataggaca

SEQ ID NO: 4939 - DNA, 15 bp, Homo sapiens
gagaaaggataggac

SEQ ID NO: 4940 - DNA, 15 bp, Homo sapiens
tgagaaaggatagga

SEQ ID NO: 4941 - DNA, 15 bp, Homo sapiens
ttgagaaaggatagg

SEQ ID NO: 4942 - DNA, 15 bp, Homo sapiens
gttgagaaaggatag

SEQ ID NO: 4943 - DNA, 15 bp, Homo sapiens
ggttgagaaaggata

SEQ ID NO: 4944 - DNA, 15 bp, Homo sapiens
gggttgagaaaggat

SEQ ID NO: 4945 - DNA, 15 bp, Homo sapiens
tgggttgagaaagga

SEQ ID NO: 4946 - DNA, 15 bp, Homo sapiens
ttgggttgagaaagg

SEQ ID NO: 4947 - DNA, 15 bp, Homo sapiens
attgggttgagaaag

SEQ ID NO: 4948 - DNA, 15 bp, Homo sapiens
aattgggttgagaaa

SEQ ID NO: 4949 - DNA, 15 bp, Homo sapiens
aaattgggttgagaa

SEQ ID NO: 4950 - DNA, 15 bp, Homo sapiens
aaaattgggttgaga

SEQ ID NO: 4951 - DNA, 15 bp, Homo sapiens
caaaattgggttgag

SEQ ID NO: 4952 - DNA, 15 bp, Homo sapiens
acaaaattgggttga

SEQ ID NO: 4953 - DNA, 15 bp, Homo sapiens
cacaaaattgggttg

SEQ ID NO: 4954 - DNA, 15 bp, Homo sapiens
gcacaaaattgggtt

SEQ ID NO: 4955 - DNA, 15 bp, Homo sapiens
agcacaaaattgggt

SEQ ID NO: 4956 - DNA, 15 bp, Homo sapiens
aagcacaaaattggg

SEQ ID NO: 4957 - DNA, 15 bp, Homo sapiens
taagcacaaaattgg

SEQ ID NO: 4958 - DNA, 15 bp, Homo sapiens
ctaagcacaaaattg

SEQ ID NO: 4959 - DNA, 15 bp, Homo sapiens
actaagcacaaaatt

SEQ ID NO: 4960 - DNA, 15 bp, Homo sapiens
cactaagcacaaaat

SEQ ID NO: 4961 - DNA, 15 bp, Homo sapiens
tcactaagcacaaaa

SEQ ID NO: 4962 - DNA, 15 bp, Homo sapiens
ttcactaagcacaaa

SEQ ID NO: 4963 - DNA, 15 bp, Homo sapiens
tttcactaagcacaa

SEQ ID NO: 4964 - DNA, 15 bp, Homo sapiens
gtttcactaagcaca

SEQ ID NO: 4965 - DNA, 15 bp, Homo sapiens
agtttcactaagcac

SEQ ID NO: 4966 - DNA, 15 bp, Homo sapiens
cagtttcactaagca

SEQ ID NO: 4967 - DNA, 15 bp, Homo sapiens
gcagtttcactaagc

SEQ ID NO: 4968 - DNA, 15 bp, Homo sapiens
agcagtttcactaag

SEQ ID NO: 4969 - DNA, 15 bp, Homo sapiens
cagcagtttcactaa

SEQ ID NO: 4970 - DNA, 15 bp, Homo sapiens
gcagcagtttcacta

SEQ ID NO: 4971 - DNA, 15 bp, Homo sapiens
agcagcagtttcact

SEQ ID NO: 4972 - DNA, 15 bp, Homo sapiens
aagcagcagtttcac

SEQ ID NO: 4973 - DNA, 15 bp, Homo sapiens
caagcagcagtttca

SEQ ID NO: 4974 - DNA, 15 bp, Homo sapiens
acaagcagcagtttc

SEQ ID NO: 4975 - DNA, 15 bp, Homo sapiens
tacaagcagcagttt

SEQ ID NO: 4976 - DNA, 15 bp, Homo sapiens
ctacaagcagcagtt

SEQ ID NO: 4977 - DNA, 15 bp, Homo sapiens
gctacaagcagcagt

SEQ ID NO: 4978 - DNA, 15 bp, Homo sapiens
agctacaagcagcag

SEQ ID NO: 4979 - DNA, 15 bp, Homo sapiens
tagctacaagcagca

SEQ ID NO: 4980 - DNA, 15 bp, Homo sapiens
ttagctacaagcagc

SEQ ID NO: 4981 - DNA, 15 bp, Homo sapiens
tttagctacaagcag

SEQ ID NO: 4982 - DNA, 15 bp, Homo sapiens
ctttagctacaagca

SEQ ID NO: 4983 - DNA, 15 bp, Homo sapiens
cctttagctacaagc

SEQ ID NO: 4984 - DNA, 15 bp, Homo sapiens
acctttagctacaag

SEQ ID NO: 4985 - DNA, 15 bp, Homo sapiens
aacctttagctacaa

SEQ ID NO: 4986 - DNA, 15 bp, Homo sapiens
caacctttagctaca

SEQ ID NO: 4987 - DNA, 15 bp, Homo sapiens
acaacctttagctac

SEQ ID NO: 4988 - DNA, 15 bp, Homo sapiens
aacaacctttagcta

SEQ ID NO: 4989 - DNA, 15 bp, Homo sapiens
gaacaacctttagct

SEQ ID NO: 4990 - DNA, 15 bp, Homo sapiens
tgaacaacctttagc

SEQ ID NO: 4991 - DNA, 15 bp, Homo sapiens
atgaacaacctttag

SEQ ID NO: 4992 - DNA, 15 bp, Homo sapiens
aatgaacaaccttta

SEQ ID NO: 4993 - DNA, 15 bp, Homo sapiens
aaatgaacaaccttt

SEQ ID NO: 4994 - DNA, 15 bp, Homo sapiens
caaatgaacaacctt

SEQ ID NO: 4995 - DNA, 15 bp, Homo sapiens
ccaaatgaacaacct

SEQ ID NO: 4996 - DNA, 15 bp, Homo sapiens
tccaaatgaacaacc

SEQ ID NO: 4997 - DNA, 15 bp, Homo sapiens
ttccaaatgaacaac

SEQ ID NO: 4998 - DNA, 15 bp, Homo sapiens
cttccaaatgaacaa

SEQ ID NO: 4999 - DNA, 15 bp, Homo sapiens
tcttccaaatgaaca

SEQ ID NO: 5000 - DNA, 15 bp, Homo sapiens
gtcttccaaatgaac

SEQ ID NO: 5001 - DNA, 15 bp, Homo sapiens
agtcttccaaatgaa

SEQ ID NO: 5002 - DNA, 15 bp, Homo sapiens
tagtcttccaaatga

SEQ ID NO: 5003 - DNA, 15 bp, Homo sapiens
gtagtcttccaaatg

SEQ ID NO: 5004 - DNA, 15 bp, Homo sapiens
agtagtcttccaaat

SEQ ID NO: 5005 - DNA, 15 bp, Homo sapiens
gagtagtcttccaaa

SEQ ID NO: 5006 - DNA, 15 bp, Homo sapiens
ggagtagtcttccaa

SEQ ID NO: 5007 - DNA, 15 bp, Homo sapiens
tggagtagtcttcca

SEQ ID NO: 5008 - DNA, 15 bp, Homo sapiens
atggagtagtcttcc

SEQ ID NO: 5009 - DNA, 15 bp, Homo sapiens
aatggagtagtcttc

SEQ ID NO: 5010 - DNA, 15 bp, Homo sapiens
taatggagtagtctt

SEQ ID NO: 5011 - DNA, 15 bp, Homo sapiens
ttaatggagtagtct

SEQ ID NO: 5012 - DNA, 15 bp, Homo sapiens
tttaatggagtagtc

SEQ ID NO: 5013 - DNA, 15 bp, Homo sapiens
ttttaatggagtagt

SEQ ID NO: 5014 - DNA, 15 bp, Homo sapiens
attttaatggagtag

SEQ ID NO: 5015 - DNA, 15 bp, Homo sapiens
tattttaatggagta

SEQ ID NO: 5016 - DNA, 15 bp, Homo sapiens
ttattttaatggagt

SEQ ID NO: 5017 - DNA, 15 bp, Homo sapiens
tttattttaatggag

SEQ ID NO: 5018 - DNA, 15 bp, Homo sapiens
ttttattttaatgga

SEQ ID NO: 5019 - DNA, 15 bp, Homo sapiens
attttattttaatgg

SEQ ID NO: 5020 - DNA, 15 bp, Homo sapiens
tattttattttaatg

SEQ ID NO: 5021 - DNA, 15 bp, Homo sapiens
gtattttattttaat

SEQ ID NO: 5022 - DNA, 15 bp, Homo sapiens
cgtattttattttaa

SEQ ID NO: 5023 - DNA, 15 bp, Homo sapiens
tcgtattttatttta

SEQ ID NO: 5024 - DNA, 15 bp, Homo sapiens
gtcgtattttatttt

SEQ ID NO: 5025 - DNA, 15 bp, Homo sapiens
ggtcgtattttattt

SEQ ID NO: 5026 - DNA, 15 bp, Homo sapiens
cggtcgtattttatt

SEQ ID NO: 5027 - DNA, 15 bp, Homo sapiens
tcggtcgtattttat

SEQ ID NO: 5028 - DNA, 15 bp, Homo sapiens
ttcggtcgtatttta

SEQ ID NO: 5029 - DNA, 15 bp, Homo sapiens
gttcggtcgtatttt

SEQ ID NO: 5030 - DNA, 15 bp, Homo sapiens
tgttcggtcgtattt

SEQ ID NO: 5031 - DNA, 15 bp, Homo sapiens
atgttcggtcgtatt

SEQ ID NO: 5032 - DNA, 15 bp, Homo sapiens
aatgttcggtcgtat

SEQ ID NO: 5033 - DNA, 15 bp, Homo sapiens
aaatgttcggtcgta

SEQ ID NO: 5034 - DNA, 15 bp, Homo sapiens
gaaatgttcggtcgt

SEQ ID NO: 5035 - DNA, 15 bp, Homo sapiens
agaaatgttcggtcg

SEQ ID NO: 5036 - DNA, 15 bp, Homo sapiens
gagaaatgttcggtc

SEQ ID NO: 5037 - DNA, 15 bp, Homo sapiens
agagaaatgttcggt

SEQ ID NO: 5038 - DNA, 15 bp, Homo sapiens
aagagaaatgttcgg

SEQ ID NO: 5039 - DNA, 15 bp, Homo sapiens
aaagagaaatgttcg

SEQ ID NO: 5040 - DNA, 15 bp, Homo sapiens
gaaagagaaatgttc

SEQ ID NO: 5041 - DNA, 15 bp, Homo sapiens
agaaagagaaatgtt

SEQ ID NO: 5042 - DNA, 15 bp, Homo sapiens
tagaaagagaaatgt

SEQ ID NO: 5043 - DNA, 15 bp, Homo sapiens
atagaaagagaaatg

SEQ ID NO: 5044 - DNA, 15 bp, Homo sapiens
aatagaaagagaaat

SEQ ID NO: 5045 - DNA, 15 bp, Homo sapiens
aaatagaaagagaaa

SEQ ID NO: 5046 - DNA, 15 bp, Homo sapiens
aaaatagaaagagaa

SEQ ID NO: 5047 - DNA, 15 bp, Homo sapiens
gaaaatagaaagaga

SEQ ID NO: 5048 - DNA, 15 bp, Homo sapiens
agaaaatagaaagag

SEQ ID NO: 5049 - DNA, 15 bp, Homo sapiens
cagaaaatagaaaga

SEQ ID NO: 5050 - DNA, 15 bp, Homo sapiens
ccagaaaatagaaag

SEQ ID NO: 5051 - DNA, 15 bp, Homo sapiens
tccagaaaatagaaa

SEQ ID NO: 5052 - DNA, 15 bp, Homo sapiens
ttccagaaaatagaa

SEQ ID NO: 5053 - DNA, 15 bp, Homo sapiens
tttccagaaaataga

SEQ ID NO: 5054 - DNA, 15 bp, Homo sapiens
atttccagaaaatag

SEQ ID NO: 5055 - DNA, 15 bp, Homo sapiens
aatttccagaaaata

SEQ ID NO: 5056 - DNA, 15 bp, Homo sapiens
caatttccagaaaat

SEQ ID NO: 5057 - DNA, 15 bp, Homo sapiens
tcaatttccagaaaa

SEQ ID NO: 5058 - DNA, 15 bp, Homo sapiens
ttcaatttccagaaa

SEQ ID NO: 5059 - DNA, 15 bp, Homo sapiens
cttcaatttccagaa

SEQ ID NO: 5060 - DNA, 15 bp, Homo sapiens
ccttcaatttccaga

SEQ ID NO: 5061 - DNA, 15 bp, Homo sapiens
cccttcaatttccag

SEQ ID NO: 5062 - DNA, 15 bp, Homo sapiens
tcccttcaatttcca

SEQ ID NO: 5063 - DNA, 15 bp, Homo sapiens
atcccttcaatttcc

SEQ ID NO: 5064 - DNA, 15 bp, Homo sapiens
aatcccttcaatttc

SEQ ID NO: 5065 - DNA, 15 bp, Homo sapiens
taatcccttcaattt

SEQ ID NO: 5066 - DNA, 15 bp, Homo sapiens
ataatcccttcaatt

SEQ ID NO: 5067 - DNA, 15 bp, Homo sapiens
tataatcccttcaat

SEQ ID NO: 5068 - DNA, 15 bp, Homo sapiens
atataatcccttcaa

SEQ ID NO: 5069 - DNA, 15 bp, Homo sapiens
catataatcccttca

SEQ ID NO: 5070 - DNA, 15 bp, Homo sapiens
gcatataatcccttc

SEQ ID NO: 5071 - DNA, 15 bp, Homo sapiens
agcatataatccctt

SEQ ID NO: 5072 - DNA, 15 bp, Homo sapiens
aagcatataatccct

SEQ ID NO: 5073 - DNA, 15 bp, Homo sapiens
taagcatataatccc

SEQ ID NO: 5074 - DNA, 15 bp, Homo sapiens
ttaagcatataatcc

SEQ ID NO: 5075 - DNA, 15 bp, Homo sapiens
attaagcatataatc

SEQ ID NO: 5076 - DNA, 15 bp, Homo sapiens
cattaagcatataat

SEQ ID NO: 5077 - DNA, 15 bp, Homo sapiens
acattaagcatataa

SEQ ID NO: 5078 - DNA, 15 bp, Homo sapiens
tacattaagcatata

SEQ ID NO: 5079 - DNA, 15 bp, Homo sapiens
ctacattaagcatat

SEQ ID NO: 5080 - DNA, 15 bp, Homo sapiens
cctacattaagcata

SEQ ID NO: 5081 - DNA, 15 bp, Homo sapiens
tcctacattaagcat

SEQ ID NO: 5082 - DNA, 15 bp, Homo sapiens
ttcctacattaagca

SEQ ID NO: 5083 - DNA, 15 bp, Homo sapiens
cttcctacattaagc

SEQ ID NO: 5084 - DNA, 15 bp, Homo sapiens
acttcctacattaag

SEQ ID NO: 5085 - DNA, 15 bp, Homo sapiens
cacttcctacattaa

SEQ ID NO: 5086 - DNA, 15 bp, Homo sapiens
gcacttcctacatta

SEQ ID NO: 5087 - DNA, 15 bp, Homo sapiens
ggcacttcctacatt

SEQ ID NO: 5088 - DNA, 15 bp, Homo sapiens
tggcacttcctacat

SEQ ID NO: 5089 - DNA, 15 bp, Homo sapiens
gtggcacttcctaca

SEQ ID NO: 5090 - DNA, 15 bp, Homo sapiens
tgtggcacttcctac

SEQ ID NO: 5091 - DNA, 15 bp, Homo sapiens
ctgtggcacttccta

SEQ ID NO: 5092 - DNA, 15 bp, Homo sapiens
actgtggcacttcct

SEQ ID NO: 5093 - DNA, 15 bp, Homo sapiens
aactgtggcacttcc

SEQ ID NO: 5094 - DNA, 15 bp, Homo sapiens
aaactgtggcacttc

SEQ ID NO: 5095 - DNA, 15 bp, Homo sapiens
gaaactgtggcactt

SEQ ID NO: 5096 - DNA, 15 bp, Homo sapiens
agaaactgtggcact

SEQ ID NO: 5097 - DNA, 15 bp, Homo sapiens
cagaaactgtggcac

SEQ ID NO: 5098 - DNA, 15 bp, Homo sapiens
ccagaaactgtggca

SEQ ID NO: 5099 - DNA, 15 bp, Homo sapiens
gccagaaactgtggc

SEQ ID NO: 5100 - DNA, 15 bp, Homo sapiens
tgccagaaactgtgg

SEQ ID NO: 5101 - DNA, 15 bp, Homo sapiens
ctgccagaaactgtg

SEQ ID NO: 5102 - DNA, 15 bp, Homo sapiens
cctgccagaaactgt

SEQ ID NO: 5103 - DNA, 15 bp, Homo sapiens
tcctgccagaaactg

SEQ ID NO: 5104 - DNA, 15 bp, Homo sapiens
ttcctgccagaaact

SEQ ID NO: 5105 - DNA, 15 bp, Homo sapiens
tttcctgccagaaac

SEQ ID NO: 5106 - DNA, 15 bp, Homo sapiens
ctttcctgccagaaa

SEQ ID NO: 5107 - DNA, 15 bp, Homo sapiens
tctttcctgccagaa

SEQ ID NO: 5108 - DNA, 15 bp, Homo sapiens
atctttcctgccaga

SEQ ID NO: 5109 - DNA, 15 bp, Homo sapiens
gatctttcctgccag

SEQ ID NO: 5110 - DNA, 15 bp, Homo sapiens
agatctttcctgcca

SEQ ID NO: 5111 - DNA, 15 bp, Homo sapiens
aagatctttcctgcc

SEQ ID NO: 5112 - DNA, 15 bp, Homo sapiens
aaagatctttcctgc

SEQ ID NO: 5113 - DNA, 15 bp, Homo sapiens
gaaagatctttcctg

SEQ ID NO: 5114 - DNA, 15 bp, Homo sapiens
tgaaagatctttcct

SEQ ID NO: 5115 - DNA, 15 bp, Homo sapiens
gtgaaagatctttcc

SEQ ID NO: 5116 - DNA, 15 bp, Homo sapiens
tgtgaaagatctttc

SEQ ID NO: 5117 - DNA, 15 bp, Homo sapiens
ctgtgaaagatcttt

SEQ ID NO: 5118 - DNA, 15 bp, Homo sapiens
actgtgaaagatctt

SEQ ID NO: 5119 - DNA, 15 bp, Homo sapiens
aactgtgaaagatct

SEQ ID NO: 5120 - DNA, 15 bp, Homo sapiens
aaactgtgaaagatc

SEQ ID NO: 5121 - DNA, 15 bp, Homo sapiens
caaactgtgaaagat

SEQ ID NO: 5122 - DNA, 15 bp, Homo sapiens
tcaaactgtgaaaga

SEQ ID NO: 5123 - DNA, 15 bp, Homo sapiens
atcaaactgtgaaag

SEQ ID NO: 5124 - DNA, 15 bp, Homo sapiens
aatcaaactgtgaaa

SEQ ID NO: 5125 - DNA, 15 bp, Homo sapiens
aaatcaaactgtgaa

SEQ ID NO: 5126 - DNA, 15 bp, Homo sapiens
gaaatcaaactgtga

SEQ ID NO: 5127 - DNA, 15 bp, Homo sapiens
tgaaatcaaactgtg

SEQ ID NO: 5128 - DNA, 15 bp, Homo sapiens
atgaaatcaaactgt

SEQ ID NO: 5129 - DNA, 15 bp, Homo sapiens
aatgaaatcaaactg

SEQ ID NO: 5130 - DNA, 15 bp, Homo sapiens
taatgaaatcaaact

SEQ ID NO: 5131 - DNA, 15 bp, Homo sapiens
gtaatgaaatcaaac

SEQ ID NO: 5132 - DNA, 15 bp, Homo sapiens
ggtaatgaaatcaaa

SEQ ID NO: 5133 - DNA, 15 bp, Homo sapiens
tggtaatgaaatcaa

SEQ ID NO: 5134 - DNA, 15 bp, Homo sapiens
atggtaatgaaatca

SEQ ID NO: 5135 - DNA, 15 bp, Homo sapiens
tatggtaatgaaatc

SEQ ID NO: 5136 - DNA, 15 bp, Homo sapiens
atatggtaatgaaat

SEQ ID NO: 5137 - DNA, 15 bp, Homo sapiens
tatatggtaatgaaa

SEQ ID NO: 5138 - DNA, 15 bp, Homo sapiens
atatatggtaatgaa

SEQ ID NO: 5139 - DNA, 15 bp, Homo sapiens
gatatatggtaatga

SEQ ID NO: 5140 - DNA, 15 bp, Homo sapiens
ggatatatggtaatg

SEQ ID NO: 5141 - DNA, 15 bp, Homo sapiens
aggatatatggtaat

SEQ ID NO: 5142 - DNA, 15 bp, Homo sapiens
gaggatatatggtaa

SEQ ID NO: 5143 - DNA, 15 bp, Homo sapiens
tgaggatatatggta

SEQ ID NO: 5144 - DNA, 15 bp, Homo sapiens
gtgaggatatatggt

SEQ ID NO: 5145 - DNA, 15 bp, Homo sapiens
ggtgaggatatatgg

SEQ ID NO: 5146 - DNA, 15 bp, Homo sapiens
gggtgaggatatatg

SEQ ID NO: 5147 - DNA, 15 bp, Homo sapiens
ggggtgaggatatat

SEQ ID NO: 5148 - DNA, 15 bp, Homo sapiens
gggggtgaggatata

SEQ ID NO: 5149 - DNA, 15 bp, Homo sapiens
tgggggtgaggatat

SEQ ID NO: 5150 - DNA, 15 bp, Homo sapiens
atgggggtgaggata

SEQ ID NO: 5151 - DNA, 15 bp, Homo sapiens
gatgggggtgaggat

SEQ ID NO: 5152 - DNA, 15 bp, Homo sapiens
ggatgggggtgagga

SEQ ID NO: 5153 - DNA, 15 bp, Homo sapiens
gggatgggggtgagg

SEQ ID NO: 5154 - DNA, 15 bp, Homo sapiens
agggatgggggtgag

SEQ ID NO: 5155 - DNA, 15 bp, Homo sapiens
cagggatgggggtga

SEQ ID NO: 5156 - DNA, 15 bp, Homo sapiens
acagggatgggggtg

SEQ ID NO: 5157 - DNA, 15 bp, Homo sapiens
aacagggatgggggt

SEQ ID NO: 5158 - DNA, 15 bp, Homo sapiens
gaacagggatggggg

SEQ ID NO: 5159 - DNA, 15 bp, Homo sapiens
tgaacagggatgggg

SEQ ID NO: 5160 - DNA, 15 bp, Homo sapiens
atgaacagggatggg

SEQ ID NO: 5161 - DNA, 15 bp, Homo sapiens
tatgaacagggatgg

SEQ ID NO: 5162 - DNA, 15 bp, Homo sapiens
ctatgaacagggatg

SEQ ID NO: 5163 - DNA, 15 bp, Homo sapiens
gctatgaacagggat

SEQ ID NO: 5164 - DNA, 15 bp, Homo sapiens
ggctatgaacaggga

SEQ ID NO: 5165 - DNA, 15 bp, Homo sapiens
tggctatgaacaggg

SEQ ID NO: 5166 - DNA, 15 bp, Homo sapiens
atggctatgaacagg

SEQ ID NO: 5167 - DNA, 15 bp, Homo sapiens
aatggctatgaacag

SEQ ID NO: 5168 - DNA, 15 bp, Homo sapiens
caatggctatgaaca

SEQ ID NO: 5169 - DNA, 15 bp, Homo sapiens
tcaatggctatgaac

SEQ ID NO: 5170 - DNA, 15 bp, Homo sapiens
atcaatggctatgaa

SEQ ID NO: 5171 - DNA, 15 bp, Homo sapiens
tatcaatggctatga

SEQ ID NO: 5172 - DNA, 15 bp, Homo sapiens
ctatcaatggctatg

SEQ ID NO: 5173 - DNA, 15 bp, Homo sapiens
cctatcaatggctat

SEQ ID NO: 5174 - DNA, 15 bp, Homo sapiens
gcctatcaatggcta

SEQ ID NO: 5175 - DNA, 15 bp, Homo sapiens
ggcctatcaatggct

SEQ ID NO: 5176 - DNA, 15 bp, Homo sapiens
tggcctatcaatggc

SEQ ID NO: 5177 - DNA, 15 bp, Homo sapiens
ttggcctatcaatgg

SEQ ID NO: 5178 - DNA, 15 bp, Homo sapiens
gttggcctatcaatg

SEQ ID NO: 5179 - DNA, 15 bp, Homo sapiens
tgttggcctatcaat

SEQ ID NO: 5180 - DNA, 15 bp, Homo sapiens
ctgttggcctatcaa

SEQ ID NO: 5181 - DNA, 15 bp, Homo sapiens
cctgttggcctatca

SEQ ID NO: 5182 - DNA, 15 bp, Homo sapiens
acctgttggcctatc

SEQ ID NO: 5183 - DNA, 15 bp, Homo sapiens
cacctgttggcctat

SEQ ID NO: 5184 - DNA, 15 bp, Homo sapiens
acacctgttggccta

SEQ ID NO: 5185 - DNA, 15 bp, Homo sapiens
gacacctgttggcct

SEQ ID NO: 5186 - DNA, 15 bp, Homo sapiens
ggacacctgttggcc

SEQ ID NO: 5187 - DNA, 15 bp, Homo sapiens
aggacacctgttggc

SEQ ID NO: 5188 - DNA, 15 bp, Homo sapiens
taggacacctgttgg

SEQ ID NO: 5189 - DNA, 15 bp, Homo sapiens
gtaggacacctgttg

SEQ ID NO: 5190 - DNA, 15 bp, Homo sapiens
ggtaggacacctgtt

SEQ ID NO: 5191 - DNA, 15 bp, Homo sapiens
aggtaggacacctgt

SEQ ID NO: 5192 - DNA, 15 bp, Homo sapiens
aaggtaggacacctg

SEQ ID NO: 5193 - DNA, 15 bp, Homo sapiens
caaggtaggacacct

SEQ ID NO: 5194 - DNA, 15 bp, Homo sapiens
tcaaggtaggacacc

SEQ ID NO: 5195 - DNA, 15 bp, Homo sapiens
ttcaaggtaggacac

SEQ ID NO: 5196 - DNA, 15 bp, Homo sapiens
tttcaaggtaggaca

SEQ ID NO: 5197 - DNA, 15 bp, Homo sapiens
atttcaaggtaggac

SEQ ID NO: 5198 - DNA, 15 bp, Homo sapiens
tatttcaaggtagga

SEQ ID NO: 5199 - DNA, 15 bp, Homo sapiens
atatttcaaggtagg

SEQ ID NO: 5200 - DNA, 15 bp, Homo sapiens
gatatttcaaggtag

SEQ ID NO: 5201 - DNA, 15 bp, Homo sapiens
agatatttcaaggta

SEQ ID NO: 5202 - DNA, 15 bp, Homo sapiens
aagatatttcaaggt

SEQ ID NO: 5203 - DNA, 15 bp, Homo sapiens
taagatatttcaagg

SEQ ID NO: 5204 - DNA, 15 bp, Homo sapiens
ataagatatttcaag

SEQ ID NO: 5205 - DNA, 15 bp, Homo sapiens
cataagatatttcaa

SEQ ID NO: 5206 - DNA, 15 bp, Homo sapiens
tcataagatatttca

SEQ ID NO: 5207 - DNA, 15 bp, Homo sapiens
ctcataagatatttc

SEQ ID NO: 5208 - DNA, 15 bp, Homo sapiens
gctcataagatattt

SEQ ID NO: 5209 - DNA, 15 bp, Homo sapiens
ggctcataagatatt

SEQ ID NO: 5210 - DNA, 15 bp, Homo sapiens
aggctcataagatat

SEQ ID NO: 5211 - DNA, 15 bp, Homo sapiens
aaggctcataagata

SEQ ID NO: 5212 - DNA, 15 bp, Homo sapiens
gaaggctcataagat

SEQ ID NO: 5213 - DNA, 15 bp, Homo sapiens
agaaggctcataaga

SEQ ID NO: 5214 - DNA, 15 bp, Homo sapiens
gagaaggctcataag

SEQ ID NO: 5215 - DNA, 15 bp, Homo sapiens
tgagaaggctcataa

SEQ ID NO: 5216 - DNA, 15 bp, Homo sapiens
ttgagaaggctcata

SEQ ID NO: 5217 - DNA, 15 bp, Homo sapiens
cttgagaaggctcat

SEQ ID NO: 5218 - DNA, 15 bp, Homo sapiens
ccttgagaaggctca

SEQ ID NO: 5219 - DNA, 15 bp, Homo sapiens
accttgagaaggctc

SEQ ID NO: 5220 - DNA, 15 bp, Homo sapiens
taccttgagaaggct

SEQ ID NO: 5221 - DNA, 15 bp, Homo sapiens
ttaccttgagaaggc

SEQ ID NO: 5222 - DNA, 15 bp, Homo sapiens
tttaccttgagaagg

SEQ ID NO: 5223 - DNA, 15 bp, Homo sapiens
ttttaccttgagaag

SEQ ID NO: 5224 - DNA, 15 bp, Homo sapiens
attttaccttgagaa

SEQ ID NO: 5225 - DNA, 15 bp, Homo sapiens
aattttaccttgaga

SEQ ID NO: 5226 - DNA, 15 bp, Homo sapiens
aaattttaccttgag

SEQ ID NO: 5227 - DNA, 15 bp, Homo sapiens
aaaattttaccttga

SEQ ID NO: 5228 - DNA, 15 bp, Homo sapiens
gaaaattttaccttg

SEQ ID NO: 5229 - DNA, 15 bp, Homo sapiens
tgaaaattttacctt

SEQ ID NO: 5230 - DNA, 15 bp, Homo sapiens
gtgaaaattttacct

SEQ ID NO: 5231 - DNA, 15 bp, Homo sapiens
ggtgaaaattttacc

SEQ ID NO: 5232 - DNA, 15 bp, Homo sapiens
aggtgaaaattttac

SEQ ID NO: 5233 - DNA, 15 bp, Homo sapiens
taggtgaaaatttta

SEQ ID NO: 5234 - DNA, 15 bp, Homo sapiens
ctaggtgaaaatttt

SEQ ID NO: 5235 - DNA, 15 bp, Homo sapiens
cctaggtgaaaattt

SEQ ID NO: 5236 - DNA, 15 bp, Homo sapiens
acctaggtgaaaatt

SEQ ID NO: 5237 - DNA, 15 bp, Homo sapiens
tacctaggtgaaaat

SEQ ID NO: 5238 - DNA, 15 bp, Homo sapiens
ttacctaggtgaaaa

SEQ ID NO: 5239 - DNA, 15 bp, Homo sapiens
attacctaggtgaaa

SEQ ID NO: 5240 - DNA, 15 bp, Homo sapiens
gattacctaggtgaa

SEQ ID NO: 5241 - DNA, 15 bp, Homo sapiens
agattacctaggtga

SEQ ID NO: 5242 - DNA, 15 bp, Homo sapiens
tagattacctaggtg

SEQ ID NO: 5243 - DNA, 15 bp, Homo sapiens
ttagattacctaggt

SEQ ID NO: 5244 - DNA, 15 bp, Homo sapiens
attagattacctagg

SEQ ID NO: 5245 - DNA, 15 bp, Homo sapiens
tattagattacctag

SEQ ID NO: 5246 - DNA, 15 bp, Homo sapiens
ttattagattaccta

SEQ ID NO: 5247 - DNA, 15 bp, Homo sapiens
tttattagattacct

SEQ ID NO: 5248 - DNA, 15 bp, Homo sapiens
gtttattagattacc

SEQ ID NO: 5249 - DNA, 15 bp, Homo sapiens
ggtttattagattac

SEQ ID NO: 5250 - DNA, 15 bp, Homo sapiens
tggtttattagatta

SEQ ID NO: 5251 - DNA, 15 bp, Homo sapiens
ctggtttattagatt

SEQ ID NO: 5252 - DNA, 15 bp, Homo sapiens
tctggtttattagat

SEQ ID NO: 5253 - DNA, 15 bp, Homo sapiens
gtctggtttattaga

SEQ ID NO: 5254 - DNA, 15 bp, Homo sapiens
agtctggtttattag

SEQ ID NO: 5255 - DNA, 15 bp, Homo sapiens
gagtctggtttatta

SEQ ID NO: 5256 - DNA, 15 bp, Homo sapiens
tgagtctggtttatt

SEQ ID NO: 5257 - DNA, 15 bp, Homo sapiens
ctgagtctggtttat

SEQ ID NO: 5258 - DNA, 15 bp, Homo sapiens
tctgagtctggttta

SEQ ID NO: 5259 - DNA, 15 bp, Homo sapiens
gtctgagtctggttt

SEQ ID NO: 5260 - DNA, 15 bp, Homo sapiens
tgtctgagtctggtt

SEQ ID NO: 5261 - DNA, 15 bp, Homo sapiens
ctgtctgagtctggt

SEQ ID NO: 5262 - DNA, 15 bp, Homo sapiens
tctgtctgagtctgg

SEQ ID NO: 5263 - DNA, 15 bp, Homo sapiens
atctgtctgagtctg

SEQ ID NO: 5264 - DNA, 15 bp, Homo sapiens
aatctgtctgagtct

SEQ ID NO: 5265 - DNA, 15 bp, Homo sapiens
gaatctgtctgagtc

SEQ ID NO: 5266 - DNA, 15 bp, Homo sapiens
tgaatctgtctgagt

SEQ ID NO: 5267 - DNA, 15 bp, Homo sapiens
atgaatctgtctgag

SEQ ID NO: 5268 - DNA, 15 bp, Homo sapiens
catgaatctgtctga

SEQ ID NO: 5269 - DNA, 15 bp, Homo sapiens
ccatgaatctgtctg

SEQ ID NO: 5270 - DNA, 15 bp, Homo sapiens
accatgaatctgtct

SEQ ID NO: 5271 - DNA, 15 bp, Homo sapiens
aaccatgaatctgtc

SEQ ID NO: 5272 - DNA, 15 bp, Homo sapiens
aaaccatgaatctgt

SEQ ID NO: 5273 - DNA, 15 bp, Homo sapiens
aaaaccatgaatctg

SEQ ID NO: 5274 - DNA, 15 bp, Homo sapiens
gaaaaccatgaatct

SEQ ID NO: 5275 - DNA, 15 bp, Homo sapiens
tgaaaaccatgaatc

SEQ ID NO: 5276 - DNA, 15 bp, Homo sapiens
gtgaaaaccatgaat

SEQ ID NO: 5277 - DNA, 15 bp, Homo sapiens
tgtgaaaaccatgaa

SEQ ID NO: 5278 - DNA, 15 bp, Homo sapiens
gtgtgaaaaccatga

SEQ ID NO: 5279 - DNA, 15 bp, Homo sapiens
cgtgtgaaaaccatg

SEQ ID NO: 5280 - DNA, 15 bp, Homo sapiens
tcgtgtgaaaaccat

SEQ ID NO: 5281 - DNA, 15 bp, Homo sapiens
ttcgtgtgaaaacca

SEQ ID NO: 5282 - DNA, 15 bp, Homo sapiens
gttcgtgtgaaaacc

SEQ ID NO: 5283 - DNA, 15 bp, Homo sapiens
tgttcgtgtgaaaac

SEQ ID NO: 5284 - DNA, 15 bp, Homo sapiens
ctgttcgtgtgaaaa

SEQ ID NO: 5285 - DNA, 15 bp, Homo sapiens
actgttcgtgtgaaa

SEQ ID NO: 5286 - DNA, 15 bp, Homo sapiens
aactgttcgtgtgaa

SEQ ID NO: 5287 - DNA, 15 bp, Homo sapiens
taactgttcgtgtga

SEQ ID NO: 5288 - DNA, 15 bp, Homo sapiens
ttaactgttcgtgtg

SEQ ID NO: 5289 - DNA, 15 bp, Homo sapiens
tttaactgttcgtgt

SEQ ID NO: 5290 - DNA, 15 bp, Homo sapiens
atttaactgttcgtg

SEQ ID NO: 5291 - DNA, 15 bp, Homo sapiens
aatttaactgttcgt

SEQ ID NO: 5292 - DNA, 15 bp, Homo sapiens
caatttaactgttcg

SEQ ID NO: 5293 - DNA, 15 bp, Homo sapiens
ccaatttaactgttc

SEQ ID NO: 5294 - DNA, 15 bp, Homo sapiens
cccaatttaactgtt

SEQ ID NO: 5295 - DNA, 15 bp, Homo sapiens
ccccaatttaactgt

SEQ ID NO: 5296 - DNA, 15 bp, Homo sapiens
accccaatttaactg

SEQ ID NO: 5297 - DNA, 15 bp, Homo sapiens
gaccccaatttaact

SEQ ID NO: 5298 - DNA, 15 bp, Homo sapiens
ggaccccaatttaac

SEQ ID NO: 5299 - DNA, 15 bp, Homo sapiens
aggaccccaatttaa

SEQ ID NO: 5300 - DNA, 15 bp, Homo sapiens
gaggaccccaattta

SEQ ID NO: 5301 - DNA, 15 bp, Homo sapiens
tgaggaccccaattt

SEQ ID NO: 5302 - DNA, 15 bp, Homo sapiens
ctgaggaccccaatt

SEQ ID NO: 5303 - DNA, 15 bp, Homo sapiens
cctgaggaccccaat

SEQ ID NO: 5304 - DNA, 15 bp, Homo sapiens
tcctgaggaccccaa

SEQ ID NO: 5305 - DNA, 15 bp, Homo sapiens
atcctgaggacccca

SEQ ID NO: 5306 - DNA, 15 bp, Homo sapiens
tatcctgaggacccc

SEQ ID NO: 5307 - DNA, 15 bp, Homo sapiens
gtatcctgaggaccc

SEQ ID NO: 5308 - DNA, 15 bp, Homo sapiens
ggtatcctgaggacc

SEQ ID NO: 5309 - DNA, 15 bp, Homo sapiens
tggtatcctgaggac

SEQ ID NO: 5310 - DNA, 15 bp, Homo sapiens
gtggtatcctgagga

SEQ ID NO: 5311 - DNA, 15 bp, Homo sapiens
ggtggtatcctgagg

SEQ ID NO: 5312 - DNA, 15 bp, Homo sapiens
gggtggtatcctgag

SEQ ID NO: 5313 - DNA, 15 bp, Homo sapiens
ggggtggtatcctga

SEQ ID NO: 5314 - DNA, 15 bp, Homo sapiens
gggggtggtatcctg

SEQ ID NO: 5315 - DNA, 15 bp, Homo sapiens
agggggtggtatcct

SEQ ID NO: 5316 - DNA, 15 bp, Homo sapiens
gagggggtggtatcc

SEQ ID NO: 5317 - DNA, 15 bp, Homo sapiens
ggagggggtggtatc

SEQ ID NO: 5318 - DNA, 15 bp, Homo sapiens
aggagggggtggtat

SEQ ID NO: 5319 - DNA, 15 bp, Homo sapiens
gaggagggggtggta

SEQ ID NO: 5320 - DNA, 15 bp, Homo sapiens
ggaggagggggtggt

SEQ ID NO: 5321 - DNA, 15 bp, Homo sapiens
tggaggagggggtgg

SEQ ID NO: 5322 - DNA, 15 bp, Homo sapiens
ttggaggagggggtg

SEQ ID NO: 5323 - DNA, 15 bp, Homo sapiens
attggaggagggggt

SEQ ID NO: 5324 - DNA, 15 bp, Homo sapiens
gattggaggaggggg

SEQ ID NO: 5325 - DNA, 15 bp, Homo sapiens
agattggaggagggg

SEQ ID NO: 5326 - DNA, 15 bp, Homo sapiens
aagattggaggaggg

SEQ ID NO: 5327 - DNA, 15 bp, Homo sapiens
aaagattggaggagg

SEQ ID NO: 5328 - DNA, 15 bp, Homo sapiens
aaaagattggaggag

SEQ ID NO: 5329 - DNA, 15 bp, Homo sapiens
aaaaagattggagga

SEQ ID NO: 5330 - DNA, 15 bp, Homo sapiens
taaaaagattggagg

SEQ ID NO: 5331 - DNA, 15 bp, Homo sapiens
ataaaaagattggag

SEQ ID NO: 5332 - DNA, 15 bp, Homo sapiens
tataaaaagattgga

SEQ ID NO: 5333 - DNA, 15 bp, Homo sapiens
atataaaaagattgg

SEQ ID NO: 5334 - DNA, 15 bp, Homo sapiens
tatataaaaagattg

SEQ ID NO: 5335 - DNA, 15 bp, Homo sapiens
ttatataaaaagatt

SEQ ID NO: 5336 - DNA, 15 bp, Homo sapiens
gttatataaaaagat

SEQ ID NO: 5337 - DNA, 15 bp, Homo sapiens
ggttatataaaaaga

SEQ ID NO: 5338 - DNA, 15 bp, Homo sapiens
cggttatataaaaag

SEQ ID NO: 5339 - DNA, 15 bp, Homo sapiens
tcggttatataaaaa

SEQ ID NO: 5340 - DNA, 15 bp, Homo sapiens
ctcggttatataaaa

SEQ ID NO: 5341 - DNA, 15 bp, Homo sapiens
actcggttatataaa

SEQ ID NO: 5342 - DNA, 15 bp, Homo sapiens
cactcggttatataa

SEQ ID NO: 5343 - DNA, 15 bp, Homo sapiens
gcactcggttatata

SEQ ID NO: 5344 - DNA, 15 bp, Homo sapiens
agcactcggttatat

SEQ ID NO: 5345 - DNA, 15 bp, Homo sapiens
aagcactcggttata

SEQ ID NO: 5346 - DNA, 15 bp, Homo sapiens
aaagcactcggttat

SEQ ID NO: 5347 - DNA, 15 bp, Homo sapiens
aaaagcactcggtta

SEQ ID NO: 5348 - DNA, 15 bp, Homo sapiens
aaaaagcactcggtt

SEQ ID NO: 5349 - DNA, 15 bp, Homo sapiens
caaaaagcactcggt

SEQ ID NO: 5350 - DNA, 15 bp, Homo sapiens
tcaaaaagcactcgg

SEQ ID NO: 5351 - DNA, 15 bp, Homo sapiens
gtcaaaaagcactcg

SEQ ID NO: 5352 - DNA, 15 bp, Homo sapiens
agtcaaaaagcactc

SEQ ID NO: 5353 - DNA, 15 bp, Homo sapiens
gagtcaaaaagcact

SEQ ID NO: 5354 - DNA, 15 bp, Homo sapiens
agagtcaaaaagcac

SEQ ID NO: 5355 - DNA, 15 bp, Homo sapiens
cagagtcaaaaagca

SEQ ID NO: 5356 - DNA, 15 bp, Homo sapiens
ccagagtcaaaaagc

SEQ ID NO: 5357 - DNA, 15 bp, Homo sapiens
gccagagtcaaaaag

SEQ ID NO: 5358 - DNA, 15 bp, Homo sapiens
agccagagtcaaaaa

SEQ ID NO: 5359 - DNA, 15 bp, Homo sapiens
cagccagagtcaaaa

SEQ ID NO: 5360 - DNA, 15 bp, Homo sapiens
acagccagagtcaaa

SEQ ID NO: 5361 - DNA, 15 bp, Homo sapiens
tacagccagagtcaa

SEQ ID NO: 5362 - DNA, 15 bp, Homo sapiens
gtacagccagagtca

SEQ ID NO: 5363 - DNA, 15 bp, Homo sapiens
tgtacagccagagtc

SEQ ID NO: 5364 - DNA, 15 bp, Homo sapiens
ctgtacagccagagt

SEQ ID NO: 5365 - DNA, 15 bp, Homo sapiens
tctgtacagccagag

SEQ ID NO: 5366 - DNA, 15 bp, Homo sapiens
atctgtacagccaga

SEQ ID NO: 5367 - DNA, 15 bp, Homo sapiens
catctgtacagccag

SEQ ID NO: 5368 - DNA, 15 bp, Homo sapiens
tcatctgtacagcca

SEQ ID NO: 5369 - DNA, 15 bp, Homo sapiens
ttcatctgtacagcc

SEQ ID NO: 5370 - DNA, 15 bp, Homo sapiens
attcatctgtacagc

SEQ ID NO: 5371 - DNA, 15 bp, Homo sapiens
gattcatctgtacag

SEQ ID NO: 5372 - DNA, 15 bp, Homo sapiens
tgattcatctgtaca

SEQ ID NO: 5373 - DNA, 15 bp, Homo sapiens
ttgattcatctgtac

SEQ ID NO: 5374 - DNA, 15 bp, Homo sapiens
gttgattcatctgta

SEQ ID NO: 5375 - DNA, 15 bp, Homo sapiens
agttgattcatctgt

SEQ ID NO: 5376 - DNA, 15 bp, Homo sapiens
cagttgattcatctg

SEQ ID NO: 5377 - DNA, 15 bp, Homo sapiens
ccagttgattcatct

SEQ ID NO: 5378 - DNA, 15 bp, Homo sapiens
cccagttgattcatc

SEQ ID NO: 5379 - DNA, 15 bp, Homo sapiens
ccccagttgattcat

SEQ ID NO: 5380 - DNA, 15 bp, Homo sapiens
tccccagttgattca

SEQ ID NO: 5381 - DNA, 15 bp, Homo sapiens
ctccccagttgattc

SEQ ID NO: 5382 - DNA, 15 bp, Homo sapiens
actccccagttgatt

SEQ ID NO: 5383 - DNA, 15 bp, Homo sapiens
aactccccagttgat

SEQ ID NO: 5384 - DNA, 15 bp, Homo sapiens
aaactccccagttga

SEQ ID NO: 5385 - DNA, 15 bp, Homo sapiens
aaaactccccagttg

SEQ ID NO: 5386 - DNA, 15 bp, Homo sapiens
taaaactccccagtt

SEQ ID NO: 5387 - DNA, 15 bp, Homo sapiens
ttaaaactccccagt

SEQ ID NO: 5388 - DNA, 15 bp, Homo sapiens
tttaaaactccccag

SEQ ID NO: 5389 - DNA, 15 bp, Homo sapiens
ttttaaaactcccca

SEQ ID NO: 5390 - DNA, 15 bp, Homo sapiens
tttttaaaactcccc

SEQ ID NO: 5391 - DNA, 15 bp, Homo sapiens
ttttttaaaactccc

SEQ ID NO: 5392 - DNA, 15 bp, Homo sapiens
gttttttaaaactcc

SEQ ID NO: 5393 - DNA, 15 bp, Homo sapiens
cgttttttaaaactc

SEQ ID NO: 5394 - DNA, 15 bp, Homo sapiens
gcgttttttaaaact

SEQ ID NO: 5395 - DNA, 15 bp, Homo sapiens
tgcgttttttaaaac

SEQ ID NO: 5396 - DNA, 15 bp, Homo sapiens
ctgcgttttttaaaa

SEQ ID NO: 5397 - DNA, 15 bp, Homo sapiens
tctgcgttttttaaa

SEQ ID NO: 5398 - DNA, 15 bp, Homo sapiens
atctgcgttttttaa

SEQ ID NO: 5399 - DNA, 15 bp, Homo sapiens
catctgcgtttttta

SEQ ID NO: 5400 - DNA, 15 bp, Homo sapiens
gcatctgcgtttttt

SEQ ID NO: 5401 - DNA, 15 bp, Homo sapiens
tgcatctgcgttttt

SEQ ID NO: 5402 - DNA, 15 bp, Homo sapiens
atgcatctgcgtttt

SEQ ID NO: 5403 - DNA, 15 bp, Homo sapiens
aatgcatctgcgttt

SEQ ID NO: 5404 - DNA, 15 bp, Homo sapiens
caatgcatctgcgtt

SEQ ID NO: 5405 - DNA, 15 bp, Homo sapiens
ccaatgcatctgcgt

SEQ ID NO: 5406 - DNA, 15 bp, Homo sapiens
gccaatgcatctgcg

SEQ ID NO: 5407 - DNA, 15 bp, Homo sapiens
agccaatgcatctgc

SEQ ID NO: 5408 - DNA, 15 bp, Homo sapiens
gagccaatgcatctg

SEQ ID NO: 5409 - DNA, 15 bp, Homo sapiens
ggagccaatgcatct

SEQ ID NO: 5410 - DNA, 15 bp, Homo sapiens
tggagccaatgcatc

SEQ ID NO: 5411 - DNA, 15 bp, Homo sapiens
atggagccaatgcat

SEQ ID NO: 5412 - DNA, 15 bp, Homo sapiens
aatggagccaatgca

SEQ ID NO: 5413 - DNA, 15 bp, Homo sapiens
gaatggagccaatgc

SEQ ID NO: 5414 - DNA, 15 bp, Homo sapiens
ggaatggagccaatg

SEQ ID NO: 5415 - DNA, 15 bp, Homo sapiens
tggaatggagccaat

SEQ ID NO: 5416 - DNA, 15 bp, Homo sapiens
ctggaatggagccaa

SEQ ID NO: 5417 - DNA, 15 bp, Homo sapiens
tctggaatggagcca

SEQ ID NO: 5418 - DNA, 15 bp, Homo sapiens
gtctggaatggagcc

SEQ ID NO: 5419 - DNA, 15 bp, Homo sapiens
ggtctggaatggagc

SEQ ID NO: 5420 - DNA, 15 bp, Homo sapiens
gggtctggaatggag

SEQ ID NO: 5421 - DNA, 15 bp, Homo sapiens
tgggtctggaatgga

SEQ ID NO: 5422 - DNA, 15 bp, Homo sapiens
atgggtctggaatgg

SEQ ID NO: 5423 - DNA, 15 bp, Homo sapiens
aatgggtctggaatg

SEQ ID NO: 5424 - DNA, 15 bp, Homo sapiens
caatgggtctggaat

SEQ ID NO: 5425 - DNA, 15 bp, Homo sapiens
tcaatgggtctggaa

SEQ ID NO: 5426 - DNA, 15 bp, Homo sapiens
ttcaatgggtctgga

SEQ ID NO: 5427 - DNA, 15 bp, Homo sapiens
attcaatgggtctgg

SEQ ID NO: 5428 - DNA, 15 bp, Homo sapiens
tattcaatgggtctg

SEQ ID NO: 5429 - DNA, 15 bp, Homo sapiens
ttattcaatgggtct

SEQ ID NO: 5430 - DNA, 15 bp, Homo sapiens
tttattcaatgggtc

SEQ ID NO: 5431 - DNA, 15 bp, Homo sapiens
ttttattcaatgggt

SEQ ID NO: 5432 - DNA, 15 bp, Homo sapiens
tttttattcaatggg

SEQ ID NO: 5433 - DNA, 15 bp, Homo sapiens
atttttattcaatgg

SEQ ID NO: 5434 - DNA, 15 bp, Homo sapiens
aatttttattcaatg

SEQ ID NO: 5435 - DNA, 15 bp, Homo sapiens
aaatttttattcaat

SEQ ID NO: 5436 - DNA, 15 bp, Homo sapiens
gaaatttttattcaa

SEQ ID NO: 5437 - DNA, 15 bp, Homo sapiens
agaaatttttattca

SEQ ID NO: 5438 - DNA, 15 bp, Homo sapiens
cagaaatttttattc

SEQ ID NO: 5439 - DNA, 15 bp, Homo sapiens
acagaaatttttatt

SEQ ID NO: 5440 - DNA, 15 bp, Homo sapiens
tacagaaatttttat

SEQ ID NO: 5441 - DNA, 15 bp, Homo sapiens
atacagaaattttta

SEQ ID NO: 5442 - DNA, 15 bp, Homo sapiens
aatacagaaattttt

SEQ ID NO: 5443 - DNA, 15 bp, Homo sapiens
aaatacagaaatttt

SEQ ID NO: 5444 - DNA, 15 bp, Homo sapiens
aaaatacagaaattt

SEQ ID NO: 5445 - DNA, 15 bp, Homo sapiens
aaaaatacagaaatt

SEQ ID NO: 5446 - DNA, 15 bp, Homo sapiens
taaaaatacagaaat

SEQ ID NO: 5447 - DNA, 15 bp, Homo sapiens
ttaaaaatacagaaa

SEQ ID NO: 5448 - DNA, 15 bp, Homo sapiens
tttaaaaatacagaa

SEQ ID NO: 5449 - DNA, 15 bp, Homo sapiens
ttttaaaaatacaga

SEQ ID NO: 5450 - DNA, 15 bp, Homo sapiens
tttttaaaaatacag

SEQ ID NO: 5451 - DNA, 15 bp, Homo sapiens
ctttttaaaaataca

SEQ ID NO: 5452 - DNA, 15 bp, Homo sapiens
gctttttaaaaatac

SEQ ID NO: 5453 - DNA, 15 bp, Homo sapiens
agctttttaaaaata

SEQ ID NO: 5454 - DNA, 15 bp, Homo sapiens
aagctttttaaaaat

SEQ ID NO: 5455 - DNA, 15 bp, Homo sapiens
gaagctttttaaaaa

SEQ ID NO: 5456 - DNA, 15 bp, Homo sapiens
tgaagctttttaaaa

SEQ ID NO: 5457 - DNA, 15 bp, Homo sapiens
ttgaagctttttaaa

SEQ ID NO: 5458 - DNA, 15 bp, Homo sapiens
tttgaagctttttaa

SEQ ID NO: 5459 - DNA, 15 bp, Homo sapiens
atttgaagcttttta

SEQ ID NO: 5460 - DNA, 15 bp, Homo sapiens
tatttgaagcttttt

SEQ ID NO: 5461 - DNA, 15 bp, Homo sapiens
atatttgaagctttt

SEQ ID NO: 5462 - DNA, 15 bp, Homo sapiens
catatttgaagcttt

SEQ ID NO: 5463 - DNA, 15 bp, Homo sapiens
tcatatttgaagctt

SEQ ID NO: 5464 - DNA, 15 bp, Homo sapiens
atcatatttgaagct

SEQ ID NO: 5465 - DNA, 15 bp, Homo sapiens
aatcatatttgaagc

SEQ ID NO: 5466 - DNA, 15 bp, Homo sapiens
gaatcatatttgaag

SEQ ID NO: 5467 - DNA, 15 bp, Homo sapiens
agaatcatatttgaa

SEQ ID NO: 5468 - DNA, 15 bp, Homo sapiens
cagaatcatatttga

SEQ ID NO: 5469 - DNA, 15 bp, Homo sapiens
tcagaatcatatttg

SEQ ID NO: 5470 - DNA, 15 bp, Homo sapiens
ctcagaatcatattt

SEQ ID NO: 5471 - DNA, 15 bp, Homo sapiens
tctcagaatcatatt

SEQ ID NO: 5472 - DNA, 15 bp, Homo sapiens
gtctcagaatcatat

SEQ ID NO: 5473 - DNA, 15 bp, Homo sapiens
tgtctcagaatcata

SEQ ID NO: 5474 - DNA, 15 bp, Homo sapiens
ttgtctcagaatcat

SEQ ID NO: 5475 - DNA, 15 bp, Homo sapiens
tttgtctcagaatca

SEQ ID NO: 5476 - DNA, 15 bp, Homo sapiens
gtttgtctcagaatc

SEQ ID NO: 5477 - DNA, 15 bp, Homo sapiens
agtttgtctcagaat

SEQ ID NO: 5478 - DNA, 15 bp, Homo sapiens
gagtttgtctcagaa

SEQ ID NO: 5479 - DNA, 15 bp, Homo sapiens
tgagtttgtctcaga

SEQ ID NO: 5480 - DNA, 15 bp, Homo sapiens
ttgagtttgtctcag

SEQ ID NO: 5481 - DNA, 15 bp, Homo sapiens
tttgagtttgtctca

SEQ ID NO: 5482 - DNA, 15 bp, Homo sapiens
ctttgagtttgtctc

SEQ ID NO: 5483 - DNA, 15 bp, Homo sapiens
cctttgagtttgtct

SEQ ID NO: 5484 - DNA, 15 bp, Homo sapiens
ccctttgagtttgtc

SEQ ID NO: 5485 - DNA, 15 bp, Homo sapiens
cccctttgagtttgt

SEQ ID NO: 5486 - DNA, 15 bp, Homo sapiens
tcccctttgagtttg

SEQ ID NO: 5487 - DNA, 15 bp, Homo sapiens
ctcccctttgagttt

SEQ ID NO: 5488 - DNA, 15 bp, Homo sapiens
tctcccctttgagtt

SEQ ID NO: 5489 - DNA, 15 bp, Homo sapiens
atctcccctttgagt

SEQ ID NO: 5490 - DNA, 15 bp, Homo sapiens
tatctcccctttgag

SEQ ID NO: 5491 - DNA, 15 bp, Homo sapiens
atatctcccctttga

SEQ ID NO: 5492 - DNA, 15 bp, Homo sapiens
aatatctcccctttg

SEQ ID NO: 5493 - DNA, 15 bp, Homo sapiens
aaatatctccccttt

SEQ ID NO: 5494 - DNA, 15 bp, Homo sapiens
aaaatatctcccctt

SEQ ID NO: 5495 - DNA, 15 bp, Homo sapiens
aaaaatatctcccct

SEQ ID NO: 5496 - DNA, 15 bp, Homo sapiens
caaaaatatctcccc

SEQ ID NO: 5497 - DNA, 15 bp, Homo sapiens
tcaaaaatatctccc

SEQ ID NO: 5498 - DNA, 15 bp, Homo sapiens
ttcaaaaatatctcc

SEQ ID NO: 5499 - DNA, 15 bp, Homo sapiens
gttcaaaaatatctc

SEQ ID NO: 5500 - DNA, 15 bp, Homo sapiens
tgttcaaaaatatct

SEQ ID NO: 5501 - DNA, 15 bp, Homo sapiens
ctgttcaaaaatatc

SEQ ID NO: 5502 - DNA, 15 bp, Homo sapiens
cctgttcaaaaatat

SEQ ID NO: 5503 - DNA, 15 bp, Homo sapiens
gcctgttcaaaaata

SEQ ID NO: 5504 - DNA, 15 bp, Homo sapiens
tgcctgttcaaaaat

SEQ ID NO: 5505 - DNA, 15 bp, Homo sapiens
ctgcctgttcaaaaa

SEQ ID NO: 5506 - DNA, 15 bp, Homo sapiens
tctgcctgttcaaaa

SEQ ID NO: 5507 - DNA, 15 bp, Homo sapiens
ttctgcctgttcaaa

SEQ ID NO: 5508 - DNA, 15 bp, Homo sapiens
gttctgcctgttcaa

SEQ ID NO: 5509 - DNA, 15 bp, Homo sapiens
tgttctgcctgttca

SEQ ID NO: 5510 - DNA, 15 bp, Homo sapiens
gtgttctgcctgttc

SEQ ID NO: 5511 - DNA, 15 bp, Homo sapiens
agtgttctgcctgtt

SEQ ID NO: 5512 - DNA, 15 bp, Homo sapiens
aagtgttctgcctgt

SEQ ID NO: 5513 - DNA, 15 bp, Homo sapiens
gaagtgttctgcctg

SEQ ID NO: 5514 - DNA, 15 bp, Homo sapiens
agaagtgttctgcct

SEQ ID NO: 5515 - DNA, 15 bp, Homo sapiens
gagaagtgttctgcc

SEQ ID NO: 5516 - DNA, 15 bp, Homo sapiens
tgagaagtgttctgc

SEQ ID NO: 5517 - DNA, 15 bp, Homo sapiens
ctgagaagtgttctg

SEQ ID NO: 5518 - DNA, 15 bp, Homo sapiens
gctgagaagtgttct

SEQ ID NO: 5519 - DNA, 15 bp, Homo sapiens
ggctgagaagtgttc

SEQ ID NO: 5520 - DNA, 15 bp, Homo sapiens
aggctgagaagtgtt

SEQ ID NO: 5521 - DNA, 15 bp, Homo sapiens
aaggctgagaagtgt

SEQ ID NO: 5522 - DNA, 15 bp, Homo sapiens
caaggctgagaagtg

SEQ ID NO: 5523 - DNA, 15 bp, Homo sapiens
tcaaggctgagaagt

SEQ ID NO: 5524 - DNA, 15 bp, Homo sapiens
ttcaaggctgagaag

SEQ ID NO: 5525 - DNA, 15 bp, Homo sapiens
tttcaaggctgagaa

SEQ ID NO: 5526 - DNA, 15 bp, Homo sapiens
ttttcaaggctgaga

SEQ ID NO: 5527 - DNA, 15 bp, Homo sapiens
attttcaaggctgag

SEQ ID NO: 5528 - DNA, 15 bp, Homo sapiens
aattttcaaggctga

SEQ ID NO: 5529 - DNA, 15 bp, Homo sapiens
taattttcaaggctg

SEQ ID NO: 5530 - DNA, 15 bp, Homo sapiens
gtaattttcaaggct

SEQ ID NO: 5531 - DNA, 15 bp, Homo sapiens
tgtaattttcaaggc

SEQ ID NO: 5532 - DNA, 15 bp, Homo sapiens
gtgtaattttcaagg

SEQ ID NO: 5533 - DNA, 15 bp, Homo sapiens
tgtgtaattttcaag

SEQ ID NO: 5534 - DNA, 15 bp, Homo sapiens
ctgtgtaattttcaa

SEQ ID NO: 5535 - DNA, 15 bp, Homo sapiens
tctgtgtaattttca

SEQ ID NO: 5536 - DNA, 15 bp, Homo sapiens
ttctgtgtaattttc

SEQ ID NO: 5537 - DNA, 15 bp, Homo sapiens
gttctgtgtaatttt

SEQ ID NO: 5538 - DNA, 15 bp, Homo sapiens
agttctgtgtaattt

SEQ ID NO: 5539 - DNA, 15 bp, Homo sapiens
gagttctgtgtaatt

SEQ ID NO: 5540 - DNA, 15 bp, Homo sapiens
ggagttctgtgtaat

SEQ ID NO: 5541 - DNA, 15 bp, Homo sapiens
tggagttctgtgtaa

SEQ ID NO: 5542 - DNA, 15 bp, Homo sapiens
gtggagttctgtgta

SEQ ID NO: 5543 - DNA, 15 bp, Homo sapiens
ggtggagttctgtgt

SEQ ID NO: 5544 - DNA, 15 bp, Homo sapiens
gggtggagttctgtg

SEQ ID NO: 5545 - DNA, 15 bp, Homo sapiens
agggtggagttctgt

SEQ ID NO: 5546 - DNA, 15 bp, Homo sapiens
cagggtggagttctg

SEQ ID NO: 5547 - DNA, 15 bp, Homo sapiens
tcagggtggagttct

SEQ ID NO: 5548 - DNA, 15 bp, Homo sapiens
ctcagggtggagttc

SEQ ID NO: 5549 - DNA, 15 bp, Homo sapiens
actcagggtggagtt

SEQ ID NO: 5550 - DNA, 15 bp, Homo sapiens
cactcagggtggagt

SEQ ID NO: 5551 - DNA, 15 bp, Homo sapiens
acactcagggtggag

SEQ ID NO: 5552 - DNA, 15 bp, Homo sapiens
cacactcagggtgga

SEQ ID NO: 5553 - DNA, 15 bp, Homo sapiens
tcacactcagggtgg

SEQ ID NO: 5554 - DNA, 15 bp, Homo sapiens
ttcacactcagggtg

SEQ ID NO: 5555 - DNA, 15 bp, Homo sapiens
gttcacactcagggt

SEQ ID NO: 5556 - DNA, 15 bp, Homo sapiens
tgttcacactcaggg

SEQ ID NO: 5557 - DNA, 15 bp, Homo sapiens
gtgttcacactcagg

SEQ ID NO: 5558 - DNA, 15 bp, Homo sapiens
agtgttcacactcag

SEQ ID NO: 5559 - DNA, 15 bp, Homo sapiens
tagtgttcacactca

SEQ ID NO: 5560 - DNA, 15 bp, Homo sapiens
atagtgttcacactc

SEQ ID NO: 5561 - DNA, 15 bp, Homo sapiens
tatagtgttcacact

SEQ ID NO: 5562 - DNA, 15 bp, Homo sapiens
gtatagtgttcacac

SEQ ID NO: 5563 - DNA, 15 bp, Homo sapiens
agtatagtgttcaca

SEQ ID NO: 5564 - DNA, 15 bp, Homo sapiens
aagtatagtgttcac

SEQ ID NO: 5565 - DNA, 15 bp, Homo sapiens
taagtatagtgttca

SEQ ID NO: 5566 - DNA, 15 bp, Homo sapiens
ttaagtatagtgttc

SEQ ID NO: 5567 - DNA, 15 bp, Homo sapiens
cttaagtatagtgtt

SEQ ID NO: 5568 - DNA, 15 bp, Homo sapiens
acttaagtatagtgt

SEQ ID NO: 5569 - DNA, 15 bp, Homo sapiens
tacttaagtatagtg

SEQ ID NO: 5570 - DNA, 15 bp, Homo sapiens
ttacttaagtatagt

SEQ ID NO: 5571 - DNA, 15 bp, Homo sapiens
gttacttaagtatag

SEQ ID NO: 5572 - DNA, 15 bp, Homo sapiens
agttacttaagtata

SEQ ID NO: 5573 - DNA, 15 bp, Homo sapiens
aagttacttaagtat

SEQ ID NO: 5574 - DNA, 15 bp, Homo sapiens
aaagttacttaagta

SEQ ID NO: 5575 - DNA, 15 bp, Homo sapiens
caaagttacttaagt

SEQ ID NO: 5576 - DNA, 15 bp, Homo sapiens
tcaaagttacttaag

SEQ ID NO: 5577 - DNA, 15 bp, Homo sapiens
ttcaaagttacttaa

SEQ ID NO: 5578 - DNA, 15 bp, Homo sapiens
tttcaaagttactta

SEQ ID NO: 5579 - DNA, 15 bp, Homo sapiens
ttttcaaagttactt

SEQ ID NO: 5580 - DNA, 15 bp, Homo sapiens
cttttcaaagttact

SEQ ID NO: 5581 - DNA, 15 bp, Homo sapiens
acttttcaaagttac

SEQ ID NO: 5582 - DNA, 15 bp, Homo sapiens
aacttttcaaagtta

SEQ ID NO: 5583 - DNA, 15 bp, Homo sapiens
taacttttcaaagtt

SEQ ID NO: 5584 - DNA, 15 bp, Homo sapiens
gtaacttttcaaagt

SEQ ID NO: 5585 - DNA, 15 bp, Homo sapiens
agtaacttttcaaag

SEQ ID NO: 5586 - DNA, 15 bp, Homo sapiens
aagtaacttttcaaa

SEQ ID NO: 5587 - DNA, 15 bp, Homo sapiens
aaagtaacttttcaa

SEQ ID NO: 5588 - DNA, 15 bp, Homo sapiens
caaagtaacttttca

SEQ ID NO: 5589 - DNA, 15 bp, Homo sapiens
tcaaagtaacttttc

SEQ ID NO: 5590 - DNA, 15 bp, Homo sapiens
ctcaaagtaactttt

SEQ ID NO: 5591 - DNA, 15 bp, Homo sapiens
cctcaaagtaacttt

SEQ ID NO: 5592 - DNA, 15 bp, Homo sapiens
acctcaaagtaactt

SEQ ID NO: 5593 - DNA, 15 bp, Homo sapiens
tacctcaaagtaact

SEQ ID NO: 5594 - DNA, 15 bp, Homo sapiens
atacctcaaagtaac

SEQ ID NO: 5595 - DNA, 15 bp, Homo sapiens
tatacctcaaagtaa

SEQ ID NO: 5596 - DNA, 15 bp, Homo sapiens
ttatacctcaaagta

SEQ ID NO: 5597 - DNA, 15 bp, Homo sapiens
tttatacctcaaagt

SEQ ID NO: 5598 - DNA, 15 bp, Homo sapiens
ttttatacctcaaag

SEQ ID NO: 5599 - DNA, 15 bp, Homo sapiens
attttatacctcaaa

SEQ ID NO: 5600 - DNA, 15 bp, Homo sapiens
aattttatacctcaa

SEQ ID NO: 5601 - DNA, 15 bp, Homo sapiens
taattttatacctca

SEQ ID NO: 5602 - DNA, 15 bp, Homo sapiens
gtaattttatacctc

SEQ ID NO: 5603 - DNA, 15 bp, Homo sapiens
tgtaattttatacct

SEQ ID NO: 5604 - DNA, 15 bp, Homo sapiens
atgtaattttatacc

SEQ ID NO: 5605 - DNA, 15 bp, Homo sapiens
gatgtaattttatac

SEQ ID NO: 5606 - DNA, 15 bp, Homo sapiens
ggatgtaattttata

SEQ ID NO: 5607 - DNA, 15 bp, Homo sapiens
tggatgtaattttat

SEQ ID NO: 5608 - DNA, 15 bp, Homo sapiens
ctggatgtaatttta

SEQ ID NO: 5609 - DNA, 15 bp, Homo sapiens
actggatgtaatttt

SEQ ID NO: 5610 - DNA, 15 bp, Homo sapiens
cactggatgtaattt

SEQ ID NO: 5611 - DNA, 15 bp, Homo sapiens
acactggatgtaatt

SEQ ID NO: 5612 - DNA, 15 bp, Homo sapiens
gacactggatgtaat

SEQ ID NO: 5613 - DNA, 15 bp, Homo sapiens
tgacactggatgtaa

SEQ ID NO: 5614 - DNA, 15 bp, Homo sapiens
gtgacactggatgta

SEQ ID NO: 5615 - DNA, 15 bp, Homo sapiens
agtgacactggatgt

SEQ ID NO: 5616 - DNA, 15 bp, Homo sapiens
aagtgacactggatg

SEQ ID NO: 5617 - DNA, 15 bp, Homo sapiens
aaagtgacactggat

SEQ ID NO: 5618 - DNA, 15 bp, Homo sapiens
taaagtgacactgga

SEQ ID NO: 5619 - DNA, 15 bp, Homo sapiens
ttaaagtgacactgg

SEQ ID NO: 5620 - DNA, 15 bp, Homo sapiens
tttaaagtgacactg

SEQ ID NO: 5621 - DNA, 15 bp, Homo sapiens
ctttaaagtgacact

SEQ ID NO: 5622 - DNA, 15 bp, Homo sapiens
tctttaaagtgacac

SEQ ID NO: 5623 - DNA, 15 bp, Homo sapiens
gtctttaaagtgaca

SEQ ID NO: 5624 - DNA, 15 bp, Homo sapiens
tgtctttaaagtgac

SEQ ID NO: 5625 - DNA, 15 bp, Homo sapiens
ttgtctttaaagtga

SEQ ID NO: 5626 - DNA, 15 bp, Homo sapiens
tttgtctttaaagtg

SEQ ID NO: 5627 - DNA, 15 bp, Homo sapiens
ttttgtctttaaagt

SEQ ID NO: 5628 - DNA, 15 bp, Homo sapiens
tttttgtctttaaag

SEQ ID NO: 5629 - DNA, 15 bp, Homo sapiens
ttttttgtctttaaa

SEQ ID NO: 5630 - DNA, 15 bp, Homo sapiens
cttttttgtctttaa

SEQ ID NO: 5631 - DNA, 15 bp, Homo sapiens
ccttttttgtcttta

SEQ ID NO: 5632 - DNA, 15 bp, Homo sapiens
tccttttttgtcttt

SEQ ID NO: 5633 - DNA, 15 bp, Homo sapiens
ttccttttttgtctt

SEQ ID NO: 5634 - DNA, 15 bp, Homo sapiens
gttccttttttgtct

SEQ ID NO: 5635 - DNA, 15 bp, Homo sapiens
ggttccttttttgtc

SEQ ID NO: 5636 - DNA, 15 bp, Homo sapiens
gggttccttttttgt

SEQ ID NO: 5637 - DNA, 15 bp, Homo sapiens
tgggttccttttttg

SEQ ID NO: 5638 - DNA, 15 bp, Homo sapiens
ttgggttcctttttt

SEQ ID NO: 5639 - DNA, 15 bp, Homo sapiens
tttgggttccttttt

SEQ ID NO: 5640 - DNA, 15 bp, Homo sapiens
ctttgggttcctttt

SEQ ID NO: 5641 - DNA, 15 bp, Homo sapiens
gctttgggttccttt

SEQ ID NO: 5642 - DNA, 15 bp, Homo sapiens
ggctttgggttcctt

SEQ ID NO: 5643 - DNA, 15 bp, Homo sapiens
aggctttgggttcct

SEQ ID NO: 5644 - DNA, 15 bp, Homo sapiens
caggctttgggttcc

SEQ ID NO: 5645 - DNA, 15 bp, Homo sapiens
acaggctttgggttc

SEQ ID NO: 5646 - DNA, 15 bp, Homo sapiens
aacaggctttgggtt

SEQ ID NO: 5647 - DNA, 15 bp, Homo sapiens
aaacaggctttgggt

SEQ ID NO: 5648 - DNA, 15 bp, Homo sapiens
aaaacaggctttggg

SEQ ID NO: 5649 - DNA, 15 bp, Homo sapiens
aaaaacaggctttgg

SEQ ID NO: 5650 - DNA, 15 bp, Homo sapiens
caaaaacaggctttg

SEQ ID NO: 5651 - DNA, 15 bp, Homo sapiens
gcaaaaacaggcttt

SEQ ID NO: 5652 - DNA, 15 bp, Homo sapiens
agcaaaaacaggctt

SEQ ID NO: 5653 - DNA, 15 bp, Homo sapiens
cagcaaaaacaggct

SEQ ID NO: 5654 - DNA, 15 bp, Homo sapiens
acagcaaaaacaggc

SEQ ID NO: 5655 - DNA, 15 bp, Homo sapiens
cacagcaaaaacagg

SEQ ID NO: 5656 - DNA, 15 bp, Homo sapiens
acacagcaaaaacag

SEQ ID NO: 5657 - DNA, 15 bp, Homo sapiens
cacacagcaaaaaca

SEQ ID NO: 5658 - DNA, 15 bp, Homo sapiens
tcacacagcaaaaac

SEQ ID NO: 5659 - DNA, 15 bp, Homo sapiens
ttcacacagcaaaaa

SEQ ID NO: 5660 - DNA, 15 bp, Homo sapiens
gttcacacagcaaaa

SEQ ID NO: 5661 - DNA, 15 bp, Homo sapiens
ggttcacacagcaaa

SEQ ID NO: 5662 - DNA, 15 bp, Homo sapiens
tggttcacacagcaa

SEQ ID NO: 5663 - DNA, 15 bp, Homo sapiens
atggttcacacagca

SEQ ID NO: 5664 - DNA, 15 bp, Homo sapiens
gatggttcacacagc

SEQ ID NO: 5665 - DNA, 15 bp, Homo sapiens
agatggttcacacag

SEQ ID NO: 5666 - DNA, 15 bp, Homo sapiens
aagatggttcacaca

SEQ ID NO: 5667 - DNA, 15 bp, Homo sapiens
aaagatggttcacac

SEQ ID NO: 5668 - DNA, 15 bp, Homo sapiens
taaagatggttcaca

SEQ ID NO: 5669 - DNA, 15 bp, Homo sapiens
ataaagatggttcac

SEQ ID NO: 5670 - DNA, 15 bp, Homo sapiens
cataaagatggttca

SEQ ID NO: 5671 - DNA, 15 bp, Homo sapiens
acataaagatggttc

SEQ ID NO: 5672 - DNA, 15 bp, Homo sapiens
aacataaagatggtt

SEQ ID NO: 5673 - DNA, 15 bp, Homo sapiens
gaacataaagatggt

SEQ ID NO: 5674 - DNA, 15 bp, Homo sapiens
agaacataaagatgg

SEQ ID NO: 5675 - DNA, 15 bp, Homo sapiens
cagaacataaagatg

SEQ ID NO: 5676 - DNA, 15 bp, Homo sapiens
acagaacataaagat

SEQ ID NO: 5677 - DNA, 15 bp, Homo sapiens
aacagaacataaaga

SEQ ID NO: 5678 - DNA, 15 bp, Homo sapiens
taacagaacataaag

SEQ ID NO: 5679 - DNA, 15 bp, Homo sapiens
ctaacagaacataaa

SEQ ID NO: 5680 - DNA, 15 bp, Homo sapiens
cctaacagaacataa

SEQ ID NO: 5681 - DNA, 15 bp, Homo sapiens
tcctaacagaacata

SEQ ID NO: 5682 - DNA, 15 bp, Homo sapiens
ctcctaacagaacat

SEQ ID NO: 5683 - DNA, 15 bp, Homo sapiens
gctcctaacagaaca

SEQ ID NO: 5684 - DNA, 15 bp, Homo sapiens
agctcctaacagaac

SEQ ID NO: 5685 - DNA, 15 bp, Homo sapiens
aagctcctaacagaa

SEQ ID NO: 5686 - DNA, 15 bp, Homo sapiens
caagctcctaacaga

SEQ ID NO: 5687 - DNA, 15 bp, Homo sapiens
acaagctcctaacag

SEQ ID NO: 5688 - DNA, 15 bp, Homo sapiens
aacaagctcctaaca

SEQ ID NO: 5689 - DNA, 15 bp, Homo sapiens
aaacaagctcctaac

SEQ ID NO: 5690 - DNA, 15 bp, Homo sapiens
gaaacaagctcctaa

SEQ ID NO: 5691 - DNA, 15 bp, Homo sapiens
agaaacaagctccta

SEQ ID NO: 5692 - DNA, 15 bp, Homo sapiens
aagaaacaagctcct

SEQ ID NO: 5693 - DNA, 15 bp, Homo sapiens
taagaaacaagctcc

SEQ ID NO: 5694 - DNA, 15 bp, Homo sapiens
ataagaaacaagctc

SEQ ID NO: 5695 - DNA, 15 bp, Homo sapiens
aataagaaacaagct

SEQ ID NO: 5696 - DNA, 15 bp, Homo sapiens
taataagaaacaagc

SEQ ID NO: 5697 - DNA, 15 bp, Homo sapiens
ataataagaaacaag

SEQ ID NO: 5698 - DNA, 15 bp, Homo sapiens
cataataagaaacaa

SEQ ID NO: 5699 - DNA, 15 bp, Homo sapiens
acataataagaaaca

SEQ ID NO: 5700 - DNA, 15 bp, Homo sapiens
cacataataagaaac

SEQ ID NO: 5701 - DNA, 15 bp, Homo sapiens
tcacataataagaaa

SEQ ID NO: 5702 - DNA, 15 bp, Homo sapiens
ttcacataataagaa

SEQ ID NO: 5703 - DNA, 15 bp, Homo sapiens
tttcacataataaga

SEQ ID NO: 5704 - DNA, 15 bp, Homo sapiens
gtttcacataataag

SEQ ID NO: 5705 - DNA, 15 bp, Homo sapiens
agtttcacataataa

SEQ ID NO: 5706 - DNA, 15 bp, Homo sapiens
cagtttcacataata

SEQ ID NO: 5707 - DNA, 15 bp, Homo sapiens
acagtttcacataat

SEQ ID NO: 5708 - DNA, 15 bp, Homo sapiens
tacagtttcacataa

SEQ ID NO: 5709 - DNA, 15 bp, Homo sapiens
ctacagtttcacata

SEQ ID NO: 5710 - DNA, 15 bp, Homo sapiens
tctacagtttcacat

SEQ ID NO: 5711 - DNA, 15 bp, Homo sapiens
ttctacagtttcaca

SEQ ID NO: 5712 - DNA, 15 bp, Homo sapiens
tttctacagtttcac

SEQ ID NO: 5713 - DNA, 15 bp, Homo sapiens
atttctacagtttca

SEQ ID NO: 5714 - DNA, 15 bp, Homo sapiens
tatttctacagtttc

SEQ ID NO: 5715 - DNA, 15 bp, Homo sapiens
gtatttctacagttt

SEQ ID NO: 5716 - DNA, 15 bp, Homo sapiens
tgtatttctacagtt

SEQ ID NO: 5717 - DNA, 15 bp, Homo sapiens
gtgtatttctacagt

SEQ ID NO: 5718 - DNA, 15 bp, Homo sapiens
tgtgtatttctacag

SEQ ID NO: 5719 - DNA, 15 bp, Homo sapiens
ctgtgtatttctaca

SEQ ID NO: 5720 - DNA, 15 bp, Homo sapiens
actgtgtatttctac

SEQ ID NO: 5721 - DNA, 15 bp, Homo sapiens
cactgtgtatttcta

SEQ ID NO: 5722 - DNA, 15 bp, Homo sapiens
tcactgtgtatttct

SEQ ID NO: 5723 - DNA, 15 bp, Homo sapiens
ttcactgtgtatttc

SEQ ID NO: 5724 - DNA, 15 bp, Homo sapiens
tttcactgtgtattt

SEQ ID NO: 5725 - DNA, 15 bp, Homo sapiens
ttttcactgtgtatt

SEQ ID NO: 5726 - DNA, 15 bp, Homo sapiens
attttcactgtgtat

SEQ ID NO: 5727 - DNA, 15 bp, Homo sapiens
tattttcactgtgta

SEQ ID NO: 5728 - DNA, 15 bp, Homo sapiens
ttattttcactgtgt

SEQ ID NO: 5729 - DNA, 15 bp, Homo sapiens
cttattttcactgtg

SEQ ID NO: 5730 - DNA, 15 bp, Homo sapiens
tcttattttcactgt

SEQ ID NO: 5731 - DNA, 15 bp, Homo sapiens
atcttattttcactg

SEQ ID NO: 5732 - DNA, 15 bp, Homo sapiens
gatcttattttcact

SEQ ID NO: 5733 - DNA, 15 bp, Homo sapiens
agatcttattttcac

SEQ ID NO: 5734 - DNA, 15 bp, Homo sapiens
tagatcttattttca

SEQ ID NO: 5735 - DNA, 15 bp, Homo sapiens
ttagatcttattttc

SEQ ID NO: 5736 - DNA, 15 bp, Homo sapiens
tttagatcttatttt

SEQ ID NO: 5737 - DNA, 15 bp, Homo sapiens
atttagatcttattt

SEQ ID NO: 5738 - DNA, 15 bp, Homo sapiens
aatttagatcttatt

SEQ ID NO: 5739 - DNA, 15 bp, Homo sapiens
taatttagatcttat

SEQ ID NO: 5740 - DNA, 15 bp, Homo sapiens
ttaatttagatctta

SEQ ID NO: 5741 - DNA, 15 bp, Homo sapiens
gttaatttagatctt

SEQ ID NO: 5742 - DNA, 15 bp, Homo sapiens
agttaatttagatct

SEQ ID NO: 5743 - DNA, 15 bp, Homo sapiens
cagttaatttagatc

SEQ ID NO: 5744 - DNA, 15 bp, Homo sapiens
acagttaatttagat

SEQ ID NO: 5745 - DNA, 15 bp, Homo sapiens
gacagttaatttaga

SEQ ID NO: 5746 - DNA, 15 bp, Homo sapiens
agacagttaatttag

SEQ ID NO: 5747 - DNA, 15 bp, Homo sapiens
aagacagttaattta

SEQ ID NO: 5748 - DNA, 15 bp, Homo sapiens
taagacagttaattt

SEQ ID NO: 5749 - DNA, 15 bp, Homo sapiens
ttaagacagttaatt

SEQ ID NO: 5750 - DNA, 15 bp, Homo sapiens
tttaagacagttaat

SEQ ID NO: 5751 - DNA, 15 bp, Homo sapiens
ttttaagacagttaa

SEQ ID NO: 5752 - DNA, 15 bp, Homo sapiens
attttaagacagtta

SEQ ID NO: 5753 - DNA, 15 bp, Homo sapiens
tattttaagacagtt

SEQ ID NO: 5754 - DNA, 15 bp, Homo sapiens
gtattttaagacagt

SEQ ID NO: 5755 - DNA, 15 bp, Homo sapiens
tgtattttaagacag

SEQ ID NO: 5756 - DNA, 15 bp, Homo sapiens
gtgtattttaagaca

SEQ ID NO: 5757 - DNA, 15 bp, Homo sapiens
tgtgtattttaagac

SEQ ID NO: 5758 - DNA, 15 bp, Homo sapiens
atgtgtattttaaga

SEQ ID NO: 5759 - DNA, 15 bp, Homo sapiens
aatgtgtattttaag

SEQ ID NO: 5760 - DNA, 15 bp, Homo sapiens
aaatgtgtattttaa

SEQ ID NO: 5761 - DNA, 15 bp, Homo sapiens
aaaatgtgtatttta

SEQ ID NO: 5762 - DNA, 15 bp, Homo sapiens
gaaaatgtgtatttt

SEQ ID NO: 5763 - DNA, 15 bp, Homo sapiens
ggaaaatgtgtattt

SEQ ID NO: 5764 - DNA, 15 bp, Homo sapiens
aggaaaatgtgtatt

SEQ ID NO: 5765 - DNA, 15 bp, Homo sapiens
gaggaaaatgtgtat

SEQ ID NO: 5766 - DNA, 15 bp, Homo sapiens
ggaggaaaatgtgta

SEQ ID NO: 5767 - DNA, 15 bp, Homo sapiens
tggaggaaaatgtgt

SEQ ID NO: 5768 - DNA, 15 bp, Homo sapiens
atggaggaaaatgtg

SEQ ID NO: 5769 - DNA, 15 bp, Homo sapiens
catggaggaaaatgt

SEQ ID NO: 5770 - DNA, 15 bp, Homo sapiens
tcatggaggaaaatg

SEQ ID NO: 5771 - DNA, 15 bp, Homo sapiens
atcatggaggaaaat

SEQ ID NO: 5772 - DNA, 15 bp, Homo sapiens
tatcatggaggaaaa

SEQ ID NO: 5773 - DNA, 15 bp, Homo sapiens
gtatcatggaggaaa

SEQ ID NO: 5774 - DNA, 15 bp, Homo sapiens
ggtatcatggaggaa

SEQ ID NO: 5775 - DNA, 15 bp, Homo sapiens
cggtatcatggagga

SEQ ID NO: 5776 - DNA, 15 bp, Homo sapiens
ccggtatcatggagg

SEQ ID NO: 5777 - DNA, 15 bp, Homo sapiens
accggtatcatggag

SEQ ID NO: 5778 - DNA, 15 bp, Homo sapiens
caccggtatcatgga

SEQ ID NO: 5779 - DNA, 15 bp, Homo sapiens
acaccggtatcatgg

SEQ ID NO: 5780 - DNA, 15 bp, Homo sapiens
aacaccggtatcatg

SEQ ID NO: 5781 - DNA, 15 bp, Homo sapiens
caacaccggtatcat

SEQ ID NO: 5782 - DNA, 15 bp, Homo sapiens
ccaacaccggtatca

SEQ ID NO: 5783 - DNA, 15 bp, Homo sapiens
accaacaccggtatc

SEQ ID NO: 5784 - DNA, 15 bp, Homo sapiens
aaccaacaccggtat

SEQ ID NO: 5785 - DNA, 15 bp, Homo sapiens
caaccaacaccggta

SEQ ID NO: 5786 - DNA, 15 bp, Homo sapiens
tcaaccaacaccggt

SEQ ID NO: 5787 - DNA, 15 bp, Homo sapiens
atcaaccaacaccgg

SEQ ID NO: 5788 - DNA, 15 bp, Homo sapiens
aatcaaccaacaccg

SEQ ID NO: 5789 - DNA, 15 bp, Homo sapiens
caatcaaccaacacc

SEQ ID NO: 5790 - DNA, 15 bp, Homo sapiens
tcaatcaaccaacac

SEQ ID NO: 5791 - DNA, 15 bp, Homo sapiens
atcaatcaaccaaca

SEQ ID NO: 5792 - DNA, 15 bp, Homo sapiens
tatcaatcaaccaac

SEQ ID NO: 5793 - DNA, 15 bp, Homo sapiens
ttatcaatcaaccaa

SEQ ID NO: 5794 - DNA, 15 bp, Homo sapiens
tttatcaatcaacca

SEQ ID NO: 5795 - DNA, 15 bp, Homo sapiens
ctttatcaatcaacc

SEQ ID NO: 5796 - DNA, 15 bp, Homo sapiens
tctttatcaatcaac

SEQ ID NO: 5797 - DNA, 15 bp, Homo sapiens
atctttatcaatcaa

SEQ ID NO: 5798 - DNA, 15 bp, Homo sapiens
aatctttatcaatca

SEQ ID NO: 5799 - DNA, 15 bp, Homo sapiens
aaatctttatcaatc

SEQ ID NO: 5800 - DNA, 15 bp, Homo sapiens
aaaatctttatcaat

SEQ ID NO: 5801 - DNA, 15 bp, Homo sapiens
taaaatctttatcaa

SEQ ID NO: 5802 - DNA, 15 bp, Homo sapiens
ctaaaatctttatca

SEQ ID NO: 5803 - DNA, 15 bp, Homo sapiens
actaaaatctttatc

SEQ ID NO: 5804 - DNA, 15 bp, Homo sapiens
aactaaaatctttat

SEQ ID NO: 5805 - DNA, 15 bp, Homo sapiens
taactaaaatcttta

SEQ ID NO: 5806 - DNA, 15 bp, Homo sapiens
ataactaaaatcttt

SEQ ID NO: 5807 - DNA, 15 bp, Homo sapiens
aataactaaaatctt

SEQ ID NO: 5808 - DNA, 15 bp, Homo sapiens
taataactaaaatct

SEQ ID NO: 5809 - DNA, 15 bp, Homo sapiens
gtaataactaaaatc

SEQ ID NO: 5810 - DNA, 15 bp, Homo sapiens
tgtaataactaaaat

SEQ ID NO: 5811 - DNA, 15 bp, Homo sapiens
ctgtaataactaaaa

SEQ ID NO: 5812 - DNA, 15 bp, Homo sapiens
tctgtaataactaaa

SEQ ID NO: 5813 - DNA, 15 bp, Homo sapiens
atctgtaataactaa

SEQ ID NO: 5814 - DNA, 15 bp, Homo sapiens
aatctgtaataacta

SEQ ID NO: 5815 - DNA, 15 bp, Homo sapiens
aaatctgtaataact

SEQ ID NO: 5816 - DNA, 15 bp, Homo sapiens
caaatctgtaataac

SEQ ID NO: 5817 - DNA, 15 bp, Homo sapiens
ccaaatctgtaataa

SEQ ID NO: 5818 - DNA, 15 bp, Homo sapiens
gccaaatctgtaata

SEQ ID NO: 5819 - DNA, 15 bp, Homo sapiens
agccaaatctgtaat

SEQ ID NO: 5820 - DNA, 15 bp, Homo sapiens
cagccaaatctgtaa

SEQ ID NO: 5821 - DNA, 15 bp, Homo sapiens
acagccaaatctgta

SEQ ID NO: 5822 - DNA, 15 bp, Homo sapiens
tacagccaaatctgt

SEQ ID NO: 5823 - DNA, 15 bp, Homo sapiens
ttacagccaaatctg

SEQ ID NO: 5824 - DNA, 15 bp, Homo sapiens
tttacagccaaatct

SEQ ID NO: 5825 - DNA, 15 bp, Homo sapiens
atttacagccaaatc

SEQ ID NO: 5826 - DNA, 15 bp, Homo sapiens
tatttacagccaaat

SEQ ID NO: 5827 - DNA, 15 bp, Homo sapiens
atatttacagccaaa

SEQ ID NO: 5828 - DNA, 15 bp, Homo sapiens
catatttacagccaa

SEQ ID NO: 5829 - DNA, 15 bp, Homo sapiens
acatatttacagcca

SEQ ID NO: 5830 - DNA, 15 bp, Homo sapiens
tacatatttacagcc

SEQ ID NO: 5831 - DNA, 15 bp, Homo sapiens
ctacatatttacagc

SEQ ID NO: 5832 - DNA, 15 bp, Homo sapiens
gctacatatttacag

SEQ ID NO: 5833 - DNA, 15 bp, Homo sapiens
tgctacatatttaca

SEQ ID NO: 5834 - DNA, 15 bp, Homo sapiens
ttgctacatatttac

SEQ ID NO: 5835 - DNA, 15 bp, Homo sapiens
gttgctacatattta

SEQ ID NO: 5836 - DNA, 15 bp, Homo sapiens
agttgctacatattt

SEQ ID NO: 5837 - DNA, 15 bp, Homo sapiens
tagttgctacatatt

SEQ ID NO: 5838 - DNA, 15 bp, Homo sapiens
atagttgctacatat

SEQ ID NO: 5839 - DNA, 15 bp, Homo sapiens
aatagttgctacata

SEQ ID NO: 5840 - DNA, 15 bp, Homo sapiens
caatagttgctacat

SEQ ID NO: 5841 - DNA, 15 bp, Homo sapiens
acaatagttgctaca

SEQ ID NO: 5842 - DNA, 15 bp, Homo sapiens
cacaatagttgctac

SEQ ID NO: 5843 - DNA, 15 bp, Homo sapiens
acacaatagttgcta

SEQ ID NO: 5844 - DNA, 15 bp, Homo sapiens
tacacaatagttgct

SEQ ID NO: 5845 - DNA, 15 bp, Homo sapiens
ctacacaatagttgc

SEQ ID NO: 5846 - DNA, 15 bp, Homo sapiens
gctacacaatagttg

SEQ ID NO: 5847 - DNA, 15 bp, Homo sapiens
agctacacaatagtt

SEQ ID NO: 5848 - DNA, 15 bp, Homo sapiens
aagctacacaatagt

SEQ ID NO: 5849 - DNA, 15 bp, Homo sapiens
caagctacacaatag

SEQ ID NO: 5850 - DNA, 15 bp, Homo sapiens
tcaagctacacaata

SEQ ID NO: 5851 - DNA, 15 bp, Homo sapiens
gtcaagctacacaat

SEQ ID NO: 5852 - DNA, 15 bp, Homo sapiens
cgtcaagctacacaa

SEQ ID NO: 5853 - DNA, 15 bp, Homo sapiens
ccgtcaagctacaca

SEQ ID NO: 5854 - DNA, 15 bp, Homo sapiens
cccgtcaagctacac

SEQ ID NO: 5855 - DNA, 15 bp, Homo sapiens
acccgtcaagctaca

SEQ ID NO: 5856 - DNA, 15 bp, Homo sapiens
gacccgtcaagctac

SEQ ID NO: 5857 - DNA, 15 bp, Homo sapiens
agacccgtcaagcta

SEQ ID NO: 5858 - DNA, 15 bp, Homo sapiens
aagacccgtcaagct

SEQ ID NO: 5859 - DNA, 15 bp, Homo sapiens
aaagacccgtcaagc

SEQ ID NO: 5860 - DNA, 15 bp, Homo sapiens
aaaagacccgtcaag

SEQ ID NO: 5861 - DNA, 15 bp, Homo sapiens
caaaagacccgtcaa

SEQ ID NO: 5862 - DNA, 15 bp, Homo sapiens
tcaaaagacccgtca

SEQ ID NO: 5863 - DNA, 15 bp, Homo sapiens
ttcaaaagacccgtc

SEQ ID NO: 5864 - DNA, 15 bp, Homo sapiens
cttcaaaagacccgt

SEQ ID NO: 5865 - DNA, 15 bp, Homo sapiens
ccttcaaaagacccg

SEQ ID NO: 5866 - DNA, 15 bp, Homo sapiens
accttcaaaagaccc

SEQ ID NO: 5867 - DNA, 15 bp, Homo sapiens
taccttcaaaagacc

SEQ ID NO: 5868 - DNA, 15 bp, Homo sapiens
ataccttcaaaagac

SEQ ID NO: 5869 - DNA, 15 bp, Homo sapiens
tataccttcaaaaga

SEQ ID NO: 5870 - DNA, 15 bp, Homo sapiens
ctataccttcaaaag

SEQ ID NO: 5871 - DNA, 15 bp, Homo sapiens
gctataccttcaaaa

SEQ ID NO: 5872 - DNA, 15 bp, Homo sapiens
agctataccttcaaa

SEQ ID NO: 5873 - DNA, 15 bp, Homo sapiens
aagctataccttcaa

SEQ ID NO: 5874 - DNA, 15 bp, Homo sapiens
taagctataccttca

SEQ ID NO: 5875 - DNA, 15 bp, Homo sapiens
ttaagctataccttc

SEQ ID NO: 5876 - DNA, 15 bp, Homo sapiens
attaagctatacctt

SEQ ID NO: 5877 - DNA, 15 bp, Homo sapiens
tattaagctatacct

SEQ ID NO: 5878 - DNA, 15 bp, Homo sapiens
atattaagctatacc

SEQ ID NO: 5879 - DNA, 15 bp, Homo sapiens
gatattaagctatac

SEQ ID NO: 5880 - DNA, 15 bp, Homo sapiens
agatattaagctata

SEQ ID NO: 5881 - DNA, 15 bp, Homo sapiens
aagatattaagctat

SEQ ID NO: 5882 - DNA, 15 bp, Homo sapiens
caagatattaagcta

SEQ ID NO: 5883 - DNA, 15 bp, Homo sapiens
acaagatattaagct

SEQ ID NO: 5884 - DNA, 15 bp, Homo sapiens
aacaagatattaagc

SEQ ID NO: 5885 - DNA, 15 bp, Homo sapiens
aaacaagatattaag

SEQ ID NO: 5886 - DNA, 15 bp, Homo sapiens
aaaacaagatattaa

SEQ ID NO: 5887 - DNA, 15 bp, Homo sapiens
taaaacaagatatta

SEQ ID NO: 5888 - DNA, 15 bp, Homo sapiens
ttaaaacaagatatt

SEQ ID NO: 5889 - DNA, 15 bp, Homo sapiens
tttaaaacaagatat

SEQ ID NO: 5890 - DNA, 15 bp, Homo sapiens
ttttaaaacaagata

SEQ ID NO: 5891 - DNA, 15 bp, Homo sapiens
attttaaaacaagat

SEQ ID NO: 5892 - DNA, 15 bp, Homo sapiens
tattttaaaacaaga

SEQ ID NO: 5893 - DNA, 15 bp, Homo sapiens
atattttaaaacaag

SEQ ID NO: 5894 - DNA, 15 bp, Homo sapiens
catattttaaaacaa

SEQ ID NO: 5895 - DNA, 15 bp, Homo sapiens
gcatattttaaaaca

SEQ ID NO: 5896 - DNA, 15 bp, Homo sapiens
agcatattttaaaac

SEQ ID NO: 5897 - DNA, 15 bp, Homo sapiens
aagcatattttaaaa

SEQ ID NO: 5898 - DNA, 15 bp, Homo sapiens
aaagcatattttaaa

SEQ ID NO: 5899 - DNA, 15 bp, Homo sapiens
caaagcatattttaa

SEQ ID NO: 5900 - DNA, 15 bp, Homo sapiens
tcaaagcatatttta

SEQ ID NO: 5901 - DNA, 15 bp, Homo sapiens
ctcaaagcatatttt

SEQ ID NO: 5902 - DNA, 15 bp, Homo sapiens
cctcaaagcatattt

SEQ ID NO: 5903 - DNA, 15 bp, Homo sapiens
tcctcaaagcatatt

SEQ ID NO: 5904 - DNA, 15 bp, Homo sapiens
atcctcaaagcatat

SEQ ID NO: 5905 - DNA, 15 bp, Homo sapiens
catcctcaaagcata

SEQ ID NO: 5906 - DNA, 15 bp, Homo sapiens
acatcctcaaagcat

SEQ ID NO: 5907 - DNA, 15 bp, Homo sapiens
aacatcctcaaagca

SEQ ID NO: 5908 - DNA, 15 bp, Homo sapiens
gaacatcctcaaagc

SEQ ID NO: 5909 - DNA, 15 bp, Homo sapiens
agaacatcctcaaag

SEQ ID NO: 5910 - DNA, 15 bp, Homo sapiens
gagaacatcctcaaa

SEQ ID NO: 5911 - DNA, 15 bp, Homo sapiens
agagaacatcctcaa

SEQ ID NO: 5912 - DNA, 15 bp, Homo sapiens
aagagaacatcctca

SEQ ID NO: 5913 - DNA, 15 bp, Homo sapiens
gaagagaacatcctc

SEQ ID NO: 5914 - DNA, 15 bp, Homo sapiens
ggaagagaacatcct

SEQ ID NO: 5915 - DNA, 15 bp, Homo sapiens
aggaagagaacatcc

SEQ ID NO: 5916 - DNA, 15 bp, Homo sapiens
caggaagagaacatc

SEQ ID NO: 5917 - DNA, 15 bp, Homo sapiens
acaggaagagaacat

SEQ ID NO: 5918 - DNA, 15 bp, Homo sapiens
tacaggaagagaaca

SEQ ID NO: 5919 - DNA, 15 bp, Homo sapiens
ttacaggaagagaac

SEQ ID NO: 5920 - DNA, 15 bp, Homo sapiens
tttacaggaagagaa

SEQ ID NO: 5921 - DNA, 15 bp, Homo sapiens
ttttacaggaagaga

SEQ ID NO: 5922 - DNA, 15 bp, Homo sapiens
attttacaggaagag

SEQ ID NO: 5923 - DNA, 15 bp, Homo sapiens
aattttacaggaaga

SEQ ID NO: 5924 - DNA, 15 bp, Homo sapiens
gaattttacaggaag

SEQ ID NO: 5925 - DNA, 15 bp, Homo sapiens
agaattttacaggaa

SEQ ID NO: 5926 - DNA, 15 bp, Homo sapiens
aagaattttacagga

SEQ ID NO: 5927 - DNA, 15 bp, Homo sapiens
aaagaattttacagg

SEQ ID NO: 5928 - DNA, 15 bp, Homo sapiens
aaaagaattttacag

SEQ ID NO: 5929 - DNA, 15 bp, Homo sapiens
aaaaagaattttaca

SEQ ID NO: 5930 - DNA, 15 bp, Homo sapiens
caaaaagaattttac

SEQ ID NO: 5931 - DNA, 15 bp, Homo sapiens
acaaaaagaatttta

SEQ ID NO: 5932 - DNA, 15 bp, Homo sapiens
aacaaaaagaatttt

SEQ ID NO: 5933 - DNA, 15 bp, Homo sapiens
aaacaaaaagaattt

SEQ ID NO: 5934 - DNA, 15 bp, Homo sapiens
aaaacaaaaagaatt

SEQ ID NO: 5935 - DNA, 15 bp, Homo sapiens
taaaacaaaaagaat

SEQ ID NO: 5936 - DNA, 15 bp, Homo sapiens
ttaaaacaaaaagaa

SEQ ID NO: 5937 - DNA, 15 bp, Homo sapiens
tttaaaacaaaaaga

SEQ ID NO: 5938 - DNA, 15 bp, Homo sapiens
atttaaaacaaaaag

SEQ ID NO: 5939 - DNA, 15 bp, Homo sapiens
catttaaaacaaaaa

SEQ ID NO: 5940 - DNA, 15 bp, Homo sapiens
acatttaaaacaaaa

SEQ ID NO: 5941 - DNA, 15 bp, Homo sapiens
aacatttaaaacaaa

SEQ ID NO: 5942 - DNA, 15 bp, Homo sapiens
aaacatttaaaacaa

SEQ ID NO: 5943 - DNA, 15 bp, Homo sapiens
aaaacatttaaaaca

SEQ ID NO: 5944 - DNA, 15 bp, Homo sapiens
taaaacatttaaaac

SEQ ID NO: 5945 - DNA, 15 bp, Homo sapiens
ctaaaacatttaaaa

SEQ ID NO: 5946 - DNA, 15 bp, Homo sapiens
actaaaacatttaaa

SEQ ID NO: 5947 - DNA, 15 bp, Homo sapiens
cactaaaacatttaa

SEQ ID NO: 5948 - DNA, 15 bp, Homo sapiens
ccactaaaacattta

SEQ ID NO: 5949 - DNA, 15 bp, Homo sapiens
accactaaaacattt

SEQ ID NO: 5950 - DNA, 15 bp, Homo sapiens
taccactaaaacatt

SEQ ID NO: 5951 - DNA, 15 bp, Homo sapiens
ataccactaaaacat

SEQ ID NO: 5952 - DNA, 15 bp, Homo sapiens
tataccactaaaaca

SEQ ID NO: 5953 - DNA, 15 bp, Homo sapiens
ttataccactaaaac

SEQ ID NO: 5954 - DNA, 15 bp, Homo sapiens
cttataccactaaaa

SEQ ID NO: 5955 - DNA, 15 bp, Homo sapiens
ccttataccactaaa

SEQ ID NO: 5956 - DNA, 15 bp, Homo sapiens
accttataccactaa

SEQ ID NO: 5957 - DNA, 15 bp, Homo sapiens
taccttataccacta

SEQ ID NO: 5958 - DNA, 15 bp, Homo sapiens
gtaccttataccact

SEQ ID NO: 5959 - DNA, 15 bp, Homo sapiens
agtaccttataccac

SEQ ID NO: 5960 - DNA, 15 bp, Homo sapiens
tagtaccttatacca

SEQ ID NO: 5961 - DNA, 15 bp, Homo sapiens
gtagtaccttatacc

SEQ ID NO: 5962 - DNA, 15 bp, Homo sapiens
tgtagtaccttatac

SEQ ID NO: 5963 - DNA, 15 bp, Homo sapiens
ttgtagtaccttata

SEQ ID NO: 5964 - DNA, 15 bp, Homo sapiens
tttgtagtaccttat

SEQ ID NO: 5965 - DNA, 15 bp, Homo sapiens
ttttgtagtacctta

SEQ ID NO: 5966 - DNA, 15 bp, Homo sapiens
tttttgtagtacctt

SEQ ID NO: 5967 - DNA, 15 bp, Homo sapiens
atttttgtagtacct

SEQ ID NO: 5968 - DNA, 15 bp, Homo sapiens
catttttgtagtacc

SEQ ID NO: 5969 - DNA, 15 bp, Homo sapiens
acatttttgtagtac

SEQ ID NO: 5970 - DNA, 15 bp, Homo sapiens
tacatttttgtagta

SEQ ID NO: 5971 - DNA, 15 bp, Homo sapiens
ttacatttttgtagt

SEQ ID NO: 5972 - DNA, 15 bp, Homo sapiens
cttacatttttgtag

SEQ ID NO: 5973 - DNA, 15 bp, Homo sapiens
ccttacatttttgta

SEQ ID NO: 5974 - DNA, 15 bp, Homo sapiens
cccttacatttttgt

SEQ ID NO: 5975 - DNA, 15 bp, Homo sapiens
tcccttacatttttg

SEQ ID NO: 5976 - DNA, 15 bp, Homo sapiens
atcccttacattttt

SEQ ID NO: 5977 - DNA, 15 bp, Homo sapiens
aatcccttacatttt

SEQ ID NO: 5978 - DNA, 15 bp, Homo sapiens
taatcccttacattt

SEQ ID NO: 5979 - DNA, 15 bp, Homo sapiens
ataatcccttacatt

SEQ ID NO: 5980 - DNA, 15 bp, Homo sapiens
aataatcccttacat

SEQ ID NO: 5981 - DNA, 15 bp, Homo sapiens
taataatcccttaca

SEQ ID NO: 5982 - DNA, 15 bp, Homo sapiens
ttaataatcccttac

SEQ ID NO: 5983 - DNA, 15 bp, Homo sapiens
attaataatccctta

SEQ ID NO: 5984 - DNA, 15 bp, Homo sapiens
tattaataatccctt

SEQ ID NO: 5985 - DNA, 15 bp, Homo sapiens
atattaataatccct

SEQ ID NO: 5986 - DNA, 15 bp, Homo sapiens
gatattaataatccc

SEQ ID NO: 5987 - DNA, 15 bp, Homo sapiens
tgatattaataatcc

SEQ ID NO: 5988 - DNA, 15 bp, Homo sapiens
atgatattaataatc

SEQ ID NO: 5989 - DNA, 15 bp, Homo sapiens
gatgatattaataat

SEQ ID NO: 5990 - DNA, 15 bp, Homo sapiens
agatgatattaataa

SEQ ID NO: 5991 - DNA, 15 bp, Homo sapiens
aagatgatattaata

SEQ ID NO: 5992 - DNA, 15 bp, Homo sapiens
taagatgatattaat

SEQ ID NO: 5993 - DNA, 15 bp, Homo sapiens
ctaagatgatattaa

SEQ ID NO: 5994 - DNA, 15 bp, Homo sapiens
cctaagatgatatta

SEQ ID NO: 5995 - DNA, 15 bp, Homo sapiens
tcctaagatgatatt

SEQ ID NO: 5996 - DNA, 15 bp, Homo sapiens
ctcctaagatgatat

SEQ ID NO: 5997 - DNA, 15 bp, Homo sapiens
actcctaagatgata

SEQ ID NO: 5998 - DNA, 15 bp, Homo sapiens
tactcctaagatgat

SEQ ID NO: 5999 - DNA, 15 bp, Homo sapiens
gtactcctaagatga

SEQ ID NO: 6000 - DNA, 15 bp, Homo sapiens
cgtactcctaagatg

SEQ ID NO: 6001 - DNA, 15 bp, Homo sapiens
ccgtactcctaagat

SEQ ID NO: 6002 - DNA, 15 bp, Homo sapiens
tccgtactcctaaga

SEQ ID NO: 6003 - DNA, 15 bp, Homo sapiens
ttccgtactcctaag

SEQ ID NO: 6004 - DNA, 15 bp, Homo sapiens
attccgtactcctaa

SEQ ID NO: 6005 - DNA, 15 bp, Homo sapiens
tattccgtactccta

SEQ ID NO: 6006 - DNA, 15 bp, Homo sapiens
gtattccgtactcct

SEQ ID NO: 6007 - DNA, 15 bp, Homo sapiens
tgtattccgtactcc

SEQ ID NO: 6008 - DNA, 15 bp, Homo sapiens
atgtattccgtactc

SEQ ID NO: 6009 - DNA, 15 bp, Homo sapiens
tatgtattccgtact

SEQ ID NO: 6010 - DNA, 15 bp, Homo sapiens
atatgtattccgtac

SEQ ID NO: 6011 - DNA, 15 bp, Homo sapiens
aatatgtattccgta

SEQ ID NO: 6012 - DNA, 15 bp, Homo sapiens
gaatatgtattccgt

SEQ ID NO: 6013 - DNA, 15 bp, Homo sapiens
tgaatatgtattccg

SEQ ID NO: 6014 - DNA, 15 bp, Homo sapiens
ctgaatatgtattcc

SEQ ID NO: 6015 - DNA, 15 bp, Homo sapiens
tctgaatatgtattc

SEQ ID NO: 6016 - DNA, 15 bp, Homo sapiens
gtctgaatatgtatt

SEQ ID NO: 6017 - DNA, 15 bp, Homo sapiens
tgtctgaatatgtat

SEQ ID NO: 6018 - DNA, 15 bp, Homo sapiens
atgtctgaatatgta

SEQ ID NO: 6019 - DNA, 15 bp, Homo sapiens
tatgtctgaatatgt

SEQ ID NO: 6020 - DNA, 15 bp, Homo sapiens
atatgtctgaatatg

SEQ ID NO: 6021 - DNA, 15 bp, Homo sapiens
catatgtctgaatat

SEQ ID NO: 6022 - DNA, 15 bp, Homo sapiens
acatatgtctgaata

SEQ ID NO: 6023 - DNA, 15 bp, Homo sapiens
tacatatgtctgaat

SEQ ID NO: 6024 - DNA, 15 bp, Homo sapiens
ttacatatgtctgaa

SEQ ID NO: 6025 - DNA, 15 bp, Homo sapiens
tttacatatgtctga

SEQ ID NO: 6026 - DNA, 15 bp, Homo sapiens
atttacatatgtctg

SEQ ID NO: 6027 - DNA, 15 bp, Homo sapiens
tatttacatatgtct

SEQ ID NO: 6028 - DNA, 15 bp, Homo sapiens
atatttacatatgtc

SEQ ID NO: 6029 - DNA, 15 bp, Homo sapiens
tatatttacatatgt

SEQ ID NO: 6030 - DNA, 15 bp, Homo sapiens
ttatatttacatatg

SEQ ID NO: 6031 - DNA, 15 bp, Homo sapiens
gttatatttacatat

SEQ ID NO: 6032 - DNA, 15 bp, Homo sapiens
tgttatatttacata

SEQ ID NO: 6033 - DNA, 15 bp, Homo sapiens
ctgttatatttacat

SEQ ID NO: 6034 - DNA, 15 bp, Homo sapiens
tctgttatatttaca

SEQ ID NO: 6035 - DNA, 15 bp, Homo sapiens
ctctgttatatttac

SEQ ID NO: 6036 - DNA, 15 bp, Homo sapiens
cctctgttatattta

SEQ ID NO: 6037 - DNA, 15 bp, Homo sapiens
tcctctgttatattt

SEQ ID NO: 6038 - DNA, 15 bp, Homo sapiens
ttcctctgttatatt

SEQ ID NO: 6039 - DNA, 15 bp, Homo sapiens
tttcctctgttatat

SEQ ID NO: 6040 - DNA, 15 bp, Homo sapiens
ttttcctctgttata

SEQ ID NO: 6041 - DNA, 15 bp, Homo sapiens
attttcctctgttat

SEQ ID NO: 6042 - DNA, 15 bp, Homo sapiens
cattttcctctgtta

SEQ ID NO: 6043 - DNA, 15 bp, Homo sapiens
ccattttcctctgtt

SEQ ID NO: 6044 - DNA, 15 bp, Homo sapiens
tccattttcctctgt

SEQ ID NO: 6045 - DNA, 15 bp, Homo sapiens
ttccattttcctctg

SEQ ID NO: 6046 - DNA, 15 bp, Homo sapiens
cttccattttcctct

SEQ ID NO: 6047 - DNA, 15 bp, Homo sapiens
tcttccattttcctc

SEQ ID NO: 6048 - DNA, 15 bp, Homo sapiens
ctcttccattttcct

SEQ ID NO: 6049 - DNA, 15 bp, Homo sapiens
tctcttccattttcc

SEQ ID NO: 6050 - DNA, 15 bp, Homo sapiens
ctctcttccattttc

SEQ ID NO: 6051 - DNA, 15 bp, Homo sapiens
tctctcttccatttt

SEQ ID NO: 6052 - DNA, 15 bp, Homo sapiens
gtctctcttccattt

SEQ ID NO: 6053 - DNA, 15 bp, Homo sapiens
cgtctctcttccatt

SEQ ID NO: 6054 - DNA, 15 bp, Homo sapiens
tcgtctctcttccat

SEQ ID NO: 6055 - DNA, 15 bp, Homo sapiens
atcgtctctcttcca

SEQ ID NO: 6056 - DNA, 15 bp, Homo sapiens
aatcgtctctcttcc

SEQ ID NO: 6057 - DNA, 15 bp, Homo sapiens
aaatcgtctctcttc

SEQ ID NO: 6058 - DNA, 15 bp, Homo sapiens
taaatcgtctctctt

SEQ ID NO: 6059 - DNA, 15 bp, Homo sapiens
ttaaatcgtctctct

SEQ ID NO: 6060 - DNA, 15 bp, Homo sapiens
attaaatcgtctctc

SEQ ID NO: 6061 - DNA, 15 bp, Homo sapiens
cattaaatcgtctct

SEQ ID NO: 6062 - DNA, 15 bp, Homo sapiens
acattaaatcgtctc

SEQ ID NO: 6063 - DNA, 15 bp, Homo sapiens
gacattaaatcgtct

SEQ ID NO: 6064 - DNA, 15 bp, Homo sapiens
agacattaaatcgtc

SEQ ID NO: 6065 - DNA, 15 bp, Homo sapiens
gagacattaaatcgt

SEQ ID NO: 6066 - DNA, 15 bp, Homo sapiens
ggagacattaaatcg

SEQ ID NO: 6067 - DNA, 15 bp, Homo sapiens
tggagacattaaatc

SEQ ID NO: 6068 - DNA, 15 bp, Homo sapiens
atggagacattaaat

SEQ ID NO: 6069 - DNA, 15 bp, Homo sapiens
tatggagacattaaa

SEQ ID NO: 6070 - DNA, 15 bp, Homo sapiens
gtatggagacattaa

SEQ ID NO: 6071 - DNA, 15 bp, Homo sapiens
agtatggagacatta

SEQ ID NO: 6072 - DNA, 15 bp, Homo sapiens
tagtatggagacatt

SEQ ID NO: 6073 - DNA, 15 bp, Homo sapiens
ctagtatggagacat

SEQ ID NO: 6074 - DNA, 15 bp, Homo sapiens
actagtatggagaca

SEQ ID NO: 6075 - DNA, 15 bp, Homo sapiens
gactagtatggagac

SEQ ID NO: 6076 - DNA, 15 bp, Homo sapiens
tgactagtatggaga

SEQ ID NO: 6077 - DNA, 15 bp, Homo sapiens
atgactagtatggag

SEQ ID NO: 6078 - DNA, 15 bp, Homo sapiens
aatgactagtatgga

SEQ ID NO: 6079 - DNA, 15 bp, Homo sapiens
aaatgactagtatgg

SEQ ID NO: 6080 - DNA, 15 bp, Homo sapiens
aaaatgactagtatg

SEQ ID NO: 6081 - DNA, 15 bp, Homo sapiens
gaaaatgactagtat

SEQ ID NO: 6082 - DNA, 15 bp, Homo sapiens
agaaaatgactagta

SEQ ID NO: 6083 - DNA, 15 bp, Homo sapiens
tagaaaatgactagt

SEQ ID NO: 6084 - DNA, 15 bp, Homo sapiens
atagaaaatgactag

SEQ ID NO: 6085 - DNA, 15 bp, Homo sapiens
tatagaaaatgacta

SEQ ID NO: 6086 - DNA, 15 bp, Homo sapiens
ttatagaaaatgact

SEQ ID NO: 6087 - DNA, 15 bp, Homo sapiens
tttatagaaaatgac

SEQ ID NO: 6088 - DNA, 15 bp, Homo sapiens
atttatagaaaatga

SEQ ID NO: 6089 - DNA, 15 bp, Homo sapiens
aatttatagaaaatg

SEQ ID NO: 6090 - DNA, 15 bp, Homo sapiens
caatttatagaaaat

SEQ ID NO: 6091 - DNA, 15 bp, Homo sapiens
acaatttatagaaaa

SEQ ID NO: 6092 - DNA, 15 bp, Homo sapiens
cacaatttatagaaa

SEQ ID NO: 6093 - DNA, 15 bp, Homo sapiens
tcacaatttatagaa

SEQ ID NO: 6094 - DNA, 15 bp, Homo sapiens
ctcacaatttataga

SEQ ID NO: 6095 - DNA, 15 bp, Homo sapiens
cctcacaatttatag

SEQ ID NO: 6096 - DNA, 15 bp, Homo sapiens
tcctcacaatttata

SEQ ID NO: 6097 - DNA, 15 bp, Homo sapiens
ctcctcacaatttat

SEQ ID NO: 6098 - DNA, 15 bp, Homo sapiens
cctcctcacaattta

SEQ ID NO: 6099 - DNA, 15 bp, Homo sapiens
acctcctcacaattt

SEQ ID NO: 6100 - DNA, 15 bp, Homo sapiens
tacctcctcacaatt

SEQ ID NO: 6101 - DNA, 15 bp, Homo sapiens
atacctcctcacaat

SEQ ID NO: 6102 - DNA, 15 bp, Homo sapiens
tatacctcctcacaa

SEQ ID NO: 6103 - DNA, 15 bp, Homo sapiens
atatacctcctcaca

SEQ ID NO: 6104 - DNA, 15 bp, Homo sapiens
aatatacctcctcac

SEQ ID NO: 6105 - DNA, 15 bp, Homo sapiens
gaatatacctcctca

SEQ ID NO: 6106 - DNA, 15 bp, Homo sapiens
ggaatatacctcctc

SEQ ID NO: 6107 - DNA, 15 bp, Homo sapiens
aggaatatacctcct

SEQ ID NO: 6108 - DNA, 15 bp, Homo sapiens
taggaatatacctcc

SEQ ID NO: 6109 - DNA, 15 bp, Homo sapiens
ttaggaatatacctc

SEQ ID NO: 6110 - DNA, 15 bp, Homo sapiens
tttaggaatatacct

SEQ ID NO: 6111 - DNA, 15 bp, Homo sapiens
atttaggaatatacc

SEQ ID NO: 6112 - DNA, 15 bp, Homo sapiens
tatttaggaatatac

SEQ ID NO: 6113 - DNA, 15 bp, Homo sapiens
ctatttaggaatata

SEQ ID NO: 6114 - DNA, 15 bp, Homo sapiens
actatttaggaatat

SEQ ID NO: 6115 - DNA, 15 bp, Homo sapiens
aactatttaggaata

SEQ ID NO: 6116 - DNA, 15 bp, Homo sapiens
aaactatttaggaat

SEQ ID NO: 6117 - DNA, 15 bp, Homo sapiens
aaaactatttaggaa

SEQ ID NO: 6118 - DNA, 15 bp, Homo sapiens
gaaaactatttagga

SEQ ID NO: 6119 - DNA, 15 bp, Homo sapiens
agaaaactatttagg

SEQ ID NO: 6120 - DNA, 15 bp, Homo sapiens
cagaaaactatttag

SEQ ID NO: 6121 - DNA, 15 bp, Homo sapiens
tcagaaaactattta

SEQ ID NO: 6122 - DNA, 15 bp, Homo sapiens
ctcagaaaactattt

SEQ ID NO: 6123 - DNA, 15 bp, Homo sapiens
actcagaaaactatt

SEQ ID NO: 6124 - DNA, 15 bp, Homo sapiens
gactcagaaaactat

SEQ ID NO: 6125 - DNA, 15 bp, Homo sapiens
tgactcagaaaacta

SEQ ID NO: 6126 - DNA, 15 bp, Homo sapiens
ctgactcagaaaact

SEQ ID NO: 6127 - DNA, 15 bp, Homo sapiens
gctgactcagaaaac

SEQ ID NO: 6128 - DNA, 15 bp, Homo sapiens
ggctgactcagaaaa

SEQ ID NO: 6129 - DNA, 15 bp, Homo sapiens
aggctgactcagaaa

SEQ ID NO: 6130 - DNA, 15 bp, Homo sapiens
aaggctgactcagaa

SEQ ID NO: 6131 - DNA, 15 bp, Homo sapiens
gaaggctgactcaga

SEQ ID NO: 6132 - DNA, 15 bp, Homo sapiens
tgaaggctgactcag

SEQ ID NO: 6133 - DNA, 15 bp, Homo sapiens
atgaaggctgactca

SEQ ID NO: 6134 - DNA, 15 bp, Homo sapiens
aatgaaggctgactc

SEQ ID NO: 6135 - DNA, 15 bp, Homo sapiens
gaatgaaggctgact

SEQ ID NO: 6136 - DNA, 15 bp, Homo sapiens
agaatgaaggctgac

SEQ ID NO: 6137 - DNA, 15 bp, Homo sapiens
tagaatgaaggctga

SEQ ID NO: 6138 - DNA, 15 bp, Homo sapiens
ctagaatgaaggctg

SEQ ID NO: 6139 - DNA, 15 bp, Homo sapiens
actagaatgaaggct

SEQ ID NO: 6140 - DNA, 15 bp, Homo sapiens
tactagaatgaaggc

SEQ ID NO: 6141 - DNA, 15 bp, Homo sapiens
ttactagaatgaagg

SEQ ID NO: 6142 - DNA, 15 bp, Homo sapiens
cttactagaatgaag

SEQ ID NO: 6143 - DNA, 15 bp, Homo sapiens
tcttactagaatgaa

SEQ ID NO: 6144 - DNA, 15 bp, Homo sapiens
gtcttactagaatga

SEQ ID NO: 6145 - DNA, 15 bp, Homo sapiens
ggtcttactagaatg

SEQ ID NO: 6146 - DNA, 15 bp, Homo sapiens
aggtcttactagaat

SEQ ID NO: 6147 - DNA, 15 bp, Homo sapiens
aaggtcttactagaa

SEQ ID NO: 6148 - DNA, 15 bp, Homo sapiens
aaaggtcttactaga

SEQ ID NO: 6149 - DNA, 15 bp, Homo sapiens
caaaggtcttactag

SEQ ID NO: 6150 - DNA, 15 bp, Homo sapiens
tcaaaggtcttacta

SEQ ID NO: 6151 - DNA, 15 bp, Homo sapiens
atcaaaggtcttact

SEQ ID NO: 6152 - DNA, 15 bp, Homo sapiens
tatcaaaggtcttac

SEQ ID NO: 6153 - DNA, 15 bp, Homo sapiens
atatcaaaggtctta

SEQ ID NO: 6154 - DNA, 15 bp, Homo sapiens
aatatcaaaggtctt

SEQ ID NO: 6155 - DNA, 15 bp, Homo sapiens
aaatatcaaaggtct

SEQ ID NO: 6156 - DNA, 15 bp, Homo sapiens
taaatatcaaaggtc

SEQ ID NO: 6157 - DNA, 15 bp, Homo sapiens
ataaatatcaaaggt

SEQ ID NO: 6158 - DNA, 15 bp, Homo sapiens
tataaatatcaaagg

SEQ ID NO: 6159 - DNA, 15 bp, Homo sapiens
ttataaatatcaaag

SEQ ID NO: 6160 - DNA, 15 bp, Homo sapiens
gttataaatatcaaa

SEQ ID NO: 6161 - DNA, 15 bp, Homo sapiens
agttataaatatcaa

SEQ ID NO: 6162 - DNA, 15 bp, Homo sapiens
aagttataaatatca

SEQ ID NO: 6163 - DNA, 15 bp, Homo sapiens
caagttataaatatc

SEQ ID NO: 6164 - DNA, 15 bp, Homo sapiens
acaagttataaatat

SEQ ID NO: 6165 - DNA, 15 bp, Homo sapiens
tacaagttataaata

SEQ ID NO: 6166 - DNA, 15 bp, Homo sapiens
gtacaagttataaat

SEQ ID NO: 6167 - DNA, 15 bp, Homo sapiens
agtacaagttataaa

SEQ ID NO: 6168 - DNA, 15 bp, Homo sapiens
aagtacaagttataa

SEQ ID NO: 6169 - DNA, 15 bp, Homo sapiens
aaagtacaagttata

SEQ ID NO: 6170 - DNA, 15 bp, Homo sapiens
taaagtacaagttat

SEQ ID NO: 6171 - DNA, 15 bp, Homo sapiens
ctaaagtacaagtta

SEQ ID NO: 6172 - DNA, 15 bp, Homo sapiens
gctaaagtacaagtt

SEQ ID NO: 6173 - DNA, 15 bp, Homo sapiens
ggctaaagtacaagt

SEQ ID NO: 6174 - DNA, 15 bp, Homo sapiens
cggctaaagtacaag

SEQ ID NO: 6175 - DNA, 15 bp, Homo sapiens
acggctaaagtacaa

SEQ ID NO: 6176 - DNA, 15 bp, Homo sapiens
cacggctaaagtaca

SEQ ID NO: 6177 - DNA, 15 bp, Homo sapiens
acacggctaaagtac

SEQ ID NO: 6178 - DNA, 15 bp, Homo sapiens
gacacggctaaagta

SEQ ID NO: 6179 - DNA, 15 bp, Homo sapiens
ggacacggctaaagt

SEQ ID NO: 6180 - DNA, 15 bp, Homo sapiens
tggacacggctaaag

SEQ ID NO: 6181 - DNA, 15 bp, Homo sapiens
atggacacggctaaa

SEQ ID NO: 6182 - DNA, 15 bp, Homo sapiens
tatggacacggctaa

SEQ ID NO: 6183 - DNA, 15 bp, Homo sapiens
ttatggacacggcta

SEQ ID NO: 6184 - DNA, 15 bp, Homo sapiens
tttatggacacggct

SEQ ID NO: 6185 - DNA, 15 bp, Homo sapiens
ttttatggacacggc

SEQ ID NO: 6186 - DNA, 15 bp, Homo sapiens
cttttatggacacgg

SEQ ID NO: 6187 - DNA, 15 bp, Homo sapiens
tcttttatggacacg

SEQ ID NO: 6188 - DNA, 15 bp, Homo sapiens
ctcttttatggacac

SEQ ID NO: 6189 - DNA, 15 bp, Homo sapiens
actcttttatggaca

SEQ ID NO: 6190 - DNA, 15 bp, Homo sapiens
tactcttttatggac

SEQ ID NO: 6191 - DNA, 15 bp, Homo sapiens
ttactcttttatgga

SEQ ID NO: 6192 - DNA, 15 bp, Homo sapiens
attactcttttatgg

SEQ ID NO: 6193 - DNA, 15 bp, Homo sapiens
aattactcttttatg

SEQ ID NO: 6194 - DNA, 15 bp, Homo sapiens
taattactcttttat

SEQ ID NO: 6195 - DNA, 15 bp, Homo sapiens
ataattactctttta

SEQ ID NO: 6196 - DNA, 15 bp, Homo sapiens
gataattactctttt

SEQ ID NO: 6197 - DNA, 15 bp, Homo sapiens
agataattactcttt

SEQ ID NO: 6198 - DNA, 15 bp, Homo sapiens
tagataattactctt

SEQ ID NO: 6199 - DNA, 15 bp, Homo sapiens
ttagataattactct

SEQ ID NO: 6200 - DNA, 15 bp, Homo sapiens
attagataattactc

SEQ ID NO: 6201 - DNA, 15 bp, Homo sapiens
aattagataattact

SEQ ID NO: 6202 - DNA, 15 bp, Homo sapiens
aaattagataattac

SEQ ID NO: 6203 - DNA, 15 bp, Homo sapiens
gaaattagataatta

SEQ ID NO: 6204 - DNA, 15 bp, Homo sapiens
tgaaattagataatt

SEQ ID NO: 6205 - DNA, 15 bp, Homo sapiens
ctgaaattagataat

SEQ ID NO: 6206 - DNA, 15 bp, Homo sapiens
tctgaaattagataa

SEQ ID NO: 6207 - DNA, 15 bp, Homo sapiens
ttctgaaattagata

SEQ ID NO: 6208 - DNA, 15 bp, Homo sapiens
atttctgaaattaga

SEQ ID NO: 6209 - DNA, 15 bp, Homo sapiens
tatttctgaaattag

SEQ ID NO: 6210 - DNA, 15 bp, Homo sapiens
gtatttctgaaatta

SEQ ID NO: 6211 - DNA, 15 bp, Homo sapiens
ggtatttctgaaatt

SEQ ID NO: 6212 - DNA, 15 bp, Homo sapiens
cggtatttctgaaat

SEQ ID NO: 6213 - DNA, 15 bp, Homo sapiens
acggtatttctgaaa

SEQ ID NO: 6214 - DNA, 15 bp, Homo sapiens
cacggtatttctgaa

SEQ ID NO: 6215 - DNA, 15 bp, Homo sapiens
acacggtatttctga

SEQ ID NO: 6216 - DNA, 15 bp, Homo sapiens
tacacggtatttctg

SEQ ID NO: 6217 - DNA, 15 bp, Homo sapiens
atacacggtatttct

SEQ ID NO: 6218 - DNA, 15 bp, Homo sapiens
tatacacggtatttc

SEQ ID NO: 6219 - DNA, 15 bp, Homo sapiens
atatacacggtattt

SEQ ID NO: 6220 - DNA, 15 bp, Homo sapiens
tatatacacggtatt

SEQ ID NO: 6221 - DNA, 15 bp, Homo sapiens
atatatacacggtat

SEQ ID NO: 6222 - DNA, 15 bp, Homo sapiens
tatatatacacggta

SEQ ID NO: 6223 - DNA, 15 bp, Homo sapiens
ttatatatacacggt

SEQ ID NO: 6224 - DNA, 15 bp, Homo sapiens
attatatatacacgg

SEQ ID NO: 6225 - DNA, 15 bp, Homo sapiens
cattatatatacacg

SEQ ID NO: 6226 - DNA, 15 bp, Homo sapiens
tcattatatatacac

SEQ ID NO: 6227 - DNA, 15 bp, Homo sapiens
ttcattatatataca

SEQ ID NO: 6228 - DNA, 15 bp, Homo sapiens
gttcattatatatac

SEQ ID NO: 6229 - DNA, 15 bp, Homo sapiens
tgttcattatatata

SEQ ID NO: 6230 - DNA, 15 bp, Homo sapiens
atgttcattatatat

SEQ ID NO: 6231 - DNA, 15 bp, Homo sapiens
tatgttcattatata

SEQ ID NO: 6232 - DNA, 15 bp, Homo sapiens
atatgttcattatat

SEQ ID NO: 6233 - DNA, 15 bp, Homo sapiens
tatatgttcattata

SEQ ID NO: 6234 - DNA, 15 bp, Homo sapiens
ttatatgttcattat

SEQ ID NO: 6235 - DNA, 15 bp, Homo sapiens
tttatatgttcatta

SEQ ID NO: 6236 - DNA, 15 bp, Homo sapiens
gtttatatgttcatt

SEQ ID NO: 6237 - DNA, 15 bp, Homo sapiens
agtttatatgttcat

SEQ ID NO: 6238 - DNA, 15 bp, Homo sapiens
gagtttatatgttca

SEQ ID NO: 6239 - DNA, 15 bp, Homo sapiens
ggagtttatatgttc

SEQ ID NO: 6240 - DNA, 15 bp, Homo sapiens
gggagtttatatgtt

SEQ ID NO: 6241 - DNA, 15 bp, Homo sapiens
tgggagtttatatgt

SEQ ID NO: 6242 - DNA, 15 bp, Homo sapiens
ttgggagtttatatg

SEQ ID NO: 6243 - DNA, 15 bp, Homo sapiens
tttgggagtttatat

SEQ ID NO: 6244 - DNA, 15 bp, Homo sapiens
gtttgggagtttata

SEQ ID NO: 6245 - DNA, 15 bp, Homo sapiens
agtttgggagtttat

SEQ ID NO: 6246 - DNA, 15 bp, Homo sapiens
tagtttgggagttta

SEQ ID NO: 6247 - DNA, 15 bp, Homo sapiens
atagtttgggagttt

SEQ ID NO: 6248 - DNA, 15 bp, Homo sapiens
aatagtttgggagtt

SEQ ID NO: 6249 - DNA, 15 bp, Homo sapiens
aaatagtttgggagt

SEQ ID NO: 6250 - DNA, 15 bp, Homo sapiens
aaaatagtttgggag

SEQ ID NO: 6251 - DNA, 15 bp, Homo sapiens
taaaatagtttggga

SEQ ID NO: 6252 - DNA, 15 bp, Homo sapiens
ttaaaatagtttggg

SEQ ID NO: 6253 - DNA, 15 bp, Homo sapiens
attaaaatagtttgg

SEQ ID NO: 6254 - DNA, 15 bp, Homo sapiens
aattaaaatagtttg

SEQ ID NO: 6255 - DNA, 15 bp, Homo sapiens
aaattaaaatagttt

SEQ ID NO: 6256 - DNA, 15 bp, Homo sapiens
taaattaaaatagtt

SEQ ID NO: 6257 - DNA, 15 bp, Homo sapiens
ttaaattaaaatagt

SEQ ID NO: 6258 - DNA, 15 bp, Homo sapiens
tttaaattaaaatag

SEQ ID NO: 6259 - DNA, 15 bp, Homo sapiens
ttttaaattaaaata

SEQ ID NO: 6260 - DNA, 15 bp, Homo sapiens
attttaaattaaaat

SEQ ID NO: 6261 - DNA, 15 bp, Homo sapiens
aattttaaattaaaa

SEQ ID NO: 6262 - DNA, 15 bp, Homo sapiens
taattttaaattaaa

SEQ ID NO: 6263 - DNA, 15 bp, Homo sapiens
ataattttaaattaa

SEQ ID NO: 6264 - DNA, 15 bp, Homo sapiens
gataattttaaatta

SEQ ID NO: 6265 - DNA, 15 bp, Homo sapiens
agataattttaaatt

SEQ ID NO: 6266 - DNA, 15 bp, Homo sapiens
aagataattttaaat

SEQ ID NO: 6267 - DNA, 15 bp, Homo sapiens
aaagataattttaaa

SEQ ID NO: 6268 - DNA, 15 bp, Homo sapiens
aaaagataattttaa

SEQ ID NO: 6269 - DNA, 15 bp, Homo sapiens
taaaagataatttta

SEQ ID NO: 6270 - DNA, 15 bp, Homo sapiens
ttaaaagataatttt

SEQ ID NO: 6271 - DNA, 15 bp, Homo sapiens
tttaaaagataattt

SEQ ID NO: 6272 - DNA, 15 bp, Homo sapiens
ttttaaaagataatt

SEQ ID NO: 6273 - DNA, 15 bp, Homo sapiens
tttttaaaagataat

SEQ ID NO: 6274 - DNA, 15 bp, Homo sapiens
ctttttaaaagataa

SEQ ID NO: 6275 - DNA, 15 bp, Homo sapiens
cctttttaaaagata

SEQ ID NO: 6276 - DNA, 15 bp, Homo sapiens
agcctttttaaaaga

SEQ ID NO: 6277 - DNA, 15 bp, Homo sapiens
cagcctttttaaaag

SEQ ID NO: 6278 - DNA, 15 bp, Homo sapiens
tcagcctttttaaaa

SEQ ID NO: 6279 - DNA, 15 bp, Homo sapiens
atcagcctttttaaa

SEQ ID NO: 6280 - DNA, 15 bp, Homo sapiens
catcagcctttttaa

SEQ ID NO: 6281 - DNA, 15 bp, Homo sapiens
tcatcagccttttta

SEQ ID NO: 6282 - DNA, 15 bp, Homo sapiens
ttcatcagccttttt

SEQ ID NO: 6283 - DNA, 15 bp, Homo sapiens
gttcatcagcctttt

SEQ ID NO: 6284 - DNA, 15 bp, Homo sapiens
ggttcatcagccttt

SEQ ID NO: 6285 - DNA, 15 bp, Homo sapiens
aggttcatcagcctt

SEQ ID NO: 6286 - DNA, 15 bp, Homo sapiens
taggttcatcagcct

SEQ ID NO: 6287 - DNA, 15 bp, Homo sapiens
ttaggttcatcagcc

SEQ ID NO: 6288 - DNA, 15 bp, Homo sapiens
tttaggttcatcagc

SEQ ID NO: 6289 - DNA, 15 bp, Homo sapiens
ttttaggttcatcag

SEQ ID NO: 6290 - DNA, 15 bp, Homo sapiens
attttaggttcatca

SEQ ID NO: 6291 - DNA, 15 bp, Homo sapiens
tattttaggttcatc

SEQ ID NO: 6292 - DNA, 15 bp, Homo sapiens
atattttaggttcat

SEQ ID NO: 6293 - DNA, 15 bp, Homo sapiens
aatattttaggttca

SEQ ID NO: 6294 - DNA, 15 bp, Homo sapiens
caatattttaggttc

SEQ ID NO: 6295 - DNA, 15 bp, Homo sapiens
gcaatattttaggtt

SEQ ID NO: 6296 - DNA, 15 bp, Homo sapiens
agcaatattttaggt

SEQ ID NO: 6297 - DNA, 15 bp, Homo sapiens
cagcaatattttagg

SEQ ID NO: 6298 - DNA, 15 bp, Homo sapiens
ccagcaatattttag

SEQ ID NO: 6299 - DNA, 15 bp, Homo sapiens
tccagcaatatttta

SEQ ID NO: 6300 - DNA, 15 bp, Homo sapiens
ctccagcaatatttt

SEQ ID NO: 6301 - DNA, 15 bp, Homo sapiens
tctccagcaatattt

SEQ ID NO: 6302 - DNA, 15 bp, Homo sapiens
ttctccagcaatatt

SEQ ID NO: 6303 - DNA, 15 bp, Homo sapiens
gttctccagcaatat

SEQ ID NO: 6304 - DNA, 15 bp, Homo sapiens
tgttctccagcaata

SEQ ID NO: 6305 - DNA, 15 bp, Homo sapiens
ttgttctccagcaat

SEQ ID NO: 6306 - DNA, 15 bp, Homo sapiens
attgttctccagcaa

SEQ ID NO: 6307 - DNA, 15 bp, Homo sapiens
aattgttctccagca

SEQ ID NO: 6308 - DNA, 15 bp, Homo sapiens
aaattgttctccagc

SEQ ID NO: 6309 - DNA, 15 bp, Homo sapiens
caaattgttctccag

SEQ ID NO: 6310 - DNA, 15 bp, Homo sapiens
ccaaattgttctcca

SEQ ID NO: 6311 - DNA, 15 bp, Homo sapiens
gccaaattgttctcc

SEQ ID NO: 6312 - DNA, 15 bp, Homo sapiens
tgccaaattgttctc

SEQ ID NO: 6313 - DNA, 15 bp, Homo sapiens
ttgccaaattgttct

SEQ ID NO: 6314 - DNA, 15 bp, Homo sapiens
tttgccaaattgttc

SEQ ID NO: 6315 - DNA, 15 bp, Homo sapiens
ttttgccaaattgtt

SEQ ID NO: 6316 - DNA, 15 bp, Homo sapiens
tttttgccaaattgt

SEQ ID NO: 6317 - DNA, 15 bp, Homo sapiens
atttttgccaaattg

SEQ ID NO: 6318 - DNA, 15 bp, Homo sapiens
catttttgccaaatt

SEQ ID NO: 6319 - DNA, 15 bp, Homo sapiens
tcatttttgccaaat

SEQ ID NO: 6320 - DNA, 15 bp, Homo sapiens
atcatttttgccaaa

SEQ ID NO: 6321 - DNA, 15 bp, Homo sapiens
tatcatttttgccaa

SEQ ID NO: 6322 - DNA, 15 bp, Homo sapiens
ttatcatttttgcca

SEQ ID NO: 6323 - DNA, 15 bp, Homo sapiens
gttatcatttttgcc

SEQ ID NO: 6324 - DNA, 15 bp, Homo sapiens
tgttatcatttttgc

SEQ ID NO: 6325 - DNA, 15 bp, Homo sapiens
atgttatcatttttg

SEQ ID NO: 6326 - DNA, 15 bp, Homo sapiens
catgttatcattttt

SEQ ID NO: 6327 - DNA, 15 bp, Homo sapiens
acatgttatcatttt

SEQ ID NO: 6328 - DNA, 15 bp, Homo sapiens
aacatgttatcattt

SEQ ID NO: 6329 - DNA, 15 bp, Homo sapiens
aaacatgttatcatt

SEQ ID NO: 6330 - DNA, 15 bp, Homo sapiens
aaaacatgttatcat

SEQ ID NO: 6331 - DNA, 15 bp, Homo sapiens
aaaaacatgttatca

SEQ ID NO: 6332 - DNA, 15 bp, Homo sapiens
taaaaacatgttatc

SEQ ID NO: 6333 - DNA, 15 bp, Homo sapiens
ttaaaaacatgttat

SEQ ID NO: 6334 - DNA, 15 bp, Homo sapiens
gttaaaaacatgtta

SEQ ID NO: 6335 - DNA, 15 bp, Homo sapiens
tgttaaaaacatgtt

SEQ ID NO: 6336 - DNA, 15 bp, Homo sapiens
gtgttaaaaacatgt

SEQ ID NO: 6337 - DNA, 15 bp, Homo sapiens
tgtgttaaaaacatg

SEQ ID NO: 6338 - DNA, 15 bp, Homo sapiens
atgtgttaaaaacat

SEQ ID NO: 6339 - DNA, 15 bp, Homo sapiens
catgtgttaaaaaca

SEQ ID NO: 6340 - DNA, 15 bp, Homo sapiens
gcatgtgttaaaaac

SEQ ID NO: 6341 - DNA, 15 bp, Homo sapiens
tgcatgtgttaaaaa

SEQ ID NO: 6342 - DNA, 15 bp, Homo sapiens
atgcatgtgttaaaa

SEQ ID NO: 6343 - DNA, 15 bp, Homo sapiens
tatgcatgtgttaaa

SEQ ID NO: 6344 - DNA, 15 bp, Homo sapiens
atatgcatgtgttaa

SEQ ID NO: 6345 - DNA, 15 bp, Homo sapiens
gatatgcatgtgtta

SEQ ID NO: 6346 - DNA, 15 bp, Homo sapiens
tgatatgcatgtgtt

SEQ ID NO: 6347 - DNA, 15 bp, Homo sapiens
ttgatatgcatgtgt

SEQ ID NO: 6348 - DNA, 15 bp, Homo sapiens
attgatatgcatgtg

SEQ ID NO: 6349 - DNA, 15 bp, Homo sapiens
aattgatatgcatgt

SEQ ID NO: 6350 - DNA, 15 bp, Homo sapiens
taattgatatgcatg

SEQ ID NO: 6351 - DNA, 15 bp, Homo sapiens
ttaattgatatgcat

SEQ ID NO: 6352 - DNA, 15 bp, Homo sapiens
gttaattgatatgca

SEQ ID NO: 6353 - DNA, 15 bp, Homo sapiens
agttaattgatatgc

SEQ ID NO: 6354 - DNA, 15 bp, Homo sapiens
cagttaattgatatg

SEQ ID NO: 6355 - DNA, 15 bp, Homo sapiens
tcagttaattgatat

SEQ ID NO: 6356 - DNA, 15 bp, Homo sapiens
ctcagttaattgata

SEQ ID NO: 6357 - DNA, 15 bp, Homo sapiens
actcagttaattgat

SEQ ID NO: 6358 - DNA, 15 bp, Homo sapiens
tactcagttaattga

SEQ ID NO: 6359 - DNA, 15 bp, Homo sapiens
ttactcagttaattg

SEQ ID NO: 6360 - DNA, 15 bp, Homo sapiens
attactcagttaatt

SEQ ID NO: 6361 - DNA, 15 bp, Homo sapiens
aattactcagttaat

SEQ ID NO: 6362 - DNA, 15 bp, Homo sapiens
gaattactcagttaa

SEQ ID NO: 6363 - DNA, 15 bp, Homo sapiens
agaattactcagtta

SEQ ID NO: 6364 - DNA, 15 bp, Homo sapiens
cagaattactcagtt

SEQ ID NO: 6365 - DNA, 15 bp, Homo sapiens
acagaattactcagt

SEQ ID NO: 6366 - DNA, 15 bp, Homo sapiens
aacagaattactcag

SEQ ID NO: 6367 - DNA, 15 bp, Homo sapiens
aaacagaattactca

SEQ ID NO: 6368 - DNA, 15 bp, Homo sapiens
gaaacagaattactc

SEQ ID NO: 6369 - DNA, 15 bp, Homo sapiens
agaaacagaattact

SEQ ID NO: 6370 - DNA, 15 bp, Homo sapiens
tagaaacagaattac

SEQ ID NO: 6371 - DNA, 15 bp, Homo sapiens
ctagaaacagaatta

SEQ ID NO: 6372 - DNA, 15 bp, Homo sapiens
tctagaaacagaatt

SEQ ID NO: 6373 - DNA, 15 bp, Homo sapiens
ctctagaaacagaat

SEQ ID NO: 6374 - DNA, 15 bp, Homo sapiens
actctagaaacagaa

SEQ ID NO: 6375 - DNA, 15 bp, Homo sapiens
aactctagaaacaga

SEQ ID NO: 6376 - DNA, 15 bp, Homo sapiens
aaactctagaaacag

SEQ ID NO: 6377 - DNA, 15 bp, Homo sapiens
aaaactctagaaaca

SEQ ID NO: 6378 - DNA, 15 bp, Homo sapiens
aaaaactctagaaac

SEQ ID NO: 6379 - DNA, 15 bp, Homo sapiens
gaaaaactctagaaa

SEQ ID NO: 6380 - DNA, 15 bp, Homo sapiens
ggaaaaactctagaa

SEQ ID NO: 6381 - DNA, 15 bp, Homo sapiens
gggaaaaactctaga

SEQ ID NO: 6382 - DNA, 15 bp, Homo sapiens
agggaaaaactctag

SEQ ID NO: 6383 - DNA, 15 bp, Homo sapiens
tagggaaaaactcta

SEQ ID NO: 6384 - DNA, 15 bp, Homo sapiens
ctagggaaaaactct

SEQ ID NO: 6385 - DNA, 15 bp, Homo sapiens
cctagggaaaaactc

SEQ ID NO: 6386 - DNA, 15 bp, Homo sapiens
gcctagggaaaaact

SEQ ID NO: 6387 - DNA, 15 bp, Homo sapiens
tgcctagggaaaaac

SEQ ID NO: 6388 - DNA, 15 bp, Homo sapiens
ttgcctagggaaaaa

SEQ ID NO: 6389 - DNA, 15 bp, Homo sapiens
attgcctagggaaaa

SEQ ID NO: 6390 - DNA, 15 bp, Homo sapiens
tattgcctagggaaa

SEQ ID NO: 6391 - DNA, 15 bp, Homo sapiens
gtattgcctagggaa

SEQ ID NO: 6392 - DNA, 15 bp, Homo sapiens
tgtattgcctaggga

SEQ ID NO: 6393 - DNA, 15 bp, Homo sapiens
atgtattgcctaggg

SEQ ID NO: 6394 - DNA, 15 bp, Homo sapiens
tatgtattgcctagg

SEQ ID NO: 6395 - DNA, 15 bp, Homo sapiens
ttatgtattgcctag

SEQ ID NO: 6396 - DNA, 15 bp, Homo sapiens
tttatgtattgccta

SEQ ID NO: 6397 - DNA, 15 bp, Homo sapiens
ttttatgtattgcct

SEQ ID NO: 6398 - DNA, 15 bp, Homo sapiens
tttttatgtattgcc

SEQ ID NO: 6399 - DNA, 15 bp, Homo sapiens
ctttttatgtattgc

SEQ ID NO: 6400 - DNA, 15 bp, Homo sapiens
cctttttatgtattg

SEQ ID NO: 6401 - DNA, 15 bp, Homo sapiens
acctttttatgtatt

SEQ ID NO: 6402 - DNA, 15 bp, Homo sapiens
tacctttttatgtat

SEQ ID NO: 6403 - DNA, 15 bp, Homo sapiens
gtacctttttatgta

SEQ ID NO: 6404 - DNA, 15 bp, Homo sapiens
tgtacctttttatgt

SEQ ID NO: 6405 - DNA, 15 bp, Homo sapiens
gtgtacctttttatg

SEQ ID NO: 6406 - DNA, 15 bp, Homo sapiens
agtgtacctttttat

SEQ ID NO: 6407 - DNA, 15 bp, Homo sapiens
gagtgtaccttttta

SEQ ID NO: 6408 - DNA, 15 bp, Homo sapiens
tgagtgtaccttttt

SEQ ID NO: 6409 - DNA, 15 bp, Homo sapiens
ttgagtgtacctttt

SEQ ID NO: 6410 - DNA, 15 bp, Homo sapiens
cttgagtgtaccttt

SEQ ID NO: 6411 - DNA, 15 bp, Homo sapiens
tcttgagtgtacctt

SEQ ID NO: 6412 - DNA, 15 bp, Homo sapiens
ttcttgagtgtacct

SEQ ID NO: 6413 - DNA, 15 bp, Homo sapiens
tttcttgagtgtacc

SEQ ID NO: 6414 - DNA, 15 bp, Homo sapiens
atttcttgagtgtac

SEQ ID NO: 6415 - DNA, 15 bp, Homo sapiens
aatttcttgagtgta

SEQ ID NO: 6416 - DNA, 15 bp, Homo sapiens
caatttcttgagtgt

SEQ ID NO: 6417 - DNA, 15 bp, Homo sapiens
tcaatttcttgagtg

SEQ ID NO: 6418 - DNA, 15 bp, Homo sapiens
atcaatttcttgagt

SEQ ID NO: 6419 - DNA, 15 bp, Homo sapiens
gatcaatttcttgag

SEQ ID NO: 6420 - DNA, 15 bp, Homo sapiens
tgatcaatttcttga

SEQ ID NO: 6421 - DNA, 15 bp, Homo sapiens
gtgatcaatttcttg

SEQ ID NO: 6422 - DNA, 15 bp, Homo sapiens
tgtgatcaatttctt

SEQ ID NO: 6423 - DNA, 15 bp, Homo sapiens
ctgtgatcaatttct

SEQ ID NO: 6424 - DNA, 15 bp, Homo sapiens
actgtgatcaatttc

SEQ ID NO: 6425 - DNA, 15 bp, Homo sapiens
tactgtgatcaattt

SEQ ID NO: 6426 - DNA, 15 bp, Homo sapiens
atactgtgatcaatt

SEQ ID NO: 6427 - DNA, 15 bp, Homo sapiens
gatactgtgatcaat

SEQ ID NO: 6428 - DNA, 15 bp, Homo sapiens
tgatactgtgatcaa

SEQ ID NO: 6429 - DNA, 15 bp, Homo sapiens
atgatactgtgatca

SEQ ID NO: 6430 - DNA, 15 bp, Homo sapiens
aatgatactgtgatc

SEQ ID NO: 6431 - DNA, 15 bp, Homo sapiens
aaatgatactgtgat

SEQ ID NO: 6432 - DNA, 15 bp, Homo sapiens
taaatgatactgtga

SEQ ID NO: 6433 - DNA, 15 bp, Homo sapiens
ataaatgatactgtg

SEQ ID NO: 6434 - DNA, 15 bp, Homo sapiens
tataaatgatactgt

SEQ ID NO: 6435 - DNA, 15 bp, Homo sapiens
ttataaatgatactg

SEQ ID NO: 6436 - DNA, 15 bp, Homo sapiens
attataaatgatact

SEQ ID NO: 6437 - DNA, 15 bp, Homo sapiens
tattataaatgatac

SEQ ID NO: 6438 - DNA, 15 bp, Homo sapiens
ctattataaatgata

SEQ ID NO: 6439 - DNA, 15 bp, Homo sapiens
tctattataaatgat

SEQ ID NO: 6440 - DNA, 15 bp, Homo sapiens
ttctattataaatga

SEQ ID NO: 6441 - DNA, 15 bp, Homo sapiens
tttctattataaatg

SEQ ID NO: 6442 - DNA, 15 bp, Homo sapiens
ttttctattataaat

SEQ ID NO: 6443 - DNA, 15 bp, Homo sapiens
gttttctattataaa

SEQ ID NO: 6444 - DNA, 15 bp, Homo sapiens
tgttttctattataa

SEQ ID NO: 6445 - DNA, 15 bp, Homo sapiens
atgttttctattata

SEQ ID NO: 6446 - DNA, 15 bp, Homo sapiens
aatgttttctattat

SEQ ID NO: 6447 - DNA, 15 bp, Homo sapiens
caatgttttctatta

SEQ ID NO: 6448 - DNA, 15 bp, Homo sapiens
acaatgttttctatt

SEQ ID NO: 6449 - DNA, 15 bp, Homo sapiens
tacaatgttttctat

SEQ ID NO: 6450 - DNA, 15 bp, Homo sapiens
ttacaatgttttcta

SEQ ID NO: 6451 - DNA, 15 bp, Homo sapiens
tttacaatgttttct

SEQ ID NO: 6452 - DNA, 15 bp, Homo sapiens
gtttacaatgttttc

SEQ ID NO: 6453 - DNA, 15 bp, Homo sapiens
tgtttacaatgtttt

SEQ ID NO: 6454 - DNA, 15 bp, Homo sapiens
gtgtttacaatgttt

SEQ ID NO: 6455 - DNA, 15 bp, Homo sapiens
ggtgtttacaatgtt

SEQ ID NO: 6456 - DNA, 15 bp, Homo sapiens
tggtgtttacaatgt

SEQ ID NO: 6457 - DNA, 15 bp, Homo sapiens
atggtgtttacaatg

SEQ ID NO: 6458 - DNA, 15 bp, Homo sapiens
catggtgtttacaat

SEQ ID NO: 6459 - DNA, 15 bp, Homo sapiens
tcatggtgtttacaa

SEQ ID NO: 6460 - DNA, 15 bp, Homo sapiens
ttcatggtgtttaca

SEQ ID NO: 6461 - DNA, 15 bp, Homo sapiens
tttcatggtgtttac

SEQ ID NO: 6462 - DNA, 15 bp, Homo sapiens
ttttcatggtgttta

SEQ ID NO: 6463 - DNA, 15 bp, Homo sapiens
attttcatggtgttt

SEQ ID NO: 6464 - DNA, 15 bp, Homo sapiens
gattttcatggtgtt

SEQ ID NO: 6465 - DNA, 15 bp, Homo sapiens
agattttcatggtgt

SEQ ID NO: 6466 - DNA, 15 bp, Homo sapiens
tagattttcatggtg

SEQ ID NO: 6467 - DNA, 15 bp, Homo sapiens
ttagattttcatggt

SEQ ID NO: 6468 - DNA, 15 bp, Homo sapiens
attagattttcatgg

SEQ ID NO: 6469 - DNA, 15 bp, Homo sapiens
tattagattttcatg

SEQ ID NO: 6470 - DNA, 15 bp, Homo sapiens
atattagattttcat

SEQ ID NO: 6471 - DNA, 15 bp, Homo sapiens
aatattagattttca

SEQ ID NO: 6472 - DNA, 15 bp, Homo sapiens
taatattagattttc

SEQ ID NO: 6473 - DNA, 15 bp, Homo sapiens
ctaatattagatttt

SEQ ID NO: 6474 - DNA, 15 bp, Homo sapiens
cctaatattagattt

SEQ ID NO: 6475 - DNA, 15 bp, Homo sapiens
tcctaatattagatt

SEQ ID NO: 6476 - DNA, 15 bp, Homo sapiens
ttcctaatattagat

SEQ ID NO: 6477 - DNA, 15 bp, Homo sapiens
attcctaatattaga

SEQ ID NO: 6478 - DNA, 15 bp, Homo sapiens
aattcctaatattag

SEQ ID NO: 6479 - DNA, 15 bp, Homo sapiens
caattcctaatatta

SEQ ID NO: 6480 - DNA, 15 bp, Homo sapiens
ccaattcctaatatt

SEQ ID NO: 6481 - DNA, 15 bp, Homo sapiens
accaattcctaatat

SEQ ID NO: 6482 - DNA, 15 bp, Homo sapiens
aaccaattcctaata

SEQ ID NO: 6483 - DNA, 15 bp, Homo sapiens
taaccaattcctaat

SEQ ID NO: 6484 - DNA, 15 bp, Homo sapiens
ctaaccaattcctaa

SEQ ID NO: 6485 - DNA, 15 bp, Homo sapiens
tctaaccaattccta

SEQ ID NO: 6486 - DNA, 15 bp, Homo sapiens
atctaaccaattcct

SEQ ID NO: 6487 - DNA, 15 bp, Homo sapiens
gatctaaccaattcc

SEQ ID NO: 6488 - DNA, 15 bp, Homo sapiens
tgatctaaccaattc

SEQ ID NO: 6489 - DNA, 15 bp, Homo sapiens
atgatctaaccaatt

SEQ ID NO: 6490 - DNA, 15 bp, Homo sapiens
aatgatctaaccaat

SEQ ID NO: 6491 - DNA, 15 bp, Homo sapiens
taatgatctaaccaa

SEQ ID NO: 6492 - DNA, 15 bp, Homo sapiens
ataatgatctaacca

SEQ ID NO: 6493 - DNA, 15 bp, Homo sapiens
aataatgatctaacc

SEQ ID NO: 6494 - DNA, 15 bp, Homo sapiens
aaataatgatctaac

SEQ ID NO: 6495 - DNA, 15 bp, Homo sapiens
gaaataatgatctaa

SEQ ID NO: 6496 - DNA, 15 bp, Homo sapiens
ggaaataatgatcta

SEQ ID NO: 6497 - DNA, 15 bp, Homo sapiens
gggaaataatgatct

SEQ ID NO: 6498 - DNA, 15 bp, Homo sapiens
tgggaaataatgatc

SEQ ID NO: 6499 - DNA, 15 bp, Homo sapiens
ttgggaaataatgat

SEQ ID NO: 6500 - DNA, 15 bp, Homo sapiens
tttgggaaataatga

SEQ ID NO: 6501 - DNA, 15 bp, Homo sapiens
ctttgggaaataatg

SEQ ID NO: 6502 - DNA, 15 bp, Homo sapiens
actttgggaaataat

SEQ ID NO: 6503 - DNA, 15 bp, Homo sapiens
tactttgggaaataa

SEQ ID NO: 6504 - DNA, 15 bp, Homo sapiens
atactttgggaaata

SEQ ID NO: 6505 - DNA, 15 bp, Homo sapiens
aatactttgggaaat

SEQ ID NO: 6506 - DNA, 15 bp, Homo sapiens
aaatactttgggaaa

SEQ ID NO: 6507 - DNA, 15 bp, Homo sapiens
gaaatactttgggaa

SEQ ID NO: 6508 - DNA, 15 bp, Homo sapiens
cgaaatactttggga

SEQ ID NO: 6509 - DNA, 15 bp, Homo sapiens
tcgaaatactttggg

SEQ ID NO: 6510 - DNA, 15 bp, Homo sapiens
ttcgaaatactttgg

SEQ ID NO: 6511 - DNA, 15 bp, Homo sapiens
tttcgaaatactttg

SEQ ID NO: 6512 - DNA, 15 bp, Homo sapiens
ttttcgaaatacttt

SEQ ID NO: 6513 - DNA, 15 bp, Homo sapiens
cttttcgaaatactt

SEQ ID NO: 6514 - DNA, 15 bp, Homo sapiens
tcttttcgaaatact

SEQ ID NO: 6515 - DNA, 15 bp, Homo sapiens
atcttttcgaaatac

SEQ ID NO: 6516 - DNA, 15 bp, Homo sapiens
gatcttttcgaaata

SEQ ID NO: 6517 - DNA, 15 bp, Homo sapiens
tgatcttttcgaaat

SEQ ID NO: 6518 - DNA, 15 bp, Homo sapiens
ttgatcttttcgaaa

SEQ ID NO: 6519 - DNA, 15 bp, Homo sapiens
tttgatcttttcgaa

SEQ ID NO: 6520 - DNA, 15 bp, Homo sapiens
ttttgatcttttcga

SEQ ID NO: 6521 - DNA, 15 bp, Homo sapiens
cttttgatcttttcg

SEQ ID NO: 6522 - DNA, 15 bp, Homo sapiens
acttttgatcttttc

SEQ ID NO: 6523 - DNA, 15 bp, Homo sapiens
aacttttgatctttt

SEQ ID NO: 6524 - DNA, 15 bp, Homo sapiens
gaacttttgatcttt

SEQ ID NO: 6525 - DNA, 15 bp, Homo sapiens
agaacttttgatctt

SEQ ID NO: 6526 - DNA, 15 bp, Homo sapiens
tagaacttttgatct

SEQ ID NO: 6527 - DNA, 15 bp, Homo sapiens
ctagaacttttgatc

SEQ ID NO: 6528 - DNA, 15 bp, Homo sapiens
cctagaacttttgat

SEQ ID NO: 6529 - DNA, 15 bp, Homo sapiens
tcctagaacttttga

SEQ ID NO: 6530 - DNA, 15 bp, Homo sapiens
atcctagaacttttg

SEQ ID NO: 6531 - DNA, 15 bp, Homo sapiens
aatcctagaactttt

SEQ ID NO: 6532 - DNA, 15 bp, Homo sapiens
caatcctagaacttt

SEQ ID NO: 6533 - DNA, 15 bp, Homo sapiens
acaatcctagaactt

SEQ ID NO: 6534 - DNA, 15 bp, Homo sapiens
aacaatcctagaact

SEQ ID NO: 6535 - DNA, 15 bp, Homo sapiens
taacaatcctagaac

SEQ ID NO: 6536 - DNA, 15 bp, Homo sapiens
ttaacaatcctagaa

SEQ ID NO: 6537 - DNA, 15 bp, Homo sapiens
attaacaatcctaga

SEQ ID NO: 6538 - DNA, 15 bp, Homo sapiens
cattaacaatcctag

SEQ ID NO: 6539 - DNA, 15 bp, Homo sapiens
acattaacaatccta

SEQ ID NO: 6540 - DNA, 15 bp, Homo sapiens
cacattaacaatcct

SEQ ID NO: 6541 - DNA, 15 bp, Homo sapiens
acacattaacaatcc

SEQ ID NO: 6542 - DNA, 15 bp, Homo sapiens
tacacattaacaatc

SEQ ID NO: 6543 - DNA, 15 bp, Homo sapiens
ttacacattaacaat

SEQ ID NO: 6544 - DNA, 15 bp, Homo sapiens
attacacattaacaa

SEQ ID NO: 6545 - DNA, 15 bp, Homo sapiens
aattacacattaaca

SEQ ID NO: 6546 - DNA, 15 bp, Homo sapiens
gaattacacattaac

SEQ ID NO: 6547 - DNA, 15 bp, Homo sapiens
tgaattacacattaa

SEQ ID NO: 6548 - DNA, 15 bp, Homo sapiens
gtgaattacacatta

SEQ ID NO: 6549 - DNA, 15 bp, Homo sapiens
tgtgaattacacatt

SEQ ID NO: 6550 - DNA, 15 bp, Homo sapiens
ttgtgaattacacat

SEQ ID NO: 6551 - DNA, 15 bp, Homo sapiens
tttgtgaattacaca

SEQ ID NO: 6552 - DNA, 15 bp, Homo sapiens
ttttgtgaattacac

SEQ ID NO: 6553 - DNA, 15 bp, Homo sapiens
cttttgtgaattaca

SEQ ID NO: 6554 - DNA, 15 bp, Homo sapiens
ccttttgtgaattac

SEQ ID NO: 6555 - DNA, 15 bp, Homo sapiens
tccttttgtgaatta

SEQ ID NO: 6556 - DNA, 15 bp, Homo sapiens
atccttttgtgaatt

SEQ ID NO: 6557 - DNA, 15 bp, Homo sapiens
catccttttgtgaat

SEQ ID NO: 6558 - DNA, 15 bp, Homo sapiens
acatccttttgtgaa

SEQ ID NO: 6559 - DNA, 15 bp, Homo sapiens
aacatccttttgtga

SEQ ID NO: 6560 - DNA, 15 bp, Homo sapiens
taacatccttttgtg

SEQ ID NO: 6561 - DNA, 15 bp, Homo sapiens
ataacatccttttgt

SEQ ID NO: 6562 - DNA, 15 bp, Homo sapiens
cataacatccttttg

SEQ ID NO: 6563 - DNA, 15 bp, Homo sapiens
ccataacatcctttt

SEQ ID NO: 6564 - DNA, 15 bp, Homo sapiens
accataacatccttt

SEQ ID NO: 6565 - DNA, 15 bp, Homo sapiens
gaccataacatcctt

SEQ ID NO: 6566 - DNA, 15 bp, Homo sapiens
tgaccataacatcct

SEQ ID NO: 6567 - DNA, 15 bp, Homo sapiens
ttgaccataacatcc

SEQ ID NO: 6568 - DNA, 15 bp, Homo sapiens
tttgaccataacatc

SEQ ID NO: 6569 - DNA, 15 bp, Homo sapiens
atttgaccataacat

SEQ ID NO: 6570 - DNA, 15 bp, Homo sapiens
tatttgaccataaca

SEQ ID NO: 6571 - DNA, 15 bp, Homo sapiens
ctatttgaccataac

SEQ ID NO: 6572 - DNA, 15 bp, Homo sapiens
gctatttgaccataa

SEQ ID NO: 6573 - DNA, 15 bp, Homo sapiens
agctatttgaccata

SEQ ID NO: 6574 - DNA, 15 bp, Homo sapiens
aagctatttgaccat

SEQ ID NO: 6575 - DNA, 15 bp, Homo sapiens
aaagctatttgacca

SEQ ID NO: 6576 - DNA, 15 bp, Homo sapiens
taaagctatttgacc

SEQ ID NO: 6577 - DNA, 15 bp, Homo sapiens
ctaaagctatttgac

SEQ ID NO: 6578 - DNA, 15 bp, Homo sapiens
cctaaagctatttga

SEQ ID NO: 6579 - DNA, 15 bp, Homo sapiens
tcctaaagctatttg

SEQ ID NO: 6580 - DNA, 15 bp, Homo sapiens
ttcctaaagctattt

SEQ ID NO: 6581 - DNA, 15 bp, Homo sapiens
tttcctaaagctatt

SEQ ID NO: 6582 - DNA, 15 bp, Homo sapiens
atttcctaaagctat

SEQ ID NO: 6583 - DNA, 15 bp, Homo sapiens
tatttcctaaagcta

SEQ ID NO: 6584 - DNA, 15 bp, Homo sapiens
ctatttcctaaagct

SEQ ID NO: 6585 - DNA, 15 bp, Homo sapiens
actatttcctaaagc

SEQ ID NO: 6586 - DNA, 15 bp, Homo sapiens
aactatttcctaaag

SEQ ID NO: 6587 - DNA, 15 bp, Homo sapiens
caactatttcctaaa

SEQ ID NO: 6588 - DNA, 15 bp, Homo sapiens
acaactatttcctaa

SEQ ID NO: 6589 - DNA, 15 bp, Homo sapiens
aacaactatttccta

SEQ ID NO: 6590 - DNA, 15 bp, Homo sapiens
aaacaactatttcct

SEQ ID NO: 6591 - DNA, 15 bp, Homo sapiens
taaacaactatttcc

SEQ ID NO: 6592 - DNA, 15 bp, Homo sapiens
ttaaacaactatttc

SEQ ID NO: 6593 - DNA, 15 bp, Homo sapiens
tttaaacaactattt

SEQ ID NO: 6594 - DNA, 15 bp, Homo sapiens
gtttaaacaactatt

SEQ ID NO: 6595 - DNA, 15 bp, Homo sapiens
ggtttaaacaactat

SEQ ID NO: 6596 - DNA, 15 bp, Homo sapiens
aggtttaaacaacta

SEQ ID NO: 6597 - DNA, 15 bp, Homo sapiens
taggtttaaacaact

SEQ ID NO: 6598 - DNA, 15 bp, Homo sapiens
ataggtttaaacaac

SEQ ID NO: 6599 - DNA, 15 bp, Homo sapiens
aataggtttaaacaa

SEQ ID NO: 6600 - DNA, 15 bp, Homo sapiens
taataggtttaaaca

SEQ ID NO: 6601 - DNA, 15 bp, Homo sapiens
ataataggtttaaac

SEQ ID NO: 6602 - DNA, 15 bp, Homo sapiens
aataataggtttaaa

SEQ ID NO: 6603 - DNA, 15 bp, Homo sapiens
gaataataggtttaa

SEQ ID NO: 6604 - DNA, 15 bp, Homo sapiens
agaataataggttta

SEQ ID NO: 6605 - DNA, 15 bp, Homo sapiens
cagaataataggttt

SEQ ID NO: 6606 - DNA, 15 bp, Homo sapiens
acagaataataggtt

SEQ ID NO: 6607 - DNA, 15 bp, Homo sapiens
aacagaataataggt

SEQ ID NO: 6608 - DNA, 15 bp, Homo sapiens
aaacagaataatagg

SEQ ID NO: 6609 - DNA, 15 bp, Homo sapiens
gaaacagaataatag

SEQ ID NO: 6610 - DNA, 15 bp, Homo sapiens
agaaacagaataata

SEQ ID NO: 6611 - DNA, 15 bp, Homo sapiens
aagaaacagaataat

SEQ ID NO: 6612 - DNA, 15 bp, Homo sapiens
aaagaaacagaataa

SEQ ID NO: 6613 - DNA, 15 bp, Homo sapiens
taaagaaacagaata

SEQ ID NO: 6614 - DNA, 15 bp, Homo sapiens
gtaaagaaacagaat

SEQ ID NO: 6615 - DNA, 15 bp, Homo sapiens
agtaaagaaacagaa

SEQ ID NO: 6616 - DNA, 15 bp, Homo sapiens
gagtaaagaaacaga

SEQ ID NO: 6617 - DNA, 15 bp, Homo sapiens
agagtaaagaaacag

SEQ ID NO: 6618 - DNA, 15 bp, Homo sapiens
tagagtaaagaaaca

SEQ ID NO: 6619 - DNA, 15 bp, Homo sapiens
ctagagtaaagaaac

SEQ ID NO: 6620 - DNA, 15 bp, Homo sapiens
gctagagtaaagaaa

SEQ ID NO: 6621 - DNA, 15 bp, Homo sapiens
tgctagagtaaagaa

SEQ ID NO: 6622 - DNA, 15 bp, Homo sapiens
gtgctagagtaaaga

SEQ ID NO: 6623 - DNA, 15 bp, Homo sapiens
tgtgctagagtaaag

SEQ ID NO: 6624 - DNA, 15 bp, Homo sapiens
atgtgctagagtaaa

SEQ ID NO: 6625 - DNA, 15 bp, Homo sapiens
gatgtgctagagtaa

SEQ ID NO: 6626 - DNA, 15 bp, Homo sapiens
agatgtgctagagta

SEQ ID NO: 6627 - DNA, 15 bp, Homo sapiens
cagatgtgctagagt

SEQ ID NO: 6628 - DNA, 15 bp, Homo sapiens
tcagatgtgctagag

SEQ ID NO: 6629 - DNA, 15 bp, Homo sapiens
ttcagatgtgctaga

SEQ ID NO: 6630 - DNA, 15 bp, Homo sapiens
gttcagatgtgctag

SEQ ID NO: 6631 - DNA, 15 bp, Homo sapiens
tgttcagatgtgcta

SEQ ID NO: 6632 - DNA, 15 bp, Homo sapiens
ctgttcagatgtgct

SEQ ID NO: 6633 - DNA, 15 bp, Homo sapiens
tctgttcagatgtgc

SEQ ID NO: 6634 - DNA, 15 bp, Homo sapiens
atctgttcagatgtg

SEQ ID NO: 6635 - DNA, 15 bp, Homo sapiens
gatctgttcagatgt

SEQ ID NO: 6636 - DNA, 15 bp, Homo sapiens
tgatctgttcagatg

SEQ ID NO: 6637 - DNA, 15 bp, Homo sapiens
atgatctgttcagat

SEQ ID NO: 6638 - DNA, 15 bp, Homo sapiens
tatgatctgttcaga

SEQ ID NO: 6639 - DNA, 15 bp, Homo sapiens
gtatgatctgttcag

SEQ ID NO: 6640 - DNA, 15 bp, Homo sapiens
tgtatgatctgttca

SEQ ID NO: 6641 - DNA, 15 bp, Homo sapiens
atgtatgatctgttc

SEQ ID NO: 6642 - DNA, 15 bp, Homo sapiens
catgtatgatctgtt

SEQ ID NO: 6643 - DNA, 15 bp, Homo sapiens
tcatgtatgatctgt

SEQ ID NO: 6644 - DNA, 15 bp, Homo sapiens
atcatgtatgatctg

SEQ ID NO: 6645 - DNA, 15 bp, Homo sapiens
gatcatgtatgatct

SEQ ID NO: 6646 - DNA, 15 bp, Homo sapiens
agatcatgtatgatc

SEQ ID NO: 6647 - DNA, 15 bp, Homo sapiens
gagatcatgtatgat

SEQ ID NO: 6648 - DNA, 15 bp, Homo sapiens
tgagatcatgtatga

SEQ ID NO: 6649 - DNA, 15 bp, Homo sapiens
ctgagatcatgtatg

SEQ ID NO: 6650 - DNA, 15 bp, Homo sapiens
actgagatcatgtat

SEQ ID NO: 6651 - DNA, 15 bp, Homo sapiens
tactgagatcatgta

SEQ ID NO: 6652 - DNA, 15 bp, Homo sapiens
ctactgagatcatgt

SEQ ID NO: 6653 - DNA, 15 bp, Homo sapiens
tctactgagatcatg

SEQ ID NO: 6654 - DNA, 15 bp, Homo sapiens
ctctactgagatcat

SEQ ID NO: 6655 - DNA, 15 bp, Homo sapiens
cctctactgagatca

SEQ ID NO: 6656 - DNA, 15 bp, Homo sapiens
acctctactgagatc

SEQ ID NO: 6657 - DNA, 15 bp, Homo sapiens
tacctctactgagat

SEQ ID NO: 6658 - DNA, 15 bp, Homo sapiens
ttacctctactgaga

SEQ ID NO: 6659 - DNA, 15 bp, Homo sapiens
gttacctctactgag

SEQ ID NO: 6660 - DNA, 15 bp, Homo sapiens
agttacctctactga

SEQ ID NO: 6661 - DNA, 15 bp, Homo sapiens
tagttacctctactg

SEQ ID NO: 6662 - DNA, 15 bp, Homo sapiens
ttagttacctctact

SEQ ID NO: 6663 - DNA, 15 bp, Homo sapiens
tttagttacctctac

SEQ ID NO: 6664 - DNA, 15 bp, Homo sapiens
atttagttacctcta

SEQ ID NO: 6665 - DNA, 15 bp, Homo sapiens
aatttagttacctct

SEQ ID NO: 6666 - DNA, 15 bp, Homo sapiens
taatttagttacctc

SEQ ID NO: 6667 - DNA, 15 bp, Homo sapiens
ctaatttagttacct

SEQ ID NO: 6668 - DNA, 15 bp, Homo sapiens
cctaatttagttacc

SEQ ID NO: 6669 - DNA, 15 bp, Homo sapiens
ccctaatttagttac

SEQ ID NO: 6670 - DNA, 15 bp, Homo sapiens
accctaatttagtta

SEQ ID NO: 6671 - DNA, 15 bp, Homo sapiens
taccctaatttagtt

SEQ ID NO: 6672 - DNA, 15 bp, Homo sapiens
ataccctaatttagt

SEQ ID NO: 6673 - DNA, 15 bp, Homo sapiens
tataccctaatttag

SEQ ID NO: 6674 - DNA, 15 bp, Homo sapiens
atataccctaattta

SEQ ID NO: 6675 - DNA, 15 bp, Homo sapiens
gatataccctaattt

SEQ ID NO: 6676 - DNA, 15 bp, Homo sapiens
ggatataccctaatt

SEQ ID NO: 6677 - DNA, 15 bp, Homo sapiens
tggatataccctaat

SEQ ID NO: 6678 - DNA, 15 bp, Homo sapiens
atggatataccctaa

SEQ ID NO: 6679 - DNA, 15 bp, Homo sapiens
tatggatatacccta

SEQ ID NO: 6680 - DNA, 15 bp, Homo sapiens
ttatggatataccct

SEQ ID NO: 6681 - DNA, 15 bp, Homo sapiens
tttatggatataccc

SEQ ID NO: 6682 - DNA, 15 bp, Homo sapiens
ctttatggatatacc

SEQ ID NO: 6683 - DNA, 15 bp, Homo sapiens
actttatggatatac

SEQ ID NO: 6684 - DNA, 15 bp, Homo sapiens
tactttatggatata

SEQ ID NO: 6685 - DNA, 15 bp, Homo sapiens
ctactttatggatat

SEQ ID NO: 6686 - DNA, 15 bp, Homo sapiens
tctactttatggata

SEQ ID NO: 6687 - DNA, 15 bp, Homo sapiens
ttctactttatggat

SEQ ID NO: 6688 - DNA, 15 bp, Homo sapiens
cttctactttatgga

SEQ ID NO: 6689 - DNA, 15 bp, Homo sapiens
tcttctactttatgg

SEQ ID NO: 6690 - DNA, 15 bp, Homo sapiens
atcttctactttatg

SEQ ID NO: 6691 - DNA, 15 bp, Homo sapiens
aatcttctactttat

SEQ ID NO: 6692 - DNA, 15 bp, Homo sapiens
taatcttctacttta

SEQ ID NO: 6693 - DNA, 15 bp, Homo sapiens
ttaatcttctacttt

SEQ ID NO: 6694 - DNA, 15 bp, Homo sapiens
cttaatcttctactt

SEQ ID NO: 6695 - DNA, 15 bp, Homo sapiens
gcttaatcttctact

SEQ ID NO: 6696 - DNA, 15 bp, Homo sapiens
tgcttaatcttctac

SEQ ID NO: 6697 - DNA, 15 bp, Homo sapiens
atgcttaatcttcta

SEQ ID NO: 6698 - DNA, 15 bp, Homo sapiens
aatgcttaatcttct

SEQ ID NO: 6699 - DNA, 15 bp, Homo sapiens
gaatgcttaatcttc

SEQ ID NO: 6700 - DNA, 15 bp, Homo sapiens
tgaatgcttaatctt

SEQ ID NO: 6701 - DNA, 15 bp, Homo sapiens
atgaatgcttaatct

SEQ ID NO: 6702 - DNA, 15 bp, Homo sapiens
tatgaatgcttaatc

SEQ ID NO: 6703 - DNA, 15 bp, Homo sapiens
ttatgaatgcttaat

SEQ ID NO: 6704 - DNA, 15 bp, Homo sapiens
tttatgaatgcttaa

SEQ ID NO: 6705 - DNA, 15 bp, Homo sapiens
ttttatgaatgctta

SEQ ID NO: 6706 - DNA, 15 bp, Homo sapiens
tttttatgaatgctt

SEQ ID NO: 6707 - DNA, 15 bp, Homo sapiens
ctttttatgaatgct

SEQ ID NO: 6708 - DNA, 15 bp, Homo sapiens
actttttatgaatgc

SEQ ID NO: 6709 - DNA, 15 bp, Homo sapiens
cactttttatgaatg

SEQ ID NO: 6710 - DNA, 15 bp, Homo sapiens
tcactttttatgaat

SEQ ID NO: 6711 - DNA, 15 bp, Homo sapiens
atcactttttatgaa

SEQ ID NO: 6712 - DNA, 15 bp, Homo sapiens
tatcactttttatga

SEQ ID NO: 6713 - DNA, 15 bp, Homo sapiens
gtatcactttttatg

SEQ ID NO: 6714 - DNA, 15 bp, Homo sapiens
tgtatcactttttat

SEQ ID NO: 6715 - DNA, 15 bp, Homo sapiens
ctgtatcacttttta

SEQ ID NO: 6716 - DNA, 15 bp, Homo sapiens
tctgtatcacttttt

SEQ ID NO: 6717 - DNA, 15 bp, Homo sapiens
atctgtatcactttt

SEQ ID NO: 6718 - DNA, 15 bp, Homo sapiens
catctgtatcacttt

SEQ ID NO: 6719 - DNA, 15 bp, Homo sapiens
acatctgtatcactt

SEQ ID NO: 6720 - DNA, 15 bp, Homo sapiens
cacatctgtatcact

SEQ ID NO: 6721 - DNA, 15 bp, Homo sapiens
acacatctgtatcac

SEQ ID NO: 6722 - DNA, 15 bp, Homo sapiens
cacacatctgtatca

SEQ ID NO: 6723 - DNA, 15 bp, Homo sapiens
acacacatctgtatc

SEQ ID NO: 6724 - DNA, 15 bp, Homo sapiens
cacacacatctgtat

SEQ ID NO: 6725 - DNA, 15 bp, Homo sapiens
tcacacacatctgta

SEQ ID NO: 6726 - DNA, 15 bp, Homo sapiens
atcacacacatctgt

SEQ ID NO: 6727 - DNA, 15 bp, Homo sapiens
catcacacacatctg

SEQ ID NO: 6728 - DNA, 15 bp, Homo sapiens
acatcacacacatct

SEQ ID NO: 6729 - DNA, 15 bp, Homo sapiens
cacatcacacacatc

SEQ ID NO: 6730 - DNA, 15 bp, Homo sapiens
acacatcacacacat

SEQ ID NO: 6731 - DNA, 15 bp, Homo sapiens
cacacatcacacaca

SEQ ID NO: 6732 - DNA, 15 bp, Homo sapiens
acacacatcacacac

SEQ ID NO: 6733 - DNA, 15 bp, Homo sapiens
cacacacatcacaca

SEQ ID NO: 6734 - DNA, 15 bp, Homo sapiens
acacacacatcacac

SEQ ID NO: 6735 - DNA, 15 bp, Homo sapiens
cacacacacatcaca

SEQ ID NO: 6736 - DNA, 15 bp, Homo sapiens
acacacacacatcac

SEQ ID NO: 6737 - DNA, 15 bp, Homo sapiens
cacacacacacatca

SEQ ID NO: 6738 - DNA, 15 bp, Homo sapiens
acacacacacacatc

SEQ ID NO: 6739 - DNA, 15 bp, Homo sapiens
acacacacacacaca

SEQ ID NO: 6740 - DNA, 15 bp, Homo sapiens
cacacacacacacac

SEQ ID NO: 6741 - DNA, 15 bp, Homo sapiens
tacacacacacacac

SEQ ID NO: 6742 - DNA, 15 bp, Homo sapiens
atacacacacacaca

SEQ ID NO: 6743 - DNA, 15 bp, Homo sapiens
catacacacacacac

SEQ ID NO: 6744 - DNA, 15 bp, Homo sapiens
tcatacacacacaca

SEQ ID NO: 6745 - DNA, 15 bp, Homo sapiens
ttcatacacacacac

SEQ ID NO: 6746 - DNA, 15 bp, Homo sapiens
attcatacacacaca

SEQ ID NO: 6747 - DNA, 15 bp, Homo sapiens
tattcatacacacac

SEQ ID NO: 6748 - DNA, 15 bp, Homo sapiens
atattcatacacaca

SEQ ID NO: 6749 - DNA, 15 bp, Homo sapiens
tatattcatacacac

SEQ ID NO: 6750 - DNA, 15 bp, Homo sapiens
ctatattcatacaca

SEQ ID NO: 6751 - DNA, 15 bp, Homo sapiens
tctatattcatacac

SEQ ID NO: 6752 - DNA, 15 bp, Homo sapiens
ttctatattcataca

SEQ ID NO: 6753 - DNA, 15 bp, Homo sapiens
tttctatattcatac

SEQ ID NO: 6754 - DNA, 15 bp, Homo sapiens
atttctatattcata

SEQ ID NO: 6755 - DNA, 15 bp, Homo sapiens
catttctatattcat

SEQ ID NO: 6756 - DNA, 15 bp, Homo sapiens
acatttctatattca

SEQ ID NO: 6757 - DNA, 15 bp, Homo sapiens
cacatttctatattc

SEQ ID NO: 6758 - DNA, 15 bp, Homo sapiens
acacatttctatatt

SEQ ID NO: 6759 - DNA, 15 bp, Homo sapiens
aacacatttctatat

SEQ ID NO: 6760 - DNA, 15 bp, Homo sapiens
gaacacatttctata

SEQ ID NO: 6761 - DNA, 15 bp, Homo sapiens
agaacacatttctat

SEQ ID NO: 6762 - DNA, 15 bp, Homo sapiens
aagaacacatttcta

SEQ ID NO: 6763 - DNA, 15 bp, Homo sapiens
caagaacacatttct

SEQ ID NO: 6764 - DNA, 15 bp, Homo sapiens
tcaagaacacatttc

SEQ ID NO: 6765 - DNA, 15 bp, Homo sapiens
atcaagaacacattt

SEQ ID NO: 6766 - DNA, 15 bp, Homo sapiens
tatcaagaacacatt

SEQ ID NO: 6767 - DNA, 15 bp, Homo sapiens
atatcaagaacacat

SEQ ID NO: 6768 - DNA, 15 bp, Homo sapiens
tatatcaagaacaca

SEQ ID NO: 6769 - DNA, 15 bp, Homo sapiens
ctatatcaagaacac

SEQ ID NO: 6770 - DNA, 15 bp, Homo sapiens
actatatcaagaaca

SEQ ID NO: 6771 - DNA, 15 bp, Homo sapiens
tactatatcaagaac

SEQ ID NO: 6772 - DNA, 15 bp, Homo sapiens
ttactatatcaagaa

SEQ ID NO: 6773 - DNA, 15 bp, Homo sapiens
cttactatatcaaga

SEQ ID NO: 6774 - DNA, 15 bp, Homo sapiens
acttactatatcaag

SEQ ID NO: 6775 - DNA, 15 bp, Homo sapiens
tacttactatatcaa

SEQ ID NO: 6776 - DNA, 15 bp, Homo sapiens
ttacttactatatca

SEQ ID NO: 6777 - DNA, 15 bp, Homo sapiens
tttacttactatatc

SEQ ID NO: 6778 - DNA, 15 bp, Homo sapiens
gtttacttactatat

SEQ ID NO: 6779 - DNA, 15 bp, Homo sapiens
tgtttacttactata

SEQ ID NO: 6780 - DNA, 15 bp, Homo sapiens
ttgtttacttactat

SEQ ID NO: 6781 - DNA, 15 bp, Homo sapiens
cttgtttacttacta

SEQ ID NO: 6782 - DNA, 15 bp, Homo sapiens
acttgtttacttact

SEQ ID NO: 6783 - DNA, 15 bp, Homo sapiens
tacttgtttacttac

SEQ ID NO: 6784 - DNA, 15 bp, Homo sapiens
atacttgtttactta

SEQ ID NO: 6785 - DNA, 15 bp, Homo sapiens
catacttgtttactt

SEQ ID NO: 6786 - DNA, 15 bp, Homo sapiens
acatacttgtttact

SEQ ID NO: 6787 - DNA, 15 bp, Homo sapiens
tacatacttgtttac

SEQ ID NO: 6788 - DNA, 15 bp, Homo sapiens
atacatacttgttta

SEQ ID NO: 6789 - DNA, 15 bp, Homo sapiens
aatacatacttgttt

SEQ ID NO: 6790 - DNA, 15 bp, Homo sapiens
taatacatacttgtt

SEQ ID NO: 6791 - DNA, 15 bp, Homo sapiens
ataatacatacttgt

SEQ ID NO: 6792 - DNA, 15 bp, Homo sapiens
tataatacatacttg

SEQ ID NO: 6793 - DNA, 15 bp, Homo sapiens
atataatacatactt

SEQ ID NO: 6794 - DNA, 15 bp, Homo sapiens
catataatacatact

SEQ ID NO: 6795 - DNA, 15 bp, Homo sapiens
tcatataatacatac

SEQ ID NO: 6796 - DNA, 15 bp, Homo sapiens
ttcatataatacata

SEQ ID NO: 6797 - DNA, 15 bp, Homo sapiens
cttcatataatacat

SEQ ID NO: 6798 - DNA, 15 bp, Homo sapiens
acttcatataataca

SEQ ID NO: 6799 - DNA, 15 bp, Homo sapiens
gacttcatataatac

SEQ ID NO: 6800 - DNA, 15 bp, Homo sapiens
tgacttcatataata

SEQ ID NO: 6801 - DNA, 15 bp, Homo sapiens
atgacttcatataat

SEQ ID NO: 6802 - DNA, 15 bp, Homo sapiens
aatgacttcatataa

SEQ ID NO: 6803 - DNA, 15 bp, Homo sapiens
aaatgacttcatata

SEQ ID NO: 6804 - DNA, 15 bp, Homo sapiens
taaatgacttcatat

SEQ ID NO: 6805 - DNA, 15 bp, Homo sapiens
ataaatgacttcata

SEQ ID NO: 6806 - DNA, 15 bp, Homo sapiens
tataaatgacttcat

SEQ ID NO: 6807 - DNA, 15 bp, Homo sapiens
atataaatgacttca

SEQ ID NO: 6808 - DNA, 15 bp, Homo sapiens
catataaatgacttc

SEQ ID NO: 6809 - DNA, 15 bp, Homo sapiens
tcatataaatgactt

SEQ ID NO: 6810 - DNA, 15 bp, Homo sapiens
ttcatataaatgact

SEQ ID NO: 6811 - DNA, 15 bp, Homo sapiens
tttcatataaatgac

SEQ ID NO: 6812 - DNA, 15 bp, Homo sapiens
ttttcatataaatga

SEQ ID NO: 6813 - DNA, 15 bp, Homo sapiens
tttttcatataaatg

SEQ ID NO: 6814 - DNA, 15 bp, Homo sapiens
atttttcatataaat

SEQ ID NO: 6815 - DNA, 15 bp, Homo sapiens
catttttcatataaa

SEQ ID NO: 6816 - DNA, 15 bp, Homo sapiens
acatttttcatataa

SEQ ID NO: 6817 - DNA, 15 bp, Homo sapiens
aacatttttcatata

SEQ ID NO: 6818 - DNA, 15 bp, Homo sapiens
aaacatttttcatat

SEQ ID NO: 6819 - DNA, 15 bp, Homo sapiens
aaaacatttttcata

SEQ ID NO: 6820 - DNA, 15 bp, Homo sapiens
aaaaacatttttcat

SEQ ID NO: 6821 - DNA, 15 bp, Homo sapiens
aaaaaacatttttca

SEQ ID NO: 6822 - DNA, 15 bp, Homo sapiens
taaaaaacatttttc

SEQ ID NO: 6823 - DNA, 15 bp, Homo sapiens
ttaaaaaacattttt

SEQ ID NO: 6824 - DNA, 15 bp, Homo sapiens
tttaaaaaacatttt

SEQ ID NO: 6825 - DNA, 15 bp, Homo sapiens
ttttaaaaaacattt

SEQ ID NO: 6826 - DNA, 15 bp, Homo sapiens
tttttaaaaaacatt

SEQ ID NO: 6827 - DNA, 15 bp, Homo sapiens
atttttaaaaaacat

SEQ ID NO: 6828 - DNA, 15 bp, Homo sapiens
aatttttaaaaaaca

SEQ ID NO: 6829 - DNA, 15 bp, Homo sapiens
aaatttttaaaaaac

SEQ ID NO: 6830 - DNA, 15 bp, Homo sapiens
taaatttttaaaaaa

SEQ ID NO: 6831 - DNA, 15 bp, Homo sapiens
ctaaatttttaaaaa

SEQ ID NO: 6832 - DNA, 15 bp, Homo sapiens
actaaatttttaaaa

SEQ ID NO: 6833 - DNA, 15 bp, Homo sapiens
cactaaatttttaaa

SEQ ID NO: 6834 - DNA, 15 bp, Homo sapiens
tcactaaatttttaa

SEQ ID NO: 6835 - DNA, 15 bp, Homo sapiens
ttcactaaattttta

SEQ ID NO: 6836 - DNA, 15 bp, Homo sapiens
cttcactaaattttt

SEQ ID NO: 6837 - DNA, 15 bp, Homo sapiens
acttcactaaatttt

SEQ ID NO: 6838 - DNA, 15 bp, Homo sapiens
tacttcactaaattt

SEQ ID NO: 6839 - DNA, 15 bp, Homo sapiens
atacttcactaaatt

SEQ ID NO: 6840 - DNA, 15 bp, Homo sapiens
tatacttcactaaat

SEQ ID NO: 6841 - DNA, 15 bp, Homo sapiens
gtatacttcactaaa

SEQ ID NO: 6842 - DNA, 15 bp, Homo sapiens
tgtatacttcactaa

SEQ ID NO: 6843 - DNA, 15 bp, Homo sapiens
ttgtatacttcacta

SEQ ID NO: 6844 - DNA, 15 bp, Homo sapiens
attgtatacttcact

SEQ ID NO: 6845 - DNA, 15 bp, Homo sapiens
tattgtatacttcac

SEQ ID NO: 6846 - DNA, 15 bp, Homo sapiens
ttattgtatacttca

SEQ ID NO: 6847 - DNA, 15 bp, Homo sapiens
tttattgtatacttc

SEQ ID NO: 6848 - DNA, 15 bp, Homo sapiens
atttattgtatactt

SEQ ID NO: 6849 - DNA, 15 bp, Homo sapiens
catttattgtatact

SEQ ID NO: 6850 - DNA, 15 bp, Homo sapiens
acatttattgtatac

SEQ ID NO: 6851 - DNA, 15 bp, Homo sapiens
aacatttattgtata

SEQ ID NO: 6852 - DNA, 15 bp, Homo sapiens
taacatttattgtat

SEQ ID NO: 6853 - DNA, 15 bp, Homo sapiens
ttaacatttattgta

SEQ ID NO: 6854 - DNA, 15 bp, Homo sapiens
attaacatttattgt

SEQ ID NO: 6855 - DNA, 15 bp, Homo sapiens
tattaacatttattg

SEQ ID NO: 6856 - DNA, 15 bp, Homo sapiens
ctattaacatttatt

SEQ ID NO: 6857 - DNA, 15 bp, Homo sapiens
actattaacatttat

SEQ ID NO: 6858 - DNA, 15 bp, Homo sapiens
cactattaacattta

SEQ ID NO: 6859 - DNA, 15 bp, Homo sapiens
ccactattaacattt

SEQ ID NO: 6860 - DNA, 15 bp, Homo sapiens
accactattaacatt

SEQ ID NO: 6861 - DNA, 15 bp, Homo sapiens
gaccactattaacat

SEQ ID NO: 6862 - DNA, 15 bp, Homo sapiens
tgaccactattaaca

SEQ ID NO: 6863 - DNA, 15 bp, Homo sapiens
atgaccactattaac

SEQ ID NO: 6864 - DNA, 15 bp, Homo sapiens
gatgaccactattaa

SEQ ID NO: 6865 - DNA, 15 bp, Homo sapiens
agatgaccactatta

SEQ ID NO: 6866 - DNA, 15 bp, Homo sapiens
aagatgaccactatt

SEQ ID NO: 6867 - DNA, 15 bp, Homo sapiens
caagatgaccactat

SEQ ID NO: 6868 - DNA, 15 bp, Homo sapiens
ccaagatgaccacta

SEQ ID NO: 6869 - DNA, 15 bp, Homo sapiens
gccaagatgaccact

SEQ ID NO: 6870 - DNA, 15 bp, Homo sapiens
tgccaagatgaccac

SEQ ID NO: 6871 - DNA, 15 bp, Homo sapiens
atgccaagatgacca

SEQ ID NO: 6872 - DNA, 15 bp, Homo sapiens
aatgccaagatgacc

SEQ ID NO: 6873 - DNA, 15 bp, Homo sapiens
aaatgccaagatgac

SEQ ID NO: 6874 - DNA, 15 bp, Homo sapiens
caaatgccaagatga

SEQ ID NO: 6875 - DNA, 15 bp, Homo sapiens
tcaaatgccaagatg

SEQ ID NO: 6876 - DNA, 15 bp, Homo sapiens
ctcaaatgccaagat

SEQ ID NO: 6877 - DNA, 15 bp, Homo sapiens
tctcaaatgccaaga

SEQ ID NO: 6878 - DNA, 15 bp, Homo sapiens
atctcaaatgccaag

SEQ ID NO: 6879 - DNA, 15 bp, Homo sapiens
aatctcaaatgccaa

SEQ ID NO: 6880 - DNA, 15 bp, Homo sapiens
taatctcaaatgcca

SEQ ID NO: 6881 - DNA, 15 bp, Homo sapiens
ataatctcaaatgcc

SEQ ID NO: 6882 - DNA, 15 bp, Homo sapiens
aataatctcaaatgc

SEQ ID NO: 6883 - DNA, 15 bp, Homo sapiens
taataatctcaaatg

SEQ ID NO: 6884 - DNA, 15 bp, Homo sapiens
gtaataatctcaaat

SEQ ID NO: 6885 - DNA, 15 bp, Homo sapiens
agtaataatctcaaa

SEQ ID NO: 6886 - DNA, 15 bp, Homo sapiens
aagtaataatctcaa

SEQ ID NO: 6887 - DNA, 15 bp, Homo sapiens
aaagtaataatctca

SEQ ID NO: 6888 - DNA, 15 bp, Homo sapiens
aaaagtaataatctc

SEQ ID NO: 6889 - DNA, 15 bp, Homo sapiens
aaaaagtaataatct

SEQ ID NO: 6890 - DNA, 15 bp, Homo sapiens
aaaaaagtaataatc

SEQ ID NO: 6891 - DNA, 15 bp, Homo sapiens
aaaaaaagtaataat

SEQ ID NO: 6892 - DNA, 15 bp, Homo sapiens
aaaaaaaagtaataa

SEQ ID NO: 6893 - DNA, 15 bp, Homo sapiens
aaaaaaaaagtaata

SEQ ID NO: 6894 - DNA, 15 bp, Homo sapiens
caaaaaaaaaagtaa

SEQ ID NO: 6895 - DNA, 15 bp, Homo sapiens
gcaaaaaaaaaagta

SEQ ID NO: 6896 - DNA, 15 bp, Homo sapiens
agcaaaaaaaaaagt

SEQ ID NO: 6897 - DNA, 15 bp, Homo sapiens
cagcaaaaaaaaaag

SEQ ID NO: 6898 - DNA, 15 bp, Homo sapiens
tcagcaaaaaaaaaa

SEQ ID NO: 6899 - DNA, 15 bp, Homo sapiens
atcagcaaaaaaaaa

SEQ ID NO: 6900 - DNA, 15 bp, Homo sapiens
aatcagcaaaaaaaa

SEQ ID NO: 6901 - DNA, 15 bp, Homo sapiens
aaatcagcaaaaaaa

SEQ ID NO: 6902 - DNA, 15 bp, Homo sapiens
taaatcagcaaaaaa

SEQ ID NO: 6903 - DNA, 15 bp, Homo sapiens
ataaatcagcaaaaa

SEQ ID NO: 6904 - DNA, 15 bp, Homo sapiens
tataaatcagcaaaa

SEQ ID NO: 6905 - DNA, 15 bp, Homo sapiens
atataaatcagcaaa

SEQ ID NO: 6906 - DNA, 15 bp, Homo sapiens
aatataaatcagcaa

SEQ ID NO: 6907 - DNA, 15 bp, Homo sapiens
aaatataaatcagca

SEQ ID NO: 6908 - DNA, 15 bp, Homo sapiens
aaaatataaatcagc

SEQ ID NO: 6909 - DNA, 15 bp, Homo sapiens
gaaaatataaatcag

SEQ ID NO: 6910 - DNA, 15 bp, Homo sapiens
agaaaatataaatca

SEQ ID NO: 6911 - DNA, 15 bp, Homo sapiens
tagaaaatataaatc

SEQ ID NO: 6912 - DNA, 15 bp, Homo sapiens
ttagaaaatataaat

SEQ ID NO: 6913 - DNA, 15 bp, Homo sapiens
tttagaaaatataaa

SEQ ID NO: 6914 - DNA, 15 bp, Homo sapiens
ctttagaaaatataa

SEQ ID NO: 6915 - DNA, 15 bp, Homo sapiens
actttagaaaatata

SEQ ID NO: 6916 - DNA, 15 bp, Homo sapiens
aactttagaaaatat

SEQ ID NO: 6917 - DNA, 15 bp, Homo sapiens
gaactttagaaaata

SEQ ID NO: 6918 - DNA, 15 bp, Homo sapiens
agaactttagaaaat

SEQ ID NO: 6919 - DNA, 15 bp, Homo sapiens
aagaactttagaaaa

SEQ ID NO: 6920 - DNA, 15 bp, Homo sapiens
gaagaactttagaaa

SEQ ID NO: 6921 - DNA, 15 bp, Homo sapiens
tgaagaactttagaa

SEQ ID NO: 6922 - DNA, 15 bp, Homo sapiens
ttgaagaactttaga

SEQ ID NO: 6923 - DNA, 15 bp, Homo sapiens
attgaagaactttag

SEQ ID NO: 6924 - DNA, 15 bp, Homo sapiens
cattgaagaacttta

SEQ ID NO: 6925 - DNA, 15 bp, Homo sapiens
tcattgaagaacttt

SEQ ID NO: 6926 - DNA, 15 bp, Homo sapiens
ttcattgaagaactt

SEQ ID NO: 6927 - DNA, 15 bp, Homo sapiens
gttcattgaagaact

SEQ ID NO: 6928 - DNA, 15 bp, Homo sapiens
ggttcattgaagaac

SEQ ID NO: 6929 - DNA, 15 bp, Homo sapiens
gggttcattgaagaa

SEQ ID NO: 6930 - DNA, 15 bp, Homo sapiens
tgggttcattgaaga

SEQ ID NO: 6931 - DNA, 15 bp, Homo sapiens
gtgggttcattgaag

SEQ ID NO: 6932 - DNA, 15 bp, Homo sapiens
tgtgggttcattgaa

SEQ ID NO: 6933 - DNA, 15 bp, Homo sapiens
atgtgggttcattga

SEQ ID NO: 6934 - DNA, 15 bp, Homo sapiens
aatgtgggttcattg

SEQ ID NO: 6935 - DNA, 15 bp, Homo sapiens
taatgtgggttcatt

SEQ ID NO: 6936 - DNA, 15 bp, Homo sapiens
gtaatgtgggttcat

SEQ ID NO: 6937 - DNA, 15 bp, Homo sapiens
agtaatgtgggttca

SEQ ID NO: 6938 - DNA, 15 bp, Homo sapiens
cagtaatgtgggttc

SEQ ID NO: 6939 - DNA, 15 bp, Homo sapiens
tcagtaatgtgggtt

SEQ ID NO: 6940 - DNA, 15 bp, Homo sapiens
ctcagtaatgtgggt

SEQ ID NO: 6941 - DNA, 15 bp, Homo sapiens
actcagtaatgtggg

SEQ ID NO: 6942 - DNA, 15 bp, Homo sapiens
aactcagtaatgtgg

SEQ ID NO: 6943 - DNA, 15 bp, Homo sapiens
gaactcagtaatgtg

SEQ ID NO: 6944 - DNA, 15 bp, Homo sapiens
agaactcagtaatgt

SEQ ID NO: 6945 - DNA, 15 bp, Homo sapiens
aagaactcagtaatg

SEQ ID NO: 6946 - DNA, 15 bp, Homo sapiens
taagaactcagtaat

SEQ ID NO: 6947 - DNA, 15 bp, Homo sapiens
ataagaactcagtaa

SEQ ID NO: 6948 - DNA, 15 bp, Homo sapiens
tataagaactcagta

SEQ ID NO: 6949 - DNA, 15 bp, Homo sapiens
atataagaactcagt

SEQ ID NO: 6950 - DNA, 15 bp, Homo sapiens
aatataagaactcag

SEQ ID NO: 6951 - DNA, 15 bp, Homo sapiens
aaatataagaactca

SEQ ID NO: 6952 - DNA, 15 bp, Homo sapiens
aaaatataagaactc

SEQ ID NO: 6953 - DNA, 15 bp, Homo sapiens
aaaaatataagaact

SEQ ID NO: 6954 - DNA, 15 bp, Homo sapiens
taaaaatataagaac

SEQ ID NO: 6955 - DNA, 15 bp, Homo sapiens
ttaaaaatataagaa

SEQ ID NO: 6956 - DNA, 15 bp, Homo sapiens
tttaaaaatataaga

SEQ ID NO: 6957 - DNA, 15 bp, Homo sapiens
ctttaaaaatataag

SEQ ID NO: 6958 - DNA, 15 bp, Homo sapiens
tctttaaaaatataa

SEQ ID NO: 6959 - DNA, 15 bp, Homo sapiens
atctttaaaaatata

SEQ ID NO: 6960 - DNA, 15 bp, Homo sapiens
aatctttaaaaatat

SEQ ID NO: 6961 - DNA, 15 bp, Homo sapiens
taatctttaaaaata

SEQ ID NO: 6962 - DNA, 15 bp, Homo sapiens
ataatctttaaaaat

SEQ ID NO: 6963 - DNA, 15 bp, Homo sapiens
gataatctttaaaaa

SEQ ID NO: 6964 - DNA, 15 bp, Homo sapiens
tgataatctttaaaa

SEQ ID NO: 6965 - DNA, 15 bp, Homo sapiens
ttgataatctttaaa

SEQ ID NO: 6966 - DNA, 15 bp, Homo sapiens
tttgataatctttaa

SEQ ID NO: 6967 - DNA, 15 bp, Homo sapiens
atttgataatcttta

SEQ ID NO: 6968 - DNA, 15 bp, Homo sapiens
aatttgataatcttt

SEQ ID NO: 6969 - DNA, 15 bp, Homo sapiens
caatttgataatctt

SEQ ID NO: 6970 - DNA, 15 bp, Homo sapiens
gcaatttgataatct

SEQ ID NO: 6971 - DNA, 15 bp, Homo sapiens
agcaatttgataatc

SEQ ID NO: 6972 - DNA, 15 bp, Homo sapiens
aagcaatttgataat

SEQ ID NO: 6973 - DNA, 15 bp, Homo sapiens
taagcaatttgataa

SEQ ID NO: 6974 - DNA, 15 bp, Homo sapiens
ctaagcaatttgata

SEQ ID NO: 6975 - DNA, 15 bp, Homo sapiens
tctaagcaatttgat

SEQ ID NO: 6976 - DNA, 15 bp, Homo sapiens
ctctaagcaatttga

SEQ ID NO: 6977 - DNA, 15 bp, Homo sapiens
actctaagcaatttg

SEQ ID NO: 6978 - DNA, 15 bp, Homo sapiens
cactctaagcaattt

SEQ ID NO: 6979 - DNA, 15 bp, Homo sapiens
acactctaagcaatt

SEQ ID NO: 6980 - DNA, 15 bp, Homo sapiens
aacactctaagcaat

SEQ ID NO: 6981 - DNA, 15 bp, Homo sapiens
aaacactctaagcaa

SEQ ID NO: 6982 - DNA, 15 bp, Homo sapiens
taaacactctaagca

SEQ ID NO: 6983 - DNA, 15 bp, Homo sapiens
ctaaacactctaagc

SEQ ID NO: 6984 - DNA, 15 bp, Homo sapiens
tctaaacactctaag

SEQ ID NO: 6985 - DNA, 15 bp, Homo sapiens
atctaaacactctaa

SEQ ID NO: 6986 - DNA, 15 bp, Homo sapiens
catctaaacactcta

SEQ ID NO: 6987 - DNA, 15 bp, Homo sapiens
gcatctaaacactct

SEQ ID NO: 6988 - DNA, 15 bp, Homo sapiens
ggcatctaaacactc

SEQ ID NO: 6989 - DNA, 15 bp, Homo sapiens
tggcatctaaacact

SEQ ID NO: 6990 - DNA, 15 bp, Homo sapiens
ttggcatctaaacac

SEQ ID NO: 6991 - DNA, 15 bp, Homo sapiens
cttggcatctaaaca

SEQ ID NO: 6992 - DNA, 15 bp, Homo sapiens
ccttggcatctaaac

SEQ ID NO: 6993 - DNA, 15 bp, Homo sapiens
accttggcatctaaa

SEQ ID NO: 6994 - DNA, 15 bp, Homo sapiens
aaccttggcatctaa

SEQ ID NO: 6995 - DNA, 15 bp, Homo sapiens
taaccttggcatcta

SEQ ID NO: 6996 - DNA, 15 bp, Homo sapiens
ataaccttggcatct

SEQ ID NO: 6997 - DNA, 15 bp, Homo sapiens
cataaccttggcatc

SEQ ID NO: 6998 - DNA, 15 bp, Homo sapiens
tcataaccttggcat

SEQ ID NO: 6999 - DNA, 15 bp, Homo sapiens
gtcataaccttggca

SEQ ID NO: 7000 - DNA, 15 bp, Homo sapiens
agtcataaccttggc

SEQ ID NO: 7001 - DNA, 15 bp, Homo sapiens
tagtcataaccttgg

SEQ ID NO: 7002 - DNA, 15 bp, Homo sapiens
atagtcataaccttg

SEQ ID NO: 7003 - DNA, 15 bp, Homo sapiens
aatagtcataacctt

SEQ ID NO: 7004 - DNA, 15 bp, Homo sapiens
taatagtcataacct

SEQ ID NO: 7005 - DNA, 15 bp, Homo sapiens
gtaatagtcataacc

SEQ ID NO: 7006 - DNA, 15 bp, Homo sapiens
agtaatagtcataac

SEQ ID NO: 7007 - DNA, 15 bp, Homo sapiens
aagtaatagtcataa

SEQ ID NO: 7008 - DNA, 15 bp, Homo sapiens
aaagtaatagtcata

SEQ ID NO: 7009 - DNA, 15 bp, Homo sapiens
aaaagtaatagtcat

SEQ ID NO: 7010 - DNA, 15 bp, Homo sapiens
aaaaagtaatagtca

SEQ ID NO: 7011 - DNA, 15 bp, Homo sapiens
aaaaaagtaatagtc

SEQ ID NO: 7012 - DNA, 15 bp, Homo sapiens
aaaaaaagtaatagt

SEQ ID NO: 7013 - DNA, 15 bp, Homo sapiens
caaaaaaagtaatag

SEQ ID NO: 7014 - DNA, 15 bp, Homo sapiens
acaaaaaaagtaata

SEQ ID NO: 7015 - DNA, 15 bp, Homo sapiens
cacaaaaaaagtaat

SEQ ID NO: 7016 - DNA, 15 bp, Homo sapiens
ccacaaaaaaagtaa

SEQ ID NO: 7017 - DNA, 15 bp, Homo sapiens
accacaaaaaaagta

SEQ ID NO: 7018 - DNA, 15 bp, Homo sapiens
caccacaaaaaaagt

SEQ ID NO: 7019 - DNA, 15 bp, Homo sapiens
ccaccacaaaaaaag

SEQ ID NO: 7020 - DNA, 15 bp, Homo sapiens
gccaccacaaaaaaa

SEQ ID NO: 7021 - DNA, 15 bp, Homo sapiens
tgccaccacaaaaaa

SEQ ID NO: 7022 - DNA, 15 bp, Homo sapiens
atgccaccacaaaaa

SEQ ID NO: 7023 - DNA, 15 bp, Homo sapiens
gatgccaccacaaaa

SEQ ID NO: 7024 - DNA, 15 bp, Homo sapiens
agatgccaccacaaa

SEQ ID NO: 7025 - DNA, 15 bp, Homo sapiens
tagatgccaccacaa

SEQ ID NO: 7026 - DNA, 15 bp, Homo sapiens
gtagatgccaccaca

SEQ ID NO: 7027 - DNA, 15 bp, Homo sapiens
agtagatgccaccac

SEQ ID NO: 7028 - DNA, 15 bp, Homo sapiens
aagtagatgccacca

SEQ ID NO: 7029 - DNA, 15 bp, Homo sapiens
gaagtagatgccacc

SEQ ID NO: 7030 - DNA, 15 bp, Homo sapiens
tgaagtagatgccac

SEQ ID NO: 7031 - DNA, 15 bp, Homo sapiens
ttgaagtagatgcca

SEQ ID NO: 7032 - DNA, 15 bp, Homo sapiens
tttgaagtagatgcc

SEQ ID NO: 7033 - DNA, 15 bp, Homo sapiens
ttttgaagtagatgc

SEQ ID NO: 7034 - DNA, 15 bp, Homo sapiens
gttttgaagtagatg

SEQ ID NO: 7035 - DNA, 15 bp, Homo sapiens
tgttttgaagtagat

SEQ ID NO: 7036 - DNA, 15 bp, Homo sapiens
gtgttttgaagtaga

SEQ ID NO: 7037 - DNA, 15 bp, Homo sapiens
tgtgttttgaagtag

SEQ ID NO: 7038 - DNA, 15 bp, Homo sapiens
gtgtgttttgaagta

SEQ ID NO: 7039 - DNA, 15 bp, Homo sapiens
agtgtgttttgaagt

SEQ ID NO: 7040 - DNA, 15 bp, Homo sapiens
cagtgtgttttgaag

SEQ ID NO: 7041 - DNA, 15 bp, Homo sapiens
tcagtgtgttttgaa

SEQ ID NO: 7042 - DNA, 15 bp, Homo sapiens
ttcagtgtgttttga

SEQ ID NO: 7043 - DNA, 15 bp, Homo sapiens
tttcagtgtgttttg

SEQ ID NO: 7044 - DNA, 15 bp, Homo sapiens
ttttcagtgtgtttt

SEQ ID NO: 7045 - DNA, 15 bp, Homo sapiens
attttcagtgtgttt

SEQ ID NO: 7046 - DNA, 15 bp, Homo sapiens
aattttcagtgtgtt

SEQ ID NO: 7047 - DNA, 15 bp, Homo sapiens
aaattttcagtgtgt

SEQ ID NO: 7048 - DNA, 15 bp, Homo sapiens
taaattttcagtgtg

SEQ ID NO: 7049 - DNA, 15 bp, Homo sapiens
ctaaattttcagtgt

SEQ ID NO: 7050 - DNA, 15 bp, Homo sapiens
actaaattttcagtg

SEQ ID NO: 7051 - DNA, 15 bp, Homo sapiens
aactaaattttcagt

SEQ ID NO: 7052 - DNA, 15 bp, Homo sapiens
caactaaattttcag

SEQ ID NO: 7053 - DNA, 15 bp, Homo sapiens
acaactaaattttca

SEQ ID NO: 7054 - DNA, 15 bp, Homo sapiens
aacaactaaattttc

SEQ ID NO: 7055 - DNA, 15 bp, Homo sapiens
taacaactaaatttt

SEQ ID NO: 7056 - DNA, 15 bp, Homo sapiens
gtaacaactaaattt

SEQ ID NO: 7057 - DNA, 15 bp, Homo sapiens
tgtaacaactaaatt

SEQ ID NO: 7058 - DNA, 15 bp, Homo sapiens
atgtaacaactaaat

SEQ ID NO: 7059 - DNA, 15 bp, Homo sapiens
tatgtaacaactaaa

SEQ ID NO: 7060 - DNA, 15 bp, Homo sapiens
ctatgtaacaactaa

SEQ ID NO: 7061 - DNA, 15 bp, Homo sapiens
gctatgtaacaacta

SEQ ID NO: 7062 - DNA, 15 bp, Homo sapiens
agctatgtaacaact

SEQ ID NO: 7063 - DNA, 15 bp, Homo sapiens
gagctatgtaacaac

SEQ ID NO: 7064 - DNA, 15 bp, Homo sapiens
tgagctatgtaacaa

SEQ ID NO: 7065 - DNA, 15 bp, Homo sapiens
ctgagctatgtaaca

SEQ ID NO: 7066 - DNA, 15 bp, Homo sapiens
tctgagctatgtaac

SEQ ID NO: 7067 - DNA, 15 bp, Homo sapiens
atctgagctatgtaa

SEQ ID NO: 7068 - DNA, 15 bp, Homo sapiens
tatctgagctatgta

SEQ ID NO: 7069 - DNA, 15 bp, Homo sapiens
atatctgagctatgt

SEQ ID NO: 7070 - DNA, 15 bp, Homo sapiens
catatctgagctatg

SEQ ID NO: 7071 - DNA, 15 bp, Homo sapiens
tcatatctgagctat

SEQ ID NO: 7072 - DNA, 15 bp, Homo sapiens
ttcatatctgagcta

SEQ ID NO: 7073 - DNA, 15 bp, Homo sapiens
attcatatctgagct

SEQ ID NO: 7074 - DNA, 15 bp, Homo sapiens
gattcatatctgagc

SEQ ID NO: 7075 - DNA, 15 bp, Homo sapiens
tgattcatatctgag

SEQ ID NO: 7076 - DNA, 15 bp, Homo sapiens
gtgattcatatctga

SEQ ID NO: 7077 - DNA, 15 bp, Homo sapiens
tgtgattcatatctg

SEQ ID NO: 7078 - DNA, 15 bp, Homo sapiens
atgtgattcatatct

SEQ ID NO: 7079 - DNA, 15 bp, Homo sapiens
aatgtgattcatatc

SEQ ID NO: 7080 - DNA, 15 bp, Homo sapiens
gaatgtgattcatat

SEQ ID NO: 7081 - DNA, 15 bp, Homo sapiens
agaatgtgattcata

SEQ ID NO: 7082 - DNA, 15 bp, Homo sapiens
aagaatgtgattcat

SEQ ID NO: 7083 - DNA, 15 bp, Homo sapiens
aaagaatgtgattca

SEQ ID NO: 7084 - DNA, 15 bp, Homo sapiens
aaaagaatgtgattc

SEQ ID NO: 7085 - DNA, 15 bp, Homo sapiens
caaaagaatgtgatt

SEQ ID NO: 7086 - DNA, 15 bp, Homo sapiens
ccaaaagaatgtgat

SEQ ID NO: 7087 - DNA, 15 bp, Homo sapiens
gccaaaagaatgtga

SEQ ID NO: 7088 - DNA, 15 bp, Homo sapiens
agccaaaagaatgtg

SEQ ID NO: 7089 - DNA, 15 bp, Homo sapiens
cagccaaaagaatgt

SEQ ID NO: 7090 - DNA, 15 bp, Homo sapiens
tcagccaaaagaatg

SEQ ID NO: 7091 - DNA, 15 bp, Homo sapiens
ttcagccaaaagaat

SEQ ID NO: 7092 - DNA, 15 bp, Homo sapiens
attcagccaaaagaa

SEQ ID NO: 7093 - DNA, 15 bp, Homo sapiens
aattcagccaaaaga

SEQ ID NO: 7094 - DNA, 15 bp, Homo sapiens
taattcagccaaaag

SEQ ID NO: 7095 - DNA, 15 bp, Homo sapiens
ataattcagccaaaa

SEQ ID NO: 7096 - DNA, 15 bp, Homo sapiens
cataattcagccaaa

SEQ ID NO: 7097 - DNA, 15 bp, Homo sapiens
acataattcagccaa

SEQ ID NO: 7098 - DNA, 15 bp, Homo sapiens
aacataattcagcca

SEQ ID NO: 7099 - DNA, 15 bp, Homo sapiens
caacataattcagcc

SEQ ID NO: 7100 - DNA, 15 bp, Homo sapiens
gcaacataattcagc

SEQ ID NO: 7101 - DNA, 15 bp, Homo sapiens
tgcaacataattcag

SEQ ID NO: 7102 - DNA, 15 bp, Homo sapiens
ttgcaacataattca

SEQ ID NO: 7103 - DNA, 15 bp, Homo sapiens
tttgcaacataattc

SEQ ID NO: 7104 - DNA, 15 bp, Homo sapiens
ttttgcaacataatt

SEQ ID NO: 7105 - DNA, 15 bp, Homo sapiens
cttttgcaacataat

SEQ ID NO: 7106 - DNA, 15 bp, Homo sapiens
gcttttgcaacataa

SEQ ID NO: 7107 - DNA, 15 bp, Homo sapiens
ggcttttgcaacata

SEQ ID NO: 7108 - DNA, 15 bp, Homo sapiens
tggcttttgcaacat

SEQ ID NO: 7109 - DNA, 15 bp, Homo sapiens
ctggcttttgcaaca

SEQ ID NO: 7110 - DNA, 15 bp, Homo sapiens
actggcttttgcaac

SEQ ID NO: 7111 - DNA, 15 bp, Homo sapiens
tactggcttttgcaa

SEQ ID NO: 7112 - DNA, 15 bp, Homo sapiens
ctactggcttttgca

SEQ ID NO: 7113 - DNA, 15 bp, Homo sapiens
tctactggcttttgc

SEQ ID NO: 7114 - DNA, 15 bp, Homo sapiens
atctactggcttttg

SEQ ID NO: 7115 - DNA, 15 bp, Homo sapiens
ttatctactggcttt

SEQ ID NO: 7116 - DNA, 15 bp, Homo sapiens
tttatctactggctt

SEQ ID NO: 7117 - DNA, 15 bp, Homo sapiens
atttatctactggct

SEQ ID NO: 7118 - DNA, 15 bp, Homo sapiens
aatttatctactggc

SEQ ID NO: 7119 - DNA, 15 bp, Homo sapiens
aaatttatctactgg

SEQ ID NO: 7120 - DNA, 15 bp, Homo sapiens
caaatttatctactg

SEQ ID NO: 7121 - DNA, 15 bp, Homo sapiens
ccaaatttatctact

SEQ ID NO: 7122 - DNA, 15 bp, Homo sapiens
tccaaatttatctac

SEQ ID NO: 7123 - DNA, 15 bp, Homo sapiens
atccaaatttatcta

SEQ ID NO: 7124 - DNA, 15 bp, Homo sapiens
aatccaaatttatct

SEQ ID NO: 7125 - DNA, 15 bp, Homo sapiens
aaatccaaatttatc

SEQ ID NO: 7126 - DNA, 15 bp, Homo sapiens
caaatccaaatttat

SEQ ID NO: 7127 - DNA, 15 bp, Homo sapiens
tcaaatccaaattta

SEQ ID NO: 7128 - DNA, 15 bp, Homo sapiens
ttcaaatccaaattt

SEQ ID NO: 7129 - DNA, 15 bp, Homo sapiens
attcaaatccaaatt

SEQ ID NO: 7130 - DNA, 15 bp, Homo sapiens
cattcaaatccaaat

SEQ ID NO: 7131 - DNA, 15 bp, Homo sapiens
ccattcaaatccaaa

SEQ ID NO: 7132 - DNA, 15 bp, Homo sapiens
tccattcaaatccaa

SEQ ID NO: 7133 - DNA, 15 bp, Homo sapiens
gtccattcaaatcca

SEQ ID NO: 7134 - DNA, 15 bp, Homo sapiens
ggtccattcaaatcc

SEQ ID NO: 7135 - DNA, 15 bp, Homo sapiens
gggtccattcaaatc

SEQ ID NO: 7136 - DNA, 15 bp, Homo sapiens
tgggtccattcaaat

SEQ ID NO: 7137 - DNA, 15 bp, Homo sapiens
atgggtccattcaaa

SEQ ID NO: 7138 - DNA, 15 bp, Homo sapiens
aatgggtccattcaa

SEQ ID NO: 7139 - DNA, 15 bp, Homo sapiens
taatgggtccattca

SEQ ID NO: 7140 - DNA, 15 bp, Homo sapiens
ctaatgggtccattc

SEQ ID NO: 7141 - DNA, 15 bp, Homo sapiens
actaatgggtccatt

SEQ ID NO: 7142 - DNA, 15 bp, Homo sapiens
gactaatgggtccat

SEQ ID NO: 7143 - DNA, 15 bp, Homo sapiens
ggactaatgggtcca

SEQ ID NO: 7144 - DNA, 15 bp, Homo sapiens
gggactaatgggtcc

SEQ ID NO: 7145 - DNA, 15 bp, Homo sapiens
tgggactaatgggtc

SEQ ID NO: 7146 - DNA, 15 bp, Homo sapiens
ttgggactaatgggt

SEQ ID NO: 7147 - DNA, 15 bp, Homo sapiens
attgggactaatggg

SEQ ID NO: 7148 - DNA, 15 bp, Homo sapiens
gattgggactaatgg

SEQ ID NO: 7149 - DNA, 15 bp, Homo sapiens
agattgggactaatg

SEQ ID NO: 7150 - DNA, 15 bp, Homo sapiens
cagattgggactaat

SEQ ID NO: 7151 - DNA, 15 bp, Homo sapiens
ccagattgggactaa

SEQ ID NO: 7152 - DNA, 15 bp, Homo sapiens
gccagattgggacta

SEQ ID NO: 7153 - DNA, 15 bp, Homo sapiens
agccagattgggact

SEQ ID NO: 7154 - DNA, 15 bp, Homo sapiens
aagccagattgggac

SEQ ID NO: 7155 - DNA, 15 bp, Homo sapiens
gaagccagattggga

SEQ ID NO: 7156 - DNA, 15 bp, Homo sapiens
ggaagccagattggg

SEQ ID NO: 7157 - DNA, 15 bp, Homo sapiens
aggaagccagattgg

SEQ ID NO: 7158 - DNA, 15 bp, Homo sapiens
gaggaagccagattg

SEQ ID NO: 7159 - DNA, 15 bp, Homo sapiens
agaggaagccagatt

SEQ ID NO: 7160 - DNA, 15 bp, Homo sapiens
tagaggaagccagat

SEQ ID NO: 7161 - DNA, 15 bp, Homo sapiens
ttagaggaagccaga

SEQ ID NO: 7162 - DNA, 15 bp, Homo sapiens
cttagaggaagccag

SEQ ID NO: 7163 - DNA, 15 bp, Homo sapiens
ccttagaggaagcca

SEQ ID NO: 7164 - DNA, 15 bp, Homo sapiens
cccttagaggaagcc

SEQ ID NO: 7165 - DNA, 15 bp, Homo sapiens
tcccttagaggaagc

SEQ ID NO: 7166 - DNA, 15 bp, Homo sapiens
gtcccttagaggaag

SEQ ID NO: 7167 - DNA, 15 bp, Homo sapiens
agtcccttagaggaa

SEQ ID NO: 7168 - DNA, 15 bp, Homo sapiens
aagtcccttagagga

SEQ ID NO: 7169 - DNA, 15 bp, Homo sapiens
aaagtcccttagagg

SEQ ID NO: 7170 - DNA, 15 bp, Homo sapiens
aaaagtcccttagag

SEQ ID NO: 7171 - DNA, 15 bp, Homo sapiens
aaaaagtcccttaga

SEQ ID NO: 7172 - DNA, 15 bp, Homo sapiens
aaaaaagtcccttag

SEQ ID NO: 7173 - DNA, 15 bp, Homo sapiens
aaaaaaagtccctta

SEQ ID NO: 7174 - DNA, 15 bp, Homo sapiens
caaaaaaagtccctt

SEQ ID NO: 7175 - DNA, 15 bp, Homo sapiens
tcaaaaaaagtccct

SEQ ID NO: 7176 - DNA, 15 bp, Homo sapiens
atcaaaaaaagtccc

SEQ ID NO: 7177 - DNA, 15 bp, Homo sapiens
aatcaaaaaaagtcc

SEQ ID NO: 7178 - DNA, 15 bp, Homo sapiens
gaatcaaaaaaagtc

SEQ ID NO: 7179 - DNA, 15 bp, Homo sapiens
agaatcaaaaaaagt

SEQ ID NO: 7180 - DNA, 15 bp, Homo sapiens
aagaatcaaaaaaag

SEQ ID NO: 7181 - DNA, 15 bp, Homo sapiens
aaagaatcaaaaaaa

SEQ ID NO: 7182 - DNA, 15 bp, Homo sapiens
aaaagaatcaaaaaa

SEQ ID NO: 7183 - DNA, 15 bp, Homo sapiens
taaaagaatcaaaaa

SEQ ID NO: 7184 - DNA, 15 bp, Homo sapiens
ttaaaagaatcaaaa

SEQ ID NO: 7185 - DNA, 15 bp, Homo sapiens
cttaaaagaatcaaa

SEQ ID NO: 7186 - DNA, 15 bp, Homo sapiens
ccttaaaagaatcaa

SEQ ID NO: 7187 - DNA, 15 bp, Homo sapiens
gccttaaaagaatca

SEQ ID NO: 7188 - DNA, 15 bp, Homo sapiens
tgccttaaaagaatc

SEQ ID NO: 7189 - DNA, 15 bp, Homo sapiens
ttgccttaaaagaat

SEQ ID NO: 7190 - DNA, 15 bp, Homo sapiens
tttgccttaaaagaa

SEQ ID NO: 7191 - DNA, 15 bp, Homo sapiens
atttgccttaaaaga

SEQ ID NO: 7192 - DNA, 15 bp, Homo sapiens
catttgccttaaaag

SEQ ID NO: 7193 - DNA, 15 bp, Homo sapiens
gcatttgccttaaaa

SEQ ID NO: 7194 - DNA, 15 bp, Homo sapiens
agcatttgccttaaa

SEQ ID NO: 7195 - DNA, 15 bp, Homo sapiens
aagcatttgccttaa

SEQ ID NO: 7196 - DNA, 15 bp, Homo sapiens
taagcatttgcctta

SEQ ID NO: 7197 - DNA, 15 bp, Homo sapiens
gtaagcatttgcctt

SEQ ID NO: 7198 - DNA, 15 bp, Homo sapiens
agtaagcatttgcct

SEQ ID NO: 7199 - DNA, 15 bp, Homo sapiens
tagtaagcatttgcc

SEQ ID NO: 7200 - DNA, 15 bp, Homo sapiens
atagtaagcatttgc

SEQ ID NO: 7201 - DNA, 15 bp, Homo sapiens
tatagtaagcatttg

SEQ ID NO: 7202 - DNA, 15 bp, Homo sapiens
gtatagtaagcattt

SEQ ID NO: 7203 - DNA, 15 bp, Homo sapiens
tgtatagtaagcatt

SEQ ID NO: 7204 - DNA, 15 bp, Homo sapiens
ctgtatagtaagcat

SEQ ID NO: 7205 - DNA, 15 bp, Homo sapiens
tctgtatagtaagca

SEQ ID NO: 7206 - DNA, 15 bp, Homo sapiens
ctctgtatagtaagc

SEQ ID NO: 7207 - DNA, 15 bp, Homo sapiens
cctctgtatagtaag

SEQ ID NO: 7208 - DNA, 15 bp, Homo sapiens
acctctgtatagtaa

SEQ ID NO: 7209 - DNA, 15 bp, Homo sapiens
tacctctgtatagta

SEQ ID NO: 7210 - DNA, 15 bp, Homo sapiens
ttacctctgtatagt

SEQ ID NO: 7211 - DNA, 15 bp, Homo sapiens
attacctctgtatag

SEQ ID NO: 7212 - DNA, 15 bp, Homo sapiens
tattacctctgtata

SEQ ID NO: 7213 - DNA, 15 bp, Homo sapiens
atattacctctgtat

SEQ ID NO: 7214 - DNA, 15 bp, Homo sapiens
aatattacctctgta

SEQ ID NO: 7215 - DNA, 15 bp, Homo sapiens
aaatattacctctgt

SEQ ID NO: 7216 - DNA, 15 bp, Homo sapiens
gaaatattacctctg

SEQ ID NO: 7217 - DNA, 15 bp, Homo sapiens
tgaaatattacctct

SEQ ID NO: 7218 - DNA, 15 bp, Homo sapiens
atgaaatattacctc

SEQ ID NO: 7219 - DNA, 15 bp, Homo sapiens
catgaaatattacct

SEQ ID NO: 7220 - DNA, 15 bp, Homo sapiens
ccatgaaatattacc

SEQ ID NO: 7221 - DNA, 15 bp, Homo sapiens
accatgaaatattac

SEQ ID NO: 7222 - DNA, 15 bp, Homo sapiens
taccatgaaatatta

SEQ ID NO: 7223 - DNA, 15 bp, Homo sapiens
gtaccatgaaatatt

SEQ ID NO: 7224 - DNA, 15 bp, Homo sapiens
agtaccatgaaatat

SEQ ID NO: 7225 - DNA, 15 bp, Homo sapiens
gagtaccatgaaata

SEQ ID NO: 7226 - DNA, 15 bp, Homo sapiens
agagtaccatgaaat

SEQ ID NO: 7227 - DNA, 15 bp, Homo sapiens
tagagtaccatgaaa

SEQ ID NO: 7228 - DNA, 15 bp, Homo sapiens
ttagagtaccatgaa

SEQ ID NO: 7229 - DNA, 15 bp, Homo sapiens
tttagagtaccatga

SEQ ID NO: 7230 - DNA, 15 bp, Homo sapiens
ttttagagtaccatg

SEQ ID NO: 7231 - DNA, 15 bp, Homo sapiens
gttttagagtaccat

SEQ ID NO: 7232 - DNA, 15 bp, Homo sapiens
agttttagagtacca

SEQ ID NO: 7233 - DNA, 15 bp, Homo sapiens
aagttttagagtacc

SEQ ID NO: 7234 - DNA, 15 bp, Homo sapiens
taagttttagagtac

SEQ ID NO: 7235 - DNA, 15 bp, Homo sapiens
gtaagttttagagta

SEQ ID NO: 7236 - DNA, 15 bp, Homo sapiens
tgtaagttttagagt

SEQ ID NO: 7237 - DNA, 15 bp, Homo sapiens
atgtaagttttagag

SEQ ID NO: 7238 - DNA, 15 bp, Homo sapiens
tatgtaagttttaga

SEQ ID NO: 7239 - DNA, 15 bp, Homo sapiens
atatgtaagttttag

SEQ ID NO: 7240 - DNA, 15 bp, Homo sapiens
aatatgtaagtttta

SEQ ID NO: 7241 - DNA, 15 bp, Homo sapiens
aaatatgtaagtttt

SEQ ID NO: 7242 - DNA, 15 bp, Homo sapiens
aaaatatgtaagttt

SEQ ID NO: 7243 - DNA, 15 bp, Homo sapiens
taaaatatgtaagtt

SEQ ID NO: 7244 - DNA, 15 bp, Homo sapiens
ttaaaatatgtaagt

SEQ ID NO: 7245 - DNA, 15 bp, Homo sapiens
cttaaaatatgtaag

SEQ ID NO: 7246 - DNA, 15 bp, Homo sapiens
tcttaaaatatgtaa

SEQ ID NO: 7247 - DNA, 15 bp, Homo sapiens
ctcttaaaatatgta

SEQ ID NO: 7248 - DNA, 15 bp, Homo sapiens
tctcttaaaatatgt

SEQ ID NO: 7249 - DNA, 15 bp, Homo sapiens
atctcttaaaatatg

SEQ ID NO: 7250 - DNA, 15 bp, Homo sapiens
aatctcttaaaatat

SEQ ID NO: 7251 - DNA, 15 bp, Homo sapiens
aaatctcttaaaata

SEQ ID NO: 7252 - DNA, 15 bp, Homo sapiens
aaaatctcttaaaat

SEQ ID NO: 7253 - DNA, 15 bp, Homo sapiens
aaaaatctcttaaaa

SEQ ID NO: 7254 - DNA, 15 bp, Homo sapiens
taaaaatctcttaaa

SEQ ID NO: 7255 - DNA, 15 bp, Homo sapiens
ctaaaaatctcttaa

SEQ ID NO: 7256 - DNA, 15 bp, Homo sapiens
actaaaaatctctta

SEQ ID NO: 7257 - DNA, 15 bp, Homo sapiens
aactaaaaatctctt

SEQ ID NO: 7258 - DNA, 15 bp, Homo sapiens
aaactaaaaatctct

SEQ ID NO: 7259 - DNA, 15 bp, Homo sapiens
taaactaaaaatctc

SEQ ID NO: 7260 - DNA, 15 bp, Homo sapiens
ctaaactaaaaatct

SEQ ID NO: 7261 - DNA, 15 bp, Homo sapiens
tctaaactaaaaatc

SEQ ID NO: 7262 - DNA, 15 bp, Homo sapiens
atctaaactaaaaat

SEQ ID NO: 7263 - DNA, 15 bp, Homo sapiens
aatctaaactaaaaa

SEQ ID NO: 7264 - DNA, 15 bp, Homo sapiens
taatctaaactaaaa

SEQ ID NO: 7265 - DNA, 15 bp, Homo sapiens
ttaatctaaactaaa

SEQ ID NO: 7266 - DNA, 15 bp, Homo sapiens
cttaatctaaactaa

SEQ ID NO: 7267 - DNA, 15 bp, Homo sapiens
acttaatctaaacta

SEQ ID NO: 7268 - DNA, 15 bp, Homo sapiens
gacttaatctaaact

SEQ ID NO: 7269 - DNA, 15 bp, Homo sapiens
tgacttaatctaaac

SEQ ID NO: 7270 - DNA, 15 bp, Homo sapiens
atgacttaatctaaa

SEQ ID NO: 7271 - DNA, 15 bp, Homo sapiens
tatgacttaatctaa

SEQ ID NO: 7272 - DNA, 15 bp, Homo sapiens
ctatgacttaatcta

SEQ ID NO: 7273 - DNA, 15 bp, Homo sapiens
cctatgacttaatct

SEQ ID NO: 7274 - DNA, 15 bp, Homo sapiens
tcctatgacttaatc

SEQ ID NO: 7275 - DNA, 15 bp, Homo sapiens
ttcctatgacttaat

SEQ ID NO: 7276 - DNA, 15 bp, Homo sapiens
attcctatgacttaa

SEQ ID NO: 7277 - DNA, 15 bp, Homo sapiens
aattcctatgactta

SEQ ID NO: 7278 - DNA, 15 bp, Homo sapiens
caattcctatgactt

SEQ ID NO: 7279 - DNA, 15 bp, Homo sapiens
acaattcctatgact

SEQ ID NO: 7280 - DNA, 15 bp, Homo sapiens
gacaattcctatgac

SEQ ID NO: 7281 - DNA, 15 bp, Homo sapiens
agacaattcctatga

SEQ ID NO: 7282 - DNA, 15 bp, Homo sapiens
tagacaattcctatg

SEQ ID NO: 7283 - DNA, 15 bp, Homo sapiens
gtagacaattcctat

SEQ ID NO: 7284 - DNA, 15 bp, Homo sapiens
tgtagacaattccta

SEQ ID NO: 7285 - DNA, 15 bp, Homo sapiens
atgtagacaattcct

SEQ ID NO: 7286 - DNA, 15 bp, Homo sapiens
tatgtagacaattcc

SEQ ID NO: 7287 - DNA, 15 bp, Homo sapiens
atatgtagacaattc

SEQ ID NO: 7288 - DNA, 15 bp, Homo sapiens
gatatgtagacaatt

SEQ ID NO: 7289 - DNA, 15 bp, Homo sapiens
tgatatgtagacaat

SEQ ID NO: 7290 - DNA, 15 bp, Homo sapiens
atgatatgtagacaa

SEQ ID NO: 7291 - DNA, 15 bp, Homo sapiens
tatgatatgtagaca

SEQ ID NO: 7292 - DNA, 15 bp, Homo sapiens
atatgatatgtagac

SEQ ID NO: 7293 - DNA, 15 bp, Homo sapiens
tatatgatatgtaga

SEQ ID NO: 7294 - DNA, 15 bp, Homo sapiens
atatatgatatgtag

SEQ ID NO: 7295 - DNA, 15 bp, Homo sapiens
catatatgatatgta

SEQ ID NO: 7296 - DNA, 15 bp, Homo sapiens
acatatatgatatgt

SEQ ID NO: 7297 - DNA, 15 bp, Homo sapiens
tacatatatgatatg

SEQ ID NO: 7298 - DNA, 15 bp, Homo sapiens
atacatatatgatat

SEQ ID NO: 7299 - DNA, 15 bp, Homo sapiens
aatacatatatgata

SEQ ID NO: 7300 - DNA, 15 bp, Homo sapiens
aaatacatatatgat

SEQ ID NO: 7301 - DNA, 15 bp, Homo sapiens
aaaatacatatatga

SEQ ID NO: 7302 - DNA, 15 bp, Homo sapiens
taaaatacatatatg

SEQ ID NO: 7303 - DNA, 15 bp, Homo sapiens
ttaaaatacatatat

SEQ ID NO: 7304 - DNA, 15 bp, Homo sapiens
tttaaaatacatata

SEQ ID NO: 7305 - DNA, 15 bp, Homo sapiens
ctttaaaatacatat

SEQ ID NO: 7306 - DNA, 15 bp, Homo sapiens
tctttaaaatacata

SEQ ID NO: 7307 - DNA, 15 bp, Homo sapiens
atctttaaaatacat

SEQ ID NO: 7308 - DNA, 15 bp, Homo sapiens
gatctttaaaataca

SEQ ID NO: 7309 - DNA, 15 bp, Homo sapiens
ggatctttaaaatac

SEQ ID NO: 7310 - DNA, 15 bp, Homo sapiens
aggatctttaaaata

SEQ ID NO: 7311 - DNA, 15 bp, Homo sapiens
gaggatctttaaaat

SEQ ID NO: 7312 - DNA, 15 bp, Homo sapiens
agaggatctttaaaa

SEQ ID NO: 7313 - DNA, 15 bp, Homo sapiens
cagaggatctttaaa

SEQ ID NO: 7314 - DNA, 15 bp, Homo sapiens
acagaggatctttaa

SEQ ID NO: 7315 - DNA, 15 bp, Homo sapiens
gacagaggatcttta

SEQ ID NO: 7316 - DNA, 15 bp, Homo sapiens
agacagaggatcttt

SEQ ID NO: 7317 - DNA, 15 bp, Homo sapiens
tagacagaggatctt

SEQ ID NO: 7318 - DNA, 15 bp, Homo sapiens
gtagacagaggatct

SEQ ID NO: 7319 - DNA, 15 bp, Homo sapiens
tgtagacagaggatc

SEQ ID NO: 7320 - DNA, 15 bp, Homo sapiens
atgtagacagaggat

SEQ ID NO: 7321 - DNA, 15 bp, Homo sapiens
catgtagacagagga

SEQ ID NO: 7322 - DNA, 15 bp, Homo sapiens
gcatgtagacagagg

SEQ ID NO: 7323 - DNA, 15 bp, Homo sapiens
agcatgtagacagag

SEQ ID NO: 7324 - DNA, 15 bp, Homo sapiens
cagcatgtagacaga

SEQ ID NO: 7325 - DNA, 15 bp, Homo sapiens
acagcatgtagacag

SEQ ID NO: 7326 - DNA, 15 bp, Homo sapiens
tacagcatgtagaca

SEQ ID NO: 7327 - DNA, 15 bp, Homo sapiens
atacagcatgtagac

SEQ ID NO: 7328 - DNA, 15 bp, Homo sapiens
catacagcatgtaga

SEQ ID NO: 7329 - DNA, 15 bp, Homo sapiens
gcatacagcatgtag

SEQ ID NO: 7330 - DNA, 15 bp, Homo sapiens
ggcatacagcatgta

SEQ ID NO: 7331 - DNA, 15 bp, Homo sapiens
tggcatacagcatgt

SEQ ID NO: 7332 - DNA, 15 bp, Homo sapiens
ttggcatacagcatg

SEQ ID NO: 7333 - DNA, 15 bp, Homo sapiens
tttggcatacagcat

SEQ ID NO: 7334 - DNA, 15 bp, Homo sapiens
atttggcatacagca

SEQ ID NO: 7335 - DNA, 15 bp, Homo sapiens
aatttggcatacagc

SEQ ID NO: 7336 - DNA, 15 bp, Homo sapiens
caatttggcatacag

SEQ ID NO: 7337 - DNA, 15 bp, Homo sapiens
ccaatttggcataca

SEQ ID NO: 7338 - DNA, 15 bp, Homo sapiens
accaatttggcatac

SEQ ID NO: 7339 - DNA, 15 bp, Homo sapiens
aaccaatttggcata

SEQ ID NO: 7340 - DNA, 15 bp, Homo sapiens
caaccaatttggcat

SEQ ID NO: 7341 - DNA, 15 bp, Homo sapiens
gcaaccaatttggca

SEQ ID NO: 7342 - DNA, 15 bp, Homo sapiens
agcaaccaatttggc

SEQ ID NO: 7343 - DNA, 15 bp, Homo sapiens
aagcaaccaatttgg

SEQ ID NO: 7344 - DNA, 15 bp, Homo sapiens
aaagcaaccaatttg

SEQ ID NO: 7345 - DNA, 15 bp, Homo sapiens
aaaagcaaccaattt

SEQ ID NO: 7346 - DNA, 15 bp, Homo sapiens
gaaaagcaaccaatt

SEQ ID NO: 7347 - DNA, 15 bp, Homo sapiens
ggaaaagcaaccaat

SEQ ID NO: 7348 - DNA, 15 bp, Homo sapiens
tggaaaagcaaccaa

SEQ ID NO: 7349 - DNA, 15 bp, Homo sapiens
atggaaaagcaacca

SEQ ID NO: 7350 - DNA, 15 bp, Homo sapiens
aatggaaaagcaacc

SEQ ID NO: 7351 - DNA, 15 bp, Homo sapiens
aaatggaaaagcaac

SEQ ID NO: 7352 - DNA, 15 bp, Homo sapiens
aaaatggaaaagcaa

SEQ ID NO: 7353 - DNA, 15 bp, Homo sapiens
aaaaatggaaaagca

SEQ ID NO: 7354 - DNA, 15 bp, Homo sapiens
aaaaaatggaaaagc

SEQ ID NO: 7355 - DNA, 15 bp, Homo sapiens
taaaaaatggaaaag

SEQ ID NO: 7356 - DNA, 15 bp, Homo sapiens
ttaaaaaatggaaaa

SEQ ID NO: 7357 - DNA, 15 bp, Homo sapiens
tttaaaaaatggaaa

SEQ ID NO: 7358 - DNA, 15 bp, Homo sapiens
ttttaaaaaatggaa

SEQ ID NO: 7359 - DNA, 15 bp, Homo sapiens
cttttaaaaaatgga

SEQ ID NO: 7360 - DNA, 15 bp, Homo sapiens
ccttttaaaaaatgg

SEQ ID NO: 7361 - DNA, 15 bp, Homo sapiens
cccttttaaaaaatg

SEQ ID NO: 7362 - DNA, 15 bp, Homo sapiens
tcccttttaaaaaat

SEQ ID NO: 7363 - DNA, 15 bp, Homo sapiens
ttcccttttaaaaaa

SEQ ID NO: 7364 - DNA, 15 bp, Homo sapiens
attcccttttaaaaa

SEQ ID NO: 7365 - DNA, 15 bp, Homo sapiens
tattcccttttaaaa

SEQ ID NO: 7366 - DNA, 15 bp, Homo sapiens
gtattcccttttaaa

SEQ ID NO: 7367 - DNA, 15 bp, Homo sapiens
agtattcccttttaa

SEQ ID NO: 7368 - DNA, 15 bp, Homo sapiens
aagtattccctttta

SEQ ID NO: 7369 - DNA, 15 bp, Homo sapiens
aaagtattccctttt

SEQ ID NO: 7370 - DNA, 15 bp, Homo sapiens
gaaagtattcccttt

SEQ ID NO: 7371 - DNA, 15 bp, Homo sapiens
ggaaagtattccctt

SEQ ID NO: 7372 - DNA, 15 bp, Homo sapiens
aggaaagtattccct

SEQ ID NO: 7373 - DNA, 15 bp, Homo sapiens
aaggaaagtattccc

SEQ ID NO: 7374 - DNA, 15 bp, Homo sapiens
aaaggaaagtattcc

SEQ ID NO: 7375 - DNA, 15 bp, Homo sapiens
taaaggaaagtattc

SEQ ID NO: 7376 - DNA, 15 bp, Homo sapiens
ctaaaggaaagtatt

SEQ ID NO: 7377 - DNA, 15 bp, Homo sapiens
cctaaaggaaagtat

SEQ ID NO: 7378 - DNA, 15 bp, Homo sapiens
tcctaaaggaaagta

SEQ ID NO: 7379 - DNA, 15 bp, Homo sapiens
ttcctaaaggaaagt

SEQ ID NO: 7380 - DNA, 15 bp, Homo sapiens
tttcctaaaggaaag

SEQ ID NO: 7381 - DNA, 15 bp, Homo sapiens
ttttcctaaaggaaa

SEQ ID NO: 7382 - DNA, 15 bp, Homo sapiens
attttcctaaaggaa

SEQ ID NO: 7383 - DNA, 15 bp, Homo sapiens
aattttcctaaagga

SEQ ID NO: 7384 - DNA, 15 bp, Homo sapiens
aaattttcctaaagg

SEQ ID NO: 7385 - DNA, 15 bp, Homo sapiens
aaaattttcctaaag

SEQ ID NO: 7386 - DNA, 15 bp, Homo sapiens
caaaattttcctaaa

SEQ ID NO: 7387 - DNA, 15 bp, Homo sapiens
tcaaaattttcctaa

SEQ ID NO: 7388 - DNA, 15 bp, Homo sapiens
atcaaaattttccta

SEQ ID NO: 7389 - DNA, 15 bp, Homo sapiens
gatcaaaattttcct

SEQ ID NO: 7390 - DNA, 15 bp, Homo sapiens
ggatcaaaattttcc

SEQ ID NO: 7391 - DNA, 15 bp, Homo sapiens
aggatcaaaattttc

SEQ ID NO: 7392 - DNA, 15 bp, Homo sapiens
gaggatcaaaatttt

SEQ ID NO: 7393 - DNA, 15 bp, Homo sapiens
tgaggatcaaaattt

SEQ ID NO: 7394 - DNA, 15 bp, Homo sapiens
atgaggatcaaaatt

SEQ ID NO: 7395 - DNA, 15 bp, Homo sapiens
gatgaggatcaaaat

SEQ ID NO: 7396 - DNA, 15 bp, Homo sapiens
agatgaggatcaaaa

SEQ ID NO: 7397 - DNA, 15 bp, Homo sapiens
cagatgaggatcaaa

SEQ ID NO: 7398 - DNA, 15 bp, Homo sapiens
gcagatgaggatcaa

SEQ ID NO: 7399 - DNA, 15 bp, Homo sapiens
agcagatgaggatca

SEQ ID NO: 7400 - DNA, 15 bp, Homo sapiens
gagcagatgaggatc

SEQ ID NO: 7401 - DNA, 15 bp, Homo sapiens
agagcagatgaggat

SEQ ID NO: 7402 - DNA, 15 bp, Homo sapiens
aagagcagatgagga

SEQ ID NO: 7403 - DNA, 15 bp, Homo sapiens
gaagagcagatgagg

SEQ ID NO: 7404 - DNA, 15 bp, Homo sapiens
ggaagagcagatgag

SEQ ID NO: 7405 - DNA, 15 bp, Homo sapiens
tggaagagcagatga

SEQ ID NO: 7406 - DNA, 15 bp, Homo sapiens
ctggaagagcagatg

SEQ ID NO: 7407 - DNA, 15 bp, Homo sapiens
cctggaagagcagat

SEQ ID NO: 7408 - DNA, 15 bp, Homo sapiens
acctggaagagcaga

SEQ ID NO: 7409 - DNA, 15 bp, Homo sapiens
aacctggaagagcag

SEQ ID NO: 7410 - DNA, 15 bp, Homo sapiens
aaacctggaagagca

SEQ ID NO: 7411 - DNA, 15 bp, Homo sapiens
gaaacctggaagagc

SEQ ID NO: 7412 - DNA, 15 bp, Homo sapiens
agaaacctggaagag

SEQ ID NO: 7413 - DNA, 15 bp, Homo sapiens
aagaaacctggaaga

SEQ ID NO: 7414 - DNA, 15 bp, Homo sapiens
aaagaaacctggaag

SEQ ID NO: 7415 - DNA, 15 bp, Homo sapiens
aaaagaaacctggaa

SEQ ID NO: 7416 - DNA, 15 bp, Homo sapiens
aaaaagaaacctgga

SEQ ID NO: 7417 - DNA, 15 bp, Homo sapiens
aaaaaagaaacctgg

SEQ ID NO: 7418 - DNA, 15 bp, Homo sapiens
caaaaaagaaacctg

SEQ ID NO: 7419 - DNA, 15 bp, Homo sapiens
ccaaaaaagaaacct

SEQ ID NO: 7420 - DNA, 15 bp, Homo sapiens
cccaaaaaagaaacc

SEQ ID NO: 7421 - DNA, 15 bp, Homo sapiens
ccccaaaaaagaaac

SEQ ID NO: 7422 - DNA, 15 bp, Homo sapiens
cccccaaaaaagaaa

SEQ ID NO: 7423 - DNA, 15 bp, Homo sapiens
ccccccaaaaaagaa

SEQ ID NO: 7424 - DNA, 15 bp, Homo sapiens
tccccccaaaaaaga

SEQ ID NO: 7425 - DNA, 15 bp, Homo sapiens
ttccccccaaaaaag

SEQ ID NO: 7426 - DNA, 15 bp, Homo sapiens
tttccccccaaaaaa

SEQ ID NO: 7427 - DNA, 15 bp, Homo sapiens
atttccccccaaaaa

SEQ ID NO: 7428 - DNA, 15 bp, Homo sapiens
aatttccccccaaaa

SEQ ID NO: 7429 - DNA, 15 bp, Homo sapiens
caatttccccccaaa

SEQ ID NO: 7430 - DNA, 15 bp, Homo sapiens
ccaatttccccccaa

SEQ ID NO: 7431 - DNA, 15 bp, Homo sapiens
tccaatttcccccca

SEQ ID NO: 7432 - DNA, 15 bp, Homo sapiens
atccaatttcccccc

SEQ ID NO: 7433 - DNA, 15 bp, Homo sapiens
catccaatttccccc

SEQ ID NO: 7434 - DNA, 15 bp, Homo sapiens
tcatccaatttcccc

SEQ ID NO: 7435 - DNA, 15 bp, Homo sapiens
ttcatccaatttccc

SEQ ID NO: 7436 - DNA, 15 bp, Homo sapiens
tttcatccaatttcc

SEQ ID NO: 7437 - DNA, 15 bp, Homo sapiens
ctttcatccaatttc

SEQ ID NO: 7438 - DNA, 15 bp, Homo sapiens
actttcatccaattt

SEQ ID NO: 7439 - DNA, 15 bp, Homo sapiens
cactttcatccaatt

SEQ ID NO: 7440 - DNA, 15 bp, Homo sapiens
ccactttcatccaat

SEQ ID NO: 7441 - DNA, 15 bp, Homo sapiens
cccactttcatccaa

SEQ ID NO: 7442 - DNA, 15 bp, Homo sapiens
ccccactttcatcca

SEQ ID NO: 7443 - DNA, 15 bp, Homo sapiens
cccccactttcatcc

SEQ ID NO: 7444 - DNA, 15 bp, Homo sapiens
ccccccactttcatc

SEQ ID NO: 7445 - DNA, 15 bp, Homo sapiens
tccccccactttcat

SEQ ID NO: 7446 - DNA, 15 bp, Homo sapiens
gtccccccactttca

SEQ ID NO: 7447 - DNA, 15 bp, Homo sapiens
cgtccccccactttc

SEQ ID NO: 7448 - DNA, 15 bp, Homo sapiens
ccgtccccccacttt

SEQ ID NO: 7449 - DNA, 15 bp, Homo sapiens
tccgtccccccactt

SEQ ID NO: 7450 - DNA, 15 bp, Homo sapiens
ctccgtccccccact

SEQ ID NO: 7451 - DNA, 15 bp, Homo sapiens
tctccgtccccccac

SEQ ID NO: 7452 - DNA, 15 bp, Homo sapiens
ctctccgtcccccca

SEQ ID NO: 7453 - DNA, 15 bp, Homo sapiens
actctccgtcccccc

SEQ ID NO: 7454 - DNA, 15 bp, Homo sapiens
cactctccgtccccc

SEQ ID NO: 7455 - DNA, 15 bp, Homo sapiens
acactctccgtcccc

SEQ ID NO: 7456 - DNA, 15 bp, Homo sapiens
cacactctccgtccc

SEQ ID NO: 7457 - DNA, 15 bp, Homo sapiens
ccacactctccgtcc

SEQ ID NO: 7458 - DNA, 15 bp, Homo sapiens
accacactctccgtc

SEQ ID NO: 7459 - DNA, 15 bp, Homo sapiens
aaccacactctccgt

SEQ ID NO: 7460 - DNA, 15 bp, Homo sapiens
aaaccacactctccg

SEQ ID NO: 7461 - DNA, 15 bp, Homo sapiens
gaaaccacactctcc

SEQ ID NO: 7462 - DNA, 15 bp, Homo sapiens
agaaaccacactctc

SEQ ID NO: 7463 - DNA, 15 bp, Homo sapiens
cagaaaccacactct

SEQ ID NO: 7464 - DNA, 15 bp, Homo sapiens
gcagaaaccacactc

SEQ ID NO: 7465 - DNA, 15 bp, Homo sapiens
agcagaaaccacact

SEQ ID NO: 7466 - DNA, 15 bp, Homo sapiens
gagcagaaaccacac

SEQ ID NO: 7467 - DNA, 15 bp, Homo sapiens
agagcagaaaccaca

SEQ ID NO: 7468 - DNA, 15 bp, Homo sapiens
gagagcagaaaccac

SEQ ID NO: 7469 - DNA, 15 bp, Homo sapiens
ggagagcagaaacca

SEQ ID NO: 7470 - DNA, 15 bp, Homo sapiens
tggagagcagaaacc

SEQ ID NO: 7471 - DNA, 15 bp, Homo sapiens
ttggagagcagaaac

SEQ ID NO: 7472 - DNA, 15 bp, Homo sapiens
tttggagagcagaaa

SEQ ID NO: 7473 - DNA, 15 bp, Homo sapiens
atttggagagcagaa

SEQ ID NO: 7474 - DNA, 15 bp, Homo sapiens
gatttggagagcaga

SEQ ID NO: 7475 - DNA, 15 bp, Homo sapiens
ggatttggagagcag

SEQ ID NO: 7476 - DNA, 15 bp, Homo sapiens
aggatttggagagca

SEQ ID NO: 7477 - DNA, 15 bp, Homo sapiens
gaggatttggagagc

SEQ ID NO: 7478 - DNA, 15 bp, Homo sapiens
cgaggatttggagag

SEQ ID NO: 7479 - DNA, 15 bp, Homo sapiens
tcgaggatttggaga

SEQ ID NO: 7480 - DNA, 15 bp, Homo sapiens
ctcgaggatttggag

SEQ ID NO: 7481 - DNA, 15 bp, Homo sapiens
actcgaggatttgga

SEQ ID NO: 7482 - DNA, 15 bp, Homo sapiens
aactcgaggatttgg

SEQ ID NO: 7483 - DNA, 15 bp, Homo sapiens
aaactcgaggatttg

SEQ ID NO: 7484 - DNA, 15 bp, Homo sapiens
caaactcgaggattt

SEQ ID NO: 7485 - DNA, 15 bp, Homo sapiens
ccaaactcgaggatt

SEQ ID NO: 7486 - DNA, 15 bp, Homo sapiens
tccaaactcgaggat

SEQ ID NO: 7487 - DNA, 15 bp, Homo sapiens
gtccaaactcgagga

SEQ ID NO: 7488 - DNA, 15 bp, Homo sapiens
tgtccaaactcgagg

SEQ ID NO: 7489 - DNA, 15 bp, Homo sapiens
ttgtccaaactcgag

SEQ ID NO: 7490 - DNA, 15 bp, Homo sapiens
attgtccaaactcga

SEQ ID NO: 7491 - DNA, 15 bp, Homo sapiens
gattgtccaaactcg

SEQ ID NO: 7492 - DNA, 15 bp, Homo sapiens
ggattgtccaaactc

SEQ ID NO: 7493 - DNA, 15 bp, Homo sapiens
tggattgtccaaact

SEQ ID NO: 7494 - DNA, 15 bp, Homo sapiens
ttggattgtccaaac

SEQ ID NO: 7495 - DNA, 15 bp, Homo sapiens
tttggattgtccaaa

SEQ ID NO: 7496 - DNA, 15 bp, Homo sapiens
ttttggattgtccaa

SEQ ID NO: 7497 - DNA, 15 bp, Homo sapiens
cttttggattgtcca

SEQ ID NO: 7498 - DNA, 15 bp, Homo sapiens
ccttttggattgtcc

SEQ ID NO: 7499 - DNA, 15 bp, Homo sapiens
gccttttggattgtc

SEQ ID NO: 7500 - DNA, 15 bp, Homo sapiens
agccttttggattgt

SEQ ID NO: 7501 - DNA, 15 bp, Homo sapiens
cagccttttggattg

SEQ ID NO: 7502 - DNA, 15 bp, Homo sapiens
ccagccttttggatt

SEQ ID NO: 7503 - DNA, 15 bp, Homo sapiens
gccagccttttggat

SEQ ID NO: 7504 - DNA, 15 bp, Homo sapiens
tgccagccttttgga

SEQ ID NO: 7505 - DNA, 15 bp, Homo sapiens
atgccagccttttgg

SEQ ID NO: 7506 - DNA, 15 bp, Homo sapiens
tatgccagccttttg

SEQ ID NO: 7507 - DNA, 15 bp, Homo sapiens
ttatgccagcctttt

SEQ ID NO: 7508 - DNA, 15 bp, Homo sapiens
attatgccagccttt

SEQ ID NO: 7509 - DNA, 15 bp, Homo sapiens
aattatgccagcctt

SEQ ID NO: 7510 - DNA, 15 bp, Homo sapiens
taattatgccagcct

SEQ ID NO: 7511 - DNA, 15 bp, Homo sapiens
ttaattatgccagcc

SEQ ID NO: 7512 - DNA, 15 bp, Homo sapiens
tttaattatgccagc

SEQ ID NO: 7513 - DNA, 15 bp, Homo sapiens
atttaattatgccag

SEQ ID NO: 7514 - DNA, 15 bp, Homo sapiens
aatttaattatgcca

SEQ ID NO: 7515 - DNA, 15 bp, Homo sapiens
caatttaattatgcc

SEQ ID NO: 7516 - DNA, 15 bp, Homo sapiens
ccaatttaattatgc

SEQ ID NO: 7517 - DNA, 15 bp, Homo sapiens
gccaatttaattatg

SEQ ID NO: 7518 - DNA, 15 bp, Homo sapiens
tgccaatttaattat

SEQ ID NO: 7519 - DNA, 15 bp, Homo sapiens
atgccaatttaatta

SEQ ID NO: 7520 - DNA, 15 bp, Homo sapiens
tatgccaatttaatt

SEQ ID NO: 7521 - DNA, 15 bp, Homo sapiens
ttatgccaatttaat

SEQ ID NO: 7522 - DNA, 15 bp, Homo sapiens
attatgccaatttaa

SEQ ID NO: 7523 - DNA, 15 bp, Homo sapiens
tattatgccaattta

SEQ ID NO: 7524 - DNA, 15 bp, Homo sapiens
ttattatgccaattt

SEQ ID NO: 7525 - DNA, 15 bp, Homo sapiens
tttattatgccaatt

SEQ ID NO: 7526 - DNA, 15 bp, Homo sapiens
ttttattatgccaat

SEQ ID NO: 7527 - DNA, 15 bp, Homo sapiens
tttttattatgccaa

SEQ ID NO: 7528 - DNA, 15 bp, Homo sapiens
atttttattatgcca

SEQ ID NO: 7529 - DNA, 15 bp, Homo sapiens
catttttattatgcc

SEQ ID NO: 7530 - DNA, 15 bp, Homo sapiens
acatttttattatgc

SEQ ID NO: 7531 - DNA, 15 bp, Homo sapiens
gacatttttattatg

SEQ ID NO: 7532 - DNA, 15 bp, Homo sapiens
agacatttttattat

SEQ ID NO: 7533 - DNA, 15 bp, Homo sapiens
tagacatttttatta

SEQ ID NO: 7534 - DNA, 15 bp, Homo sapiens
atagacatttttatt

SEQ ID NO: 7535 - DNA, 15 bp, Homo sapiens
catagacatttttat

SEQ ID NO: 7536 - DNA, 15 bp, Homo sapiens
gcatagacattttta

SEQ ID NO: 7537 - DNA, 15 bp, Homo sapiens
tgcatagacattttt

SEQ ID NO: 7538 - DNA, 15 bp, Homo sapiens
atgcatagacatttt

SEQ ID NO: 7539 - DNA, 15 bp, Homo sapiens
aatgcatagacattt

SEQ ID NO: 7540 - DNA, 15 bp, Homo sapiens
aaatgcatagacatt

SEQ ID NO: 7541 - DNA, 15 bp, Homo sapiens
aaaatgcatagacat

SEQ ID NO: 7542 - DNA, 15 bp, Homo sapiens
taaaatgcatagaca

SEQ ID NO: 7543 - DNA, 15 bp, Homo sapiens
ataaaatgcatagac

SEQ ID NO: 7544 - DNA, 15 bp, Homo sapiens
cataaaatgcataga

SEQ ID NO: 7545 - DNA, 15 bp, Homo sapiens
acataaaatgcatag

SEQ ID NO: 7546 - DNA, 15 bp, Homo sapiens
aacataaaatgcata

SEQ ID NO: 7547 - DNA, 15 bp, Homo sapiens
taacataaaatgcat

SEQ ID NO: 7548 - DNA, 15 bp, Homo sapiens
ttaacataaaatgca

SEQ ID NO: 7549 - DNA, 15 bp, Homo sapiens
cttaacataaaatgc

SEQ ID NO: 7550 - DNA, 15 bp, Homo sapiens
acttaacataaaatg

SEQ ID NO: 7551 - DNA, 15 bp, Homo sapiens
aacttaacataaaat

SEQ ID NO: 7552 - DNA, 15 bp, Homo sapiens
taacttaacataaaa

SEQ ID NO: 7553 - DNA, 15 bp, Homo sapiens
ataacttaacataaa

SEQ ID NO: 7554 - DNA, 15 bp, Homo sapiens
aataacttaacataa

SEQ ID NO: 7555 - DNA, 15 bp, Homo sapiens
caataacttaacata

SEQ ID NO: 7556 - DNA, 15 bp, Homo sapiens
acaataacttaacat

SEQ ID NO: 7557 - DNA, 15 bp, Homo sapiens
cacaataacttaaca

SEQ ID NO: 7558 - DNA, 15 bp, Homo sapiens
tcacaataacttaac

SEQ ID NO: 7559 - DNA, 15 bp, Homo sapiens
atcacaataacttaa

SEQ ID NO: 7560 - DNA, 15 bp, Homo sapiens
aatcacaataactta

SEQ ID NO: 7561 - DNA, 15 bp, Homo sapiens
taatcacaataactt

SEQ ID NO: 7562 - DNA, 15 bp, Homo sapiens
ataatcacaataact

SEQ ID NO: 7563 - DNA, 15 bp, Homo sapiens
aataatcacaataac

SEQ ID NO: 7564 - DNA, 15 bp, Homo sapiens
aaataatcacaataa

SEQ ID NO: 7565 - DNA, 15 bp, Homo sapiens
aaaataatcacaata

SEQ ID NO: 7566 - DNA, 15 bp, Homo sapiens
aaaaataatcacaat

SEQ ID NO: 7567 - DNA, 15 bp, Homo sapiens
taaaaataatcacaa

SEQ ID NO: 7568 - DNA, 15 bp, Homo sapiens
ataaaaataatcaca

SEQ ID NO: 7569 - DNA, 15 bp, Homo sapiens
aataaaaataatcac

SEQ ID NO: 7570 - DNA, 15 bp, Homo sapiens
caataaaaataatca

SEQ ID NO: 7571 - DNA, 15 bp, Homo sapiens
acaataaaaataatc

SEQ ID NO: 7572 - DNA, 15 bp, Homo sapiens
gacaataaaaataat

SEQ ID NO: 7573 - DNA, 15 bp, Homo sapiens
ggacaataaaaataa

SEQ ID NO: 7574 - DNA, 15 bp, Homo sapiens
aggacaataaaaata

SEQ ID NO: 7575 - DNA, 15 bp, Homo sapiens
gaggacaataaaaat

SEQ ID NO: 7576 - DNA, 15 bp, Homo sapiens
tgaggacaataaaaa

SEQ ID NO: 7577 - DNA, 15 bp, Homo sapiens
gtgaggacaataaaa

SEQ ID NO: 7578 - DNA, 15 bp, Homo sapiens
agtgaggacaataaa

SEQ ID NO: 7579 - DNA, 15 bp, Homo sapiens
aagtgaggacaataa

SEQ ID NO: 7580 - DNA, 15 bp, Homo sapiens
taagtgaggacaata

SEQ ID NO: 7581 - DNA, 15 bp, Homo sapiens
ctaagtgaggacaat

SEQ ID NO: 7582 - DNA, 15 bp, Homo sapiens
actaagtgaggacaa

SEQ ID NO: 7583 - DNA, 15 bp, Homo sapiens
tactaagtgaggaca

SEQ ID NO: 7584 - DNA, 15 bp, Homo sapiens
atactaagtgaggac

SEQ ID NO: 7585 - DNA, 15 bp, Homo sapiens
aatactaagtgagga

SEQ ID NO: 7586 - DNA, 15 bp, Homo sapiens
taatactaagtgagg

SEQ ID NO: 7587 - DNA, 15 bp, Homo sapiens
gtaatactaagtgag

SEQ ID NO: 7588 - DNA, 15 bp, Homo sapiens
agtaatactaagtga

SEQ ID NO: 7589 - DNA, 15 bp, Homo sapiens
aagtaatactaagtg

SEQ ID NO: 7590 - DNA, 15 bp, Homo sapiens
aaagtaatactaagt

SEQ ID NO: 7591 - DNA, 15 bp, Homo sapiens
caaagtaatactaag

SEQ ID NO: 7592 - DNA, 15 bp, Homo sapiens
acaaagtaatactaa

SEQ ID NO: 7593 - DNA, 15 bp, Homo sapiens
aacaaagtaatacta

SEQ ID NO: 7594 - DNA, 15 bp, Homo sapiens
aaacaaagtaatact

SEQ ID NO: 7595 - DNA, 15 bp, Homo sapiens
gaaacaaagtaatac

SEQ ID NO: 7596 - DNA, 15 bp, Homo sapiens
tgaaacaaagtaata

SEQ ID NO: 7597 - DNA, 15 bp, Homo sapiens
atgaaacaaagtaat

SEQ ID NO: 7598 - DNA, 15 bp, Homo sapiens
catgaaacaaagtaa

SEQ ID NO: 7599 - DNA, 15 bp, Homo sapiens
gcatgaaacaaagta

SEQ ID NO: 7600 - DNA, 15 bp, Homo sapiens
ggcatgaaacaaagt

SEQ ID NO: 7601 - DNA, 15 bp, Homo sapiens
tggcatgaaacaaag

SEQ ID NO: 7602 - DNA, 15 bp, Homo sapiens
atggcatgaaacaaa

SEQ ID NO: 7603 - DNA, 15 bp, Homo sapiens
aatggcatgaaacaa

SEQ ID NO: 7604 - DNA, 15 bp, Homo sapiens
aaatggcatgaaaca

SEQ ID NO: 7605 - DNA, 15 bp, Homo sapiens
aaaatggcatgaaac

SEQ ID NO: 7606 - DNA, 15 bp, Homo sapiens
caaaatggcatgaaa

SEQ ID NO: 7607 - DNA, 15 bp, Homo sapiens
tcaaaatggcatgaa

SEQ ID NO: 7608 - DNA, 15 bp, Homo sapiens
ttcaaaatggcatga

SEQ ID NO: 7609 - DNA, 15 bp, Homo sapiens
attcaaaatggcatg

SEQ ID NO: 7610 - DNA, 15 bp, Homo sapiens
tattcaaaatggcat

SEQ ID NO: 7611 - DNA, 15 bp, Homo sapiens
atattcaaaatggca

SEQ ID NO: 7612 - DNA, 15 bp, Homo sapiens
aatattcaaaatggc

SEQ ID NO: 7613 - DNA, 15 bp, Homo sapiens
taatattcaaaatgg

SEQ ID NO: 7614 - DNA, 15 bp, Homo sapiens
ataatattcaaaatg

SEQ ID NO: 7615 - DNA, 15 bp, Homo sapiens
tataatattcaaaat

SEQ ID NO: 7616 - DNA, 15 bp, Homo sapiens
ttataatattcaaaa

SEQ ID NO: 7617 - DNA, 15 bp, Homo sapiens
attataatattcaaa

SEQ ID NO: 7618 - DNA, 15 bp, Homo sapiens
aattataatattcaa

SEQ ID NO: 7619 - DNA, 15 bp, Homo sapiens
aaattataatattca

SEQ ID NO: 7620 - DNA, 15 bp, Homo sapiens
aaaattataatattc

SEQ ID NO: 7621 - DNA, 15 bp, Homo sapiens
aaaaattataatatt

SEQ ID NO: 7622 - DNA, 15 bp, Homo sapiens
aaaaaattataatat

SEQ ID NO: 7623 - DNA, 15 bp, Homo sapiens
taaaaaattataata

SEQ ID NO: 7624 - DNA, 15 bp, Homo sapiens
ttaaaaaattataat

SEQ ID NO: 7625 - DNA, 15 bp, Homo sapiens
tttaaaaaattataa

SEQ ID NO: 7626 - DNA, 15 bp, Homo sapiens
atttaaaaaattata

SEQ ID NO: 7627 - DNA, 15 bp, Homo sapiens
aatttaaaaaattat

SEQ ID NO: 7628 - DNA, 15 bp, Homo sapiens
aaatttaaaaaatta

SEQ ID NO: 7629 - DNA, 15 bp, Homo sapiens
aaaatttaaaaaatt

SEQ ID NO: 7630 - DNA, 15 bp, Homo sapiens
ataaaatttaaaaaa

SEQ ID NO: 7631 - DNA, 15 bp, Homo sapiens
tataaaatttaaaaa

SEQ ID NO: 7632 - DNA, 15 bp, Homo sapiens
ttataaaatttaaaa

SEQ ID NO: 7633 - DNA, 15 bp, Homo sapiens
attataaaatttaaa

SEQ ID NO: 7634 - DNA, 15 bp, Homo sapiens
aattataaaatttaa

SEQ ID NO: 7635 - DNA, 15 bp, Homo sapiens
aaattataaaattta

SEQ ID NO: 7636 - DNA, 15 bp, Homo sapiens
aaaattataaaattt

SEQ ID NO: 7637 - DNA, 15 bp, Homo sapiens
taaaattataaaatt

SEQ ID NO: 7638 - DNA, 15 bp, Homo sapiens
ttaaaattataaaat

SEQ ID NO: 7639 - DNA, 15 bp, Homo sapiens
tttaaaattataaaa

SEQ ID NO: 7640 - DNA, 15 bp, Homo sapiens
ctttaaaattataaa

SEQ ID NO: 7641 - DNA, 15 bp, Homo sapiens
gctttaaaattataa

SEQ ID NO: 7642 - DNA, 15 bp, Homo sapiens
ggctttaaaattata

SEQ ID NO: 7643 - DNA, 15 bp, Homo sapiens
tggctttaaaattat

SEQ ID NO: 7644 - DNA, 15 bp, Homo sapiens
atggctttaaaatta

SEQ ID NO: 7645 - DNA, 15 bp, Homo sapiens
aatggctttaaaatt

SEQ ID NO: 7646 - DNA, 15 bp, Homo sapiens
aaatggctttaaaat

SEQ ID NO: 7647 - DNA, 15 bp, Homo sapiens
gaaatggctttaaaa

SEQ ID NO: 7648 - DNA, 15 bp, Homo sapiens
agaaatggctttaaa

SEQ ID NO: 7649 - DNA, 15 bp, Homo sapiens
tagaaatggctttaa

SEQ ID NO: 7650 - DNA, 15 bp, Homo sapiens
gtagaaatggcttta

SEQ ID NO: 7651 - DNA, 15 bp, Homo sapiens
ggtagaaatggcttt

SEQ ID NO: 7652 - DNA, 15 bp, Homo sapiens
tggtagaaatggctt

SEQ ID NO: 7653 - DNA, 15 bp, Homo sapiens
atggtagaaatggct

SEQ ID NO: 7654 - DNA, 15 bp, Homo sapiens
gatggtagaaatggc

SEQ ID NO: 7655 - DNA, 15 bp, Homo sapiens
agatggtagaaatgg

SEQ ID NO: 7656 - DNA, 15 bp, Homo sapiens
tagatggtagaaatg

SEQ ID NO: 7657 - DNA, 15 bp, Homo sapiens
ttagatggtagaaat

SEQ ID NO: 7658 - DNA, 15 bp, Homo sapiens
tttagatggtagaaa

SEQ ID NO: 7659 - DNA, 15 bp, Homo sapiens
gtttagatggtagaa

SEQ ID NO: 7660 - DNA, 15 bp, Homo sapiens
tgtttagatggtaga

SEQ ID NO: 7661 - DNA, 15 bp, Homo sapiens
ctgtttagatggtag

SEQ ID NO: 7662 - DNA, 15 bp, Homo sapiens
tctgtttagatggta

SEQ ID NO: 7663 - DNA, 15 bp, Homo sapiens
ttctgtttagatggt

SEQ ID NO: 7664 - DNA, 15 bp, Homo sapiens
tttctgtttagatgg

SEQ ID NO: 7665 - DNA, 15 bp, Homo sapiens
atttctgtttagatg

SEQ ID NO: 7666 - DNA, 15 bp, Homo sapiens
tatttctgtttagat

SEQ ID NO: 7667 - DNA, 15 bp, Homo sapiens
ctatttctgtttaga

SEQ ID NO: 7668 - DNA, 15 bp, Homo sapiens
cctatttctgtttag

SEQ ID NO: 7669 - DNA, 15 bp, Homo sapiens
tcctatttctgttta

SEQ ID NO: 7670 - DNA, 15 bp, Homo sapiens
ttcctatttctgttt

SEQ ID NO: 7671 - DNA, 15 bp, Homo sapiens
cttcctatttctgtt

SEQ ID NO: 7672 - DNA, 15 bp, Homo sapiens
acttcctatttctgt

SEQ ID NO: 7673 - DNA, 15 bp, Homo sapiens
aacttcctatttctg

SEQ ID NO: 7674 - DNA, 15 bp, Homo sapiens
caacttcctatttct

SEQ ID NO: 7675 - DNA, 15 bp, Homo sapiens
acaacttcctatttc

SEQ ID NO: 7676 - DNA, 15 bp, Homo sapiens
gacaacttcctattt

SEQ ID NO: 7677 - DNA, 15 bp, Homo sapiens
tgacaacttcctatt

SEQ ID NO: 7678 - DNA, 15 bp, Homo sapiens
ttgacaacttcctat

SEQ ID NO: 7679 - DNA, 15 bp, Homo sapiens
cttgacaacttccta

SEQ ID NO: 7680 - DNA, 15 bp, Homo sapiens
ccttgacaacttcct

SEQ ID NO: 7681 - DNA, 15 bp, Homo sapiens
cccttgacaacttcc

SEQ ID NO: 7682 - DNA, 15 bp, Homo sapiens
acccttgacaacttc

SEQ ID NO: 7683 - DNA, 15 bp, Homo sapiens
tacccttgacaactt

SEQ ID NO: 7684 - DNA, 15 bp, Homo sapiens
gtacccttgacaact

SEQ ID NO: 7685 - DNA, 15 bp, Homo sapiens
cgtacccttgacaac

SEQ ID NO: 7686 - DNA, 15 bp, Homo sapiens
acgtacccttgacaa

SEQ ID NO: 7687 - DNA, 15 bp, Homo sapiens
tacgtacccttgaca

SEQ ID NO: 7688 - DNA, 15 bp, Homo sapiens
ttacgtacccttgac

SEQ ID NO: 7689 - DNA, 15 bp, Homo sapiens
attacgtacccttga

SEQ ID NO: 7690 - DNA, 15 bp, Homo sapiens
cattacgtacccttg

SEQ ID NO: 7691 - DNA, 15 bp, Homo sapiens
tcattacgtaccctt

SEQ ID NO: 7692 - DNA, 15 bp, Homo sapiens
ttcattacgtaccct

SEQ ID NO: 7693 - DNA, 15 bp, Homo sapiens
cttcattacgtaccc

SEQ ID NO: 7694 - DNA, 15 bp, Homo sapiens
acttcattacgtacc

SEQ ID NO: 7695 - DNA, 15 bp, Homo sapiens
tacttcattacgtac

SEQ ID NO: 7696 - DNA, 15 bp, Homo sapiens
ctacttcattacgta

SEQ ID NO: 7697 - DNA, 15 bp, Homo sapiens
actacttcattacgt

SEQ ID NO: 7698 - DNA, 15 bp, Homo sapiens
aactacttcattacg

SEQ ID NO: 7699 - DNA, 15 bp, Homo sapiens
aaactacttcattac

SEQ ID NO: 7700 - DNA, 15 bp, Homo sapiens
gaaactacttcatta

SEQ ID NO: 7701 - DNA, 15 bp, Homo sapiens
tgaaactacttcatt

SEQ ID NO: 7702 - DNA, 15 bp, Homo sapiens
atgaaactacttcat

SEQ ID NO: 7703 - DNA, 15 bp, Homo sapiens
tatgaaactacttca

SEQ ID NO: 7704 - DNA, 15 bp, Homo sapiens
ttatgaaactacttc

SEQ ID NO: 7705 - DNA, 15 bp, Homo sapiens
tttatgaaactactt

SEQ ID NO: 7706 - DNA, 15 bp, Homo sapiens
atttatgaaactact

SEQ ID NO: 7707 - DNA, 15 bp, Homo sapiens
tatttatgaaactac

SEQ ID NO: 7708 - DNA, 15 bp, Homo sapiens
gtatttatgaaacta

SEQ ID NO: 7709 - DNA, 15 bp, Homo sapiens
tgtatttatgaaact

SEQ ID NO: 7710 - DNA, 15 bp, Homo sapiens
ttgtatttatgaaac

SEQ ID NO: 7711 - DNA, 15 bp, Homo sapiens
tttgtatttatgaaa

SEQ ID NO: 7712 - DNA, 15 bp, Homo sapiens
ctttgtatttatgaa

SEQ ID NO: 7713 - DNA, 15 bp, Homo sapiens
gctttgtatttatga

SEQ ID NO: 7714 - DNA, 15 bp, Homo sapiens
ggctttgtatttatg

SEQ ID NO: 7715 - DNA, 15 bp, Homo sapiens
tggctttgtatttat

SEQ ID NO: 7716 - DNA, 15 bp, Homo sapiens
atggctttgtattta

SEQ ID NO: 7717 - DNA, 15 bp, Homo sapiens
catggctttgtattt

SEQ ID NO: 7718 - DNA, 15 bp, Homo sapiens
acatggctttgtatt

SEQ ID NO: 7719 - DNA, 15 bp, Homo sapiens
tacatggctttgtat

SEQ ID NO: 7720 - DNA, 15 bp, Homo sapiens
atacatggctttgta

SEQ ID NO: 7721 - DNA, 15 bp, Homo sapiens
aatacatggctttgt

SEQ ID NO: 7722 - DNA, 15 bp, Homo sapiens
aaatacatggctttg

SEQ ID NO: 7723 - DNA, 15 bp, Homo sapiens
taaatacatggcttt

SEQ ID NO: 7724 - DNA, 15 bp, Homo sapiens
ataaatacatggctt

SEQ ID NO: 7725 - DNA, 15 bp, Homo sapiens
aataaatacatggct

SEQ ID NO: 7726 - DNA, 15 bp, Homo sapiens
aaataaatacatggc

SEQ ID NO: 7727 - DNA, 15 bp, Homo sapiens
taaataaatacatgg

SEQ ID NO: 7728 - DNA, 15 bp, Homo sapiens
ataaataaatacatg

SEQ ID NO: 7729 - DNA, 15 bp, Homo sapiens
cataaataaatacat

SEQ ID NO: 7730 - DNA, 15 bp, Homo sapiens
ccataaataaataca

SEQ ID NO: 7731 - DNA, 15 bp, Homo sapiens
accataaataaatac

SEQ ID NO: 7732 - DNA, 15 bp, Homo sapiens
aaccataaataaata

SEQ ID NO: 7733 - DNA, 15 bp, Homo sapiens
caaccataaataaat

SEQ ID NO: 7734 - DNA, 15 bp, Homo sapiens
acaaccataaataaa

SEQ ID NO: 7735 - DNA, 15 bp, Homo sapiens
tacaaccataaataa

SEQ ID NO: 7736 - DNA, 15 bp, Homo sapiens
ctacaaccataaata

SEQ ID NO: 7737 - DNA, 15 bp, Homo sapiens
actacaaccataaat

SEQ ID NO: 7738 - DNA, 15 bp, Homo sapiens
tactacaaccataaa

SEQ ID NO: 7739 - DNA, 15 bp, Homo sapiens
atactacaaccataa

SEQ ID NO: 7740 - DNA, 15 bp, Homo sapiens
tatactacaaccata

SEQ ID NO: 7741 - DNA, 15 bp, Homo sapiens
gtatactacaaccat

SEQ ID NO: 7742 - DNA, 15 bp, Homo sapiens
agtatactacaacca

SEQ ID NO: 7743 - DNA, 15 bp, Homo sapiens
aagtatactacaacc

SEQ ID NO: 7744 - DNA, 15 bp, Homo sapiens
caagtatactacaac

SEQ ID NO: 7745 - DNA, 15 bp, Homo sapiens
gcaagtatactacaa

SEQ ID NO: 7746 - DNA, 15 bp, Homo sapiens
ggcaagtatactaca

SEQ ID NO: 7747 - DNA, 15 bp, Homo sapiens
aggcaagtatactac

SEQ ID NO: 7748 - DNA, 15 bp, Homo sapiens
aaggcaagtatacta

SEQ ID NO: 7749 - DNA, 15 bp, Homo sapiens
caaggcaagtatact

SEQ ID NO: 7750 - DNA, 15 bp, Homo sapiens
ccaaggcaagtatac

SEQ ID NO: 7751 - DNA, 15 bp, Homo sapiens
cccaaggcaagtata

SEQ ID NO: 7752 - DNA, 15 bp, Homo sapiens
acccaaggcaagtat

SEQ ID NO: 7753 - DNA, 15 bp, Homo sapiens
aacccaaggcaagta

SEQ ID NO: 7754 - DNA, 15 bp, Homo sapiens
aaacccaaggcaagt

SEQ ID NO: 7755 - DNA, 15 bp, Homo sapiens
caaacccaaggcaag

SEQ ID NO: 7756 - DNA, 15 bp, Homo sapiens
ccaaacccaaggcaa

SEQ ID NO: 7757 - DNA, 15 bp, Homo sapiens
cccaaacccaaggca

SEQ ID NO: 7758 - DNA, 15 bp, Homo sapiens
acccaaacccaaggc

SEQ ID NO: 7759 - DNA, 15 bp, Homo sapiens
cacccaaacccaagg

SEQ ID NO: 7760 - DNA, 15 bp, Homo sapiens
tcacccaaacccaag

SEQ ID NO: 7761 - DNA, 15 bp, Homo sapiens
ctcacccaaacccaa

SEQ ID NO: 7762 - DNA, 15 bp, Homo sapiens
actcacccaaaccca

SEQ ID NO: 7763 - DNA, 15 bp, Homo sapiens
cactcacccaaaccc

SEQ ID NO: 7764 - DNA, 15 bp, Homo sapiens
acactcacccaaacc

SEQ ID NO: 7765 - DNA, 15 bp, Homo sapiens
aacactcacccaaac

SEQ ID NO: 7766 - DNA, 15 bp, Homo sapiens
taacactcacccaaa

SEQ ID NO: 7767 - DNA, 15 bp, Homo sapiens
ctaacactcacccaa

SEQ ID NO: 7768 - DNA, 15 bp, Homo sapiens
tctaacactcaccca

SEQ ID NO: 7769 - DNA, 15 bp, Homo sapiens
ttctaacactcaccc

SEQ ID NO: 7770 - DNA, 15 bp, Homo sapiens
tttctaacactcacc

SEQ ID NO: 7771 - DNA, 15 bp, Homo sapiens
ctttctaacactcac

SEQ ID NO: 7772 - DNA, 15 bp, Homo sapiens
cctttctaacactca

SEQ ID NO: 7773 - DNA, 15 bp, Homo sapiens
tcctttctaacactc

SEQ ID NO: 7774 - DNA, 15 bp, Homo sapiens
ttcctttctaacact

SEQ ID NO: 7775 - DNA, 15 bp, Homo sapiens
gttcctttctaacac

SEQ ID NO: 7776 - DNA, 15 bp, Homo sapiens
agttcctttctaaca

SEQ ID NO: 7777 - DNA, 15 bp, Homo sapiens
cagttcctttctaac

SEQ ID NO: 7778 - DNA, 15 bp, Homo sapiens
ccagttcctttctaa

SEQ ID NO: 7779 - DNA, 15 bp, Homo sapiens
tccagttcctttcta

SEQ ID NO: 7780 - DNA, 15 bp, Homo sapiens
ttccagttcctttct

SEQ ID NO: 7781 - DNA, 15 bp, Homo sapiens
tttccagttcctttc

SEQ ID NO: 7782 - DNA, 15 bp, Homo sapiens
ctttccagttccttt

SEQ ID NO: 7783 - DNA, 15 bp, Homo sapiens
tctttccagttcctt

SEQ ID NO: 7784 - DNA, 15 bp, Homo sapiens
ttctttccagttcct

SEQ ID NO: 7785 - DNA, 15 bp, Homo sapiens
attctttccagttcc

SEQ ID NO: 7786 - DNA, 15 bp, Homo sapiens
aattctttccagttc

SEQ ID NO: 7787 - DNA, 15 bp, Homo sapiens
aaattctttccagtt

SEQ ID NO: 7788 - DNA, 15 bp, Homo sapiens
caaattctttccagt

SEQ ID NO: 7789 - DNA, 15 bp, Homo sapiens
tcaaattctttccag

SEQ ID NO: 7790 - DNA, 15 bp, Homo sapiens
atcaaattctttcca

SEQ ID NO: 7791 - DNA, 15 bp, Homo sapiens
gatcaaattctttcc

SEQ ID NO: 7792 - DNA, 15 bp, Homo sapiens
agatcaaattctttc

SEQ ID NO: 7793 - DNA, 15 bp, Homo sapiens
tagatcaaattcttt

SEQ ID NO: 7794 - DNA, 15 bp, Homo sapiens
atagatcaaattctt

SEQ ID NO: 7795 - DNA, 15 bp, Homo sapiens
tatagatcaaattct

SEQ ID NO: 7796 - DNA, 15 bp, Homo sapiens
ttatagatcaaattc

SEQ ID NO: 7797 - DNA, 15 bp, Homo sapiens
attatagatcaaatt

SEQ ID NO: 7798 - DNA, 15 bp, Homo sapiens
cattatagatcaaat

SEQ ID NO: 7799 - DNA, 15 bp, Homo sapiens
tcattatagatcaaa

SEQ ID NO: 7800 - DNA, 15 bp, Homo sapiens
gtcattatagatcaa

SEQ ID NO: 7801 - DNA, 15 bp, Homo sapiens
ggtcattatagatca

SEQ ID NO: 7802 - DNA, 15 bp, Homo sapiens
tggtcattatagatc

SEQ ID NO: 7803 - DNA, 15 bp, Homo sapiens
ttggtcattatagat

SEQ ID NO: 7804 - DNA, 15 bp, Homo sapiens
cttggtcattataga

SEQ ID NO: 7805 - DNA, 15 bp, Homo sapiens
ccttggtcattatag

SEQ ID NO: 7806 - DNA, 15 bp, Homo sapiens
tccttggtcattata

SEQ ID NO: 7807 - DNA, 15 bp, Homo sapiens
atccttggtcattat

SEQ ID NO: 7808 - DNA, 15 bp, Homo sapiens
aatccttggtcatta

SEQ ID NO: 7809 - DNA, 15 bp, Homo sapiens
aaatccttggtcatt

SEQ ID NO: 7810 - DNA, 15 bp, Homo sapiens
caaatccttggtcat

SEQ ID NO: 7811 - DNA, 15 bp, Homo sapiens
ccaaatccttggtca

SEQ ID NO: 7812 - DNA, 15 bp, Homo sapiens
accaaatccttggtc

SEQ ID NO: 7813 - DNA, 15 bp, Homo sapiens
caccaaatccttggt

SEQ ID NO: 7814 - DNA, 15 bp, Homo sapiens
acaccaaatccttgg

SEQ ID NO: 7815 - DNA, 15 bp, Homo sapiens
aacaccaaatccttg

SEQ ID NO: 7816 - DNA, 15 bp, Homo sapiens
caacaccaaatcctt

SEQ ID NO: 7817 - DNA, 15 bp, Homo sapiens
ccaacaccaaatcct

SEQ ID NO: 7818 - DNA, 15 bp, Homo sapiens
cccaacaccaaatcc

SEQ ID NO: 7819 - DNA, 15 bp, Homo sapiens
acccaacaccaaatc

SEQ ID NO: 7820 - DNA, 15 bp, Homo sapiens
tacccaacaccaaat

SEQ ID NO: 7821 - DNA, 15 bp, Homo sapiens
ttacccaacaccaaa

SEQ ID NO: 7822 - DNA, 15 bp, Homo sapiens
tttacccaacaccaa

SEQ ID NO: 7823 - DNA, 15 bp, Homo sapiens
ttttacccaacacca

SEQ ID NO: 7824 - DNA, 15 bp, Homo sapiens
cttttacccaacacc

SEQ ID NO: 7825 - DNA, 15 bp, Homo sapiens
acttttacccaacac

SEQ ID NO: 7826 - DNA, 15 bp, Homo sapiens
tacttttacccaaca

SEQ ID NO: 7827 - DNA, 15 bp, Homo sapiens
ctacttttacccaac

SEQ ID NO: 7828 - DNA, 15 bp, Homo sapiens
tctacttttacccaa

SEQ ID NO: 7829 - DNA, 15 bp, Homo sapiens
gtctacttttaccca

SEQ ID NO: 7830 - DNA, 15 bp, Homo sapiens
ggtctacttttaccc

SEQ ID NO: 7831 - DNA, 15 bp, Homo sapiens
aggtctacttttacc

SEQ ID NO: 7832 - DNA, 15 bp, Homo sapiens
caggtctacttttac

SEQ ID NO: 7833 - DNA, 15 bp, Homo sapiens
acaggtctactttta

SEQ ID NO: 7834 - DNA, 15 bp, Homo sapiens
gacaggtctactttt

SEQ ID NO: 7835 - DNA, 15 bp, Homo sapiens
agacaggtctacttt

SEQ ID NO: 7836 - DNA, 15 bp, Homo sapiens
aagacaggtctactt

SEQ ID NO: 7837 - DNA, 15 bp, Homo sapiens
aaagacaggtctact

SEQ ID NO: 7838 - DNA, 15 bp, Homo sapiens
gaaagacaggtctac

SEQ ID NO: 7839 - DNA, 15 bp, Homo sapiens
agaaagacaggtcta

SEQ ID NO: 7840 - DNA, 15 bp, Homo sapiens
gagaaagacaggtct

SEQ ID NO: 7841 - DNA, 15 bp, Homo sapiens
agagaaagacaggtc

SEQ ID NO: 7842 - DNA, 15 bp, Homo sapiens
tagagaaagacaggt

SEQ ID NO: 7843 - DNA, 15 bp, Homo sapiens
ttagagaaagacagg

SEQ ID NO: 7844 - DNA, 15 bp, Homo sapiens
gttagagaaagacag

SEQ ID NO: 7845 - DNA, 15 bp, Homo sapiens
agttagagaaagaca

SEQ ID NO: 7846 - DNA, 15 bp, Homo sapiens
aagttagagaaagac

SEQ ID NO: 7847 - DNA, 15 bp, Homo sapiens
taagttagagaaaga

SEQ ID NO: 7848 - DNA, 15 bp, Homo sapiens
ttaagttagagaaag

SEQ ID NO: 7849 - DNA, 15 bp, Homo sapiens
tttaagttagagaaa

SEQ ID NO: 7850 - DNA, 15 bp, Homo sapiens
ttttaagttagagaa

SEQ ID NO: 7851 - DNA, 15 bp, Homo sapiens
cttttaagttagaga

SEQ ID NO: 7852 - DNA, 15 bp, Homo sapiens
gcttttaagttagag

SEQ ID NO: 7853 - DNA, 15 bp, Homo sapiens
tgcttttaagttaga

SEQ ID NO: 7854 - DNA, 15 bp, Homo sapiens
gtgcttttaagttag

SEQ ID NO: 7855 - DNA, 15 bp, Homo sapiens
tgtgcttttaagtta

SEQ ID NO: 7856 - DNA, 15 bp, Homo sapiens
atgtgcttttaagtt

SEQ ID NO: 7857 - DNA, 15 bp, Homo sapiens
tatgtgcttttaagt

SEQ ID NO: 7858 - DNA, 15 bp, Homo sapiens
atatgtgcttttaag

SEQ ID NO: 7859 - DNA, 15 bp, Homo sapiens
catatgtgcttttaa

SEQ ID NO: 7860 - DNA, 15 bp, Homo sapiens
gcatatgtgctttta

SEQ ID NO: 7861 - DNA, 15 bp, Homo sapiens
ggcatatgtgctttt

SEQ ID NO: 7862 - DNA, 15 bp, Homo sapiens
tggcatatgtgcttt

SEQ ID NO: 7863 - DNA, 15 bp, Homo sapiens
ttggcatatgtgctt

SEQ ID NO: 7864 - DNA, 15 bp, Homo sapiens
cttggcatatgtgct

SEQ ID NO: 7865 - DNA, 15 bp, Homo sapiens
acttggcatatgtgc

SEQ ID NO: 7866 - DNA, 15 bp, Homo sapiens
aacttggcatatgtg

SEQ ID NO: 7867 - DNA, 15 bp, Homo sapiens
gaacttggcatatgt

SEQ ID NO: 7868 - DNA, 15 bp, Homo sapiens
tgaacttggcatatg

SEQ ID NO: 7869 - DNA, 15 bp, Homo sapiens
atgaacttggcatat

SEQ ID NO: 7870 - DNA, 15 bp, Homo sapiens
gatgaacttggcata

SEQ ID NO: 7871 - DNA, 15 bp, Homo sapiens
tgatgaacttggcat

SEQ ID NO: 7872 - DNA, 15 bp, Homo sapiens
atgatgaacttggca

SEQ ID NO: 7873 - DNA, 15 bp, Homo sapiens
gatgatgaacttggc

SEQ ID NO: 7874 - DNA, 15 bp, Homo sapiens
tgatgatgaacttgg

SEQ ID NO: 7875 - DNA, 15 bp, Homo sapiens
ttgatgatgaacttg

SEQ ID NO: 7876 - DNA, 15 bp, Homo sapiens
cttgatgatgaactt

SEQ ID NO: 7877 - DNA, 15 bp, Homo sapiens
acttgatgatgaact

SEQ ID NO: 7878 - DNA, 15 bp, Homo sapiens
tacttgatgatgaac

SEQ ID NO: 7879 - DNA, 15 bp, Homo sapiens
gtacttgatgatgaa

SEQ ID NO: 7880 - DNA, 15 bp, Homo sapiens
agtacttgatgatga

SEQ ID NO: 7881 - DNA, 15 bp, Homo sapiens
cagtacttgatgatg

SEQ ID NO: 7882 - DNA, 15 bp, Homo sapiens
acagtacttgatgat

SEQ ID NO: 7883 - DNA, 15 bp, Homo sapiens
tacagtacttgatga

SEQ ID NO: 7884 - DNA, 15 bp, Homo sapiens
atacagtacttgatg

SEQ ID NO: 7885 - DNA, 15 bp, Homo sapiens
aatacagtacttgat

SEQ ID NO: 7886 - DNA, 15 bp, Homo sapiens
taatacagtacttga

SEQ ID NO: 7887 - DNA, 15 bp, Homo sapiens
ataatacagtacttg

SEQ ID NO: 7888 - DNA, 15 bp, Homo sapiens
aataatacagtactt

SEQ ID NO: 7889 - DNA, 15 bp, Homo sapiens
taataatacagtact

SEQ ID NO: 7890 - DNA, 15 bp, Homo sapiens
ttaataatacagtac

SEQ ID NO: 7891 - DNA, 15 bp, Homo sapiens
gttaataatacagta

SEQ ID NO: 7892 - DNA, 15 bp, Homo sapiens
tgttaataatacagt

SEQ ID NO: 7893 - DNA, 15 bp, Homo sapiens
ctgttaataatacag

SEQ ID NO: 7894 - DNA, 15 bp, Homo sapiens
gctgttaataataca

SEQ ID NO: 7895 - DNA, 15 bp, Homo sapiens
ggctgttaataatac

SEQ ID NO: 7896 - DNA, 15 bp, Homo sapiens
aggctgttaataata

SEQ ID NO: 7897 - DNA, 15 bp, Homo sapiens
aaggctgttaataat

SEQ ID NO: 7898 - DNA, 15 bp, Homo sapiens
taaggctgttaataa

SEQ ID NO: 7899 - DNA, 15 bp, Homo sapiens
ttaaggctgttaata

SEQ ID NO: 7900 - DNA, 15 bp, Homo sapiens
attaaggctgttaat

SEQ ID NO: 7901 - DNA, 15 bp, Homo sapiens
aattaaggctgttaa

SEQ ID NO: 7902 - DNA, 15 bp, Homo sapiens
taattaaggctgtta

SEQ ID NO: 7903 - DNA, 15 bp, Homo sapiens
ctaattaaggctgtt

SEQ ID NO: 7904 - DNA, 15 bp, Homo sapiens
actaattaaggctgt

SEQ ID NO: 7905 - DNA, 15 bp, Homo sapiens
tactaattaaggctg

SEQ ID NO: 7906 - DNA, 15 bp, Homo sapiens
ctactaattaaggct

SEQ ID NO: 7907 - DNA, 15 bp, Homo sapiens
cctactaattaaggc

SEQ ID NO: 7908 - DNA, 15 bp, Homo sapiens
gcctactaattaagg

SEQ ID NO: 7909 - DNA, 15 bp, Homo sapiens
agcctactaattaag

SEQ ID NO: 7910 - DNA, 15 bp, Homo sapiens
aagcctactaattaa

SEQ ID NO: 7911 - DNA, 15 bp, Homo sapiens
aaagcctactaatta

SEQ ID NO: 7912 - DNA, 15 bp, Homo sapiens
taaagcctactaatt

SEQ ID NO: 7913 - DNA, 15 bp, Homo sapiens
ctaaagcctactaat

SEQ ID NO: 7914 - DNA, 15 bp, Homo sapiens
tctaaagcctactaa

SEQ ID NO: 7915 - DNA, 15 bp, Homo sapiens
ttctaaagcctacta

SEQ ID NO: 7916 - DNA, 15 bp, Homo sapiens
tttctaaagcctact

SEQ ID NO: 7917 - DNA, 15 bp, Homo sapiens
ctttctaaagcctac

SEQ ID NO: 7918 - DNA, 15 bp, Homo sapiens
actttctaaagccta

SEQ ID NO: 7919 - DNA, 15 bp, Homo sapiens
aactttctaaagcct

SEQ ID NO: 7920 - DNA, 15 bp, Homo sapiens
gaactttctaaagcc

SEQ ID NO: 7921 - DNA, 15 bp, Homo sapiens
tgaactttctaaagc

SEQ ID NO: 7922 - DNA, 15 bp, Homo sapiens
ttgaactttctaaag

SEQ ID NO: 7923 - DNA, 15 bp, Homo sapiens
gttgaactttctaaa

SEQ ID NO: 7924 - DNA, 15 bp, Homo sapiens
tgttgaactttctaa

SEQ ID NO: 7925 - DNA, 15 bp, Homo sapiens
ttgttgaactttcta

SEQ ID NO: 7926 - DNA, 15 bp, Homo sapiens
cttgttgaactttct

SEQ ID NO: 7927 - DNA, 15 bp, Homo sapiens
acttgttgaactttc

SEQ ID NO: 7928 - DNA, 15 bp, Homo sapiens
aacttgttgaacttt

SEQ ID NO: 7929 - DNA, 15 bp, Homo sapiens
taacttgttgaactt

SEQ ID NO: 7930 - DNA, 15 bp, Homo sapiens
ctaacttgttgaact

SEQ ID NO: 7931 - DNA, 15 bp, Homo sapiens
actaacttgttgaac

SEQ ID NO: 7932 - DNA, 15 bp, Homo sapiens
tactaacttgttgaa

SEQ ID NO: 7933 - DNA, 15 bp, Homo sapiens
ttactaacttgttga

SEQ ID NO: 7934 - DNA, 15 bp, Homo sapiens
tttactaacttgttg

SEQ ID NO: 7935 - DNA, 15 bp, Homo sapiens
atttactaacttgtt

SEQ ID NO: 7936 - DNA, 15 bp, Homo sapiens
tatttactaacttgt

SEQ ID NO: 7937 - DNA, 15 bp, Homo sapiens
atatttactaacttg

SEQ ID NO: 7938 - DNA, 15 bp, Homo sapiens
aatatttactaactt

SEQ ID NO: 7939 - DNA, 15 bp, Homo sapiens
aaatatttactaact

SEQ ID NO: 7940 - DNA, 15 bp, Homo sapiens
aaaatatttactaac

SEQ ID NO: 7941 - DNA, 15 bp, Homo sapiens
caaaatatttactaa

SEQ ID NO: 7942 - DNA, 15 bp, Homo sapiens
tcaaaatatttacta

SEQ ID NO: 7943 - DNA, 15 bp, Homo sapiens
ttcaaaatatttact

SEQ ID NO: 7944 - DNA, 15 bp, Homo sapiens
tttcaaaatatttac

SEQ ID NO: 7945 - DNA, 15 bp, Homo sapiens
gtttcaaaatattta

SEQ ID NO: 7946 - DNA, 15 bp, Homo sapiens
tgtttcaaaatattt

SEQ ID NO: 7947 - DNA, 15 bp, Homo sapiens
ttgtttcaaaatatt

SEQ ID NO: 7948 - DNA, 15 bp, Homo sapiens
attgtttcaaaatat

SEQ ID NO: 7949 - DNA, 15 bp, Homo sapiens
tattgtttcaaaata

SEQ ID NO: 7950 - DNA, 15 bp, Homo sapiens
ctattgtttcaaaat

SEQ ID NO: 7951 - DNA, 15 bp, Homo sapiens
cctattgtttcaaaa

SEQ ID NO: 7952 - DNA, 15 bp, Homo sapiens
gcctattgtttcaaa

SEQ ID NO: 7953 - DNA, 15 bp, Homo sapiens
ggcctattgtttcaa

SEQ ID NO: 7954 - DNA, 15 bp, Homo sapiens
tggcctattgtttca

SEQ ID NO: 7955 - DNA, 15 bp, Homo sapiens
ttggcctattgtttc

SEQ ID NO: 7956 - DNA, 15 bp, Homo sapiens
cttggcctattgttt

SEQ ID NO: 7957 - DNA, 15 bp, Homo sapiens
tcttggcctattgtt

SEQ ID NO: 7958 - DNA, 15 bp, Homo sapiens
gtcttggcctattgt

SEQ ID NO: 7959 - DNA, 15 bp, Homo sapiens
agtcttggcctattg

SEQ ID NO: 7960 - DNA, 15 bp, Homo sapiens
tagtcttggcctatt

SEQ ID NO: 7961 - DNA, 15 bp, Homo sapiens
ttagtcttggcctat

SEQ ID NO: 7962 - DNA, 15 bp, Homo sapiens
cttagtcttggccta

SEQ ID NO: 7963 - DNA, 15 bp, Homo sapiens
tcttagtcttggcct

SEQ ID NO: 7964 - DNA, 15 bp, Homo sapiens
ttcttagtcttggcc

SEQ ID NO: 7965 - DNA, 15 bp, Homo sapiens
attcttagtcttggc

SEQ ID NO: 7966 - DNA, 15 bp, Homo sapiens
aattcttagtcttgg

SEQ ID NO: 7967 - DNA, 15 bp, Homo sapiens
aaattcttagtcttg

SEQ ID NO: 7968 - DNA, 15 bp, Homo sapiens
aaaattcttagtctt

SEQ ID NO: 7969 - DNA, 15 bp, Homo sapiens
aaaaattcttagtct

SEQ ID NO: 7970 - DNA, 15 bp, Homo sapiens
taaaaattcttagtc

SEQ ID NO: 7971 - DNA, 15 bp, Homo sapiens
ttaaaaattcttagt

SEQ ID NO: 7972 - DNA, 15 bp, Homo sapiens
tttaaaaattcttag

SEQ ID NO: 7973 - DNA, 15 bp, Homo sapiens
ttttaaaaattctta

SEQ ID NO: 7974 - DNA, 15 bp, Homo sapiens
tttttaaaaattctt

SEQ ID NO: 7975 - DNA, 15 bp, Homo sapiens
ctttttaaaaattct

SEQ ID NO: 7976 - DNA, 15 bp, Homo sapiens
actttttaaaaattc

SEQ ID NO: 7977 - DNA, 15 bp, Homo sapiens
cactttttaaaaatt

SEQ ID NO: 7978 - DNA, 15 bp, Homo sapiens
tcactttttaaaaat

SEQ ID NO: 7979 - DNA, 15 bp, Homo sapiens
ttcactttttaaaaa

SEQ ID NO: 7980 - DNA, 15 bp, Homo sapiens
tttcactttttaaaa

SEQ ID NO: 7981 - DNA, 15 bp, Homo sapiens
atttcactttttaaa

SEQ ID NO: 7982 - DNA, 15 bp, Homo sapiens
aatttcactttttaa

SEQ ID NO: 7983 - DNA, 15 bp, Homo sapiens
aaatttcacttttta

SEQ ID NO: 7984 - DNA, 15 bp, Homo sapiens
taaatttcacttttt

SEQ ID NO: 7985 - DNA, 15 bp, Homo sapiens
ataaatttcactttt

SEQ ID NO: 7986 - DNA, 15 bp, Homo sapiens
aataaatttcacttt

SEQ ID NO: 7987 - DNA, 15 bp, Homo sapiens
caataaatttcactt

SEQ ID NO: 7988 - DNA, 15 bp, Homo sapiens
gcaataaatttcact

SEQ ID NO: 7989 - DNA, 15 bp, Homo sapiens
ggcaataaatttcac

SEQ ID NO: 7990 - DNA, 15 bp, Homo sapiens
tggcaataaatttca

SEQ ID NO: 7991 - DNA, 15 bp, Homo sapiens
ctggcaataaatttc

SEQ ID NO: 7992 - DNA, 15 bp, Homo sapiens
actggcaataaattt

SEQ ID NO: 7993 - DNA, 15 bp, Homo sapiens
tactggcaataaatt

SEQ ID NO: 7994 - DNA, 15 bp, Homo sapiens
ctactggcaataaat

SEQ ID NO: 7995 - DNA, 15 bp, Homo sapiens
tctactggcaataaa

SEQ ID NO: 7996 - DNA, 15 bp, Homo sapiens
ctctactggcaataa

SEQ ID NO: 7997 - DNA, 15 bp, Homo sapiens
actctactggcaata

SEQ ID NO: 7998 - DNA, 15 bp, Homo sapiens
cactctactggcaat

SEQ ID NO: 7999 - DNA, 15 bp, Homo sapiens
acactctactggcaa

SEQ ID NO: 8000 - DNA, 15 bp, Homo sapiens
cacactctactggca

SEQ ID NO: 8001 - DNA, 15 bp, Homo sapiens
acacactctactggc

SEQ ID NO: 8002 - DNA, 15 bp, Homo sapiens
cacacactctactgg

SEQ ID NO: 8003 - DNA, 15 bp, Homo sapiens
tcacacactctactg

SEQ ID NO: 8004 - DNA, 15 bp, Homo sapiens
atcacacactctact

SEQ ID NO: 8005 - DNA, 15 bp, Homo sapiens
catcacacactctac

SEQ ID NO: 8006 - DNA, 15 bp, Homo sapiens
gcatcacacactcta

SEQ ID NO: 8007 - DNA, 15 bp, Homo sapiens
tgcatcacacactct

SEQ ID NO: 8008 - DNA, 15 bp, Homo sapiens
ctgcatcacacactc

SEQ ID NO: 8009 - DNA, 15 bp, Homo sapiens
tctgcatcacacact

SEQ ID NO: 8010 - DNA, 15 bp, Homo sapiens
ttctgcatcacacac

SEQ ID NO: 8011 - DNA, 15 bp, Homo sapiens
tttctgcatcacaca

SEQ ID NO: 8012 - DNA, 15 bp, Homo sapiens
ctttctgcatcacac

SEQ ID NO: 8013 - DNA, 15 bp, Homo sapiens
actttctgcatcaca

SEQ ID NO: 8014 - DNA, 15 bp, Homo sapiens
tactttctgcatcac

SEQ ID NO: 8015 - DNA, 15 bp, Homo sapiens
gtactttctgcatca

SEQ ID NO: 8016 - DNA, 15 bp, Homo sapiens
agtactttctgcatc

SEQ ID NO: 8017 - DNA, 15 bp, Homo sapiens
cagtactttctgcat

SEQ ID NO: 8018 - DNA, 15 bp, Homo sapiens
gcagtactttctgca

SEQ ID NO: 8019 - DNA, 15 bp, Homo sapiens
agcagtactttctgc

SEQ ID NO: 8020 - DNA, 15 bp, Homo sapiens
aagcagtactttctg

SEQ ID NO: 8021 - DNA, 15 bp, Homo sapiens
caagcagtactttct

SEQ ID NO: 8022 - DNA, 15 bp, Homo sapiens
ccaagcagtactttc

SEQ ID NO: 8023 - DNA, 15 bp, Homo sapiens
tccaagcagtacttt

SEQ ID NO: 8024 - DNA, 15 bp, Homo sapiens
ttccaagcagtactt

SEQ ID NO: 8025 - DNA, 15 bp, Homo sapiens
gttccaagcagtact

SEQ ID NO: 8026 - DNA, 15 bp, Homo sapiens
tgttccaagcagtac

SEQ ID NO: 8027 - DNA, 15 bp, Homo sapiens
atgttccaagcagta

SEQ ID NO: 8028 - DNA, 15 bp, Homo sapiens
aatgttccaagcagt

SEQ ID NO: 8029 - DNA, 15 bp, Homo sapiens
aaatgttccaagcag

SEQ ID NO: 8030 - DNA, 15 bp, Homo sapiens
aaaatgttccaagca

SEQ ID NO: 8031 - DNA, 15 bp, Homo sapiens
taaaatgttccaagc

SEQ ID NO: 8032 - DNA, 15 bp, Homo sapiens
ttaaaatgttccaag

SEQ ID NO: 8033 - DNA, 15 bp, Homo sapiens
tttaaaatgttccaa

SEQ ID NO: 8034 - DNA, 15 bp, Homo sapiens
gtttaaaatgttcca

SEQ ID NO: 8035 - DNA, 15 bp, Homo sapiens
tgtttaaaatgttcc

SEQ ID NO: 8036 - DNA, 15 bp, Homo sapiens
atgtttaaaatgttc

SEQ ID NO: 8037 - DNA, 15 bp, Homo sapiens
catgtttaaaatgtt

SEQ ID NO: 8038 - DNA, 15 bp, Homo sapiens
tcatgtttaaaatgt

SEQ ID NO: 8039 - DNA, 15 bp, Homo sapiens
ttcatgtttaaaatg

SEQ ID NO: 8040 - DNA, 15 bp, Homo sapiens
tttcatgtttaaaat

SEQ ID NO: 8041 - DNA, 15 bp, Homo sapiens
atttcatgtttaaaa

SEQ ID NO: 8042 - DNA, 15 bp, Homo sapiens
tatttcatgtttaaa

SEQ ID NO: 8043 - DNA, 15 bp, Homo sapiens
ttatttcatgtttaa

SEQ ID NO: 8044 - DNA, 15 bp, Homo sapiens
attatttcatgttta

SEQ ID NO: 8045 - DNA, 15 bp, Homo sapiens
tattatttcatgttt

SEQ ID NO: 8046 - DNA, 15 bp, Homo sapiens
ttattatttcatgtt

SEQ ID NO: 8047 - DNA, 15 bp, Homo sapiens
tttattatttcatgt

SEQ ID NO: 8048 - DNA, 15 bp, Homo sapiens
ttttattatttcatg

SEQ ID NO: 8049 - DNA, 15 bp, Homo sapiens
attttattatttcat

SEQ ID NO: 8050 - DNA, 15 bp, Homo sapiens
cattttattatttca

SEQ ID NO: 8051 - DNA, 15 bp, Homo sapiens
ccattttattatttc

SEQ ID NO: 8052 - DNA, 15 bp, Homo sapiens
accattttattattt

SEQ ID NO: 8053 - DNA, 15 bp, Homo sapiens
aaccattttattatt

SEQ ID NO: 8054 - DNA, 15 bp, Homo sapiens
aaaccattttattat

SEQ ID NO: 8055 - DNA, 15 bp, Homo sapiens
caaaccattttatta

SEQ ID NO: 8056 - DNA, 15 bp, Homo sapiens
ccaaaccattttatt

SEQ ID NO: 8057 - DNA, 15 bp, Homo sapiens
cccaaaccattttat

SEQ ID NO: 8058 - DNA, 15 bp, Homo sapiens
tcccaaaccatttta

SEQ ID NO: 8059 - DNA, 15 bp, Homo sapiens
atcccaaaccatttt

SEQ ID NO: 8060 - DNA, 15 bp, Homo sapiens
catcccaaaccattt

SEQ ID NO: 8061 - DNA, 15 bp, Homo sapiens
gcatcccaaaccatt

SEQ ID NO: 8062 - DNA, 15 bp, Homo sapiens
tgcatcccaaaccat

SEQ ID NO: 8063 - DNA, 15 bp, Homo sapiens
atgcatcccaaacca

SEQ ID NO: 8064 - DNA, 15 bp, Homo sapiens
tatgcatcccaaacc

SEQ ID NO: 8065 - DNA, 15 bp, Homo sapiens
atatgcatcccaaac

SEQ ID NO: 8066 - DNA, 15 bp, Homo sapiens
tatatgcatcccaaa

SEQ ID NO: 8067 - DNA, 15 bp, Homo sapiens
gtatatgcatcccaa

SEQ ID NO: 8068 - DNA, 15 bp, Homo sapiens
tgtatatgcatccca

SEQ ID NO: 8069 - DNA, 15 bp, Homo sapiens
ttgtatatgcatccc

SEQ ID NO: 8070 - DNA, 15 bp, Homo sapiens
attgtatatgcatcc

SEQ ID NO: 8071 - DNA, 15 bp, Homo sapiens
gattgtatatgcatc

SEQ ID NO: 8072 - DNA, 15 bp, Homo sapiens
cgattgtatatgcat

SEQ ID NO: 8073 - DNA, 15 bp, Homo sapiens
tcgattgtatatgca

SEQ ID NO: 8074 - DNA, 15 bp, Homo sapiens
ttcgattgtatatgc

SEQ ID NO: 8075 - DNA, 15 bp, Homo sapiens
cttcgattgtatatg

SEQ ID NO: 8076 - DNA, 15 bp, Homo sapiens
tcttcgattgtatat

SEQ ID NO: 8077 - DNA, 15 bp, Homo sapiens
ttcttcgattgtata

SEQ ID NO: 8078 - DNA, 15 bp, Homo sapiens
attcttcgattgtat

SEQ ID NO: 8079 - DNA, 15 bp, Homo sapiens
tattcttcgattgta

SEQ ID NO: 8080 - DNA, 15 bp, Homo sapiens
atattcttcgattgt

SEQ ID NO: 8081 - DNA, 15 bp, Homo sapiens
gatattcttcgattg

SEQ ID NO: 8082 - DNA, 15 bp, Homo sapiens
ggatattcttcgatt

SEQ ID NO: 8083 - DNA, 15 bp, Homo sapiens
aggatattcttcgat

SEQ ID NO: 8084 - DNA, 15 bp, Homo sapiens
gaggatattcttcga

SEQ ID NO: 8085 - DNA, 15 bp, Homo sapiens
tgaggatattcttcg

SEQ ID NO: 8086 - DNA, 15 bp, Homo sapiens
gtgaggatattcttc

SEQ ID NO: 8087 - DNA, 15 bp, Homo sapiens
agtgaggatattctt

SEQ ID NO: 8088 - DNA, 15 bp, Homo sapiens
cagtgaggatattct

SEQ ID NO: 8089 - DNA, 15 bp, Homo sapiens
gcagtgaggatattc

SEQ ID NO: 8090 - DNA, 15 bp, Homo sapiens
agcagtgaggatatt

SEQ ID NO: 8091 - DNA, 15 bp, Homo sapiens
tagcagtgaggatat

SEQ ID NO: 8092 - DNA, 15 bp, Homo sapiens
atagcagtgaggata

SEQ ID NO: 8093 - DNA, 15 bp, Homo sapiens
aatagcagtgaggat

SEQ ID NO: 8094 - DNA, 15 bp, Homo sapiens
aaatagcagtgagga

SEQ ID NO: 8095 - DNA, 15 bp, Homo sapiens
gaaatagcagtgagg

SEQ ID NO: 8096 - DNA, 15 bp, Homo sapiens
tgaaatagcagtgag

SEQ ID NO: 8097 - DNA, 15 bp, Homo sapiens
atgaaatagcagtga

SEQ ID NO: 8098 - DNA, 15 bp, Homo sapiens
aatgaaatagcagtg

SEQ ID NO: 8099 - DNA, 15 bp, Homo sapiens
gaatgaaatagcagt

SEQ ID NO: 8100 - DNA, 15 bp, Homo sapiens
tgaatgaaatagcag

SEQ ID NO: 8101 - DNA, 15 bp, Homo sapiens
ttgaatgaaatagca

SEQ ID NO: 8102 - DNA, 15 bp, Homo sapiens
attgaatgaaatagc

SEQ ID NO: 8103 - DNA, 15 bp, Homo sapiens
tattgaatgaaatag

SEQ ID NO: 8104 - DNA, 15 bp, Homo sapiens
ttattgaatgaaata

SEQ ID NO: 8105 - DNA, 15 bp, Homo sapiens
attattgaatgaaat

SEQ ID NO: 8106 - DNA, 15 bp, Homo sapiens
aattattgaatgaaa

SEQ ID NO: 8107 - DNA, 15 bp, Homo sapiens
taattattgaatgaa

SEQ ID NO: 8108 - DNA, 15 bp, Homo sapiens
ttaattattgaatga

SEQ ID NO: 8109 - DNA, 15 bp, Homo sapiens
gttaattattgaatg

SEQ ID NO: 8110 - DNA, 15 bp, Homo sapiens
tgttaattattgaat

SEQ ID NO: 8111 - DNA, 15 bp, Homo sapiens
atgttaattattgaa

SEQ ID NO: 8112 - DNA, 15 bp, Homo sapiens
tatgttaattattga

SEQ ID NO: 8113 - DNA, 15 bp, Homo sapiens
gtatgttaattattg

SEQ ID NO: 8114 - DNA, 15 bp, Homo sapiens
tgtatgttaattatt

SEQ ID NO: 8115 - DNA, 15 bp, Homo sapiens
atgtatgttaattat

SEQ ID NO: 8116 - DNA, 15 bp, Homo sapiens
aatgtatgttaatta

SEQ ID NO: 8117 - DNA, 15 bp, Homo sapiens
taatgtatgttaatt

SEQ ID NO: 8118 - DNA, 15 bp, Homo sapiens
ttaatgtatgttaat

SEQ ID NO: 8119 - DNA, 15 bp, Homo sapiens
tttaatgtatgttaa

SEQ ID NO: 8120 - DNA, 15 bp, Homo sapiens
ctttaatgtatgtta

SEQ ID NO: 8121 - DNA, 15 bp, Homo sapiens
gctttaatgtatgtt

SEQ ID NO: 8122 - DNA, 15 bp, Homo sapiens
agctttaatgtatgt

SEQ ID NO: 8123 - DNA, 15 bp, Homo sapiens
tagctttaatgtatg

SEQ ID NO: 8124 - DNA, 15 bp, Homo sapiens
ctagctttaatgtat

SEQ ID NO: 8125 - DNA, 15 bp, Homo sapiens
actagctttaatgta

SEQ ID NO: 8126 - DNA, 15 bp, Homo sapiens
tactagctttaatgt

SEQ ID NO: 8127 - DNA, 15 bp, Homo sapiens
ttactagctttaatg

SEQ ID NO: 8128 - DNA, 15 bp, Homo sapiens
gttactagctttaat

SEQ ID NO: 8129 - DNA, 15 bp, Homo sapiens
tgttactagctttaa

SEQ ID NO: 8130 - DNA, 15 bp, Homo sapiens
gtgttactagcttta

SEQ ID NO: 8131 - DNA, 15 bp, Homo sapiens
tgtgttactagcttt

SEQ ID NO: 8132 - DNA, 15 bp, Homo sapiens
ctgtgttactagctt

SEQ ID NO: 8133 - DNA, 15 bp, Homo sapiens
tctgtgttactagct

SEQ ID NO: 8134 - DNA, 15 bp, Homo sapiens
ttctgtgttactagc

SEQ ID NO: 8135 - DNA, 15 bp, Homo sapiens
attctgtgttactag

SEQ ID NO: 8136 - DNA, 15 bp, Homo sapiens
tattctgtgttacta

SEQ ID NO: 8137 - DNA, 15 bp, Homo sapiens
ttattctgtgttact

SEQ ID NO: 8138 - DNA, 15 bp, Homo sapiens
cttattctgtgttac

SEQ ID NO: 8139 - DNA, 15 bp, Homo sapiens
acttattctgtgtta

SEQ ID NO: 8140 - DNA, 15 bp, Homo sapiens
gacttattctgtgtt

SEQ ID NO: 8141 - DNA, 15 bp, Homo sapiens
tgacttattctgtgt

SEQ ID NO: 8142 - DNA, 15 bp, Homo sapiens
atgacttattctgtg

SEQ ID NO: 8143 - DNA, 15 bp, Homo sapiens
gatgacttattctgt

SEQ ID NO: 8144 - DNA, 15 bp, Homo sapiens
ggatgacttattctg

SEQ ID NO: 8145 - DNA, 15 bp, Homo sapiens
aggatgacttattct

SEQ ID NO: 8146 - DNA, 15 bp, Homo sapiens
aaggatgacttattc

SEQ ID NO: 8147 - DNA, 15 bp, Homo sapiens
aaaggatgacttatt

SEQ ID NO: 8148 - DNA, 15 bp, Homo sapiens
aaaaggatgacttat

SEQ ID NO: 8149 - DNA, 15 bp, Homo sapiens
gaaaaggatgactta

SEQ ID NO: 8150 - DNA, 15 bp, Homo sapiens
agaaaaggatgactt

SEQ ID NO: 8151 - DNA, 15 bp, Homo sapiens
cagaaaaggatgact

SEQ ID NO: 8152 - DNA, 15 bp, Homo sapiens
acagaaaaggatgac

SEQ ID NO: 8153 - DNA, 15 bp, Homo sapiens
aacagaaaaggatga

SEQ ID NO: 8154 - DNA, 15 bp, Homo sapiens
caacagaaaaggatg

SEQ ID NO: 8155 - DNA, 15 bp, Homo sapiens
gcaacagaaaaggat

SEQ ID NO: 8156 - DNA, 15 bp, Homo sapiens
agcaacagaaaagga

SEQ ID NO: 8157 - DNA, 15 bp, Homo sapiens
cagcaacagaaaagg

SEQ ID NO: 8158 - DNA, 15 bp, Homo sapiens
acagcaacagaaaag

SEQ ID NO: 8159 - DNA, 15 bp, Homo sapiens
gacagcaacagaaaa

SEQ ID NO: 8160 - DNA, 15 bp, Homo sapiens
tgacagcaacagaaa

SEQ ID NO: 8161 - DNA, 15 bp, Homo sapiens
ctgacagcaacagaa

SEQ ID NO: 8162 - DNA, 15 bp, Homo sapiens
actgacagcaacaga

SEQ ID NO: 8163 - DNA, 15 bp, Homo sapiens
cactgacagcaacag

SEQ ID NO: 8164 - DNA, 15 bp, Homo sapiens
acactgacagcaaca

SEQ ID NO: 8165 - DNA, 15 bp, Homo sapiens
aacactgacagcaac

SEQ ID NO: 8166 - DNA, 15 bp, Homo sapiens
caacactgacagcaa

SEQ ID NO: 8167 - DNA, 15 bp, Homo sapiens
acaacactgacagca

SEQ ID NO: 8168 - DNA, 15 bp, Homo sapiens
aacaacactgacagc

SEQ ID NO: 8169 - DNA, 15 bp, Homo sapiens
caacaacactgacag

SEQ ID NO: 8170 - DNA, 15 bp, Homo sapiens
acaacaacactgaca

SEQ ID NO: 8171 - DNA, 15 bp, Homo sapiens
cacaacaacactgac

SEQ ID NO: 8172 - DNA, 15 bp, Homo sapiens
ccacaacaacactga

SEQ ID NO: 8173 - DNA, 15 bp, Homo sapiens
accacaacaacactg

SEQ ID NO: 8174 - DNA, 15 bp, Homo sapiens
aaccacaacaacact

SEQ ID NO: 8175 - DNA, 15 bp, Homo sapiens
aaaccacaacaacac

SEQ ID NO: 8176 - DNA, 15 bp, Homo sapiens
aaaaccacaacaaca

SEQ ID NO: 8177 - DNA, 15 bp, Homo sapiens
taaaaccacaacaac

SEQ ID NO: 8178 - DNA, 15 bp, Homo sapiens
ataaaaccacaacaa

SEQ ID NO: 8179 - DNA, 15 bp, Homo sapiens
gataaaaccacaaca

SEQ ID NO: 8180 - DNA, 15 bp, Homo sapiens
ggataaaaccacaac

SEQ ID NO: 8181 - DNA, 15 bp, Homo sapiens
gggataaaaccacaa

SEQ ID NO: 8182 - DNA, 15 bp, Homo sapiens
tgggataaaaccaca

SEQ ID NO: 8183 - DNA, 15 bp, Homo sapiens
ctgggataaaaccac

SEQ ID NO: 8184 - DNA, 15 bp, Homo sapiens
tctgggataaaacca

SEQ ID NO: 8185 - DNA, 15 bp, Homo sapiens
ctctgggataaaacc

SEQ ID NO: 8186 - DNA, 15 bp, Homo sapiens
gctctgggataaaac

SEQ ID NO: 8187 - DNA, 15 bp, Homo sapiens
ggctctgggataaaa

SEQ ID NO: 8188 - DNA, 15 bp, Homo sapiens
gggctctgggataaa

SEQ ID NO: 8189 - DNA, 15 bp, Homo sapiens
agggctctgggataa

SEQ ID NO: 8190 - DNA, 15 bp, Homo sapiens
cagggctctgggata

SEQ ID NO: 8191 - DNA, 15 bp, Homo sapiens
acagggctctgggat

SEQ ID NO: 8192 - DNA, 15 bp, Homo sapiens
tacagggctctggga

SEQ ID NO: 8193 - DNA, 15 bp, Homo sapiens
ctacagggctctggg

SEQ ID NO: 8194 - DNA, 15 bp, Homo sapiens
tctacagggctctgg

SEQ ID NO: 8195 - DNA, 15 bp, Homo sapiens
ttctacagggctctg

SEQ ID NO: 8196 - DNA, 15 bp, Homo sapiens
tttctacagggctct

SEQ ID NO: 8197 - DNA, 15 bp, Homo sapiens
ctttctacagggctc

SEQ ID NO: 8198 - DNA, 15 bp, Homo sapiens
tctttctacagggct

SEQ ID NO: 8199 - DNA, 15 bp, Homo sapiens
ctctttctacagggc

SEQ ID NO: 8200 - DNA, 15 bp, Homo sapiens
actctttctacaggg

SEQ ID NO: 8201 - DNA, 15 bp, Homo sapiens
tactctttctacagg

SEQ ID NO: 8202 - DNA, 15 bp, Homo sapiens
ctactctttctacag

SEQ ID NO: 8203 - DNA, 15 bp, Homo sapiens
tctactctttctaca

SEQ ID NO: 8204 - DNA, 15 bp, Homo sapiens
gtctactctttctac

SEQ ID NO: 8205 - DNA, 15 bp, Homo sapiens
ggtctactctttcta

SEQ ID NO: 8206 - DNA, 15 bp, Homo sapiens
aggtctactctttct

SEQ ID NO: 8207 - DNA, 15 bp, Homo sapiens
gaggtctactctttc

SEQ ID NO: 8208 - DNA, 15 bp, Homo sapiens
tgaggtctactcttt

SEQ ID NO: 8209 - DNA, 15 bp, Homo sapiens
ctgaggtctactctt

SEQ ID NO: 8210 - DNA, 15 bp, Homo sapiens
cctgaggtctactct

SEQ ID NO: 8211 - DNA, 15 bp, Homo sapiens
ccctgaggtctactc

SEQ ID NO: 8212 - DNA, 15 bp, Homo sapiens
gccctgaggtctact

SEQ ID NO: 8213 - DNA, 15 bp, Homo sapiens
agccctgaggtctac

SEQ ID NO: 8214 - DNA, 15 bp, Homo sapiens
tagccctgaggtcta

SEQ ID NO: 8215 - DNA, 15 bp, Homo sapiens
ttagccctgaggtct

SEQ ID NO: 8216 - DNA, 15 bp, Homo sapiens
cttagccctgaggtc

SEQ ID NO: 8217 - DNA, 15 bp, Homo sapiens
ccttagccctgaggt

SEQ ID NO: 8218 - DNA, 15 bp, Homo sapiens
tccttagccctgagg

SEQ ID NO: 8219 - DNA, 15 bp, Homo sapiens
gtccttagccctgag

SEQ ID NO: 8220 - DNA, 15 bp, Homo sapiens
tgtccttagccctga

SEQ ID NO: 8221 - DNA, 15 bp, Homo sapiens
ctgtccttagccctg

SEQ ID NO: 8222 - DNA, 15 bp, Homo sapiens
actgtccttagccct

SEQ ID NO: 8223 - DNA, 15 bp, Homo sapiens
cactgtccttagccc

SEQ ID NO: 8224 - DNA, 15 bp, Homo sapiens
acactgtccttagcc

SEQ ID NO: 8225 - DNA, 15 bp, Homo sapiens
cacactgtccttagc

SEQ ID NO: 8226 - DNA, 15 bp, Homo sapiens
acacactgtccttag

SEQ ID NO: 8227 - DNA, 15 bp, Homo sapiens
gacacactgtcctta

SEQ ID NO: 8228 - DNA, 15 bp, Homo sapiens
tgacacactgtcctt

SEQ ID NO: 8229 - DNA, 15 bp, Homo sapiens
ctgacacactgtcct

SEQ ID NO: 8230 - DNA, 15 bp, Homo sapiens
gctgacacactgtcc

SEQ ID NO: 8231 - DNA, 15 bp, Homo sapiens
agctgacacactgtc

SEQ ID NO: 8232 - DNA, 15 bp, Homo sapiens
cagctgacacactgt

SEQ ID NO: 8233 - DNA, 15 bp, Homo sapiens
ccagctgacacactg

SEQ ID NO: 8234 - DNA, 15 bp, Homo sapiens
gccagctgacacact

SEQ ID NO: 8235 - DNA, 15 bp, Homo sapiens
agccagctgacacac

SEQ ID NO: 8236 - DNA, 15 bp, Homo sapiens
gagccagctgacaca

SEQ ID NO: 8237 - DNA, 15 bp, Homo sapiens
ggagccagctgacac

SEQ ID NO: 8238 - DNA, 15 bp, Homo sapiens
tggagccagctgaca

SEQ ID NO: 8239 - DNA, 15 bp, Homo sapiens
atggagccagctgac

SEQ ID NO: 8240 - DNA, 15 bp, Homo sapiens
catggagccagctga

SEQ ID NO: 8241 - DNA, 15 bp, Homo sapiens
acatggagccagctg

SEQ ID NO: 8242 - DNA, 15 bp, Homo sapiens
cacatggagccagct

SEQ ID NO: 8243 - DNA, 15 bp, Homo sapiens
ccacatggagccagc

SEQ ID NO: 8244 - DNA, 15 bp, Homo sapiens
tccacatggagccag

SEQ ID NO: 8245 - DNA, 15 bp, Homo sapiens
ctccacatggagcca

SEQ ID NO: 8246 - DNA, 15 bp, Homo sapiens
actccacatggagcc

SEQ ID NO: 8247 - DNA, 15 bp, Homo sapiens
aactccacatggagc

SEQ ID NO: 8248 - DNA, 15 bp, Homo sapiens
gaactccacatggag

SEQ ID NO: 8249 - DNA, 15 bp, Homo sapiens
agaactccacatgga

SEQ ID NO: 8250 - DNA, 15 bp, Homo sapiens
aagaactccacatgg

SEQ ID NO: 8251 - DNA, 15 bp, Homo sapiens
caagaactccacatg

SEQ ID NO: 8252 - DNA, 15 bp, Homo sapiens
tcaagaactccacat

SEQ ID NO: 8253 - DNA, 15 bp, Homo sapiens
gtcaagaactccaca

SEQ ID NO: 8254 - DNA, 15 bp, Homo sapiens
tgtcaagaactccac

SEQ ID NO: 8255 - DNA, 15 bp, Homo sapiens
ctgtcaagaactcca

SEQ ID NO: 8256 - DNA, 15 bp, Homo sapiens
actgtcaagaactcc

SEQ ID NO: 8257 - DNA, 15 bp, Homo sapiens
aactgtcaagaactc

SEQ ID NO: 8258 - DNA, 15 bp, Homo sapiens
aaactgtcaagaact

SEQ ID NO: 8259 - DNA, 15 bp, Homo sapiens
caaactgtcaagaac

SEQ ID NO: 8260 - DNA, 15 bp, Homo sapiens
ccaaactgtcaagaa

SEQ ID NO: 8261 - DNA, 15 bp, Homo sapiens
cccaaactgtcaaga

SEQ ID NO: 8262 - DNA, 15 bp, Homo sapiens
tcccaaactgtcaag

SEQ ID NO: 8263 - DNA, 15 bp, Homo sapiens
atcccaaactgtcaa

SEQ ID NO: 8264 - DNA, 15 bp, Homo sapiens
aatcccaaactgtca

SEQ ID NO: 8265 - DNA, 15 bp, Homo sapiens
taatcccaaactgtc

SEQ ID NO: 8266 - DNA, 15 bp, Homo sapiens
ataatcccaaactgt

SEQ ID NO: 8267 - DNA, 15 bp, Homo sapiens
tataatcccaaactg

SEQ ID NO: 8268 - DNA, 15 bp, Homo sapiens
ctataatcccaaact

SEQ ID NO: 8269 - DNA, 15 bp, Homo sapiens
tctataatcccaaac

SEQ ID NO: 8270 - DNA, 15 bp, Homo sapiens
gtctataatcccaaa

SEQ ID NO: 8271 - DNA, 15 bp, Homo sapiens
agtctataatcccaa

SEQ ID NO: 8272 - DNA, 15 bp, Homo sapiens
gagtctataatccca

SEQ ID NO: 8273 - DNA, 15 bp, Homo sapiens
agagtctataatccc

SEQ ID NO: 8274 - DNA, 15 bp, Homo sapiens
gagagtctataatcc

SEQ ID NO: 8275 - DNA, 15 bp, Homo sapiens
tgagagtctataatc

SEQ ID NO: 8276 - DNA, 15 bp, Homo sapiens
ctgagagtctataat

SEQ ID NO: 8277 - DNA, 15 bp, Homo sapiens
gctgagagtctataa

SEQ ID NO: 8278 - DNA, 15 bp, Homo sapiens
agctgagagtctata

SEQ ID NO: 8279 - DNA, 15 bp, Homo sapiens
cagctgagagtctat

SEQ ID NO: 8280 - DNA, 15 bp, Homo sapiens
ccagctgagagtcta

SEQ ID NO: 8281 - DNA, 15 bp, Homo sapiens
cccagctgagagtct

SEQ ID NO: 8282 - DNA, 15 bp, Homo sapiens
tcccagctgagagtc

SEQ ID NO: 8283 - DNA, 15 bp, Homo sapiens
ttcccagctgagagt

SEQ ID NO: 8284 - DNA, 15 bp, Homo sapiens
tttcccagctgagag

SEQ ID NO: 8285 - DNA, 15 bp, Homo sapiens
ctttcccagctgaga

SEQ ID NO: 8286 - DNA, 15 bp, Homo sapiens
tctttcccagctgag

SEQ ID NO: 8287 - DNA, 15 bp, Homo sapiens
ttctttcccagctga

SEQ ID NO: 8288 - DNA, 15 bp, Homo sapiens
gttctttcccagctg

SEQ ID NO: 8289 - DNA, 15 bp, Homo sapiens
agttctttcccagct

SEQ ID NO: 8290 - DNA, 15 bp, Homo sapiens
cagttctttcccagc

SEQ ID NO: 8291 - DNA, 15 bp, Homo sapiens
acagttctttcccag

SEQ ID NO: 8292 - DNA, 15 bp, Homo sapiens
aacagttctttccca

SEQ ID NO: 8293 - DNA, 15 bp, Homo sapiens
aaacagttctttccc

SEQ ID NO: 8294 - DNA, 15 bp, Homo sapiens
caaacagttctttcc

SEQ ID NO: 8295 - DNA, 15 bp, Homo sapiens
tcaaacagttctttc

SEQ ID NO: 8296 - DNA, 15 bp, Homo sapiens
atcaaacagttcttt

SEQ ID NO: 8297 - DNA, 15 bp, Homo sapiens
catcaaacagttctt

SEQ ID NO: 8298 - DNA, 15 bp, Homo sapiens
tcatcaaacagttct

SEQ ID NO: 8299 - DNA, 15 bp, Homo sapiens
ttcatcaaacagttc

SEQ ID NO: 8300 - DNA, 15 bp, Homo sapiens
attcatcaaacagtt

SEQ ID NO: 8301 - DNA, 15 bp, Homo sapiens
cattcatcaaacagt

SEQ ID NO: 8302 - DNA, 15 bp, Homo sapiens
tcattcatcaaacag

SEQ ID NO: 8303 - DNA, 15 bp, Homo sapiens
ttcattcatcaaaca

SEQ ID NO: 8304 - DNA, 15 bp, Homo sapiens
tttcattcatcaaac

SEQ ID NO: 8305 - DNA, 15 bp, Homo sapiens
atttcattcatcaaa

SEQ ID NO: 8306 - DNA, 15 bp, Homo sapiens
tatttcattcatcaa

SEQ ID NO: 8307 - DNA, 15 bp, Homo sapiens
ctatttcattcatca

SEQ ID NO: 8308 - DNA, 15 bp, Homo sapiens
actatttcattcatc

SEQ ID NO: 8309 - DNA, 15 bp, Homo sapiens
aactatttcattcat

SEQ ID NO: 8310 - DNA, 15 bp, Homo sapiens
caactatttcattca

SEQ ID NO: 8311 - DNA, 15 bp, Homo sapiens
ccaactatttcattc

SEQ ID NO: 8312 - DNA, 15 bp, Homo sapiens
cccaactatttcatt

SEQ ID NO: 8313 - DNA, 15 bp, Homo sapiens
gcccaactatttcat

SEQ ID NO: 8314 - DNA, 15 bp, Homo sapiens
tgcccaactatttca

SEQ ID NO: 8315 - DNA, 15 bp, Homo sapiens
ttgcccaactatttc

SEQ ID NO: 8316 - DNA, 15 bp, Homo sapiens
cttgcccaactattt

SEQ ID NO: 8317 - DNA, 15 bp, Homo sapiens
gcttgcccaactatt

SEQ ID NO: 8318 - DNA, 15 bp, Homo sapiens
agcttgcccaactat

SEQ ID NO: 8319 - DNA, 15 bp, Homo sapiens
aagcttgcccaacta

SEQ ID NO: 8320 - DNA, 15 bp, Homo sapiens
gaagcttgcccaact

SEQ ID NO: 8321 - DNA, 15 bp, Homo sapiens
tgaagcttgcccaac

SEQ ID NO: 8322 - DNA, 15 bp, Homo sapiens
gtgaagcttgcccaa

SEQ ID NO: 8323 - DNA, 15 bp, Homo sapiens
tgtgaagcttgccca

SEQ ID NO: 8324 - DNA, 15 bp, Homo sapiens
atgtgaagcttgccc

SEQ ID NO: 8325 - DNA, 15 bp, Homo sapiens
aatgtgaagcttgcc

SEQ ID NO: 8326 - DNA, 15 bp, Homo sapiens
aaatgtgaagcttgc

SEQ ID NO: 8327 - DNA, 15 bp, Homo sapiens
aaaatgtgaagcttg

SEQ ID NO: 8328 - DNA, 15 bp, Homo sapiens
aaaaatgtgaagctt

SEQ ID NO: 8329 - DNA, 15 bp, Homo sapiens
caaaaatgtgaagct

SEQ ID NO: 8330 - DNA, 15 bp, Homo sapiens
ccaaaaatgtgaagc

SEQ ID NO: 8331 - DNA, 15 bp, Homo sapiens
tccaaaaatgtgaag

SEQ ID NO: 8332 - DNA, 15 bp, Homo sapiens
atccaaaaatgtgaa

SEQ ID NO: 8333 - DNA, 15 bp, Homo sapiens
tatccaaaaatgtga

SEQ ID NO: 8334 - DNA, 15 bp, Homo sapiens
ttatccaaaaatgtg

SEQ ID NO: 8335 - DNA, 15 bp, Homo sapiens
attatccaaaaatgt

SEQ ID NO: 8336 - DNA, 15 bp, Homo sapiens
aattatccaaaaatg

SEQ ID NO: 8337 - DNA, 15 bp, Homo sapiens
gaattatccaaaaat

SEQ ID NO: 8338 - DNA, 15 bp, Homo sapiens
tgaattatccaaaaa

SEQ ID NO: 8339 - DNA, 15 bp, Homo sapiens
ttgaattatccaaaa

SEQ ID NO: 8340 - DNA, 15 bp, Homo sapiens
attgaattatccaaa

SEQ ID NO: 8341 - DNA, 15 bp, Homo sapiens
cattgaattatccaa

SEQ ID NO: 8342 - DNA, 15 bp, Homo sapiens
acattgaattatcca

SEQ ID NO: 8343 - DNA, 15 bp, Homo sapiens
cacattgaattatcc

SEQ ID NO: 8344 - DNA, 15 bp, Homo sapiens
acacattgaattatc

SEQ ID NO: 8345 - DNA, 15 bp, Homo sapiens
aacacattgaattat

SEQ ID NO: 8346 - DNA, 15 bp, Homo sapiens
gaacacattgaatta

SEQ ID NO: 8347 - DNA, 15 bp, Homo sapiens
agaacacattgaatt

SEQ ID NO: 8348 - DNA, 15 bp, Homo sapiens
aagaacacattgaat

SEQ ID NO: 8349 - DNA, 15 bp, Homo sapiens
gaagaacacattgaa

SEQ ID NO: 8350 - DNA, 15 bp, Homo sapiens
tgaagaacacattga

SEQ ID NO: 8351 - DNA, 15 bp, Homo sapiens
ttgaagaacacattg

SEQ ID NO: 8352 - DNA, 15 bp, Homo sapiens
cttgaagaacacatt

SEQ ID NO: 8353 - DNA, 15 bp, Homo sapiens
gcttgaagaacacat

SEQ ID NO: 8354 - DNA, 15 bp, Homo sapiens
cgcttgaagaacaca

SEQ ID NO: 8355 - DNA, 15 bp, Homo sapiens
tcgcttgaagaacac

SEQ ID NO: 8356 - DNA, 15 bp, Homo sapiens
gtcgcttgaagaaca

SEQ ID NO: 8357 - DNA, 15 bp, Homo sapiens
ggtcgcttgaagaac

SEQ ID NO: 8358 - DNA, 15 bp, Homo sapiens
aggtcgcttgaagaa

SEQ ID NO: 8359 - DNA, 15 bp, Homo sapiens
aaggtcgcttgaaga

SEQ ID NO: 8360 - DNA, 15 bp, Homo sapiens
caaggtcgcttgaag

SEQ ID NO: 8361 - DNA, 15 bp, Homo sapiens
ccaaggtcgcttgaa

SEQ ID NO: 8362 - DNA, 15 bp, Homo sapiens
cccaaggtcgcttga

SEQ ID NO: 8363 - DNA, 15 bp, Homo sapiens
gcccaaggtcgcttg

SEQ ID NO: 8364 - DNA, 15 bp, Homo sapiens
agcccaaggtcgctt

SEQ ID NO: 8365 - DNA, 15 bp, Homo sapiens
cagcccaaggtcgct

SEQ ID NO: 8366 - DNA, 15 bp, Homo sapiens
ccagcccaaggtcgc

SEQ ID NO: 8367 - DNA, 15 bp, Homo sapiens
tccagcccaaggtcg

SEQ ID NO: 8368 - DNA, 15 bp, Homo sapiens
ttccagcccaaggtc

SEQ ID NO: 8369 - DNA, 15 bp, Homo sapiens
cttccagcccaaggt

SEQ ID NO: 8370 - DNA, 15 bp, Homo sapiens
gcttccagcccaagg

SEQ ID NO: 8371 - DNA, 15 bp, Homo sapiens
ggcttccagcccaag

SEQ ID NO: 8372 - DNA, 15 bp, Homo sapiens
aggcttccagcccaa

SEQ ID NO: 8373 - DNA, 15 bp, Homo sapiens
caggcttccagccca

SEQ ID NO: 8374 - DNA, 15 bp, Homo sapiens
acaggcttccagccc

SEQ ID NO: 8375 - DNA, 15 bp, Homo sapiens
cacaggcttccagcc

SEQ ID NO: 8376 - DNA, 15 bp, Homo sapiens
acacaggcttccagc

SEQ ID NO: 8377 - DNA, 15 bp, Homo sapiens
cacacaggcttccag

SEQ ID NO: 8378 - DNA, 15 bp, Homo sapiens
acacacaggcttcca

SEQ ID NO: 8379 - DNA, 15 bp, Homo sapiens
tacacacaggcttcc

SEQ ID NO: 8380 - DNA, 15 bp, Homo sapiens
ttacacacaggcttc

SEQ ID NO: 8381 - DNA, 15 bp, Homo sapiens
gttacacacaggctt

SEQ ID NO: 8382 - DNA, 15 bp, Homo sapiens
tgttacacacaggct

SEQ ID NO: 8383 - DNA, 15 bp, Homo sapiens
ttgttacacacaggc

SEQ ID NO: 8384 - DNA, 15 bp, Homo sapiens
attgttacacacagg

SEQ ID NO: 8385 - DNA, 15 bp, Homo sapiens
aattgttacacacag

SEQ ID NO: 8386 - DNA, 15 bp, Homo sapiens
aaattgttacacaca

SEQ ID NO: 8387 - DNA, 15 bp, Homo sapiens
aaaattgttacacac

SEQ ID NO: 8388 - DNA, 15 bp, Homo sapiens
taaaattgttacaca

SEQ ID NO: 8389 - DNA, 15 bp, Homo sapiens
ataaaattgttacac

SEQ ID NO: 8390 - DNA, 15 bp, Homo sapiens
gataaaattgttaca

SEQ ID NO: 8391 - DNA, 15 bp, Homo sapiens
tgataaaattgttac

SEQ ID NO: 8392 - DNA, 15 bp, Homo sapiens
atgataaaattgtta

SEQ ID NO: 8393 - DNA, 15 bp, Homo sapiens
aatgataaaattgtt

SEQ ID NO: 8394 - DNA, 15 bp, Homo sapiens
aaatgataaaattgt

SEQ ID NO: 8395 - DNA, 15 bp, Homo sapiens
gaaatgataaaattg

SEQ ID NO: 8396 - DNA, 15 bp, Homo sapiens
agaaatgataaaatt

SEQ ID NO: 8397 - DNA, 15 bp, Homo sapiens
aagaaatgataaaat

SEQ ID NO: 8398 - DNA, 15 bp, Homo sapiens
gaagaaatgataaaa

SEQ ID NO: 8399 - DNA, 15 bp, Homo sapiens
ggaagaaatgataaa

SEQ ID NO: 8400 - DNA, 15 bp, Homo sapiens
aggaagaaatgataa

SEQ ID NO: 8401 - DNA, 15 bp, Homo sapiens
aaggaagaaatgata

SEQ ID NO: 8402 - DNA, 15 bp, Homo sapiens
aaaggaagaaatgat

SEQ ID NO: 8403 - DNA, 15 bp, Homo sapiens
caaaggaagaaatga

SEQ ID NO: 8404 - DNA, 15 bp, Homo sapiens
gcaaaggaagaaatg

SEQ ID NO: 8405 - DNA, 15 bp, Homo sapiens
tgcaaaggaagaaat

SEQ ID NO: 8406 - DNA, 15 bp, Homo sapiens
atgcaaaggaagaaa

SEQ ID NO: 8407 - DNA, 15 bp, Homo sapiens
aatgcaaaggaagaa

SEQ ID NO: 8408 - DNA, 15 bp, Homo sapiens
aaatgcaaaggaaga

SEQ ID NO: 8409 - DNA, 15 bp, Homo sapiens
aaaatgcaaaggaag

SEQ ID NO: 8410 - DNA, 15 bp, Homo sapiens
gaaaatgcaaaggaa

SEQ ID NO: 8411 - DNA, 15 bp, Homo sapiens
agaaaatgcaaagga

SEQ ID NO: 8412 - DNA, 15 bp, Homo sapiens
gagaaaatgcaaagg

SEQ ID NO: 8413 - DNA, 15 bp, Homo sapiens
agagaaaatgcaaag

SEQ ID NO: 8414 - DNA, 15 bp, Homo sapiens
aagagaaaatgcaaa

SEQ ID NO: 8415 - DNA, 15 bp, Homo sapiens
gaagagaaaatgcaa

SEQ ID NO: 8416 - DNA, 15 bp, Homo sapiens
agaagagaaaatgca

SEQ ID NO: 8417 - DNA, 15 bp, Homo sapiens
aagaagagaaaatgc

SEQ ID NO: 8418 - DNA, 15 bp, Homo sapiens
caagaagagaaaatg

SEQ ID NO: 8419 - DNA, 15 bp, Homo sapiens
acaagaagagaaaat

SEQ ID NO: 8420 - DNA, 15 bp, Homo sapiens
gacaagaagagaaaa

SEQ ID NO: 8421 - DNA, 15 bp, Homo sapiens
agacaagaagagaaa

SEQ ID NO: 8422 - DNA, 15 bp, Homo sapiens
tagacaagaagagaa

SEQ ID NO: 8423 - DNA, 15 bp, Homo sapiens
ttagacaagaagaga

SEQ ID NO: 8424 - DNA, 15 bp, Homo sapiens
attagacaagaagag

SEQ ID NO: 8425 - DNA, 15 bp, Homo sapiens
gattagacaagaaga

SEQ ID NO: 8426 - DNA, 15 bp, Homo sapiens
agattagacaagaag

SEQ ID NO: 8427 - DNA, 15 bp, Homo sapiens
aagattagacaagaa

SEQ ID NO: 8428 - DNA, 15 bp, Homo sapiens
taagattagacaaga

SEQ ID NO: 8429 - DNA, 15 bp, Homo sapiens
ctaagattagacaag

SEQ ID NO: 8430 - DNA, 15 bp, Homo sapiens
cctaagattagacaa

SEQ ID NO: 8431 - DNA, 15 bp, Homo sapiens
tcctaagattagaca

SEQ ID NO: 8432 - DNA, 15 bp, Homo sapiens
atcctaagattagac

SEQ ID NO: 8433 - DNA, 15 bp, Homo sapiens
gatcctaagattaga

SEQ ID NO: 8434 - DNA, 15 bp, Homo sapiens
agatcctaagattag

SEQ ID NO: 8435 - DNA, 15 bp, Homo sapiens
tagatcctaagatta

SEQ ID NO: 8436 - DNA, 15 bp, Homo sapiens
ttagatcctaagatt

SEQ ID NO: 8437 - DNA, 15 bp, Homo sapiens
attagatcctaagat

SEQ ID NO: 8438 - DNA, 15 bp, Homo sapiens
aattagatcctaaga

SEQ ID NO: 8439 - DNA, 15 bp, Homo sapiens
caattagatcctaag

SEQ ID NO: 8440 - DNA, 15 bp, Homo sapiens
acaattagatcctaa

SEQ ID NO: 8441 - DNA, 15 bp, Homo sapiens
aacaattagatccta

SEQ ID NO: 8442 - DNA, 15 bp, Homo sapiens
caacaattagatcct

SEQ ID NO: 8443 - DNA, 15 bp, Homo sapiens
tcaacaattagatcc

SEQ ID NO: 8444 - DNA, 15 bp, Homo sapiens
ctcaacaattagatc

SEQ ID NO: 8445 - DNA, 15 bp, Homo sapiens
cctcaacaattagat

SEQ ID NO: 8446 - DNA, 15 bp, Homo sapiens
ccctcaacaattaga

SEQ ID NO: 8447 - DNA, 15 bp, Homo sapiens
tccctcaacaattag

SEQ ID NO: 8448 - DNA, 15 bp, Homo sapiens
ttccctcaacaatta

SEQ ID NO: 8449 - DNA, 15 bp, Homo sapiens
gttccctcaacaatt

SEQ ID NO: 8450 - DNA, 15 bp, Homo sapiens
ggttccctcaacaat

SEQ ID NO: 8451 - DNA, 15 bp, Homo sapiens
aggttccctcaacaa

SEQ ID NO: 8452 - DNA, 15 bp, Homo sapiens
aaggttccctcaaca

SEQ ID NO: 8453 - DNA, 15 bp, Homo sapiens
taaggttccctcaac

SEQ ID NO: 8454 - DNA, 15 bp, Homo sapiens
ttaaggttccctcaa

SEQ ID NO: 8455 - DNA, 15 bp, Homo sapiens
tttaaggttccctca

SEQ ID NO: 8456 - DNA, 15 bp, Homo sapiens
gtttaaggttccctc

SEQ ID NO: 8457 - DNA, 15 bp, Homo sapiens
cgtttaaggttccct

SEQ ID NO: 8458 - DNA, 15 bp, Homo sapiens
gcgtttaaggttccc

SEQ ID NO: 8459 - DNA, 15 bp, Homo sapiens
ggcgtttaaggttcc

SEQ ID NO: 8460 - DNA, 15 bp, Homo sapiens
gggcgtttaaggttc

SEQ ID NO: 8461 - DNA, 15 bp, Homo sapiens
agggcgtttaaggtt

SEQ ID NO: 8462 - DNA, 15 bp, Homo sapiens
tagggcgtttaaggt

SEQ ID NO: 8463 - DNA, 15 bp, Homo sapiens
atagggcgtttaagg

SEQ ID NO: 8464 - DNA, 15 bp, Homo sapiens
tatagggcgtttaag

SEQ ID NO: 8465 - DNA, 15 bp, Homo sapiens
ttatagggcgtttaa

SEQ ID NO: 8466 - DNA, 15 bp, Homo sapiens
gttatagggcgttta

SEQ ID NO: 8467 - DNA, 15 bp, Homo sapiens
ggttatagggcgttt

SEQ ID NO: 8468 - DNA, 15 bp, Homo sapiens
gggttatagggcgtt

SEQ ID NO: 8469 - DNA, 15 bp, Homo sapiens
tgggttatagggcgt

SEQ ID NO: 8470 - DNA, 15 bp, Homo sapiens
ctgggttatagggcg

SEQ ID NO: 8471 - DNA, 15 bp, Homo sapiens
gctgggttatagggc

SEQ ID NO: 8472 - DNA, 15 bp, Homo sapiens
ggctgggttataggg

SEQ ID NO: 8473 - DNA, 15 bp, Homo sapiens
tggctgggttatagg

SEQ ID NO: 8474 - DNA, 15 bp, Homo sapiens
atggctgggttatag

SEQ ID NO: 8475 - DNA, 15 bp, Homo sapiens
aatggctgggttata

SEQ ID NO: 8476 - DNA, 15 bp, Homo sapiens
gaatggctgggttat

SEQ ID NO: 8477 - DNA, 15 bp, Homo sapiens
ggaatggctgggtta

SEQ ID NO: 8478 - DNA, 15 bp, Homo sapiens
aggaatggctgggtt

SEQ ID NO: 8479 - DNA, 15 bp, Homo sapiens
caggaatggctgggt

SEQ ID NO: 8480 - DNA, 15 bp, Homo sapiens
acaggaatggctggg

SEQ ID NO: 8481 - DNA, 15 bp, Homo sapiens
cacaggaatggctgg

SEQ ID NO: 8482 - DNA, 15 bp, Homo sapiens
tcacaggaatggctg

SEQ ID NO: 8483 - DNA, 15 bp, Homo sapiens
atcacaggaatggct

SEQ ID NO: 8484 - DNA, 15 bp, Homo sapiens
catcacaggaatggc

SEQ ID NO: 8485 - DNA, 15 bp, Homo sapiens
acatcacaggaatgg

SEQ ID NO: 8486 - DNA, 15 bp, Homo sapiens
cacatcacaggaatg

SEQ ID NO: 8487 - DNA, 15 bp, Homo sapiens
gcacatcacaggaat

SEQ ID NO: 8488 - DNA, 15 bp, Homo sapiens
agcacatcacaggaa

SEQ ID NO: 8489 - DNA, 15 bp, Homo sapiens
gagcacatcacagga

SEQ ID NO: 8490 - DNA, 15 bp, Homo sapiens
tgagcacatcacagg

SEQ ID NO: 8491 - DNA, 15 bp, Homo sapiens
gtgagcacatcacag

SEQ ID NO: 8492 - DNA, 15 bp, Homo sapiens
ggtgagcacatcaca

SEQ ID NO: 8493 - DNA, 15 bp, Homo sapiens
gggtgagcacatcac

SEQ ID NO: 8494 - DNA, 15 bp, Homo sapiens
tgggtgagcacatca

SEQ ID NO: 8495 - DNA, 15 bp, Homo sapiens
ctgggtgagcacatc

SEQ ID NO: 8496 - DNA, 15 bp, Homo sapiens
actgggtgagcacat

SEQ ID NO: 8497 - DNA, 15 bp, Homo sapiens
gactgggtgagcaca

SEQ ID NO: 8498 - DNA, 15 bp, Homo sapiens
agactgggtgagcac

SEQ ID NO: 8499 - DNA, 15 bp, Homo sapiens
gagactgggtgagca

SEQ ID NO: 8500 - DNA, 15 bp, Homo sapiens
agagactgggtgagc

SEQ ID NO: 8501 - DNA, 15 bp, Homo sapiens
cagagactgggtgag

SEQ ID NO: 8502 - DNA, 15 bp, Homo sapiens
acagagactgggtga

SEQ ID NO: 8503 - DNA, 15 bp, Homo sapiens
aacagagactgggtg

SEQ ID NO: 8504 - DNA, 15 bp, Homo sapiens
aaacagagactgggt

SEQ ID NO: 8505 - DNA, 15 bp, Homo sapiens
caaacagagactggg

SEQ ID NO: 8506 - DNA, 15 bp, Homo sapiens
gcaaacagagactgg

SEQ ID NO: 8507 - DNA, 15 bp, Homo sapiens
tgcaaacagagactg

SEQ ID NO: 8508 - DNA, 15 bp, Homo sapiens
gtgcaaacagagact

SEQ ID NO: 8509 - DNA, 15 bp, Homo sapiens
tgtgcaaacagagac

SEQ ID NO: 8510 - DNA, 15 bp, Homo sapiens
gtgtgcaaacagaga

SEQ ID NO: 8511 - DNA, 15 bp, Homo sapiens
ggtgtgcaaacagag

SEQ ID NO: 8512 - DNA, 15 bp, Homo sapiens
aggtgtgcaaacaga

SEQ ID NO: 8513 - DNA, 15 bp, Homo sapiens
gaggtgtgcaaacag

SEQ ID NO: 8514 - DNA, 15 bp, Homo sapiens
ggaggtgtgcaaaca

SEQ ID NO: 8515 - DNA, 15 bp, Homo sapiens
tggaggtgtgcaaac

SEQ ID NO: 8516 - DNA, 15 bp, Homo sapiens
ttggaggtgtgcaaa

SEQ ID NO: 8517 - DNA, 15 bp, Homo sapiens
attggaggtgtgcaa

SEQ ID NO: 8518 - DNA, 15 bp, Homo sapiens
cattggaggtgtgca

SEQ ID NO: 8519 - DNA, 15 bp, Homo sapiens
tcattggaggtgtgc

SEQ ID NO: 8520 - DNA, 15 bp, Homo sapiens
atcattggaggtgtg

SEQ ID NO: 8521 - DNA, 15 bp, Homo sapiens
catcattggaggtgt

SEQ ID NO: 8522 - DNA, 15 bp, Homo sapiens
ccatcattggaggtg

SEQ ID NO: 8523 - DNA, 15 bp, Homo sapiens
gccatcattggaggt

SEQ ID NO: 8524 - DNA, 15 bp, Homo sapiens
tgccatcattggagg

SEQ ID NO: 8525 - DNA, 15 bp, Homo sapiens
atgccatcattggag

SEQ ID NO: 8526 - DNA, 15 bp, Homo sapiens
gatgccatcattgga

SEQ ID NO: 8527 - DNA, 15 bp, Homo sapiens
agatgccatcattgg

SEQ ID NO: 8528 - DNA, 15 bp, Homo sapiens
gagatgccatcattg

SEQ ID NO: 8529 - DNA, 15 bp, Homo sapiens
tgagatgccatcatt

SEQ ID NO: 8530 - DNA, 15 bp, Homo sapiens
gtgagatgccatcat

SEQ ID NO: 8531 - DNA, 15 bp, Homo sapiens
agtgagatgccatca

SEQ ID NO: 8532 - DNA, 15 bp, Homo sapiens
cagtgagatgccatc

SEQ ID NO: 8533 - DNA, 15 bp, Homo sapiens
gcagtgagatgccat

SEQ ID NO: 8534 - DNA, 15 bp, Homo sapiens
agcagtgagatgcca

SEQ ID NO: 8535 - DNA, 15 bp, Homo sapiens
cagcagtgagatgcc

SEQ ID NO: 8536 - DNA, 15 bp, Homo sapiens
gcagcagtgagatgc

SEQ ID NO: 8537 - DNA, 15 bp, Homo sapiens
agcagcagtgagatg

SEQ ID NO: 8538 - DNA, 15 bp, Homo sapiens
cagcagcagtgagat

SEQ ID NO: 8539 - DNA, 15 bp, Homo sapiens
gcagcagcagtgaga

SEQ ID NO: 8540 - DNA, 15 bp, Homo sapiens
agcagcagcagtgag

SEQ ID NO: 8541 - DNA, 15 bp, Homo sapiens
cagcagcagcagtga

SEQ ID NO: 8542 - DNA, 15 bp, Homo sapiens
tcagcagcagcagtg

SEQ ID NO: 8543 - DNA, 15 bp, Homo sapiens
atcagcagcagcagt

SEQ ID NO: 8544 - DNA, 15 bp, Homo sapiens
catcagcagcagcag

SEQ ID NO: 8545 - DNA, 15 bp, Homo sapiens
tcatcagcagcagca

SEQ ID NO: 8546 - DNA, 15 bp, Homo sapiens
atcatcagcagcagc

SEQ ID NO: 8547 - DNA, 15 bp, Homo sapiens
catcatcagcagcag

SEQ ID NO: 8548 - DNA, 15 bp, Homo sapiens
cgtcatcatcagcag

SEQ ID NO: 8549 - DNA, 15 bp, Homo sapiens
tcgtcatcatcagca

SEQ ID NO: 8550 - DNA, 15 bp, Homo sapiens
atcgtcatcatcagc

SEQ ID NO: 8551 - DNA, 15 bp, Homo sapiens
aatcgtcatcatcag

SEQ ID NO: 8552 - DNA, 15 bp, Homo sapiens
gaatcgtcatcatca

SEQ ID NO: 8553 - DNA, 15 bp, Homo sapiens
agaatcgtcatcatc

SEQ ID NO: 8554 - DNA, 15 bp, Homo sapiens
tagaatcgtcatcat

SEQ ID NO: 8555 - DNA, 15 bp, Homo sapiens
ctagaatcgtcatca

SEQ ID NO: 8556 - DNA, 15 bp, Homo sapiens
gctagaatcgtcatc

SEQ ID NO: 8557 - DNA, 15 bp, Homo sapiens
tgctagaatcgtcat

SEQ ID NO: 8558 - DNA, 15 bp, Homo sapiens
ttgctagaatcgtca

SEQ ID NO: 8559 - DNA, 15 bp, Homo sapiens
gttgctagaatcgtc

SEQ ID NO: 8560 - DNA, 15 bp, Homo sapiens
agttgctagaatcgt

SEQ ID NO: 8561 - DNA, 15 bp, Homo sapiens
aagttgctagaatcg

SEQ ID NO: 8562 - DNA, 15 bp, Homo sapiens
taagttgctagaatc

SEQ ID NO: 8563 - DNA, 15 bp, Homo sapiens
gtaagttgctagaat

SEQ ID NO: 8564 - DNA, 15 bp, Homo sapiens
tgtaagttgctagaa

SEQ ID NO: 8565 - DNA, 15 bp, Homo sapiens
gtgtaagttgctaga

SEQ ID NO: 8566 - DNA, 15 bp, Homo sapiens
agtgtaagttgctag

SEQ ID NO: 8567 - DNA, 15 bp, Homo sapiens
tagtgtaagttgcta

SEQ ID NO: 8568 - DNA, 15 bp, Homo sapiens
ttagtgtaagttgct

SEQ ID NO: 8569 - DNA, 15 bp, Homo sapiens
attagtgtaagttgc

SEQ ID NO: 8570 - DNA, 15 bp, Homo sapiens
aattagtgtaagttg

SEQ ID NO: 8571 - DNA, 15 bp, Homo sapiens
caattagtgtaagtt

SEQ ID NO: 8572 - DNA, 15 bp, Homo sapiens
ttcaattagtgtaag

SEQ ID NO: 8573 - DNA, 15 bp, Homo sapiens
gttcaattagtgtaa

SEQ ID NO: 8574 - DNA, 15 bp, Homo sapiens
tgttcaattagtgta

SEQ ID NO: 8575 - DNA, 15 bp, Homo sapiens
gtgttcaattagtgt

SEQ ID NO: 8576 - DNA, 15 bp, Homo sapiens
tgtgttcaattagtg

SEQ ID NO: 8577 - DNA, 15 bp, Homo sapiens
atgtgttcaattagt

SEQ ID NO: 8578 - DNA, 15 bp, Homo sapiens
aatgtgttcaattag

SEQ ID NO: 8579 - DNA, 15 bp, Homo sapiens
gaatgtgttcaatta

SEQ ID NO: 8580 - DNA, 15 bp, Homo sapiens
agaatgtgttcaatt

SEQ ID NO: 8581 - DNA, 15 bp, Homo sapiens
cagaatgtgttcaat

SEQ ID NO: 8582 - DNA, 15 bp, Homo sapiens
acagaatgtgttcaa

SEQ ID NO: 8583 - DNA, 15 bp, Homo sapiens
cacagaatgtgttca

SEQ ID NO: 8584 - DNA, 15 bp, Homo sapiens
acacagaatgtgttc

SEQ ID NO: 8585 - DNA, 15 bp, Homo sapiens
cacacagaatgtgtt

SEQ ID NO: 8586 - DNA, 15 bp, Homo sapiens
gcacacagaatgtgt

SEQ ID NO: 8587 - DNA, 15 bp, Homo sapiens
tgcacacagaatgtg

SEQ ID NO: 8588 - DNA, 15 bp, Homo sapiens
ctgcacacagaatgt

SEQ ID NO: 8589 - DNA, 15 bp, Homo sapiens
tctgcacacagaatg

SEQ ID NO: 8590 - DNA, 15 bp, Homo sapiens
atctgcacacagaat

SEQ ID NO: 8591 - DNA, 15 bp, Homo sapiens
catctgcacacagaa

SEQ ID NO: 8592 - DNA, 15 bp, Homo sapiens
acatctgcacacaga

SEQ ID NO: 8593 - DNA, 15 bp, Homo sapiens
cacatctgcacacag

SEQ ID NO: 8594 - DNA, 15 bp, Homo sapiens
ccacatctgcacaca

SEQ ID NO: 8595 - DNA, 15 bp, Homo sapiens
accacatctgcacac

SEQ ID NO: 8596 - DNA, 15 bp, Homo sapiens
caccacatctgcaca

SEQ ID NO: 8597 - DNA, 15 bp, Homo sapiens
gcaccacatctgcac

SEQ ID NO: 8598 - DNA, 15 bp, Homo sapiens
agcaccacatctgca

SEQ ID NO: 8599 - DNA, 15 bp, Homo sapiens
tagcaccacatctgc

SEQ ID NO: 8600 - DNA, 15 bp, Homo sapiens
ttagcaccacatctg

SEQ ID NO: 8601 - DNA, 15 bp, Homo sapiens
gttagcaccacatct

SEQ ID NO: 8602 - DNA, 15 bp, Homo sapiens
tgttagcaccacatc

SEQ ID NO: 8603 - DNA, 15 bp, Homo sapiens
ctgttagcaccacat

SEQ ID NO: 8604 - DNA, 15 bp, Homo sapiens
actgttagcaccaca

SEQ ID NO: 8605 - DNA, 15 bp, Homo sapiens
aactgttagcaccac

SEQ ID NO: 8606 - DNA, 15 bp, Homo sapiens
aaactgttagcacca

SEQ ID NO: 8607 - DNA, 15 bp, Homo sapiens
taaactgttagcacc

SEQ ID NO: 8608 - DNA, 15 bp, Homo sapiens
ttaaactgttagcac

SEQ ID NO: 8609 - DNA, 15 bp, Homo sapiens
attaaactgttagca

SEQ ID NO: 8610 - DNA, 15 bp, Homo sapiens
gattaaactgttagc

SEQ ID NO: 8611 - DNA, 15 bp, Homo sapiens
ggattaaactgttag

SEQ ID NO: 8612 - DNA, 15 bp, Homo sapiens
aggattaaactgtta

SEQ ID NO: 8613 - DNA, 15 bp, Homo sapiens
gaggattaaactgtt

SEQ ID NO: 8614 - DNA, 15 bp, Homo sapiens
tgaggattaaactgt

SEQ ID NO: 8615 - DNA, 15 bp, Homo sapiens
gtgaggattaaactg

SEQ ID NO: 8616 - DNA, 15 bp, Homo sapiens
tgtgaggattaaact

SEQ ID NO: 8617 - DNA, 15 bp, Homo sapiens
ttgtgaggattaaac

SEQ ID NO: 8618 - DNA, 15 bp, Homo sapiens
gttgtgaggattaaa

SEQ ID NO: 8619 - DNA, 15 bp, Homo sapiens
ggttgtgaggattaa

SEQ ID NO: 8620 - DNA, 15 bp, Homo sapiens
cggttgtgaggatta

SEQ ID NO: 8621 - DNA, 15 bp, Homo sapiens
gcggttgtgaggatt

SEQ ID NO: 8622 - DNA, 15 bp, Homo sapiens
ggcggttgtgaggat

SEQ ID NO: 8623 - DNA, 15 bp, Homo sapiens
tggcggttgtgagga

SEQ ID NO: 8624 - DNA, 15 bp, Homo sapiens
atggcggttgtgagg

SEQ ID NO: 8625 - DNA, 15 bp, Homo sapiens
aatggcggttgtgag

SEQ ID NO: 8626 - DNA, 15 bp, Homo sapiens
aaatggcggttgtga

SEQ ID NO: 8627 - DNA, 15 bp, Homo sapiens
aaaatggcggttgtg

SEQ ID NO: 8628 - DNA, 15 bp, Homo sapiens
caaaatggcggttgt

SEQ ID NO: 8629 - DNA, 15 bp, Homo sapiens
gcaaaatggcggttg

SEQ ID NO: 8630 - DNA, 15 bp, Homo sapiens
tgcaaaatggcggtt

SEQ ID NO: 8631 - DNA, 15 bp, Homo sapiens
ctgcaaaatggcggt

SEQ ID NO: 8632 - DNA, 15 bp, Homo sapiens
tctgcaaaatggcgg

SEQ ID NO: 8633 - DNA, 15 bp, Homo sapiens
atctgcaaaatggcg

SEQ ID NO: 8634 - DNA, 15 bp, Homo sapiens
catctgcaaaatggc

SEQ ID NO: 8635 - DNA, 15 bp, Homo sapiens
tcatctgcaaaatgg

SEQ ID NO: 8636 - DNA, 15 bp, Homo sapiens
atcatctgcaaaatg

SEQ ID NO: 8637 - DNA, 15 bp, Homo sapiens
tatcatctgcaaaat

SEQ ID NO: 8638 - DNA, 15 bp, Homo sapiens
ttatcatctgcaaaa

SEQ ID NO: 8639 - DNA, 15 bp, Homo sapiens
tttatcatctgcaaa

SEQ ID NO: 8640 - DNA, 15 bp, Homo sapiens
atttatcatctgcaa

SEQ ID NO: 8641 - DNA, 15 bp, Homo sapiens
catttatcatctgca

SEQ ID NO: 8642 - DNA, 15 bp, Homo sapiens
acatttatcatctgc

SEQ ID NO: 8643 - DNA, 15 bp, Homo sapiens
cacatttatcatctg

SEQ ID NO: 8644 - DNA, 15 bp, Homo sapiens
tcacatttatcatct

SEQ ID NO: 8645 - DNA, 15 bp, Homo sapiens
ctcacatttatcatc

SEQ ID NO: 8646 - DNA, 15 bp, Homo sapiens
gctcacatttatcat

SEQ ID NO: 8647 - DNA, 15 bp, Homo sapiens
ggctcacatttatca

SEQ ID NO: 8648 - DNA, 15 bp, Homo sapiens
tggctcacatttatc

SEQ ID NO: 8649 - DNA, 15 bp, Homo sapiens
atggctcacatttat

SEQ ID NO: 8650 - DNA, 15 bp, Homo sapiens
tatggctcacattta

SEQ ID NO: 8651 - DNA, 15 bp, Homo sapiens
gtatggctcacattt

SEQ ID NO: 8652 - DNA, 15 bp, Homo sapiens
agtatggctcacatt

SEQ ID NO: 8653 - DNA, 15 bp, Homo sapiens
cagtatggctcacat

SEQ ID NO: 8654 - DNA, 15 bp, Homo sapiens
tcagtatggctcaca

SEQ ID NO: 8655 - DNA, 15 bp, Homo sapiens
ttcagtatggctcac

SEQ ID NO: 8656 - DNA, 15 bp, Homo sapiens
cttcagtatggctca

SEQ ID NO: 8657 - DNA, 15 bp, Homo sapiens
acttcagtatggctc

SEQ ID NO: 8658 - DNA, 15 bp, Homo sapiens
cacttcagtatggct

SEQ ID NO: 8659 - DNA, 15 bp, Homo sapiens
tcacttcagtatggc

SEQ ID NO: 8660 - DNA, 15 bp, Homo sapiens
atcacttcagtatgg

SEQ ID NO: 8661 - DNA, 15 bp, Homo sapiens
aatcacttcagtatg

SEQ ID NO: 8662 - DNA, 15 bp, Homo sapiens
aaatcacttcagtat

SEQ ID NO: 8663 - DNA, 15 bp, Homo sapiens
caaatcacttcagta

SEQ ID NO: 8664 - DNA, 15 bp, Homo sapiens
acaaatcacttcagt

SEQ ID NO: 8665 - DNA, 15 bp, Homo sapiens
cacaaatcacttcag

SEQ ID NO: 8666 - DNA, 15 bp, Homo sapiens
ccacaaatcacttca

SEQ ID NO: 8667 - DNA, 15 bp, Homo sapiens
gccacaaatcacttc

SEQ ID NO: 8668 - DNA, 15 bp, Homo sapiens
tgccacaaatcactt

SEQ ID NO: 8669 - DNA, 15 bp, Homo sapiens
gtgccacaaatcact

SEQ ID NO: 8670 - DNA, 15 bp, Homo sapiens
agtgccacaaatcac

SEQ ID NO: 8671 - DNA, 15 bp, Homo sapiens
cagtgccacaaatca

SEQ ID NO: 8672 - DNA, 15 bp, Homo sapiens
ccagtgccacaaatc

SEQ ID NO: 8673 - DNA, 15 bp, Homo sapiens
tccagtgccacaaat

SEQ ID NO: 8674 - DNA, 15 bp, Homo sapiens
gtccagtgccacaaa

SEQ ID NO: 8675 - DNA, 15 bp, Homo sapiens
agtccagtgccacaa

SEQ ID NO: 8676 - DNA, 15 bp, Homo sapiens
aagtccagtgccaca

SEQ ID NO: 8677 - DNA, 15 bp, Homo sapiens
gaagtccagtgccac

SEQ ID NO: 8678 - DNA, 15 bp, Homo sapiens
agaagtccagtgcca

SEQ ID NO: 8679 - DNA, 15 bp, Homo sapiens
aagaagtccagtgcc

SEQ ID NO: 8680 - DNA, 15 bp, Homo sapiens
aaagaagtccagtgc

SEQ ID NO: 8681 - DNA, 15 bp, Homo sapiens
gaaagaagtccagtg

SEQ ID NO: 8682 - DNA, 15 bp, Homo sapiens
agaaagaagtccagt

SEQ ID NO: 8683 - DNA, 15 bp, Homo sapiens
tagaaagaagtccag

SEQ ID NO: 8684 - DNA, 15 bp, Homo sapiens
atagaaagaagtcca

SEQ ID NO: 8685 - DNA, 15 bp, Homo sapiens
aatagaaagaagtcc

SEQ ID NO: 8686 - DNA, 15 bp, Homo sapiens
aaatagaaagaagtc

SEQ ID NO: 8687 - DNA, 15 bp, Homo sapiens
gaaatagaaagaagt

SEQ ID NO: 8688 - DNA, 15 bp, Homo sapiens
agaaatagaaagaag

SEQ ID NO: 8689 - DNA, 15 bp, Homo sapiens
gagaaatagaaagaa

SEQ ID NO: 8690 - DNA, 15 bp, Homo sapiens
tggagaaatagaaag

SEQ ID NO: 8691 - DNA, 15 bp, Homo sapiens
ttggagaaatagaaa

SEQ ID NO: 8692 - DNA, 15 bp, Homo sapiens
tttggagaaatagaa

SEQ ID NO: 8693 - DNA, 15 bp, Homo sapiens
ctttggagaaataga

SEQ ID NO: 8694 - DNA, 15 bp, Homo sapiens
cctttggagaaatag

SEQ ID NO: 8695 - DNA, 15 bp, Homo sapiens
gcctttggagaaata

SEQ ID NO: 8696 - DNA, 15 bp, Homo sapiens
ggcctttggagaaat

SEQ ID NO: 8697 - DNA, 15 bp, Homo sapiens
gggcctttggagaaa

SEQ ID NO: 8698 - DNA, 15 bp, Homo sapiens
tgggcctttggagaa

SEQ ID NO: 8699 - DNA, 15 bp, Homo sapiens
ctgggcctttggaga

SEQ ID NO: 8700 - DNA, 15 bp, Homo sapiens
actgggcctttggag

SEQ ID NO: 8701 - DNA, 15 bp, Homo sapiens
cactgggcctttgga

SEQ ID NO: 8702 - DNA, 15 bp, Homo sapiens
acactgggcctttgg

SEQ ID NO: 8703 - DNA, 15 bp, Homo sapiens
cacactgggcctttg

SEQ ID NO: 8704 - DNA, 15 bp, Homo sapiens
acacactgggccttt

SEQ ID NO: 8705 - DNA, 15 bp, Homo sapiens
gacacactgggcctt

SEQ ID NO: 8706 - DNA, 15 bp, Homo sapiens
agacacactgggcct

SEQ ID NO: 8707 - DNA, 15 bp, Homo sapiens
aagacacactgggcc

SEQ ID NO: 8708 - DNA, 15 bp, Homo sapiens
gaagacacactgggc

SEQ ID NO: 8709 - DNA, 15 bp, Homo sapiens
ggaagacacactggg

SEQ ID NO: 8710 - DNA, 15 bp, Homo sapiens
aggaagacacactgg

SEQ ID NO: 8711 - DNA, 15 bp, Homo sapiens
gaggaagacacactg

SEQ ID NO: 8712 - DNA, 15 bp, Homo sapiens
tgaggaagacacact

SEQ ID NO: 8713 - DNA, 15 bp, Homo sapiens
ctgaggaagacacac

SEQ ID NO: 8714 - DNA, 15 bp, Homo sapiens
cctgaggaagacaca

SEQ ID NO: 8715 - DNA, 15 bp, Homo sapiens
ccctgaggaagacac

SEQ ID NO: 8716 - DNA, 15 bp, Homo sapiens
gccctgaggaagaca

SEQ ID NO: 8717 - DNA, 15 bp, Homo sapiens
ggccctgaggaagac

SEQ ID NO: 8718 - DNA, 15 bp, Homo sapiens
aggccctgaggaaga

SEQ ID NO: 8719 - DNA, 15 bp, Homo sapiens
aaggccctgaggaag

SEQ ID NO: 8720 - DNA, 15 bp, Homo sapiens
aaaggccctgaggaa

SEQ ID NO: 8721 - DNA, 15 bp, Homo sapiens
caaaggccctgagga

SEQ ID NO: 8722 - DNA, 15 bp, Homo sapiens
gcaaaggccctgagg

SEQ ID NO: 8723 - DNA, 15 bp, Homo sapiens
tgcaaaggccctgag

SEQ ID NO: 8724 - DNA, 15 bp, Homo sapiens
gtgcaaaggccctga

SEQ ID NO: 8725 - DNA, 15 bp, Homo sapiens
tgtgcaaaggccctg

SEQ ID NO: 8726 - DNA, 15 bp, Homo sapiens
atgtgcaaaggccct

SEQ ID NO: 8727 - DNA, 15 bp, Homo sapiens
gatgtgcaaaggccc

SEQ ID NO: 8728 - DNA, 15 bp, Homo sapiens
agatgtgcaaaggcc

SEQ ID NO: 8729 - DNA, 15 bp, Homo sapiens
gagatgtgcaaaggc

SEQ ID NO: 8730 - DNA, 15 bp, Homo sapiens
agagatgtgcaaagg

SEQ ID NO: 8731 - DNA, 15 bp, Homo sapiens
gagagatgtgcaaag

SEQ ID NO: 8732 - DNA, 15 bp, Homo sapiens
agagagatgtgcaaa

SEQ ID NO: 8733 - DNA, 15 bp, Homo sapiens
aagagagatgtgcaa

SEQ ID NO: 8734 - DNA, 15 bp, Homo sapiens
gaagagagatgtgca

SEQ ID NO: 8735 - DNA, 15 bp, Homo sapiens
agaagagagatgtgc

SEQ ID NO: 8736 - DNA, 15 bp, Homo sapiens
aagaagagagatgtg

SEQ ID NO: 8737 - DNA, 15 bp, Homo sapiens
gaagaagagagatgt

SEQ ID NO: 8738 - DNA, 15 bp, Homo sapiens
ggaagaagagagatg

SEQ ID NO: 8739 - DNA, 15 bp, Homo sapiens
tggaagaagagagat

SEQ ID NO: 8740 - DNA, 15 bp, Homo sapiens
atggaagaagagaga

SEQ ID NO: 8741 - DNA, 15 bp, Homo sapiens
gatggaagaagagag

SEQ ID NO: 8742 - DNA, 15 bp, Homo sapiens
agatggaagaagaga

SEQ ID NO: 8743 - DNA, 15 bp, Homo sapiens
aagatggaagaagag

SEQ ID NO: 8744 - DNA, 15 bp, Homo sapiens
aaagatggaagaaga

SEQ ID NO: 8745 - DNA, 15 bp, Homo sapiens
caaagatggaagaag

SEQ ID NO: 8746 - DNA, 15 bp, Homo sapiens
gcaaagatggaagaa

SEQ ID NO: 8747 - DNA, 15 bp, Homo sapiens
ggcaaagatggaaga

SEQ ID NO: 8748 - DNA, 15 bp, Homo sapiens
aggcaaagatggaag

SEQ ID NO: 8749 - DNA, 15 bp, Homo sapiens
caggcaaagatggaa

SEQ ID NO: 8750 - DNA, 15 bp, Homo sapiens
ccaggcaaagatgga

SEQ ID NO: 8751 - DNA, 15 bp, Homo sapiens
gccaggcaaagatgg

SEQ ID NO: 8752 - DNA, 15 bp, Homo sapiens
agccaggcaaagatg

SEQ ID NO: 8753 - DNA, 15 bp, Homo sapiens
cagccaggcaaagat

SEQ ID NO: 8754 - DNA, 15 bp, Homo sapiens
ccagccaggcaaaga

SEQ ID NO: 8755 - DNA, 15 bp, Homo sapiens
accagccaggcaaag

SEQ ID NO: 8756 - DNA, 15 bp, Homo sapiens
aaccagccaggcaaa

SEQ ID NO: 8757 - DNA, 15 bp, Homo sapiens
gaaccagccaggcaa

SEQ ID NO: 8758 - DNA, 15 bp, Homo sapiens
ggaaccagccaggca

SEQ ID NO: 8759 - DNA, 15 bp, Homo sapiens
aggaaccagccaggc

SEQ ID NO: 8760 - DNA, 15 bp, Homo sapiens
aaggaaccagccagg

SEQ ID NO: 8761 - DNA, 15 bp, Homo sapiens
gaaggaaccagccag

SEQ ID NO: 8762 - DNA, 15 bp, Homo sapiens
agaaggaaccagcca

SEQ ID NO: 8763 - DNA, 15 bp, Homo sapiens
aagaaggaaccagcc

SEQ ID NO: 8764 - DNA, 15 bp, Homo sapiens
caagaaggaaccagc

SEQ ID NO: 8765 - DNA, 15 bp, Homo sapiens
acaagaaggaaccag

SEQ ID NO: 8766 - DNA, 15 bp, Homo sapiens
gacaagaaggaacca

SEQ ID NO: 8767 - DNA, 15 bp, Homo sapiens
tgacaagaaggaacc

SEQ ID NO: 8768 - DNA, 15 bp, Homo sapiens
atgacaagaaggaac

SEQ ID NO: 8769 - DNA, 15 bp, Homo sapiens
aatgacaagaaggaa

SEQ ID NO: 8770 - DNA, 15 bp, Homo sapiens
aaatgacaagaagga

SEQ ID NO: 8771 - DNA, 15 bp, Homo sapiens
taaatgacaagaagg

SEQ ID NO: 8772 - DNA, 15 bp, Homo sapiens
ctaaatgacaagaag

SEQ ID NO: 8773 - DNA, 15 bp, Homo sapiens
tctaaatgacaagaa

SEQ ID NO: 8774 - DNA, 15 bp, Homo sapiens
atctaaatgacaaga

SEQ ID NO: 8775 - DNA, 15 bp, Homo sapiens
catctaaatgacaag

SEQ ID NO: 8776 - DNA, 15 bp, Homo sapiens
acatctaaatgacaa

SEQ ID NO: 8777 - DNA, 15 bp, Homo sapiens
tacatctaaatgaca

SEQ ID NO: 8778 - DNA, 15 bp, Homo sapiens
ctacatctaaatgac

SEQ ID NO: 8779 - DNA, 15 bp, Homo sapiens
cctacatctaaatga

SEQ ID NO: 8780 - DNA, 15 bp, Homo sapiens
gcctacatctaaatg

SEQ ID NO: 8781 - DNA, 15 bp, Homo sapiens
ggcctacatctaaat

SEQ ID NO: 8782 - DNA, 15 bp, Homo sapiens
aggcctacatctaaa

SEQ ID NO: 8783 - DNA, 15 bp, Homo sapiens
taggcctacatctaa

SEQ ID NO: 8784 - DNA, 15 bp, Homo sapiens
ttaggcctacatcta

SEQ ID NO: 8785 - DNA, 15 bp, Homo sapiens
attaggcctacatct

SEQ ID NO: 8786 - DNA, 15 bp, Homo sapiens
cattaggcctacatc

SEQ ID NO: 8787 - DNA, 15 bp, Homo sapiens
acattaggcctacat

SEQ ID NO: 8788 - DNA, 15 bp, Homo sapiens
gacattaggcctaca

SEQ ID NO: 8789 - DNA, 15 bp, Homo sapiens
tgacattaggcctac

SEQ ID NO: 8790 - DNA, 15 bp, Homo sapiens
gtgacattaggccta

SEQ ID NO: 8791 - DNA, 15 bp, Homo sapiens
ggtgacattaggcct

SEQ ID NO: 8792 - DNA, 15 bp, Homo sapiens
aggtgacattaggcc

SEQ ID NO: 8793 - DNA, 15 bp, Homo sapiens
gaggtgacattaggc

SEQ ID NO: 8794 - DNA, 15 bp, Homo sapiens
agaggtgacattagg

SEQ ID NO: 8795 - DNA, 15 bp, Homo sapiens
aagaggtgacattag

SEQ ID NO: 8796 - DNA, 15 bp, Homo sapiens
gaagaggtgacatta

SEQ ID NO: 8797 - DNA, 15 bp, Homo sapiens
tgaagaggtgacatt

SEQ ID NO: 8798 - DNA, 15 bp, Homo sapiens
ctgaagaggtgacat

SEQ ID NO: 8799 - DNA, 15 bp, Homo sapiens
tctgaagaggtgaca

SEQ ID NO: 8800 - DNA, 15 bp, Homo sapiens
ctctgaagaggtgac

SEQ ID NO: 8801 - DNA, 15 bp, Homo sapiens
tctctgaagaggtga

SEQ ID NO: 8802 - DNA, 15 bp, Homo sapiens
atctctgaagaggtg

SEQ ID NO: 8803 - DNA, 15 bp, Homo sapiens
gatctctgaagaggt

SEQ ID NO: 8804 - DNA, 15 bp, Homo sapiens
agatctctgaagagg

SEQ ID NO: 8805 - DNA, 15 bp, Homo sapiens
aagatctctgaagag

SEQ ID NO: 8806 - DNA, 15 bp, Homo sapiens
gaagatctctgaaga

SEQ ID NO: 8807 - DNA, 15 bp, Homo sapiens
ggaagatctctgaag

SEQ ID NO: 8808 - DNA, 15 bp, Homo sapiens
aggaagatctctgaa

SEQ ID NO: 8809 - DNA, 15 bp, Homo sapiens
aaggaagatctctga

SEQ ID NO: 8810 - DNA, 15 bp, Homo sapiens
caaggaagatctctg

SEQ ID NO: 8811 - DNA, 15 bp, Homo sapiens
gcaaggaagatctct

SEQ ID NO: 8812 - DNA, 15 bp, Homo sapiens
agcaaggaagatctc

SEQ ID NO: 8813 - DNA, 15 bp, Homo sapiens
cagcaaggaagatct

SEQ ID NO: 8814 - DNA, 15 bp, Homo sapiens
tcagcaaggaagatc

SEQ ID NO: 8815 - DNA, 15 bp, Homo sapiens
gtcagcaaggaagat

SEQ ID NO: 8816 - DNA, 15 bp, Homo sapiens
agtcagcaaggaaga

SEQ ID NO: 8817 - DNA, 15 bp, Homo sapiens
aagtcagcaaggaag

SEQ ID NO: 8818 - DNA, 15 bp, Homo sapiens
aaagtcagcaaggaa

SEQ ID NO: 8819 - DNA, 15 bp, Homo sapiens
taaagtcagcaagga

SEQ ID NO: 8820 - DNA, 15 bp, Homo sapiens
ctaaagtcagcaagg

SEQ ID NO: 8821 - DNA, 15 bp, Homo sapiens
tctaaagtcagcaag

SEQ ID NO: 8822 - DNA, 15 bp, Homo sapiens
ttctaaagtcagcaa

SEQ ID NO: 8823 - DNA, 15 bp, Homo sapiens
tttctaaagtcagca

SEQ ID NO: 8824 - DNA, 15 bp, Homo sapiens
ctttctaaagtcagc

SEQ ID NO: 8825 - DNA, 15 bp, Homo sapiens
actttctaaagtcag

SEQ ID NO: 8826 - DNA, 15 bp, Homo sapiens
tactttctaaagtca

SEQ ID NO: 8827 - DNA, 15 bp, Homo sapiens
ctactttctaaagtc

SEQ ID NO: 8828 - DNA, 15 bp, Homo sapiens
gctactttctaaagt

SEQ ID NO: 8829 - DNA, 15 bp, Homo sapiens
agctactttctaaag

SEQ ID NO: 8830 - DNA, 15 bp, Homo sapiens
gagctactttctaaa

SEQ ID NO: 8831 - DNA, 15 bp, Homo sapiens
agagctactttctaa

SEQ ID NO: 8832 - DNA, 15 bp, Homo sapiens
gagagctactttcta

SEQ ID NO: 8833 - DNA, 15 bp, Homo sapiens
ggagagctactttct

SEQ ID NO: 8834 - DNA, 15 bp, Homo sapiens
gggagagctactttc

SEQ ID NO: 8835 - DNA, 15 bp, Homo sapiens
tgggagagctacttt

SEQ ID NO: 8836 - DNA, 15 bp, Homo sapiens
ctgggagagctactt

SEQ ID NO: 8837 - DNA, 15 bp, Homo sapiens
actgggagagctact

SEQ ID NO: 8838 - DNA, 15 bp, Homo sapiens
gactgggagagctac

SEQ ID NO: 8839 - DNA, 15 bp, Homo sapiens
tgactgggagagcta

SEQ ID NO: 8840 - DNA, 15 bp, Homo sapiens
gtgactgggagagct

SEQ ID NO: 8841 - DNA, 15 bp, Homo sapiens
agtgactgggagagc

SEQ ID NO: 8842 - DNA, 15 bp, Homo sapiens
gagtgactgggagag

SEQ ID NO: 8843 - DNA, 15 bp, Homo sapiens
agagtgactgggaga

SEQ ID NO: 8844 - DNA, 15 bp, Homo sapiens
aagagtgactgggag

SEQ ID NO: 8845 - DNA, 15 bp, Homo sapiens
caagagtgactggga

SEQ ID NO: 8846 - DNA, 15 bp, Homo sapiens
tcaagagtgactggg

SEQ ID NO: 8847 - DNA, 15 bp, Homo sapiens
gtcaagagtgactgg

SEQ ID NO: 8848 - DNA, 15 bp, Homo sapiens
agtcaagagtgactg

SEQ ID NO: 8849 - DNA, 15 bp, Homo sapiens
cagtcaagagtgact

SEQ ID NO: 8850 - DNA, 15 bp, Homo sapiens
gcagtcaagagtgac

SEQ ID NO: 8851 - DNA, 15 bp, Homo sapiens
tgcagtcaagagtga

SEQ ID NO: 8852 - DNA, 15 bp, Homo sapiens
atgcagtcaagagtg

SEQ ID NO: 8853 - DNA, 15 bp, Homo sapiens
gatgcagtcaagagt

SEQ ID NO: 8854 - DNA, 15 bp, Homo sapiens
agatgcagtcaagag

SEQ ID NO: 8855 - DNA, 15 bp, Homo sapiens
gagatgcagtcaaga

SEQ ID NO: 8856 - DNA, 15 bp, Homo sapiens
agagatgcagtcaag

SEQ ID NO: 8857 - DNA, 15 bp, Homo sapiens
cagagatgcagtcaa

SEQ ID NO: 8858 - DNA, 15 bp, Homo sapiens
acagagatgcagtca

SEQ ID NO: 8859 - DNA, 15 bp, Homo sapiens
tacagagatgcagtc

SEQ ID NO: 8860 - DNA, 15 bp, Homo sapiens
atacagagatgcagt

SEQ ID NO: 8861 - DNA, 15 bp, Homo sapiens
aatacagagatgcag

SEQ ID NO: 8862 - DNA, 15 bp, Homo sapiens
aaatacagagatgca

SEQ ID NO: 8863 - DNA, 15 bp, Homo sapiens
taaatacagagatgc

SEQ ID NO: 8864 - DNA, 15 bp, Homo sapiens
gtaaatacagagatg

SEQ ID NO: 8865 - DNA, 15 bp, Homo sapiens
cgtaaatacagagat

SEQ ID NO: 8866 - DNA, 15 bp, Homo sapiens
acgtaaatacagaga

SEQ ID NO: 8867 - DNA, 15 bp, Homo sapiens
aacgtaaatacagag

SEQ ID NO: 8868 - DNA, 15 bp, Homo sapiens
gaacgtaaatacaga

SEQ ID NO: 8869 - DNA, 15 bp, Homo sapiens
ggaacgtaaatacag

SEQ ID NO: 8870 - DNA, 15 bp, Homo sapiens
gggaacgtaaataca

SEQ ID NO: 8871 - DNA, 15 bp, Homo sapiens
agggaacgtaaatac

SEQ ID NO: 8872 - DNA, 15 bp, Homo sapiens
cagggaacgtaaata

SEQ ID NO: 8873 - DNA, 15 bp, Homo sapiens
acagggaacgtaaat

SEQ ID NO: 8874 - DNA, 15 bp, Homo sapiens
cacagggaacgtaaa

SEQ ID NO: 8875 - DNA, 15 bp, Homo sapiens
acacagggaacgtaa

SEQ ID NO: 8876 - DNA, 15 bp, Homo sapiens
aacacagggaacgta

SEQ ID NO: 8877 - DNA, 15 bp, Homo sapiens
caacacagggaacgt

SEQ ID NO: 8878 - DNA, 15 bp, Homo sapiens
acaacacagggaacg

SEQ ID NO: 8879 - DNA, 15 bp, Homo sapiens
aacaacacagggaac

SEQ ID NO: 8880 - DNA, 15 bp, Homo sapiens
gaacaacacagggaa

SEQ ID NO: 8881 - DNA, 15 bp, Homo sapiens
agaacaacacaggga

SEQ ID NO: 8882 - DNA, 15 bp, Homo sapiens
aagaacaacacaggg

SEQ ID NO: 8883 - DNA, 15 bp, Homo sapiens
taagaacaacacagg

SEQ ID NO: 8884 - DNA, 15 bp, Homo sapiens
ctaagaacaacacag

SEQ ID NO: 8885 - DNA, 15 bp, Homo sapiens
gctaagaacaacaca

SEQ ID NO: 8886 - DNA, 15 bp, Homo sapiens
tgctaagaacaacac

SEQ ID NO: 8887 - DNA, 15 bp, Homo sapiens
gtgctaagaacaaca

SEQ ID NO: 8888 - DNA, 15 bp, Homo sapiens
agtgctaagaacaac

SEQ ID NO: 8889 - DNA, 15 bp, Homo sapiens
gagtgctaagaacaa

SEQ ID NO: 8890 - DNA, 15 bp, Homo sapiens
agagtgctaagaaca

SEQ ID NO: 8891 - DNA, 15 bp, Homo sapiens
gagagtgctaagaac

SEQ ID NO: 8892 - DNA, 15 bp, Homo sapiens
agagagtgctaagaa

SEQ ID NO: 8893 - DNA, 15 bp, Homo sapiens
cagagagtgctaaga

SEQ ID NO: 8894 - DNA, 15 bp, Homo sapiens
ccagagagtgctaag

SEQ ID NO: 8895 - DNA, 15 bp, Homo sapiens
accagagagtgctaa

SEQ ID NO: 8896 - DNA, 15 bp, Homo sapiens
taccagagagtgcta

SEQ ID NO: 8897 - DNA, 15 bp, Homo sapiens
gtaccagagagtgct

SEQ ID NO: 8898 - DNA, 15 bp, Homo sapiens
ggtaccagagagtgc

SEQ ID NO: 8899 - DNA, 15 bp, Homo sapiens
aggtaccagagagtg

SEQ ID NO: 8900 - DNA, 15 bp, Homo sapiens
aaggtaccagagagt

SEQ ID NO: 8901 - DNA, 15 bp, Homo sapiens
aaaggtaccagagag

SEQ ID NO: 8902 - DNA, 15 bp, Homo sapiens
aaaaggtaccagaga

SEQ ID NO: 8903 - DNA, 15 bp, Homo sapiens
gaaaaggtaccagag

SEQ ID NO: 8904 - DNA, 15 bp, Homo sapiens
agaaaaggtaccaga

SEQ ID NO: 8905 - DNA, 15 bp, Homo sapiens
cagaaaaggtaccag

SEQ ID NO: 8906 - DNA, 15 bp, Homo sapiens
ccagaaaaggtacca

SEQ ID NO: 8907 - DNA, 15 bp, Homo sapiens
accagaaaaggtacc

SEQ ID NO: 8908 - DNA, 15 bp, Homo sapiens
taccagaaaaggtac

SEQ ID NO: 8909 - DNA, 15 bp, Homo sapiens
gtaccagaaaaggta

SEQ ID NO: 8910 - DNA, 15 bp, Homo sapiens
agtaccagaaaaggt

SEQ ID NO: 8911 - DNA, 15 bp, Homo sapiens
cagtaccagaaaagg

SEQ ID NO: 8912 - DNA, 15 bp, Homo sapiens
acagtaccagaaaag

SEQ ID NO: 8913 - DNA, 15 bp, Homo sapiens
cacagtaccagaaaa

SEQ ID NO: 8914 - DNA, 15 bp, Homo sapiens
acacagtaccagaaa

SEQ ID NO: 8915 - DNA, 15 bp, Homo sapiens
cacacagtaccagaa

SEQ ID NO: 8916 - DNA, 15 bp, Homo sapiens
acacacagtaccaga

SEQ ID NO: 8917 - DNA, 15 bp, Homo sapiens
aacacacagtaccag

SEQ ID NO: 8918 - DNA, 15 bp, Homo sapiens
gaacacacagtacca

SEQ ID NO: 8919 - DNA, 15 bp, Homo sapiens
tgaacacacagtacc

SEQ ID NO: 8920 - DNA, 15 bp, Homo sapiens
atgaacacacagtac

SEQ ID NO: 8921 - DNA, 15 bp, Homo sapiens
aatgaacacacagta

SEQ ID NO: 8922 - DNA, 15 bp, Homo sapiens
taatgaacacacagt

SEQ ID NO: 8923 - DNA, 15 bp, Homo sapiens
ttaatgaacacacag

SEQ ID NO: 8924 - DNA, 15 bp, Homo sapiens
attaatgaacacaca

SEQ ID NO: 8925 - DNA, 15 bp, Homo sapiens
tattaatgaacacac

SEQ ID NO: 8926 - DNA, 15 bp, Homo sapiens
ctattaatgaacaca

SEQ ID NO: 8927 - DNA, 15 bp, Homo sapiens
gctattaatgaacac

SEQ ID NO: 8928 - DNA, 15 bp, Homo sapiens
ggctattaatgaaca

SEQ ID NO: 8929 - DNA, 15 bp, Homo sapiens
aggctattaatgaac

SEQ ID NO: 8930 - DNA, 15 bp, Homo sapiens
aaggctattaatgaa

SEQ ID NO: 8931 - DNA, 15 bp, Homo sapiens
gaaggctattaatga

SEQ ID NO: 8932 - DNA, 15 bp, Homo sapiens
ggaaggctattaatg

SEQ ID NO: 8933 - DNA, 15 bp, Homo sapiens
gggaaggctattaat

SEQ ID NO: 8934 - DNA, 15 bp, Homo sapiens
tgggaaggctattaa

SEQ ID NO: 8935 - DNA, 15 bp, Homo sapiens
gtgggaaggctatta

SEQ ID NO: 8936 - DNA, 15 bp, Homo sapiens
agtgggaaggctatt

SEQ ID NO: 8937 - DNA, 15 bp, Homo sapiens
tagtgggaaggctat

SEQ ID NO: 8938 - DNA, 15 bp, Homo sapiens
ctagtgggaaggcta

SEQ ID NO: 8939 - DNA, 15 bp, Homo sapiens
tctagtgggaaggct

SEQ ID NO: 8940 - DNA, 15 bp, Homo sapiens
ttctagtgggaaggc

SEQ ID NO: 8941 - DNA, 15 bp, Homo sapiens
gttctagtgggaagg

SEQ ID NO: 8942 - DNA, 15 bp, Homo sapiens
tgttctagtgggaag

SEQ ID NO: 8943 - DNA, 15 bp, Homo sapiens
ctgttctagtgggaa

SEQ ID NO: 8944 - DNA, 15 bp, Homo sapiens
cctgttctagtggga

SEQ ID NO: 8945 - DNA, 15 bp, Homo sapiens
ccctgttctagtggg

SEQ ID NO: 8946 - DNA, 15 bp, Homo sapiens
gccctgttctagtgg

SEQ ID NO: 8947 - DNA, 15 bp, Homo sapiens
agccctgttctagtg

SEQ ID NO: 8948 - DNA, 15 bp, Homo sapiens
gagccctgttctagt

SEQ ID NO: 8949 - DNA, 15 bp, Homo sapiens
ggagccctgttctag

SEQ ID NO: 8950 - DNA, 15 bp, Homo sapiens
gggagccctgttcta

SEQ ID NO: 8951 - DNA, 15 bp, Homo sapiens
ggggagccctgttct

SEQ ID NO: 8952 - DNA, 15 bp, Homo sapiens
tggggagccctgttc

SEQ ID NO: 8953 - DNA, 15 bp, Homo sapiens
ttggggagccctgtt

SEQ ID NO: 8954 - DNA, 15 bp, Homo sapiens
gttggggagccctgt

SEQ ID NO: 8955 - DNA, 15 bp, Homo sapiens
agttggggagccctg

SEQ ID NO: 8956 - DNA, 15 bp, Homo sapiens
gagttggggagccct

SEQ ID NO: 8957 - DNA, 15 bp, Homo sapiens
ggagttggggagccc

SEQ ID NO: 8958 - DNA, 15 bp, Homo sapiens
gggagttggggagcc

SEQ ID NO: 8959 - DNA, 15 bp, Homo sapiens
tgggagttggggagc

SEQ ID NO: 8960 - DNA, 15 bp, Homo sapiens
ctgggagttggggag

SEQ ID NO: 8961 - DNA, 15 bp, Homo sapiens
cctgggagttgggga

SEQ ID NO: 8962 - DNA, 15 bp, Homo sapiens
ccctgggagttgggg

SEQ ID NO: 8963 - DNA, 15 bp, Homo sapiens
gccctgggagttggg

SEQ ID NO: 8964 - DNA, 15 bp, Homo sapiens
ggccctgggagttgg

SEQ ID NO: 8965 - DNA, 15 bp, Homo sapiens
aggccctgggagttg

SEQ ID NO: 8966 - DNA, 15 bp, Homo sapiens
caggccctgggagtt

SEQ ID NO: 8967 - DNA, 15 bp, Homo sapiens
ccaggccctgggagt

SEQ ID NO: 8968 - DNA, 15 bp, Homo sapiens
tccaggccctgggag

SEQ ID NO: 8969 - DNA, 15 bp, Homo sapiens
gtccaggccctggga

SEQ ID NO: 8970 - DNA, 15 bp, Homo sapiens
agtccaggccctggg

SEQ ID NO: 8971 - DNA, 15 bp, Homo sapiens
cagtccaggccctgg

SEQ ID NO: 8972 - DNA, 15 bp, Homo sapiens
ccagtccaggccctg

SEQ ID NO: 8973 - DNA, 15 bp, Homo sapiens
accagtccaggccct

SEQ ID NO: 8974 - DNA, 15 bp, Homo sapiens
taccagtccaggccc

SEQ ID NO: 8975 - DNA, 15 bp, Homo sapiens
gtaccagtccaggcc

SEQ ID NO: 8976 - DNA, 15 bp, Homo sapiens
ggtaccagtccaggc

SEQ ID NO: 8977 - DNA, 15 bp, Homo sapiens
tggtaccagtccagg

SEQ ID NO: 8978 - DNA, 15 bp, Homo sapiens
ctggtaccagtccag

SEQ ID NO: 8979 - DNA, 15 bp, Homo sapiens
actggtaccagtcca

SEQ ID NO: 8980 - DNA, 15 bp, Homo sapiens
gactggtaccagtcc

SEQ ID NO: 8981 - DNA, 15 bp, Homo sapiens
ggactggtaccagtc

SEQ ID NO: 8982 - DNA, 15 bp, Homo sapiens
cggactggtaccagt

SEQ ID NO: 8983 - DNA, 15 bp, Homo sapiens
acggactggtaccag

SEQ ID NO: 8984 - DNA, 15 bp, Homo sapiens
aacggactggtacca

SEQ ID NO: 8985 - DNA, 15 bp, Homo sapiens
caacggactggtacc

SEQ ID NO: 8986 - DNA, 15 bp, Homo sapiens
gcaacggactggtac

SEQ ID NO: 8987 - DNA, 15 bp, Homo sapiens
ggcaacggactggta

SEQ ID NO: 8988 - DNA, 15 bp, Homo sapiens
aggcaacggactggt

SEQ ID NO: 8989 - DNA, 15 bp, Homo sapiens
caggcaacggactgg

SEQ ID NO: 8990 - DNA, 15 bp, Homo sapiens
acaggcaacggactg

SEQ ID NO: 8991 - DNA, 15 bp, Homo sapiens
aacaggcaacggact

SEQ ID NO: 8992 - DNA, 15 bp, Homo sapiens
taacaggcaacggac

SEQ ID NO: 8993 - DNA, 15 bp, Homo sapiens
ctaacaggcaacgga

SEQ ID NO: 8994 - DNA, 15 bp, Homo sapiens
cctaacaggcaacgg

SEQ ID NO: 8995 - DNA, 15 bp, Homo sapiens
ccctaacaggcaacg

SEQ ID NO: 8996 - DNA, 15 bp, Homo sapiens
tccctaacaggcaac

SEQ ID NO: 8997 - DNA, 15 bp, Homo sapiens
gtccctaacaggcaa

SEQ ID NO: 8998 - DNA, 15 bp, Homo sapiens
ggtccctaacaggca

SEQ ID NO: 8999 - DNA, 15 bp, Homo sapiens
tggtccctaacaggc

SEQ ID NO: 9000 - DNA, 15 bp, Homo sapiens
ctggtccctaacagg

SEQ ID NO: 9001 - DNA, 15 bp, Homo sapiens
cctggtccctaacag

SEQ ID NO: 9002 - DNA, 15 bp, Homo sapiens
acctggtccctaaca

SEQ ID NO: 9003 - DNA, 15 bp, Homo sapiens
cacctggtccctaac

SEQ ID NO: 9004 - DNA, 15 bp, Homo sapiens
ccacctggtccctaa

SEQ ID NO: 9005 - DNA, 15 bp, Homo sapiens
gccacctggtcccta

SEQ ID NO: 9006 - DNA, 15 bp, Homo sapiens
tgccacctggtccct

SEQ ID NO: 9007 - DNA, 15 bp, Homo sapiens
gtgccacctggtccc

SEQ ID NO: 9008 - DNA, 15 bp, Homo sapiens
tgtgccacctggtcc

SEQ ID NO: 9009 - DNA, 15 bp, Homo sapiens
ctgtgccacctggtc

SEQ ID NO: 9010 - DNA, 15 bp, Homo sapiens
gctgtgccacctggt

SEQ ID NO: 9011 - DNA, 15 bp, Homo sapiens
tgctgtgccacctgg

SEQ ID NO: 9012 - DNA, 15 bp, Homo sapiens
ctgctgtgccacctg

SEQ ID NO: 9013 - DNA, 15 bp, Homo sapiens
cctgctgtgccacct

SEQ ID NO: 9014 - DNA, 15 bp, Homo sapiens
tcctgctgtgccacc

SEQ ID NO: 9015 - DNA, 15 bp, Homo sapiens
ctcctgctgtgccac

SEQ ID NO: 9016 - DNA, 15 bp, Homo sapiens
cctcctgctgtgcca

SEQ ID NO: 9017 - DNA, 15 bp, Homo sapiens
acctcctgctgtgcc

SEQ ID NO: 9018 - DNA, 15 bp, Homo sapiens
cacctcctgctgtgc

SEQ ID NO: 9019 - DNA, 15 bp, Homo sapiens
tcacctcctgctgtg

SEQ ID NO: 9020 - DNA, 15 bp, Homo sapiens
ctcacctcctgctgt

SEQ ID NO: 9021 - DNA, 15 bp, Homo sapiens
actcacctcctgctg

SEQ ID NO: 9022 - DNA, 15 bp, Homo sapiens
cactcacctcctgct

SEQ ID NO: 9023 - DNA, 15 bp, Homo sapiens
ccactcacctcctgc

SEQ ID NO: 9024 - DNA, 15 bp, Homo sapiens
accactcacctcctg

SEQ ID NO: 9025 - DNA, 15 bp, Homo sapiens
caccactcacctcct

SEQ ID NO: 9026 - DNA, 15 bp, Homo sapiens
ccaccactcacctcc

SEQ ID NO: 9027 - DNA, 15 bp, Homo sapiens
gccaccactcacctc

SEQ ID NO: 9028 - DNA, 15 bp, Homo sapiens
agccaccactcacct

SEQ ID NO: 9029 - DNA, 15 bp, Homo sapiens
cagccaccactcacc

SEQ ID NO: 9030 - DNA, 15 bp, Homo sapiens
tcagccaccactcac

SEQ ID NO: 9031 - DNA, 15 bp, Homo sapiens
ctcagccaccactca

SEQ ID NO: 9032 - DNA, 15 bp, Homo sapiens
gctcagccaccactc

SEQ ID NO: 9033 - DNA, 15 bp, Homo sapiens
tgctcagccaccact

SEQ ID NO: 9034 - DNA, 15 bp, Homo sapiens
ttgctcagccaccac

SEQ ID NO: 9035 - DNA, 15 bp, Homo sapiens
cttgctcagccacca

SEQ ID NO: 9036 - DNA, 15 bp, Homo sapiens
gcttgctcagccacc

SEQ ID NO: 9037 - DNA, 15 bp, Homo sapiens
tgcttgctcagccac

SEQ ID NO: 9038 - DNA, 15 bp, Homo sapiens
gtgcttgctcagcca

SEQ ID NO: 9039 - DNA, 15 bp, Homo sapiens
agtgcttgctcagcc

SEQ ID NO: 9040 - DNA, 15 bp, Homo sapiens
tagtgcttgctcagc

SEQ ID NO: 9041 - DNA, 15 bp, Homo sapiens
gtagtgcttgctcag

SEQ ID NO: 9042 - DNA, 15 bp, Homo sapiens
ggtagtgcttgctca

SEQ ID NO: 9043 - DNA, 15 bp, Homo sapiens
cggtagtgcttgctc

SEQ ID NO: 9044 - DNA, 15 bp, Homo sapiens
gcggtagtgcttgct

SEQ ID NO: 9045 - DNA, 15 bp, Homo sapiens
ggcggtagtgcttgc

SEQ ID NO: 9046 - DNA, 15 bp, Homo sapiens
aggcggtagtgcttg

SEQ ID NO: 9047 - DNA, 15 bp, Homo sapiens
caggcggtagtgctt

SEQ ID NO: 9048 - DNA, 15 bp, Homo sapiens
tcaggcggtagtgct

SEQ ID NO: 9049 - DNA, 15 bp, Homo sapiens
ctcaggcggtagtgc

SEQ ID NO: 9050 - DNA, 15 bp, Homo sapiens
gctcaggcggtagtg

SEQ ID NO: 9051 - DNA, 15 bp, Homo sapiens
agctcaggcggtagt

SEQ ID NO: 9052 - DNA, 15 bp, Homo sapiens
gagctcaggcggtag

SEQ ID NO: 9053 - DNA, 15 bp, Homo sapiens
agagctcaggcggta

SEQ ID NO: 9054 - DNA, 15 bp, Homo sapiens
cagagctcaggcggt

SEQ ID NO: 9055 - DNA, 15 bp, Homo sapiens
gcagagctcaggcgg

SEQ ID NO: 9056 - DNA, 15 bp, Homo sapiens
ggcagagctcaggcg

SEQ ID NO: 9057 - DNA, 15 bp, Homo sapiens
aggcagagctcaggc

SEQ ID NO: 9058 - DNA, 15 bp, Homo sapiens
gaggcagagctcagg

SEQ ID NO: 9059 - DNA, 15 bp, Homo sapiens
ggaggcagagctcag

SEQ ID NO: 9060 - DNA, 15 bp, Homo sapiens
aggaggcagagctca

SEQ ID NO: 9061 - DNA, 15 bp, Homo sapiens
caggaggcagagctc

SEQ ID NO: 9062 - DNA, 15 bp, Homo sapiens
acaggaggcagagct

SEQ ID NO: 9063 - DNA, 15 bp, Homo sapiens
gacaggaggcagagc

SEQ ID NO: 9064 - DNA, 15 bp, Homo sapiens
tgacaggaggcagag

SEQ ID NO: 9065 - DNA, 15 bp, Homo sapiens
ctgacaggaggcaga

SEQ ID NO: 9066 - DNA, 15 bp, Homo sapiens
tctgacaggaggcag

SEQ ID NO: 9067 - DNA, 15 bp, Homo sapiens
atctgacaggaggca

SEQ ID NO: 9068 - DNA, 15 bp, Homo sapiens
gatctgacaggaggc

SEQ ID NO: 9069 - DNA, 15 bp, Homo sapiens
tgatctgacaggagg

SEQ ID NO: 9070 - DNA, 15 bp, Homo sapiens
ctgatctgacaggag

SEQ ID NO: 9071 - DNA, 15 bp, Homo sapiens
gctgatctgacagga

SEQ ID NO: 9072 - DNA, 15 bp, Homo sapiens
cgctgatctgacagg

SEQ ID NO: 9073 - DNA, 15 bp, Homo sapiens
ccgctgatctgacag

SEQ ID NO: 9074 - DNA, 15 bp, Homo sapiens
gccgctgatctgaca

SEQ ID NO: 9075 - DNA, 15 bp, Homo sapiens
tgccgctgatctgac

SEQ ID NO: 9076 - DNA, 15 bp, Homo sapiens
ctgccgctgatctga

SEQ ID NO: 9077 - DNA, 15 bp, Homo sapiens
gctgccgctgatctg

SEQ ID NO: 9078 - DNA, 15 bp, Homo sapiens
tgctgccgctgatct

SEQ ID NO: 9079 - DNA, 15 bp, Homo sapiens
atgctgccgctgatc

SEQ ID NO: 9080 - DNA, 15 bp, Homo sapiens
aatgctgccgctgat

SEQ ID NO: 9081 - DNA, 15 bp, Homo sapiens
taatgctgccgctga

SEQ ID NO: 9082 - DNA, 15 bp, Homo sapiens
ctaatgctgccgctg

SEQ ID NO: 9083 - DNA, 15 bp, Homo sapiens
tctaatgctgccgct

SEQ ID NO: 9084 - DNA, 15 bp, Homo sapiens
atctaatgctgccgc

SEQ ID NO: 9085 - DNA, 15 bp, Homo sapiens
aatctaatgctgccg

SEQ ID NO: 9086 - DNA, 15 bp, Homo sapiens
gaatctaatgctgcc

SEQ ID NO: 9087 - DNA, 15 bp, Homo sapiens
agaatctaatgctgc

SEQ ID NO: 9088 - DNA, 15 bp, Homo sapiens
gagaatctaatgctg

SEQ ID NO: 9089 - DNA, 15 bp, Homo sapiens
tgagaatctaatgct

SEQ ID NO: 9090 - DNA, 15 bp, Homo sapiens
atgagaatctaatgc

SEQ ID NO: 9091 - DNA, 15 bp, Homo sapiens
tatgagaatctaatg

SEQ ID NO: 9092 - DNA, 15 bp, Homo sapiens
ctatgagaatctaat

SEQ ID NO: 9093 - DNA, 15 bp, Homo sapiens
cctatgagaatctaa

SEQ ID NO: 9094 - DNA, 15 bp, Homo sapiens
tcctatgagaatcta

SEQ ID NO: 9095 - DNA, 15 bp, Homo sapiens
ctcctatgagaatct

SEQ ID NO: 9096 - DNA, 15 bp, Homo sapiens
actcctatgagaatc

SEQ ID NO: 9097 - DNA, 15 bp, Homo sapiens
cactcctatgagaat

SEQ ID NO: 9098 - DNA, 15 bp, Homo sapiens
tcactcctatgagaa

SEQ ID NO: 9099 - DNA, 15 bp, Homo sapiens
ctcactcctatgaga

SEQ ID NO: 9100 - DNA, 15 bp, Homo sapiens
tctcactcctatgag

SEQ ID NO: 9101 - DNA, 15 bp, Homo sapiens
gtctcactcctatga

SEQ ID NO: 9102 - DNA, 15 bp, Homo sapiens
agtctcactcctatg

SEQ ID NO: 9103 - DNA, 15 bp, Homo sapiens
gagtctcactcctat

SEQ ID NO: 9104 - DNA, 15 bp, Homo sapiens
agagtctcactccta

SEQ ID NO: 9105 - DNA, 15 bp, Homo sapiens
tagagtctcactcct

SEQ ID NO: 9106 - DNA, 15 bp, Homo sapiens
atagagtctcactcc

SEQ ID NO: 9107 - DNA, 15 bp, Homo sapiens
catagagtctcactc

SEQ ID NO: 9108 - DNA, 15 bp, Homo sapiens
ccatagagtctcact

SEQ ID NO: 9109 - DNA, 15 bp, Homo sapiens
accatagagtctcac

SEQ ID NO: 9110 - DNA, 15 bp, Homo sapiens
caccatagagtctca

SEQ ID NO: 9111 - DNA, 15 bp, Homo sapiens
tcaccatagagtctc

SEQ ID NO: 9112 - DNA, 15 bp, Homo sapiens
ttcaccatagagtct

SEQ ID NO: 9113 - DNA, 15 bp, Homo sapiens
gttcaccatagagtc

SEQ ID NO: 9114 - DNA, 15 bp, Homo sapiens
ggttcaccatagagt

SEQ ID NO: 9115 - DNA, 15 bp, Homo sapiens
cggttcaccatagag

SEQ ID NO: 9116 - DNA, 15 bp, Homo sapiens
gcggttcaccataga

SEQ ID NO: 9117 - DNA, 15 bp, Homo sapiens
tgcggttcaccatag

SEQ ID NO: 9118 - DNA, 15 bp, Homo sapiens
gtgcggttcaccata

SEQ ID NO: 9119 - DNA, 15 bp, Homo sapiens
tgtgcggttcaccat

SEQ ID NO: 9120 - DNA, 15 bp, Homo sapiens
atgtgcggttcacca

SEQ ID NO: 9121 - DNA, 15 bp, Homo sapiens
catgtgcggttcacc

SEQ ID NO: 9122 - DNA, 15 bp, Homo sapiens
gcatgtgcggttcac

SEQ ID NO: 9123 - DNA, 15 bp, Homo sapiens
cgcatgtgcggttca

SEQ ID NO: 9124 - DNA, 15 bp, Homo sapiens
tcgcatgtgcggttc

SEQ ID NO: 9125 - DNA, 15 bp, Homo sapiens
ctcgcatgtgcggtt

SEQ ID NO: 9126 - DNA, 15 bp, Homo sapiens
cctcgcatgtgcggt

SEQ ID NO: 9127 - DNA, 15 bp, Homo sapiens
ccctcgcatgtgcgg

SEQ ID NO: 9128 - DNA, 15 bp, Homo sapiens
tccctcgcatgtgcg

SEQ ID NO: 9129 - DNA, 15 bp, Homo sapiens
atccctcgcatgtgc

SEQ ID NO: 9130 - DNA, 15 bp, Homo sapiens
gatccctcgcatgtg

SEQ ID NO: 9131 - DNA, 15 bp, Homo sapiens
agatccctcgcatgt

SEQ ID NO: 9132 - DNA, 15 bp, Homo sapiens
tagatccctcgcatg

SEQ ID NO: 9133 - DNA, 15 bp, Homo sapiens
ctagatccctcgcat

SEQ ID NO: 9134 - DNA, 15 bp, Homo sapiens
cctagatccctcgca

SEQ ID NO: 9135 - DNA, 15 bp, Homo sapiens
acctagatccctcgc

SEQ ID NO: 9136 - DNA, 15 bp, Homo sapiens
aacctagatccctcg

SEQ ID NO: 9137 - DNA, 15 bp, Homo sapiens
caacctagatccctc

SEQ ID NO: 9138 - DNA, 15 bp, Homo sapiens
gcaacctagatccct

SEQ ID NO: 9139 - DNA, 15 bp, Homo sapiens
ggcaacctagatccc

SEQ ID NO: 9140 - DNA, 15 bp, Homo sapiens
aggcaacctagatcc

SEQ ID NO: 9141 - DNA, 15 bp, Homo sapiens
caggcaacctagatc

SEQ ID NO: 9142 - DNA, 15 bp, Homo sapiens
gcaggcaacctagat

SEQ ID NO: 9143 - DNA, 15 bp, Homo sapiens
agcaggcaacctaga

SEQ ID NO: 9144 - DNA, 15 bp, Homo sapiens
gagcaggcaacctag

SEQ ID NO: 9145 - DNA, 15 bp, Homo sapiens
ggagcaggcaaccta

SEQ ID NO: 9146 - DNA, 15 bp, Homo sapiens
aggagcaggcaacct

SEQ ID NO: 9147 - DNA, 15 bp, Homo sapiens
aaggagcaggcaacc

SEQ ID NO: 9148 - DNA, 15 bp, Homo sapiens
taaggagcaggcaac

SEQ ID NO: 9149 - DNA, 15 bp, Homo sapiens
ataaggagcaggcaa

SEQ ID NO: 9150 - DNA, 15 bp, Homo sapiens
cataaggagcaggca

SEQ ID NO: 9151 - DNA, 15 bp, Homo sapiens
tcataaggagcaggc

SEQ ID NO: 9152 - DNA, 15 bp, Homo sapiens
ctcataaggagcagg

SEQ ID NO: 9153 - DNA, 15 bp, Homo sapiens
tctcataaggagcag

SEQ ID NO: 9154 - DNA, 15 bp, Homo sapiens
ttctcataaggagca

SEQ ID NO: 9155 - DNA, 15 bp, Homo sapiens
attctcataaggagc

SEQ ID NO: 9156 - DNA, 15 bp, Homo sapiens
gattctcataaggag

SEQ ID NO: 9157 - DNA, 15 bp, Homo sapiens
agattctcataagga

SEQ ID NO: 9158 - DNA, 15 bp, Homo sapiens
tagattctcataagg

SEQ ID NO: 9159 - DNA, 15 bp, Homo sapiens
ttagattctcataag

SEQ ID NO: 9160 - DNA, 15 bp, Homo sapiens
attagattctcataa

SEQ ID NO: 9161 - DNA, 15 bp, Homo sapiens
cattagattctcata

SEQ ID NO: 9162 - DNA, 15 bp, Homo sapiens
gcattagattctcat

SEQ ID NO: 9163 - DNA, 15 bp, Homo sapiens
ggcattagattctca

SEQ ID NO: 9164 - DNA, 15 bp, Homo sapiens
aggcattagattctc

SEQ ID NO: 9165 - DNA, 15 bp, Homo sapiens
caggcattagattct

SEQ ID NO: 9166 - DNA, 15 bp, Homo sapiens
tcaggcattagattc

SEQ ID NO: 9167 - DNA, 15 bp, Homo sapiens
atcaggcattagatt

SEQ ID NO: 9168 - DNA, 15 bp, Homo sapiens
catcaggcattagat

SEQ ID NO: 9169 - DNA, 15 bp, Homo sapiens
tcatcaggcattaga

SEQ ID NO: 9170 - DNA, 15 bp, Homo sapiens
atcatcaggcattag

SEQ ID NO: 9171 - DNA, 15 bp, Homo sapiens
gatcatcaggcatta

SEQ ID NO: 9172 - DNA, 15 bp, Homo sapiens
agatcatcaggcatt

SEQ ID NO: 9173 - DNA, 15 bp, Homo sapiens
cagatcatcaggcat

SEQ ID NO: 9174 - DNA, 15 bp, Homo sapiens
tcagatcatcaggca

SEQ ID NO: 9175 - DNA, 15 bp, Homo sapiens
ctcagatcatcaggc

SEQ ID NO: 9176 - DNA, 15 bp, Homo sapiens
cctcagatcatcagg

SEQ ID NO: 9177 - DNA, 15 bp, Homo sapiens
acctcagatcatcag

SEQ ID NO: 9178 - DNA, 15 bp, Homo sapiens
tacctcagatcatca

SEQ ID NO: 9179 - DNA, 15 bp, Homo sapiens
ctacctcagatcatc

SEQ ID NO: 9180 - DNA, 15 bp, Homo sapiens
tctacctcagatcat

SEQ ID NO: 9181 - DNA, 15 bp, Homo sapiens
ttctacctcagatca

SEQ ID NO: 9182 - DNA, 15 bp, Homo sapiens
gttctacctcagatc

SEQ ID NO: 9183 - DNA, 15 bp, Homo sapiens
tgttctacctcagat

SEQ ID NO: 9184 - DNA, 15 bp, Homo sapiens
ctgttctacctcaga

SEQ ID NO: 9185 - DNA, 15 bp, Homo sapiens
actgttctacctcag

SEQ ID NO: 9186 - DNA, 15 bp, Homo sapiens
aactgttctacctca

SEQ ID NO: 9187 - DNA, 15 bp, Homo sapiens
aaactgttctacctc

SEQ ID NO: 9188 - DNA, 15 bp, Homo sapiens
gaaactgttctacct

SEQ ID NO: 9189 - DNA, 15 bp, Homo sapiens
tgaaactgttctacc

SEQ ID NO: 9190 - DNA, 15 bp, Homo sapiens
atgaaactgttctac

SEQ ID NO: 9191 - DNA, 15 bp, Homo sapiens
gatgaaactgttcta

SEQ ID NO: 9192 - DNA, 15 bp, Homo sapiens
ggatgaaactgttct

SEQ ID NO: 9193 - DNA, 15 bp, Homo sapiens
gggatgaaactgttc

SEQ ID NO: 9194 - DNA, 15 bp, Homo sapiens
tgggatgaaactgtt

SEQ ID NO: 9195 - DNA, 15 bp, Homo sapiens
ttgggatgaaactgt

SEQ ID NO: 9196 - DNA, 15 bp, Homo sapiens
tttgggatgaaactg

SEQ ID NO: 9197 - DNA, 15 bp, Homo sapiens
ttttgggatgaaact

SEQ ID NO: 9198 - DNA, 15 bp, Homo sapiens
gttttgggatgaaac

SEQ ID NO: 9199 - DNA, 15 bp, Homo sapiens
ggttttgggatgaaa

SEQ ID NO: 9200 - DNA, 15 bp, Homo sapiens
tggttttgggatgaa

SEQ ID NO: 9201 - DNA, 15 bp, Homo sapiens
atggttttgggatga

SEQ ID NO: 9202 - DNA, 15 bp, Homo sapiens
gatggttttgggatg

SEQ ID NO: 9203 - DNA, 15 bp, Homo sapiens
ggatggttttgggat

SEQ ID NO: 9204 - DNA, 15 bp, Homo sapiens
gggatggttttggga

SEQ ID NO: 9205 - DNA, 15 bp, Homo sapiens
ggggatggttttggg

SEQ ID NO: 9206 - DNA, 15 bp, Homo sapiens
gggggatggttttgg

SEQ ID NO: 9207 - DNA, 15 bp, Homo sapiens
agggggatggttttg

SEQ ID NO: 9208 - DNA, 15 bp, Homo sapiens
gagggggatggtttt

SEQ ID NO: 9209 - DNA, 15 bp, Homo sapiens
tgagggggatggttt

SEQ ID NO: 9210 - DNA, 15 bp, Homo sapiens
atgagggggatggtt

SEQ ID NO: 9211 - DNA, 15 bp, Homo sapiens
gatgagggggatggt

SEQ ID NO: 9212 - DNA, 15 bp, Homo sapiens
ggatgagggggatgg

SEQ ID NO: 9213 - DNA, 15 bp, Homo sapiens
gggatgagggggatg

SEQ ID NO: 9214 - DNA, 15 bp, Homo sapiens
agggatgagggggat

SEQ ID NO: 9215 - DNA, 15 bp, Homo sapiens
aagggatgaggggga

SEQ ID NO: 9216 - DNA, 15 bp, Homo sapiens
caagggatgaggggg

SEQ ID NO: 9217 - DNA, 15 bp, Homo sapiens
ccaagggatgagggg

SEQ ID NO: 9218 - DNA, 15 bp, Homo sapiens
tccaagggatgaggg

SEQ ID NO: 9219 - DNA, 15 bp, Homo sapiens
ttccaagggatgagg

SEQ ID NO: 9220 - DNA, 15 bp, Homo sapiens
tttccaagggatgag

SEQ ID NO: 9221 - DNA, 15 bp, Homo sapiens
ttttccaagggatga

SEQ ID NO: 9222 - DNA, 15 bp, Homo sapiens
tttttccaagggatg

SEQ ID NO: 9223 - DNA, 15 bp, Homo sapiens
atttttccaagggat

SEQ ID NO: 9224 - DNA, 15 bp, Homo sapiens
aatttttccaaggga

SEQ ID NO: 9225 - DNA, 15 bp, Homo sapiens
caatttttccaaggg

SEQ ID NO: 9226 - DNA, 15 bp, Homo sapiens
acaatttttccaagg

SEQ ID NO: 9227 - DNA, 15 bp, Homo sapiens
gacaatttttccaag

SEQ ID NO: 9228 - DNA, 15 bp, Homo sapiens
agacaatttttccaa

SEQ ID NO: 9229 - DNA, 15 bp, Homo sapiens
cagacaatttttcca

SEQ ID NO: 9230 - DNA, 15 bp, Homo sapiens
gcagacaatttttcc

SEQ ID NO: 9231 - DNA, 15 bp, Homo sapiens
ggcagacaatttttc

SEQ ID NO: 9232 - DNA, 15 bp, Homo sapiens
tggcagacaattttt

SEQ ID NO: 9233 - DNA, 15 bp, Homo sapiens
atggcagacaatttt

SEQ ID NO: 9234 - DNA, 15 bp, Homo sapiens
catggcagacaattt

SEQ ID NO: 9235 - DNA, 15 bp, Homo sapiens
tcatggcagacaatt

SEQ ID NO: 9236 - DNA, 15 bp, Homo sapiens
ttcatggcagacaat

SEQ ID NO: 9237 - DNA, 15 bp, Homo sapiens
tttcatggcagacaa

SEQ ID NO: 9238 - DNA, 15 bp, Homo sapiens
gtttcatggcagaca

SEQ ID NO: 9239 - DNA, 15 bp, Homo sapiens
agtttcatggcagac

SEQ ID NO: 9240 - DNA, 15 bp, Homo sapiens
cagtttcatggcaga

SEQ ID NO: 9241 - DNA, 15 bp, Homo sapiens
ccagtttcatggcag

SEQ ID NO: 9242 - DNA, 15 bp, Homo sapiens
accagtttcatggca

SEQ ID NO: 9243 - DNA, 15 bp, Homo sapiens
gaccagtttcatggc

SEQ ID NO: 9244 - DNA, 15 bp, Homo sapiens
ggaccagtttcatgg

SEQ ID NO: 9245 - DNA, 15 bp, Homo sapiens
gggaccagtttcatg

SEQ ID NO: 9246 - DNA, 15 bp, Homo sapiens
agggaccagtttcat

SEQ ID NO: 9247 - DNA, 15 bp, Homo sapiens
cagggaccagtttca

SEQ ID NO: 9248 - DNA, 15 bp, Homo sapiens
ccagggaccagtttc

SEQ ID NO: 9249 - DNA, 15 bp, Homo sapiens
accagggaccagttt

SEQ ID NO: 9250 - DNA, 15 bp, Homo sapiens
caccagggaccagtt

SEQ ID NO: 9251 - DNA, 15 bp, Homo sapiens
gcaccagggaccagt

SEQ ID NO: 9252 - DNA, 15 bp, Homo sapiens
ggcaccagggaccag

SEQ ID NO: 9253 - DNA, 15 bp, Homo sapiens
tggcaccagggacca

SEQ ID NO: 9254 - DNA, 15 bp, Homo sapiens
ttggcaccagggacc

SEQ ID NO: 9255 - DNA, 15 bp, Homo sapiens
tttggcaccagggac

SEQ ID NO: 9256 - DNA, 15 bp, Homo sapiens
ttttggcaccaggga

SEQ ID NO: 9257 - DNA, 15 bp, Homo sapiens
tttttggcaccaggg

SEQ ID NO: 9258 - DNA, 15 bp, Homo sapiens
ctttttggcaccagg

SEQ ID NO: 9259 - DNA, 15 bp, Homo sapiens
cctttttggcaccag

SEQ ID NO: 9260 - DNA, 15 bp, Homo sapiens
gcctttttggcacca

SEQ ID NO: 9261 - DNA, 15 bp, Homo sapiens
agcctttttggcacc

SEQ ID NO: 9262 - DNA, 15 bp, Homo sapiens
cagcctttttggcac

SEQ ID NO: 9263 - DNA, 15 bp, Homo sapiens
ccagcctttttggca

SEQ ID NO: 9264 - DNA, 15 bp, Homo sapiens
cccagcctttttggc

SEQ ID NO: 9265 - DNA, 15 bp, Homo sapiens
ccccagcctttttgg

SEQ ID NO: 9266 - DNA, 15 bp, Homo sapiens
tccccagcctttttg

SEQ ID NO: 9267 - DNA, 15 bp, Homo sapiens
gtccccagccttttt

SEQ ID NO: 9268 - DNA, 15 bp, Homo sapiens
agtccccagcctttt

SEQ ID NO: 9269 - DNA, 15 bp, Homo sapiens
cagtccccagccttt

SEQ ID NO: 9270 - DNA, 15 bp, Homo sapiens
gcagtccccagcctt

SEQ ID NO: 9271 - DNA, 15 bp, Homo sapiens
agcagtccccagcct

SEQ ID NO: 9272 - DNA, 15 bp, Homo sapiens
cagcagtccccagcc

SEQ ID NO: 9273 - DNA, 15 bp, Homo sapiens
gcagcagtccccagc

SEQ ID NO: 9274 - DNA, 15 bp, Homo sapiens
tgcagcagtccccag

SEQ ID NO: 9275 - DNA, 15 bp, Homo sapiens
gtgcagcagtcccca

SEQ ID NO: 9276 - DNA, 15 bp, Homo sapiens
agtgcagcagtcccc

SEQ ID NO: 9277 - DNA, 15 bp, Homo sapiens
aagtgcagcagtccc

SEQ ID NO: 9278 - DNA, 15 bp, Homo sapiens
aaagtgcagcagtcc

SEQ ID NO: 9279 - DNA, 15 bp, Homo sapiens
taaagtgcagcagtc

SEQ ID NO: 9280 - DNA, 15 bp, Homo sapiens
ttaaagtgcagcagt

SEQ ID NO: 9281 - DNA, 15 bp, Homo sapiens
attaaagtgcagcag

SEQ ID NO: 9282 - DNA, 15 bp, Homo sapiens
aattaaagtgcagca

SEQ ID NO: 9283 - DNA, 15 bp, Homo sapiens
taattaaagtgcagc

SEQ ID NO: 9284 - DNA, 15 bp, Homo sapiens
ttaattaaagtgcag

SEQ ID NO: 9285 - DNA, 15 bp, Homo sapiens
gttaattaaagtgca

SEQ ID NO: 9286 - DNA, 15 bp, Homo sapiens
agttaattaaagtgc

SEQ ID NO: 9287 - DNA, 15 bp, Homo sapiens
gagttaattaaagtg

SEQ ID NO: 9288 - DNA, 15 bp, Homo sapiens
ggagttaattaaagt

SEQ ID NO: 9289 - DNA, 15 bp, Homo sapiens
gggagttaattaaag

SEQ ID NO: 9290 - DNA, 15 bp, Homo sapiens
ggggagttaattaaa

SEQ ID NO: 9291 - DNA, 15 bp, Homo sapiens
tggggagttaattaa

SEQ ID NO: 9292 - DNA, 15 bp, Homo sapiens
ttggggagttaatta

SEQ ID NO: 9293 - DNA, 15 bp, Homo sapiens
cttggggagttaatt

SEQ ID NO: 9294 - DNA, 15 bp, Homo sapiens
tcttggggagttaat

SEQ ID NO: 9295 - DNA, 15 bp, Homo sapiens
ctcttggggagttaa

SEQ ID NO: 9296 - DNA, 15 bp, Homo sapiens
gctcttggggagtta

SEQ ID NO: 9297 - DNA, 15 bp, Homo sapiens
tgctcttggggagtt

SEQ ID NO: 9298 - DNA, 15 bp, Homo sapiens
ctgctcttggggagt

SEQ ID NO: 9299 - DNA, 15 bp, Homo sapiens
cctgctcttggggag

SEQ ID NO: 9300 - DNA, 15 bp, Homo sapiens
ccctgctcttgggga

SEQ ID NO: 9301 - DNA, 15 bp, Homo sapiens
tccctgctcttgggg

SEQ ID NO: 9302 - DNA, 15 bp, Homo sapiens
gtccctgctcttggg

SEQ ID NO: 9303 - DNA, 15 bp, Homo sapiens
ggtccctgctcttgg

SEQ ID NO: 9304 - DNA, 15 bp, Homo sapiens
tggtccctgctcttg

SEQ ID NO: 9305 - DNA, 15 bp, Homo sapiens
ttggtccctgctctt

SEQ ID NO: 9306 - DNA, 15 bp, Homo sapiens
attggtccctgctct

SEQ ID NO: 9307 - DNA, 15 bp, Homo sapiens
tattggtccctgctc

SEQ ID NO: 9308 - DNA, 15 bp, Homo sapiens
gtattggtccctgct

SEQ ID NO: 9309 - DNA, 15 bp, Homo sapiens
tgtattggtccctgc

SEQ ID NO: 9310 - DNA, 15 bp, Homo sapiens
atgtattggtccctg

SEQ ID NO: 9311 - DNA, 15 bp, Homo sapiens
gatgtattggtccct

SEQ ID NO: 9312 - DNA, 15 bp, Homo sapiens
ggatgtattggtccc

SEQ ID NO: 9313 - DNA, 15 bp, Homo sapiens
gggatgtattggtcc

SEQ ID NO: 9314 - DNA, 15 bp, Homo sapiens
agggatgtattggtc

SEQ ID NO: 9315 - DNA, 15 bp, Homo sapiens
cagggatgtattggt

SEQ ID NO: 9316 - DNA, 15 bp, Homo sapiens
ccagggatgtattgg

SEQ ID NO: 9317 - DNA, 15 bp, Homo sapiens
accagggatgtattg

SEQ ID NO: 9318 - DNA, 15 bp, Homo sapiens
taccagggatgtatt

SEQ ID NO: 9319 - DNA, 15 bp, Homo sapiens
gtaccagggatgtat

SEQ ID NO: 9320 - DNA, 15 bp, Homo sapiens
agtaccagggatgta

SEQ ID NO: 9321 - DNA, 15 bp, Homo sapiens
cagtaccagggatgt

SEQ ID NO: 9322 - DNA, 15 bp, Homo sapiens
tcagtaccagggatg

SEQ ID NO: 9323 - DNA, 15 bp, Homo sapiens
ctcagtaccagggat

SEQ ID NO: 9324 - DNA, 15 bp, Homo sapiens
gctcagtaccaggga

SEQ ID NO: 9325 - DNA, 15 bp, Homo sapiens
ggctcagtaccaggg

SEQ ID NO: 9326 - DNA, 15 bp, Homo sapiens
gggctcagtaccagg

SEQ ID NO: 9327 - DNA, 15 bp, Homo sapiens
tgggctcagtaccag

SEQ ID NO: 9328 - DNA, 15 bp, Homo sapiens
ttgggctcagtacca

SEQ ID NO: 9329 - DNA, 15 bp, Homo sapiens
attgggctcagtacc

SEQ ID NO: 9330 - DNA, 15 bp, Homo sapiens
cattgggctcagtac

SEQ ID NO: 9331 - DNA, 15 bp, Homo sapiens
gcattgggctcagta

SEQ ID NO: 9332 - DNA, 15 bp, Homo sapiens
ggcattgggctcagt

SEQ ID NO: 9333 - DNA, 15 bp, Homo sapiens
aggcattgggctcag

SEQ ID NO: 9334 - DNA, 15 bp, Homo sapiens
caggcattgggctca

SEQ ID NO: 9335 - DNA, 15 bp, Homo sapiens
ccaggcattgggctc

SEQ ID NO: 9336 - DNA, 15 bp, Homo sapiens
gccaggcattgggct

SEQ ID NO: 9337 - DNA, 15 bp, Homo sapiens
agccaggcattgggc

SEQ ID NO: 9338 - DNA, 15 bp, Homo sapiens
gagccaggcattggg

SEQ ID NO: 9339 - DNA, 15 bp, Homo sapiens
tgagccaggcattgg

SEQ ID NO: 9340 - DNA, 15 bp, Homo sapiens
atgagccaggcattg

SEQ ID NO: 9341 - DNA, 15 bp, Homo sapiens
tatgagccaggcatt

SEQ ID NO: 9342 - DNA, 15 bp, Homo sapiens
ttatgagccaggcat

SEQ ID NO: 9343 - DNA, 15 bp, Homo sapiens
attatgagccaggca

SEQ ID NO: 9344 - DNA, 15 bp, Homo sapiens
tattatgagccaggc

SEQ ID NO: 9345 - DNA, 15 bp, Homo sapiens
ctattatgagccagg

SEQ ID NO: 9346 - DNA, 15 bp, Homo sapiens
cctattatgagccag

SEQ ID NO: 9347 - DNA, 15 bp, Homo sapiens
acctattatgagcca

SEQ ID NO: 9348 - DNA, 15 bp, Homo sapiens
cacctattatgagcc

SEQ ID NO: 9349 - DNA, 15 bp, Homo sapiens
tcacctattatgagc

SEQ ID NO: 9350 - DNA, 15 bp, Homo sapiens
ctcacctattatgag

SEQ ID NO: 9351 - DNA, 15 bp, Homo sapiens
gctcacctattatga

SEQ ID NO: 9352 - DNA, 15 bp, Homo sapiens
tgctcacctattatg

SEQ ID NO: 9353 - DNA, 15 bp, Homo sapiens
ttgctcacctattat

SEQ ID NO: 9354 - DNA, 15 bp, Homo sapiens
attgctcacctatta

SEQ ID NO: 9355 - DNA, 15 bp, Homo sapiens
tattgctcacctatt

SEQ ID NO: 9356 - DNA, 15 bp, Homo sapiens
ttattgctcacctat

SEQ ID NO: 9357 - DNA, 15 bp, Homo sapiens
tttattgctcaccta

SEQ ID NO: 9358 - DNA, 15 bp, Homo sapiens
atttattgctcacct

SEQ ID NO: 9359 - DNA, 15 bp, Homo sapiens
catttattgctcacc

SEQ ID NO: 9360 - DNA, 15 bp, Homo sapiens
acatttattgctcac

SEQ ID NO: 9361 - DNA, 15 bp, Homo sapiens
aacatttattgctca

SEQ ID NO: 9362 - DNA, 15 bp, Homo sapiens
aaacatttattgctc

SEQ ID NO: 9363 - DNA, 15 bp, Homo sapiens
taaacatttattgct

SEQ ID NO: 9364 - DNA, 15 bp, Homo sapiens
ataaacatttattgc

SEQ ID NO: 9365 - DNA, 15 bp, Homo sapiens
gaataaacatttatt

SEQ ID NO: 9366 - DNA, 15 bp, Homo sapiens
tgaataaacatttat

SEQ ID NO: 9367 - DNA, 15 bp, Homo sapiens
ttgaataaacattta

SEQ ID NO: 9368 - DNA, 15 bp, Homo sapiens
attgaataaacattt

SEQ ID NO: 9369 - DNA, 15 bp, Homo sapiens
cattgaataaacatt

SEQ ID NO: 9370 - DNA, 15 bp, Homo sapiens
tcattgaataaacat

SEQ ID NO: 9371 - DNA, 15 bp, Homo sapiens
atcattgaataaaca

SEQ ID NO: 9372 - DNA, 15 bp, Homo sapiens
tatcattgaataaac

SEQ ID NO: 9373 - DNA, 15 bp, Homo sapiens
ttatcattgaataaa

SEQ ID NO: 9374 - DNA, 15 bp, Homo sapiens
tttatcattgaataa

SEQ ID NO: 9375 - DNA, 15 bp, Homo sapiens
ctttatcattgaata

SEQ ID NO: 9376 - DNA, 15 bp, Homo sapiens
cctttatcattgaat

SEQ ID NO: 9377 - DNA, 15 bp, Homo sapiens
gcctttatcattgaa

SEQ ID NO: 9378 - DNA, 15 bp, Homo sapiens
agcctttatcattga

SEQ ID NO: 9379 - DNA, 15 bp, Homo sapiens
tagcctttatcattg

SEQ ID NO: 9380 - DNA, 15 bp, Homo sapiens
gtagcctttatcatt

SEQ ID NO: 9381 - DNA, 15 bp, Homo sapiens
tgtagcctttatcat

SEQ ID NO: 9382 - DNA, 15 bp, Homo sapiens
ctgtagcctttatca

SEQ ID NO: 9383 - DNA, 15 bp, Homo sapiens
tctgtagcctttatc

SEQ ID NO: 9384 - DNA, 15 bp, Homo sapiens
ctctgtagcctttat

SEQ ID NO: 9385 - DNA, 15 bp, Homo sapiens
actctgtagccttta

SEQ ID NO: 9386 - DNA, 15 bp, Homo sapiens
gactctgtagccttt

SEQ ID NO: 9387 - DNA, 15 bp, Homo sapiens
agactctgtagcctt

SEQ ID NO: 9388 - DNA, 15 bp, Homo sapiens
cagactctgtagcct

SEQ ID NO: 9389 - DNA, 15 bp, Homo sapiens
ccagactctgtagcc

SEQ ID NO: 9390 - DNA, 15 bp, Homo sapiens
tccagactctgtagc

SEQ ID NO: 9391 - DNA, 15 bp, Homo sapiens
ttccagactctgtag

SEQ ID NO: 9392 - DNA, 15 bp, Homo sapiens
cttccagactctgta

SEQ ID NO: 9393 - DNA, 15 bp, Homo sapiens
acttccagactctgt

SEQ ID NO: 9394 - DNA, 15 bp, Homo sapiens
cacttccagactctg

SEQ ID NO: 9395 - DNA, 15 bp, Homo sapiens
gcacttccagactct

SEQ ID NO: 9396 - DNA, 15 bp, Homo sapiens
ggcacttccagactc

SEQ ID NO: 9397 - DNA, 15 bp, Homo sapiens
tggcacttccagact

SEQ ID NO: 9398 - DNA, 15 bp, Homo sapiens
ctggcacttccagac

SEQ ID NO: 9399 - DNA, 15 bp, Homo sapiens
tctggcacttccaga

SEQ ID NO: 9400 - DNA, 15 bp, Homo sapiens
ctctggcacttccag

SEQ ID NO: 9401 - DNA, 15 bp, Homo sapiens
gctctggcacttcca

SEQ ID NO: 9402 - DNA, 15 bp, Homo sapiens
agctctggcacttcc

SEQ ID NO: 9403 - DNA, 15 bp, Homo sapiens
cagctctggcacttc

SEQ ID NO: 9404 - DNA, 15 bp, Homo sapiens
ccagctctggcactt

SEQ ID NO: 9405 - DNA, 15 bp, Homo sapiens
gccagctctggcact

SEQ ID NO: 9406 - DNA, 15 bp, Homo sapiens
tgccagctctggcac

SEQ ID NO: 9407 - DNA, 15 bp, Homo sapiens
atgccagctctggca

SEQ ID NO: 9408 - DNA, 15 bp, Homo sapiens
aatgccagctctggc

SEQ ID NO: 9409 - DNA, 15 bp, Homo sapiens
aaatgccagctctgg

SEQ ID NO: 9410 - DNA, 15 bp, Homo sapiens
caaatgccagctctg

SEQ ID NO: 9411 - DNA, 15 bp, Homo sapiens
tcaaatgccagctct

SEQ ID NO: 9412 - DNA, 15 bp, Homo sapiens
ttcaaatgccagctc

SEQ ID NO: 9413 - DNA, 15 bp, Homo sapiens
gttcaaatgccagct

SEQ ID NO: 9414 - DNA, 15 bp, Homo sapiens
agttcaaatgccagc

SEQ ID NO: 9415 - DNA, 15 bp, Homo sapiens
gagttcaaatgccag

SEQ ID NO: 9416 - DNA, 15 bp, Homo sapiens
tgagttcaaatgcca

SEQ ID NO: 9417 - DNA, 15 bp, Homo sapiens
ctgagttcaaatgcc

SEQ ID NO: 9418 - DNA, 15 bp, Homo sapiens
tctgagttcaaatgc

SEQ ID NO: 9419 - DNA, 15 bp, Homo sapiens
atctgagttcaaatg

SEQ ID NO: 9420 - DNA, 15 bp, Homo sapiens
catctgagttcaaat

SEQ ID NO: 9421 - DNA, 15 bp, Homo sapiens
tcatctgagttcaaa

SEQ ID NO: 9422 - DNA, 15 bp, Homo sapiens
atcatctgagttcaa

SEQ ID NO: 9423 - DNA, 15 bp, Homo sapiens
gatcatctgagttca

SEQ ID NO: 9424 - DNA, 15 bp, Homo sapiens
agatcatctgagttc

SEQ ID NO: 9425 - DNA, 15 bp, Homo sapiens
cagatcatctgagtt

SEQ ID NO: 9426 - DNA, 15 bp, Homo sapiens
tcagatcatctgagt

SEQ ID NO: 9427 - DNA, 15 bp, Homo sapiens
gtcagatcatctgag

SEQ ID NO: 9428 - DNA, 15 bp, Homo sapiens
agtcagatcatctga

SEQ ID NO: 9429 - DNA, 15 bp, Homo sapiens
gagtcagatcatctg

SEQ ID NO: 9430 - DNA, 15 bp, Homo sapiens
agagtcagatcatct

SEQ ID NO: 9431 - DNA, 15 bp, Homo sapiens
tagagtcagatcatc

SEQ ID NO: 9432 - DNA, 15 bp, Homo sapiens
ctagagtcagatcat

SEQ ID NO: 9433 - DNA, 15 bp, Homo sapiens
tctagagtcagatca

SEQ ID NO: 9434 - DNA, 15 bp, Homo sapiens
ttctagagtcagatc

SEQ ID NO: 9435 - DNA, 15 bp, Homo sapiens
tttctagagtcagat

SEQ ID NO: 9436 - DNA, 15 bp, Homo sapiens
gtttctagagtcaga

SEQ ID NO: 9437 - DNA, 15 bp, Homo sapiens
ggtttctagagtcag

SEQ ID NO: 9438 - DNA, 15 bp, Homo sapiens
gggtttctagagtca

SEQ ID NO: 9439 - DNA, 15 bp, Homo sapiens
agggtttctagagtc

SEQ ID NO: 9440 - DNA, 15 bp, Homo sapiens
cagggtttctagagt

SEQ ID NO: 9441 - DNA, 15 bp, Homo sapiens
gcagggtttctagag

SEQ ID NO: 9442 - DNA, 15 bp, Homo sapiens
tgcagggtttctaga

SEQ ID NO: 9443 - DNA, 15 bp, Homo sapiens
atgcagggtttctag

SEQ ID NO: 9444 - DNA, 15 bp, Homo sapiens
aatgcagggtttcta

SEQ ID NO: 9445 - DNA, 15 bp, Homo sapiens
aaatgcagggtttct

SEQ ID NO: 9446 - DNA, 15 bp, Homo sapiens
caaatgcagggtttc

SEQ ID NO: 9447 - DNA, 15 bp, Homo sapiens
tcaaatgcagggttt

SEQ ID NO: 9448 - DNA, 15 bp, Homo sapiens
gtcaaatgcagggtt

SEQ ID NO: 9449 - DNA, 15 bp, Homo sapiens
ggtcaaatgcagggt

SEQ ID NO: 9450 - DNA, 15 bp, Homo sapiens
aggtcaaatgcaggg

SEQ ID NO: 9451 - DNA, 15 bp, Homo sapiens
gaggtcaaatgcagg

SEQ ID NO: 9452 - DNA, 15 bp, Homo sapiens
agaggtcaaatgcag

SEQ ID NO: 9453 - DNA, 15 bp, Homo sapiens
tagaggtcaaatgca

SEQ ID NO: 9454 - DNA, 15 bp, Homo sapiens
atagaggtcaaatgc

SEQ ID NO: 9455 - DNA, 15 bp, Homo sapiens
catagaggtcaaatg

SEQ ID NO: 9456 - DNA, 15 bp, Homo sapiens
ccatagaggtcaaat

SEQ ID NO: 9457 - DNA, 15 bp, Homo sapiens
tccatagaggtcaaa

SEQ ID NO: 9458 - DNA, 15 bp, Homo sapiens
ctccatagaggtcaa

SEQ ID NO: 9459 - DNA, 15 bp, Homo sapiens
actccatagaggtca

SEQ ID NO: 9460 - DNA, 15 bp, Homo sapiens
cactccatagaggtc

SEQ ID NO: 9461 - DNA, 15 bp, Homo sapiens
gcactccatagaggt

SEQ ID NO: 9462 - DNA, 15 bp, Homo sapiens
ggcactccatagagg

SEQ ID NO: 9463 - DNA, 15 bp, Homo sapiens
gggcactccatagag

SEQ ID NO: 9464 - DNA, 15 bp, Homo sapiens
tgggcactccataga

SEQ ID NO: 9465 - DNA, 15 bp, Homo sapiens
ctgggcactccatag

SEQ ID NO: 9466 - DNA, 15 bp, Homo sapiens
actgggcactccata

SEQ ID NO: 9467 - DNA, 15 bp, Homo sapiens
gactgggcactccat

SEQ ID NO: 9468 - DNA, 15 bp, Homo sapiens
agactgggcactcca

SEQ ID NO: 9469 - DNA, 15 bp, Homo sapiens
gagactgggcactcc

SEQ ID NO: 9470 - DNA, 15 bp, Homo sapiens
ggagactgggcactc

SEQ ID NO: 9471 - DNA, 15 bp, Homo sapiens
aggagactgggcact

SEQ ID NO: 9472 - DNA, 15 bp, Homo sapiens
taggagactgggcac

SEQ ID NO: 9473 - DNA, 15 bp, Homo sapiens
ttaggagactgggca

SEQ ID NO: 9474 - DNA, 15 bp, Homo sapiens
gttaggagactgggc

SEQ ID NO: 9475 - DNA, 15 bp, Homo sapiens
agttaggagactggg

SEQ ID NO: 9476 - DNA, 15 bp, Homo sapiens
gagttaggagactgg

SEQ ID NO: 9477 - DNA, 15 bp, Homo sapiens
tgagttaggagactg

SEQ ID NO: 9478 - DNA, 15 bp, Homo sapiens
gtgagttaggagact

SEQ ID NO: 9479 - DNA, 15 bp, Homo sapiens
tgtgagttaggagac

SEQ ID NO: 9480 - DNA, 15 bp, Homo sapiens
ttgtgagttaggaga

SEQ ID NO: 9481 - DNA, 15 bp, Homo sapiens
cttgtgagttaggag

SEQ ID NO: 9482 - DNA, 15 bp, Homo sapiens
tcttgtgagttagga

SEQ ID NO: 9483 - DNA, 15 bp, Homo sapiens
gtcttgtgagttagg

SEQ ID NO: 9484 - DNA, 15 bp, Homo sapiens
tgtcttgtgagttag

SEQ ID NO: 9485 - DNA, 15 bp, Homo sapiens
atgtcttgtgagtta

SEQ ID NO: 9486 - DNA, 15 bp, Homo sapiens
aatgtcttgtgagtt

SEQ ID NO: 9487 - DNA, 15 bp, Homo sapiens
aaatgtcttgtgagt

SEQ ID NO: 9488 - DNA, 15 bp, Homo sapiens
aaaatgtcttgtgag

SEQ ID NO: 9489 - DNA, 15 bp, Homo sapiens
taaaatgtcttgtga

SEQ ID NO: 9490 - DNA, 15 bp, Homo sapiens
ataaaatgtcttgtg

SEQ ID NO: 9491 - DNA, 15 bp, Homo sapiens
aataaaatgtcttgt

SEQ ID NO: 9492 - DNA, 15 bp, Homo sapiens
gaataaaatgtcttg

SEQ ID NO: 9493 - DNA, 15 bp, Homo sapiens
ggaataaaatgtctt

SEQ ID NO: 9494 - DNA, 15 bp, Homo sapiens
tggaataaaatgtct

SEQ ID NO: 9495 - DNA, 15 bp, Homo sapiens
atggaataaaatgtc

SEQ ID NO: 9496 - DNA, 15 bp, Homo sapiens
aatggaataaaatgt

SEQ ID NO: 9497 - DNA, 15 bp, Homo sapiens
caatggaataaaatg

SEQ ID NO: 9498 - DNA, 15 bp, Homo sapiens
gcaatggaataaaat

SEQ ID NO: 9499 - DNA, 15 bp, Homo sapiens
agcaatggaataaaa

SEQ ID NO: 9500 - DNA, 15 bp, Homo sapiens
cagcaatggaataaa

SEQ ID NO: 9501 - DNA, 15 bp, Homo sapiens
gcagcaatggaataa

SEQ ID NO: 9502 - DNA, 15 bp, Homo sapiens
agcagcaatggaata

SEQ ID NO: 9503 - DNA, 15 bp, Homo sapiens
gagcagcaatggaat

SEQ ID NO: 9504 - DNA, 15 bp, Homo sapiens
cgagcagcaatggaa

SEQ ID NO: 9505 - DNA, 15 bp, Homo sapiens
ccgagcagcaatgga

SEQ ID NO: 9506 - DNA, 15 bp, Homo sapiens
accgagcagcaatgg

SEQ ID NO: 9507 - DNA, 15 bp, Homo sapiens
caccgagcagcaatg

SEQ ID NO: 9508 - DNA, 15 bp, Homo sapiens
tcaccgagcagcaat

SEQ ID NO: 9509 - DNA, 15 bp, Homo sapiens
gtcaccgagcagcaa

SEQ ID NO: 9510 - DNA, 15 bp, Homo sapiens
agtcaccgagcagca

SEQ ID NO: 9511 - DNA, 15 bp, Homo sapiens
gagtcaccgagcagc

SEQ ID NO: 9512 - DNA, 15 bp, Homo sapiens
agagtcaccgagcag

SEQ ID NO: 9513 - DNA, 15 bp, Homo sapiens
aagagtcaccgagca

SEQ ID NO: 9514 - DNA, 15 bp, Homo sapiens
gaagagtcaccgagc

SEQ ID NO: 9515 - DNA, 15 bp, Homo sapiens
agaagagtcaccgag

SEQ ID NO: 9516 - DNA, 15 bp, Homo sapiens
aagaagagtcaccga

SEQ ID NO: 9517 - DNA, 15 bp, Homo sapiens
gaagaagagtcaccg

SEQ ID NO: 9518 - DNA, 15 bp, Homo sapiens
tgaagaagagtcacc

SEQ ID NO: 9519 - DNA, 15 bp, Homo sapiens
atgaagaagagtcac

SEQ ID NO: 9520 - DNA, 15 bp, Homo sapiens
aatgaagaagagtca

SEQ ID NO: 9521 - DNA, 15 bp, Homo sapiens
aaatgaagaagagtc

SEQ ID NO: 9522 - DNA, 15 bp, Homo sapiens
aaaatgaagaagagt

SEQ ID NO: 9523 - DNA, 15 bp, Homo sapiens
caaaatgaagaagag

SEQ ID NO: 9524 - DNA, 15 bp, Homo sapiens
acaaaatgaagaaga

SEQ ID NO: 9525 - DNA, 15 bp, Homo sapiens
cacaaaatgaagaag

SEQ ID NO: 9526 - DNA, 15 bp, Homo sapiens
gcacaaaatgaagaa

SEQ ID NO: 9527 - DNA, 15 bp, Homo sapiens
ggcacaaaatgaaga

SEQ ID NO: 9528 - DNA, 15 bp, Homo sapiens
aggcacaaaatgaag

SEQ ID NO: 9529 - DNA, 15 bp, Homo sapiens
taggcacaaaatgaa

SEQ ID NO: 9530 - DNA, 15 bp, Homo sapiens
ttaggcacaaaatga

SEQ ID NO: 9531 - DNA, 15 bp, Homo sapiens
attaggcacaaaatg

SEQ ID NO: 9532 - DNA, 15 bp, Homo sapiens
aattaggcacaaaat

SEQ ID NO: 9533 - DNA, 15 bp, Homo sapiens
gaattaggcacaaaa

SEQ ID NO: 9534 - DNA, 15 bp, Homo sapiens
agaattaggcacaaa

SEQ ID NO: 9535 - DNA, 15 bp, Homo sapiens
cagaattaggcacaa

SEQ ID NO: 9536 - DNA, 15 bp, Homo sapiens
acagaattaggcaca

SEQ ID NO: 9537 - DNA, 15 bp, Homo sapiens
gacagaattaggcac

SEQ ID NO: 9538 - DNA, 15 bp, Homo sapiens
ggacagaattaggca

SEQ ID NO: 9539 - DNA, 15 bp, Homo sapiens
gggacagaattaggc

SEQ ID NO: 9540 - DNA, 15 bp, Homo sapiens
agggacagaattagg

SEQ ID NO: 9541 - DNA, 15 bp, Homo sapiens
aagggacagaattag

SEQ ID NO: 9542 - DNA, 15 bp, Homo sapiens
taagggacagaatta

SEQ ID NO: 9543 - DNA, 15 bp, Homo sapiens
gtaagggacagaatt

SEQ ID NO: 9544 - DNA, 15 bp, Homo sapiens
tgtaagggacagaat

SEQ ID NO: 9545 - DNA, 15 bp, Homo sapiens
gtgtaagggacagaa

SEQ ID NO: 9546 - DNA, 15 bp, Homo sapiens
tgtgtaagggacaga

SEQ ID NO: 9547 - DNA, 15 bp, Homo sapiens
atgtgtaagggacag

SEQ ID NO: 9548 - DNA, 15 bp, Homo sapiens
aatgtgtaagggaca

SEQ ID NO: 9549 - DNA, 15 bp, Homo sapiens
aaatgtgtaagggac

SEQ ID NO: 9550 - DNA, 15 bp, Homo sapiens
aaaatgtgtaaggga

SEQ ID NO: 9551 - DNA, 15 bp, Homo sapiens
caaaatgtgtaaggg

SEQ ID NO: 9552 - DNA, 15 bp, Homo sapiens
gcaaaatgtgtaagg

SEQ ID NO: 9553 - DNA, 15 bp, Homo sapiens
tgcaaaatgtgtaag

SEQ ID NO: 9554 - DNA, 15 bp, Homo sapiens
gtgcaaaatgtgtaa

SEQ ID NO: 9555 - DNA, 15 bp, Homo sapiens
agtgcaaaatgtgta

SEQ ID NO: 9556 - DNA, 15 bp, Homo sapiens
cagtgcaaaatgtgt

SEQ ID NO: 9557 - DNA, 15 bp, Homo sapiens
acagtgcaaaatgtg

SEQ ID NO: 9558 - DNA, 15 bp, Homo sapiens
tacagtgcaaaatgt

SEQ ID NO: 9559 - DNA, 15 bp, Homo sapiens
atacagtgcaaaatg

SEQ ID NO: 9560 - DNA, 15 bp, Homo sapiens
aatacagtgcaaaat

SEQ ID NO: 9561 - DNA, 15 bp, Homo sapiens
taatacagtgcaaaa

SEQ ID NO: 9562 - DNA, 15 bp, Homo sapiens
ttaatacagtgcaaa

SEQ ID NO: 9563 - DNA, 15 bp, Homo sapiens
attaatacagtgcaa

SEQ ID NO: 9564 - DNA, 15 bp, Homo sapiens
aattaatacagtgca

SEQ ID NO: 9565 - DNA, 15 bp, Homo sapiens
caattaatacagtgc

SEQ ID NO: 9566 - DNA, 15 bp, Homo sapiens
acaattaatacagtg

SEQ ID NO: 9567 - DNA, 15 bp, Homo sapiens
tacaattaatacagt

SEQ ID NO: 9568 - DNA, 15 bp, Homo sapiens
atacaattaatacag

SEQ ID NO: 9569 - DNA, 15 bp, Homo sapiens
aatacaattaataca

SEQ ID NO: 9570 - DNA, 15 bp, Homo sapiens
aaatacaattaatac

SEQ ID NO: 9571 - DNA, 15 bp, Homo sapiens
taaatacaattaata

SEQ ID NO: 9572 - DNA, 15 bp, Homo sapiens
ataaatacaattaat

SEQ ID NO: 9573 - DNA, 15 bp, Homo sapiens
tataaatacaattaa

SEQ ID NO: 9574 - DNA, 15 bp, Homo sapiens
gtataaatacaatta

SEQ ID NO: 9575 - DNA, 15 bp, Homo sapiens
tgtataaatacaatt

SEQ ID NO: 9576 - DNA, 15 bp, Homo sapiens
ctgtataaatacaat

SEQ ID NO: 9577 - DNA, 15 bp, Homo sapiens
gctgtataaatacaa

SEQ ID NO: 9578 - DNA, 15 bp, Homo sapiens
agctgtataaataca

SEQ ID NO: 9579 - DNA, 15 bp, Homo sapiens
gagctgtataaatac

SEQ ID NO: 9580 - DNA, 15 bp, Homo sapiens
agagctgtataaata

SEQ ID NO: 9581 - DNA, 15 bp, Homo sapiens
aagagctgtataaat

SEQ ID NO: 9582 - DNA, 15 bp, Homo sapiens
gaagagctgtataaa

SEQ ID NO: 9583 - DNA, 15 bp, Homo sapiens
agaagagctgtataa

SEQ ID NO: 9584 - DNA, 15 bp, Homo sapiens
tagaagagctgtata

SEQ ID NO: 9585 - DNA, 15 bp, Homo sapiens
atagaagagctgtat

SEQ ID NO: 9586 - DNA, 15 bp, Homo sapiens
gatagaagagctgta

SEQ ID NO: 9587 - DNA, 15 bp, Homo sapiens
agatagaagagctgt

SEQ ID NO: 9588 - DNA, 15 bp, Homo sapiens
gagatagaagagctg

SEQ ID NO: 9589 - DNA, 15 bp, Homo sapiens
agagatagaagagct

SEQ ID NO: 9590 - DNA, 15 bp, Homo sapiens
aagagatagaagagc

SEQ ID NO: 9591 - DNA, 15 bp, Homo sapiens
aaagagatagaagag

SEQ ID NO: 9592 - DNA, 15 bp, Homo sapiens
aaaagagatagaaga

SEQ ID NO: 9593 - DNA, 15 bp, Homo sapiens
aaaaagagatagaag

SEQ ID NO: 9594 - DNA, 15 bp, Homo sapiens
aaaaaagagatagaa

SEQ ID NO: 9595 - DNA, 15 bp, Homo sapiens
aaaaaaagagataga

SEQ ID NO: 9596 - DNA, 15 bp, Homo sapiens
caaaaaaagagatag

SEQ ID NO: 9597 - DNA, 15 bp, Homo sapiens
acaaaaaaagagata

SEQ ID NO: 9598 - DNA, 15 bp, Homo sapiens
tacaaaaaaagagat

SEQ ID NO: 9599 - DNA, 15 bp, Homo sapiens
ctacaaaaaaagaga

SEQ ID NO: 9600 - DNA, 15 bp, Homo sapiens
actacaaaaaaagag

SEQ ID NO: 9601 - DNA, 15 bp, Homo sapiens
aactacaaaaaaaga

SEQ ID NO: 9602 - DNA, 15 bp, Homo sapiens
aaactacaaaaaaag

SEQ ID NO: 9603 - DNA, 15 bp, Homo sapiens
aaaactacaaaaaaa

SEQ ID NO: 9604 - DNA, 15 bp, Homo sapiens
gaaaactacaaaaaa

SEQ ID NO: 9605 - DNA, 15 bp, Homo sapiens
tgaaaactacaaaaa

SEQ ID NO: 9606 - DNA, 15 bp, Homo sapiens
ctgaaaactacaaaa

SEQ ID NO: 9607 - DNA, 15 bp, Homo sapiens
cctgaaaactacaaa

SEQ ID NO: 9608 - DNA, 15 bp, Homo sapiens
ccctgaaaactacaa

SEQ ID NO: 9609 - DNA, 15 bp, Homo sapiens
cccctgaaaactaca

SEQ ID NO: 9610 - DNA, 15 bp, Homo sapiens
acccctgaaaactac

SEQ ID NO: 9611 - DNA, 15 bp, Homo sapiens
cacccctgaaaacta

SEQ ID NO: 9612 - DNA, 15 bp, Homo sapiens
ccacccctgaaaact

SEQ ID NO: 9613 - DNA, 15 bp, Homo sapiens
cccacccctgaaaac

SEQ ID NO: 9614 - DNA, 15 bp, Homo sapiens
tcccacccctgaaaa

SEQ ID NO: 9615 - DNA, 15 bp, Homo sapiens
gtcccacccctgaaa

SEQ ID NO: 9616 - DNA, 15 bp, Homo sapiens
ggtcccacccctgaa

SEQ ID NO: 9617 - DNA, 15 bp, Homo sapiens
gggtcccacccctga

SEQ ID NO: 9618 - DNA, 15 bp, Homo sapiens
agggtcccacccctg

SEQ ID NO: 9619 - DNA, 15 bp, Homo sapiens
cagggtcccacccct

SEQ ID NO: 9620 - DNA, 15 bp, Homo sapiens
ccagggtcccacccc

SEQ ID NO: 9621 - DNA, 15 bp, Homo sapiens
tccagggtcccaccc

SEQ ID NO: 9622 - DNA, 15 bp, Homo sapiens
gtccagggtcccacc

SEQ ID NO: 9623 - DNA, 15 bp, Homo sapiens
agtccagggtcccac

SEQ ID NO: 9624 - DNA, 15 bp, Homo sapiens
cagtccagggtccca

SEQ ID NO: 9625 - DNA, 15 bp, Homo sapiens
acagtccagggtccc

SEQ ID NO: 9626 - DNA, 15 bp, Homo sapiens
cacagtccagggtcc

SEQ ID NO: 9627 - DNA, 15 bp, Homo sapiens
tcacagtccagggtc

SEQ ID NO: 9628 - DNA, 15 bp, Homo sapiens
ctcacagtccagggt

SEQ ID NO: 9629 - DNA, 15 bp, Homo sapiens
cctcacagtccaggg

SEQ ID NO: 9630 - DNA, 15 bp, Homo sapiens
acctcacagtccagg

SEQ ID NO: 9631 - DNA, 15 bp, Homo sapiens
tacctcacagtccag

SEQ ID NO: 9632 - DNA, 15 bp, Homo sapiens
ctacctcacagtcca

SEQ ID NO: 9633 - DNA, 15 bp, Homo sapiens
tctacctcacagtcc

SEQ ID NO: 9634 - DNA, 15 bp, Homo sapiens
ctctacctcacagtc

SEQ ID NO: 9635 - DNA, 15 bp, Homo sapiens
gctctacctcacagt

SEQ ID NO: 9636 - DNA, 15 bp, Homo sapiens
agctctacctcacag

SEQ ID NO: 9637 - DNA, 15 bp, Homo sapiens
gagctctacctcaca

SEQ ID NO: 9638 - DNA, 15 bp, Homo sapiens
ggagctctacctcac

SEQ ID NO: 9639 - DNA, 15 bp, Homo sapiens
aggagctctacctca

SEQ ID NO: 9640 - DNA, 15 bp, Homo sapiens
gaggagctctacctc

SEQ ID NO: 9641 - DNA, 15 bp, Homo sapiens
agaggagctctacct

SEQ ID NO: 9642 - DNA, 15 bp, Homo sapiens
cagaggagctctacc

SEQ ID NO: 9643 - DNA, 15 bp, Homo sapiens
ccagaggagctctac

SEQ ID NO: 9644 - DNA, 15 bp, Homo sapiens
tccagaggagctcta

SEQ ID NO: 9645 - DNA, 15 bp, Homo sapiens
gtccagaggagctct

SEQ ID NO: 9646 - DNA, 15 bp, Homo sapiens
ggtccagaggagctc

SEQ ID NO: 9647 - DNA, 15 bp, Homo sapiens
gggtccagaggagct

SEQ ID NO: 9648 - DNA, 15 bp, Homo sapiens
ggggtccagaggagc

SEQ ID NO: 9649 - DNA, 15 bp, Homo sapiens
tggggtccagaggag

SEQ ID NO: 9650 - DNA, 15 bp, Homo sapiens
ctggggtccagagga

SEQ ID NO: 9651 - DNA, 15 bp, Homo sapiens
cctggggtccagagg

SEQ ID NO: 9652 - DNA, 15 bp, Homo sapiens
acctggggtccagag

SEQ ID NO: 9653 - DNA, 15 bp, Homo sapiens
aacctggggtccaga

SEQ ID NO: 9654 - DNA, 15 bp, Homo sapiens
taacctggggtccag

SEQ ID NO: 9655 - DNA, 15 bp, Homo sapiens
ctaacctggggtcca

SEQ ID NO: 9656 - DNA, 15 bp, Homo sapiens
actaacctggggtcc

SEQ ID NO: 9657 - DNA, 15 bp, Homo sapiens
tactaacctggggtc

SEQ ID NO: 9658 - DNA, 15 bp, Homo sapiens
atactaacctggggt

SEQ ID NO: 9659 - DNA, 15 bp, Homo sapiens
gatactaacctgggg

SEQ ID NO: 9660 - DNA, 15 bp, Homo sapiens
agatactaacctggg

SEQ ID NO: 9661 - DNA, 15 bp, Homo sapiens
gagatactaacctgg

SEQ ID NO: 9662 - DNA, 15 bp, Homo sapiens
tgagatactaacctg

SEQ ID NO: 9663 - DNA, 15 bp, Homo sapiens
ctgagatactaacct

SEQ ID NO: 9664 - DNA, 15 bp, Homo sapiens
tctgagatactaacc

SEQ ID NO: 9665 - DNA, 15 bp, Homo sapiens
ctctgagatactaac

SEQ ID NO: 9666 - DNA, 15 bp, Homo sapiens
gctctgagatactaa

SEQ ID NO: 9667 - DNA, 15 bp, Homo sapiens
ggctctgagatacta

SEQ ID NO: 9668 - DNA, 15 bp, Homo sapiens
gggctctgagatact

SEQ ID NO: 9669 - DNA, 15 bp, Homo sapiens
agggctctgagatac

SEQ ID NO: 9670 - DNA, 15 bp, Homo sapiens
cagggctctgagata

SEQ ID NO: 9671 - DNA, 15 bp, Homo sapiens
tcagggctctgagat

SEQ ID NO: 9672 - DNA, 15 bp, Homo sapiens
gtcagggctctgaga

SEQ ID NO: 9673 - DNA, 15 bp, Homo sapiens
tgtcagggctctgag

SEQ ID NO: 9674 - DNA, 15 bp, Homo sapiens
ttgtcagggctctga

SEQ ID NO: 9675 - DNA, 15 bp, Homo sapiens
cttgtcagggctctg

SEQ ID NO: 9676 - DNA, 15 bp, Homo sapiens
ccttgtcagggctct

SEQ ID NO: 9677 - DNA, 15 bp, Homo sapiens
cccttgtcagggctc

SEQ ID NO: 9678 - DNA, 15 bp, Homo sapiens
tcccttgtcagggct

SEQ ID NO: 9679 - DNA, 15 bp, Homo sapiens
ttcccttgtcagggc

SEQ ID NO: 9680 - DNA, 15 bp, Homo sapiens
cttcccttgtcaggg

SEQ ID NO: 9681 - DNA, 15 bp, Homo sapiens
ccttcccttgtcagg

SEQ ID NO: 9682 - DNA, 15 bp, Homo sapiens
gccttcccttgtcag

SEQ ID NO: 9683 - DNA, 15 bp, Homo sapiens
ggccttcccttgtca

SEQ ID NO: 9684 - DNA, 15 bp, Homo sapiens
tggccttcccttgtc

SEQ ID NO: 9685 - DNA, 15 bp, Homo sapiens
ttggccttcccttgt

SEQ ID NO: 9686 - DNA, 15 bp, Homo sapiens
attggccttcccttg

SEQ ID NO: 9687 - DNA, 15 bp, Homo sapiens
aattggccttccctt

SEQ ID NO: 9688 - DNA, 15 bp, Homo sapiens
caattggccttccct

SEQ ID NO: 9689 - DNA, 15 bp, Homo sapiens
acaattggccttccc

SEQ ID NO: 9690 - DNA, 15 bp, Homo sapiens
tacaattggccttcc

SEQ ID NO: 9691 - DNA, 15 bp, Homo sapiens
ttacaattggccttc

SEQ ID NO: 9692 - DNA, 15 bp, Homo sapiens
cttacaattggcctt

SEQ ID NO: 9693 - DNA, 15 bp, Homo sapiens
tcttacaattggcct

SEQ ID NO: 9694 - DNA, 15 bp, Homo sapiens
ctcttacaattggcc

SEQ ID NO: 9695 - DNA, 15 bp, Homo sapiens
tctcttacaattggc

SEQ ID NO: 9696 - DNA, 15 bp, Homo sapiens
gtctcttacaattgg

SEQ ID NO: 9697 - DNA, 15 bp, Homo sapiens
tgtctcttacaattg

SEQ ID NO: 9698 - DNA, 15 bp, Homo sapiens
gtgtctcttacaatt

SEQ ID NO: 9699 - DNA, 15 bp, Homo sapiens
tgtgtctcttacaat

SEQ ID NO: 9700 - DNA, 15 bp, Homo sapiens
ctgtgtctcttacaa

SEQ ID NO: 9701 - DNA, 15 bp, Homo sapiens
gctgtgtctcttaca

SEQ ID NO: 9702 - DNA, 15 bp, Homo sapiens
ggctgtgtctcttac

SEQ ID NO: 9703 - DNA, 15 bp, Homo sapiens
aggctgtgtctctta

SEQ ID NO: 9704 - DNA, 15 bp, Homo sapiens
taggctgtgtctctt

SEQ ID NO: 9705 - DNA, 15 bp, Homo sapiens
gtaggctgtgtctct

SEQ ID NO: 9706 - DNA, 15 bp, Homo sapiens
agtaggctgtgtctc

SEQ ID NO: 9707 - DNA, 15 bp, Homo sapiens
cagtaggctgtgtct

SEQ ID NO: 9708 - DNA, 15 bp, Homo sapiens
gcagtaggctgtgtc

SEQ ID NO: 9709 - DNA, 15 bp, Homo sapiens
agcagtaggctgtgt

SEQ ID NO: 9710 - DNA, 15 bp, Homo sapiens
aagcagtaggctgtg

SEQ ID NO: 9711 - DNA, 15 bp, Homo sapiens
gaagcagtaggctgt

SEQ ID NO: 9712 - DNA, 15 bp, Homo sapiens
agaagcagtaggctg

SEQ ID NO: 9713 - DNA, 15 bp, Homo sapiens
cagaagcagtaggct

SEQ ID NO: 9714 - DNA, 15 bp, Homo sapiens
ccagaagcagtaggc

SEQ ID NO: 9715 - DNA, 15 bp, Homo sapiens
cccagaagcagtagg

SEQ ID NO: 9716 - DNA, 15 bp, Homo sapiens
gcccagaagcagtag

SEQ ID NO: 9717 - DNA, 15 bp, Homo sapiens
ggcccagaagcagta

SEQ ID NO: 9718 - DNA, 15 bp, Homo sapiens
tggcccagaagcagt

SEQ ID NO: 9719 - DNA, 15 bp, Homo sapiens
ctggcccagaagcag

SEQ ID NO: 9720 - DNA, 15 bp, Homo sapiens
actggcccagaagca

SEQ ID NO: 9721 - DNA, 15 bp, Homo sapiens
aactggcccagaagc

SEQ ID NO: 9722 - DNA, 15 bp, Homo sapiens
caactggcccagaag

SEQ ID NO: 9723 - DNA, 15 bp, Homo sapiens
gcaactggcccagaa

SEQ ID NO: 9724 - DNA, 15 bp, Homo sapiens
tgcaactggcccaga

SEQ ID NO: 9725 - DNA, 15 bp, Homo sapiens
atgcaactggcccag

SEQ ID NO: 9726 - DNA, 15 bp, Homo sapiens
gatgcaactggccca

SEQ ID NO: 9727 - DNA, 15 bp, Homo sapiens
ggatgcaactggccc

SEQ ID NO: 9728 - DNA, 15 bp, Homo sapiens
aggatgcaactggcc

SEQ ID NO: 9729 - DNA, 15 bp, Homo sapiens
aaggatgcaactggc

SEQ ID NO: 9730 - DNA, 15 bp, Homo sapiens
aaaggatgcaactgg

SEQ ID NO: 9731 - DNA, 15 bp, Homo sapiens
gaaaggatgcaactg

SEQ ID NO: 9732 - DNA, 15 bp, Homo sapiens
agaaaggatgcaact

SEQ ID NO: 9733 - DNA, 15 bp, Homo sapiens
aagaaaggatgcaac

SEQ ID NO: 9734 - DNA, 15 bp, Homo sapiens
caagaaaggatgcaa

SEQ ID NO: 9735 - DNA, 15 bp, Homo sapiens
tcaagaaaggatgca

SEQ ID NO: 9736 - DNA, 15 bp, Homo sapiens
atcaagaaaggatgc

SEQ ID NO: 9737 - DNA, 15 bp, Homo sapiens
aatcaagaaaggatg

SEQ ID NO: 9738 - DNA, 15 bp, Homo sapiens
aaatcaagaaaggat

SEQ ID NO: 9739 - DNA, 15 bp, Homo sapiens
aaaatcaagaaagga

SEQ ID NO: 9740 - DNA, 15 bp, Homo sapiens
aaaaatcaagaaagg

SEQ ID NO: 9741 - DNA, 15 bp, Homo sapiens
caaaaatcaagaaag

SEQ ID NO: 9742 - DNA, 15 bp, Homo sapiens
ccaaaaatcaagaaa

SEQ ID NO: 9743 - DNA, 15 bp, Homo sapiens
gccaaaaatcaagaa

SEQ ID NO: 9744 - DNA, 15 bp, Homo sapiens
agccaaaaatcaaga

SEQ ID NO: 9745 - DNA, 15 bp, Homo sapiens
gagccaaaaatcaag

SEQ ID NO: 9746 - DNA, 15 bp, Homo sapiens
agagccaaaaatcaa

SEQ ID NO: 9747 - DNA, 15 bp, Homo sapiens
tagagccaaaaatca

SEQ ID NO: 9748 - DNA, 15 bp, Homo sapiens
ctagagccaaaaatc

SEQ ID NO: 9749 - DNA, 15 bp, Homo sapiens
actagagccaaaaat

SEQ ID NO: 9750 - DNA, 15 bp, Homo sapiens
gactagagccaaaaa

SEQ ID NO: 9751 - DNA, 15 bp, Homo sapiens
agactagagccaaaa

SEQ ID NO: 9752 - DNA, 15 bp, Homo sapiens
gagactagagccaaa

SEQ ID NO: 9753 - DNA, 15 bp, Homo sapiens
agagactagagccaa

SEQ ID NO: 9754 - DNA, 15 bp, Homo sapiens
cagagactagagcca

SEQ ID NO: 9755 - DNA, 15 bp, Homo sapiens
acagagactagagcc

SEQ ID NO: 9756 - DNA, 15 bp, Homo sapiens
gacagagactagagc

SEQ ID NO: 9757 - DNA, 15 bp, Homo sapiens
tgacagagactagag

SEQ ID NO: 9758 - DNA, 15 bp, Homo sapiens
atgacagagactaga

SEQ ID NO: 9759 - DNA, 15 bp, Homo sapiens
aatgacagagactag

SEQ ID NO: 9760 - DNA, 15 bp, Homo sapiens
gaatgacagagacta

SEQ ID NO: 9761 - DNA, 15 bp, Homo sapiens
agaatgacagagact

SEQ ID NO: 9762 - DNA, 15 bp, Homo sapiens
gagaatgacagagac

SEQ ID NO: 9763 - DNA, 15 bp, Homo sapiens
agagaatgacagaga

SEQ ID NO: 9764 - DNA, 15 bp, Homo sapiens
cagagaatgacagag

SEQ ID NO: 9765 - DNA, 15 bp, Homo sapiens
acagagaatgacaga

SEQ ID NO: 9766 - DNA, 15 bp, Homo sapiens
aacagagaatgacag

SEQ ID NO: 9767 - DNA, 15 bp, Homo sapiens
caacagagaatgaca

SEQ ID NO: 9768 - DNA, 15 bp, Homo sapiens
tcaacagagaatgac

SEQ ID NO: 9769 - DNA, 15 bp, Homo sapiens
ctcaacagagaatga

SEQ ID NO: 9770 - DNA, 15 bp, Homo sapiens
actcaacagagaatg

SEQ ID NO: 9771 - DNA, 15 bp, Homo sapiens
aactcaacagagaat

SEQ ID NO: 9772 - DNA, 15 bp, Homo sapiens
taactcaacagagaa

SEQ ID NO: 9773 - DNA, 15 bp, Homo sapiens
ctaactcaacagaga

SEQ ID NO: 9774 - DNA, 15 bp, Homo sapiens
gctaactcaacagag

SEQ ID NO: 9775 - DNA, 15 bp, Homo sapiens
tgctaactcaacaga

SEQ ID NO: 9776 - DNA, 15 bp, Homo sapiens
ttgctaactcaacag

SEQ ID NO: 9777 - DNA, 15 bp, Homo sapiens
tttgctaactcaaca

SEQ ID NO: 9778 - DNA, 15 bp, Homo sapiens
ctttgctaactcaac

SEQ ID NO: 9779 - DNA, 15 bp, Homo sapiens
cctttgctaactcaa

SEQ ID NO: 9780 - DNA, 15 bp, Homo sapiens
ccctttgctaactca

SEQ ID NO: 9781 - DNA, 15 bp, Homo sapiens
cccctttgctaactc

SEQ ID NO: 9782 - DNA, 15 bp, Homo sapiens
tcccctttgctaact

SEQ ID NO: 9783 - DNA, 15 bp, Homo sapiens
ttcccctttgctaac

SEQ ID NO: 9784 - DNA, 15 bp, Homo sapiens
tttcccctttgctaa

SEQ ID NO: 9785 - DNA, 15 bp, Homo sapiens
ttttcccctttgcta

SEQ ID NO: 9786 - DNA, 15 bp, Homo sapiens
attttcccctttgct

SEQ ID NO: 9787 - DNA, 15 bp, Homo sapiens
tattttcccctttgc

SEQ ID NO: 9788 - DNA, 15 bp, Homo sapiens
gtattttcccctttg

SEQ ID NO: 9789 - DNA, 15 bp, Homo sapiens
ggtattttccccttt

SEQ ID NO: 9790 - DNA, 15 bp, Homo sapiens
tggtattttcccctt

SEQ ID NO: 9791 - DNA, 15 bp, Homo sapiens
ctggtattttcccct

SEQ ID NO: 9792 - DNA, 15 bp, Homo sapiens
tctggtattttcccc

SEQ ID NO: 9793 - DNA, 15 bp, Homo sapiens
ctctggtattttccc

SEQ ID NO: 9794 - DNA, 15 bp, Homo sapiens
cctctggtattttcc

SEQ ID NO: 9795 - DNA, 15 bp, Homo sapiens
tcctctggtattttc

SEQ ID NO: 9796 - DNA, 15 bp, Homo sapiens
gtcctctggtatttt

SEQ ID NO: 9797 - DNA, 15 bp, Homo sapiens
tgtcctctggtattt

SEQ ID NO: 9798 - DNA, 15 bp, Homo sapiens
ttgtcctctggtatt

SEQ ID NO: 9799 - DNA, 15 bp, Homo sapiens
tttgtcctctggtat

SEQ ID NO: 9800 - DNA, 15 bp, Homo sapiens
gtttgtcctctggta

SEQ ID NO: 9801 - DNA, 15 bp, Homo sapiens
tgtttgtcctctggt

SEQ ID NO: 9802 - DNA, 15 bp, Homo sapiens
ctgtttgtcctctgg

SEQ ID NO: 9803 - DNA, 15 bp, Homo sapiens
actgtttgtcctctg

SEQ ID NO: 9804 - DNA, 15 bp, Homo sapiens
gactgtttgtcctct

SEQ ID NO: 9805 - DNA, 15 bp, Homo sapiens
ggactgtttgtcctc

SEQ ID NO: 9806 - DNA, 15 bp, Homo sapiens
aggactgtttgtcct

SEQ ID NO: 9807 - DNA, 15 bp, Homo sapiens
aaggactgtttgtcc

SEQ ID NO: 9808 - DNA, 15 bp, Homo sapiens
aaaggactgtttgtc

SEQ ID NO: 9809 - DNA, 15 bp, Homo sapiens
caaaggactgtttgt

SEQ ID NO: 9810 - DNA, 15 bp, Homo sapiens
ccaaaggactgtttg

SEQ ID NO: 9811 - DNA, 15 bp, Homo sapiens
cccaaaggactgttt

SEQ ID NO: 9812 - DNA, 15 bp, Homo sapiens
acccaaaggactgtt

SEQ ID NO: 9813 - DNA, 15 bp, Homo sapiens
cacccaaaggactgt

SEQ ID NO: 9814 - DNA, 15 bp, Homo sapiens
ccacccaaaggactg

SEQ ID NO: 9815 - DNA, 15 bp, Homo sapiens
tccacccaaaggact

SEQ ID NO: 9816 - DNA, 15 bp, Homo sapiens
ttccacccaaaggac

SEQ ID NO: 9817 - DNA, 15 bp, Homo sapiens
cttccacccaaagga

SEQ ID NO: 9818 - DNA, 15 bp, Homo sapiens
tcttccacccaaagg

SEQ ID NO: 9819 - DNA, 15 bp, Homo sapiens
atcttccacccaaag

SEQ ID NO: 9820 - DNA, 15 bp, Homo sapiens
tatcttccacccaaa

SEQ ID NO: 9821 - DNA, 15 bp, Homo sapiens
ctatcttccacccaa

SEQ ID NO: 9822 - DNA, 15 bp, Homo sapiens
tctatcttccaccca

SEQ ID NO: 9823 - DNA, 15 bp, Homo sapiens
ctctatcttccaccc

SEQ ID NO: 9824 - DNA, 15 bp, Homo sapiens
tctctatcttccacc

SEQ ID NO: 9825 - DNA, 15 bp, Homo sapiens
ttctctatcttccac

SEQ ID NO: 9826 - DNA, 15 bp, Homo sapiens
tttctctatcttcca

SEQ ID NO: 9827 - DNA, 15 bp, Homo sapiens
atttctctatcttcc

SEQ ID NO: 9828 - DNA, 15 bp, Homo sapiens
catttctctatcttc

SEQ ID NO: 9829 - DNA, 15 bp, Homo sapiens
ccatttctctatctt

SEQ ID NO: 9830 - DNA, 15 bp, Homo sapiens
tccatttctctatct

SEQ ID NO: 9831 - DNA, 15 bp, Homo sapiens
atccatttctctatc

SEQ ID NO: 9832 - DNA, 15 bp, Homo sapiens
tatccatttctctat

SEQ ID NO: 9833 - DNA, 15 bp, Homo sapiens
ttatccatttctcta

SEQ ID NO: 9834 - DNA, 15 bp, Homo sapiens
attatccatttctct

SEQ ID NO: 9835 - DNA, 15 bp, Homo sapiens
cattatccatttctc

SEQ ID NO: 9836 - DNA, 15 bp, Homo sapiens
acattatccatttct

SEQ ID NO: 9837 - DNA, 15 bp, Homo sapiens
cacattatccatttc

SEQ ID NO: 9838 - DNA, 15 bp, Homo sapiens
acacattatccattt

SEQ ID NO: 9839 - DNA, 15 bp, Homo sapiens
aacacattatccatt

SEQ ID NO: 9840 - DNA, 15 bp, Homo sapiens
aaacacattatccat

SEQ ID NO: 9841 - DNA, 15 bp, Homo sapiens
gaaacacattatcca

SEQ ID NO: 9842 - DNA, 15 bp, Homo sapiens
agaaacacattatcc

SEQ ID NO: 9843 - DNA, 15 bp, Homo sapiens
cagaaacacattatc

SEQ ID NO: 9844 - DNA, 15 bp, Homo sapiens
tcagaaacacattat

SEQ ID NO: 9845 - DNA, 15 bp, Homo sapiens
gtcagaaacacatta

SEQ ID NO: 9846 - DNA, 15 bp, Homo sapiens
tgtcagaaacacatt

SEQ ID NO: 9847 - DNA, 15 bp, Homo sapiens
atgtcagaaacacat

SEQ ID NO: 9848 - DNA, 15 bp, Homo sapiens
catgtcagaaacaca

SEQ ID NO: 9849 - DNA, 15 bp, Homo sapiens
tcatgtcagaaacac

SEQ ID NO: 9850 - DNA, 15 bp, Homo sapiens
ttcatgtcagaaaca

SEQ ID NO: 9851 - DNA, 15 bp, Homo sapiens
attcatgtcagaaac

SEQ ID NO: 9852 - DNA, 15 bp, Homo sapiens
aattcatgtcagaaa

SEQ ID NO: 9853 - DNA, 15 bp, Homo sapiens
gaattcatgtcagaa

SEQ ID NO: 9854 - DNA, 15 bp, Homo sapiens
ggaattcatgtcaga

SEQ ID NO: 9855 - DNA, 15 bp, Homo sapiens
aggaattcatgtcag

SEQ ID NO: 9856 - DNA, 15 bp, Homo sapiens
aaggaattcatgtca

SEQ ID NO: 9857 - DNA, 15 bp, Homo sapiens
aaaggaattcatgtc

SEQ ID NO: 9858 - DNA, 15 bp, Homo sapiens
aaaaggaattcatgt

SEQ ID NO: 9859 - DNA, 15 bp, Homo sapiens
aaaaaggaattcatg

SEQ ID NO: 9860 - DNA, 15 bp, Homo sapiens
gaaaaaggaattcat

SEQ ID NO: 9861 - DNA, 15 bp, Homo sapiens
agaaaaaggaattca

SEQ ID NO: 9862 - DNA, 15 bp, Homo sapiens
gagaaaaaggaattc

SEQ ID NO: 9863 - DNA, 15 bp, Homo sapiens
agagaaaaaggaatt

SEQ ID NO: 9864 - DNA, 15 bp, Homo sapiens
aagagaaaaaggaat

SEQ ID NO: 9865 - DNA, 15 bp, Homo sapiens
aaagagaaaaaggaa

SEQ ID NO: 9866 - DNA, 15 bp, Homo sapiens
aaaagagaaaaagga

SEQ ID NO: 9867 - DNA, 15 bp, Homo sapiens
gaaaagagaaaaagg

SEQ ID NO: 9868 - DNA, 15 bp, Homo sapiens
agaaaagagaaaaag

SEQ ID NO: 9869 - DNA, 15 bp, Homo sapiens
aagaaaagagaaaaa

SEQ ID NO: 9870 - DNA, 15 bp, Homo sapiens
gaagaaaagagaaaa

SEQ ID NO: 9871 - DNA, 15 bp, Homo sapiens
agaagaaaagagaaa

SEQ ID NO: 9872 - DNA, 15 bp, Homo sapiens
cagaagaaaagagaa

SEQ ID NO: 9873 - DNA, 15 bp, Homo sapiens
tcagaagaaaagaga

SEQ ID NO: 9874 - DNA, 15 bp, Homo sapiens
gtcagaagaaaagag

SEQ ID NO: 9875 - DNA, 15 bp, Homo sapiens
agtcagaagaaaaga

SEQ ID NO: 9876 - DNA, 15 bp, Homo sapiens
tagtcagaagaaaag

SEQ ID NO: 9877 - DNA, 15 bp, Homo sapiens
gtagtcagaagaaaa

SEQ ID NO: 9878 - DNA, 15 bp, Homo sapiens
agtagtcagaagaaa

SEQ ID NO: 9879 - DNA, 15 bp, Homo sapiens
cagtagtcagaagaa

SEQ ID NO: 9880 - DNA, 15 bp, Homo sapiens
gcagtagtcagaaga

SEQ ID NO: 9881 - DNA, 15 bp, Homo sapiens
agcagtagtcagaag

SEQ ID NO: 9882 - DNA, 15 bp, Homo sapiens
gagcagtagtcagaa

SEQ ID NO: 9883 - DNA, 15 bp, Homo sapiens
tgagcagtagtcaga

SEQ ID NO: 9884 - DNA, 15 bp, Homo sapiens
ttgagcagtagtcag

SEQ ID NO: 9885 - DNA, 15 bp, Homo sapiens
cttgagcagtagtca

SEQ ID NO: 9886 - DNA, 15 bp, Homo sapiens
ccttgagcagtagtc

SEQ ID NO: 9887 - DNA, 15 bp, Homo sapiens
gccttgagcagtagt

SEQ ID NO: 9888 - DNA, 15 bp, Homo sapiens
agccttgagcagtag

SEQ ID NO: 9889 - DNA, 15 bp, Homo sapiens
aagccttgagcagta

SEQ ID NO: 9890 - DNA, 15 bp, Homo sapiens
aaagccttgagcagt

SEQ ID NO: 9891 - DNA, 15 bp, Homo sapiens
aaaagccttgagcag

SEQ ID NO: 9892 - DNA, 15 bp, Homo sapiens
taaaagccttgagca

SEQ ID NO: 9893 - DNA, 15 bp, Homo sapiens
ttaaaagccttgagc

SEQ ID NO: 9894 - DNA, 15 bp, Homo sapiens
gttaaaagccttgag

SEQ ID NO: 9895 - DNA, 15 bp, Homo sapiens
cgttaaaagccttga

SEQ ID NO: 9896 - DNA, 15 bp, Homo sapiens
tcgttaaaagccttg

SEQ ID NO: 9897 - DNA, 15 bp, Homo sapiens
ctcgttaaaagcctt

SEQ ID NO: 9898 - DNA, 15 bp, Homo sapiens
gctcgttaaaagcct

SEQ ID NO: 9899 - DNA, 15 bp, Homo sapiens
agctcgttaaaagcc

SEQ ID NO: 9900 - DNA, 15 bp, Homo sapiens
cagctcgttaaaagc

SEQ ID NO: 9901 - DNA, 15 bp, Homo sapiens
tcagctcgttaaaag

SEQ ID NO: 9902 - DNA, 15 bp, Homo sapiens
ttcagctcgttaaaa

SEQ ID NO: 9903 - DNA, 15 bp, Homo sapiens
cttcagctcgttaaa

SEQ ID NO: 9904 - DNA, 15 bp, Homo sapiens
acttcagctcgttaa

SEQ ID NO: 9905 - DNA, 15 bp, Homo sapiens
aacttcagctcgtta

SEQ ID NO: 9906 - DNA, 15 bp, Homo sapiens
taacttcagctcgtt

SEQ ID NO: 9907 - DNA, 15 bp, Homo sapiens
ttaacttcagctcgt

SEQ ID NO: 9908 - DNA, 15 bp, Homo sapiens
tttaacttcagctcg

SEQ ID NO: 9909 - DNA, 15 bp, Homo sapiens
ttttaacttcagctc

SEQ ID NO: 9910 - DNA, 15 bp, Homo sapiens
tttttaacttcagct

SEQ ID NO: 9911 - DNA, 15 bp, Homo sapiens
ttttttaacttcagc

SEQ ID NO: 9912 - DNA, 15 bp, Homo sapiens
tttttttaacttcag

SEQ ID NO: 9913 - DNA, 15 bp, Homo sapiens
ttttttttaacttca

SEQ ID NO: 9914 - DNA, 15 bp, Homo sapiens
tttttttttaacttc

SEQ ID NO: 9915 - DNA, 15 bp, Homo sapiens
ttttttttttaactt

SEQ ID NO: 9916 - DNA, 15 bp, Homo sapiens
tttttttttttaact

SEQ ID NO: 9917 - DNA, 15 bp, Homo sapiens
acctttttttttttt

SEQ ID NO: 9918 - DNA, 15 bp, Homo sapiens
taccttttttttttt

SEQ ID NO: 9919 - DNA, 15 bp, Homo sapiens
ctacctttttttttt

SEQ ID NO: 9920 - DNA, 15 bp, Homo sapiens
actaccttttttttt

SEQ ID NO: 9921 - DNA, 15 bp, Homo sapiens
cactacctttttttt

SEQ ID NO: 9922 - DNA, 15 bp, Homo sapiens
ccactaccttttttt

SEQ ID NO: 9923 - DNA, 15 bp, Homo sapiens
tccactacctttttt

SEQ ID NO: 9924 - DNA, 15 bp, Homo sapiens
atccactaccttttt

SEQ ID NO: 9925 - DNA, 15 bp, Homo sapiens
aatccactacctttt

SEQ ID NO: 9926 - DNA, 15 bp, Homo sapiens
aaatccactaccttt

SEQ ID NO: 9927 - DNA, 15 bp, Homo sapiens
gaaatccactacctt

SEQ ID NO: 9928 - DNA, 15 bp, Homo sapiens
tgaaatccactacct

SEQ ID NO: 9929 - DNA, 15 bp, Homo sapiens
atgaaatccactacc

SEQ ID NO: 9930 - DNA, 15 bp, Homo sapiens
tatgaaatccactac

SEQ ID NO: 9931 - DNA, 15 bp, Homo sapiens
ttatgaaatccacta

SEQ ID NO: 9932 - DNA, 15 bp, Homo sapiens
cttatgaaatccact

SEQ ID NO: 9933 - DNA, 15 bp, Homo sapiens
ccttatgaaatccac

SEQ ID NO: 9934 - DNA, 15 bp, Homo sapiens
tccttatgaaatcca

SEQ ID NO: 9935 - DNA, 15 bp, Homo sapiens
gtccttatgaaatcc

SEQ ID NO: 9936 - DNA, 15 bp, Homo sapiens
agtccttatgaaatc

SEQ ID NO: 9937 - DNA, 15 bp, Homo sapiens
cagtccttatgaaat

SEQ ID NO: 9938 - DNA, 15 bp, Homo sapiens
tcagtccttatgaaa

SEQ ID NO: 9939 - DNA, 15 bp, Homo sapiens
gtcagtccttatgaa

SEQ ID NO: 9940 - DNA, 15 bp, Homo sapiens
tgtcagtccttatga

SEQ ID NO: 9941 - DNA, 15 bp, Homo sapiens
atgtcagtccttatg

SEQ ID NO: 9942 - DNA, 15 bp, Homo sapiens
aatgtcagtccttat

SEQ ID NO: 9943 - DNA, 15 bp, Homo sapiens
aaatgtcagtcctta

SEQ ID NO: 9944 - DNA, 15 bp, Homo sapiens
caaatgtcagtcctt

SEQ ID NO: 9945 - DNA, 15 bp, Homo sapiens
ccaaatgtcagtcct

SEQ ID NO: 9946 - DNA, 15 bp, Homo sapiens
gccaaatgtcagtcc

SEQ ID NO: 9947 - DNA, 15 bp, Homo sapiens
tgccaaatgtcagtc

SEQ ID NO: 9948 - DNA, 15 bp, Homo sapiens
gtgccaaatgtcagt

SEQ ID NO: 9949 - DNA, 15 bp, Homo sapiens
tgtgccaaatgtcag

SEQ ID NO: 9950 - DNA, 15 bp, Homo sapiens
ctgtgccaaatgtca

SEQ ID NO: 9951 - DNA, 15 bp, Homo sapiens
actgtgccaaatgtc

SEQ ID NO: 9952 - DNA, 15 bp, Homo sapiens
cactgtgccaaatgt

SEQ ID NO: 9953 - DNA, 15 bp, Homo sapiens
acactgtgccaaatg

SEQ ID NO: 9954 - DNA, 15 bp, Homo sapiens
tacactgtgccaaat

SEQ ID NO: 9955 - DNA, 15 bp, Homo sapiens
ctacactgtgccaaa

SEQ ID NO: 9956 - DNA, 15 bp, Homo sapiens
cctacactgtgccaa

SEQ ID NO: 9957 - DNA, 15 bp, Homo sapiens
acctacactgtgcca

SEQ ID NO: 9958 - DNA, 15 bp, Homo sapiens
gacctacactgtgcc

SEQ ID NO: 9959 - DNA, 15 bp, Homo sapiens
ggacctacactgtgc

SEQ ID NO: 9960 - DNA, 15 bp, Homo sapiens
aggacctacactgtg

SEQ ID NO: 9961 - DNA, 15 bp, Homo sapiens
caggacctacactgt

SEQ ID NO: 9962 - DNA, 15 bp, Homo sapiens
ccaggacctacactg

SEQ ID NO: 9963 - DNA, 15 bp, Homo sapiens
accaggacctacact

SEQ ID NO: 9964 - DNA, 15 bp, Homo sapiens
gaccaggacctacac

SEQ ID NO: 9965 - DNA, 15 bp, Homo sapiens
ggaccaggacctaca

SEQ ID NO: 9966 - DNA, 15 bp, Homo sapiens
cggaccaggacctac

SEQ ID NO: 9967 - DNA, 15 bp, Homo sapiens
tcggaccaggaccta

SEQ ID NO: 9968 - DNA, 15 bp, Homo sapiens
atcggaccaggacct

SEQ ID NO: 9969 - DNA, 15 bp, Homo sapiens
catcggaccaggacc

SEQ ID NO: 9970 - DNA, 15 bp, Homo sapiens
gcatcggaccaggac

SEQ ID NO: 9971 - DNA, 15 bp, Homo sapiens
ggcatcggaccagga

SEQ ID NO: 9972 - DNA, 15 bp, Homo sapiens
gggcatcggaccagg

SEQ ID NO: 9973 - DNA, 15 bp, Homo sapiens
tgggcatcggaccag

SEQ ID NO: 9974 - DNA, 15 bp, Homo sapiens
ctgggcatcggacca

SEQ ID NO: 9975 - DNA, 15 bp, Homo sapiens
tctgggcatcggacc

SEQ ID NO: 9976 - DNA, 15 bp, Homo sapiens
atctgggcatcggac

SEQ ID NO: 9977 - DNA, 15 bp, Homo sapiens
tatctgggcatcgga

SEQ ID NO: 9978 - DNA, 15 bp, Homo sapiens
ctatctgggcatcgg

SEQ ID NO: 9979 - DNA, 15 bp, Homo sapiens
cctatctgggcatcg

SEQ ID NO: 9980 - DNA, 15 bp, Homo sapiens
acctatctgggcatc

SEQ ID NO: 9981 - DNA, 15 bp, Homo sapiens
tacctatctgggcat

SEQ ID NO: 9982 - DNA, 15 bp, Homo sapiens
atacctatctgggca

SEQ ID NO: 9983 - DNA, 15 bp, Homo sapiens
gatacctatctgggc

SEQ ID NO: 9984 - DNA, 15 bp, Homo sapiens
agatacctatctggg

SEQ ID NO: 9985 - DNA, 15 bp, Homo sapiens
cagatacctatctgg

SEQ ID NO: 9986 - DNA, 15 bp, Homo sapiens
acagatacctatctg

SEQ ID NO: 9987 - DNA, 15 bp, Homo sapiens
cacagatacctatct

SEQ ID NO: 9988 - DNA, 15 bp, Homo sapiens
ccacagatacctatc

SEQ ID NO: 9989 - DNA, 15 bp, Homo sapiens
accacagatacctat

SEQ ID NO: 9990 - DNA, 15 bp, Homo sapiens
taccacagataccta

SEQ ID NO: 9991 - DNA, 15 bp, Homo sapiens
gtaccacagatacct

SEQ ID NO: 9992 - DNA, 15 bp, Homo sapiens
agtaccacagatacc

SEQ ID NO: 9993 - DNA, 15 bp, Homo sapiens
cagtaccacagatac

SEQ ID NO: 9994 - DNA, 15 bp, Homo sapiens
tcagtaccacagata

SEQ ID NO: 9995 - DNA, 15 bp, Homo sapiens
ttcagtaccacagat

SEQ ID NO: 9996 - DNA, 15 bp, Homo sapiens
tttcagtaccacaga

SEQ ID NO: 9997 - DNA, 15 bp, Homo sapiens
ctttcagtaccacag

SEQ ID NO: 9998 - DNA, 15 bp, Homo sapiens
tctttcagtaccaca

SEQ ID NO: 9999 - DNA, 15 bp, Homo sapiens
ctctttcagtaccac

SEQ ID NO: 10000 - DNA, 15 bp, Homo sapiens
actctttcagtacca

SEQ ID NO: 10001 - DNA, 15 bp, Homo sapiens
aactctttcagtacc

SEQ ID NO: 10002 - DNA, 15 bp, Homo sapiens
caactctttcagtac

SEQ ID NO: 10003 - DNA, 15 bp, Homo sapiens
ccaactctttcagta

SEQ ID NO: 10004 - DNA, 15 bp, Homo sapiens
accaactctttcagt

SEQ ID NO: 10005 - DNA, 15 bp, Homo sapiens
aaccaactctttcag

SEQ ID NO: 10006 - DNA, 15 bp, Homo sapiens
caaccaactctttca

SEQ ID NO: 10007 - DNA, 15 bp, Homo sapiens
tcaaccaactctttc

SEQ ID NO: 10008 - DNA, 15 bp, Homo sapiens
ctcaaccaactcttt

SEQ ID NO: 10009 - DNA, 15 bp, Homo sapiens
cctcaaccaactctt

SEQ ID NO: 10010 - DNA, 15 bp, Homo sapiens
tcctcaaccaactct

SEQ ID NO: 10011 - DNA, 15 bp, Homo sapiens
ctcctcaaccaactc

SEQ ID NO: 10012 - DNA, 15 bp, Homo sapiens
actcctcaaccaact

SEQ ID NO: 10013 - DNA, 15 bp, Homo sapiens
cactcctcaaccaac

SEQ ID NO: 10014 - DNA, 15 bp, Homo sapiens
acactcctcaaccaa

SEQ ID NO: 10015 - DNA, 15 bp, Homo sapiens
tacactcctcaacca

SEQ ID NO: 10016 - DNA, 15 bp, Homo sapiens
ctacactcctcaacc

SEQ ID NO: 10017 - DNA, 15 bp, Homo sapiens
cctacactcctcaac

SEQ ID NO: 10018 - DNA, 15 bp, Homo sapiens
ccctacactcctcaa

SEQ ID NO: 10019 - DNA, 15 bp, Homo sapiens
cccctacactcctca

SEQ ID NO: 10020 - DNA, 15 bp, Homo sapiens
tcccctacactcctc

SEQ ID NO: 10021 - DNA, 15 bp, Homo sapiens
ttcccctacactcct

SEQ ID NO: 10022 - DNA, 15 bp, Homo sapiens
cttcccctacactcc

SEQ ID NO: 10023 - DNA, 15 bp, Homo sapiens
ccttcccctacactc

SEQ ID NO: 10024 - DNA, 15 bp, Homo sapiens
tccttcccctacact

SEQ ID NO: 10025 - DNA, 15 bp, Homo sapiens
ttccttcccctacac

SEQ ID NO: 10026 - DNA, 15 bp, Homo sapiens
cttccttcccctaca

SEQ ID NO: 10027 - DNA, 15 bp, Homo sapiens
gcttccttcccctac

SEQ ID NO: 10028 - DNA, 15 bp, Homo sapiens
tgcttccttccccta

SEQ ID NO: 10029 - DNA, 15 bp, Homo sapiens
ttgcttccttcccct

SEQ ID NO: 10030 - DNA, 15 bp, Homo sapiens
tttgcttccttcccc

SEQ ID NO: 10031 - DNA, 15 bp, Homo sapiens
ctttgcttccttccc

SEQ ID NO: 10032 - DNA, 15 bp, Homo sapiens
cctttgcttccttcc

SEQ ID NO: 10033 - DNA, 15 bp, Homo sapiens
ccctttgcttccttc

SEQ ID NO: 10034 - DNA, 15 bp, Homo sapiens
accctttgcttcctt

SEQ ID NO: 10035 - DNA, 15 bp, Homo sapiens
aaccctttgcttcct

SEQ ID NO: 10036 - DNA, 15 bp, Homo sapiens
caaccctttgcttcc

SEQ ID NO: 10037 - DNA, 15 bp, Homo sapiens
ccaaccctttgcttc

SEQ ID NO: 10038 - DNA, 15 bp, Homo sapiens
accaaccctttgctt

SEQ ID NO: 10039 - DNA, 15 bp, Homo sapiens
aaccaaccctttgct

SEQ ID NO: 10040 - DNA, 15 bp, Homo sapiens
caaccaaccctttgc

SEQ ID NO: 10041 - DNA, 15 bp, Homo sapiens
tcaaccaaccctttg

SEQ ID NO: 10042 - DNA, 15 bp, Homo sapiens
ctcaaccaacccttt

SEQ ID NO: 10043 - DNA, 15 bp, Homo sapiens
cctcaaccaaccctt

SEQ ID NO: 10044 - DNA, 15 bp, Homo sapiens
tcctcaaccaaccct

SEQ ID NO: 10045 - DNA, 15 bp, Homo sapiens
ctcctcaaccaaccc

SEQ ID NO: 10046 - DNA, 15 bp, Homo sapiens
actcctcaaccaacc

SEQ ID NO: 10047 - DNA, 15 bp, Homo sapiens
tctttgcttccttcc

SEQ ID NO: 10048 - DNA, 15 bp, Homo sapiens
ctctttgcttccttc

SEQ ID NO: 10049 - DNA, 15 bp, Homo sapiens
tctctttgcttcctt

SEQ ID NO: 10050 - DNA, 15 bp, Homo sapiens
ctctctttgcttcct

SEQ ID NO: 10051 - DNA, 15 bp, Homo sapiens
tctctctttgcttcc

SEQ ID NO: 10052 - DNA, 15 bp, Homo sapiens
gtctctctttgcttc

SEQ ID NO: 10053 - DNA, 15 bp, Homo sapiens
ggtctctctttgctt

SEQ ID NO: 10054 - DNA, 15 bp, Homo sapiens
tggtctctctttgct

SEQ ID NO: 10055 - DNA, 15 bp, Homo sapiens
ctggtctctctttgc

SEQ ID NO: 10056 - DNA, 15 bp, Homo sapiens
actggtctctctttg

SEQ ID NO: 10057 - DNA, 15 bp, Homo sapiens
cactggtctctcttt

SEQ ID NO: 10058 - DNA, 15 bp, Homo sapiens
tcactggtctctctt

SEQ ID NO: 10059 - DNA, 15 bp, Homo sapiens
ttcactggtctctct

SEQ ID NO: 10060 - DNA, 15 bp, Homo sapiens
tttcactggtctctc

SEQ ID NO: 10061 - DNA, 15 bp, Homo sapiens
atttcactggtctct

SEQ ID NO: 10062 - DNA, 15 bp, Homo sapiens
tatttcactggtctc

SEQ ID NO: 10063 - DNA, 15 bp, Homo sapiens
ttatttcactggtct

SEQ ID NO: 10064 - DNA, 15 bp, Homo sapiens
tttatttcactggtc

SEQ ID NO: 10065 - DNA, 15 bp, Homo sapiens
ttttatttcactggt

SEQ ID NO: 10066 - DNA, 15 bp, Homo sapiens
tttttatttcactgg

SEQ ID NO: 10067 - DNA, 15 bp, Homo sapiens
atttttatttcactg

SEQ ID NO: 10068 - DNA, 15 bp, Homo sapiens
tatttttatttcact

SEQ ID NO: 10069 - DNA, 15 bp, Homo sapiens
ttatttttatttcac

SEQ ID NO: 10070 - DNA, 15 bp, Homo sapiens
tttatttttatttca

SEQ ID NO: 10071 - DNA, 15 bp, Homo sapiens
ttttatttttatttc

SEQ ID NO: 10072 - DNA, 15 bp, Homo sapiens
gttttatttttattt

SEQ ID NO: 10073 - DNA, 15 bp, Homo sapiens
tgttttatttttatt

SEQ ID NO: 10074 - DNA, 15 bp, Homo sapiens
ttgttttatttttat

SEQ ID NO: 10075 - DNA, 15 bp, Homo sapiens
tttgttttattttta

SEQ ID NO: 10076 - DNA, 15 bp, Homo sapiens
atttgttttattttt

SEQ ID NO: 10077 - DNA, 15 bp, Homo sapiens
aatttgttttatttt

SEQ ID NO: 10078 - DNA, 15 bp, Homo sapiens
taatttgttttattt

SEQ ID NO: 10079 - DNA, 15 bp, Homo sapiens
ataatttgttttatt

SEQ ID NO: 10080 - DNA, 15 bp, Homo sapiens
aataatttgttttat

SEQ ID NO: 10081 - DNA, 15 bp, Homo sapiens
taataatttgtttta

SEQ ID NO: 10082 - DNA, 15 bp, Homo sapiens
ttaataatttgtttt

SEQ ID NO: 10083 - DNA, 15 bp, Homo sapiens
tttaataatttgttt

SEQ ID NO: 10084 - DNA, 15 bp, Homo sapiens
atttaataatttgtt

SEQ ID NO: 10085 - DNA, 15 bp, Homo sapiens
tatttaataatttgt

SEQ ID NO: 10086 - DNA, 15 bp, Homo sapiens
atatttaataatttg

SEQ ID NO: 10087 - DNA, 15 bp, Homo sapiens
catatttaataattt

SEQ ID NO: 10088 - DNA, 15 bp, Homo sapiens
tcatatttaataatt

SEQ ID NO: 10089 - DNA, 15 bp, Homo sapiens
ttcatatttaataat

SEQ ID NO: 10090 - DNA, 15 bp, Homo sapiens
tttcatatttaataa

SEQ ID NO: 10091 - DNA, 15 bp, Homo sapiens
atttcatatttaata

SEQ ID NO: 10092 - DNA, 15 bp, Homo sapiens
tatttcatatttaat

SEQ ID NO: 10093 - DNA, 15 bp, Homo sapiens
atatttcatatttaa

SEQ ID NO: 10094 - DNA, 15 bp, Homo sapiens
aatatttcatattta

SEQ ID NO: 10095 - DNA, 15 bp, Homo sapiens
taatatttcatattt

SEQ ID NO: 10096 - DNA, 15 bp, Homo sapiens
ataatatttcatatt

SEQ ID NO: 10097 - DNA, 15 bp, Homo sapiens
tataatatttcatat

SEQ ID NO: 10098 - DNA, 15 bp, Homo sapiens
gtataatatttcata

SEQ ID NO: 10099 - DNA, 15 bp, Homo sapiens
ggtataatatttcat

SEQ ID NO: 10100 - DNA, 15 bp, Homo sapiens
tggtataatatttca

SEQ ID NO: 10101 - DNA, 15 bp, Homo sapiens
ctggtataatatttc

SEQ ID NO: 10102 - DNA, 15 bp, Homo sapiens
cctggtataatattt

SEQ ID NO: 10103 - DNA, 15 bp, Homo sapiens
acctggtataatatt

SEQ ID NO: 10104 - DNA, 15 bp, Homo sapiens
aacctggtataatat

SEQ ID NO: 10105 - DNA, 15 bp, Homo sapiens
taacctggtataata

SEQ ID NO: 10106 - DNA, 15 bp, Homo sapiens
gtaacctggtataat

SEQ ID NO: 10107 - DNA, 15 bp, Homo sapiens
tgtaacctggtataa

SEQ ID NO: 10108 - DNA, 15 bp, Homo sapiens
atgtaacctggtata

SEQ ID NO: 10109 - DNA, 15 bp, Homo sapiens
aatgtaacctggtat

SEQ ID NO: 10110 - DNA, 15 bp, Homo sapiens
aaatgtaacctggta

SEQ ID NO: 10111 - DNA, 15 bp, Homo sapiens
taaatgtaacctggt

SEQ ID NO: 10112 - DNA, 15 bp, Homo sapiens
ataaatgtaacctgg

SEQ ID NO: 10113 - DNA, 15 bp, Homo sapiens
tataaatgtaacctg

SEQ ID NO: 10114 - DNA, 15 bp, Homo sapiens
ctataaatgtaacct

SEQ ID NO: 10115 - DNA, 15 bp, Homo sapiens
gctataaatgtaacc

SEQ ID NO: 10116 - DNA, 15 bp, Homo sapiens
tgctataaatgtaac

SEQ ID NO: 10117 - DNA, 15 bp, Homo sapiens
ttgctataaatgtaa

SEQ ID NO: 10118 - DNA, 15 bp, Homo sapiens
cttgctataaatgta

SEQ ID NO: 10119 - DNA, 15 bp, Homo sapiens
gcttgctataaatgt

SEQ ID NO: 10120 - DNA, 15 bp, Homo sapiens
ggcttgctataaatg

SEQ ID NO: 10121 - DNA, 15 bp, Homo sapiens
aggcttgctataaat

SEQ ID NO: 10122 - DNA, 15 bp, Homo sapiens
gaggcttgctataaa

SEQ ID NO: 10123 - DNA, 15 bp, Homo sapiens
ggaggcttgctataa

SEQ ID NO: 10124 - DNA, 15 bp, Homo sapiens
aggaggcttgctata

SEQ ID NO: 10125 - DNA, 15 bp, Homo sapiens
caggaggcttgctat

SEQ ID NO: 10126 - DNA, 15 bp, Homo sapiens
tcaggaggcttgcta

SEQ ID NO: 10127 - DNA, 15 bp, Homo sapiens
ttcaggaggcttgct

SEQ ID NO: 10128 - DNA, 15 bp, Homo sapiens
tttcaggaggcttgc

SEQ ID NO: 10129 - DNA, 15 bp, Homo sapiens
ttttcaggaggcttg

SEQ ID NO: 10130 - DNA, 15 bp, Homo sapiens
attttcaggaggctt

SEQ ID NO: 10131 - DNA, 15 bp, Homo sapiens
gattttcaggaggct

SEQ ID NO: 10132 - DNA, 15 bp, Homo sapiens
agattttcaggaggc

SEQ ID NO: 10133 - DNA, 15 bp, Homo sapiens
cagattttcaggagg

SEQ ID NO: 10134 - DNA, 15 bp, Homo sapiens
gcagattttcaggag

SEQ ID NO: 10135 - DNA, 15 bp, Homo sapiens
agcagattttcagga

SEQ ID NO: 10136 - DNA, 15 bp, Homo sapiens
tagcagattttcagg

SEQ ID NO: 10137 - DNA, 15 bp, Homo sapiens
atagcagattttcag

SEQ ID NO: 10138 - DNA, 15 bp, Homo sapiens
catagcagattttca

SEQ ID NO: 10139 - DNA, 15 bp, Homo sapiens
acatagcagattttc

SEQ ID NO: 10140 - DNA, 15 bp, Homo sapiens
aacatagcagatttt

SEQ ID NO: 10141 - DNA, 15 bp, Homo sapiens
aaacatagcagattt

SEQ ID NO: 10142 - DNA, 15 bp, Homo sapiens
caaacatagcagatt

SEQ ID NO: 10143 - DNA, 15 bp, Homo sapiens
ccaaacatagcagat

SEQ ID NO: 10144 - DNA, 15 bp, Homo sapiens
tccaaacatagcaga

SEQ ID NO: 10145 - DNA, 15 bp, Homo sapiens
ttccaaacatagcag

SEQ ID NO: 10146 - DNA, 15 bp, Homo sapiens
tttccaaacatagca

SEQ ID NO: 10147 - DNA, 15 bp, Homo sapiens
ctttccaaacatagc

SEQ ID NO: 10148 - DNA, 15 bp, Homo sapiens
actttccaaacatag

SEQ ID NO: 10149 - DNA, 15 bp, Homo sapiens
tactttccaaacata

SEQ ID NO: 10150 - DNA, 15 bp, Homo sapiens
ttactttccaaacat

SEQ ID NO: 10151 - DNA, 15 bp, Homo sapiens
tttactttccaaaca

SEQ ID NO: 10152 - DNA, 15 bp, Homo sapiens
gtttactttccaaac

SEQ ID NO: 10153 - DNA, 15 bp, Homo sapiens
agtttactttccaaa

SEQ ID NO: 10154 - DNA, 15 bp, Homo sapiens
aagtttactttccaa

SEQ ID NO: 10155 - DNA, 15 bp, Homo sapiens
caagtttactttcca

SEQ ID NO: 10156 - DNA, 15 bp, Homo sapiens
gcaagtttactttcc

SEQ ID NO: 10157 - DNA, 15 bp, Homo sapiens
agcaagtttactttc

SEQ ID NO: 10158 - DNA, 15 bp, Homo sapiens
aagcaagtttacttt

SEQ ID NO: 10159 - DNA, 15 bp, Homo sapiens
taagcaagtttactt

SEQ ID NO: 10160 - DNA, 15 bp, Homo sapiens
ttaagcaagtttact

SEQ ID NO: 10161 - DNA, 15 bp, Homo sapiens
gttaagcaagtttac

SEQ ID NO: 10162 - DNA, 15 bp, Homo sapiens
tgttaagcaagttta

SEQ ID NO: 10163 - DNA, 15 bp, Homo sapiens
ttgttaagcaagttt

SEQ ID NO: 10164 - DNA, 15 bp, Homo sapiens
cttgttaagcaagtt

SEQ ID NO: 10165 - DNA, 15 bp, Homo sapiens
tcttgttaagcaagt

SEQ ID NO: 10166 - DNA, 15 bp, Homo sapiens
atcttgttaagcaag

SEQ ID NO: 10167 - DNA, 15 bp, Homo sapiens
aatcttgttaagcaa

SEQ ID NO: 10168 - DNA, 15 bp, Homo sapiens
gaatcttgttaagca

SEQ ID NO: 10169 - DNA, 15 bp, Homo sapiens
tgaatcttgttaagc

SEQ ID NO: 10170 - DNA, 15 bp, Homo sapiens
ttgaatcttgttaag

SEQ ID NO: 10171 - DNA, 15 bp, Homo sapiens
attgaatcttgttaa

SEQ ID NO: 10172 - DNA, 15 bp, Homo sapiens
aattgaatcttgtta

SEQ ID NO: 10173 - DNA, 15 bp, Homo sapiens
aaattgaatcttgtt

SEQ ID NO: 10174 - DNA, 15 bp, Homo sapiens
aaaattgaatcttgt

SEQ ID NO: 10175 - DNA, 15 bp, Homo sapiens
taaaattgaatcttg

SEQ ID NO: 10176 - DNA, 15 bp, Homo sapiens
ataaaattgaatctt

SEQ ID NO: 10177 - DNA, 15 bp, Homo sapiens
cataaaattgaatct

SEQ ID NO: 10178 - DNA, 15 bp, Homo sapiens
tcataaaattgaatc

SEQ ID NO: 10179 - DNA, 15 bp, Homo sapiens
ttcataaaattgaat

SEQ ID NO: 10180 - DNA, 15 bp, Homo sapiens
tttcataaaattgaa

SEQ ID NO: 10181 - DNA, 15 bp, Homo sapiens
ttttcataaaattga

SEQ ID NO: 10182 - DNA, 15 bp, Homo sapiens
attttcataaaattg

SEQ ID NO: 10183 - DNA, 15 bp, Homo sapiens
aattttcataaaatt

SEQ ID NO: 10184 - DNA, 15 bp, Homo sapiens
gaattttcataaaat

SEQ ID NO: 10185 - DNA, 15 bp, Homo sapiens
agaattttcataaaa

SEQ ID NO: 10186 - DNA, 15 bp, Homo sapiens
cagaattttcataaa

SEQ ID NO: 10187 - DNA, 15 bp, Homo sapiens
tcagaattttcataa

SEQ ID NO: 10188 - DNA, 15 bp, Homo sapiens
ctcagaattttcata

SEQ ID NO: 10189 - DNA, 15 bp, Homo sapiens
cctcagaattttcat

SEQ ID NO: 10190 - DNA, 15 bp, Homo sapiens
tcctcagaattttca

SEQ ID NO: 10191 - DNA, 15 bp, Homo sapiens
ctcctcagaattttc

SEQ ID NO: 10192 - DNA, 15 bp, Homo sapiens
cctcctcagaatttt

SEQ ID NO: 10193 - DNA, 15 bp, Homo sapiens
tcctcctcagaattt

SEQ ID NO: 10194 - DNA, 15 bp, Homo sapiens
atcctcctcagaatt

SEQ ID NO: 10195 - DNA, 15 bp, Homo sapiens
aatcctcctcagaat

SEQ ID NO: 10196 - DNA, 15 bp, Homo sapiens
taatcctcctcagaa

SEQ ID NO: 10197 - DNA, 15 bp, Homo sapiens
gtaatcctcctcaga

SEQ ID NO: 10198 - DNA, 15 bp, Homo sapiens
ggtaatcctcctcag

SEQ ID NO: 10199 - DNA, 15 bp, Homo sapiens
aggtaatcctcctca

SEQ ID NO: 10200 - DNA, 15 bp, Homo sapiens
aaggtaatcctcctc

SEQ ID NO: 10201 - DNA, 15 bp, Homo sapiens
taaggtaatcctcct

SEQ ID NO: 10202 - DNA, 15 bp, Homo sapiens
ataaggtaatcctcc

SEQ ID NO: 10203 - DNA, 15 bp, Homo sapiens
aataaggtaatcctc

SEQ ID NO: 10204 - DNA, 15 bp, Homo sapiens
aaataaggtaatcct

SEQ ID NO: 10205 - DNA, 15 bp, Homo sapiens
caaataaggtaatcc

SEQ ID NO: 10206 - DNA, 15 bp, Homo sapiens
acaaataaggtaatc

SEQ ID NO: 10207 - DNA, 15 bp, Homo sapiens
aacaaataaggtaat

SEQ ID NO: 10208 - DNA, 15 bp, Homo sapiens
aaacaaataaggtaa

SEQ ID NO: 10209 - DNA, 15 bp, Homo sapiens
taaacaaataaggta

SEQ ID NO: 10210 - DNA, 15 bp, Homo sapiens
ataaacaaataaggt

SEQ ID NO: 10211 - DNA, 15 bp, Homo sapiens
gataaacaaataagg

SEQ ID NO: 10212 - DNA, 15 bp, Homo sapiens
agataaacaaataag

SEQ ID NO: 10213 - DNA, 15 bp, Homo sapiens
aagataaacaaataa

SEQ ID NO: 10214 - DNA, 15 bp, Homo sapiens
aaagataaacaaata

SEQ ID NO: 10215 - DNA, 15 bp, Homo sapiens
gaaagataaacaaat

SEQ ID NO: 10216 - DNA, 15 bp, Homo sapiens
agaaagataaacaaa

SEQ ID NO: 10217 - DNA, 15 bp, Homo sapiens
cagaaagataaacaa

SEQ ID NO: 10218 - DNA, 15 bp, Homo sapiens
tcagaaagataaaca

SEQ ID NO: 10219 - DNA, 15 bp, Homo sapiens
ctcagaaagataaac

SEQ ID NO: 10220 - DNA, 15 bp, Homo sapiens
cctcagaaagataaa

SEQ ID NO: 10221 - DNA, 15 bp, Homo sapiens
gcctcagaaagataa

SEQ ID NO: 10222 - DNA, 15 bp, Homo sapiens
ggcctcagaaagata

SEQ ID NO: 10223 - DNA, 15 bp, Homo sapiens
aggcctcagaaagat

SEQ ID NO: 10224 - DNA, 15 bp, Homo sapiens
aaggcctcagaaaga

SEQ ID NO: 10225 - DNA, 15 bp, Homo sapiens
aaaggcctcagaaag

SEQ ID NO: 10226 - DNA, 15 bp, Homo sapiens
gaaaggcctcagaaa

SEQ ID NO: 10227 - DNA, 15 bp, Homo sapiens
agaaaggcctcagaa

SEQ ID NO: 10228 - DNA, 15 bp, Homo sapiens
aagaaaggcctcaga

SEQ ID NO: 10229 - DNA, 15 bp, Homo sapiens
caagaaaggcctcag

SEQ ID NO: 10230 - DNA, 15 bp, Homo sapiens
tcaagaaaggcctca

SEQ ID NO: 10231 - DNA, 15 bp, Homo sapiens
ctcaagaaaggcctc

SEQ ID NO: 10232 - DNA, 15 bp, Homo sapiens
cctcaagaaaggcct

SEQ ID NO: 10233 - DNA, 15 bp, Homo sapiens
tcctcaagaaaggcc

SEQ ID NO: 10234 - DNA, 15 bp, Homo sapiens
ttcctcaagaaaggc

SEQ ID NO: 10235 - DNA, 15 bp, Homo sapiens
tttcctcaagaaagg

SEQ ID NO: 10236 - DNA, 15 bp, Homo sapiens
ctttcctcaagaaag

SEQ ID NO: 10237 - DNA, 15 bp, Homo sapiens
tctttcctcaagaaa

SEQ ID NO: 10238 - DNA, 15 bp, Homo sapiens
gtctttcctcaagaa

SEQ ID NO: 10239 - DNA, 15 bp, Homo sapiens
tgtctttcctcaaga

SEQ ID NO: 10240 - DNA, 15 bp, Homo sapiens
ctgtctttcctcaag

SEQ ID NO: 10241 - DNA, 15 bp, Homo sapiens
actgtctttcctcaa

SEQ ID NO: 10242 - DNA, 15 bp, Homo sapiens
cactgtctttcctca

SEQ ID NO: 10243 - DNA, 15 bp, Homo sapiens
ccactgtctttcctc

SEQ ID NO: 10244 - DNA, 15 bp, Homo sapiens
accactgtctttcct

SEQ ID NO: 10245 - DNA, 15 bp, Homo sapiens
aaccactgtctttcc

SEQ ID NO: 10246 - DNA, 15 bp, Homo sapiens
taaccactgtctttc

SEQ ID NO: 10247 - DNA, 15 bp, Homo sapiens
ttaaccactgtcttt

SEQ ID NO: 10248 - DNA, 15 bp, Homo sapiens
cttaaccactgtctt

SEQ ID NO: 10249 - DNA, 15 bp, Homo sapiens
acttaaccactgtct

SEQ ID NO: 10250 - DNA, 15 bp, Homo sapiens
aacttaaccactgtc

SEQ ID NO: 10251 - DNA, 15 bp, Homo sapiens
caacttaaccactgt

SEQ ID NO: 10252 - DNA, 15 bp, Homo sapiens
acaacttaaccactg

SEQ ID NO: 10253 - DNA, 15 bp, Homo sapiens
tacaacttaaccact

SEQ ID NO: 10254 - DNA, 15 bp, Homo sapiens
atacaacttaaccac

SEQ ID NO: 10255 - DNA, 15 bp, Homo sapiens
aatacaacttaacca

SEQ ID NO: 10256 - DNA, 15 bp, Homo sapiens
aaatacaacttaacc

SEQ ID NO: 10257 - DNA, 15 bp, Homo sapiens
taaatacaacttaac

SEQ ID NO: 10258 - DNA, 15 bp, Homo sapiens
ctaaatacaacttaa

SEQ ID NO: 10259 - DNA, 15 bp, Homo sapiens
cctaaatacaactta

SEQ ID NO: 10260 - DNA, 15 bp, Homo sapiens
gcctaaatacaactt

SEQ ID NO: 10261 - DNA, 15 bp, Homo sapiens
tgcctaaatacaact

SEQ ID NO: 10262 - DNA, 15 bp, Homo sapiens
ctgcctaaatacaac

SEQ ID NO: 10263 - DNA, 15 bp, Homo sapiens
actgcctaaatacaa

SEQ ID NO: 10264 - DNA, 15 bp, Homo sapiens
gactgcctaaataca

SEQ ID NO: 10265 - DNA, 15 bp, Homo sapiens
tgactgcctaaatac

SEQ ID NO: 10266 - DNA, 15 bp, Homo sapiens
atgactgcctaaata

SEQ ID NO: 10267 - DNA, 15 bp, Homo sapiens
gatgactgcctaaat

SEQ ID NO: 10268 - DNA, 15 bp, Homo sapiens
cgatgactgcctaaa

SEQ ID NO: 10269 - DNA, 15 bp, Homo sapiens
ccgatgactgcctaa

SEQ ID NO: 10270 - DNA, 15 bp, Homo sapiens
accgatgactgccta

SEQ ID NO: 10271 - DNA, 15 bp, Homo sapiens
gaccgatgactgcct

SEQ ID NO: 10272 - DNA, 15 bp, Homo sapiens
agaccgatgactgcc

SEQ ID NO: 10273 - DNA, 15 bp, Homo sapiens
tagaccgatgactgc

SEQ ID NO: 10274 - DNA, 15 bp, Homo sapiens
atagaccgatgactg

SEQ ID NO: 10275 - DNA, 15 bp, Homo sapiens
aatagaccgatgact

SEQ ID NO: 10276 - DNA, 15 bp, Homo sapiens
aaatagaccgatgac

SEQ ID NO: 10277 - DNA, 15 bp, Homo sapiens
gaaatagaccgatga

SEQ ID NO: 10278 - DNA, 15 bp, Homo sapiens
agaaatagaccgatg

SEQ ID NO: 10279 - DNA, 15 bp, Homo sapiens
aagaaatagaccgat

SEQ ID NO: 10280 - DNA, 15 bp, Homo sapiens
aaagaaatagaccga

SEQ ID NO: 10281 - DNA, 15 bp, Homo sapiens
gaaagaaatagaccg

SEQ ID NO: 10282 - DNA, 15 bp, Homo sapiens
agaaagaaatagacc

SEQ ID NO: 10283 - DNA, 15 bp, Homo sapiens
aagaaagaaatagac

SEQ ID NO: 10284 - DNA, 15 bp, Homo sapiens
aaagaaagaaataga

SEQ ID NO: 10285 - DNA, 15 bp, Homo sapiens
aaaagaaagaaatag

SEQ ID NO: 10286 - DNA, 15 bp, Homo sapiens
taaaagaaagaaata

SEQ ID NO: 10287 - DNA, 15 bp, Homo sapiens
ataaaagaaagaaat

SEQ ID NO: 10288 - DNA, 15 bp, Homo sapiens
cataaaagaaagaaa

SEQ ID NO: 10289 - DNA, 15 bp, Homo sapiens
acataaaagaaagaa

SEQ ID NO: 10290 - DNA, 15 bp, Homo sapiens
aacataaaagaaaga

SEQ ID NO: 10291 - DNA, 15 bp, Homo sapiens
aaacataaaagaaag

SEQ ID NO: 10292 - DNA, 15 bp, Homo sapiens
taaacataaaagaaa

SEQ ID NO: 10293 - DNA, 15 bp, Homo sapiens
ttaaacataaaagaa

SEQ ID NO: 10294 - DNA, 15 bp, Homo sapiens
tttaaacataaaaga

SEQ ID NO: 10295 - DNA, 15 bp, Homo sapiens
ctttaaacataaaag

SEQ ID NO: 10296 - DNA, 15 bp, Homo sapiens
gctttaaacataaaa

SEQ ID NO: 10297 - DNA, 15 bp, Homo sapiens
tgctttaaacataaa

SEQ ID NO: 10298 - DNA, 15 bp, Homo sapiens
ctgctttaaacataa

SEQ ID NO: 10299 - DNA, 15 bp, Homo sapiens
actgctttaaacata

SEQ ID NO: 10300 - DNA, 15 bp, Homo sapiens
tactgctttaaacat

SEQ ID NO: 10301 - DNA, 15 bp, Homo sapiens
atactgctttaaaca

SEQ ID NO: 10302 - DNA, 15 bp, Homo sapiens
gatactgctttaaac

SEQ ID NO: 10303 - DNA, 15 bp, Homo sapiens
agatactgctttaaa

SEQ ID NO: 10304 - DNA, 15 bp, Homo sapiens
cagatactgctttaa

SEQ ID NO: 10305 - DNA, 15 bp, Homo sapiens
acagatactgcttta

SEQ ID NO: 10306 - DNA, 15 bp, Homo sapiens
cacagatactgcttt

SEQ ID NO: 10307 - DNA, 15 bp, Homo sapiens
tcacagatactgctt

SEQ ID NO: 10308 - DNA, 15 bp, Homo sapiens
ctcacagatactgct

SEQ ID NO: 10309 - DNA, 15 bp, Homo sapiens
cctcacagatactgc

SEQ ID NO: 10310 - DNA, 15 bp, Homo sapiens
ccctcacagatactg

SEQ ID NO: 10311 - DNA, 15 bp, Homo sapiens
cccctcacagatact

SEQ ID NO: 10312 - DNA, 15 bp, Homo sapiens
tcccctcacagatac

SEQ ID NO: 10313 - DNA, 15 bp, Homo sapiens
atcccctcacagata

SEQ ID NO: 10314 - DNA, 15 bp, Homo sapiens
aatcccctcacagat

SEQ ID NO: 10315 - DNA, 15 bp, Homo sapiens
aaatcccctcacaga

SEQ ID NO: 10316 - DNA, 15 bp, Homo sapiens
aaaatcccctcacag

SEQ ID NO: 10317 - DNA, 15 bp, Homo sapiens
aaaaatcccctcaca

SEQ ID NO: 10318 - DNA, 15 bp, Homo sapiens
gaaaaatcccctcac

SEQ ID NO: 10319 - DNA, 15 bp, Homo sapiens
agaaaaatcccctca

SEQ ID NO: 10320 - DNA, 15 bp, Homo sapiens
tagaaaaatcccctc

SEQ ID NO: 10321 - DNA, 15 bp, Homo sapiens
ttagaaaaatcccct

SEQ ID NO: 10322 - DNA, 15 bp, Homo sapiens
tttagaaaaatcccc

SEQ ID NO: 10323 - DNA, 15 bp, Homo sapiens
gtttagaaaaatccc

SEQ ID NO: 10324 - DNA, 15 bp, Homo sapiens
tgtttagaaaaatcc

SEQ ID NO: 10325 - DNA, 15 bp, Homo sapiens
ctgtttagaaaaatc

SEQ ID NO: 10326 - DNA, 15 bp, Homo sapiens
gctgtttagaaaaat

SEQ ID NO: 10327 - DNA, 15 bp, Homo sapiens
agctgtttagaaaaa

SEQ ID NO: 10328 - DNA, 15 bp, Homo sapiens
gagctgtttagaaaa

SEQ ID NO: 10329 - DNA, 15 bp, Homo sapiens
tgagctgtttagaaa

SEQ ID NO: 10330 - DNA, 15 bp, Homo sapiens
ttgagctgtttagaa

SEQ ID NO: 10331 - DNA, 15 bp, Homo sapiens
cttgagctgtttaga

SEQ ID NO: 10332 - DNA, 15 bp, Homo sapiens
ccttgagctgtttag

SEQ ID NO: 10333 - DNA, 15 bp, Homo sapiens
cccttgagctgttta

SEQ ID NO: 10334 - DNA, 15 bp, Homo sapiens
tcccttgagctgttt

SEQ ID NO: 10335 - DNA, 15 bp, Homo sapiens
gtcccttgagctgtt

SEQ ID NO: 10336 - DNA, 15 bp, Homo sapiens
agtcccttgagctgt

SEQ ID NO: 10337 - DNA, 15 bp, Homo sapiens
cagtcccttgagctg

SEQ ID NO: 10338 - DNA, 15 bp, Homo sapiens
acagtcccttgagct

SEQ ID NO: 10339 - DNA, 15 bp, Homo sapiens
cacagtcccttgagc

SEQ ID NO: 10340 - DNA, 15 bp, Homo sapiens
tcacagtcccttgag

SEQ ID NO: 10341 - DNA, 15 bp, Homo sapiens
ttcacagtcccttga

SEQ ID NO: 10342 - DNA, 15 bp, Homo sapiens
tttcacagtcccttg

SEQ ID NO: 10343 - DNA, 15 bp, Homo sapiens
ttttcacagtccctt

SEQ ID NO: 10344 - DNA, 15 bp, Homo sapiens
tttttcacagtccct

SEQ ID NO: 10345 - DNA, 15 bp, Homo sapiens
ttttttcacagtccc

SEQ ID NO: 10346 - DNA, 15 bp, Homo sapiens
attttttcacagtcc

SEQ ID NO: 10347 - DNA, 15 bp, Homo sapiens
tattttttcacagtc

SEQ ID NO: 10348 - DNA, 15 bp, Homo sapiens
ctattttttcacagt

SEQ ID NO: 10349 - DNA, 15 bp, Homo sapiens
actattttttcacag

SEQ ID NO: 10350 - DNA, 15 bp, Homo sapiens
aactattttttcaca

SEQ ID NO: 10351 - DNA, 15 bp, Homo sapiens
gaactattttttcac

SEQ ID NO: 10352 - DNA, 15 bp, Homo sapiens
tgaactattttttca

SEQ ID NO: 10353 - DNA, 15 bp, Homo sapiens
atgaactattttttc

SEQ ID NO: 10354 - DNA, 15 bp, Homo sapiens
aatgaactatttttt

SEQ ID NO: 10355 - DNA, 15 bp, Homo sapiens
aaatgaactattttt

SEQ ID NO: 10356 - DNA, 15 bp, Homo sapiens
aaaatgaactatttt

SEQ ID NO: 10357 - DNA, 15 bp, Homo sapiens
aaaaatgaactattt

SEQ ID NO: 10358 - DNA, 15 bp, Homo sapiens
aaaaaatgaactatt

SEQ ID NO: 10359 - DNA, 15 bp, Homo sapiens
caaaaaatgaactat

SEQ ID NO: 10360 - DNA, 15 bp, Homo sapiens
acaaaaaatgaacta

SEQ ID NO: 10361 - DNA, 15 bp, Homo sapiens
aacaaaaaatgaact

SEQ ID NO: 10362 - DNA, 15 bp, Homo sapiens
aaacaaaaaatgaac

SEQ ID NO: 10363 - DNA, 15 bp, Homo sapiens
gaaacaaaaaatgaa

SEQ ID NO: 10364 - DNA, 15 bp, Homo sapiens
agaaacaaaaaatga

SEQ ID NO: 10365 - DNA, 15 bp, Homo sapiens
gagaaacaaaaaatg

SEQ ID NO: 10366 - DNA, 15 bp, Homo sapiens
ggagaaacaaaaaat

SEQ ID NO: 10367 - DNA, 15 bp, Homo sapiens
aggagaaacaaaaaa

SEQ ID NO: 10368 - DNA, 15 bp, Homo sapiens
caggagaaacaaaaa

SEQ ID NO: 10369 - DNA, 15 bp, Homo sapiens
tcaggagaaacaaaa

SEQ ID NO: 10370 - DNA, 15 bp, Homo sapiens
ttcaggagaaacaaa

SEQ ID NO: 10371 - DNA, 15 bp, Homo sapiens
cttcaggagaaacaa

SEQ ID NO: 10372 - DNA, 15 bp, Homo sapiens
gcttcaggagaaaca

SEQ ID NO: 10373 - DNA, 15 bp, Homo sapiens
agcttcaggagaaac

SEQ ID NO: 10374 - DNA, 15 bp, Homo sapiens
aagcttcaggagaaa

SEQ ID NO: 10375 - DNA, 15 bp, Homo sapiens
aaagcttcaggagaa

SEQ ID NO: 10376 - DNA, 15 bp, Homo sapiens
gaaagcttcaggaga

SEQ ID NO: 10377 - DNA, 15 bp, Homo sapiens
ggaaagcttcaggag

SEQ ID NO: 10378 - DNA, 15 bp, Homo sapiens
aggaaagcttcagga

SEQ ID NO: 10379 - DNA, 15 bp, Homo sapiens
aaggaaagcttcagg

SEQ ID NO: 10380 - DNA, 15 bp, Homo sapiens
caaggaaagcttcag

SEQ ID NO: 10381 - DNA, 15 bp, Homo sapiens
ccaaggaaagcttca

SEQ ID NO: 10382 - DNA, 15 bp, Homo sapiens
gccaaggaaagcttc

SEQ ID NO: 10383 - DNA, 15 bp, Homo sapiens
agccaaggaaagctt

SEQ ID NO: 10384 - DNA, 15 bp, Homo sapiens
cagccaaggaaagct

SEQ ID NO: 10385 - DNA, 15 bp, Homo sapiens
ccagccaaggaaagc

SEQ ID NO: 10386 - DNA, 15 bp, Homo sapiens
tccagccaaggaaag

SEQ ID NO: 10387 - DNA, 15 bp, Homo sapiens
ttccagccaaggaaa

SEQ ID NO: 10388 - DNA, 15 bp, Homo sapiens
attccagccaaggaa

SEQ ID NO: 10389 - DNA, 15 bp, Homo sapiens
tattccagccaagga

SEQ ID NO: 10390 - DNA, 15 bp, Homo sapiens
gtattccagccaagg

SEQ ID NO: 10391 - DNA, 15 bp, Homo sapiens
ggtattccagccaag

SEQ ID NO: 10392 - DNA, 15 bp, Homo sapiens
aggtattccagccaa

SEQ ID NO: 10393 - DNA, 15 bp, Homo sapiens
caggtattccagcca

SEQ ID NO: 10394 - DNA, 15 bp, Homo sapiens
acaggtattccagcc

SEQ ID NO: 10395 - DNA, 15 bp, Homo sapiens
cacaggtattccagc

SEQ ID NO: 10396 - DNA, 15 bp, Homo sapiens
gcacaggtattccag

SEQ ID NO: 10397 - DNA, 15 bp, Homo sapiens
agcacaggtattcca

SEQ ID NO: 10398 - DNA, 15 bp, Homo sapiens
aagcacaggtattcc

SEQ ID NO: 10399 - DNA, 15 bp, Homo sapiens
aaagcacaggtattc

SEQ ID NO: 10400 - DNA, 15 bp, Homo sapiens
caaagcacaggtatt

SEQ ID NO: 10401 - DNA, 15 bp, Homo sapiens
tcaaagcacaggtat

SEQ ID NO: 10402 - DNA, 15 bp, Homo sapiens
ttcaaagcacaggta

SEQ ID NO: 10403 - DNA, 15 bp, Homo sapiens
cttcaaagcacaggt

SEQ ID NO: 10404 - DNA, 15 bp, Homo sapiens
ccttcaaagcacagg

SEQ ID NO: 10405 - DNA, 15 bp, Homo sapiens
cccttcaaagcacag

SEQ ID NO: 10406 - DNA, 15 bp, Homo sapiens
tcccttcaaagcaca

SEQ ID NO: 10407 - DNA, 15 bp, Homo sapiens
ctcccttcaaagcac

SEQ ID NO: 10408 - DNA, 15 bp, Homo sapiens
cctcccttcaaagca

SEQ ID NO: 10409 - DNA, 15 bp, Homo sapiens
acctcccttcaaagc

SEQ ID NO: 10410 - DNA, 15 bp, Homo sapiens
gacctcccttcaaag

SEQ ID NO: 10411 - DNA, 15 bp, Homo sapiens
agacctcccttcaaa

SEQ ID NO: 10412 - DNA, 15 bp, Homo sapiens
aagacctcccttcaa

SEQ ID NO: 10413 - DNA, 15 bp, Homo sapiens
aaagacctcccttca

SEQ ID NO: 10414 - DNA, 15 bp, Homo sapiens
caaagacctcccttc

SEQ ID NO: 10415 - DNA, 15 bp, Homo sapiens
tcaaagacctccctt

SEQ ID NO: 10416 - DNA, 15 bp, Homo sapiens
ctcaaagacctccct

SEQ ID NO: 10417 - DNA, 15 bp, Homo sapiens
gctcaaagacctccc

SEQ ID NO: 10418 - DNA, 15 bp, Homo sapiens
tgctcaaagacctcc

SEQ ID NO: 10419 - DNA, 15 bp, Homo sapiens
ctgctcaaagacctc

SEQ ID NO: 10420 - DNA, 15 bp, Homo sapiens
cctgctcaaagacct

SEQ ID NO: 10421 - DNA, 15 bp, Homo sapiens
acctgctcaaagacc

SEQ ID NO: 10422 - DNA, 15 bp, Homo sapiens
aacctgctcaaagac

SEQ ID NO: 10423 - DNA, 15 bp, Homo sapiens
aaacctgctcaaaga

SEQ ID NO: 10424 - DNA, 15 bp, Homo sapiens
caaacctgctcaaag

SEQ ID NO: 10425 - DNA, 15 bp, Homo sapiens
acaaacctgctcaaa

SEQ ID NO: 10426 - DNA, 15 bp, Homo sapiens
aacaaacctgctcaa

SEQ ID NO: 10427 - DNA, 15 bp, Homo sapiens
aaacaaacctgctca

SEQ ID NO: 10428 - DNA, 15 bp, Homo sapiens
aaaacaaacctgctc

SEQ ID NO: 10429 - DNA, 15 bp, Homo sapiens
aaaaacaaacctgct

SEQ ID NO: 10430 - DNA, 15 bp, Homo sapiens
aaaaaacaaacctgc

SEQ ID NO: 10431 - DNA, 15 bp, Homo sapiens
aaaaaaacaaacctg

SEQ ID NO: 10432 - DNA, 15 bp, Homo sapiens
gaaaaaaacaaacct

SEQ ID NO: 10433 - DNA, 15 bp, Homo sapiens
ggaaaaaaacaaacc

SEQ ID NO: 10434 - DNA, 15 bp, Homo sapiens
tggaaaaaaacaaac

SEQ ID NO: 10435 - DNA, 15 bp, Homo sapiens
atggaaaaaaacaaa

SEQ ID NO: 10436 - DNA, 15 bp, Homo sapiens
catggaaaaaaacaa

SEQ ID NO: 10437 - DNA, 15 bp, Homo sapiens
tcatggaaaaaaaca

SEQ ID NO: 10438 - DNA, 15 bp, Homo sapiens
ctcatggaaaaaaac

SEQ ID NO: 10439 - DNA, 15 bp, Homo sapiens
gctcatggaaaaaaa

SEQ ID NO: 10440 - DNA, 15 bp, Homo sapiens
ggctcatggaaaaaa

SEQ ID NO: 10441 - DNA, 15 bp, Homo sapiens
gggctcatggaaaaa

SEQ ID NO: 10442 - DNA, 15 bp, Homo sapiens
agggctcatggaaaa

SEQ ID NO: 10443 - DNA, 15 bp, Homo sapiens
cagggctcatggaaa

SEQ ID NO: 10444 - DNA, 15 bp, Homo sapiens
ccagggctcatggaa

SEQ ID NO: 10445 - DNA, 15 bp, Homo sapiens
cccagggctcatgga

SEQ ID NO: 10446 - DNA, 15 bp, Homo sapiens
ccccagggctcatgg

SEQ ID NO: 10447 - DNA, 15 bp, Homo sapiens
tccccagggctcatg

SEQ ID NO: 10448 - DNA, 15 bp, Homo sapiens
atccccagggctcat

SEQ ID NO: 10449 - DNA, 15 bp, Homo sapiens
aatccccagggctca

SEQ ID NO: 10450 - DNA, 15 bp, Homo sapiens
aaatccccagggctc

SEQ ID NO: 10451 - DNA, 15 bp, Homo sapiens
caaatccccagggct

SEQ ID NO: 10452 - DNA, 15 bp, Homo sapiens
acaaatccccagggc

SEQ ID NO: 10453 - DNA, 15 bp, Homo sapiens
tacaaatccccaggg

SEQ ID NO: 10454 - DNA, 15 bp, Homo sapiens
ctacaaatccccagg

SEQ ID NO: 10455 - DNA, 15 bp, Homo sapiens
actacaaatccccag

SEQ ID NO: 10456 - DNA, 15 bp, Homo sapiens
cactacaaatcccca

SEQ ID NO: 10457 - DNA, 15 bp, Homo sapiens
tcactacaaatcccc

SEQ ID NO: 10458 - DNA, 15 bp, Homo sapiens
atcactacaaatccc

SEQ ID NO: 10459 - DNA, 15 bp, Homo sapiens
tatcactacaaatcc

SEQ ID NO: 10460 - DNA, 15 bp, Homo sapiens
ctatcactacaaatc

SEQ ID NO: 10461 - DNA, 15 bp, Homo sapiens
tctatcactacaaat

SEQ ID NO: 10462 - DNA, 15 bp, Homo sapiens
gtctatcactacaaa

SEQ ID NO: 10463 - DNA, 15 bp, Homo sapiens
tgtctatcactacaa

SEQ ID NO: 10464 - DNA, 15 bp, Homo sapiens
ctgtctatcactaca

SEQ ID NO: 10465 - DNA, 15 bp, Homo sapiens
actgtctatcactac

SEQ ID NO: 10466 - DNA, 15 bp, Homo sapiens
tactgtctatcacta

SEQ ID NO: 10467 - DNA, 15 bp, Homo sapiens
ttactgtctatcact

SEQ ID NO: 10468 - DNA, 15 bp, Homo sapiens
gttactgtctatcac

SEQ ID NO: 10469 - DNA, 15 bp, Homo sapiens
ggttactgtctatca

SEQ ID NO: 10470 - DNA, 15 bp, Homo sapiens
gggttactgtctatc

SEQ ID NO: 10471 - DNA, 15 bp, Homo sapiens
agggttactgtctat

SEQ ID NO: 10472 - DNA, 15 bp, Homo sapiens
cagggttactgtcta

SEQ ID NO: 10473 - DNA, 15 bp, Homo sapiens
tcagggttactgtct

SEQ ID NO: 10474 - DNA, 15 bp, Homo sapiens
atcagggttactgtc

SEQ ID NO: 10475 - DNA, 15 bp, Homo sapiens
catcagggttactgt

SEQ ID NO: 10476 - DNA, 15 bp, Homo sapiens
ccatcagggttactg

SEQ ID NO: 10477 - DNA, 15 bp, Homo sapiens
tccatcagggttact

SEQ ID NO: 10478 - DNA, 15 bp, Homo sapiens
ttccatcagggttac

SEQ ID NO: 10479 - DNA, 15 bp, Homo sapiens
tttccatcagggtta

SEQ ID NO: 10480 - DNA, 15 bp, Homo sapiens
atttccatcagggtt

SEQ ID NO: 10481 - DNA, 15 bp, Homo sapiens
aatttccatcagggt

SEQ ID NO: 10482 - DNA, 15 bp, Homo sapiens
gaatttccatcaggg

SEQ ID NO: 10483 - DNA, 15 bp, Homo sapiens
tgaatttccatcagg

SEQ ID NO: 10484 - DNA, 15 bp, Homo sapiens
ttgaatttccatcag

SEQ ID NO: 10485 - DNA, 15 bp, Homo sapiens
gttgaatttccatca

SEQ ID NO: 10486 - DNA, 15 bp, Homo sapiens
agttgaatttccatc

SEQ ID NO: 10487 - DNA, 15 bp, Homo sapiens
gagttgaatttccat

SEQ ID NO: 10488 - DNA, 15 bp, Homo sapiens
agagttgaatttcca

SEQ ID NO: 10489 - DNA, 15 bp, Homo sapiens
cagagttgaatttcc

SEQ ID NO: 10490 - DNA, 15 bp, Homo sapiens
ccagagttgaatttc

SEQ ID NO: 10491 - DNA, 15 bp, Homo sapiens
gccagagttgaattt

SEQ ID NO: 10492 - DNA, 15 bp, Homo sapiens
tgccagagttgaatt

SEQ ID NO: 10493 - DNA, 15 bp, Homo sapiens
ctgccagagttgaat

SEQ ID NO: 10494 - DNA, 15 bp, Homo sapiens
tctgccagagttgaa

SEQ ID NO: 10495 - DNA, 15 bp, Homo sapiens
ctctgccagagttga

SEQ ID NO: 10496 - DNA, 15 bp, Homo sapiens
tctctgccagagttg

SEQ ID NO: 10497 - DNA, 15 bp, Homo sapiens
ttctctgccagagtt

SEQ ID NO: 10498 - DNA, 15 bp, Homo sapiens
cttctctgccagagt

SEQ ID NO: 10499 - DNA, 15 bp, Homo sapiens
ccttctctgccagag

SEQ ID NO: 10500 - DNA, 15 bp, Homo sapiens
cccttctctgccaga

SEQ ID NO: 10501 - DNA, 15 bp, Homo sapiens
gcccttctctgccag

SEQ ID NO: 10502 - DNA, 15 bp, Homo sapiens
tgcccttctctgcca

SEQ ID NO: 10503 - DNA, 15 bp, Homo sapiens
ctgcccttctctgcc

SEQ ID NO: 10504 - DNA, 15 bp, Homo sapiens
gctgcccttctctgc

SEQ ID NO: 10505 - DNA, 15 bp, Homo sapiens
agctgcccttctctg

SEQ ID NO: 10506 - DNA, 15 bp, Homo sapiens
tagctgcccttctct

SEQ ID NO: 10507 - DNA, 15 bp, Homo sapiens
atagctgcccttctc

SEQ ID NO: 10508 - DNA, 15 bp, Homo sapiens
aatagctgcccttct

SEQ ID NO: 10509 - DNA, 15 bp, Homo sapiens
gaatagctgcccttc

SEQ ID NO: 10510 - DNA, 15 bp, Homo sapiens
agaatagctgccctt

SEQ ID NO: 10511 - DNA, 15 bp, Homo sapiens
aagaatagctgccct

SEQ ID NO: 10512 - DNA, 15 bp, Homo sapiens
caagaatagctgccc

SEQ ID NO: 10513 - DNA, 15 bp, Homo sapiens
acaagaatagctgcc

SEQ ID NO: 10514 - DNA, 15 bp, Homo sapiens
gacaagaatagctgc

SEQ ID NO: 10515 - DNA, 15 bp, Homo sapiens
ggacaagaatagctg

SEQ ID NO: 10516 - DNA, 15 bp, Homo sapiens
aggacaagaatagct

SEQ ID NO: 10517 - DNA, 15 bp, Homo sapiens
caggacaagaatagc

SEQ ID NO: 10518 - DNA, 15 bp, Homo sapiens
gcaggacaagaatag

SEQ ID NO: 10519 - DNA, 15 bp, Homo sapiens
agcaggacaagaata

SEQ ID NO: 10520 - DNA, 15 bp, Homo sapiens
aagcaggacaagaat

SEQ ID NO: 10521 - DNA, 15 bp, Homo sapiens
caagcaggacaagaa

SEQ ID NO: 10522 - DNA, 15 bp, Homo sapiens
acaagcaggacaaga

SEQ ID NO: 10523 - DNA, 15 bp, Homo sapiens
tacaagcaggacaag

SEQ ID NO: 10524 - DNA, 15 bp, Homo sapiens
ttacaagcaggacaa

SEQ ID NO: 10525 - DNA, 15 bp, Homo sapiens
tttacaagcaggaca

SEQ ID NO: 10526 - DNA, 15 bp, Homo sapiens
ctttacaagcaggac

SEQ ID NO: 10527 - DNA, 15 bp, Homo sapiens
tctttacaagcagga

SEQ ID NO: 10528 - DNA, 15 bp, Homo sapiens
atctttacaagcagg

SEQ ID NO: 10529 - DNA, 15 bp, Homo sapiens
tatctttacaagcag

SEQ ID NO: 10530 - DNA, 15 bp, Homo sapiens
atatctttacaagca

SEQ ID NO: 10531 - DNA, 15 bp, Homo sapiens
aatatctttacaagc

SEQ ID NO: 10532 - DNA, 15 bp, Homo sapiens
gaatatctttacaag

SEQ ID NO: 10533 - DNA, 15 bp, Homo sapiens
agaatatctttacaa

SEQ ID NO: 10534 - DNA, 15 bp, Homo sapiens
gagaatatctttaca

SEQ ID NO: 10535 - DNA, 15 bp, Homo sapiens
ggagaatatctttac

SEQ ID NO: 10536 - DNA, 15 bp, Homo sapiens
tggagaatatcttta

SEQ ID NO: 10537 - DNA, 15 bp, Homo sapiens
atggagaatatcttt

SEQ ID NO: 10538 - DNA, 15 bp, Homo sapiens
catggagaatatctt

SEQ ID NO: 10539 - DNA, 15 bp, Homo sapiens
acatggagaatatct

SEQ ID NO: 10540 - DNA, 15 bp, Homo sapiens
aacatggagaatatc

SEQ ID NO: 10541 - DNA, 15 bp, Homo sapiens
caacatggagaatat

SEQ ID NO: 10542 - DNA, 15 bp, Homo sapiens
acaacatggagaata

SEQ ID NO: 10543 - DNA, 15 bp, Homo sapiens
aacaacatggagaat

SEQ ID NO: 10544 - DNA, 15 bp, Homo sapiens
taacaacatggagaa

SEQ ID NO: 10545 - DNA, 15 bp, Homo sapiens
gtaacaacatggaga

SEQ ID NO: 10546 - DNA, 15 bp, Homo sapiens
ggtaacaacatggag

SEQ ID NO: 10547 - DNA, 15 bp, Homo sapiens
aggtaacaacatgga

SEQ ID NO: 10548 - DNA, 15 bp, Homo sapiens
gaggtaacaacatgg

SEQ ID NO: 10549 - DNA, 15 bp, Homo sapiens
tgaggtaacaacatg

SEQ ID NO: 10550 - DNA, 15 bp, Homo sapiens
atgaggtaacaacat

SEQ ID NO: 10551 - DNA, 15 bp, Homo sapiens
aatgaggtaacaaca

SEQ ID NO: 10552 - DNA, 15 bp, Homo sapiens
taatgaggtaacaac

SEQ ID NO: 10553 - DNA, 15 bp, Homo sapiens
ataatgaggtaacaa

SEQ ID NO: 10554 - DNA, 15 bp, Homo sapiens
cataatgaggtaaca

SEQ ID NO: 10555 - DNA, 15 bp, Homo sapiens
gcataatgaggtaac

SEQ ID NO: 10556 - DNA, 15 bp, Homo sapiens
agcataatgaggtaa

SEQ ID NO: 10557 - DNA, 15 bp, Homo sapiens
cagcataatgaggta

SEQ ID NO: 10558 - DNA, 15 bp, Homo sapiens
tcagcataatgaggt

SEQ ID NO: 10559 - DNA, 15 bp, Homo sapiens
ttcagcataatgagg

SEQ ID NO: 10560 - DNA, 15 bp, Homo sapiens
cttcagcataatgag

SEQ ID NO: 10561 - DNA, 15 bp, Homo sapiens
acttcagcataatga

SEQ ID NO: 10562 - DNA, 15 bp, Homo sapiens
tacttcagcataatg

SEQ ID NO: 10563 - DNA, 15 bp, Homo sapiens
ctacttcagcataat

SEQ ID NO: 10564 - DNA, 15 bp, Homo sapiens
actacttcagcataa

SEQ ID NO: 10565 - DNA, 15 bp, Homo sapiens
cactacttcagcata

SEQ ID NO: 10566 - DNA, 15 bp, Homo sapiens
gcactacttcagcat

SEQ ID NO: 10567 - DNA, 15 bp, Homo sapiens
tgcactacttcagca

SEQ ID NO: 10568 - DNA, 15 bp, Homo sapiens
ttgcactacttcagc

SEQ ID NO: 10569 - DNA, 15 bp, Homo sapiens
attgcactacttcag

SEQ ID NO: 10570 - DNA, 15 bp, Homo sapiens
gattgcactacttca

SEQ ID NO: 10571 - DNA, 15 bp, Homo sapiens
tgattgcactacttc

SEQ ID NO: 10572 - DNA, 15 bp, Homo sapiens
atgattgcactactt

SEQ ID NO: 10573 - DNA, 15 bp, Homo sapiens
catgattgcactact

SEQ ID NO: 10574 - DNA, 15 bp, Homo sapiens
tcatgattgcactac

SEQ ID NO: 10575 - DNA, 15 bp, Homo sapiens
ctcatgattgcacta

SEQ ID NO: 10576 - DNA, 15 bp, Homo sapiens
tctcatgattgcact

SEQ ID NO: 10577 - DNA, 15 bp, Homo sapiens
ttctcatgattgcac

SEQ ID NO: 10578 - DNA, 15 bp, Homo sapiens
tttctcatgattgca

SEQ ID NO: 10579 - DNA, 15 bp, Homo sapiens
ctttctcatgattgc

SEQ ID NO: 10580 - DNA, 15 bp, Homo sapiens
actttctcatgattg

SEQ ID NO: 10581 - DNA, 15 bp, Homo sapiens
aactttctcatgatt

SEQ ID NO: 10582 - DNA, 15 bp, Homo sapiens
aaactttctcatgat

SEQ ID NO: 10583 - DNA, 15 bp, Homo sapiens
aaaactttctcatga

SEQ ID NO: 10584 - DNA, 15 bp, Homo sapiens
aaaaactttctcatg

SEQ ID NO: 10585 - DNA, 15 bp, Homo sapiens
aaaaaactttctcat

SEQ ID NO: 10586 - DNA, 15 bp, Homo sapiens
aaaaaaactttctca

SEQ ID NO: 10587 - DNA, 15 bp, Homo sapiens
caaaaaaactttctc

SEQ ID NO: 10588 - DNA, 15 bp, Homo sapiens
acaaaaaaactttct

SEQ ID NO: 10589 - DNA, 15 bp, Homo sapiens
tacaaaaaaactttc

SEQ ID NO: 10590 - DNA, 15 bp, Homo sapiens
atacaaaaaaacttt

SEQ ID NO: 10591 - DNA, 15 bp, Homo sapiens
aatacaaaaaaactt

SEQ ID NO: 10592 - DNA, 15 bp, Homo sapiens
taatacaaaaaaact

SEQ ID NO: 10593 - DNA, 15 bp, Homo sapiens
ttaatacaaaaaaac

SEQ ID NO: 10594 - DNA, 15 bp, Homo sapiens
attaatacaaaaaaa

SEQ ID NO: 10595 - DNA, 15 bp, Homo sapiens
cattaatacaaaaaa

SEQ ID NO: 10596 - DNA, 15 bp, Homo sapiens
acattaatacaaaaa

SEQ ID NO: 10597 - DNA, 15 bp, Homo sapiens
cacattaatacaaaa

SEQ ID NO: 10598 - DNA, 15 bp, Homo sapiens
tcacattaatacaaa

SEQ ID NO: 10599 - DNA, 15 bp, Homo sapiens
atcacattaatacaa

SEQ ID NO: 10600 - DNA, 15 bp, Homo sapiens
aatcacattaataca

SEQ ID NO: 10601 - DNA, 15 bp, Homo sapiens
gaatcacattaatac

SEQ ID NO: 10602 - DNA, 15 bp, Homo sapiens
agaatcacattaata

SEQ ID NO: 10603 - DNA, 15 bp, Homo sapiens
gagaatcacattaat

SEQ ID NO: 10604 - DNA, 15 bp, Homo sapiens
tgagaatcacattaa

SEQ ID NO: 10605 - DNA, 15 bp, Homo sapiens
atgagaatcacatta

SEQ ID NO: 10606 - DNA, 15 bp, Homo sapiens
catgagaatcacatt

SEQ ID NO: 10607 - DNA, 15 bp, Homo sapiens
tcatgagaatcacat

SEQ ID NO: 10608 - DNA, 15 bp, Homo sapiens
gtcatgagaatcaca

SEQ ID NO: 10609 - DNA, 15 bp, Homo sapiens
ggtcatgagaatcac

SEQ ID NO: 10610 - DNA, 15 bp, Homo sapiens
aggtcatgagaatca

SEQ ID NO: 10611 - DNA, 15 bp, Homo sapiens
caggtcatgagaatc

SEQ ID NO: 10612 - DNA, 15 bp, Homo sapiens
acaggtcatgagaat

SEQ ID NO: 10613 - DNA, 15 bp, Homo sapiens
aacaggtcatgagaa

SEQ ID NO: 10614 - DNA, 15 bp, Homo sapiens
taacaggtcatgaga

SEQ ID NO: 10615 - DNA, 15 bp, Homo sapiens
gtaacaggtcatgag

SEQ ID NO: 10616 - DNA, 15 bp, Homo sapiens
agtaacaggtcatga

SEQ ID NO: 10617 - DNA, 15 bp, Homo sapiens
tagtaacaggtcatg

SEQ ID NO: 10618 - DNA, 15 bp, Homo sapiens
atagtaacaggtcat

SEQ ID NO: 10619 - DNA, 15 bp, Homo sapiens
catagtaacaggtca

SEQ ID NO: 10620 - DNA, 15 bp, Homo sapiens
ccatagtaacaggtc

SEQ ID NO: 10621 - DNA, 15 bp, Homo sapiens
accatagtaacaggt

SEQ ID NO: 10622 - DNA, 15 bp, Homo sapiens
aaccatagtaacagg

SEQ ID NO: 10623 - DNA, 15 bp, Homo sapiens
caaccatagtaacag

SEQ ID NO: 10624 - DNA, 15 bp, Homo sapiens
acaaccatagtaaca

SEQ ID NO: 10625 - DNA, 15 bp, Homo sapiens
cacaaccatagtaac

SEQ ID NO: 10626 - DNA, 15 bp, Homo sapiens
tcacaaccatagtaa

SEQ ID NO: 10627 - DNA, 15 bp, Homo sapiens
ttcacaaccatagta

SEQ ID NO: 10628 - DNA, 15 bp, Homo sapiens
tttcacaaccatagt

SEQ ID NO: 10629 - DNA, 15 bp, Homo sapiens
gtttcacaaccatag

SEQ ID NO: 10630 - DNA, 15 bp, Homo sapiens
agtttcacaaccata

SEQ ID NO: 10631 - DNA, 15 bp, Homo sapiens
aagtttcacaaccat

SEQ ID NO: 10632 - DNA, 15 bp, Homo sapiens
aaagtttcacaacca

SEQ ID NO: 10633 - DNA, 15 bp, Homo sapiens
aaaagtttcacaacc

SEQ ID NO: 10634 - DNA, 15 bp, Homo sapiens
taaaagtttcacaac

SEQ ID NO: 10635 - DNA, 15 bp, Homo sapiens
ctaaaagtttcacaa

SEQ ID NO: 10636 - DNA, 15 bp, Homo sapiens
tctaaaagtttcaca

SEQ ID NO: 10637 - DNA, 15 bp, Homo sapiens
ctctaaaagtttcac

SEQ ID NO: 10638 - DNA, 15 bp, Homo sapiens
cctctaaaagtttca

SEQ ID NO: 10639 - DNA, 15 bp, Homo sapiens
tcctctaaaagtttc

SEQ ID NO: 10640 - DNA, 15 bp, Homo sapiens
ctcctctaaaagttt

SEQ ID NO: 10641 - DNA, 15 bp, Homo sapiens
tctcctctaaaagtt

SEQ ID NO: 10642 - DNA, 15 bp, Homo sapiens
atctcctctaaaagt

SEQ ID NO: 10643 - DNA, 15 bp, Homo sapiens
gatctcctctaaaag

SEQ ID NO: 10644 - DNA, 15 bp, Homo sapiens
ggatctcctctaaaa

SEQ ID NO: 10645 - DNA, 15 bp, Homo sapiens
tggatctcctctaaa

SEQ ID NO: 10646 - DNA, 15 bp, Homo sapiens
atggatctcctctaa

SEQ ID NO: 10647 - DNA, 15 bp, Homo sapiens
aatggatctcctcta

SEQ ID NO: 10648 - DNA, 15 bp, Homo sapiens
gaatggatctcctct

SEQ ID NO: 10649 - DNA, 15 bp, Homo sapiens
ggaatggatctcctc

SEQ ID NO: 10650 - DNA, 15 bp, Homo sapiens
gggaatggatctcct

SEQ ID NO: 10651 - DNA, 15 bp, Homo sapiens
cgggaatggatctcc

SEQ ID NO: 10652 - DNA, 15 bp, Homo sapiens
tcgggaatggatctc

SEQ ID NO: 10653 - DNA, 15 bp, Homo sapiens
gtcgggaatggatct

SEQ ID NO: 10654 - DNA, 15 bp, Homo sapiens
agtcgggaatggatc

SEQ ID NO: 10655 - DNA, 15 bp, Homo sapiens
cagtcgggaatggat

SEQ ID NO: 10656 - DNA, 15 bp, Homo sapiens
ccagtcgggaatgga

SEQ ID NO: 10657 - DNA, 15 bp, Homo sapiens
tccagtcgggaatgg

SEQ ID NO: 10658 - DNA, 15 bp, Homo sapiens
ttccagtcgggaatg

SEQ ID NO: 10659 - DNA, 15 bp, Homo sapiens
tttccagtcgggaat

SEQ ID NO: 10660 - DNA, 15 bp, Homo sapiens
ttttccagtcgggaa

SEQ ID NO: 10661 - DNA, 15 bp, Homo sapiens
gttttccagtcggga

SEQ ID NO: 10662 - DNA, 15 bp, Homo sapiens
cgttttccagtcggg

SEQ ID NO: 10663 - DNA, 15 bp, Homo sapiens
acgttttccagtcgg

SEQ ID NO: 10664 - DNA, 15 bp, Homo sapiens
cacgttttccagtcg

SEQ ID NO: 10665 - DNA, 15 bp, Homo sapiens
tcacgttttccagtc

SEQ ID NO: 10666 - DNA, 15 bp, Homo sapiens
ttcacgttttccagt

SEQ ID NO: 10667 - DNA, 15 bp, Homo sapiens
attcacgttttccag

SEQ ID NO: 10668 - DNA, 15 bp, Homo sapiens
aattcacgttttcca

SEQ ID NO: 10669 - DNA, 15 bp, Homo sapiens
caattcacgttttcc

SEQ ID NO: 10670 - DNA, 15 bp, Homo sapiens
gcaattcacgttttc

SEQ ID NO: 10671 - DNA, 15 bp, Homo sapiens
agcaattcacgtttt

SEQ ID NO: 10672 - DNA, 15 bp, Homo sapiens
cagcaattcacgttt

SEQ ID NO: 10673 - DNA, 15 bp, Homo sapiens
tcagcaattcacgtt

SEQ ID NO: 10674 - DNA, 15 bp, Homo sapiens
ctcagcaattcacgt

SEQ ID NO: 10675 - DNA, 15 bp, Homo sapiens
cctcagcaattcacg

SEQ ID NO: 10676 - DNA, 15 bp, Homo sapiens
tcctcagcaattcac

SEQ ID NO: 10677 - DNA, 15 bp, Homo sapiens
atcctcagcaattca

SEQ ID NO: 10678 - DNA, 15 bp, Homo sapiens
catcctcagcaattc

SEQ ID NO: 10679 - DNA, 15 bp, Homo sapiens
tcatcctcagcaatt

SEQ ID NO: 10680 - DNA, 15 bp, Homo sapiens
atcatcctcagcaat

SEQ ID NO: 10681 - DNA, 15 bp, Homo sapiens
aatcatcctcagcaa

SEQ ID NO: 10682 - DNA, 15 bp, Homo sapiens
gaatcatcctcagca

SEQ ID NO: 10683 - DNA, 15 bp, Homo sapiens
agaatcatcctcagc

SEQ ID NO: 10684 - DNA, 15 bp, Homo sapiens
tagaatcatcctcag

SEQ ID NO: 10685 - DNA, 15 bp, Homo sapiens
ttagaatcatcctca

SEQ ID NO: 10686 - DNA, 15 bp, Homo sapiens
cttagaatcatcctc

SEQ ID NO: 10687 - DNA, 15 bp, Homo sapiens
gcttagaatcatcct

SEQ ID NO: 10688 - DNA, 15 bp, Homo sapiens
tgcttagaatcatcc

SEQ ID NO: 10689 - DNA, 15 bp, Homo sapiens
ttgcttagaatcatc

SEQ ID NO: 10690 - DNA, 15 bp, Homo sapiens
tttgcttagaatcat

SEQ ID NO: 10691 - DNA, 15 bp, Homo sapiens
ctttgcttagaatca

SEQ ID NO: 10692 - DNA, 15 bp, Homo sapiens
cctttgcttagaatc

SEQ ID NO: 10693 - DNA, 15 bp, Homo sapiens
tcctttgcttagaat

SEQ ID NO: 10694 - DNA, 15 bp, Homo sapiens
ttcctttgcttagaa

SEQ ID NO: 10695 - DNA, 15 bp, Homo sapiens
cttcctttgcttaga

SEQ ID NO: 10696 - DNA, 15 bp, Homo sapiens
acttcctttgcttag

SEQ ID NO: 10697 - DNA, 15 bp, Homo sapiens
tacttcctttgctta

SEQ ID NO: 10698 - DNA, 15 bp, Homo sapiens
gtacttcctttgctt

SEQ ID NO: 10699 - DNA, 15 bp, Homo sapiens
cgtacttcctttgct

SEQ ID NO: 10700 - DNA, 15 bp, Homo sapiens
acgtacttcctttgc

SEQ ID NO: 10701 - DNA, 15 bp, Homo sapiens
aacgtacttcctttg

SEQ ID NO: 10702 - DNA, 15 bp, Homo sapiens
taacgtacttccttt

SEQ ID NO: 10703 - DNA, 15 bp, Homo sapiens
ttaacgtacttcctt

SEQ ID NO: 10704 - DNA, 15 bp, Homo sapiens
attaacgtacttcct

SEQ ID NO: 10705 - DNA, 15 bp, Homo sapiens
aattaacgtacttcc

SEQ ID NO: 10706 - DNA, 15 bp, Homo sapiens
taattaacgtacttc

SEQ ID NO: 10707 - DNA, 15 bp, Homo sapiens
ataattaacgtactt

SEQ ID NO: 10708 - DNA, 15 bp, Homo sapiens
tataattaacgtact

SEQ ID NO: 10709 - DNA, 15 bp, Homo sapiens
atataattaacgtac

SEQ ID NO: 10710 - DNA, 15 bp, Homo sapiens
tatataattaacgta

SEQ ID NO: 10711 - DNA, 15 bp, Homo sapiens
ctatataattaacgt

SEQ ID NO: 10712 - DNA, 15 bp, Homo sapiens
tctatataattaacg

SEQ ID NO: 10713 - DNA, 15 bp, Homo sapiens
gtctatataattaac

SEQ ID NO: 10714 - DNA, 15 bp, Homo sapiens
tgtctatataattaa

SEQ ID NO: 10715 - DNA, 15 bp, Homo sapiens
ctgtctatataatta

SEQ ID NO: 10716 - DNA, 15 bp, Homo sapiens
tctgtctatataatt

SEQ ID NO: 10717 - DNA, 15 bp, Homo sapiens
ttctgtctatataat

SEQ ID NO: 10718 - DNA, 15 bp, Homo sapiens
gttctgtctatataa

SEQ ID NO: 10719 - DNA, 15 bp, Homo sapiens
tgttctgtctatata

SEQ ID NO: 10720 - DNA, 15 bp, Homo sapiens
ctgttctgtctatat

SEQ ID NO: 10721 - DNA, 15 bp, Homo sapiens
tctgttctgtctata

SEQ ID NO: 10722 - DNA, 15 bp, Homo sapiens
ctctgttctgtctat

SEQ ID NO: 10723 - DNA, 15 bp, Homo sapiens
tctctgttctgtcta

SEQ ID NO: 10724 - DNA, 15 bp, Homo sapiens
ttctctgttctgtct

SEQ ID NO: 10725 - DNA, 15 bp, Homo sapiens
gttctctgttctgtc

SEQ ID NO: 10726 - DNA, 15 bp, Homo sapiens
agttctctgttctgt

SEQ ID NO: 10727 - DNA, 15 bp, Homo sapiens
gagttctctgttctg

SEQ ID NO: 10728 - DNA, 15 bp, Homo sapiens
tgagttctctgttct

SEQ ID NO: 10729 - DNA, 15 bp, Homo sapiens
ttgagttctctgttc

SEQ ID NO: 10730 - DNA, 15 bp, Homo sapiens
attgagttctctgtt

SEQ ID NO: 10731 - DNA, 15 bp, Homo sapiens
aattgagttctctgt

SEQ ID NO: 10732 - DNA, 15 bp, Homo sapiens
aaattgagttctctg

SEQ ID NO: 10733 - DNA, 15 bp, Homo sapiens
aaaattgagttctct

SEQ ID NO: 10734 - DNA, 15 bp, Homo sapiens
taaaattgagttctc

SEQ ID NO: 10735 - DNA, 15 bp, Homo sapiens
ataaaattgagttct

SEQ ID NO: 10736 - DNA, 15 bp, Homo sapiens
aataaaattgagttc

SEQ ID NO: 10737 - DNA, 15 bp, Homo sapiens
caataaaattgagtt

SEQ ID NO: 10738 - DNA, 15 bp, Homo sapiens
tcaataaaattgagt

SEQ ID NO: 10739 - DNA, 15 bp, Homo sapiens
ttcaataaaattgag

SEQ ID NO: 10740 - DNA, 15 bp, Homo sapiens
gttcaataaaattga

SEQ ID NO: 10741 - DNA, 15 bp, Homo sapiens
ggttcaataaaattg

SEQ ID NO: 10742 - DNA, 15 bp, Homo sapiens
aggttcaataaaatt

SEQ ID NO: 10743 - DNA, 15 bp, Homo sapiens
aaggttcaataaaat

SEQ ID NO: 10744 - DNA, 15 bp, Homo sapiens
taaggttcaataaaa

SEQ ID NO: 10745 - DNA, 15 bp, Homo sapiens
ataaggttcaataaa

SEQ ID NO: 10746 - DNA, 15 bp, Homo sapiens
aataaggttcaataa

SEQ ID NO: 10747 - DNA, 15 bp, Homo sapiens
aaataaggttcaata

SEQ ID NO: 10748 - DNA, 15 bp, Homo sapiens
caaataaggttcaat

SEQ ID NO: 10749 - DNA, 15 bp, Homo sapiens
acaaataaggttcaa

SEQ ID NO: 10750 - DNA, 15 bp, Homo sapiens
tacaaataaggttca

SEQ ID NO: 10751 - DNA, 15 bp, Homo sapiens
gtacaaataaggttc

SEQ ID NO: 10752 - DNA, 15 bp, Homo sapiens
ggtacaaataaggtt

SEQ ID NO: 10753 - DNA, 15 bp, Homo sapiens
gggtacaaataaggt

SEQ ID NO: 10754 - DNA, 15 bp, Homo sapiens
tgggtacaaataagg

SEQ ID NO: 10755 - DNA, 15 bp, Homo sapiens
ctgggtacaaataag

SEQ ID NO: 10756 - DNA, 15 bp, Homo sapiens
tctgggtacaaataa

SEQ ID NO: 10757 - DNA, 15 bp, Homo sapiens
ttctgggtacaaata

SEQ ID NO: 10758 - DNA, 15 bp, Homo sapiens
cttctgggtacaaat

SEQ ID NO: 10759 - DNA, 15 bp, Homo sapiens
acttctgggtacaaa

SEQ ID NO: 10760 - DNA, 15 bp, Homo sapiens
aacttctgggtacaa

SEQ ID NO: 10761 - DNA, 15 bp, Homo sapiens
aaacttctgggtaca

SEQ ID NO: 10762 - DNA, 15 bp, Homo sapiens
caaacttctgggtac

SEQ ID NO: 10763 - DNA, 15 bp, Homo sapiens
tcaaacttctgggta

SEQ ID NO: 10764 - DNA, 15 bp, Homo sapiens
ttcaaacttctgggt

SEQ ID NO: 10765 - DNA, 15 bp, Homo sapiens
gttcaaacttctggg

SEQ ID NO: 10766 - DNA, 15 bp, Homo sapiens
agttcaaacttctgg

SEQ ID NO: 10767 - DNA, 15 bp, Homo sapiens
tagttcaaacttctg

SEQ ID NO: 10768 - DNA, 15 bp, Homo sapiens
ctagttcaaacttct

SEQ ID NO: 10769 - DNA, 15 bp, Homo sapiens
tctagttcaaacttc

SEQ ID NO: 10770 - DNA, 15 bp, Homo sapiens
atctagttcaaactt

SEQ ID NO: 10771 - DNA, 15 bp, Homo sapiens
catctagttcaaact

SEQ ID NO: 10772 - DNA, 15 bp, Homo sapiens
gcatctagttcaaac

SEQ ID NO: 10773 - DNA, 15 bp, Homo sapiens
agcatctagttcaaa

SEQ ID NO: 10774 - DNA, 15 bp, Homo sapiens
cagcatctagttcaa

SEQ ID NO: 10775 - DNA, 15 bp, Homo sapiens
tcagcatctagttca

SEQ ID NO: 10776 - DNA, 15 bp, Homo sapiens
atcagcatctagttc

SEQ ID NO: 10777 - DNA, 15 bp, Homo sapiens
tatcagcatctagtt

SEQ ID NO: 10778 - DNA, 15 bp, Homo sapiens
atatcagcatctagt

SEQ ID NO: 10779 - DNA, 15 bp, Homo sapiens
catatcagcatctag

SEQ ID NO: 10780 - DNA, 15 bp, Homo sapiens
tcatatcagcatcta

SEQ ID NO: 10781 - DNA, 15 bp, Homo sapiens
atcatatcagcatct

SEQ ID NO: 10782 - DNA, 15 bp, Homo sapiens
catcatatcagcatc

SEQ ID NO: 10783 - DNA, 15 bp, Homo sapiens
tcatcatatcagcat

SEQ ID NO: 10784 - DNA, 15 bp, Homo sapiens
atcatcatatcagca

SEQ ID NO: 10785 - DNA, 15 bp, Homo sapiens
aatcatcatatcagc

SEQ ID NO: 10786 - DNA, 15 bp, Homo sapiens
aaatcatcatatcag

SEQ ID NO: 10787 - DNA, 15 bp, Homo sapiens
aaaatcatcatatca

SEQ ID NO: 10788 - DNA, 15 bp, Homo sapiens
aaaaatcatcatatc

SEQ ID NO: 10789 - DNA, 15 bp, Homo sapiens
gaaaaatcatcatat

SEQ ID NO: 10790 - DNA, 15 bp, Homo sapiens
agaaaaatcatcata

SEQ ID NO: 10791 - DNA, 15 bp, Homo sapiens
cagaaaaatcatcat

SEQ ID NO: 10792 - DNA, 15 bp, Homo sapiens
ccagaaaaatcatca

SEQ ID NO: 10793 - DNA, 15 bp, Homo sapiens
cccagaaaaatcatc

SEQ ID NO: 10794 - DNA, 15 bp, Homo sapiens
tcccagaaaaatcat

SEQ ID NO: 10795 - DNA, 15 bp, Homo sapiens
ttcccagaaaaatca

SEQ ID NO: 10796 - DNA, 15 bp, Homo sapiens
gttcccagaaaaatc

SEQ ID NO: 10797 - DNA, 15 bp, Homo sapiens
tgttcccagaaaaat

SEQ ID NO: 10798 - DNA, 15 bp, Homo sapiens
ttgttcccagaaaaa

SEQ ID NO: 10799 - DNA, 15 bp, Homo sapiens
cttgttcccagaaaa

SEQ ID NO: 10800 - DNA, 15 bp, Homo sapiens
acttgttcccagaaa

SEQ ID NO: 10801 - DNA, 15 bp, Homo sapiens
gacttgttcccagaa

SEQ ID NO: 10802 - DNA, 15 bp, Homo sapiens
tgacttgttcccaga

SEQ ID NO: 10803 - DNA, 15 bp, Homo sapiens
ttgacttgttcccag

SEQ ID NO: 10804 - DNA, 15 bp, Homo sapiens
gttgacttgttccca

SEQ ID NO: 10805 - DNA, 15 bp, Homo sapiens
tgttgacttgttccc

SEQ ID NO: 10806 - DNA, 15 bp, Homo sapiens
atgttgacttgttcc

SEQ ID NO: 10807 - DNA, 15 bp, Homo sapiens
catgttgacttgttc

SEQ ID NO: 10808 - DNA, 15 bp, Homo sapiens
gcatgttgacttgtt

SEQ ID NO: 10809 - DNA, 15 bp, Homo sapiens
tgcatgttgacttgt

SEQ ID NO: 10810 - DNA, 15 bp, Homo sapiens
ttgcatgttgacttg

SEQ ID NO: 10811 - DNA, 15 bp, Homo sapiens
cttgcatgttgactt

SEQ ID NO: 10812 - DNA, 15 bp, Homo sapiens
tcttgcatgttgact

SEQ ID NO: 10813 - DNA, 15 bp, Homo sapiens
gtcttgcatgttgac

SEQ ID NO: 10814 - DNA, 15 bp, Homo sapiens
agtcttgcatgttga

SEQ ID NO: 10815 - DNA, 15 bp, Homo sapiens
tagtcttgcatgttg

SEQ ID NO: 10816 - DNA, 15 bp, Homo sapiens
atagtcttgcatgtt

SEQ ID NO: 10817 - DNA, 15 bp, Homo sapiens
aatagtcttgcatgt

SEQ ID NO: 10818 - DNA, 15 bp, Homo sapiens
aaatagtcttgcatg

SEQ ID NO: 10819 - DNA, 15 bp, Homo sapiens
caaatagtcttgcat

SEQ ID NO: 10820 - DNA, 15 bp, Homo sapiens
tcaaatagtcttgca

SEQ ID NO: 10821 - DNA, 15 bp, Homo sapiens
ctcaaatagtcttgc

SEQ ID NO: 10822 - DNA, 15 bp, Homo sapiens
gctcaaatagtcttg

SEQ ID NO: 10823 - DNA, 15 bp, Homo sapiens
tgctcaaatagtctt

SEQ ID NO: 10824 - DNA, 15 bp, Homo sapiens
ctgctcaaatagtct

SEQ ID NO: 10825 - DNA, 15 bp, Homo sapiens
gctgctcaaatagtc

SEQ ID NO: 10826 - DNA, 15 bp, Homo sapiens
agctgctcaaatagt

SEQ ID NO: 10827 - DNA, 15 bp, Homo sapiens
cagctgctcaaatag

SEQ ID NO: 10828 - DNA, 15 bp, Homo sapiens
acagctgctcaaata

SEQ ID NO: 10829 - DNA, 15 bp, Homo sapiens
tacagctgctcaaat

SEQ ID NO: 10830 - DNA, 15 bp, Homo sapiens
ttacagctgctcaaa

SEQ ID NO: 10831 - DNA, 15 bp, Homo sapiens
tttacagctgctcaa

SEQ ID NO: 10832 - DNA, 15 bp, Homo sapiens
atttacagctgctca

SEQ ID NO: 10833 - DNA, 15 bp, Homo sapiens
tatttacagctgctc

SEQ ID NO: 10834 - DNA, 15 bp, Homo sapiens
atatttacagctgct

SEQ ID NO: 10835 - DNA, 15 bp, Homo sapiens
aatatttacagctgc

SEQ ID NO: 10836 - DNA, 15 bp, Homo sapiens
taatatttacagctg

SEQ ID NO: 10837 - DNA, 15 bp, Homo sapiens
ctaatatttacagct

SEQ ID NO: 10838 - DNA, 15 bp, Homo sapiens
actaatatttacagc

SEQ ID NO: 10839 - DNA, 15 bp, Homo sapiens
aactaatatttacag

SEQ ID NO: 10840 - DNA, 15 bp, Homo sapiens
taactaatatttaca

SEQ ID NO: 10841 - DNA, 15 bp, Homo sapiens
ttaactaatatttac

SEQ ID NO: 10842 - DNA, 15 bp, Homo sapiens
tttaactaatattta

SEQ ID NO: 10843 - DNA, 15 bp, Homo sapiens
ttttaactaatattt

SEQ ID NO: 10844 - DNA, 15 bp, Homo sapiens
attttaactaatatt

SEQ ID NO: 10845 - DNA, 15 bp, Homo sapiens
aattttaactaatat

SEQ ID NO: 10846 - DNA, 15 bp, Homo sapiens
aaattttaactaata

SEQ ID NO: 10847 - DNA, 15 bp, Homo sapiens
taaattttaactaat

SEQ ID NO: 10848 - DNA, 15 bp, Homo sapiens
ttaaattttaactaa

SEQ ID NO: 10849 - DNA, 15 bp, Homo sapiens
attaaattttaacta

SEQ ID NO: 10850 - DNA, 15 bp, Homo sapiens
gattaaattttaact

SEQ ID NO: 10851 - DNA, 15 bp, Homo sapiens
agattaaattttaac

SEQ ID NO: 10852 - DNA, 15 bp, Homo sapiens
tagattaaattttaa

SEQ ID NO: 10853 - DNA, 15 bp, Homo sapiens
ttagattaaatttta

SEQ ID NO: 10854 - DNA, 15 bp, Homo sapiens
tttagattaaatttt

SEQ ID NO: 10855 - DNA, 15 bp, Homo sapiens
ctttagattaaattt

SEQ ID NO: 10856 - DNA, 15 bp, Homo sapiens
gctttagattaaatt

SEQ ID NO: 10857 - DNA, 15 bp, Homo sapiens
tgctttagattaaat

SEQ ID NO: 10858 - DNA, 15 bp, Homo sapiens
ttgctttagattaaa

SEQ ID NO: 10859 - DNA, 15 bp, Homo sapiens
attgctttagattaa

SEQ ID NO: 10860 - DNA, 15 bp, Homo sapiens
cattgctttagatta

SEQ ID NO: 10861 - DNA, 15 bp, Homo sapiens
ccattgctttagatt

SEQ ID NO: 10862 - DNA, 15 bp, Homo sapiens
tccattgctttagat

SEQ ID NO: 10863 - DNA, 15 bp, Homo sapiens
ctccattgctttaga

SEQ ID NO: 10864 - DNA, 15 bp, Homo sapiens
tctccattgctttag

SEQ ID NO: 10865 - DNA, 15 bp, Homo sapiens
ttctccattgcttta

SEQ ID NO: 10866 - DNA, 15 bp, Homo sapiens
tttctccattgcttt

SEQ ID NO: 10867 - DNA, 15 bp, Homo sapiens
ctttctccattgctt

SEQ ID NO: 10868 - DNA, 15 bp, Homo sapiens
cctttctccattgct

SEQ ID NO: 10869 - DNA, 15 bp, Homo sapiens
ccctttctccattgc

SEQ ID NO: 10870 - DNA, 15 bp, Homo sapiens
accctttctccattg

SEQ ID NO: 10871 - DNA, 15 bp, Homo sapiens
taccctttctccatt

SEQ ID NO: 10872 - DNA, 15 bp, Homo sapiens
gtaccctttctccat

SEQ ID NO: 10873 - DNA, 15 bp, Homo sapiens
agtaccctttctcca

SEQ ID NO: 10874 - DNA, 15 bp, Homo sapiens
gagtaccctttctcc

SEQ ID NO: 10875 - DNA, 15 bp, Homo sapiens
agagtaccctttctc

SEQ ID NO: 10876 - DNA, 15 bp, Homo sapiens
cagagtaccctttct

SEQ ID NO: 10877 - DNA, 15 bp, Homo sapiens
gcagagtaccctttc

SEQ ID NO: 10878 - DNA, 15 bp, Homo sapiens
agcagagtacccttt

SEQ ID NO: 10879 - DNA, 15 bp, Homo sapiens
cagcagagtaccctt

SEQ ID NO: 10880 - DNA, 15 bp, Homo sapiens
tcagcagagtaccct

SEQ ID NO: 10881 - DNA, 15 bp, Homo sapiens
ttcagcagagtaccc

SEQ ID NO: 10882 - DNA, 15 bp, Homo sapiens
cttcagcagagtacc

SEQ ID NO: 10883 - DNA, 15 bp, Homo sapiens
acttcagcagagtac

SEQ ID NO: 10884 - DNA, 15 bp, Homo sapiens
cacttcagcagagta

SEQ ID NO: 10885 - DNA, 15 bp, Homo sapiens
ccacttcagcagagt

SEQ ID NO: 10886 - DNA, 15 bp, Homo sapiens
accacttcagcagag

SEQ ID NO: 10887 - DNA, 15 bp, Homo sapiens
aaccacttcagcaga

SEQ ID NO: 10888 - DNA, 15 bp, Homo sapiens
aaaccacttcagcag

SEQ ID NO: 10889 - DNA, 15 bp, Homo sapiens
gaaaccacttcagca

SEQ ID NO: 10890 - DNA, 15 bp, Homo sapiens
tgaaaccacttcagc

SEQ ID NO: 10891 - DNA, 15 bp, Homo sapiens
ctgaaaccacttcag

SEQ ID NO: 10892 - DNA, 15 bp, Homo sapiens
tctgaaaccacttca

SEQ ID NO: 10893 - DNA, 15 bp, Homo sapiens
atctgaaaccacttc

SEQ ID NO: 10894 - DNA, 15 bp, Homo sapiens
catctgaaaccactt

SEQ ID NO: 10895 - DNA, 15 bp, Homo sapiens
gcatctgaaaccact

SEQ ID NO: 10896 - DNA, 15 bp, Homo sapiens
tgcatctgaaaccac

SEQ ID NO: 10897 - DNA, 15 bp, Homo sapiens
atgcatctgaaacca

SEQ ID NO: 10898 - DNA, 15 bp, Homo sapiens
aatgcatctgaaacc

SEQ ID NO: 10899 - DNA, 15 bp, Homo sapiens
caatgcatctgaaac

SEQ ID NO: 10900 - DNA, 15 bp, Homo sapiens
ccaatgcatctgaaa

SEQ ID NO: 10901 - DNA, 15 bp, Homo sapiens
gccaatgcatctgaa

SEQ ID NO: 10902 - DNA, 15 bp, Homo sapiens
agccaatgcatctga

SEQ ID NO: 10903 - DNA, 15 bp, Homo sapiens
cagccaatgcatctg

SEQ ID NO: 10904 - DNA, 15 bp, Homo sapiens
ccagccaatgcatct

SEQ ID NO: 10905 - DNA, 15 bp, Homo sapiens
tccagccaatgcatc

SEQ ID NO: 10906 - DNA, 15 bp, Homo sapiens
atccagccaatgcat

SEQ ID NO: 10907 - DNA, 15 bp, Homo sapiens
aatccagccaatgca

SEQ ID NO: 10908 - DNA, 15 bp, Homo sapiens
aaatccagccaatgc

SEQ ID NO: 10909 - DNA, 15 bp, Homo sapiens
aaaatccagccaatg

SEQ ID NO: 10910 - DNA, 15 bp, Homo sapiens
aaaaatccagccaat

SEQ ID NO: 10911 - DNA, 15 bp, Homo sapiens
aaaaaatccagccaa

SEQ ID NO: 10912 - DNA, 15 bp, Homo sapiens
aaaaaaatccagcca

SEQ ID NO: 10913 - DNA, 15 bp, Homo sapiens
aaaaaaaatccagcc

SEQ ID NO: 10914 - DNA, 15 bp, Homo sapiens
aaaaaaaaatccagc

SEQ ID NO: 10915 - DNA, 15 bp, Homo sapiens
gaaaaaaaaatccag

SEQ ID NO: 10916 - DNA, 15 bp, Homo sapiens
agaaaaaaaaatcca

SEQ ID NO: 10917 - DNA, 15 bp, Homo sapiens
gagaaaaaaaaatcc

SEQ ID NO: 10918 - DNA, 15 bp, Homo sapiens
ggagaaaaaaaaatc

SEQ ID NO: 10919 - DNA, 15 bp, Homo sapiens
gggagaaaaaaaaat

SEQ ID NO: 10920 - DNA, 15 bp, Homo sapiens
ggggagaaaaaaaaa

SEQ ID NO: 10921 - DNA, 15 bp, Homo sapiens
aggggagaaaaaaaa

SEQ ID NO: 10922 - DNA, 15 bp, Homo sapiens
aaggggagaaaaaaa

SEQ ID NO: 10923 - DNA, 15 bp, Homo sapiens
taaggggagaaaaaa

SEQ ID NO: 10924 - DNA, 15 bp, Homo sapiens
ttaaggggagaaaaa

SEQ ID NO: 10925 - DNA, 15 bp, Homo sapiens
tttaaggggagaaaa

SEQ ID NO: 10926 - DNA, 15 bp, Homo sapiens
atttaaggggagaaa

SEQ ID NO: 10927 - DNA, 15 bp, Homo sapiens
aatttaaggggagaa

SEQ ID NO: 10928 - DNA, 15 bp, Homo sapiens
caatttaaggggaga

SEQ ID NO: 10929 - DNA, 15 bp, Homo sapiens
acaatttaaggggag

SEQ ID NO: 10930 - DNA, 15 bp, Homo sapiens
cacaatttaagggga

SEQ ID NO: 10931 - DNA, 15 bp, Homo sapiens
acacaatttaagggg

SEQ ID NO: 10932 - DNA, 15 bp, Homo sapiens
cacacaatttaaggg

SEQ ID NO: 10933 - DNA, 15 bp, Homo sapiens
ccacacaatttaagg

SEQ ID NO: 10934 - DNA, 15 bp, Homo sapiens
tccacacaatttaag

SEQ ID NO: 10935 - DNA, 15 bp, Homo sapiens
ctccacacaatttaa

SEQ ID NO: 10936 - DNA, 15 bp, Homo sapiens
cctccacacaattta

SEQ ID NO: 10937 - DNA, 15 bp, Homo sapiens
gcctccacacaattt

SEQ ID NO: 10938 - DNA, 15 bp, Homo sapiens
tgcctccacacaatt

SEQ ID NO: 10939 - DNA, 15 bp, Homo sapiens
atgcctccacacaat

SEQ ID NO: 10940 - DNA, 15 bp, Homo sapiens
tatgcctccacacaa

SEQ ID NO: 10941 - DNA, 15 bp, Homo sapiens
ctatgcctccacaca

SEQ ID NO: 10942 - DNA, 15 bp, Homo sapiens
tctatgcctccacac

SEQ ID NO: 10943 - DNA, 15 bp, Homo sapiens
gtctatgcctccaca

SEQ ID NO: 10944 - DNA, 15 bp, Homo sapiens
tgtctatgcctccac

SEQ ID NO: 10945 - DNA, 15 bp, Homo sapiens
atgtctatgcctcca

SEQ ID NO: 10946 - DNA, 15 bp, Homo sapiens
aatgtctatgcctcc

SEQ ID NO: 10947 - DNA, 15 bp, Homo sapiens
aaatgtctatgcctc

SEQ ID NO: 10948 - DNA, 15 bp, Homo sapiens
taaatgtctatgcct

SEQ ID NO: 10949 - DNA, 15 bp, Homo sapiens
gtaaatgtctatgcc

SEQ ID NO: 10950 - DNA, 15 bp, Homo sapiens
agtaaatgtctatgc

SEQ ID NO: 10951 - DNA, 15 bp, Homo sapiens
tagtaaatgtctatg

SEQ ID NO: 10952 - DNA, 15 bp, Homo sapiens
atagtaaatgtctat

SEQ ID NO: 10953 - DNA, 15 bp, Homo sapiens
catagtaaatgtcta

SEQ ID NO: 10954 - DNA, 15 bp, Homo sapiens
acatagtaaatgtct

SEQ ID NO: 10955 - DNA, 15 bp, Homo sapiens
aacatagtaaatgtc

SEQ ID NO: 10956 - DNA, 15 bp, Homo sapiens
taacatagtaaatgt

SEQ ID NO: 10957 - DNA, 15 bp, Homo sapiens
ataacatagtaaatg

SEQ ID NO: 10958 - DNA, 15 bp, Homo sapiens
tataacatagtaaat

SEQ ID NO: 10959 - DNA, 15 bp, Homo sapiens
atataacatagtaaa

SEQ ID NO: 10960 - DNA, 15 bp, Homo sapiens
aatataacatagtaa

SEQ ID NO: 10961 - DNA, 15 bp, Homo sapiens
aaatataacatagta

SEQ ID NO: 10962 - DNA, 15 bp, Homo sapiens
aaaatataacatagt

SEQ ID NO: 10963 - DNA, 15 bp, Homo sapiens
aaaaatataacatag

SEQ ID NO: 10964 - DNA, 15 bp, Homo sapiens
taaaaatataacata

SEQ ID NO: 10965 - DNA, 15 bp, Homo sapiens
ataaaaatataacat

SEQ ID NO: 10966 - DNA, 15 bp, Homo sapiens
gataaaaatataaca

SEQ ID NO: 10967 - DNA, 15 bp, Homo sapiens
agataaaaatataac

SEQ ID NO: 10968 - DNA, 15 bp, Homo sapiens
aagataaaaatataa

SEQ ID NO: 10969 - DNA, 15 bp, Homo sapiens
aaagataaaaatata

SEQ ID NO: 10970 - DNA, 15 bp, Homo sapiens
aaaagataaaaatat

SEQ ID NO: 10971 - DNA, 15 bp, Homo sapiens
aaaaagataaaaata

SEQ ID NO: 10972 - DNA, 15 bp, Homo sapiens
taaaaagataaaaat

SEQ ID NO: 10973 - DNA, 15 bp, Homo sapiens
ataaaaagataaaaa

SEQ ID NO: 10974 - DNA, 15 bp, Homo sapiens
tataaaaagataaaa

SEQ ID NO: 10975 - DNA, 15 bp, Homo sapiens
atataaaaagataaa

SEQ ID NO: 10976 - DNA, 15 bp, Homo sapiens
catataaaaagataa

SEQ ID NO: 10977 - DNA, 15 bp, Homo sapiens
gcatataaaaagata

SEQ ID NO: 10978 - DNA, 15 bp, Homo sapiens
ggcatataaaaagat

SEQ ID NO: 10979 - DNA, 15 bp, Homo sapiens
aggcatataaaaaga

SEQ ID NO: 10980 - DNA, 15 bp, Homo sapiens
aaggcatataaaaag

SEQ ID NO: 10981 - DNA, 15 bp, Homo sapiens
taaggcatataaaaa

SEQ ID NO: 10982 - DNA, 15 bp, Homo sapiens
ttaaggcatataaaa

SEQ ID NO: 10983 - DNA, 15 bp, Homo sapiens
gttaaggcatataaa

SEQ ID NO: 10984 - DNA, 15 bp, Homo sapiens
agttaaggcatataa

SEQ ID NO: 10985 - DNA, 15 bp, Homo sapiens
cagttaaggcatata

SEQ ID NO: 10986 - DNA, 15 bp, Homo sapiens
acagttaaggcatat

SEQ ID NO: 10987 - DNA, 15 bp, Homo sapiens
aacagttaaggcata

SEQ ID NO: 10988 - DNA, 15 bp, Homo sapiens
aaacagttaaggcat

SEQ ID NO: 10989 - DNA, 15 bp, Homo sapiens
taaacagttaaggca

SEQ ID NO: 10990 - DNA, 15 bp, Homo sapiens
ttaaacagttaaggc

SEQ ID NO: 10991 - DNA, 15 bp, Homo sapiens
attaaacagttaagg

SEQ ID NO: 10992 - DNA, 15 bp, Homo sapiens
tattaaacagttaag

SEQ ID NO: 10993 - DNA, 15 bp, Homo sapiens
ttattaaacagttaa

SEQ ID NO: 10994 - DNA, 15 bp, Homo sapiens
attattaaacagtta

SEQ ID NO: 10995 - DNA, 15 bp, Homo sapiens
tattattaaacagtt

SEQ ID NO: 10996 - DNA, 15 bp, Homo sapiens
ttattattaaacagt

SEQ ID NO: 10997 - DNA, 15 bp, Homo sapiens
tttattattaaacag

SEQ ID NO: 10998 - DNA, 15 bp, Homo sapiens
atttattattaaaca

SEQ ID NO: 10999 - DNA, 15 bp, Homo sapiens
tatttattattaaac

SEQ ID NO: 11000 - DNA, 15 bp, Homo sapiens
ctatttattattaaa

SEQ ID NO: 11001 - DNA, 15 bp, Homo sapiens
tctatttattattaa

SEQ ID NO: 11002 - DNA, 15 bp, Homo sapiens
gtctatttattatta

SEQ ID NO: 11003 - DNA, 15 bp, Homo sapiens
agtctatttattatt

SEQ ID NO: 11004 - DNA, 15 bp, Homo sapiens
aagtctatttattat

SEQ ID NO: 11005 - DNA, 15 bp, Homo sapiens
taagtctatttatta

SEQ ID NO: 11006 - DNA, 15 bp, Homo sapiens
ataagtctatttatt

SEQ ID NO: 11007 - DNA, 15 bp, Homo sapiens
aataagtctatttat

SEQ ID NO: 11008 - DNA, 15 bp, Homo sapiens
aaataagtctattta

SEQ ID NO: 11009 - DNA, 15 bp, Homo sapiens
gaaataagtctattt

SEQ ID NO: 11010 - DNA, 15 bp, Homo sapiens
tgaaataagtctatt

SEQ ID NO: 11011 - DNA, 15 bp, Homo sapiens
ttgaaataagtctat

SEQ ID NO: 11012 - DNA, 15 bp, Homo sapiens
attgaaataagtcta

SEQ ID NO: 11013 - DNA, 15 bp, Homo sapiens
tattgaaataagtct

SEQ ID NO: 11014 - DNA, 15 bp, Homo sapiens
atattgaaataagtc

SEQ ID NO: 11015 - DNA, 15 bp, Homo sapiens
aatattgaaataagt

SEQ ID NO: 11016 - DNA, 15 bp, Homo sapiens
aaatattgaaataag

SEQ ID NO: 11017 - DNA, 15 bp, Homo sapiens
caaatattgaaataa

SEQ ID NO: 11018 - DNA, 15 bp, Homo sapiens
tcaaatattgaaata

SEQ ID NO: 11019 - DNA, 15 bp, Homo sapiens
ttcaaatattgaaat

SEQ ID NO: 11020 - DNA, 15 bp, Homo sapiens
tttcaaatattgaaa

SEQ ID NO: 11021 - DNA, 15 bp, Homo sapiens
atttcaaatattgaa

SEQ ID NO: 11022 - DNA, 15 bp, Homo sapiens
catttcaaatattga

SEQ ID NO: 11023 - DNA, 15 bp, Homo sapiens
acatttcaaatattg

SEQ ID NO: 11024 - DNA, 15 bp, Homo sapiens
cacatttcaaatatt

SEQ ID NO: 11025 - DNA, 15 bp, Homo sapiens
tcacatttcaaatat

SEQ ID NO: 11026 - DNA, 15 bp, Homo sapiens
ctcacatttcaaata

SEQ ID NO: 11027 - DNA, 15 bp, Homo sapiens
cctcacatttcaaat

SEQ ID NO: 11028 - DNA, 15 bp, Homo sapiens
gcctcacatttcaaa

SEQ ID NO: 11029 - DNA, 15 bp, Homo sapiens
tgcctcacatttcaa

SEQ ID NO: 11030 - DNA, 15 bp, Homo sapiens
ctgcctcacatttca

SEQ ID NO: 11031 - DNA, 15 bp, Homo sapiens
actgcctcacatttc

SEQ ID NO: 11032 - DNA, 15 bp, Homo sapiens
tactgcctcacattt

SEQ ID NO: 11033 - DNA, 15 bp, Homo sapiens
atactgcctcacatt

SEQ ID NO: 11034 - DNA, 15 bp, Homo sapiens
catactgcctcacat

SEQ ID NO: 11035 - DNA, 15 bp, Homo sapiens
tcatactgcctcaca

SEQ ID NO: 11036 - DNA, 15 bp, Homo sapiens
ctcatactgcctcac

SEQ ID NO: 11037 - DNA, 15 bp, Homo sapiens
actcatactgcctca

SEQ ID NO: 11038 - DNA, 15 bp, Homo sapiens
aactcatactgcctc

SEQ ID NO: 11039 - DNA, 15 bp, Homo sapiens
gaactcatactgcct

SEQ ID NO: 11040 - DNA, 15 bp, Homo sapiens
agaactcatactgcc

SEQ ID NO: 11041 - DNA, 15 bp, Homo sapiens
aagaactcatactgc

SEQ ID NO: 11042 - DNA, 15 bp, Homo sapiens
taagaactcatactg

SEQ ID NO: 11043 - DNA, 15 bp, Homo sapiens
ttaagaactcatact

SEQ ID NO: 11044 - DNA, 15 bp, Homo sapiens
attaagaactcatac

SEQ ID NO: 11045 - DNA, 15 bp, Homo sapiens
cattaagaactcata

SEQ ID NO: 11046 - DNA, 15 bp, Homo sapiens
acattaagaactcat

SEQ ID NO: 11047 - DNA, 15 bp, Homo sapiens
tacattaagaactca

SEQ ID NO: 11048 - DNA, 15 bp, Homo sapiens
atacattaagaactc

SEQ ID NO: 11049 - DNA, 15 bp, Homo sapiens
tatacattaagaact

SEQ ID NO: 11050 - DNA, 15 bp, Homo sapiens
gtatacattaagaac

SEQ ID NO: 11051 - DNA, 15 bp, Homo sapiens
agtatacattaagaa

SEQ ID NO: 11052 - DNA, 15 bp, Homo sapiens
aagtatacattaaga

SEQ ID NO: 11053 - DNA, 15 bp, Homo sapiens
taagtatacattaag

SEQ ID NO: 11054 - DNA, 15 bp, Homo sapiens
gtaagtatacattaa

SEQ ID NO: 11055 - DNA, 15 bp, Homo sapiens
agtaagtatacatta

SEQ ID NO: 11056 - DNA, 15 bp, Homo sapiens
gagtaagtatacatt

SEQ ID NO: 11057 - DNA, 15 bp, Homo sapiens
agagtaagtatacat

SEQ ID NO: 11058 - DNA, 15 bp, Homo sapiens
gagagtaagtataca

SEQ ID NO: 11059 - DNA, 15 bp, Homo sapiens
cgagagtaagtatac

SEQ ID NO: 11060 - DNA, 15 bp, Homo sapiens
tcgagagtaagtata

SEQ ID NO: 11061 - DNA, 15 bp, Homo sapiens
ctcgagagtaagtat

SEQ ID NO: 11062 - DNA, 15 bp, Homo sapiens
tctcgagagtaagta

SEQ ID NO: 11063 - DNA, 15 bp, Homo sapiens
atctcgagagtaagt

SEQ ID NO: 11064 - DNA, 15 bp, Homo sapiens
catctcgagagtaag

SEQ ID NO: 11065 - DNA, 15 bp, Homo sapiens
tcatctcgagagtaa

SEQ ID NO: 11066 - DNA, 15 bp, Homo sapiens
atcatctcgagagta

SEQ ID NO: 11067 - DNA, 15 bp, Homo sapiens
catcatctcgagagt

SEQ ID NO: 11068 - DNA, 15 bp, Homo sapiens
ccatcatctcgagag

SEQ ID NO: 11069 - DNA, 15 bp, Homo sapiens
gccatcatctcgaga

SEQ ID NO: 11070 - DNA, 15 bp, Homo sapiens
agccatcatctcgag

SEQ ID NO: 11071 - DNA, 15 bp, Homo sapiens
gagccatcatctcga

SEQ ID NO: 11072 - DNA, 15 bp, Homo sapiens
agagccatcatctcg

SEQ ID NO: 11073 - DNA, 15 bp, Homo sapiens
aagagccatcatctc

SEQ ID NO: 11074 - DNA, 15 bp, Homo sapiens
caagagccatcatct

SEQ ID NO: 11075 - DNA, 15 bp, Homo sapiens
ccaagagccatcatc

SEQ ID NO: 11076 - DNA, 15 bp, Homo sapiens
tccaagagccatcat

SEQ ID NO: 11077 - DNA, 15 bp, Homo sapiens
gtccaagagccatca

SEQ ID NO: 11078 - DNA, 15 bp, Homo sapiens
agtccaagagccatc

SEQ ID NO: 11079 - DNA, 15 bp, Homo sapiens
cagtccaagagccat

SEQ ID NO: 11080 - DNA, 15 bp, Homo sapiens
tcagtccaagagcca

SEQ ID NO: 11081 - DNA, 15 bp, Homo sapiens
ctcagtccaagagcc

SEQ ID NO: 11082 - DNA, 15 bp, Homo sapiens
tctcagtccaagagc

SEQ ID NO: 11083 - DNA, 15 bp, Homo sapiens
ttctcagtccaagag

SEQ ID NO: 11084 - DNA, 15 bp, Homo sapiens
tttctcagtccaaga

SEQ ID NO: 11085 - DNA, 15 bp, Homo sapiens
atttctcagtccaag

SEQ ID NO: 11086 - DNA, 15 bp, Homo sapiens
aatttctcagtccaa

SEQ ID NO: 11087 - DNA, 15 bp, Homo sapiens
caatttctcagtcca

SEQ ID NO: 11088 - DNA, 15 bp, Homo sapiens
tcaatttctcagtcc

SEQ ID NO: 11089 - DNA, 15 bp, Homo sapiens
ttcaatttctcagtc

SEQ ID NO: 11090 - DNA, 15 bp, Homo sapiens
tttcaatttctcagt

SEQ ID NO: 11091 - DNA, 15 bp, Homo sapiens
gtttcaatttctcag

SEQ ID NO: 11092 - DNA, 15 bp, Homo sapiens
ggtttcaatttctca

SEQ ID NO: 11093 - DNA, 15 bp, Homo sapiens
tggtttcaatttctc

SEQ ID NO: 11094 - DNA, 15 bp, Homo sapiens
ctggtttcaatttct

SEQ ID NO: 11095 - DNA, 15 bp, Homo sapiens
cctggtttcaatttc

SEQ ID NO: 11096 - DNA, 15 bp, Homo sapiens
acctggtttcaattt

SEQ ID NO: 11097 - DNA, 15 bp, Homo sapiens
gacctggtttcaatt

SEQ ID NO: 11098 - DNA, 15 bp, Homo sapiens
ggacctggtttcaat

SEQ ID NO: 11099 - DNA, 15 bp, Homo sapiens
gggacctggtttcaa

SEQ ID NO: 11100 - DNA, 15 bp, Homo sapiens
tgggacctggtttca

SEQ ID NO: 11101 - DNA, 15 bp, Homo sapiens
ctgggacctggtttc

SEQ ID NO: 11102 - DNA, 15 bp, Homo sapiens
actgggacctggttt

SEQ ID NO: 11103 - DNA, 15 bp, Homo sapiens
gactgggacctggtt

SEQ ID NO: 11104 - DNA, 15 bp, Homo sapiens
ggactgggacctggt

SEQ ID NO: 11105 - DNA, 15 bp, Homo sapiens
aggactgggacctgg

SEQ ID NO: 11106 - DNA, 15 bp, Homo sapiens
aaggactgggacctg

SEQ ID NO: 11107 - DNA, 15 bp, Homo sapiens
aaaggactgggacct

SEQ ID NO: 11108 - DNA, 15 bp, Homo sapiens
gaaaggactgggacc

SEQ ID NO: 11109 - DNA, 15 bp, Homo sapiens
cgaaaggactgggac

SEQ ID NO: 11110 - DNA, 15 bp, Homo sapiens
gcgaaaggactggga

SEQ ID NO: 11111 - DNA, 15 bp, Homo sapiens
agcgaaaggactggg

SEQ ID NO: 11112 - DNA, 15 bp, Homo sapiens
aagcgaaaggactgg

SEQ ID NO: 11113 - DNA, 15 bp, Homo sapiens
aaagcgaaaggactg

SEQ ID NO: 11114 - DNA, 15 bp, Homo sapiens
aaaagcgaaaggact

SEQ ID NO: 11115 - DNA, 15 bp, Homo sapiens
taaaagcgaaaggac

SEQ ID NO: 11116 - DNA, 15 bp, Homo sapiens
gtaaaagcgaaagga

SEQ ID NO: 11117 - DNA, 15 bp, Homo sapiens
agtaaaagcgaaagg

SEQ ID NO: 11118 - DNA, 15 bp, Homo sapiens
aagtaaaagcgaaag

SEQ ID NO: 11119 - DNA, 15 bp, Homo sapiens
gaagtaaaagcgaaa

SEQ ID NO: 11120 - DNA, 15 bp, Homo sapiens
ggaagtaaaagcgaa

SEQ ID NO: 11121 - DNA, 15 bp, Homo sapiens
aggaagtaaaagcga

SEQ ID NO: 11122 - DNA, 15 bp, Homo sapiens
caggaagtaaaagcg

SEQ ID NO: 11123 - DNA, 15 bp, Homo sapiens
acaggaagtaaaagc

SEQ ID NO: 11124 - DNA, 15 bp, Homo sapiens
cacaggaagtaaaag

SEQ ID NO: 11125 - DNA, 15 bp, Homo sapiens
tcacaggaagtaaaa

SEQ ID NO: 11126 - DNA, 15 bp, Homo sapiens
gtcacaggaagtaaa

SEQ ID NO: 11127 - DNA, 15 bp, Homo sapiens
tgtcacaggaagtaa

SEQ ID NO: 11128 - DNA, 15 bp, Homo sapiens
gtgtcacaggaagta

SEQ ID NO: 11129 - DNA, 15 bp, Homo sapiens
agtgtcacaggaagt

SEQ ID NO: 11130 - DNA, 15 bp, Homo sapiens
cagtgtcacaggaag

SEQ ID NO: 11131 - DNA, 15 bp, Homo sapiens
ccagtgtcacaggaa

SEQ ID NO: 11132 - DNA, 15 bp, Homo sapiens
tccagtgtcacagga

SEQ ID NO: 11133 - DNA, 15 bp, Homo sapiens
atccagtgtcacagg

SEQ ID NO: 11134 - DNA, 15 bp, Homo sapiens
aatccagtgtcacag

SEQ ID NO: 11135 - DNA, 15 bp, Homo sapiens
aaatccagtgtcaca

SEQ ID NO: 11136 - DNA, 15 bp, Homo sapiens
caaatccagtgtcac

SEQ ID NO: 11137 - DNA, 15 bp, Homo sapiens
gcaaatccagtgtca

SEQ ID NO: 11138 - DNA, 15 bp, Homo sapiens
tgcaaatccagtgtc

SEQ ID NO: 11139 - DNA, 15 bp, Homo sapiens
gtgcaaatccagtgt

SEQ ID NO: 11140 - DNA, 15 bp, Homo sapiens
tgtgcaaatccagtg

SEQ ID NO: 11141 - DNA, 15 bp, Homo sapiens
atgtgcaaatccagt

SEQ ID NO: 11142 - DNA, 15 bp, Homo sapiens
catgtgcaaatccag

SEQ ID NO: 11143 - DNA, 15 bp, Homo sapiens
acatgtgcaaatcca

SEQ ID NO: 11144 - DNA, 15 bp, Homo sapiens
gacatgtgcaaatcc

SEQ ID NO: 11145 - DNA, 15 bp, Homo sapiens
tgacatgtgcaaatc

SEQ ID NO: 11146 - DNA, 15 bp, Homo sapiens
ttgacatgtgcaaat

SEQ ID NO: 11147 - DNA, 15 bp, Homo sapiens
attgacatgtgcaaa

SEQ ID NO: 11148 - DNA, 15 bp, Homo sapiens
aattgacatgtgcaa

SEQ ID NO: 11149 - DNA, 15 bp, Homo sapiens
gaattgacatgtgca

SEQ ID NO: 11150 - DNA, 15 bp, Homo sapiens
ggaattgacatgtgc

SEQ ID NO: 11151 - DNA, 15 bp, Homo sapiens
tggaattgacatgtg

SEQ ID NO: 11152 - DNA, 15 bp, Homo sapiens
ctggaattgacatgt

SEQ ID NO: 11153 - DNA, 15 bp, Homo sapiens
cctggaattgacatg

SEQ ID NO: 11154 - DNA, 15 bp, Homo sapiens
tcctggaattgacat

SEQ ID NO: 11155 - DNA, 15 bp, Homo sapiens
ttcctggaattgaca

SEQ ID NO: 11156 - DNA, 15 bp, Homo sapiens
cttcctggaattgac

SEQ ID NO: 11157 - DNA, 15 bp, Homo sapiens
gcttcctggaattga

SEQ ID NO: 11158 - DNA, 15 bp, Homo sapiens
tgcttcctggaattg

SEQ ID NO: 11159 - DNA, 15 bp, Homo sapiens
ctgcttcctggaatt

SEQ ID NO: 11160 - DNA, 15 bp, Homo sapiens
cctgcttcctggaat

SEQ ID NO: 11161 - DNA, 15 bp, Homo sapiens
acctgcttcctggaa

SEQ ID NO: 11162 - DNA, 15 bp, Homo sapiens
tacctgcttcctgga

SEQ ID NO: 11163 - DNA, 15 bp, Homo sapiens
ctacctgcttcctgg

SEQ ID NO: 11164 - DNA, 15 bp, Homo sapiens
actacctgcttcctg

SEQ ID NO: 11165 - DNA, 15 bp, Homo sapiens
aactacctgcttcct

SEQ ID NO: 11166 - DNA, 15 bp, Homo sapiens
aaactacctgcttcc

SEQ ID NO: 11167 - DNA, 15 bp, Homo sapiens
gaaactacctgcttc

SEQ ID NO: 11168 - DNA, 15 bp, Homo sapiens
ggaaactacctgctt

SEQ ID NO: 11169 - DNA, 15 bp, Homo sapiens
tggaaactacctgct

SEQ ID NO: 11170 - DNA, 15 bp, Homo sapiens
ctggaaactacctgc

SEQ ID NO: 11171 - DNA, 15 bp, Homo sapiens
gctggaaactacctg

SEQ ID NO: 11172 - DNA, 15 bp, Homo sapiens
tgctggaaactacct

SEQ ID NO: 11173 - DNA, 15 bp, Homo sapiens
atgctggaaactacc

SEQ ID NO: 11174 - DNA, 15 bp, Homo sapiens
gatgctggaaactac

SEQ ID NO: 11175 - DNA, 15 bp, Homo sapiens
ggatgctggaaacta

SEQ ID NO: 11176 - DNA, 15 bp, Homo sapiens
tggatgctggaaact

SEQ ID NO: 11177 - DNA, 15 bp, Homo sapiens
atggatgctggaaac

SEQ ID NO: 11178 - DNA, 15 bp, Homo sapiens
catggatgctggaaa

SEQ ID NO: 11179 - DNA, 15 bp, Homo sapiens
acatggatgctggaa

SEQ ID NO: 11180 - DNA, 15 bp, Homo sapiens
cacatggatgctgga

SEQ ID NO: 11181 - DNA, 15 bp, Homo sapiens
ccacatggatgctgg

SEQ ID NO: 11182 - DNA, 15 bp, Homo sapiens
accacatggatgctg

SEQ ID NO: 11183 - DNA, 15 bp, Homo sapiens
aaccacatggatgct

SEQ ID NO: 11184 - DNA, 15 bp, Homo sapiens
aaaccacatggatgc

SEQ ID NO: 11185 - DNA, 15 bp, Homo sapiens
aaaaccacatggatg

SEQ ID NO: 11186 - DNA, 15 bp, Homo sapiens
gaaaaccacatggat

SEQ ID NO: 11187 - DNA, 15 bp, Homo sapiens
ggaaaaccacatgga

SEQ ID NO: 11188 - DNA, 15 bp, Homo sapiens
tggaaaaccacatgg

SEQ ID NO: 11189 - DNA, 15 bp, Homo sapiens
ttggaaaaccacatg

SEQ ID NO: 11190 - DNA, 15 bp, Homo sapiens
attggaaaaccacat

SEQ ID NO: 11191 - DNA, 15 bp, Homo sapiens
gattggaaaaccaca

SEQ ID NO: 11192 - DNA, 15 bp, Homo sapiens
agattggaaaaccac

SEQ ID NO: 11193 - DNA, 15 bp, Homo sapiens
aagattggaaaacca

SEQ ID NO: 11194 - DNA, 15 bp, Homo sapiens
aaagattggaaaacc

SEQ ID NO: 11195 - DNA, 15 bp, Homo sapiens
caaagattggaaaac

SEQ ID NO: 11196 - DNA, 15 bp, Homo sapiens
gcaaagattggaaaa

SEQ ID NO: 11197 - DNA, 15 bp, Homo sapiens
tgcaaagattggaaa

SEQ ID NO: 11198 - DNA, 15 bp, Homo sapiens
atgcaaagattggaa

SEQ ID NO: 11199 - DNA, 15 bp, Homo sapiens
aatgcaaagattgga

SEQ ID NO: 11200 - DNA, 15 bp, Homo sapiens
aaatgcaaagattgg

SEQ ID NO: 11201 - DNA, 15 bp, Homo sapiens
caaatgcaaagattg

SEQ ID NO: 11202 - DNA, 15 bp, Homo sapiens
acaaatgcaaagatt

SEQ ID NO: 11203 - DNA, 15 bp, Homo sapiens
cacaaatgcaaagat

SEQ ID NO: 11204 - DNA, 15 bp, Homo sapiens
gcacaaatgcaaaga

SEQ ID NO: 11205 - DNA, 15 bp, Homo sapiens
ggcacaaatgcaaag

SEQ ID NO: 11206 - DNA, 15 bp, Homo sapiens
aggcacaaatgcaaa

SEQ ID NO: 11207 - DNA, 15 bp, Homo sapiens
aaggcacaaatgcaa

SEQ ID NO: 11208 - DNA, 15 bp, Homo sapiens
aaaggcacaaatgca

SEQ ID NO: 11209 - DNA, 15 bp, Homo sapiens
taaaggcacaaatgc

SEQ ID NO: 11210 - DNA, 15 bp, Homo sapiens
ttaaaggcacaaatg

SEQ ID NO: 11211 - DNA, 15 bp, Homo sapiens
tttaaaggcacaaat

SEQ ID NO: 11212 - DNA, 15 bp, Homo sapiens
gtttaaaggcacaaa

SEQ ID NO: 11213 - DNA, 15 bp, Homo sapiens
tgtttaaaggcacaa

SEQ ID NO: 11214 - DNA, 15 bp, Homo sapiens
ttgtttaaaggcaca

SEQ ID NO: 11215 - DNA, 15 bp, Homo sapiens
gttgtttaaaggcac

SEQ ID NO: 11216 - DNA, 15 bp, Homo sapiens
ggttgtttaaaggca

SEQ ID NO: 11217 - DNA, 15 bp, Homo sapiens
tggttgtttaaaggc

SEQ ID NO: 11218 - DNA, 15 bp, Homo sapiens
ttggttgtttaaagg

SEQ ID NO: 11219 - DNA, 15 bp, Homo sapiens
tttggttgtttaaag

SEQ ID NO: 11220 - DNA, 15 bp, Homo sapiens
atttggttgtttaaa

SEQ ID NO: 11221 - DNA, 15 bp, Homo sapiens
tatttggttgtttaa

SEQ ID NO: 11222 - DNA, 15 bp, Homo sapiens
gtatttggttgttta

SEQ ID NO: 11223 - DNA, 15 bp, Homo sapiens
ggtatttggttgttt

SEQ ID NO: 11224 - DNA, 15 bp, Homo sapiens
aggtatttggttgtt

SEQ ID NO: 11225 - DNA, 15 bp, Homo sapiens
caggtatttggttgt

SEQ ID NO: 11226 - DNA, 15 bp, Homo sapiens
tcaggtatttggttg

SEQ ID NO: 11227 - DNA, 15 bp, Homo sapiens
gtcaggtatttggtt

SEQ ID NO: 11228 - DNA, 15 bp, Homo sapiens
cgtcaggtatttggt

SEQ ID NO: 11229 - DNA, 15 bp, Homo sapiens
acgtcaggtatttgg

SEQ ID NO: 11230 - DNA, 15 bp, Homo sapiens
aacgtcaggtatttg

SEQ ID NO: 11231 - DNA, 15 bp, Homo sapiens
aaacgtcaggtattt

SEQ ID NO: 11232 - DNA, 15 bp, Homo sapiens
taaacgtcaggtatt

SEQ ID NO: 11233 - DNA, 15 bp, Homo sapiens
ataaacgtcaggtat

SEQ ID NO: 11234 - DNA, 15 bp, Homo sapiens
aataaacgtcaggta

SEQ ID NO: 11235 - DNA, 15 bp, Homo sapiens
taataaacgtcaggt

SEQ ID NO: 11236 - DNA, 15 bp, Homo sapiens
ttaataaacgtcagg

SEQ ID NO: 11237 - DNA, 15 bp, Homo sapiens
attaataaacgtcag

SEQ ID NO: 11238 - DNA, 15 bp, Homo sapiens
tattaataaacgtca

SEQ ID NO: 11239 - DNA, 15 bp, Homo sapiens
atattaataaacgtc

SEQ ID NO: 11240 - DNA, 15 bp, Homo sapiens
gatattaataaacgt

SEQ ID NO: 11241 - DNA, 15 bp, Homo sapiens
ggatattaataaacg

SEQ ID NO: 11242 - DNA, 15 bp, Homo sapiens
aggatattaataaac

SEQ ID NO: 11243 - DNA, 15 bp, Homo sapiens
caggatattaataaa

SEQ ID NO: 11244 - DNA, 15 bp, Homo sapiens
acaggatattaataa

SEQ ID NO: 11245 - DNA, 15 bp, Homo sapiens
cacaggatattaata

SEQ ID NO: 11246 - DNA, 15 bp, Homo sapiens
ccacaggatattaat

SEQ ID NO: 11247 - DNA, 15 bp, Homo sapiens
cccacaggatattaa

SEQ ID NO: 11248 - DNA, 15 bp, Homo sapiens
ccccacaggatatta

SEQ ID NO: 11249 - DNA, 15 bp, Homo sapiens
gccccacaggatatt

SEQ ID NO: 11250 - DNA, 15 bp, Homo sapiens
agccccacaggatat

SEQ ID NO: 11251 - DNA, 15 bp, Homo sapiens
gagccccacaggata

SEQ ID NO: 11252 - DNA, 15 bp, Homo sapiens
agagccccacaggat

SEQ ID NO: 11253 - DNA, 15 bp, Homo sapiens
aagagccccacagga

SEQ ID NO: 11254 - DNA, 15 bp, Homo sapiens
gaagagccccacagg

SEQ ID NO: 11255 - DNA, 15 bp, Homo sapiens
agaagagccccacag

SEQ ID NO: 11256 - DNA, 15 bp, Homo sapiens
tagaagagccccaca

SEQ ID NO: 11257 - DNA, 15 bp, Homo sapiens
atagaagagccccac

SEQ ID NO: 11258 - DNA, 15 bp, Homo sapiens
gatagaagagcccca

SEQ ID NO: 11259 - DNA, 15 bp, Homo sapiens
tgatagaagagcccc

SEQ ID NO: 11260 - DNA, 15 bp, Homo sapiens
ctgatagaagagccc

SEQ ID NO: 11261 - DNA, 15 bp, Homo sapiens
tctgatagaagagcc

SEQ ID NO: 11262 - DNA, 15 bp, Homo sapiens
ttctgatagaagagc

SEQ ID NO: 11263 - DNA, 15 bp, Homo sapiens
cttctgatagaagag

SEQ ID NO: 11264 - DNA, 15 bp, Homo sapiens
gcttctgatagaaga

SEQ ID NO: 11265 - DNA, 15 bp, Homo sapiens
tgcttctgatagaag

SEQ ID NO: 11266 - DNA, 15 bp, Homo sapiens
gtgcttctgatagaa

SEQ ID NO: 11267 - DNA, 15 bp, Homo sapiens
tgtgcttctgataga

SEQ ID NO: 11268 - DNA, 15 bp, Homo sapiens
atgtgcttctgatag

SEQ ID NO: 11269 - DNA, 15 bp, Homo sapiens
aatgtgcttctgata

SEQ ID NO: 11270 - DNA, 15 bp, Homo sapiens
gaatgtgcttctgat

SEQ ID NO: 11271 - DNA, 15 bp, Homo sapiens
agaatgtgcttctga

SEQ ID NO: 11272 - DNA, 15 bp, Homo sapiens
gagaatgtgcttctg

SEQ ID NO: 11273 - DNA, 15 bp, Homo sapiens
agagaatgtgcttct

SEQ ID NO: 11274 - DNA, 15 bp, Homo sapiens
aagagaatgtgcttc

SEQ ID NO: 11275 - DNA, 15 bp, Homo sapiens
caagagaatgtgctt

SEQ ID NO: 11276 - DNA, 15 bp, Homo sapiens
ccaagagaatgtgct

SEQ ID NO: 11277 - DNA, 15 bp, Homo sapiens
gccaagagaatgtgc

SEQ ID NO: 11278 - DNA, 15 bp, Homo sapiens
ggccaagagaatgtg

SEQ ID NO: 11279 - DNA, 15 bp, Homo sapiens
gggccaagagaatgt

SEQ ID NO: 11280 - DNA, 15 bp, Homo sapiens
cgggccaagagaatg

SEQ ID NO: 11281 - DNA, 15 bp, Homo sapiens
ccgggccaagagaat

SEQ ID NO: 11282 - DNA, 15 bp, Homo sapiens
accgggccaagagaa

SEQ ID NO: 11283 - DNA, 15 bp, Homo sapiens
aaccgggccaagaga

SEQ ID NO: 11284 - DNA, 15 bp, Homo sapiens
gaaccgggccaagag

SEQ ID NO: 11285 - DNA, 15 bp, Homo sapiens
tgaaccgggccaaga

SEQ ID NO: 11286 - DNA, 15 bp, Homo sapiens
atgaaccgggccaag

SEQ ID NO: 11287 - DNA, 15 bp, Homo sapiens
tatgaaccgggccaa

SEQ ID NO: 11288 - DNA, 15 bp, Homo sapiens
ttatgaaccgggcca

SEQ ID NO: 11289 - DNA, 15 bp, Homo sapiens
cttatgaaccgggcc

SEQ ID NO: 11290 - DNA, 15 bp, Homo sapiens
ccttatgaaccgggc

SEQ ID NO: 11291 - DNA, 15 bp, Homo sapiens
cccttatgaaccggg

SEQ ID NO: 11292 - DNA, 15 bp, Homo sapiens
tcccttatgaaccgg

SEQ ID NO: 11293 - DNA, 15 bp, Homo sapiens
ttcccttatgaaccg

SEQ ID NO: 11294 - DNA, 15 bp, Homo sapiens
tttcccttatgaacc

SEQ ID NO: 11295 - DNA, 15 bp, Homo sapiens
atttcccttatgaac

SEQ ID NO: 11296 - DNA, 15 bp, Homo sapiens
catttcccttatgaa

SEQ ID NO: 11297 - DNA, 15 bp, Homo sapiens
acatttcccttatga

SEQ ID NO: 11298 - DNA, 15 bp, Homo sapiens
gacatttcccttatg

SEQ ID NO: 11299 - DNA, 15 bp, Homo sapiens
agacatttcccttat

SEQ ID NO: 11300 - DNA, 15 bp, Homo sapiens
cagacatttccctta

SEQ ID NO: 11301 - DNA, 15 bp, Homo sapiens
acagacatttccctt

SEQ ID NO: 11302 - DNA, 15 bp, Homo sapiens
cacagacatttccct

SEQ ID NO: 11303 - DNA, 15 bp, Homo sapiens
acacagacatttccc

SEQ ID NO: 11304 - DNA, 15 bp, Homo sapiens
tacacagacatttcc

SEQ ID NO: 11305 - DNA, 15 bp, Homo sapiens
atacacagacatttc

SEQ ID NO: 11306 - DNA, 15 bp, Homo sapiens
catacacagacattt

SEQ ID NO: 11307 - DNA, 15 bp, Homo sapiens
gcatacacagacatt

SEQ ID NO: 11308 - DNA, 15 bp, Homo sapiens
cgcatacacagacat

SEQ ID NO: 11309 - DNA, 15 bp, Homo sapiens
gcgcatacacagaca

SEQ ID NO: 11310 - DNA, 15 bp, Homo sapiens
tgcgcatacacagac

SEQ ID NO: 11311 - DNA, 15 bp, Homo sapiens
atgcgcatacacaga

SEQ ID NO: 11312 - DNA, 15 bp, Homo sapiens
gatgcgcatacacag

SEQ ID NO: 11313 - DNA, 15 bp, Homo sapiens
agatgcgcatacaca

SEQ ID NO: 11314 - DNA, 15 bp, Homo sapiens
cagatgcgcatacac

SEQ ID NO: 11315 - DNA, 15 bp, Homo sapiens
ccagatgcgcataca

SEQ ID NO: 11316 - DNA, 15 bp, Homo sapiens
gccagatgcgcatac

SEQ ID NO: 11317 - DNA, 15 bp, Homo sapiens
tgccagatgcgcata

SEQ ID NO: 11318 - DNA, 15 bp, Homo sapiens
ctgccagatgcgcat

SEQ ID NO: 11319 - DNA, 15 bp, Homo sapiens
gctgccagatgcgca

SEQ ID NO: 11320 - DNA, 15 bp, Homo sapiens
agctgccagatgcgc

SEQ ID NO: 11321 - DNA, 15 bp, Homo sapiens
tagctgccagatgcg

SEQ ID NO: 11322 - DNA, 15 bp, Homo sapiens
ttagctgccagatgc

SEQ ID NO: 11323 - DNA, 15 bp, Homo sapiens
cttagctgccagatg

SEQ ID NO: 11324 - DNA, 15 bp, Homo sapiens
tcttagctgccagat

SEQ ID NO: 11325 - DNA, 15 bp, Homo sapiens
atcttagctgccaga

SEQ ID NO: 11326 - DNA, 15 bp, Homo sapiens
aatcttagctgccag

SEQ ID NO: 11327 - DNA, 15 bp, Homo sapiens
taatcttagctgcca

SEQ ID NO: 11328 - DNA, 15 bp, Homo sapiens
ttaatcttagctgcc

SEQ ID NO: 11329 - DNA, 15 bp, Homo sapiens
cttaatcttagctgc

SEQ ID NO: 11330 - DNA, 15 bp, Homo sapiens
ccttaatcttagctg

SEQ ID NO: 11331 - DNA, 15 bp, Homo sapiens
accttaatcttagct

SEQ ID NO: 11332 - DNA, 15 bp, Homo sapiens
aaccttaatcttagc

SEQ ID NO: 11333 - DNA, 15 bp, Homo sapiens
aaaccttaatcttag

SEQ ID NO: 11334 - DNA, 15 bp, Homo sapiens
taaaccttaatctta

SEQ ID NO: 11335 - DNA, 15 bp, Homo sapiens
gtaaaccttaatctt

SEQ ID NO: 11336 - DNA, 15 bp, Homo sapiens
tgtaaaccttaatct

SEQ ID NO: 11337 - DNA, 15 bp, Homo sapiens
ctgtaaaccttaatc

SEQ ID NO: 11338 - DNA, 15 bp, Homo sapiens
actgtaaaccttaat

SEQ ID NO: 11339 - DNA, 15 bp, Homo sapiens
cactgtaaaccttaa

SEQ ID NO: 11340 - DNA, 15 bp, Homo sapiens
ccactgtaaacctta

SEQ ID NO: 11341 - DNA, 15 bp, Homo sapiens
accactgtaaacctt

SEQ ID NO: 11342 - DNA, 15 bp, Homo sapiens
taccactgtaaacct

SEQ ID NO: 11343 - DNA, 15 bp, Homo sapiens
ataccactgtaaacc

SEQ ID NO: 11344 - DNA, 15 bp, Homo sapiens
tataccactgtaaac

SEQ ID NO: 11345 - DNA, 15 bp, Homo sapiens
ttataccactgtaaa

SEQ ID NO: 11346 - DNA, 15 bp, Homo sapiens
gttataccactgtaa

SEQ ID NO: 11347 - DNA, 15 bp, Homo sapiens
ggttataccactgta

SEQ ID NO: 11348 - DNA, 15 bp, Homo sapiens
aggttataccactgt

SEQ ID NO: 11349 - DNA, 15 bp, Homo sapiens
gaggttataccactg

SEQ ID NO: 11350 - DNA, 15 bp, Homo sapiens
tgaggttataccact

SEQ ID NO: 11351 - DNA, 15 bp, Homo sapiens
gtgaggttataccac

SEQ ID NO: 11352 - DNA, 15 bp, Homo sapiens
ggtgaggttatacca

SEQ ID NO: 11353 - DNA, 15 bp, Homo sapiens
aggtgaggttatacc

SEQ ID NO: 11354 - DNA, 15 bp, Homo sapiens
aaggtgaggttatac

SEQ ID NO: 11355 - DNA, 15 bp, Homo sapiens
gaaggtgaggttata

SEQ ID NO: 11356 - DNA, 15 bp, Homo sapiens
tgaaggtgaggttat

SEQ ID NO: 11357 - DNA, 15 bp, Homo sapiens
gtgaaggtgaggtta

SEQ ID NO: 11358 - DNA, 15 bp, Homo sapiens
agtgaaggtgaggtt

SEQ ID NO: 11359 - DNA, 15 bp, Homo sapiens
aagtgaaggtgaggt

SEQ ID NO: 11360 - DNA, 15 bp, Homo sapiens
aaagtgaaggtgagg

SEQ ID NO: 11361 - DNA, 15 bp, Homo sapiens
aaaagtgaaggtgag

SEQ ID NO: 11362 - DNA, 15 bp, Homo sapiens
taaaagtgaaggtga

SEQ ID NO: 11363 - DNA, 15 bp, Homo sapiens
ttaaaagtgaaggtg

SEQ ID NO: 11364 - DNA, 15 bp, Homo sapiens
cttaaaagtgaaggt

SEQ ID NO: 11365 - DNA, 15 bp, Homo sapiens
tcttaaaagtgaagg

SEQ ID NO: 11366 - DNA, 15 bp, Homo sapiens
ttcttaaaagtgaag

SEQ ID NO: 11367 - DNA, 15 bp, Homo sapiens
tttcttaaaagtgaa

SEQ ID NO: 11368 - DNA, 15 bp, Homo sapiens
atttcttaaaagtga

SEQ ID NO: 11369 - DNA, 15 bp, Homo sapiens
aatttcttaaaagtg

SEQ ID NO: 11370 - DNA, 15 bp, Homo sapiens
taatttcttaaaagt

SEQ ID NO: 11371 - DNA, 15 bp, Homo sapiens
ttaatttcttaaaag

SEQ ID NO: 11372 - DNA, 15 bp, Homo sapiens
cttaatttcttaaaa

SEQ ID NO: 11373 - DNA, 15 bp, Homo sapiens
acttaatttcttaaa

SEQ ID NO: 11374 - DNA, 15 bp, Homo sapiens
aacttaatttcttaa

SEQ ID NO: 11375 - DNA, 15 bp, Homo sapiens
aaacttaatttctta

SEQ ID NO: 11376 - DNA, 15 bp, Homo sapiens
taaacttaatttctt

SEQ ID NO: 11377 - DNA, 15 bp, Homo sapiens
ttaaacttaatttct

SEQ ID NO: 11378 - DNA, 15 bp, Homo sapiens
tttaaacttaatttc

SEQ ID NO: 11379 - DNA, 15 bp, Homo sapiens
ttttaaacttaattt

SEQ ID NO: 11380 - DNA, 15 bp, Homo sapiens
tttttaaacttaatt

SEQ ID NO: 11381 - DNA, 15 bp, Homo sapiens
ttttttaaacttaat

SEQ ID NO: 11382 - DNA, 15 bp, Homo sapiens
tttttttaaacttaa

SEQ ID NO: 11383 - DNA, 15 bp, Homo sapiens
ttttttttaaactta

SEQ ID NO: 11384 - DNA, 15 bp, Homo sapiens
attttttttaaactt

SEQ ID NO: 11385 - DNA, 15 bp, Homo sapiens
cattttttttaaact

SEQ ID NO: 11386 - DNA, 15 bp, Homo sapiens
gcattttttttaaac

SEQ ID NO: 11387 - DNA, 15 bp, Homo sapiens
tgcattttttttaaa

SEQ ID NO: 11388 - DNA, 15 bp, Homo sapiens
ctgcattttttttaa

SEQ ID NO: 11389 - DNA, 15 bp, Homo sapiens
tctgcatttttttta

SEQ ID NO: 11390 - DNA, 15 bp, Homo sapiens
atctgcatttttttt

SEQ ID NO: 11391 - DNA, 15 bp, Homo sapiens
gatctgcattttttt

SEQ ID NO: 11392 - DNA, 15 bp, Homo sapiens
agatctgcatttttt

SEQ ID NO: 11393 - DNA, 15 bp, Homo sapiens
cagatctgcattttt

SEQ ID NO: 11394 - DNA, 15 bp, Homo sapiens
acagatctgcatttt

SEQ ID NO: 11395 - DNA, 15 bp, Homo sapiens
gacagatctgcattt

SEQ ID NO: 11396 - DNA, 15 bp, Homo sapiens
agacagatctgcatt

SEQ ID NO: 11397 - DNA, 15 bp, Homo sapiens
aagacagatctgcat

SEQ ID NO: 11398 - DNA, 15 bp, Homo sapiens
aaagacagatctgca

SEQ ID NO: 11399 - DNA, 15 bp, Homo sapiens
gaaagacagatctgc

SEQ ID NO: 11400 - DNA, 15 bp, Homo sapiens
tgaaagacagatctg

SEQ ID NO: 11401 - DNA, 15 bp, Homo sapiens
atgaaagacagatct

SEQ ID NO: 11402 - DNA, 15 bp, Homo sapiens
tatgaaagacagatc

SEQ ID NO: 11403 - DNA, 15 bp, Homo sapiens
ctatgaaagacagat

SEQ ID NO: 11404 - DNA, 15 bp, Homo sapiens
gctatgaaagacaga

SEQ ID NO: 11405 - DNA, 15 bp, Homo sapiens
tgctatgaaagacag

SEQ ID NO: 11406 - DNA, 15 bp, Homo sapiens
ctgctatgaaagaca

SEQ ID NO: 11407 - DNA, 15 bp, Homo sapiens
actgctatgaaagac

SEQ ID NO: 11408 - DNA, 15 bp, Homo sapiens
cactgctatgaaaga

SEQ ID NO: 11409 - DNA, 15 bp, Homo sapiens
ccactgctatgaaag

SEQ ID NO: 11410 - DNA, 15 bp, Homo sapiens
tccactgctatgaaa

SEQ ID NO: 11411 - DNA, 15 bp, Homo sapiens
ctccactgctatgaa

SEQ ID NO: 11412 - DNA, 15 bp, Homo sapiens
gctccactgctatga

SEQ ID NO: 11413 - DNA, 15 bp, Homo sapiens
agctccactgctatg

SEQ ID NO: 11414 - DNA, 15 bp, Homo sapiens
gagctccactgctat

SEQ ID NO: 11415 - DNA, 15 bp, Homo sapiens
tgagctccactgcta

SEQ ID NO: 11416 - DNA, 15 bp, Homo sapiens
ttgagctccactgct

SEQ ID NO: 11417 - DNA, 15 bp, Homo sapiens
gttgagctccactgc

SEQ ID NO: 11418 - DNA, 15 bp, Homo sapiens
tgttgagctccactg

SEQ ID NO: 11419 - DNA, 15 bp, Homo sapiens
ttgttgagctccact

SEQ ID NO: 11420 - DNA, 15 bp, Homo sapiens
gttgttgagctccac

SEQ ID NO: 11421 - DNA, 15 bp, Homo sapiens
tgttgttgagctcca

SEQ ID NO: 11422 - DNA, 15 bp, Homo sapiens
gtgttgttgagctcc

SEQ ID NO: 11423 - DNA, 15 bp, Homo sapiens
tgtgttgttgagctc

SEQ ID NO: 11424 - DNA, 15 bp, Homo sapiens
atgtgttgttgagct

SEQ ID NO: 11425 - DNA, 15 bp, Homo sapiens
tatgtgttgttgagc

SEQ ID NO: 11426 - DNA, 15 bp, Homo sapiens
ctatgtgttgttgag

SEQ ID NO: 11427 - DNA, 15 bp, Homo sapiens
tctatgtgttgttga

SEQ ID NO: 11428 - DNA, 15 bp, Homo sapiens
ctctatgtgttgttg

SEQ ID NO: 11429 - DNA, 15 bp, Homo sapiens
gctctatgtgttgtt

SEQ ID NO: 11430 - DNA, 15 bp, Homo sapiens
tgctctatgtgttgt

SEQ ID NO: 11431 - DNA, 15 bp, Homo sapiens
atgctctatgtgttg

SEQ ID NO: 11432 - DNA, 15 bp, Homo sapiens
catgctctatgtgtt

SEQ ID NO: 11433 - DNA, 15 bp, Homo sapiens
tcatgctctatgtgt

SEQ ID NO: 11434 - DNA, 15 bp, Homo sapiens
ctcatgctctatgtg

SEQ ID NO: 11435 - DNA, 15 bp, Homo sapiens
tctcatgctctatgt

SEQ ID NO: 11436 - DNA, 15 bp, Homo sapiens
ctctcatgctctatg

SEQ ID NO: 11437 - DNA, 15 bp, Homo sapiens
actctcatgctctat

SEQ ID NO: 11438 - DNA, 15 bp, Homo sapiens
gactctcatgctcta

SEQ ID NO: 11439 - DNA, 15 bp, Homo sapiens
tgactctcatgctct

SEQ ID NO: 11440 - DNA, 15 bp, Homo sapiens
gtgactctcatgctc

SEQ ID NO: 11441 - DNA, 15 bp, Homo sapiens
tgtgactctcatgct

SEQ ID NO: 11442 - DNA, 15 bp, Homo sapiens
atgtgactctcatgc

SEQ ID NO: 11443 - DNA, 15 bp, Homo sapiens
aatgtgactctcatg

SEQ ID NO: 11444 - DNA, 15 bp, Homo sapiens
aaatgtgactctcat

SEQ ID NO: 11445 - DNA, 15 bp, Homo sapiens
aaaatgtgactctca

SEQ ID NO: 11446 - DNA, 15 bp, Homo sapiens
aaaaatgtgactctc

SEQ ID NO: 11447 - DNA, 15 bp, Homo sapiens
aaaaaatgtgactct

SEQ ID NO: 11448 - DNA, 15 bp, Homo sapiens
caaaaaatgtgactc

SEQ ID NO: 11449 - DNA, 15 bp, Homo sapiens
acaaaaaatgtgact

SEQ ID NO: 11450 - DNA, 15 bp, Homo sapiens
cacaaaaaatgtgac

SEQ ID NO: 11451 - DNA, 15 bp, Homo sapiens
acacaaaaaatgtga

SEQ ID NO: 11452 - DNA, 15 bp, Homo sapiens
cacacaaaaaatgtg

SEQ ID NO: 11453 - DNA, 15 bp, Homo sapiens
tcacacaaaaaatgt

SEQ ID NO: 11454 - DNA, 15 bp, Homo sapiens
ttcacacaaaaaatg

SEQ ID NO: 11455 - DNA, 15 bp, Homo sapiens
attcacacaaaaaat

SEQ ID NO: 11456 - DNA, 15 bp, Homo sapiens
tattcacacaaaaaa

SEQ ID NO: 11457 - DNA, 15 bp, Homo sapiens
atattcacacaaaaa

SEQ ID NO: 11458 - DNA, 15 bp, Homo sapiens
aatattcacacaaaa

SEQ ID NO: 11459 - DNA, 15 bp, Homo sapiens
aaatattcacacaaa

SEQ ID NO: 11460 - DNA, 15 bp, Homo sapiens
aaaatattcacacaa

SEQ ID NO: 11461 - DNA, 15 bp, Homo sapiens
gaaaatattcacaca

SEQ ID NO: 11462 - DNA, 15 bp, Homo sapiens
cgaaaatattcacac

SEQ ID NO: 11463 - DNA, 15 bp, Homo sapiens
tcgaaaatattcaca

SEQ ID NO: 11464 - DNA, 15 bp, Homo sapiens
ttcgaaaatattcac

SEQ ID NO: 11465 - DNA, 15 bp, Homo sapiens
attcgaaaatattca

SEQ ID NO: 11466 - DNA, 15 bp, Homo sapiens
cattcgaaaatattc

SEQ ID NO: 11467 - DNA, 15 bp, Homo sapiens
tcattcgaaaatatt

SEQ ID NO: 11468 - DNA, 15 bp, Homo sapiens
ctcattcgaaaatat

SEQ ID NO: 11469 - DNA, 15 bp, Homo sapiens
gctcattcgaaaata

SEQ ID NO: 11470 - DNA, 15 bp, Homo sapiens
ggctcattcgaaaat

SEQ ID NO: 11471 - DNA, 15 bp, Homo sapiens
aggctcattcgaaaa

SEQ ID NO: 11472 - DNA, 15 bp, Homo sapiens
aaggctcattcgaaa

SEQ ID NO: 11473 - DNA, 15 bp, Homo sapiens
aaaggctcattcgaa

SEQ ID NO: 11474 - DNA, 15 bp, Homo sapiens
aaaaggctcattcga

SEQ ID NO: 11475 - DNA, 15 bp, Homo sapiens
aaaaaggctcattcg

SEQ ID NO: 11476 - DNA, 15 bp, Homo sapiens
aaaaaaggctcattc

SEQ ID NO: 11477 - DNA, 15 bp, Homo sapiens
caaaaaaggctcatt

SEQ ID NO: 11478 - DNA, 15 bp, Homo sapiens
ccaaaaaaggctcat

SEQ ID NO: 11479 - DNA, 15 bp, Homo sapiens
accaaaaaaggctca

SEQ ID NO: 11480 - DNA, 15 bp, Homo sapiens
taccaaaaaaggctc

SEQ ID NO: 11481 - DNA, 15 bp, Homo sapiens
ataccaaaaaaggct

SEQ ID NO: 11482 - DNA, 15 bp, Homo sapiens
cataccaaaaaaggc

SEQ ID NO: 11483 - DNA, 15 bp, Homo sapiens
acataccaaaaaagg

SEQ ID NO: 11484 - DNA, 15 bp, Homo sapiens
cacataccaaaaaag

SEQ ID NO: 11485 - DNA, 15 bp, Homo sapiens
ccacataccaaaaaa

SEQ ID NO: 11486 - DNA, 15 bp, Homo sapiens
tccacataccaaaaa

SEQ ID NO: 11487 - DNA, 15 bp, Homo sapiens
gtccacataccaaaa

SEQ ID NO: 11488 - DNA, 15 bp, Homo sapiens
cgtccacataccaaa

SEQ ID NO: 11489 - DNA, 15 bp, Homo sapiens
ccgtccacataccaa

SEQ ID NO: 11490 - DNA, 15 bp, Homo sapiens
cccgtccacatacca

SEQ ID NO: 11491 - DNA, 15 bp, Homo sapiens
acccgtccacatacc

SEQ ID NO: 11492 - DNA, 15 bp, Homo sapiens
cacccgtccacatac

SEQ ID NO: 11493 - DNA, 15 bp, Homo sapiens
ccacccgtccacata

SEQ ID NO: 11494 - DNA, 15 bp, Homo sapiens
gccacccgtccacat

SEQ ID NO: 11495 - DNA, 15 bp, Homo sapiens
agccacccgtccaca

SEQ ID NO: 11496 - DNA, 15 bp, Homo sapiens
tagccacccgtccac

SEQ ID NO: 11497 - DNA, 15 bp, Homo sapiens
ctagccacccgtcca

SEQ ID NO: 11498 - DNA, 15 bp, Homo sapiens
actagccacccgtcc

SEQ ID NO: 11499 - DNA, 15 bp, Homo sapiens
aactagccacccgtc

SEQ ID NO: 11500 - DNA, 15 bp, Homo sapiens
taactagccacccgt

SEQ ID NO: 11501 - DNA, 15 bp, Homo sapiens
gtaactagccacccg

SEQ ID NO: 11502 - DNA, 15 bp, Homo sapiens
tgtaactagccaccc

SEQ ID NO: 11503 - DNA, 15 bp, Homo sapiens
atgtaactagccacc

SEQ ID NO: 11504 - DNA, 15 bp, Homo sapiens
aatgtaactagccac

SEQ ID NO: 11505 - DNA, 15 bp, Homo sapiens
gaatgtaactagcca

SEQ ID NO: 11506 - DNA, 15 bp, Homo sapiens
tgaatgtaactagcc

SEQ ID NO: 11507 - DNA, 15 bp, Homo sapiens
ctgaatgtaactagc

SEQ ID NO: 11508 - DNA, 15 bp, Homo sapiens
actgaatgtaactag

SEQ ID NO: 11509 - DNA, 15 bp, Homo sapiens
aactgaatgtaacta

SEQ ID NO: 11510 - DNA, 15 bp, Homo sapiens
gaactgaatgtaact

SEQ ID NO: 11511 - DNA, 15 bp, Homo sapiens
tgaactgaatgtaac

SEQ ID NO: 11512 - DNA, 15 bp, Homo sapiens
ttgaactgaatgtaa

SEQ ID NO: 11513 - DNA, 15 bp, Homo sapiens
attgaactgaatgta

SEQ ID NO: 11514 - DNA, 15 bp, Homo sapiens
gattgaactgaatgt

SEQ ID NO: 11515 - DNA, 15 bp, Homo sapiens
ggattgaactgaatg

SEQ ID NO: 11516 - DNA, 15 bp, Homo sapiens
aggattgaactgaat

SEQ ID NO: 11517 - DNA, 15 bp, Homo sapiens
aaggattgaactgaa

SEQ ID NO: 11518 - DNA, 15 bp, Homo sapiens
aaaggattgaactga

SEQ ID NO: 11519 - DNA, 15 bp, Homo sapiens
aaaaggattgaactg

SEQ ID NO: 11520 - DNA, 15 bp, Homo sapiens
taaaaggattgaact

SEQ ID NO: 11521 - DNA, 15 bp, Homo sapiens
ttaaaaggattgaac

SEQ ID NO: 11522 - DNA, 15 bp, Homo sapiens
gttaaaaggattgaa

SEQ ID NO: 11523 - DNA, 15 bp, Homo sapiens
tgttaaaaggattga

SEQ ID NO: 11524 - DNA, 15 bp, Homo sapiens
atgttaaaaggattg

SEQ ID NO: 11525 - DNA, 15 bp, Homo sapiens
aatgttaaaaggatt

SEQ ID NO: 11526 - DNA, 15 bp, Homo sapiens
aaatgttaaaaggat

SEQ ID NO: 11527 - DNA, 15 bp, Homo sapiens
taaatgttaaaagga

SEQ ID NO: 11528 - DNA, 15 bp, Homo sapiens
ttaaatgttaaaagg

SEQ ID NO: 11529 - DNA, 15 bp, Homo sapiens
attaaatgttaaaag

SEQ ID NO: 11530 - DNA, 15 bp, Homo sapiens
aattaaatgttaaaa

SEQ ID NO: 11531 - DNA, 15 bp, Homo sapiens
taattaaatgttaaa

SEQ ID NO: 11532 - DNA, 15 bp, Homo sapiens
ataattaaatgttaa

SEQ ID NO: 11533 - DNA, 15 bp, Homo sapiens
cataattaaatgtta

SEQ ID NO: 11534 - DNA, 15 bp, Homo sapiens
ccataattaaatgtt

SEQ ID NO: 11535 - DNA, 15 bp, Homo sapiens
tccataattaaatgt

SEQ ID NO: 11536 - DNA, 15 bp, Homo sapiens
ttccataattaaatg

SEQ ID NO: 11537 - DNA, 15 bp, Homo sapiens
gttccataattaaat

SEQ ID NO: 11538 - DNA, 15 bp, Homo sapiens
tgttccataattaaa

SEQ ID NO: 11539 - DNA, 15 bp, Homo sapiens
ttgttccataattaa

SEQ ID NO: 11540 - DNA, 15 bp, Homo sapiens
tttgttccataatta

SEQ ID NO: 11541 - DNA, 15 bp, Homo sapiens
ttttgttccataatt

SEQ ID NO: 11542 - DNA, 15 bp, Homo sapiens
attttgttccataat

SEQ ID NO: 11543 - DNA, 15 bp, Homo sapiens
gattttgttccataa

SEQ ID NO: 11544 - DNA, 15 bp, Homo sapiens
agattttgttccata

SEQ ID NO: 11545 - DNA, 15 bp, Homo sapiens
aagattttgttccat

SEQ ID NO: 11546 - DNA, 15 bp, Homo sapiens
aaagattttgttcca

SEQ ID NO: 11547 - DNA, 15 bp, Homo sapiens
aaaagattttgttcc

SEQ ID NO: 11548 - DNA, 15 bp, Homo sapiens
aaaaagattttgttc

SEQ ID NO: 11549 - DNA, 15 bp, Homo sapiens
aaaaaagattttgtt

SEQ ID NO: 11550 - DNA, 15 bp, Homo sapiens
gaaaaaagattttgt

SEQ ID NO: 11551 - DNA, 15 bp, Homo sapiens
tgaaaaaagattttg

SEQ ID NO: 11552 - DNA, 15 bp, Homo sapiens
ttgaaaaaagatttt

SEQ ID NO: 11553 - DNA, 15 bp, Homo sapiens
tttgaaaaaagattt

SEQ ID NO: 11554 - DNA, 15 bp, Homo sapiens
ctttgaaaaaagatt

SEQ ID NO: 11555 - DNA, 15 bp, Homo sapiens
actttgaaaaaagat

SEQ ID NO: 11556 - DNA, 15 bp, Homo sapiens
cactttgaaaaaaga

SEQ ID NO: 11557 - DNA, 15 bp, Homo sapiens
acactttgaaaaaag

SEQ ID NO: 11558 - DNA, 15 bp, Homo sapiens
tacactttgaaaaaa

SEQ ID NO: 11559 - DNA, 15 bp, Homo sapiens
ctacactttgaaaaa

SEQ ID NO: 11560 - DNA, 15 bp, Homo sapiens
tctacactttgaaaa

SEQ ID NO: 11561 - DNA, 15 bp, Homo sapiens
ctctacactttgaaa

SEQ ID NO: 11562 - DNA, 15 bp, Homo sapiens
tctctacactttgaa

SEQ ID NO: 11563 - DNA, 15 bp, Homo sapiens
ttctctacactttga

SEQ ID NO: 11564 - DNA, 15 bp, Homo sapiens
tttctctacactttg

SEQ ID NO: 11565 - DNA, 15 bp, Homo sapiens
ttttctctacacttt

SEQ ID NO: 11566 - DNA, 15 bp, Homo sapiens
cttttctctacactt

SEQ ID NO: 11567 - DNA, 15 bp, Homo sapiens
gcttttctctacact

SEQ ID NO: 11568 - DNA, 15 bp, Homo sapiens
tgcttttctctacac

SEQ ID NO: 11569 - DNA, 15 bp, Homo sapiens
atgcttttctctaca

SEQ ID NO: 11570 - DNA, 15 bp, Homo sapiens
tatgcttttctctac

SEQ ID NO: 11571 - DNA, 15 bp, Homo sapiens
atatgcttttctcta

SEQ ID NO: 11572 - DNA, 15 bp, Homo sapiens
tatatgcttttctct

SEQ ID NO: 11573 - DNA, 15 bp, Homo sapiens
ttatatgcttttctc

SEQ ID NO: 11574 - DNA, 15 bp, Homo sapiens
cttatatgcttttct

SEQ ID NO: 11575 - DNA, 15 bp, Homo sapiens
ccttatatgcttttc

SEQ ID NO: 11576 - DNA, 15 bp, Homo sapiens
cccttatatgctttt

SEQ ID NO: 11577 - DNA, 15 bp, Homo sapiens
gcccttatatgcttt

SEQ ID NO: 11578 - DNA, 15 bp, Homo sapiens
tgcccttatatgctt

SEQ ID NO: 11579 - DNA, 15 bp, Homo sapiens
atgcccttatatgct

SEQ ID NO: 11580 - DNA, 15 bp, Homo sapiens
aatgcccttatatgc

SEQ ID NO: 11581 - DNA, 15 bp, Homo sapiens
aaatgcccttatatg

SEQ ID NO: 11582 - DNA, 15 bp, Homo sapiens
gaaatgcccttatat

SEQ ID NO: 11583 - DNA, 15 bp, Homo sapiens
agaaatgcccttata

SEQ ID NO: 11584 - DNA, 15 bp, Homo sapiens
cagaaatgcccttat

SEQ ID NO: 11585 - DNA, 15 bp, Homo sapiens
tcagaaatgccctta

SEQ ID NO: 11586 - DNA, 15 bp, Homo sapiens
atcagaaatgccctt

SEQ ID NO: 11587 - DNA, 15 bp, Homo sapiens
catcagaaatgccct

SEQ ID NO: 11588 - DNA, 15 bp, Homo sapiens
acatcagaaatgccc

SEQ ID NO: 11589 - DNA, 15 bp, Homo sapiens
tacatcagaaatgcc

SEQ ID NO: 11590 - DNA, 15 bp, Homo sapiens
ctacatcagaaatgc

SEQ ID NO: 11591 - DNA, 15 bp, Homo sapiens
gctacatcagaaatg

SEQ ID NO: 11592 - DNA, 15 bp, Homo sapiens
tgctacatcagaaat

SEQ ID NO: 11593 - DNA, 15 bp, Homo sapiens
ctgctacatcagaaa

SEQ ID NO: 11594 - DNA, 15 bp, Homo sapiens
tctgctacatcagaa

SEQ ID NO: 11595 - DNA, 15 bp, Homo sapiens
ctctgctacatcaga

SEQ ID NO: 11596 - DNA, 15 bp, Homo sapiens
cctctgctacatcag

SEQ ID NO: 11597 - DNA, 15 bp, Homo sapiens
tcctctgctacatca

SEQ ID NO: 11598 - DNA, 15 bp, Homo sapiens
ttcctctgctacatc

SEQ ID NO: 11599 - DNA, 15 bp, Homo sapiens
attcctctgctacat

SEQ ID NO: 11600 - DNA, 15 bp, Homo sapiens
gattcctctgctaca

SEQ ID NO: 11601 - DNA, 15 bp, Homo sapiens
ggattcctctgctac

SEQ ID NO: 11602 - DNA, 15 bp, Homo sapiens
tggattcctctgcta

SEQ ID NO: 11603 - DNA, 15 bp, Homo sapiens
ttggattcctctgct

SEQ ID NO: 11604 - DNA, 15 bp, Homo sapiens
attggattcctctgc

SEQ ID NO: 11605 - DNA, 15 bp, Homo sapiens
tattggattcctctg

SEQ ID NO: 11606 - DNA, 15 bp, Homo sapiens
ttattggattcctct

SEQ ID NO: 11607 - DNA, 15 bp, Homo sapiens
tttattggattcctc

SEQ ID NO: 11608 - DNA, 15 bp, Homo sapiens
ttttattggattcct

SEQ ID NO: 11609 - DNA, 15 bp, Homo sapiens
tttttattggattcc

SEQ ID NO: 11610 - DNA, 15 bp, Homo sapiens
ttttttattggattc

SEQ ID NO: 11611 - DNA, 15 bp, Homo sapiens
attttttattggatt

SEQ ID NO: 11612 - DNA, 15 bp, Homo sapiens
tattttttattggat

SEQ ID NO: 11613 - DNA, 15 bp, Homo sapiens
atattttttattgga

SEQ ID NO: 11614 - DNA, 15 bp, Homo sapiens
catattttttattgg

SEQ ID NO: 11615 - DNA, 15 bp, Homo sapiens
tcatattttttattg

SEQ ID NO: 11616 - DNA, 15 bp, Homo sapiens
gtcatattttttatt

SEQ ID NO: 11617 - DNA, 15 bp, Homo sapiens
agtcatattttttat

SEQ ID NO: 11618 - DNA, 15 bp, Homo sapiens
aagtcatatttttta

SEQ ID NO: 11619 - DNA, 15 bp, Homo sapiens
aaagtcatatttttt

SEQ ID NO: 11620 - DNA, 15 bp, Homo sapiens
caaagtcatattttt

SEQ ID NO: 11621 - DNA, 15 bp, Homo sapiens
acaaagtcatatttt

SEQ ID NO: 11622 - DNA, 15 bp, Homo sapiens
cacaaagtcatattt

SEQ ID NO: 11623 - DNA, 15 bp, Homo sapiens
acacaaagtcatatt

SEQ ID NO: 11624 - DNA, 15 bp, Homo sapiens
gacacaaagtcatat

SEQ ID NO: 11625 - DNA, 15 bp, Homo sapiens
agacacaaagtcata

SEQ ID NO: 11626 - DNA, 15 bp, Homo sapiens
gagacacaaagtcat

SEQ ID NO: 11627 - DNA, 15 bp, Homo sapiens
agagacacaaagtca

SEQ ID NO: 11628 - DNA, 15 bp, Homo sapiens
tagagacacaaagtc

SEQ ID NO: 11629 - DNA, 15 bp, Homo sapiens
ttagagacacaaagt

SEQ ID NO: 11630 - DNA, 15 bp, Homo sapiens
tttagagacacaaag

SEQ ID NO: 11631 - DNA, 15 bp, Homo sapiens
ctttagagacacaaa

SEQ ID NO: 11632 - DNA, 15 bp, Homo sapiens
actttagagacacaa

SEQ ID NO: 11633 - DNA, 15 bp, Homo sapiens
cactttagagacaca

SEQ ID NO: 11634 - DNA, 15 bp, Homo sapiens
ccactttagagacac

SEQ ID NO: 11635 - DNA, 15 bp, Homo sapiens
accactttagagaca

SEQ ID NO: 11636 - DNA, 15 bp, Homo sapiens
taccactttagagac

SEQ ID NO: 11637 - DNA, 15 bp, Homo sapiens
gtaccactttagaga

SEQ ID NO: 11638 - DNA, 15 bp, Homo sapiens
tgtaccactttagag

SEQ ID NO: 11639 - DNA, 15 bp, Homo sapiens
ctgtaccactttaga

SEQ ID NO: 11640 - DNA, 15 bp, Homo sapiens
gctgtaccactttag

SEQ ID NO: 11641 - DNA, 15 bp, Homo sapiens
agctgtaccacttta

SEQ ID NO: 11642 - DNA, 15 bp, Homo sapiens
aagctgtaccacttt

SEQ ID NO: 11643 - DNA, 15 bp, Homo sapiens
aaagctgtaccactt

SEQ ID NO: 11644 - DNA, 15 bp, Homo sapiens
caaagctgtaccact

SEQ ID NO: 11645 - DNA, 15 bp, Homo sapiens
tcaaagctgtaccac

SEQ ID NO: 11646 - DNA, 15 bp, Homo sapiens
ttcaaagctgtacca

SEQ ID NO: 11647 - DNA, 15 bp, Homo sapiens
tttcaaagctgtacc

SEQ ID NO: 11648 - DNA, 15 bp, Homo sapiens
atttcaaagctgtac

SEQ ID NO: 11649 - DNA, 15 bp, Homo sapiens
aatttcaaagctgta

SEQ ID NO: 11650 - DNA, 15 bp, Homo sapiens
taatttcaaagctgt

SEQ ID NO: 11651 - DNA, 15 bp, Homo sapiens
ttaatttcaaagctg

SEQ ID NO: 11652 - DNA, 15 bp, Homo sapiens
gttaatttcaaagct

SEQ ID NO: 11653 - DNA, 15 bp, Homo sapiens
tgttaatttcaaagc

SEQ ID NO: 11654 - DNA, 15 bp, Homo sapiens
gtgttaatttcaaag

SEQ ID NO: 11655 - DNA, 15 bp, Homo sapiens
tgtgttaatttcaaa

SEQ ID NO: 11656 - DNA, 15 bp, Homo sapiens
atgtgttaatttcaa

SEQ ID NO: 11657 - DNA, 15 bp, Homo sapiens
gatgtgttaatttca

SEQ ID NO: 11658 - DNA, 15 bp, Homo sapiens
agatgtgttaatttc

SEQ ID NO: 11659 - DNA, 15 bp, Homo sapiens
cagatgtgttaattt

SEQ ID NO: 11660 - DNA, 15 bp, Homo sapiens
acagatgtgttaatt

SEQ ID NO: 11661 - DNA, 15 bp, Homo sapiens
tacagatgtgttaat

SEQ ID NO: 11662 - DNA, 15 bp, Homo sapiens
atacagatgtgttaa

SEQ ID NO: 11663 - DNA, 15 bp, Homo sapiens
tatacagatgtgtta

SEQ ID NO: 11664 - DNA, 15 bp, Homo sapiens
ttatacagatgtgtt

SEQ ID NO: 11665 - DNA, 15 bp, Homo sapiens
attatacagatgtgt

SEQ ID NO: 11666 - DNA, 15 bp, Homo sapiens
aattatacagatgtg

SEQ ID NO: 11667 - DNA, 15 bp, Homo sapiens
aaattatacagatgt

SEQ ID NO: 11668 - DNA, 15 bp, Homo sapiens
gaaattatacagatg

SEQ ID NO: 11669 - DNA, 15 bp, Homo sapiens
tgaaattatacagat

SEQ ID NO: 11670 - DNA, 15 bp, Homo sapiens
ttgaaattatacaga

SEQ ID NO: 11671 - DNA, 15 bp, Homo sapiens
tttgaaattatacag

SEQ ID NO: 11672 - DNA, 15 bp, Homo sapiens
ttttgaaattataca

SEQ ID NO: 11673 - DNA, 15 bp, Homo sapiens
cttttgaaattatac

SEQ ID NO: 11674 - DNA, 15 bp, Homo sapiens
acttttgaaattata

SEQ ID NO: 11675 - DNA, 15 bp, Homo sapiens
tacttttgaaattat

SEQ ID NO: 11676 - DNA, 15 bp, Homo sapiens
atacttttgaaatta

SEQ ID NO: 11677 - DNA, 15 bp, Homo sapiens
catacttttgaaatt

SEQ ID NO: 11678 - DNA, 15 bp, Homo sapiens
tcatacttttgaaat

SEQ ID NO: 11679 - DNA, 15 bp, Homo sapiens
atcatacttttgaaa

SEQ ID NO: 11680 - DNA, 15 bp, Homo sapiens
gatcatacttttgaa

SEQ ID NO: 11681 - DNA, 15 bp, Homo sapiens
agatcatacttttga

SEQ ID NO: 11682 - DNA, 15 bp, Homo sapiens
gagatcatacttttg

SEQ ID NO: 11683 - DNA, 15 bp, Homo sapiens
agagatcatactttt

SEQ ID NO: 11684 - DNA, 15 bp, Homo sapiens
aagagatcatacttt

SEQ ID NO: 11685 - DNA, 15 bp, Homo sapiens
aaagagatcatactt

SEQ ID NO: 11686 - DNA, 15 bp, Homo sapiens
taaagagatcatact

SEQ ID NO: 11687 - DNA, 15 bp, Homo sapiens
ctaaagagatcatac

SEQ ID NO: 11688 - DNA, 15 bp, Homo sapiens
tctaaagagatcata

SEQ ID NO: 11689 - DNA, 15 bp, Homo sapiens
atctaaagagatcat

SEQ ID NO: 11690 - DNA, 15 bp, Homo sapiens
gatctaaagagatca

SEQ ID NO: 11691 - DNA, 15 bp, Homo sapiens
agatctaaagagatc

SEQ ID NO: 11692 - DNA, 15 bp, Homo sapiens
aagatctaaagagat

SEQ ID NO: 11693 - DNA, 15 bp, Homo sapiens
aaagatctaaagaga

SEQ ID NO: 11694 - DNA, 15 bp, Homo sapiens
aaaagatctaaagag

SEQ ID NO: 11695 - DNA, 15 bp, Homo sapiens
aaaaagatctaaaga

SEQ ID NO: 11696 - DNA, 15 bp, Homo sapiens
gaaaaagatctaaag

SEQ ID NO: 11697 - DNA, 15 bp, Homo sapiens
agaaaaagatctaaa

SEQ ID NO: 11698 - DNA, 15 bp, Homo sapiens
aagaaaaagatctaa

SEQ ID NO: 11699 - DNA, 15 bp, Homo sapiens
aaagaaaaagatcta

SEQ ID NO: 11700 - DNA, 15 bp, Homo sapiens
taaagaaaaagatct

SEQ ID NO: 11701 - DNA, 15 bp, Homo sapiens
ttaaagaaaaagatc

SEQ ID NO: 11702 - DNA, 15 bp, Homo sapiens
attaaagaaaaagat

SEQ ID NO: 11703 - DNA, 15 bp, Homo sapiens
aattaaagaaaaaga

SEQ ID NO: 11704 - DNA, 15 bp, Homo sapiens
aaattaaagaaaaag

SEQ ID NO: 11705 - DNA, 15 bp, Homo sapiens
gaaattaaagaaaaa

SEQ ID NO: 11706 - DNA, 15 bp, Homo sapiens
tgaaattaaagaaaa

SEQ ID NO: 11707 - DNA, 15 bp, Homo sapiens
atgaaattaaagaaa

SEQ ID NO: 11708 - DNA, 15 bp, Homo sapiens
tatgaaattaaagaa

SEQ ID NO: 11709 - DNA, 15 bp, Homo sapiens
ctatgaaattaaaga

SEQ ID NO: 11710 - DNA, 15 bp, Homo sapiens
actatgaaattaaag

SEQ ID NO: 11711 - DNA, 15 bp, Homo sapiens
gactatgaaattaaa

SEQ ID NO: 11712 - DNA, 15 bp, Homo sapiens
agactatgaaattaa

SEQ ID NO: 11713 - DNA, 15 bp, Homo sapiens
aagactatgaaatta

SEQ ID NO: 11714 - DNA, 15 bp, Homo sapiens
taagactatgaaatt

SEQ ID NO: 11715 - DNA, 15 bp, Homo sapiens
ttaagactatgaaat

SEQ ID NO: 11716 - DNA, 15 bp, Homo sapiens
attaagactatgaaa

SEQ ID NO: 11717 - DNA, 15 bp, Homo sapiens
aattaagactatgaa

SEQ ID NO: 11718 - DNA, 15 bp, Homo sapiens
aaattaagactatga

SEQ ID NO: 11719 - DNA, 15 bp, Homo sapiens
aaaattaagactatg

SEQ ID NO: 11720 - DNA, 15 bp, Homo sapiens
aaaaattaagactat

SEQ ID NO: 11721 - DNA, 15 bp, Homo sapiens
caaaaattaagacta

SEQ ID NO: 11722 - DNA, 15 bp, Homo sapiens
gcaaaaattaagact

SEQ ID NO: 11723 - DNA, 15 bp, Homo sapiens
tgcaaaaattaagac

SEQ ID NO: 11724 - DNA, 15 bp, Homo sapiens
ttgcaaaaattaaga

SEQ ID NO: 11725 - DNA, 15 bp, Homo sapiens
tttgcaaaaattaag

SEQ ID NO: 11726 - DNA, 15 bp, Homo sapiens
atttgcaaaaattaa

SEQ ID NO: 11727 - DNA, 15 bp, Homo sapiens
aatttgcaaaaatta

SEQ ID NO: 11728 - DNA, 15 bp, Homo sapiens
aaatttgcaaaaatt

SEQ ID NO: 11729 - DNA, 15 bp, Homo sapiens
gaaatttgcaaaaat

SEQ ID NO: 11730 - DNA, 15 bp, Homo sapiens
agaaatttgcaaaaa

SEQ ID NO: 11731 - DNA, 15 bp, Homo sapiens
aagaaatttgcaaaa

SEQ ID NO: 11732 - DNA, 15 bp, Homo sapiens
gaagaaatttgcaaa

SEQ ID NO: 11733 - DNA, 15 bp, Homo sapiens
tgaagaaatttgcaa

SEQ ID NO: 11734 - DNA, 15 bp, Homo sapiens
ttgaagaaatttgca

SEQ ID NO: 11735 - DNA, 15 bp, Homo sapiens
gttgaagaaatttgc

SEQ ID NO: 11736 - DNA, 15 bp, Homo sapiens
agttgaagaaatttg

SEQ ID NO: 11737 - DNA, 15 bp, Homo sapiens
gagttgaagaaattt

SEQ ID NO: 11738 - DNA, 15 bp, Homo sapiens
ggagttgaagaaatt

SEQ ID NO: 11739 - DNA, 15 bp, Homo sapiens
tggagttgaagaaat

SEQ ID NO: 11740 - DNA, 15 bp, Homo sapiens
atggagttgaagaaa

SEQ ID NO: 11741 - DNA, 15 bp, Homo sapiens
aatggagttgaagaa

SEQ ID NO: 11742 - DNA, 15 bp, Homo sapiens
gaatggagttgaaga

SEQ ID NO: 11743 - DNA, 15 bp, Homo sapiens
agaatggagttgaag

SEQ ID NO: 11744 - DNA, 15 bp, Homo sapiens
gagaatggagttgaa

SEQ ID NO: 11745 - DNA, 15 bp, Homo sapiens
agagaatggagttga

SEQ ID NO: 11746 - DNA, 15 bp, Homo sapiens
tagagaatggagttg

SEQ ID NO: 11747 - DNA, 15 bp, Homo sapiens
ttagagaatggagtt

SEQ ID NO: 11748 - DNA, 15 bp, Homo sapiens
attagagaatggagt

SEQ ID NO: 11749 - DNA, 15 bp, Homo sapiens
aattagagaatggag

SEQ ID NO: 11750 - DNA, 15 bp, Homo sapiens
taattagagaatgga

SEQ ID NO: 11751 - DNA, 15 bp, Homo sapiens
ttaattagagaatgg

SEQ ID NO: 11752 - DNA, 15 bp, Homo sapiens
cttaattagagaatg

SEQ ID NO: 11753 - DNA, 15 bp, Homo sapiens
tcttaattagagaat

SEQ ID NO: 11754 - DNA, 15 bp, Homo sapiens
atcttaattagagaa

SEQ ID NO: 11755 - DNA, 15 bp, Homo sapiens
aatcttaattagaga

SEQ ID NO: 11756 - DNA, 15 bp, Homo sapiens
aaatcttaattagag

SEQ ID NO: 11757 - DNA, 15 bp, Homo sapiens
aaaatcttaattaga

SEQ ID NO: 11758 - DNA, 15 bp, Homo sapiens
caaaatcttaattag

SEQ ID NO: 11759 - DNA, 15 bp, Homo sapiens
ccaaaatcttaatta

SEQ ID NO: 11760 - DNA, 15 bp, Homo sapiens
accaaaatcttaatt

SEQ ID NO: 11761 - DNA, 15 bp, Homo sapiens
taccaaaatcttaat

SEQ ID NO: 11762 - DNA, 15 bp, Homo sapiens
ataccaaaatcttaa

SEQ ID NO: 11763 - DNA, 15 bp, Homo sapiens
tataccaaaatctta

SEQ ID NO: 11764 - DNA, 15 bp, Homo sapiens
gtataccaaaatctt

SEQ ID NO: 11765 - DNA, 15 bp, Homo sapiens
tgtataccaaaatct

SEQ ID NO: 11766 - DNA, 15 bp, Homo sapiens
ttgtataccaaaatc

SEQ ID NO: 11767 - DNA, 15 bp, Homo sapiens
attgtataccaaaat

SEQ ID NO: 11768 - DNA, 15 bp, Homo sapiens
tattgtataccaaaa

SEQ ID NO: 11769 - DNA, 15 bp, Homo sapiens
atattgtataccaaa

SEQ ID NO: 11770 - DNA, 15 bp, Homo sapiens
aatattgtataccaa

SEQ ID NO: 11771 - DNA, 15 bp, Homo sapiens
aaatattgtatacca

SEQ ID NO: 11772 - DNA, 15 bp, Homo sapiens
taaatattgtatacc

SEQ ID NO: 11773 - DNA, 15 bp, Homo sapiens
ataaatattgtatac

SEQ ID NO: 11774 - DNA, 15 bp, Homo sapiens
tataaatattgtata

SEQ ID NO: 11775 - DNA, 15 bp, Homo sapiens
atataaatattgtat

SEQ ID NO: 11776 - DNA, 15 bp, Homo sapiens
catataaatattgta

SEQ ID NO: 11777 - DNA, 15 bp, Homo sapiens
gcatataaatattgt

SEQ ID NO: 11778 - DNA, 15 bp, Homo sapiens
tgcatataaatattg

SEQ ID NO: 11779 - DNA, 15 bp, Homo sapiens
ttgcatataaatatt

SEQ ID NO: 11780 - DNA, 15 bp, Homo sapiens
tttgcatataaatat

SEQ ID NO: 11781 - DNA, 15 bp, Homo sapiens
ttttgcatataaata

SEQ ID NO: 11782 - DNA, 15 bp, Homo sapiens
cttttgcatataaat

SEQ ID NO: 11783 - DNA, 15 bp, Homo sapiens
tcttttgcatataaa

SEQ ID NO: 11784 - DNA, 15 bp, Homo sapiens
atcttttgcatataa

SEQ ID NO: 11785 - DNA, 15 bp, Homo sapiens
aatcttttgcatata

SEQ ID NO: 11786 - DNA, 15 bp, Homo sapiens
aaatcttttgcatat

SEQ ID NO: 11787 - DNA, 15 bp, Homo sapiens
aaaatcttttgcata

SEQ ID NO: 11788 - DNA, 15 bp, Homo sapiens
aaaaatcttttgcat

SEQ ID NO: 11789 - DNA, 15 bp, Homo sapiens
caaaaatcttttgca

SEQ ID NO: 11790 - DNA, 15 bp, Homo sapiens
ccaaaaatcttttgc

SEQ ID NO: 11791 - DNA, 15 bp, Homo sapiens
accaaaaatcttttg

SEQ ID NO: 11792 - DNA, 15 bp, Homo sapiens
caccaaaaatctttt

SEQ ID NO: 11793 - DNA, 15 bp, Homo sapiens
gcaccaaaaatcttt

SEQ ID NO: 11794 - DNA, 15 bp, Homo sapiens
tgcaccaaaaatctt

SEQ ID NO: 11795 - DNA, 15 bp, Homo sapiens
ctgcaccaaaaatct

SEQ ID NO: 11796 - DNA, 15 bp, Homo sapiens
cctgcaccaaaaatc

SEQ ID NO: 11797 - DNA, 15 bp, Homo sapiens
tcctgcaccaaaaat

SEQ ID NO: 11798 - DNA, 15 bp, Homo sapiens
ttcctgcaccaaaaa

SEQ ID NO: 11799 - DNA, 15 bp, Homo sapiens
tttcctgcaccaaaa

SEQ ID NO: 11800 - DNA, 15 bp, Homo sapiens
atttcctgcaccaaa

SEQ ID NO: 11801 - DNA, 15 bp, Homo sapiens
tatttcctgcaccaa

SEQ ID NO: 11802 - DNA, 15 bp, Homo sapiens
ttatttcctgcacca

SEQ ID NO: 11803 - DNA, 15 bp, Homo sapiens
gttatttcctgcacc

SEQ ID NO: 11804 - DNA, 15 bp, Homo sapiens
tgttatttcctgcac

SEQ ID NO: 11805 - DNA, 15 bp, Homo sapiens
atgttatttcctgca

SEQ ID NO: 11806 - DNA, 15 bp, Homo sapiens
aatgttatttcctgc

SEQ ID NO: 11807 - DNA, 15 bp, Homo sapiens
aaatgttatttcctg

SEQ ID NO: 11808 - DNA, 15 bp, Homo sapiens
aaaatgttatttcct

SEQ ID NO: 11809 - DNA, 15 bp, Homo sapiens
caaaatgttatttcc

SEQ ID NO: 11810 - DNA, 15 bp, Homo sapiens
tcaaaatgttatttc

SEQ ID NO: 11811 - DNA, 15 bp, Homo sapiens
ctcaaaatgttattt

SEQ ID NO: 11812 - DNA, 15 bp, Homo sapiens
cctcaaaatgttatt

SEQ ID NO: 11813 - DNA, 15 bp, Homo sapiens
acctcaaaatgttat

SEQ ID NO: 11814 - DNA, 15 bp, Homo sapiens
aacctcaaaatgtta

SEQ ID NO: 11815 - DNA, 15 bp, Homo sapiens
caacctcaaaatgtt

SEQ ID NO: 11816 - DNA, 15 bp, Homo sapiens
tcaacctcaaaatgt

SEQ ID NO: 11817 - DNA, 15 bp, Homo sapiens
atcaacctcaaaatg

SEQ ID NO: 11818 - DNA, 15 bp, Homo sapiens
tatcaacctcaaaat

SEQ ID NO: 11819 - DNA, 15 bp, Homo sapiens
gtatcaacctcaaaa

SEQ ID NO: 11820 - DNA, 15 bp, Homo sapiens
agtatcaacctcaaa

SEQ ID NO: 11821 - DNA, 15 bp, Homo sapiens
tagtatcaacctcaa

SEQ ID NO: 11822 - DNA, 15 bp, Homo sapiens
ttagtatcaacctca

SEQ ID NO: 11823 - DNA, 15 bp, Homo sapiens
attagtatcaacctc

SEQ ID NO: 11824 - DNA, 15 bp, Homo sapiens
aattagtatcaacct

SEQ ID NO: 11825 - DNA, 15 bp, Homo sapiens
caattagtatcaacc

SEQ ID NO: 11826 - DNA, 15 bp, Homo sapiens
tcaattagtatcaac

SEQ ID NO: 11827 - DNA, 15 bp, Homo sapiens
atcaattagtatcaa

SEQ ID NO: 11828 - DNA, 15 bp, Homo sapiens
aatcaattagtatca

SEQ ID NO: 11829 - DNA, 15 bp, Homo sapiens
aaatcaattagtatc

SEQ ID NO: 11830 - DNA, 15 bp, Homo sapiens
caaatcaattagtat

SEQ ID NO: 11831 - DNA, 15 bp, Homo sapiens
acaaatcaattagta

SEQ ID NO: 11832 - DNA, 15 bp, Homo sapiens
aacaaatcaattagt

SEQ ID NO: 11833 - DNA, 15 bp, Homo sapiens
gaacaaatcaattag

SEQ ID NO: 11834 - DNA, 15 bp, Homo sapiens
tgaacaaatcaatta

SEQ ID NO: 11835 - DNA, 15 bp, Homo sapiens
gtgaacaaatcaatt

SEQ ID NO: 11836 - DNA, 15 bp, Homo sapiens
agtgaacaaatcaat

SEQ ID NO: 11837 - DNA, 15 bp, Homo sapiens
aagtgaacaaatcaa

SEQ ID NO: 11838 - DNA, 15 bp, Homo sapiens
caagtgaacaaatca

SEQ ID NO: 11839 - DNA, 15 bp, Homo sapiens
gcaagtgaacaaatc

SEQ ID NO: 11840 - DNA, 15 bp, Homo sapiens
ggcaagtgaacaaat

SEQ ID NO: 11841 - DNA, 15 bp, Homo sapiens
gggcaagtgaacaaa

SEQ ID NO: 11842 - DNA, 15 bp, Homo sapiens
ggggcaagtgaacaa

SEQ ID NO: 11843 - DNA, 15 bp, Homo sapiens
aggggcaagtgaaca

SEQ ID NO: 11844 - DNA, 15 bp, Homo sapiens
gaggggcaagtgaac

SEQ ID NO: 11845 - DNA, 15 bp, Homo sapiens
tgaggggcaagtgaa

SEQ ID NO: 11846 - DNA, 15 bp, Homo sapiens
ttgaggggcaagtga

SEQ ID NO: 11847 - DNA, 15 bp, Homo sapiens
tttgaggggcaagtg

SEQ ID NO: 11848 - DNA, 15 bp, Homo sapiens
ctttgaggggcaagt

SEQ ID NO: 11849 - DNA, 15 bp, Homo sapiens
cctttgaggggcaag

SEQ ID NO: 11850 - DNA, 15 bp, Homo sapiens
gcctttgaggggcaa

SEQ ID NO: 11851 - DNA, 15 bp, Homo sapiens
agcctttgaggggca

SEQ ID NO: 11852 - DNA, 15 bp, Homo sapiens
tagcctttgaggggc

SEQ ID NO: 11853 - DNA, 15 bp, Homo sapiens
gtagcctttgagggg

SEQ ID NO: 11854 - DNA, 15 bp, Homo sapiens
cgtagcctttgaggg

SEQ ID NO: 11855 - DNA, 15 bp, Homo sapiens
acgtagcctttgagg

SEQ ID NO: 11856 - DNA, 15 bp, Homo sapiens
cacgtagcctttgag

SEQ ID NO: 11857 - DNA, 15 bp, Homo sapiens
acacgtagcctttga

SEQ ID NO: 11858 - DNA, 15 bp, Homo sapiens
cacacgtagcctttg

SEQ ID NO: 11859 - DNA, 15 bp, Homo sapiens
tcacacgtagccttt

SEQ ID NO: 11860 - DNA, 15 bp, Homo sapiens
ctcacacgtagcctt

SEQ ID NO: 11861 - DNA, 15 bp, Homo sapiens
actcacacgtagcct

SEQ ID NO: 11862 - DNA, 15 bp, Homo sapiens
gactcacacgtagcc

SEQ ID NO: 11863 - DNA, 15 bp, Homo sapiens
tgactcacacgtagc

SEQ ID NO: 11864 - DNA, 15 bp, Homo sapiens
atgactcacacgtag

SEQ ID NO: 11865 - DNA, 15 bp, Homo sapiens
catgactcacacgta

SEQ ID NO: 11866 - DNA, 15 bp, Homo sapiens
acatgactcacacgt

SEQ ID NO: 11867 - DNA, 15 bp, Homo sapiens
aacatgactcacacg

SEQ ID NO: 11868 - DNA, 15 bp, Homo sapiens
taacatgactcacac

SEQ ID NO: 11869 - DNA, 15 bp, Homo sapiens
ataacatgactcaca

SEQ ID NO: 11870 - DNA, 15 bp, Homo sapiens
aataacatgactcac

SEQ ID NO: 11871 - DNA, 15 bp, Homo sapiens
aaataacatgactca

SEQ ID NO: 11872 - DNA, 15 bp, Homo sapiens
taaataacatgactc

SEQ ID NO: 11873 - DNA, 15 bp, Homo sapiens
ttaaataacatgact

SEQ ID NO: 11874 - DNA, 15 bp, Homo sapiens
gttaaataacatgac

SEQ ID NO: 11875 - DNA, 15 bp, Homo sapiens
tgttaaataacatga

SEQ ID NO: 11876 - DNA, 15 bp, Homo sapiens
atgttaaataacatg

SEQ ID NO: 11877 - DNA, 15 bp, Homo sapiens
aatgttaaataacat

SEQ ID NO: 11878 - DNA, 15 bp, Homo sapiens
caatgttaaataaca

SEQ ID NO: 11879 - DNA, 15 bp, Homo sapiens
tcaatgttaaataac

SEQ ID NO: 11880 - DNA, 15 bp, Homo sapiens
atcaatgttaaataa

SEQ ID NO: 11881 - DNA, 15 bp, Homo sapiens
gatcaatgttaaata

SEQ ID NO: 11882 - DNA, 15 bp, Homo sapiens
ggatcaatgttaaat

SEQ ID NO: 11883 - DNA, 15 bp, Homo sapiens
tggatcaatgttaaa

SEQ ID NO: 11884 - DNA, 15 bp, Homo sapiens
ctggatcaatgttaa

SEQ ID NO: 11885 - DNA, 15 bp, Homo sapiens
actggatcaatgtta

SEQ ID NO: 11886 - DNA, 15 bp, Homo sapiens
gactggatcaatgtt

SEQ ID NO: 11887 - DNA, 15 bp, Homo sapiens
tgactggatcaatgt

SEQ ID NO: 11888 - DNA, 15 bp, Homo sapiens
ttgactggatcaatg

SEQ ID NO: 11889 - DNA, 15 bp, Homo sapiens
attgactggatcaat

SEQ ID NO: 11890 - DNA, 15 bp, Homo sapiens
tattgactggatcaa

SEQ ID NO: 11891 - DNA, 15 bp, Homo sapiens
atattgactggatca

SEQ ID NO: 11892 - DNA, 15 bp, Homo sapiens
catattgactggatc

SEQ ID NO: 11893 - DNA, 15 bp, Homo sapiens
acatattgactggat

SEQ ID NO: 11894 - DNA, 15 bp, Homo sapiens
tacatattgactgga

SEQ ID NO: 11895 - DNA, 15 bp, Homo sapiens
ctacatattgactgg

SEQ ID NO: 11896 - DNA, 15 bp, Homo sapiens
tctacatattgactg

SEQ ID NO: 11897 - DNA, 15 bp, Homo sapiens
atctacatattgact

SEQ ID NO: 11898 - DNA, 15 bp, Homo sapiens
aatctacatattgac

SEQ ID NO: 11899 - DNA, 15 bp, Homo sapiens
aaatctacatattga

SEQ ID NO: 11900 - DNA, 15 bp, Homo sapiens
taaatctacatattg

SEQ ID NO: 11901 - DNA, 15 bp, Homo sapiens
ataaatctacatatt

SEQ ID NO: 11902 - DNA, 15 bp, Homo sapiens
cataaatctacatat

SEQ ID NO: 11903 - DNA, 15 bp, Homo sapiens
gcataaatctacata

SEQ ID NO: 11904 - DNA, 15 bp, Homo sapiens
tgcataaatctacat

SEQ ID NO: 11905 - DNA, 15 bp, Homo sapiens
gtgcataaatctaca

SEQ ID NO: 11906 - DNA, 15 bp, Homo sapiens
tgtgcataaatctac

SEQ ID NO: 11907 - DNA, 15 bp, Homo sapiens
atgtgcataaatcta

SEQ ID NO: 11908 - DNA, 15 bp, Homo sapiens
catgtgcataaatct

SEQ ID NO: 11909 - DNA, 15 bp, Homo sapiens
gcatgtgcataaatc

SEQ ID NO: 11910 - DNA, 15 bp, Homo sapiens
agcatgtgcataaat

SEQ ID NO: 11911 - DNA, 15 bp, Homo sapiens
aagcatgtgcataaa

SEQ ID NO: 11912 - DNA, 15 bp, Homo sapiens
aaagcatgtgcataa

SEQ ID NO: 11913 - DNA, 15 bp, Homo sapiens
aaaagcatgtgcata

SEQ ID NO: 11914 - DNA, 15 bp, Homo sapiens
taaaagcatgtgcat

SEQ ID NO: 11915 - DNA, 15 bp, Homo sapiens
ataaaagcatgtgca

SEQ ID NO: 11916 - DNA, 15 bp, Homo sapiens
aataaaagcatgtgc

SEQ ID NO: 11917 - DNA, 15 bp, Homo sapiens
aaataaaagcatgtg

SEQ ID NO: 11918 - DNA, 15 bp, Homo sapiens
aaaataaaagcatgt

SEQ ID NO: 11919 - DNA, 15 bp, Homo sapiens
caaaataaaagcatg

SEQ ID NO: 11920 - DNA, 15 bp, Homo sapiens
tcaaaataaaagcat

SEQ ID NO: 11921 - DNA, 15 bp, Homo sapiens
ttcaaaataaaagca

SEQ ID NO: 11922 - DNA, 15 bp, Homo sapiens
tttcaaaataaaagc

SEQ ID NO: 11923 - DNA, 15 bp, Homo sapiens
ttttcaaaataaaag

SEQ ID NO: 11924 - DNA, 15 bp, Homo sapiens
gttttcaaaataaaa

SEQ ID NO: 11925 - DNA, 15 bp, Homo sapiens
agttttcaaaataaa

SEQ ID NO: 11926 - DNA, 15 bp, Homo sapiens
tagttttcaaaataa

SEQ ID NO: 11927 - DNA, 15 bp, Homo sapiens
ctagttttcaaaata

SEQ ID NO: 11928 - DNA, 15 bp, Homo sapiens
cctagttttcaaaat

SEQ ID NO: 11929 - DNA, 15 bp, Homo sapiens
acctagttttcaaaa

SEQ ID NO: 11930 - DNA, 15 bp, Homo sapiens
aacctagttttcaaa

SEQ ID NO: 11931 - DNA, 15 bp, Homo sapiens
aaacctagttttcaa

SEQ ID NO: 11932 - DNA, 15 bp, Homo sapiens
aaaacctagttttca

SEQ ID NO: 11933 - DNA, 15 bp, Homo sapiens
caaaacctagttttc

SEQ ID NO: 11934 - DNA, 15 bp, Homo sapiens
tcaaaacctagtttt

SEQ ID NO: 11935 - DNA, 15 bp, Homo sapiens
ctcaaaacctagttt

SEQ ID NO: 11936 - DNA, 15 bp, Homo sapiens
gctcaaaacctagtt

SEQ ID NO: 11937 - DNA, 15 bp, Homo sapiens
agctcaaaacctagt

SEQ ID NO: 11938 - DNA, 15 bp, Homo sapiens
aagctcaaaacctag

SEQ ID NO: 11939 - DNA, 15 bp, Homo sapiens
gaagctcaaaaccta

SEQ ID NO: 11940 - DNA, 15 bp, Homo sapiens
agaagctcaaaacct

SEQ ID NO: 11941 - DNA, 15 bp, Homo sapiens
gagaagctcaaaacc

SEQ ID NO: 11942 - DNA, 15 bp, Homo sapiens
tgagaagctcaaaac

SEQ ID NO: 11943 - DNA, 15 bp, Homo sapiens
gtgagaagctcaaaa

SEQ ID NO: 11944 - DNA, 15 bp, Homo sapiens
tgtgagaagctcaaa

SEQ ID NO: 11945 - DNA, 15 bp, Homo sapiens
atgtgagaagctcaa

SEQ ID NO: 11946 - DNA, 15 bp, Homo sapiens
tatgtgagaagctca

SEQ ID NO: 11947 - DNA, 15 bp, Homo sapiens
atatgtgagaagctc

SEQ ID NO: 11948 - DNA, 15 bp, Homo sapiens
catatgtgagaagct

SEQ ID NO: 11949 - DNA, 15 bp, Homo sapiens
ccatatgtgagaagc

SEQ ID NO: 11950 - DNA, 15 bp, Homo sapiens
tccatatgtgagaag

SEQ ID NO: 11951 - DNA, 15 bp, Homo sapiens
ctccatatgtgagaa

SEQ ID NO: 11952 - DNA, 15 bp, Homo sapiens
actccatatgtgaga

SEQ ID NO: 11953 - DNA, 15 bp, Homo sapiens
aactccatatgtgag

SEQ ID NO: 11954 - DNA, 15 bp, Homo sapiens
gaactccatatgtga

SEQ ID NO: 11955 - DNA, 15 bp, Homo sapiens
ggaactccatatgtg

SEQ ID NO: 11956 - DNA, 15 bp, Homo sapiens
aggaactccatatgt

SEQ ID NO: 11957 - DNA, 15 bp, Homo sapiens
taggaactccatatg

SEQ ID NO: 11958 - DNA, 15 bp, Homo sapiens
ttaggaactccatat

SEQ ID NO: 11959 - DNA, 15 bp, Homo sapiens
attaggaactccata

SEQ ID NO: 11960 - DNA, 15 bp, Homo sapiens
aattaggaactccat

SEQ ID NO: 11961 - DNA, 15 bp, Homo sapiens
gaattaggaactcca

SEQ ID NO: 11962 - DNA, 15 bp, Homo sapiens
tgaattaggaactcc

SEQ ID NO: 11963 - DNA, 15 bp, Homo sapiens
ttgaattaggaactc

SEQ ID NO: 11964 - DNA, 15 bp, Homo sapiens
cttgaattaggaact

SEQ ID NO: 11965 - DNA, 15 bp, Homo sapiens
gcttgaattaggaac

SEQ ID NO: 11966 - DNA, 15 bp, Homo sapiens
agcttgaattaggaa

SEQ ID NO: 11967 - DNA, 15 bp, Homo sapiens
aagcttgaattagga

SEQ ID NO: 11968 - DNA, 15 bp, Homo sapiens
aaagcttgaattagg

SEQ ID NO: 11969 - DNA, 15 bp, Homo sapiens
taaagcttgaattag

SEQ ID NO: 11970 - DNA, 15 bp, Homo sapiens
ataaagcttgaatta

SEQ ID NO: 11971 - DNA, 15 bp, Homo sapiens
cataaagcttgaatt

SEQ ID NO: 11972 - DNA, 15 bp, Homo sapiens
acataaagcttgaat

SEQ ID NO: 11973 - DNA, 15 bp, Homo sapiens
gacataaagcttgaa

SEQ ID NO: 11974 - DNA, 15 bp, Homo sapiens
tgacataaagcttga

SEQ ID NO: 11975 - DNA, 15 bp, Homo sapiens
ctgacataaagcttg

SEQ ID NO: 11976 - DNA, 15 bp, Homo sapiens
tctgacataaagctt

SEQ ID NO: 11977 - DNA, 15 bp, Homo sapiens
ttctgacataaagct

SEQ ID NO: 11978 - DNA, 15 bp, Homo sapiens
gttctgacataaagc

SEQ ID NO: 11979 - DNA, 15 bp, Homo sapiens
ggttctgacataaag

SEQ ID NO: 11980 - DNA, 15 bp, Homo sapiens
tggttctgacataaa

SEQ ID NO: 11981 - DNA, 15 bp, Homo sapiens
gtggttctgacataa

SEQ ID NO: 11982 - DNA, 15 bp, Homo sapiens
ggtggttctgacata

SEQ ID NO: 11983 - DNA, 15 bp, Homo sapiens
gggtggttctgacat

SEQ ID NO: 11984 - DNA, 15 bp, Homo sapiens
agggtggttctgaca

SEQ ID NO: 11985 - DNA, 15 bp, Homo sapiens
aagggtggttctgac

SEQ ID NO: 11986 - DNA, 15 bp, Homo sapiens
gaagggtggttctga

SEQ ID NO: 11987 - DNA, 15 bp, Homo sapiens
agaagggtggttctg

SEQ ID NO: 11988 - DNA, 15 bp, Homo sapiens
cagaagggtggttct

SEQ ID NO: 11989 - DNA, 15 bp, Homo sapiens
ccagaagggtggttc

SEQ ID NO: 11990 - DNA, 15 bp, Homo sapiens
cccagaagggtggtt

SEQ ID NO: 11991 - DNA, 15 bp, Homo sapiens
acccagaagggtggt

SEQ ID NO: 11992 - DNA, 15 bp, Homo sapiens
gacccagaagggtgg

SEQ ID NO: 11993 - DNA, 15 bp, Homo sapiens
ggacccagaagggtg

SEQ ID NO: 11994 - DNA, 15 bp, Homo sapiens
tggacccagaagggt

SEQ ID NO: 11995 - DNA, 15 bp, Homo sapiens
ctggacccagaaggg

SEQ ID NO: 11996 - DNA, 15 bp, Homo sapiens
tctggacccagaagg

SEQ ID NO: 11997 - DNA, 15 bp, Homo sapiens
gtctggacccagaag

SEQ ID NO: 11998 - DNA, 15 bp, Homo sapiens
agtctggacccagaa

SEQ ID NO: 11999 - DNA, 15 bp, Homo sapiens
gagtctggacccaga

SEQ ID NO: 12000 - DNA, 15 bp, Homo sapiens
tgagtctggacccag

SEQ ID NO: 12001 - DNA, 15 bp, Homo sapiens
ctgagtctggaccca

SEQ ID NO: 12002 - DNA, 15 bp, Homo sapiens
tctgagtctggaccc

SEQ ID NO: 12003 - DNA, 15 bp, Homo sapiens
atctgagtctggacc

SEQ ID NO: 12004 - DNA, 15 bp, Homo sapiens
tatctgagtctggac

SEQ ID NO: 12005 - DNA, 15 bp, Homo sapiens
atatctgagtctgga

SEQ ID NO: 12006 - DNA, 15 bp, Homo sapiens
catatctgagtctgg

SEQ ID NO: 12007 - DNA, 15 bp, Homo sapiens
acatatctgagtctg

SEQ ID NO: 12008 - DNA, 15 bp, Homo sapiens
cacatatctgagtct

SEQ ID NO: 12009 - DNA, 15 bp, Homo sapiens
ccacatatctgagtc

SEQ ID NO: 12010 - DNA, 15 bp, Homo sapiens
cccacatatctgagt

SEQ ID NO: 12011 - DNA, 15 bp, Homo sapiens
ccccacatatctgag

SEQ ID NO: 12012 - DNA, 15 bp, Homo sapiens
accccacatatctga

SEQ ID NO: 12013 - DNA, 15 bp, Homo sapiens
caccccacatatctg

SEQ ID NO: 12014 - DNA, 15 bp, Homo sapiens
ccaccccacatatct

SEQ ID NO: 12015 - DNA, 15 bp, Homo sapiens
cccaccccacatatc

SEQ ID NO: 12016 - DNA, 15 bp, Homo sapiens
ccccaccccacatat

SEQ ID NO: 12017 - DNA, 15 bp, Homo sapiens
accccaccccacata

SEQ ID NO: 12018 - DNA, 15 bp, Homo sapiens
gaccccaccccacat

SEQ ID NO: 12019 - DNA, 15 bp, Homo sapiens
ggaccccaccccaca

SEQ ID NO: 12020 - DNA, 15 bp, Homo sapiens
gggaccccaccccac

SEQ ID NO: 12021 - DNA, 15 bp, Homo sapiens
tgggaccccacccca

SEQ ID NO: 12022 - DNA, 15 bp, Homo sapiens
ctgggaccccacccc

SEQ ID NO: 12023 - DNA, 15 bp, Homo sapiens
gctgggaccccaccc

SEQ ID NO: 12024 - DNA, 15 bp, Homo sapiens
tgctgggaccccacc

SEQ ID NO: 12025 - DNA, 15 bp, Homo sapiens
atgctgggaccccac

SEQ ID NO: 12026 - DNA, 15 bp, Homo sapiens
gatgctgggacccca

SEQ ID NO: 12027 - DNA, 15 bp, Homo sapiens
agatgctgggacccc

SEQ ID NO: 12028 - DNA, 15 bp, Homo sapiens
cagatgctgggaccc

SEQ ID NO: 12029 - DNA, 15 bp, Homo sapiens
ccagatgctgggacc

SEQ ID NO: 12030 - DNA, 15 bp, Homo sapiens
tccagatgctgggac

SEQ ID NO: 12031 - DNA, 15 bp, Homo sapiens
ctccagatgctggga

SEQ ID NO: 12032 - DNA, 15 bp, Homo sapiens
actccagatgctggg

SEQ ID NO: 12033 - DNA, 15 bp, Homo sapiens
aactccagatgctgg

SEQ ID NO: 12034 - DNA, 15 bp, Homo sapiens
aaactccagatgctg

SEQ ID NO: 12035 - DNA, 15 bp, Homo sapiens
aaaactccagatgct

SEQ ID NO: 12036 - DNA, 15 bp, Homo sapiens
taaaactccagatgc

SEQ ID NO: 12037 - DNA, 15 bp, Homo sapiens
ttaaaactccagatg

SEQ ID NO: 12038 - DNA, 15 bp, Homo sapiens
gttaaaactccagat

SEQ ID NO: 12039 - DNA, 15 bp, Homo sapiens
tgttaaaactccaga

SEQ ID NO: 12040 - DNA, 15 bp, Homo sapiens
ttgttaaaactccag

SEQ ID NO: 12041 - DNA, 15 bp, Homo sapiens
cttgttaaaactcca

SEQ ID NO: 12042 - DNA, 15 bp, Homo sapiens
acttgttaaaactcc

SEQ ID NO: 12043 - DNA, 15 bp, Homo sapiens
aacttgttaaaactc

SEQ ID NO: 12044 - DNA, 15 bp, Homo sapiens
gaacttgttaaaact

SEQ ID NO: 12045 - DNA, 15 bp, Homo sapiens
agaacttgttaaaac

SEQ ID NO: 12046 - DNA, 15 bp, Homo sapiens
cagaacttgttaaaa

SEQ ID NO: 12047 - DNA, 15 bp, Homo sapiens
acagaacttgttaaa

SEQ ID NO: 12048 - DNA, 15 bp, Homo sapiens
cacagaacttgttaa

SEQ ID NO: 12049 - DNA, 15 bp, Homo sapiens
ccacagaacttgtta

SEQ ID NO: 12050 - DNA, 15 bp, Homo sapiens
cccacagaacttgtt

SEQ ID NO: 12051 - DNA, 15 bp, Homo sapiens
gcccacagaacttgt

SEQ ID NO: 12052 - DNA, 15 bp, Homo sapiens
agcccacagaacttg

SEQ ID NO: 12053 - DNA, 15 bp, Homo sapiens
tagcccacagaactt

SEQ ID NO: 12054 - DNA, 15 bp, Homo sapiens
atagcccacagaact

SEQ ID NO: 12055 - DNA, 15 bp, Homo sapiens
aatagcccacagaac

SEQ ID NO: 12056 - DNA, 15 bp, Homo sapiens
gaatagcccacagaa

SEQ ID NO: 12057 - DNA, 15 bp, Homo sapiens
agaatagcccacaga

SEQ ID NO: 12058 - DNA, 15 bp, Homo sapiens
gagaatagcccacag

SEQ ID NO: 12059 - DNA, 15 bp, Homo sapiens
agagaatagcccaca

SEQ ID NO: 12060 - DNA, 15 bp, Homo sapiens
aagagaatagcccac

SEQ ID NO: 12061 - DNA, 15 bp, Homo sapiens
aaagagaatagccca

SEQ ID NO: 12062 - DNA, 15 bp, Homo sapiens
taaagagaatagccc

SEQ ID NO: 12063 - DNA, 15 bp, Homo sapiens
ctaaagagaatagcc

SEQ ID NO: 12064 - DNA, 15 bp, Homo sapiens
actaaagagaatagc

SEQ ID NO: 12065 - DNA, 15 bp, Homo sapiens
cactaaagagaatag

SEQ ID NO: 12066 - DNA, 15 bp, Homo sapiens
gcactaaagagaata

SEQ ID NO: 12067 - DNA, 15 bp, Homo sapiens
agcactaaagagaat

SEQ ID NO: 12068 - DNA, 15 bp, Homo sapiens
gagcactaaagagaa

SEQ ID NO: 12069 - DNA, 15 bp, Homo sapiens
agagcactaaagaga

SEQ ID NO: 12070 - DNA, 15 bp, Homo sapiens
aagagcactaaagag

SEQ ID NO: 12071 - DNA, 15 bp, Homo sapiens
taagagcactaaaga

SEQ ID NO: 12072 - DNA, 15 bp, Homo sapiens
ttaagagcactaaag

SEQ ID NO: 12073 - DNA, 15 bp, Homo sapiens
attaagagcactaaa

SEQ ID NO: 12074 - DNA, 15 bp, Homo sapiens
aattaagagcactaa

SEQ ID NO: 12075 - DNA, 15 bp, Homo sapiens
aaattaagagcacta

SEQ ID NO: 12076 - DNA, 15 bp, Homo sapiens
taaattaagagcact

SEQ ID NO: 12077 - DNA, 15 bp, Homo sapiens
ataaattaagagcac

SEQ ID NO: 12078 - DNA, 15 bp, Homo sapiens
tataaattaagagca

SEQ ID NO: 12079 - DNA, 15 bp, Homo sapiens
ctataaattaagagc

SEQ ID NO: 12080 - DNA, 15 bp, Homo sapiens
tctataaattaagag

SEQ ID NO: 12081 - DNA, 15 bp, Homo sapiens
gtctataaattaaga

SEQ ID NO: 12082 - DNA, 15 bp, Homo sapiens
tgtctataaattaag

SEQ ID NO: 12083 - DNA, 15 bp, Homo sapiens
ttgtctataaattaa

SEQ ID NO: 12084 - DNA, 15 bp, Homo sapiens
cttgtctataaatta

SEQ ID NO: 12085 - DNA, 15 bp, Homo sapiens
ccttgtctataaatt

SEQ ID NO: 12086 - DNA, 15 bp, Homo sapiens
tccttgtctataaat

SEQ ID NO: 12087 - DNA, 15 bp, Homo sapiens
ttccttgtctataaa

SEQ ID NO: 12088 - DNA, 15 bp, Homo sapiens
cttccttgtctataa

SEQ ID NO: 12089 - DNA, 15 bp, Homo sapiens
ccttccttgtctata

SEQ ID NO: 12090 - DNA, 15 bp, Homo sapiens
gccttccttgtctat

SEQ ID NO: 12091 - DNA, 15 bp, Homo sapiens
tgccttccttgtcta

SEQ ID NO: 12092 - DNA, 15 bp, Homo sapiens
ctgccttccttgtct

SEQ ID NO: 12093 - DNA, 15 bp, Homo sapiens
cctgccttccttgtc

SEQ ID NO: 12094 - DNA, 15 bp, Homo sapiens
acctgccttccttgt

SEQ ID NO: 12095 - DNA, 15 bp, Homo sapiens
aacctgccttccttg

SEQ ID NO: 12096 - DNA, 15 bp, Homo sapiens
aaacctgccttcctt

SEQ ID NO: 12097 - DNA, 15 bp, Homo sapiens
taaacctgccttcct

SEQ ID NO: 12098 - DNA, 15 bp, Homo sapiens
ttaaacctgccttcc

SEQ ID NO: 12099 - DNA, 15 bp, Homo sapiens
tttaaacctgccttc

SEQ ID NO: 12100 - DNA, 15 bp, Homo sapiens
ttttaaacctgcctt

SEQ ID NO: 12101 - DNA, 15 bp, Homo sapiens
cttttaaacctgcct

SEQ ID NO: 12102 - DNA, 15 bp, Homo sapiens
acttttaaacctgcc

SEQ ID NO: 12103 - DNA, 15 bp, Homo sapiens
gacttttaaacctgc

SEQ ID NO: 12104 - DNA, 15 bp, Homo sapiens
tgacttttaaacctg

SEQ ID NO: 12105 - DNA, 15 bp, Homo sapiens
atgacttttaaacct

SEQ ID NO: 12106 - DNA, 15 bp, Homo sapiens
tatgacttttaaacc

SEQ ID NO: 12107 - DNA, 15 bp, Homo sapiens
ctatgacttttaaac

SEQ ID NO: 12108 - DNA, 15 bp, Homo sapiens
tctatgacttttaaa

SEQ ID NO: 12109 - DNA, 15 bp, Homo sapiens
ttctatgacttttaa

SEQ ID NO: 12110 - DNA, 15 bp, Homo sapiens
gttctatgactttta

SEQ ID NO: 12111 - DNA, 15 bp, Homo sapiens
ggttctatgactttt

SEQ ID NO: 12112 - DNA, 15 bp, Homo sapiens
tggttctatgacttt

SEQ ID NO: 12113 - DNA, 15 bp, Homo sapiens
ttggttctatgactt

SEQ ID NO: 12114 - DNA, 15 bp, Homo sapiens
tttggttctatgact

SEQ ID NO: 12115 - DNA, 15 bp, Homo sapiens
ctttggttctatgac

SEQ ID NO: 12116 - DNA, 15 bp, Homo sapiens
actttggttctatga

SEQ ID NO: 12117 - DNA, 15 bp, Homo sapiens
cactttggttctatg

SEQ ID NO: 12118 - DNA, 15 bp, Homo sapiens
tcactttggttctat

SEQ ID NO: 12119 - DNA, 15 bp, Homo sapiens
ttcactttggttcta

SEQ ID NO: 12120 - DNA, 15 bp, Homo sapiens
tttcactttggttct

SEQ ID NO: 12121 - DNA, 15 bp, Homo sapiens
ttttcactttggttc

SEQ ID NO: 12122 - DNA, 15 bp, Homo sapiens
attttcactttggtt

SEQ ID NO: 12123 - DNA, 15 bp, Homo sapiens
cattttcactttggt

SEQ ID NO: 12124 - DNA, 15 bp, Homo sapiens
tcattttcactttgg

SEQ ID NO: 12125 - DNA, 15 bp, Homo sapiens
atcattttcactttg

SEQ ID NO: 12126 - DNA, 15 bp, Homo sapiens
gatcattttcacttt

SEQ ID NO: 12127 - DNA, 15 bp, Homo sapiens
agatcattttcactt

SEQ ID NO: 12128 - DNA, 15 bp, Homo sapiens
cagatcattttcact

SEQ ID NO: 12129 - DNA, 15 bp, Homo sapiens
gcagatcattttcac

SEQ ID NO: 12130 - DNA, 15 bp, Homo sapiens
tgcagatcattttca

SEQ ID NO: 12131 - DNA, 15 bp, Homo sapiens
atgcagatcattttc

SEQ ID NO: 12132 - DNA, 15 bp, Homo sapiens
aatgcagatcatttt

SEQ ID NO: 12133 - DNA, 15 bp, Homo sapiens
aaatgcagatcattt

SEQ ID NO: 12134 - DNA, 15 bp, Homo sapiens
aaaatgcagatcatt

SEQ ID NO: 12135 - DNA, 15 bp, Homo sapiens
taaaatgcagatcat

SEQ ID NO: 12136 - DNA, 15 bp, Homo sapiens
ctaaaatgcagatca

SEQ ID NO: 12137 - DNA, 15 bp, Homo sapiens
tctaaaatgcagatc

SEQ ID NO: 12138 - DNA, 15 bp, Homo sapiens
ctctaaaatgcagat

SEQ ID NO: 12139 - DNA, 15 bp, Homo sapiens
cctctaaaatgcaga

SEQ ID NO: 12140 - DNA, 15 bp, Homo sapiens
tcctctaaaatgcag

SEQ ID NO: 12141 - DNA, 15 bp, Homo sapiens
ctcctctaaaatgca

SEQ ID NO: 12142 - DNA, 15 bp, Homo sapiens
gctcctctaaaatgc

SEQ ID NO: 12143 - DNA, 15 bp, Homo sapiens
tgctcctctaaaatg

SEQ ID NO: 12144 - DNA, 15 bp, Homo sapiens
ttgctcctctaaaat

SEQ ID NO: 12145 - DNA, 15 bp, Homo sapiens
cttgctcctctaaaa

SEQ ID NO: 12146 - DNA, 15 bp, Homo sapiens
ccttgctcctctaaa

SEQ ID NO: 12147 - DNA, 15 bp, Homo sapiens
tccttgctcctctaa

SEQ ID NO: 12148 - DNA, 15 bp, Homo sapiens
ttccttgctcctcta

SEQ ID NO: 12149 - DNA, 15 bp, Homo sapiens
tttccttgctcctct

SEQ ID NO: 12150 - DNA, 15 bp, Homo sapiens
ctttccttgctcctc

SEQ ID NO: 12151 - DNA, 15 bp, Homo sapiens
gctttccttgctcct

SEQ ID NO: 12152 - DNA, 15 bp, Homo sapiens
agctttccttgctcc

SEQ ID NO: 12153 - DNA, 15 bp, Homo sapiens
tagctttccttgctc

SEQ ID NO: 12154 - DNA, 15 bp, Homo sapiens
gtagctttccttgct

SEQ ID NO: 12155 - DNA, 15 bp, Homo sapiens
tgtagctttccttgc

SEQ ID NO: 12156 - DNA, 15 bp, Homo sapiens
ttgtagctttccttg

SEQ ID NO: 12157 - DNA, 15 bp, Homo sapiens
gttgtagctttcctt

SEQ ID NO: 12158 - DNA, 15 bp, Homo sapiens
cgttgtagctttcct

SEQ ID NO: 12159 - DNA, 15 bp, Homo sapiens
acgttgtagctttcc

SEQ ID NO: 12160 - DNA, 15 bp, Homo sapiens
aacgttgtagctttc

SEQ ID NO: 12161 - DNA, 15 bp, Homo sapiens
aaacgttgtagcttt

SEQ ID NO: 12162 - DNA, 15 bp, Homo sapiens
taaacgttgtagctt

SEQ ID NO: 12163 - DNA, 15 bp, Homo sapiens
ataaacgttgtagct

SEQ ID NO: 12164 - DNA, 15 bp, Homo sapiens
aataaacgttgtagc

SEQ ID NO: 12165 - DNA, 15 bp, Homo sapiens
taataaacgttgtag

SEQ ID NO: 12166 - DNA, 15 bp, Homo sapiens
ataataaacgttgta

SEQ ID NO: 12167 - DNA, 15 bp, Homo sapiens
aataataaacgttgt

SEQ ID NO: 12168 - DNA, 15 bp, Homo sapiens
aaataataaacgttg

SEQ ID NO: 12169 - DNA, 15 bp, Homo sapiens
gaaataataaacgtt

SEQ ID NO: 12170 - DNA, 15 bp, Homo sapiens
agaaataataaacgt

SEQ ID NO: 12171 - DNA, 15 bp, Homo sapiens
tagaaataataaacg

SEQ ID NO: 12172 - DNA, 15 bp, Homo sapiens
gtagaaataataaac

SEQ ID NO: 12173 - DNA, 15 bp, Homo sapiens
agtagaaataataaa

SEQ ID NO: 12174 - DNA, 15 bp, Homo sapiens
aagtagaaataataa

SEQ ID NO: 12175 - DNA, 15 bp, Homo sapiens
taagtagaaataata

SEQ ID NO: 12176 - DNA, 15 bp, Homo sapiens
ataagtagaaataat

SEQ ID NO: 12177 - DNA, 15 bp, Homo sapiens
tataagtagaaataa

SEQ ID NO: 12178 - DNA, 15 bp, Homo sapiens
ttataagtagaaata

SEQ ID NO: 12179 - DNA, 15 bp, Homo sapiens
tttataagtagaaat

SEQ ID NO: 12180 - DNA, 15 bp, Homo sapiens
gtttataagtagaaa

SEQ ID NO: 12181 - DNA, 15 bp, Homo sapiens
tgtttataagtagaa

SEQ ID NO: 12182 - DNA, 15 bp, Homo sapiens
gtgtttataagtaga

SEQ ID NO: 12183 - DNA, 15 bp, Homo sapiens
agtgtttataagtag

SEQ ID NO: 12184 - DNA, 15 bp, Homo sapiens
aagtgtttataagta

SEQ ID NO: 12185 - DNA, 15 bp, Homo sapiens
gaagtgtttataagt

SEQ ID NO: 12186 - DNA, 15 bp, Homo sapiens
ggaagtgtttataag

SEQ ID NO: 12187 - DNA, 15 bp, Homo sapiens
gggaagtgtttataa

SEQ ID NO: 12188 - DNA, 15 bp, Homo sapiens
agggaagtgtttata

SEQ ID NO: 12189 - DNA, 15 bp, Homo sapiens
aagggaagtgtttat

SEQ ID NO: 12190 - DNA, 15 bp, Homo sapiens
aaagggaagtgttta

SEQ ID NO: 12191 - DNA, 15 bp, Homo sapiens
taaagggaagtgttt

SEQ ID NO: 12192 - DNA, 15 bp, Homo sapiens
ttaaagggaagtgtt

SEQ ID NO: 12193 - DNA, 15 bp, Homo sapiens
tttaaagggaagtgt

SEQ ID NO: 12194 - DNA, 15 bp, Homo sapiens
atttaaagggaagtg

SEQ ID NO: 12195 - DNA, 15 bp, Homo sapiens
tatttaaagggaagt

SEQ ID NO: 12196 - DNA, 15 bp, Homo sapiens
ttatttaaagggaag

SEQ ID NO: 12197 - DNA, 15 bp, Homo sapiens
attatttaaagggaa

SEQ ID NO: 12198 - DNA, 15 bp, Homo sapiens
aattatttaaaggga

SEQ ID NO: 12199 - DNA, 15 bp, Homo sapiens
aaattatttaaaggg

SEQ ID NO: 12200 - DNA, 15 bp, Homo sapiens
caaattatttaaagg

SEQ ID NO: 12201 - DNA, 15 bp, Homo sapiens
tcaaattatttaaag

SEQ ID NO: 12202 - DNA, 15 bp, Homo sapiens
ttcaaattatttaaa

SEQ ID NO: 12203 - DNA, 15 bp, Homo sapiens
tttcaaattatttaa

SEQ ID NO: 12204 - DNA, 15 bp, Homo sapiens
ttttcaaattattta

SEQ ID NO: 12205 - DNA, 15 bp, Homo sapiens
cttttcaaattattt

SEQ ID NO: 12206 - DNA, 15 bp, Homo sapiens
tcttttcaaattatt

SEQ ID NO: 12207 - DNA, 15 bp, Homo sapiens
atcttttcaaattat

SEQ ID NO: 12208 - DNA, 15 bp, Homo sapiens
tatcttttcaaatta

SEQ ID NO: 12209 - DNA, 15 bp, Homo sapiens
ttatcttttcaaatt

SEQ ID NO: 12210 - DNA, 15 bp, Homo sapiens
attatcttttcaaat

SEQ ID NO: 12211 - DNA, 15 bp, Homo sapiens
tattatcttttcaaa

SEQ ID NO: 12212 - DNA, 15 bp, Homo sapiens
ctattatcttttcaa

SEQ ID NO: 12213 - DNA, 15 bp, Homo sapiens
tctattatcttttca

SEQ ID NO: 12214 - DNA, 15 bp, Homo sapiens
atctattatcttttc

SEQ ID NO: 12215 - DNA, 15 bp, Homo sapiens
aatctattatctttt

SEQ ID NO: 12216 - DNA, 15 bp, Homo sapiens
aaatctattatcttt

SEQ ID NO: 12217 - DNA, 15 bp, Homo sapiens
gaaatctattatctt

SEQ ID NO: 12218 - DNA, 15 bp, Homo sapiens
tgaaatctattatct

SEQ ID NO: 12219 - DNA, 15 bp, Homo sapiens
atgaaatctattatc

SEQ ID NO: 12220 - DNA, 15 bp, Homo sapiens
catgaaatctattat

SEQ ID NO: 12221 - DNA, 15 bp, Homo sapiens
tcatgaaatctatta

SEQ ID NO: 12222 - DNA, 15 bp, Homo sapiens
atcatgaaatctatt

SEQ ID NO: 12223 - DNA, 15 bp, Homo sapiens
catcatgaaatctat

SEQ ID NO: 12224 - DNA, 15 bp, Homo sapiens
acatcatgaaatcta

SEQ ID NO: 12225 - DNA, 15 bp, Homo sapiens
aacatcatgaaatct

SEQ ID NO: 12226 - DNA, 15 bp, Homo sapiens
caacatcatgaaatc

SEQ ID NO: 12227 - DNA, 15 bp, Homo sapiens
ccaacatcatgaaat

SEQ ID NO: 12228 - DNA, 15 bp, Homo sapiens
cccaacatcatgaaa

SEQ ID NO: 12229 - DNA, 15 bp, Homo sapiens
gcccaacatcatgaa

SEQ ID NO: 12230 - DNA, 15 bp, Homo sapiens
tgcccaacatcatga

SEQ ID NO: 12231 - DNA, 15 bp, Homo sapiens
atgcccaacatcatg

SEQ ID NO: 12232 - DNA, 15 bp, Homo sapiens
aatgcccaacatcat

SEQ ID NO: 12233 - DNA, 15 bp, Homo sapiens
aaatgcccaacatca

SEQ ID NO: 12234 - DNA, 15 bp, Homo sapiens
aaaatgcccaacatc

SEQ ID NO: 12235 - DNA, 15 bp, Homo sapiens
aaaaatgcccaacat

SEQ ID NO: 12236 - DNA, 15 bp, Homo sapiens
aaaaaatgcccaaca

SEQ ID NO: 12237 - DNA, 15 bp, Homo sapiens
gaaaaaatgcccaac

SEQ ID NO: 12238 - DNA, 15 bp, Homo sapiens
agaaaaaatgcccaa

SEQ ID NO: 12239 - DNA, 15 bp, Homo sapiens
aagaaaaaatgccca

SEQ ID NO: 12240 - DNA, 15 bp, Homo sapiens
aaagaaaaaatgccc

SEQ ID NO: 12241 - DNA, 15 bp, Homo sapiens
aaaagaaaaaatgcc

SEQ ID NO: 12242 - DNA, 15 bp, Homo sapiens
taaaagaaaaaatgc

SEQ ID NO: 12243 - DNA, 15 bp, Homo sapiens
gtaaaagaaaaaatg

SEQ ID NO: 12244 - DNA, 15 bp, Homo sapiens
tgtaaaagaaaaaat

SEQ ID NO: 12245 - DNA, 15 bp, Homo sapiens
gtgtaaaagaaaaaa

SEQ ID NO: 12246 - DNA, 15 bp, Homo sapiens
agtgtaaaagaaaaa

SEQ ID NO: 12247 - DNA, 15 bp, Homo sapiens
cagtgtaaaagaaaa

SEQ ID NO: 12248 - DNA, 15 bp, Homo sapiens
acagtgtaaaagaaa

SEQ ID NO: 12249 - DNA, 15 bp, Homo sapiens
tacagtgtaaaagaa

SEQ ID NO: 12250 - DNA, 15 bp, Homo sapiens
atacagtgtaaaaga

SEQ ID NO: 12251 - DNA, 15 bp, Homo sapiens
aatacagtgtaaaag

SEQ ID NO: 12252 - DNA, 15 bp, Homo sapiens
aaatacagtgtaaaa

SEQ ID NO: 12253 - DNA, 15 bp, Homo sapiens
aaaatacagtgtaaa

SEQ ID NO: 12254 - DNA, 15 bp, Homo sapiens
caaaatacagtgtaa

SEQ ID NO: 12255 - DNA, 15 bp, Homo sapiens
tcaaaatacagtgta

SEQ ID NO: 12256 - DNA, 15 bp, Homo sapiens
ttcaaaatacagtgt

SEQ ID NO: 12257 - DNA, 15 bp, Homo sapiens
cttcaaaatacagtg

SEQ ID NO: 12258 - DNA, 15 bp, Homo sapiens
tcttcaaaatacagt

SEQ ID NO: 12259 - DNA, 15 bp, Homo sapiens
ctcttcaaaatacag

SEQ ID NO: 12260 - DNA, 15 bp, Homo sapiens
actcttcaaaataca

SEQ ID NO: 12261 - DNA, 15 bp, Homo sapiens
aactcttcaaaatac

SEQ ID NO: 12262 - DNA, 15 bp, Homo sapiens
aaactcttcaaaata

SEQ ID NO: 12263 - DNA, 15 bp, Homo sapiens
caaactcttcaaaat

SEQ ID NO: 12264 - DNA, 15 bp, Homo sapiens
ccaaactcttcaaaa

SEQ ID NO: 12265 - DNA, 15 bp, Homo sapiens
cccaaactcttcaaa

SEQ ID NO: 12266 - DNA, 15 bp, Homo sapiens
acccaaactcttcaa

SEQ ID NO: 12267 - DNA, 15 bp, Homo sapiens
aacccaaactcttca

SEQ ID NO: 12268 - DNA, 15 bp, Homo sapiens
caacccaaactcttc

SEQ ID NO: 12269 - DNA, 15 bp, Homo sapiens
acaacccaaactctt

SEQ ID NO: 12270 - DNA, 15 bp, Homo sapiens
cacaacccaaactct

SEQ ID NO: 12271 - DNA, 15 bp, Homo sapiens
acacaacccaaactc

SEQ ID NO: 12272 - DNA, 15 bp, Homo sapiens
aacacaacccaaact

SEQ ID NO: 12273 - DNA, 15 bp, Homo sapiens
caacacaacccaaac

SEQ ID NO: 12274 - DNA, 15 bp, Homo sapiens
ccaacacaacccaaa

SEQ ID NO: 12275 - DNA, 15 bp, Homo sapiens
cccaacacaacccaa

SEQ ID NO: 12276 - DNA, 15 bp, Homo sapiens
acccaacacaaccca

SEQ ID NO: 12277 - DNA, 15 bp, Homo sapiens
cacccaacacaaccc

SEQ ID NO: 12278 - DNA, 15 bp, Homo sapiens
tcacccaacacaacc

SEQ ID NO: 12279 - DNA, 15 bp, Homo sapiens
ttcacccaacacaac

SEQ ID NO: 12280 - DNA, 15 bp, Homo sapiens
cttcacccaacacaa

SEQ ID NO: 12281 - DNA, 15 bp, Homo sapiens
acttcacccaacaca

SEQ ID NO: 12282 - DNA, 15 bp, Homo sapiens
aacttcacccaacac

SEQ ID NO: 12283 - DNA, 15 bp, Homo sapiens
taacttcacccaaca

SEQ ID NO: 12284 - DNA, 15 bp, Homo sapiens
ttaacttcacccaac

SEQ ID NO: 12285 - DNA, 15 bp, Homo sapiens
tttaacttcacccaa

SEQ ID NO: 12286 - DNA, 15 bp, Homo sapiens
ttttaacttcaccca

SEQ ID NO: 12287 - DNA, 15 bp, Homo sapiens
cttttaacttcaccc

SEQ ID NO: 12288 - DNA, 15 bp, Homo sapiens
acttttaacttcacc

SEQ ID NO: 12289 - DNA, 15 bp, Homo sapiens
cacttttaacttcac

SEQ ID NO: 12290 - DNA, 15 bp, Homo sapiens
tcacttttaacttca

SEQ ID NO: 12291 - DNA, 15 bp, Homo sapiens
ctcacttttaacttc

SEQ ID NO: 12292 - DNA, 15 bp, Homo sapiens
cctcacttttaactt

SEQ ID NO: 12293 - DNA, 15 bp, Homo sapiens
tcctcacttttaact

SEQ ID NO: 12294 - DNA, 15 bp, Homo sapiens
ttcctcacttttaac

SEQ ID NO: 12295 - DNA, 15 bp, Homo sapiens
tttcctcacttttaa

SEQ ID NO: 12296 - DNA, 15 bp, Homo sapiens
ctttcctcactttta

SEQ ID NO: 12297 - DNA, 15 bp, Homo sapiens
actttcctcactttt

SEQ ID NO: 12298 - DNA, 15 bp, Homo sapiens
cactttcctcacttt

SEQ ID NO: 12299 - DNA, 15 bp, Homo sapiens
ccactttcctcactt

SEQ ID NO: 12300 - DNA, 15 bp, Homo sapiens
cccactttcctcact

SEQ ID NO: 12301 - DNA, 15 bp, Homo sapiens
acccactttcctcac

SEQ ID NO: 12302 - DNA, 15 bp, Homo sapiens
gacccactttcctca

SEQ ID NO: 12303 - DNA, 15 bp, Homo sapiens
tgacccactttcctc

SEQ ID NO: 12304 - DNA, 15 bp, Homo sapiens
ctgacccactttcct

SEQ ID NO: 12305 - DNA, 15 bp, Homo sapiens
cctgacccactttcc

SEQ ID NO: 12306 - DNA, 15 bp, Homo sapiens
tcctgacccactttc

SEQ ID NO: 12307 - DNA, 15 bp, Homo sapiens
ctcctgacccacttt

SEQ ID NO: 12308 - DNA, 15 bp, Homo sapiens
tctcctgacccactt

SEQ ID NO: 12309 - DNA, 15 bp, Homo sapiens
ctctcctgacccact

SEQ ID NO: 12310 - DNA, 15 bp, Homo sapiens
actctcctgacccac

SEQ ID NO: 12311 - DNA, 15 bp, Homo sapiens
cactctcctgaccca

SEQ ID NO: 12312 - DNA, 15 bp, Homo sapiens
tcactctcctgaccc

SEQ ID NO: 12313 - DNA, 15 bp, Homo sapiens
atcactctcctgacc

SEQ ID NO: 12314 - DNA, 15 bp, Homo sapiens
catcactctcctgac

SEQ ID NO: 12315 - DNA, 15 bp, Homo sapiens
tcatcactctcctga

SEQ ID NO: 12316 - DNA, 15 bp, Homo sapiens
ttcatcactctcctg

SEQ ID NO: 12317 - DNA, 15 bp, Homo sapiens
tttcatcactctcct

SEQ ID NO: 12318 - DNA, 15 bp, Homo sapiens
gtttcatcactctcc

SEQ ID NO: 12319 - DNA, 15 bp, Homo sapiens
ggtttcatcactctc

SEQ ID NO: 12320 - DNA, 15 bp, Homo sapiens
aggtttcatcactct

SEQ ID NO: 12321 - DNA, 15 bp, Homo sapiens
caggtttcatcactc

SEQ ID NO: 12322 - DNA, 15 bp, Homo sapiens
ccaggtttcatcact

SEQ ID NO: 12323 - DNA, 15 bp, Homo sapiens
accaggtttcatcac

SEQ ID NO: 12324 - DNA, 15 bp, Homo sapiens
caccaggtttcatca

SEQ ID NO: 12325 - DNA, 15 bp, Homo sapiens
gcaccaggtttcatc

SEQ ID NO: 12326 - DNA, 15 bp, Homo sapiens
tgcaccaggtttcat

SEQ ID NO: 12327 - DNA, 15 bp, Homo sapiens
atgcaccaggtttca

SEQ ID NO: 12328 - DNA, 15 bp, Homo sapiens
aatgcaccaggtttc

SEQ ID NO: 12329 - DNA, 15 bp, Homo sapiens
aaatgcaccaggttt

SEQ ID NO: 12330 - DNA, 15 bp, Homo sapiens
gaaatgcaccaggtt

SEQ ID NO: 12331 - DNA, 15 bp, Homo sapiens
agaaatgcaccaggt

SEQ ID NO: 12332 - DNA, 15 bp, Homo sapiens
aagaaatgcaccagg

SEQ ID NO: 12333 - DNA, 15 bp, Homo sapiens
taagaaatgcaccag

SEQ ID NO: 12334 - DNA, 15 bp, Homo sapiens
ataagaaatgcacca

SEQ ID NO: 12335 - DNA, 15 bp, Homo sapiens
aataagaaatgcacc

SEQ ID NO: 12336 - DNA, 15 bp, Homo sapiens
aaataagaaatgcac

SEQ ID NO: 12337 - DNA, 15 bp, Homo sapiens
aaaataagaaatgca

SEQ ID NO: 12338 - DNA, 15 bp, Homo sapiens
caaaataagaaatgc

SEQ ID NO: 12339 - DNA, 15 bp, Homo sapiens
ccaaaataagaaatg

SEQ ID NO: 12340 - DNA, 15 bp, Homo sapiens
gccaaaataagaaat

SEQ ID NO: 12341 - DNA, 15 bp, Homo sapiens
ggccaaaataagaaa

SEQ ID NO: 12342 - DNA, 15 bp, Homo sapiens
gggccaaaataagaa

SEQ ID NO: 12343 - DNA, 15 bp, Homo sapiens
tgggccaaaataaga

SEQ ID NO: 12344 - DNA, 15 bp, Homo sapiens
atgggccaaaataag

SEQ ID NO: 12345 - DNA, 15 bp, Homo sapiens
aatgggccaaaataa

SEQ ID NO: 12346 - DNA, 15 bp, Homo sapiens
caatgggccaaaata

SEQ ID NO: 12347 - DNA, 15 bp, Homo sapiens
tcaatgggccaaaat

SEQ ID NO: 12348 - DNA, 15 bp, Homo sapiens
ttcaatgggccaaaa

SEQ ID NO: 12349 - DNA, 15 bp, Homo sapiens
gttcaatgggccaaa

SEQ ID NO: 12350 - DNA, 15 bp, Homo sapiens
ggttcaatgggccaa

SEQ ID NO: 12351 - DNA, 15 bp, Homo sapiens
tggttcaatgggcca

SEQ ID NO: 12352 - DNA, 15 bp, Homo sapiens
ctggttcaatgggcc

SEQ ID NO: 12353 - DNA, 15 bp, Homo sapiens
tctggttcaatgggc

SEQ ID NO: 12354 - DNA, 15 bp, Homo sapiens
ttctggttcaatggg

SEQ ID NO: 12355 - DNA, 15 bp, Homo sapiens
cttctggttcaatgg

SEQ ID NO: 12356 - DNA, 15 bp, Homo sapiens
tcttctggttcaatg

SEQ ID NO: 12357 - DNA, 15 bp, Homo sapiens
atcttctggttcaat

SEQ ID NO: 12358 - DNA, 15 bp, Homo sapiens
catcttctggttcaa

SEQ ID NO: 12359 - DNA, 15 bp, Homo sapiens
tcatcttctggttca

SEQ ID NO: 12360 - DNA, 15 bp, Homo sapiens
atcatcttctggttc

SEQ ID NO: 12361 - DNA, 15 bp, Homo sapiens
tatcatcttctggtt

SEQ ID NO: 12362 - DNA, 15 bp, Homo sapiens
gtatcatcttctggt

SEQ ID NO: 12363 - DNA, 15 bp, Homo sapiens
ggtatcatcttctgg

SEQ ID NO: 12364 - DNA, 15 bp, Homo sapiens
tggtatcatcttctg

SEQ ID NO: 12365 - DNA, 15 bp, Homo sapiens
ttggtatcatcttct

SEQ ID NO: 12366 - DNA, 15 bp, Homo sapiens
attggtatcatcttc

SEQ ID NO: 12367 - DNA, 15 bp, Homo sapiens
tattggtatcatctt

SEQ ID NO: 12368 - DNA, 15 bp, Homo sapiens
atattggtatcatct

SEQ ID NO: 12369 - DNA, 15 bp, Homo sapiens
tatattggtatcatc

SEQ ID NO: 12370 - DNA, 15 bp, Homo sapiens
atatattggtatcat

SEQ ID NO: 12371 - DNA, 15 bp, Homo sapiens
gatatattggtatca

SEQ ID NO: 12372 - DNA, 15 bp, Homo sapiens
agatatattggtatc

SEQ ID NO: 12373 - DNA, 15 bp, Homo sapiens
tagatatattggtat

SEQ ID NO: 12374 - DNA, 15 bp, Homo sapiens
ctagatatattggta

SEQ ID NO: 12375 - DNA, 15 bp, Homo sapiens
actagatatattggt

SEQ ID NO: 12376 - DNA, 15 bp, Homo sapiens
cactagatatattgg

SEQ ID NO: 12377 - DNA, 15 bp, Homo sapiens
gcactagatatattg

SEQ ID NO: 12378 - DNA, 15 bp, Homo sapiens
ggcactagatatatt

SEQ ID NO: 12379 - DNA, 15 bp, Homo sapiens
cggcactagatatat

SEQ ID NO: 12380 - DNA, 15 bp, Homo sapiens
tcggcactagatata

SEQ ID NO: 12381 - DNA, 15 bp, Homo sapiens
gtcggcactagatat

SEQ ID NO: 12382 - DNA, 15 bp, Homo sapiens
tgtcggcactagata

SEQ ID NO: 12383 - DNA, 15 bp, Homo sapiens
atgtcggcactagat

SEQ ID NO: 12384 - DNA, 15 bp, Homo sapiens
tatgtcggcactaga

SEQ ID NO: 12385 - DNA, 15 bp, Homo sapiens
atatgtcggcactag

SEQ ID NO: 12386 - DNA, 15 bp, Homo sapiens
aatatgtcggcacta

SEQ ID NO: 12387 - DNA, 15 bp, Homo sapiens
aaatatgtcggcact

SEQ ID NO: 12388 - DNA, 15 bp, Homo sapiens
gaaatatgtcggcac

SEQ ID NO: 12389 - DNA, 15 bp, Homo sapiens
agaaatatgtcggca

SEQ ID NO: 12390 - DNA, 15 bp, Homo sapiens
gagaaatatgtcggc

SEQ ID NO: 12391 - DNA, 15 bp, Homo sapiens
ggagaaatatgtcgg

SEQ ID NO: 12392 - DNA, 15 bp, Homo sapiens
tggagaaatatgtcg

SEQ ID NO: 12393 - DNA, 15 bp, Homo sapiens
gtggagaaatatgtc

SEQ ID NO: 12394 - DNA, 15 bp, Homo sapiens
agtggagaaatatgt

SEQ ID NO: 12395 - DNA, 15 bp, Homo sapiens
cagtggagaaatatg

SEQ ID NO: 12396 - DNA, 15 bp, Homo sapiens
gcagtggagaaatat

SEQ ID NO: 12397 - DNA, 15 bp, Homo sapiens
cgcagtggagaaata

SEQ ID NO: 12398 - DNA, 15 bp, Homo sapiens
gcgcagtggagaaat

SEQ ID NO: 12399 - DNA, 15 bp, Homo sapiens
agcgcagtggagaaa

SEQ ID NO: 12400 - DNA, 15 bp, Homo sapiens
gagcgcagtggagaa

SEQ ID NO: 12401 - DNA, 15 bp, Homo sapiens
ggagcgcagtggaga

SEQ ID NO: 12402 - DNA, 15 bp, Homo sapiens
aggagcgcagtggag

SEQ ID NO: 12403 - DNA, 15 bp, Homo sapiens
aaggagcgcagtgga

SEQ ID NO: 12404 - DNA, 15 bp, Homo sapiens
taaggagcgcagtgg

SEQ ID NO: 12405 - DNA, 15 bp, Homo sapiens
ctaaggagcgcagtg

SEQ ID NO: 12406 - DNA, 15 bp, Homo sapiens
actaaggagcgcagt

SEQ ID NO: 12407 - DNA, 15 bp, Homo sapiens
aactaaggagcgcag

SEQ ID NO: 12408 - DNA, 15 bp, Homo sapiens
taactaaggagcgca

SEQ ID NO: 12409 - DNA, 15 bp, Homo sapiens
ataactaaggagcgc

SEQ ID NO: 12410 - DNA, 15 bp, Homo sapiens
aataactaaggagcg

SEQ ID NO: 12411 - DNA, 15 bp, Homo sapiens
caataactaaggagc

SEQ ID NO: 12412 - DNA, 15 bp, Homo sapiens
gcaataactaaggag

SEQ ID NO: 12413 - DNA, 15 bp, Homo sapiens
agcaataactaagga

SEQ ID NO: 12414 - DNA, 15 bp, Homo sapiens
cagcaataactaagg

SEQ ID NO: 12415 - DNA, 15 bp, Homo sapiens
gcagcaataactaag

SEQ ID NO: 12416 - DNA, 15 bp, Homo sapiens
tgcagcaataactaa

SEQ ID NO: 12417 - DNA, 15 bp, Homo sapiens
ctgcagcaataacta

SEQ ID NO: 12418 - DNA, 15 bp, Homo sapiens
actgcagcaataact

SEQ ID NO: 12419 - DNA, 15 bp, Homo sapiens
cactgcagcaataac

SEQ ID NO: 12420 - DNA, 15 bp, Homo sapiens
acactgcagcaataa

SEQ ID NO: 12421 - DNA, 15 bp, Homo sapiens
cacactgcagcaata

SEQ ID NO: 12422 - DNA, 15 bp, Homo sapiens
acacactgcagcaat

SEQ ID NO: 12423 - DNA, 15 bp, Homo sapiens
aacacactgcagcaa

SEQ ID NO: 12424 - DNA, 15 bp, Homo sapiens
gaacacactgcagca

SEQ ID NO: 12425 - DNA, 15 bp, Homo sapiens
tgaacacactgcagc

SEQ ID NO: 12426 - DNA, 15 bp, Homo sapiens
ttgaacacactgcag

SEQ ID NO: 12427 - DNA, 15 bp, Homo sapiens
cttgaacacactgca

SEQ ID NO: 12428 - DNA, 15 bp, Homo sapiens
ccttgaacacactgc

SEQ ID NO: 12429 - DNA, 15 bp, Homo sapiens
accttgaacacactg

SEQ ID NO: 12430 - DNA, 15 bp, Homo sapiens
gaccttgaacacact

SEQ ID NO: 12431 - DNA, 15 bp, Homo sapiens
agaccttgaacacac

SEQ ID NO: 12432 - DNA, 15 bp, Homo sapiens
aagaccttgaacaca

SEQ ID NO: 12433 - DNA, 15 bp, Homo sapiens
gaagaccttgaacac

SEQ ID NO: 12434 - DNA, 15 bp, Homo sapiens
agaagaccttgaaca

SEQ ID NO: 12435 - DNA, 15 bp, Homo sapiens
aagaagaccttgaac

SEQ ID NO: 12436 - DNA, 15 bp, Homo sapiens
caagaagaccttgaa

SEQ ID NO: 12437 - DNA, 15 bp, Homo sapiens
gcaagaagaccttga

SEQ ID NO: 12438 - DNA, 15 bp, Homo sapiens
agcaagaagaccttg

SEQ ID NO: 12439 - DNA, 15 bp, Homo sapiens
cagcaagaagacctt

SEQ ID NO: 12440 - DNA, 15 bp, Homo sapiens
acagcaagaagacct

SEQ ID NO: 12441 - DNA, 15 bp, Homo sapiens
cacagcaagaagacc

SEQ ID NO: 12442 - DNA, 15 bp, Homo sapiens
tcacagcaagaagac

SEQ ID NO: 12443 - DNA, 15 bp, Homo sapiens
ctcacagcaagaaga

SEQ ID NO: 12444 - DNA, 15 bp, Homo sapiens
actcacagcaagaag

SEQ ID NO: 12445 - DNA, 15 bp, Homo sapiens
cactcacagcaagaa

SEQ ID NO: 12446 - DNA, 15 bp, Homo sapiens
acactcacagcaaga

SEQ ID NO: 12447 - DNA, 15 bp, Homo sapiens
tacactcacagcaag

SEQ ID NO: 12448 - DNA, 15 bp, Homo sapiens
ttacactcacagcaa

SEQ ID NO: 12449 - DNA, 15 bp, Homo sapiens
gttacactcacagca

SEQ ID NO: 12450 - DNA, 15 bp, Homo sapiens
tgttacactcacagc

SEQ ID NO: 12451 - DNA, 15 bp, Homo sapiens
atgttacactcacag

SEQ ID NO: 12452 - DNA, 15 bp, Homo sapiens
gatgttacactcaca

SEQ ID NO: 12453 - DNA, 15 bp, Homo sapiens
tgatgttacactcac

SEQ ID NO: 12454 - DNA, 15 bp, Homo sapiens
gtgatgttacactca

SEQ ID NO: 12455 - DNA, 15 bp, Homo sapiens
tgtgatgttacactc

SEQ ID NO: 12456 - DNA, 15 bp, Homo sapiens
atgtgatgttacact

SEQ ID NO: 12457 - DNA, 15 bp, Homo sapiens
gatgtgatgttacac

SEQ ID NO: 12458 - DNA, 15 bp, Homo sapiens
agatgtgatgttaca

SEQ ID NO: 12459 - DNA, 15 bp, Homo sapiens
aagatgtgatgttac

SEQ ID NO: 12460 - DNA, 15 bp, Homo sapiens
caagatgtgatgtta

SEQ ID NO: 12461 - DNA, 15 bp, Homo sapiens
tcaagatgtgatgtt

SEQ ID NO: 12462 - DNA, 15 bp, Homo sapiens
ttcaagatgtgatgt

SEQ ID NO: 12463 - DNA, 15 bp, Homo sapiens
gttcaagatgtgatg

SEQ ID NO: 12464 - DNA, 15 bp, Homo sapiens
agttcaagatgtgat

SEQ ID NO: 12465 - DNA, 15 bp, Homo sapiens
gagttcaagatgtga

SEQ ID NO: 12466 - DNA, 15 bp, Homo sapiens
agagttcaagatgtg

SEQ ID NO: 12467 - DNA, 15 bp, Homo sapiens
aagagttcaagatgt

SEQ ID NO: 12468 - DNA, 15 bp, Homo sapiens
aaagagttcaagatg

SEQ ID NO: 12469 - DNA, 15 bp, Homo sapiens
aaaagagttcaagat

SEQ ID NO: 12470 - DNA, 15 bp, Homo sapiens
aaaaagagttcaaga

SEQ ID NO: 12471 - DNA, 15 bp, Homo sapiens
gaaaaagagttcaag

SEQ ID NO: 12472 - DNA, 15 bp, Homo sapiens
agaaaaagagttcaa

SEQ ID NO: 12473 - DNA, 15 bp, Homo sapiens
tagaaaaagagttca

SEQ ID NO: 12474 - DNA, 15 bp, Homo sapiens
ctagaaaaagagttc

SEQ ID NO: 12475 - DNA, 15 bp, Homo sapiens
cctagaaaaagagtt

SEQ ID NO: 12476 - DNA, 15 bp, Homo sapiens
ccctagaaaaagagt

SEQ ID NO: 12477 - DNA, 15 bp, Homo sapiens
tccctagaaaaagag

SEQ ID NO: 12478 - DNA, 15 bp, Homo sapiens
ttccctagaaaaaga

SEQ ID NO: 12479 - DNA, 15 bp, Homo sapiens
attccctagaaaaag

SEQ ID NO: 12480 - DNA, 15 bp, Homo sapiens
cattccctagaaaaa

SEQ ID NO: 12481 - DNA, 15 bp, Homo sapiens
gcattccctagaaaa

SEQ ID NO: 12482 - DNA, 15 bp, Homo sapiens
tgcattccctagaaa

SEQ ID NO: 12483 - DNA, 15 bp, Homo sapiens
atgcattccctagaa

SEQ ID NO: 12484 - DNA, 15 bp, Homo sapiens
gatgcattccctaga

SEQ ID NO: 12485 - DNA, 15 bp, Homo sapiens
tgatgcattccctag

SEQ ID NO: 12486 - DNA, 15 bp, Homo sapiens
ctgatgcattcccta

SEQ ID NO: 12487 - DNA, 15 bp, Homo sapiens
gctgatgcattccct

SEQ ID NO: 12488 - DNA, 15 bp, Homo sapiens
agctgatgcattccc

SEQ ID NO: 12489 - DNA, 15 bp, Homo sapiens
aagctgatgcattcc

SEQ ID NO: 12490 - DNA, 15 bp, Homo sapiens
taagctgatgcattc

SEQ ID NO: 12491 - DNA, 15 bp, Homo sapiens
ctaagctgatgcatt

SEQ ID NO: 12492 - DNA, 15 bp, Homo sapiens
tctaagctgatgcat

SEQ ID NO: 12493 - DNA, 15 bp, Homo sapiens
ctctaagctgatgca

SEQ ID NO: 12494 - DNA, 15 bp, Homo sapiens
actctaagctgatgc

SEQ ID NO: 12495 - DNA, 15 bp, Homo sapiens
gactctaagctgatg

SEQ ID NO: 12496 - DNA, 15 bp, Homo sapiens
ggactctaagctgat

SEQ ID NO: 12497 - DNA, 15 bp, Homo sapiens
cggactctaagctga

SEQ ID NO: 12498 - DNA, 15 bp, Homo sapiens
gcggactctaagctg

SEQ ID NO: 12499 - DNA, 15 bp, Homo sapiens
agcggactctaagct

SEQ ID NO: 12500 - DNA, 15 bp, Homo sapiens
cagcggactctaagc

SEQ ID NO: 12501 - DNA, 15 bp, Homo sapiens
tcagcggactctaag

SEQ ID NO: 12502 - DNA, 15 bp, Homo sapiens
atcagcggactctaa

SEQ ID NO: 12503 - DNA, 15 bp, Homo sapiens
catcagcggactcta

SEQ ID NO: 12504 - DNA, 15 bp, Homo sapiens
gcatcagcggactct

SEQ ID NO: 12505 - DNA, 15 bp, Homo sapiens
tgcatcagcggactc

SEQ ID NO: 12506 - DNA, 15 bp, Homo sapiens
atgcatcagcggact

SEQ ID NO: 12507 - DNA, 15 bp, Homo sapiens
aatgcatcagcggac

SEQ ID NO: 12508 - DNA, 15 bp, Homo sapiens
gaatgcatcagcgga

SEQ ID NO: 12509 - DNA, 15 bp, Homo sapiens
tgaatgcatcagcgg

SEQ ID NO: 12510 - DNA, 15 bp, Homo sapiens
atgaatgcatcagcg

SEQ ID NO: 12511 - DNA, 15 bp, Homo sapiens
aatgaatgcatcagc

SEQ ID NO: 12512 - DNA, 15 bp, Homo sapiens
taatgaatgcatcag

SEQ ID NO: 12513 - DNA, 15 bp, Homo sapiens
ataatgaatgcatca

SEQ ID NO: 12514 - DNA, 15 bp, Homo sapiens
tataatgaatgcatc

SEQ ID NO: 12515 - DNA, 15 bp, Homo sapiens
ttataatgaatgcat

SEQ ID NO: 12516 - DNA, 15 bp, Homo sapiens
tttataatgaatgca

SEQ ID NO: 12517 - DNA, 15 bp, Homo sapiens
ttttataatgaatgc

SEQ ID NO: 12518 - DNA, 15 bp, Homo sapiens
tttttataatgaatg

SEQ ID NO: 12519 - DNA, 15 bp, Homo sapiens
atttttataatgaat

SEQ ID NO: 12520 - DNA, 15 bp, Homo sapiens
catttttataatgaa

SEQ ID NO: 12521 - DNA, 15 bp, Homo sapiens
acatttttataatga

SEQ ID NO: 12522 - DNA, 15 bp, Homo sapiens
tacatttttataatg

SEQ ID NO: 12523 - DNA, 15 bp, Homo sapiens
atacatttttataat

SEQ ID NO: 12524 - DNA, 15 bp, Homo sapiens
aatacatttttataa

SEQ ID NO: 12525 - DNA, 15 bp, Homo sapiens
caatacatttttata

SEQ ID NO: 12526 - DNA, 15 bp, Homo sapiens
acaatacatttttat

SEQ ID NO: 12527 - DNA, 15 bp, Homo sapiens
cacaatacattttta

SEQ ID NO: 12528 - DNA, 15 bp, Homo sapiens
acacaatacattttt

SEQ ID NO: 12529 - DNA, 15 bp, Homo sapiens
tacacaatacatttt

SEQ ID NO: 12530 - DNA, 15 bp, Homo sapiens
atacacaatacattt

SEQ ID NO: 12531 - DNA, 15 bp, Homo sapiens
tatacacaatacatt

SEQ ID NO: 12532 - DNA, 15 bp, Homo sapiens
atatacacaatacat

SEQ ID NO: 12533 - DNA, 15 bp, Homo sapiens
aatatacacaataca

SEQ ID NO: 12534 - DNA, 15 bp, Homo sapiens
aaatatacacaatac

SEQ ID NO: 12535 - DNA, 15 bp, Homo sapiens
aaaatatacacaata

SEQ ID NO: 12536 - DNA, 15 bp, Homo sapiens
gaaaatatacacaat

SEQ ID NO: 12537 - DNA, 15 bp, Homo sapiens
agaaaatatacacaa

SEQ ID NO: 12538 - DNA, 15 bp, Homo sapiens
tagaaaatatacaca

SEQ ID NO: 12539 - DNA, 15 bp, Homo sapiens
atagaaaatatacac

SEQ ID NO: 12540 - DNA, 15 bp, Homo sapiens
aatagaaaatataca

SEQ ID NO: 12541 - DNA, 15 bp, Homo sapiens
taatagaaaatatac

SEQ ID NO: 12542 - DNA, 15 bp, Homo sapiens
gtaatagaaaatata

SEQ ID NO: 12543 - DNA, 15 bp, Homo sapiens
tgtaatagaaaatat

SEQ ID NO: 12544 - DNA, 15 bp, Homo sapiens
atgtaatagaaaata

SEQ ID NO: 12545 - DNA, 15 bp, Homo sapiens
aatgtaatagaaaat

SEQ ID NO: 12546 - DNA, 15 bp, Homo sapiens
taatgtaatagaaaa

SEQ ID NO: 12547 - DNA, 15 bp, Homo sapiens
ataatgtaatagaaa

SEQ ID NO: 12548 - DNA, 15 bp, Homo sapiens
aataatgtaatagaa

SEQ ID NO: 12549 - DNA, 15 bp, Homo sapiens
aaataatgtaataga

SEQ ID NO: 12550 - DNA, 15 bp, Homo sapiens
gaaataatgtaatag

SEQ ID NO: 12551 - DNA, 15 bp, Homo sapiens
tgaaataatgtaata

SEQ ID NO: 12552 - DNA, 15 bp, Homo sapiens
ttgaaataatgtaat

SEQ ID NO: 12553 - DNA, 15 bp, Homo sapiens
tttgaaataatgtaa

SEQ ID NO: 12554 - DNA, 15 bp, Homo sapiens
ctttgaaataatgta

SEQ ID NO: 12555 - DNA, 15 bp, Homo sapiens
tctttgaaataatgt

SEQ ID NO: 12556 - DNA, 15 bp, Homo sapiens
gtctttgaaataatg

SEQ ID NO: 12557 - DNA, 15 bp, Homo sapiens
tgtctttgaaataat

SEQ ID NO: 12558 - DNA, 15 bp, Homo sapiens
ctgtctttgaaataa

SEQ ID NO: 12559 - DNA, 15 bp, Homo sapiens
tctgtctttgaaata

SEQ ID NO: 12560 - DNA, 15 bp, Homo sapiens
gtctgtctttgaaat

SEQ ID NO: 12561 - DNA, 15 bp, Homo sapiens
cgtctgtctttgaaa

SEQ ID NO: 12562 - DNA, 15 bp, Homo sapiens
acgtctgtctttgaa

SEQ ID NO: 12563 - DNA, 15 bp, Homo sapiens
cacgtctgtctttga

SEQ ID NO: 12564 - DNA, 15 bp, Homo sapiens
acacgtctgtctttg

SEQ ID NO: 12565 - DNA, 15 bp, Homo sapiens
aacacgtctgtcttt

SEQ ID NO: 12566 - DNA, 15 bp, Homo sapiens
aaacacgtctgtctt

SEQ ID NO: 12567 - DNA, 15 bp, Homo sapiens
aaaacacgtctgtct

SEQ ID NO: 12568 - DNA, 15 bp, Homo sapiens
aaaaacacgtctgtc

SEQ ID NO: 12569 - DNA, 15 bp, Homo sapiens
caaaaacacgtctgt

SEQ ID NO: 12570 - DNA, 15 bp, Homo sapiens
tcaaaaacacgtctg

SEQ ID NO: 12571 - DNA, 15 bp, Homo sapiens
ttcaaaaacacgtct

SEQ ID NO: 12572 - DNA, 15 bp, Homo sapiens
attcaaaaacacgtc

SEQ ID NO: 12573 - DNA, 15 bp, Homo sapiens
gattcaaaaacacgt

SEQ ID NO: 12574 - DNA, 15 bp, Homo sapiens
tgattcaaaaacacg

SEQ ID NO: 12575 - DNA, 15 bp, Homo sapiens
atgattcaaaaacac

SEQ ID NO: 12576 - DNA, 15 bp, Homo sapiens
catgattcaaaaaca

SEQ ID NO: 12577 - DNA, 15 bp, Homo sapiens
ccatgattcaaaaac

SEQ ID NO: 12578 - DNA, 15 bp, Homo sapiens
accatgattcaaaaa

SEQ ID NO: 12579 - DNA, 15 bp, Homo sapiens
caccatgattcaaaa

SEQ ID NO: 12580 - DNA, 15 bp, Homo sapiens
ccaccatgattcaaa

SEQ ID NO: 12581 - DNA, 15 bp, Homo sapiens
cccaccatgattcaa

SEQ ID NO: 12582 - DNA, 15 bp, Homo sapiens
tcccaccatgattca

SEQ ID NO: 12583 - DNA, 15 bp, Homo sapiens
ttcccaccatgattc

SEQ ID NO: 12584 - DNA, 15 bp, Homo sapiens
tttcccaccatgatt

SEQ ID NO: 12585 - DNA, 15 bp, Homo sapiens
ttttcccaccatgat

SEQ ID NO: 12586 - DNA, 15 bp, Homo sapiens
tttttcccaccatga

SEQ ID NO: 12587 - DNA, 15 bp, Homo sapiens
ttttttcccaccatg

SEQ ID NO: 12588 - DNA, 15 bp, Homo sapiens
tttttttcccaccat

SEQ ID NO: 12589 - DNA, 15 bp, Homo sapiens
gtttttttcccacca

SEQ ID NO: 12590 - DNA, 15 bp, Homo sapiens
agtttttttcccacc

SEQ ID NO: 12591 - DNA, 15 bp, Homo sapiens
gagtttttttcccac

SEQ ID NO: 12592 - DNA, 15 bp, Homo sapiens
ggagtttttttccca

SEQ ID NO: 12593 - DNA, 15 bp, Homo sapiens
aggagtttttttccc

SEQ ID NO: 12594 - DNA, 15 bp, Homo sapiens
gaggagtttttttcc

SEQ ID NO: 12595 - DNA, 15 bp, Homo sapiens
tgaggagtttttttc

SEQ ID NO: 12596 - DNA, 15 bp, Homo sapiens
gtgaggagttttttt

SEQ ID NO: 12597 - DNA, 15 bp, Homo sapiens
tgtgaggagtttttt

SEQ ID NO: 12598 - DNA, 15 bp, Homo sapiens
atgtgaggagttttt

SEQ ID NO: 12599 - DNA, 15 bp, Homo sapiens
aatgtgaggagtttt

SEQ ID NO: 12600 - DNA, 15 bp, Homo sapiens
gaatgtgaggagttt

SEQ ID NO: 12601 - DNA, 15 bp, Homo sapiens
tgaatgtgaggagtt

SEQ ID NO: 12602 - DNA, 15 bp, Homo sapiens
ttgaatgtgaggagt

SEQ ID NO: 12603 - DNA, 15 bp, Homo sapiens
gttgaatgtgaggag

SEQ ID NO: 12604 - DNA, 15 bp, Homo sapiens
ggttgaatgtgagga

SEQ ID NO: 12605 - DNA, 15 bp, Homo sapiens
aggttgaatgtgagg

SEQ ID NO: 12606 - DNA, 15 bp, Homo sapiens
gaggttgaatgtgag

SEQ ID NO: 12607 - DNA, 15 bp, Homo sapiens
agaggttgaatgtga

SEQ ID NO: 12608 - DNA, 15 bp, Homo sapiens
tagaggttgaatgtg

SEQ ID NO: 12609 - DNA, 15 bp, Homo sapiens
atagaggttgaatgt

SEQ ID NO: 12610 - DNA, 15 bp, Homo sapiens
catagaggttgaatg

SEQ ID NO: 12611 - DNA, 15 bp, Homo sapiens
gcatagaggttgaat

SEQ ID NO: 12612 - DNA, 15 bp, Homo sapiens
agcatagaggttgaa

SEQ ID NO: 12613 - DNA, 15 bp, Homo sapiens
tagcatagaggttga

SEQ ID NO: 12614 - DNA, 15 bp, Homo sapiens
ctagcatagaggttg

SEQ ID NO: 12615 - DNA, 15 bp, Homo sapiens
actagcatagaggtt

SEQ ID NO: 12616 - DNA, 15 bp, Homo sapiens
aactagcatagaggt

SEQ ID NO: 12617 - DNA, 15 bp, Homo sapiens
aaactagcatagagg

SEQ ID NO: 12618 - DNA, 15 bp, Homo sapiens
aaaactagcatagag

SEQ ID NO: 12619 - DNA, 15 bp, Homo sapiens
gaaaactagcataga

SEQ ID NO: 12620 - DNA, 15 bp, Homo sapiens
agaaaactagcatag

SEQ ID NO: 12621 - DNA, 15 bp, Homo sapiens
aagaaaactagcata

SEQ ID NO: 12622 - DNA, 15 bp, Homo sapiens
taagaaaactagcat

SEQ ID NO: 12623 - DNA, 15 bp, Homo sapiens
ataagaaaactagca

SEQ ID NO: 12624 - DNA, 15 bp, Homo sapiens
gataagaaaactagc

SEQ ID NO: 12625 - DNA, 15 bp, Homo sapiens
agataagaaaactag

SEQ ID NO: 12626 - DNA, 15 bp, Homo sapiens
aagataagaaaacta

SEQ ID NO: 12627 - DNA, 15 bp, Homo sapiens
taagataagaaaact

SEQ ID NO: 12628 - DNA, 15 bp, Homo sapiens
ttaagataagaaaac

SEQ ID NO: 12629 - DNA, 15 bp, Homo sapiens
cttaagataagaaaa

SEQ ID NO: 12630 - DNA, 15 bp, Homo sapiens
ccttaagataagaaa

SEQ ID NO: 12631 - DNA, 15 bp, Homo sapiens
cccttaagataagaa

SEQ ID NO: 12632 - DNA, 15 bp, Homo sapiens
ccccttaagataaga

SEQ ID NO: 12633 - DNA, 15 bp, Homo sapiens
cccccttaagataag

SEQ ID NO: 12634 - DNA, 15 bp, Homo sapiens
ccccccttaagataa

SEQ ID NO: 12635 - DNA, 15 bp, Homo sapiens
cccccccttaagata

SEQ ID NO: 12636 - DNA, 15 bp, Homo sapiens
acccccccttaagat

SEQ ID NO: 12637 - DNA, 15 bp, Homo sapiens
cacccccccttaaga

SEQ ID NO: 12638 - DNA, 15 bp, Homo sapiens
ccacccccccttaag

SEQ ID NO: 12639 - DNA, 15 bp, Homo sapiens
accacccccccttaa

SEQ ID NO: 12640 - DNA, 15 bp, Homo sapiens
aaccaccccccctta

SEQ ID NO: 12641 - DNA, 15 bp, Homo sapiens
taaccaccccccctt

SEQ ID NO: 12642 - DNA, 15 bp, Homo sapiens
ctaaccaccccccct

SEQ ID NO: 12643 - DNA, 15 bp, Homo sapiens
tctaaccaccccccc

SEQ ID NO: 12644 - DNA, 15 bp, Homo sapiens
ctctaaccacccccc

SEQ ID NO: 12645 - DNA, 15 bp, Homo sapiens
tctctaaccaccccc

SEQ ID NO: 12646 - DNA, 15 bp, Homo sapiens
ttctctaaccacccc

SEQ ID NO: 12647 - DNA, 15 bp, Homo sapiens
tttctctaaccaccc

SEQ ID NO: 12648 - DNA, 15 bp, Homo sapiens
atttctctaaccacc

SEQ ID NO: 12649 - DNA, 15 bp, Homo sapiens
catttctctaaccac

SEQ ID NO: 12650 - DNA, 15 bp, Homo sapiens
acatttctctaacca

SEQ ID NO: 12651 - DNA, 15 bp, Homo sapiens
tacatttctctaacc

SEQ ID NO: 12652 - DNA, 15 bp, Homo sapiens
atacatttctctaac

SEQ ID NO: 12653 - DNA, 15 bp, Homo sapiens
aatacatttctctaa

SEQ ID NO: 12654 - DNA, 15 bp, Homo sapiens
taatacatttctcta

SEQ ID NO: 12655 - DNA, 15 bp, Homo sapiens
ataatacatttctct

SEQ ID NO: 12656 - DNA, 15 bp, Homo sapiens
tataatacatttctc

SEQ ID NO: 12657 - DNA, 15 bp, Homo sapiens
atataatacatttct

SEQ ID NO: 12658 - DNA, 15 bp, Homo sapiens
tatataatacatttc

SEQ ID NO: 12659 - DNA, 15 bp, Homo sapiens
atatataatacattt

SEQ ID NO: 12660 - DNA, 15 bp, Homo sapiens
catatataatacatt

SEQ ID NO: 12661 - DNA, 15 bp, Homo sapiens
acatatataatacat

SEQ ID NO: 12662 - DNA, 15 bp, Homo sapiens
tacatatataataca

SEQ ID NO: 12663 - DNA, 15 bp, Homo sapiens
atacatatataatac

SEQ ID NO: 12664 - DNA, 15 bp, Homo sapiens
aatacatatataata

SEQ ID NO: 12665 - DNA, 15 bp, Homo sapiens
taatacatatataat

SEQ ID NO: 12666 - DNA, 15 bp, Homo sapiens
ttaatacatatataa

SEQ ID NO: 12667 - DNA, 15 bp, Homo sapiens
attaatacatatata

SEQ ID NO: 12668 - DNA, 15 bp, Homo sapiens
tattaatacatatat

SEQ ID NO: 12669 - DNA, 15 bp, Homo sapiens
atattaatacatata

SEQ ID NO: 12670 - DNA, 15 bp, Homo sapiens
aatattaatacatat

SEQ ID NO: 12671 - DNA, 15 bp, Homo sapiens
aaatattaatacata

SEQ ID NO: 12672 - DNA, 15 bp, Homo sapiens
caaatattaatacat

SEQ ID NO: 12673 - DNA, 15 bp, Homo sapiens
gcaaatattaataca

SEQ ID NO: 12674 - DNA, 15 bp, Homo sapiens
ggcaaatattaatac

SEQ ID NO: 12675 - DNA, 15 bp, Homo sapiens
aggcaaatattaata

SEQ ID NO: 12676 - DNA, 15 bp, Homo sapiens
gaggcaaatattaat

SEQ ID NO: 12677 - DNA, 15 bp, Homo sapiens
ggaggcaaatattaa

SEQ ID NO: 12678 - DNA, 15 bp, Homo sapiens
gggaggcaaatatta

SEQ ID NO: 12679 - DNA, 15 bp, Homo sapiens
agggaggcaaatatt

SEQ ID NO: 12680 - DNA, 15 bp, Homo sapiens
cagggaggcaaatat

SEQ ID NO: 12681 - DNA, 15 bp, Homo sapiens
acagggaggcaaata

SEQ ID NO: 12682 - DNA, 15 bp, Homo sapiens
aacagggaggcaaat

SEQ ID NO: 12683 - DNA, 15 bp, Homo sapiens
aaacagggaggcaaa

SEQ ID NO: 12684 - DNA, 15 bp, Homo sapiens
aaaacagggaggcaa

SEQ ID NO: 12685 - DNA, 15 bp, Homo sapiens
aaaaacagggaggca

SEQ ID NO: 12686 - DNA, 15 bp, Homo sapiens
aaaaaacagggaggc

SEQ ID NO: 12687 - DNA, 15 bp, Homo sapiens
taaaaaacagggagg

SEQ ID NO: 12688 - DNA, 15 bp, Homo sapiens
ttaaaaaacagggag

SEQ ID NO: 12689 - DNA, 15 bp, Homo sapiens
attaaaaaacaggga

SEQ ID NO: 12690 - DNA, 15 bp, Homo sapiens
aattaaaaaacaggg

SEQ ID NO: 12691 - DNA, 15 bp, Homo sapiens
gaattaaaaaacagg

SEQ ID NO: 12692 - DNA, 15 bp, Homo sapiens
agaattaaaaaacag

SEQ ID NO: 12693 - DNA, 15 bp, Homo sapiens
tagaattaaaaaaca

SEQ ID NO: 12694 - DNA, 15 bp, Homo sapiens
ttagaattaaaaaac

SEQ ID NO: 12695 - DNA, 15 bp, Homo sapiens
tttagaattaaaaaa

SEQ ID NO: 12696 - DNA, 15 bp, Homo sapiens
atttagaattaaaaa

SEQ ID NO: 12697 - DNA, 15 bp, Homo sapiens
tatttagaattaaaa

SEQ ID NO: 12698 - DNA, 15 bp, Homo sapiens
ctatttagaattaaa

SEQ ID NO: 12699 - DNA, 15 bp, Homo sapiens
cctatttagaattaa

SEQ ID NO: 12700 - DNA, 15 bp, Homo sapiens
acctatttagaatta

SEQ ID NO: 12701 - DNA, 15 bp, Homo sapiens
cacctatttagaatt

SEQ ID NO: 12702 - DNA, 15 bp, Homo sapiens
tcacctatttagaat

SEQ ID NO: 12703 - DNA, 15 bp, Homo sapiens
gtcacctatttagaa

SEQ ID NO: 12704 - DNA, 15 bp, Homo sapiens
tgtcacctatttaga

SEQ ID NO: 12705 - DNA, 15 bp, Homo sapiens
atgtcacctatttag

SEQ ID NO: 12706 - DNA, 15 bp, Homo sapiens
tatgtcacctattta

SEQ ID NO: 12707 - DNA, 15 bp, Homo sapiens
atatgtcacctattt

SEQ ID NO: 12708 - DNA, 15 bp, Homo sapiens
aatatgtcacctatt

SEQ ID NO: 12709 - DNA, 15 bp, Homo sapiens
aaatatgtcacctat

SEQ ID NO: 12710 - DNA, 15 bp, Homo sapiens
taaatatgtcaccta

SEQ ID NO: 12711 - DNA, 15 bp, Homo sapiens
ttaaatatgtcacct

SEQ ID NO: 12712 - DNA, 15 bp, Homo sapiens
attaaatatgtcacc

SEQ ID NO: 12713 - DNA, 15 bp, Homo sapiens
tattaaatatgtcac

SEQ ID NO: 12714 - DNA, 15 bp, Homo sapiens
atattaaatatgtca

SEQ ID NO: 12715 - DNA, 15 bp, Homo sapiens
tatattaaatatgtc

SEQ ID NO: 12716 - DNA, 15 bp, Homo sapiens
ttatattaaatatgt

SEQ ID NO: 12717 - DNA, 15 bp, Homo sapiens
gttatattaaatatg

SEQ ID NO: 12718 - DNA, 15 bp, Homo sapiens
agttatattaaatat

SEQ ID NO: 12719 - DNA, 15 bp, Homo sapiens
tagttatattaaata

SEQ ID NO: 12720 - DNA, 15 bp, Homo sapiens
atagttatattaaat

SEQ ID NO: 12721 - DNA, 15 bp, Homo sapiens
catagttatattaaa

SEQ ID NO: 12722 - DNA, 15 bp, Homo sapiens
gcatagttatattaa

SEQ ID NO: 12723 - DNA, 15 bp, Homo sapiens
agcatagttatatta

SEQ ID NO: 12724 - DNA, 15 bp, Homo sapiens
aagcatagttatatt

SEQ ID NO: 12725 - DNA, 15 bp, Homo sapiens
caagcatagttatat

SEQ ID NO: 12726 - DNA, 15 bp, Homo sapiens
gcaagcatagttata

SEQ ID NO: 12727 - DNA, 15 bp, Homo sapiens
agcaagcatagttat

SEQ ID NO: 12728 - DNA, 15 bp, Homo sapiens
aagcaagcatagtta

SEQ ID NO: 12729 - DNA, 15 bp, Homo sapiens
aaagcaagcatagtt

SEQ ID NO: 12730 - DNA, 15 bp, Homo sapiens
aaaagcaagcatagt

SEQ ID NO: 12731 - DNA, 15 bp, Homo sapiens
caaaagcaagcatag

SEQ ID NO: 12732 - DNA, 15 bp, Homo sapiens
tcaaaagcaagcata

SEQ ID NO: 12733 - DNA, 15 bp, Homo sapiens
ttcaaaagcaagcat

SEQ ID NO: 12734 - DNA, 15 bp, Homo sapiens
tttcaaaagcaagca

SEQ ID NO: 12735 - DNA, 15 bp, Homo sapiens
atttcaaaagcaagc

SEQ ID NO: 12736 - DNA, 15 bp, Homo sapiens
tatttcaaaagcaag

SEQ ID NO: 12737 - DNA, 15 bp, Homo sapiens
ttatttcaaaagcaa

SEQ ID NO: 12738 - DNA, 15 bp, Homo sapiens
attatttcaaaagca

SEQ ID NO: 12739 - DNA, 15 bp, Homo sapiens
aattatttcaaaagc

SEQ ID NO: 12740 - DNA, 15 bp, Homo sapiens
aaattatttcaaaag

SEQ ID NO: 12741 - DNA, 15 bp, Homo sapiens
caaattatttcaaaa

SEQ ID NO: 12742 - DNA, 15 bp, Homo sapiens
gcaaattatttcaaa

SEQ ID NO: 12743 - DNA, 15 bp, Homo sapiens
ggcaaattatttcaa

SEQ ID NO: 12744 - DNA, 15 bp, Homo sapiens
aggcaaattatttca

SEQ ID NO: 12745 - DNA, 15 bp, Homo sapiens
taggcaaattatttc

SEQ ID NO: 12746 - DNA, 15 bp, Homo sapiens
gtaggcaaattattt

SEQ ID NO: 12747 - DNA, 15 bp, Homo sapiens
ggtaggcaaattatt

SEQ ID NO: 12748 - DNA, 15 bp, Homo sapiens
tggtaggcaaattat

SEQ ID NO: 12749 - DNA, 15 bp, Homo sapiens
atggtaggcaaatta

SEQ ID NO: 12750 - DNA, 15 bp, Homo sapiens
aatggtaggcaaatt

SEQ ID NO: 12751 - DNA, 15 bp, Homo sapiens
gaatggtaggcaaat

SEQ ID NO: 12752 - DNA, 15 bp, Homo sapiens
agaatggtaggcaaa

SEQ ID NO: 12753 - DNA, 15 bp, Homo sapiens
aagaatggtaggcaa

SEQ ID NO: 12754 - DNA, 15 bp, Homo sapiens
aaagaatggtaggca

SEQ ID NO: 12755 - DNA, 15 bp, Homo sapiens
taaagaatggtaggc

SEQ ID NO: 12756 - DNA, 15 bp, Homo sapiens
ttaaagaatggtagg

SEQ ID NO: 12757 - DNA, 15 bp, Homo sapiens
tttaaagaatggtag

SEQ ID NO: 12758 - DNA, 15 bp, Homo sapiens
ttttaaagaatggta

SEQ ID NO: 12759 - DNA, 15 bp, Homo sapiens
attttaaagaatggt

SEQ ID NO: 12760 - DNA, 15 bp, Homo sapiens
cattttaaagaatgg

SEQ ID NO: 12761 - DNA, 15 bp, Homo sapiens
tcattttaaagaatg

SEQ ID NO: 12762 - DNA, 15 bp, Homo sapiens
ctcattttaaagaat

SEQ ID NO: 12763 - DNA, 15 bp, Homo sapiens
actcattttaaagaa

SEQ ID NO: 12764 - DNA, 15 bp, Homo sapiens
cactcattttaaaga

SEQ ID NO: 12765 - DNA, 15 bp, Homo sapiens
tcactcattttaaag

SEQ ID NO: 12766 - DNA, 15 bp, Homo sapiens
ttcactcattttaaa

SEQ ID NO: 12767 - DNA, 15 bp, Homo sapiens
attcactcattttaa

SEQ ID NO: 12768 - DNA, 15 bp, Homo sapiens
aattcactcatttta

SEQ ID NO: 12769 - DNA, 15 bp, Homo sapiens
aaattcactcatttt

SEQ ID NO: 12770 - DNA, 15 bp, Homo sapiens
aaaattcactcattt

SEQ ID NO: 12771 - DNA, 15 bp, Homo sapiens
taaaattcactcatt

SEQ ID NO: 12772 - DNA, 15 bp, Homo sapiens
ttaaaattcactcat

SEQ ID NO: 12773 - DNA, 15 bp, Homo sapiens
tttaaaattcactca

SEQ ID NO: 12774 - DNA, 15 bp, Homo sapiens
ttttaaaattcactc

SEQ ID NO: 12775 - DNA, 15 bp, Homo sapiens
cttttaaaattcact

SEQ ID NO: 12776 - DNA, 15 bp, Homo sapiens
tcttttaaaattcac

SEQ ID NO: 12777 - DNA, 15 bp, Homo sapiens
atcttttaaaattca

SEQ ID NO: 12778 - DNA, 15 bp, Homo sapiens
catcttttaaaattc

SEQ ID NO: 12779 - DNA, 15 bp, Homo sapiens
acatcttttaaaatt

SEQ ID NO: 12780 - DNA, 15 bp, Homo sapiens
tacatcttttaaaat

SEQ ID NO: 12781 - DNA, 15 bp, Homo sapiens
atacatcttttaaaa

SEQ ID NO: 12782 - DNA, 15 bp, Homo sapiens
tatacatcttttaaa

SEQ ID NO: 12783 - DNA, 15 bp, Homo sapiens
ctatacatcttttaa

SEQ ID NO: 12784 - DNA, 15 bp, Homo sapiens
actatacatctttta

SEQ ID NO: 12785 - DNA, 15 bp, Homo sapiens
cactatacatctttt

SEQ ID NO: 12786 - DNA, 15 bp, Homo sapiens
tcactatacatcttt

SEQ ID NO: 12787 - DNA, 15 bp, Homo sapiens
atcactatacatctt

SEQ ID NO: 12788 - DNA, 15 bp, Homo sapiens
aatcactatacatct

SEQ ID NO: 12789 - DNA, 15 bp, Homo sapiens
aaatcactatacatc

SEQ ID NO: 12790 - DNA, 15 bp, Homo sapiens
aaaatcactatacat

SEQ ID NO: 12791 - DNA, 15 bp, Homo sapiens
aaaaatcactataca

SEQ ID NO: 12792 - DNA, 15 bp, Homo sapiens
taaaaatcactatac

SEQ ID NO: 12793 - DNA, 15 bp, Homo sapiens
ataaaaatcactata

SEQ ID NO: 12794 - DNA, 15 bp, Homo sapiens
cataaaaatcactat

SEQ ID NO: 12795 - DNA, 15 bp, Homo sapiens
acataaaaatcacta

SEQ ID NO: 12796 - DNA, 15 bp, Homo sapiens
cacataaaaatcact

SEQ ID NO: 12797 - DNA, 15 bp, Homo sapiens
tcacataaaaatcac

SEQ ID NO: 12798 - DNA, 15 bp, Homo sapiens
ttcacataaaaatca

SEQ ID NO: 12799 - DNA, 15 bp, Homo sapiens
cttcacataaaaatc

SEQ ID NO: 12800 - DNA, 15 bp, Homo sapiens
tcttcacataaaaat

SEQ ID NO: 12801 - DNA, 15 bp, Homo sapiens
atcttcacataaaaa

SEQ ID NO: 12802 - DNA, 15 bp, Homo sapiens
catcttcacataaaa

SEQ ID NO: 12803 - DNA, 15 bp, Homo sapiens
tcatcttcacataaa

SEQ ID NO: 12804 - DNA, 15 bp, Homo sapiens
ttcatcttcacataa

SEQ ID NO: 12805 - DNA, 15 bp, Homo sapiens
attcatcttcacata

SEQ ID NO: 12806 - DNA, 15 bp, Homo sapiens
aattcatcttcacat

SEQ ID NO: 12807 - DNA, 15 bp, Homo sapiens
taattcatcttcaca

SEQ ID NO: 12808 - DNA, 15 bp, Homo sapiens
ttaattcatcttcac

SEQ ID NO: 12809 - DNA, 15 bp, Homo sapiens
tttaattcatcttca

SEQ ID NO: 12810 - DNA, 15 bp, Homo sapiens
ctttaattcatcttc

SEQ ID NO: 12811 - DNA, 15 bp, Homo sapiens
tctttaattcatctt

SEQ ID NO: 12812 - DNA, 15 bp, Homo sapiens
ctctttaattcatct

SEQ ID NO: 12813 - DNA, 15 bp, Homo sapiens
actctttaattcatc

SEQ ID NO: 12814 - DNA, 15 bp, Homo sapiens
aactctttaattcat

SEQ ID NO: 12815 - DNA, 15 bp, Homo sapiens
taactctttaattca

SEQ ID NO: 12816 - DNA, 15 bp, Homo sapiens
ttaactctttaattc

SEQ ID NO: 12817 - DNA, 15 bp, Homo sapiens
cttaactctttaatt

SEQ ID NO: 12818 - DNA, 15 bp, Homo sapiens
acttaactctttaat

SEQ ID NO: 12819 - DNA, 15 bp, Homo sapiens
cacttaactctttaa

SEQ ID NO: 12820 - DNA, 15 bp, Homo sapiens
tcacttaactcttta

SEQ ID NO: 12821 - DNA, 15 bp, Homo sapiens
gtcacttaactcttt

SEQ ID NO: 12822 - DNA, 15 bp, Homo sapiens
tgtcacttaactctt

SEQ ID NO: 12823 - DNA, 15 bp, Homo sapiens
atgtcacttaactct

SEQ ID NO: 12824 - DNA, 15 bp, Homo sapiens
tatgtcacttaactc

SEQ ID NO: 12825 - DNA, 15 bp, Homo sapiens
ctatgtcacttaact

SEQ ID NO: 12826 - DNA, 15 bp, Homo sapiens
tctatgtcacttaac

SEQ ID NO: 12827 - DNA, 15 bp, Homo sapiens
gtctatgtcacttaa

SEQ ID NO: 12828 - DNA, 15 bp, Homo sapiens
ggtctatgtcactta

SEQ ID NO: 12829 - DNA, 15 bp, Homo sapiens
tggtctatgtcactt

SEQ ID NO: 12830 - DNA, 15 bp, Homo sapiens
gtggtctatgtcact

SEQ ID NO: 12831 - DNA, 15 bp, Homo sapiens
ggtggtctatgtcac

SEQ ID NO: 12832 - DNA, 15 bp, Homo sapiens
cggtggtctatgtca

SEQ ID NO: 12833 - DNA, 15 bp, Homo sapiens
acggtggtctatgtc

SEQ ID NO: 12834 - DNA, 15 bp, Homo sapiens
tacggtggtctatgt

SEQ ID NO: 12835 - DNA, 15 bp, Homo sapiens
ctacggtggtctatg

SEQ ID NO: 12836 - DNA, 15 bp, Homo sapiens
gctacggtggtctat

SEQ ID NO: 12837 - DNA, 15 bp, Homo sapiens
tgctacggtggtcta

SEQ ID NO: 12838 - DNA, 15 bp, Homo sapiens
atgctacggtggtct

SEQ ID NO: 12839 - DNA, 15 bp, Homo sapiens
aatgctacggtggtc

SEQ ID NO: 12840 - DNA, 15 bp, Homo sapiens
aaatgctacggtggt

SEQ ID NO: 12841 - DNA, 15 bp, Homo sapiens
aaaatgctacggtgg

SEQ ID NO: 12842 - DNA, 15 bp, Homo sapiens
gaaaatgctacggtg

SEQ ID NO: 12843 - DNA, 15 bp, Homo sapiens
ggaaaatgctacggt

SEQ ID NO: 12844 - DNA, 15 bp, Homo sapiens
gggaaaatgctacgg

SEQ ID NO: 12845 - DNA, 15 bp, Homo sapiens
agggaaaatgctacg

SEQ ID NO: 12846 - DNA, 15 bp, Homo sapiens
tagggaaaatgctac

SEQ ID NO: 12847 - DNA, 15 bp, Homo sapiens
atagggaaaatgcta

SEQ ID NO: 12848 - DNA, 15 bp, Homo sapiens
catagggaaaatgct

SEQ ID NO: 12849 - DNA, 15 bp, Homo sapiens
ccatagggaaaatgc

SEQ ID NO: 12850 - DNA, 15 bp, Homo sapiens
tccatagggaaaatg

SEQ ID NO: 12851 - DNA, 15 bp, Homo sapiens
atccatagggaaaat

SEQ ID NO: 12852 - DNA, 15 bp, Homo sapiens
gatccatagggaaaa

SEQ ID NO: 12853 - DNA, 15 bp, Homo sapiens
agatccatagggaaa

SEQ ID NO: 12854 - DNA, 15 bp, Homo sapiens
cagatccatagggaa

SEQ ID NO: 12855 - DNA, 15 bp, Homo sapiens
acagatccataggga

SEQ ID NO: 12856 - DNA, 15 bp, Homo sapiens
tacagatccataggg

SEQ ID NO: 12857 - DNA, 15 bp, Homo sapiens
ttacagatccatagg

SEQ ID NO: 12858 - DNA, 15 bp, Homo sapiens
tttacagatccatag

SEQ ID NO: 12859 - DNA, 15 bp, Homo sapiens
ttttacagatccata

SEQ ID NO: 12860 - DNA, 15 bp, Homo sapiens
tttttacagatccat

SEQ ID NO: 12861 - DNA, 15 bp, Homo sapiens
gtttttacagatcca

SEQ ID NO: 12862 - DNA, 15 bp, Homo sapiens
tgtttttacagatcc

SEQ ID NO: 12863 - DNA, 15 bp, Homo sapiens
ctgtttttacagatc

SEQ ID NO: 12864 - DNA, 15 bp, Homo sapiens
gctgtttttacagat

SEQ ID NO: 12865 - DNA, 15 bp, Homo sapiens
ggctgtttttacaga

SEQ ID NO: 12866 - DNA, 15 bp, Homo sapiens
gggctgtttttacag

SEQ ID NO: 12867 - DNA, 15 bp, Homo sapiens
tgggctgtttttaca

SEQ ID NO: 12868 - DNA, 15 bp, Homo sapiens
ttgggctgtttttac

SEQ ID NO: 12869 - DNA, 15 bp, Homo sapiens
tttgggctgttttta

SEQ ID NO: 12870 - DNA, 15 bp, Homo sapiens
ttttgggctgttttt

SEQ ID NO: 12871 - DNA, 15 bp, Homo sapiens
cttttgggctgtttt

SEQ ID NO: 12872 - DNA, 15 bp, Homo sapiens
acttttgggctgttt

SEQ ID NO: 12873 - DNA, 15 bp, Homo sapiens
gacttttgggctgtt

SEQ ID NO: 12874 - DNA, 15 bp, Homo sapiens
agacttttgggctgt

SEQ ID NO: 12875 - DNA, 15 bp, Homo sapiens
aagacttttgggctg

SEQ ID NO: 12876 - DNA, 15 bp, Homo sapiens
caagacttttgggct

SEQ ID NO: 12877 - DNA, 15 bp, Homo sapiens
acaagacttttgggc

SEQ ID NO: 12878 - DNA, 15 bp, Homo sapiens
cacaagacttttggg

SEQ ID NO: 12879 - DNA, 15 bp, Homo sapiens
tcacaagacttttgg

SEQ ID NO: 12880 - DNA, 15 bp, Homo sapiens
atcacaagacttttg

SEQ ID NO: 12881 - DNA, 15 bp, Homo sapiens
aatcacaagactttt

SEQ ID NO: 12882 - DNA, 15 bp, Homo sapiens
aaatcacaagacttt

SEQ ID NO: 12883 - DNA, 15 bp, Homo sapiens
aaaatcacaagactt

SEQ ID NO: 12884 - DNA, 15 bp, Homo sapiens
aaaaatcacaagact

SEQ ID NO: 12885 - DNA, 15 bp, Homo sapiens
aaaaaatcacaagac

SEQ ID NO: 12886 - DNA, 15 bp, Homo sapiens
aaaaaaatcacaaga

SEQ ID NO: 12887 - DNA, 15 bp, Homo sapiens
aaaaaaaatcacaag

SEQ ID NO: 12888 - DNA, 15 bp, Homo sapiens
aaaaaaaaatcacaa

SEQ ID NO: 12889 - DNA, 15 bp, Homo sapiens
aaaaaaaaaatcaca

SEQ ID NO: 12890 - DNA, 15 bp, Homo sapiens
aaaaaaaaaaatcac

SEQ ID NO: 12891 - DNA, 15 bp, Homo sapiens
gctcaaaaaaaaaaa

SEQ ID NO: 12892 - DNA, 15 bp, Homo sapiens
ggctcaaaaaaaaaa

SEQ ID NO: 12893 - DNA, 15 bp, Homo sapiens
cggctcaaaaaaaaa

SEQ ID NO: 12894 - DNA, 15 bp, Homo sapiens
acggctcaaaaaaaa

SEQ ID NO: 12895 - DNA, 15 bp, Homo sapiens
tacggctcaaaaaaa

SEQ ID NO: 12896 - DNA, 15 bp, Homo sapiens
ctacggctcaaaaaa

SEQ ID NO: 12897 - DNA, 15 bp, Homo sapiens
actacggctcaaaaa

SEQ ID NO: 12898 - DNA, 15 bp, Homo sapiens
gactacggctcaaaa

SEQ ID NO: 12899 - DNA, 15 bp, Homo sapiens
agactacggctcaaa

SEQ ID NO: 12900 - DNA, 15 bp, Homo sapiens
aagactacggctcaa

SEQ ID NO: 12901 - DNA, 15 bp, Homo sapiens
gaagactacggctca

SEQ ID NO: 12902 - DNA, 15 bp, Homo sapiens
ggaagactacggctc

SEQ ID NO: 12903 - DNA, 15 bp, Homo sapiens
aggaagactacggct

SEQ ID NO: 12904 - DNA, 15 bp, Homo sapiens
gaggaagactacggc

SEQ ID NO: 12905 - DNA, 15 bp, Homo sapiens
agaggaagactacgg

SEQ ID NO: 12906 - DNA, 15 bp, Homo sapiens
aagaggaagactacg

SEQ ID NO: 12907 - DNA, 15 bp, Homo sapiens
caagaggaagactac

SEQ ID NO: 12908 - DNA, 15 bp, Homo sapiens
gcaagaggaagacta

SEQ ID NO: 12909 - DNA, 15 bp, Homo sapiens
agcaagaggaagact

SEQ ID NO: 12910 - DNA, 15 bp, Homo sapiens
gagcaagaggaagac

SEQ ID NO: 12911 - DNA, 15 bp, Homo sapiens
agagcaagaggaaga

SEQ ID NO: 12912 - DNA, 15 bp, Homo sapiens
cagagcaagaggaag

SEQ ID NO: 12913 - DNA, 15 bp, Homo sapiens
acagagcaagaggaa

SEQ ID NO: 12914 - DNA, 15 bp, Homo sapiens
aacagagcaagagga

SEQ ID NO: 12915 - DNA, 15 bp, Homo sapiens
caacagagcaagagg

SEQ ID NO: 12916 - DNA, 15 bp, Homo sapiens
gcaacagagcaagag

SEQ ID NO: 12917 - DNA, 15 bp, Homo sapiens
ggcaacagagcaaga

SEQ ID NO: 12918 - DNA, 15 bp, Homo sapiens
gggcaacagagcaag

SEQ ID NO: 12919 - DNA, 15 bp, Homo sapiens
tgggcaacagagcaa

SEQ ID NO: 12920 - DNA, 15 bp, Homo sapiens
ctgggcaacagagca

SEQ ID NO: 12921 - DNA, 15 bp, Homo sapiens
cctgggcaacagagc

SEQ ID NO: 12922 - DNA, 15 bp, Homo sapiens
gcctgggcaacagag

SEQ ID NO: 12923 - DNA, 15 bp, Homo sapiens
agcctgggcaacaga

SEQ ID NO: 12924 - DNA, 15 bp, Homo sapiens
cagcctgggcaacag

SEQ ID NO: 12925 - DNA, 15 bp, Homo sapiens
ccagcctgggcaaca

SEQ ID NO: 12926 - DNA, 15 bp, Homo sapiens
tccagcctgggcaac

SEQ ID NO: 12927 - DNA, 15 bp, Homo sapiens
ctccagcctgggcaa

SEQ ID NO: 12928 - DNA, 15 bp, Homo sapiens
actccagcctgggca

SEQ ID NO: 12929 - DNA, 15 bp, Homo sapiens
cactccagcctgggc

SEQ ID NO: 12930 - DNA, 15 bp, Homo sapiens
gcactccagcctggg

SEQ ID NO: 12931 - DNA, 15 bp, Homo sapiens
tgcactccagcctgg

SEQ ID NO: 12932 - DNA, 15 bp, Homo sapiens
ctgcactccagcctg

SEQ ID NO: 12933 - DNA, 15 bp, Homo sapiens
accactgcactccag

SEQ ID NO: 12934 - DNA, 15 bp, Homo sapiens
caccactgcactcca

SEQ ID NO: 12935 - DNA, 15 bp, Homo sapiens
tgagatggcaccact

SEQ ID NO: 12936 - DNA, 15 bp, Homo sapiens
ctgagatggcaccac

SEQ ID NO: 12937 - DNA, 15 bp, Homo sapiens
gctgagatggcacca

SEQ ID NO: 12938 - DNA, 15 bp, Homo sapiens
agctgagatggcacc

SEQ ID NO: 12939 - DNA, 15 bp, Homo sapiens
gagctgagatggcac

SEQ ID NO: 12940 - DNA, 15 bp, Homo sapiens
tgagctgagatggca

SEQ ID NO: 12941 - DNA, 15 bp, Homo sapiens
gtgagctgagatggc

SEQ ID NO: 12942 - DNA, 15 bp, Homo sapiens
agtgagctgagatgg

SEQ ID NO: 12943 - DNA, 15 bp, Homo sapiens
cagtgagctgagatg

SEQ ID NO: 12944 - DNA, 15 bp, Homo sapiens
ggttgcagtgagctg

SEQ ID NO: 12945 - DNA, 15 bp, Homo sapiens
aggttgcagtgagct

SEQ ID NO: 12946 - DNA, 15 bp, Homo sapiens
gaggttgcagtgagc

SEQ ID NO: 12947 - DNA, 15 bp, Homo sapiens
agaggttgcagtgag

SEQ ID NO: 12948 - DNA, 15 bp, Homo sapiens
cagaggttgcagtga

SEQ ID NO: 12949 - DNA, 15 bp, Homo sapiens
gcagaggttgcagtg

SEQ ID NO: 12950 - DNA, 15 bp, Homo sapiens
ggcagaggttgcagt

SEQ ID NO: 12951 - DNA, 15 bp, Homo sapiens
aggcagaggttgcag

SEQ ID NO: 12952 - DNA, 15 bp, Homo sapiens
gaggcagaggttgca

SEQ ID NO: 12953 - DNA, 15 bp, Homo sapiens
ggaggcagaggttgc

SEQ ID NO: 12954 - DNA, 15 bp, Homo sapiens
aggaggcagaggttg

SEQ ID NO: 12955 - DNA, 15 bp, Homo sapiens
taggaggcagaggtt

SEQ ID NO: 12956 - DNA, 15 bp, Homo sapiens
ctaggaggcagaggt

SEQ ID NO: 12957 - DNA, 15 bp, Homo sapiens
cctaggaggcagagg

SEQ ID NO: 12958 - DNA, 15 bp, Homo sapiens
tcctaggaggcagag

SEQ ID NO: 12959 - DNA, 15 bp, Homo sapiens
atcctaggaggcaga

SEQ ID NO: 12960 - DNA, 15 bp, Homo sapiens
gatcctaggaggcag

SEQ ID NO: 12961 - DNA, 15 bp, Homo sapiens
tgatcctaggaggca

SEQ ID NO: 12962 - DNA, 15 bp, Homo sapiens
ttgatcctaggaggc

SEQ ID NO: 12963 - DNA, 15 bp, Homo sapiens
cttgatcctaggagg

SEQ ID NO: 12964 - DNA, 15 bp, Homo sapiens
acttgatcctaggag

SEQ ID NO: 12965 - DNA, 15 bp, Homo sapiens
cacttgatcctagga

SEQ ID NO: 12966 - DNA, 15 bp, Homo sapiens
tcacttgatcctagg

SEQ ID NO: 12967 - DNA, 15 bp, Homo sapiens
atcacttgatcctag

SEQ ID NO: 12968 - DNA, 15 bp, Homo sapiens
aatcacttgatccta

SEQ ID NO: 12969 - DNA, 15 bp, Homo sapiens
gaatcacttgatcct

SEQ ID NO: 12970 - DNA, 15 bp, Homo sapiens
agaatcacttgatcc

SEQ ID NO: 12971 - DNA, 15 bp, Homo sapiens
gagaatcacttgatc

SEQ ID NO: 12972 - DNA, 15 bp, Homo sapiens
ggagaatcacttgat

SEQ ID NO: 12973 - DNA, 15 bp, Homo sapiens
tgggagaatcacttg

SEQ ID NO: 12974 - DNA, 15 bp, Homo sapiens
gtgggagaatcactt

SEQ ID NO: 12975 - DNA, 15 bp, Homo sapiens
ggtgggagaatcact

SEQ ID NO: 12976 - DNA, 15 bp, Homo sapiens
aggtgggagaatcac

SEQ ID NO: 12977 - DNA, 15 bp, Homo sapiens
gaggtgggagaatca

SEQ ID NO: 12978 - DNA, 15 bp, Homo sapiens
tgaggtgggagaatc

SEQ ID NO: 12979 - DNA, 15 bp, Homo sapiens
ctgaggtgggagaat

SEQ ID NO: 12980 - DNA, 15 bp, Homo sapiens
gctgaggtgggagaa

SEQ ID NO: 12981 - DNA, 15 bp, Homo sapiens
agctgaggtgggaga

SEQ ID NO: 12982 - DNA, 15 bp, Homo sapiens
aagctgaggtgggag

SEQ ID NO: 12983 - DNA, 15 bp, Homo sapiens
gaagctgaggtggga

SEQ ID NO: 12984 - DNA, 15 bp, Homo sapiens
tgaagctgaggtggg

SEQ ID NO: 12985 - DNA, 15 bp, Homo sapiens
atgaagctgaggtgg

SEQ ID NO: 12986 - DNA, 15 bp, Homo sapiens
catgaagctgaggtg

SEQ ID NO: 12987 - DNA, 15 bp, Homo sapiens
tcatgaagctgaggt

SEQ ID NO: 12988 - DNA, 15 bp, Homo sapiens
ctcatgaagctgagg

SEQ ID NO: 12989 - DNA, 15 bp, Homo sapiens
actcatgaagctgag

SEQ ID NO: 12990 - DNA, 15 bp, Homo sapiens
tactcatgaagctga

SEQ ID NO: 12991 - DNA, 15 bp, Homo sapiens
ctactcatgaagctg

SEQ ID NO: 12992 - DNA, 15 bp, Homo sapiens
gctactcatgaagct

SEQ ID NO: 12993 - DNA, 15 bp, Homo sapiens
agctactcatgaagc

SEQ ID NO: 12994 - DNA, 15 bp, Homo sapiens
cagctactcatgaag

SEQ ID NO: 12995 - DNA, 15 bp, Homo sapiens
ccagctactcatgaa

SEQ ID NO: 12996 - DNA, 15 bp, Homo sapiens
cccagctactcatga

SEQ ID NO: 12997 - DNA, 15 bp, Homo sapiens
tcccagctactcatg

SEQ ID NO: 12998 - DNA, 15 bp, Homo sapiens
gtcccagctactcat

SEQ ID NO: 12999 - DNA, 15 bp, Homo sapiens
tagtcccagctactc

SEQ ID NO: 13000 - DNA, 15 bp, Homo sapiens
gtagtcccagctact

SEQ ID NO: 13001 - DNA, 15 bp, Homo sapiens
tgtagtcccagctac

SEQ ID NO: 13002 - DNA, 15 bp, Homo sapiens
ctgtagtcccagcta

SEQ ID NO: 13003 - DNA, 15 bp, Homo sapiens
cctgtagtcccagct

SEQ ID NO: 13004 - DNA, 15 bp, Homo sapiens
acacctgtagtccca

SEQ ID NO: 13005 - DNA, 15 bp, Homo sapiens
cacacctgtagtccc

SEQ ID NO: 13006 - DNA, 15 bp, Homo sapiens
acacacctgtagtcc

SEQ ID NO: 13007 - DNA, 15 bp, Homo sapiens
cacacacctgtagtc

SEQ ID NO: 13008 - DNA, 15 bp, Homo sapiens
gcacacacctgtagt

SEQ ID NO: 13009 - DNA, 15 bp, Homo sapiens
ggcacacacctgtag

SEQ ID NO: 13010 - DNA, 15 bp, Homo sapiens
tggcacacacctgta

SEQ ID NO: 13011 - DNA, 15 bp, Homo sapiens
gtggcacacacctgt

SEQ ID NO: 13012 - DNA, 15 bp, Homo sapiens
ggtggcacacacctg

SEQ ID NO: 13013 - DNA, 15 bp, Homo sapiens
atggtggcacacacc

SEQ ID NO: 13014 - DNA, 15 bp, Homo sapiens
catggtggcacacac

SEQ ID NO: 13015 - DNA, 15 bp, Homo sapiens
gcatggtggcacaca

SEQ ID NO: 13016 - DNA, 15 bp, Homo sapiens
ggcatggtggcacac

SEQ ID NO: 13017 - DNA, 15 bp, Homo sapiens
aggcatggtggcaca

SEQ ID NO: 13018 - DNA, 15 bp, Homo sapiens
caggcatggtggcac

SEQ ID NO: 13019 - DNA, 15 bp, Homo sapiens
caaaaattagccagg

SEQ ID NO: 13020 - DNA, 15 bp, Homo sapiens
acaaaaattagccag

SEQ ID NO: 13021 - DNA, 15 bp, Homo sapiens
tacaaaaattagcca

SEQ ID NO: 13022 - DNA, 15 bp, Homo sapiens
atacaaaaattagcc

SEQ ID NO: 13023 - DNA, 15 bp, Homo sapiens
caaaaatacaaaaat

SEQ ID NO: 13024 - DNA, 15 bp, Homo sapiens
ccaaaaatacaaaaa

SEQ ID NO: 13025 - DNA, 15 bp, Homo sapiens
accaaaaatacaaaa

SEQ ID NO: 13026 - DNA, 15 bp, Homo sapiens
taccaaaaatacaaa

SEQ ID NO: 13027 - DNA, 15 bp, Homo sapiens
ctaccaaaaatacaa

SEQ ID NO: 13028 - DNA, 15 bp, Homo sapiens
tctaccaaaaataca

SEQ ID NO: 13029 - DNA, 15 bp, Homo sapiens
ctctaccaaaaatac

SEQ ID NO: 13030 - DNA, 15 bp, Homo sapiens
tctctaccaaaaata

SEQ ID NO: 13031 - DNA, 15 bp, Homo sapiens
atctctaccaaaaat

SEQ ID NO: 13032 - DNA, 15 bp, Homo sapiens
catctctaccaaaaa

SEQ ID NO: 13033 - DNA, 15 bp, Homo sapiens
ccatctctaccaaaa

SEQ ID NO: 13034 - DNA, 15 bp, Homo sapiens
cccatctctaccaaa

SEQ ID NO: 13035 - DNA, 15 bp, Homo sapiens
ccccatctctaccaa

SEQ ID NO: 13036 - DNA, 15 bp, Homo sapiens
accccatctctacca

SEQ ID NO: 13037 - DNA, 15 bp, Homo sapiens
aaccccatctctacc

SEQ ID NO: 13038 - DNA, 15 bp, Homo sapiens
gacatggtgaaaccc

SEQ ID NO: 13039 - DNA, 15 bp, Homo sapiens
tgacatggtgaaacc

SEQ ID NO: 13040 - DNA, 15 bp, Homo sapiens
ctgacatggtgaaac

SEQ ID NO: 13041 - DNA, 15 bp, Homo sapiens
gctgacatggtgaaa

SEQ ID NO: 13042 - DNA, 15 bp, Homo sapiens
ggctgacatggtgaa

SEQ ID NO: 13043 - DNA, 15 bp, Homo sapiens
tggctgacatggtga

SEQ ID NO: 13044 - DNA, 15 bp, Homo sapiens
ctggctgacatggtg

SEQ ID NO: 13045 - DNA, 15 bp, Homo sapiens
cctggctgacatggt

SEQ ID NO: 13046 - DNA, 15 bp, Homo sapiens
gcctggctgacatgg

SEQ ID NO: 13047 - DNA, 15 bp, Homo sapiens
agcctggctgacatg

SEQ ID NO: 13048 - DNA, 15 bp, Homo sapiens
cagcctggctgacat

SEQ ID NO: 13049 - DNA, 15 bp, Homo sapiens
accagcctggctgac

SEQ ID NO: 13050 - DNA, 15 bp, Homo sapiens
gaccagcctggctga

SEQ ID NO: 13051 - DNA, 15 bp, Homo sapiens
agaccagcctggctg

SEQ ID NO: 13052 - DNA, 15 bp, Homo sapiens
gagaccagcctggct

SEQ ID NO: 13053 - DNA, 15 bp, Homo sapiens
aagttcgagaccagc

SEQ ID NO: 13054 - DNA, 15 bp, Homo sapiens
gaagttcgagaccag

SEQ ID NO: 13055 - DNA, 15 bp, Homo sapiens
agaagttcgagacca

SEQ ID NO: 13056 - DNA, 15 bp, Homo sapiens
cagaagttcgagacc

SEQ ID NO: 13057 - DNA, 15 bp, Homo sapiens
tcagaagttcgagac

SEQ ID NO: 13058 - DNA, 15 bp, Homo sapiens
gtcagaagttcgaga

SEQ ID NO: 13059 - DNA, 15 bp, Homo sapiens
ggtcagaagttcgag

SEQ ID NO: 13060 - DNA, 15 bp, Homo sapiens
aggtcagaagttcga

SEQ ID NO: 13061 - DNA, 15 bp, Homo sapiens
gaggtcagaagttcg

SEQ ID NO: 13062 - DNA, 15 bp, Homo sapiens
tgaggtcagaagttc

SEQ ID NO: 13063 - DNA, 15 bp, Homo sapiens
ttgaggtcagaagtt

SEQ ID NO: 13064 - DNA, 15 bp, Homo sapiens
cttgaggtcagaagt

SEQ ID NO: 13065 - DNA, 15 bp, Homo sapiens
acttgaggtcagaag

SEQ ID NO: 13066 - DNA, 15 bp, Homo sapiens
cacttgaggtcagaa

SEQ ID NO: 13067 - DNA, 15 bp, Homo sapiens
atcacttgaggtcag

SEQ ID NO: 13068 - DNA, 15 bp, Homo sapiens
gatcacttgaggtca

SEQ ID NO: 13069 - DNA, 15 bp, Homo sapiens
tagatcacttgaggt

SEQ ID NO: 13070 - DNA, 15 bp, Homo sapiens
gtagatcacttgagg

SEQ ID NO: 13071 - DNA, 15 bp, Homo sapiens
ggtagatcacttgag

SEQ ID NO: 13072 - DNA, 15 bp, Homo sapiens
gggtagatcacttga

SEQ ID NO: 13073 - DNA, 15 bp, Homo sapiens
tgggtagatcacttg

SEQ ID NO: 13074 - DNA, 15 bp, Homo sapiens
gtgggtagatcactt

SEQ ID NO: 13075 - DNA, 15 bp, Homo sapiens
ggtgggtagatcact

SEQ ID NO: 13076 - DNA, 15 bp, Homo sapiens
tgaggtgggtagatc

SEQ ID NO: 13077 - DNA, 15 bp, Homo sapiens
ctgaggtgggtagat

SEQ ID NO: 13078 - DNA, 15 bp, Homo sapiens
gctgaggtgggtaga

SEQ ID NO: 13079 - DNA, 15 bp, Homo sapiens
ggctgaggtgggtag

SEQ ID NO: 13080 - DNA, 15 bp, Homo sapiens
aggctgaggtgggta

SEQ ID NO: 13081 - DNA, 15 bp, Homo sapiens
agaggctgaggtggg

SEQ ID NO: 13082 - DNA, 15 bp, Homo sapiens
gagaggctgaggtgg

SEQ ID NO: 13083 - DNA, 15 bp, Homo sapiens
tgagaggctgaggtg

SEQ ID NO: 13084 - DNA, 15 bp, Homo sapiens
ttgagaggctgaggt

SEQ ID NO: 13085 - DNA, 15 bp, Homo sapiens
tttgagaggctgagg

SEQ ID NO: 13086 - DNA, 15 bp, Homo sapiens
ctttgagaggctgag

SEQ ID NO: 13087 - DNA, 15 bp, Homo sapiens
actttgagaggctga

SEQ ID NO: 13088 - DNA, 15 bp, Homo sapiens
cactttgagaggctg

SEQ ID NO: 13089 - DNA, 15 bp, Homo sapiens
gcactttgagaggct

SEQ ID NO: 13090 - DNA, 15 bp, Homo sapiens
agcactttgagaggc

SEQ ID NO: 13091 - DNA, 15 bp, Homo sapiens
cagcactttgagagg

SEQ ID NO: 13092 - DNA, 15 bp, Homo sapiens
ccagcactttgagag

SEQ ID NO: 13093 - DNA, 15 bp, Homo sapiens
tccagcactttgaga

SEQ ID NO: 13094 - DNA, 15 bp, Homo sapiens
ttccagcactttgag

SEQ ID NO: 13095 - DNA, 15 bp, Homo sapiens
tttccagcactttga

SEQ ID NO: 13096 - DNA, 15 bp, Homo sapiens
atttccagcactttg

SEQ ID NO: 13097 - DNA, 15 bp, Homo sapiens
tatttccagcacttt

SEQ ID NO: 13098 - DNA, 15 bp, Homo sapiens
gtatttccagcactt

SEQ ID NO: 13099 - DNA, 15 bp, Homo sapiens
tgtatttccagcact

SEQ ID NO: 13100 - DNA, 15 bp, Homo sapiens
ctgtatttccagcac

SEQ ID NO: 13101 - DNA, 15 bp, Homo sapiens
cctgtatttccagca

SEQ ID NO: 13102 - DNA, 15 bp, Homo sapiens
gcctgtatttccagc

SEQ ID NO: 13103 - DNA, 15 bp, Homo sapiens
tgcctgtatttccag

SEQ ID NO: 13104 - DNA, 15 bp, Homo sapiens
atgcctgtatttcca

SEQ ID NO: 13105 - DNA, 15 bp, Homo sapiens
catgcctgtatttcc

SEQ ID NO: 13106 - DNA, 15 bp, Homo sapiens
tcatgcctgtatttc

SEQ ID NO: 13107 - DNA, 15 bp, Homo sapiens
ctcatgcctgtattt

SEQ ID NO: 13108 - DNA, 15 bp, Homo sapiens
gctcatgcctgtatt

SEQ ID NO: 13109 - DNA, 15 bp, Homo sapiens
ggctcatgcctgtat

SEQ ID NO: 13110 - DNA, 15 bp, Homo sapiens
catggctcatgcctg

SEQ ID NO: 13111 - DNA, 15 bp, Homo sapiens
ccatggctcatgcct

SEQ ID NO: 13112 - DNA, 15 bp, Homo sapiens
accatggctcatgcc

SEQ ID NO: 13113 - DNA, 15 bp, Homo sapiens
aaccatggctcatgc

SEQ ID NO: 13114 - DNA, 15 bp, Homo sapiens
gaaccatggctcatg

SEQ ID NO: 13115 - DNA, 15 bp, Homo sapiens
ggaaccatggctcat

SEQ ID NO: 13116 - DNA, 15 bp, Homo sapiens
gggaaccatggctca

SEQ ID NO: 13117 - DNA, 15 bp, Homo sapiens
cgggaaccatggctc

SEQ ID NO: 13118 - DNA, 15 bp, Homo sapiens
ccgggaaccatggct

SEQ ID NO: 13119 - DNA, 15 bp, Homo sapiens
gccgggaaccatggc

SEQ ID NO: 13120 - DNA, 15 bp, Homo sapiens
ggccgggaaccatgg

SEQ ID NO: 13121 - DNA, 15 bp, Homo sapiens
aggccgggaaccatg

SEQ ID NO: 13122 - DNA, 15 bp, Homo sapiens
gaggccgggaaccat

SEQ ID NO: 13123 - DNA, 15 bp, Homo sapiens
agaggccgggaacca

SEQ ID NO: 13124 - DNA, 15 bp, Homo sapiens
aagaggccgggaacc

SEQ ID NO: 13125 - DNA, 15 bp, Homo sapiens
caagaggccgggaac

SEQ ID NO: 13126 - DNA, 15 bp, Homo sapiens
acaagaggccgggaa

SEQ ID NO: 13127 - DNA, 15 bp, Homo sapiens
cacaagaggccggga

SEQ ID NO: 13128 - DNA, 15 bp, Homo sapiens
tcacaagaggccggg

SEQ ID NO: 13129 - DNA, 15 bp, Homo sapiens
atcacaagaggccgg

SEQ ID NO: 13130 - DNA, 15 bp, Homo sapiens
tatcacaagaggccg

SEQ ID NO: 13131 - DNA, 15 bp, Homo sapiens
atatcacaagaggcc

SEQ ID NO: 13132 - DNA, 15 bp, Homo sapiens
gatatcacaagaggc

SEQ ID NO: 13133 - DNA, 15 bp, Homo sapiens
ggatatcacaagagg

SEQ ID NO: 13134 - DNA, 15 bp, Homo sapiens
aggatatcacaagag

SEQ ID NO: 13135 - DNA, 15 bp, Homo sapiens
aaggatatcacaaga

SEQ ID NO: 13136 - DNA, 15 bp, Homo sapiens
taaggatatcacaag

SEQ ID NO: 13137 - DNA, 15 bp, Homo sapiens
ataaggatatcacaa

SEQ ID NO: 13138 - DNA, 15 bp, Homo sapiens
tataaggatatcaca

SEQ ID NO: 13139 - DNA, 15 bp, Homo sapiens
atataaggatatcac

SEQ ID NO: 13140 - DNA, 15 bp, Homo sapiens
aatataaggatatca

SEQ ID NO: 13141 - DNA, 15 bp, Homo sapiens
gaatataaggatatc

SEQ ID NO: 13142 - DNA, 15 bp, Homo sapiens
tgaatataaggatat

SEQ ID NO: 13143 - DNA, 15 bp, Homo sapiens
ctgaatataaggata

SEQ ID NO: 13144 - DNA, 15 bp, Homo sapiens
actgaatataaggat

SEQ ID NO: 13145 - DNA, 15 bp, Homo sapiens
aactgaatataagga

SEQ ID NO: 13146 - DNA, 15 bp, Homo sapiens
taactgaatataagg

SEQ ID NO: 13147 - DNA, 15 bp, Homo sapiens
ttaactgaatataag

SEQ ID NO: 13148 - DNA, 15 bp, Homo sapiens
gttaactgaatataa

SEQ ID NO: 13149 - DNA, 15 bp, Homo sapiens
ggttaactgaatata

SEQ ID NO: 13150 - DNA, 15 bp, Homo sapiens
tggttaactgaatat

SEQ ID NO: 13151 - DNA, 15 bp, Homo sapiens
ttggttaactgaata

SEQ ID NO: 13152 - DNA, 15 bp, Homo sapiens
tttggttaactgaat

SEQ ID NO: 13153 - DNA, 15 bp, Homo sapiens
gtttggttaactgaa

SEQ ID NO: 13154 - DNA, 15 bp, Homo sapiens
ggtttggttaactga

SEQ ID NO: 13155 - DNA, 15 bp, Homo sapiens
tggtttggttaactg

SEQ ID NO: 13156 - DNA, 15 bp, Homo sapiens
ttggtttggttaact

SEQ ID NO: 13157 - DNA, 15 bp, Homo sapiens
tttggtttggttaac

SEQ ID NO: 13158 - DNA, 15 bp, Homo sapiens
atttggtttggttaa

SEQ ID NO: 13159 - DNA, 15 bp, Homo sapiens
gatttggtttggtta

SEQ ID NO: 13160 - DNA, 15 bp, Homo sapiens
tgatttggtttggtt

SEQ ID NO: 13161 - DNA, 15 bp, Homo sapiens
ttgatttggtttggt

SEQ ID NO: 13162 - DNA, 15 bp, Homo sapiens
cttgatttggtttgg

SEQ ID NO: 13163 - DNA, 15 bp, Homo sapiens
acttgatttggtttg

SEQ ID NO: 13164 - DNA, 15 bp, Homo sapiens
gacttgatttggttt

SEQ ID NO: 13165 - DNA, 15 bp, Homo sapiens
tgacttgatttggtt

SEQ ID NO: 13166 - DNA, 15 bp, Homo sapiens
ttgacttgatttggt

SEQ ID NO: 13167 - DNA, 15 bp, Homo sapiens
tttgacttgatttgg

SEQ ID NO: 13168 - DNA, 15 bp, Homo sapiens
atttgacttgatttg

SEQ ID NO: 13169 - DNA, 15 bp, Homo sapiens
tatttgacttgattt

SEQ ID NO: 13170 - DNA, 15 bp, Homo sapiens
ttatttgacttgatt

SEQ ID NO: 13171 - DNA, 15 bp, Homo sapiens
gttatttgacttgat

SEQ ID NO: 13172 - DNA, 15 bp, Homo sapiens
tgttatttgacttga

SEQ ID NO: 13173 - DNA, 15 bp, Homo sapiens
ttgttatttgacttg

SEQ ID NO: 13174 - DNA, 15 bp, Homo sapiens
tttgttatttgactt

SEQ ID NO: 13175 - DNA, 15 bp, Homo sapiens
gtttgttatttgact

SEQ ID NO: 13176 - DNA, 15 bp, Homo sapiens
ggtttgttatttgac

SEQ ID NO: 13177 - DNA, 15 bp, Homo sapiens
gggtttgttatttga

SEQ ID NO: 13178 - DNA, 15 bp, Homo sapiens
ggggtttgttatttg

SEQ ID NO: 13179 - DNA, 15 bp, Homo sapiens
tggggtttgttattt

SEQ ID NO: 13180 - DNA, 15 bp, Homo sapiens
ttggggtttgttatt

SEQ ID NO: 13181 - DNA, 15 bp, Homo sapiens
tttggggtttgttat

SEQ ID NO: 13182 - DNA, 15 bp, Homo sapiens
gtttggggtttgtta

SEQ ID NO: 13183 - DNA, 15 bp, Homo sapiens
ggtttggggtttgtt

SEQ ID NO: 13184 - DNA, 15 bp, Homo sapiens
aggtttggggtttgt

SEQ ID NO: 13185 - DNA, 15 bp, Homo sapiens
aaggtttggggtttg

SEQ ID NO: 13186 - DNA, 15 bp, Homo sapiens
aaaggtttggggttt

SEQ ID NO: 13187 - DNA, 15 bp, Homo sapiens
aaaaggtttggggtt

SEQ ID NO: 13188 - DNA, 15 bp, Homo sapiens
taaaaggtttggggt

SEQ ID NO: 13189 - DNA, 15 bp, Homo sapiens
ataaaaggtttgggg

SEQ ID NO: 13190 - DNA, 15 bp, Homo sapiens
tataaaaggtttggg

SEQ ID NO: 13191 - DNA, 15 bp, Homo sapiens
ctataaaaggtttgg

SEQ ID NO: 13192 - DNA, 15 bp, Homo sapiens
tctataaaaggtttg

SEQ ID NO: 13193 - DNA, 15 bp, Homo sapiens
gtctataaaaggttt

SEQ ID NO: 13194 - DNA, 15 bp, Homo sapiens
ggtctataaaaggtt

SEQ ID NO: 13195 - DNA, 15 bp, Homo sapiens
aggtctataaaaggt

SEQ ID NO: 13196 - DNA, 15 bp, Homo sapiens
aaggtctataaaagg

SEQ ID NO: 13197 - DNA, 15 bp, Homo sapiens
caaggtctataaaag

SEQ ID NO: 13198 - DNA, 15 bp, Homo sapiens
tcaaggtctataaaa

SEQ ID NO: 13199 - DNA, 15 bp, Homo sapiens
ctcaaggtctataaa

SEQ ID NO: 13200 - DNA, 15 bp, Homo sapiens
actcaaggtctataa

SEQ ID NO: 13201 - DNA, 15 bp, Homo sapiens
aactcaaggtctata

SEQ ID NO: 13202 - DNA, 15 bp, Homo sapiens
taactcaaggtctat

SEQ ID NO: 13203 - DNA, 15 bp, Homo sapiens
ataactcaaggtcta

SEQ ID NO: 13204 - DNA, 15 bp, Homo sapiens
aataactcaaggtct

SEQ ID NO: 13205 - DNA, 15 bp, Homo sapiens
aaataactcaaggtc

SEQ ID NO: 13206 - DNA, 15 bp, Homo sapiens
caaataactcaaggt

SEQ ID NO: 13207 - DNA, 15 bp, Homo sapiens
gcaaataactcaagg

SEQ ID NO: 13208 - DNA, 15 bp, Homo sapiens
tgcaaataactcaag

SEQ ID NO: 13209 - DNA, 15 bp, Homo sapiens
ctgcaaataactcaa

SEQ ID NO: 13210 - DNA, 15 bp, Homo sapiens
tctgcaaataactca

SEQ ID NO: 13211 - DNA, 15 bp, Homo sapiens
atctgcaaataactc

SEQ ID NO: 13212 - DNA, 15 bp, Homo sapiens
gatctgcaaataact

SEQ ID NO: 13213 - DNA, 15 bp, Homo sapiens
agatctgcaaataac

SEQ ID NO: 13214 - DNA, 15 bp, Homo sapiens
aagatctgcaaataa

SEQ ID NO: 13215 - DNA, 15 bp, Homo sapiens
aaagatctgcaaata

SEQ ID NO: 13216 - DNA, 15 bp, Homo sapiens
caaagatctgcaaat

SEQ ID NO: 13217 - DNA, 15 bp, Homo sapiens
ccaaagatctgcaaa

SEQ ID NO: 13218 - DNA, 15 bp, Homo sapiens
cccaaagatctgcaa

SEQ ID NO: 13219 - DNA, 15 bp, Homo sapiens
ccccaaagatctgca

SEQ ID NO: 13220 - DNA, 15 bp, Homo sapiens
accccaaagatctgc

SEQ ID NO: 13221 - DNA, 15 bp, Homo sapiens
aaccccaaagatctg

SEQ ID NO: 13222 - DNA, 15 bp, Homo sapiens
taaccccaaagatct

SEQ ID NO: 13223 - DNA, 15 bp, Homo sapiens
ataaccccaaagatc

SEQ ID NO: 13224 - DNA, 15 bp, Homo sapiens
aataaccccaaagat

SEQ ID NO: 13225 - DNA, 15 bp, Homo sapiens
aaataaccccaaaga

SEQ ID NO: 13226 - DNA, 15 bp, Homo sapiens
taaataaccccaaag

SEQ ID NO: 13227 - DNA, 15 bp, Homo sapiens
gtaaataaccccaaa

SEQ ID NO: 13228 - DNA, 15 bp, Homo sapiens
ggtaaataaccccaa

SEQ ID NO: 13229 - DNA, 15 bp, Homo sapiens
aggtaaataacccca

SEQ ID NO: 13230 - DNA, 15 bp, Homo sapiens
caggtaaataacccc

SEQ ID NO: 13231 - DNA, 15 bp, Homo sapiens
acaggtaaataaccc

SEQ ID NO: 13232 - DNA, 15 bp, Homo sapiens
gacaggtaaataacc

SEQ ID NO: 13233 - DNA, 15 bp, Homo sapiens
agacaggtaaataac

SEQ ID NO: 13234 - DNA, 15 bp, Homo sapiens
aagacaggtaaataa

SEQ ID NO: 13235 - DNA, 15 bp, Homo sapiens
aaagacaggtaaata

SEQ ID NO: 13236 - DNA, 15 bp, Homo sapiens
aaaagacaggtaaat

SEQ ID NO: 13237 - DNA, 15 bp, Homo sapiens
caaaagacaggtaaa

SEQ ID NO: 13238 - DNA, 15 bp, Homo sapiens
tcaaaagacaggtaa

SEQ ID NO: 13239 - DNA, 15 bp, Homo sapiens
ctcaaaagacaggta

SEQ ID NO: 13240 - DNA, 15 bp, Homo sapiens
gctcaaaagacaggt

SEQ ID NO: 13241 - DNA, 15 bp, Homo sapiens
agctcaaaagacagg

SEQ ID NO: 13242 - DNA, 15 bp, Homo sapiens
aagctcaaaagacag

SEQ ID NO: 13243 - DNA, 15 bp, Homo sapiens
aaagctcaaaagaca

SEQ ID NO: 13244 - DNA, 15 bp, Homo sapiens
taaagctcaaaagac

SEQ ID NO: 13245 - DNA, 15 bp, Homo sapiens
ttaaagctcaaaaga

SEQ ID NO: 13246 - DNA, 15 bp, Homo sapiens
attaaagctcaaaag

SEQ ID NO: 13247 - DNA, 15 bp, Homo sapiens
gattaaagctcaaaa

SEQ ID NO: 13248 - DNA, 15 bp, Homo sapiens
agattaaagctcaaa

SEQ ID NO: 13249 - DNA, 15 bp, Homo sapiens
aagattaaagctcaa

SEQ ID NO: 13250 - DNA, 15 bp, Homo sapiens
aaagattaaagctca

SEQ ID NO: 13251 - DNA, 15 bp, Homo sapiens
aaaagattaaagctc

SEQ ID NO: 13252 - DNA, 15 bp, Homo sapiens
taaaagattaaagct

SEQ ID NO: 13253 - DNA, 15 bp, Homo sapiens
gtaaaagattaaagc

SEQ ID NO: 13254 - DNA, 15 bp, Homo sapiens
ggtaaaagattaaag

SEQ ID NO: 13255 - DNA, 15 bp, Homo sapiens
aggtaaaagattaaa

SEQ ID NO: 13256 - DNA, 15 bp, Homo sapiens
gaggtaaaagattaa

SEQ ID NO: 13257 - DNA, 15 bp, Homo sapiens
agaggtaaaagatta

SEQ ID NO: 13258 - DNA, 15 bp, Homo sapiens
aagaggtaaaagatt

SEQ ID NO: 13259 - DNA, 15 bp, Homo sapiens
aaagaggtaaaagat

SEQ ID NO: 13260 - DNA, 15 bp, Homo sapiens
caaagaggtaaaaga

SEQ ID NO: 13261 - DNA, 15 bp, Homo sapiens
tcaaagaggtaaaag

SEQ ID NO: 13262 - DNA, 15 bp, Homo sapiens
ttcaaagaggtaaaa

SEQ ID NO: 13263 - DNA, 15 bp, Homo sapiens
cttcaaagaggtaaa

SEQ ID NO: 13264 - DNA, 15 bp, Homo sapiens
tcttcaaagaggtaa

SEQ ID NO: 13265 - DNA, 15 bp, Homo sapiens
atcttcaaagaggta

SEQ ID NO: 13266 - DNA, 15 bp, Homo sapiens
tatcttcaaagaggt

SEQ ID NO: 13267 - DNA, 15 bp, Homo sapiens
gtatcttcaaagagg

SEQ ID NO: 13268 - DNA, 15 bp, Homo sapiens
tgtatcttcaaagag

SEQ ID NO: 13269 - DNA, 15 bp, Homo sapiens
ctgtatcttcaaaga

SEQ ID NO: 13270 - DNA, 15 bp, Homo sapiens
cctgtatcttcaaag

SEQ ID NO: 13271 - DNA, 15 bp, Homo sapiens
tcctgtatcttcaaa

SEQ ID NO: 13272 - DNA, 15 bp, Homo sapiens
ttcctgtatcttcaa

SEQ ID NO: 13273 - DNA, 15 bp, Homo sapiens
cttcctgtatcttca

SEQ ID NO: 13274 - DNA, 15 bp, Homo sapiens
ccttcctgtatcttc

SEQ ID NO: 13275 - DNA, 15 bp, Homo sapiens
cccttcctgtatctt

SEQ ID NO: 13276 - DNA, 15 bp, Homo sapiens
tcccttcctgtatct

SEQ ID NO: 13277 - DNA, 15 bp, Homo sapiens
atcccttcctgtatc

SEQ ID NO: 13278 - DNA, 15 bp, Homo sapiens
gatcccttcctgtat

SEQ ID NO: 13279 - DNA, 15 bp, Homo sapiens
agatcccttcctgta

SEQ ID NO: 13280 - DNA, 15 bp, Homo sapiens
aagatcccttcctgt

SEQ ID NO: 13281 - DNA, 15 bp, Homo sapiens
aaagatcccttcctg

SEQ ID NO: 13282 - DNA, 15 bp, Homo sapiens
taaagatcccttcct

SEQ ID NO: 13283 - DNA, 15 bp, Homo sapiens
ataaagatcccttcc

SEQ ID NO: 13284 - DNA, 15 bp, Homo sapiens
aataaagatcccttc

SEQ ID NO: 13285 - DNA, 15 bp, Homo sapiens
aaataaagatccctt

SEQ ID NO: 13286 - DNA, 15 bp, Homo sapiens
gaaataaagatccct

SEQ ID NO: 13287 - DNA, 15 bp, Homo sapiens
agaaataaagatccc

SEQ ID NO: 13288 - DNA, 15 bp, Homo sapiens
aagaaataaagatcc

SEQ ID NO: 13289 - DNA, 15 bp, Homo sapiens
gaagaaataaagatc

SEQ ID NO: 13290 - DNA, 15 bp, Homo sapiens
agaagaaataaagat

SEQ ID NO: 13291 - DNA, 15 bp, Homo sapiens
aagaagaaataaaga

SEQ ID NO: 13292 - DNA, 15 bp, Homo sapiens
aaagaagaaataaag

SEQ ID NO: 13293 - DNA, 15 bp, Homo sapiens
caaagaagaaataaa

SEQ ID NO: 13294 - DNA, 15 bp, Homo sapiens
tcaaagaagaaataa

SEQ ID NO: 13295 - DNA, 15 bp, Homo sapiens
atcaaagaagaaata

SEQ ID NO: 13296 - DNA, 15 bp, Homo sapiens
tatcaaagaagaaat

SEQ ID NO: 13297 - DNA, 15 bp, Homo sapiens
ttatcaaagaagaaa

SEQ ID NO: 13298 - DNA, 15 bp, Homo sapiens
tttatcaaagaagaa

SEQ ID NO: 13299 - DNA, 15 bp, Homo sapiens
ttttatcaaagaaga

SEQ ID NO: 13300 - DNA, 15 bp, Homo sapiens
attttatcaaagaag

SEQ ID NO: 13301 - DNA, 15 bp, Homo sapiens
tattttatcaaagaa

SEQ ID NO: 13302 - DNA, 15 bp, Homo sapiens
ttattttatcaaaga

SEQ ID NO: 13303 - DNA, 15 bp, Homo sapiens
gttattttatcaaag

SEQ ID NO: 13304 - DNA, 15 bp, Homo sapiens
ggttattttatcaaa

SEQ ID NO: 13305 - DNA, 15 bp, Homo sapiens
aggttattttatcaa

SEQ ID NO: 13306 - DNA, 15 bp, Homo sapiens
aaggttattttatca

SEQ ID NO: 13307 - DNA, 15 bp, Homo sapiens
gaaggttattttatc

SEQ ID NO: 13308 - DNA, 15 bp, Homo sapiens
tgaaggttattttat

SEQ ID NO: 13309 - DNA, 15 bp, Homo sapiens
ctgaaggttatttta

SEQ ID NO: 13310 - DNA, 15 bp, Homo sapiens
tctgaaggttatttt

SEQ ID NO: 13311 - DNA, 15 bp, Homo sapiens
ctctgaaggttattt

SEQ ID NO: 13312 - DNA, 15 bp, Homo sapiens
actctgaaggttatt

SEQ ID NO: 13313 - DNA, 15 bp, Homo sapiens
cactctgaaggttat

SEQ ID NO: 13314 - DNA, 15 bp, Homo sapiens
tcactctgaaggtta

SEQ ID NO: 13315 - DNA, 15 bp, Homo sapiens
gtcactctgaaggtt

SEQ ID NO: 13316 - DNA, 15 bp, Homo sapiens
agtcactctgaaggt

SEQ ID NO: 13317 - DNA, 15 bp, Homo sapiens
aagtcactctgaagg

SEQ ID NO: 13318 - DNA, 15 bp, Homo sapiens
caagtcactctgaag

SEQ ID NO: 13319 - DNA, 15 bp, Homo sapiens
tcaagtcactctgaa

SEQ ID NO: 13320 - DNA, 15 bp, Homo sapiens
ctcaagtcactctga

SEQ ID NO: 13321 - DNA, 15 bp, Homo sapiens
tctcaagtcactctg

SEQ ID NO: 13322 - DNA, 15 bp, Homo sapiens
atctcaagtcactct

SEQ ID NO: 13323 - DNA, 15 bp, Homo sapiens
tatctcaagtcactc

SEQ ID NO: 13324 - DNA, 15 bp, Homo sapiens
gtatctcaagtcact

SEQ ID NO: 13325 - DNA, 15 bp, Homo sapiens
cgtatctcaagtcac

SEQ ID NO: 13326 - DNA, 15 bp, Homo sapiens
ccgtatctcaagtca

SEQ ID NO: 13327 - DNA, 15 bp, Homo sapiens
tccgtatctcaagtc

SEQ ID NO: 13328 - DNA, 15 bp, Homo sapiens
ttccgtatctcaagt

SEQ ID NO: 13329 - DNA, 15 bp, Homo sapiens
attccgtatctcaag

SEQ ID NO: 13330 - DNA, 15 bp, Homo sapiens
aattccgtatctcaa

SEQ ID NO: 13331 - DNA, 15 bp, Homo sapiens
caattccgtatctca

SEQ ID NO: 13332 - DNA, 15 bp, Homo sapiens
gcaattccgtatctc

SEQ ID NO: 13333 - DNA, 15 bp, Homo sapiens
agcaattccgtatct

SEQ ID NO: 13334 - DNA, 15 bp, Homo sapiens
aagcaattccgtatc

SEQ ID NO: 13335 - DNA, 15 bp, Homo sapiens
gaagcaattccgtat

SEQ ID NO: 13336 - DNA, 15 bp, Homo sapiens
agaagcaattccgta

SEQ ID NO: 13337 - DNA, 15 bp, Homo sapiens
aagaagcaattccgt

SEQ ID NO: 13338 - DNA, 15 bp, Homo sapiens
aaagaagcaattccg

SEQ ID NO: 13339 - DNA, 15 bp, Homo sapiens
caaagaagcaattcc

SEQ ID NO: 13340 - DNA, 15 bp, Homo sapiens
acaaagaagcaattc

SEQ ID NO: 13341 - DNA, 15 bp, Homo sapiens
tacaaagaagcaatt

SEQ ID NO: 13342 - DNA, 15 bp, Homo sapiens
atacaaagaagcaat

SEQ ID NO: 13343 - DNA, 15 bp, Homo sapiens
tatacaaagaagcaa

SEQ ID NO: 13344 - DNA, 15 bp, Homo sapiens
atatacaaagaagca

SEQ ID NO: 13345 - DNA, 15 bp, Homo sapiens
gatatacaaagaagc

SEQ ID NO: 13346 - DNA, 15 bp, Homo sapiens
tgatatacaaagaag

SEQ ID NO: 13347 - DNA, 15 bp, Homo sapiens
atgatatacaaagaa

SEQ ID NO: 13348 - DNA, 15 bp, Homo sapiens
aatgatatacaaaga

SEQ ID NO: 13349 - DNA, 15 bp, Homo sapiens
caatgatatacaaag

SEQ ID NO: 13350 - DNA, 15 bp, Homo sapiens
acaatgatatacaaa

SEQ ID NO: 13351 - DNA, 15 bp, Homo sapiens
cacaatgatatacaa

SEQ ID NO: 13352 - DNA, 15 bp, Homo sapiens
acacaatgatataca

SEQ ID NO: 13353 - DNA, 15 bp, Homo sapiens
cacacaatgatatac

SEQ ID NO: 13354 - DNA, 15 bp, Homo sapiens
ccacacaatgatata

SEQ ID NO: 13355 - DNA, 15 bp, Homo sapiens
accacacaatgatat

SEQ ID NO: 13356 - DNA, 15 bp, Homo sapiens
taccacacaatgata

SEQ ID NO: 13357 - DNA, 15 bp, Homo sapiens
ataccacacaatgat

SEQ ID NO: 13358 - DNA, 15 bp, Homo sapiens
aataccacacaatga

SEQ ID NO: 13359 - DNA, 15 bp, Homo sapiens
aaataccacacaatg

SEQ ID NO: 13360 - DNA, 15 bp, Homo sapiens
caaataccacacaat

SEQ ID NO: 13361 - DNA, 15 bp, Homo sapiens
tcaaataccacacaa

SEQ ID NO: 13362 - DNA, 15 bp, Homo sapiens
ctcaaataccacaca

SEQ ID NO: 13363 - DNA, 15 bp, Homo sapiens
tctcaaataccacac

SEQ ID NO: 13364 - DNA, 15 bp, Homo sapiens
atctcaaataccaca

SEQ ID NO: 13365 - DNA, 15 bp, Homo sapiens
gatctcaaataccac

SEQ ID NO: 13366 - DNA, 15 bp, Homo sapiens
tgatctcaaatacca

SEQ ID NO: 13367 - DNA, 15 bp, Homo sapiens
gtgatctcaaatacc

SEQ ID NO: 13368 - DNA, 15 bp, Homo sapiens
tgtgatctcaaatac

SEQ ID NO: 13369 - DNA, 15 bp, Homo sapiens
atgtgatctcaaata

SEQ ID NO: 13370 - DNA, 15 bp, Homo sapiens
gatgtgatctcaaat

SEQ ID NO: 13371 - DNA, 15 bp, Homo sapiens
agatgtgatctcaaa

SEQ ID NO: 13372 - DNA, 15 bp, Homo sapiens
gagatgtgatctcaa

SEQ ID NO: 13373 - DNA, 15 bp, Homo sapiens
tgagatgtgatctca

SEQ ID NO: 13374 - DNA, 15 bp, Homo sapiens
ttgagatgtgatctc

SEQ ID NO: 13375 - DNA, 15 bp, Homo sapiens
tttgagatgtgatct

SEQ ID NO: 13376 - DNA, 15 bp, Homo sapiens
ttttgagatgtgatc

SEQ ID NO: 13377 - DNA, 15 bp, Homo sapiens
attttgagatgtgat

SEQ ID NO: 13378 - DNA, 15 bp, Homo sapiens
aattttgagatgtga

SEQ ID NO: 13379 - DNA, 15 bp, Homo sapiens
aaattttgagatgtg

SEQ ID NO: 13380 - DNA, 15 bp, Homo sapiens
taaattttgagatgt

SEQ ID NO: 13381 - DNA, 15 bp, Homo sapiens
ttaaattttgagatg

SEQ ID NO: 13382 - DNA, 15 bp, Homo sapiens
attaaattttgagat

SEQ ID NO: 13383 - DNA, 15 bp, Homo sapiens
cattaaattttgaga

SEQ ID NO: 13384 - DNA, 15 bp, Homo sapiens
tcattaaattttgag

SEQ ID NO: 13385 - DNA, 15 bp, Homo sapiens
ctcattaaattttga

SEQ ID NO: 13386 - DNA, 15 bp, Homo sapiens
tctcattaaattttg

SEQ ID NO: 13387 - DNA, 15 bp, Homo sapiens
gtctcattaaatttt

SEQ ID NO: 13388 - DNA, 15 bp, Homo sapiens
ggtctcattaaattt

SEQ ID NO: 13389 - DNA, 15 bp, Homo sapiens
aggtctcattaaatt

SEQ ID NO: 13390 - DNA, 15 bp, Homo sapiens
caggtctcattaaat

SEQ ID NO: 13391 - DNA, 15 bp, Homo sapiens
gcaggtctcattaaa

SEQ ID NO: 13392 - DNA, 15 bp, Homo sapiens
agcaggtctcattaa

SEQ ID NO: 13393 - DNA, 15 bp, Homo sapiens
gagcaggtctcatta

SEQ ID NO: 13394 - DNA, 15 bp, Homo sapiens
ggagcaggtctcatt

SEQ ID NO: 13395 - DNA, 15 bp, Homo sapiens
aggagcaggtctcat

SEQ ID NO: 13396 - DNA, 15 bp, Homo sapiens
gaggagcaggtctca

SEQ ID NO: 13397 - DNA, 15 bp, Homo sapiens
tgaggagcaggtctc

SEQ ID NO: 13398 - DNA, 15 bp, Homo sapiens
ctgaggagcaggtct

SEQ ID NO: 13399 - DNA, 15 bp, Homo sapiens
cctgaggagcaggtc

SEQ ID NO: 13400 - DNA, 15 bp, Homo sapiens
gcctgaggagcaggt

SEQ ID NO: 13401 - DNA, 15 bp, Homo sapiens
tgcctgaggagcagg

SEQ ID NO: 13402 - DNA, 15 bp, Homo sapiens
ctgcctgaggagcag

SEQ ID NO: 13403 - DNA, 15 bp, Homo sapiens
actgcctgaggagca

SEQ ID NO: 13404 - DNA, 15 bp, Homo sapiens
aactgcctgaggagc

SEQ ID NO: 13405 - DNA, 15 bp, Homo sapiens
aaactgcctgaggag

SEQ ID NO: 13406 - DNA, 15 bp, Homo sapiens
aaaactgcctgagga

SEQ ID NO: 13407 - DNA, 15 bp, Homo sapiens
taaaactgcctgagg

SEQ ID NO: 13408 - DNA, 15 bp, Homo sapiens
ttaaaactgcctgag

SEQ ID NO: 13409 - DNA, 15 bp, Homo sapiens
cttaaaactgcctga

SEQ ID NO: 13410 - DNA, 15 bp, Homo sapiens
tcttaaaactgcctg

SEQ ID NO: 13411 - DNA, 15 bp, Homo sapiens
atcttaaaactgcct

SEQ ID NO: 13412 - DNA, 15 bp, Homo sapiens
aatcttaaaactgcc

SEQ ID NO: 13413 - DNA, 15 bp, Homo sapiens
taatcttaaaactgc

SEQ ID NO: 13414 - DNA, 15 bp, Homo sapiens
ttaatcttaaaactg

SEQ ID NO: 13415 - DNA, 15 bp, Homo sapiens
cttaatcttaaaact

SEQ ID NO: 13416 - DNA, 15 bp, Homo sapiens
ccttaatcttaaaac

SEQ ID NO: 13417 - DNA, 15 bp, Homo sapiens
tccttaatcttaaaa

SEQ ID NO: 13418 - DNA, 15 bp, Homo sapiens
atccttaatcttaaa

SEQ ID NO: 13419 - DNA, 15 bp, Homo sapiens
gatccttaatcttaa

SEQ ID NO: 13420 - DNA, 15 bp, Homo sapiens
tgatccttaatctta

SEQ ID NO: 13421 - DNA, 15 bp, Homo sapiens
ttgatccttaatctt

SEQ ID NO: 13422 - DNA, 15 bp, Homo sapiens
tttgatccttaatct

SEQ ID NO: 13423 - DNA, 15 bp, Homo sapiens
ttttgatccttaatc

SEQ ID NO: 13424 - DNA, 15 bp, Homo sapiens
tttttgatccttaat

SEQ ID NO: 13425 - DNA, 15 bp, Homo sapiens
ctttttgatccttaa

SEQ ID NO: 13426 - DNA, 15 bp, Homo sapiens
cctttttgatcctta

SEQ ID NO: 13427 - DNA, 15 bp, Homo sapiens
ccctttttgatcctt

SEQ ID NO: 13428 - DNA, 15 bp, Homo sapiens
tccctttttgatcct

SEQ ID NO: 13429 - DNA, 15 bp, Homo sapiens
ctccctttttgatcc

SEQ ID NO: 13430 - DNA, 15 bp, Homo sapiens
gctccctttttgatc

SEQ ID NO: 13431 - DNA, 15 bp, Homo sapiens
ggctccctttttgat

SEQ ID NO: 13432 - DNA, 15 bp, Homo sapiens
tggctccctttttga

SEQ ID NO: 13433 - DNA, 15 bp, Homo sapiens
gtggctccctttttg

SEQ ID NO: 13434 - DNA, 15 bp, Homo sapiens
agtggctcccttttt

SEQ ID NO: 13435 - DNA, 15 bp, Homo sapiens
cagtggctccctttt

SEQ ID NO: 13436 - DNA, 15 bp, Homo sapiens
ccagtggctcccttt

SEQ ID NO: 13437 - DNA, 15 bp, Homo sapiens
tccagtggctccctt

SEQ ID NO: 13438 - DNA, 15 bp, Homo sapiens
ttccagtggctccct

SEQ ID NO: 13439 - DNA, 15 bp, Homo sapiens
tttccagtggctccc

SEQ ID NO: 13440 - DNA, 15 bp, Homo sapiens
ctttccagtggctcc

SEQ ID NO: 13441 - DNA, 15 bp, Homo sapiens
cctttccagtggctc

SEQ ID NO: 13442 - DNA, 15 bp, Homo sapiens
acctttccagtggct

SEQ ID NO: 13443 - DNA, 15 bp, Homo sapiens
cacctttccagtggc

SEQ ID NO: 13444 - DNA, 15 bp, Homo sapiens
acacctttccagtgg

SEQ ID NO: 13445 - DNA, 15 bp, Homo sapiens
cacacctttccagtg

SEQ ID NO: 13446 - DNA, 15 bp, Homo sapiens
tcacacctttccagt

SEQ ID NO: 13447 - DNA, 15 bp, Homo sapiens
ctcacacctttccag

SEQ ID NO: 13448 - DNA, 15 bp, Homo sapiens
actcacacctttcca

SEQ ID NO: 13449 - DNA, 15 bp, Homo sapiens
cactcacacctttcc

SEQ ID NO: 13450 - DNA, 15 bp, Homo sapiens
ccactcacacctttc

SEQ ID NO: 13451 - DNA, 15 bp, Homo sapiens
gccactcacaccttt

SEQ ID NO: 13452 - DNA, 15 bp, Homo sapiens
agccactcacacctt

SEQ ID NO: 13453 - DNA, 15 bp, Homo sapiens
cagccactcacacct

SEQ ID NO: 13454 - DNA, 15 bp, Homo sapiens
ccagccactcacacc

SEQ ID NO: 13455 - DNA, 15 bp, Homo sapiens
accagccactcacac

SEQ ID NO: 13456 - DNA, 15 bp, Homo sapiens
taccagccactcaca

SEQ ID NO: 13457 - DNA, 15 bp, Homo sapiens
ttaccagccactcac

SEQ ID NO: 13458 - DNA, 15 bp, Homo sapiens
attaccagccactca

SEQ ID NO: 13459 - DNA, 15 bp, Homo sapiens
gattaccagccactc

SEQ ID NO: 13460 - DNA, 15 bp, Homo sapiens
agattaccagccact

SEQ ID NO: 13461 - DNA, 15 bp, Homo sapiens
tagattaccagccac

SEQ ID NO: 13462 - DNA, 15 bp, Homo sapiens
atagattaccagcca

SEQ ID NO: 13463 - DNA, 15 bp, Homo sapiens
catagattaccagcc

SEQ ID NO: 13464 - DNA, 15 bp, Homo sapiens
acatagattaccagc

SEQ ID NO: 13465 - DNA, 15 bp, Homo sapiens
aacatagattaccag

SEQ ID NO: 13466 - DNA, 15 bp, Homo sapiens
taacatagattacca

SEQ ID NO: 13467 - DNA, 15 bp, Homo sapiens
ctaacatagattacc

SEQ ID NO: 13468 - DNA, 15 bp, Homo sapiens
tctaacatagattac

SEQ ID NO: 13469 - DNA, 15 bp, Homo sapiens
ttctaacatagatta

SEQ ID NO: 13470 - DNA, 15 bp, Homo sapiens
gttctaacatagatt

SEQ ID NO: 13471 - DNA, 15 bp, Homo sapiens
tgttctaacatagat

SEQ ID NO: 13472 - DNA, 15 bp, Homo sapiens
ctgttctaacataga

SEQ ID NO: 13473 - DNA, 15 bp, Homo sapiens
tctgttctaacatag

SEQ ID NO: 13474 - DNA, 15 bp, Homo sapiens
ctctgttctaacata

SEQ ID NO: 13475 - DNA, 15 bp, Homo sapiens
tctctgttctaacat

SEQ ID NO: 13476 - DNA, 15 bp, Homo sapiens
gtctctgttctaaca

SEQ ID NO: 13477 - DNA, 15 bp, Homo sapiens
agtctctgttctaac

SEQ ID NO: 13478 - DNA, 15 bp, Homo sapiens
aagtctctgttctaa

SEQ ID NO: 13479 - DNA, 15 bp, Homo sapiens
aaagtctctgttcta

SEQ ID NO: 13480 - DNA, 15 bp, Homo sapiens
caaagtctctgttct

SEQ ID NO: 13481 - DNA, 15 bp, Homo sapiens
ccaaagtctctgttc

SEQ ID NO: 13482 - DNA, 15 bp, Homo sapiens
accaaagtctctgtt

SEQ ID NO: 13483 - DNA, 15 bp, Homo sapiens
caccaaagtctctgt

SEQ ID NO: 13484 - DNA, 15 bp, Homo sapiens
gcaccaaagtctctg

SEQ ID NO: 13485 - DNA, 15 bp, Homo sapiens
tgcaccaaagtctct

SEQ ID NO: 13486 - DNA, 15 bp, Homo sapiens
ctgcaccaaagtctc

SEQ ID NO: 13487 - DNA, 15 bp, Homo sapiens
tctgcaccaaagtct

SEQ ID NO: 13488 - DNA, 15 bp, Homo sapiens
ctctgcaccaaagtc

SEQ ID NO: 13489 - DNA, 15 bp, Homo sapiens
cctctgcaccaaagt

SEQ ID NO: 13490 - DNA, 15 bp, Homo sapiens
acctctgcaccaaag

SEQ ID NO: 13491 - DNA, 15 bp, Homo sapiens
aacctctgcaccaaa

SEQ ID NO: 13492 - DNA, 15 bp, Homo sapiens
caacctctgcaccaa

SEQ ID NO: 13493 - DNA, 15 bp, Homo sapiens
ccaacctctgcacca

SEQ ID NO: 13494 - DNA, 15 bp, Homo sapiens
gccaacctctgcacc

SEQ ID NO: 13495 - DNA, 15 bp, Homo sapiens
ggccaacctctgcac

SEQ ID NO: 13496 - DNA, 15 bp, Homo sapiens
tggccaacctctgca

SEQ ID NO: 13497 - DNA, 15 bp, Homo sapiens
atggccaacctctgc

SEQ ID NO: 13498 - DNA, 15 bp, Homo sapiens
catggccaacctctg

SEQ ID NO: 13499 - DNA, 15 bp, Homo sapiens
acatggccaacctct

SEQ ID NO: 13500 - DNA, 15 bp, Homo sapiens
aacatggccaacctc

SEQ ID NO: 13501 - DNA, 15 bp, Homo sapiens
gaacatggccaacct

SEQ ID NO: 13502 - DNA, 15 bp, Homo sapiens
tgaacatggccaacc

SEQ ID NO: 13503 - DNA, 15 bp, Homo sapiens
atgaacatggccaac

SEQ ID NO: 13504 - DNA, 15 bp, Homo sapiens
tatgaacatggccaa

SEQ ID NO: 13505 - DNA, 15 bp, Homo sapiens
atatgaacatggcca

SEQ ID NO: 13506 - DNA, 15 bp, Homo sapiens
catatgaacatggcc

SEQ ID NO: 13507 - DNA, 15 bp, Homo sapiens
acatatgaacatggc

SEQ ID NO: 13508 - DNA, 15 bp, Homo sapiens
cacatatgaacatgg

SEQ ID NO: 13509 - DNA, 15 bp, Homo sapiens
ccacatatgaacatg

SEQ ID NO: 13510 - DNA, 15 bp, Homo sapiens
tccacatatgaacat

SEQ ID NO: 13511 - DNA, 15 bp, Homo sapiens
ctccacatatgaaca

SEQ ID NO: 13512 - DNA, 15 bp, Homo sapiens
actccacatatgaac

SEQ ID NO: 13513 - DNA, 15 bp, Homo sapiens
tactccacatatgaa

SEQ ID NO: 13514 - DNA, 15 bp, Homo sapiens
ttactccacatatga

SEQ ID NO: 13515 - DNA, 15 bp, Homo sapiens
cttactccacatatg

SEQ ID NO: 13516 - DNA, 15 bp, Homo sapiens
acttactccacatat

SEQ ID NO: 13517 - DNA, 15 bp, Homo sapiens
aacttactccacata

SEQ ID NO: 13518 - DNA, 15 bp, Homo sapiens
aaacttactccacat

SEQ ID NO: 13519 - DNA, 15 bp, Homo sapiens
aaaacttactccaca

SEQ ID NO: 13520 - DNA, 15 bp, Homo sapiens
gaaaacttactccac

SEQ ID NO: 13521 - DNA, 15 bp, Homo sapiens
tgaaaacttactcca

SEQ ID NO: 13522 - DNA, 15 bp, Homo sapiens
atgaaaacttactcc

SEQ ID NO: 13523 - DNA, 15 bp, Homo sapiens
catgaaaacttactc

SEQ ID NO: 13524 - DNA, 15 bp, Homo sapiens
tcatgaaaacttact

SEQ ID NO: 13525 - DNA, 15 bp, Homo sapiens
ttcatgaaaacttac

SEQ ID NO: 13526 - DNA, 15 bp, Homo sapiens
tttcatgaaaactta

SEQ ID NO: 13527 - DNA, 15 bp, Homo sapiens
gtttcatgaaaactt

SEQ ID NO: 13528 - DNA, 15 bp, Homo sapiens
tgtttcatgaaaact

SEQ ID NO: 13529 - DNA, 15 bp, Homo sapiens
ctgtttcatgaaaac

SEQ ID NO: 13530 - DNA, 15 bp, Homo sapiens
cctgtttcatgaaaa

SEQ ID NO: 13531 - DNA, 15 bp, Homo sapiens
tcctgtttcatgaaa

SEQ ID NO: 13532 - DNA, 15 bp, Homo sapiens
ctcctgtttcatgaa

SEQ ID NO: 13533 - DNA, 15 bp, Homo sapiens
cctcctgtttcatga

SEQ ID NO: 13534 - DNA, 15 bp, Homo sapiens
tcctcctgtttcatg

SEQ ID NO: 13535 - DNA, 15 bp, Homo sapiens
ttcctcctgtttcat

SEQ ID NO: 13536 - DNA, 15 bp, Homo sapiens
cttcctcctgtttca

SEQ ID NO: 13537 - DNA, 15 bp, Homo sapiens
gcttcctcctgtttc

SEQ ID NO: 13538 - DNA, 15 bp, Homo sapiens
ggcttcctcctgttt

SEQ ID NO: 13539 - DNA, 15 bp, Homo sapiens
aggcttcctcctgtt

SEQ ID NO: 13540 - DNA, 15 bp, Homo sapiens
aaggcttcctcctgt

SEQ ID NO: 13541 - DNA, 15 bp, Homo sapiens
aaaggcttcctcctg

SEQ ID NO: 13542 - DNA, 15 bp, Homo sapiens
aaaaggcttcctcct

SEQ ID NO: 13543 - DNA, 15 bp, Homo sapiens
gaaaaggcttcctcc

SEQ ID NO: 13544 - DNA, 15 bp, Homo sapiens
agaaaaggcttcctc

SEQ ID NO: 13545 - DNA, 15 bp, Homo sapiens
aagaaaaggcttcct

SEQ ID NO: 13546 - DNA, 15 bp, Homo sapiens
taagaaaaggcttcc

SEQ ID NO: 13547 - DNA, 15 bp, Homo sapiens
ataagaaaaggcttc

SEQ ID NO: 13548 - DNA, 15 bp, Homo sapiens
aataagaaaaggctt

SEQ ID NO: 13549 - DNA, 15 bp, Homo sapiens
aaataagaaaaggct

SEQ ID NO: 13550 - DNA, 15 bp, Homo sapiens
caaataagaaaaggc

SEQ ID NO: 13551 - DNA, 15 bp, Homo sapiens
tcaaataagaaaagg

SEQ ID NO: 13552 - DNA, 15 bp, Homo sapiens
ttcaaataagaaaag

SEQ ID NO: 13553 - DNA, 15 bp, Homo sapiens
tttcaaataagaaaa

SEQ ID NO: 13554 - DNA, 15 bp, Homo sapiens
gtttcaaataagaaa

SEQ ID NO: 13555 - DNA, 15 bp, Homo sapiens
agtttcaaataagaa

SEQ ID NO: 13556 - DNA, 15 bp, Homo sapiens
tagtttcaaataaga

SEQ ID NO: 13557 - DNA, 15 bp, Homo sapiens
ttagtttcaaataag

SEQ ID NO: 13558 - DNA, 15 bp, Homo sapiens
cttagtttcaaataa

SEQ ID NO: 13559 - DNA, 15 bp, Homo sapiens
tcttagtttcaaata

SEQ ID NO: 13560 - DNA, 15 bp, Homo sapiens
ttcttagtttcaaat

SEQ ID NO: 13561 - DNA, 15 bp, Homo sapiens
tttcttagtttcaaa

SEQ ID NO: 13562 - DNA, 15 bp, Homo sapiens
gtttcttagtttcaa

SEQ ID NO: 13563 - DNA, 15 bp, Homo sapiens
agtttcttagtttca

SEQ ID NO: 13564 - DNA, 15 bp, Homo sapiens
cagtttcttagtttc

SEQ ID NO: 13565 - DNA, 15 bp, Homo sapiens
gcagtttcttagttt

SEQ ID NO: 13566 - DNA, 15 bp, Homo sapiens
tgcagtttcttagtt

SEQ ID NO: 13567 - DNA, 15 bp, Homo sapiens
ttgcagtttcttagt

SEQ ID NO: 13568 - DNA, 15 bp, Homo sapiens
tttgcagtttcttag

SEQ ID NO: 13569 - DNA, 15 bp, Homo sapiens
ttttgcagtttctta

SEQ ID NO: 13570 - DNA, 15 bp, Homo sapiens
attttgcagtttctt

SEQ ID NO: 13571 - DNA, 15 bp, Homo sapiens
tattttgcagtttct

SEQ ID NO: 13572 - DNA, 15 bp, Homo sapiens
ttattttgcagtttc

SEQ ID NO: 13573 - DNA, 15 bp, Homo sapiens
tttattttgcagttt

SEQ ID NO: 13574 - DNA, 15 bp, Homo sapiens
ttttattttgcagtt

SEQ ID NO: 13575 - DNA, 15 bp, Homo sapiens
cttttattttgcagt

SEQ ID NO: 13576 - DNA, 15 bp, Homo sapiens
acttttattttgcag

SEQ ID NO: 13577 - DNA, 15 bp, Homo sapiens
tacttttattttgca

SEQ ID NO: 13578 - DNA, 15 bp, Homo sapiens
ttacttttattttgc

SEQ ID NO: 13579 - DNA, 15 bp, Homo sapiens
attacttttattttg

SEQ ID NO: 13580 - DNA, 15 bp, Homo sapiens
tattacttttatttt

SEQ ID NO: 13581 - DNA, 15 bp, Homo sapiens
ttattacttttattt

SEQ ID NO: 13582 - DNA, 15 bp, Homo sapiens
tttattacttttatt

SEQ ID NO: 13583 - DNA, 15 bp, Homo sapiens
ttttattacttttat

SEQ ID NO: 13584 - DNA, 15 bp, Homo sapiens
attttattactttta

SEQ ID NO: 13585 - DNA, 15 bp, Homo sapiens
tattttattactttt

SEQ ID NO: 13586 - DNA, 15 bp, Homo sapiens
gtattttattacttt

SEQ ID NO: 13587 - DNA, 15 bp, Homo sapiens
ggtattttattactt

SEQ ID NO: 13588 - DNA, 15 bp, Homo sapiens
gggtattttattact

SEQ ID NO: 13589 - DNA, 15 bp, Homo sapiens
ggggtattttattac

SEQ ID NO: 13590 - DNA, 15 bp, Homo sapiens
cggggtattttatta

SEQ ID NO: 13591 - DNA, 15 bp, Homo sapiens
tcggggtattttatt

SEQ ID NO: 13592 - DNA, 15 bp, Homo sapiens
ttcggggtattttat

SEQ ID NO: 13593 - DNA, 15 bp, Homo sapiens
cttcggggtatttta

SEQ ID NO: 13594 - DNA, 15 bp, Homo sapiens
gcttcggggtatttt

SEQ ID NO: 13595 - DNA, 15 bp, Homo sapiens
tgcttcggggtattt

SEQ ID NO: 13596 - DNA, 15 bp, Homo sapiens
ttgcttcggggtatt

SEQ ID NO: 13597 - DNA, 15 bp, Homo sapiens
tttgcttcggggtat

SEQ ID NO: 13598 - DNA, 15 bp, Homo sapiens
atttgcttcggggta

SEQ ID NO: 13599 - DNA, 15 bp, Homo sapiens
tatttgcttcggggt

SEQ ID NO: 13600 - DNA, 15 bp, Homo sapiens
ctatttgcttcgggg

SEQ ID NO: 13601 - DNA, 15 bp, Homo sapiens
tctatttgcttcggg

SEQ ID NO: 13602 - DNA, 15 bp, Homo sapiens
gtctatttgcttcgg

SEQ ID NO: 13603 - DNA, 15 bp, Homo sapiens
agtctatttgcttcg

SEQ ID NO: 13604 - DNA, 15 bp, Homo sapiens
aagtctatttgcttc

SEQ ID NO: 13605 - DNA, 15 bp, Homo sapiens
aaagtctatttgctt

SEQ ID NO: 13606 - DNA, 15 bp, Homo sapiens
taaagtctatttgct

SEQ ID NO: 13607 - DNA, 15 bp, Homo sapiens
ttaaagtctatttgc

SEQ ID NO: 13608 - DNA, 15 bp, Homo sapiens
tttaaagtctatttg

SEQ ID NO: 13609 - DNA, 15 bp, Homo sapiens
ttttaaagtctattt

SEQ ID NO: 13610 - DNA, 15 bp, Homo sapiens
gttttaaagtctatt

SEQ ID NO: 13611 - DNA, 15 bp, Homo sapiens
tgttttaaagtctat

SEQ ID NO: 13612 - DNA, 15 bp, Homo sapiens
ttgttttaaagtcta

SEQ ID NO: 13613 - DNA, 15 bp, Homo sapiens
gttgttttaaagtct

SEQ ID NO: 13614 - DNA, 15 bp, Homo sapiens
tgttgttttaaagtc

SEQ ID NO: 13615 - DNA, 15 bp, Homo sapiens
atgttgttttaaagt

SEQ ID NO: 13616 - DNA, 15 bp, Homo sapiens
aatgttgttttaaag

SEQ ID NO: 13617 - DNA, 15 bp, Homo sapiens
aaatgttgttttaaa

SEQ ID NO: 13618 - DNA, 15 bp, Homo sapiens
caaatgttgttttaa

SEQ ID NO: 13619 - DNA, 15 bp, Homo sapiens
ccaaatgttgtttta

SEQ ID NO: 13620 - DNA, 15 bp, Homo sapiens
accaaatgttgtttt

SEQ ID NO: 13621 - DNA, 15 bp, Homo sapiens
gaccaaatgttgttt

SEQ ID NO: 13622 - DNA, 15 bp, Homo sapiens
ggaccaaatgttgtt

SEQ ID NO: 13623 - DNA, 15 bp, Homo sapiens
aggaccaaatgttgt

SEQ ID NO: 13624 - DNA, 15 bp, Homo sapiens
taggaccaaatgttg

SEQ ID NO: 13625 - DNA, 15 bp, Homo sapiens
ttaggaccaaatgtt

SEQ ID NO: 13626 - DNA, 15 bp, Homo sapiens
cttaggaccaaatgt

SEQ ID NO: 13627 - DNA, 15 bp, Homo sapiens
acttaggaccaaatg

SEQ ID NO: 13628 - DNA, 15 bp, Homo sapiens
aacttaggaccaaat

SEQ ID NO: 13629 - DNA, 15 bp, Homo sapiens
caacttaggaccaaa

SEQ ID NO: 13630 - DNA, 15 bp, Homo sapiens
acaacttaggaccaa

SEQ ID NO: 13631 - DNA, 15 bp, Homo sapiens
tacaacttaggacca

SEQ ID NO: 13632 - DNA, 15 bp, Homo sapiens
atacaacttaggacc

SEQ ID NO: 13633 - DNA, 15 bp, Homo sapiens
tatacaacttaggac

SEQ ID NO: 13634 - DNA, 15 bp, Homo sapiens
atatacaacttagga

SEQ ID NO: 13635 - DNA, 15 bp, Homo sapiens
catatacaacttagg

SEQ ID NO: 13636 - DNA, 15 bp, Homo sapiens
tcatatacaacttag

SEQ ID NO: 13637 - DNA, 15 bp, Homo sapiens
gtcatatacaactta

SEQ ID NO: 13638 - DNA, 15 bp, Homo sapiens
ggtcatatacaactt

SEQ ID NO: 13639 - DNA, 15 bp, Homo sapiens
tggtcatatacaact

SEQ ID NO: 13640 - DNA, 15 bp, Homo sapiens
ttggtcatatacaac

SEQ ID NO: 13641 - DNA, 15 bp, Homo sapiens
attggtcatatacaa

SEQ ID NO: 13642 - DNA, 15 bp, Homo sapiens
aattggtcatataca

SEQ ID NO: 13643 - DNA, 15 bp, Homo sapiens
aaattggtcatatac

SEQ ID NO: 13644 - DNA, 15 bp, Homo sapiens
gaaattggtcatata

SEQ ID NO: 13645 - DNA, 15 bp, Homo sapiens
agaaattggtcatat

SEQ ID NO: 13646 - DNA, 15 bp, Homo sapiens
aagaaattggtcata

SEQ ID NO: 13647 - DNA, 15 bp, Homo sapiens
taagaaattggtcat

SEQ ID NO: 13648 - DNA, 15 bp, Homo sapiens
ctttaagaaattggt

SEQ ID NO: 13649 - DNA, 15 bp, Homo sapiens
actttaagaaattgg

SEQ ID NO: 13650 - DNA, 15 bp, Homo sapiens
cactttaagaaattg

SEQ ID NO: 13651 - DNA, 15 bp, Homo sapiens
tcactttaagaaatt

SEQ ID NO: 13652 - DNA, 15 bp, Homo sapiens
atcactttaagaaat

SEQ ID NO: 13653 - DNA, 15 bp, Homo sapiens
aatcactttaagaaa

SEQ ID NO: 13654 - DNA, 15 bp, Homo sapiens
caatcactttaagaa

SEQ ID NO: 13655 - DNA, 15 bp, Homo sapiens
acaatcactttaaga

SEQ ID NO: 13656 - DNA, 15 bp, Homo sapiens
aacaatcactttaag

SEQ ID NO: 13657 - DNA, 15 bp, Homo sapiens
taacaatcactttaa

SEQ ID NO: 13658 - DNA, 15 bp, Homo sapiens
ataacaatcacttta

SEQ ID NO: 13659 - DNA, 15 bp, Homo sapiens
tataacaatcacttt

SEQ ID NO: 13660 - DNA, 15 bp, Homo sapiens
atataacaatcactt

SEQ ID NO: 13661 - DNA, 15 bp, Homo sapiens
aatataacaatcact

SEQ ID NO: 13662 - DNA, 15 bp, Homo sapiens
caatataacaatcac

SEQ ID NO: 13663 - DNA, 15 bp, Homo sapiens
gcaatataacaatca

SEQ ID NO: 13664 - DNA, 15 bp, Homo sapiens
ggcaatataacaatc

SEQ ID NO: 13665 - DNA, 15 bp, Homo sapiens
tggcaatataacaat

SEQ ID NO: 13666 - DNA, 15 bp, Homo sapiens
ctggcaatataacaa

SEQ ID NO: 13667 - DNA, 15 bp, Homo sapiens
actggcaatataaca

SEQ ID NO: 13668 - DNA, 15 bp, Homo sapiens
aactggcaatataac

SEQ ID NO: 13669 - DNA, 15 bp, Homo sapiens
aaactggcaatataa

SEQ ID NO: 13670 - DNA, 15 bp, Homo sapiens
aaaactggcaatata

SEQ ID NO: 13671 - DNA, 15 bp, Homo sapiens
caaaactggcaatat

SEQ ID NO: 13672 - DNA, 15 bp, Homo sapiens
tcaaaactggcaata

SEQ ID NO: 13673 - DNA, 15 bp, Homo sapiens
ttcaaaactggcaat

SEQ ID NO: 13674 - DNA, 15 bp, Homo sapiens
tttcaaaactggcaa

SEQ ID NO: 13675 - DNA, 15 bp, Homo sapiens
atttcaaaactggca

SEQ ID NO: 13676 - DNA, 15 bp, Homo sapiens
aatttcaaaactggc

SEQ ID NO: 13677 - DNA, 15 bp, Homo sapiens
taatttcaaaactgg

SEQ ID NO: 13678 - DNA, 15 bp, Homo sapiens
ataatttcaaaactg

SEQ ID NO: 13679 - DNA, 15 bp, Homo sapiens
tataatttcaaaact

SEQ ID NO: 13680 - DNA, 15 bp, Homo sapiens
atataatttcaaaac

SEQ ID NO: 13681 - DNA, 15 bp, Homo sapiens
aatataatttcaaaa

SEQ ID NO: 13682 - DNA, 15 bp, Homo sapiens
taatataatttcaaa

SEQ ID NO: 13683 - DNA, 15 bp, Homo sapiens
ataatataatttcaa

SEQ ID NO: 13684 - DNA, 15 bp, Homo sapiens
gataatataatttca

SEQ ID NO: 13685 - DNA, 15 bp, Homo sapiens
agataatataatttc

SEQ ID NO: 13686 - DNA, 15 bp, Homo sapiens
aagataatataattt

SEQ ID NO: 13687 - DNA, 15 bp, Homo sapiens
aaagataatataatt

SEQ ID NO: 13688 - DNA, 15 bp, Homo sapiens
aaaagataatataat

SEQ ID NO: 13689 - DNA, 15 bp, Homo sapiens
taaaagataatataa

SEQ ID NO: 13690 - DNA, 15 bp, Homo sapiens
ttaaaagataatata

SEQ ID NO: 13691 - DNA, 15 bp, Homo sapiens
tttaaaagataatat

SEQ ID NO: 13692 - DNA, 15 bp, Homo sapiens
ttttaaaagataata

SEQ ID NO: 13693 - DNA, 15 bp, Homo sapiens
attttaaaagataat

SEQ ID NO: 13694 - DNA, 15 bp, Homo sapiens
aattttaaaagataa

SEQ ID NO: 13695 - DNA, 15 bp, Homo sapiens
aaattttaaaagata

SEQ ID NO: 13696 - DNA, 15 bp, Homo sapiens
taaattttaaaagat

SEQ ID NO: 13697 - DNA, 15 bp, Homo sapiens
ttaaattttaaaaga

SEQ ID NO: 13698 - DNA, 15 bp, Homo sapiens
tttaaattttaaaag

SEQ ID NO: 13699 - DNA, 15 bp, Homo sapiens
ttttaaattttaaaa

SEQ ID NO: 13700 - DNA, 15 bp, Homo sapiens
attttaaattttaaa

SEQ ID NO: 13701 - DNA, 15 bp, Homo sapiens
cattttaaattttaa

SEQ ID NO: 13702 - DNA, 15 bp, Homo sapiens
acattttaaatttta

SEQ ID NO: 13703 - DNA, 15 bp, Homo sapiens
tacattttaaatttt

SEQ ID NO: 13704 - DNA, 15 bp, Homo sapiens
ttacattttaaattt

SEQ ID NO: 13705 - DNA, 15 bp, Homo sapiens
tttacattttaaatt

SEQ ID NO: 13706 - DNA, 15 bp, Homo sapiens
atttacattttaaat

SEQ ID NO: 13707 - DNA, 15 bp, Homo sapiens
tatttacattttaaa

SEQ ID NO: 13708 - DNA, 15 bp, Homo sapiens
atatttacattttaa

SEQ ID NO: 13709 - DNA, 15 bp, Homo sapiens
aatatttacatttta

SEQ ID NO: 13710 - DNA, 15 bp, Homo sapiens
caatatttacatttt

SEQ ID NO: 13711 - DNA, 15 bp, Homo sapiens
acaatatttacattt

SEQ ID NO: 13712 - DNA, 15 bp, Homo sapiens
gacaatatttacatt

SEQ ID NO: 13713 - DNA, 15 bp, Homo sapiens
agacaatatttacat

SEQ ID NO: 13714 - DNA, 15 bp, Homo sapiens
gagacaatatttaca

SEQ ID NO: 13715 - DNA, 15 bp, Homo sapiens
tgagacaatatttac

SEQ ID NO: 13716 - DNA, 15 bp, Homo sapiens
ctgagacaatattta

SEQ ID NO: 13717 - DNA, 15 bp, Homo sapiens
cctgagacaatattt

SEQ ID NO: 13718 - DNA, 15 bp, Homo sapiens
ccctgagacaatatt

SEQ ID NO: 13719 - DNA, 15 bp, Homo sapiens
cccctgagacaatat

SEQ ID NO: 13720 - DNA, 15 bp, Homo sapiens
acccctgagacaata

SEQ ID NO: 13721 - DNA, 15 bp, Homo sapiens
cacccctgagacaat

SEQ ID NO: 13722 - DNA, 15 bp, Homo sapiens
ccacccctgagacaa

SEQ ID NO: 13723 - DNA, 15 bp, Homo sapiens
cccacccctgagaca

SEQ ID NO: 13724 - DNA, 15 bp, Homo sapiens
tcccacccctgagac

SEQ ID NO: 13725 - DNA, 15 bp, Homo sapiens
ctcccacccctgaga

SEQ ID NO: 13726 - DNA, 15 bp, Homo sapiens
cctcccacccctgag

SEQ ID NO: 13727 - DNA, 15 bp, Homo sapiens
tcctcccacccctga

SEQ ID NO: 13728 - DNA, 15 bp, Homo sapiens
atcctcccacccctg

SEQ ID NO: 13729 - DNA, 15 bp, Homo sapiens
catcctcccacccct

SEQ ID NO: 13730 - DNA, 15 bp, Homo sapiens
tcatcctcccacccc

SEQ ID NO: 13731 - DNA, 15 bp, Homo sapiens
ttcatcctcccaccc

SEQ ID NO: 13732 - DNA, 15 bp, Homo sapiens
attcatcctcccacc

SEQ ID NO: 13733 - DNA, 15 bp, Homo sapiens
gattcatcctcccac

SEQ ID NO: 13734 - DNA, 15 bp, Homo sapiens
agattcatcctccca

SEQ ID NO: 13735 - DNA, 15 bp, Homo sapiens
gagattcatcctccc

SEQ ID NO: 13736 - DNA, 15 bp, Homo sapiens
ggagattcatcctcc

SEQ ID NO: 13737 - DNA, 15 bp, Homo sapiens
tggagattcatcctc

SEQ ID NO: 13738 - DNA, 15 bp, Homo sapiens
atggagattcatcct

SEQ ID NO: 13739 - DNA, 15 bp, Homo sapiens
gatggagattcatcc

SEQ ID NO: 13740 - DNA, 15 bp, Homo sapiens
agatggagattcatc

SEQ ID NO: 13741 - DNA, 15 bp, Homo sapiens
aagatggagattcat

SEQ ID NO: 13742 - DNA, 15 bp, Homo sapiens
taagatggagattca

SEQ ID NO: 13743 - DNA, 15 bp, Homo sapiens
ataagatggagattc

SEQ ID NO: 13744 - DNA, 15 bp, Homo sapiens
aataagatggagatt

SEQ ID NO: 13745 - DNA, 15 bp, Homo sapiens
aaataagatggagat

SEQ ID NO: 13746 - DNA, 15 bp, Homo sapiens
taaataagatggaga

SEQ ID NO: 13747 - DNA, 15 bp, Homo sapiens
ctaaataagatggag

SEQ ID NO: 13748 - DNA, 15 bp, Homo sapiens
actaaataagatgga

SEQ ID NO: 13749 - DNA, 15 bp, Homo sapiens
cactaaataagatgg

SEQ ID NO: 13750 - DNA, 15 bp, Homo sapiens
acactaaataagatg

SEQ ID NO: 13751 - DNA, 15 bp, Homo sapiens
aacactaaataagat

SEQ ID NO: 13752 - DNA, 15 bp, Homo sapiens
taacactaaataaga

SEQ ID NO: 13753 - DNA, 15 bp, Homo sapiens
ttaacactaaataag

SEQ ID NO: 13754 - DNA, 15 bp, Homo sapiens
tttaacactaaataa

SEQ ID NO: 13755 - DNA, 15 bp, Homo sapiens
ctttaacactaaata

SEQ ID NO: 13756 - DNA, 15 bp, Homo sapiens
cctttaacactaaat

SEQ ID NO: 13757 - DNA, 15 bp, Homo sapiens
gcctttaacactaaa

SEQ ID NO: 13758 - DNA, 15 bp, Homo sapiens
agcctttaacactaa

SEQ ID NO: 13759 - DNA, 15 bp, Homo sapiens
gagcctttaacacta

SEQ ID NO: 13760 - DNA, 15 bp, Homo sapiens
ggagcctttaacact

SEQ ID NO: 13761 - DNA, 15 bp, Homo sapiens
aggagcctttaacac

SEQ ID NO: 13762 - DNA, 15 bp, Homo sapiens
caggagcctttaaca

SEQ ID NO: 13763 - DNA, 15 bp, Homo sapiens
ccaggagcctttaac

SEQ ID NO: 13764 - DNA, 15 bp, Homo sapiens
tccaggagcctttaa

SEQ ID NO: 13765 - DNA, 15 bp, Homo sapiens
gtccaggagccttta

SEQ ID NO: 13766 - DNA, 15 bp, Homo sapiens
agtccaggagccttt

SEQ ID NO: 13767 - DNA, 15 bp, Homo sapiens
aagtccaggagcctt

SEQ ID NO: 13768 - DNA, 15 bp, Homo sapiens
taagtccaggagcct

SEQ ID NO: 13769 - DNA, 15 bp, Homo sapiens
gtaagtccaggagcc

SEQ ID NO: 13770 - DNA, 15 bp, Homo sapiens
ggtaagtccaggagc

SEQ ID NO: 13771 - DNA, 15 bp, Homo sapiens
gggtaagtccaggag

SEQ ID NO: 13772 - DNA, 15 bp, Homo sapiens
agggtaagtccagga

SEQ ID NO: 13773 - DNA, 15 bp, Homo sapiens
tagggtaagtccagg

SEQ ID NO: 13774 - DNA, 15 bp, Homo sapiens
ttagggtaagtccag

SEQ ID NO: 13775 - DNA, 15 bp, Homo sapiens
tttagggtaagtcca

SEQ ID NO: 13776 - DNA, 15 bp, Homo sapiens
ctttagggtaagtcc

SEQ ID NO: 13777 - DNA, 15 bp, Homo sapiens
gctttagggtaagtc

SEQ ID NO: 13778 - DNA, 15 bp, Homo sapiens
ggctttagggtaagt

SEQ ID NO: 13779 - DNA, 15 bp, Homo sapiens
gggctttagggtaag

SEQ ID NO: 13780 - DNA, 15 bp, Homo sapiens
tgggctttagggtaa

SEQ ID NO: 13781 - DNA, 15 bp, Homo sapiens
ctgggctttagggta

SEQ ID NO: 13782 - DNA, 15 bp, Homo sapiens
gctgggctttagggt

SEQ ID NO: 13783 - DNA, 15 bp, Homo sapiens
agctgggctttaggg

SEQ ID NO: 13784 - DNA, 15 bp, Homo sapiens
aagctgggctttagg

SEQ ID NO: 13785 - DNA, 15 bp, Homo sapiens
aaagctgggctttag

SEQ ID NO: 13786 - DNA, 15 bp, Homo sapiens
aaaagctgggcttta

SEQ ID NO: 13787 - DNA, 15 bp, Homo sapiens
aaaaagctgggcttt

SEQ ID NO: 13788 - DNA, 15 bp, Homo sapiens
gaaaaagctgggctt

SEQ ID NO: 13789 - DNA, 15 bp, Homo sapiens
cgaaaaagctgggct

SEQ ID NO: 13790 - DNA, 15 bp, Homo sapiens
ccgaaaaagctgggc

SEQ ID NO: 13791 - DNA, 15 bp, Homo sapiens
accgaaaaagctggg

SEQ ID NO: 13792 - DNA, 15 bp, Homo sapiens
caccgaaaaagctgg

SEQ ID NO: 13793 - DNA, 15 bp, Homo sapiens
ccaccgaaaaagctg

SEQ ID NO: 13794 - DNA, 15 bp, Homo sapiens
cccaccgaaaaagct

SEQ ID NO: 13795 - DNA, 15 bp, Homo sapiens
ccccaccgaaaaagc

SEQ ID NO: 13796 - DNA, 15 bp, Homo sapiens
cccccaccgaaaaag

SEQ ID NO: 13797 - DNA, 15 bp, Homo sapiens
ccccccaccgaaaaa

SEQ ID NO: 13798 - DNA, 15 bp, Homo sapiens
gccccccaccgaaaa

SEQ ID NO: 13799 - DNA, 15 bp, Homo sapiens
agccccccaccgaaa

SEQ ID NO: 13800 - DNA, 15 bp, Homo sapiens
gagccccccaccgaa

SEQ ID NO: 13801 - DNA, 15 bp, Homo sapiens
tgagccccccaccga

SEQ ID NO: 13802 - DNA, 15 bp, Homo sapiens
atgagccccccaccg

SEQ ID NO: 13803 - DNA, 15 bp, Homo sapiens
tatgagccccccacc

SEQ ID NO: 13804 - DNA, 15 bp, Homo sapiens
ttatgagccccccac

SEQ ID NO: 13805 - DNA, 15 bp, Homo sapiens
tttatgagcccccca

SEQ ID NO: 13806 - DNA, 15 bp, Homo sapiens
atttatgagcccccc

SEQ ID NO: 13807 - DNA, 15 bp, Homo sapiens
tatttatgagccccc

SEQ ID NO: 13808 - DNA, 15 bp, Homo sapiens
ttatttatgagcccc

SEQ ID NO: 13809 - DNA, 15 bp, Homo sapiens
tttatttatgagccc

SEQ ID NO: 13810 - DNA, 15 bp, Homo sapiens
ttttatttatgagcc

SEQ ID NO: 13811 - DNA, 15 bp, Homo sapiens
gttttatttatgagc

SEQ ID NO: 13812 - DNA, 15 bp, Homo sapiens
agttttatttatgag

SEQ ID NO: 13813 - DNA, 15 bp, Homo sapiens
cagttttatttatga

SEQ ID NO: 13814 - DNA, 15 bp, Homo sapiens
acagttttatttatg

SEQ ID NO: 13815 - DNA, 15 bp, Homo sapiens
cacagttttatttat

SEQ ID NO: 13816 - DNA, 15 bp, Homo sapiens
acacagttttattta

SEQ ID NO: 13817 - DNA, 15 bp, Homo sapiens
cacacagttttattt

SEQ ID NO: 13818 - DNA, 15 bp, Homo sapiens
acacacagttttatt

SEQ ID NO: 13819 - DNA, 15 bp, Homo sapiens
cacacacagttttat

SEQ ID NO: 13820 - DNA, 15 bp, Homo sapiens
acacacacagtttta

SEQ ID NO: 13821 - DNA, 15 bp, Homo sapiens
aacacacacagtttt

SEQ ID NO: 13822 - DNA, 15 bp, Homo sapiens
gaacacacacagttt

SEQ ID NO: 13823 - DNA, 15 bp, Homo sapiens
agaacacacacagtt

SEQ ID NO: 13824 - DNA, 15 bp, Homo sapiens
tagaacacacacagt

SEQ ID NO: 13825 - DNA, 15 bp, Homo sapiens
ctagaacacacacag

SEQ ID NO: 13826 - DNA, 15 bp, Homo sapiens
actagaacacacaca

SEQ ID NO: 13827 - DNA, 15 bp, Homo sapiens
aactagaacacacac

SEQ ID NO: 13828 - DNA, 15 bp, Homo sapiens
aaactagaacacaca

SEQ ID NO: 13829 - DNA, 15 bp, Homo sapiens
taaactagaacacac

SEQ ID NO: 13830 - DNA, 15 bp, Homo sapiens
gtaaactagaacaca

SEQ ID NO: 13831 - DNA, 15 bp, Homo sapiens
agtaaactagaacac

SEQ ID NO: 13832 - DNA, 15 bp, Homo sapiens
gagtaaactagaaca

SEQ ID NO: 13833 - DNA, 15 bp, Homo sapiens
agagtaaactagaac

SEQ ID NO: 13834 - DNA, 15 bp, Homo sapiens
cagagtaaactagaa

SEQ ID NO: 13835 - DNA, 15 bp, Homo sapiens
acagagtaaactaga

SEQ ID NO: 13836 - DNA, 15 bp, Homo sapiens
aacagagtaaactag

SEQ ID NO: 13837 - DNA, 15 bp, Homo sapiens
taacagagtaaacta

SEQ ID NO: 13838 - DNA, 15 bp, Homo sapiens
gtaacagagtaaact

SEQ ID NO: 13839 - DNA, 15 bp, Homo sapiens
ggtaacagagtaaac

SEQ ID NO: 13840 - DNA, 15 bp, Homo sapiens
aggtaacagagtaaa

SEQ ID NO: 13841 - DNA, 15 bp, Homo sapiens
gaggtaacagagtaa

SEQ ID NO: 13842 - DNA, 15 bp, Homo sapiens
tgaggtaacagagta

SEQ ID NO: 13843 - DNA, 15 bp, Homo sapiens
atgaggtaacagagt

SEQ ID NO: 13844 - DNA, 15 bp, Homo sapiens
gatgaggtaacagag

SEQ ID NO: 13845 - DNA, 15 bp, Homo sapiens
agatgaggtaacaga

SEQ ID NO: 13846 - DNA, 15 bp, Homo sapiens
tagatgaggtaacag

SEQ ID NO: 13847 - DNA, 15 bp, Homo sapiens
ctagatgaggtaaca

SEQ ID NO: 13848 - DNA, 15 bp, Homo sapiens
actagatgaggtaac

SEQ ID NO: 13849 - DNA, 15 bp, Homo sapiens
aactagatgaggtaa

SEQ ID NO: 13850 - DNA, 15 bp, Homo sapiens
gaactagatgaggta

SEQ ID NO: 13851 - DNA, 15 bp, Homo sapiens
ggaactagatgaggt

SEQ ID NO: 13852 - DNA, 15 bp, Homo sapiens
aggaactagatgagg

SEQ ID NO: 13853 - DNA, 15 bp, Homo sapiens
aaggaactagatgag

SEQ ID NO: 13854 - DNA, 15 bp, Homo sapiens
aaaggaactagatga

SEQ ID NO: 13855 - DNA, 15 bp, Homo sapiens
taaaggaactagatg

SEQ ID NO: 13856 - DNA, 15 bp, Homo sapiens
ctaaaggaactagat

SEQ ID NO: 13857 - DNA, 15 bp, Homo sapiens
cctaaaggaactaga

SEQ ID NO: 13858 - DNA, 15 bp, Homo sapiens
acctaaaggaactag

SEQ ID NO: 13859 - DNA, 15 bp, Homo sapiens
cacctaaaggaacta

SEQ ID NO: 13860 - DNA, 15 bp, Homo sapiens
tcacctaaaggaact

SEQ ID NO: 13861 - DNA, 15 bp, Homo sapiens
atcacctaaaggaac

SEQ ID NO: 13862 - DNA, 15 bp, Homo sapiens
aatcacctaaaggaa

SEQ ID NO: 13863 - DNA, 15 bp, Homo sapiens
taatcacctaaagga

SEQ ID NO: 13864 - DNA, 15 bp, Homo sapiens
ctaatcacctaaagg

SEQ ID NO: 13865 - DNA, 15 bp, Homo sapiens
tctaatcacctaaag

SEQ ID NO: 13866 - DNA, 15 bp, Homo sapiens
ttctaatcacctaaa

SEQ ID NO: 13867 - DNA, 15 bp, Homo sapiens
tttctaatcacctaa

SEQ ID NO: 13868 - DNA, 15 bp, Homo sapiens
ttttctaatcaccta

SEQ ID NO: 13869 - DNA, 15 bp, Homo sapiens
attttctaatcacct

SEQ ID NO: 13870 - DNA, 15 bp, Homo sapiens
cattttctaatcacc

SEQ ID NO: 13871 - DNA, 15 bp, Homo sapiens
gcattttctaatcac

SEQ ID NO: 13872 - DNA, 15 bp, Homo sapiens
ggcattttctaatca

SEQ ID NO: 13873 - DNA, 15 bp, Homo sapiens
cggcattttctaatc

SEQ ID NO: 13874 - DNA, 15 bp, Homo sapiens
acggcattttctaat

SEQ ID NO: 13875 - DNA, 15 bp, Homo sapiens
tacggcattttctaa

SEQ ID NO: 13876 - DNA, 15 bp, Homo sapiens
atacggcattttcta

SEQ ID NO: 13877 - DNA, 15 bp, Homo sapiens
aatacggcattttct

SEQ ID NO: 13878 - DNA, 15 bp, Homo sapiens
taatacggcattttc

SEQ ID NO: 13879 - DNA, 15 bp, Homo sapiens
ctaatacggcatttt

SEQ ID NO: 13880 - DNA, 15 bp, Homo sapiens
gctaatacggcattt

SEQ ID NO: 13881 - DNA, 15 bp, Homo sapiens
tgctaatacggcatt

SEQ ID NO: 13882 - DNA, 15 bp, Homo sapiens
ttgctaatacggcat

SEQ ID NO: 13883 - DNA, 15 bp, Homo sapiens
tttgctaatacggca

SEQ ID NO: 13884 - DNA, 15 bp, Homo sapiens
atttgctaatacggc

SEQ ID NO: 13885 - DNA, 15 bp, Homo sapiens
tatttgctaatacgg

SEQ ID NO: 13886 - DNA, 15 bp, Homo sapiens
atatttgctaatacg

SEQ ID NO: 13887 - DNA, 15 bp, Homo sapiens
tatatttgctaatac

SEQ ID NO: 13888 - DNA, 15 bp, Homo sapiens
ttatatttgctaata

SEQ ID NO: 13889 - DNA, 15 bp, Homo sapiens
tttatatttgctaat

SEQ ID NO: 13890 - DNA, 15 bp, Homo sapiens
ttttatatttgctaa

SEQ ID NO: 13891 - DNA, 15 bp, Homo sapiens
tttttatatttgcta

SEQ ID NO: 13892 - DNA, 15 bp, Homo sapiens
ctttttatatttgct

SEQ ID NO: 13893 - DNA, 15 bp, Homo sapiens
cctttttatatttgc

SEQ ID NO: 13894 - DNA, 15 bp, Homo sapiens
acctttttatatttg

SEQ ID NO: 13895 - DNA, 15 bp, Homo sapiens
aacctttttatattt

SEQ ID NO: 13896 - DNA, 15 bp, Homo sapiens
aaacctttttatatt

SEQ ID NO: 13897 - DNA, 15 bp, Homo sapiens
taaacctttttatat

SEQ ID NO: 13898 - DNA, 15 bp, Homo sapiens
gtaaacctttttata

SEQ ID NO: 13899 - DNA, 15 bp, Homo sapiens
agtaaacctttttat

SEQ ID NO: 13900 - DNA, 15 bp, Homo sapiens
aagtaaaccttttta

SEQ ID NO: 13901 - DNA, 15 bp, Homo sapiens
aaagtaaaccttttt

SEQ ID NO: 13902 - DNA, 15 bp, Homo sapiens
aaaagtaaacctttt

SEQ ID NO: 13903 - DNA, 15 bp, Homo sapiens
caaaagtaaaccttt

SEQ ID NO: 13904 - DNA, 15 bp, Homo sapiens
acaaaagtaaacctt

SEQ ID NO: 13905 - DNA, 15 bp, Homo sapiens
cacaaaagtaaacct

SEQ ID NO: 13906 - DNA, 15 bp, Homo sapiens
acacaaaagtaaacc

SEQ ID NO: 13907 - DNA, 15 bp, Homo sapiens
aacacaaaagtaaac

SEQ ID NO: 13908 - DNA, 15 bp, Homo sapiens
aaacacaaaagtaaa

SEQ ID NO: 13909 - DNA, 15 bp, Homo sapiens
aaaacacaaaagtaa

SEQ ID NO: 13910 - DNA, 15 bp, Homo sapiens
aaaaacacaaaagta

SEQ ID NO: 13911 - DNA, 15 bp, Homo sapiens
taaaaacacaaaagt

SEQ ID NO: 13912 - DNA, 15 bp, Homo sapiens
gtaaaaacacaaaag

SEQ ID NO: 13913 - DNA, 15 bp, Homo sapiens
tgtaaaaacacaaaa

SEQ ID NO: 13914 - DNA, 15 bp, Homo sapiens
atgtaaaaacacaaa

SEQ ID NO: 13915 - DNA, 15 bp, Homo sapiens
catgtaaaaacacaa

SEQ ID NO: 13916 - DNA, 15 bp, Homo sapiens
acatgtaaaaacaca

SEQ ID NO: 13917 - DNA, 15 bp, Homo sapiens
cacatgtaaaaacac

SEQ ID NO: 13918 - DNA, 15 bp, Homo sapiens
tcacatgtaaaaaca

SEQ ID NO: 13919 - DNA, 15 bp, Homo sapiens
ttcacatgtaaaaac

SEQ ID NO: 13920 - DNA, 15 bp, Homo sapiens
tttcacatgtaaaaa

SEQ ID NO: 13921 - DNA, 15 bp, Homo sapiens
atttcacatgtaaaa

SEQ ID NO: 13922 - DNA, 15 bp, Homo sapiens
gatttcacatgtaaa

SEQ ID NO: 13923 - DNA, 15 bp, Homo sapiens
tgatttcacatgtaa

SEQ ID NO: 13924 - DNA, 15 bp, Homo sapiens
ttgatttcacatgta

SEQ ID NO: 13925 - DNA, 15 bp, Homo sapiens
attgatttcacatgt

SEQ ID NO: 13926 - DNA, 15 bp, Homo sapiens
cattgatttcacatg

SEQ ID NO: 13927 - DNA, 15 bp, Homo sapiens
ccattgatttcacat

SEQ ID NO: 13928 - DNA, 15 bp, Homo sapiens
gccattgatttcaca

SEQ ID NO: 13929 - DNA, 15 bp, Homo sapiens
ggccattgatttcac

SEQ ID NO: 13930 - DNA, 15 bp, Homo sapiens
tggccattgatttca

SEQ ID NO: 13931 - DNA, 15 bp, Homo sapiens
ctggccattgatttc

SEQ ID NO: 13932 - DNA, 15 bp, Homo sapiens
actggccattgattt

SEQ ID NO: 13933 - DNA, 15 bp, Homo sapiens
aactggccattgatt

SEQ ID NO: 13934 - DNA, 15 bp, Homo sapiens
gaactggccattgat

SEQ ID NO: 13935 - DNA, 15 bp, Homo sapiens
agaactggccattga

SEQ ID NO: 13936 - DNA, 15 bp, Homo sapiens
tagaactggccattg

SEQ ID NO: 13937 - DNA, 15 bp, Homo sapiens
atagaactggccatt

SEQ ID NO: 13938 - DNA, 15 bp, Homo sapiens
tatagaactggccat

SEQ ID NO: 13939 - DNA, 15 bp, Homo sapiens
ttatagaactggcca

SEQ ID NO: 13940 - DNA, 15 bp, Homo sapiens
attatagaactggcc

SEQ ID NO: 13941 - DNA, 15 bp, Homo sapiens
cattatagaactggc

SEQ ID NO: 13942 - DNA, 15 bp, Homo sapiens
acattatagaactgg

SEQ ID NO: 13943 - DNA, 15 bp, Homo sapiens
aacattatagaactg

SEQ ID NO: 13944 - DNA, 15 bp, Homo sapiens
taacattatagaact

SEQ ID NO: 13945 - DNA, 15 bp, Homo sapiens
ttaacattatagaac

SEQ ID NO: 13946 - DNA, 15 bp, Homo sapiens
gttaacattatagaa

SEQ ID NO: 13947 - DNA, 15 bp, Homo sapiens
tgttaacattataga

SEQ ID NO: 13948 - DNA, 15 bp, Homo sapiens
atgttaacattatag

SEQ ID NO: 13949 - DNA, 15 bp, Homo sapiens
tatgttaacattata

SEQ ID NO: 13950 - DNA, 15 bp, Homo sapiens
atatgttaacattat

SEQ ID NO: 13951 - DNA, 15 bp, Homo sapiens
gatatgttaacatta

SEQ ID NO: 13952 - DNA, 15 bp, Homo sapiens
tgatatgttaacatt

SEQ ID NO: 13953 - DNA, 15 bp, Homo sapiens
ctgatatgttaacat

SEQ ID NO: 13954 - DNA, 15 bp, Homo sapiens
tctgatatgttaaca

SEQ ID NO: 13955 - DNA, 15 bp, Homo sapiens
gtctgatatgttaac

SEQ ID NO: 13956 - DNA, 15 bp, Homo sapiens
ggtctgatatgttaa

SEQ ID NO: 13957 - DNA, 15 bp, Homo sapiens
gggtctgatatgtta

SEQ ID NO: 13958 - DNA, 15 bp, Homo sapiens
agggtctgatatgtt

SEQ ID NO: 13959 - DNA, 15 bp, Homo sapiens
aagggtctgatatgt

SEQ ID NO: 13960 - DNA, 15 bp, Homo sapiens
taagggtctgatatg

SEQ ID NO: 13961 - DNA, 15 bp, Homo sapiens
ttaagggtctgatat

SEQ ID NO: 13962 - DNA, 15 bp, Homo sapiens
attaagggtctgata

SEQ ID NO: 13963 - DNA, 15 bp, Homo sapiens
aattaagggtctgat

SEQ ID NO: 13964 - DNA, 15 bp, Homo sapiens
taattaagggtctga

SEQ ID NO: 13965 - DNA, 15 bp, Homo sapiens
ataattaagggtctg

SEQ ID NO: 13966 - DNA, 15 bp, Homo sapiens
tataattaagggtct

SEQ ID NO: 13967 - DNA, 15 bp, Homo sapiens
atataattaagggtc

SEQ ID NO: 13968 - DNA, 15 bp, Homo sapiens
tatataattaagggt

SEQ ID NO: 13969 - DNA, 15 bp, Homo sapiens
atatataattaaggg

SEQ ID NO: 13970 - DNA, 15 bp, Homo sapiens
aatatataattaagg

SEQ ID NO: 13971 - DNA, 15 bp, Homo sapiens
taatatataattaag

SEQ ID NO: 13972 - DNA, 15 bp, Homo sapiens
ttaatatataattaa

SEQ ID NO: 13973 - DNA, 15 bp, Homo sapiens
gttaatatataatta

SEQ ID NO: 13974 - DNA, 15 bp, Homo sapiens
agttaatatataatt

SEQ ID NO: 13975 - DNA, 15 bp, Homo sapiens
gagttaatatataat

SEQ ID NO: 13976 - DNA, 15 bp, Homo sapiens
ggagttaatatataa

SEQ ID NO: 13977 - DNA, 15 bp, Homo sapiens
gggagttaatatata

SEQ ID NO: 13978 - DNA, 15 bp, Homo sapiens
tgggagttaatatat

SEQ ID NO: 13979 - DNA, 15 bp, Homo sapiens
atgggagttaatata

SEQ ID NO: 13980 - DNA, 15 bp, Homo sapiens
aatgggagttaatat

SEQ ID NO: 13981 - DNA, 15 bp, Homo sapiens
aaatgggagttaata

SEQ ID NO: 13982 - DNA, 15 bp, Homo sapiens
aaaatgggagttaat

SEQ ID NO: 13983 - DNA, 15 bp, Homo sapiens
caaaatgggagttaa

SEQ ID NO: 13984 - DNA, 15 bp, Homo sapiens
tcaaaatgggagtta

SEQ ID NO: 13985 - DNA, 15 bp, Homo sapiens
atcaaaatgggagtt

SEQ ID NO: 13986 - DNA, 15 bp, Homo sapiens
tatcaaaatgggagt

SEQ ID NO: 13987 - DNA, 15 bp, Homo sapiens
ctatcaaaatgggag

SEQ ID NO: 13988 - DNA, 15 bp, Homo sapiens
actatcaaaatggga

SEQ ID NO: 13989 - DNA, 15 bp, Homo sapiens
aactatcaaaatggg

SEQ ID NO: 13990 - DNA, 15 bp, Homo sapiens
aaactatcaaaatgg

SEQ ID NO: 13991 - DNA, 15 bp, Homo sapiens
caaactatcaaaatg

SEQ ID NO: 13992 - DNA, 15 bp, Homo sapiens
acaaactatcaaaat

SEQ ID NO: 13993 - DNA, 15 bp, Homo sapiens
tacaaactatcaaaa

SEQ ID NO: 13994 - DNA, 15 bp, Homo sapiens
atacaaactatcaaa

SEQ ID NO: 13995 - DNA, 15 bp, Homo sapiens
tatacaaactatcaa

SEQ ID NO: 13996 - DNA, 15 bp, Homo sapiens
ctatacaaactatca

SEQ ID NO: 13997 - DNA, 15 bp, Homo sapiens
tctatacaaactatc

SEQ ID NO: 13998 - DNA, 15 bp, Homo sapiens
ttctatacaaactat

SEQ ID NO: 13999 - DNA, 15 bp, Homo sapiens
tttctatacaaacta

SEQ ID NO: 14000 - DNA, 15 bp, Homo sapiens
ttttctatacaaact

SEQ ID NO: 14001 - DNA, 15 bp, Homo sapiens
tttttctatacaaac

SEQ ID NO: 14002 - DNA, 15 bp, Homo sapiens
atttttctatacaaa

SEQ ID NO: 14003 - DNA, 15 bp, Homo sapiens
gatttttctatacaa

SEQ ID NO: 14004 - DNA, 15 bp, Homo sapiens
tgatttttctataca

SEQ ID NO: 14005 - DNA, 15 bp, Homo sapiens
ctgatttttctatac

SEQ ID NO: 14006 - DNA, 15 bp, Homo sapiens
tctgatttttctata

SEQ ID NO: 14007 - DNA, 15 bp, Homo sapiens
ctctgatttttctat

SEQ ID NO: 14008 - DNA, 15 bp, Homo sapiens
actctgatttttcta

SEQ ID NO: 14009 - DNA, 15 bp, Homo sapiens
aactctgatttttct

SEQ ID NO: 14010 - DNA, 15 bp, Homo sapiens
caactctgatttttc

SEQ ID NO: 14011 - DNA, 15 bp, Homo sapiens
tcaactctgattttt

SEQ ID NO: 14012 - DNA, 15 bp, Homo sapiens
gtcaactctgatttt

SEQ ID NO: 14013 - DNA, 15 bp, Homo sapiens
agtcaactctgattt

SEQ ID NO: 14014 - DNA, 15 bp, Homo sapiens
aagtcaactctgatt

SEQ ID NO: 14015 - DNA, 15 bp, Homo sapiens
caagtcaactctgat

SEQ ID NO: 14016 - DNA, 15 bp, Homo sapiens
tcaagtcaactctga

SEQ ID NO: 14017 - DNA, 15 bp, Homo sapiens
ttcaagtcaactctg

SEQ ID NO: 14018 - DNA, 15 bp, Homo sapiens
attcaagtcaactct

SEQ ID NO: 14019 - DNA, 15 bp, Homo sapiens
aattcaagtcaactc

SEQ ID NO: 14020 - DNA, 15 bp, Homo sapiens
taattcaagtcaact

SEQ ID NO: 14021 - DNA, 15 bp, Homo sapiens
ataattcaagtcaac

SEQ ID NO: 14022 - DNA, 15 bp, Homo sapiens
aataattcaagtcaa

SEQ ID NO: 14023 - DNA, 15 bp, Homo sapiens
aaataattcaagtca

SEQ ID NO: 14024 - DNA, 15 bp, Homo sapiens
caaataattcaagtc

SEQ ID NO: 14025 - DNA, 15 bp, Homo sapiens
tcaaataattcaagt

SEQ ID NO: 14026 - DNA, 15 bp, Homo sapiens
ttcaaataattcaag

SEQ ID NO: 14027 - DNA, 15 bp, Homo sapiens
gttcaaataattcaa

SEQ ID NO: 14028 - DNA, 15 bp, Homo sapiens
agttcaaataattca

SEQ ID NO: 14029 - DNA, 15 bp, Homo sapiens
aagttcaaataattc

SEQ ID NO: 14030 - DNA, 15 bp, Homo sapiens
caagttcaaataatt

SEQ ID NO: 14031 - DNA, 15 bp, Homo sapiens
gcaagttcaaataat

SEQ ID NO: 14032 - DNA, 15 bp, Homo sapiens
tgcaagttcaaataa

SEQ ID NO: 14033 - DNA, 15 bp, Homo sapiens
atgcaagttcaaata

SEQ ID NO: 14034 - DNA, 15 bp, Homo sapiens
tatgcaagttcaaat

SEQ ID NO: 14035 - DNA, 15 bp, Homo sapiens
gtatgcaagttcaaa

SEQ ID NO: 14036 - DNA, 15 bp, Homo sapiens
cgtatgcaagttcaa

SEQ ID NO: 14037 - DNA, 15 bp, Homo sapiens
gcgtatgcaagttca

SEQ ID NO: 14038 - DNA, 15 bp, Homo sapiens
agcgtatgcaagttc

SEQ ID NO: 14039 - DNA, 15 bp, Homo sapiens
aagcgtatgcaagtt

SEQ ID NO: 14040 - DNA, 15 bp, Homo sapiens
aaagcgtatgcaagt

SEQ ID NO: 14041 - DNA, 15 bp, Homo sapiens
aaaagcgtatgcaag

SEQ ID NO: 14042 - DNA, 15 bp, Homo sapiens
aaaaagcgtatgcaa

SEQ ID NO: 14043 - DNA, 15 bp, Homo sapiens
gaaaaagcgtatgca

SEQ ID NO: 14044 - DNA, 15 bp, Homo sapiens
tgaaaaagcgtatgc

SEQ ID NO: 14045 - DNA, 15 bp, Homo sapiens
ttgaaaaagcgtatg

SEQ ID NO: 14046 - DNA, 15 bp, Homo sapiens
cttgaaaaagcgtat

SEQ ID NO: 14047 - DNA, 15 bp, Homo sapiens
tcttgaaaaagcgta

SEQ ID NO: 14048 - DNA, 15 bp, Homo sapiens
atcttgaaaaagcgt

SEQ ID NO: 14049 - DNA, 15 bp, Homo sapiens
tatcttgaaaaagcg

SEQ ID NO: 14050 - DNA, 15 bp, Homo sapiens
gtatcttgaaaaagc

SEQ ID NO: 14051 - DNA, 15 bp, Homo sapiens
cgtatcttgaaaaag

SEQ ID NO: 14052 - DNA, 15 bp, Homo sapiens
acgtatcttgaaaaa

SEQ ID NO: 14053 - DNA, 15 bp, Homo sapiens
tacgtatcttgaaaa

SEQ ID NO: 14054 - DNA, 15 bp, Homo sapiens
ttacgtatcttgaaa

SEQ ID NO: 14055 - DNA, 15 bp, Homo sapiens
gttacgtatcttgaa

SEQ ID NO: 14056 - DNA, 15 bp, Homo sapiens
cgttacgtatcttga

SEQ ID NO: 14057 - DNA, 15 bp, Homo sapiens
acgttacgtatcttg

SEQ ID NO: 14058 - DNA, 15 bp, Homo sapiens
cacgttacgtatctt

SEQ ID NO: 14059 - DNA, 15 bp, Homo sapiens
acacgttacgtatct

SEQ ID NO: 14060 - DNA, 15 bp, Homo sapiens
aacacgttacgtatc

SEQ ID NO: 14061 - DNA, 15 bp, Homo sapiens
caacacgttacgtat

SEQ ID NO: 14062 - DNA, 15 bp, Homo sapiens
acaacacgttacgta

SEQ ID NO: 14063 - DNA, 15 bp, Homo sapiens
tacaacacgttacgt

SEQ ID NO: 14064 - DNA, 15 bp, Homo sapiens
ttacaacacgttacg

SEQ ID NO: 14065 - DNA, 15 bp, Homo sapiens
tttacaacacgttac

SEQ ID NO: 14066 - DNA, 15 bp, Homo sapiens
atttacaacacgtta

SEQ ID NO: 14067 - DNA, 15 bp, Homo sapiens
aatttacaacacgtt

SEQ ID NO: 14068 - DNA, 15 bp, Homo sapiens
taatttacaacacgt

SEQ ID NO: 14069 - DNA, 15 bp, Homo sapiens
ctaatttacaacacg

SEQ ID NO: 14070 - DNA, 15 bp, Homo sapiens
tctaatttacaacac

SEQ ID NO: 14071 - DNA, 15 bp, Homo sapiens
ttctaatttacaaca

SEQ ID NO: 14072 - DNA, 15 bp, Homo sapiens
cttctaatttacaac

SEQ ID NO: 14073 - DNA, 15 bp, Homo sapiens
tcttctaatttacaa

SEQ ID NO: 14074 - DNA, 15 bp, Homo sapiens
ctcttctaatttaca

SEQ ID NO: 14075 - DNA, 15 bp, Homo sapiens
actcttctaatttac

SEQ ID NO: 14076 - DNA, 15 bp, Homo sapiens
cactcttctaattta

SEQ ID NO: 14077 - DNA, 15 bp, Homo sapiens
acactcttctaattt

SEQ ID NO: 14078 - DNA, 15 bp, Homo sapiens
aacactcttctaatt

SEQ ID NO: 14079 - DNA, 15 bp, Homo sapiens
caacactcttctaat

SEQ ID NO: 14080 - DNA, 15 bp, Homo sapiens
ccaacactcttctaa

SEQ ID NO: 14081 - DNA, 15 bp, Homo sapiens
accaacactcttcta

SEQ ID NO: 14082 - DNA, 15 bp, Homo sapiens
caccaacactcttct

SEQ ID NO: 14083 - DNA, 15 bp, Homo sapiens
acaccaacactcttc

SEQ ID NO: 14084 - DNA, 15 bp, Homo sapiens
aacaccaacactctt

SEQ ID NO: 14085 - DNA, 15 bp, Homo sapiens
aaacaccaacactct

SEQ ID NO: 14086 - DNA, 15 bp, Homo sapiens
aaaacaccaacactc

SEQ ID NO: 14087 - DNA, 15 bp, Homo sapiens
gaaaacaccaacact

SEQ ID NO: 14088 - DNA, 15 bp, Homo sapiens
cgaaaacaccaacac

SEQ ID NO: 14089 - DNA, 15 bp, Homo sapiens
ccgaaaacaccaaca

SEQ ID NO: 14090 - DNA, 15 bp, Homo sapiens
tccgaaaacaccaac

SEQ ID NO: 14091 - DNA, 15 bp, Homo sapiens
ttccgaaaacaccaa

SEQ ID NO: 14092 - DNA, 15 bp, Homo sapiens
gttccgaaaacacca

SEQ ID NO: 14093 - DNA, 15 bp, Homo sapiens
tgttccgaaaacacc

SEQ ID NO: 14094 - DNA, 15 bp, Homo sapiens
gtgttccgaaaacac

SEQ ID NO: 14095 - DNA, 15 bp, Homo sapiens
tgtgttccgaaaaca

SEQ ID NO: 14096 - DNA, 15 bp, Homo sapiens
atgtgttccgaaaac

SEQ ID NO: 14097 - DNA, 15 bp, Homo sapiens
catgtgttccgaaaa

SEQ ID NO: 14098 - DNA, 15 bp, Homo sapiens
gcatgtgttccgaaa

SEQ ID NO: 14099 - DNA, 15 bp, Homo sapiens
tgcatgtgttccgaa

SEQ ID NO: 14100 - DNA, 15 bp, Homo sapiens
atgcatgtgttccga

SEQ ID NO: 14101 - DNA, 15 bp, Homo sapiens
tatgcatgtgttccg

SEQ ID NO: 14102 - DNA, 15 bp, Homo sapiens
atatgcatgtgttcc

SEQ ID NO: 14103 - DNA, 15 bp, Homo sapiens
catatgcatgtgttc

SEQ ID NO: 14104 - DNA, 15 bp, Homo sapiens
gcatatgcatgtgtt

SEQ ID NO: 14105 - DNA, 15 bp, Homo sapiens
agcatatgcatgtgt

SEQ ID NO: 14106 - DNA, 15 bp, Homo sapiens
aagcatatgcatgtg

SEQ ID NO: 14107 - DNA, 15 bp, Homo sapiens
caagcatatgcatgt

SEQ ID NO: 14108 - DNA, 15 bp, Homo sapiens
gcaagcatatgcatg

SEQ ID NO: 14109 - DNA, 15 bp, Homo sapiens
agcaagcatatgcat

SEQ ID NO: 14110 - DNA, 15 bp, Homo sapiens
cagcaagcatatgca

SEQ ID NO: 14111 - DNA, 15 bp, Homo sapiens
acagcaagcatatgc

SEQ ID NO: 14112 - DNA, 15 bp, Homo sapiens
gacagcaagcatatg

SEQ ID NO: 14113 - DNA, 15 bp, Homo sapiens
agacagcaagcatat

SEQ ID NO: 14114 - DNA, 15 bp, Homo sapiens
gagacagcaagcata

SEQ ID NO: 14115 - DNA, 15 bp, Homo sapiens
tgagacagcaagcat

SEQ ID NO: 14116 - DNA, 15 bp, Homo sapiens
ctgagacagcaagca

SEQ ID NO: 14117 - DNA, 15 bp, Homo sapiens
cctgagacagcaagc

SEQ ID NO: 14118 - DNA, 15 bp, Homo sapiens
ccctgagacagcaag

SEQ ID NO: 14119 - DNA, 15 bp, Homo sapiens
gccctgagacagcaa

SEQ ID NO: 14120 - DNA, 15 bp, Homo sapiens
tgccctgagacagca

SEQ ID NO: 14121 - DNA, 15 bp, Homo sapiens
ctgccctgagacagc

SEQ ID NO: 14122 - DNA, 15 bp, Homo sapiens
gctgccctgagacag

SEQ ID NO: 14123 - DNA, 15 bp, Homo sapiens
ggctgccctgagaca

SEQ ID NO: 14124 - DNA, 15 bp, Homo sapiens
aggctgccctgagac

SEQ ID NO: 14125 - DNA, 15 bp, Homo sapiens
aaggctgccctgaga

SEQ ID NO: 14126 - DNA, 15 bp, Homo sapiens
caaggctgccctgag

SEQ ID NO: 14127 - DNA, 15 bp, Homo sapiens
acaaggctgccctga

SEQ ID NO: 14128 - DNA, 15 bp, Homo sapiens
aacaaggctgccctg

SEQ ID NO: 14129 - DNA, 15 bp, Homo sapiens
caacaaggctgccct

SEQ ID NO: 14130 - DNA, 15 bp, Homo sapiens
ccaacaaggctgccc

SEQ ID NO: 14131 - DNA, 15 bp, Homo sapiens
cccaacaaggctgcc

SEQ ID NO: 14132 - DNA, 15 bp, Homo sapiens
gcccaacaaggctgc

SEQ ID NO: 14133 - DNA, 15 bp, Homo sapiens
tgcccaacaaggctg

SEQ ID NO: 14134 - DNA, 15 bp, Homo sapiens
atgcccaacaaggct

SEQ ID NO: 14135 - DNA, 15 bp, Homo sapiens
aatgcccaacaaggc

SEQ ID NO: 14136 - DNA, 15 bp, Homo sapiens
aaatgcccaacaagg

SEQ ID NO: 14137 - DNA, 15 bp, Homo sapiens
caaatgcccaacaag

SEQ ID NO: 14138 - DNA, 15 bp, Homo sapiens
ccaaatgcccaacaa

SEQ ID NO: 14139 - DNA, 15 bp, Homo sapiens
accaaatgcccaaca

SEQ ID NO: 14140 - DNA, 15 bp, Homo sapiens
caccaaatgcccaac

SEQ ID NO: 14141 - DNA, 15 bp, Homo sapiens
acaccaaatgcccaa

SEQ ID NO: 14142 - DNA, 15 bp, Homo sapiens
gacaccaaatgccca

SEQ ID NO: 14143 - DNA, 15 bp, Homo sapiens
tgacaccaaatgccc

SEQ ID NO: 14144 - DNA, 15 bp, Homo sapiens
ctgacaccaaatgcc

SEQ ID NO: 14145 - DNA, 15 bp, Homo sapiens
tctgacaccaaatgc

SEQ ID NO: 14146 - DNA, 15 bp, Homo sapiens
gtctgacaccaaatg

SEQ ID NO: 14147 - DNA, 15 bp, Homo sapiens
tgtctgacaccaaat

SEQ ID NO: 14148 - DNA, 15 bp, Homo sapiens
atgtctgacaccaaa

SEQ ID NO: 14149 - DNA, 15 bp, Homo sapiens
tatgtctgacaccaa

SEQ ID NO: 14150 - DNA, 15 bp, Homo sapiens
gtatgtctgacacca

SEQ ID NO: 14151 - DNA, 15 bp, Homo sapiens
ggtatgtctgacacc

SEQ ID NO: 14152 - DNA, 15 bp, Homo sapiens
aggtatgtctgacac

SEQ ID NO: 14153 - DNA, 15 bp, Homo sapiens
aaggtatgtctgaca

SEQ ID NO: 14154 - DNA, 15 bp, Homo sapiens
taaggtatgtctgac

SEQ ID NO: 14155 - DNA, 15 bp, Homo sapiens
ataaggtatgtctga

SEQ ID NO: 14156 - DNA, 15 bp, Homo sapiens
aataaggtatgtctg

SEQ ID NO: 14157 - DNA, 15 bp, Homo sapiens
gaataaggtatgtct

SEQ ID NO: 14158 - DNA, 15 bp, Homo sapiens
agaataaggtatgtc

SEQ ID NO: 14159 - DNA, 15 bp, Homo sapiens
cagaataaggtatgt

SEQ ID NO: 14160 - DNA, 15 bp, Homo sapiens
tcagaataaggtatg

SEQ ID NO: 14161 - DNA, 15 bp, Homo sapiens
ctcagaataaggtat

SEQ ID NO: 14162 - DNA, 15 bp, Homo sapiens
cctcagaataaggta

SEQ ID NO: 14163 - DNA, 15 bp, Homo sapiens
ccctcagaataaggt

SEQ ID NO: 14164 - DNA, 15 bp, Homo sapiens
gccctcagaataagg

SEQ ID NO: 14165 - DNA, 15 bp, Homo sapiens
ggccctcagaataag

SEQ ID NO: 14166 - DNA, 15 bp, Homo sapiens
aggccctcagaataa

SEQ ID NO: 14167 - DNA, 15 bp, Homo sapiens
aaggccctcagaata

SEQ ID NO: 14168 - DNA, 15 bp, Homo sapiens
caaggccctcagaat

SEQ ID NO: 14169 - DNA, 15 bp, Homo sapiens
ccaaggccctcagaa

SEQ ID NO: 14170 - DNA, 15 bp, Homo sapiens
gccaaggccctcaga

SEQ ID NO: 14171 - DNA, 15 bp, Homo sapiens
tgccaaggccctcag

SEQ ID NO: 14172 - DNA, 15 bp, Homo sapiens
atgccaaggccctca

SEQ ID NO: 14173 - DNA, 15 bp, Homo sapiens
gatgccaaggccctc

SEQ ID NO: 14174 - DNA, 15 bp, Homo sapiens
tgatgccaaggccct

SEQ ID NO: 14175 - DNA, 15 bp, Homo sapiens
ttgatgccaaggccc

SEQ ID NO: 14176 - DNA, 15 bp, Homo sapiens
cttgatgccaaggcc

SEQ ID NO: 14177 - DNA, 15 bp, Homo sapiens
ccttgatgccaaggc

SEQ ID NO: 14178 - DNA, 15 bp, Homo sapiens
gccttgatgccaagg

SEQ ID NO: 14179 - DNA, 15 bp, Homo sapiens
tgccttgatgccaag

SEQ ID NO: 14180 - DNA, 15 bp, Homo sapiens
ctgccttgatgccaa

SEQ ID NO: 14181 - DNA, 15 bp, Homo sapiens
tctgccttgatgcca

SEQ ID NO: 14182 - DNA, 15 bp, Homo sapiens
atctgccttgatgcc

SEQ ID NO: 14183 - DNA, 15 bp, Homo sapiens
aatctgccttgatgc

SEQ ID NO: 14184 - DNA, 15 bp, Homo sapiens
caatctgccttgatg

SEQ ID NO: 14185 - DNA, 15 bp, Homo sapiens
gcaatctgccttgat

SEQ ID NO: 14186 - DNA, 15 bp, Homo sapiens
agcaatctgccttga

SEQ ID NO: 14187 - DNA, 15 bp, Homo sapiens
gagcaatctgccttg

SEQ ID NO: 14188 - DNA, 15 bp, Homo sapiens
tgagcaatctgcctt

SEQ ID NO: 14189 - DNA, 15 bp, Homo sapiens
ctgagcaatctgcct

SEQ ID NO: 14190 - DNA, 15 bp, Homo sapiens
tctgagcaatctgcc

SEQ ID NO: 14191 - DNA, 15 bp, Homo sapiens
ctctgagcaatctgc

SEQ ID NO: 14192 - DNA, 15 bp, Homo sapiens
tctctgagcaatctg

SEQ ID NO: 14193 - DNA, 15 bp, Homo sapiens
ctctctgagcaatct

SEQ ID NO: 14194 - DNA, 15 bp, Homo sapiens
cctctctgagcaatc

SEQ ID NO: 14195 - DNA, 15 bp, Homo sapiens
ccctctctgagcaat

SEQ ID NO: 14196 - DNA, 15 bp, Homo sapiens
cccctctctgagcaa

SEQ ID NO: 14197 - DNA, 15 bp, Homo sapiens
ccccctctctgagca

SEQ ID NO: 14198 - DNA, 15 bp, Homo sapiens
accccctctctgagc

SEQ ID NO: 14199 - DNA, 15 bp, Homo sapiens
gaccccctctctgag

SEQ ID NO: 14200 - DNA, 15 bp, Homo sapiens
agaccccctctctga

SEQ ID NO: 14201 - DNA, 15 bp, Homo sapiens
gagaccccctctctg

SEQ ID NO: 14202 - DNA, 15 bp, Homo sapiens
agagaccccctctct

SEQ ID NO: 14203 - DNA, 15 bp, Homo sapiens
gagagaccccctctc

SEQ ID NO: 14204 - DNA, 15 bp, Homo sapiens
agagagaccccctct

SEQ ID NO: 14205 - DNA, 15 bp, Homo sapiens
cagagagaccccctc

SEQ ID NO: 14206 - DNA, 15 bp, Homo sapiens
gcagagagaccccct

SEQ ID NO: 14207 - DNA, 15 bp, Homo sapiens
tgcagagagaccccc

SEQ ID NO: 14208 - DNA, 15 bp, Homo sapiens
atgcagagagacccc

SEQ ID NO: 14209 - DNA, 15 bp, Homo sapiens
tatgcagagagaccc

SEQ ID NO: 14210 - DNA, 15 bp, Homo sapiens
atatgcagagagacc

SEQ ID NO: 14211 - DNA, 15 bp, Homo sapiens
tatatgcagagagac

SEQ ID NO: 14212 - DNA, 15 bp, Homo sapiens
atatatgcagagaga

SEQ ID NO: 14213 - DNA, 15 bp, Homo sapiens
catatatgcagagag

SEQ ID NO: 14214 - DNA, 15 bp, Homo sapiens
acatatatgcagaga

SEQ ID NO: 14215 - DNA, 15 bp, Homo sapiens
gacatatatgcagag

SEQ ID NO: 14216 - DNA, 15 bp, Homo sapiens
agacatatatgcaga

SEQ ID NO: 14217 - DNA, 15 bp, Homo sapiens
tagacatatatgcag

SEQ ID NO: 14218 - DNA, 15 bp, Homo sapiens
ttagacatatatgca

SEQ ID NO: 14219 - DNA, 15 bp, Homo sapiens
cttagacatatatgc

SEQ ID NO: 14220 - DNA, 15 bp, Homo sapiens
ccttagacatatatg

SEQ ID NO: 14221 - DNA, 15 bp, Homo sapiens
cccttagacatatat

SEQ ID NO: 14222 - DNA, 15 bp, Homo sapiens
tcccttagacatata

SEQ ID NO: 14223 - DNA, 15 bp, Homo sapiens
ctcccttagacatat

SEQ ID NO: 14224 - DNA, 15 bp, Homo sapiens
tctcccttagacata

SEQ ID NO: 14225 - DNA, 15 bp, Homo sapiens
gtctcccttagacat

SEQ ID NO: 14226 - DNA, 15 bp, Homo sapiens
tgtctcccttagaca

SEQ ID NO: 14227 - DNA, 15 bp, Homo sapiens
atgtctcccttagac

SEQ ID NO: 14228 - DNA, 15 bp, Homo sapiens
aatgtctcccttaga

SEQ ID NO: 14229 - DNA, 15 bp, Homo sapiens
aaatgtctcccttag

SEQ ID NO: 14230 - DNA, 15 bp, Homo sapiens
taaatgtctccctta

SEQ ID NO: 14231 - DNA, 15 bp, Homo sapiens
ctaaatgtctccctt

SEQ ID NO: 14232 - DNA, 15 bp, Homo sapiens
cctaaatgtctccct

SEQ ID NO: 14233 - DNA, 15 bp, Homo sapiens
ccctaaatgtctccc

SEQ ID NO: 14234 - DNA, 15 bp, Homo sapiens
tccctaaatgtctcc

SEQ ID NO: 14235 - DNA, 15 bp, Homo sapiens
ttccctaaatgtctc

SEQ ID NO: 14236 - DNA, 15 bp, Homo sapiens
cttccctaaatgtct

SEQ ID NO: 14237 - DNA, 15 bp, Homo sapiens
acttccctaaatgtc

SEQ ID NO: 14238 - DNA, 15 bp, Homo sapiens
gacttccctaaatgt

SEQ ID NO: 14239 - DNA, 15 bp, Homo sapiens
agacttccctaaatg

SEQ ID NO: 14240 - DNA, 15 bp, Homo sapiens
gagacttccctaaat

SEQ ID NO: 14241 - DNA, 15 bp, Homo sapiens
tgagacttccctaaa

SEQ ID NO: 14242 - DNA, 15 bp, Homo sapiens
atgagacttccctaa

SEQ ID NO: 14243 - DNA, 15 bp, Homo sapiens
catgagacttcccta

SEQ ID NO: 14244 - DNA, 15 bp, Homo sapiens
gcatgagacttccct

SEQ ID NO: 14245 - DNA, 15 bp, Homo sapiens
ggcatgagacttccc

SEQ ID NO: 14246 - DNA, 15 bp, Homo sapiens
tggcatgagacttcc

SEQ ID NO: 14247 - DNA, 15 bp, Homo sapiens
atggcatgagacttc

SEQ ID NO: 14248 - DNA, 15 bp, Homo sapiens
gatggcatgagactt

SEQ ID NO: 14249 - DNA, 15 bp, Homo sapiens
ggatggcatgagact

SEQ ID NO: 14250 - DNA, 15 bp, Homo sapiens
aggatggcatgagac

SEQ ID NO: 14251 - DNA, 15 bp, Homo sapiens
taggatggcatgaga

SEQ ID NO: 14252 - DNA, 15 bp, Homo sapiens
ataggatggcatgag

SEQ ID NO: 14253 - DNA, 15 bp, Homo sapiens
gataggatggcatga

SEQ ID NO: 14254 - DNA, 15 bp, Homo sapiens
agataggatggcatg

SEQ ID NO: 14255 - DNA, 15 bp, Homo sapiens
aagataggatggcat

SEQ ID NO: 14256 - DNA, 15 bp, Homo sapiens
aaagataggatggca

SEQ ID NO: 14257 - DNA, 15 bp, Homo sapiens
gaaagataggatggc

SEQ ID NO: 14258 - DNA, 15 bp, Homo sapiens
agaaagataggatgg

SEQ ID NO: 14259 - DNA, 15 bp, Homo sapiens
aagaaagataggatg

SEQ ID NO: 14260 - DNA, 15 bp, Homo sapiens
aaagaaagataggat

SEQ ID NO: 14261 - DNA, 15 bp, Homo sapiens
gaaagaaagatagga

SEQ ID NO: 14262 - DNA, 15 bp, Homo sapiens
agaaagaaagatagg

SEQ ID NO: 14263 - DNA, 15 bp, Homo sapiens
aagaaagaaagatag

SEQ ID NO: 14264 - DNA, 15 bp, Homo sapiens
aaagaaagaaagata

SEQ ID NO: 14265 - DNA, 15 bp, Homo sapiens
gaaagaaagaaagat

SEQ ID NO: 14266 - DNA, 15 bp, Homo sapiens
aaaaaaaagaaagaa

SEQ ID NO: 14267 - DNA, 15 bp, Homo sapiens
aaaaaaaaagaaaga

SEQ ID NO: 14268 - DNA, 15 bp, Homo sapiens
aaaaaaaaaagaaag

SEQ ID NO: 14269 - DNA, 15 bp, Homo sapiens
aaaaaaaaaaagaaa

SEQ ID NO: 14270 - DNA, 15 bp, Homo sapiens
aaaaaaaaaaaagaa

SEQ ID NO: 14271 - DNA, 15 bp, Homo sapiens
gtctcaaaaaaaaaa

SEQ ID NO: 14272 - DNA, 15 bp, Homo sapiens
tgtctcaaaaaaaaa

SEQ ID NO: 14273 - DNA, 15 bp, Homo sapiens
ctgtctcaaaaaaaa

SEQ ID NO: 14274 - DNA, 15 bp, Homo sapiens
gaccctgtctcaaaa

SEQ ID NO: 14275 - DNA, 15 bp, Homo sapiens
agaccctgtctcaaa

SEQ ID NO: 14276 - DNA, 15 bp, Homo sapiens
aagaccctgtctcaa

SEQ ID NO: 14277 - DNA, 15 bp, Homo sapiens
caagaccctgtctca

SEQ ID NO: 14278 - DNA, 15 bp, Homo sapiens
gcaagaccctgtctc

SEQ ID NO: 14279 - DNA, 15 bp, Homo sapiens
agcaagaccctgtct

SEQ ID NO: 14280 - DNA, 15 bp, Homo sapiens
gagcaagaccctgtc

SEQ ID NO: 14281 - DNA, 15 bp, Homo sapiens
ggagcaagaccctgt

SEQ ID NO: 14282 - DNA, 15 bp, Homo sapiens
tggagcaagaccctg

SEQ ID NO: 14283 - DNA, 15 bp, Homo sapiens
atggagcaagaccct

SEQ ID NO: 14284 - DNA, 15 bp, Homo sapiens
aatggagcaagaccc

SEQ ID NO: 14285 - DNA, 15 bp, Homo sapiens
caatggagcaagacc

SEQ ID NO: 14286 - DNA, 15 bp, Homo sapiens
gcaatggagcaagac

SEQ ID NO: 14287 - DNA, 15 bp, Homo sapiens
ggcaatggagcaaga

SEQ ID NO: 14288 - DNA, 15 bp, Homo sapiens
gggcaatggagcaag

SEQ ID NO: 14289 - DNA, 15 bp, Homo sapiens
tgggcaatggagcaa

SEQ ID NO: 14290 - DNA, 15 bp, Homo sapiens
ctgggcaatggagca

SEQ ID NO: 14291 - DNA, 15 bp, Homo sapiens
cctgggcaatggagc

SEQ ID NO: 14292 - DNA, 15 bp, Homo sapiens
gcctgggcaatggag

SEQ ID NO: 14293 - DNA, 15 bp, Homo sapiens
agcctgggcaatgga

SEQ ID NO: 14294 - DNA, 15 bp, Homo sapiens
cagcctgggcaatgg

SEQ ID NO: 14295 - DNA, 15 bp, Homo sapiens
ccagcctgggcaatg

SEQ ID NO: 14296 - DNA, 15 bp, Homo sapiens
tccagcctgggcaat

SEQ ID NO: 14297 - DNA, 15 bp, Homo sapiens
gtcactgcactccag

SEQ ID NO: 14298 - DNA, 15 bp, Homo sapiens
agtcactgcactcca

SEQ ID NO: 14299 - DNA, 15 bp, Homo sapiens
gagtcactgcactcc

SEQ ID NO: 14300 - DNA, 15 bp, Homo sapiens
tgagtcactgcactc

SEQ ID NO: 14301 - DNA, 15 bp, Homo sapiens
ttgagtcactgcact

SEQ ID NO: 14302 - DNA, 15 bp, Homo sapiens
attgagtcactgcac

SEQ ID NO: 14303 - DNA, 15 bp, Homo sapiens
aattgagtcactgca

SEQ ID NO: 14304 - DNA, 15 bp, Homo sapiens
aaattgagtcactgc

SEQ ID NO: 14305 - DNA, 15 bp, Homo sapiens
gaaattgagtcactg

SEQ ID NO: 14306 - DNA, 15 bp, Homo sapiens
tgaaattgagtcact

SEQ ID NO: 14307 - DNA, 15 bp, Homo sapiens
ctgaaattgagtcac

SEQ ID NO: 14308 - DNA, 15 bp, Homo sapiens
gctgaaattgagtca

SEQ ID NO: 14309 - DNA, 15 bp, Homo sapiens
ggctgaaattgagtc

SEQ ID NO: 14310 - DNA, 15 bp, Homo sapiens
gggctgaaattgagt

SEQ ID NO: 14311 - DNA, 15 bp, Homo sapiens
agggctgaaattgag

SEQ ID NO: 14312 - DNA, 15 bp, Homo sapiens
gagggctgaaattga

SEQ ID NO: 14313 - DNA, 15 bp, Homo sapiens
ggagggctgaaattg

SEQ ID NO: 14314 - DNA, 15 bp, Homo sapiens
cggagggctgaaatt

SEQ ID NO: 14315 - DNA, 15 bp, Homo sapiens
gcggagggctgaaat

SEQ ID NO: 14316 - DNA, 15 bp, Homo sapiens
ggcggagggctgaaa

SEQ ID NO: 14317 - DNA, 15 bp, Homo sapiens
aggcggagggctgaa

SEQ ID NO: 14318 - DNA, 15 bp, Homo sapiens
gaggcggagggctga

SEQ ID NO: 14319 - DNA, 15 bp, Homo sapiens
ggaggcggagggctg

SEQ ID NO: 14320 - DNA, 15 bp, Homo sapiens
gggaggcggagggct

SEQ ID NO: 14321 - DNA, 15 bp, Homo sapiens
tgggaggcggagggc

SEQ ID NO: 14322 - DNA, 15 bp, Homo sapiens
ctgggaggcggaggg

SEQ ID NO: 14323 - DNA, 15 bp, Homo sapiens
cctgggaggcggagg

SEQ ID NO: 14324 - DNA, 15 bp, Homo sapiens
acctgggaggcggag

SEQ ID NO: 14325 - DNA, 15 bp, Homo sapiens
aacctgggaggcgga

SEQ ID NO: 14326 - DNA, 15 bp, Homo sapiens
gaacctgggaggcgg

SEQ ID NO: 14327 - DNA, 15 bp, Homo sapiens
tgaacctgggaggcg

SEQ ID NO: 14328 - DNA, 15 bp, Homo sapiens
ttgaacctgggaggc

SEQ ID NO: 14329 - DNA, 15 bp, Homo sapiens
acttgaacctgggag

SEQ ID NO: 14330 - DNA, 15 bp, Homo sapiens
cacttgaacctggga

SEQ ID NO: 14331 - DNA, 15 bp, Homo sapiens
tcacttgaacctggg

SEQ ID NO: 14332 - DNA, 15 bp, Homo sapiens
atcacttgaacctgg

SEQ ID NO: 14333 - DNA, 15 bp, Homo sapiens
aatcacttgaacctg

SEQ ID NO: 14334 - DNA, 15 bp, Homo sapiens
gaatcacttgaacct

SEQ ID NO: 14335 - DNA, 15 bp, Homo sapiens
aagaatcacttgaac

SEQ ID NO: 14336 - DNA, 15 bp, Homo sapiens
gaagaatcacttgaa

SEQ ID NO: 14337 - DNA, 15 bp, Homo sapiens
agaagaatcacttga

SEQ ID NO: 14338 - DNA, 15 bp, Homo sapiens
cagaagaatcacttg

SEQ ID NO: 14339 - DNA, 15 bp, Homo sapiens
gcagaagaatcactt

SEQ ID NO: 14340 - DNA, 15 bp, Homo sapiens
ggcagaagaatcact

SEQ ID NO: 14341 - DNA, 15 bp, Homo sapiens
aggcagaagaatcac

SEQ ID NO: 14342 - DNA, 15 bp, Homo sapiens
gaggcagaagaatca

SEQ ID NO: 14343 - DNA, 15 bp, Homo sapiens
tgaggcagaagaatc

SEQ ID NO: 14344 - DNA, 15 bp, Homo sapiens
ctgaggcagaagaat

SEQ ID NO: 14345 - DNA, 15 bp, Homo sapiens
gctgaggcagaagaa

SEQ ID NO: 14346 - DNA, 15 bp, Homo sapiens
ggctgaggcagaaga

SEQ ID NO: 14347 - DNA, 15 bp, Homo sapiens
aggctgaggcagaag

SEQ ID NO: 14348 - DNA, 15 bp, Homo sapiens
gaggctgaggcagaa

SEQ ID NO: 14349 - DNA, 15 bp, Homo sapiens
ggaggctgaggcaga

SEQ ID NO: 14350 - DNA, 15 bp, Homo sapiens
ggcacctgtaatccc

SEQ ID NO: 14351 - DNA, 15 bp, Homo sapiens
tggcaggcacctgta

SEQ ID NO: 14352 - DNA, 15 bp, Homo sapiens
gtggcaggcacctgt

SEQ ID NO: 14353 - DNA, 15 bp, Homo sapiens
ggtggcaggcacctg

SEQ ID NO: 14354 - DNA, 15 bp, Homo sapiens
tggtggcaggcacct

SEQ ID NO: 14355 - DNA, 15 bp, Homo sapiens
atggtggcaggcacc

SEQ ID NO: 14356 - DNA, 15 bp, Homo sapiens
catggtggcaggcac

SEQ ID NO: 14357 - DNA, 15 bp, Homo sapiens
gcatggtggcaggca

SEQ ID NO: 14358 - DNA, 15 bp, Homo sapiens
agcatggtggcaggc

SEQ ID NO: 14359 - DNA, 15 bp, Homo sapiens
aagcatggtggcagg

SEQ ID NO: 14360 - DNA, 15 bp, Homo sapiens
caagcatggtggcag

SEQ ID NO: 14361 - DNA, 15 bp, Homo sapiens
ccaagcatggtggca

SEQ ID NO: 14362 - DNA, 15 bp, Homo sapiens
gccaagcatggtggc

SEQ ID NO: 14363 - DNA, 15 bp, Homo sapiens
agccaagcatggtgg

SEQ ID NO: 14364 - DNA, 15 bp, Homo sapiens
tagccaagcatggtg

SEQ ID NO: 14365 - DNA, 15 bp, Homo sapiens
gtagccaagcatggt

SEQ ID NO: 14366 - DNA, 15 bp, Homo sapiens
agtagccaagcatgg

SEQ ID NO: 14367 - DNA, 15 bp, Homo sapiens
aagtagccaagcatg

SEQ ID NO: 14368 - DNA, 15 bp, Homo sapiens
aaagtagccaagcat

SEQ ID NO: 14369 - DNA, 15 bp, Homo sapiens
aaaagtagccaagca

SEQ ID NO: 14370 - DNA, 15 bp, Homo sapiens
aaaaagtagccaagc

SEQ ID NO: 14371 - DNA, 15 bp, Homo sapiens
caaaaagtagccaag

SEQ ID NO: 14372 - DNA, 15 bp, Homo sapiens
acaaaaagtagccaa

SEQ ID NO: 14373 - DNA, 15 bp, Homo sapiens
tacaaaaagtagcca

SEQ ID NO: 14374 - DNA, 15 bp, Homo sapiens
cttctactaaaaata

SEQ ID NO: 14375 - DNA, 15 bp, Homo sapiens
acttctactaaaaat

SEQ ID NO: 14376 - DNA, 15 bp, Homo sapiens
cacttctactaaaaa

SEQ ID NO: 14377 - DNA, 15 bp, Homo sapiens
ccacttctactaaaa

SEQ ID NO: 14378 - DNA, 15 bp, Homo sapiens
tccacttctactaaa

SEQ ID NO: 14379 - DNA, 15 bp, Homo sapiens
ctccacttctactaa

SEQ ID NO: 14380 - DNA, 15 bp, Homo sapiens
actccacttctacta

SEQ ID NO: 14381 - DNA, 15 bp, Homo sapiens
aactccacttctact

SEQ ID NO: 14382 - DNA, 15 bp, Homo sapiens
aaactccacttctac

SEQ ID NO: 14383 - DNA, 15 bp, Homo sapiens
gaaactccacttcta

SEQ ID NO: 14384 - DNA, 15 bp, Homo sapiens
tgaaactccacttct

SEQ ID NO: 14385 - DNA, 15 bp, Homo sapiens
gtgaaactccacttc

SEQ ID NO: 14386 - DNA, 15 bp, Homo sapiens
ggtgaaactccactt

SEQ ID NO: 14387 - DNA, 15 bp, Homo sapiens
tggtgaaactccact

SEQ ID NO: 14388 - DNA, 15 bp, Homo sapiens
gtggtgaaactccac

SEQ ID NO: 14389 - DNA, 15 bp, Homo sapiens
cgtggtgaaactcca

SEQ ID NO: 14390 - DNA, 15 bp, Homo sapiens
acgtggtgaaactcc

SEQ ID NO: 14391 - DNA, 15 bp, Homo sapiens
aacgtggtgaaactc

SEQ ID NO: 14392 - DNA, 15 bp, Homo sapiens
caacgtggtgaaact

SEQ ID NO: 14393 - DNA, 15 bp, Homo sapiens
gcaacgtggtgaaac

SEQ ID NO: 14394 - DNA, 15 bp, Homo sapiens
ggcaacgtggtgaaa

SEQ ID NO: 14395 - DNA, 15 bp, Homo sapiens
cggcaacgtggtgaa

SEQ ID NO: 14396 - DNA, 15 bp, Homo sapiens
tcggcaacgtggtga

SEQ ID NO: 14397 - DNA, 15 bp, Homo sapiens
ctcggcaacgtggtg

SEQ ID NO: 14398 - DNA, 15 bp, Homo sapiens
cctcggcaacgtggt

SEQ ID NO: 14399 - DNA, 15 bp, Homo sapiens
gcctcggcaacgtgg

SEQ ID NO: 14400 - DNA, 15 bp, Homo sapiens
agcctcggcaacgtg

SEQ ID NO: 14401 - DNA, 15 bp, Homo sapiens
cagcctcggcaacgt

SEQ ID NO: 14402 - DNA, 15 bp, Homo sapiens
ccagcctcggcaacg

SEQ ID NO: 14403 - DNA, 15 bp, Homo sapiens
accagcctcggcaac

SEQ ID NO: 14404 - DNA, 15 bp, Homo sapiens
gaccagcctcggcaa

SEQ ID NO: 14405 - DNA, 15 bp, Homo sapiens
ggaccagcctcggca

SEQ ID NO: 14406 - DNA, 15 bp, Homo sapiens
aggaccagcctcggc

SEQ ID NO: 14407 - DNA, 15 bp, Homo sapiens
caggaccagcctcgg

SEQ ID NO: 14408 - DNA, 15 bp, Homo sapiens
tcaggaccagcctcg

SEQ ID NO: 14409 - DNA, 15 bp, Homo sapiens
ctcaggaccagcctc

SEQ ID NO: 14410 - DNA, 15 bp, Homo sapiens
gctcaggaccagcct

SEQ ID NO: 14411 - DNA, 15 bp, Homo sapiens
agctcaggaccagcc

SEQ ID NO: 14412 - DNA, 15 bp, Homo sapiens
gagctcaggaccagc

SEQ ID NO: 14413 - DNA, 15 bp, Homo sapiens
ggagctcaggaccag

SEQ ID NO: 14414 - DNA, 15 bp, Homo sapiens
aggagctcaggacca

SEQ ID NO: 14415 - DNA, 15 bp, Homo sapiens
taggagctcaggacc

SEQ ID NO: 14416 - DNA, 15 bp, Homo sapiens
ttaggagctcaggac

SEQ ID NO: 14417 - DNA, 15 bp, Homo sapiens
gttaggagctcagga

SEQ ID NO: 14418 - DNA, 15 bp, Homo sapiens
ggttaggagctcagg

SEQ ID NO: 14419 - DNA, 15 bp, Homo sapiens
aggttaggagctcag

SEQ ID NO: 14420 - DNA, 15 bp, Homo sapiens
gaggttaggagctca

SEQ ID NO: 14421 - DNA, 15 bp, Homo sapiens
tgaggttaggagctc

SEQ ID NO: 14422 - DNA, 15 bp, Homo sapiens
ttgaggttaggagct

SEQ ID NO: 14423 - DNA, 15 bp, Homo sapiens
cttgaggttaggagc

SEQ ID NO: 14424 - DNA, 15 bp, Homo sapiens
acttgaggttaggag

SEQ ID NO: 14425 - DNA, 15 bp, Homo sapiens
cacttgaggttagga

SEQ ID NO: 14426 - DNA, 15 bp, Homo sapiens
tcacttgaggttagg

SEQ ID NO: 14427 - DNA, 15 bp, Homo sapiens
ttcacttgaggttag

SEQ ID NO: 14428 - DNA, 15 bp, Homo sapiens
gttcacttgaggtta

SEQ ID NO: 14429 - DNA, 15 bp, Homo sapiens
ggttcacttgaggtt

SEQ ID NO: 14430 - DNA, 15 bp, Homo sapiens
cggttcacttgaggt

SEQ ID NO: 14431 - DNA, 15 bp, Homo sapiens
gcggttcacttgagg

SEQ ID NO: 14432 - DNA, 15 bp, Homo sapiens
ggcggttcacttgag

SEQ ID NO: 14433 - DNA, 15 bp, Homo sapiens
aggcggttcacttga

SEQ ID NO: 14434 - DNA, 15 bp, Homo sapiens
caggcggttcacttg

SEQ ID NO: 14435 - DNA, 15 bp, Homo sapiens
gcaggcggttcactt

SEQ ID NO: 14436 - DNA, 15 bp, Homo sapiens
ggcaggcggttcact

SEQ ID NO: 14437 - DNA, 15 bp, Homo sapiens
aggcaggcggttcac

SEQ ID NO: 14438 - DNA, 15 bp, Homo sapiens
aaggcaggcggttca

SEQ ID NO: 14439 - DNA, 15 bp, Homo sapiens
caaggcaggcggttc

SEQ ID NO: 14440 - DNA, 15 bp, Homo sapiens
ccaaggcaggcggtt

SEQ ID NO: 14441 - DNA, 15 bp, Homo sapiens
gccaaggcaggcggt

SEQ ID NO: 14442 - DNA, 15 bp, Homo sapiens
ggccaaggcaggcgg

SEQ ID NO: 14443 - DNA, 15 bp, Homo sapiens
aggccaaggcaggcg

SEQ ID NO: 14444 - DNA, 15 bp, Homo sapiens
gaggccaaggcaggc

SEQ ID NO: 14445 - DNA, 15 bp, Homo sapiens
ggaggccaaggcagg

SEQ ID NO: 14446 - DNA, 15 bp, Homo sapiens
gggaggccaaggcag

SEQ ID NO: 14447 - DNA, 15 bp, Homo sapiens
tgggaggccaaggca

SEQ ID NO: 14448 - DNA, 15 bp, Homo sapiens
tttgggaggccaagg

SEQ ID NO: 14449 - DNA, 15 bp, Homo sapiens
ttttgggaggccaag

SEQ ID NO: 14450 - DNA, 15 bp, Homo sapiens
attttgggaggccaa

SEQ ID NO: 14451 - DNA, 15 bp, Homo sapiens
tattttgggaggcca

SEQ ID NO: 14452 - DNA, 15 bp, Homo sapiens
gtattttgggaggcc

SEQ ID NO: 14453 - DNA, 15 bp, Homo sapiens
agtattttgggaggc

SEQ ID NO: 14454 - DNA, 15 bp, Homo sapiens
cagtattttgggagg

SEQ ID NO: 14455 - DNA, 15 bp, Homo sapiens
ccagtattttgggag

SEQ ID NO: 14456 - DNA, 15 bp, Homo sapiens
tccagtattttggga

SEQ ID NO: 14457 - DNA, 15 bp, Homo sapiens
atccagtattttggg

SEQ ID NO: 14458 - DNA, 15 bp, Homo sapiens
aatccagtattttgg

SEQ ID NO: 14459 - DNA, 15 bp, Homo sapiens
taatccagtattttg

SEQ ID NO: 14460 - DNA, 15 bp, Homo sapiens
gtaatccagtatttt

SEQ ID NO: 14461 - DNA, 15 bp, Homo sapiens
tgtaatccagtattt

SEQ ID NO: 14462 - DNA, 15 bp, Homo sapiens
ctgtaatccagtatt

SEQ ID NO: 14463 - DNA, 15 bp, Homo sapiens
cctgtaatccagtat

SEQ ID NO: 14464 - DNA, 15 bp, Homo sapiens
gcctgtaatccagta

SEQ ID NO: 14465 - DNA, 15 bp, Homo sapiens
cgcctgtaatccagt

SEQ ID NO: 14466 - DNA, 15 bp, Homo sapiens
acgcctgtaatccag

SEQ ID NO: 14467 - DNA, 15 bp, Homo sapiens
cacgcctgtaatcca

SEQ ID NO: 14468 - DNA, 15 bp, Homo sapiens
tctcacgcctgtaat

SEQ ID NO: 14469 - DNA, 15 bp, Homo sapiens
gtctcacgcctgtaa

SEQ ID NO: 14470 - DNA, 15 bp, Homo sapiens
tgtctcacgcctgta

SEQ ID NO: 14471 - DNA, 15 bp, Homo sapiens
gtgtctcacgcctgt

SEQ ID NO: 14472 - DNA, 15 bp, Homo sapiens
agtgtctcacgcctg

SEQ ID NO: 14473 - DNA, 15 bp, Homo sapiens
cagtgtctcacgcct

SEQ ID NO: 14474 - DNA, 15 bp, Homo sapiens
gcagtgtctcacgcc

SEQ ID NO: 14475 - DNA, 15 bp, Homo sapiens
agcagtgtctcacgc

SEQ ID NO: 14476 - DNA, 15 bp, Homo sapiens
gagcagtgtctcacg

SEQ ID NO: 14477 - DNA, 15 bp, Homo sapiens
tgagcagtgtctcac

SEQ ID NO: 14478 - DNA, 15 bp, Homo sapiens
atgagcagtgtctca

SEQ ID NO: 14479 - DNA, 15 bp, Homo sapiens
catgagcagtgtctc

SEQ ID NO: 14480 - DNA, 15 bp, Homo sapiens
ccatgagcagtgtct

SEQ ID NO: 14481 - DNA, 15 bp, Homo sapiens
gccatgagcagtgtc

SEQ ID NO: 14482 - DNA, 15 bp, Homo sapiens
ggccatgagcagtgt

SEQ ID NO: 14483 - DNA, 15 bp, Homo sapiens
tggccatgagcagtg

SEQ ID NO: 14484 - DNA, 15 bp, Homo sapiens
gtggccatgagcagt

SEQ ID NO: 14485 - DNA, 15 bp, Homo sapiens
ggtggccatgagcag

SEQ ID NO: 14486 - DNA, 15 bp, Homo sapiens
tggtggccatgagca

SEQ ID NO: 14487 - DNA, 15 bp, Homo sapiens
atggtggccatgagc

SEQ ID NO: 14488 - DNA, 15 bp, Homo sapiens
gatggtggccatgag

SEQ ID NO: 14489 - DNA, 15 bp, Homo sapiens
ggatggtggccatga

SEQ ID NO: 14490 - DNA, 15 bp, Homo sapiens
aggatggtggccatg

SEQ ID NO: 14491 - DNA, 15 bp, Homo sapiens
taggatggtggccat

SEQ ID NO: 14492 - DNA, 15 bp, Homo sapiens
gtaggatggtggcca

SEQ ID NO: 14493 - DNA, 15 bp, Homo sapiens
agtaggatggtggcc

SEQ ID NO: 14494 - DNA, 15 bp, Homo sapiens
aagtaggatggtggc

SEQ ID NO: 14495 - DNA, 15 bp, Homo sapiens
aaagtaggatggtgg

SEQ ID NO: 14496 - DNA, 15 bp, Homo sapiens
gaaagtaggatggtg

SEQ ID NO: 14497 - DNA, 15 bp, Homo sapiens
agaaagtaggatggt

SEQ ID NO: 14498 - DNA, 15 bp, Homo sapiens
tagaaagtaggatgg

SEQ ID NO: 14499 - DNA, 15 bp, Homo sapiens
ttagaaagtaggatg

SEQ ID NO: 14500 - DNA, 15 bp, Homo sapiens
gttagaaagtaggat

SEQ ID NO: 14501 - DNA, 15 bp, Homo sapiens
tgttagaaagtagga

SEQ ID NO: 14502 - DNA, 15 bp, Homo sapiens
ctgttagaaagtagg

SEQ ID NO: 14503 - DNA, 15 bp, Homo sapiens
gctgttagaaagtag

SEQ ID NO: 14504 - DNA, 15 bp, Homo sapiens
tgctgttagaaagta

SEQ ID NO: 14505 - DNA, 15 bp, Homo sapiens
gtgctgttagaaagt

SEQ ID NO: 14506 - DNA, 15 bp, Homo sapiens
agtgctgttagaaag

SEQ ID NO: 14507 - DNA, 15 bp, Homo sapiens
cagtgctgttagaaa

SEQ ID NO: 14508 - DNA, 15 bp, Homo sapiens
gcagtgctgttagaa

SEQ ID NO: 14509 - DNA, 15 bp, Homo sapiens
ggcagtgctgttaga

SEQ ID NO: 14510 - DNA, 15 bp, Homo sapiens
gggcagtgctgttag

SEQ ID NO: 14511 - DNA, 15 bp, Homo sapiens
ggggcagtgctgtta

SEQ ID NO: 14512 - DNA, 15 bp, Homo sapiens
tggggcagtgctgtt

SEQ ID NO: 14513 - DNA, 15 bp, Homo sapiens
gtggggcagtgctgt

SEQ ID NO: 14514 - DNA, 15 bp, Homo sapiens
ggtggggcagtgctg

SEQ ID NO: 14515 - DNA, 15 bp, Homo sapiens
gggtggggcagtgct

SEQ ID NO: 14516 - DNA, 15 bp, Homo sapiens
agggtggggcagtgc

SEQ ID NO: 14517 - DNA, 15 bp, Homo sapiens
gagggtggggcagtg

SEQ ID NO: 14518 - DNA, 15 bp, Homo sapiens
ggagggtggggcagt

SEQ ID NO: 14519 - DNA, 15 bp, Homo sapiens
gggagggtggggcag

SEQ ID NO: 14520 - DNA, 15 bp, Homo sapiens
ggggagggtggggca

SEQ ID NO: 14521 - DNA, 15 bp, Homo sapiens
gggggagggtggggc

SEQ ID NO: 14522 - DNA, 15 bp, Homo sapiens
agggggagggtgggg

SEQ ID NO: 14523 - DNA, 15 bp, Homo sapiens
gagggggagggtggg

SEQ ID NO: 14524 - DNA, 15 bp, Homo sapiens
cgagggggagggtgg

SEQ ID NO: 14525 - DNA, 15 bp, Homo sapiens
gcgagggggagggtg

SEQ ID NO: 14526 - DNA, 15 bp, Homo sapiens
ggcgagggggagggt

SEQ ID NO: 14527 - DNA, 15 bp, Homo sapiens
gggcgagggggaggg

SEQ ID NO: 14528 - DNA, 15 bp, Homo sapiens
ggggcgagggggagg

SEQ ID NO: 14529 - DNA, 15 bp, Homo sapiens
tggggcgagggggag

SEQ ID NO: 14530 - DNA, 15 bp, Homo sapiens
ttggggcgaggggga

SEQ ID NO: 14531 - DNA, 15 bp, Homo sapiens
tttggggcgaggggg

SEQ ID NO: 14532 - DNA, 15 bp, Homo sapiens
ttttggggcgagggg

SEQ ID NO: 14533 - DNA, 15 bp, Homo sapiens
tttttggggcgaggg

SEQ ID NO: 14534 - DNA, 15 bp, Homo sapiens
gtttttggggcgagg

SEQ ID NO: 14535 - DNA, 15 bp, Homo sapiens
ggtttttggggcgag

SEQ ID NO: 14536 - DNA, 15 bp, Homo sapiens
tggtttttggggcga

SEQ ID NO: 14537 - DNA, 15 bp, Homo sapiens
gtggtttttggggcg

SEQ ID NO: 14538 - DNA, 15 bp, Homo sapiens
ggtggtttttggggc

SEQ ID NO: 14539 - DNA, 15 bp, Homo sapiens
tggtggtttttgggg

SEQ ID NO: 14540 - DNA, 15 bp, Homo sapiens
atggtggtttttggg

SEQ ID NO: 14541 - DNA, 15 bp, Homo sapiens
catggtggtttttgg

SEQ ID NO: 14542 - DNA, 15 bp, Homo sapiens
tcatggtggtttttg

SEQ ID NO: 14543 - DNA, 15 bp, Homo sapiens
ttcatggtggttttt

SEQ ID NO: 14544 - DNA, 15 bp, Homo sapiens
cttcatggtggtttt

SEQ ID NO: 14545 - DNA, 15 bp, Homo sapiens
ccttcatggtggttt

SEQ ID NO: 14546 - DNA, 15 bp, Homo sapiens
tccttcatggtggtt

SEQ ID NO: 14547 - DNA, 15 bp, Homo sapiens
ctccttcatggtggt

SEQ ID NO: 14548 - DNA, 15 bp, Homo sapiens
cctccttcatggtgg

SEQ ID NO: 14549 - DNA, 15 bp, Homo sapiens
gcctccttcatggtg

SEQ ID NO: 14550 - DNA, 15 bp, Homo sapiens
tgcctccttcatggt

SEQ ID NO: 14551 - DNA, 15 bp, Homo sapiens
ctgcctccttcatgg

SEQ ID NO: 14552 - DNA, 15 bp, Homo sapiens
tctgcctccttcatg

SEQ ID NO: 14553 - DNA, 15 bp, Homo sapiens
ctctgcctccttcat

SEQ ID NO: 14554 - DNA, 15 bp, Homo sapiens
cctctgcctccttca

SEQ ID NO: 14555 - DNA, 15 bp, Homo sapiens
ccctctgcctccttc

SEQ ID NO: 14556 - DNA, 15 bp, Homo sapiens
gccctctgcctcctt

SEQ ID NO: 14557 - DNA, 15 bp, Homo sapiens
tgccctctgcctcct

SEQ ID NO: 14558 - DNA, 15 bp, Homo sapiens
gtgccctctgcctcc

SEQ ID NO: 14559 - DNA, 15 bp, Homo sapiens
ggtgccctctgcctc

SEQ ID NO: 14560 - DNA, 15 bp, Homo sapiens
tggtgccctctgcct

SEQ ID NO: 14561 - DNA, 15 bp, Homo sapiens
ctggtgccctctgcc

SEQ ID NO: 14562 - DNA, 15 bp, Homo sapiens
cctggtgccctctgc

SEQ ID NO: 14563 - DNA, 15 bp, Homo sapiens
acctggtgccctctg

SEQ ID NO: 14564 - DNA, 15 bp, Homo sapiens
cacctggtgccctct

SEQ ID NO: 14565 - DNA, 15 bp, Homo sapiens
tcacctggtgccctc

SEQ ID NO: 14566 - DNA, 15 bp, Homo sapiens
ttcacctggtgccct

SEQ ID NO: 14567 - DNA, 15 bp, Homo sapiens
cttcacctggtgccc

SEQ ID NO: 14568 - DNA, 15 bp, Homo sapiens
tcttcacctggtgcc

SEQ ID NO: 14569 - DNA, 15 bp, Homo sapiens
gtcttcacctggtgc

SEQ ID NO: 14570 - DNA, 15 bp, Homo sapiens
agtcttcacctggtg

SEQ ID NO: 14571 - DNA, 15 bp, Homo sapiens
cagtcttcacctggt

SEQ ID NO: 14572 - DNA, 15 bp, Homo sapiens
gcagtcttcacctgg

SEQ ID NO: 14573 - DNA, 15 bp, Homo sapiens
ggcagtcttcacctg

SEQ ID NO: 14574 - DNA, 15 bp, Homo sapiens
gggcagtcttcacct

SEQ ID NO: 14575 - DNA, 15 bp, Homo sapiens
tgggcagtcttcacc

SEQ ID NO: 14576 - DNA, 15 bp, Homo sapiens
atgggcagtcttcac

SEQ ID NO: 14577 - DNA, 15 bp, Homo sapiens
catgggcagtcttca

SEQ ID NO: 14578 - DNA, 15 bp, Homo sapiens
ccatgggcagtcttc

SEQ ID NO: 14579 - DNA, 15 bp, Homo sapiens
accatgggcagtctt

SEQ ID NO: 14580 - DNA, 15 bp, Homo sapiens
gaccatgggcagtct

SEQ ID NO: 14581 - DNA, 15 bp, Homo sapiens
ggaccatgggcagtc

SEQ ID NO: 14582 - DNA, 15 bp, Homo sapiens
aggaccatgggcagt

SEQ ID NO: 14583 - DNA, 15 bp, Homo sapiens
aaggaccatgggcag

SEQ ID NO: 14584 - DNA, 15 bp, Homo sapiens
aaaggaccatgggca

SEQ ID NO: 14585 - DNA, 15 bp, Homo sapiens
aaaaggaccatgggc

SEQ ID NO: 14586 - DNA, 15 bp, Homo sapiens
gaaaaggaccatggg

SEQ ID NO: 14587 - DNA, 15 bp, Homo sapiens
agaaaaggaccatgg

SEQ ID NO: 14588 - DNA, 15 bp, Homo sapiens
aagaaaaggaccatg

SEQ ID NO: 14589 - DNA, 15 bp, Homo sapiens
taagaaaaggaccat

SEQ ID NO: 14590 - DNA, 15 bp, Homo sapiens
gtaagaaaaggacca

SEQ ID NO: 14591 - DNA, 15 bp, Homo sapiens
ggtaagaaaaggacc

SEQ ID NO: 14592 - DNA, 15 bp, Homo sapiens
aggtaagaaaaggac

SEQ ID NO: 14593 - DNA, 15 bp, Homo sapiens
gaggtaagaaaagga

SEQ ID NO: 14594 - DNA, 15 bp, Homo sapiens
agaggtaagaaaagg

SEQ ID NO: 14595 - DNA, 15 bp, Homo sapiens
cagaggtaagaaaag

SEQ ID NO: 14596 - DNA, 15 bp, Homo sapiens
acagaggtaagaaaa

SEQ ID NO: 14597 - DNA, 15 bp, Homo sapiens
cacagaggtaagaaa

SEQ ID NO: 14598 - DNA, 15 bp, Homo sapiens
tcacagaggtaagaa

SEQ ID NO: 14599 - DNA, 15 bp, Homo sapiens
gtcacagaggtaaga

SEQ ID NO: 14600 - DNA, 15 bp, Homo sapiens
agtcacagaggtaag

SEQ ID NO: 14601 - DNA, 15 bp, Homo sapiens
aagtcacagaggtaa

SEQ ID NO: 14602 - DNA, 15 bp, Homo sapiens
gaagtcacagaggta

SEQ ID NO: 14603 - DNA, 15 bp, Homo sapiens
cgaagtcacagaggt

SEQ ID NO: 14604 - DNA, 15 bp, Homo sapiens
gcgaagtcacagagg

SEQ ID NO: 14605 - DNA, 15 bp, Homo sapiens
agcgaagtcacagag

SEQ ID NO: 14606 - DNA, 15 bp, Homo sapiens
aagcgaagtcacaga

SEQ ID NO: 14607 - DNA, 15 bp, Homo sapiens
caagcgaagtcacag

SEQ ID NO: 14608 - DNA, 15 bp, Homo sapiens
acaagcgaagtcaca

SEQ ID NO: 14609 - DNA, 15 bp, Homo sapiens
aacaagcgaagtcac

SEQ ID NO: 14610 - DNA, 15 bp, Homo sapiens
aaacaagcgaagtca

SEQ ID NO: 14611 - DNA, 15 bp, Homo sapiens
aaaacaagcgaagtc

SEQ ID NO: 14612 - DNA, 15 bp, Homo sapiens
caaaacaagcgaagt

SEQ ID NO: 14613 - DNA, 15 bp, Homo sapiens
acaaaacaagcgaag

SEQ ID NO: 14614 - DNA, 15 bp, Homo sapiens
cacaaaacaagcgaa

SEQ ID NO: 14615 - DNA, 15 bp, Homo sapiens
acacaaaacaagcga

SEQ ID NO: 14616 - DNA, 15 bp, Homo sapiens
aacacaaaacaagcg

SEQ ID NO: 14617 - DNA, 15 bp, Homo sapiens
gaacacaaaacaagc

SEQ ID NO: 14618 - DNA, 15 bp, Homo sapiens
agaacacaaaacaag

SEQ ID NO: 14619 - DNA, 15 bp, Homo sapiens
cagaacacaaaacaa

SEQ ID NO: 14620 - DNA, 15 bp, Homo sapiens
ccagaacacaaaaca

SEQ ID NO: 14621 - DNA, 15 bp, Homo sapiens
cccagaacacaaaac

SEQ ID NO: 14622 - DNA, 15 bp, Homo sapiens
gcccagaacacaaaa

SEQ ID NO: 14623 - DNA, 15 bp, Homo sapiens
agcccagaacacaaa

SEQ ID NO: 14624 - DNA, 15 bp, Homo sapiens
aagcccagaacacaa

SEQ ID NO: 14625 - DNA, 15 bp, Homo sapiens
caagcccagaacaca

SEQ ID NO: 14626 - DNA, 15 bp, Homo sapiens
tcaagcccagaacac

SEQ ID NO: 14627 - DNA, 15 bp, Homo sapiens
atcaagcccagaaca

SEQ ID NO: 14628 - DNA, 15 bp, Homo sapiens
aatcaagcccagaac

SEQ ID NO: 14629 - DNA, 15 bp, Homo sapiens
caatcaagcccagaa

SEQ ID NO: 14630 - DNA, 15 bp, Homo sapiens
acaatcaagcccaga

SEQ ID NO: 14631 - DNA, 15 bp, Homo sapiens
aacaatcaagcccag

SEQ ID NO: 14632 - DNA, 15 bp, Homo sapiens
gaacaatcaagccca

SEQ ID NO: 14633 - DNA, 15 bp, Homo sapiens
agaacaatcaagccc

SEQ ID NO: 14634 - DNA, 15 bp, Homo sapiens
gagaacaatcaagcc

SEQ ID NO: 14635 - DNA, 15 bp, Homo sapiens
ggagaacaatcaagc

SEQ ID NO: 14636 - DNA, 15 bp, Homo sapiens
aggagaacaatcaag

SEQ ID NO: 14637 - DNA, 15 bp, Homo sapiens
aaggagaacaatcaa

SEQ ID NO: 14638 - DNA, 15 bp, Homo sapiens
gaaggagaacaatca

SEQ ID NO: 14639 - DNA, 15 bp, Homo sapiens
agaaggagaacaatc

SEQ ID NO: 14640 - DNA, 15 bp, Homo sapiens
gagaaggagaacaat

SEQ ID NO: 14641 - DNA, 15 bp, Homo sapiens
ggagaaggagaacaa

SEQ ID NO: 14642 - DNA, 15 bp, Homo sapiens
gggagaaggagaaca

SEQ ID NO: 14643 - DNA, 15 bp, Homo sapiens
agggagaaggagaac

SEQ ID NO: 14644 - DNA, 15 bp, Homo sapiens
cagggagaaggagaa

SEQ ID NO: 14645 - DNA, 15 bp, Homo sapiens
gcagggagaaggaga

SEQ ID NO: 14646 - DNA, 15 bp, Homo sapiens
cgcagggagaaggag

SEQ ID NO: 14647 - DNA, 15 bp, Homo sapiens
acgcagggagaagga

SEQ ID NO: 14648 - DNA, 15 bp, Homo sapiens
gacgcagggagaagg

SEQ ID NO: 14649 - DNA, 15 bp, Homo sapiens
ggacgcagggagaag

SEQ ID NO: 14650 - DNA, 15 bp, Homo sapiens
gggacgcagggagaa

SEQ ID NO: 14651 - DNA, 15 bp, Homo sapiens
ggggacgcagggaga

SEQ ID NO: 14652 - DNA, 15 bp, Homo sapiens
tggggacgcagggag

SEQ ID NO: 14653 - DNA, 15 bp, Homo sapiens
ctggggacgcaggga

SEQ ID NO: 14654 - DNA, 15 bp, Homo sapiens
actggggacgcaggg

SEQ ID NO: 14655 - DNA, 15 bp, Homo sapiens
aactggggacgcagg

SEQ ID NO: 14656 - DNA, 15 bp, Homo sapiens
aaactggggacgcag

SEQ ID NO: 14657 - DNA, 15 bp, Homo sapiens
aaaactggggacgca

SEQ ID NO: 14658 - DNA, 15 bp, Homo sapiens
caaaactggggacgc

SEQ ID NO: 14659 - DNA, 15 bp, Homo sapiens
gcaaaactggggacg

SEQ ID NO: 14660 - DNA, 15 bp, Homo sapiens
tgcaaaactggggac

SEQ ID NO: 14661 - DNA, 15 bp, Homo sapiens
ttgcaaaactgggga

SEQ ID NO: 14662 - DNA, 15 bp, Homo sapiens
gttgcaaaactgggg

SEQ ID NO: 14663 - DNA, 15 bp, Homo sapiens
ggttgcaaaactggg

SEQ ID NO: 14664 - DNA, 15 bp, Homo sapiens
aggttgcaaaactgg

SEQ ID NO: 14665 - DNA, 15 bp, Homo sapiens
gaggttgcaaaactg

SEQ ID NO: 14666 - DNA, 15 bp, Homo sapiens
ggaggttgcaaaact

SEQ ID NO: 14667 - DNA, 15 bp, Homo sapiens
tggaggttgcaaaac

SEQ ID NO: 14668 - DNA, 15 bp, Homo sapiens
atggaggttgcaaaa

SEQ ID NO: 14669 - DNA, 15 bp, Homo sapiens
gatggaggttgcaaa

SEQ ID NO: 14670 - DNA, 15 bp, Homo sapiens
agatggaggttgcaa

SEQ ID NO: 14671 - DNA, 15 bp, Homo sapiens
aagatggaggttgca

SEQ ID NO: 14672 - DNA, 15 bp, Homo sapiens
aaagatggaggttgc

SEQ ID NO: 14673 - DNA, 15 bp, Homo sapiens
taaagatggaggttg

SEQ ID NO: 14674 - DNA, 15 bp, Homo sapiens
ttaaagatggaggtt

SEQ ID NO: 14675 - DNA, 15 bp, Homo sapiens
tttaaagatggaggt

SEQ ID NO: 14676 - DNA, 15 bp, Homo sapiens
ttttaaagatggagg

SEQ ID NO: 14677 - DNA, 15 bp, Homo sapiens
gttttaaagatggag

SEQ ID NO: 14678 - DNA, 15 bp, Homo sapiens
tgttttaaagatgga

SEQ ID NO: 14679 - DNA, 15 bp, Homo sapiens
atgttttaaagatgg

SEQ ID NO: 14680 - DNA, 15 bp, Homo sapiens
gatgttttaaagatg

SEQ ID NO: 14681 - DNA, 15 bp, Homo sapiens
tgatgttttaaagat

SEQ ID NO: 14682 - DNA, 15 bp, Homo sapiens
ctgatgttttaaaga

SEQ ID NO: 14683 - DNA, 15 bp, Homo sapiens
gctgatgttttaaag

SEQ ID NO: 14684 - DNA, 15 bp, Homo sapiens
tgctgatgttttaaa

SEQ ID NO: 14685 - DNA, 15 bp, Homo sapiens
atgctgatgttttaa

SEQ ID NO: 14686 - DNA, 15 bp, Homo sapiens
gatgctgatgtttta

SEQ ID NO: 14687 - DNA, 15 bp, Homo sapiens
tgatgctgatgtttt

SEQ ID NO: 14688 - DNA, 15 bp, Homo sapiens
ctgatgctgatgttt

SEQ ID NO: 14689 - DNA, 15 bp, Homo sapiens
actgatgctgatgtt

SEQ ID NO: 14690 - DNA, 15 bp, Homo sapiens
cactgatgctgatgt

SEQ ID NO: 14691 - DNA, 15 bp, Homo sapiens
gcactgatgctgatg

SEQ ID NO: 14692 - DNA, 15 bp, Homo sapiens
ggcactgatgctgat

SEQ ID NO: 14693 - DNA, 15 bp, Homo sapiens
tggcactgatgctga

SEQ ID NO: 14694 - DNA, 15 bp, Homo sapiens
gtggcactgatgctg

SEQ ID NO: 14695 - DNA, 15 bp, Homo sapiens
ggtggcactgatgct

SEQ ID NO: 14696 - DNA, 15 bp, Homo sapiens
tggtggcactgatgc

SEQ ID NO: 14697 - DNA, 15 bp, Homo sapiens
ctggtggcactgatg

SEQ ID NO: 14698 - DNA, 15 bp, Homo sapiens
cctggtggcactgat

SEQ ID NO: 14699 - DNA, 15 bp, Homo sapiens
acctggtggcactga

SEQ ID NO: 14700 - DNA, 15 bp, Homo sapiens
cacctggtggcactg

SEQ ID NO: 14701 - DNA, 15 bp, Homo sapiens
acacctggtggcact

SEQ ID NO: 14702 - DNA, 15 bp, Homo sapiens
aacacctggtggcac

SEQ ID NO: 14703 - DNA, 15 bp, Homo sapiens
gaacacctggtggca

SEQ ID NO: 14704 - DNA, 15 bp, Homo sapiens
agaacacctggtggc

SEQ ID NO: 14705 - DNA, 15 bp, Homo sapiens
cagaacacctggtgg

SEQ ID NO: 14706 - DNA, 15 bp, Homo sapiens
gcagaacacctggtg

SEQ ID NO: 14707 - DNA, 15 bp, Homo sapiens
agcagaacacctggt

SEQ ID NO: 14708 - DNA, 15 bp, Homo sapiens
gagcagaacacctgg

SEQ ID NO: 14709 - DNA, 15 bp, Homo sapiens
agagcagaacacctg

SEQ ID NO: 14710 - DNA, 15 bp, Homo sapiens
gagagcagaacacct

SEQ ID NO: 14711 - DNA, 15 bp, Homo sapiens
agagagcagaacacc

SEQ ID NO: 14712 - DNA, 15 bp, Homo sapiens
cagagagcagaacac

SEQ ID NO: 14713 - DNA, 15 bp, Homo sapiens
acagagagcagaaca

SEQ ID NO: 14714 - DNA, 15 bp, Homo sapiens
cacagagagcagaac

SEQ ID NO: 14715 - DNA, 15 bp, Homo sapiens
gcacagagagcagaa

SEQ ID NO: 14716 - DNA, 15 bp, Homo sapiens
agcacagagagcaga

SEQ ID NO: 14717 - DNA, 15 bp, Homo sapiens
tagcacagagagcag

SEQ ID NO: 14718 - DNA, 15 bp, Homo sapiens
atagcacagagagca

SEQ ID NO: 14719 - DNA, 15 bp, Homo sapiens
gatagcacagagagc

SEQ ID NO: 14720 - DNA, 15 bp, Homo sapiens
agatagcacagagag

SEQ ID NO: 14721 - DNA, 15 bp, Homo sapiens
cagatagcacagaga

SEQ ID NO: 14722 - DNA, 15 bp, Homo sapiens
gcagatagcacagag

SEQ ID NO: 14723 - DNA, 15 bp, Homo sapiens
tgcagatagcacaga

SEQ ID NO: 14724 - DNA, 15 bp, Homo sapiens
atgcagatagcacag

SEQ ID NO: 14725 - DNA, 15 bp, Homo sapiens
catgcagatagcaca

SEQ ID NO: 14726 - DNA, 15 bp, Homo sapiens
gcatgcagatagcac

SEQ ID NO: 14727 - DNA, 15 bp, Homo sapiens
ggcatgcagatagca

SEQ ID NO: 14728 - DNA, 15 bp, Homo sapiens
tggcatgcagatagc

SEQ ID NO: 14729 - DNA, 15 bp, Homo sapiens
ctggcatgcagatag

SEQ ID NO: 14730 - DNA, 15 bp, Homo sapiens
tctggcatgcagata

SEQ ID NO: 14731 - DNA, 15 bp, Homo sapiens
ttctggcatgcagat

SEQ ID NO: 14732 - DNA, 15 bp, Homo sapiens
attctggcatgcaga

SEQ ID NO: 14733 - DNA, 15 bp, Homo sapiens
gattctggcatgcag

SEQ ID NO: 14734 - DNA, 15 bp, Homo sapiens
tgattctggcatgca

SEQ ID NO: 14735 - DNA, 15 bp, Homo sapiens
ttgattctggcatgc

SEQ ID NO: 14736 - DNA, 15 bp, Homo sapiens
attgattctggcatg

SEQ ID NO: 14737 - DNA, 15 bp, Homo sapiens
gattgattctggcat

SEQ ID NO: 14738 - DNA, 15 bp, Homo sapiens
agattgattctggca

SEQ ID NO: 14739 - DNA, 15 bp, Homo sapiens
aagattgattctggc

SEQ ID NO: 14740 - DNA, 15 bp, Homo sapiens
aaagattgattctgg

SEQ ID NO: 14741 - DNA, 15 bp, Homo sapiens
gaaagattgattctg

SEQ ID NO: 14742 - DNA, 15 bp, Homo sapiens
ggaaagattgattct

SEQ ID NO: 14743 - DNA, 15 bp, Homo sapiens
gggaaagattgattc

SEQ ID NO: 14744 - DNA, 15 bp, Homo sapiens
tgggaaagattgatt

SEQ ID NO: 14745 - DNA, 15 bp, Homo sapiens
gtgggaaagattgat

SEQ ID NO: 14746 - DNA, 15 bp, Homo sapiens
cgtgggaaagattga

SEQ ID NO: 14747 - DNA, 15 bp, Homo sapiens
acgtgggaaagattg

SEQ ID NO: 14748 - DNA, 15 bp, Homo sapiens
cacgtgggaaagatt

SEQ ID NO: 14749 - DNA, 15 bp, Homo sapiens
acacgtgggaaagat

SEQ ID NO: 14750 - DNA, 15 bp, Homo sapiens
aacacgtgggaaaga

SEQ ID NO: 14751 - DNA, 15 bp, Homo sapiens
gaacacgtgggaaag

SEQ ID NO: 14752 - DNA, 15 bp, Homo sapiens
tgaacacgtgggaaa

SEQ ID NO: 14753 - DNA, 15 bp, Homo sapiens
gtgaacacgtgggaa

SEQ ID NO: 14754 - DNA, 15 bp, Homo sapiens
agtgaacacgtggga

SEQ ID NO: 14755 - DNA, 15 bp, Homo sapiens
gagtgaacacgtggg

SEQ ID NO: 14756 - DNA, 15 bp, Homo sapiens
agagtgaacacgtgg

SEQ ID NO: 14757 - DNA, 15 bp, Homo sapiens
aagagtgaacacgtg

SEQ ID NO: 14758 - DNA, 15 bp, Homo sapiens
gaagagtgaacacgt

SEQ ID NO: 14759 - DNA, 15 bp, Homo sapiens
tgaagagtgaacacg

SEQ ID NO: 14760 - DNA, 15 bp, Homo sapiens
atgaagagtgaacac

SEQ ID NO: 14761 - DNA, 15 bp, Homo sapiens
aatgaagagtgaaca

SEQ ID NO: 14762 - DNA, 15 bp, Homo sapiens
aaatgaagagtgaac

SEQ ID NO: 14763 - DNA, 15 bp, Homo sapiens
gaaatgaagagtgaa

SEQ ID NO: 14764 - DNA, 15 bp, Homo sapiens
agaaatgaagagtga

SEQ ID NO: 14765 - DNA, 15 bp, Homo sapiens
cagaaatgaagagtg

SEQ ID NO: 14766 - DNA, 15 bp, Homo sapiens
acagaaatgaagagt

SEQ ID NO: 14767 - DNA, 15 bp, Homo sapiens
aacagaaatgaagag

SEQ ID NO: 14768 - DNA, 15 bp, Homo sapiens
aaacagaaatgaaga

SEQ ID NO: 14769 - DNA, 15 bp, Homo sapiens
caaacagaaatgaag

SEQ ID NO: 14770 - DNA, 15 bp, Homo sapiens
acaaacagaaatgaa

SEQ ID NO: 14771 - DNA, 15 bp, Homo sapiens
cacaaacagaaatga

SEQ ID NO: 14772 - DNA, 15 bp, Homo sapiens
ccacaaacagaaatg

SEQ ID NO: 14773 - DNA, 15 bp, Homo sapiens
gccacaaacagaaat

SEQ ID NO: 14774 - DNA, 15 bp, Homo sapiens
ggccacaaacagaaa

SEQ ID NO: 14775 - DNA, 15 bp, Homo sapiens
gggccacaaacagaa

SEQ ID NO: 14776 - DNA, 15 bp, Homo sapiens
agggccacaaacaga

SEQ ID NO: 14777 - DNA, 15 bp, Homo sapiens
aagggccacaaacag

SEQ ID NO: 14778 - DNA, 15 bp, Homo sapiens
gaagggccacaaaca

SEQ ID NO: 14779 - DNA, 15 bp, Homo sapiens
agaagggccacaaac

SEQ ID NO: 14780 - DNA, 15 bp, Homo sapiens
cagaagggccacaaa

SEQ ID NO: 14781 - DNA, 15 bp, Homo sapiens
ccagaagggccacaa

SEQ ID NO: 14782 - DNA, 15 bp, Homo sapiens
gccagaagggccaca

SEQ ID NO: 14783 - DNA, 15 bp, Homo sapiens
agccagaagggccac

SEQ ID NO: 14784 - DNA, 15 bp, Homo sapiens
aagccagaagggcca

SEQ ID NO: 14785 - DNA, 15 bp, Homo sapiens
caagccagaagggcc

SEQ ID NO: 14786 - DNA, 15 bp, Homo sapiens
acaagccagaagggc

SEQ ID NO: 14787 - DNA, 15 bp, Homo sapiens
cacaagccagaaggg

SEQ ID NO: 14788 - DNA, 15 bp, Homo sapiens
acacaagccagaagg

SEQ ID NO: 14789 - DNA, 15 bp, Homo sapiens
tacacaagccagaag

SEQ ID NO: 14790 - DNA, 15 bp, Homo sapiens
atacacaagccagaa

SEQ ID NO: 14791 - DNA, 15 bp, Homo sapiens
catacacaagccaga

SEQ ID NO: 14792 - DNA, 15 bp, Homo sapiens
acatacacaagccag

SEQ ID NO: 14793 - DNA, 15 bp, Homo sapiens
gacatacacaagcca

SEQ ID NO: 14794 - DNA, 15 bp, Homo sapiens
agacatacacaagcc

SEQ ID NO: 14795 - DNA, 15 bp, Homo sapiens
tagacatacacaagc

SEQ ID NO: 14796 - DNA, 15 bp, Homo sapiens
atagacatacacaag

SEQ ID NO: 14797 - DNA, 15 bp, Homo sapiens
tatagacatacacaa

SEQ ID NO: 14798 - DNA, 15 bp, Homo sapiens
atatagacatacaca

SEQ ID NO: 14799 - DNA, 15 bp, Homo sapiens
catatagacatacac

SEQ ID NO: 14800 - DNA, 15 bp, Homo sapiens
gcatatagacataca

SEQ ID NO: 14801 - DNA, 15 bp, Homo sapiens
ggcatatagacatac

SEQ ID NO: 14802 - DNA, 15 bp, Homo sapiens
aggcatatagacata

SEQ ID NO: 14803 - DNA, 15 bp, Homo sapiens
aaggcatatagacat

SEQ ID NO: 14804 - DNA, 15 bp, Homo sapiens
aaaggcatatagaca

SEQ ID NO: 14805 - DNA, 15 bp, Homo sapiens
aaaaggcatatagac

SEQ ID NO: 14806 - DNA, 15 bp, Homo sapiens
aaaaaggcatataga

SEQ ID NO: 14807 - DNA, 15 bp, Homo sapiens
aaaaaaggcatatag

SEQ ID NO: 14808 - DNA, 15 bp, Homo sapiens
gaaaaaaggcatata

SEQ ID NO: 14809 - DNA, 15 bp, Homo sapiens
tgaaaaaaggcatat

SEQ ID NO: 14810 - DNA, 15 bp, Homo sapiens
atgaaaaaaggcata

SEQ ID NO: 14811 - DNA, 15 bp, Homo sapiens
gatgaaaaaaggcat

SEQ ID NO: 14812 - DNA, 15 bp, Homo sapiens
agatgaaaaaaggca

SEQ ID NO: 14813 - DNA, 15 bp, Homo sapiens
cagatgaaaaaaggc

SEQ ID NO: 14814 - DNA, 15 bp, Homo sapiens
tcagatgaaaaaagg

SEQ ID NO: 14815 - DNA, 15 bp, Homo sapiens
gtcagatgaaaaaag

SEQ ID NO: 14816 - DNA, 15 bp, Homo sapiens
agtcagatgaaaaaa

SEQ ID NO: 14817 - DNA, 15 bp, Homo sapiens
aagtcagatgaaaaa

SEQ ID NO: 14818 - DNA, 15 bp, Homo sapiens
aaagtcagatgaaaa

SEQ ID NO: 14819 - DNA, 15 bp, Homo sapiens
gaaagtcagatgaaa

SEQ ID NO: 14820 - DNA, 15 bp, Homo sapiens
agaaagtcagatgaa

SEQ ID NO: 14821 - DNA, 15 bp, Homo sapiens
cagaaagtcagatga

SEQ ID NO: 14822 - DNA, 15 bp, Homo sapiens
tcagaaagtcagatg

SEQ ID NO: 14823 - DNA, 15 bp, Homo sapiens
atcagaaagtcagat

SEQ ID NO: 14824 - DNA, 15 bp, Homo sapiens
catcagaaagtcaga

SEQ ID NO: 14825 - DNA, 15 bp, Homo sapiens
gcatcagaaagtcag

SEQ ID NO: 14826 - DNA, 15 bp, Homo sapiens
agcatcagaaagtca

SEQ ID NO: 14827 - DNA, 15 bp, Homo sapiens
tagcatcagaaagtc

SEQ ID NO: 14828 - DNA, 15 bp, Homo sapiens
ctagcatcagaaagt

SEQ ID NO: 14829 - DNA, 15 bp, Homo sapiens
gctagcatcagaaag

SEQ ID NO: 14830 - DNA, 15 bp, Homo sapiens
ggctagcatcagaaa

SEQ ID NO: 14831 - DNA, 15 bp, Homo sapiens
aggctagcatcagaa

SEQ ID NO: 14832 - DNA, 15 bp, Homo sapiens
aaggctagcatcaga

SEQ ID NO: 14833 - DNA, 15 bp, Homo sapiens
aaaggctagcatcag

SEQ ID NO: 14834 - DNA, 15 bp, Homo sapiens
taaaggctagcatca

SEQ ID NO: 14835 - DNA, 15 bp, Homo sapiens
ctaaaggctagcatc

SEQ ID NO: 14836 - DNA, 15 bp, Homo sapiens
gctaaaggctagcat

SEQ ID NO: 14837 - DNA, 15 bp, Homo sapiens
agctaaaggctagca

SEQ ID NO: 14838 - DNA, 15 bp, Homo sapiens
aagctaaaggctagc

SEQ ID NO: 14839 - DNA, 15 bp, Homo sapiens
taagctaaaggctag

SEQ ID NO: 14840 - DNA, 15 bp, Homo sapiens
ctaagctaaaggcta

SEQ ID NO: 14841 - DNA, 15 bp, Homo sapiens
actaagctaaaggct

SEQ ID NO: 14842 - DNA, 15 bp, Homo sapiens
gactaagctaaaggc

SEQ ID NO: 14843 - DNA, 15 bp, Homo sapiens
agactaagctaaagg

SEQ ID NO: 14844 - DNA, 15 bp, Homo sapiens
gagactaagctaaag

SEQ ID NO: 14845 - DNA, 15 bp, Homo sapiens
ggagactaagctaaa

SEQ ID NO: 14846 - DNA, 15 bp, Homo sapiens
tggagactaagctaa

SEQ ID NO: 14847 - DNA, 15 bp, Homo sapiens
gtggagactaagcta

SEQ ID NO: 14848 - DNA, 15 bp, Homo sapiens
tgtggagactaagct

SEQ ID NO: 14849 - DNA, 15 bp, Homo sapiens
gtgtggagactaagc

SEQ ID NO: 14850 - DNA, 15 bp, Homo sapiens
tgtgtggagactaag

SEQ ID NO: 14851 - DNA, 15 bp, Homo sapiens
gtgtgtggagactaa

SEQ ID NO: 14852 - DNA, 15 bp, Homo sapiens
tgtgtgtggagacta

SEQ ID NO: 14853 - DNA, 15 bp, Homo sapiens
gtgtgtgtggagact

SEQ ID NO: 14854 - DNA, 15 bp, Homo sapiens
tgtgtgtgtggagac

SEQ ID NO: 14855 - DNA, 15 bp, Homo sapiens
ctgtgtgtgtggaga

SEQ ID NO: 14856 - DNA, 15 bp, Homo sapiens
actgtgtgtgtggag

SEQ ID NO: 14857 - DNA, 15 bp, Homo sapiens
tactgtgtgtgtgga

SEQ ID NO: 14858 - DNA, 15 bp, Homo sapiens
ttactgtgtgtgtgg

SEQ ID NO: 14859 - DNA, 15 bp, Homo sapiens
cttactgtgtgtgtg

SEQ ID NO: 14860 - DNA, 15 bp, Homo sapiens
acttactgtgtgtgt

SEQ ID NO: 14861 - DNA, 15 bp, Homo sapiens
cacttactgtgtgtg

SEQ ID NO: 14862 - DNA, 15 bp, Homo sapiens
gcacttactgtgtgt

SEQ ID NO: 14863 - DNA, 15 bp, Homo sapiens
agcacttactgtgtg

SEQ ID NO: 14864 - DNA, 15 bp, Homo sapiens
aagcacttactgtgt

SEQ ID NO: 14865 - DNA, 15 bp, Homo sapiens
taagcacttactgtg

SEQ ID NO: 14866 - DNA, 15 bp, Homo sapiens
ttaagcacttactgt

SEQ ID NO: 14867 - DNA, 15 bp, Homo sapiens
gttaagcacttactg

SEQ ID NO: 14868 - DNA, 15 bp, Homo sapiens
tgttaagcacttact

SEQ ID NO: 14869 - DNA, 15 bp, Homo sapiens
ttgttaagcacttac

SEQ ID NO: 14870 - DNA, 15 bp, Homo sapiens
tttgttaagcactta

SEQ ID NO: 14871 - DNA, 15 bp, Homo sapiens
ctttgttaagcactt

SEQ ID NO: 14872 - DNA, 15 bp, Homo sapiens
tctttgttaagcact

SEQ ID NO: 14873 - DNA, 15 bp, Homo sapiens
gtctttgttaagcac

SEQ ID NO: 14874 - DNA, 15 bp, Homo sapiens
agtctttgttaagca

SEQ ID NO: 14875 - DNA, 15 bp, Homo sapiens
aagtctttgttaagc

SEQ ID NO: 14876 - DNA, 15 bp, Homo sapiens
caagtctttgttaag

SEQ ID NO: 14877 - DNA, 15 bp, Homo sapiens
acaagtctttgttaa

SEQ ID NO: 14878 - DNA, 15 bp, Homo sapiens
cacaagtctttgtta

SEQ ID NO: 14879 - DNA, 15 bp, Homo sapiens
ccacaagtctttgtt

SEQ ID NO: 14880 - DNA, 15 bp, Homo sapiens
gccacaagtctttgt

SEQ ID NO: 14881 - DNA, 15 bp, Homo sapiens
ggccacaagtctttg

SEQ ID NO: 14882 - DNA, 15 bp, Homo sapiens
cggccacaagtcttt

SEQ ID NO: 14883 - DNA, 15 bp, Homo sapiens
acggccacaagtctt

SEQ ID NO: 14884 - DNA, 15 bp, Homo sapiens
cacggccacaagtct

SEQ ID NO: 14885 - DNA, 15 bp, Homo sapiens
acacggccacaagtc

SEQ ID NO: 14886 - DNA, 15 bp, Homo sapiens
cacacggccacaagt

SEQ ID NO: 14887 - DNA, 15 bp, Homo sapiens
gcacacggccacaag

SEQ ID NO: 14888 - DNA, 15 bp, Homo sapiens
tgcacacggccacaa

SEQ ID NO: 14889 - DNA, 15 bp, Homo sapiens
ctgcacacggccaca

SEQ ID NO: 14890 - DNA, 15 bp, Homo sapiens
actgcacacggccac

SEQ ID NO: 14891 - DNA, 15 bp, Homo sapiens
cactgcacacggcca

SEQ ID NO: 14892 - DNA, 15 bp, Homo sapiens
ccactgcacacggcc

SEQ ID NO: 14893 - DNA, 15 bp, Homo sapiens
gccactgcacacggc

SEQ ID NO: 14894 - DNA, 15 bp, Homo sapiens
agccactgcacacgg

SEQ ID NO: 14895 - DNA, 15 bp, Homo sapiens
gagccactgcacacg

SEQ ID NO: 14896 - DNA, 15 bp, Homo sapiens
tgagccactgcacac

SEQ ID NO: 14897 - DNA, 15 bp, Homo sapiens
atgagccactgcaca

SEQ ID NO: 14898 - DNA, 15 bp, Homo sapiens
catgagccactgcac

SEQ ID NO: 14899 - DNA, 15 bp, Homo sapiens
gcatgagccactgca

SEQ ID NO: 14900 - DNA, 15 bp, Homo sapiens
ggcatgagccactgc

SEQ ID NO: 14901 - DNA, 15 bp, Homo sapiens
aggcatgagccactg

SEQ ID NO: 14902 - DNA, 15 bp, Homo sapiens
caggcatgagccact

SEQ ID NO: 14903 - DNA, 15 bp, Homo sapiens
tagcctcccaaagtg

SEQ ID NO: 14904 - DNA, 15 bp, Homo sapiens
ttagcctcccaaagt

SEQ ID NO: 14905 - DNA, 15 bp, Homo sapiens
cttagcctcccaaag

SEQ ID NO: 14906 - DNA, 15 bp, Homo sapiens
ccttagcctcccaaa

SEQ ID NO: 14907 - DNA, 15 bp, Homo sapiens
accttagcctcccaa

SEQ ID NO: 14908 - DNA, 15 bp, Homo sapiens
caccttagcctccca

SEQ ID NO: 14909 - DNA, 15 bp, Homo sapiens
ccaccttagcctccc

SEQ ID NO: 14910 - DNA, 15 bp, Homo sapiens
cccaccttagcctcc

SEQ ID NO: 14911 - DNA, 15 bp, Homo sapiens
acccaccttagcctc

SEQ ID NO: 14912 - DNA, 15 bp, Homo sapiens
cacccaccttagcct

SEQ ID NO: 14913 - DNA, 15 bp, Homo sapiens
ccacccaccttagcc

SEQ ID NO: 14914 - DNA, 15 bp, Homo sapiens
tccacccaccttagc

SEQ ID NO: 14915 - DNA, 15 bp, Homo sapiens
atccacccaccttag

SEQ ID NO: 14916 - DNA, 15 bp, Homo sapiens
gatccacccacctta

SEQ ID NO: 14917 - DNA, 15 bp, Homo sapiens
tgatccacccacctt

SEQ ID NO: 14918 - DNA, 15 bp, Homo sapiens
atgatccacccacct

SEQ ID NO: 14919 - DNA, 15 bp, Homo sapiens
gatgatccacccacc

SEQ ID NO: 14920 - DNA, 15 bp, Homo sapiens
agatgatccacccac

SEQ ID NO: 14921 - DNA, 15 bp, Homo sapiens
cagatgatccaccca

SEQ ID NO: 14922 - DNA, 15 bp, Homo sapiens
tcagatgatccaccc

SEQ ID NO: 14923 - DNA, 15 bp, Homo sapiens
ctcagatgatccacc

SEQ ID NO: 14924 - DNA, 15 bp, Homo sapiens
cctcagatgatccac

SEQ ID NO: 14925 - DNA, 15 bp, Homo sapiens
acctcagatgatcca

SEQ ID NO: 14926 - DNA, 15 bp, Homo sapiens
gacctcagatgatcc

SEQ ID NO: 14927 - DNA, 15 bp, Homo sapiens
tgacctcagatgatc

SEQ ID NO: 14928 - DNA, 15 bp, Homo sapiens
ctgacctcagatgat

SEQ ID NO: 14929 - DNA, 15 bp, Homo sapiens
cctgacctcagatga

SEQ ID NO: 14930 - DNA, 15 bp, Homo sapiens
tcctgacctcagatg

SEQ ID NO: 14931 - DNA, 15 bp, Homo sapiens
ctcctgacctcagat

SEQ ID NO: 14932 - DNA, 15 bp, Homo sapiens
actcctgacctcaga

SEQ ID NO: 14933 - DNA, 15 bp, Homo sapiens
aactcctgacctcag

SEQ ID NO: 14934 - DNA, 15 bp, Homo sapiens
gaactcctgacctca

SEQ ID NO: 14935 - DNA, 15 bp, Homo sapiens
cgaactcctgacctc

SEQ ID NO: 14936 - DNA, 15 bp, Homo sapiens
tcgaactcctgacct

SEQ ID NO: 14937 - DNA, 15 bp, Homo sapiens
ctcgaactcctgacc

SEQ ID NO: 14938 - DNA, 15 bp, Homo sapiens
tctcgaactcctgac

SEQ ID NO: 14939 - DNA, 15 bp, Homo sapiens
ggccaggctggtctc

SEQ ID NO: 14940 - DNA, 15 bp, Homo sapiens
tggccaggctggtct

SEQ ID NO: 14941 - DNA, 15 bp, Homo sapiens
ttggccaggctggtc

SEQ ID NO: 14942 - DNA, 15 bp, Homo sapiens
gttggccaggctggt

SEQ ID NO: 14943 - DNA, 15 bp, Homo sapiens
tgttggccaggctgg

SEQ ID NO: 14944 - DNA, 15 bp, Homo sapiens
atgttggccaggctg

SEQ ID NO: 14945 - DNA, 15 bp, Homo sapiens
catgttggccaggct

SEQ ID NO: 14946 - DNA, 15 bp, Homo sapiens
gcatgttggccaggc

SEQ ID NO: 14947 - DNA, 15 bp, Homo sapiens
agcatgttggccagg

SEQ ID NO: 14948 - DNA, 15 bp, Homo sapiens
cagcatgttggccag

SEQ ID NO: 14949 - DNA, 15 bp, Homo sapiens
tcagcatgttggcca

SEQ ID NO: 14950 - DNA, 15 bp, Homo sapiens
ttcagcatgttggcc

SEQ ID NO: 14951 - DNA, 15 bp, Homo sapiens
tttcagcatgttggc

SEQ ID NO: 14952 - DNA, 15 bp, Homo sapiens
gtttcagcatgttgg

SEQ ID NO: 14953 - DNA, 15 bp, Homo sapiens
ggtttcagcatgttg

SEQ ID NO: 14954 - DNA, 15 bp, Homo sapiens
aggtttcagcatgtt

SEQ ID NO: 14955 - DNA, 15 bp, Homo sapiens
gaggtttcagcatgt

SEQ ID NO: 14956 - DNA, 15 bp, Homo sapiens
cgaggtttcagcatg

SEQ ID NO: 14957 - DNA, 15 bp, Homo sapiens
acgaggtttcagcat

SEQ ID NO: 14958 - DNA, 15 bp, Homo sapiens
gacgaggtttcagca

SEQ ID NO: 14959 - DNA, 15 bp, Homo sapiens
agacgaggtttcagc

SEQ ID NO: 14960 - DNA, 15 bp, Homo sapiens
gagacgaggtttcag

SEQ ID NO: 14961 - DNA, 15 bp, Homo sapiens
atttttgtattttta

SEQ ID NO: 14962 - DNA, 15 bp, Homo sapiens
gatttttgtattttt

SEQ ID NO: 14963 - DNA, 15 bp, Homo sapiens
tgatttttgtatttt

SEQ ID NO: 14964 - DNA, 15 bp, Homo sapiens
ctgatttttgtattt

SEQ ID NO: 14965 - DNA, 15 bp, Homo sapiens
gctgatttttgtatt

SEQ ID NO: 14966 - DNA, 15 bp, Homo sapiens
ggctgatttttgtat

SEQ ID NO: 14967 - DNA, 15 bp, Homo sapiens
tggctgatttttgta

SEQ ID NO: 14968 - DNA, 15 bp, Homo sapiens
ctggctgatttttgt

SEQ ID NO: 14969 - DNA, 15 bp, Homo sapiens
cctggctgatttttg

SEQ ID NO: 14970 - DNA, 15 bp, Homo sapiens
gcctggctgattttt

SEQ ID NO: 14971 - DNA, 15 bp, Homo sapiens
cgcctggctgatttt

SEQ ID NO: 14972 - DNA, 15 bp, Homo sapiens
acgcctggctgattt

SEQ ID NO: 14973 - DNA, 15 bp, Homo sapiens
cacgcctggctgatt

SEQ ID NO: 14974 - DNA, 15 bp, Homo sapiens
ccacgcctggctgat

SEQ ID NO: 14975 - DNA, 15 bp, Homo sapiens
accacgcctggctga

SEQ ID NO: 14976 - DNA, 15 bp, Homo sapiens
caccacgcctggctg

SEQ ID NO: 14977 - DNA, 15 bp, Homo sapiens
agtgccaccacgcct

SEQ ID NO: 14978 - DNA, 15 bp, Homo sapiens
gagtgccaccacgcc

SEQ ID NO: 14979 - DNA, 15 bp, Homo sapiens
tgagtgccaccacgc

SEQ ID NO: 14980 - DNA, 15 bp, Homo sapiens
gtgagtgccaccacg

SEQ ID NO: 14981 - DNA, 15 bp, Homo sapiens
ggtgagtgccaccac

SEQ ID NO: 14982 - DNA, 15 bp, Homo sapiens
aggtgagtgccacca

SEQ ID NO: 14983 - DNA, 15 bp, Homo sapiens
caggtgagtgccacc

SEQ ID NO: 14984 - DNA, 15 bp, Homo sapiens
acaggtgagtgccac

SEQ ID NO: 14985 - DNA, 15 bp, Homo sapiens
tacaggtgagtgcca

SEQ ID NO: 14986 - DNA, 15 bp, Homo sapiens
ttacaggtgagtgcc

SEQ ID NO: 14987 - DNA, 15 bp, Homo sapiens
attacaggtgagtgc

SEQ ID NO: 14988 - DNA, 15 bp, Homo sapiens
gattacaggtgagtg

SEQ ID NO: 14989 - DNA, 15 bp, Homo sapiens
ggattacaggtgagt

SEQ ID NO: 14990 - DNA, 15 bp, Homo sapiens
gggattacaggtgag

SEQ ID NO: 14991 - DNA, 15 bp, Homo sapiens
tgggattacaggtga

SEQ ID NO: 14992 - DNA, 15 bp, Homo sapiens
aagtagctgggatta

SEQ ID NO: 14993 - DNA, 15 bp, Homo sapiens
caagtagctgggatt

SEQ ID NO: 14994 - DNA, 15 bp, Homo sapiens
ccaagtagctgggat

SEQ ID NO: 14995 - DNA, 15 bp, Homo sapiens
cccaagtagctggga

SEQ ID NO: 14996 - DNA, 15 bp, Homo sapiens
tcccaagtagctggg

SEQ ID NO: 14997 - DNA, 15 bp, Homo sapiens
ctcccaagtagctgg

SEQ ID NO: 14998 - DNA, 15 bp, Homo sapiens
cctcccaagtagctg

SEQ ID NO: 14999 - DNA, 15 bp, Homo sapiens
gcctcccaagtagct

SEQ ID NO: 15000 - DNA, 15 bp, Homo sapiens
agcctcccaagtagc

SEQ ID NO: 15001 - DNA, 15 bp, Homo sapiens
cagcctcccaagtag

SEQ ID NO: 15002 - DNA, 15 bp, Homo sapiens
tcagcctcccaagta

SEQ ID NO: 15003 - DNA, 15 bp, Homo sapiens
ctcagcctcccaagt

SEQ ID NO: 15004 - DNA, 15 bp, Homo sapiens
cctcagcctcccaag

SEQ ID NO: 15005 - DNA, 15 bp, Homo sapiens
tgcctcagcctccca

SEQ ID NO: 15006 - DNA, 15 bp, Homo sapiens
gattctcctgcctca

SEQ ID NO: 15007 - DNA, 15 bp, Homo sapiens
cgattctcctgcctc

SEQ ID NO: 15008 - DNA, 15 bp, Homo sapiens
gcgattctcctgcct

SEQ ID NO: 15009 - DNA, 15 bp, Homo sapiens
agcgattctcctgcc

SEQ ID NO: 15010 - DNA, 15 bp, Homo sapiens
aagcgattctcctgc

SEQ ID NO: 15011 - DNA, 15 bp, Homo sapiens
caagcgattctcctg

SEQ ID NO: 15012 - DNA, 15 bp, Homo sapiens
tcaagcgattctcct

SEQ ID NO: 15013 - DNA, 15 bp, Homo sapiens
ttcaagcgattctcc

SEQ ID NO: 15014 - DNA, 15 bp, Homo sapiens
gttcaagcgattctc

SEQ ID NO: 15015 - DNA, 15 bp, Homo sapiens
agttcaagcgattct

SEQ ID NO: 15016 - DNA, 15 bp, Homo sapiens
cagttcaagcgattc

SEQ ID NO: 15017 - DNA, 15 bp, Homo sapiens
ccagttcaagcgatt

SEQ ID NO: 15018 - DNA, 15 bp, Homo sapiens
cccagttcaagcgat

SEQ ID NO: 15019 - DNA, 15 bp, Homo sapiens
tcccagttcaagcga

SEQ ID NO: 15020 - DNA, 15 bp, Homo sapiens
ctcccagttcaagcg

SEQ ID NO: 15021 - DNA, 15 bp, Homo sapiens
cctcccagttcaagc

SEQ ID NO: 15022 - DNA, 15 bp, Homo sapiens
gcctcccagttcaag

SEQ ID NO: 15023 - DNA, 15 bp, Homo sapiens
tgcctcccagttcaa

SEQ ID NO: 15024 - DNA, 15 bp, Homo sapiens
ctgcctcccagttca

SEQ ID NO: 15025 - DNA, 15 bp, Homo sapiens
tctgcctcccagttc

SEQ ID NO: 15026 - DNA, 15 bp, Homo sapiens
ctctgcctcccagtt

SEQ ID NO: 15027 - DNA, 15 bp, Homo sapiens
cctctgcctcccagt

SEQ ID NO: 15028 - DNA, 15 bp, Homo sapiens
acaacctctgcctcc

SEQ ID NO: 15029 - DNA, 15 bp, Homo sapiens
tacaacctctgcctc

SEQ ID NO: 15030 - DNA, 15 bp, Homo sapiens
ctacaacctctgcct

SEQ ID NO: 15031 - DNA, 15 bp, Homo sapiens
actacaacctctgcc

SEQ ID NO: 15032 - DNA, 15 bp, Homo sapiens
cactacaacctctgc

SEQ ID NO: 15033 - DNA, 15 bp, Homo sapiens
tcactacaacctctg

SEQ ID NO: 15034 - DNA, 15 bp, Homo sapiens
ctcactacaacctct

SEQ ID NO: 15035 - DNA, 15 bp, Homo sapiens
tctcactacaacctc

SEQ ID NO: 15036 - DNA, 15 bp, Homo sapiens
gtctcactacaacct

SEQ ID NO: 15037 - DNA, 15 bp, Homo sapiens
cgtctcactacaacc

SEQ ID NO: 15038 - DNA, 15 bp, Homo sapiens
tcgtctcactacaac

SEQ ID NO: 15039 - DNA, 15 bp, Homo sapiens
ctcgtctcactacaa

SEQ ID NO: 15040 - DNA, 15 bp, Homo sapiens
tctcgtctcactaca

SEQ ID NO: 15041 - DNA, 15 bp, Homo sapiens
atctcgtctcactac

SEQ ID NO: 15042 - DNA, 15 bp, Homo sapiens
aatctcgtctcacta

SEQ ID NO: 15043 - DNA, 15 bp, Homo sapiens
caatctcgtctcact

SEQ ID NO: 15044 - DNA, 15 bp, Homo sapiens
acaatctcgtctcac

SEQ ID NO: 15045 - DNA, 15 bp, Homo sapiens
cacaatctcgtctca

SEQ ID NO: 15046 - DNA, 15 bp, Homo sapiens
gcacaatctcgtctc

SEQ ID NO: 15047 - DNA, 15 bp, Homo sapiens
ggcacaatctcgtct

SEQ ID NO: 15048 - DNA, 15 bp, Homo sapiens
tggcacaatctcgtc

SEQ ID NO: 15049 - DNA, 15 bp, Homo sapiens
ttggcacaatctcgt

SEQ ID NO: 15050 - DNA, 15 bp, Homo sapiens
attggcacaatctcg

SEQ ID NO: 15051 - DNA, 15 bp, Homo sapiens
cattggcacaatctc

SEQ ID NO: 15052 - DNA, 15 bp, Homo sapiens
gcattggcacaatct

SEQ ID NO: 15053 - DNA, 15 bp, Homo sapiens
tgcattggcacaatc

SEQ ID NO: 15054 - DNA, 15 bp, Homo sapiens
gtgcattggcacaat

SEQ ID NO: 15055 - DNA, 15 bp, Homo sapiens
agtgcattggcacaa

SEQ ID NO: 15056 - DNA, 15 bp, Homo sapiens
gagtgcattggcaca

SEQ ID NO: 15057 - DNA, 15 bp, Homo sapiens
ggagtgcattggcac

SEQ ID NO: 15058 - DNA, 15 bp, Homo sapiens
tggagtgcattggca

SEQ ID NO: 15059 - DNA, 15 bp, Homo sapiens
ctggagtgcattggc

SEQ ID NO: 15060 - DNA, 15 bp, Homo sapiens
gctggagtgcattgg

SEQ ID NO: 15061 - DNA, 15 bp, Homo sapiens
ggctggagtgcattg

SEQ ID NO: 15062 - DNA, 15 bp, Homo sapiens
aggctggagtgcatt

SEQ ID NO: 15063 - DNA, 15 bp, Homo sapiens
caggctggagtgcat

SEQ ID NO: 15064 - DNA, 15 bp, Homo sapiens
gcccaggctggagtg

SEQ ID NO: 15065 - DNA, 15 bp, Homo sapiens
tgcccaggctggagt

SEQ ID NO: 15066 - DNA, 15 bp, Homo sapiens
ttgcccaggctggag

SEQ ID NO: 15067 - DNA, 15 bp, Homo sapiens
gttgcccaggctgga

SEQ ID NO: 15068 - DNA, 15 bp, Homo sapiens
tgttgcccaggctgg

SEQ ID NO: 15069 - DNA, 15 bp, Homo sapiens
ctgttgcccaggctg

SEQ ID NO: 15070 - DNA, 15 bp, Homo sapiens
tctgttgcccaggct

SEQ ID NO: 15071 - DNA, 15 bp, Homo sapiens
ctctgttgcccaggc

SEQ ID NO: 15072 - DNA, 15 bp, Homo sapiens
actctgttgcccagg

SEQ ID NO: 15073 - DNA, 15 bp, Homo sapiens
gagtctcactctgtt

SEQ ID NO: 15074 - DNA, 15 bp, Homo sapiens
acagagtctcactct

SEQ ID NO: 15075 - DNA, 15 bp, Homo sapiens
gacagagtctcactc

SEQ ID NO: 15076 - DNA, 15 bp, Homo sapiens
agacagagtctcact

SEQ ID NO: 15077 - DNA, 15 bp, Homo sapiens
gagacagagtctcac

SEQ ID NO: 15078 - DNA, 15 bp, Homo sapiens
tgagacagagtctca

SEQ ID NO: 15079 - DNA, 15 bp, Homo sapiens
ttgagacagagtctc

SEQ ID NO: 15080 - DNA, 15 bp, Homo sapiens
tttgagacagagtct

SEQ ID NO: 15081 - DNA, 15 bp, Homo sapiens
ttttgagacagagtc

SEQ ID NO: 15082 - DNA, 15 bp, Homo sapiens
tttttgagacagagt

SEQ ID NO: 15083 - DNA, 15 bp, Homo sapiens
ttttttgagacagag

SEQ ID NO: 15084 - DNA, 15 bp, Homo sapiens
tttttttgagacaga

SEQ ID NO: 15085 - DNA, 15 bp, Homo sapiens
ttttttttgagacag

SEQ ID NO: 15086 - DNA, 15 bp, Homo sapiens
tttttttttgagaca

SEQ ID NO: 15087 - DNA, 15 bp, Homo sapiens
ctttttttttgagac

SEQ ID NO: 15088 - DNA, 15 bp, Homo sapiens
tctttttttttgaga

SEQ ID NO: 15089 - DNA, 15 bp, Homo sapiens
gtctttttttttgag

SEQ ID NO: 15090 - DNA, 15 bp, Homo sapiens
agtctttttttttga

SEQ ID NO: 15091 - DNA, 15 bp, Homo sapiens
aagtctttttttttg

SEQ ID NO: 15092 - DNA, 15 bp, Homo sapiens
caagtcttttttttt

SEQ ID NO: 15093 - DNA, 15 bp, Homo sapiens
gcaagtctttttttt

SEQ ID NO: 15094 - DNA, 15 bp, Homo sapiens
agcaagtcttttttt

SEQ ID NO: 15095 - DNA, 15 bp, Homo sapiens
tagcaagtctttttt

SEQ ID NO: 15096 - DNA, 15 bp, Homo sapiens
atagcaagtcttttt

SEQ ID NO: 15097 - DNA, 15 bp, Homo sapiens
catagcaagtctttt

SEQ ID NO: 15098 - DNA, 15 bp, Homo sapiens
gcatagcaagtcttt

SEQ ID NO: 15099 - DNA, 15 bp, Homo sapiens
ggcatagcaagtctt

SEQ ID NO: 15100 - DNA, 15 bp, Homo sapiens
aggcatagcaagtct

SEQ ID NO: 15101 - DNA, 15 bp, Homo sapiens
aaggcatagcaagtc

SEQ ID NO: 15102 - DNA, 15 bp, Homo sapiens
aaaggcatagcaagt

SEQ ID NO: 15103 - DNA, 15 bp, Homo sapiens
aaaaggcatagcaag

SEQ ID NO: 15104 - DNA, 15 bp, Homo sapiens
taaaaggcatagcaa

SEQ ID NO: 15105 - DNA, 15 bp, Homo sapiens
ttaaaaggcatagca

SEQ ID NO: 15106 - DNA, 15 bp, Homo sapiens
attaaaaggcatagc

SEQ ID NO: 15107 - DNA, 15 bp, Homo sapiens
cattaaaaggcatag

SEQ ID NO: 15108 - DNA, 15 bp, Homo sapiens
ccattaaaaggcata

SEQ ID NO: 15109 - DNA, 15 bp, Homo sapiens
accattaaaaggcat

SEQ ID NO: 15110 - DNA, 15 bp, Homo sapiens
aaccattaaaaggca

SEQ ID NO: 15111 - DNA, 15 bp, Homo sapiens
aaaccattaaaaggc

SEQ ID NO: 15112 - DNA, 15 bp, Homo sapiens
aaaaccattaaaagg

SEQ ID NO: 15113 - DNA, 15 bp, Homo sapiens
taaaaccattaaaag

SEQ ID NO: 15114 - DNA, 15 bp, Homo sapiens
ttaaaaccattaaaa

SEQ ID NO: 15115 - DNA, 15 bp, Homo sapiens
tttaaaaccattaaa

SEQ ID NO: 15116 - DNA, 15 bp, Homo sapiens
ttttaaaaccattaa

SEQ ID NO: 15117 - DNA, 15 bp, Homo sapiens
tttttaaaaccatta

SEQ ID NO: 15118 - DNA, 15 bp, Homo sapiens
atttttaaaaccatt

SEQ ID NO: 15119 - DNA, 15 bp, Homo sapiens
aatttttaaaaccat

SEQ ID NO: 15120 - DNA, 15 bp, Homo sapiens
taatttttaaaacca

SEQ ID NO: 15121 - DNA, 15 bp, Homo sapiens
gtaatttttaaaacc

SEQ ID NO: 15122 - DNA, 15 bp, Homo sapiens
tgtaatttttaaaac

SEQ ID NO: 15123 - DNA, 15 bp, Homo sapiens
gtgtaatttttaaaa

SEQ ID NO: 15124 - DNA, 15 bp, Homo sapiens
agtgtaatttttaaa

SEQ ID NO: 15125 - DNA, 15 bp, Homo sapiens
aagtgtaatttttaa

SEQ ID NO: 15126 - DNA, 15 bp, Homo sapiens
caagtgtaattttta

SEQ ID NO: 15127 - DNA, 15 bp, Homo sapiens
gcaagtgtaattttt

SEQ ID NO: 15128 - DNA, 15 bp, Homo sapiens
agcaagtgtaatttt

SEQ ID NO: 15129 - DNA, 15 bp, Homo sapiens
aagcaagtgtaattt

SEQ ID NO: 15130 - DNA, 15 bp, Homo sapiens
taagcaagtgtaatt

SEQ ID NO: 15131 - DNA, 15 bp, Homo sapiens
gtaagcaagtgtaat

SEQ ID NO: 15132 - DNA, 15 bp, Homo sapiens
tgtaagcaagtgtaa

SEQ ID NO: 15133 - DNA, 15 bp, Homo sapiens
atgtaagcaagtgta

SEQ ID NO: 15134 - DNA, 15 bp, Homo sapiens
tatgtaagcaagtgt

SEQ ID NO: 15135 - DNA, 15 bp, Homo sapiens
gtatgtaagcaagtg

SEQ ID NO: 15136 - DNA, 15 bp, Homo sapiens
tgtatgtaagcaagt

SEQ ID NO: 15137 - DNA, 15 bp, Homo sapiens
atgtatgtaagcaag

SEQ ID NO: 15138 - DNA, 15 bp, Homo sapiens
tatgtatgtaagcaa

SEQ ID NO: 15139 - DNA, 15 bp, Homo sapiens
gtatgtatgtaagca

SEQ ID NO: 15140 - DNA, 15 bp, Homo sapiens
ggtatgtatgtaagc

SEQ ID NO: 15141 - DNA, 15 bp, Homo sapiens
aggtatgtatgtaag

SEQ ID NO: 15142 - DNA, 15 bp, Homo sapiens
gaggtatgtatgtaa

SEQ ID NO: 15143 - DNA, 15 bp, Homo sapiens
tgaggtatgtatgta

SEQ ID NO: 15144 - DNA, 15 bp, Homo sapiens
atgaggtatgtatgt

SEQ ID NO: 15145 - DNA, 15 bp, Homo sapiens
aatgaggtatgtatg

SEQ ID NO: 15146 - DNA, 15 bp, Homo sapiens
gaatgaggtatgtat

SEQ ID NO: 15147 - DNA, 15 bp, Homo sapiens
tgaatgaggtatgta

SEQ ID NO: 15148 - DNA, 15 bp, Homo sapiens
atgaatgaggtatgt

SEQ ID NO: 15149 - DNA, 15 bp, Homo sapiens
aatgaatgaggtatg

SEQ ID NO: 15150 - DNA, 15 bp, Homo sapiens
gaatgaatgaggtat

SEQ ID NO: 15151 - DNA, 15 bp, Homo sapiens
tgaatgaatgaggta

SEQ ID NO: 15152 - DNA, 15 bp, Homo sapiens
ctgaatgaatgaggt

SEQ ID NO: 15153 - DNA, 15 bp, Homo sapiens
gctgaatgaatgagg

SEQ ID NO: 15154 - DNA, 15 bp, Homo sapiens
tgctgaatgaatgag

SEQ ID NO: 15155 - DNA, 15 bp, Homo sapiens
ttgctgaatgaatga

SEQ ID NO: 15156 - DNA, 15 bp, Homo sapiens
tttgctgaatgaatg

SEQ ID NO: 15157 - DNA, 15 bp, Homo sapiens
atttgctgaatgaat

SEQ ID NO: 15158 - DNA, 15 bp, Homo sapiens
catttgctgaatgaa

SEQ ID NO: 15159 - DNA, 15 bp, Homo sapiens
ccatttgctgaatga

SEQ ID NO: 15160 - DNA, 15 bp, Homo sapiens
accatttgctgaatg

SEQ ID NO: 15161 - DNA, 15 bp, Homo sapiens
aaccatttgctgaat

SEQ ID NO: 15162 - DNA, 15 bp, Homo sapiens
taaccatttgctgaa

SEQ ID NO: 15163 - DNA, 15 bp, Homo sapiens
ataaccatttgctga

SEQ ID NO: 15164 - DNA, 15 bp, Homo sapiens
aataaccatttgctg

SEQ ID NO: 15165 - DNA, 15 bp, Homo sapiens
caataaccatttgct

SEQ ID NO: 15166 - DNA, 15 bp, Homo sapiens
acaataaccatttgc

SEQ ID NO: 15167 - DNA, 15 bp, Homo sapiens
aacaataaccatttg

SEQ ID NO: 15168 - DNA, 15 bp, Homo sapiens
gaacaataaccattt

SEQ ID NO: 15169 - DNA, 15 bp, Homo sapiens
tgaacaataaccatt

SEQ ID NO: 15170 - DNA, 15 bp, Homo sapiens
atgaacaataaccat

SEQ ID NO: 15171 - DNA, 15 bp, Homo sapiens
aatgaacaataacca

SEQ ID NO: 15172 - DNA, 15 bp, Homo sapiens
gaatgaacaataacc

SEQ ID NO: 15173 - DNA, 15 bp, Homo sapiens
tgaatgaacaataac

SEQ ID NO: 15174 - DNA, 15 bp, Homo sapiens
atgaatgaacaataa

SEQ ID NO: 15175 - DNA, 15 bp, Homo sapiens
aatgaatgaacaata

SEQ ID NO: 15176 - DNA, 15 bp, Homo sapiens
caatgaatgaacaat

SEQ ID NO: 15177 - DNA, 15 bp, Homo sapiens
acaatgaatgaacaa

SEQ ID NO: 15178 - DNA, 15 bp, Homo sapiens
aacaatgaatgaaca

SEQ ID NO: 15179 - DNA, 15 bp, Homo sapiens
taacaatgaatgaac

SEQ ID NO: 15180 - DNA, 15 bp, Homo sapiens
ctaacaatgaatgaa

SEQ ID NO: 15181 - DNA, 15 bp, Homo sapiens
tctaacaatgaatga

SEQ ID NO: 15182 - DNA, 15 bp, Homo sapiens
atctaacaatgaatg

SEQ ID NO: 15183 - DNA, 15 bp, Homo sapiens
catctaacaatgaat

SEQ ID NO: 15184 - DNA, 15 bp, Homo sapiens
gcatctaacaatgaa

SEQ ID NO: 15185 - DNA, 15 bp, Homo sapiens
agcatctaacaatga

SEQ ID NO: 15186 - DNA, 15 bp, Homo sapiens
cagcatctaacaatg

SEQ ID NO: 15187 - DNA, 15 bp, Homo sapiens
ccagcatctaacaat

SEQ ID NO: 15188 - DNA, 15 bp, Homo sapiens
cccagcatctaacaa

SEQ ID NO: 15189 - DNA, 15 bp, Homo sapiens
gcccagcatctaaca

SEQ ID NO: 15190 - DNA, 15 bp, Homo sapiens
agcccagcatctaac

SEQ ID NO: 15191 - DNA, 15 bp, Homo sapiens
gagcccagcatctaa

SEQ ID NO: 15192 - DNA, 15 bp, Homo sapiens
tgagcccagcatcta

SEQ ID NO: 15193 - DNA, 15 bp, Homo sapiens
ctgagcccagcatct

SEQ ID NO: 15194 - DNA, 15 bp, Homo sapiens
tctgagcccagcatc

SEQ ID NO: 15195 - DNA, 15 bp, Homo sapiens
ctctgagcccagcat

SEQ ID NO: 15196 - DNA, 15 bp, Homo sapiens
tctctgagcccagca

SEQ ID NO: 15197 - DNA, 15 bp, Homo sapiens
atctctgagcccagc

SEQ ID NO: 15198 - DNA, 15 bp, Homo sapiens
tatctctgagcccag

SEQ ID NO: 15199 - DNA, 15 bp, Homo sapiens
ttatctctgagccca

SEQ ID NO: 15200 - DNA, 15 bp, Homo sapiens
cttatctctgagccc

SEQ ID NO: 15201 - DNA, 15 bp, Homo sapiens
gcttatctctgagcc

SEQ ID NO: 15202 - DNA, 15 bp, Homo sapiens
tgcttatctctgagc

SEQ ID NO: 15203 - DNA, 15 bp, Homo sapiens
ttgcttatctctgag

SEQ ID NO: 15204 - DNA, 15 bp, Homo sapiens
cttgcttatctctga

SEQ ID NO: 15205 - DNA, 15 bp, Homo sapiens
tcttgcttatctctg

SEQ ID NO: 15206 - DNA, 15 bp, Homo sapiens
gtcttgcttatctct

SEQ ID NO: 15207 - DNA, 15 bp, Homo sapiens
ggtcttgcttatctc

SEQ ID NO: 15208 - DNA, 15 bp, Homo sapiens
gggtcttgcttatct

SEQ ID NO: 15209 - DNA, 15 bp, Homo sapiens
tgggtcttgcttatc

SEQ ID NO: 15210 - DNA, 15 bp, Homo sapiens
gtgggtcttgcttat

SEQ ID NO: 15211 - DNA, 15 bp, Homo sapiens
ggtgggtcttgctta

SEQ ID NO: 15212 - DNA, 15 bp, Homo sapiens
aggtgggtcttgctt

SEQ ID NO: 15213 - DNA, 15 bp, Homo sapiens
gaggtgggtcttgct

SEQ ID NO: 15214 - DNA, 15 bp, Homo sapiens
agaggtgggtcttgc

SEQ ID NO: 15215 - DNA, 15 bp, Homo sapiens
cagaggtgggtcttg

SEQ ID NO: 15216 - DNA, 15 bp, Homo sapiens
acagaggtgggtctt

SEQ ID NO: 15217 - DNA, 15 bp, Homo sapiens
aacagaggtgggtct

SEQ ID NO: 15218 - DNA, 15 bp, Homo sapiens
gaacagaggtgggtc

SEQ ID NO: 15219 - DNA, 15 bp, Homo sapiens
agaacagaggtgggt

SEQ ID NO: 15220 - DNA, 15 bp, Homo sapiens
aagaacagaggtggg

SEQ ID NO: 15221 - DNA, 15 bp, Homo sapiens
taagaacagaggtgg

SEQ ID NO: 15222 - DNA, 15 bp, Homo sapiens
ttaagaacagaggtg

SEQ ID NO: 15223 - DNA, 15 bp, Homo sapiens
cttaagaacagaggt

SEQ ID NO: 15224 - DNA, 15 bp, Homo sapiens
tcttaagaacagagg

SEQ ID NO: 15225 - DNA, 15 bp, Homo sapiens
atcttaagaacagag

SEQ ID NO: 15226 - DNA, 15 bp, Homo sapiens
catcttaagaacaga

SEQ ID NO: 15227 - DNA, 15 bp, Homo sapiens
gcatcttaagaacag

SEQ ID NO: 15228 - DNA, 15 bp, Homo sapiens
agcatcttaagaaca

SEQ ID NO: 15229 - DNA, 15 bp, Homo sapiens
gagcatcttaagaac

SEQ ID NO: 15230 - DNA, 15 bp, Homo sapiens
agagcatcttaagaa

SEQ ID NO: 15231 - DNA, 15 bp, Homo sapiens
gagagcatcttaaga

SEQ ID NO: 15232 - DNA, 15 bp, Homo sapiens
tgagagcatcttaag

SEQ ID NO: 15233 - DNA, 15 bp, Homo sapiens
ctgagagcatcttaa

SEQ ID NO: 15234 - DNA, 15 bp, Homo sapiens
cctgagagcatctta

SEQ ID NO: 15235 - DNA, 15 bp, Homo sapiens
gcctgagagcatctt

SEQ ID NO: 15236 - DNA, 15 bp, Homo sapiens
agcctgagagcatct

SEQ ID NO: 15237 - DNA, 15 bp, Homo sapiens
tagcctgagagcatc

SEQ ID NO: 15238 - DNA, 15 bp, Homo sapiens
ctagcctgagagcat

SEQ ID NO: 15239 - DNA, 15 bp, Homo sapiens
actagcctgagagca

SEQ ID NO: 15240 - DNA, 15 bp, Homo sapiens
aactagcctgagagc

SEQ ID NO: 15241 - DNA, 15 bp, Homo sapiens
caactagcctgagag

SEQ ID NO: 15242 - DNA, 15 bp, Homo sapiens
ccaactagcctgaga

SEQ ID NO: 15243 - DNA, 15 bp, Homo sapiens
tccaactagcctgag

SEQ ID NO: 15244 - DNA, 15 bp, Homo sapiens
ttccaactagcctga

SEQ ID NO: 15245 - DNA, 15 bp, Homo sapiens
tttccaactagcctg

SEQ ID NO: 15246 - DNA, 15 bp, Homo sapiens
ctttccaactagcct

SEQ ID NO: 15247 - DNA, 15 bp, Homo sapiens
tctttccaactagcc

SEQ ID NO: 15248 - DNA, 15 bp, Homo sapiens
ttctttccaactagc

SEQ ID NO: 15249 - DNA, 15 bp, Homo sapiens
tttctttccaactag

SEQ ID NO: 15250 - DNA, 15 bp, Homo sapiens
ctttctttccaacta

SEQ ID NO: 15251 - DNA, 15 bp, Homo sapiens
tctttctttccaact

SEQ ID NO: 15252 - DNA, 15 bp, Homo sapiens
gtctttctttccaac

SEQ ID NO: 15253 - DNA, 15 bp, Homo sapiens
tgtctttctttccaa

SEQ ID NO: 15254 - DNA, 15 bp, Homo sapiens
atgtctttctttcca

SEQ ID NO: 15255 - DNA, 15 bp, Homo sapiens
gatgtctttctttcc

SEQ ID NO: 15256 - DNA, 15 bp, Homo sapiens
tgatgtctttctttc

SEQ ID NO: 15257 - DNA, 15 bp, Homo sapiens
ttgatgtctttcttt

SEQ ID NO: 15258 - DNA, 15 bp, Homo sapiens
attgatgtctttctt

SEQ ID NO: 15259 - DNA, 15 bp, Homo sapiens
tattgatgtctttct

SEQ ID NO: 15260 - DNA, 15 bp, Homo sapiens
ttattgatgtctttc

SEQ ID NO: 15261 - DNA, 15 bp, Homo sapiens
tttattgatgtcttt

SEQ ID NO: 15262 - DNA, 15 bp, Homo sapiens
gtttattgatgtctt

SEQ ID NO: 15263 - DNA, 15 bp, Homo sapiens
tgtttattgatgtct

SEQ ID NO: 15264 - DNA, 15 bp, Homo sapiens
atgtttattgatgtc

SEQ ID NO: 15265 - DNA, 15 bp, Homo sapiens
gatgtttattgatgt

SEQ ID NO: 15266 - DNA, 15 bp, Homo sapiens
ggatgtttattgatg

SEQ ID NO: 15267 - DNA, 15 bp, Homo sapiens
gggatgtttattgat

SEQ ID NO: 15268 - DNA, 15 bp, Homo sapiens
ggggatgtttattga

SEQ ID NO: 15269 - DNA, 15 bp, Homo sapiens
tggggatgtttattg

SEQ ID NO: 15270 - DNA, 15 bp, Homo sapiens
gtggggatgtttatt

SEQ ID NO: 15271 - DNA, 15 bp, Homo sapiens
tgtggggatgtttat

SEQ ID NO: 15272 - DNA, 15 bp, Homo sapiens
gtgtggggatgttta

SEQ ID NO: 15273 - DNA, 15 bp, Homo sapiens
tgtgtggggatgttt

SEQ ID NO: 15274 - DNA, 15 bp, Homo sapiens
ttgtgtggggatgtt

SEQ ID NO: 15275 - DNA, 15 bp, Homo sapiens
tttgtgtggggatgt

SEQ ID NO: 15276 - DNA, 15 bp, Homo sapiens
gtttgtgtggggatg

SEQ ID NO: 15277 - DNA, 15 bp, Homo sapiens
ggtttgtgtggggat

SEQ ID NO: 15278 - DNA, 15 bp, Homo sapiens
tggtttgtgtgggga

SEQ ID NO: 15279 - DNA, 15 bp, Homo sapiens
ctggtttgtgtgggg

SEQ ID NO: 15280 - DNA, 15 bp, Homo sapiens
cctggtttgtgtggg

SEQ ID NO: 15281 - DNA, 15 bp, Homo sapiens
ccctggtttgtgtgg

SEQ ID NO: 15282 - DNA, 15 bp, Homo sapiens
tccctggtttgtgtg

SEQ ID NO: 15283 - DNA, 15 bp, Homo sapiens
gtccctggtttgtgt

SEQ ID NO: 15284 - DNA, 15 bp, Homo sapiens
tgtccctggtttgtg

SEQ ID NO: 15285 - DNA, 15 bp, Homo sapiens
gtgtccctggtttgt

SEQ ID NO: 15286 - DNA, 15 bp, Homo sapiens
tgtgtccctggtttg

SEQ ID NO: 15287 - DNA, 15 bp, Homo sapiens
atgtgtccctggttt

SEQ ID NO: 15288 - DNA, 15 bp, Homo sapiens
catgtgtccctggtt

SEQ ID NO: 15289 - DNA, 15 bp, Homo sapiens
ccatgtgtccctggt

SEQ ID NO: 15290 - DNA, 15 bp, Homo sapiens
tccatgtgtccctgg

SEQ ID NO: 15291 - DNA, 15 bp, Homo sapiens
ctccatgtgtccctg

SEQ ID NO: 15292 - DNA, 15 bp, Homo sapiens
cctccatgtgtccct

SEQ ID NO: 15293 - DNA, 15 bp, Homo sapiens
ccctccatgtgtccc

SEQ ID NO: 15294 - DNA, 15 bp, Homo sapiens
tccctccatgtgtcc

SEQ ID NO: 15295 - DNA, 15 bp, Homo sapiens
ctccctccatgtgtc

SEQ ID NO: 15296 - DNA, 15 bp, Homo sapiens
cctccctccatgtgt

SEQ ID NO: 15297 - DNA, 15 bp, Homo sapiens
tcctccctccatgtg

SEQ ID NO: 15298 - DNA, 15 bp, Homo sapiens
ttcctccctccatgt

SEQ ID NO: 15299 - DNA, 15 bp, Homo sapiens
cttcctccctccatg

SEQ ID NO: 15300 - DNA, 15 bp, Homo sapiens
ccttcctccctccat

SEQ ID NO: 15301 - DNA, 15 bp, Homo sapiens
tccttcctccctcca

SEQ ID NO: 15302 - DNA, 15 bp, Homo sapiens
atccttcctccctcc

SEQ ID NO: 15303 - DNA, 15 bp, Homo sapiens
catccttcctccctc

SEQ ID NO: 15304 - DNA, 15 bp, Homo sapiens
acatccttcctccct

SEQ ID NO: 15305 - DNA, 15 bp, Homo sapiens
gacatccttcctccc

SEQ ID NO: 15306 - DNA, 15 bp, Homo sapiens
agacatccttcctcc

SEQ ID NO: 15307 - DNA, 15 bp, Homo sapiens
aagacatccttcctc

SEQ ID NO: 15308 - DNA, 15 bp, Homo sapiens
caagacatccttcct

SEQ ID NO: 15309 - DNA, 15 bp, Homo sapiens
gcaagacatccttcc

SEQ ID NO: 15310 - DNA, 15 bp, Homo sapiens
agcaagacatccttc

SEQ ID NO: 15311 - DNA, 15 bp, Homo sapiens
aagcaagacatcctt

SEQ ID NO: 15312 - DNA, 15 bp, Homo sapiens
aaagcaagacatcct

SEQ ID NO: 15313 - DNA, 15 bp, Homo sapiens
caaagcaagacatcc

SEQ ID NO: 15314 - DNA, 15 bp, Homo sapiens
ccaaagcaagacatc

SEQ ID NO: 15315 - DNA, 15 bp, Homo sapiens
accaaagcaagacat

SEQ ID NO: 15316 - DNA, 15 bp, Homo sapiens
aaccaaagcaagaca

SEQ ID NO: 15317 - DNA, 15 bp, Homo sapiens
caaccaaagcaagac

SEQ ID NO: 15318 - DNA, 15 bp, Homo sapiens
ccaaccaaagcaaga

SEQ ID NO: 15319 - DNA, 15 bp, Homo sapiens
tccaaccaaagcaag

SEQ ID NO: 15320 - DNA, 15 bp, Homo sapiens
ttccaaccaaagcaa

SEQ ID NO: 15321 - DNA, 15 bp, Homo sapiens
attccaaccaaagca

SEQ ID NO: 15322 - DNA, 15 bp, Homo sapiens
cattccaaccaaagc

SEQ ID NO: 15323 - DNA, 15 bp, Homo sapiens
tcattccaaccaaag

SEQ ID NO: 15324 - DNA, 15 bp, Homo sapiens
ctcattccaaccaaa

SEQ ID NO: 15325 - DNA, 15 bp, Homo sapiens
cctcattccaaccaa

SEQ ID NO: 15326 - DNA, 15 bp, Homo sapiens
ccctcattccaacca

SEQ ID NO: 15327 - DNA, 15 bp, Homo sapiens
accctcattccaacc

SEQ ID NO: 15328 - DNA, 15 bp, Homo sapiens
taccctcattccaac

SEQ ID NO: 15329 - DNA, 15 bp, Homo sapiens
ctaccctcattccaa

SEQ ID NO: 15330 - DNA, 15 bp, Homo sapiens
cctaccctcattcca

SEQ ID NO: 15331 - DNA, 15 bp, Homo sapiens
acctaccctcattcc

SEQ ID NO: 15332 - DNA, 15 bp, Homo sapiens
aacctaccctcattc

SEQ ID NO: 15333 - DNA, 15 bp, Homo sapiens
aaacctaccctcatt

SEQ ID NO: 15334 - DNA, 15 bp, Homo sapiens
caaacctaccctcat

SEQ ID NO: 15335 - DNA, 15 bp, Homo sapiens
tcaaacctaccctca

SEQ ID NO: 15336 - DNA, 15 bp, Homo sapiens
ctcaaacctaccctc

SEQ ID NO: 15337 - DNA, 15 bp, Homo sapiens
actcaaacctaccct

SEQ ID NO: 15338 - DNA, 15 bp, Homo sapiens
tactcaaacctaccc

SEQ ID NO: 15339 - DNA, 15 bp, Homo sapiens
ttactcaaacctacc

SEQ ID NO: 15340 - DNA, 15 bp, Homo sapiens
cttactcaaacctac

SEQ ID NO: 15341 - DNA, 15 bp, Homo sapiens
tcttactcaaaccta

SEQ ID NO: 15342 - DNA, 15 bp, Homo sapiens
ctcttactcaaacct

SEQ ID NO: 15343 - DNA, 15 bp, Homo sapiens
tctcttactcaaacc

SEQ ID NO: 15344 - DNA, 15 bp, Homo sapiens
ctctcttactcaaac

SEQ ID NO: 15345 - DNA, 15 bp, Homo sapiens
gctctcttactcaaa

SEQ ID NO: 15346 - DNA, 15 bp, Homo sapiens
cgctctcttactcaa

SEQ ID NO: 15347 - DNA, 15 bp, Homo sapiens
acgctctcttactca

SEQ ID NO: 15348 - DNA, 15 bp, Homo sapiens
cacgctctcttactc

SEQ ID NO: 15349 - DNA, 15 bp, Homo sapiens
tcacgctctcttact

SEQ ID NO: 15350 - DNA, 15 bp, Homo sapiens
ttcacgctctcttac

SEQ ID NO: 15351 - DNA, 15 bp, Homo sapiens
tttcacgctctctta

SEQ ID NO: 15352 - DNA, 15 bp, Homo sapiens
ctttcacgctctctt

SEQ ID NO: 15353 - DNA, 15 bp, Homo sapiens
tctttcacgctctct

SEQ ID NO: 15354 - DNA, 15 bp, Homo sapiens
ctctttcacgctctc

SEQ ID NO: 15355 - DNA, 15 bp, Homo sapiens
cctctttcacgctct

SEQ ID NO: 15356 - DNA, 15 bp, Homo sapiens
gcctctttcacgctc

SEQ ID NO: 15357 - DNA, 15 bp, Homo sapiens
tgcctctttcacgct

SEQ ID NO: 15358 - DNA, 15 bp, Homo sapiens
ttgcctctttcacgc

SEQ ID NO: 15359 - DNA, 15 bp, Homo sapiens
cttgcctctttcacg

SEQ ID NO: 15360 - DNA, 15 bp, Homo sapiens
ccttgcctctttcac

SEQ ID NO: 15361 - DNA, 15 bp, Homo sapiens
tccttgcctctttca

SEQ ID NO: 15362 - DNA, 15 bp, Homo sapiens
ttccttgcctctttc

SEQ ID NO: 15363 - DNA, 15 bp, Homo sapiens
attccttgcctcttt

SEQ ID NO: 15364 - DNA, 15 bp, Homo sapiens
aattccttgcctctt

SEQ ID NO: 15365 - DNA, 15 bp, Homo sapiens
aaattccttgcctct

SEQ ID NO: 15366 - DNA, 15 bp, Homo sapiens
caaattccttgcctc

SEQ ID NO: 15367 - DNA, 15 bp, Homo sapiens
tcaaattccttgcct

SEQ ID NO: 15368 - DNA, 15 bp, Homo sapiens
ctcaaattccttgcc

SEQ ID NO: 15369 - DNA, 15 bp, Homo sapiens
cctcaaattccttgc

SEQ ID NO: 15370 - DNA, 15 bp, Homo sapiens
acctcaaattccttg

SEQ ID NO: 15371 - DNA, 15 bp, Homo sapiens
cacctcaaattcctt

SEQ ID NO: 15372 - DNA, 15 bp, Homo sapiens
acacctcaaattcct

SEQ ID NO: 15373 - DNA, 15 bp, Homo sapiens
cacacctcaaattcc

SEQ ID NO: 15374 - DNA, 15 bp, Homo sapiens
gcacacctcaaattc

SEQ ID NO: 15375 - DNA, 15 bp, Homo sapiens
ggcacacctcaaatt

SEQ ID NO: 15376 - DNA, 15 bp, Homo sapiens
aggcacacctcaaat

SEQ ID NO: 15377 - DNA, 15 bp, Homo sapiens
aaggcacacctcaaa

SEQ ID NO: 15378 - DNA, 15 bp, Homo sapiens
caaggcacacctcaa

SEQ ID NO: 15379 - DNA, 15 bp, Homo sapiens
tcaaggcacacctca

SEQ ID NO: 15380 - DNA, 15 bp, Homo sapiens
ttcaaggcacacctc

SEQ ID NO: 15381 - DNA, 15 bp, Homo sapiens
cttcaaggcacacct

SEQ ID NO: 15382 - DNA, 15 bp, Homo sapiens
ccttcaaggcacacc

SEQ ID NO: 15383 - DNA, 15 bp, Homo sapiens
tccttcaaggcacac

SEQ ID NO: 15384 - DNA, 15 bp, Homo sapiens
atccttcaaggcaca

SEQ ID NO: 15385 - DNA, 15 bp, Homo sapiens
catccttcaaggcac

SEQ ID NO: 15386 - DNA, 15 bp, Homo sapiens
acatccttcaaggca

SEQ ID NO: 15387 - DNA, 15 bp, Homo sapiens
cacatccttcaaggc

SEQ ID NO: 15388 - DNA, 15 bp, Homo sapiens
acacatccttcaagg

SEQ ID NO: 15389 - DNA, 15 bp, Homo sapiens
tacacatccttcaag

SEQ ID NO: 15390 - DNA, 15 bp, Homo sapiens
ttacacatccttcaa

SEQ ID NO: 15391 - DNA, 15 bp, Homo sapiens
cttacacatccttca

SEQ ID NO: 15392 - DNA, 15 bp, Homo sapiens
tcttacacatccttc

SEQ ID NO: 15393 - DNA, 15 bp, Homo sapiens
ctcttacacatcctt

SEQ ID NO: 15394 - DNA, 15 bp, Homo sapiens
cctcttacacatcct

SEQ ID NO: 15395 - DNA, 15 bp, Homo sapiens
gcctcttacacatcc

SEQ ID NO: 15396 - DNA, 15 bp, Homo sapiens
tgcctcttacacatc

SEQ ID NO: 15397 - DNA, 15 bp, Homo sapiens
ttgcctcttacacat

SEQ ID NO: 15398 - DNA, 15 bp, Homo sapiens
gttgcctcttacaca

SEQ ID NO: 15399 - DNA, 15 bp, Homo sapiens
cgttgcctcttacac

SEQ ID NO: 15400 - DNA, 15 bp, Homo sapiens
gcgttgcctcttaca

SEQ ID NO: 15401 - DNA, 15 bp, Homo sapiens
agcgttgcctcttac

SEQ ID NO: 15402 - DNA, 15 bp, Homo sapiens
cagcgttgcctctta

SEQ ID NO: 15403 - DNA, 15 bp, Homo sapiens
acagcgttgcctctt

SEQ ID NO: 15404 - DNA, 15 bp, Homo sapiens
cacagcgttgcctct

SEQ ID NO: 15405 - DNA, 15 bp, Homo sapiens
ccacagcgttgcctc

SEQ ID NO: 15406 - DNA, 15 bp, Homo sapiens
tccacagcgttgcct

SEQ ID NO: 15407 - DNA, 15 bp, Homo sapiens
gtccacagcgttgcc

SEQ ID NO: 15408 - DNA, 15 bp, Homo sapiens
tgtccacagcgttgc

SEQ ID NO: 15409 - DNA, 15 bp, Homo sapiens
ctgtccacagcgttg

SEQ ID NO: 15410 - DNA, 15 bp, Homo sapiens
actgtccacagcgtt

SEQ ID NO: 15411 - DNA, 15 bp, Homo sapiens
cactgtccacagcgt

SEQ ID NO: 15412 - DNA, 15 bp, Homo sapiens
acactgtccacagcg

SEQ ID NO: 15413 - DNA, 15 bp, Homo sapiens
cacactgtccacagc

SEQ ID NO: 15414 - DNA, 15 bp, Homo sapiens
ccacactgtccacag

SEQ ID NO: 15415 - DNA, 15 bp, Homo sapiens
cccacactgtccaca

SEQ ID NO: 15416 - DNA, 15 bp, Homo sapiens
tcccacactgtccac

SEQ ID NO: 15417 - DNA, 15 bp, Homo sapiens
ttcccacactgtcca

SEQ ID NO: 15418 - DNA, 15 bp, Homo sapiens
cttcccacactgtcc

SEQ ID NO: 15419 - DNA, 15 bp, Homo sapiens
tcttcccacactgtc

SEQ ID NO: 15420 - DNA, 15 bp, Homo sapiens
ttcttcccacactgt

SEQ ID NO: 15421 - DNA, 15 bp, Homo sapiens
gttcttcccacactg

SEQ ID NO: 15422 - DNA, 15 bp, Homo sapiens
tgttcttcccacact

SEQ ID NO: 15423 - DNA, 15 bp, Homo sapiens
atgttcttcccacac

SEQ ID NO: 15424 - DNA, 15 bp, Homo sapiens
aatgttcttcccaca

SEQ ID NO: 15425 - DNA, 15 bp, Homo sapiens
caatgttcttcccac

SEQ ID NO: 15426 - DNA, 15 bp, Homo sapiens
gcaatgttcttccca

SEQ ID NO: 15427 - DNA, 15 bp, Homo sapiens
tgcaatgttcttccc

SEQ ID NO: 15428 - DNA, 15 bp, Homo sapiens
ctgcaatgttcttcc

SEQ ID NO: 15429 - DNA, 15 bp, Homo sapiens
tctgcaatgttcttc

SEQ ID NO: 15430 - DNA, 15 bp, Homo sapiens
atctgcaatgttctt

SEQ ID NO: 15431 - DNA, 15 bp, Homo sapiens
catctgcaatgttct

SEQ ID NO: 15432 - DNA, 15 bp, Homo sapiens
tcatctgcaatgttc

SEQ ID NO: 15433 - DNA, 15 bp, Homo sapiens
atcatctgcaatgtt

SEQ ID NO: 15434 - DNA, 15 bp, Homo sapiens
catcatctgcaatgt

SEQ ID NO: 15435 - DNA, 15 bp, Homo sapiens
tcatcatctgcaatg

SEQ ID NO: 15436 - DNA, 15 bp, Homo sapiens
ctcatcatctgcaat

SEQ ID NO: 15437 - DNA, 15 bp, Homo sapiens
tctcatcatctgcaa

SEQ ID NO: 15438 - DNA, 15 bp, Homo sapiens
ttctcatcatctgca

SEQ ID NO: 15439 - DNA, 15 bp, Homo sapiens
tttctcatcatctgc

SEQ ID NO: 15440 - DNA, 15 bp, Homo sapiens
ttttctcatcatctg

SEQ ID NO: 15441 - DNA, 15 bp, Homo sapiens
cttttctcatcatct

SEQ ID NO: 15442 - DNA, 15 bp, Homo sapiens
tcttttctcatcatc

SEQ ID NO: 15443 - DNA, 15 bp, Homo sapiens
ctcttttctcatcat

SEQ ID NO: 15444 - DNA, 15 bp, Homo sapiens
gctcttttctcatca

SEQ ID NO: 15445 - DNA, 15 bp, Homo sapiens
tgctcttttctcatc

SEQ ID NO: 15446 - DNA, 15 bp, Homo sapiens
ttgctcttttctcat

SEQ ID NO: 15447 - DNA, 15 bp, Homo sapiens
cttgctcttttctca

SEQ ID NO: 15448 - DNA, 15 bp, Homo sapiens
ccttgctcttttctc

SEQ ID NO: 15449 - DNA, 15 bp, Homo sapiens
gccttgctcttttct

SEQ ID NO: 15450 - DNA, 15 bp, Homo sapiens
tgccttgctcttttc

SEQ ID NO: 15451 - DNA, 15 bp, Homo sapiens
atgccttgctctttt

SEQ ID NO: 15452 - DNA, 15 bp, Homo sapiens
aatgccttgctcttt

SEQ ID NO: 15453 - DNA, 15 bp, Homo sapiens
aaatgccttgctctt

SEQ ID NO: 15454 - DNA, 15 bp, Homo sapiens
caaatgccttgctct

SEQ ID NO: 15455 - DNA, 15 bp, Homo sapiens
tcaaatgccttgctc

SEQ ID NO: 15456 - DNA, 15 bp, Homo sapiens
ttcaaatgccttgct

SEQ ID NO: 15457 - DNA, 15 bp, Homo sapiens
cttcaaatgccttgc

SEQ ID NO: 15458 - DNA, 15 bp, Homo sapiens
acttcaaatgccttg

SEQ ID NO: 15459 - DNA, 15 bp, Homo sapiens
gacttcaaatgcctt

SEQ ID NO: 15460 - DNA, 15 bp, Homo sapiens
agacttcaaatgcct

SEQ ID NO: 15461 - DNA, 15 bp, Homo sapiens
cagacttcaaatgcc

SEQ ID NO: 15462 - DNA, 15 bp, Homo sapiens
acagacttcaaatgc

SEQ ID NO: 15463 - DNA, 15 bp, Homo sapiens
gacagacttcaaatg

SEQ ID NO: 15464 - DNA, 15 bp, Homo sapiens
ggacagacttcaaat

SEQ ID NO: 15465 - DNA, 15 bp, Homo sapiens
gggacagacttcaaa

SEQ ID NO: 15466 - DNA, 15 bp, Homo sapiens
agggacagacttcaa

SEQ ID NO: 15467 - DNA, 15 bp, Homo sapiens
cagggacagacttca

SEQ ID NO: 15468 - DNA, 15 bp, Homo sapiens
ccagggacagacttc

SEQ ID NO: 15469 - DNA, 15 bp, Homo sapiens
accagggacagactt

SEQ ID NO: 15470 - DNA, 15 bp, Homo sapiens
taccagggacagact

SEQ ID NO: 15471 - DNA, 15 bp, Homo sapiens
ttaccagggacagac

SEQ ID NO: 15472 - DNA, 15 bp, Homo sapiens
gttaccagggacaga

SEQ ID NO: 15473 - DNA, 15 bp, Homo sapiens
agttaccagggacag

SEQ ID NO: 15474 - DNA, 15 bp, Homo sapiens
cagttaccagggaca

SEQ ID NO: 15475 - DNA, 15 bp, Homo sapiens
tcagttaccagggac

SEQ ID NO: 15476 - DNA, 15 bp, Homo sapiens
ctcagttaccaggga

SEQ ID NO: 15477 - DNA, 15 bp, Homo sapiens
actcagttaccaggg

SEQ ID NO: 15478 - DNA, 15 bp, Homo sapiens
cactcagttaccagg

SEQ ID NO: 15479 - DNA, 15 bp, Homo sapiens
acactcagttaccag

SEQ ID NO: 15480 - DNA, 15 bp, Homo sapiens
cacactcagttacca

SEQ ID NO: 15481 - DNA, 15 bp, Homo sapiens
ccacactcagttacc

SEQ ID NO: 15482 - DNA, 15 bp, Homo sapiens
gccacactcagttac

SEQ ID NO: 15483 - DNA, 15 bp, Homo sapiens
agccacactcagtta

SEQ ID NO: 15484 - DNA, 15 bp, Homo sapiens
cagccacactcagtt

SEQ ID NO: 15485 - DNA, 15 bp, Homo sapiens
ccagccacactcagt

SEQ ID NO: 15486 - DNA, 15 bp, Homo sapiens
cccagccacactcag

SEQ ID NO: 15487 - DNA, 15 bp, Homo sapiens
ccccagccacactca

SEQ ID NO: 15488 - DNA, 15 bp, Homo sapiens
accccagccacactc

SEQ ID NO: 15489 - DNA, 15 bp, Homo sapiens
taccccagccacact

SEQ ID NO: 15490 - DNA, 15 bp, Homo sapiens
ttaccccagccacac

SEQ ID NO: 15491 - DNA, 15 bp, Homo sapiens
attaccccagccaca

SEQ ID NO: 15492 - DNA, 15 bp, Homo sapiens
cattaccccagccac

SEQ ID NO: 15493 - DNA, 15 bp, Homo sapiens
ccattaccccagcca

SEQ ID NO: 15494 - DNA, 15 bp, Homo sapiens
cccattaccccagcc

SEQ ID NO: 15495 - DNA, 15 bp, Homo sapiens
ccccattaccccagc

SEQ ID NO: 15496 - DNA, 15 bp, Homo sapiens
tccccattaccccag

SEQ ID NO: 15497 - DNA, 15 bp, Homo sapiens
atccccattacccca

SEQ ID NO: 15498 - DNA, 15 bp, Homo sapiens
catccccattacccc

SEQ ID NO: 15499 - DNA, 15 bp, Homo sapiens
tcatccccattaccc

SEQ ID NO: 15500 - DNA, 15 bp, Homo sapiens
atcatccccattacc

SEQ ID NO: 15501 - DNA, 15 bp, Homo sapiens
catcatccccattac

SEQ ID NO: 15502 - DNA, 15 bp, Homo sapiens
ccatcatccccatta

SEQ ID NO: 15503 - DNA, 15 bp, Homo sapiens
cccatcatccccatt

SEQ ID NO: 15504 - DNA, 15 bp, Homo sapiens
tcccatcatccccat

SEQ ID NO: 15505 - DNA, 15 bp, Homo sapiens
ctcccatcatcccca

SEQ ID NO: 15506 - DNA, 15 bp, Homo sapiens
tctcccatcatcccc

SEQ ID NO: 15507 - DNA, 15 bp, Homo sapiens
ttctcccatcatccc

SEQ ID NO: 15508 - DNA, 15 bp, Homo sapiens
cttctcccatcatcc

SEQ ID NO: 15509 - DNA, 15 bp, Homo sapiens
gcttctcccatcatc

SEQ ID NO: 15510 - DNA, 15 bp, Homo sapiens
agcttctcccatcat

SEQ ID NO: 15511 - DNA, 15 bp, Homo sapiens
cagcttctcccatca

SEQ ID NO: 15512 - DNA, 15 bp, Homo sapiens
ccagcttctcccatc

SEQ ID NO: 15513 - DNA, 15 bp, Homo sapiens
cccagcttctcccat

SEQ ID NO: 15514 - DNA, 15 bp, Homo sapiens
ccccagcttctccca

SEQ ID NO: 15515 - DNA, 15 bp, Homo sapiens
accccagcttctccc

SEQ ID NO: 15516 - DNA, 15 bp, Homo sapiens
gaccccagcttctcc

SEQ ID NO: 15517 - DNA, 15 bp, Homo sapiens
tgaccccagcttctc

SEQ ID NO: 15518 - DNA, 15 bp, Homo sapiens
ctgaccccagcttct

SEQ ID NO: 15519 - DNA, 15 bp, Homo sapiens
tctgaccccagcttc

SEQ ID NO: 15520 - DNA, 15 bp, Homo sapiens
atctgaccccagctt

SEQ ID NO: 15521 - DNA, 15 bp, Homo sapiens
aatctgaccccagct

SEQ ID NO: 15522 - DNA, 15 bp, Homo sapiens
aaatctgaccccagc

SEQ ID NO: 15523 - DNA, 15 bp, Homo sapiens
gaaatctgaccccag

SEQ ID NO: 15524 - DNA, 15 bp, Homo sapiens
cgaaatctgacccca

SEQ ID NO: 15525 - DNA, 15 bp, Homo sapiens
tcgaaatctgacccc

SEQ ID NO: 15526 - DNA, 15 bp, Homo sapiens
ttcgaaatctgaccc

SEQ ID NO: 15527 - DNA, 15 bp, Homo sapiens
tttcgaaatctgacc

SEQ ID NO: 15528 - DNA, 15 bp, Homo sapiens
ctttcgaaatctgac

SEQ ID NO: 15529 - DNA, 15 bp, Homo sapiens
gctttcgaaatctga

SEQ ID NO: 15530 - DNA, 15 bp, Homo sapiens
ggctttcgaaatctg

SEQ ID NO: 15531 - DNA, 15 bp, Homo sapiens
gggctttcgaaatct

SEQ ID NO: 15532 - DNA, 15 bp, Homo sapiens
agggctttcgaaatc

SEQ ID NO: 15533 - DNA, 15 bp, Homo sapiens
aagggctttcgaaat

SEQ ID NO: 15534 - DNA, 15 bp, Homo sapiens
aaagggctttcgaaa

SEQ ID NO: 15535 - DNA, 15 bp, Homo sapiens
aaaagggctttcgaa

SEQ ID NO: 15536 - DNA, 15 bp, Homo sapiens
caaaagggctttcga

SEQ ID NO: 15537 - DNA, 15 bp, Homo sapiens
tcaaaagggctttcg

SEQ ID NO: 15538 - DNA, 15 bp, Homo sapiens
ttcaaaagggctttc

SEQ ID NO: 15539 - DNA, 15 bp, Homo sapiens
cttcaaaagggcttt

SEQ ID NO: 15540 - DNA, 15 bp, Homo sapiens
gcttcaaaagggctt

SEQ ID NO: 15541 - DNA, 15 bp, Homo sapiens
tgcttcaaaagggct

SEQ ID NO: 15542 - DNA, 15 bp, Homo sapiens
ctgcttcaaaagggc

SEQ ID NO: 15543 - DNA, 15 bp, Homo sapiens
cctgcttcaaaaggg

SEQ ID NO: 15544 - DNA, 15 bp, Homo sapiens
ccctgcttcaaaagg

SEQ ID NO: 15545 - DNA, 15 bp, Homo sapiens
accctgcttcaaaag

SEQ ID NO: 15546 - DNA, 15 bp, Homo sapiens
aaccctgcttcaaaa

SEQ ID NO: 15547 - DNA, 15 bp, Homo sapiens
aaaccctgcttcaaa

SEQ ID NO: 15548 - DNA, 15 bp, Homo sapiens
taaaccctgcttcaa

SEQ ID NO: 15549 - DNA, 15 bp, Homo sapiens
ataaaccctgcttca

SEQ ID NO: 15550 - DNA, 15 bp, Homo sapiens
aataaaccctgcttc

SEQ ID NO: 15551 - DNA, 15 bp, Homo sapiens
aaataaaccctgctt

SEQ ID NO: 15552 - DNA, 15 bp, Homo sapiens
caaataaaccctgct

SEQ ID NO: 15553 - DNA, 15 bp, Homo sapiens
tcaaataaaccctgc

SEQ ID NO: 15554 - DNA, 15 bp, Homo sapiens
atcaaataaaccctg

SEQ ID NO: 15555 - DNA, 15 bp, Homo sapiens
gatcaaataaaccct

SEQ ID NO: 15556 - DNA, 15 bp, Homo sapiens
agatcaaataaaccc

SEQ ID NO: 15557 - DNA, 15 bp, Homo sapiens
aagatcaaataaacc

SEQ ID NO: 15558 - DNA, 15 bp, Homo sapiens
aaagatcaaataaac

SEQ ID NO: 15559 - DNA, 15 bp, Homo sapiens
gaaagatcaaataaa

SEQ ID NO: 15560 - DNA, 15 bp, Homo sapiens
ggaaagatcaaataa

SEQ ID NO: 15561 - DNA, 15 bp, Homo sapiens
gggaaagatcaaata

SEQ ID NO: 15562 - DNA, 15 bp, Homo sapiens
agggaaagatcaaat

SEQ ID NO: 15563 - DNA, 15 bp, Homo sapiens
cagggaaagatcaaa

SEQ ID NO: 15564 - DNA, 15 bp, Homo sapiens
acagggaaagatcaa

SEQ ID NO: 15565 - DNA, 15 bp, Homo sapiens
tacagggaaagatca

SEQ ID NO: 15566 - DNA, 15 bp, Homo sapiens
ttacagggaaagatc

SEQ ID NO: 15567 - DNA, 15 bp, Homo sapiens
cttacagggaaagat

SEQ ID NO: 15568 - DNA, 15 bp, Homo sapiens
tcttacagggaaaga

SEQ ID NO: 15569 - DNA, 15 bp, Homo sapiens
ttcttacagggaaag

SEQ ID NO: 15570 - DNA, 15 bp, Homo sapiens
cttcttacagggaaa

SEQ ID NO: 15571 - DNA, 15 bp, Homo sapiens
gcttcttacagggaa

SEQ ID NO: 15572 - DNA, 15 bp, Homo sapiens
ggcttcttacaggga

SEQ ID NO: 15573 - DNA, 15 bp, Homo sapiens
tggcttcttacaggg

SEQ ID NO: 15574 - DNA, 15 bp, Homo sapiens
gtggcttcttacagg

SEQ ID NO: 15575 - DNA, 15 bp, Homo sapiens
agtggcttcttacag

SEQ ID NO: 15576 - DNA, 15 bp, Homo sapiens
tagtggcttcttaca

SEQ ID NO: 15577 - DNA, 15 bp, Homo sapiens
gtagtggcttcttac

SEQ ID NO: 15578 - DNA, 15 bp, Homo sapiens
tgtagtggcttctta

SEQ ID NO: 15579 - DNA, 15 bp, Homo sapiens
ctgtagtggcttctt

SEQ ID NO: 15580 - DNA, 15 bp, Homo sapiens
cctgtagtggcttct

SEQ ID NO: 15581 - DNA, 15 bp, Homo sapiens
tcctgtagtggcttc

SEQ ID NO: 15582 - DNA, 15 bp, Homo sapiens
atcctgtagtggctt

SEQ ID NO: 15583 - DNA, 15 bp, Homo sapiens
aatcctgtagtggct

SEQ ID NO: 15584 - DNA, 15 bp, Homo sapiens
aaatcctgtagtggc

SEQ ID NO: 15585 - DNA, 15 bp, Homo sapiens
aaaatcctgtagtgg

SEQ ID NO: 15586 - DNA, 15 bp, Homo sapiens
taaaatcctgtagtg

SEQ ID NO: 15587 - DNA, 15 bp, Homo sapiens
ctaaaatcctgtagt

SEQ ID NO: 15588 - DNA, 15 bp, Homo sapiens
cctaaaatcctgtag

SEQ ID NO: 15589 - DNA, 15 bp, Homo sapiens
acctaaaatcctgta

SEQ ID NO: 15590 - DNA, 15 bp, Homo sapiens
cacctaaaatcctgt

SEQ ID NO: 15591 - DNA, 15 bp, Homo sapiens
tcacctaaaatcctg

SEQ ID NO: 15592 - DNA, 15 bp, Homo sapiens
ctcacctaaaatcct

SEQ ID NO: 15593 - DNA, 15 bp, Homo sapiens
actcacctaaaatcc

SEQ ID NO: 15594 - DNA, 15 bp, Homo sapiens
aactcacctaaaatc

SEQ ID NO: 15595 - DNA, 15 bp, Homo sapiens
taactcacctaaaat

SEQ ID NO: 15596 - DNA, 15 bp, Homo sapiens
ttaactcacctaaaa

SEQ ID NO: 15597 - DNA, 15 bp, Homo sapiens
attaactcacctaaa

SEQ ID NO: 15598 - DNA, 15 bp, Homo sapiens
cattaactcacctaa

SEQ ID NO: 15599 - DNA, 15 bp, Homo sapiens
tcattaactcaccta

SEQ ID NO: 15600 - DNA, 15 bp, Homo sapiens
gtcattaactcacct

SEQ ID NO: 15601 - DNA, 15 bp, Homo sapiens
agtcattaactcacc

SEQ ID NO: 15602 - DNA, 15 bp, Homo sapiens
tagtcattaactcac

SEQ ID NO: 15603 - DNA, 15 bp, Homo sapiens
ctagtcattaactca

SEQ ID NO: 15604 - DNA, 15 bp, Homo sapiens
gctagtcattaactc

SEQ ID NO: 15605 - DNA, 15 bp, Homo sapiens
agctagtcattaact

SEQ ID NO: 15606 - DNA, 15 bp, Homo sapiens
gagctagtcattaac

SEQ ID NO: 15607 - DNA, 15 bp, Homo sapiens
tgagctagtcattaa

SEQ ID NO: 15608 - DNA, 15 bp, Homo sapiens
ctgagctagtcatta

SEQ ID NO: 15609 - DNA, 15 bp, Homo sapiens
tctgagctagtcatt

SEQ ID NO: 15610 - DNA, 15 bp, Homo sapiens
ttctgagctagtcat

SEQ ID NO: 15611 - DNA, 15 bp, Homo sapiens
gttctgagctagtca

SEQ ID NO: 15612 - DNA, 15 bp, Homo sapiens
agttctgagctagtc

SEQ ID NO: 15613 - DNA, 15 bp, Homo sapiens
cagttctgagctagt

SEQ ID NO: 15614 - DNA, 15 bp, Homo sapiens
acagttctgagctag

SEQ ID NO: 15615 - DNA, 15 bp, Homo sapiens
aacagttctgagcta

SEQ ID NO: 15616 - DNA, 15 bp, Homo sapiens
aaacagttctgagct

SEQ ID NO: 15617 - DNA, 15 bp, Homo sapiens
aaaacagttctgagc

SEQ ID NO: 15618 - DNA, 15 bp, Homo sapiens
aaaaacagttctgag

SEQ ID NO: 15619 - DNA, 15 bp, Homo sapiens
gaaaaacagttctga

SEQ ID NO: 15620 - DNA, 15 bp, Homo sapiens
tgaaaaacagttctg

SEQ ID NO: 15621 - DNA, 15 bp, Homo sapiens
ctgaaaaacagttct

SEQ ID NO: 15622 - DNA, 15 bp, Homo sapiens
tctgaaaaacagttc

SEQ ID NO: 15623 - DNA, 15 bp, Homo sapiens
ttctgaaaaacagtt

SEQ ID NO: 15624 - DNA, 15 bp, Homo sapiens
tttctgaaaaacagt

SEQ ID NO: 15625 - DNA, 15 bp, Homo sapiens
ctttctgaaaaacag

SEQ ID NO: 15626 - DNA, 15 bp, Homo sapiens
tctttctgaaaaaca

SEQ ID NO: 15627 - DNA, 15 bp, Homo sapiens
atctttctgaaaaac

SEQ ID NO: 15628 - DNA, 15 bp, Homo sapiens
tatctttctgaaaaa

SEQ ID NO: 15629 - DNA, 15 bp, Homo sapiens
ttatctttctgaaaa

SEQ ID NO: 15630 - DNA, 15 bp, Homo sapiens
gttatctttctgaaa

SEQ ID NO: 15631 - DNA, 15 bp, Homo sapiens
agttatctttctgaa

SEQ ID NO: 15632 - DNA, 15 bp, Homo sapiens
aagttatctttctga

SEQ ID NO: 15633 - DNA, 15 bp, Homo sapiens
caagttatctttctg

SEQ ID NO: 15634 - DNA, 15 bp, Homo sapiens
ccaagttatctttct

SEQ ID NO: 15635 - DNA, 15 bp, Homo sapiens
gccaagttatctttc

SEQ ID NO: 15636 - DNA, 15 bp, Homo sapiens
agccaagttatcttt

SEQ ID NO: 15637 - DNA, 15 bp, Homo sapiens
cagccaagttatctt

SEQ ID NO: 15638 - DNA, 15 bp, Homo sapiens
ccagccaagttatct

SEQ ID NO: 15639 - DNA, 15 bp, Homo sapiens
gccagccaagttatc

SEQ ID NO: 15640 - DNA, 15 bp, Homo sapiens
tgccagccaagttat

SEQ ID NO: 15641 - DNA, 15 bp, Homo sapiens
ctgccagccaagtta

SEQ ID NO: 15642 - DNA, 15 bp, Homo sapiens
gctgccagccaagtt

SEQ ID NO: 15643 - DNA, 15 bp, Homo sapiens
tgctgccagccaagt

SEQ ID NO: 15644 - DNA, 15 bp, Homo sapiens
ctgctgccagccaag

SEQ ID NO: 15645 - DNA, 15 bp, Homo sapiens
cctgctgccagccaa

SEQ ID NO: 15646 - DNA, 15 bp, Homo sapiens
tcctgctgccagcca

SEQ ID NO: 15647 - DNA, 15 bp, Homo sapiens
ttcctgctgccagcc

SEQ ID NO: 15648 - DNA, 15 bp, Homo sapiens
tttcctgctgccagc

SEQ ID NO: 15649 - DNA, 15 bp, Homo sapiens
ctttcctgctgccag

SEQ ID NO: 15650 - DNA, 15 bp, Homo sapiens
tctttcctgctgcca

SEQ ID NO: 15651 - DNA, 15 bp, Homo sapiens
atctttcctgctgcc

SEQ ID NO: 15652 - DNA, 15 bp, Homo sapiens
tatctttcctgctgc

SEQ ID NO: 15653 - DNA, 15 bp, Homo sapiens
ctatctttcctgctg

SEQ ID NO: 15654 - DNA, 15 bp, Homo sapiens
tctatctttcctgct

SEQ ID NO: 15655 - DNA, 15 bp, Homo sapiens
atctatctttcctgc

SEQ ID NO: 15656 - DNA, 15 bp, Homo sapiens
aatctatctttcctg

SEQ ID NO: 15657 - DNA, 15 bp, Homo sapiens
aaatctatctttcct

SEQ ID NO: 15658 - DNA, 15 bp, Homo sapiens
caaatctatctttcc

SEQ ID NO: 15659 - DNA, 15 bp, Homo sapiens
ccaaatctatctttc

SEQ ID NO: 15660 - DNA, 15 bp, Homo sapiens
tccaaatctatcttt

SEQ ID NO: 15661 - DNA, 15 bp, Homo sapiens
ttccaaatctatctt

SEQ ID NO: 15662 - DNA, 15 bp, Homo sapiens
cttccaaatctatct

SEQ ID NO: 15663 - DNA, 15 bp, Homo sapiens
ccttccaaatctatc

SEQ ID NO: 15664 - DNA, 15 bp, Homo sapiens
accttccaaatctat

SEQ ID NO: 15665 - DNA, 15 bp, Homo sapiens
taccttccaaatcta

SEQ ID NO: 15666 - DNA, 15 bp, Homo sapiens
ctaccttccaaatct

SEQ ID NO: 15667 - DNA, 15 bp, Homo sapiens
gctaccttccaaatc

SEQ ID NO: 15668 - DNA, 15 bp, Homo sapiens
tgctaccttccaaat

SEQ ID NO: 15669 - DNA, 15 bp, Homo sapiens
ctgctaccttccaaa

SEQ ID NO: 15670 - DNA, 15 bp, Homo sapiens
tctgctaccttccaa

SEQ ID NO: 15671 - DNA, 15 bp, Homo sapiens
ctctgctaccttcca

SEQ ID NO: 15672 - DNA, 15 bp, Homo sapiens
actctgctaccttcc

SEQ ID NO: 15673 - DNA, 15 bp, Homo sapiens
aactctgctaccttc

SEQ ID NO: 15674 - DNA, 15 bp, Homo sapiens
taactctgctacctt

SEQ ID NO: 15675 - DNA, 15 bp, Homo sapiens
ctaactctgctacct

SEQ ID NO: 15676 - DNA, 15 bp, Homo sapiens
cctaactctgctacc

SEQ ID NO: 15677 - DNA, 15 bp, Homo sapiens
ccctaactctgctac

SEQ ID NO: 15678 - DNA, 15 bp, Homo sapiens
cccctaactctgcta

SEQ ID NO: 15679 - DNA, 15 bp, Homo sapiens
ccccctaactctgct

SEQ ID NO: 15680 - DNA, 15 bp, Homo sapiens
tccccctaactctgc

SEQ ID NO: 15681 - DNA, 15 bp, Homo sapiens
ctccccctaactctg

SEQ ID NO: 15682 - DNA, 15 bp, Homo sapiens
cctccccctaactct

SEQ ID NO: 15683 - DNA, 15 bp, Homo sapiens
gcctccccctaactc

SEQ ID NO: 15684 - DNA, 15 bp, Homo sapiens
tgcctccccctaact

SEQ ID NO: 15685 - DNA, 15 bp, Homo sapiens
ctgcctccccctaac

SEQ ID NO: 15686 - DNA, 15 bp, Homo sapiens
cctgcctccccctaa

SEQ ID NO: 15687 - DNA, 15 bp, Homo sapiens
ccctgcctcccccta

SEQ ID NO: 15688 - DNA, 15 bp, Homo sapiens
tccctgcctccccct

SEQ ID NO: 15689 - DNA, 15 bp, Homo sapiens
ttccctgcctccccc

SEQ ID NO: 15690 - DNA, 15 bp, Homo sapiens
gttccctgcctcccc

SEQ ID NO: 15691 - DNA, 15 bp, Homo sapiens
tgttccctgcctccc

SEQ ID NO: 15692 - DNA, 15 bp, Homo sapiens
ctgttccctgcctcc

SEQ ID NO: 15693 - DNA, 15 bp, Homo sapiens
cctgttccctgcctc

SEQ ID NO: 15694 - DNA, 15 bp, Homo sapiens
acctgttccctgcct

SEQ ID NO: 15695 - DNA, 15 bp, Homo sapiens
tacctgttccctgcc

SEQ ID NO: 15696 - DNA, 15 bp, Homo sapiens
ttacctgttccctgc

SEQ ID NO: 15697 - DNA, 15 bp, Homo sapiens
cttacctgttccctg

SEQ ID NO: 15698 - DNA, 15 bp, Homo sapiens
tcttacctgttccct

SEQ ID NO: 15699 - DNA, 15 bp, Homo sapiens
ctcttacctgttccc

SEQ ID NO: 15700 - DNA, 15 bp, Homo sapiens
actcttacctgttcc

SEQ ID NO: 15701 - DNA, 15 bp, Homo sapiens
aactcttacctgttc

SEQ ID NO: 15702 - DNA, 15 bp, Homo sapiens
caactcttacctgtt

SEQ ID NO: 15703 - DNA, 15 bp, Homo sapiens
acaactcttacctgt

SEQ ID NO: 15704 - DNA, 15 bp, Homo sapiens
cacaactcttacctg

SEQ ID NO: 15705 - DNA, 15 bp, Homo sapiens
tcacaactcttacct

SEQ ID NO: 15706 - DNA, 15 bp, Homo sapiens
ttcacaactcttacc

SEQ ID NO: 15707 - DNA, 15 bp, Homo sapiens
tttcacaactcttac

SEQ ID NO: 15708 - DNA, 15 bp, Homo sapiens
ttttcacaactctta

SEQ ID NO: 15709 - DNA, 15 bp, Homo sapiens
tttttcacaactctt

SEQ ID NO: 15710 - DNA, 15 bp, Homo sapiens
ttttttcacaactct

SEQ ID NO: 15711 - DNA, 15 bp, Homo sapiens
attttttcacaactc

SEQ ID NO: 15712 - DNA, 15 bp, Homo sapiens
aattttttcacaact

SEQ ID NO: 15713 - DNA, 15 bp, Homo sapiens
caattttttcacaac

SEQ ID NO: 15714 - DNA, 15 bp, Homo sapiens
tcaattttttcacaa

SEQ ID NO: 15715 - DNA, 15 bp, Homo sapiens
ctcaattttttcaca

SEQ ID NO: 15716 - DNA, 15 bp, Homo sapiens
cctcaattttttcac

SEQ ID NO: 15717 - DNA, 15 bp, Homo sapiens
acctcaattttttca

SEQ ID NO: 15718 - DNA, 15 bp, Homo sapiens
aacctcaattttttc

SEQ ID NO: 15719 - DNA, 15 bp, Homo sapiens
taacctcaatttttt

SEQ ID NO: 15720 - DNA, 15 bp, Homo sapiens
ttaacctcaattttt

SEQ ID NO: 15721 - DNA, 15 bp, Homo sapiens
cttaacctcaatttt

SEQ ID NO: 15722 - DNA, 15 bp, Homo sapiens
ccttaacctcaattt

SEQ ID NO: 15723 - DNA, 15 bp, Homo sapiens
tccttaacctcaatt

SEQ ID NO: 15724 - DNA, 15 bp, Homo sapiens
ctccttaacctcaat

SEQ ID NO: 15725 - DNA, 15 bp, Homo sapiens
actccttaacctcaa

SEQ ID NO: 15726 - DNA, 15 bp, Homo sapiens
tactccttaacctca

SEQ ID NO: 15727 - DNA, 15 bp, Homo sapiens
atactccttaacctc

SEQ ID NO: 15728 - DNA, 15 bp, Homo sapiens
tatactccttaacct

SEQ ID NO: 15729 - DNA, 15 bp, Homo sapiens
ttatactccttaacc

SEQ ID NO: 15730 - DNA, 15 bp, Homo sapiens
cttatactccttaac

SEQ ID NO: 15731 - DNA, 15 bp, Homo sapiens
ccttatactccttaa

SEQ ID NO: 15732 - DNA, 15 bp, Homo sapiens
tccttatactcctta

SEQ ID NO: 15733 - DNA, 15 bp, Homo sapiens
gtccttatactcctt

SEQ ID NO: 15734 - DNA, 15 bp, Homo sapiens
agtccttatactcct

SEQ ID NO: 15735 - DNA, 15 bp, Homo sapiens
aagtccttatactcc

SEQ ID NO: 15736 - DNA, 15 bp, Homo sapiens
caagtccttatactc

SEQ ID NO: 15737 - DNA, 15 bp, Homo sapiens
ccaagtccttatact

SEQ ID NO: 15738 - DNA, 15 bp, Homo sapiens
tccaagtccttatac

SEQ ID NO: 15739 - DNA, 15 bp, Homo sapiens
gtccaagtccttata

SEQ ID NO: 15740 - DNA, 15 bp, Homo sapiens
ggtccaagtccttat

SEQ ID NO: 15741 - DNA, 15 bp, Homo sapiens
tggtccaagtcctta

SEQ ID NO: 15742 - DNA, 15 bp, Homo sapiens
ctggtccaagtcctt

SEQ ID NO: 15743 - DNA, 15 bp, Homo sapiens
tctggtccaagtcct

SEQ ID NO: 15744 - DNA, 15 bp, Homo sapiens
ctctggtccaagtcc

SEQ ID NO: 15745 - DNA, 15 bp, Homo sapiens
actctggtccaagtc

SEQ ID NO: 15746 - DNA, 15 bp, Homo sapiens
cactctggtccaagt

SEQ ID NO: 15747 - DNA, 15 bp, Homo sapiens
ccactctggtccaag

SEQ ID NO: 15748 - DNA, 15 bp, Homo sapiens
accactctggtccaa

SEQ ID NO: 15749 - DNA, 15 bp, Homo sapiens
taccactctggtcca

SEQ ID NO: 15750 - DNA, 15 bp, Homo sapiens
gtaccactctggtcc

SEQ ID NO: 15751 - DNA, 15 bp, Homo sapiens
tgtaccactctggtc

SEQ ID NO: 15752 - DNA, 15 bp, Homo sapiens
ttgtaccactctggt

SEQ ID NO: 15753 - DNA, 15 bp, Homo sapiens
cttgtaccactctgg

SEQ ID NO: 15754 - DNA, 15 bp, Homo sapiens
tcttgtaccactctg

SEQ ID NO: 15755 - DNA, 15 bp, Homo sapiens
ctcttgtaccactct

SEQ ID NO: 15756 - DNA, 15 bp, Homo sapiens
cctcttgtaccactc

SEQ ID NO: 15757 - DNA, 15 bp, Homo sapiens
tcctcttgtaccact

SEQ ID NO: 15758 - DNA, 15 bp, Homo sapiens
ctcctcttgtaccac

SEQ ID NO: 15759 - DNA, 15 bp, Homo sapiens
tctcctcttgtacca

SEQ ID NO: 15760 - DNA, 15 bp, Homo sapiens
gtctcctcttgtacc

SEQ ID NO: 15761 - DNA, 15 bp, Homo sapiens
agtctcctcttgtac

SEQ ID NO: 15762 - DNA, 15 bp, Homo sapiens
cagtctcctcttgta

SEQ ID NO: 15763 - DNA, 15 bp, Homo sapiens
tcagtctcctcttgt

SEQ ID NO: 15764 - DNA, 15 bp, Homo sapiens
ctcagtctcctcttg

SEQ ID NO: 15765 - DNA, 15 bp, Homo sapiens
gctcagtctcctctt

SEQ ID NO: 15766 - DNA, 15 bp, Homo sapiens
tgctcagtctcctct

SEQ ID NO: 15767 - DNA, 15 bp, Homo sapiens
ctgctcagtctcctc

SEQ ID NO: 15768 - DNA, 15 bp, Homo sapiens
cctgctcagtctcct

SEQ ID NO: 15769 - DNA, 15 bp, Homo sapiens
ccctgctcagtctcc

SEQ ID NO: 15770 - DNA, 15 bp, Homo sapiens
cccctgctcagtctc

SEQ ID NO: 15771 - DNA, 15 bp, Homo sapiens
tcccctgctcagtct

SEQ ID NO: 15772 - DNA, 15 bp, Homo sapiens
ttcccctgctcagtc

SEQ ID NO: 15773 - DNA, 15 bp, Homo sapiens
tttcccctgctcagt

SEQ ID NO: 15774 - DNA, 15 bp, Homo sapiens
ctttcccctgctcag

SEQ ID NO: 15775 - DNA, 15 bp, Homo sapiens
cctttcccctgctca

SEQ ID NO: 15776 - DNA, 15 bp, Homo sapiens
tcctttcccctgctc

SEQ ID NO: 15777 - DNA, 15 bp, Homo sapiens
atcctttcccctgct

SEQ ID NO: 15778 - DNA, 15 bp, Homo sapiens
catcctttcccctgc

SEQ ID NO: 15779 - DNA, 15 bp, Homo sapiens
acatcctttcccctg

SEQ ID NO: 15780 - DNA, 15 bp, Homo sapiens
cacatcctttcccct

SEQ ID NO: 15781 - DNA, 15 bp, Homo sapiens
tcacatcctttcccc

SEQ ID NO: 15782 - DNA, 15 bp, Homo sapiens
ttcacatcctttccc

SEQ ID NO: 15783 - DNA, 15 bp, Homo sapiens
tttcacatcctttcc

SEQ ID NO: 15784 - DNA, 15 bp, Homo sapiens
ttttcacatcctttc

SEQ ID NO: 15785 - DNA, 15 bp, Homo sapiens
cttttcacatccttt

SEQ ID NO: 15786 - DNA, 15 bp, Homo sapiens
acttttcacatcctt

SEQ ID NO: 15787 - DNA, 15 bp, Homo sapiens
cacttttcacatcct

SEQ ID NO: 15788 - DNA, 15 bp, Homo sapiens
ccacttttcacatcc

SEQ ID NO: 15789 - DNA, 15 bp, Homo sapiens
accacttttcacatc

SEQ ID NO: 15790 - DNA, 15 bp, Homo sapiens
aaccacttttcacat

SEQ ID NO: 15791 - DNA, 15 bp, Homo sapiens
taaccacttttcaca

SEQ ID NO: 15792 - DNA, 15 bp, Homo sapiens
ctaaccacttttcac

SEQ ID NO: 15793 - DNA, 15 bp, Homo sapiens
gctaaccacttttca

SEQ ID NO: 15794 - DNA, 15 bp, Homo sapiens
tgctaaccacttttc

SEQ ID NO: 15795 - DNA, 15 bp, Homo sapiens
ctgctaaccactttt

SEQ ID NO: 15796 - DNA, 15 bp, Homo sapiens
actgctaaccacttt

SEQ ID NO: 15797 - DNA, 15 bp, Homo sapiens
aactgctaaccactt

SEQ ID NO: 15798 - DNA, 15 bp, Homo sapiens
taactgctaaccact

SEQ ID NO: 15799 - DNA, 15 bp, Homo sapiens
ctaactgctaaccac

SEQ ID NO: 15800 - DNA, 15 bp, Homo sapiens
actaactgctaacca

SEQ ID NO: 15801 - DNA, 15 bp, Homo sapiens
tactaactgctaacc

SEQ ID NO: 15802 - DNA, 15 bp, Homo sapiens
ttactaactgctaac

SEQ ID NO: 15803 - DNA, 15 bp, Homo sapiens
gttactaactgctaa

SEQ ID NO: 15804 - DNA, 15 bp, Homo sapiens
tgttactaactgcta

SEQ ID NO: 15805 - DNA, 15 bp, Homo sapiens
ctgttactaactgct

SEQ ID NO: 15806 - DNA, 15 bp, Homo sapiens
cctgttactaactgc

SEQ ID NO: 15807 - DNA, 15 bp, Homo sapiens
ccctgttactaactg

SEQ ID NO: 15808 - DNA, 15 bp, Homo sapiens
accctgttactaact

SEQ ID NO: 15809 - DNA, 15 bp, Homo sapiens
caccctgttactaac

SEQ ID NO: 15810 - DNA, 15 bp, Homo sapiens
acaccctgttactaa

SEQ ID NO: 15811 - DNA, 15 bp, Homo sapiens
cacaccctgttacta

SEQ ID NO: 15812 - DNA, 15 bp, Homo sapiens
gcacaccctgttact

SEQ ID NO: 15813 - DNA, 15 bp, Homo sapiens
tgcacaccctgttac

SEQ ID NO: 15814 - DNA, 15 bp, Homo sapiens
ttgcacaccctgtta

SEQ ID NO: 15815 - DNA, 15 bp, Homo sapiens
tttgcacaccctgtt

SEQ ID NO: 15816 - DNA, 15 bp, Homo sapiens
ctttgcacaccctgt

SEQ ID NO: 15817 - DNA, 15 bp, Homo sapiens
gctttgcacaccctg

SEQ ID NO: 15818 - DNA, 15 bp, Homo sapiens
ggctttgcacaccct

SEQ ID NO: 15819 - DNA, 15 bp, Homo sapiens
aggctttgcacaccc

SEQ ID NO: 15820 - DNA, 15 bp, Homo sapiens
gaggctttgcacacc

SEQ ID NO: 15821 - DNA, 15 bp, Homo sapiens
tgaggctttgcacac

SEQ ID NO: 15822 - DNA, 15 bp, Homo sapiens
ttgaggctttgcaca

SEQ ID NO: 15823 - DNA, 15 bp, Homo sapiens
attgaggctttgcac

SEQ ID NO: 15824 - DNA, 15 bp, Homo sapiens
cattgaggctttgca

SEQ ID NO: 15825 - DNA, 15 bp, Homo sapiens
acattgaggctttgc

SEQ ID NO: 15826 - DNA, 15 bp, Homo sapiens
tacattgaggctttg

SEQ ID NO: 15827 - DNA, 15 bp, Homo sapiens
ttacattgaggcttt

SEQ ID NO: 15828 - DNA, 15 bp, Homo sapiens
tttacattgaggctt

SEQ ID NO: 15829 - DNA, 15 bp, Homo sapiens
gtttacattgaggct

SEQ ID NO: 15830 - DNA, 15 bp, Homo sapiens
agtttacattgaggc

SEQ ID NO: 15831 - DNA, 15 bp, Homo sapiens
aagtttacattgagg

SEQ ID NO: 15832 - DNA, 15 bp, Homo sapiens
gaagtttacattgag

SEQ ID NO: 15833 - DNA, 15 bp, Homo sapiens
cgaagtttacattga

SEQ ID NO: 15834 - DNA, 15 bp, Homo sapiens
gcgaagtttacattg

SEQ ID NO: 15835 - DNA, 15 bp, Homo sapiens
ggcgaagtttacatt

SEQ ID NO: 15836 - DNA, 15 bp, Homo sapiens
aggcgaagtttacat

SEQ ID NO: 15837 - DNA, 15 bp, Homo sapiens
aaggcgaagtttaca

SEQ ID NO: 15838 - DNA, 15 bp, Homo sapiens
aaaggcgaagtttac

SEQ ID NO: 15839 - DNA, 15 bp, Homo sapiens
caaaggcgaagttta

SEQ ID NO: 15840 - DNA, 15 bp, Homo sapiens
acaaaggcgaagttt

SEQ ID NO: 15841 - DNA, 15 bp, Homo sapiens
cacaaaggcgaagtt

SEQ ID NO: 15842 - DNA, 15 bp, Homo sapiens
ccacaaaggcgaagt

SEQ ID NO: 15843 - DNA, 15 bp, Homo sapiens
cccacaaaggcgaag

SEQ ID NO: 15844 - DNA, 15 bp, Homo sapiens
tcccacaaaggcgaa

SEQ ID NO: 15845 - DNA, 15 bp, Homo sapiens
atcccacaaaggcga

SEQ ID NO: 15846 - DNA, 15 bp, Homo sapiens
aatcccacaaaggcg

SEQ ID NO: 15847 - DNA, 15 bp, Homo sapiens
aaatcccacaaaggc

SEQ ID NO: 15848 - DNA, 15 bp, Homo sapiens
caaatcccacaaagg

SEQ ID NO: 15849 - DNA, 15 bp, Homo sapiens
acaaatcccacaaag

SEQ ID NO: 15850 - DNA, 15 bp, Homo sapiens
aacaaatcccacaaa

SEQ ID NO: 15851 - DNA, 15 bp, Homo sapiens
taacaaatcccacaa

SEQ ID NO: 15852 - DNA, 15 bp, Homo sapiens
ctaacaaatcccaca

SEQ ID NO: 15853 - DNA, 15 bp, Homo sapiens
actaacaaatcccac

SEQ ID NO: 15854 - DNA, 15 bp, Homo sapiens
aactaacaaatccca

SEQ ID NO: 15855 - DNA, 15 bp, Homo sapiens
taactaacaaatccc

SEQ ID NO: 15856 - DNA, 15 bp, Homo sapiens
ctaactaacaaatcc

SEQ ID NO: 15857 - DNA, 15 bp, Homo sapiens
actaactaacaaatc

SEQ ID NO: 15858 - DNA, 15 bp, Homo sapiens
tactaactaacaaat

SEQ ID NO: 15859 - DNA, 15 bp, Homo sapiens
ttactaactaacaaa

SEQ ID NO: 15860 - DNA, 15 bp, Homo sapiens
gttactaactaacaa

SEQ ID NO: 15861 - DNA, 15 bp, Homo sapiens
tgttactaactaaca

SEQ ID NO: 15862 - DNA, 15 bp, Homo sapiens
ctgttactaactaac

SEQ ID NO: 15863 - DNA, 15 bp, Homo sapiens
actgttactaactaa

SEQ ID NO: 15864 - DNA, 15 bp, Homo sapiens
tactgttactaacta

SEQ ID NO: 15865 - DNA, 15 bp, Homo sapiens
atactgttactaact

SEQ ID NO: 15866 - DNA, 15 bp, Homo sapiens
catactgttactaac

SEQ ID NO: 15867 - DNA, 15 bp, Homo sapiens
acatactgttactaa

SEQ ID NO: 15868 - DNA, 15 bp, Homo sapiens
aacatactgttacta

SEQ ID NO: 15869 - DNA, 15 bp, Homo sapiens
aaacatactgttact

SEQ ID NO: 15870 - DNA, 15 bp, Homo sapiens
taaacatactgttac

SEQ ID NO: 15871 - DNA, 15 bp, Homo sapiens
ttaaacatactgtta

SEQ ID NO: 15872 - DNA, 15 bp, Homo sapiens
tttaaacatactgtt

SEQ ID NO: 15873 - DNA, 15 bp, Homo sapiens
ctttaaacatactgt

SEQ ID NO: 15874 - DNA, 15 bp, Homo sapiens
gctttaaacatactg

SEQ ID NO: 15875 - DNA, 15 bp, Homo sapiens
ggctttaaacatact

SEQ ID NO: 15876 - DNA, 15 bp, Homo sapiens
aggctttaaacatac

SEQ ID NO: 15877 - DNA, 15 bp, Homo sapiens
gaggctttaaacata

SEQ ID NO: 15878 - DNA, 15 bp, Homo sapiens
agaggctttaaacat

SEQ ID NO: 15879 - DNA, 15 bp, Homo sapiens
tagaggctttaaaca

SEQ ID NO: 15880 - DNA, 15 bp, Homo sapiens
ctagaggctttaaac

SEQ ID NO: 15881 - DNA, 15 bp, Homo sapiens
cctagaggctttaaa

SEQ ID NO: 15882 - DNA, 15 bp, Homo sapiens
acctagaggctttaa

SEQ ID NO: 15883 - DNA, 15 bp, Homo sapiens
tacctagaggcttta

SEQ ID NO: 15884 - DNA, 15 bp, Homo sapiens
ttacctagaggcttt

SEQ ID NO: 15885 - DNA, 15 bp, Homo sapiens
tttacctagaggctt

SEQ ID NO: 15886 - DNA, 15 bp, Homo sapiens
atttacctagaggct

SEQ ID NO: 15887 - DNA, 15 bp, Homo sapiens
aatttacctagaggc

SEQ ID NO: 15888 - DNA, 15 bp, Homo sapiens
aaatttacctagagg

SEQ ID NO: 15889 - DNA, 15 bp, Homo sapiens
gaaatttacctagag

SEQ ID NO: 15890 - DNA, 15 bp, Homo sapiens
tgaaatttacctaga

SEQ ID NO: 15891 - DNA, 15 bp, Homo sapiens
gtgaaatttacctag

SEQ ID NO: 15892 - DNA, 15 bp, Homo sapiens
ggtgaaatttaccta

SEQ ID NO: 15893 - DNA, 15 bp, Homo sapiens
aggtgaaatttacct

SEQ ID NO: 15894 - DNA, 15 bp, Homo sapiens
aaggtgaaatttacc

SEQ ID NO: 15895 - DNA, 15 bp, Homo sapiens
aaaggtgaaatttac

SEQ ID NO: 15896 - DNA, 15 bp, Homo sapiens
caaaggtgaaattta

SEQ ID NO: 15897 - DNA, 15 bp, Homo sapiens
acaaaggtgaaattt

SEQ ID NO: 15898 - DNA, 15 bp, Homo sapiens
cacaaaggtgaaatt

SEQ ID NO: 15899 - DNA, 15 bp, Homo sapiens
ccacaaaggtgaaat

SEQ ID NO: 15900 - DNA, 15 bp, Homo sapiens
cccacaaaggtgaaa

SEQ ID NO: 15901 - DNA, 15 bp, Homo sapiens
tcccacaaaggtgaa

SEQ ID NO: 15902 - DNA, 15 bp, Homo sapiens
gtcccacaaaggtga

SEQ ID NO: 15903 - DNA, 15 bp, Homo sapiens
agtcccacaaaggtg

SEQ ID NO: 15904 - DNA, 15 bp, Homo sapiens
aagtcccacaaaggt

SEQ ID NO: 15905 - DNA, 15 bp, Homo sapiens
aaagtcccacaaagg

SEQ ID NO: 15906 - DNA, 15 bp, Homo sapiens
aaaagtcccacaaag

SEQ ID NO: 15907 - DNA, 15 bp, Homo sapiens
aaaaagtcccacaaa

SEQ ID NO: 15908 - DNA, 15 bp, Homo sapiens
taaaaagtcccacaa

SEQ ID NO: 15909 - DNA, 15 bp, Homo sapiens
ctaaaaagtcccaca

SEQ ID NO: 15910 - DNA, 15 bp, Homo sapiens
actaaaaagtcccac

SEQ ID NO: 15911 - DNA, 15 bp, Homo sapiens
tactaaaaagtccca

SEQ ID NO: 15912 - DNA, 15 bp, Homo sapiens
ttactaaaaagtccc

SEQ ID NO: 15913 - DNA, 15 bp, Homo sapiens
gttactaaaaagtcc

SEQ ID NO: 15914 - DNA, 15 bp, Homo sapiens
tgttactaaaaagtc

SEQ ID NO: 15915 - DNA, 15 bp, Homo sapiens
ctgttactaaaaagt

SEQ ID NO: 15916 - DNA, 15 bp, Homo sapiens
actgttactaaaaag

SEQ ID NO: 15917 - DNA, 15 bp, Homo sapiens
tactgttactaaaaa

SEQ ID NO: 15918 - DNA, 15 bp, Homo sapiens
atactgttactaaaa

SEQ ID NO: 15919 - DNA, 15 bp, Homo sapiens
gatactgttactaaa

SEQ ID NO: 15920 - DNA, 15 bp, Homo sapiens
agatactgttactaa

SEQ ID NO: 15921 - DNA, 15 bp, Homo sapiens
tagatactgttacta

SEQ ID NO: 15922 - DNA, 15 bp, Homo sapiens
atagatactgttact

SEQ ID NO: 15923 - DNA, 15 bp, Homo sapiens
tatagatactgttac

SEQ ID NO: 15924 - DNA, 15 bp, Homo sapiens
ttatagatactgtta

SEQ ID NO: 15925 - DNA, 15 bp, Homo sapiens
tttatagatactgtt

SEQ ID NO: 15926 - DNA, 15 bp, Homo sapiens
ctttatagatactgt

SEQ ID NO: 15927 - DNA, 15 bp, Homo sapiens
gctttatagatactg

SEQ ID NO: 15928 - DNA, 15 bp, Homo sapiens
ggctttatagatact

SEQ ID NO: 15929 - DNA, 15 bp, Homo sapiens
cggctttatagatac

SEQ ID NO: 15930 - DNA, 15 bp, Homo sapiens
gcggctttatagata

SEQ ID NO: 15931 - DNA, 15 bp, Homo sapiens
tgcggctttatagat

SEQ ID NO: 15932 - DNA, 15 bp, Homo sapiens
ttgcggctttataga

SEQ ID NO: 15933 - DNA, 15 bp, Homo sapiens
attgcggctttatag

SEQ ID NO: 15934 - DNA, 15 bp, Homo sapiens
cattgcggctttata

SEQ ID NO: 15935 - DNA, 15 bp, Homo sapiens
acattgcggctttat

SEQ ID NO: 15936 - DNA, 15 bp, Homo sapiens
tacattgcggcttta

SEQ ID NO: 15937 - DNA, 15 bp, Homo sapiens
ttacattgcggcttt

SEQ ID NO: 15938 - DNA, 15 bp, Homo sapiens
tttacattgcggctt

SEQ ID NO: 15939 - DNA, 15 bp, Homo sapiens
gtttacattgcggct

SEQ ID NO: 15940 - DNA, 15 bp, Homo sapiens
agtttacattgcggc

SEQ ID NO: 15941 - DNA, 15 bp, Homo sapiens
aagtttacattgcgg

SEQ ID NO: 15942 - DNA, 15 bp, Homo sapiens
gaagtttacattgcg

SEQ ID NO: 15943 - DNA, 15 bp, Homo sapiens
tgaagtttacattgc

SEQ ID NO: 15944 - DNA, 15 bp, Homo sapiens
gtgaagtttacattg

SEQ ID NO: 15945 - DNA, 15 bp, Homo sapiens
ggtgaagtttacatt

SEQ ID NO: 15946 - DNA, 15 bp, Homo sapiens
aggtgaagtttacat

SEQ ID NO: 15947 - DNA, 15 bp, Homo sapiens
aaggtgaagtttaca

SEQ ID NO: 15948 - DNA, 15 bp, Homo sapiens
caaggtgaagtttac

SEQ ID NO: 15949 - DNA, 15 bp, Homo sapiens
ccaaggtgaagttta

SEQ ID NO: 15950 - DNA, 15 bp, Homo sapiens
accaaggtgaagttt

SEQ ID NO: 15951 - DNA, 15 bp, Homo sapiens
caccaaggtgaagtt

SEQ ID NO: 15952 - DNA, 15 bp, Homo sapiens
ccaccaaggtgaagt

SEQ ID NO: 15953 - DNA, 15 bp, Homo sapiens
cccaccaaggtgaag

SEQ ID NO: 15954 - DNA, 15 bp, Homo sapiens
tcccaccaaggtgaa

SEQ ID NO: 15955 - DNA, 15 bp, Homo sapiens
atcccaccaaggtga

SEQ ID NO: 15956 - DNA, 15 bp, Homo sapiens
aatcccaccaaggtg

SEQ ID NO: 15957 - DNA, 15 bp, Homo sapiens
aaatcccaccaaggt

SEQ ID NO: 15958 - DNA, 15 bp, Homo sapiens
caaatcccaccaagg

SEQ ID NO: 15959 - DNA, 15 bp, Homo sapiens
gcaaatcccaccaag

SEQ ID NO: 15960 - DNA, 15 bp, Homo sapiens
agcaaatcccaccaa

SEQ ID NO: 15961 - DNA, 15 bp, Homo sapiens
aagcaaatcccacca

SEQ ID NO: 15962 - DNA, 15 bp, Homo sapiens
aaagcaaatcccacc

SEQ ID NO: 15963 - DNA, 15 bp, Homo sapiens
taaagcaaatcccac

SEQ ID NO: 15964 - DNA, 15 bp, Homo sapiens
ataaagcaaatccca

SEQ ID NO: 15965 - DNA, 15 bp, Homo sapiens
cataaagcaaatccc

SEQ ID NO: 15966 - DNA, 15 bp, Homo sapiens
acataaagcaaatcc

SEQ ID NO: 15967 - DNA, 15 bp, Homo sapiens
aacataaagcaaatc

SEQ ID NO: 15968 - DNA, 15 bp, Homo sapiens
aaacataaagcaaat

SEQ ID NO: 15969 - DNA, 15 bp, Homo sapiens
aaaacataaagcaaa

SEQ ID NO: 15970 - DNA, 15 bp, Homo sapiens
gaaaacataaagcaa

SEQ ID NO: 15971 - DNA, 15 bp, Homo sapiens
tgaaaacataaagca

SEQ ID NO: 15972 - DNA, 15 bp, Homo sapiens
ttgaaaacataaagc

SEQ ID NO: 15973 - DNA, 15 bp, Homo sapiens
attgaaaacataaag

SEQ ID NO: 15974 - DNA, 15 bp, Homo sapiens
cattgaaaacataaa

SEQ ID NO: 15975 - DNA, 15 bp, Homo sapiens
tcattgaaaacataa

SEQ ID NO: 15976 - DNA, 15 bp, Homo sapiens
ctcattgaaaacata

SEQ ID NO: 15977 - DNA, 15 bp, Homo sapiens
cctcattgaaaacat

SEQ ID NO: 15978 - DNA, 15 bp, Homo sapiens
acctcattgaaaaca

SEQ ID NO: 15979 - DNA, 15 bp, Homo sapiens
tacctcattgaaaac

SEQ ID NO: 15980 - DNA, 15 bp, Homo sapiens
atacctcattgaaaa

SEQ ID NO: 15981 - DNA, 15 bp, Homo sapiens
catacctcattgaaa

SEQ ID NO: 15982 - DNA, 15 bp, Homo sapiens
acatacctcattgaa

SEQ ID NO: 15983 - DNA, 15 bp, Homo sapiens
tacatacctcattga

SEQ ID NO: 15984 - DNA, 15 bp, Homo sapiens
ctacatacctcattg

SEQ ID NO: 15985 - DNA, 15 bp, Homo sapiens
actacatacctcatt

SEQ ID NO: 15986 - DNA, 15 bp, Homo sapiens
aactacatacctcat

SEQ ID NO: 15987 - DNA, 15 bp, Homo sapiens
aaactacatacctca

SEQ ID NO: 15988 - DNA, 15 bp, Homo sapiens
aaaactacatacctc

SEQ ID NO: 15989 - DNA, 15 bp, Homo sapiens
aaaaactacatacct

SEQ ID NO: 15990 - DNA, 15 bp, Homo sapiens
gaaaaactacatacc

SEQ ID NO: 15991 - DNA, 15 bp, Homo sapiens
tgaaaaactacatac

SEQ ID NO: 15992 - DNA, 15 bp, Homo sapiens
ttgaaaaactacata

SEQ ID NO: 15993 - DNA, 15 bp, Homo sapiens
tttgaaaaactacat

SEQ ID NO: 15994 - DNA, 15 bp, Homo sapiens
atttgaaaaactaca

SEQ ID NO: 15995 - DNA, 15 bp, Homo sapiens
gatttgaaaaactac

SEQ ID NO: 15996 - DNA, 15 bp, Homo sapiens
cgatttgaaaaacta

SEQ ID NO: 15997 - DNA, 15 bp, Homo sapiens
acgatttgaaaaact

SEQ ID NO: 15998 - DNA, 15 bp, Homo sapiens
tacgatttgaaaaac

SEQ ID NO: 15999 - DNA, 15 bp, Homo sapiens
gtacgatttgaaaaa

SEQ ID NO: 16000 - DNA, 15 bp, Homo sapiens
agtacgatttgaaaa

SEQ ID NO: 16001 - DNA, 15 bp, Homo sapiens
cagtacgatttgaaa

SEQ ID NO: 16002 - DNA, 15 bp, Homo sapiens
acagtacgatttgaa

SEQ ID NO: 16003 - DNA, 15 bp, Homo sapiens
tacagtacgatttga

SEQ ID NO: 16004 - DNA, 15 bp, Homo sapiens
ttacagtacgatttg

SEQ ID NO: 16005 - DNA, 15 bp, Homo sapiens
attacagtacgattt

SEQ ID NO: 16006 - DNA, 15 bp, Homo sapiens
aattacagtacgatt

SEQ ID NO: 16007 - DNA, 15 bp, Homo sapiens
gaattacagtacgat

SEQ ID NO: 16008 - DNA, 15 bp, Homo sapiens
tgaattacagtacga

SEQ ID NO: 16009 - DNA, 15 bp, Homo sapiens
ctgaattacagtacg

SEQ ID NO: 16010 - DNA, 15 bp, Homo sapiens
tctgaattacagtac

SEQ ID NO: 16011 - DNA, 15 bp, Homo sapiens
atctgaattacagta

SEQ ID NO: 16012 - DNA, 15 bp, Homo sapiens
aatctgaattacagt

SEQ ID NO: 16013 - DNA, 15 bp, Homo sapiens
aaatctgaattacag

SEQ ID NO: 16014 - DNA, 15 bp, Homo sapiens
aaaatctgaattaca

SEQ ID NO: 16015 - DNA, 15 bp, Homo sapiens
gaaaatctgaattac

SEQ ID NO: 16016 - DNA, 15 bp, Homo sapiens
tgaaaatctgaatta

SEQ ID NO: 16017 - DNA, 15 bp, Homo sapiens
ttgaaaatctgaatt

SEQ ID NO: 16018 - DNA, 15 bp, Homo sapiens
gttgaaaatctgaat

SEQ ID NO: 16019 - DNA, 15 bp, Homo sapiens
tgttgaaaatctgaa

SEQ ID NO: 16020 - DNA, 15 bp, Homo sapiens
gtgttgaaaatctga

SEQ ID NO: 16021 - DNA, 15 bp, Homo sapiens
agtgttgaaaatctg

SEQ ID NO: 16022 - DNA, 15 bp, Homo sapiens
aagtgttgaaaatct

SEQ ID NO: 16023 - DNA, 15 bp, Homo sapiens
aaagtgttgaaaatc

SEQ ID NO: 16024 - DNA, 15 bp, Homo sapiens
gaaagtgttgaaaat

SEQ ID NO: 16025 - DNA, 15 bp, Homo sapiens
cgaaagtgttgaaaa

SEQ ID NO: 16026 - DNA, 15 bp, Homo sapiens
ccgaaagtgttgaaa

SEQ ID NO: 16027 - DNA, 15 bp, Homo sapiens
accgaaagtgttgaa

SEQ ID NO: 16028 - DNA, 15 bp, Homo sapiens
aaccgaaagtgttga

SEQ ID NO: 16029 - DNA, 15 bp, Homo sapiens
taaccgaaagtgttg

SEQ ID NO: 16030 - DNA, 15 bp, Homo sapiens
ataaccgaaagtgtt

SEQ ID NO: 16031 - DNA, 15 bp, Homo sapiens
aataaccgaaagtgt

SEQ ID NO: 16032 - DNA, 15 bp, Homo sapiens
taataaccgaaagtg

SEQ ID NO: 16033 - DNA, 15 bp, Homo sapiens
ctaataaccgaaagt

SEQ ID NO: 16034 - DNA, 15 bp, Homo sapiens
gctaataaccgaaag

SEQ ID NO: 16035 - DNA, 15 bp, Homo sapiens
agctaataaccgaaa

SEQ ID NO: 16036 - DNA, 15 bp, Homo sapiens
aagctaataaccgaa

SEQ ID NO: 16037 - DNA, 15 bp, Homo sapiens
aaagctaataaccga

SEQ ID NO: 16038 - DNA, 15 bp, Homo sapiens
aaaagctaataaccg

SEQ ID NO: 16039 - DNA, 15 bp, Homo sapiens
aaaaagctaataacc

SEQ ID NO: 16040 - DNA, 15 bp, Homo sapiens
gaaaaagctaataac

SEQ ID NO: 16041 - DNA, 15 bp, Homo sapiens
agaaaaagctaataa

SEQ ID NO: 16042 - DNA, 15 bp, Homo sapiens
gagaaaaagctaata

SEQ ID NO: 16043 - DNA, 15 bp, Homo sapiens
agagaaaaagctaat

SEQ ID NO: 16044 - DNA, 15 bp, Homo sapiens
tagagaaaaagctaa

SEQ ID NO: 16045 - DNA, 15 bp, Homo sapiens
ctagagaaaaagcta

SEQ ID NO: 16046 - DNA, 15 bp, Homo sapiens
tctagagaaaaagct

SEQ ID NO: 16047 - DNA, 15 bp, Homo sapiens
ttctagagaaaaagc

SEQ ID NO: 16048 - DNA, 15 bp, Homo sapiens
attctagagaaaaag

SEQ ID NO: 16049 - DNA, 15 bp, Homo sapiens
aattctagagaaaaa

SEQ ID NO: 16050 - DNA, 15 bp, Homo sapiens
aaattctagagaaaa

SEQ ID NO: 16051 - DNA, 15 bp, Homo sapiens
aaaattctagagaaa

SEQ ID NO: 16052 - DNA, 15 bp, Homo sapiens
gaaaattctagagaa

SEQ ID NO: 16053 - DNA, 15 bp, Homo sapiens
agaaaattctagaga

SEQ ID NO: 16054 - DNA, 15 bp, Homo sapiens
aagaaaattctagag

SEQ ID NO: 16055 - DNA, 15 bp, Homo sapiens
caagaaaattctaga

SEQ ID NO: 16056 - DNA, 15 bp, Homo sapiens
tcaagaaaattctag

SEQ ID NO: 16057 - DNA, 15 bp, Homo sapiens
atcaagaaaattcta

SEQ ID NO: 16058 - DNA, 15 bp, Homo sapiens
gatcaagaaaattct

SEQ ID NO: 16059 - DNA, 15 bp, Homo sapiens
tgatcaagaaaattc

SEQ ID NO: 16060 - DNA, 15 bp, Homo sapiens
ttgatcaagaaaatt

SEQ ID NO: 16061 - DNA, 15 bp, Homo sapiens
attgatcaagaaaat

SEQ ID NO: 16062 - DNA, 15 bp, Homo sapiens
aattgatcaagaaaa

SEQ ID NO: 16063 - DNA, 15 bp, Homo sapiens
aaattgatcaagaaa

SEQ ID NO: 16064 - DNA, 15 bp, Homo sapiens
gaaattgatcaagaa

SEQ ID NO: 16065 - DNA, 15 bp, Homo sapiens
agaaattgatcaaga

SEQ ID NO: 16066 - DNA, 15 bp, Homo sapiens
aagaaattgatcaag

SEQ ID NO: 16067 - DNA, 15 bp, Homo sapiens
taagaaattgatcaa

SEQ ID NO: 16068 - DNA, 15 bp, Homo sapiens
ttaagaaattgatca

SEQ ID NO: 16069 - DNA, 15 bp, Homo sapiens
gttaagaaattgatc

SEQ ID NO: 16070 - DNA, 15 bp, Homo sapiens
ggttaagaaattgat

SEQ ID NO: 16071 - DNA, 15 bp, Homo sapiens
cggttaagaaattga

SEQ ID NO: 16072 - DNA, 15 bp, Homo sapiens
acggttaagaaattg

SEQ ID NO: 16073 - DNA, 15 bp, Homo sapiens
aacggttaagaaatt

SEQ ID NO: 16074 - DNA, 15 bp, Homo sapiens
aaacggttaagaaat

SEQ ID NO: 16075 - DNA, 15 bp, Homo sapiens
taaacggttaagaaa

SEQ ID NO: 16076 - DNA, 15 bp, Homo sapiens
gtaaacggttaagaa

SEQ ID NO: 16077 - DNA, 15 bp, Homo sapiens
tgtaaacggttaaga

SEQ ID NO: 16078 - DNA, 15 bp, Homo sapiens
ctgtaaacggttaag

SEQ ID NO: 16079 - DNA, 15 bp, Homo sapiens
actgtaaacggttaa

SEQ ID NO: 16080 - DNA, 15 bp, Homo sapiens
aactgtaaacggtta

SEQ ID NO: 16081 - DNA, 15 bp, Homo sapiens
taactgtaaacggtt

SEQ ID NO: 16082 - DNA, 15 bp, Homo sapiens
gtaactgtaaacggt

SEQ ID NO: 16083 - DNA, 15 bp, Homo sapiens
agtaactgtaaacgg

SEQ ID NO: 16084 - DNA, 15 bp, Homo sapiens
aagtaactgtaaacg

SEQ ID NO: 16085 - DNA, 15 bp, Homo sapiens
gaagtaactgtaaac

SEQ ID NO: 16086 - DNA, 15 bp, Homo sapiens
agaagtaactgtaaa

SEQ ID NO: 16087 - DNA, 15 bp, Homo sapiens
tagaagtaactgtaa

SEQ ID NO: 16088 - DNA, 15 bp, Homo sapiens
gtagaagtaactgta

SEQ ID NO: 16089 - DNA, 15 bp, Homo sapiens
agtagaagtaactgt

SEQ ID NO: 16090 - DNA, 15 bp, Homo sapiens
aagtagaagtaactg

SEQ ID NO: 16091 - DNA, 15 bp, Homo sapiens
gaagtagaagtaact

SEQ ID NO: 16092 - DNA, 15 bp, Homo sapiens
agaagtagaagtaac

SEQ ID NO: 16093 - DNA, 15 bp, Homo sapiens
aagaagtagaagtaa

SEQ ID NO: 16094 - DNA, 15 bp, Homo sapiens
taagaagtagaagta

SEQ ID NO: 16095 - DNA, 15 bp, Homo sapiens
gtaagaagtagaagt

SEQ ID NO: 16096 - DNA, 15 bp, Homo sapiens
agtaagaagtagaag

SEQ ID NO: 16097 - DNA, 15 bp, Homo sapiens
cagtaagaagtagaa

SEQ ID NO: 16098 - DNA, 15 bp, Homo sapiens
tcagtaagaagtaga

SEQ ID NO: 16099 - DNA, 15 bp, Homo sapiens
ttcagtaagaagtag

SEQ ID NO: 16100 - DNA, 15 bp, Homo sapiens
cttcagtaagaagta

SEQ ID NO: 16101 - DNA, 15 bp, Homo sapiens
acttcagtaagaagt

SEQ ID NO: 16102 - DNA, 15 bp, Homo sapiens
aacttcagtaagaag

SEQ ID NO: 16103 - DNA, 15 bp, Homo sapiens
caacttcagtaagaa

SEQ ID NO: 16104 - DNA, 15 bp, Homo sapiens
tcaacttcagtaaga

SEQ ID NO: 16105 - DNA, 15 bp, Homo sapiens
gtcaacttcagtaag

SEQ ID NO: 16106 - DNA, 15 bp, Homo sapiens
agtcaacttcagtaa

SEQ ID NO: 16107 - DNA, 15 bp, Homo sapiens
tagtcaacttcagta

SEQ ID NO: 16108 - DNA, 15 bp, Homo sapiens
gtagtcaacttcagt

SEQ ID NO: 16109 - DNA, 15 bp, Homo sapiens
agtagtcaacttcag

SEQ ID NO: 16110 - DNA, 15 bp, Homo sapiens
cagtagtcaacttca

SEQ ID NO: 16111 - DNA, 15 bp, Homo sapiens
gcagtagtcaacttc

SEQ ID NO: 16112 - DNA, 15 bp, Homo sapiens
agcagtagtcaactt

SEQ ID NO: 16113 - DNA, 15 bp, Homo sapiens
cagcagtagtcaact

SEQ ID NO: 16114 - DNA, 15 bp, Homo sapiens
acagcagtagtcaac

SEQ ID NO: 16115 - DNA, 15 bp, Homo sapiens
aacagcagtagtcaa

SEQ ID NO: 16116 - DNA, 15 bp, Homo sapiens
aaacagcagtagtca

SEQ ID NO: 16117 - DNA, 15 bp, Homo sapiens
aaaacagcagtagtc

SEQ ID NO: 16118 - DNA, 15 bp, Homo sapiens
aaaaacagcagtagt

SEQ ID NO: 16119 - DNA, 15 bp, Homo sapiens
gaaaaacagcagtag

SEQ ID NO: 16120 - DNA, 15 bp, Homo sapiens
agaaaaacagcagta

SEQ ID NO: 16121 - DNA, 15 bp, Homo sapiens
gagaaaaacagcagt

SEQ ID NO: 16122 - DNA, 15 bp, Homo sapiens
tgagaaaaacagcag

SEQ ID NO: 16123 - DNA, 15 bp, Homo sapiens
gtgagaaaaacagca

SEQ ID NO: 16124 - DNA, 15 bp, Homo sapiens
tgtgagaaaaacagc

SEQ ID NO: 16125 - DNA, 15 bp, Homo sapiens
ctgtgagaaaaacag

SEQ ID NO: 16126 - DNA, 15 bp, Homo sapiens
actgtgagaaaaaca

SEQ ID NO: 16127 - DNA, 15 bp, Homo sapiens
tactgtgagaaaaac

SEQ ID NO: 16128 - DNA, 15 bp, Homo sapiens
gtactgtgagaaaaa

SEQ ID NO: 16129 - DNA, 15 bp, Homo sapiens
ggtactgtgagaaaa

SEQ ID NO: 16130 - DNA, 15 bp, Homo sapiens
aggtactgtgagaaa

SEQ ID NO: 16131 - DNA, 15 bp, Homo sapiens
gaggtactgtgagaa

SEQ ID NO: 16132 - DNA, 15 bp, Homo sapiens
agaggtactgtgaga

SEQ ID NO: 16133 - DNA, 15 bp, Homo sapiens
aagaggtactgtgag

SEQ ID NO: 16134 - DNA, 15 bp, Homo sapiens
caagaggtactgtga

SEQ ID NO: 16135 - DNA, 15 bp, Homo sapiens
ccaagaggtactgtg

SEQ ID NO: 16136 - DNA, 15 bp, Homo sapiens
accaagaggtactgt

SEQ ID NO: 16137 - DNA, 15 bp, Homo sapiens
gaccaagaggtactg

SEQ ID NO: 16138 - DNA, 15 bp, Homo sapiens
tgaccaagaggtact

SEQ ID NO: 16139 - DNA, 15 bp, Homo sapiens
ctgaccaagaggtac

SEQ ID NO: 16140 - DNA, 15 bp, Homo sapiens
actgaccaagaggta

SEQ ID NO: 16141 - DNA, 15 bp, Homo sapiens
aactgaccaagaggt

SEQ ID NO: 16142 - DNA, 15 bp, Homo sapiens
aaactgaccaagagg

SEQ ID NO: 16143 - DNA, 15 bp, Homo sapiens
taaactgaccaagag

SEQ ID NO: 16144 - DNA, 15 bp, Homo sapiens
ataaactgaccaaga

SEQ ID NO: 16145 - DNA, 15 bp, Homo sapiens
tataaactgaccaag

SEQ ID NO: 16146 - DNA, 15 bp, Homo sapiens
atataaactgaccaa

SEQ ID NO: 16147 - DNA, 15 bp, Homo sapiens
catataaactgacca

SEQ ID NO: 16148 - DNA, 15 bp, Homo sapiens
ccatataaactgacc

SEQ ID NO: 16149 - DNA, 15 bp, Homo sapiens
cccatataaactgac

SEQ ID NO: 16150 - DNA, 15 bp, Homo sapiens
ccccatataaactga

SEQ ID NO: 16151 - DNA, 15 bp, Homo sapiens
tccccatataaactg

SEQ ID NO: 16152 - DNA, 15 bp, Homo sapiens
ttccccatataaact

SEQ ID NO: 16153 - DNA, 15 bp, Homo sapiens
gttccccatataaac

SEQ ID NO: 16154 - DNA, 15 bp, Homo sapiens
agttccccatataaa

SEQ ID NO: 16155 - DNA, 15 bp, Homo sapiens
aagttccccatataa

SEQ ID NO: 16156 - DNA, 15 bp, Homo sapiens
gaagttccccatata

SEQ ID NO: 16157 - DNA, 15 bp, Homo sapiens
tgaagttccccatat

SEQ ID NO: 16158 - DNA, 15 bp, Homo sapiens
ttgaagttccccata

SEQ ID NO: 16159 - DNA, 15 bp, Homo sapiens
tttgaagttccccat

SEQ ID NO: 16160 - DNA, 15 bp, Homo sapiens
atttgaagttcccca

SEQ ID NO: 16161 - DNA, 15 bp, Homo sapiens
aatttgaagttcccc

SEQ ID NO: 16162 - DNA, 15 bp, Homo sapiens
gaatttgaagttccc

SEQ ID NO: 16163 - DNA, 15 bp, Homo sapiens
tgaatttgaagttcc

SEQ ID NO: 16164 - DNA, 15 bp, Homo sapiens
ctgaatttgaagttc

SEQ ID NO: 16165 - DNA, 15 bp, Homo sapiens
actgaatttgaagtt

SEQ ID NO: 16166 - DNA, 15 bp, Homo sapiens
aactgaatttgaagt

SEQ ID NO: 16167 - DNA, 15 bp, Homo sapiens
gaactgaatttgaag

SEQ ID NO: 16168 - DNA, 15 bp, Homo sapiens
tgaactgaatttgaa

SEQ ID NO: 16169 - DNA, 15 bp, Homo sapiens
ctgaactgaatttga

SEQ ID NO: 16170 - DNA, 15 bp, Homo sapiens
gctgaactgaatttg

SEQ ID NO: 16171 - DNA, 15 bp, Homo sapiens
agctgaactgaattt

SEQ ID NO: 16172 - DNA, 15 bp, Homo sapiens
cagctgaactgaatt

SEQ ID NO: 16173 - DNA, 15 bp, Homo sapiens
gcagctgaactgaat

SEQ ID NO: 16174 - DNA, 15 bp, Homo sapiens
tgcagctgaactgaa

SEQ ID NO: 16175 - DNA, 15 bp, Homo sapiens
ttgcagctgaactga

SEQ ID NO: 16176 - DNA, 15 bp, Homo sapiens
attgcagctgaactg

SEQ ID NO: 16177 - DNA, 15 bp, Homo sapiens
tattgcagctgaact

SEQ ID NO: 16178 - DNA, 15 bp, Homo sapiens
ctattgcagctgaac

SEQ ID NO: 16179 - DNA, 15 bp, Homo sapiens
cctattgcagctgaa

SEQ ID NO: 16180 - DNA, 15 bp, Homo sapiens
tcctattgcagctga

SEQ ID NO: 16181 - DNA, 15 bp, Homo sapiens
atcctattgcagctg

SEQ ID NO: 16182 - DNA, 15 bp, Homo sapiens
gatcctattgcagct

SEQ ID NO: 16183 - DNA, 15 bp, Homo sapiens
agatcctattgcagc

SEQ ID NO: 16184 - DNA, 15 bp, Homo sapiens
cagatcctattgcag

SEQ ID NO: 16185 - DNA, 15 bp, Homo sapiens
acagatcctattgca

SEQ ID NO: 16186 - DNA, 15 bp, Homo sapiens
tacagatcctattgc

SEQ ID NO: 16187 - DNA, 15 bp, Homo sapiens
atacagatcctattg

SEQ ID NO: 16188 - DNA, 15 bp, Homo sapiens
aatacagatcctatt

SEQ ID NO: 16189 - DNA, 15 bp, Homo sapiens
aaatacagatcctat

SEQ ID NO: 16190 - DNA, 15 bp, Homo sapiens
aaaatacagatccta

SEQ ID NO: 16191 - DNA, 15 bp, Homo sapiens
aaaaatacagatcct

SEQ ID NO: 16192 - DNA, 15 bp, Homo sapiens
aaaaaatacagatcc

SEQ ID NO: 16193 - DNA, 15 bp, Homo sapiens
aaaaaaatacagatc

SEQ ID NO: 16194 - DNA, 15 bp, Homo sapiens
gaaaaaaatacagat

SEQ ID NO: 16195 - DNA, 15 bp, Homo sapiens
agaaaaaaatacaga

SEQ ID NO: 16196 - DNA, 15 bp, Homo sapiens
tagaaaaaaatacag

SEQ ID NO: 16197 - DNA, 15 bp, Homo sapiens
atagaaaaaaataca

SEQ ID NO: 16198 - DNA, 15 bp, Homo sapiens
tatagaaaaaaatac

SEQ ID NO: 16199 - DNA, 15 bp, Homo sapiens
atatagaaaaaaata

SEQ ID NO: 16200 - DNA, 15 bp, Homo sapiens
tatatagaaaaaaat

SEQ ID NO: 16201 - DNA, 15 bp, Homo sapiens
atatatagaaaaaaa

SEQ ID NO: 16202 - DNA, 15 bp, Homo sapiens
tatatatagaaaaaa

SEQ ID NO: 16203 - DNA, 15 bp, Homo sapiens
atatatatagaaaaa

SEQ ID NO: 16204 - DNA, 15 bp, Homo sapiens
aatatatatagaaaa

SEQ ID NO: 16205 - DNA, 15 bp, Homo sapiens
gaatatatatagaaa

SEQ ID NO: 16206 - DNA, 15 bp, Homo sapiens
agaatatatatagaa

SEQ ID NO: 16207 - DNA, 15 bp, Homo sapiens
cagaatatatataga

SEQ ID NO: 16208 - DNA, 15 bp, Homo sapiens
tcagaatatatatag

SEQ ID NO: 16209 - DNA, 15 bp, Homo sapiens
ctcagaatatatata

SEQ ID NO: 16210 - DNA, 15 bp, Homo sapiens
tctcagaatatatat

SEQ ID NO: 16211 - DNA, 15 bp, Homo sapiens
ctctcagaatatata

SEQ ID NO: 16212 - DNA, 15 bp, Homo sapiens
tctctcagaatatat

SEQ ID NO: 16213 - DNA, 15 bp, Homo sapiens
ttctctcagaatata

SEQ ID NO: 16214 - DNA, 15 bp, Homo sapiens
cttctctcagaatat

SEQ ID NO: 16215 - DNA, 15 bp, Homo sapiens
ccttctctcagaata

SEQ ID NO: 16216 - DNA, 15 bp, Homo sapiens
cccttctctcagaat

SEQ ID NO: 16217 - DNA, 15 bp, Homo sapiens
acccttctctcagaa

SEQ ID NO: 16218 - DNA, 15 bp, Homo sapiens
gacccttctctcaga

SEQ ID NO: 16219 - DNA, 15 bp, Homo sapiens
tgacccttctctcag

SEQ ID NO: 16220 - DNA, 15 bp, Homo sapiens
atgacccttctctca

SEQ ID NO: 16221 - DNA, 15 bp, Homo sapiens
catgacccttctctc

SEQ ID NO: 16222 - DNA, 15 bp, Homo sapiens
gcatgacccttctct

SEQ ID NO: 16223 - DNA, 15 bp, Homo sapiens
agcatgacccttctc

SEQ ID NO: 16224 - DNA, 15 bp, Homo sapiens
aagcatgacccttct

SEQ ID NO: 16225 - DNA, 15 bp, Homo sapiens
aaagcatgacccttc

SEQ ID NO: 16226 - DNA, 15 bp, Homo sapiens
taaagcatgaccctt

SEQ ID NO: 16227 - DNA, 15 bp, Homo sapiens
ctaaagcatgaccct

SEQ ID NO: 16228 - DNA, 15 bp, Homo sapiens
cctaaagcatgaccc

SEQ ID NO: 16229 - DNA, 15 bp, Homo sapiens
tcctaaagcatgacc

SEQ ID NO: 16230 - DNA, 15 bp, Homo sapiens
ttcctaaagcatgac

SEQ ID NO: 16231 - DNA, 15 bp, Homo sapiens
tttcctaaagcatga

SEQ ID NO: 16232 - DNA, 15 bp, Homo sapiens
ttttcctaaagcatg

SEQ ID NO: 16233 - DNA, 15 bp, Homo sapiens
tttttcctaaagcat

SEQ ID NO: 16234 - DNA, 15 bp, Homo sapiens
ctttttcctaaagca

SEQ ID NO: 16235 - DNA, 15 bp, Homo sapiens
actttttcctaaagc

SEQ ID NO: 16236 - DNA, 15 bp, Homo sapiens
aactttttcctaaag

SEQ ID NO: 16237 - DNA, 15 bp, Homo sapiens
caactttttcctaaa

SEQ ID NO: 16238 - DNA, 15 bp, Homo sapiens
tcaactttttcctaa

SEQ ID NO: 16239 - DNA, 15 bp, Homo sapiens
atcaactttttccta

SEQ ID NO: 16240 - DNA, 15 bp, Homo sapiens
catcaactttttcct

SEQ ID NO: 16241 - DNA, 15 bp, Homo sapiens
tcatcaactttttcc

SEQ ID NO: 16242 - DNA, 15 bp, Homo sapiens
ttcatcaactttttc

SEQ ID NO: 16243 - DNA, 15 bp, Homo sapiens
tttcatcaacttttt

SEQ ID NO: 16244 - DNA, 15 bp, Homo sapiens
ttttcatcaactttt

SEQ ID NO: 16245 - DNA, 15 bp, Homo sapiens
attttcatcaacttt

SEQ ID NO: 16246 - DNA, 15 bp, Homo sapiens
cattttcatcaactt

SEQ ID NO: 16247 - DNA, 15 bp, Homo sapiens
tcattttcatcaact

SEQ ID NO: 16248 - DNA, 15 bp, Homo sapiens
ctcattttcatcaac

SEQ ID NO: 16249 - DNA, 15 bp, Homo sapiens
tctcattttcatcaa

SEQ ID NO: 16250 - DNA, 15 bp, Homo sapiens
ttctcattttcatca

SEQ ID NO: 16251 - DNA, 15 bp, Homo sapiens
tttctcattttcatc

SEQ ID NO: 16252 - DNA, 15 bp, Homo sapiens
ttttctcattttcat

SEQ ID NO: 16253 - DNA, 15 bp, Homo sapiens
cttttctcattttca

SEQ ID NO: 16254 - DNA, 15 bp, Homo sapiens
tcttttctcattttc

SEQ ID NO: 16255 - DNA, 15 bp, Homo sapiens
ctcttttctcatttt

SEQ ID NO: 16256 - DNA, 15 bp, Homo sapiens
tctcttttctcattt

SEQ ID NO: 16257 - DNA, 15 bp, Homo sapiens
atctcttttctcatt

SEQ ID NO: 16258 - DNA, 15 bp, Homo sapiens
catctcttttctcat

SEQ ID NO: 16259 - DNA, 15 bp, Homo sapiens
ccatctcttttctca

SEQ ID NO: 16260 - DNA, 15 bp, Homo sapiens
accatctcttttctc

SEQ ID NO: 16261 - DNA, 15 bp, Homo sapiens
aaccatctcttttct

SEQ ID NO: 16262 - DNA, 15 bp, Homo sapiens
aaaccatctcttttc

SEQ ID NO: 16263 - DNA, 15 bp, Homo sapiens
taaaccatctctttt

SEQ ID NO: 16264 - DNA, 15 bp, Homo sapiens
ataaaccatctcttt

SEQ ID NO: 16265 - DNA, 15 bp, Homo sapiens
aataaaccatctctt

SEQ ID NO: 16266 - DNA, 15 bp, Homo sapiens
gaataaaccatctct

SEQ ID NO: 16267 - DNA, 15 bp, Homo sapiens
tgaataaaccatctc

SEQ ID NO: 16268 - DNA, 15 bp, Homo sapiens
atgaataaaccatct

SEQ ID NO: 16269 - DNA, 15 bp, Homo sapiens
catgaataaaccatc

SEQ ID NO: 16270 - DNA, 15 bp, Homo sapiens
acatgaataaaccat

SEQ ID NO: 16271 - DNA, 15 bp, Homo sapiens
gacatgaataaacca

SEQ ID NO: 16272 - DNA, 15 bp, Homo sapiens
agacatgaataaacc

SEQ ID NO: 16273 - DNA, 15 bp, Homo sapiens
tagacatgaataaac

SEQ ID NO: 16274 - DNA, 15 bp, Homo sapiens
atagacatgaataaa

SEQ ID NO: 16275 - DNA, 15 bp, Homo sapiens
catagacatgaataa

SEQ ID NO: 16276 - DNA, 15 bp, Homo sapiens
gcatagacatgaata

SEQ ID NO: 16277 - DNA, 15 bp, Homo sapiens
tgcatagacatgaat

SEQ ID NO: 16278 - DNA, 15 bp, Homo sapiens
ctgcatagacatgaa

SEQ ID NO: 16279 - DNA, 15 bp, Homo sapiens
actgcatagacatga

SEQ ID NO: 16280 - DNA, 15 bp, Homo sapiens
tactgcatagacatg

SEQ ID NO: 16281 - DNA, 15 bp, Homo sapiens
atactgcatagacat

SEQ ID NO: 16282 - DNA, 15 bp, Homo sapiens
tatactgcatagaca

SEQ ID NO: 16283 - DNA, 15 bp, Homo sapiens
gtatactgcatagac

SEQ ID NO: 16284 - DNA, 15 bp, Homo sapiens
agtatactgcataga

SEQ ID NO: 16285 - DNA, 15 bp, Homo sapiens
tagtatactgcatag

SEQ ID NO: 16286 - DNA, 15 bp, Homo sapiens
atagtatactgcata

SEQ ID NO: 16287 - DNA, 15 bp, Homo sapiens
aatagtatactgcat

SEQ ID NO: 16288 - DNA, 15 bp, Homo sapiens
taatagtatactgca

SEQ ID NO: 16289 - DNA, 15 bp, Homo sapiens
ttaatagtatactgc

SEQ ID NO: 16290 - DNA, 15 bp, Homo sapiens
gttaatagtatactg

SEQ ID NO: 16291 - DNA, 15 bp, Homo sapiens
tgttaatagtatact

SEQ ID NO: 16292 - DNA, 15 bp, Homo sapiens
ctgttaatagtatac

SEQ ID NO: 16293 - DNA, 15 bp, Homo sapiens
actgttaatagtata

SEQ ID NO: 16294 - DNA, 15 bp, Homo sapiens
aactgttaatagtat

SEQ ID NO: 16295 - DNA, 15 bp, Homo sapiens
gaactgttaatagta

SEQ ID NO: 16296 - DNA, 15 bp, Homo sapiens
agaactgttaatagt

SEQ ID NO: 16297 - DNA, 15 bp, Homo sapiens
aagaactgttaatag

SEQ ID NO: 16298 - DNA, 15 bp, Homo sapiens
aaagaactgttaata

SEQ ID NO: 16299 - DNA, 15 bp, Homo sapiens
caaagaactgttaat

SEQ ID NO: 16300 - DNA, 15 bp, Homo sapiens
tcaaagaactgttaa

SEQ ID NO: 16301 - DNA, 15 bp, Homo sapiens
ttcaaagaactgtta

SEQ ID NO: 16302 - DNA, 15 bp, Homo sapiens
tttcaaagaactgtt

SEQ ID NO: 16303 - DNA, 15 bp, Homo sapiens
ttttcaaagaactgt

SEQ ID NO: 16304 - DNA, 15 bp, Homo sapiens
tttttcaaagaactg

SEQ ID NO: 16305 - DNA, 15 bp, Homo sapiens
ctttttcaaagaact

SEQ ID NO: 16306 - DNA, 15 bp, Homo sapiens
actttttcaaagaac

SEQ ID NO: 16307 - DNA, 15 bp, Homo sapiens
tactttttcaaagaa

SEQ ID NO: 16308 - DNA, 15 bp, Homo sapiens
ctactttttcaaaga

SEQ ID NO: 16309 - DNA, 15 bp, Homo sapiens
gctactttttcaaag

SEQ ID NO: 16310 - DNA, 15 bp, Homo sapiens
tgctactttttcaaa

SEQ ID NO: 16311 - DNA, 15 bp, Homo sapiens
ttgctactttttcaa

SEQ ID NO: 16312 - DNA, 15 bp, Homo sapiens
tttgctactttttca

SEQ ID NO: 16313 - DNA, 15 bp, Homo sapiens
ctttgctactttttc

SEQ ID NO: 16314 - DNA, 15 bp, Homo sapiens
tctttgctacttttt

SEQ ID NO: 16315 - DNA, 15 bp, Homo sapiens
ttctttgctactttt

SEQ ID NO: 16316 - DNA, 15 bp, Homo sapiens
tttctttgctacttt

SEQ ID NO: 16317 - DNA, 15 bp, Homo sapiens
ctttctttgctactt

SEQ ID NO: 16318 - DNA, 15 bp, Homo sapiens
cctttctttgctact

SEQ ID NO: 16319 - DNA, 15 bp, Homo sapiens
acctttctttgctac

SEQ ID NO: 16320 - DNA, 15 bp, Homo sapiens
tacctttctttgcta

SEQ ID NO: 16321 - DNA, 15 bp, Homo sapiens
ttacctttctttgct

SEQ ID NO: 16322 - DNA, 15 bp, Homo sapiens
attacctttctttgc

SEQ ID NO: 16323 - DNA, 15 bp, Homo sapiens
cattacctttctttg

SEQ ID NO: 16324 - DNA, 15 bp, Homo sapiens
acattacctttcttt

SEQ ID NO: 16325 - DNA, 15 bp, Homo sapiens
aacattacctttctt

SEQ ID NO: 16326 - DNA, 15 bp, Homo sapiens
taacattacctttct

SEQ ID NO: 16327 - DNA, 15 bp, Homo sapiens
ttaacattacctttc

SEQ ID NO: 16328 - DNA, 15 bp, Homo sapiens
attaacattaccttt

SEQ ID NO: 16329 - DNA, 15 bp, Homo sapiens
gattaacattacctt

SEQ ID NO: 16330 - DNA, 15 bp, Homo sapiens
agattaacattacct

SEQ ID NO: 16331 - DNA, 15 bp, Homo sapiens
gagattaacattacc

SEQ ID NO: 16332 - DNA, 15 bp, Homo sapiens
tgagattaacattac

SEQ ID NO: 16333 - DNA, 15 bp, Homo sapiens
atgagattaacatta

SEQ ID NO: 16334 - DNA, 15 bp, Homo sapiens
gatgagattaacatt

SEQ ID NO: 16335 - DNA, 15 bp, Homo sapiens
agatgagattaacat

SEQ ID NO: 16336 - DNA, 15 bp, Homo sapiens
aagatgagattaaca

SEQ ID NO: 16337 - DNA, 15 bp, Homo sapiens
taagatgagattaac

SEQ ID NO: 16338 - DNA, 15 bp, Homo sapiens
ttaagatgagattaa

SEQ ID NO: 16339 - DNA, 15 bp, Homo sapiens
tttaagatgagatta

SEQ ID NO: 16340 - DNA, 15 bp, Homo sapiens
atttaagatgagatt

SEQ ID NO: 16341 - DNA, 15 bp, Homo sapiens
catttaagatgagat

SEQ ID NO: 16342 - DNA, 15 bp, Homo sapiens
tcatttaagatgaga

SEQ ID NO: 16343 - DNA, 15 bp, Homo sapiens
ttcatttaagatgag

SEQ ID NO: 16344 - DNA, 15 bp, Homo sapiens
cttcatttaagatga

SEQ ID NO: 16345 - DNA, 15 bp, Homo sapiens
ccttcatttaagatg

SEQ ID NO: 16346 - DNA, 15 bp, Homo sapiens
accttcatttaagat

SEQ ID NO: 16347 - DNA, 15 bp, Homo sapiens
taccttcatttaaga

SEQ ID NO: 16348 - DNA, 15 bp, Homo sapiens
ttaccttcatttaag

SEQ ID NO: 16349 - DNA, 15 bp, Homo sapiens
tttaccttcatttaa

SEQ ID NO: 16350 - DNA, 15 bp, Homo sapiens
ttttaccttcattta

SEQ ID NO: 16351 - DNA, 15 bp, Homo sapiens
gttttaccttcattt

SEQ ID NO: 16352 - DNA, 15 bp, Homo sapiens
agttttaccttcatt

SEQ ID NO: 16353 - DNA, 15 bp, Homo sapiens
gagttttaccttcat

SEQ ID NO: 16354 - DNA, 15 bp, Homo sapiens
agagttttaccttca

SEQ ID NO: 16355 - DNA, 15 bp, Homo sapiens
aagagttttaccttc

SEQ ID NO: 16356 - DNA, 15 bp, Homo sapiens
caagagttttacctt

SEQ ID NO: 16357 - DNA, 15 bp, Homo sapiens
gcaagagttttacct

SEQ ID NO: 16358 - DNA, 15 bp, Homo sapiens
tgcaagagttttacc

SEQ ID NO: 16359 - DNA, 15 bp, Homo sapiens
gtgcaagagttttac

SEQ ID NO: 16360 - DNA, 15 bp, Homo sapiens
tgtgcaagagtttta

SEQ ID NO: 16361 - DNA, 15 bp, Homo sapiens
ctgtgcaagagtttt

SEQ ID NO: 16362 - DNA, 15 bp, Homo sapiens
gctgtgcaagagttt

SEQ ID NO: 16363 - DNA, 15 bp, Homo sapiens
agctgtgcaagagtt

SEQ ID NO: 16364 - DNA, 15 bp, Homo sapiens
tagctgtgcaagagt

SEQ ID NO: 16365 - DNA, 15 bp, Homo sapiens
ttagctgtgcaagag

SEQ ID NO: 16366 - DNA, 15 bp, Homo sapiens
cttagctgtgcaaga

SEQ ID NO: 16367 - DNA, 15 bp, Homo sapiens
tcttagctgtgcaag

SEQ ID NO: 16368 - DNA, 15 bp, Homo sapiens
ctcttagctgtgcaa

SEQ ID NO: 16369 - DNA, 15 bp, Homo sapiens
tctcttagctgtgca

SEQ ID NO: 16370 - DNA, 15 bp, Homo sapiens
ttctcttagctgtgc

SEQ ID NO: 16371 - DNA, 15 bp, Homo sapiens
tttctcttagctgtg

SEQ ID NO: 16372 - DNA, 15 bp, Homo sapiens
ttttctcttagctgt

SEQ ID NO: 16373 - DNA, 15 bp, Homo sapiens
attttctcttagctg

SEQ ID NO: 16374 - DNA, 15 bp, Homo sapiens
gattttctcttagct

SEQ ID NO: 16375 - DNA, 15 bp, Homo sapiens
agattttctcttagc

SEQ ID NO: 16376 - DNA, 15 bp, Homo sapiens
tagattttctcttag

SEQ ID NO: 16377 - DNA, 15 bp, Homo sapiens
atagattttctctta

SEQ ID NO: 16378 - DNA, 15 bp, Homo sapiens
tatagattttctctt

SEQ ID NO: 16379 - DNA, 15 bp, Homo sapiens
atatagattttctct

SEQ ID NO: 16380 - DNA, 15 bp, Homo sapiens
tatatagattttctc

SEQ ID NO: 16381 - DNA, 15 bp, Homo sapiens
gtatatagattttct

SEQ ID NO: 16382 - DNA, 15 bp, Homo sapiens
agtatatagattttc

SEQ ID NO: 16383 - DNA, 15 bp, Homo sapiens
tagtatatagatttt

SEQ ID NO: 16384 - DNA, 15 bp, Homo sapiens
ttagtatatagattt

SEQ ID NO: 16385 - DNA, 15 bp, Homo sapiens
tttagtatatagatt

SEQ ID NO: 16386 - DNA, 15 bp, Homo sapiens
ttttagtatatagat

SEQ ID NO: 16387 - DNA, 15 bp, Homo sapiens
cttttagtatataga

SEQ ID NO: 16388 - DNA, 15 bp, Homo sapiens
tcttttagtatatag

SEQ ID NO: 16389 - DNA, 15 bp, Homo sapiens
ctcttttagtatata

SEQ ID NO: 16390 - DNA, 15 bp, Homo sapiens
actcttttagtatat

SEQ ID NO: 16391 - DNA, 15 bp, Homo sapiens
aactcttttagtata

SEQ ID NO: 16392 - DNA, 15 bp, Homo sapiens
aaactcttttagtat

SEQ ID NO: 16393 - DNA, 15 bp, Homo sapiens
caaactcttttagta

SEQ ID NO: 16394 - DNA, 15 bp, Homo sapiens
ccaaactcttttagt

SEQ ID NO: 16395 - DNA, 15 bp, Homo sapiens
tccaaactcttttag

SEQ ID NO: 16396 - DNA, 15 bp, Homo sapiens
ttccaaactctttta

SEQ ID NO: 16397 - DNA, 15 bp, Homo sapiens
tttccaaactctttt

SEQ ID NO: 16398 - DNA, 15 bp, Homo sapiens
ttttccaaactcttt

SEQ ID NO: 16399 - DNA, 15 bp, Homo sapiens
gttttccaaactctt

SEQ ID NO: 16400 - DNA, 15 bp, Homo sapiens
agttttccaaactct

SEQ ID NO: 16401 - DNA, 15 bp, Homo sapiens
tagttttccaaactc

SEQ ID NO: 16402 - DNA, 15 bp, Homo sapiens
gtagttttccaaact

SEQ ID NO: 16403 - DNA, 15 bp, Homo sapiens
agtagttttccaaac

SEQ ID NO: 16404 - DNA, 15 bp, Homo sapiens
aagtagttttccaaa

SEQ ID NO: 16405 - DNA, 15 bp, Homo sapiens
gaagtagttttccaa

SEQ ID NO: 16406 - DNA, 15 bp, Homo sapiens
tgaagtagttttcca

SEQ ID NO: 16407 - DNA, 15 bp, Homo sapiens
ctgaagtagttttcc

SEQ ID NO: 16408 - DNA, 15 bp, Homo sapiens
tctgaagtagttttc

SEQ ID NO: 16409 - DNA, 15 bp, Homo sapiens
ctctgaagtagtttt

SEQ ID NO: 16410 - DNA, 15 bp, Homo sapiens
cctctgaagtagttt

SEQ ID NO: 16411 - DNA, 15 bp, Homo sapiens
tcctctgaagtagtt

SEQ ID NO: 16412 - DNA, 15 bp, Homo sapiens
ttcctctgaagtagt

SEQ ID NO: 16413 - DNA, 15 bp, Homo sapiens
gttcctctgaagtag

SEQ ID NO: 16414 - DNA, 15 bp, Homo sapiens
agttcctctgaagta

SEQ ID NO: 16415 - DNA, 15 bp, Homo sapiens
aagttcctctgaagt

SEQ ID NO: 16416 - DNA, 15 bp, Homo sapiens
aaagttcctctgaag

SEQ ID NO: 16417 - DNA, 15 bp, Homo sapiens
taaagttcctctgaa

SEQ ID NO: 16418 - DNA, 15 bp, Homo sapiens
ttaaagttcctctga

SEQ ID NO: 16419 - DNA, 15 bp, Homo sapiens
attaaagttcctctg

SEQ ID NO: 16420 - DNA, 15 bp, Homo sapiens
aattaaagttcctct

SEQ ID NO: 16421 - DNA, 15 bp, Homo sapiens
taattaaagttcctc

SEQ ID NO: 16422 - DNA, 15 bp, Homo sapiens
ttaattaaagttcct

SEQ ID NO: 16423 - DNA, 15 bp, Homo sapiens
tttaattaaagttcc

SEQ ID NO: 16424 - DNA, 15 bp, Homo sapiens
ctttaattaaagttc

SEQ ID NO: 16425 - DNA, 15 bp, Homo sapiens
tctttaattaaagtt

SEQ ID NO: 16426 - DNA, 15 bp, Homo sapiens
ctctttaattaaagt

SEQ ID NO: 16427 - DNA, 15 bp, Homo sapiens
actctttaattaaag

SEQ ID NO: 16428 - DNA, 15 bp, Homo sapiens
tactctttaattaaa

SEQ ID NO: 16429 - DNA, 15 bp, Homo sapiens
ctactctttaattaa

SEQ ID NO: 16430 - DNA, 15 bp, Homo sapiens
actactctttaatta

SEQ ID NO: 16431 - DNA, 15 bp, Homo sapiens
gactactctttaatt

SEQ ID NO: 16432 - DNA, 15 bp, Homo sapiens
agactactctttaat

SEQ ID NO: 16433 - DNA, 15 bp, Homo sapiens
tagactactctttaa

SEQ ID NO: 16434 - DNA, 15 bp, Homo sapiens
ttagactactcttta

SEQ ID NO: 16435 - DNA, 15 bp, Homo sapiens
attagactactcttt

SEQ ID NO: 16436 - DNA, 15 bp, Homo sapiens
cattagactactctt

SEQ ID NO: 16437 - DNA, 15 bp, Homo sapiens
acattagactactct

SEQ ID NO: 16438 - DNA, 15 bp, Homo sapiens
cacattagactactc

SEQ ID NO: 16439 - DNA, 15 bp, Homo sapiens
tcacattagactact

SEQ ID NO: 16440 - DNA, 15 bp, Homo sapiens
atcacattagactac

SEQ ID NO: 16441 - DNA, 15 bp, Homo sapiens
catcacattagacta

SEQ ID NO: 16442 - DNA, 15 bp, Homo sapiens
gcatcacattagact

SEQ ID NO: 16443 - DNA, 15 bp, Homo sapiens
agcatcacattagac

SEQ ID NO: 16444 - DNA, 15 bp, Homo sapiens
cagcatcacattaga

SEQ ID NO: 16445 - DNA, 15 bp, Homo sapiens
acagcatcacattag

SEQ ID NO: 16446 - DNA, 15 bp, Homo sapiens
cacagcatcacatta

SEQ ID NO: 16447 - DNA, 15 bp, Homo sapiens
tcacagcatcacatt

SEQ ID NO: 16448 - DNA, 15 bp, Homo sapiens
ttcacagcatcacat

SEQ ID NO: 16449 - DNA, 15 bp, Homo sapiens
cttcacagcatcaca

SEQ ID NO: 16450 - DNA, 15 bp, Homo sapiens
tcttcacagcatcac

SEQ ID NO: 16451 - DNA, 15 bp, Homo sapiens
atcttcacagcatca

SEQ ID NO: 16452 - DNA, 15 bp, Homo sapiens
tatcttcacagcatc

SEQ ID NO: 16453 - DNA, 15 bp, Homo sapiens
ttatcttcacagcat

SEQ ID NO: 16454 - DNA, 15 bp, Homo sapiens
attatcttcacagca

SEQ ID NO: 16455 - DNA, 15 bp, Homo sapiens
cattatcttcacagc

SEQ ID NO: 16456 - DNA, 15 bp, Homo sapiens
gcattatcttcacag

SEQ ID NO: 16457 - DNA, 15 bp, Homo sapiens
ggcattatcttcaca

SEQ ID NO: 16458 - DNA, 15 bp, Homo sapiens
tggcattatcttcac

SEQ ID NO: 16459 - DNA, 15 bp, Homo sapiens
atggcattatcttca

SEQ ID NO: 16460 - DNA, 15 bp, Homo sapiens
gatggcattatcttc

SEQ ID NO: 16461 - DNA, 15 bp, Homo sapiens
ggatggcattatctt

SEQ ID NO: 16462 - DNA, 15 bp, Homo sapiens
aggatggcattatct

SEQ ID NO: 16463 - DNA, 15 bp, Homo sapiens
gaggatggcattatc

SEQ ID NO: 16464 - DNA, 15 bp, Homo sapiens
agaggatggcattat

SEQ ID NO: 16465 - DNA, 15 bp, Homo sapiens
tagaggatggcatta

SEQ ID NO: 16466 - DNA, 15 bp, Homo sapiens
atagaggatggcatt

SEQ ID NO: 16467 - DNA, 15 bp, Homo sapiens
aatagaggatggcat

SEQ ID NO: 16468 - DNA, 15 bp, Homo sapiens
taatagaggatggca

SEQ ID NO: 16469 - DNA, 15 bp, Homo sapiens
ctaatagaggatggc

SEQ ID NO: 16470 - DNA, 15 bp, Homo sapiens
actaatagaggatgg

SEQ ID NO: 16471 - DNA, 15 bp, Homo sapiens
tactaatagaggatg

SEQ ID NO: 16472 - DNA, 15 bp, Homo sapiens
ttactaatagaggat

SEQ ID NO: 16473 - DNA, 15 bp, Homo sapiens
attactaatagagga

SEQ ID NO: 16474 - DNA, 15 bp, Homo sapiens
aattactaatagagg

SEQ ID NO: 16475 - DNA, 15 bp, Homo sapiens
aaattactaatagag

SEQ ID NO: 16476 - DNA, 15 bp, Homo sapiens
gaaattactaataga

SEQ ID NO: 16477 - DNA, 15 bp, Homo sapiens
tgaaattactaatag

SEQ ID NO: 16478 - DNA, 15 bp, Homo sapiens
ctgaaattactaata

SEQ ID NO: 16479 - DNA, 15 bp, Homo sapiens
gctgaaattactaat

SEQ ID NO: 16480 - DNA, 15 bp, Homo sapiens
agctgaaattactaa

SEQ ID NO: 16481 - DNA, 15 bp, Homo sapiens
aagctgaaattacta

SEQ ID NO: 16482 - DNA, 15 bp, Homo sapiens
gaagctgaaattact

SEQ ID NO: 16483 - DNA, 15 bp, Homo sapiens
tgaagctgaaattac

SEQ ID NO: 16484 - DNA, 15 bp, Homo sapiens
ttgaagctgaaatta

SEQ ID NO: 16485 - DNA, 15 bp, Homo sapiens
gttgaagctgaaatt

SEQ ID NO: 16486 - DNA, 15 bp, Homo sapiens
tgttgaagctgaaat

SEQ ID NO: 16487 - DNA, 15 bp, Homo sapiens
ttgttgaagctgaaa

SEQ ID NO: 16488 - DNA, 15 bp, Homo sapiens
tttgttgaagctgaa

SEQ ID NO: 16489 - DNA, 15 bp, Homo sapiens
atttgttgaagctga

SEQ ID NO: 16490 - DNA, 15 bp, Homo sapiens
tatttgttgaagctg

SEQ ID NO: 16491 - DNA, 15 bp, Homo sapiens
ctatttgttgaagct

SEQ ID NO: 16492 - DNA, 15 bp, Homo sapiens
cctatttgttgaagc

SEQ ID NO: 16493 - DNA, 15 bp, Homo sapiens
tcctatttgttgaag

SEQ ID NO: 16494 - DNA, 15 bp, Homo sapiens
atcctatttgttgaa

SEQ ID NO: 16495 - DNA, 15 bp, Homo sapiens
tatcctatttgttga

SEQ ID NO: 16496 - DNA, 15 bp, Homo sapiens
ctatcctatttgttg

SEQ ID NO: 16497 - DNA, 15 bp, Homo sapiens
tctatcctatttgtt

SEQ ID NO: 16498 - DNA, 15 bp, Homo sapiens
ttctatcctatttgt

SEQ ID NO: 16499 - DNA, 15 bp, Homo sapiens
attctatcctatttg

SEQ ID NO: 16500 - DNA, 15 bp, Homo sapiens
tattctatcctattt

SEQ ID NO: 16501 - DNA, 15 bp, Homo sapiens
ttattctatcctatt

SEQ ID NO: 16502 - DNA, 15 bp, Homo sapiens
tttattctatcctat

SEQ ID NO: 16503 - DNA, 15 bp, Homo sapiens
atttattctatccta

SEQ ID NO: 16504 - DNA, 15 bp, Homo sapiens
catttattctatcct

SEQ ID NO: 16505 - DNA, 15 bp, Homo sapiens
gcatttattctatcc

SEQ ID NO: 16506 - DNA, 15 bp, Homo sapiens
tgcatttattctatc

SEQ ID NO: 16507 - DNA, 15 bp, Homo sapiens
ttgcatttattctat

SEQ ID NO: 16508 - DNA, 15 bp, Homo sapiens
tttgcatttattcta

SEQ ID NO: 16509 - DNA, 15 bp, Homo sapiens
atttgcatttattct

SEQ ID NO: 16510 - DNA, 15 bp, Homo sapiens
aatttgcatttattc

SEQ ID NO: 16511 - DNA, 15 bp, Homo sapiens
taatttgcatttatt

SEQ ID NO: 16512 - DNA, 15 bp, Homo sapiens
ttaatttgcatttat

SEQ ID NO: 16513 - DNA, 15 bp, Homo sapiens
tttaatttgcattta

SEQ ID NO: 16514 - DNA, 15 bp, Homo sapiens
ttttaatttgcattt

SEQ ID NO: 16515 - DNA, 15 bp, Homo sapiens
tttttaatttgcatt

SEQ ID NO: 16516 - DNA, 15 bp, Homo sapiens
atttttaatttgcat

SEQ ID NO: 16517 - DNA, 15 bp, Homo sapiens
tatttttaatttgca

SEQ ID NO: 16518 - DNA, 15 bp, Homo sapiens
ttatttttaatttgc

SEQ ID NO: 16519 - DNA, 15 bp, Homo sapiens
tttatttttaatttg

SEQ ID NO: 16520 - DNA, 15 bp, Homo sapiens
atttatttttaattt

SEQ ID NO: 16521 - DNA, 15 bp, Homo sapiens
aatttatttttaatt

SEQ ID NO: 16522 - DNA, 15 bp, Homo sapiens
taatttatttttaat

SEQ ID NO: 16523 - DNA, 15 bp, Homo sapiens
ctaatttatttttaa

SEQ ID NO: 16524 - DNA, 15 bp, Homo sapiens
cctaatttattttta

SEQ ID NO: 16525 - DNA, 15 bp, Homo sapiens
tcctaatttattttt

SEQ ID NO: 16526 - DNA, 15 bp, Homo sapiens
ctcctaatttatttt

SEQ ID NO: 16527 - DNA, 15 bp, Homo sapiens
gctcctaatttattt

SEQ ID NO: 16528 - DNA, 15 bp, Homo sapiens
tgctcctaatttatt

SEQ ID NO: 16529 - DNA, 15 bp, Homo sapiens
ctgctcctaatttat

SEQ ID NO: 16530 - DNA, 15 bp, Homo sapiens
tctgctcctaattta

SEQ ID NO: 16531 - DNA, 15 bp, Homo sapiens
atctgctcctaattt

SEQ ID NO: 16532 - DNA, 15 bp, Homo sapiens
catctgctcctaatt

SEQ ID NO: 16533 - DNA, 15 bp, Homo sapiens
acatctgctcctaat

SEQ ID NO: 16534 - DNA, 15 bp, Homo sapiens
aacatctgctcctaa

SEQ ID NO: 16535 - DNA, 15 bp, Homo sapiens
caacatctgctccta

SEQ ID NO: 16536 - DNA, 15 bp, Homo sapiens
tcaacatctgctcct

SEQ ID NO: 16537 - DNA, 15 bp, Homo sapiens
ctcaacatctgctcc

SEQ ID NO: 16538 - DNA, 15 bp, Homo sapiens
tctcaacatctgctc

SEQ ID NO: 16539 - DNA, 15 bp, Homo sapiens
ttctcaacatctgct

SEQ ID NO: 16540 - DNA, 15 bp, Homo sapiens
tttctcaacatctgc

SEQ ID NO: 16541 - DNA, 15 bp, Homo sapiens
atttctcaacatctg

SEQ ID NO: 16542 - DNA, 15 bp, Homo sapiens
tatttctcaacatct

SEQ ID NO: 16543 - DNA, 15 bp, Homo sapiens
atatttctcaacatc

SEQ ID NO: 16544 - DNA, 15 bp, Homo sapiens
gatatttctcaacat

SEQ ID NO: 16545 - DNA, 15 bp, Homo sapiens
agatatttctcaaca

SEQ ID NO: 16546 - DNA, 15 bp, Homo sapiens
aagatatttctcaac

SEQ ID NO: 16547 - DNA, 15 bp, Homo sapiens
taagatatttctcaa

SEQ ID NO: 16548 - DNA, 15 bp, Homo sapiens
gtaagatatttctca

SEQ ID NO: 16549 - DNA, 15 bp, Homo sapiens
tgtaagatatttctc

SEQ ID NO: 16550 - DNA, 15 bp, Homo sapiens
atgtaagatatttct

SEQ ID NO: 16551 - DNA, 15 bp, Homo sapiens
aatgtaagatatttc

SEQ ID NO: 16552 - DNA, 15 bp, Homo sapiens
aaatgtaagatattt

SEQ ID NO: 16553 - DNA, 15 bp, Homo sapiens
taaatgtaagatatt

SEQ ID NO: 16554 - DNA, 15 bp, Homo sapiens
ctaaatgtaagatat

SEQ ID NO: 16555 - DNA, 15 bp, Homo sapiens
cctaaatgtaagata

SEQ ID NO: 16556 - DNA, 15 bp, Homo sapiens
ccctaaatgtaagat

SEQ ID NO: 16557 - DNA, 15 bp, Homo sapiens
tccctaaatgtaaga

SEQ ID NO: 16558 - DNA, 15 bp, Homo sapiens
ttccctaaatgtaag

SEQ ID NO: 16559 - DNA, 15 bp, Homo sapiens
attccctaaatgtaa

SEQ ID NO: 16560 - DNA, 15 bp, Homo sapiens
aattccctaaatgta

SEQ ID NO: 16561 - DNA, 15 bp, Homo sapiens
gaattccctaaatgt

SEQ ID NO: 16562 - DNA, 15 bp, Homo sapiens
agaattccctaaatg

SEQ ID NO: 16563 - DNA, 15 bp, Homo sapiens
aagaattccctaaat

SEQ ID NO: 16564 - DNA, 15 bp, Homo sapiens
taagaattccctaaa

SEQ ID NO: 16565 - DNA, 15 bp, Homo sapiens
ttaagaattccctaa

SEQ ID NO: 16566 - DNA, 15 bp, Homo sapiens
cttaagaattcccta

SEQ ID NO: 16567 - DNA, 15 bp, Homo sapiens
acttaagaattccct

SEQ ID NO: 16568 - DNA, 15 bp, Homo sapiens
cacttaagaattccc

SEQ ID NO: 16569 - DNA, 15 bp, Homo sapiens
ccacttaagaattcc

SEQ ID NO: 16570 - DNA, 15 bp, Homo sapiens
accacttaagaattc

SEQ ID NO: 16571 - DNA, 15 bp, Homo sapiens
taccacttaagaatt

SEQ ID NO: 16572 - DNA, 15 bp, Homo sapiens
ctaccacttaagaat

SEQ ID NO: 16573 - DNA, 15 bp, Homo sapiens
tctaccacttaagaa

SEQ ID NO: 16574 - DNA, 15 bp, Homo sapiens
ttctaccacttaaga

SEQ ID NO: 16575 - DNA, 15 bp, Homo sapiens
cttctaccacttaag

SEQ ID NO: 16576 - DNA, 15 bp, Homo sapiens
ccttctaccacttaa

SEQ ID NO: 16577 - DNA, 15 bp, Homo sapiens
cccttctaccactta

SEQ ID NO: 16578 - DNA, 15 bp, Homo sapiens
gcccttctaccactt

SEQ ID NO: 16579 - DNA, 15 bp, Homo sapiens
ggcccttctaccact

SEQ ID NO: 16580 - DNA, 15 bp, Homo sapiens
gggcccttctaccac

SEQ ID NO: 16581 - DNA, 15 bp, Homo sapiens
agggcccttctacca

SEQ ID NO: 16582 - DNA, 15 bp, Homo sapiens
cagggcccttctacc

SEQ ID NO: 16583 - DNA, 15 bp, Homo sapiens
ccagggcccttctac

SEQ ID NO: 16584 - DNA, 15 bp, Homo sapiens
tccagggcccttcta

SEQ ID NO: 16585 - DNA, 15 bp, Homo sapiens
ctccagggcccttct

SEQ ID NO: 16586 - DNA, 15 bp, Homo sapiens
actccagggcccttc

SEQ ID NO: 16587 - DNA, 15 bp, Homo sapiens
aactccagggccctt

SEQ ID NO: 16588 - DNA, 15 bp, Homo sapiens
gaactccagggccct

SEQ ID NO: 16589 - DNA, 15 bp, Homo sapiens
tgaactccagggccc

SEQ ID NO: 16590 - DNA, 15 bp, Homo sapiens
ctgaactccagggcc

SEQ ID NO: 16591 - DNA, 15 bp, Homo sapiens
actgaactccagggc

SEQ ID NO: 16592 - DNA, 15 bp, Homo sapiens
aactgaactccaggg

SEQ ID NO: 16593 - DNA, 15 bp, Homo sapiens
taactgaactccagg

SEQ ID NO: 16594 - DNA, 15 bp, Homo sapiens
ttaactgaactccag

SEQ ID NO: 16595 - DNA, 15 bp, Homo sapiens
attaactgaactcca

SEQ ID NO: 16596 - DNA, 15 bp, Homo sapiens
tattaactgaactcc

SEQ ID NO: 16597 - DNA, 15 bp, Homo sapiens
ttattaactgaactc

SEQ ID NO: 16598 - DNA, 15 bp, Homo sapiens
tttattaactgaact

SEQ ID NO: 16599 - DNA, 15 bp, Homo sapiens
ctttattaactgaac

SEQ ID NO: 16600 - DNA, 15 bp, Homo sapiens
gctttattaactgaa

SEQ ID NO: 16601 - DNA, 15 bp, Homo sapiens
agctttattaactga

SEQ ID NO: 16602 - DNA, 15 bp, Homo sapiens
cagctttattaactg

SEQ ID NO: 16603 - DNA, 15 bp, Homo sapiens
ccagctttattaact

SEQ ID NO: 16604 - DNA, 15 bp, Homo sapiens
cccagctttattaac

SEQ ID NO: 16605 - DNA, 15 bp, Homo sapiens
tcccagctttattaa

SEQ ID NO: 16606 - DNA, 15 bp, Homo sapiens
atcccagctttatta

SEQ ID NO: 16607 - DNA, 15 bp, Homo sapiens
catcccagctttatt

SEQ ID NO: 16608 - DNA, 15 bp, Homo sapiens
gcatcccagctttat

SEQ ID NO: 16609 - DNA, 15 bp, Homo sapiens
agcatcccagcttta

SEQ ID NO: 16610 - DNA, 15 bp, Homo sapiens
gagcatcccagcttt

SEQ ID NO: 16611 - DNA, 15 bp, Homo sapiens
tgagcatcccagctt

SEQ ID NO: 16612 - DNA, 15 bp, Homo sapiens
ctgagcatcccagct

SEQ ID NO: 16613 - DNA, 15 bp, Homo sapiens
tctgagcatcccagc

SEQ ID NO: 16614 - DNA, 15 bp, Homo sapiens
ttctgagcatcccag

SEQ ID NO: 16615 - DNA, 15 bp, Homo sapiens
tttctgagcatccca

SEQ ID NO: 16616 - DNA, 15 bp, Homo sapiens
atttctgagcatccc

SEQ ID NO: 16617 - DNA, 15 bp, Homo sapiens
aatttctgagcatcc

SEQ ID NO: 16618 - DNA, 15 bp, Homo sapiens
taatttctgagcatc

SEQ ID NO: 16619 - DNA, 15 bp, Homo sapiens
ataatttctgagcat

SEQ ID NO: 16620 - DNA, 15 bp, Homo sapiens
tataatttctgagca

SEQ ID NO: 16621 - DNA, 15 bp, Homo sapiens
ttataatttctgagc

SEQ ID NO: 16622 - DNA, 15 bp, Homo sapiens
attataatttctgag

SEQ ID NO: 16623 - DNA, 15 bp, Homo sapiens
tattataatttctga

SEQ ID NO: 16624 - DNA, 15 bp, Homo sapiens
ttattataatttctg

SEQ ID NO: 16625 - DNA, 15 bp, Homo sapiens
attattataatttct

SEQ ID NO: 16626 - DNA, 15 bp, Homo sapiens
aattattataatttc

SEQ ID NO: 16627 - DNA, 15 bp, Homo sapiens
gaattattataattt

SEQ ID NO: 16628 - DNA, 15 bp, Homo sapiens
tgaattattataatt

SEQ ID NO: 16629 - DNA, 15 bp, Homo sapiens
ctgaattattataat

SEQ ID NO: 16630 - DNA, 15 bp, Homo sapiens
cctgaattattataa

SEQ ID NO: 16631 - DNA, 15 bp, Homo sapiens
acctgaattattata

SEQ ID NO: 16632 - DNA, 15 bp, Homo sapiens
tacctgaattattat

SEQ ID NO: 16633 - DNA, 15 bp, Homo sapiens
ttacctgaattatta

SEQ ID NO: 16634 - DNA, 15 bp, Homo sapiens
gttacctgaattatt

SEQ ID NO: 16635 - DNA, 15 bp, Homo sapiens
tgttacctgaattat

SEQ ID NO: 16636 - DNA, 15 bp, Homo sapiens
ttgttacctgaatta

SEQ ID NO: 16637 - DNA, 15 bp, Homo sapiens
tttgttacctgaatt

SEQ ID NO: 16638 - DNA, 15 bp, Homo sapiens
atttgttacctgaat

SEQ ID NO: 16639 - DNA, 15 bp, Homo sapiens
catttgttacctgaa

SEQ ID NO: 16640 - DNA, 15 bp, Homo sapiens
gcatttgttacctga

SEQ ID NO: 16641 - DNA, 15 bp, Homo sapiens
agcatttgttacctg

SEQ ID NO: 16642 - DNA, 15 bp, Homo sapiens
aagcatttgttacct

SEQ ID NO: 16643 - DNA, 15 bp, Homo sapiens
aaagcatttgttacc

SEQ ID NO: 16644 - DNA, 15 bp, Homo sapiens
gaaagcatttgttac

SEQ ID NO: 16645 - DNA, 15 bp, Homo sapiens
ggaaagcatttgtta

SEQ ID NO: 16646 - DNA, 15 bp, Homo sapiens
aggaaagcatttgtt

SEQ ID NO: 16647 - DNA, 15 bp, Homo sapiens
aaggaaagcatttgt

SEQ ID NO: 16648 - DNA, 15 bp, Homo sapiens
taaggaaagcatttg

SEQ ID NO: 16649 - DNA, 15 bp, Homo sapiens
ttaaggaaagcattt

SEQ ID NO: 16650 - DNA, 15 bp, Homo sapiens
attaaggaaagcatt

SEQ ID NO: 16651 - DNA, 15 bp, Homo sapiens
cattaaggaaagcat

SEQ ID NO: 16652 - DNA, 15 bp, Homo sapiens
acattaaggaaagca

SEQ ID NO: 16653 - DNA, 15 bp, Homo sapiens
cacattaaggaaagc

SEQ ID NO: 16654 - DNA, 15 bp, Homo sapiens
tcacattaaggaaag

SEQ ID NO: 16655 - DNA, 15 bp, Homo sapiens
atcacattaaggaaa

SEQ ID NO: 16656 - DNA, 15 bp, Homo sapiens
catcacattaaggaa

SEQ ID NO: 16657 - DNA, 15 bp, Homo sapiens
gcatcacattaagga

SEQ ID NO: 16658 - DNA, 15 bp, Homo sapiens
agcatcacattaagg

SEQ ID NO: 16659 - DNA, 15 bp, Homo sapiens
gagcatcacattaag

SEQ ID NO: 16660 - DNA, 15 bp, Homo sapiens
agagcatcacattaa

SEQ ID NO: 16661 - DNA, 15 bp, Homo sapiens
cagagcatcacatta

SEQ ID NO: 16662 - DNA, 15 bp, Homo sapiens
gcagagcatcacatt

SEQ ID NO: 16663 - DNA, 15 bp, Homo sapiens
agcagagcatcacat

SEQ ID NO: 16664 - DNA, 15 bp, Homo sapiens
cagcagagcatcaca

SEQ ID NO: 16665 - DNA, 15 bp, Homo sapiens
acagcagagcatcac

SEQ ID NO: 16666 - DNA, 15 bp, Homo sapiens
cacagcagagcatca

SEQ ID NO: 16667 - DNA, 15 bp, Homo sapiens
ccacagcagagcatc

SEQ ID NO: 16668 - DNA, 15 bp, Homo sapiens
tccacagcagagcat

SEQ ID NO: 16669 - DNA, 15 bp, Homo sapiens
ctccacagcagagca

SEQ ID NO: 16670 - DNA, 15 bp, Homo sapiens
cctccacagcagagc

SEQ ID NO: 16671 - DNA, 15 bp, Homo sapiens
acctccacagcagag

SEQ ID NO: 16672 - DNA, 15 bp, Homo sapiens
aacctccacagcaga

SEQ ID NO: 16673 - DNA, 15 bp, Homo sapiens
aaacctccacagcag

SEQ ID NO: 16674 - DNA, 15 bp, Homo sapiens
aaaacctccacagca

SEQ ID NO: 16675 - DNA, 15 bp, Homo sapiens
caaaacctccacagc

SEQ ID NO: 16676 - DNA, 15 bp, Homo sapiens
ccaaaacctccacag

SEQ ID NO: 16677 - DNA, 15 bp, Homo sapiens
cccaaaacctccaca

SEQ ID NO: 16678 - DNA, 15 bp, Homo sapiens
tcccaaaacctccac

SEQ ID NO: 16679 - DNA, 15 bp, Homo sapiens
ttcccaaaacctcca

SEQ ID NO: 16680 - DNA, 15 bp, Homo sapiens
attcccaaaacctcc

SEQ ID NO: 16681 - DNA, 15 bp, Homo sapiens
tattcccaaaacctc

SEQ ID NO: 16682 - DNA, 15 bp, Homo sapiens
ctattcccaaaacct

SEQ ID NO: 16683 - DNA, 15 bp, Homo sapiens
tctattcccaaaacc

SEQ ID NO: 16684 - DNA, 15 bp, Homo sapiens
ttctattcccaaaac

SEQ ID NO: 16685 - DNA, 15 bp, Homo sapiens
cttctattcccaaaa

SEQ ID NO: 16686 - DNA, 15 bp, Homo sapiens
tcttctattcccaaa

SEQ ID NO: 16687 - DNA, 15 bp, Homo sapiens
ttcttctattcccaa

SEQ ID NO: 16688 - DNA, 15 bp, Homo sapiens
tttcttctattccca

SEQ ID NO: 16689 - DNA, 15 bp, Homo sapiens
ctttcttctattccc

SEQ ID NO: 16690 - DNA, 15 bp, Homo sapiens
tctttcttctattcc

SEQ ID NO: 16691 - DNA, 15 bp, Homo sapiens
ttctttcttctattc

SEQ ID NO: 16692 - DNA, 15 bp, Homo sapiens
cttctttcttctatt

SEQ ID NO: 16693 - DNA, 15 bp, Homo sapiens
tcttctttcttctat

SEQ ID NO: 16694 - DNA, 15 bp, Homo sapiens
ctcttctttcttcta

SEQ ID NO: 16695 - DNA, 15 bp, Homo sapiens
cctcttctttcttct

SEQ ID NO: 16696 - DNA, 15 bp, Homo sapiens
gcctcttctttcttc

SEQ ID NO: 16697 - DNA, 15 bp, Homo sapiens
agcctcttctttctt

SEQ ID NO: 16698 - DNA, 15 bp, Homo sapiens
cagcctcttctttct

SEQ ID NO: 16699 - DNA, 15 bp, Homo sapiens
acagcctcttctttc

SEQ ID NO: 16700 - DNA, 15 bp, Homo sapiens
aacagcctcttcttt

SEQ ID NO: 16701 - DNA, 15 bp, Homo sapiens
taacagcctcttctt

SEQ ID NO: 16702 - DNA, 15 bp, Homo sapiens
ataacagcctcttct

SEQ ID NO: 16703 - DNA, 15 bp, Homo sapiens
aataacagcctcttc

SEQ ID NO: 16704 - DNA, 15 bp, Homo sapiens
caataacagcctctt

SEQ ID NO: 16705 - DNA, 15 bp, Homo sapiens
acaataacagcctct

SEQ ID NO: 16706 - DNA, 15 bp, Homo sapiens
gacaataacagcctc

SEQ ID NO: 16707 - DNA, 15 bp, Homo sapiens
tgacaataacagcct

SEQ ID NO: 16708 - DNA, 15 bp, Homo sapiens
atgacaataacagcc

SEQ ID NO: 16709 - DNA, 15 bp, Homo sapiens
tatgacaataacagc

SEQ ID NO: 16710 - DNA, 15 bp, Homo sapiens
gtatgacaataacag

SEQ ID NO: 16711 - DNA, 15 bp, Homo sapiens
agtatgacaataaca

SEQ ID NO: 16712 - DNA, 15 bp, Homo sapiens
cagtatgacaataac

SEQ ID NO: 16713 - DNA, 15 bp, Homo sapiens
acagtatgacaataa

SEQ ID NO: 16714 - DNA, 15 bp, Homo sapiens
aacagtatgacaata

SEQ ID NO: 16715 - DNA, 15 bp, Homo sapiens
aaacagtatgacaat

SEQ ID NO: 16716 - DNA, 15 bp, Homo sapiens
caaacagtatgacaa

SEQ ID NO: 16717 - DNA, 15 bp, Homo sapiens
acaaacagtatgaca

SEQ ID NO: 16718 - DNA, 15 bp, Homo sapiens
tacaaacagtatgac

SEQ ID NO: 16719 - DNA, 15 bp, Homo sapiens
ttacaaacagtatga

SEQ ID NO: 16720 - DNA, 15 bp, Homo sapiens
cttacaaacagtatg

SEQ ID NO: 16721 - DNA, 15 bp, Homo sapiens
acttacaaacagtat

SEQ ID NO: 16722 - DNA, 15 bp, Homo sapiens
aacttacaaacagta

SEQ ID NO: 16723 - DNA, 15 bp, Homo sapiens
gaacttacaaacagt

SEQ ID NO: 16724 - DNA, 15 bp, Homo sapiens
tgaacttacaaacag

SEQ ID NO: 16725 - DNA, 15 bp, Homo sapiens
atgaacttacaaaca

SEQ ID NO: 16726 - DNA, 15 bp, Homo sapiens
gatgaacttacaaac

SEQ ID NO: 16727 - DNA, 15 bp, Homo sapiens
agatgaacttacaaa

SEQ ID NO: 16728 - DNA, 15 bp, Homo sapiens
aagatgaacttacaa

SEQ ID NO: 16729 - DNA, 15 bp, Homo sapiens
aaagatgaacttaca

SEQ ID NO: 16730 - DNA, 15 bp, Homo sapiens
gaaagatgaacttac

SEQ ID NO: 16731 - DNA, 15 bp, Homo sapiens
agaaagatgaactta

SEQ ID NO: 16732 - DNA, 15 bp, Homo sapiens
aagaaagatgaactt

SEQ ID NO: 16733 - DNA, 15 bp, Homo sapiens
aaagaaagatgaact

SEQ ID NO: 16734 - DNA, 15 bp, Homo sapiens
taaagaaagatgaac

SEQ ID NO: 16735 - DNA, 15 bp, Homo sapiens
gtaaagaaagatgaa

SEQ ID NO: 16736 - DNA, 15 bp, Homo sapiens
tgtaaagaaagatga

SEQ ID NO: 16737 - DNA, 15 bp, Homo sapiens
atgtaaagaaagatg

SEQ ID NO: 16738 - DNA, 15 bp, Homo sapiens
aatgtaaagaaagat

SEQ ID NO: 16739 - DNA, 15 bp, Homo sapiens
gaatgtaaagaaaga

SEQ ID NO: 16740 - DNA, 15 bp, Homo sapiens
tgaatgtaaagaaag

SEQ ID NO: 16741 - DNA, 15 bp, Homo sapiens
ctgaatgtaaagaaa

SEQ ID NO: 16742 - DNA, 15 bp, Homo sapiens
actgaatgtaaagaa

SEQ ID NO: 16743 - DNA, 15 bp, Homo sapiens
cactgaatgtaaaga

SEQ ID NO: 16744 - DNA, 15 bp, Homo sapiens
ccactgaatgtaaag

SEQ ID NO: 16745 - DNA, 15 bp, Homo sapiens
tccactgaatgtaaa

SEQ ID NO: 16746 - DNA, 15 bp, Homo sapiens
atccactgaatgtaa

SEQ ID NO: 16747 - DNA, 15 bp, Homo sapiens
tatccactgaatgta

SEQ ID NO: 16748 - DNA, 15 bp, Homo sapiens
ttatccactgaatgt

SEQ ID NO: 16749 - DNA, 15 bp, Homo sapiens
gttatccactgaatg

SEQ ID NO: 16750 - DNA, 15 bp, Homo sapiens
agttatccactgaat

SEQ ID NO: 16751 - DNA, 15 bp, Homo sapiens
tagttatccactgaa

SEQ ID NO: 16752 - DNA, 15 bp, Homo sapiens
ttagttatccactga

SEQ ID NO: 16753 - DNA, 15 bp, Homo sapiens
tttagttatccactg

SEQ ID NO: 16754 - DNA, 15 bp, Homo sapiens
ttttagttatccact

SEQ ID NO: 16755 - DNA, 15 bp, Homo sapiens
attttagttatccac

SEQ ID NO: 16756 - DNA, 15 bp, Homo sapiens
gattttagttatcca

SEQ ID NO: 16757 - DNA, 15 bp, Homo sapiens
agattttagttatcc

SEQ ID NO: 16758 - DNA, 15 bp, Homo sapiens
tagattttagttatc

SEQ ID NO: 16759 - DNA, 15 bp, Homo sapiens
gtagattttagttat

SEQ ID NO: 16760 - DNA, 15 bp, Homo sapiens
agtagattttagtta

SEQ ID NO: 16761 - DNA, 15 bp, Homo sapiens
tagtagattttagtt

SEQ ID NO: 16762 - DNA, 15 bp, Homo sapiens
atagtagattttagt

SEQ ID NO: 16763 - DNA, 15 bp, Homo sapiens
tatagtagattttag

SEQ ID NO: 16764 - DNA, 15 bp, Homo sapiens
atatagtagatttta

SEQ ID NO: 16765 - DNA, 15 bp, Homo sapiens
tatatagtagatttt

SEQ ID NO: 16766 - DNA, 15 bp, Homo sapiens
atatatagtagattt

SEQ ID NO: 16767 - DNA, 15 bp, Homo sapiens
catatatagtagatt

SEQ ID NO: 16768 - DNA, 15 bp, Homo sapiens
gcatatatagtagat

SEQ ID NO: 16769 - DNA, 15 bp, Homo sapiens
agcatatatagtaga

SEQ ID NO: 16770 - DNA, 15 bp, Homo sapiens
cagcatatatagtag

SEQ ID NO: 16771 - DNA, 15 bp, Homo sapiens
tcagcatatatagta

SEQ ID NO: 16772 - DNA, 15 bp, Homo sapiens
atcagcatatatagt

SEQ ID NO: 16773 - DNA, 15 bp, Homo sapiens
tatcagcatatatag

SEQ ID NO: 16774 - DNA, 15 bp, Homo sapiens
atatcagcatatata

SEQ ID NO: 16775 - DNA, 15 bp, Homo sapiens
aatatcagcatatat

SEQ ID NO: 16776 - DNA, 15 bp, Homo sapiens
aaatatcagcatata

SEQ ID NO: 16777 - DNA, 15 bp, Homo sapiens
gaaatatcagcatat

SEQ ID NO: 16778 - DNA, 15 bp, Homo sapiens
tgaaatatcagcata

SEQ ID NO: 16779 - DNA, 15 bp, Homo sapiens
ctgaaatatcagcat

SEQ ID NO: 16780 - DNA, 15 bp, Homo sapiens
tctgaaatatcagca

SEQ ID NO: 16781 - DNA, 15 bp, Homo sapiens
ttctgaaatatcagc

SEQ ID NO: 16782 - DNA, 15 bp, Homo sapiens
tttctgaaatatcag

SEQ ID NO: 16783 - DNA, 15 bp, Homo sapiens
atttctgaaatatca

SEQ ID NO: 16784 - DNA, 15 bp, Homo sapiens
catttctgaaatatc

SEQ ID NO: 16785 - DNA, 15 bp, Homo sapiens
ccatttctgaaatat

SEQ ID NO: 16786 - DNA, 15 bp, Homo sapiens
accatttctgaaata

SEQ ID NO: 16787 - DNA, 15 bp, Homo sapiens
caccatttctgaaat

SEQ ID NO: 16788 - DNA, 15 bp, Homo sapiens
ccaccatttctgaaa

SEQ ID NO: 16789 - DNA, 15 bp, Homo sapiens
accaccatttctgaa

SEQ ID NO: 16790 - DNA, 15 bp, Homo sapiens
aaccaccatttctga

SEQ ID NO: 16791 - DNA, 15 bp, Homo sapiens
gaaccaccatttctg

SEQ ID NO: 16792 - DNA, 15 bp, Homo sapiens
ggaaccaccatttct

SEQ ID NO: 16793 - DNA, 15 bp, Homo sapiens
gggaaccaccatttc

SEQ ID NO: 16794 - DNA, 15 bp, Homo sapiens
agggaaccaccattt

SEQ ID NO: 16795 - DNA, 15 bp, Homo sapiens
aagggaaccaccatt

SEQ ID NO: 16796 - DNA, 15 bp, Homo sapiens
taagggaaccaccat

SEQ ID NO: 16797 - DNA, 15 bp, Homo sapiens
ttaagggaaccacca

SEQ ID NO: 16798 - DNA, 15 bp, Homo sapiens
gttaagggaaccacc

SEQ ID NO: 16799 - DNA, 15 bp, Homo sapiens
ggttaagggaaccac

SEQ ID NO: 16800 - DNA, 15 bp, Homo sapiens
aggttaagggaacca

SEQ ID NO: 16801 - DNA, 15 bp, Homo sapiens
aaggttaagggaacc

SEQ ID NO: 16802 - DNA, 15 bp, Homo sapiens
gaaggttaagggaac

SEQ ID NO: 16803 - DNA, 15 bp, Homo sapiens
tgaaggttaagggaa

SEQ ID NO: 16804 - DNA, 15 bp, Homo sapiens
ttgaaggttaaggga

SEQ ID NO: 16805 - DNA, 15 bp, Homo sapiens
cttgaaggttaaggg

SEQ ID NO: 16806 - DNA, 15 bp, Homo sapiens
tcttgaaggttaagg

SEQ ID NO: 16807 - DNA, 15 bp, Homo sapiens
ttcttgaaggttaag

SEQ ID NO: 16808 - DNA, 15 bp, Homo sapiens
tttcttgaaggttaa

SEQ ID NO: 16809 - DNA, 15 bp, Homo sapiens
ttttcttgaaggtta

SEQ ID NO: 16810 - DNA, 15 bp, Homo sapiens
tttttcttgaaggtt

SEQ ID NO: 16811 - DNA, 15 bp, Homo sapiens
ttttttcttgaaggt

SEQ ID NO: 16812 - DNA, 15 bp, Homo sapiens
gttttttcttgaagg

SEQ ID NO: 16813 - DNA, 15 bp, Homo sapiens
tgttttttcttgaag

SEQ ID NO: 16814 - DNA, 15 bp, Homo sapiens
ttgttttttcttgaa

SEQ ID NO: 16815 - DNA, 15 bp, Homo sapiens
tttgttttttcttga

SEQ ID NO: 16816 - DNA, 15 bp, Homo sapiens
ttttgttttttcttg

SEQ ID NO: 16817 - DNA, 15 bp, Homo sapiens
cttttgttttttctt

SEQ ID NO: 16818 - DNA, 15 bp, Homo sapiens
gcttttgttttttct

SEQ ID NO: 16819 - DNA, 15 bp, Homo sapiens
agcttttgttttttc

SEQ ID NO: 16820 - DNA, 15 bp, Homo sapiens
gagcttttgtttttt

SEQ ID NO: 16821 - DNA, 15 bp, Homo sapiens
agagcttttgttttt

SEQ ID NO: 16822 - DNA, 15 bp, Homo sapiens
gagagcttttgtttt

SEQ ID NO: 16823 - DNA, 15 bp, Homo sapiens
tgagagcttttgttt

SEQ ID NO: 16824 - DNA, 15 bp, Homo sapiens
atgagagcttttgtt

SEQ ID NO: 16825 - DNA, 15 bp, Homo sapiens
aatgagagcttttgt

SEQ ID NO: 16826 - DNA, 15 bp, Homo sapiens
aaatgagagcttttg

SEQ ID NO: 16827 - DNA, 15 bp, Homo sapiens
caaatgagagctttt

SEQ ID NO: 16828 - DNA, 15 bp, Homo sapiens
acaaatgagagcttt

SEQ ID NO: 16829 - DNA, 15 bp, Homo sapiens
tacaaatgagagctt

SEQ ID NO: 16830 - DNA, 15 bp, Homo sapiens
ttacaaatgagagct

SEQ ID NO: 16831 - DNA, 15 bp, Homo sapiens
tttacaaatgagagc

SEQ ID NO: 16832 - DNA, 15 bp, Homo sapiens
gtttacaaatgagag

SEQ ID NO: 16833 - DNA, 15 bp, Homo sapiens
tgtttacaaatgaga

SEQ ID NO: 16834 - DNA, 15 bp, Homo sapiens
gtgtttacaaatgag

SEQ ID NO: 16835 - DNA, 15 bp, Homo sapiens
agtgtttacaaatga

SEQ ID NO: 16836 - DNA, 15 bp, Homo sapiens
aagtgtttacaaatg

SEQ ID NO: 16837 - DNA, 15 bp, Homo sapiens
caagtgtttacaaat

SEQ ID NO: 16838 - DNA, 15 bp, Homo sapiens
gcaagtgtttacaaa

SEQ ID NO: 16839 - DNA, 15 bp, Homo sapiens
tgcaagtgtttacaa

SEQ ID NO: 16840 - DNA, 15 bp, Homo sapiens
ttgcaagtgtttaca

SEQ ID NO: 16841 - DNA, 15 bp, Homo sapiens
cttgcaagtgtttac

SEQ ID NO: 16842 - DNA, 15 bp, Homo sapiens
gcttgcaagtgttta

SEQ ID NO: 16843 - DNA, 15 bp, Homo sapiens
tgcttgcaagtgttt

SEQ ID NO: 16844 - DNA, 15 bp, Homo sapiens
atgcttgcaagtgtt

SEQ ID NO: 16845 - DNA, 15 bp, Homo sapiens
aatgcttgcaagtgt

SEQ ID NO: 16846 - DNA, 15 bp, Homo sapiens
gaatgcttgcaagtg

SEQ ID NO: 16847 - DNA, 15 bp, Homo sapiens
agaatgcttgcaagt

SEQ ID NO: 16848 - DNA, 15 bp, Homo sapiens
aagaatgcttgcaag

SEQ ID NO: 16849 - DNA, 15 bp, Homo sapiens
caagaatgcttgcaa

SEQ ID NO: 16850 - DNA, 15 bp, Homo sapiens
ccaagaatgcttgca

SEQ ID NO: 16851 - DNA, 15 bp, Homo sapiens
cccaagaatgcttgc

SEQ ID NO: 16852 - DNA, 15 bp, Homo sapiens
acccaagaatgcttg

SEQ ID NO: 16853 - DNA, 15 bp, Homo sapiens
aacccaagaatgctt

SEQ ID NO: 16854 - DNA, 15 bp, Homo sapiens
caacccaagaatgct

SEQ ID NO: 16855 - DNA, 15 bp, Homo sapiens
acaacccaagaatgc

SEQ ID NO: 16856 - DNA, 15 bp, Homo sapiens
gacaacccaagaatg

SEQ ID NO: 16857 - DNA, 15 bp, Homo sapiens
agacaacccaagaat

SEQ ID NO: 16858 - DNA, 15 bp, Homo sapiens
gagacaacccaagaa

SEQ ID NO: 16859 - DNA, 15 bp, Homo sapiens
agagacaacccaaga

SEQ ID NO: 16860 - DNA, 15 bp, Homo sapiens
aagagacaacccaag

SEQ ID NO: 16861 - DNA, 15 bp, Homo sapiens
caagagacaacccaa

SEQ ID NO: 16862 - DNA, 15 bp, Homo sapiens
ccaagagacaaccca

SEQ ID NO: 16863 - DNA, 15 bp, Homo sapiens
accaagagacaaccc

SEQ ID NO: 16864 - DNA, 15 bp, Homo sapiens
caccaagagacaacc

SEQ ID NO: 16865 - DNA, 15 bp, Homo sapiens
ccaccaagagacaac

SEQ ID NO: 16866 - DNA, 15 bp, Homo sapiens
accaccaagagacaa

SEQ ID NO: 16867 - DNA, 15 bp, Homo sapiens
taccaccaagagaca

SEQ ID NO: 16868 - DNA, 15 bp, Homo sapiens
gtaccaccaagagac

SEQ ID NO: 16869 - DNA, 15 bp, Homo sapiens
ggtaccaccaagaga

SEQ ID NO: 16870 - DNA, 15 bp, Homo sapiens
gggtaccaccaagag

SEQ ID NO: 16871 - DNA, 15 bp, Homo sapiens
tgggtaccaccaaga

SEQ ID NO: 16872 - DNA, 15 bp, Homo sapiens
ttgggtaccaccaag

SEQ ID NO: 16873 - DNA, 15 bp, Homo sapiens
cttgggtaccaccaa

SEQ ID NO: 16874 - DNA, 15 bp, Homo sapiens
acttgggtaccacca

SEQ ID NO: 16875 - DNA, 15 bp, Homo sapiens
aacttgggtaccacc

SEQ ID NO: 16876 - DNA, 15 bp, Homo sapiens
aaacttgggtaccac

SEQ ID NO: 16877 - DNA, 15 bp, Homo sapiens
aaaacttgggtacca

SEQ ID NO: 16878 - DNA, 15 bp, Homo sapiens
aaaaacttgggtacc

SEQ ID NO: 16879 - DNA, 15 bp, Homo sapiens
caaaaacttgggtac

SEQ ID NO: 16880 - DNA, 15 bp, Homo sapiens
gcaaaaacttgggta

SEQ ID NO: 16881 - DNA, 15 bp, Homo sapiens
agcaaaaacttgggt

SEQ ID NO: 16882 - DNA, 15 bp, Homo sapiens
aagcaaaaacttggg

SEQ ID NO: 16883 - DNA, 15 bp, Homo sapiens
aaagcaaaaacttgg

SEQ ID NO: 16884 - DNA, 15 bp, Homo sapiens
caaagcaaaaacttg

SEQ ID NO: 16885 - DNA, 15 bp, Homo sapiens
ccaaagcaaaaactt

SEQ ID NO: 16886 - DNA, 15 bp, Homo sapiens
gccaaagcaaaaact

SEQ ID NO: 16887 - DNA, 15 bp, Homo sapiens
ggccaaagcaaaaac

SEQ ID NO: 16888 - DNA, 15 bp, Homo sapiens
cggccaaagcaaaaa

SEQ ID NO: 16889 - DNA, 15 bp, Homo sapiens
ccggccaaagcaaaa

SEQ ID NO: 16890 - DNA, 15 bp, Homo sapiens
accggccaaagcaaa

SEQ ID NO: 16891 - DNA, 15 bp, Homo sapiens
taccggccaaagcaa

SEQ ID NO: 16892 - DNA, 15 bp, Homo sapiens
ttaccggccaaagca

SEQ ID NO: 16893 - DNA, 15 bp, Homo sapiens
cttaccggccaaagc

SEQ ID NO: 16894 - DNA, 15 bp, Homo sapiens
tcttaccggccaaag

SEQ ID NO: 16895 - DNA, 15 bp, Homo sapiens
ctcttaccggccaaa

SEQ ID NO: 16896 - DNA, 15 bp, Homo sapiens
tctcttaccggccaa

SEQ ID NO: 16897 - DNA, 15 bp, Homo sapiens
gtctcttaccggcca

SEQ ID NO: 16898 - DNA, 15 bp, Homo sapiens
agtctcttaccggcc

SEQ ID NO: 16899 - DNA, 15 bp, Homo sapiens
aagtctcttaccggc

SEQ ID NO: 16900 - DNA, 15 bp, Homo sapiens
aaagtctcttaccgg

SEQ ID NO: 16901 - DNA, 15 bp, Homo sapiens
aaaagtctcttaccg

SEQ ID NO: 16902 - DNA, 15 bp, Homo sapiens
caaaagtctcttacc

SEQ ID NO: 16903 - DNA, 15 bp, Homo sapiens
gcaaaagtctcttac

SEQ ID NO: 16904 - DNA, 15 bp, Homo sapiens
tgcaaaagtctctta

SEQ ID NO: 16905 - DNA, 15 bp, Homo sapiens
atgcaaaagtctctt

SEQ ID NO: 16906 - DNA, 15 bp, Homo sapiens
tatgcaaaagtctct

SEQ ID NO: 16907 - DNA, 15 bp, Homo sapiens
ctatgcaaaagtctc

SEQ ID NO: 16908 - DNA, 15 bp, Homo sapiens
actatgcaaaagtct

SEQ ID NO: 16909 - DNA, 15 bp, Homo sapiens
tactatgcaaaagtc

SEQ ID NO: 16910 - DNA, 15 bp, Homo sapiens
gtactatgcaaaagt

SEQ ID NO: 16911 - DNA, 15 bp, Homo sapiens
agtactatgcaaaag

SEQ ID NO: 16912 - DNA, 15 bp, Homo sapiens
aagtactatgcaaaa

SEQ ID NO: 16913 - DNA, 15 bp, Homo sapiens
aaagtactatgcaaa

SEQ ID NO: 16914 - DNA, 15 bp, Homo sapiens
caaagtactatgcaa

SEQ ID NO: 16915 - DNA, 15 bp, Homo sapiens
acaaagtactatgca

SEQ ID NO: 16916 - DNA, 15 bp, Homo sapiens
aacaaagtactatgc

SEQ ID NO: 16917 - DNA, 15 bp, Homo sapiens
caacaaagtactatg

SEQ ID NO: 16918 - DNA, 15 bp, Homo sapiens
gcaacaaagtactat

SEQ ID NO: 16919 - DNA, 15 bp, Homo sapiens
ggcaacaaagtacta

SEQ ID NO: 16920 - DNA, 15 bp, Homo sapiens
aggcaacaaagtact

SEQ ID NO: 16921 - DNA, 15 bp, Homo sapiens
aaggcaacaaagtac

SEQ ID NO: 16922 - DNA, 15 bp, Homo sapiens
caaggcaacaaagta

SEQ ID NO: 16923 - DNA, 15 bp, Homo sapiens
gcaaggcaacaaagt

SEQ ID NO: 16924 - DNA, 15 bp, Homo sapiens
ggcaaggcaacaaag

SEQ ID NO: 16925 - DNA, 15 bp, Homo sapiens
aggcaaggcaacaaa

SEQ ID NO: 16926 - DNA, 15 bp, Homo sapiens
gaggcaaggcaacaa

SEQ ID NO: 16927 - DNA, 15 bp, Homo sapiens
agaggcaaggcaaca

SEQ ID NO: 16928 - DNA, 15 bp, Homo sapiens
tagaggcaaggcaac

SEQ ID NO: 16929 - DNA, 15 bp, Homo sapiens
gtagaggcaaggcaa

SEQ ID NO: 16930 - DNA, 15 bp, Homo sapiens
tgtagaggcaaggca

SEQ ID NO: 16931 - DNA, 15 bp, Homo sapiens
ttgtagaggcaaggc

SEQ ID NO: 16932 - DNA, 15 bp, Homo sapiens
gttgtagaggcaagg

SEQ ID NO: 16933 - DNA, 15 bp, Homo sapiens
tgttgtagaggcaag

SEQ ID NO: 16934 - DNA, 15 bp, Homo sapiens
atgttgtagaggcaa

SEQ ID NO: 16935 - DNA, 15 bp, Homo sapiens
catgttgtagaggca

SEQ ID NO: 16936 - DNA, 15 bp, Homo sapiens
acatgttgtagaggc

SEQ ID NO: 16937 - DNA, 15 bp, Homo sapiens
aacatgttgtagagg

SEQ ID NO: 16938 - DNA, 15 bp, Homo sapiens
taacatgttgtagag

SEQ ID NO: 16939 - DNA, 15 bp, Homo sapiens
ctaacatgttgtaga

SEQ ID NO: 16940 - DNA, 15 bp, Homo sapiens
cctaacatgttgtag

SEQ ID NO: 16941 - DNA, 15 bp, Homo sapiens
gcctaacatgttgta

SEQ ID NO: 16942 - DNA, 15 bp, Homo sapiens
agcctaacatgttgt

SEQ ID NO: 16943 - DNA, 15 bp, Homo sapiens
aagcctaacatgttg

SEQ ID NO: 16944 - DNA, 15 bp, Homo sapiens
caagcctaacatgtt

SEQ ID NO: 16945 - DNA, 15 bp, Homo sapiens
acaagcctaacatgt

SEQ ID NO: 16946 - DNA, 15 bp, Homo sapiens
cacaagcctaacatg

SEQ ID NO: 16947 - DNA, 15 bp, Homo sapiens
ccacaagcctaacat

SEQ ID NO: 16948 - DNA, 15 bp, Homo sapiens
tccacaagcctaaca

SEQ ID NO: 16949 - DNA, 15 bp, Homo sapiens
atccacaagcctaac

SEQ ID NO: 16950 - DNA, 15 bp, Homo sapiens
aatccacaagcctaa

SEQ ID NO: 16951 - DNA, 15 bp, Homo sapiens
caatccacaagccta

SEQ ID NO: 16952 - DNA, 15 bp, Homo sapiens
ccaatccacaagcct

SEQ ID NO: 16953 - DNA, 15 bp, Homo sapiens
gccaatccacaagcc

SEQ ID NO: 16954 - DNA, 15 bp, Homo sapiens
cgccaatccacaagc

SEQ ID NO: 16955 - DNA, 15 bp, Homo sapiens
gcgccaatccacaag

SEQ ID NO: 16956 - DNA, 15 bp, Homo sapiens
tgcgccaatccacaa

SEQ ID NO: 16957 - DNA, 15 bp, Homo sapiens
atgcgccaatccaca

SEQ ID NO: 16958 - DNA, 15 bp, Homo sapiens
catgcgccaatccac

SEQ ID NO: 16959 - DNA, 15 bp, Homo sapiens
ccatgcgccaatcca

SEQ ID NO: 16960 - DNA, 15 bp, Homo sapiens
accatgcgccaatcc

SEQ ID NO: 16961 - DNA, 15 bp, Homo sapiens
caccatgcgccaatc

SEQ ID NO: 16962 - DNA, 15 bp, Homo sapiens
tcaccatgcgccaat

SEQ ID NO: 16963 - DNA, 15 bp, Homo sapiens
ttcaccatgcgccaa

SEQ ID NO: 16964 - DNA, 15 bp, Homo sapiens
attcaccatgcgcca

SEQ ID NO: 16965 - DNA, 15 bp, Homo sapiens
tattcaccatgcgcc

SEQ ID NO: 16966 - DNA, 15 bp, Homo sapiens
ttattcaccatgcgc

SEQ ID NO: 16967 - DNA, 15 bp, Homo sapiens
cttattcaccatgcg

SEQ ID NO: 16968 - DNA, 15 bp, Homo sapiens
tcttattcaccatgc

SEQ ID NO: 16969 - DNA, 15 bp, Homo sapiens
gtcttattcaccatg

SEQ ID NO: 16970 - DNA, 15 bp, Homo sapiens
tgtcttattcaccat

SEQ ID NO: 16971 - DNA, 15 bp, Homo sapiens
gtgtcttattcacca

SEQ ID NO: 16972 - DNA, 15 bp, Homo sapiens
tgtgtcttattcacc

SEQ ID NO: 16973 - DNA, 15 bp, Homo sapiens
ctgtgtcttattcac

SEQ ID NO: 16974 - DNA, 15 bp, Homo sapiens
actgtgtcttattca

SEQ ID NO: 16975 - DNA, 15 bp, Homo sapiens
aactgtgtcttattc

SEQ ID NO: 16976 - DNA, 15 bp, Homo sapiens
gaactgtgtcttatt

SEQ ID NO: 16977 - DNA, 15 bp, Homo sapiens
ggaactgtgtcttat

SEQ ID NO: 16978 - DNA, 15 bp, Homo sapiens
tggaactgtgtctta

SEQ ID NO: 16979 - DNA, 15 bp, Homo sapiens
ctggaactgtgtctt

SEQ ID NO: 16980 - DNA, 15 bp, Homo sapiens
actggaactgtgtct

SEQ ID NO: 16981 - DNA, 15 bp, Homo sapiens
aactggaactgtgtc

SEQ ID NO: 16982 - DNA, 15 bp, Homo sapiens
caactggaactgtgt

SEQ ID NO: 16983 - DNA, 15 bp, Homo sapiens
acaactggaactgtg

SEQ ID NO: 16984 - DNA, 15 bp, Homo sapiens
gacaactggaactgt

SEQ ID NO: 16985 - DNA, 15 bp, Homo sapiens
cgacaactggaactg

SEQ ID NO: 16986 - DNA, 15 bp, Homo sapiens
tcgacaactggaact

SEQ ID NO: 16987 - DNA, 15 bp, Homo sapiens
gtcgacaactggaac

SEQ ID NO: 16988 - DNA, 15 bp, Homo sapiens
agtcgacaactggaa

SEQ ID NO: 16989 - DNA, 15 bp, Homo sapiens
cagtcgacaactgga

SEQ ID NO: 16990 - DNA, 15 bp, Homo sapiens
acagtcgacaactgg

SEQ ID NO: 16991 - DNA, 15 bp, Homo sapiens
gacagtcgacaactg

SEQ ID NO: 16992 - DNA, 15 bp, Homo sapiens
agacagtcgacaact

SEQ ID NO: 16993 - DNA, 15 bp, Homo sapiens
cagacagtcgacaac

SEQ ID NO: 16994 - DNA, 15 bp, Homo sapiens
acagacagtcgacaa

SEQ ID NO: 16995 - DNA, 15 bp, Homo sapiens
gacagacagtcgaca

SEQ ID NO: 16996 - DNA, 15 bp, Homo sapiens
tgacagacagtcgac

SEQ ID NO: 16997 - DNA, 15 bp, Homo sapiens
gtgacagacagtcga

SEQ ID NO: 16998 - DNA, 15 bp, Homo sapiens
ggtgacagacagtcg

SEQ ID NO: 16999 - DNA, 15 bp, Homo sapiens
aggtgacagacagtc

SEQ ID NO: 17000 - DNA, 15 bp, Homo sapiens
taggtgacagacagt

SEQ ID NO: 17001 - DNA, 15 bp, Homo sapiens
ctaggtgacagacag

SEQ ID NO: 17002 - DNA, 15 bp, Homo sapiens
tctaggtgacagaca

SEQ ID NO: 17003 - DNA, 15 bp, Homo sapiens
ctctaggtgacagac

SEQ ID NO: 17004 - DNA, 15 bp, Homo sapiens
tctctaggtgacaga

SEQ ID NO: 17005 - DNA, 15 bp, Homo sapiens
ctctctaggtgacag

SEQ ID NO: 17006 - DNA, 15 bp, Homo sapiens
cctctctaggtgaca

SEQ ID NO: 17007 - DNA, 15 bp, Homo sapiens
ccctctctaggtgac

SEQ ID NO: 17008 - DNA, 15 bp, Homo sapiens
gccctctctaggtga

SEQ ID NO: 17009 - DNA, 15 bp, Homo sapiens
tgccctctctaggtg

SEQ ID NO: 17010 - DNA, 15 bp, Homo sapiens
ctgccctctctaggt

SEQ ID NO: 17011 - DNA, 15 bp, Homo sapiens
cctgccctctctagg

SEQ ID NO: 17012 - DNA, 15 bp, Homo sapiens
acctgccctctctag

SEQ ID NO: 17013 - DNA, 15 bp, Homo sapiens
tacctgccctctcta

SEQ ID NO: 17014 - DNA, 15 bp, Homo sapiens
gtacctgccctctct

SEQ ID NO: 17015 - DNA, 15 bp, Homo sapiens
tgtacctgccctctc

SEQ ID NO: 17016 - DNA, 15 bp, Homo sapiens
gtgtacctgccctct

SEQ ID NO: 17017 - DNA, 15 bp, Homo sapiens
tgtgtacctgccctc

SEQ ID NO: 17018 - DNA, 15 bp, Homo sapiens
ctgtgtacctgccct

SEQ ID NO: 17019 - DNA, 15 bp, Homo sapiens
cctgtgtacctgccc

SEQ ID NO: 17020 - DNA, 15 bp, Homo sapiens
tcctgtgtacctgcc

SEQ ID NO: 17021 - DNA, 15 bp, Homo sapiens
ttcctgtgtacctgc

SEQ ID NO: 17022 - DNA, 15 bp, Homo sapiens
attcctgtgtacctg

SEQ ID NO: 17023 - DNA, 15 bp, Homo sapiens
aattcctgtgtacct

SEQ ID NO: 17024 - DNA, 15 bp, Homo sapiens
aaattcctgtgtacc

SEQ ID NO: 17025 - DNA, 15 bp, Homo sapiens
taaattcctgtgtac

SEQ ID NO: 17026 - DNA, 15 bp, Homo sapiens
ttaaattcctgtgta

SEQ ID NO: 17027 - DNA, 15 bp, Homo sapiens
cttaaattcctgtgt

SEQ ID NO: 17028 - DNA, 15 bp, Homo sapiens
tcttaaattcctgtg

SEQ ID NO: 17029 - DNA, 15 bp, Homo sapiens
ttcttaaattcctgt

SEQ ID NO: 17030 - DNA, 15 bp, Homo sapiens
tttcttaaattcctg

SEQ ID NO: 17031 - DNA, 15 bp, Homo sapiens
ttttcttaaattcct

SEQ ID NO: 17032 - DNA, 15 bp, Homo sapiens
gttttcttaaattcc

SEQ ID NO: 17033 - DNA, 15 bp, Homo sapiens
tgttttcttaaattc

SEQ ID NO: 17034 - DNA, 15 bp, Homo sapiens
ctgttttcttaaatt

SEQ ID NO: 17035 - DNA, 15 bp, Homo sapiens
tctgttttcttaaat

SEQ ID NO: 17036 - DNA, 15 bp, Homo sapiens
atctgttttcttaaa

SEQ ID NO: 17037 - DNA, 15 bp, Homo sapiens
aatctgttttcttaa

SEQ ID NO: 17038 - DNA, 15 bp, Homo sapiens
taatctgttttctta

SEQ ID NO: 17039 - DNA, 15 bp, Homo sapiens
ttaatctgttttctt

SEQ ID NO: 17040 - DNA, 15 bp, Homo sapiens
tttaatctgttttct

SEQ ID NO: 17041 - DNA, 15 bp, Homo sapiens
gtttaatctgttttc

SEQ ID NO: 17042 - DNA, 15 bp, Homo sapiens
tgtttaatctgtttt

SEQ ID NO: 17043 - DNA, 15 bp, Homo sapiens
ctgtttaatctgttt

SEQ ID NO: 17044 - DNA, 15 bp, Homo sapiens
cctgtttaatctgtt

SEQ ID NO: 17045 - DNA, 15 bp, Homo sapiens
gcctgtttaatctgt

SEQ ID NO: 17046 - DNA, 15 bp, Homo sapiens
tgcctgtttaatctg

SEQ ID NO: 17047 - DNA, 15 bp, Homo sapiens
ctgcctgtttaatct

SEQ ID NO: 17048 - DNA, 15 bp, Homo sapiens
actgcctgtttaatc

SEQ ID NO: 17049 - DNA, 15 bp, Homo sapiens
aactgcctgtttaat

SEQ ID NO: 17050 - DNA, 15 bp, Homo sapiens
taactgcctgtttaa

SEQ ID NO: 17051 - DNA, 15 bp, Homo sapiens
gtaactgcctgttta

SEQ ID NO: 17052 - DNA, 15 bp, Homo sapiens
tgtaactgcctgttt

SEQ ID NO: 17053 - DNA, 15 bp, Homo sapiens
gtgtaactgcctgtt

SEQ ID NO: 17054 - DNA, 15 bp, Homo sapiens
tgtgtaactgcctgt

SEQ ID NO: 17055 - DNA, 15 bp, Homo sapiens
ctgtgtaactgcctg

SEQ ID NO: 17056 - DNA, 15 bp, Homo sapiens
actgtgtaactgcct

SEQ ID NO: 17057 - DNA, 15 bp, Homo sapiens
aactgtgtaactgcc

SEQ ID NO: 17058 - DNA, 15 bp, Homo sapiens
caactgtgtaactgc

SEQ ID NO: 17059 - DNA, 15 bp, Homo sapiens
acaactgtgtaactg

SEQ ID NO: 17060 - DNA, 15 bp, Homo sapiens
tacaactgtgtaact

SEQ ID NO: 17061 - DNA, 15 bp, Homo sapiens
ttacaactgtgtaac

SEQ ID NO: 17062 - DNA, 15 bp, Homo sapiens
tttacaactgtgtaa

SEQ ID NO: 17063 - DNA, 15 bp, Homo sapiens
ttttacaactgtgta

SEQ ID NO: 17064 - DNA, 15 bp, Homo sapiens
cttttacaactgtgt

SEQ ID NO: 17065 - DNA, 15 bp, Homo sapiens
acttttacaactgtg

SEQ ID NO: 17066 - DNA, 15 bp, Homo sapiens
tacttttacaactgt

SEQ ID NO: 17067 - DNA, 15 bp, Homo sapiens
ttacttttacaactg

SEQ ID NO: 17068 - DNA, 15 bp, Homo sapiens
tttacttttacaact

SEQ ID NO: 17069 - DNA, 15 bp, Homo sapiens
ttttacttttacaac

SEQ ID NO: 17070 - DNA, 15 bp, Homo sapiens
tttttacttttacaa

SEQ ID NO: 17071 - DNA, 15 bp, Homo sapiens
gtttttacttttaca

SEQ ID NO: 17072 - DNA, 15 bp, Homo sapiens
tgtttttacttttac

SEQ ID NO: 17073 - DNA, 15 bp, Homo sapiens
ctgtttttactttta

SEQ ID NO: 17074 - DNA, 15 bp, Homo sapiens
gctgtttttactttt

SEQ ID NO: 17075 - DNA, 15 bp, Homo sapiens
tgctgtttttacttt

SEQ ID NO: 17076 - DNA, 15 bp, Homo sapiens
gtgctgtttttactt

SEQ ID NO: 17077 - DNA, 15 bp, Homo sapiens
tgtgctgtttttact

SEQ ID NO: 17078 - DNA, 15 bp, Homo sapiens
ctgtgctgtttttac

SEQ ID NO: 17079 - DNA, 15 bp, Homo sapiens
tctgtgctgttttta

SEQ ID NO: 17080 - DNA, 15 bp, Homo sapiens
atctgtgctgttttt

SEQ ID NO: 17081 - DNA, 15 bp, Homo sapiens
aatctgtgctgtttt

SEQ ID NO: 17082 - DNA, 15 bp, Homo sapiens
caatctgtgctgttt

SEQ ID NO: 17083 - DNA, 15 bp, Homo sapiens
gcaatctgtgctgtt

SEQ ID NO: 17084 - DNA, 15 bp, Homo sapiens
agcaatctgtgctgt

SEQ ID NO: 17085 - DNA, 15 bp, Homo sapiens
cagcaatctgtgctg

SEQ ID NO: 17086 - DNA, 15 bp, Homo sapiens
acagcaatctgtgct

SEQ ID NO: 17087 - DNA, 15 bp, Homo sapiens
cacagcaatctgtgc

SEQ ID NO: 17088 - DNA, 15 bp, Homo sapiens
acacagcaatctgtg

SEQ ID NO: 17089 - DNA, 15 bp, Homo sapiens
cacacagcaatctgt

SEQ ID NO: 17090 - DNA, 15 bp, Homo sapiens
tcacacagcaatctg

SEQ ID NO: 17091 - DNA, 15 bp, Homo sapiens
ctcacacagcaatct

SEQ ID NO: 17092 - DNA, 15 bp, Homo sapiens
gctcacacagcaatc

SEQ ID NO: 17093 - DNA, 15 bp, Homo sapiens
agctcacacagcaat

SEQ ID NO: 17094 - DNA, 15 bp, Homo sapiens
gagctcacacagcaa

SEQ ID NO: 17095 - DNA, 15 bp, Homo sapiens
tgagctcacacagca

SEQ ID NO: 17096 - DNA, 15 bp, Homo sapiens
gtgagctcacacagc

SEQ ID NO: 17097 - DNA, 15 bp, Homo sapiens
cgtgagctcacacag

SEQ ID NO: 17098 - DNA, 15 bp, Homo sapiens
ccgtgagctcacaca

SEQ ID NO: 17099 - DNA, 15 bp, Homo sapiens
cccgtgagctcacac

SEQ ID NO: 17100 - DNA, 15 bp, Homo sapiens
tcccgtgagctcaca

SEQ ID NO: 17101 - DNA, 15 bp, Homo sapiens
ctcccgtgagctcac

SEQ ID NO: 17102 - DNA, 15 bp, Homo sapiens
actcccgtgagctca

SEQ ID NO: 17103 - DNA, 15 bp, Homo sapiens
cactcccgtgagctc

SEQ ID NO: 17104 - DNA, 15 bp, Homo sapiens
ccactcccgtgagct

SEQ ID NO: 17105 - DNA, 15 bp, Homo sapiens
accactcccgtgagc

SEQ ID NO: 17106 - DNA, 15 bp, Homo sapiens
taccactcccgtgag

SEQ ID NO: 17107 - DNA, 15 bp, Homo sapiens
gtaccactcccgtga

SEQ ID NO: 17108 - DNA, 15 bp, Homo sapiens
ggtaccactcccgtg

SEQ ID NO: 17109 - DNA, 15 bp, Homo sapiens
aggtaccactcccgt

SEQ ID NO: 17110 - DNA, 15 bp, Homo sapiens
caggtaccactcccg

SEQ ID NO: 17111 - DNA, 15 bp, Homo sapiens
tcaggtaccactccc

SEQ ID NO: 17112 - DNA, 15 bp, Homo sapiens
gtcaggtaccactcc

SEQ ID NO: 17113 - DNA, 15 bp, Homo sapiens
tgtcaggtaccactc

SEQ ID NO: 17114 - DNA, 15 bp, Homo sapiens
atgtcaggtaccact

SEQ ID NO: 17115 - DNA, 15 bp, Homo sapiens
gatgtcaggtaccac

SEQ ID NO: 17116 - DNA, 15 bp, Homo sapiens
ggatgtcaggtacca

SEQ ID NO: 17117 - DNA, 15 bp, Homo sapiens
gggatgtcaggtacc

SEQ ID NO: 17118 - DNA, 15 bp, Homo sapiens
tgggatgtcaggtac

SEQ ID NO: 17119 - DNA, 15 bp, Homo sapiens
ctgggatgtcaggta

SEQ ID NO: 17120 - DNA, 15 bp, Homo sapiens
cctgggatgtcaggt

SEQ ID NO: 17121 - DNA, 15 bp, Homo sapiens
ccctgggatgtcagg

SEQ ID NO: 17122 - DNA, 15 bp, Homo sapiens
gccctgggatgtcag

SEQ ID NO: 17123 - DNA, 15 bp, Homo sapiens
agccctgggatgtca

SEQ ID NO: 17124 - DNA, 15 bp, Homo sapiens
aagccctgggatgtc

SEQ ID NO: 17125 - DNA, 15 bp, Homo sapiens
gaagccctgggatgt

SEQ ID NO: 17126 - DNA, 15 bp, Homo sapiens
tgaagccctgggatg

SEQ ID NO: 17127 - DNA, 15 bp, Homo sapiens
ttgaagccctgggat

SEQ ID NO: 17128 - DNA, 15 bp, Homo sapiens
cttgaagccctggga

SEQ ID NO: 17129 - DNA, 15 bp, Homo sapiens
ccttgaagccctggg

SEQ ID NO: 17130 - DNA, 15 bp, Homo sapiens
tccttgaagccctgg

SEQ ID NO: 17131 - DNA, 15 bp, Homo sapiens
ttccttgaagccctg

SEQ ID NO: 17132 - DNA, 15 bp, Homo sapiens
cttccttgaagccct

SEQ ID NO: 17133 - DNA, 15 bp, Homo sapiens
ccttccttgaagccc

SEQ ID NO: 17134 - DNA, 15 bp, Homo sapiens
gccttccttgaagcc

SEQ ID NO: 17135 - DNA, 15 bp, Homo sapiens
tgccttccttgaagc

SEQ ID NO: 17136 - DNA, 15 bp, Homo sapiens
atgccttccttgaag

SEQ ID NO: 17137 - DNA, 15 bp, Homo sapiens
gatgccttccttgaa

SEQ ID NO: 17138 - DNA, 15 bp, Homo sapiens
agatgccttccttga

SEQ ID NO: 17139 - DNA, 15 bp, Homo sapiens
aagatgccttccttg

SEQ ID NO: 17140 - DNA, 15 bp, Homo sapiens
caagatgccttcctt

SEQ ID NO: 17141 - DNA, 15 bp, Homo sapiens
ccaagatgccttcct

SEQ ID NO: 17142 - DNA, 15 bp, Homo sapiens
tccaagatgccttcc

SEQ ID NO: 17143 - DNA, 15 bp, Homo sapiens
ttccaagatgccttc

SEQ ID NO: 17144 - DNA, 15 bp, Homo sapiens
cttccaagatgcctt

SEQ ID NO: 17145 - DNA, 15 bp, Homo sapiens
tcttccaagatgcct

SEQ ID NO: 17146 - DNA, 15 bp, Homo sapiens
ctcttccaagatgcc

SEQ ID NO: 17147 - DNA, 15 bp, Homo sapiens
actcttccaagatgc

SEQ ID NO: 17148 - DNA, 15 bp, Homo sapiens
cactcttccaagatg

SEQ ID NO: 17149 - DNA, 15 bp, Homo sapiens
ccactcttccaagat

SEQ ID NO: 17150 - DNA, 15 bp, Homo sapiens
tccactcttccaaga

SEQ ID NO: 17151 - DNA, 15 bp, Homo sapiens
atccactcttccaag

SEQ ID NO: 17152 - DNA, 15 bp, Homo sapiens
tatccactcttccaa

SEQ ID NO: 17153 - DNA, 15 bp, Homo sapiens
atatccactcttcca

SEQ ID NO: 17154 - DNA, 15 bp, Homo sapiens
gatatccactcttcc

SEQ ID NO: 17155 - DNA, 15 bp, Homo sapiens
agatatccactcttc

SEQ ID NO: 17156 - DNA, 15 bp, Homo sapiens
tagatatccactctt

SEQ ID NO: 17157 - DNA, 15 bp, Homo sapiens
ttagatatccactct

SEQ ID NO: 17158 - DNA, 15 bp, Homo sapiens
cttagatatccactc

SEQ ID NO: 17159 - DNA, 15 bp, Homo sapiens
gcttagatatccact

SEQ ID NO: 17160 - DNA, 15 bp, Homo sapiens
agcttagatatccac

SEQ ID NO: 17161 - DNA, 15 bp, Homo sapiens
cagcttagatatcca

SEQ ID NO: 17162 - DNA, 15 bp, Homo sapiens
tcagcttagatatcc

SEQ ID NO: 17163 - DNA, 15 bp, Homo sapiens
ctcagcttagatatc

SEQ ID NO: 17164 - DNA, 15 bp, Homo sapiens
tctcagcttagatat

SEQ ID NO: 17165 - DNA, 15 bp, Homo sapiens
atctcagcttagata

SEQ ID NO: 17166 - DNA, 15 bp, Homo sapiens
gatctcagcttagat

SEQ ID NO: 17167 - DNA, 15 bp, Homo sapiens
agatctcagcttaga

SEQ ID NO: 17168 - DNA, 15 bp, Homo sapiens
cagatctcagcttag

SEQ ID NO: 17169 - DNA, 15 bp, Homo sapiens
tcagatctcagctta

SEQ ID NO: 17170 - DNA, 15 bp, Homo sapiens
ttcagatctcagctt

SEQ ID NO: 17171 - DNA, 15 bp, Homo sapiens
tttcagatctcagct

SEQ ID NO: 17172 - DNA, 15 bp, Homo sapiens
ctttcagatctcagc

SEQ ID NO: 17173 - DNA, 15 bp, Homo sapiens
tctttcagatctcag

SEQ ID NO: 17174 - DNA, 15 bp, Homo sapiens
ttctttcagatctca

SEQ ID NO: 17175 - DNA, 15 bp, Homo sapiens
attctttcagatctc

SEQ ID NO: 17176 - DNA, 15 bp, Homo sapiens
cattctttcagatct

SEQ ID NO: 17177 - DNA, 15 bp, Homo sapiens
tcattctttcagatc

SEQ ID NO: 17178 - DNA, 15 bp, Homo sapiens
ctcattctttcagat

SEQ ID NO: 17179 - DNA, 15 bp, Homo sapiens
actcattctttcaga

SEQ ID NO: 17180 - DNA, 15 bp, Homo sapiens
cactcattctttcag

SEQ ID NO: 17181 - DNA, 15 bp, Homo sapiens
ccactcattctttca

SEQ ID NO: 17182 - DNA, 15 bp, Homo sapiens
cccactcattctttc

SEQ ID NO: 17183 - DNA, 15 bp, Homo sapiens
ccccactcattcttt

SEQ ID NO: 17184 - DNA, 15 bp, Homo sapiens
tccccactcattctt

SEQ ID NO: 17185 - DNA, 15 bp, Homo sapiens
atccccactcattct

SEQ ID NO: 17186 - DNA, 15 bp, Homo sapiens
catccccactcattc

SEQ ID NO: 17187 - DNA, 15 bp, Homo sapiens
acatccccactcatt

SEQ ID NO: 17188 - DNA, 15 bp, Homo sapiens
cacatccccactcat

SEQ ID NO: 17189 - DNA, 15 bp, Homo sapiens
ccacatccccactca

SEQ ID NO: 17190 - DNA, 15 bp, Homo sapiens
cccacatccccactc

SEQ ID NO: 17191 - DNA, 15 bp, Homo sapiens
ccccacatccccact

SEQ ID NO: 17192 - DNA, 15 bp, Homo sapiens
tccccacatccccac

SEQ ID NO: 17193 - DNA, 15 bp, Homo sapiens
ctccccacatcccca

SEQ ID NO: 17194 - DNA, 15 bp, Homo sapiens
cctccccacatcccc

SEQ ID NO: 17195 - DNA, 15 bp, Homo sapiens
gcctccccacatccc

SEQ ID NO: 17196 - DNA, 15 bp, Homo sapiens
agcctccccacatcc

SEQ ID NO: 17197 - DNA, 15 bp, Homo sapiens
cagcctccccacatc

SEQ ID NO: 17198 - DNA, 15 bp, Homo sapiens
acagcctccccacat

SEQ ID NO: 17199 - DNA, 15 bp, Homo sapiens
aacagcctccccaca

SEQ ID NO: 17200 - DNA, 15 bp, Homo sapiens
taacagcctccccac

SEQ ID NO: 17201 - DNA, 15 bp, Homo sapiens
ttaacagcctcccca

SEQ ID NO: 17202 - DNA, 15 bp, Homo sapiens
cttaacagcctcccc

SEQ ID NO: 17203 - DNA, 15 bp, Homo sapiens
tcttaacagcctccc

SEQ ID NO: 17204 - DNA, 15 bp, Homo sapiens
gtcttaacagcctcc

SEQ ID NO: 17205 - DNA, 15 bp, Homo sapiens
tgtcttaacagcctc

SEQ ID NO: 17206 - DNA, 15 bp, Homo sapiens
ctgtcttaacagcct

SEQ ID NO: 17207 - DNA, 15 bp, Homo sapiens
tctgtcttaacagcc

SEQ ID NO: 17208 - DNA, 15 bp, Homo sapiens
ctctgtcttaacagc

SEQ ID NO: 17209 - DNA, 15 bp, Homo sapiens
cctctgtcttaacag

SEQ ID NO: 17210 - DNA, 15 bp, Homo sapiens
ccctctgtcttaaca

SEQ ID NO: 17211 - DNA, 15 bp, Homo sapiens
tccctctgtcttaac

SEQ ID NO: 17212 - DNA, 15 bp, Homo sapiens
ctccctctgtcttaa

SEQ ID NO: 17213 - DNA, 15 bp, Homo sapiens
actccctctgtctta

SEQ ID NO: 17214 - DNA, 15 bp, Homo sapiens
aactccctctgtctt

SEQ ID NO: 17215 - DNA, 15 bp, Homo sapiens
caactccctctgtct

SEQ ID NO: 17216 - DNA, 15 bp, Homo sapiens
tcaactccctctgtc

SEQ ID NO: 17217 - DNA, 15 bp, Homo sapiens
atcaactccctctgt

SEQ ID NO: 17218 - DNA, 15 bp, Homo sapiens
catcaactccctctg

SEQ ID NO: 17219 - DNA, 15 bp, Homo sapiens
tcatcaactccctct

SEQ ID NO: 17220 - DNA, 15 bp, Homo sapiens
gtcatcaactccctc

SEQ ID NO: 17221 - DNA, 15 bp, Homo sapiens
tgtcatcaactccct

SEQ ID NO: 17222 - DNA, 15 bp, Homo sapiens
ttgtcatcaactccc

SEQ ID NO: 17223 - DNA, 15 bp, Homo sapiens
cttgtcatcaactcc

SEQ ID NO: 17224 - DNA, 15 bp, Homo sapiens
tcttgtcatcaactc

SEQ ID NO: 17225 - DNA, 15 bp, Homo sapiens
ctcttgtcatcaact

SEQ ID NO: 17226 - DNA, 15 bp, Homo sapiens
cctcttgtcatcaac

SEQ ID NO: 17227 - DNA, 15 bp, Homo sapiens
acctcttgtcatcaa

SEQ ID NO: 17228 - DNA, 15 bp, Homo sapiens
aacctcttgtcatca

SEQ ID NO: 17229 - DNA, 15 bp, Homo sapiens
aaacctcttgtcatc

SEQ ID NO: 17230 - DNA, 15 bp, Homo sapiens
caaacctcttgtcat

SEQ ID NO: 17231 - DNA, 15 bp, Homo sapiens
ccaaacctcttgtca

SEQ ID NO: 17232 - DNA, 15 bp, Homo sapiens
tccaaacctcttgtc

SEQ ID NO: 17233 - DNA, 15 bp, Homo sapiens
ctccaaacctcttgt

SEQ ID NO: 17234 - DNA, 15 bp, Homo sapiens
cctccaaacctcttg

SEQ ID NO: 17235 - DNA, 15 bp, Homo sapiens
acctccaaacctctt

SEQ ID NO: 17236 - DNA, 15 bp, Homo sapiens
cacctccaaacctct

SEQ ID NO: 17237 - DNA, 15 bp, Homo sapiens
tcacctccaaacctc

SEQ ID NO: 17238 - DNA, 15 bp, Homo sapiens
ctcacctccaaacct

SEQ ID NO: 17239 - DNA, 15 bp, Homo sapiens
tctcacctccaaacc

SEQ ID NO: 17240 - DNA, 15 bp, Homo sapiens
ttctcacctccaaac

SEQ ID NO: 17241 - DNA, 15 bp, Homo sapiens
attctcacctccaaa

SEQ ID NO: 17242 - DNA, 15 bp, Homo sapiens
aattctcacctccaa

SEQ ID NO: 17243 - DNA, 15 bp, Homo sapiens
caattctcacctcca

SEQ ID NO: 17244 - DNA, 15 bp, Homo sapiens
acaattctcacctcc

SEQ ID NO: 17245 - DNA, 15 bp, Homo sapiens
cacaattctcacctc

SEQ ID NO: 17246 - DNA, 15 bp, Homo sapiens
tcacaattctcacct

SEQ ID NO: 17247 - DNA, 15 bp, Homo sapiens
ctcacaattctcacc

SEQ ID NO: 17248 - DNA, 15 bp, Homo sapiens
cctcacaattctcac

SEQ ID NO: 17249 - DNA, 15 bp, Homo sapiens
acctcacaattctca

SEQ ID NO: 17250 - DNA, 15 bp, Homo sapiens
aacctcacaattctc

SEQ ID NO: 17251 - DNA, 15 bp, Homo sapiens
aaacctcacaattct

SEQ ID NO: 17252 - DNA, 15 bp, Homo sapiens
aaaacctcacaattc

SEQ ID NO: 17253 - DNA, 15 bp, Homo sapiens
gaaaacctcacaatt

SEQ ID NO: 17254 - DNA, 15 bp, Homo sapiens
tgaaaacctcacaat

SEQ ID NO: 17255 - DNA, 15 bp, Homo sapiens
ttgaaaacctcacaa

SEQ ID NO: 17256 - DNA, 15 bp, Homo sapiens
attgaaaacctcaca

SEQ ID NO: 17257 - DNA, 15 bp, Homo sapiens
tattgaaaacctcac

SEQ ID NO: 17258 - DNA, 15 bp, Homo sapiens
atattgaaaacctca

SEQ ID NO: 17259 - DNA, 15 bp, Homo sapiens
catattgaaaacctc

SEQ ID NO: 17260 - DNA, 15 bp, Homo sapiens
ccatattgaaaacct

SEQ ID NO: 17261 - DNA, 15 bp, Homo sapiens
gccatattgaaaacc

SEQ ID NO: 17262 - DNA, 15 bp, Homo sapiens
agccatattgaaaac

SEQ ID NO: 17263 - DNA, 15 bp, Homo sapiens
tagccatattgaaaa

SEQ ID NO: 17264 - DNA, 15 bp, Homo sapiens
ttagccatattgaaa

SEQ ID NO: 17265 - DNA, 15 bp, Homo sapiens
tttagccatattgaa

SEQ ID NO: 17266 - DNA, 15 bp, Homo sapiens
ctttagccatattga

SEQ ID NO: 17267 - DNA, 15 bp, Homo sapiens
gctttagccatattg

SEQ ID NO: 17268 - DNA, 15 bp, Homo sapiens
tgctttagccatatt

SEQ ID NO: 17269 - DNA, 15 bp, Homo sapiens
ctgctttagccatat

SEQ ID NO: 17270 - DNA, 15 bp, Homo sapiens
cctgctttagccata

SEQ ID NO: 17271 - DNA, 15 bp, Homo sapiens
tcctgctttagccat

SEQ ID NO: 17272 - DNA, 15 bp, Homo sapiens
atcctgctttagcca

SEQ ID NO: 17273 - DNA, 15 bp, Homo sapiens
catcctgctttagcc

SEQ ID NO: 17274 - DNA, 15 bp, Homo sapiens
gcatcctgctttagc

SEQ ID NO: 17275 - DNA, 15 bp, Homo sapiens
agcatcctgctttag

SEQ ID NO: 17276 - DNA, 15 bp, Homo sapiens
cagcatcctgcttta

SEQ ID NO: 17277 - DNA, 15 bp, Homo sapiens
ccagcatcctgcttt

SEQ ID NO: 17278 - DNA, 15 bp, Homo sapiens
tccagcatcctgctt

SEQ ID NO: 17279 - DNA, 15 bp, Homo sapiens
ctccagcatcctgct

SEQ ID NO: 17280 - DNA, 15 bp, Homo sapiens
tctccagcatcctgc

SEQ ID NO: 17281 - DNA, 15 bp, Homo sapiens
ttctccagcatcctg

SEQ ID NO: 17282 - DNA, 15 bp, Homo sapiens
attctccagcatcct

SEQ ID NO: 17283 - DNA, 15 bp, Homo sapiens
cattctccagcatcc

SEQ ID NO: 17284 - DNA, 15 bp, Homo sapiens
tcattctccagcatc

SEQ ID NO: 17285 - DNA, 15 bp, Homo sapiens
ttcattctccagcat

SEQ ID NO: 17286 - DNA, 15 bp, Homo sapiens
cttcattctccagca

SEQ ID NO: 17287 - DNA, 15 bp, Homo sapiens
gcttcattctccagc

SEQ ID NO: 17288 - DNA, 15 bp, Homo sapiens
agcttcattctccag

SEQ ID NO: 17289 - DNA, 15 bp, Homo sapiens
cagcttcattctcca

SEQ ID NO: 17290 - DNA, 15 bp, Homo sapiens
tcagcttcattctcc

SEQ ID NO: 17291 - DNA, 15 bp, Homo sapiens
ctcagcttcattctc

SEQ ID NO: 17292 - DNA, 15 bp, Homo sapiens
tctcagcttcattct

SEQ ID NO: 17293 - DNA, 15 bp, Homo sapiens
ttctcagcttcattc

SEQ ID NO: 17294 - DNA, 15 bp, Homo sapiens
cttctcagcttcatt

SEQ ID NO: 17295 - DNA, 15 bp, Homo sapiens
tcttctcagcttcat

SEQ ID NO: 17296 - DNA, 15 bp, Homo sapiens
ctcttctcagcttca

SEQ ID NO: 17297 - DNA, 15 bp, Homo sapiens
actcttctcagcttc

SEQ ID NO: 17298 - DNA, 15 bp, Homo sapiens
cactcttctcagctt

SEQ ID NO: 17299 - DNA, 15 bp, Homo sapiens
acactcttctcagct

SEQ ID NO: 17300 - DNA, 15 bp, Homo sapiens
aacactcttctcagc

SEQ ID NO: 17301 - DNA, 15 bp, Homo sapiens
taacactcttctcag

SEQ ID NO: 17302 - DNA, 15 bp, Homo sapiens
ataacactcttctca

SEQ ID NO: 17303 - DNA, 15 bp, Homo sapiens
tataacactcttctc

SEQ ID NO: 17304 - DNA, 15 bp, Homo sapiens
ttataacactcttct

SEQ ID NO: 17305 - DNA, 15 bp, Homo sapiens
cttataacactcttc

SEQ ID NO: 17306 - DNA, 15 bp, Homo sapiens
gcttataacactctt

SEQ ID NO: 17307 - DNA, 15 bp, Homo sapiens
ggcttataacactct

SEQ ID NO: 17308 - DNA, 15 bp, Homo sapiens
tggcttataacactc

SEQ ID NO: 17309 - DNA, 15 bp, Homo sapiens
atggcttataacact

SEQ ID NO: 17310 - DNA, 15 bp, Homo sapiens
gatggcttataacac

SEQ ID NO: 17311 - DNA, 15 bp, Homo sapiens
agatggcttataaca

SEQ ID NO: 17312 - DNA, 15 bp, Homo sapiens
aagatggcttataac

SEQ ID NO: 17313 - DNA, 15 bp, Homo sapiens
aaagatggcttataa

SEQ ID NO: 17314 - DNA, 15 bp, Homo sapiens
taaagatggcttata

SEQ ID NO: 17315 - DNA, 15 bp, Homo sapiens
ctaaagatggcttat

SEQ ID NO: 17316 - DNA, 15 bp, Homo sapiens
cctaaagatggctta

SEQ ID NO: 17317 - DNA, 15 bp, Homo sapiens
tcctaaagatggctt

SEQ ID NO: 17318 - DNA, 15 bp, Homo sapiens
ctcctaaagatggct

SEQ ID NO: 17319 - DNA, 15 bp, Homo sapiens
actcctaaagatggc

SEQ ID NO: 17320 - DNA, 15 bp, Homo sapiens
aactcctaaagatgg

SEQ ID NO: 17321 - DNA, 15 bp, Homo sapiens
aaactcctaaagatg

SEQ ID NO: 17322 - DNA, 15 bp, Homo sapiens
caaactcctaaagat

SEQ ID NO: 17323 - DNA, 15 bp, Homo sapiens
tcaaactcctaaaga

SEQ ID NO: 17324 - DNA, 15 bp, Homo sapiens
ctcaaactcctaaag

SEQ ID NO: 17325 - DNA, 15 bp, Homo sapiens
actcaaactcctaaa

SEQ ID NO: 17326 - DNA, 15 bp, Homo sapiens
aactcaaactcctaa

SEQ ID NO: 17327 - DNA, 15 bp, Homo sapiens
caactcaaactccta

SEQ ID NO: 17328 - DNA, 15 bp, Homo sapiens
acaactcaaactcct

SEQ ID NO: 17329 - DNA, 15 bp, Homo sapiens
tacaactcaaactcc

SEQ ID NO: 17330 - DNA, 15 bp, Homo sapiens
atacaactcaaactc

SEQ ID NO: 17331 - DNA, 15 bp, Homo sapiens
gatacaactcaaact

SEQ ID NO: 17332 - DNA, 15 bp, Homo sapiens
ggatacaactcaaac

SEQ ID NO: 17333 - DNA, 15 bp, Homo sapiens
aggatacaactcaaa

SEQ ID NO: 17334 - DNA, 15 bp, Homo sapiens
taggatacaactcaa

SEQ ID NO: 17335 - DNA, 15 bp, Homo sapiens
ttaggatacaactca

SEQ ID NO: 17336 - DNA, 15 bp, Homo sapiens
cttaggatacaactc

SEQ ID NO: 17337 - DNA, 15 bp, Homo sapiens
gcttaggatacaact

SEQ ID NO: 17338 - DNA, 15 bp, Homo sapiens
tgcttaggatacaac

SEQ ID NO: 17339 - DNA, 15 bp, Homo sapiens
atgcttaggatacaa

SEQ ID NO: 17340 - DNA, 15 bp, Homo sapiens
tatgcttaggataca

SEQ ID NO: 17341 - DNA, 15 bp, Homo sapiens
ttatgcttaggatac

SEQ ID NO: 17342 - DNA, 15 bp, Homo sapiens
attatgcttaggata

SEQ ID NO: 17343 - DNA, 15 bp, Homo sapiens
cattatgcttaggat

SEQ ID NO: 17344 - DNA, 15 bp, Homo sapiens
ccattatgcttagga

SEQ ID NO: 17345 - DNA, 15 bp, Homo sapiens
accattatgcttagg

SEQ ID NO: 17346 - DNA, 15 bp, Homo sapiens
caccattatgcttag

SEQ ID NO: 17347 - DNA, 15 bp, Homo sapiens
tcaccattatgctta

SEQ ID NO: 17348 - DNA, 15 bp, Homo sapiens
ttcaccattatgctt

SEQ ID NO: 17349 - DNA, 15 bp, Homo sapiens
attcaccattatgct

SEQ ID NO: 17350 - DNA, 15 bp, Homo sapiens
gattcaccattatgc

SEQ ID NO: 17351 - DNA, 15 bp, Homo sapiens
agattcaccattatg

SEQ ID NO: 17352 - DNA, 15 bp, Homo sapiens
aagattcaccattat

SEQ ID NO: 17353 - DNA, 15 bp, Homo sapiens
aaagattcaccatta

SEQ ID NO: 17354 - DNA, 15 bp, Homo sapiens
caaagattcaccatt

SEQ ID NO: 17355 - DNA, 15 bp, Homo sapiens
tcaaagattcaccat

SEQ ID NO: 17356 - DNA, 15 bp, Homo sapiens
ttcaaagattcacca

SEQ ID NO: 17357 - DNA, 15 bp, Homo sapiens
tttcaaagattcacc

SEQ ID NO: 17358 - DNA, 15 bp, Homo sapiens
ctttcaaagattcac

SEQ ID NO: 17359 - DNA, 15 bp, Homo sapiens
cctttcaaagattca

SEQ ID NO: 17360 - DNA, 15 bp, Homo sapiens
ccctttcaaagattc

SEQ ID NO: 17361 - DNA, 15 bp, Homo sapiens
gccctttcaaagatt

SEQ ID NO: 17362 - DNA, 15 bp, Homo sapiens
agccctttcaaagat

SEQ ID NO: 17363 - DNA, 15 bp, Homo sapiens
aagccctttcaaaga

SEQ ID NO: 17364 - DNA, 15 bp, Homo sapiens
aaagccctttcaaag

SEQ ID NO: 17365 - DNA, 15 bp, Homo sapiens
taaagccctttcaaa

SEQ ID NO: 17366 - DNA, 15 bp, Homo sapiens
ttaaagccctttcaa

SEQ ID NO: 17367 - DNA, 15 bp, Homo sapiens
tttaaagccctttca

SEQ ID NO: 17368 - DNA, 15 bp, Homo sapiens
ttttaaagccctttc

SEQ ID NO: 17369 - DNA, 15 bp, Homo sapiens
attttaaagcccttt

SEQ ID NO: 17370 - DNA, 15 bp, Homo sapiens
aattttaaagccctt

SEQ ID NO: 17371 - DNA, 15 bp, Homo sapiens
taattttaaagccct

SEQ ID NO: 17372 - DNA, 15 bp, Homo sapiens
ttaattttaaagccc

SEQ ID NO: 17373 - DNA, 15 bp, Homo sapiens
tttaattttaaagcc

SEQ ID NO: 17374 - DNA, 15 bp, Homo sapiens
ttttaattttaaagc

SEQ ID NO: 17375 - DNA, 15 bp, Homo sapiens
tttttaattttaaag

SEQ ID NO: 17376 - DNA, 15 bp, Homo sapiens
ttttttaattttaaa

SEQ ID NO: 17377 - DNA, 15 bp, Homo sapiens
tttttttaattttaa

SEQ ID NO: 17378 - DNA, 15 bp, Homo sapiens
atttttttaatttta

SEQ ID NO: 17379 - DNA, 15 bp, Homo sapiens
aatttttttaatttt

SEQ ID NO: 17380 - DNA, 15 bp, Homo sapiens
aaatttttttaattt

SEQ ID NO: 17381 - DNA, 15 bp, Homo sapiens
taaatttttttaatt

SEQ ID NO: 17382 - DNA, 15 bp, Homo sapiens
ataaatttttttaat

SEQ ID NO: 17383 - DNA, 15 bp, Homo sapiens
tataaatttttttaa

SEQ ID NO: 17384 - DNA, 15 bp, Homo sapiens
atataaattttttta

SEQ ID NO: 17385 - DNA, 15 bp, Homo sapiens
aatataaattttttt

SEQ ID NO: 17386 - DNA, 15 bp, Homo sapiens
aaatataaatttttt

SEQ ID NO: 17387 - DNA, 15 bp, Homo sapiens
taaatataaattttt

SEQ ID NO: 17388 - DNA, 15 bp, Homo sapiens
ataaatataaatttt

SEQ ID NO: 17389 - DNA, 15 bp, Homo sapiens
tataaatataaattt

SEQ ID NO: 17390 - DNA, 15 bp, Homo sapiens
atataaatataaatt

SEQ ID NO: 17391 - DNA, 15 bp, Homo sapiens
tatataaatataaat

SEQ ID NO: 17392 - DNA, 15 bp, Homo sapiens
atatataaatataaa

SEQ ID NO: 17393 - DNA, 15 bp, Homo sapiens
aatatataaatataa

SEQ ID NO: 17394 - DNA, 15 bp, Homo sapiens
aaatatataaatata

SEQ ID NO: 17395 - DNA, 15 bp, Homo sapiens
taaatatataaatat

SEQ ID NO: 17396 - DNA, 15 bp, Homo sapiens
ataaatatataaata

SEQ ID NO: 17397 - DNA, 15 bp, Homo sapiens
gataaatatataaat

SEQ ID NO: 17398 - DNA, 15 bp, Homo sapiens
tgataaatatataaa

SEQ ID NO: 17399 - DNA, 15 bp, Homo sapiens
atgataaatatataa

SEQ ID NO: 17400 - DNA, 15 bp, Homo sapiens
aatgataaatatata

SEQ ID NO: 17401 - DNA, 15 bp, Homo sapiens
aaatgataaatatat

SEQ ID NO: 17402 - DNA, 15 bp, Homo sapiens
aaaatgataaatata

SEQ ID NO: 17403 - DNA, 15 bp, Homo sapiens
aaaaatgataaatat

SEQ ID NO: 17404 - DNA, 15 bp, Homo sapiens
taaaaatgataaata

SEQ ID NO: 17405 - DNA, 15 bp, Homo sapiens
ttaaaaatgataaat

SEQ ID NO: 17406 - DNA, 15 bp, Homo sapiens
tttaaaaatgataaa

SEQ ID NO: 17407 - DNA, 15 bp, Homo sapiens
ttttaaaaatgataa

SEQ ID NO: 17408 - DNA, 15 bp, Homo sapiens
attttaaaaatgata

SEQ ID NO: 17409 - DNA, 15 bp, Homo sapiens
aattttaaaaatgat

SEQ ID NO: 17410 - DNA, 15 bp, Homo sapiens
gaattttaaaaatga

SEQ ID NO: 17411 - DNA, 15 bp, Homo sapiens
agaattttaaaaatg

SEQ ID NO: 17412 - DNA, 15 bp, Homo sapiens
cagaattttaaaaat

SEQ ID NO: 17413 - DNA, 15 bp, Homo sapiens
tcagaattttaaaaa

SEQ ID NO: 17414 - DNA, 15 bp, Homo sapiens
cttcagaattttaaa

SEQ ID NO: 17415 - DNA, 15 bp, Homo sapiens
acttcagaattttaa

SEQ ID NO: 17416 - DNA, 15 bp, Homo sapiens
tacttcagaatttta

SEQ ID NO: 17417 - DNA, 15 bp, Homo sapiens
atacttcagaatttt

SEQ ID NO: 17418 - DNA, 15 bp, Homo sapiens
aatacttcagaattt

SEQ ID NO: 17419 - DNA, 15 bp, Homo sapiens
gaatacttcagaatt

SEQ ID NO: 17420 - DNA, 15 bp, Homo sapiens
tgaatacttcagaat

SEQ ID NO: 17421 - DNA, 15 bp, Homo sapiens
ttgaatacttcagaa

SEQ ID NO: 17422 - DNA, 15 bp, Homo sapiens
attgaatacttcaga

SEQ ID NO: 17423 - DNA, 15 bp, Homo sapiens
gattgaatacttcag

SEQ ID NO: 17424 - DNA, 15 bp, Homo sapiens
agattgaatacttca

SEQ ID NO: 17425 - DNA, 15 bp, Homo sapiens
tagattgaatacttc

SEQ ID NO: 17426 - DNA, 15 bp, Homo sapiens
ttagattgaatactt

SEQ ID NO: 17427 - DNA, 15 bp, Homo sapiens
tttagattgaatact

SEQ ID NO: 17428 - DNA, 15 bp, Homo sapiens
ttttagattgaatac

SEQ ID NO: 17429 - DNA, 15 bp, Homo sapiens
tttttagattgaata

SEQ ID NO: 17430 - DNA, 15 bp, Homo sapiens
ttttttagattgaat

SEQ ID NO: 17431 - DNA, 15 bp, Homo sapiens
tttttttagattgaa

SEQ ID NO: 17432 - DNA, 15 bp, Homo sapiens
atttttttagattga

SEQ ID NO: 17433 - DNA, 15 bp, Homo sapiens
catttttttagattg

SEQ ID NO: 17434 - DNA, 15 bp, Homo sapiens
acatttttttagatt

SEQ ID NO: 17435 - DNA, 15 bp, Homo sapiens
tacatttttttagat

SEQ ID NO: 17436 - DNA, 15 bp, Homo sapiens
gtacatttttttaga

SEQ ID NO: 17437 - DNA, 15 bp, Homo sapiens
tgtacatttttttag

SEQ ID NO: 17438 - DNA, 15 bp, Homo sapiens
ctgtacattttttta

SEQ ID NO: 17439 - DNA, 15 bp, Homo sapiens
cctgtacattttttt

SEQ ID NO: 17440 - DNA, 15 bp, Homo sapiens
tcctgtacatttttt

SEQ ID NO: 17441 - DNA, 15 bp, Homo sapiens
ttcctgtacattttt

SEQ ID NO: 17442 - DNA, 15 bp, Homo sapiens
tttcctgtacatttt

SEQ ID NO: 17443 - DNA, 15 bp, Homo sapiens
atttcctgtacattt

SEQ ID NO: 17444 - DNA, 15 bp, Homo sapiens
catttcctgtacatt

SEQ ID NO: 17445 - DNA, 15 bp, Homo sapiens
tcatttcctgtacat

SEQ ID NO: 17446 - DNA, 15 bp, Homo sapiens
atcatttcctgtaca

SEQ ID NO: 17447 - DNA, 15 bp, Homo sapiens
tatcatttcctgtac

SEQ ID NO: 17448 - DNA, 15 bp, Homo sapiens
atatcatttcctgta

SEQ ID NO: 17449 - DNA, 15 bp, Homo sapiens
tatatcatttcctgt

SEQ ID NO: 17450 - DNA, 15 bp, Homo sapiens
atatatcatttcctg

SEQ ID NO: 17451 - DNA, 15 bp, Homo sapiens
gatatatcatttcct

SEQ ID NO: 17452 - DNA, 15 bp, Homo sapiens
tgatatatcatttcc

SEQ ID NO: 17453 - DNA, 15 bp, Homo sapiens
ctgatatatcatttc

SEQ ID NO: 17454 - DNA, 15 bp, Homo sapiens
tctgatatatcattt

SEQ ID NO: 17455 - DNA, 15 bp, Homo sapiens
atctgatatatcatt

SEQ ID NO: 17456 - DNA, 15 bp, Homo sapiens
tatctgatatatcat

SEQ ID NO: 17457 - DNA, 15 bp, Homo sapiens
atatctgatatatca

SEQ ID NO: 17458 - DNA, 15 bp, Homo sapiens
catatctgatatatc

SEQ ID NO: 17459 - DNA, 15 bp, Homo sapiens
gcatatctgatatat

SEQ ID NO: 17460 - DNA, 15 bp, Homo sapiens
agcatatctgatata

SEQ ID NO: 17461 - DNA, 15 bp, Homo sapiens
gagcatatctgatat

SEQ ID NO: 17462 - DNA, 15 bp, Homo sapiens
cgagcatatctgata

SEQ ID NO: 17463 - DNA, 15 bp, Homo sapiens
acgagcatatctgat

SEQ ID NO: 17464 - DNA, 15 bp, Homo sapiens
cacgagcatatctga

SEQ ID NO: 17465 - DNA, 15 bp, Homo sapiens
gcacgagcatatctg

SEQ ID NO: 17466 - DNA, 15 bp, Homo sapiens
ggcacgagcatatct

SEQ ID NO: 17467 - DNA, 15 bp, Homo sapiens
gggcacgagcatatc

SEQ ID NO: 17468 - DNA, 15 bp, Homo sapiens
agggcacgagcatat

SEQ ID NO: 17469 - DNA, 15 bp, Homo sapiens
gagggcacgagcata

SEQ ID NO: 17470 - DNA, 15 bp, Homo sapiens
tgagggcacgagcat

SEQ ID NO: 17471 - DNA, 15 bp, Homo sapiens
atgagggcacgagca

SEQ ID NO: 17472 - DNA, 15 bp, Homo sapiens
aatgagggcacgagc

SEQ ID NO: 17473 - DNA, 15 bp, Homo sapiens
aaatgagggcacgag

SEQ ID NO: 17474 - DNA, 15 bp, Homo sapiens
caaatgagggcacga

SEQ ID NO: 17475 - DNA, 15 bp, Homo sapiens
tcaaatgagggcacg

SEQ ID NO: 17476 - DNA, 15 bp, Homo sapiens
ttcaaatgagggcac

SEQ ID NO: 17477 - DNA, 15 bp, Homo sapiens
tttcaaatgagggca

SEQ ID NO: 17478 - DNA, 15 bp, Homo sapiens
atttcaaatgagggc

SEQ ID NO: 17479 - DNA, 15 bp, Homo sapiens
aatttcaaatgaggg

SEQ ID NO: 17480 - DNA, 15 bp, Homo sapiens
aaatttcaaatgagg

SEQ ID NO: 17481 - DNA, 15 bp, Homo sapiens
taaatttcaaatgag

SEQ ID NO: 17482 - DNA, 15 bp, Homo sapiens
ataaatttcaaatga

SEQ ID NO: 17483 - DNA, 15 bp, Homo sapiens
gataaatttcaaatg

SEQ ID NO: 17484 - DNA, 15 bp, Homo sapiens
tgataaatttcaaat

SEQ ID NO: 17485 - DNA, 15 bp, Homo sapiens
ctgataaatttcaaa

SEQ ID NO: 17486 - DNA, 15 bp, Homo sapiens
gctgataaatttcaa

SEQ ID NO: 17487 - DNA, 15 bp, Homo sapiens
agctgataaatttca

SEQ ID NO: 17488 - DNA, 15 bp, Homo sapiens
cagctgataaatttc

SEQ ID NO: 17489 - DNA, 15 bp, Homo sapiens
acagctgataaattt

SEQ ID NO: 17490 - DNA, 15 bp, Homo sapiens
aacagctgataaatt

SEQ ID NO: 17491 - DNA, 15 bp, Homo sapiens
taacagctgataaat

SEQ ID NO: 17492 - DNA, 15 bp, Homo sapiens
ttaacagctgataaa

SEQ ID NO: 17493 - DNA, 15 bp, Homo sapiens
attaacagctgataa

SEQ ID NO: 17494 - DNA, 15 bp, Homo sapiens
cattaacagctgata

SEQ ID NO: 17495 - DNA, 15 bp, Homo sapiens
acattaacagctgat

SEQ ID NO: 17496 - DNA, 15 bp, Homo sapiens
aacattaacagctga

SEQ ID NO: 17497 - DNA, 15 bp, Homo sapiens
aaacattaacagctg

SEQ ID NO: 17498 - DNA, 15 bp, Homo sapiens
aaaacattaacagct

SEQ ID NO: 17499 - DNA, 15 bp, Homo sapiens
caaaacattaacagc

SEQ ID NO: 17500 - DNA, 15 bp, Homo sapiens
tcaaaacattaacag

SEQ ID NO: 17501 - DNA, 15 bp, Homo sapiens
gtcaaaacattaaca

SEQ ID NO: 17502 - DNA, 15 bp, Homo sapiens
agtcaaaacattaac

SEQ ID NO: 17503 - DNA, 15 bp, Homo sapiens
aagtcaaaacattaa

SEQ ID NO: 17504 - DNA, 15 bp, Homo sapiens
aaagtcaaaacatta

SEQ ID NO: 17505 - DNA, 15 bp, Homo sapiens
aaaagtcaaaacatt

SEQ ID NO: 17506 - DNA, 15 bp, Homo sapiens
aaaaagtcaaaacat

SEQ ID NO: 17507 - DNA, 15 bp, Homo sapiens
aaaaaagtcaaaaca

SEQ ID NO: 17508 - DNA, 15 bp, Homo sapiens
aaaaaaagtcaaaac

SEQ ID NO: 17509 - DNA, 15 bp, Homo sapiens
aaaaaaaagtcaaaa

SEQ ID NO: 17510 - DNA, 15 bp, Homo sapiens
aaaaaaaaagtcaaa

SEQ ID NO: 17511 - DNA, 15 bp, Homo sapiens
aaaaaaaaaagtcaa

SEQ ID NO: 17512 - DNA, 15 bp, Homo sapiens
aaaaaaaaaaagtca

SEQ ID NO: 17513 - DNA, 15 bp, Homo sapiens
aaaaaaaaaaaagtc

SEQ ID NO: 17514 - DNA, 15 bp, Homo sapiens
ttcaaaaaaaaaaaa

SEQ ID NO: 17515 - DNA, 15 bp, Homo sapiens
tttcaaaaaaaaaaa

SEQ ID NO: 17516 - DNA, 15 bp, Homo sapiens
atttcaaaaaaaaaa

SEQ ID NO: 17517 - DNA, 15 bp, Homo sapiens
catttcaaaaaaaaa

SEQ ID NO: 17518 - DNA, 15 bp, Homo sapiens
ccatttcaaaaaaaa

SEQ ID NO: 17519 - DNA, 15 bp, Homo sapiens
tccatttcaaaaaaa

SEQ ID NO: 17520 - DNA, 15 bp, Homo sapiens
ctccatttcaaaaaa

SEQ ID NO: 17521 - DNA, 15 bp, Homo sapiens
actccatttcaaaaa

SEQ ID NO: 17522 - DNA, 15 bp, Homo sapiens
aactccatttcaaaa

SEQ ID NO: 17523 - DNA, 15 bp, Homo sapiens
aaactccatttcaaa

SEQ ID NO: 17524 - DNA, 15 bp, Homo sapiens
gaaactccatttcaa

SEQ ID NO: 17525 - DNA, 15 bp, Homo sapiens
tgaaactccatttca

SEQ ID NO: 17526 - DNA, 15 bp, Homo sapiens
gtgaaactccatttc

SEQ ID NO: 17527 - DNA, 15 bp, Homo sapiens
agtgaaactccattt

SEQ ID NO: 17528 - DNA, 15 bp, Homo sapiens
gagtgaaactccatt

SEQ ID NO: 17529 - DNA, 15 bp, Homo sapiens
agagtgaaactccat

SEQ ID NO: 17530 - DNA, 15 bp, Homo sapiens
aagagtgaaactcca

SEQ ID NO: 17531 - DNA, 15 bp, Homo sapiens
caagagtgaaactcc

SEQ ID NO: 17532 - DNA, 15 bp, Homo sapiens
acaagagtgaaactc

SEQ ID NO: 17533 - DNA, 15 bp, Homo sapiens
aacaagagtgaaact

SEQ ID NO: 17534 - DNA, 15 bp, Homo sapiens
caacaagagtgaaac

SEQ ID NO: 17535 - DNA, 15 bp, Homo sapiens
gcaacaagagtgaaa

SEQ ID NO: 17536 - DNA, 15 bp, Homo sapiens
ggcaacaagagtgaa

SEQ ID NO: 17537 - DNA, 15 bp, Homo sapiens
gggcaacaagagtga

SEQ ID NO: 17538 - DNA, 15 bp, Homo sapiens
tgggcaacaagagtg

SEQ ID NO: 17539 - DNA, 15 bp, Homo sapiens
ctgggcaacaagagt

SEQ ID NO: 17540 - DNA, 15 bp, Homo sapiens
cctgggcaacaagag

SEQ ID NO: 17541 - DNA, 15 bp, Homo sapiens
gcctgggcaacaaga

SEQ ID NO: 17542 - DNA, 15 bp, Homo sapiens
ttgcactccagcctg

SEQ ID NO: 17543 - DNA, 15 bp, Homo sapiens
attgcactccagcct

SEQ ID NO: 17544 - DNA, 15 bp, Homo sapiens
cattgcactccagcc

SEQ ID NO: 17545 - DNA, 15 bp, Homo sapiens
ccattgcactccagc

SEQ ID NO: 17546 - DNA, 15 bp, Homo sapiens
gccattgcactccag

SEQ ID NO: 17547 - DNA, 15 bp, Homo sapiens
cgccattgcactcca

SEQ ID NO: 17548 - DNA, 15 bp, Homo sapiens
gcgccattgcactcc

SEQ ID NO: 17549 - DNA, 15 bp, Homo sapiens
cgcgccattgcactc

SEQ ID NO: 17550 - DNA, 15 bp, Homo sapiens
tcgcgccattgcact

SEQ ID NO: 17551 - DNA, 15 bp, Homo sapiens
atcgcgccattgcac

SEQ ID NO: 17552 - DNA, 15 bp, Homo sapiens
gatcgcgccattgca

SEQ ID NO: 17553 - DNA, 15 bp, Homo sapiens
agatcgcgccattgc

SEQ ID NO: 17554 - DNA, 15 bp, Homo sapiens
gagatcgcgccattg

SEQ ID NO: 17555 - DNA, 15 bp, Homo sapiens
agtgagccgagatcg

SEQ ID NO: 17556 - DNA, 15 bp, Homo sapiens
tagtgagccgagatc

SEQ ID NO: 17557 - DNA, 15 bp, Homo sapiens
gtagtgagccgagat

SEQ ID NO: 17558 - DNA, 15 bp, Homo sapiens
tgtagtgagccgaga

SEQ ID NO: 17559 - DNA, 15 bp, Homo sapiens
ttgtagtgagccgag

SEQ ID NO: 17560 - DNA, 15 bp, Homo sapiens
attgtagtgagccga

SEQ ID NO: 17561 - DNA, 15 bp, Homo sapiens
gattgtagtgagccg

SEQ ID NO: 17562 - DNA, 15 bp, Homo sapiens
agattgtagtgagcc

SEQ ID NO: 17563 - DNA, 15 bp, Homo sapiens
gagattgtagtgagc

SEQ ID NO: 17564 - DNA, 15 bp, Homo sapiens
ggagattgtagtgag

SEQ ID NO: 17565 - DNA, 15 bp, Homo sapiens
gggagattgtagtga

SEQ ID NO: 17566 - DNA, 15 bp, Homo sapiens
ggggagattgtagtg

SEQ ID NO: 17567 - DNA, 15 bp, Homo sapiens
aggggagattgtagt

SEQ ID NO: 17568 - DNA, 15 bp, Homo sapiens
aaggggagattgtag

SEQ ID NO: 17569 - DNA, 15 bp, Homo sapiens
gaaggggagattgta

SEQ ID NO: 17570 - DNA, 15 bp, Homo sapiens
ggaaggggagattgt

SEQ ID NO: 17571 - DNA, 15 bp, Homo sapiens
aggaaggggagattg

SEQ ID NO: 17572 - DNA, 15 bp, Homo sapiens
caggaaggggagatt

SEQ ID NO: 17573 - DNA, 15 bp, Homo sapiens
ccaggaaggggagat

SEQ ID NO: 17574 - DNA, 15 bp, Homo sapiens
cccaggaaggggaga

SEQ ID NO: 17575 - DNA, 15 bp, Homo sapiens
acccaggaaggggag

SEQ ID NO: 17576 - DNA, 15 bp, Homo sapiens
aacccaggaagggga

SEQ ID NO: 17577 - DNA, 15 bp, Homo sapiens
gaacccaggaagggg

SEQ ID NO: 17578 - DNA, 15 bp, Homo sapiens
tgaacccaggaaggg

SEQ ID NO: 17579 - DNA, 15 bp, Homo sapiens
ttgaacccaggaagg

SEQ ID NO: 17580 - DNA, 15 bp, Homo sapiens
tttgaacccaggaag

SEQ ID NO: 17581 - DNA, 15 bp, Homo sapiens
gtttgaacccaggaa

SEQ ID NO: 17582 - DNA, 15 bp, Homo sapiens
tgtttgaacccagga

SEQ ID NO: 17583 - DNA, 15 bp, Homo sapiens
ttgtttgaacccagg

SEQ ID NO: 17584 - DNA, 15 bp, Homo sapiens
attgtttgaacccag

SEQ ID NO: 17585 - DNA, 15 bp, Homo sapiens
aattgtttgaaccca

SEQ ID NO: 17586 - DNA, 15 bp, Homo sapiens
gaattgtttgaaccc

SEQ ID NO: 17587 - DNA, 15 bp, Homo sapiens
agaattgtttgaacc

SEQ ID NO: 17588 - DNA, 15 bp, Homo sapiens
aagaattgtttgaac

SEQ ID NO: 17589 - DNA, 15 bp, Homo sapiens
caagaattgtttgaa

SEQ ID NO: 17590 - DNA, 15 bp, Homo sapiens
acaagaattgtttga

SEQ ID NO: 17591 - DNA, 15 bp, Homo sapiens
cacaagaattgtttg

SEQ ID NO: 17592 - DNA, 15 bp, Homo sapiens
gcacaagaattgttt

SEQ ID NO: 17593 - DNA, 15 bp, Homo sapiens
ggcacaagaattgtt

SEQ ID NO: 17594 - DNA, 15 bp, Homo sapiens
aggcacaagaattgt

SEQ ID NO: 17595 - DNA, 15 bp, Homo sapiens
gaggcacaagaattg

SEQ ID NO: 17596 - DNA, 15 bp, Homo sapiens
tgaggcacaagaatt

SEQ ID NO: 17597 - DNA, 15 bp, Homo sapiens
ctgaggcacaagaat

SEQ ID NO: 17598 - DNA, 15 bp, Homo sapiens
gctgaggcacaagaa

SEQ ID NO: 17599 - DNA, 15 bp, Homo sapiens
ggctgaggcacaaga

SEQ ID NO: 17600 - DNA, 15 bp, Homo sapiens
tggctgaggcacaag

SEQ ID NO: 17601 - DNA, 15 bp, Homo sapiens
gtggctgaggcacaa

SEQ ID NO: 17602 - DNA, 15 bp, Homo sapiens
ggtggctgaggcaca

SEQ ID NO: 17603 - DNA, 15 bp, Homo sapiens
gggtggctgaggcac

SEQ ID NO: 17604 - DNA, 15 bp, Homo sapiens
cgggtggctgaggca

SEQ ID NO: 17605 - DNA, 15 bp, Homo sapiens
tcgggtggctgaggc

SEQ ID NO: 17606 - DNA, 15 bp, Homo sapiens
ttcgggtggctgagg

SEQ ID NO: 17607 - DNA, 15 bp, Homo sapiens
attcgggtggctgag

SEQ ID NO: 17608 - DNA, 15 bp, Homo sapiens
tattcgggtggctga

SEQ ID NO: 17609 - DNA, 15 bp, Homo sapiens
ctattcgggtggctg

SEQ ID NO: 17610 - DNA, 15 bp, Homo sapiens
gctattcgggtggct

SEQ ID NO: 17611 - DNA, 15 bp, Homo sapiens
agctattcgggtggc

SEQ ID NO: 17612 - DNA, 15 bp, Homo sapiens
cagctattcgggtgg

SEQ ID NO: 17613 - DNA, 15 bp, Homo sapiens
tcagctattcgggtg

SEQ ID NO: 17614 - DNA, 15 bp, Homo sapiens
ctcagctattcgggt

SEQ ID NO: 17615 - DNA, 15 bp, Homo sapiens
tctcagctattcggg

SEQ ID NO: 17616 - DNA, 15 bp, Homo sapiens
atctcagctattcgg

SEQ ID NO: 17617 - DNA, 15 bp, Homo sapiens
aatctcagctattcg

SEQ ID NO: 17618 - DNA, 15 bp, Homo sapiens
taatctcagctattc

SEQ ID NO: 17619 - DNA, 15 bp, Homo sapiens
gtaatctcagctatt

SEQ ID NO: 17620 - DNA, 15 bp, Homo sapiens
tgtaatctcagctat

SEQ ID NO: 17621 - DNA, 15 bp, Homo sapiens
ctgtaatctcagcta

SEQ ID NO: 17622 - DNA, 15 bp, Homo sapiens
cctgtaatctcagct

SEQ ID NO: 17623 - DNA, 15 bp, Homo sapiens
gcctgtaatctcagc

SEQ ID NO: 17624 - DNA, 15 bp, Homo sapiens
tgcctgtaatctcag

SEQ ID NO: 17625 - DNA, 15 bp, Homo sapiens
atgcctgtaatctca

SEQ ID NO: 17626 - DNA, 15 bp, Homo sapiens
tatgcctgtaatctc

SEQ ID NO: 17627 - DNA, 15 bp, Homo sapiens
atatgcctgtaatct

SEQ ID NO: 17628 - DNA, 15 bp, Homo sapiens
tatatgcctgtaatc

SEQ ID NO: 17629 - DNA, 15 bp, Homo sapiens
gtatatgcctgtaat

SEQ ID NO: 17630 - DNA, 15 bp, Homo sapiens
ggtatatgcctgtaa

SEQ ID NO: 17631 - DNA, 15 bp, Homo sapiens
tggtatatgcctgta

SEQ ID NO: 17632 - DNA, 15 bp, Homo sapiens
atggtatatgcctgt

SEQ ID NO: 17633 - DNA, 15 bp, Homo sapiens
gatggtatatgcctg

SEQ ID NO: 17634 - DNA, 15 bp, Homo sapiens
tgatggtatatgcct

SEQ ID NO: 17635 - DNA, 15 bp, Homo sapiens
atgatggtatatgcc

SEQ ID NO: 17636 - DNA, 15 bp, Homo sapiens
catgatggtatatgc

SEQ ID NO: 17637 - DNA, 15 bp, Homo sapiens
gcatgatggtatatg

SEQ ID NO: 17638 - DNA, 15 bp, Homo sapiens
ggcatgatggtatat

SEQ ID NO: 17639 - DNA, 15 bp, Homo sapiens
gggcatgatggtata

SEQ ID NO: 17640 - DNA, 15 bp, Homo sapiens
tgggcatgatggtat

SEQ ID NO: 17641 - DNA, 15 bp, Homo sapiens
ctgggcatgatggta

SEQ ID NO: 17642 - DNA, 15 bp, Homo sapiens
gctgggcatgatggt

SEQ ID NO: 17643 - DNA, 15 bp, Homo sapiens
agctgggcatgatgg

SEQ ID NO: 17644 - DNA, 15 bp, Homo sapiens
tagctgggcatgatg

SEQ ID NO: 17645 - DNA, 15 bp, Homo sapiens
ttagctgggcatgat

SEQ ID NO: 17646 - DNA, 15 bp, Homo sapiens
attagctgggcatga

SEQ ID NO: 17647 - DNA, 15 bp, Homo sapiens
aaaaaattagctggg

SEQ ID NO: 17648 - DNA, 15 bp, Homo sapiens
aaaaaaaattagctg

SEQ ID NO: 17649 - DNA, 15 bp, Homo sapiens
caaaaaaaattagct

SEQ ID NO: 17650 - DNA, 15 bp, Homo sapiens
acaaaaaaaattagc

SEQ ID NO: 17651 - DNA, 15 bp, Homo sapiens
tacaaaaaaaattag

SEQ ID NO: 17652 - DNA, 15 bp, Homo sapiens
atacaaaaaaaatta

SEQ ID NO: 17653 - DNA, 15 bp, Homo sapiens
catacaaaaaaaatt

SEQ ID NO: 17654 - DNA, 15 bp, Homo sapiens
acatacaaaaaaaat

SEQ ID NO: 17655 - DNA, 15 bp, Homo sapiens
aacatacaaaaaaaa

SEQ ID NO: 17656 - DNA, 15 bp, Homo sapiens
aaacatacaaaaaaa

SEQ ID NO: 17657 - DNA, 15 bp, Homo sapiens
aaaacatacaaaaaa

SEQ ID NO: 17658 - DNA, 15 bp, Homo sapiens
caaaacatacaaaaa

SEQ ID NO: 17659 - DNA, 15 bp, Homo sapiens
acaaaacatacaaaa

SEQ ID NO: 17660 - DNA, 15 bp, Homo sapiens
tacaaaacatacaaa

SEQ ID NO: 17661 - DNA, 15 bp, Homo sapiens
ctacaaaacatacaa

SEQ ID NO: 17662 - DNA, 15 bp, Homo sapiens
tctacaaaacataca

SEQ ID NO: 17663 - DNA, 15 bp, Homo sapiens
ctctacaaaacatac

SEQ ID NO: 17664 - DNA, 15 bp, Homo sapiens
tctctacaaaacata

SEQ ID NO: 17665 - DNA, 15 bp, Homo sapiens
gtctctacaaaacat

SEQ ID NO: 17666 - DNA, 15 bp, Homo sapiens
tgtctctacaaaaca

SEQ ID NO: 17667 - DNA, 15 bp, Homo sapiens
atgtctctacaaaac

SEQ ID NO: 17668 - DNA, 15 bp, Homo sapiens
catgtctctacaaaa

SEQ ID NO: 17669 - DNA, 15 bp, Homo sapiens
ccatgtctctacaaa

SEQ ID NO: 17670 - DNA, 15 bp, Homo sapiens
accatgtctctacaa

SEQ ID NO: 17671 - DNA, 15 bp, Homo sapiens
aaccatgtctctaca

SEQ ID NO: 17672 - DNA, 15 bp, Homo sapiens
aaaccatgtctctac

SEQ ID NO: 17673 - DNA, 15 bp, Homo sapiens
gaaaccatgtctcta

SEQ ID NO: 17674 - DNA, 15 bp, Homo sapiens
tgaaaccatgtctct

SEQ ID NO: 17675 - DNA, 15 bp, Homo sapiens
gtgaaaccatgtctc

SEQ ID NO: 17676 - DNA, 15 bp, Homo sapiens
ggtgaaaccatgtct

SEQ ID NO: 17677 - DNA, 15 bp, Homo sapiens
tggtgaaaccatgtc

SEQ ID NO: 17678 - DNA, 15 bp, Homo sapiens
atggtgaaaccatgt

SEQ ID NO: 17679 - DNA, 15 bp, Homo sapiens
catggtgaaaccatg

SEQ ID NO: 17680 - DNA, 15 bp, Homo sapiens
acatggtgaaaccat

SEQ ID NO: 17681 - DNA, 15 bp, Homo sapiens
aacatggtgaaacca

SEQ ID NO: 17682 - DNA, 15 bp, Homo sapiens
ttaccagcctggcca

SEQ ID NO: 17683 - DNA, 15 bp, Homo sapiens
attaccagcctggcc

SEQ ID NO: 17684 - DNA, 15 bp, Homo sapiens
cattaccagcctggc

SEQ ID NO: 17685 - DNA, 15 bp, Homo sapiens
acattaccagcctgg

SEQ ID NO: 17686 - DNA, 15 bp, Homo sapiens
aacattaccagcctg

SEQ ID NO: 17687 - DNA, 15 bp, Homo sapiens
aaacattaccagcct

SEQ ID NO: 17688 - DNA, 15 bp, Homo sapiens
aaaacattaccagcc

SEQ ID NO: 17689 - DNA, 15 bp, Homo sapiens
caaaacattaccagc

SEQ ID NO: 17690 - DNA, 15 bp, Homo sapiens
tcaaaacattaccag

SEQ ID NO: 17691 - DNA, 15 bp, Homo sapiens
gtcaaaacattacca

SEQ ID NO: 17692 - DNA, 15 bp, Homo sapiens
cgtcaaaacattacc

SEQ ID NO: 17693 - DNA, 15 bp, Homo sapiens
acgtcaaaacattac

SEQ ID NO: 17694 - DNA, 15 bp, Homo sapiens
tacgtcaaaacatta

SEQ ID NO: 17695 - DNA, 15 bp, Homo sapiens
atacgtcaaaacatt

SEQ ID NO: 17696 - DNA, 15 bp, Homo sapiens
aatacgtcaaaacat

SEQ ID NO: 17697 - DNA, 15 bp, Homo sapiens
aaatacgtcaaaaca

SEQ ID NO: 17698 - DNA, 15 bp, Homo sapiens
caaatacgtcaaaac

SEQ ID NO: 17699 - DNA, 15 bp, Homo sapiens
tcaaatacgtcaaaa

SEQ ID NO: 17700 - DNA, 15 bp, Homo sapiens
atcaaatacgtcaaa

SEQ ID NO: 17701 - DNA, 15 bp, Homo sapiens
aatcaaatacgtcaa

SEQ ID NO: 17702 - DNA, 15 bp, Homo sapiens
aaatcaaatacgtca

SEQ ID NO: 17703 - DNA, 15 bp, Homo sapiens
taaatcaaatacgtc

SEQ ID NO: 17704 - DNA, 15 bp, Homo sapiens
ctaaatcaaatacgt

SEQ ID NO: 17705 - DNA, 15 bp, Homo sapiens
cctaaatcaaatacg

SEQ ID NO: 17706 - DNA, 15 bp, Homo sapiens
acctaaatcaaatac

SEQ ID NO: 17707 - DNA, 15 bp, Homo sapiens
aacctaaatcaaata

SEQ ID NO: 17708 - DNA, 15 bp, Homo sapiens
caacctaaatcaaat

SEQ ID NO: 17709 - DNA, 15 bp, Homo sapiens
acaacctaaatcaaa

SEQ ID NO: 17710 - DNA, 15 bp, Homo sapiens
tacaacctaaatcaa

SEQ ID NO: 17711 - DNA, 15 bp, Homo sapiens
atacaacctaaatca

SEQ ID NO: 17712 - DNA, 15 bp, Homo sapiens
aatacaacctaaatc

SEQ ID NO: 17713 - DNA, 15 bp, Homo sapiens
aaatacaacctaaat

SEQ ID NO: 17714 - DNA, 15 bp, Homo sapiens
aaaatacaacctaaa

SEQ ID NO: 17715 - DNA, 15 bp, Homo sapiens
taaaatacaacctaa

SEQ ID NO: 17716 - DNA, 15 bp, Homo sapiens
ttaaaatacaaccta

SEQ ID NO: 17717 - DNA, 15 bp, Homo sapiens
tttaaaatacaacct

SEQ ID NO: 17718 - DNA, 15 bp, Homo sapiens
ctttaaaatacaacc

SEQ ID NO: 17719 - DNA, 15 bp, Homo sapiens
tctttaaaatacaac

SEQ ID NO: 17720 - DNA, 15 bp, Homo sapiens
ctctttaaaatacaa

SEQ ID NO: 17721 - DNA, 15 bp, Homo sapiens
gctctttaaaataca

SEQ ID NO: 17722 - DNA, 15 bp, Homo sapiens
agctctttaaaatac

SEQ ID NO: 17723 - DNA, 15 bp, Homo sapiens
tagctctttaaaata

SEQ ID NO: 17724 - DNA, 15 bp, Homo sapiens
ttagctctttaaaat

SEQ ID NO: 17725 - DNA, 15 bp, Homo sapiens
attagctctttaaaa

SEQ ID NO: 17726 - DNA, 15 bp, Homo sapiens
aattagctctttaaa

SEQ ID NO: 17727 - DNA, 15 bp, Homo sapiens
taattagctctttaa

SEQ ID NO: 17728 - DNA, 15 bp, Homo sapiens
ataattagctcttta

SEQ ID NO: 17729 - DNA, 15 bp, Homo sapiens
cataattagctcttt

SEQ ID NO: 17730 - DNA, 15 bp, Homo sapiens
acataattagctctt

SEQ ID NO: 17731 - DNA, 15 bp, Homo sapiens
gacataattagctct

SEQ ID NO: 17732 - DNA, 15 bp, Homo sapiens
tgacataattagctc

SEQ ID NO: 17733 - DNA, 15 bp, Homo sapiens
ctgacataattagct

SEQ ID NO: 17734 - DNA, 15 bp, Homo sapiens
gctgacataattagc

SEQ ID NO: 17735 - DNA, 15 bp, Homo sapiens
tgctgacataattag

SEQ ID NO: 17736 - DNA, 15 bp, Homo sapiens
atgctgacataatta

SEQ ID NO: 17737 - DNA, 15 bp, Homo sapiens
tatgctgacataatt

SEQ ID NO: 17738 - DNA, 15 bp, Homo sapiens
ctatgctgacataat

SEQ ID NO: 17739 - DNA, 15 bp, Homo sapiens
tctatgctgacataa

SEQ ID NO: 17740 - DNA, 15 bp, Homo sapiens
atctatgctgacata

SEQ ID NO: 17741 - DNA, 15 bp, Homo sapiens
tatctatgctgacat

SEQ ID NO: 17742 - DNA, 15 bp, Homo sapiens
ttatctatgctgaca

SEQ ID NO: 17743 - DNA, 15 bp, Homo sapiens
tttatctatgctgac

SEQ ID NO: 17744 - DNA, 15 bp, Homo sapiens
atttatctatgctga

SEQ ID NO: 17745 - DNA, 15 bp, Homo sapiens
gatttatctatgctg

SEQ ID NO: 17746 - DNA, 15 bp, Homo sapiens
agatttatctatgct

SEQ ID NO: 17747 - DNA, 15 bp, Homo sapiens
aagatttatctatgc

SEQ ID NO: 17748 - DNA, 15 bp, Homo sapiens
taagatttatctatg

SEQ ID NO: 17749 - DNA, 15 bp, Homo sapiens
ttaagatttatctat

SEQ ID NO: 17750 - DNA, 15 bp, Homo sapiens
tttaagatttatcta

SEQ ID NO: 17751 - DNA, 15 bp, Homo sapiens
ttttaagatttatct

SEQ ID NO: 17752 - DNA, 15 bp, Homo sapiens
tttttaagatttatc

SEQ ID NO: 17753 - DNA, 15 bp, Homo sapiens
gtttttaagatttat

SEQ ID NO: 17754 - DNA, 15 bp, Homo sapiens
tgtttttaagattta

SEQ ID NO: 17755 - DNA, 15 bp, Homo sapiens
ttgtttttaagattt

SEQ ID NO: 17756 - DNA, 15 bp, Homo sapiens
attgtttttaagatt

SEQ ID NO: 17757 - DNA, 15 bp, Homo sapiens
aattgtttttaagat

SEQ ID NO: 17758 - DNA, 15 bp, Homo sapiens
aaattgtttttaaga

SEQ ID NO: 17759 - DNA, 15 bp, Homo sapiens
caaattgtttttaag

SEQ ID NO: 17760 - DNA, 15 bp, Homo sapiens
tcaaattgtttttaa

SEQ ID NO: 17761 - DNA, 15 bp, Homo sapiens
gtcaaattgttttta

SEQ ID NO: 17762 - DNA, 15 bp, Homo sapiens
agtcaaattgttttt

SEQ ID NO: 17763 - DNA, 15 bp, Homo sapiens
tagtcaaattgtttt

SEQ ID NO: 17764 - DNA, 15 bp, Homo sapiens
gtagtcaaattgttt

SEQ ID NO: 17765 - DNA, 15 bp, Homo sapiens
tgtagtcaaattgtt

SEQ ID NO: 17766 - DNA, 15 bp, Homo sapiens
ttgtagtcaaattgt

SEQ ID NO: 17767 - DNA, 15 bp, Homo sapiens
tttgtagtcaaattg

SEQ ID NO: 17768 - DNA, 15 bp, Homo sapiens
gtttgtagtcaaatt

SEQ ID NO: 17769 - DNA, 15 bp, Homo sapiens
tgtttgtagtcaaat

SEQ ID NO: 17770 - DNA, 15 bp, Homo sapiens
ttgtttgtagtcaaa

SEQ ID NO: 17771 - DNA, 15 bp, Homo sapiens
tttgtttgtagtcaa

SEQ ID NO: 17772 - DNA, 15 bp, Homo sapiens
ttttgtttgtagtca

SEQ ID NO: 17773 - DNA, 15 bp, Homo sapiens
tttttgtttgtagtc

SEQ ID NO: 17774 - DNA, 15 bp, Homo sapiens
atttttgtttgtagt

SEQ ID NO: 17775 - DNA, 15 bp, Homo sapiens
gatttttgtttgtag

SEQ ID NO: 17776 - DNA, 15 bp, Homo sapiens
tgatttttgtttgta

SEQ ID NO: 17777 - DNA, 15 bp, Homo sapiens
ctgatttttgtttgt

SEQ ID NO: 17778 - DNA, 15 bp, Homo sapiens
cctgatttttgtttg

SEQ ID NO: 17779 - DNA, 15 bp, Homo sapiens
acctgatttttgttt

SEQ ID NO: 17780 - DNA, 15 bp, Homo sapiens
aacctgatttttgtt

SEQ ID NO: 17781 - DNA, 15 bp, Homo sapiens
caacctgatttttgt

SEQ ID NO: 17782 - DNA, 15 bp, Homo sapiens
gcaacctgatttttg

SEQ ID NO: 17783 - DNA, 15 bp, Homo sapiens
tgcaacctgattttt

SEQ ID NO: 17784 - DNA, 15 bp, Homo sapiens
gtgcaacctgatttt

SEQ ID NO: 17785 - DNA, 15 bp, Homo sapiens
tgtgcaacctgattt

SEQ ID NO: 17786 - DNA, 15 bp, Homo sapiens
ttgtgcaacctgatt

SEQ ID NO: 17787 - DNA, 15 bp, Homo sapiens
attgtgcaacctgat

SEQ ID NO: 17788 - DNA, 15 bp, Homo sapiens
cattgtgcaacctga

SEQ ID NO: 17789 - DNA, 15 bp, Homo sapiens
acattgtgcaacctg

SEQ ID NO: 17790 - DNA, 15 bp, Homo sapiens
tacattgtgcaacct

SEQ ID NO: 17791 - DNA, 15 bp, Homo sapiens
atacattgtgcaacc

SEQ ID NO: 17792 - DNA, 15 bp, Homo sapiens
aatacattgtgcaac

SEQ ID NO: 17793 - DNA, 15 bp, Homo sapiens
caatacattgtgcaa

SEQ ID NO: 17794 - DNA, 15 bp, Homo sapiens
tcaatacattgtgca

SEQ ID NO: 17795 - DNA, 15 bp, Homo sapiens
ttcaatacattgtgc

SEQ ID NO: 17796 - DNA, 15 bp, Homo sapiens
attcaatacattgtg

SEQ ID NO: 17797 - DNA, 15 bp, Homo sapiens
cattcaatacattgt

SEQ ID NO: 17798 - DNA, 15 bp, Homo sapiens
ccattcaatacattg

SEQ ID NO: 17799 - DNA, 15 bp, Homo sapiens
accattcaatacatt

SEQ ID NO: 17800 - DNA, 15 bp, Homo sapiens
taccattcaatacat

SEQ ID NO: 17801 - DNA, 15 bp, Homo sapiens
gtaccattcaataca

SEQ ID NO: 17802 - DNA, 15 bp, Homo sapiens
agtaccattcaatac

SEQ ID NO: 17803 - DNA, 15 bp, Homo sapiens
cagtaccattcaata

SEQ ID NO: 17804 - DNA, 15 bp, Homo sapiens
acagtaccattcaat

SEQ ID NO: 17805 - DNA, 15 bp, Homo sapiens
tacagtaccattcaa

SEQ ID NO: 17806 - DNA, 15 bp, Homo sapiens
atacagtaccattca

SEQ ID NO: 17807 - DNA, 15 bp, Homo sapiens
tatacagtaccattc

SEQ ID NO: 17808 - DNA, 15 bp, Homo sapiens
atatacagtaccatt

SEQ ID NO: 17809 - DNA, 15 bp, Homo sapiens
tatatacagtaccat

SEQ ID NO: 17810 - DNA, 15 bp, Homo sapiens
ttatatacagtacca

SEQ ID NO: 17811 - DNA, 15 bp, Homo sapiens
tttatatacagtacc

SEQ ID NO: 17812 - DNA, 15 bp, Homo sapiens
ctttatatacagtac

SEQ ID NO: 17813 - DNA, 15 bp, Homo sapiens
gctttatatacagta

SEQ ID NO: 17814 - DNA, 15 bp, Homo sapiens
agctttatatacagt

SEQ ID NO: 17815 - DNA, 15 bp, Homo sapiens
gagctttatatacag

SEQ ID NO: 17816 - DNA, 15 bp, Homo sapiens
tgagctttatataca

SEQ ID NO: 17817 - DNA, 15 bp, Homo sapiens
atgagctttatatac

SEQ ID NO: 17818 - DNA, 15 bp, Homo sapiens
tatgagctttatata

SEQ ID NO: 17819 - DNA, 15 bp, Homo sapiens
atatgagctttatat

SEQ ID NO: 17820 - DNA, 15 bp, Homo sapiens
tatatgagctttata

SEQ ID NO: 17821 - DNA, 15 bp, Homo sapiens
gtatatgagctttat

SEQ ID NO: 17822 - DNA, 15 bp, Homo sapiens
ggtatatgagcttta

SEQ ID NO: 17823 - DNA, 15 bp, Homo sapiens
aggtatatgagcttt

SEQ ID NO: 17824 - DNA, 15 bp, Homo sapiens
caggtatatgagctt

SEQ ID NO: 17825 - DNA, 15 bp, Homo sapiens
gcaggtatatgagct

SEQ ID NO: 17826 - DNA, 15 bp, Homo sapiens
tgcaggtatatgagc

SEQ ID NO: 17827 - DNA, 15 bp, Homo sapiens
ctgcaggtatatgag

SEQ ID NO: 17828 - DNA, 15 bp, Homo sapiens
tctgcaggtatatga

SEQ ID NO: 17829 - DNA, 15 bp, Homo sapiens
ttctgcaggtatatg

SEQ ID NO: 17830 - DNA, 15 bp, Homo sapiens
tttctgcaggtatat

SEQ ID NO: 17831 - DNA, 15 bp, Homo sapiens
atttctgcaggtata

SEQ ID NO: 17832 - DNA, 15 bp, Homo sapiens
aatttctgcaggtat

SEQ ID NO: 17833 - DNA, 15 bp, Homo sapiens
caatttctgcaggta

SEQ ID NO: 17834 - DNA, 15 bp, Homo sapiens
gcaatttctgcaggt

SEQ ID NO: 17835 - DNA, 15 bp, Homo sapiens
ggcaatttctgcagg

SEQ ID NO: 17836 - DNA, 15 bp, Homo sapiens
gggcaatttctgcag

SEQ ID NO: 17837 - DNA, 15 bp, Homo sapiens
agggcaatttctgca

SEQ ID NO: 17838 - DNA, 15 bp, Homo sapiens
cagggcaatttctgc

SEQ ID NO: 17839 - DNA, 15 bp, Homo sapiens
gcagggcaatttctg

SEQ ID NO: 17840 - DNA, 15 bp, Homo sapiens
tgcagggcaatttct

SEQ ID NO: 17841 - DNA, 15 bp, Homo sapiens
ctgcagggcaatttc

SEQ ID NO: 17842 - DNA, 15 bp, Homo sapiens
actgcagggcaattt

SEQ ID NO: 17843 - DNA, 15 bp, Homo sapiens
cactgcagggcaatt

SEQ ID NO: 17844 - DNA, 15 bp, Homo sapiens
acactgcagggcaat

SEQ ID NO: 17845 - DNA, 15 bp, Homo sapiens
aacactgcagggcaa

SEQ ID NO: 17846 - DNA, 15 bp, Homo sapiens
aaacactgcagggca

SEQ ID NO: 17847 - DNA, 15 bp, Homo sapiens
taaacactgcagggc

SEQ ID NO: 17848 - DNA, 15 bp, Homo sapiens
ataaacactgcaggg

SEQ ID NO: 17849 - DNA, 15 bp, Homo sapiens
cataaacactgcagg

SEQ ID NO: 17850 - DNA, 15 bp, Homo sapiens
acataaacactgcag

SEQ ID NO: 17851 - DNA, 15 bp, Homo sapiens
tacataaacactgca

SEQ ID NO: 17852 - DNA, 15 bp, Homo sapiens
atacataaacactgc

SEQ ID NO: 17853 - DNA, 15 bp, Homo sapiens
aatacataaacactg

SEQ ID NO: 17854 - DNA, 15 bp, Homo sapiens
gaatacataaacact

SEQ ID NO: 17855 - DNA, 15 bp, Homo sapiens
tgaatacataaacac

SEQ ID NO: 17856 - DNA, 15 bp, Homo sapiens
atgaatacataaaca

SEQ ID NO: 17857 - DNA, 15 bp, Homo sapiens
tatgaatacataaac

SEQ ID NO: 17858 - DNA, 15 bp, Homo sapiens
atatgaatacataaa

SEQ ID NO: 17859 - DNA, 15 bp, Homo sapiens
aatatgaatacataa

SEQ ID NO: 17860 - DNA, 15 bp, Homo sapiens
taatatgaatacata

SEQ ID NO: 17861 - DNA, 15 bp, Homo sapiens
ataatatgaatacat

SEQ ID NO: 17862 - DNA, 15 bp, Homo sapiens
tataatatgaataca

SEQ ID NO: 17863 - DNA, 15 bp, Homo sapiens
ttataatatgaatac

SEQ ID NO: 17864 - DNA, 15 bp, Homo sapiens
tttataatatgaata

SEQ ID NO: 17865 - DNA, 15 bp, Homo sapiens
atttataatatgaat

SEQ ID NO: 17866 - DNA, 15 bp, Homo sapiens
tatttataatatgaa

SEQ ID NO: 17867 - DNA, 15 bp, Homo sapiens
atatttataatatga

SEQ ID NO: 17868 - DNA, 15 bp, Homo sapiens
tatatttataatatg

SEQ ID NO: 17869 - DNA, 15 bp, Homo sapiens
atatatttataatat

SEQ ID NO: 17870 - DNA, 15 bp, Homo sapiens
tatatatttataata

SEQ ID NO: 17871 - DNA, 15 bp, Homo sapiens
ctatatatttataat

SEQ ID NO: 17872 - DNA, 15 bp, Homo sapiens
gctatatatttataa

SEQ ID NO: 17873 - DNA, 15 bp, Homo sapiens
tgctatatatttata

SEQ ID NO: 17874 - DNA, 15 bp, Homo sapiens
ttgctatatatttat

SEQ ID NO: 17875 - DNA, 15 bp, Homo sapiens
tttgctatatattta

SEQ ID NO: 17876 - DNA, 15 bp, Homo sapiens
ttttgctatatattt

SEQ ID NO: 17877 - DNA, 15 bp, Homo sapiens
attttgctatatatt

SEQ ID NO: 17878 - DNA, 15 bp, Homo sapiens
tattttgctatatat

SEQ ID NO: 17879 - DNA, 15 bp, Homo sapiens
gtattttgctatata

SEQ ID NO: 17880 - DNA, 15 bp, Homo sapiens
tgtattttgctatat

SEQ ID NO: 17881 - DNA, 15 bp, Homo sapiens
ttgtattttgctata

SEQ ID NO: 17882 - DNA, 15 bp, Homo sapiens
tttgtattttgctat

SEQ ID NO: 17883 - DNA, 15 bp, Homo sapiens
ttttgtattttgcta

SEQ ID NO: 17884 - DNA, 15 bp, Homo sapiens
tttttgtattttgct

SEQ ID NO: 17885 - DNA, 15 bp, Homo sapiens
atttttgtattttgc

SEQ ID NO: 17886 - DNA, 15 bp, Homo sapiens
aatttttgtattttg

SEQ ID NO: 17887 - DNA, 15 bp, Homo sapiens
aaatttttgtatttt

SEQ ID NO: 17888 - DNA, 15 bp, Homo sapiens
aaaatttttgtattt

SEQ ID NO: 17889 - DNA, 15 bp, Homo sapiens
aaaaatttttgtatt

SEQ ID NO: 17890 - DNA, 15 bp, Homo sapiens
taaaaatttttgtat

SEQ ID NO: 17891 - DNA, 15 bp, Homo sapiens
ataaaaatttttgta

SEQ ID NO: 17892 - DNA, 15 bp, Homo sapiens
cataaaaatttttgt

SEQ ID NO: 17893 - DNA, 15 bp, Homo sapiens
ccataaaaatttttg

SEQ ID NO: 17894 - DNA, 15 bp, Homo sapiens
tccataaaaattttt

SEQ ID NO: 17895 - DNA, 15 bp, Homo sapiens
ttccataaaaatttt

SEQ ID NO: 17896 - DNA, 15 bp, Homo sapiens
tttccataaaaattt

SEQ ID NO: 17897 - DNA, 15 bp, Homo sapiens
atttccataaaaatt

SEQ ID NO: 17898 - DNA, 15 bp, Homo sapiens
aatttccataaaaat

SEQ ID NO: 17899 - DNA, 15 bp, Homo sapiens
taatttccataaaaa

SEQ ID NO: 17900 - DNA, 15 bp, Homo sapiens
ataatttccataaaa

SEQ ID NO: 17901 - DNA, 15 bp, Homo sapiens
tataatttccataaa

SEQ ID NO: 17902 - DNA, 15 bp, Homo sapiens
ttataatttccataa

SEQ ID NO: 17903 - DNA, 15 bp, Homo sapiens
tttataatttccata

SEQ ID NO: 17904 - DNA, 15 bp, Homo sapiens
gtttataatttccat

SEQ ID NO: 17905 - DNA, 15 bp, Homo sapiens
tgtttataatttcca

SEQ ID NO: 17906 - DNA, 15 bp, Homo sapiens
gtgtttataatttcc

SEQ ID NO: 17907 - DNA, 15 bp, Homo sapiens
agtgtttataatttc

SEQ ID NO: 17908 - DNA, 15 bp, Homo sapiens
tagtgtttataattt

SEQ ID NO: 17909 - DNA, 15 bp, Homo sapiens
ctagtgtttataatt

SEQ ID NO: 17910 - DNA, 15 bp, Homo sapiens
tctagtgtttataat

SEQ ID NO: 17911 - DNA, 15 bp, Homo sapiens
atctagtgtttataa

SEQ ID NO: 17912 - DNA, 15 bp, Homo sapiens
aatctagtgtttata

SEQ ID NO: 17913 - DNA, 15 bp, Homo sapiens
aaatctagtgtttat

SEQ ID NO: 17914 - DNA, 15 bp, Homo sapiens
gaaatctagtgttta

SEQ ID NO: 17915 - DNA, 15 bp, Homo sapiens
agaaatctagtgttt

SEQ ID NO: 17916 - DNA, 15 bp, Homo sapiens
aagaaatctagtgtt

SEQ ID NO: 17917 - DNA, 15 bp, Homo sapiens
aaagaaatctagtgt

SEQ ID NO: 17918 - DNA, 15 bp, Homo sapiens
taaagaaatctagtg

SEQ ID NO: 17919 - DNA, 15 bp, Homo sapiens
ctaaagaaatctagt

SEQ ID NO: 17920 - DNA, 15 bp, Homo sapiens
tctaaagaaatctag

SEQ ID NO: 17921 - DNA, 15 bp, Homo sapiens
ctctaaagaaatcta

SEQ ID NO: 17922 - DNA, 15 bp, Homo sapiens
tctctaaagaaatct

SEQ ID NO: 17923 - DNA, 15 bp, Homo sapiens
atctctaaagaaatc

SEQ ID NO: 17924 - DNA, 15 bp, Homo sapiens
tatctctaaagaaat

SEQ ID NO: 17925 - DNA, 15 bp, Homo sapiens
ctatctctaaagaaa

SEQ ID NO: 17926 - DNA, 15 bp, Homo sapiens
actatctctaaagaa

SEQ ID NO: 17927 - DNA, 15 bp, Homo sapiens
cactatctctaaaga

SEQ ID NO: 17928 - DNA, 15 bp, Homo sapiens
tcactatctctaaag

SEQ ID NO: 17929 - DNA, 15 bp, Homo sapiens
ctcactatctctaaa

SEQ ID NO: 17930 - DNA, 15 bp, Homo sapiens
tctcactatctctaa

SEQ ID NO: 17931 - DNA, 15 bp, Homo sapiens
ctctcactatctcta

SEQ ID NO: 17932 - DNA, 15 bp, Homo sapiens
tctctcactatctct

SEQ ID NO: 17933 - DNA, 15 bp, Homo sapiens
ctctctcactatctc

SEQ ID NO: 17934 - DNA, 15 bp, Homo sapiens
cctctctcactatct

SEQ ID NO: 17935 - DNA, 15 bp, Homo sapiens
tcctctctcactatc

SEQ ID NO: 17936 - DNA, 15 bp, Homo sapiens
ctcctctctcactat

SEQ ID NO: 17937 - DNA, 15 bp, Homo sapiens
cctcctctctcacta

SEQ ID NO: 17938 - DNA, 15 bp, Homo sapiens
acctcctctctcact

SEQ ID NO: 17939 - DNA, 15 bp, Homo sapiens
aacctcctctctcac

SEQ ID NO: 17940 - DNA, 15 bp, Homo sapiens
gaacctcctctctca

SEQ ID NO: 17941 - DNA, 15 bp, Homo sapiens
agaacctcctctctc

SEQ ID NO: 17942 - DNA, 15 bp, Homo sapiens
aagaacctcctctct

SEQ ID NO: 17943 - DNA, 15 bp, Homo sapiens
gaagaacctcctctc

SEQ ID NO: 17944 - DNA, 15 bp, Homo sapiens
tgaagaacctcctct

SEQ ID NO: 17945 - DNA, 15 bp, Homo sapiens
ctgaagaacctcctc

SEQ ID NO: 17946 - DNA, 15 bp, Homo sapiens
actgaagaacctcct

SEQ ID NO: 17947 - DNA, 15 bp, Homo sapiens
aactgaagaacctcc

SEQ ID NO: 17948 - DNA, 15 bp, Homo sapiens
aaactgaagaacctc

SEQ ID NO: 17949 - DNA, 15 bp, Homo sapiens
aaaactgaagaacct

SEQ ID NO: 17950 - DNA, 15 bp, Homo sapiens
taaaactgaagaacc

SEQ ID NO: 17951 - DNA, 15 bp, Homo sapiens
ataaaactgaagaac

SEQ ID NO: 17952 - DNA, 15 bp, Homo sapiens
gataaaactgaagaa

SEQ ID NO: 17953 - DNA, 15 bp, Homo sapiens
agataaaactgaaga

SEQ ID NO: 17954 - DNA, 15 bp, Homo sapiens
tagataaaactgaag

SEQ ID NO: 17955 - DNA, 15 bp, Homo sapiens
atagataaaactgaa

SEQ ID NO: 17956 - DNA, 15 bp, Homo sapiens
tatagataaaactga

SEQ ID NO: 17957 - DNA, 15 bp, Homo sapiens
ttatagataaaactg

SEQ ID NO: 17958 - DNA, 15 bp, Homo sapiens
attatagataaaact

SEQ ID NO: 17959 - DNA, 15 bp, Homo sapiens
tattatagataaaac

SEQ ID NO: 17960 - DNA, 15 bp, Homo sapiens
atattatagataaaa

SEQ ID NO: 17961 - DNA, 15 bp, Homo sapiens
aatattatagataaa

SEQ ID NO: 17962 - DNA, 15 bp, Homo sapiens
aaatattatagataa

SEQ ID NO: 17963 - DNA, 15 bp, Homo sapiens
taaatattatagata

SEQ ID NO: 17964 - DNA, 15 bp, Homo sapiens
ttaaatattatagat

SEQ ID NO: 17965 - DNA, 15 bp, Homo sapiens
attaaatattataga

SEQ ID NO: 17966 - DNA, 15 bp, Homo sapiens
aattaaatattatag

SEQ ID NO: 17967 - DNA, 15 bp, Homo sapiens
gaattaaatattata

SEQ ID NO: 17968 - DNA, 15 bp, Homo sapiens
ggaattaaatattat

SEQ ID NO: 17969 - DNA, 15 bp, Homo sapiens
aggaattaaatatta

SEQ ID NO: 17970 - DNA, 15 bp, Homo sapiens
gaggaattaaatatt

SEQ ID NO: 17971 - DNA, 15 bp, Homo sapiens
tgaggaattaaatat

SEQ ID NO: 17972 - DNA, 15 bp, Homo sapiens
ttgaggaattaaata

SEQ ID NO: 17973 - DNA, 15 bp, Homo sapiens
attgaggaattaaat

SEQ ID NO: 17974 - DNA, 15 bp, Homo sapiens
cattgaggaattaaa

SEQ ID NO: 17975 - DNA, 15 bp, Homo sapiens
tcattgaggaattaa

SEQ ID NO: 17976 - DNA, 15 bp, Homo sapiens
ttcattgaggaatta

SEQ ID NO: 17977 - DNA, 15 bp, Homo sapiens
tttcattgaggaatt

SEQ ID NO: 17978 - DNA, 15 bp, Homo sapiens
ttttcattgaggaat

SEQ ID NO: 17979 - DNA, 15 bp, Homo sapiens
attttcattgaggaa

SEQ ID NO: 17980 - DNA, 15 bp, Homo sapiens
tattttcattgagga

SEQ ID NO: 17981 - DNA, 15 bp, Homo sapiens
ctattttcattgagg

SEQ ID NO: 17982 - DNA, 15 bp, Homo sapiens
tctattttcattgag

SEQ ID NO: 17983 - DNA, 15 bp, Homo sapiens
ttctattttcattga

SEQ ID NO: 17984 - DNA, 15 bp, Homo sapiens
tttctattttcattg

SEQ ID NO: 17985 - DNA, 15 bp, Homo sapiens
atttctattttcatt

SEQ ID NO: 17986 - DNA, 15 bp, Homo sapiens
tatttctattttcat

SEQ ID NO: 17987 - DNA, 15 bp, Homo sapiens
ctatttctattttca

SEQ ID NO: 17988 - DNA, 15 bp, Homo sapiens
tctatttctattttc

SEQ ID NO: 17989 - DNA, 15 bp, Homo sapiens
ttctatttctatttt

SEQ ID NO: 17990 - DNA, 15 bp, Homo sapiens
attctatttctattt

SEQ ID NO: 17991 - DNA, 15 bp, Homo sapiens
gattctatttctatt

SEQ ID NO: 17992 - DNA, 15 bp, Homo sapiens
agattctatttctat

SEQ ID NO: 17993 - DNA, 15 bp, Homo sapiens
aagattctatttcta

SEQ ID NO: 17994 - DNA, 15 bp, Homo sapiens
taagattctatttct

SEQ ID NO: 17995 - DNA, 15 bp, Homo sapiens
ttaagattctatttc

SEQ ID NO: 17996 - DNA, 15 bp, Homo sapiens
atttaagattctatt

SEQ ID NO: 17997 - DNA, 15 bp, Homo sapiens
aatttaagattctat

SEQ ID NO: 17998 - DNA, 15 bp, Homo sapiens
taatttaagattcta

SEQ ID NO: 17999 - DNA, 15 bp, Homo sapiens
ttaatttaagattct

SEQ ID NO: 18000 - DNA, 15 bp, Homo sapiens
attaatttaagattc

SEQ ID NO: 18001 - DNA, 15 bp, Homo sapiens
tattaatttaagatt

SEQ ID NO: 18002 - DNA, 15 bp, Homo sapiens
atattaatttaagat

SEQ ID NO: 18003 - DNA, 15 bp, Homo sapiens
catattaatttaaga

SEQ ID NO: 18004 - DNA, 15 bp, Homo sapiens
tcatattaatttaag

SEQ ID NO: 18005 - DNA, 15 bp, Homo sapiens
ttcatattaatttaa

SEQ ID NO: 18006 - DNA, 15 bp, Homo sapiens
tttcatattaattta

SEQ ID NO: 18007 - DNA, 15 bp, Homo sapiens
atttcatattaattt

SEQ ID NO: 18008 - DNA, 15 bp, Homo sapiens
tatttcatattaatt

SEQ ID NO: 18009 - DNA, 15 bp, Homo sapiens
ttatttcatattaat

SEQ ID NO: 18010 - DNA, 15 bp, Homo sapiens
attatttcatattaa

SEQ ID NO: 18011 - DNA, 15 bp, Homo sapiens
cattatttcatatta

SEQ ID NO: 18012 - DNA, 15 bp, Homo sapiens
gcattatttcatatt

SEQ ID NO: 18013 - DNA, 15 bp, Homo sapiens
agcattatttcatat

SEQ ID NO: 18014 - DNA, 15 bp, Homo sapiens
cagcattatttcata

SEQ ID NO: 18015 - DNA, 15 bp, Homo sapiens
tcagcattatttcat

SEQ ID NO: 18016 - DNA, 15 bp, Homo sapiens
atcagcattatttca

SEQ ID NO: 18017 - DNA, 15 bp, Homo sapiens
aatcagcattatttc

SEQ ID NO: 18018 - DNA, 15 bp, Homo sapiens
aaatcagcattattt

SEQ ID NO: 18019 - DNA, 15 bp, Homo sapiens
caaatcagcattatt

SEQ ID NO: 18020 - DNA, 15 bp, Homo sapiens
acaaatcagcattat

SEQ ID NO: 18021 - DNA, 15 bp, Homo sapiens
cacaaatcagcatta

SEQ ID NO: 18022 - DNA, 15 bp, Homo sapiens
tcacaaatcagcatt

SEQ ID NO: 18023 - DNA, 15 bp, Homo sapiens
ttcacaaatcagcat

SEQ ID NO: 18024 - DNA, 15 bp, Homo sapiens
gttcacaaatcagca

SEQ ID NO: 18025 - DNA, 15 bp, Homo sapiens
agttcacaaatcagc

SEQ ID NO: 18026 - DNA, 15 bp, Homo sapiens
cagttcacaaatcag

SEQ ID NO: 18027 - DNA, 15 bp, Homo sapiens
tcagttcacaaatca

SEQ ID NO: 18028 - DNA, 15 bp, Homo sapiens
ctcagttcacaaatc

SEQ ID NO: 18029 - DNA, 15 bp, Homo sapiens
actcagttcacaaat

SEQ ID NO: 18030 - DNA, 15 bp, Homo sapiens
cactcagttcacaaa

SEQ ID NO: 18031 - DNA, 15 bp, Homo sapiens
tcactcagttcacaa

SEQ ID NO: 18032 - DNA, 15 bp, Homo sapiens
atcactcagttcaca

SEQ ID NO: 18033 - DNA, 15 bp, Homo sapiens
catcactcagttcac

SEQ ID NO: 18034 - DNA, 15 bp, Homo sapiens
tcatcactcagttca

SEQ ID NO: 18035 - DNA, 15 bp, Homo sapiens
gtcatcactcagttc

SEQ ID NO: 18036 - DNA, 15 bp, Homo sapiens
agtcatcactcagtt

SEQ ID NO: 18037 - DNA, 15 bp, Homo sapiens
cagtcatcactcagt

SEQ ID NO: 18038 - DNA, 15 bp, Homo sapiens
acagtcatcactcag

SEQ ID NO: 18039 - DNA, 15 bp, Homo sapiens
gacagtcatcactca

SEQ ID NO: 18040 - DNA, 15 bp, Homo sapiens
agacagtcatcactc

SEQ ID NO: 18041 - DNA, 15 bp, Homo sapiens
aagacagtcatcact

SEQ ID NO: 18042 - DNA, 15 bp, Homo sapiens
taagacagtcatcac

SEQ ID NO: 18043 - DNA, 15 bp, Homo sapiens
ttaagacagtcatca

SEQ ID NO: 18044 - DNA, 15 bp, Homo sapiens
cttaagacagtcatc

SEQ ID NO: 18045 - DNA, 15 bp, Homo sapiens
gcttaagacagtcat

SEQ ID NO: 18046 - DNA, 15 bp, Homo sapiens
ggcttaagacagtca

SEQ ID NO: 18047 - DNA, 15 bp, Homo sapiens
gggcttaagacagtc

SEQ ID NO: 18048 - DNA, 15 bp, Homo sapiens
tgggcttaagacagt

SEQ ID NO: 18049 - DNA, 15 bp, Homo sapiens
ctgggcttaagacag

SEQ ID NO: 18050 - DNA, 15 bp, Homo sapiens
actgggcttaagaca

SEQ ID NO: 18051 - DNA, 15 bp, Homo sapiens
aactgggcttaagac

SEQ ID NO: 18052 - DNA, 15 bp, Homo sapiens
gaactgggcttaaga

SEQ ID NO: 18053 - DNA, 15 bp, Homo sapiens
ggaactgggcttaag

SEQ ID NO: 18054 - DNA, 15 bp, Homo sapiens
aggaactgggcttaa

SEQ ID NO: 18055 - DNA, 15 bp, Homo sapiens
aaggaactgggctta

SEQ ID NO: 18056 - DNA, 15 bp, Homo sapiens
caaggaactgggctt

SEQ ID NO: 18057 - DNA, 15 bp, Homo sapiens
ccaaggaactgggct

SEQ ID NO: 18058 - DNA, 15 bp, Homo sapiens
tccaaggaactgggc

SEQ ID NO: 18059 - DNA, 15 bp, Homo sapiens
ttccaaggaactggg

SEQ ID NO: 18060 - DNA, 15 bp, Homo sapiens
cttccaaggaactgg

SEQ ID NO: 18061 - DNA, 15 bp, Homo sapiens
acttccaaggaactg

SEQ ID NO: 18062 - DNA, 15 bp, Homo sapiens
tacttccaaggaact

SEQ ID NO: 18063 - DNA, 15 bp, Homo sapiens
ctacttccaaggaac

SEQ ID NO: 18064 - DNA, 15 bp, Homo sapiens
cctacttccaaggaa

SEQ ID NO: 18065 - DNA, 15 bp, Homo sapiens
tcctacttccaagga

SEQ ID NO: 18066 - DNA, 15 bp, Homo sapiens
atcctacttccaagg

SEQ ID NO: 18067 - DNA, 15 bp, Homo sapiens
aatcctacttccaag

SEQ ID NO: 18068 - DNA, 15 bp, Homo sapiens
aaatcctacttccaa

SEQ ID NO: 18069 - DNA, 15 bp, Homo sapiens
caaatcctacttcca

SEQ ID NO: 18070 - DNA, 15 bp, Homo sapiens
tcaaatcctacttcc

SEQ ID NO: 18071 - DNA, 15 bp, Homo sapiens
ctcaaatcctacttc

SEQ ID NO: 18072 - DNA, 15 bp, Homo sapiens
tctcaaatcctactt

SEQ ID NO: 18073 - DNA, 15 bp, Homo sapiens
gtctcaaatcctact

SEQ ID NO: 18074 - DNA, 15 bp, Homo sapiens
tgtctcaaatcctac

SEQ ID NO: 18075 - DNA, 15 bp, Homo sapiens
ctgtctcaaatccta

SEQ ID NO: 18076 - DNA, 15 bp, Homo sapiens
tctgtctcaaatcct

SEQ ID NO: 18077 - DNA, 15 bp, Homo sapiens
ctctgtctcaaatcc

SEQ ID NO: 18078 - DNA, 15 bp, Homo sapiens
tctctgtctcaaatc

SEQ ID NO: 18079 - DNA, 15 bp, Homo sapiens
atctctgtctcaaat

SEQ ID NO: 18080 - DNA, 15 bp, Homo sapiens
aatctctgtctcaaa

SEQ ID NO: 18081 - DNA, 15 bp, Homo sapiens
aaatctctgtctcaa

SEQ ID NO: 18082 - DNA, 15 bp, Homo sapiens
caaatctctgtctca

SEQ ID NO: 18083 - DNA, 15 bp, Homo sapiens
acaaatctctgtctc

SEQ ID NO: 18084 - DNA, 15 bp, Homo sapiens
cacaaatctctgtct

SEQ ID NO: 18085 - DNA, 15 bp, Homo sapiens
acacaaatctctgtc

SEQ ID NO: 18086 - DNA, 15 bp, Homo sapiens
cacacaaatctctgt

SEQ ID NO: 18087 - DNA, 15 bp, Homo sapiens
gcacacaaatctctg

SEQ ID NO: 18088 - DNA, 15 bp, Homo sapiens
tgcacacaaatctct

SEQ ID NO: 18089 - DNA, 15 bp, Homo sapiens
gtgcacacaaatctc

SEQ ID NO: 18090 - DNA, 15 bp, Homo sapiens
agtgcacacaaatct

SEQ ID NO: 18091 - DNA, 15 bp, Homo sapiens
aagtgcacacaaatc

SEQ ID NO: 18092 - DNA, 15 bp, Homo sapiens
caagtgcacacaaat

SEQ ID NO: 18093 - DNA, 15 bp, Homo sapiens
tcaagtgcacacaaa

SEQ ID NO: 18094 - DNA, 15 bp, Homo sapiens
ctcaagtgcacacaa

SEQ ID NO: 18095 - DNA, 15 bp, Homo sapiens
tctcaagtgcacaca

SEQ ID NO: 18096 - DNA, 15 bp, Homo sapiens
ttctcaagtgcacac

SEQ ID NO: 18097 - DNA, 15 bp, Homo sapiens
gttctcaagtgcaca

SEQ ID NO: 18098 - DNA, 15 bp, Homo sapiens
tgttctcaagtgcac

SEQ ID NO: 18099 - DNA, 15 bp, Homo sapiens
ttgttctcaagtgca

SEQ ID NO: 18100 - DNA, 15 bp, Homo sapiens
attgttctcaagtgc

SEQ ID NO: 18101 - DNA, 15 bp, Homo sapiens
aattgttctcaagtg

SEQ ID NO: 18102 - DNA, 15 bp, Homo sapiens
gaattgttctcaagt

SEQ ID NO: 18103 - DNA, 15 bp, Homo sapiens
ggaattgttctcaag

SEQ ID NO: 18104 - DNA, 15 bp, Homo sapiens
aggaattgttctcaa

SEQ ID NO: 18105 - DNA, 15 bp, Homo sapiens
caggaattgttctca

SEQ ID NO: 18106 - DNA, 15 bp, Homo sapiens
acaggaattgttctc

SEQ ID NO: 18107 - DNA, 15 bp, Homo sapiens
aacaggaattgttct

SEQ ID NO: 18108 - DNA, 15 bp, Homo sapiens
taacaggaattgttc

SEQ ID NO: 18109 - DNA, 15 bp, Homo sapiens
ttaacaggaattgtt

SEQ ID NO: 18110 - DNA, 15 bp, Homo sapiens
attaacaggaattgt

SEQ ID NO: 18111 - DNA, 15 bp, Homo sapiens
cattaacaggaattg

SEQ ID NO: 18112 - DNA, 15 bp, Homo sapiens
tcattaacaggaatt

SEQ ID NO: 18113 - DNA, 15 bp, Homo sapiens
ttcattaacaggaat

SEQ ID NO: 18114 - DNA, 15 bp, Homo sapiens
tttcattaacaggaa

SEQ ID NO: 18115 - DNA, 15 bp, Homo sapiens
ctttcattaacagga

SEQ ID NO: 18116 - DNA, 15 bp, Homo sapiens
tctttcattaacagg

SEQ ID NO: 18117 - DNA, 15 bp, Homo sapiens
ttctttcattaacag

SEQ ID NO: 18118 - DNA, 15 bp, Homo sapiens
tttctttcattaaca

SEQ ID NO: 18119 - DNA, 15 bp, Homo sapiens
atttctttcattaac

SEQ ID NO: 18120 - DNA, 15 bp, Homo sapiens
catttctttcattaa

SEQ ID NO: 18121 - DNA, 15 bp, Homo sapiens
tcatttctttcatta

SEQ ID NO: 18122 - DNA, 15 bp, Homo sapiens
ctcatttctttcatt

SEQ ID NO: 18123 - DNA, 15 bp, Homo sapiens
cctcatttctttcat

SEQ ID NO: 18124 - DNA, 15 bp, Homo sapiens
ccctcatttctttca

SEQ ID NO: 18125 - DNA, 15 bp, Homo sapiens
tccctcatttctttc

SEQ ID NO: 18126 - DNA, 15 bp, Homo sapiens
ttccctcatttcttt

SEQ ID NO: 18127 - DNA, 15 bp, Homo sapiens
cttccctcatttctt

SEQ ID NO: 18128 - DNA, 15 bp, Homo sapiens
tcttccctcatttct

SEQ ID NO: 18129 - DNA, 15 bp, Homo sapiens
ttcttccctcatttc

SEQ ID NO: 18130 - DNA, 15 bp, Homo sapiens
cttcttccctcattt

SEQ ID NO: 18131 - DNA, 15 bp, Homo sapiens
ccttcttccctcatt

SEQ ID NO: 18132 - DNA, 15 bp, Homo sapiens
tccttcttccctcat

SEQ ID NO: 18133 - DNA, 15 bp, Homo sapiens
gtccttcttccctca

SEQ ID NO: 18134 - DNA, 15 bp, Homo sapiens
agtccttcttccctc

SEQ ID NO: 18135 - DNA, 15 bp, Homo sapiens
cagtccttcttccct

SEQ ID NO: 18136 - DNA, 15 bp, Homo sapiens
ccagtccttcttccc

SEQ ID NO: 18137 - DNA, 15 bp, Homo sapiens
cccagtccttcttcc

SEQ ID NO: 18138 - DNA, 15 bp, Homo sapiens
gcccagtccttcttc

SEQ ID NO: 18139 - DNA, 15 bp, Homo sapiens
ggcccagtccttctt

SEQ ID NO: 18140 - DNA, 15 bp, Homo sapiens
tggcccagtccttct

SEQ ID NO: 18141 - DNA, 15 bp, Homo sapiens
ctggcccagtccttc

SEQ ID NO: 18142 - DNA, 15 bp, Homo sapiens
cctggcccagtcctt

SEQ ID NO: 18143 - DNA, 15 bp, Homo sapiens
ccctggcccagtcct

SEQ ID NO: 18144 - DNA, 15 bp, Homo sapiens
tccctggcccagtcc

SEQ ID NO: 18145 - DNA, 15 bp, Homo sapiens
ttccctggcccagtc

SEQ ID NO: 18146 - DNA, 15 bp, Homo sapiens
tttccctggcccagt

SEQ ID NO: 18147 - DNA, 15 bp, Homo sapiens
ttttccctggcccag

SEQ ID NO: 18148 - DNA, 15 bp, Homo sapiens
cttttccctggccca

SEQ ID NO: 18149 - DNA, 15 bp, Homo sapiens
gcttttccctggccc

SEQ ID NO: 18150 - DNA, 15 bp, Homo sapiens
agcttttccctggcc

SEQ ID NO: 18151 - DNA, 15 bp, Homo sapiens
cagcttttccctggc

SEQ ID NO: 18152 - DNA, 15 bp, Homo sapiens
tcagcttttccctgg

SEQ ID NO: 18153 - DNA, 15 bp, Homo sapiens
ttcagcttttccctg

SEQ ID NO: 18154 - DNA, 15 bp, Homo sapiens
cttcagcttttccct

SEQ ID NO: 18155 - DNA, 15 bp, Homo sapiens
acttcagcttttccc

SEQ ID NO: 18156 - DNA, 15 bp, Homo sapiens
cacttcagcttttcc

SEQ ID NO: 18157 - DNA, 15 bp, Homo sapiens
acacttcagcttttc

SEQ ID NO: 18158 - DNA, 15 bp, Homo sapiens
tacacttcagctttt

SEQ ID NO: 18159 - DNA, 15 bp, Homo sapiens
ctacacttcagcttt

SEQ ID NO: 18160 - DNA, 15 bp, Homo sapiens
actacacttcagctt

SEQ ID NO: 18161 - DNA, 15 bp, Homo sapiens
aactacacttcagct

SEQ ID NO: 18162 - DNA, 15 bp, Homo sapiens
caactacacttcagc

SEQ ID NO: 18163 - DNA, 15 bp, Homo sapiens
tcaactacacttcag

SEQ ID NO: 18164 - DNA, 15 bp, Homo sapiens
ctcaactacacttca

SEQ ID NO: 18165 - DNA, 15 bp, Homo sapiens
actcaactacacttc

SEQ ID NO: 18166 - DNA, 15 bp, Homo sapiens
aactcaactacactt

SEQ ID NO: 18167 - DNA, 15 bp, Homo sapiens
taactcaactacact

SEQ ID NO: 18168 - DNA, 15 bp, Homo sapiens
gtaactcaactacac

SEQ ID NO: 18169 - DNA, 15 bp, Homo sapiens
tgtaactcaactaca

SEQ ID NO: 18170 - DNA, 15 bp, Homo sapiens
ctgtaactcaactac

SEQ ID NO: 18171 - DNA, 15 bp, Homo sapiens
gctgtaactcaacta

SEQ ID NO: 18172 - DNA, 15 bp, Homo sapiens
tgctgtaactcaact

SEQ ID NO: 18173 - DNA, 15 bp, Homo sapiens
ctgctgtaactcaac

SEQ ID NO: 18174 - DNA, 15 bp, Homo sapiens
cctgctgtaactcaa

SEQ ID NO: 18175 - DNA, 15 bp, Homo sapiens
ccctgctgtaactca

SEQ ID NO: 18176 - DNA, 15 bp, Homo sapiens
gccctgctgtaactc

SEQ ID NO: 18177 - DNA, 15 bp, Homo sapiens
ggccctgctgtaact

SEQ ID NO: 18178 - DNA, 15 bp, Homo sapiens
tggccctgctgtaac

SEQ ID NO: 18179 - DNA, 15 bp, Homo sapiens
gtggccctgctgtaa

SEQ ID NO: 18180 - DNA, 15 bp, Homo sapiens
ggtggccctgctgta

SEQ ID NO: 18181 - DNA, 15 bp, Homo sapiens
tggtggccctgctgt

SEQ ID NO: 18182 - DNA, 15 bp, Homo sapiens
atggtggccctgctg

SEQ ID NO: 18183 - DNA, 15 bp, Homo sapiens
aatggtggccctgct

SEQ ID NO: 18184 - DNA, 15 bp, Homo sapiens
caatggtggccctgc

SEQ ID NO: 18185 - DNA, 15 bp, Homo sapiens
ccaatggtggccctg

SEQ ID NO: 18186 - DNA, 15 bp, Homo sapiens
tccaatggtggccct

SEQ ID NO: 18187 - DNA, 15 bp, Homo sapiens
atccaatggtggccc

SEQ ID NO: 18188 - DNA, 15 bp, Homo sapiens
gatccaatggtggcc

SEQ ID NO: 18189 - DNA, 15 bp, Homo sapiens
ggatccaatggtggc

SEQ ID NO: 18190 - DNA, 15 bp, Homo sapiens
tggatccaatggtgg

SEQ ID NO: 18191 - DNA, 15 bp, Homo sapiens
atggatccaatggtg

SEQ ID NO: 18192 - DNA, 15 bp, Homo sapiens
tatggatccaatggt

SEQ ID NO: 18193 - DNA, 15 bp, Homo sapiens
ctatggatccaatgg

SEQ ID NO: 18194 - DNA, 15 bp, Homo sapiens
cctatggatccaatg

SEQ ID NO: 18195 - DNA, 15 bp, Homo sapiens
ccctatggatccaat

SEQ ID NO: 18196 - DNA, 15 bp, Homo sapiens
tccctatggatccaa

SEQ ID NO: 18197 - DNA, 15 bp, Homo sapiens
ttccctatggatcca

SEQ ID NO: 18198 - DNA, 15 bp, Homo sapiens
attccctatggatcc

SEQ ID NO: 18199 - DNA, 15 bp, Homo sapiens
cattccctatggatc

SEQ ID NO: 18200 - DNA, 15 bp, Homo sapiens
gcattccctatggat

SEQ ID NO: 18201 - DNA, 15 bp, Homo sapiens
agcattccctatgga

SEQ ID NO: 18202 - DNA, 15 bp, Homo sapiens
cagcattccctatgg

SEQ ID NO: 18203 - DNA, 15 bp, Homo sapiens
ccagcattccctatg

SEQ ID NO: 18204 - DNA, 15 bp, Homo sapiens
accagcattccctat

SEQ ID NO: 18205 - DNA, 15 bp, Homo sapiens
caccagcattcccta

SEQ ID NO: 18206 - DNA, 15 bp, Homo sapiens
gcaccagcattccct

SEQ ID NO: 18207 - DNA, 15 bp, Homo sapiens
agcaccagcattccc

SEQ ID NO: 18208 - DNA, 15 bp, Homo sapiens
cagcaccagcattcc

SEQ ID NO: 18209 - DNA, 15 bp, Homo sapiens
ccagcaccagcattc

SEQ ID NO: 18210 - DNA, 15 bp, Homo sapiens
cccagcaccagcatt

SEQ ID NO: 18211 - DNA, 15 bp, Homo sapiens
tcccagcaccagcat

SEQ ID NO: 18212 - DNA, 15 bp, Homo sapiens
atcccagcaccagca

SEQ ID NO: 18213 - DNA, 15 bp, Homo sapiens
catcccagcaccagc

SEQ ID NO: 18214 - DNA, 15 bp, Homo sapiens
ccatcccagcaccag

SEQ ID NO: 18215 - DNA, 15 bp, Homo sapiens
gccatcccagcacca

SEQ ID NO: 18216 - DNA, 15 bp, Homo sapiens
ggccatcccagcacc

SEQ ID NO: 18217 - DNA, 15 bp, Homo sapiens
gggccatcccagcac

SEQ ID NO: 18218 - DNA, 15 bp, Homo sapiens
agggccatcccagca

SEQ ID NO: 18219 - DNA, 15 bp, Homo sapiens
aagggccatcccagc

SEQ ID NO: 18220 - DNA, 15 bp, Homo sapiens
tgaagggccatccca

SEQ ID NO: 18221 - DNA, 15 bp, Homo sapiens
ctgaagggccatccc

SEQ ID NO: 18222 - DNA, 15 bp, Homo sapiens
tctgaagggccatcc

SEQ ID NO: 18223 - DNA, 15 bp, Homo sapiens
ctctgaagggccatc

SEQ ID NO: 18224 - DNA, 15 bp, Homo sapiens
tctctgaagggccat

SEQ ID NO: 18225 - DNA, 15 bp, Homo sapiens
atctctgaagggcca

SEQ ID NO: 18226 - DNA, 15 bp, Homo sapiens
aatctctgaagggcc

SEQ ID NO: 18227 - DNA, 15 bp, Homo sapiens
aaatctctgaagggc

SEQ ID NO: 18228 - DNA, 15 bp, Homo sapiens
gaaatctctgaaggg

SEQ ID NO: 18229 - DNA, 15 bp, Homo sapiens
ggaaatctctgaagg

SEQ ID NO: 18230 - DNA, 15 bp, Homo sapiens
gggaaatctctgaag

SEQ ID NO: 18231 - DNA, 15 bp, Homo sapiens
tgggaaatctctgaa

SEQ ID NO: 18232 - DNA, 15 bp, Homo sapiens
ttgggaaatctctga

SEQ ID NO: 18233 - DNA, 15 bp, Homo sapiens
gttgggaaatctctg

SEQ ID NO: 18234 - DNA, 15 bp, Homo sapiens
agttgggaaatctct

SEQ ID NO: 18235 - DNA, 15 bp, Homo sapiens
aagttgggaaatctc

SEQ ID NO: 18236 - DNA, 15 bp, Homo sapiens
caagttgggaaatct

SEQ ID NO: 18237 - DNA, 15 bp, Homo sapiens
tcaagttgggaaatc

SEQ ID NO: 18238 - DNA, 15 bp, Homo sapiens
ctcaagttgggaaat

SEQ ID NO: 18239 - DNA, 15 bp, Homo sapiens
cctcaagttgggaaa

SEQ ID NO: 18240 - DNA, 15 bp, Homo sapiens
gcctcaagttgggaa

SEQ ID NO: 18241 - DNA, 15 bp, Homo sapiens
tgcctcaagttggga

SEQ ID NO: 18242 - DNA, 15 bp, Homo sapiens
ttgcctcaagttggg

SEQ ID NO: 18243 - DNA, 15 bp, Homo sapiens
attgcctcaagttgg

SEQ ID NO: 18244 - DNA, 15 bp, Homo sapiens
cattgcctcaagttg

SEQ ID NO: 18245 - DNA, 15 bp, Homo sapiens
acattgcctcaagtt

SEQ ID NO: 18246 - DNA, 15 bp, Homo sapiens
cacattgcctcaagt

SEQ ID NO: 18247 - DNA, 15 bp, Homo sapiens
acacattgcctcaag

SEQ ID NO: 18248 - DNA, 15 bp, Homo sapiens
aacacattgcctcaa

SEQ ID NO: 18249 - DNA, 15 bp, Homo sapiens
caacacattgcctca

SEQ ID NO: 18250 - DNA, 15 bp, Homo sapiens
tcaacacattgcctc

SEQ ID NO: 18251 - DNA, 15 bp, Homo sapiens
ctcaacacattgcct

SEQ ID NO: 18252 - DNA, 15 bp, Homo sapiens
gctcaacacattgcc

SEQ ID NO: 18253 - DNA, 15 bp, Homo sapiens
ggctcaacacattgc

SEQ ID NO: 18254 - DNA, 15 bp, Homo sapiens
aggctcaacacattg

SEQ ID NO: 18255 - DNA, 15 bp, Homo sapiens
caggctcaacacatt

SEQ ID NO: 18256 - DNA, 15 bp, Homo sapiens
ccaggctcaacacat

SEQ ID NO: 18257 - DNA, 15 bp, Homo sapiens
cccaggctcaacaca

SEQ ID NO: 18258 - DNA, 15 bp, Homo sapiens
ccccaggctcaacac

SEQ ID NO: 18259 - DNA, 15 bp, Homo sapiens
tccccaggctcaaca

SEQ ID NO: 18260 - DNA, 15 bp, Homo sapiens
gtccccaggctcaac

SEQ ID NO: 18261 - DNA, 15 bp, Homo sapiens
ggtccccaggctcaa

SEQ ID NO: 18262 - DNA, 15 bp, Homo sapiens
aggtccccaggctca

SEQ ID NO: 18263 - DNA, 15 bp, Homo sapiens
aaggtccccaggctc

SEQ ID NO: 18264 - DNA, 15 bp, Homo sapiens
aaaggtccccaggct

SEQ ID NO: 18265 - DNA, 15 bp, Homo sapiens
caaaggtccccaggc

SEQ ID NO: 18266 - DNA, 15 bp, Homo sapiens
gcaaaggtccccagg

SEQ ID NO: 18267 - DNA, 15 bp, Homo sapiens
ggcaaaggtccccag

SEQ ID NO: 18268 - DNA, 15 bp, Homo sapiens
aggcaaaggtcccca

SEQ ID NO: 18269 - DNA, 15 bp, Homo sapiens
aaggcaaaggtcccc

SEQ ID NO: 18270 - DNA, 15 bp, Homo sapiens
caaggcaaaggtccc

SEQ ID NO: 18271 - DNA, 15 bp, Homo sapiens
tcaaggcaaaggtcc

SEQ ID NO: 18272 - DNA, 15 bp, Homo sapiens
gtcaaggcaaaggtc

SEQ ID NO: 18273 - DNA, 15 bp, Homo sapiens
ggtcaaggcaaaggt

SEQ ID NO: 18274 - DNA, 15 bp, Homo sapiens
tggtcaaggcaaagg

SEQ ID NO: 18275 - DNA, 15 bp, Homo sapiens
ctggtcaaggcaaag

SEQ ID NO: 18276 - DNA, 15 bp, Homo sapiens
actggtcaaggcaaa

SEQ ID NO: 18277 - DNA, 15 bp, Homo sapiens
tactggtcaaggcaa

SEQ ID NO: 18278 - DNA, 15 bp, Homo sapiens
ctactggtcaaggca

SEQ ID NO: 18279 - DNA, 15 bp, Homo sapiens
cctactggtcaaggc

SEQ ID NO: 18280 - DNA, 15 bp, Homo sapiens
gcctactggtcaagg

SEQ ID NO: 18281 - DNA, 15 bp, Homo sapiens
agcctactggtcaag

SEQ ID NO: 18282 - DNA, 15 bp, Homo sapiens
aagcctactggtcaa

SEQ ID NO: 18283 - DNA, 15 bp, Homo sapiens
aaagcctactggtca

SEQ ID NO: 18284 - DNA, 15 bp, Homo sapiens
aaaagcctactggtc

SEQ ID NO: 18285 - DNA, 15 bp, Homo sapiens
caaaagcctactggt

SEQ ID NO: 18286 - DNA, 15 bp, Homo sapiens
ccaaaagcctactgg

SEQ ID NO: 18287 - DNA, 15 bp, Homo sapiens
gccaaaagcctactg

SEQ ID NO: 18288 - DNA, 15 bp, Homo sapiens
agccaaaagcctact

SEQ ID NO: 18289 - DNA, 15 bp, Homo sapiens
cagccaaaagcctac

SEQ ID NO: 18290 - DNA, 15 bp, Homo sapiens
tcagccaaaagccta

SEQ ID NO: 18291 - DNA, 15 bp, Homo sapiens
gtcagccaaaagcct

SEQ ID NO: 18292 - DNA, 15 bp, Homo sapiens
ggtcagccaaaagcc

SEQ ID NO: 18293 - DNA, 15 bp, Homo sapiens
gggtcagccaaaagc

SEQ ID NO: 18294 - DNA, 15 bp, Homo sapiens
agggtcagccaaaag

SEQ ID NO: 18295 - DNA, 15 bp, Homo sapiens
cagggtcagccaaaa

SEQ ID NO: 18296 - DNA, 15 bp, Homo sapiens
ccagggtcagccaaa

SEQ ID NO: 18297 - DNA, 15 bp, Homo sapiens
cccagggtcagccaa

SEQ ID NO: 18298 - DNA, 15 bp, Homo sapiens
tcccagggtcagcca

SEQ ID NO: 18299 - DNA, 15 bp, Homo sapiens
ttcccagggtcagcc

SEQ ID NO: 18300 - DNA, 15 bp, Homo sapiens
cttcccagggtcagc

SEQ ID NO: 18301 - DNA, 15 bp, Homo sapiens
ccttcccagggtcag

SEQ ID NO: 18302 - DNA, 15 bp, Homo sapiens
tccttcccagggtca

SEQ ID NO: 18303 - DNA, 15 bp, Homo sapiens
ctccttcccagggtc

SEQ ID NO: 18304 - DNA, 15 bp, Homo sapiens
cctccttcccagggt

SEQ ID NO: 18305 - DNA, 15 bp, Homo sapiens
acctccttcccaggg

SEQ ID NO: 18306 - DNA, 15 bp, Homo sapiens
cacctccttcccagg

SEQ ID NO: 18307 - DNA, 15 bp, Homo sapiens
tcacctccttcccag

SEQ ID NO: 18308 - DNA, 15 bp, Homo sapiens
ctcacctccttccca

SEQ ID NO: 18309 - DNA, 15 bp, Homo sapiens
cctcacctccttccc

SEQ ID NO: 18310 - DNA, 15 bp, Homo sapiens
acctcacctccttcc

SEQ ID NO: 18311 - DNA, 15 bp, Homo sapiens
cacctcacctccttc

SEQ ID NO: 18312 - DNA, 15 bp, Homo sapiens
tcacctcacctcctt

SEQ ID NO: 18313 - DNA, 15 bp, Homo sapiens
ttcacctcacctcct

SEQ ID NO: 18314 - DNA, 15 bp, Homo sapiens
tttcacctcacctcc

SEQ ID NO: 18315 - DNA, 15 bp, Homo sapiens
ttttcacctcacctc

SEQ ID NO: 18316 - DNA, 15 bp, Homo sapiens
attttcacctcacct

SEQ ID NO: 18317 - DNA, 15 bp, Homo sapiens
gattttcacctcacc

SEQ ID NO: 18318 - DNA, 15 bp, Homo sapiens
agattttcacctcac

SEQ ID NO: 18319 - DNA, 15 bp, Homo sapiens
cagattttcacctca

SEQ ID NO: 18320 - DNA, 15 bp, Homo sapiens
ccagattttcacctc

SEQ ID NO: 18321 - DNA, 15 bp, Homo sapiens
cccagattttcacct

SEQ ID NO: 18322 - DNA, 15 bp, Homo sapiens
gcccagattttcacc

SEQ ID NO: 18323 - DNA, 15 bp, Homo sapiens
tgcccagattttcac

SEQ ID NO: 18324 - DNA, 15 bp, Homo sapiens
ttgcccagattttca

SEQ ID NO: 18325 - DNA, 15 bp, Homo sapiens
cttgcccagattttc

SEQ ID NO: 18326 - DNA, 15 bp, Homo sapiens
ccttgcccagatttt

SEQ ID NO: 18327 - DNA, 15 bp, Homo sapiens
accttgcccagattt

SEQ ID NO: 18328 - DNA, 15 bp, Homo sapiens
taccttgcccagatt

SEQ ID NO: 18329 - DNA, 15 bp, Homo sapiens
ttaccttgcccagat

SEQ ID NO: 18330 - DNA, 15 bp, Homo sapiens
gttaccttgcccaga

SEQ ID NO: 18331 - DNA, 15 bp, Homo sapiens
agttaccttgcccag

SEQ ID NO: 18332 - DNA, 15 bp, Homo sapiens
aagttaccttgccca

SEQ ID NO: 18333 - DNA, 15 bp, Homo sapiens
caagttaccttgccc

SEQ ID NO: 18334 - DNA, 15 bp, Homo sapiens
ccaagttaccttgcc

SEQ ID NO: 18335 - DNA, 15 bp, Homo sapiens
gccaagttaccttgc

SEQ ID NO: 18336 - DNA, 15 bp, Homo sapiens
ggccaagttaccttg

SEQ ID NO: 18337 - DNA, 15 bp, Homo sapiens
tggccaagttacctt

SEQ ID NO: 18338 - DNA, 15 bp, Homo sapiens
ttggccaagttacct

SEQ ID NO: 18339 - DNA, 15 bp, Homo sapiens
cttggccaagttacc

SEQ ID NO: 18340 - DNA, 15 bp, Homo sapiens
ccttggccaagttac

SEQ ID NO: 18341 - DNA, 15 bp, Homo sapiens
cccttggccaagtta

SEQ ID NO: 18342 - DNA, 15 bp, Homo sapiens
gcccttggccaagtt

SEQ ID NO: 18343 - DNA, 15 bp, Homo sapiens
tgcccttggccaagt

SEQ ID NO: 18344 - DNA, 15 bp, Homo sapiens
ctgcccttggccaag

SEQ ID NO: 18345 - DNA, 15 bp, Homo sapiens
actgcccttggccaa

SEQ ID NO: 18346 - DNA, 15 bp, Homo sapiens
aactgcccttggcca

SEQ ID NO: 18347 - DNA, 15 bp, Homo sapiens
gaactgcccttggcc

SEQ ID NO: 18348 - DNA, 15 bp, Homo sapiens
ggaactgcccttggc

SEQ ID NO: 18349 - DNA, 15 bp, Homo sapiens
aggaactgcccttgg

SEQ ID NO: 18350 - DNA, 15 bp, Homo sapiens
caggaactgcccttg

SEQ ID NO: 18351 - DNA, 15 bp, Homo sapiens
ccaggaactgccctt

SEQ ID NO: 18352 - DNA, 15 bp, Homo sapiens
tccaggaactgccct

SEQ ID NO: 18353 - DNA, 15 bp, Homo sapiens
gtccaggaactgccc

SEQ ID NO: 18354 - DNA, 15 bp, Homo sapiens
cgtccaggaactgcc

SEQ ID NO: 18355 - DNA, 15 bp, Homo sapiens
ccgtccaggaactgc

SEQ ID NO: 18356 - DNA, 15 bp, Homo sapiens
tccgtccaggaactg

SEQ ID NO: 18357 - DNA, 15 bp, Homo sapiens
atccgtccaggaact

SEQ ID NO: 18358 - DNA, 15 bp, Homo sapiens
catccgtccaggaac

SEQ ID NO: 18359 - DNA, 15 bp, Homo sapiens
gcatccgtccaggaa

SEQ ID NO: 18360 - DNA, 15 bp, Homo sapiens
agcatccgtccagga

SEQ ID NO: 18361 - DNA, 15 bp, Homo sapiens
gagcatccgtccagg

SEQ ID NO: 18362 - DNA, 15 bp, Homo sapiens
tgagcatccgtccag

SEQ ID NO: 18363 - DNA, 15 bp, Homo sapiens
ctgagcatccgtcca

SEQ ID NO: 18364 - DNA, 15 bp, Homo sapiens
gctgagcatccgtcc

SEQ ID NO: 18365 - DNA, 15 bp, Homo sapiens
agctgagcatccgtc

SEQ ID NO: 18366 - DNA, 15 bp, Homo sapiens
tagctgagcatccgt

SEQ ID NO: 18367 - DNA, 15 bp, Homo sapiens
atagctgagcatccg

SEQ ID NO: 18368 - DNA, 15 bp, Homo sapiens
catagctgagcatcc

SEQ ID NO: 18369 - DNA, 15 bp, Homo sapiens
tcatagctgagcatc

SEQ ID NO: 18370 - DNA, 15 bp, Homo sapiens
ctcatagctgagcat

SEQ ID NO: 18371 - DNA, 15 bp, Homo sapiens
gctcatagctgagca

SEQ ID NO: 18372 - DNA, 15 bp, Homo sapiens
ggctcatagctgagc

SEQ ID NO: 18373 - DNA, 15 bp, Homo sapiens
gggctcatagctgag

SEQ ID NO: 18374 - DNA, 15 bp, Homo sapiens
agggctcatagctga

SEQ ID NO: 18375 - DNA, 15 bp, Homo sapiens
gagggctcatagctg

SEQ ID NO: 18376 - DNA, 15 bp, Homo sapiens
tgagggctcatagct

SEQ ID NO: 18377 - DNA, 15 bp, Homo sapiens
ctgagggctcatagc

SEQ ID NO: 18378 - DNA, 15 bp, Homo sapiens
gctgagggctcatag

SEQ ID NO: 18379 - DNA, 15 bp, Homo sapiens
agctgagggctcata

SEQ ID NO: 18380 - DNA, 15 bp, Homo sapiens
cagctgagggctcat

SEQ ID NO: 18381 - DNA, 15 bp, Homo sapiens
gcagctgagggctca

SEQ ID NO: 18382 - DNA, 15 bp, Homo sapiens
agcagctgagggctc

SEQ ID NO: 18383 - DNA, 15 bp, Homo sapiens
cagcagctgagggct

SEQ ID NO: 18384 - DNA, 15 bp, Homo sapiens
ccagcagctgagggc

SEQ ID NO: 18385 - DNA, 15 bp, Homo sapiens
cccagcagctgaggg

SEQ ID NO: 18386 - DNA, 15 bp, Homo sapiens
ccccagcagctgagg

SEQ ID NO: 18387 - DNA, 15 bp, Homo sapiens
cccccagcagctgag

SEQ ID NO: 18388 - DNA, 15 bp, Homo sapiens
tcccccagcagctga

SEQ ID NO: 18389 - DNA, 15 bp, Homo sapiens
ttcccccagcagctg

SEQ ID NO: 18390 - DNA, 15 bp, Homo sapiens
attcccccagcagct

SEQ ID NO: 18391 - DNA, 15 bp, Homo sapiens
cattcccccagcagc

SEQ ID NO: 18392 - DNA, 15 bp, Homo sapiens
tcattcccccagcag

SEQ ID NO: 18393 - DNA, 15 bp, Homo sapiens
ttcattcccccagca

SEQ ID NO: 18394 - DNA, 15 bp, Homo sapiens
attcattcccccagc

SEQ ID NO: 18395 - DNA, 15 bp, Homo sapiens
aattcattcccccag

SEQ ID NO: 18396 - DNA, 15 bp, Homo sapiens
aaattcattccccca

SEQ ID NO: 18397 - DNA, 15 bp, Homo sapiens
caaattcattccccc

SEQ ID NO: 18398 - DNA, 15 bp, Homo sapiens
acaaattcattcccc

SEQ ID NO: 18399 - DNA, 15 bp, Homo sapiens
cacaaattcattccc

SEQ ID NO: 18400 - DNA, 15 bp, Homo sapiens
gcacaaattcattcc

SEQ ID NO: 18401 - DNA, 15 bp, Homo sapiens
tgcacaaattcattc

SEQ ID NO: 18402 - DNA, 15 bp, Homo sapiens
atgcacaaattcatt

SEQ ID NO: 18403 - DNA, 15 bp, Homo sapiens
aatgcacaaattcat

SEQ ID NO: 18404 - DNA, 15 bp, Homo sapiens
caatgcacaaattca

SEQ ID NO: 18405 - DNA, 15 bp, Homo sapiens
gcaatgcacaaattc

SEQ ID NO: 18406 - DNA, 15 bp, Homo sapiens
ggcaatgcacaaatt

SEQ ID NO: 18407 - DNA, 15 bp, Homo sapiens
aggcaatgcacaaat

SEQ ID NO: 18408 - DNA, 15 bp, Homo sapiens
aaggcaatgcacaaa

SEQ ID NO: 18409 - DNA, 15 bp, Homo sapiens
caaggcaatgcacaa

SEQ ID NO: 18410 - DNA, 15 bp, Homo sapiens
gcaaggcaatgcaca

SEQ ID NO: 18411 - DNA, 15 bp, Homo sapiens
ggcaaggcaatgcac

SEQ ID NO: 18412 - DNA, 15 bp, Homo sapiens
aggcaaggcaatgca

SEQ ID NO: 18413 - DNA, 15 bp, Homo sapiens
caggcaaggcaatgc

SEQ ID NO: 18414 - DNA, 15 bp, Homo sapiens
tcaggcaaggcaatg

SEQ ID NO: 18415 - DNA, 15 bp, Homo sapiens
ttcaggcaaggcaat

SEQ ID NO: 18416 - DNA, 15 bp, Homo sapiens
tttcaggcaaggcaa

SEQ ID NO: 18417 - DNA, 15 bp, Homo sapiens
ctttcaggcaaggca

SEQ ID NO: 18418 - DNA, 15 bp, Homo sapiens
cctttcaggcaaggc

SEQ ID NO: 18419 - DNA, 15 bp, Homo sapiens
gcctttcaggcaagg

SEQ ID NO: 18420 - DNA, 15 bp, Homo sapiens
tgcctttcaggcaag

SEQ ID NO: 18421 - DNA, 15 bp, Homo sapiens
ctgcctttcaggcaa

SEQ ID NO: 18422 - DNA, 15 bp, Homo sapiens
tctgcctttcaggca

SEQ ID NO: 18423 - DNA, 15 bp, Homo sapiens
atctgcctttcaggc

SEQ ID NO: 18424 - DNA, 15 bp, Homo sapiens
gatctgcctttcagg

SEQ ID NO: 18425 - DNA, 15 bp, Homo sapiens
agatctgcctttcag

SEQ ID NO: 18426 - DNA, 15 bp, Homo sapiens
cagatctgcctttca

SEQ ID NO: 18427 - DNA, 15 bp, Homo sapiens
ccagatctgcctttc

SEQ ID NO: 18428 - DNA, 15 bp, Homo sapiens
tccagatctgccttt

SEQ ID NO: 18429 - DNA, 15 bp, Homo sapiens
atccagatctgcctt

SEQ ID NO: 18430 - DNA, 15 bp, Homo sapiens
tatccagatctgcct

SEQ ID NO: 18431 - DNA, 15 bp, Homo sapiens
ctatccagatctgcc

SEQ ID NO: 18432 - DNA, 15 bp, Homo sapiens
cctatccagatctgc

SEQ ID NO: 18433 - DNA, 15 bp, Homo sapiens
tcctatccagatctg

SEQ ID NO: 18434 - DNA, 15 bp, Homo sapiens
ctcctatccagatct

SEQ ID NO: 18435 - DNA, 15 bp, Homo sapiens
tctcctatccagatc

SEQ ID NO: 18436 - DNA, 15 bp, Homo sapiens
atctcctatccagat

SEQ ID NO: 18437 - DNA, 15 bp, Homo sapiens
aatctcctatccaga

SEQ ID NO: 18438 - DNA, 15 bp, Homo sapiens
gaatctcctatccag

SEQ ID NO: 18439 - DNA, 15 bp, Homo sapiens
tgaatctcctatcca

SEQ ID NO: 18440 - DNA, 15 bp, Homo sapiens
gtgaatctcctatcc

SEQ ID NO: 18441 - DNA, 15 bp, Homo sapiens
agtgaatctcctatc

SEQ ID NO: 18442 - DNA, 15 bp, Homo sapiens
cagtgaatctcctat

SEQ ID NO: 18443 - DNA, 15 bp, Homo sapiens
gcagtgaatctccta

SEQ ID NO: 18444 - DNA, 15 bp, Homo sapiens
tgcagtgaatctcct

SEQ ID NO: 18445 - DNA, 15 bp, Homo sapiens
ctgcagtgaatctcc

SEQ ID NO: 18446 - DNA, 15 bp, Homo sapiens
actgcagtgaatctc

SEQ ID NO: 18447 - DNA, 15 bp, Homo sapiens
gactgcagtgaatct

SEQ ID NO: 18448 - DNA, 15 bp, Homo sapiens
tgactgcagtgaatc

SEQ ID NO: 18449 - DNA, 15 bp, Homo sapiens
atgactgcagtgaat

SEQ ID NO: 18450 - DNA, 15 bp, Homo sapiens
catgactgcagtgaa

SEQ ID NO: 18451 - DNA, 15 bp, Homo sapiens
ccatgactgcagtga

SEQ ID NO: 18452 - DNA, 15 bp, Homo sapiens
tccatgactgcagtg

SEQ ID NO: 18453 - DNA, 15 bp, Homo sapiens
gtccatgactgcagt

SEQ ID NO: 18454 - DNA, 15 bp, Homo sapiens
ggtccatgactgcag

SEQ ID NO: 18455 - DNA, 15 bp, Homo sapiens
aggtccatgactgca

SEQ ID NO: 18456 - DNA, 15 bp, Homo sapiens
aaggtccatgactgc

SEQ ID NO: 18457 - DNA, 15 bp, Homo sapiens
caaggtccatgactg

SEQ ID NO: 18458 - DNA, 15 bp, Homo sapiens
acaaggtccatgact

SEQ ID NO: 18459 - DNA, 15 bp, Homo sapiens
tacaaggtccatgac

SEQ ID NO: 18460 - DNA, 15 bp, Homo sapiens
gtacaaggtccatga

SEQ ID NO: 18461 - DNA, 15 bp, Homo sapiens
ggtacaaggtccatg

SEQ ID NO: 18462 - DNA, 15 bp, Homo sapiens
tggtacaaggtccat

SEQ ID NO: 18463 - DNA, 15 bp, Homo sapiens
atggtacaaggtcca

SEQ ID NO: 18464 - DNA, 15 bp, Homo sapiens
aatggtacaaggtcc

SEQ ID NO: 18465 - DNA, 15 bp, Homo sapiens
aaatggtacaaggtc

SEQ ID NO: 18466 - DNA, 15 bp, Homo sapiens
aaaatggtacaaggt

SEQ ID NO: 18467 - DNA, 15 bp, Homo sapiens
gaaaatggtacaagg

SEQ ID NO: 18468 - DNA, 15 bp, Homo sapiens
agaaaatggtacaag

SEQ ID NO: 18469 - DNA, 15 bp, Homo sapiens
aagaaaatggtacaa

SEQ ID NO: 18470 - DNA, 15 bp, Homo sapiens
aaagaaaatggtaca

SEQ ID NO: 18471 - DNA, 15 bp, Homo sapiens
aaaagaaaatggtac

SEQ ID NO: 18472 - DNA, 15 bp, Homo sapiens
caaaagaaaatggta

SEQ ID NO: 18473 - DNA, 15 bp, Homo sapiens
gcaaaagaaaatggt

SEQ ID NO: 18474 - DNA, 15 bp, Homo sapiens
ggcaaaagaaaatgg

SEQ ID NO: 18475 - DNA, 15 bp, Homo sapiens
aggcaaaagaaaatg

SEQ ID NO: 18476 - DNA, 15 bp, Homo sapiens
taggcaaaagaaaat

SEQ ID NO: 18477 - DNA, 15 bp, Homo sapiens
ataggcaaaagaaaa

SEQ ID NO: 18478 - DNA, 15 bp, Homo sapiens
aataggcaaaagaaa

SEQ ID NO: 18479 - DNA, 15 bp, Homo sapiens
taataggcaaaagaa

SEQ ID NO: 18480 - DNA, 15 bp, Homo sapiens
ataataggcaaaaga

SEQ ID NO: 18481 - DNA, 15 bp, Homo sapiens
aataataggcaaaag

SEQ ID NO: 18482 - DNA, 15 bp, Homo sapiens
caataataggcaaaa

SEQ ID NO: 18483 - DNA, 15 bp, Homo sapiens
acaataataggcaaa

SEQ ID NO: 18484 - DNA, 15 bp, Homo sapiens
gacaataataggcaa

SEQ ID NO: 18485 - DNA, 15 bp, Homo sapiens
agacaataataggca

SEQ ID NO: 18486 - DNA, 15 bp, Homo sapiens
tagacaataataggc

SEQ ID NO: 18487 - DNA, 15 bp, Homo sapiens
atagacaataatagg

SEQ ID NO: 18488 - DNA, 15 bp, Homo sapiens
aatagacaataatag

SEQ ID NO: 18489 - DNA, 15 bp, Homo sapiens
aaatagacaataata

SEQ ID NO: 18490 - DNA, 15 bp, Homo sapiens
gaaatagacaataat

SEQ ID NO: 18491 - DNA, 15 bp, Homo sapiens
agaaatagacaataa

SEQ ID NO: 18492 - DNA, 15 bp, Homo sapiens
tagaaatagacaata

SEQ ID NO: 18493 - DNA, 15 bp, Homo sapiens
atagaaatagacaat

SEQ ID NO: 18494 - DNA, 15 bp, Homo sapiens
catagaaatagacaa

SEQ ID NO: 18495 - DNA, 15 bp, Homo sapiens
acatagaaatagaca

SEQ ID NO: 18496 - DNA, 15 bp, Homo sapiens
gacatagaaatagac

SEQ ID NO: 18497 - DNA, 15 bp, Homo sapiens
agacatagaaataga

SEQ ID NO: 18498 - DNA, 15 bp, Homo sapiens
cagacatagaaatag

SEQ ID NO: 18499 - DNA, 15 bp, Homo sapiens
tcagacatagaaata

SEQ ID NO: 18500 - DNA, 15 bp, Homo sapiens
ttcagacatagaaat

SEQ ID NO: 18501 - DNA, 15 bp, Homo sapiens
tttcagacatagaaa

SEQ ID NO: 18502 - DNA, 15 bp, Homo sapiens
ctttcagacatagaa

SEQ ID NO: 18503 - DNA, 15 bp, Homo sapiens
tctttcagacataga

SEQ ID NO: 18504 - DNA, 15 bp, Homo sapiens
atctttcagacatag

SEQ ID NO: 18505 - DNA, 15 bp, Homo sapiens
tatctttcagacata

SEQ ID NO: 18506 - DNA, 15 bp, Homo sapiens
atatctttcagacat

SEQ ID NO: 18507 - DNA, 15 bp, Homo sapiens
catatctttcagaca

SEQ ID NO: 18508 - DNA, 15 bp, Homo sapiens
tcatatctttcagac

SEQ ID NO: 18509 - DNA, 15 bp, Homo sapiens
gtcatatctttcaga

SEQ ID NO: 18510 - DNA, 15 bp, Homo sapiens
tgtcatatctttcag

SEQ ID NO: 18511 - DNA, 15 bp, Homo sapiens
atgtcatatctttca

SEQ ID NO: 18512 - DNA, 15 bp, Homo sapiens
tatgtcatatctttc

SEQ ID NO: 18513 - DNA, 15 bp, Homo sapiens
atatgtcatatcttt

SEQ ID NO: 18514 - DNA, 15 bp, Homo sapiens
aatatgtcatatctt

SEQ ID NO: 18515 - DNA, 15 bp, Homo sapiens
taatatgtcatatct

SEQ ID NO: 18516 - DNA, 15 bp, Homo sapiens
ttaatatgtcatatc

SEQ ID NO: 18517 - DNA, 15 bp, Homo sapiens
tttaatatgtcatat

SEQ ID NO: 18518 - DNA, 15 bp, Homo sapiens
atttaatatgtcata

SEQ ID NO: 18519 - DNA, 15 bp, Homo sapiens
tatttaatatgtcat

SEQ ID NO: 18520 - DNA, 15 bp, Homo sapiens
ttatttaatatgtca

SEQ ID NO: 18521 - DNA, 15 bp, Homo sapiens
tttatttaatatgtc

SEQ ID NO: 18522 - DNA, 15 bp, Homo sapiens
ttttatttaatatgt

SEQ ID NO: 18523 - DNA, 15 bp, Homo sapiens
tttttatttaatatg

SEQ ID NO: 18524 - DNA, 15 bp, Homo sapiens
ttttttatttaatat

SEQ ID NO: 18525 - DNA, 15 bp, Homo sapiens
tttttttatttaata

SEQ ID NO: 18526 - DNA, 15 bp, Homo sapiens
ctttttttatttaat

SEQ ID NO: 18527 - DNA, 15 bp, Homo sapiens
gctttttttatttaa

SEQ ID NO: 18528 - DNA, 15 bp, Homo sapiens
agctttttttattta

SEQ ID NO: 18529 - DNA, 15 bp, Homo sapiens
aagctttttttattt

SEQ ID NO: 18530 - DNA, 15 bp, Homo sapiens
gaagctttttttatt

SEQ ID NO: 18531 - DNA, 15 bp, Homo sapiens
ggaagctttttttat

SEQ ID NO: 18532 - DNA, 15 bp, Homo sapiens
tggaagcttttttta

SEQ ID NO: 18533 - DNA, 15 bp, Homo sapiens
ttggaagcttttttt

SEQ ID NO: 18534 - DNA, 15 bp, Homo sapiens
attggaagctttttt

SEQ ID NO: 18535 - DNA, 15 bp, Homo sapiens
aattggaagcttttt

SEQ ID NO: 18536 - DNA, 15 bp, Homo sapiens
aaattggaagctttt

SEQ ID NO: 18537 - DNA, 15 bp, Homo sapiens
gaaattggaagcttt

SEQ ID NO: 18538 - DNA, 15 bp, Homo sapiens
agaaattggaagctt

SEQ ID NO: 18539 - DNA, 15 bp, Homo sapiens
tagaaattggaagct

SEQ ID NO: 18540 - DNA, 15 bp, Homo sapiens
ctagaaattggaagc

SEQ ID NO: 18541 - DNA, 15 bp, Homo sapiens
cctagaaattggaag

SEQ ID NO: 18542 - DNA, 15 bp, Homo sapiens
tcctagaaattggaa

SEQ ID NO: 18543 - DNA, 15 bp, Homo sapiens
ctcctagaaattgga

SEQ ID NO: 18544 - DNA, 15 bp, Homo sapiens
gctcctagaaattgg

SEQ ID NO: 18545 - DNA, 15 bp, Homo sapiens
tgctcctagaaattg

SEQ ID NO: 18546 - DNA, 15 bp, Homo sapiens
ctgctcctagaaatt

SEQ ID NO: 18547 - DNA, 15 bp, Homo sapiens
actgctcctagaaat

SEQ ID NO: 18548 - DNA, 15 bp, Homo sapiens
tactgctcctagaaa

SEQ ID NO: 18549 - DNA, 15 bp, Homo sapiens
atactgctcctagaa

SEQ ID NO: 18550 - DNA, 15 bp, Homo sapiens
aatactgctcctaga

SEQ ID NO: 18551 - DNA, 15 bp, Homo sapiens
gaatactgctcctag

SEQ ID NO: 18552 - DNA, 15 bp, Homo sapiens
tgaatactgctccta

SEQ ID NO: 18553 - DNA, 15 bp, Homo sapiens
gtgaatactgctcct

SEQ ID NO: 18554 - DNA, 15 bp, Homo sapiens
ggtgaatactgctcc

SEQ ID NO: 18555 - DNA, 15 bp, Homo sapiens
cggtgaatactgctc

SEQ ID NO: 18556 - DNA, 15 bp, Homo sapiens
tcggtgaatactgct

SEQ ID NO: 18557 - DNA, 15 bp, Homo sapiens
ttcggtgaatactgc

SEQ ID NO: 18558 - DNA, 15 bp, Homo sapiens
gttcggtgaatactg

SEQ ID NO: 18559 - DNA, 15 bp, Homo sapiens
agttcggtgaatact

SEQ ID NO: 18560 - DNA, 15 bp, Homo sapiens
tagttcggtgaatac

SEQ ID NO: 18561 - DNA, 15 bp, Homo sapiens
gtagttcggtgaata

SEQ ID NO: 18562 - DNA, 15 bp, Homo sapiens
agtagttcggtgaat

SEQ ID NO: 18563 - DNA, 15 bp, Homo sapiens
aagtagttcggtgaa

SEQ ID NO: 18564 - DNA, 15 bp, Homo sapiens
gaagtagttcggtga

SEQ ID NO: 18565 - DNA, 15 bp, Homo sapiens
ggaagtagttcggtg

SEQ ID NO: 18566 - DNA, 15 bp, Homo sapiens
gggaagtagttcggt

SEQ ID NO: 18567 - DNA, 15 bp, Homo sapiens
agggaagtagttcgg

SEQ ID NO: 18568 - DNA, 15 bp, Homo sapiens
cagggaagtagttcg

SEQ ID NO: 18569 - DNA, 15 bp, Homo sapiens
tcagggaagtagttc

SEQ ID NO: 18570 - DNA, 15 bp, Homo sapiens
gtcagggaagtagtt

SEQ ID NO: 18571 - DNA, 15 bp, Homo sapiens
tgtcagggaagtagt

SEQ ID NO: 18572 - DNA, 15 bp, Homo sapiens
gtgtcagggaagtag

SEQ ID NO: 18573 - DNA, 15 bp, Homo sapiens
tgtgtcagggaagta

SEQ ID NO: 18574 - DNA, 15 bp, Homo sapiens
atgtgtcagggaagt

SEQ ID NO: 18575 - DNA, 15 bp, Homo sapiens
tatgtgtcagggaag

SEQ ID NO: 18576 - DNA, 15 bp, Homo sapiens
gtatgtgtcagggaa

SEQ ID NO: 18577 - DNA, 15 bp, Homo sapiens
tgtatgtgtcaggga

SEQ ID NO: 18578 - DNA, 15 bp, Homo sapiens
atgtatgtgtcaggg

SEQ ID NO: 18579 - DNA, 15 bp, Homo sapiens
tatgtatgtgtcagg

SEQ ID NO: 18580 - DNA, 15 bp, Homo sapiens
gtatgtatgtgtcag

SEQ ID NO: 18581 - DNA, 15 bp, Homo sapiens
ggtatgtatgtgtca

SEQ ID NO: 18582 - DNA, 15 bp, Homo sapiens
aggtatgtatgtgtc

SEQ ID NO: 18583 - DNA, 15 bp, Homo sapiens
gaggtatgtatgtgt

SEQ ID NO: 18584 - DNA, 15 bp, Homo sapiens
tgaggtatgtatgtg

SEQ ID NO: 18585 - DNA, 15 bp, Homo sapiens
gtgaggtatgtatgt

SEQ ID NO: 18586 - DNA, 15 bp, Homo sapiens
tgtgaggtatgtatg

SEQ ID NO: 18587 - DNA, 15 bp, Homo sapiens
gtgtgaggtatgtat

SEQ ID NO: 18588 - DNA, 15 bp, Homo sapiens
ggtgtgaggtatgta

SEQ ID NO: 18589 - DNA, 15 bp, Homo sapiens
gggtgtgaggtatgt

SEQ ID NO: 18590 - DNA, 15 bp, Homo sapiens
agggtgtgaggtatg

SEQ ID NO: 18591 - DNA, 15 bp, Homo sapiens
cagggtgtgaggtat

SEQ ID NO: 18592 - DNA, 15 bp, Homo sapiens
gcagggtgtgaggta

SEQ ID NO: 18593 - DNA, 15 bp, Homo sapiens
tgcagggtgtgaggt

SEQ ID NO: 18594 - DNA, 15 bp, Homo sapiens
gtgcagggtgtgagg

SEQ ID NO: 18595 - DNA, 15 bp, Homo sapiens
tgtgcagggtgtgag

SEQ ID NO: 18596 - DNA, 15 bp, Homo sapiens
gtgtgcagggtgtga

SEQ ID NO: 18597 - DNA, 15 bp, Homo sapiens
tgtgtgcagggtgtg

SEQ ID NO: 18598 - DNA, 15 bp, Homo sapiens
gtgtgtgcagggtgt

SEQ ID NO: 18599 - DNA, 15 bp, Homo sapiens
ggtgtgtgcagggtg

SEQ ID NO: 18600 - DNA, 15 bp, Homo sapiens
tggtgtgtgcagggt

SEQ ID NO: 18601 - DNA, 15 bp, Homo sapiens
gtggtgtgtgcaggg

SEQ ID NO: 18602 - DNA, 15 bp, Homo sapiens
tgtggtgtgtgcagg

SEQ ID NO: 18603 - DNA, 15 bp, Homo sapiens
gtgtggtgtgtgcag

SEQ ID NO: 18604 - DNA, 15 bp, Homo sapiens
tgtgtggtgtgtgca

SEQ ID NO: 18605 - DNA, 15 bp, Homo sapiens
gtgtgtggtgtgtgc

SEQ ID NO: 18606 - DNA, 15 bp, Homo sapiens
ggtgtgtggtgtgtg

SEQ ID NO: 18607 - DNA, 15 bp, Homo sapiens
tggtgtgtggtgtgt

SEQ ID NO: 18608 - DNA, 15 bp, Homo sapiens
gtggtgtgtggtgtg

SEQ ID NO: 18609 - DNA, 15 bp, Homo sapiens
tgtggtgtgtggtgt

SEQ ID NO: 18610 - DNA, 15 bp, Homo sapiens
ttgtggtgtgtggtg

SEQ ID NO: 18611 - DNA, 15 bp, Homo sapiens
tttgtggtgtgtggt

SEQ ID NO: 18612 - DNA, 15 bp, Homo sapiens
gtttgtggtgtgtgg

SEQ ID NO: 18613 - DNA, 15 bp, Homo sapiens
ggtttgtggtgtgtg

SEQ ID NO: 18614 - DNA, 15 bp, Homo sapiens
cggtttgtggtgtgt

SEQ ID NO: 18615 - DNA, 15 bp, Homo sapiens
acggtttgtggtgtg

SEQ ID NO: 18616 - DNA, 15 bp, Homo sapiens
tacggtttgtggtgt

SEQ ID NO: 18617 - DNA, 15 bp, Homo sapiens
ctacggtttgtggtg

SEQ ID NO: 18618 - DNA, 15 bp, Homo sapiens
gctacggtttgtggt

SEQ ID NO: 18619 - DNA, 15 bp, Homo sapiens
agctacggtttgtgg

SEQ ID NO: 18620 - DNA, 15 bp, Homo sapiens
cagctacggtttgtg

SEQ ID NO: 18621 - DNA, 15 bp, Homo sapiens
acagctacggtttgt

SEQ ID NO: 18622 - DNA, 15 bp, Homo sapiens
tacagctacggtttg

SEQ ID NO: 18623 - DNA, 15 bp, Homo sapiens
ttacagctacggttt

SEQ ID NO: 18624 - DNA, 15 bp, Homo sapiens
attacagctacggtt

SEQ ID NO: 18625 - DNA, 15 bp, Homo sapiens
tattacagctacggt

SEQ ID NO: 18626 - DNA, 15 bp, Homo sapiens
atattacagctacgg

SEQ ID NO: 18627 - DNA, 15 bp, Homo sapiens
gatattacagctacg

SEQ ID NO: 18628 - DNA, 15 bp, Homo sapiens
tgatattacagctac

SEQ ID NO: 18629 - DNA, 15 bp, Homo sapiens
ctgatattacagcta

SEQ ID NO: 18630 - DNA, 15 bp, Homo sapiens
cctgatattacagct

SEQ ID NO: 18631 - DNA, 15 bp, Homo sapiens
acctgatattacagc

SEQ ID NO: 18632 - DNA, 15 bp, Homo sapiens
aacctgatattacag

SEQ ID NO: 18633 - DNA, 15 bp, Homo sapiens
taacctgatattaca

SEQ ID NO: 18634 - DNA, 15 bp, Homo sapiens
gtaacctgatattac

SEQ ID NO: 18635 - DNA, 15 bp, Homo sapiens
tgtaacctgatatta

SEQ ID NO: 18636 - DNA, 15 bp, Homo sapiens
atgtaacctgatatt

SEQ ID NO: 18637 - DNA, 15 bp, Homo sapiens
tatgtaacctgatat

SEQ ID NO: 18638 - DNA, 15 bp, Homo sapiens
gtatgtaacctgata

SEQ ID NO: 18639 - DNA, 15 bp, Homo sapiens
agtatgtaacctgat

SEQ ID NO: 18640 - DNA, 15 bp, Homo sapiens
aagtatgtaacctga

SEQ ID NO: 18641 - DNA, 15 bp, Homo sapiens
aaagtatgtaacctg

SEQ ID NO: 18642 - DNA, 15 bp, Homo sapiens
gaaagtatgtaacct

SEQ ID NO: 18643 - DNA, 15 bp, Homo sapiens
agaaagtatgtaacc

SEQ ID NO: 18644 - DNA, 15 bp, Homo sapiens
cagaaagtatgtaac

SEQ ID NO: 18645 - DNA, 15 bp, Homo sapiens
acagaaagtatgtaa

SEQ ID NO: 18646 - DNA, 15 bp, Homo sapiens
aacagaaagtatgta

SEQ ID NO: 18647 - DNA, 15 bp, Homo sapiens
aaacagaaagtatgt

SEQ ID NO: 18648 - DNA, 15 bp, Homo sapiens
aaaacagaaagtatg

SEQ ID NO: 18649 - DNA, 15 bp, Homo sapiens
taaaacagaaagtat

SEQ ID NO: 18650 - DNA, 15 bp, Homo sapiens
ataaaacagaaagta

SEQ ID NO: 18651 - DNA, 15 bp, Homo sapiens
aataaaacagaaagt

SEQ ID NO: 18652 - DNA, 15 bp, Homo sapiens
aaataaaacagaaag

SEQ ID NO: 18653 - DNA, 15 bp, Homo sapiens
aaaataaaacagaaa

SEQ ID NO: 18654 - DNA, 15 bp, Homo sapiens
gaaaataaaacagaa

SEQ ID NO: 18655 - DNA, 15 bp, Homo sapiens
ggaaaataaaacaga

SEQ ID NO: 18656 - DNA, 15 bp, Homo sapiens
gggaaaataaaacag

SEQ ID NO: 18657 - DNA, 15 bp, Homo sapiens
agggaaaataaaaca

SEQ ID NO: 18658 - DNA, 15 bp, Homo sapiens
aagggaaaataaaac

SEQ ID NO: 18659 - DNA, 15 bp, Homo sapiens
aaagggaaaataaaa

SEQ ID NO: 18660 - DNA, 15 bp, Homo sapiens
aaaagggaaaataaa

SEQ ID NO: 18661 - DNA, 15 bp, Homo sapiens
gaaaagggaaaataa

SEQ ID NO: 18662 - DNA, 15 bp, Homo sapiens
agaaaagggaaaata

SEQ ID NO: 18663 - DNA, 15 bp, Homo sapiens
gagaaaagggaaaat

SEQ ID NO: 18664 - DNA, 15 bp, Homo sapiens
agagaaaagggaaaa

SEQ ID NO: 18665 - DNA, 15 bp, Homo sapiens
cagagaaaagggaaa

SEQ ID NO: 18666 - DNA, 15 bp, Homo sapiens
acagagaaaagggaa

SEQ ID NO: 18667 - DNA, 15 bp, Homo sapiens
cacagagaaaaggga

SEQ ID NO: 18668 - DNA, 15 bp, Homo sapiens
acacagagaaaaggg

SEQ ID NO: 18669 - DNA, 15 bp, Homo sapiens
aacacagagaaaagg

SEQ ID NO: 18670 - DNA, 15 bp, Homo sapiens
aaacacagagaaaag

SEQ ID NO: 18671 - DNA, 15 bp, Homo sapiens
aaaacacagagaaaa

SEQ ID NO: 18672 - DNA, 15 bp, Homo sapiens
aaaaacacagagaaa

SEQ ID NO: 18673 - DNA, 15 bp, Homo sapiens
caaaaacacagagaa

SEQ ID NO: 18674 - DNA, 15 bp, Homo sapiens
ccaaaaacacagaga

SEQ ID NO: 18675 - DNA, 15 bp, Homo sapiens
accaaaaacacagag

SEQ ID NO: 18676 - DNA, 15 bp, Homo sapiens
aaccaaaaacacaga

SEQ ID NO: 18677 - DNA, 15 bp, Homo sapiens
taaccaaaaacacag

SEQ ID NO: 18678 - DNA, 15 bp, Homo sapiens
gtaaccaaaaacaca

SEQ ID NO: 18679 - DNA, 15 bp, Homo sapiens
agtaaccaaaaacac

SEQ ID NO: 18680 - DNA, 15 bp, Homo sapiens
aagtaaccaaaaaca

SEQ ID NO: 18681 - DNA, 15 bp, Homo sapiens
caagtaaccaaaaac

SEQ ID NO: 18682 - DNA, 15 bp, Homo sapiens
tcaagtaaccaaaaa

SEQ ID NO: 18683 - DNA, 15 bp, Homo sapiens
ctcaagtaaccaaaa

SEQ ID NO: 18684 - DNA, 15 bp, Homo sapiens
tctcaagtaaccaaa

SEQ ID NO: 18685 - DNA, 15 bp, Homo sapiens
atctcaagtaaccaa

SEQ ID NO: 18686 - DNA, 15 bp, Homo sapiens
catctcaagtaacca

SEQ ID NO: 18687 - DNA, 15 bp, Homo sapiens
ccatctcaagtaacc

SEQ ID NO: 18688 - DNA, 15 bp, Homo sapiens
gccatctcaagtaac

SEQ ID NO: 18689 - DNA, 15 bp, Homo sapiens
ggccatctcaagtaa

SEQ ID NO: 18690 - DNA, 15 bp, Homo sapiens
aggccatctcaagta

SEQ ID NO: 18691 - DNA, 15 bp, Homo sapiens
gaggccatctcaagt

SEQ ID NO: 18692 - DNA, 15 bp, Homo sapiens
ggaggccatctcaag

SEQ ID NO: 18693 - DNA, 15 bp, Homo sapiens
aggaggccatctcaa

SEQ ID NO: 18694 - DNA, 15 bp, Homo sapiens
gaggaggccatctca

SEQ ID NO: 18695 - DNA, 15 bp, Homo sapiens
agaggaggccatctc

SEQ ID NO: 18696 - DNA, 15 bp, Homo sapiens
gagaggaggccatct

SEQ ID NO: 18697 - DNA, 15 bp, Homo sapiens
agagaggaggccatc

SEQ ID NO: 18698 - DNA, 15 bp, Homo sapiens
gagagaggaggccat

SEQ ID NO: 18699 - DNA, 15 bp, Homo sapiens
agagagaggaggcca

SEQ ID NO: 18700 - DNA, 15 bp, Homo sapiens
gagagagaggaggcc

SEQ ID NO: 18701 - DNA, 15 bp, Homo sapiens
tgagagagaggaggc

SEQ ID NO: 18702 - DNA, 15 bp, Homo sapiens
gtgagagagaggagg

SEQ ID NO: 18703 - DNA, 15 bp, Homo sapiens
agtgagagagaggag

SEQ ID NO: 18704 - DNA, 15 bp, Homo sapiens
gagtgagagagagga

SEQ ID NO: 18705 - DNA, 15 bp, Homo sapiens
ggagtgagagagagg

SEQ ID NO: 18706 - DNA, 15 bp, Homo sapiens
aggagtgagagagag

SEQ ID NO: 18707 - DNA, 15 bp, Homo sapiens
caggagtgagagaga

SEQ ID NO: 18708 - DNA, 15 bp, Homo sapiens
ccaggagtgagagag

SEQ ID NO: 18709 - DNA, 15 bp, Homo sapiens
accaggagtgagaga

SEQ ID NO: 18710 - DNA, 15 bp, Homo sapiens
aaccaggagtgagag

SEQ ID NO: 18711 - DNA, 15 bp, Homo sapiens
aaaccaggagtgaga

SEQ ID NO: 18712 - DNA, 15 bp, Homo sapiens
caaaccaggagtgag

SEQ ID NO: 18713 - DNA, 15 bp, Homo sapiens
ccaaaccaggagtga

SEQ ID NO: 18714 - DNA, 15 bp, Homo sapiens
cccaaaccaggagtg

SEQ ID NO: 18715 - DNA, 15 bp, Homo sapiens
tcccaaaccaggagt

SEQ ID NO: 18716 - DNA, 15 bp, Homo sapiens
ttcccaaaccaggag

SEQ ID NO: 18717 - DNA, 15 bp, Homo sapiens
cttcccaaaccagga

SEQ ID NO: 18718 - DNA, 15 bp, Homo sapiens
ccttcccaaaccagg

SEQ ID NO: 18719 - DNA, 15 bp, Homo sapiens
gccttcccaaaccag

SEQ ID NO: 18720 - DNA, 15 bp, Homo sapiens
ggccttcccaaacca

SEQ ID NO: 18721 - DNA, 15 bp, Homo sapiens
aggccttcccaaacc

SEQ ID NO: 18722 - DNA, 15 bp, Homo sapiens
aaggccttcccaaac

SEQ ID NO: 18723 - DNA, 15 bp, Homo sapiens
caaggccttcccaaa

SEQ ID NO: 18724 - DNA, 15 bp, Homo sapiens
gcaaggccttcccaa

SEQ ID NO: 18725 - DNA, 15 bp, Homo sapiens
agcaaggccttccca

SEQ ID NO: 18726 - DNA, 15 bp, Homo sapiens
aagcaaggccttccc

SEQ ID NO: 18727 - DNA, 15 bp, Homo sapiens
gaagcaaggccttcc

SEQ ID NO: 18728 - DNA, 15 bp, Homo sapiens
ggaagcaaggccttc

SEQ ID NO: 18729 - DNA, 15 bp, Homo sapiens
aggaagcaaggcctt

SEQ ID NO: 18730 - DNA, 15 bp, Homo sapiens
gaggaagcaaggcct

SEQ ID NO: 18731 - DNA, 15 bp, Homo sapiens
agaggaagcaaggcc

SEQ ID NO: 18732 - DNA, 15 bp, Homo sapiens
cagaggaagcaaggc

SEQ ID NO: 18733 - DNA, 15 bp, Homo sapiens
tcagaggaagcaagg

SEQ ID NO: 18734 - DNA, 15 bp, Homo sapiens
ttcagaggaagcaag

SEQ ID NO: 18735 - DNA, 15 bp, Homo sapiens
tttcagaggaagcaa

SEQ ID NO: 18736 - DNA, 15 bp, Homo sapiens
ctttcagaggaagca

SEQ ID NO: 18737 - DNA, 15 bp, Homo sapiens
gctttcagaggaagc

SEQ ID NO: 18738 - DNA, 15 bp, Homo sapiens
agctttcagaggaag

SEQ ID NO: 18739 - DNA, 15 bp, Homo sapiens
aagctttcagaggaa

SEQ ID NO: 18740 - DNA, 15 bp, Homo sapiens
caagctttcagagga

SEQ ID NO: 18741 - DNA, 15 bp, Homo sapiens
acaagctttcagagg

SEQ ID NO: 18742 - DNA, 15 bp, Homo sapiens
cacaagctttcagag

SEQ ID NO: 18743 - DNA, 15 bp, Homo sapiens
tcacaagctttcaga

SEQ ID NO: 18744 - DNA, 15 bp, Homo sapiens
ctcacaagctttcag

SEQ ID NO: 18745 - DNA, 15 bp, Homo sapiens
gctcacaagctttca

SEQ ID NO: 18746 - DNA, 15 bp, Homo sapiens
tgctcacaagctttc

SEQ ID NO: 18747 - DNA, 15 bp, Homo sapiens
ctgctcacaagcttt

SEQ ID NO: 18748 - DNA, 15 bp, Homo sapiens
tctgctcacaagctt

SEQ ID NO: 18749 - DNA, 15 bp, Homo sapiens
ctctgctcacaagct

SEQ ID NO: 18750 - DNA, 15 bp, Homo sapiens
cctctgctcacaagc

SEQ ID NO: 18751 - DNA, 15 bp, Homo sapiens
ccctctgctcacaag

SEQ ID NO: 18752 - DNA, 15 bp, Homo sapiens
gccctctgctcacaa

SEQ ID NO: 18753 - DNA, 15 bp, Homo sapiens
agccctctgctcaca

SEQ ID NO: 18754 - DNA, 15 bp, Homo sapiens
cagccctctgctcac

SEQ ID NO: 18755 - DNA, 15 bp, Homo sapiens
tcagccctctgctca

SEQ ID NO: 18756 - DNA, 15 bp, Homo sapiens
atcagccctctgctc

SEQ ID NO: 18757 - DNA, 15 bp, Homo sapiens
gatcagccctctgct

SEQ ID NO: 18758 - DNA, 15 bp, Homo sapiens
agatcagccctctgc

SEQ ID NO: 18759 - DNA, 15 bp, Homo sapiens
cagatcagccctctg

SEQ ID NO: 18760 - DNA, 15 bp, Homo sapiens
tcagatcagccctct

SEQ ID NO: 18761 - DNA, 15 bp, Homo sapiens
atcagatcagccctc

SEQ ID NO: 18762 - DNA, 15 bp, Homo sapiens
gatcagatcagccct

SEQ ID NO: 18763 - DNA, 15 bp, Homo sapiens
tgatcagatcagccc

SEQ ID NO: 18764 - DNA, 15 bp, Homo sapiens
ctgatcagatcagcc

SEQ ID NO: 18765 - DNA, 15 bp, Homo sapiens
tctgatcagatcagc

SEQ ID NO: 18766 - DNA, 15 bp, Homo sapiens
atctgatcagatcag

SEQ ID NO: 18767 - DNA, 15 bp, Homo sapiens
aatctgatcagatca

SEQ ID NO: 18768 - DNA, 15 bp, Homo sapiens
aaatctgatcagatc

SEQ ID NO: 18769 - DNA, 15 bp, Homo sapiens
caaatctgatcagat

SEQ ID NO: 18770 - DNA, 15 bp, Homo sapiens
gcaaatctgatcaga

SEQ ID NO: 18771 - DNA, 15 bp, Homo sapiens
agcaaatctgatcag

SEQ ID NO: 18772 - DNA, 15 bp, Homo sapiens
gagcaaatctgatca

SEQ ID NO: 18773 - DNA, 15 bp, Homo sapiens
agagcaaatctgatc

SEQ ID NO: 18774 - DNA, 15 bp, Homo sapiens
aagagcaaatctgat

SEQ ID NO: 18775 - DNA, 15 bp, Homo sapiens
gaagagcaaatctga

SEQ ID NO: 18776 - DNA, 15 bp, Homo sapiens
agaagagcaaatctg

SEQ ID NO: 18777 - DNA, 15 bp, Homo sapiens
cagaagagcaaatct

SEQ ID NO: 18778 - DNA, 15 bp, Homo sapiens
tcagaagagcaaatc

SEQ ID NO: 18779 - DNA, 15 bp, Homo sapiens
ctcagaagagcaaat

SEQ ID NO: 18780 - DNA, 15 bp, Homo sapiens
actcagaagagcaaa

SEQ ID NO: 18781 - DNA, 15 bp, Homo sapiens
cactcagaagagcaa

SEQ ID NO: 18782 - DNA, 15 bp, Homo sapiens
ccactcagaagagca

SEQ ID NO: 18783 - DNA, 15 bp, Homo sapiens
accactcagaagagc

SEQ ID NO: 18784 - DNA, 15 bp, Homo sapiens
caccactcagaagag

SEQ ID NO: 18785 - DNA, 15 bp, Homo sapiens
gcaccactcagaaga

SEQ ID NO: 18786 - DNA, 15 bp, Homo sapiens
agcaccactcagaag

SEQ ID NO: 18787 - DNA, 15 bp, Homo sapiens
gagcaccactcagaa

SEQ ID NO: 18788 - DNA, 15 bp, Homo sapiens
agagcaccactcaga

SEQ ID NO: 18789 - DNA, 15 bp, Homo sapiens
tagagcaccactcag

SEQ ID NO: 18790 - DNA, 15 bp, Homo sapiens
ctagagcaccactca

SEQ ID NO: 18791 - DNA, 15 bp, Homo sapiens
tctagagcaccactc

SEQ ID NO: 18792 - DNA, 15 bp, Homo sapiens
ttctagagcaccact

SEQ ID NO: 18793 - DNA, 15 bp, Homo sapiens
cttctagagcaccac

SEQ ID NO: 18794 - DNA, 15 bp, Homo sapiens
gcttctagagcacca

SEQ ID NO: 18795 - DNA, 15 bp, Homo sapiens
ggcttctagagcacc

SEQ ID NO: 18796 - DNA, 15 bp, Homo sapiens
tggcttctagagcac

SEQ ID NO: 18797 - DNA, 15 bp, Homo sapiens
gtggcttctagagca

SEQ ID NO: 18798 - DNA, 15 bp, Homo sapiens
cgtggcttctagagc

SEQ ID NO: 18799 - DNA, 15 bp, Homo sapiens
acgtggcttctagag

SEQ ID NO: 18800 - DNA, 15 bp, Homo sapiens
cacgtggcttctaga

SEQ ID NO: 18801 - DNA, 15 bp, Homo sapiens
ccacgtggcttctag

SEQ ID NO: 18802 - DNA, 15 bp, Homo sapiens
tccacgtggcttcta

SEQ ID NO: 18803 - DNA, 15 bp, Homo sapiens
ctccacgtggcttct

SEQ ID NO: 18804 - DNA, 15 bp, Homo sapiens
gctccacgtggcttc

SEQ ID NO: 18805 - DNA, 15 bp, Homo sapiens
tgctccacgtggctt

SEQ ID NO: 18806 - DNA, 15 bp, Homo sapiens
atgctccacgtggct

SEQ ID NO: 18807 - DNA, 15 bp, Homo sapiens
catgctccacgtggc

SEQ ID NO: 18808 - DNA, 15 bp, Homo sapiens
ccatgctccacgtgg

SEQ ID NO: 18809 - DNA, 15 bp, Homo sapiens
tccatgctccacgtg

SEQ ID NO: 18810 - DNA, 15 bp, Homo sapiens
atccatgctccacgt

SEQ ID NO: 18811 - DNA, 15 bp, Homo sapiens
catccatgctccacg

SEQ ID NO: 18812 - DNA, 15 bp, Homo sapiens
ccatccatgctccac

SEQ ID NO: 18813 - DNA, 15 bp, Homo sapiens
accatccatgctcca

SEQ ID NO: 18814 - DNA, 15 bp, Homo sapiens
caccatccatgctcc

SEQ ID NO: 18815 - DNA, 15 bp, Homo sapiens
acaccatccatgctc

SEQ ID NO: 18816 - DNA, 15 bp, Homo sapiens
cacaccatccatgct

SEQ ID NO: 18817 - DNA, 15 bp, Homo sapiens
ccacaccatccatgc

SEQ ID NO: 18818 - DNA, 15 bp, Homo sapiens
cccacaccatccatg

SEQ ID NO: 18819 - DNA, 15 bp, Homo sapiens
ccccacaccatccat

SEQ ID NO: 18820 - DNA, 15 bp, Homo sapiens
accccacaccatcca

SEQ ID NO: 18821 - DNA, 15 bp, Homo sapiens
caccccacaccatcc

SEQ ID NO: 18822 - DNA, 15 bp, Homo sapiens
acaccccacaccatc

SEQ ID NO: 18823 - DNA, 15 bp, Homo sapiens
cacaccccacaccat

SEQ ID NO: 18824 - DNA, 15 bp, Homo sapiens
acacaccccacacca

SEQ ID NO: 18825 - DNA, 15 bp, Homo sapiens
cacacaccccacacc

SEQ ID NO: 18826 - DNA, 15 bp, Homo sapiens
gcacacaccccacac

SEQ ID NO: 18827 - DNA, 15 bp, Homo sapiens
agcacacaccccaca

SEQ ID NO: 18828 - DNA, 15 bp, Homo sapiens
cagcacacaccccac

SEQ ID NO: 18829 - DNA, 15 bp, Homo sapiens
ccagcacacacccca

SEQ ID NO: 18830 - DNA, 15 bp, Homo sapiens
tccagcacacacccc

SEQ ID NO: 18831 - DNA, 15 bp, Homo sapiens
atccagcacacaccc

SEQ ID NO: 18832 - DNA, 15 bp, Homo sapiens
catccagcacacacc

SEQ ID NO: 18833 - DNA, 15 bp, Homo sapiens
tcatccagcacacac

SEQ ID NO: 18834 - DNA, 15 bp, Homo sapiens
ctcatccagcacaca

SEQ ID NO: 18835 - DNA, 15 bp, Homo sapiens
cctcatccagcacac

SEQ ID NO: 18836 - DNA, 15 bp, Homo sapiens
gcctcatccagcaca

SEQ ID NO: 18837 - DNA, 15 bp, Homo sapiens
tgcctcatccagcac

SEQ ID NO: 18838 - DNA, 15 bp, Homo sapiens
ttgcctcatccagca

SEQ ID NO: 18839 - DNA, 15 bp, Homo sapiens
cttgcctcatccagc

SEQ ID NO: 18840 - DNA, 15 bp, Homo sapiens
gcttgcctcatccag

SEQ ID NO: 18841 - DNA, 15 bp, Homo sapiens
ggcttgcctcatcca

SEQ ID NO: 18842 - DNA, 15 bp, Homo sapiens
aggcttgcctcatcc

SEQ ID NO: 18843 - DNA, 15 bp, Homo sapiens
caggcttgcctcatc

SEQ ID NO: 18844 - DNA, 15 bp, Homo sapiens
ccaggcttgcctcat

SEQ ID NO: 18845 - DNA, 15 bp, Homo sapiens
cccaggcttgcctca

SEQ ID NO: 18846 - DNA, 15 bp, Homo sapiens
ccccaggcttgcctc

SEQ ID NO: 18847 - DNA, 15 bp, Homo sapiens
accccaggcttgcct

SEQ ID NO: 18848 - DNA, 15 bp, Homo sapiens
aaccccaggcttgcc

SEQ ID NO: 18849 - DNA, 15 bp, Homo sapiens
gaaccccaggcttgc

SEQ ID NO: 18850 - DNA, 15 bp, Homo sapiens
agaaccccaggcttg

SEQ ID NO: 18851 - DNA, 15 bp, Homo sapiens
cagaaccccaggctt

SEQ ID NO: 18852 - DNA, 15 bp, Homo sapiens
ccagaaccccaggct

SEQ ID NO: 18853 - DNA, 15 bp, Homo sapiens
tccagaaccccaggc

SEQ ID NO: 18854 - DNA, 15 bp, Homo sapiens
ctccagaaccccagg

SEQ ID NO: 18855 - DNA, 15 bp, Homo sapiens
cctccagaaccccag

SEQ ID NO: 18856 - DNA, 15 bp, Homo sapiens
tcctccagaacccca

SEQ ID NO: 18857 - DNA, 15 bp, Homo sapiens
gtcctccagaacccc

SEQ ID NO: 18858 - DNA, 15 bp, Homo sapiens
ggtcctccagaaccc

SEQ ID NO: 18859 - DNA, 15 bp, Homo sapiens
aggtcctccagaacc

SEQ ID NO: 18860 - DNA, 15 bp, Homo sapiens
aaggtcctccagaac

SEQ ID NO: 18861 - DNA, 15 bp, Homo sapiens
aaaggtcctccagaa

SEQ ID NO: 18862 - DNA, 15 bp, Homo sapiens
caaaggtcctccaga

SEQ ID NO: 18863 - DNA, 15 bp, Homo sapiens
ccaaaggtcctccag

SEQ ID NO: 18864 - DNA, 15 bp, Homo sapiens
cccaaaggtcctcca

SEQ ID NO: 18865 - DNA, 15 bp, Homo sapiens
acccaaaggtcctcc

SEQ ID NO: 18866 - DNA, 15 bp, Homo sapiens
cacccaaaggtcctc

SEQ ID NO: 18867 - DNA, 15 bp, Homo sapiens
ccacccaaaggtcct

SEQ ID NO: 18868 - DNA, 15 bp, Homo sapiens
gccacccaaaggtcc

SEQ ID NO: 18869 - DNA, 15 bp, Homo sapiens
agccacccaaaggtc

SEQ ID NO: 18870 - DNA, 15 bp, Homo sapiens
cagccacccaaaggt

SEQ ID NO: 18871 - DNA, 15 bp, Homo sapiens
acagccacccaaagg

SEQ ID NO: 18872 - DNA, 15 bp, Homo sapiens
gacagccacccaaag

SEQ ID NO: 18873 - DNA, 15 bp, Homo sapiens
tgacagccacccaaa

SEQ ID NO: 18874 - DNA, 15 bp, Homo sapiens
gtgacagccacccaa

SEQ ID NO: 18875 - DNA, 15 bp, Homo sapiens
tgtgacagccaccca

SEQ ID NO: 18876 - DNA, 15 bp, Homo sapiens
ctgtgacagccaccc

SEQ ID NO: 18877 - DNA, 15 bp, Homo sapiens
actgtgacagccacc

SEQ ID NO: 18878 - DNA, 15 bp, Homo sapiens
aactgtgacagccac

SEQ ID NO: 18879 - DNA, 15 bp, Homo sapiens
taactgtgacagcca

SEQ ID NO: 18880 - DNA, 15 bp, Homo sapiens
ctaactgtgacagcc

SEQ ID NO: 18881 - DNA, 15 bp, Homo sapiens
tctaactgtgacagc

SEQ ID NO: 18882 - DNA, 15 bp, Homo sapiens
ctctaactgtgacag

SEQ ID NO: 18883 - DNA, 15 bp, Homo sapiens
cctctaactgtgaca

SEQ ID NO: 18884 - DNA, 15 bp, Homo sapiens
tcctctaactgtgac

SEQ ID NO: 18885 - DNA, 15 bp, Homo sapiens
atcctctaactgtga

SEQ ID NO: 18886 - DNA, 15 bp, Homo sapiens
tatcctctaactgtg

SEQ ID NO: 18887 - DNA, 15 bp, Homo sapiens
ttatcctctaactgt

SEQ ID NO: 18888 - DNA, 15 bp, Homo sapiens
cttatcctctaactg

SEQ ID NO: 18889 - DNA, 15 bp, Homo sapiens
tcttatcctctaact

SEQ ID NO: 18890 - DNA, 15 bp, Homo sapiens
ctcttatcctctaac

SEQ ID NO: 18891 - DNA, 15 bp, Homo sapiens
cctcttatcctctaa

SEQ ID NO: 18892 - DNA, 15 bp, Homo sapiens
acctcttatcctcta

SEQ ID NO: 18893 - DNA, 15 bp, Homo sapiens
tacctcttatcctct

SEQ ID NO: 18894 - DNA, 15 bp, Homo sapiens
atacctcttatcctc

SEQ ID NO: 18895 - DNA, 15 bp, Homo sapiens
aatacctcttatcct

SEQ ID NO: 18896 - DNA, 15 bp, Homo sapiens
caatacctcttatcc

SEQ ID NO: 18897 - DNA, 15 bp, Homo sapiens
tcaatacctcttatc

SEQ ID NO: 18898 - DNA, 15 bp, Homo sapiens
ttcaatacctcttat

SEQ ID NO: 18899 - DNA, 15 bp, Homo sapiens
cttcaatacctctta

SEQ ID NO: 18900 - DNA, 15 bp, Homo sapiens
gcttcaatacctctt

SEQ ID NO: 18901 - DNA, 15 bp, Homo sapiens
ggcttcaatacctct

SEQ ID NO: 18902 - DNA, 15 bp, Homo sapiens
tggcttcaatacctc

SEQ ID NO: 18903 - DNA, 15 bp, Homo sapiens
ttggcttcaatacct

SEQ ID NO: 18904 - DNA, 15 bp, Homo sapiens
tttggcttcaatacc

SEQ ID NO: 18905 - DNA, 15 bp, Homo sapiens
ttttggcttcaatac

SEQ ID NO: 18906 - DNA, 15 bp, Homo sapiens
gttttggcttcaata

SEQ ID NO: 18907 - DNA, 15 bp, Homo sapiens
agttttggcttcaat

SEQ ID NO: 18908 - DNA, 15 bp, Homo sapiens
cagttttggcttcaa

SEQ ID NO: 18909 - DNA, 15 bp, Homo sapiens
tcagttttggcttca

SEQ ID NO: 18910 - DNA, 15 bp, Homo sapiens
ctcagttttggcttc

SEQ ID NO: 18911 - DNA, 15 bp, Homo sapiens
tctcagttttggctt

SEQ ID NO: 18912 - DNA, 15 bp, Homo sapiens
atctcagttttggct

SEQ ID NO: 18913 - DNA, 15 bp, Homo sapiens
aatctcagttttggc

SEQ ID NO: 18914 - DNA, 15 bp, Homo sapiens
caatctcagttttgg

SEQ ID NO: 18915 - DNA, 15 bp, Homo sapiens
tcaatctcagttttg

SEQ ID NO: 18916 - DNA, 15 bp, Homo sapiens
ctcaatctcagtttt

SEQ ID NO: 18917 - DNA, 15 bp, Homo sapiens
cctcaatctcagttt

SEQ ID NO: 18918 - DNA, 15 bp, Homo sapiens
acctcaatctcagtt

SEQ ID NO: 18919 - DNA, 15 bp, Homo sapiens
tacctcaatctcagt

SEQ ID NO: 18920 - DNA, 15 bp, Homo sapiens
ctacctcaatctcag

SEQ ID NO: 18921 - DNA, 15 bp, Homo sapiens
gctacctcaatctca

SEQ ID NO: 18922 - DNA, 15 bp, Homo sapiens
agctacctcaatctc

SEQ ID NO: 18923 - DNA, 15 bp, Homo sapiens
cagctacctcaatct

SEQ ID NO: 18924 - DNA, 15 bp, Homo sapiens
ccagctacctcaatc

SEQ ID NO: 18925 - DNA, 15 bp, Homo sapiens
cccagctacctcaat

SEQ ID NO: 18926 - DNA, 15 bp, Homo sapiens
tcccagctacctcaa

SEQ ID NO: 18927 - DNA, 15 bp, Homo sapiens
ttcccagctacctca

SEQ ID NO: 18928 - DNA, 15 bp, Homo sapiens
cttcccagctacctc

SEQ ID NO: 18929 - DNA, 15 bp, Homo sapiens
ccttcccagctacct

SEQ ID NO: 18930 - DNA, 15 bp, Homo sapiens
tccttcccagctacc

SEQ ID NO: 18931 - DNA, 15 bp, Homo sapiens
ctccttcccagctac

SEQ ID NO: 18932 - DNA, 15 bp, Homo sapiens
cctccttcccagcta

SEQ ID NO: 18933 - DNA, 15 bp, Homo sapiens
tcctccttcccagct

SEQ ID NO: 18934 - DNA, 15 bp, Homo sapiens
ctcctccttcccagc

SEQ ID NO: 18935 - DNA, 15 bp, Homo sapiens
tctcctccttcccag

SEQ ID NO: 18936 - DNA, 15 bp, Homo sapiens
ctctcctccttccca

SEQ ID NO: 18937 - DNA, 15 bp, Homo sapiens
cctctcctccttccc

SEQ ID NO: 18938 - DNA, 15 bp, Homo sapiens
ccctctcctccttcc

SEQ ID NO: 18939 - DNA, 15 bp, Homo sapiens
cccctctcctccttc

SEQ ID NO: 18940 - DNA, 15 bp, Homo sapiens
tcccctctcctcctt

SEQ ID NO: 18941 - DNA, 15 bp, Homo sapiens
ctcccctctcctcct

SEQ ID NO: 18942 - DNA, 15 bp, Homo sapiens
tctcccctctcctcc

SEQ ID NO: 18943 - DNA, 15 bp, Homo sapiens
ctctcccctctcctc

SEQ ID NO: 18944 - DNA, 15 bp, Homo sapiens
actctcccctctcct

SEQ ID NO: 18945 - DNA, 15 bp, Homo sapiens
aactctcccctctcc

SEQ ID NO: 18946 - DNA, 15 bp, Homo sapiens
aaactctcccctctc

SEQ ID NO: 18947 - DNA, 15 bp, Homo sapiens
taaactctcccctct

SEQ ID NO: 18948 - DNA, 15 bp, Homo sapiens
ctaaactctcccctc

SEQ ID NO: 18949 - DNA, 15 bp, Homo sapiens
tctaaactctcccct

SEQ ID NO: 18950 - DNA, 15 bp, Homo sapiens
ttctaaactctcccc

SEQ ID NO: 18951 - DNA, 15 bp, Homo sapiens
cttctaaactctccc

SEQ ID NO: 18952 - DNA, 15 bp, Homo sapiens
gcttctaaactctcc

SEQ ID NO: 18953 - DNA, 15 bp, Homo sapiens
agcttctaaactctc

SEQ ID NO: 18954 - DNA, 15 bp, Homo sapiens
aagcttctaaactct

SEQ ID NO: 18955 - DNA, 15 bp, Homo sapiens
aaagcttctaaactc

SEQ ID NO: 18956 - DNA, 15 bp, Homo sapiens
taaagcttctaaact

SEQ ID NO: 18957 - DNA, 15 bp, Homo sapiens
ctaaagcttctaaac

SEQ ID NO: 18958 - DNA, 15 bp, Homo sapiens
cctaaagcttctaaa

SEQ ID NO: 18959 - DNA, 15 bp, Homo sapiens
acctaaagcttctaa

SEQ ID NO: 18960 - DNA, 15 bp, Homo sapiens
tacctaaagcttcta

SEQ ID NO: 18961 - DNA, 15 bp, Homo sapiens
ctacctaaagcttct

SEQ ID NO: 18962 - DNA, 15 bp, Homo sapiens
cctacctaaagcttc

SEQ ID NO: 18963 - DNA, 15 bp, Homo sapiens
tcctacctaaagctt

SEQ ID NO: 18964 - DNA, 15 bp, Homo sapiens
ctcctacctaaagct

SEQ ID NO: 18965 - DNA, 15 bp, Homo sapiens
cctcctacctaaagc

SEQ ID NO: 18966 - DNA, 15 bp, Homo sapiens
gcctcctacctaaag

SEQ ID NO: 18967 - DNA, 15 bp, Homo sapiens
tgcctcctacctaaa

SEQ ID NO: 18968 - DNA, 15 bp, Homo sapiens
ctgcctcctacctaa

SEQ ID NO: 18969 - DNA, 15 bp, Homo sapiens
tctgcctcctaccta

SEQ ID NO: 18970 - DNA, 15 bp, Homo sapiens
gtctgcctcctacct

SEQ ID NO: 18971 - DNA, 15 bp, Homo sapiens
ggtctgcctcctacc

SEQ ID NO: 18972 - DNA, 15 bp, Homo sapiens
aggtctgcctcctac

SEQ ID NO: 18973 - DNA, 15 bp, Homo sapiens
caggtctgcctccta

SEQ ID NO: 18974 - DNA, 15 bp, Homo sapiens
tcaggtctgcctcct

SEQ ID NO: 18975 - DNA, 15 bp, Homo sapiens
atcaggtctgcctcc

SEQ ID NO: 18976 - DNA, 15 bp, Homo sapiens
tatcaggtctgcctc

SEQ ID NO: 18977 - DNA, 15 bp, Homo sapiens
ctatcaggtctgcct

SEQ ID NO: 18978 - DNA, 15 bp, Homo sapiens
cctatcaggtctgcc

SEQ ID NO: 18979 - DNA, 15 bp, Homo sapiens
tcctatcaggtctgc

SEQ ID NO: 18980 - DNA, 15 bp, Homo sapiens
gtcctatcaggtctg

SEQ ID NO: 18981 - DNA, 15 bp, Homo sapiens
tgtcctatcaggtct

SEQ ID NO: 18982 - DNA, 15 bp, Homo sapiens
atgtcctatcaggtc

SEQ ID NO: 18983 - DNA, 15 bp, Homo sapiens
catgtcctatcaggt

SEQ ID NO: 18984 - DNA, 15 bp, Homo sapiens
ccatgtcctatcagg

SEQ ID NO: 18985 - DNA, 15 bp, Homo sapiens
accatgtcctatcag

SEQ ID NO: 18986 - DNA, 15 bp, Homo sapiens
caccatgtcctatca

SEQ ID NO: 18987 - DNA, 15 bp, Homo sapiens
ccaccatgtcctatc

SEQ ID NO: 18988 - DNA, 15 bp, Homo sapiens
accaccatgtcctat

SEQ ID NO: 18989 - DNA, 15 bp, Homo sapiens
caccaccatgtccta

SEQ ID NO: 18990 - DNA, 15 bp, Homo sapiens
ccaccaccatgtcct

SEQ ID NO: 18991 - DNA, 15 bp, Homo sapiens
accaccaccatgtcc

SEQ ID NO: 18992 - DNA, 15 bp, Homo sapiens
gaccaccaccatgtc

SEQ ID NO: 18993 - DNA, 15 bp, Homo sapiens
agaccaccaccatgt

SEQ ID NO: 18994 - DNA, 15 bp, Homo sapiens
aagaccaccaccatg

SEQ ID NO: 18995 - DNA, 15 bp, Homo sapiens
gaagaccaccaccat

SEQ ID NO: 18996 - DNA, 15 bp, Homo sapiens
tgaagaccaccacca

SEQ ID NO: 18997 - DNA, 15 bp, Homo sapiens
ctgaagaccaccacc

SEQ ID NO: 18998 - DNA, 15 bp, Homo sapiens
tctgaagaccaccac

SEQ ID NO: 18999 - DNA, 15 bp, Homo sapiens
atctgaagaccacca

SEQ ID NO: 19000 - DNA, 15 bp, Homo sapiens
catctgaagaccacc

SEQ ID NO: 19001 - DNA, 15 bp, Homo sapiens
tcatctgaagaccac

SEQ ID NO: 19002 - DNA, 15 bp, Homo sapiens
atcatctgaagacca

SEQ ID NO: 19003 - DNA, 15 bp, Homo sapiens
catcatctgaagacc

SEQ ID NO: 19004 - DNA, 15 bp, Homo sapiens
ccatcatctgaagac

SEQ ID NO: 19005 - DNA, 15 bp, Homo sapiens
cccatcatctgaaga

SEQ ID NO: 19006 - DNA, 15 bp, Homo sapiens
acccatcatctgaag

SEQ ID NO: 19007 - DNA, 15 bp, Homo sapiens
cacccatcatctgaa

SEQ ID NO: 19008 - DNA, 15 bp, Homo sapiens
ccacccatcatctga

SEQ ID NO: 19009 - DNA, 15 bp, Homo sapiens
accacccatcatctg

SEQ ID NO: 19010 - DNA, 15 bp, Homo sapiens
caccacccatcatct

SEQ ID NO: 19011 - DNA, 15 bp, Homo sapiens
ccaccacccatcatc

SEQ ID NO: 19012 - DNA, 15 bp, Homo sapiens
tccaccacccatcat

SEQ ID NO: 19013 - DNA, 15 bp, Homo sapiens
atccaccacccatca

SEQ ID NO: 19014 - DNA, 15 bp, Homo sapiens
catccaccacccatc

SEQ ID NO: 19015 - DNA, 15 bp, Homo sapiens
ccatccaccacccat

SEQ ID NO: 19016 - DNA, 15 bp, Homo sapiens
cccatccaccaccca

SEQ ID NO: 19017 - DNA, 15 bp, Homo sapiens
tcccatccaccaccc

SEQ ID NO: 19018 - DNA, 15 bp, Homo sapiens
atcccatccaccacc

SEQ ID NO: 19019 - DNA, 15 bp, Homo sapiens
catcccatccaccac

SEQ ID NO: 19020 - DNA, 15 bp, Homo sapiens
ccatcccatccacca

SEQ ID NO: 19021 - DNA, 15 bp, Homo sapiens
tccatcccatccacc

SEQ ID NO: 19022 - DNA, 15 bp, Homo sapiens
ctccatcccatccac

SEQ ID NO: 19023 - DNA, 15 bp, Homo sapiens
tctccatcccatcca

SEQ ID NO: 19024 - DNA, 15 bp, Homo sapiens
ctctccatcccatcc

SEQ ID NO: 19025 - DNA, 15 bp, Homo sapiens
tctctccatcccatc

SEQ ID NO: 19026 - DNA, 15 bp, Homo sapiens
ctctctccatcccat

SEQ ID NO: 19027 - DNA, 15 bp, Homo sapiens
tctctctccatccca

SEQ ID NO: 19028 - DNA, 15 bp, Homo sapiens
ttctctctccatccc

SEQ ID NO: 19029 - DNA, 15 bp, Homo sapiens
cttctctctccatcc

SEQ ID NO: 19030 - DNA, 15 bp, Homo sapiens
gcttctctctccatc

SEQ ID NO: 19031 - DNA, 15 bp, Homo sapiens
ggcttctctctccat

SEQ ID NO: 19032 - DNA, 15 bp, Homo sapiens
aggcttctctctcca

SEQ ID NO: 19033 - DNA, 15 bp, Homo sapiens
caggcttctctctcc

SEQ ID NO: 19034 - DNA, 15 bp, Homo sapiens
ccaggcttctctctc

SEQ ID NO: 19035 - DNA, 15 bp, Homo sapiens
accaggcttctctct

SEQ ID NO: 19036 - DNA, 15 bp, Homo sapiens
aaccaggcttctctc

SEQ ID NO: 19037 - DNA, 15 bp, Homo sapiens
aaaccaggcttctct

SEQ ID NO: 19038 - DNA, 15 bp, Homo sapiens
aaaaccaggcttctc

SEQ ID NO: 19039 - DNA, 15 bp, Homo sapiens
aaaaaccaggcttct

SEQ ID NO: 19040 - DNA, 15 bp, Homo sapiens
caaaaaccaggcttc

SEQ ID NO: 19041 - DNA, 15 bp, Homo sapiens
tcaaaaaccaggctt

SEQ ID NO: 19042 - DNA, 15 bp, Homo sapiens
gtcaaaaaccaggct

SEQ ID NO: 19043 - DNA, 15 bp, Homo sapiens
agtcaaaaaccaggc

SEQ ID NO: 19044 - DNA, 15 bp, Homo sapiens
aagtcaaaaaccagg

SEQ ID NO: 19045 - DNA, 15 bp, Homo sapiens
aaagtcaaaaaccag

SEQ ID NO: 19046 - DNA, 15 bp, Homo sapiens
taaagtcaaaaacca

SEQ ID NO: 19047 - DNA, 15 bp, Homo sapiens
ttaaagtcaaaaacc

SEQ ID NO: 19048 - DNA, 15 bp, Homo sapiens
gttaaagtcaaaaac

SEQ ID NO: 19049 - DNA, 15 bp, Homo sapiens
tgttaaagtcaaaaa

SEQ ID NO: 19050 - DNA, 15 bp, Homo sapiens
gtgttaaagtcaaaa

SEQ ID NO: 19051 - DNA, 15 bp, Homo sapiens
agtgttaaagtcaaa

SEQ ID NO: 19052 - DNA, 15 bp, Homo sapiens
gagtgttaaagtcaa

SEQ ID NO: 19053 - DNA, 15 bp, Homo sapiens
cgagtgttaaagtca

SEQ ID NO: 19054 - DNA, 15 bp, Homo sapiens
gcgagtgttaaagtc

SEQ ID NO: 19055 - DNA, 15 bp, Homo sapiens
tgcgagtgttaaagt

SEQ ID NO: 19056 - DNA, 15 bp, Homo sapiens
ttgcgagtgttaaag

SEQ ID NO: 19057 - DNA, 15 bp, Homo sapiens
tttgcgagtgttaaa

SEQ ID NO: 19058 - DNA, 15 bp, Homo sapiens
atttgcgagtgttaa

SEQ ID NO: 19059 - DNA, 15 bp, Homo sapiens
catttgcgagtgtta

SEQ ID NO: 19060 - DNA, 15 bp, Homo sapiens
tcatttgcgagtgtt

SEQ ID NO: 19061 - DNA, 15 bp, Homo sapiens
ttcatttgcgagtgt

SEQ ID NO: 19062 - DNA, 15 bp, Homo sapiens
cttcatttgcgagtg

SEQ ID NO: 19063 - DNA, 15 bp, Homo sapiens
gcttcatttgcgagt

SEQ ID NO: 19064 - DNA, 15 bp, Homo sapiens
ggcttcatttgcgag

SEQ ID NO: 19065 - DNA, 15 bp, Homo sapiens
aggcttcatttgcga

SEQ ID NO: 19066 - DNA, 15 bp, Homo sapiens
aaggcttcatttgcg

SEQ ID NO: 19067 - DNA, 15 bp, Homo sapiens
aaaggcttcatttgc

SEQ ID NO: 19068 - DNA, 15 bp, Homo sapiens
gaaaggcttcatttg

SEQ ID NO: 19069 - DNA, 15 bp, Homo sapiens
agaaaggcttcattt

SEQ ID NO: 19070 - DNA, 15 bp, Homo sapiens
aagaaaggcttcatt

SEQ ID NO: 19071 - DNA, 15 bp, Homo sapiens
aaagaaaggcttcat

SEQ ID NO: 19072 - DNA, 15 bp, Homo sapiens
gaaagaaaggcttca

SEQ ID NO: 19073 - DNA, 15 bp, Homo sapiens
agaaagaaaggcttc

SEQ ID NO: 19074 - DNA, 15 bp, Homo sapiens
tagaaagaaaggctt

SEQ ID NO: 19075 - DNA, 15 bp, Homo sapiens
ctagaaagaaaggct

SEQ ID NO: 19076 - DNA, 15 bp, Homo sapiens
cctagaaagaaaggc

SEQ ID NO: 19077 - DNA, 15 bp, Homo sapiens
acctagaaagaaagg

SEQ ID NO: 19078 - DNA, 15 bp, Homo sapiens
aacctagaaagaaag

SEQ ID NO: 19079 - DNA, 15 bp, Homo sapiens
aaacctagaaagaaa

SEQ ID NO: 19080 - DNA, 15 bp, Homo sapiens
aaaacctagaaagaa

SEQ ID NO: 19081 - DNA, 15 bp, Homo sapiens
caaaacctagaaaga

SEQ ID NO: 19082 - DNA, 15 bp, Homo sapiens
acaaaacctagaaag

SEQ ID NO: 19083 - DNA, 15 bp, Homo sapiens
cacaaaacctagaaa

SEQ ID NO: 19084 - DNA, 15 bp, Homo sapiens
ccacaaaacctagaa

SEQ ID NO: 19085 - DNA, 15 bp, Homo sapiens
tccacaaaacctaga

SEQ ID NO: 19086 - DNA, 15 bp, Homo sapiens
ctccacaaaacctag

SEQ ID NO: 19087 - DNA, 15 bp, Homo sapiens
tctccacaaaaccta

SEQ ID NO: 19088 - DNA, 15 bp, Homo sapiens
ctctccacaaaacct

SEQ ID NO: 19089 - DNA, 15 bp, Homo sapiens
cctctccacaaaacc

SEQ ID NO: 19090 - DNA, 15 bp, Homo sapiens
ccctctccacaaaac

SEQ ID NO: 19091 - DNA, 15 bp, Homo sapiens
gccctctccacaaaa

SEQ ID NO: 19092 - DNA, 15 bp, Homo sapiens
tgccctctccacaaa

SEQ ID NO: 19093 - DNA, 15 bp, Homo sapiens
ctgccctctccacaa

SEQ ID NO: 19094 - DNA, 15 bp, Homo sapiens
actgccctctccaca

SEQ ID NO: 19095 - DNA, 15 bp, Homo sapiens
cactgccctctccac

SEQ ID NO: 19096 - DNA, 15 bp, Homo sapiens
gcactgccctctcca

SEQ ID NO: 19097 - DNA, 15 bp, Homo sapiens
tgcactgccctctcc

SEQ ID NO: 19098 - DNA, 15 bp, Homo sapiens
atgcactgccctctc

SEQ ID NO: 19099 - DNA, 15 bp, Homo sapiens
tatgcactgccctct

SEQ ID NO: 19100 - DNA, 15 bp, Homo sapiens
ttatgcactgccctc

SEQ ID NO: 19101 - DNA, 15 bp, Homo sapiens
cttatgcactgccct

SEQ ID NO: 19102 - DNA, 15 bp, Homo sapiens
ccttatgcactgccc

SEQ ID NO: 19103 - DNA, 15 bp, Homo sapiens
cccttatgcactgcc

SEQ ID NO: 19104 - DNA, 15 bp, Homo sapiens
ccccttatgcactgc

SEQ ID NO: 19105 - DNA, 15 bp, Homo sapiens
tccccttatgcactg

SEQ ID NO: 19106 - DNA, 15 bp, Homo sapiens
atccccttatgcact

SEQ ID NO: 19107 - DNA, 15 bp, Homo sapiens
tatccccttatgcac

SEQ ID NO: 19108 - DNA, 15 bp, Homo sapiens
ctatccccttatgca

SEQ ID NO: 19109 - DNA, 15 bp, Homo sapiens
actatccccttatgc

SEQ ID NO: 19110 - DNA, 15 bp, Homo sapiens
tactatccccttatg

SEQ ID NO: 19111 - DNA, 15 bp, Homo sapiens
ttactatccccttat

SEQ ID NO: 19112 - DNA, 15 bp, Homo sapiens
cttactatcccctta

SEQ ID NO: 19113 - DNA, 15 bp, Homo sapiens
acttactatcccctt

SEQ ID NO: 19114 - DNA, 15 bp, Homo sapiens
cacttactatcccct

SEQ ID NO: 19115 - DNA, 15 bp, Homo sapiens
tcacttactatcccc

SEQ ID NO: 19116 - DNA, 15 bp, Homo sapiens
ttcacttactatccc

SEQ ID NO: 19117 - DNA, 15 bp, Homo sapiens
cttcacttactatcc

SEQ ID NO: 19118 - DNA, 15 bp, Homo sapiens
acttcacttactatc

SEQ ID NO: 19119 - DNA, 15 bp, Homo sapiens
aacttcacttactat

SEQ ID NO: 19120 - DNA, 15 bp, Homo sapiens
gaacttcacttacta

SEQ ID NO: 19121 - DNA, 15 bp, Homo sapiens
agaacttcacttact

SEQ ID NO: 19122 - DNA, 15 bp, Homo sapiens
tagaacttcacttac

SEQ ID NO: 19123 - DNA, 15 bp, Homo sapiens
ctagaacttcactta

SEQ ID NO: 19124 - DNA, 15 bp, Homo sapiens
tctagaacttcactt

SEQ ID NO: 19125 - DNA, 15 bp, Homo sapiens
atctagaacttcact

SEQ ID NO: 19126 - DNA, 15 bp, Homo sapiens
aatctagaacttcac

SEQ ID NO: 19127 - DNA, 15 bp, Homo sapiens
caatctagaacttca

SEQ ID NO: 19128 - DNA, 15 bp, Homo sapiens
tcaatctagaacttc

SEQ ID NO: 19129 - DNA, 15 bp, Homo sapiens
ctcaatctagaactt

SEQ ID NO: 19130 - DNA, 15 bp, Homo sapiens
actcaatctagaact

SEQ ID NO: 19131 - DNA, 15 bp, Homo sapiens
aactcaatctagaac

SEQ ID NO: 19132 - DNA, 15 bp, Homo sapiens
aaactcaatctagaa

SEQ ID NO: 19133 - DNA, 15 bp, Homo sapiens
aaaactcaatctaga

SEQ ID NO: 19134 - DNA, 15 bp, Homo sapiens
caaaactcaatctag

SEQ ID NO: 19135 - DNA, 15 bp, Homo sapiens
tcaaaactcaatcta

SEQ ID NO: 19136 - DNA, 15 bp, Homo sapiens
ctcaaaactcaatct

SEQ ID NO: 19137 - DNA, 15 bp, Homo sapiens
cctcaaaactcaatc

SEQ ID NO: 19138 - DNA, 15 bp, Homo sapiens
acctcaaaactcaat

SEQ ID NO: 19139 - DNA, 15 bp, Homo sapiens
cacctcaaaactcaa

SEQ ID NO: 19140 - DNA, 15 bp, Homo sapiens
gcacctcaaaactca

SEQ ID NO: 19141 - DNA, 15 bp, Homo sapiens
ggcacctcaaaactc

SEQ ID NO: 19142 - DNA, 15 bp, Homo sapiens
aggcacctcaaaact

SEQ ID NO: 19143 - DNA, 15 bp, Homo sapiens
caggcacctcaaaac

SEQ ID NO: 19144 - DNA, 15 bp, Homo sapiens
ccaggcacctcaaaa

SEQ ID NO: 19145 - DNA, 15 bp, Homo sapiens
tccaggcacctcaaa

SEQ ID NO: 19146 - DNA, 15 bp, Homo sapiens
ctccaggcacctcaa

SEQ ID NO: 19147 - DNA, 15 bp, Homo sapiens
tctccaggcacctca

SEQ ID NO: 19148 - DNA, 15 bp, Homo sapiens
atctccaggcacctc

SEQ ID NO: 19149 - DNA, 15 bp, Homo sapiens
tatctccaggcacct

SEQ ID NO: 19150 - DNA, 15 bp, Homo sapiens
atatctccaggcacc

SEQ ID NO: 19151 - DNA, 15 bp, Homo sapiens
gatatctccaggcac

SEQ ID NO: 19152 - DNA, 15 bp, Homo sapiens
agatatctccaggca

SEQ ID NO: 19153 - DNA, 15 bp, Homo sapiens
cagatatctccaggc

SEQ ID NO: 19154 - DNA, 15 bp, Homo sapiens
ccagatatctccagg

SEQ ID NO: 19155 - DNA, 15 bp, Homo sapiens
cccagatatctccag

SEQ ID NO: 19156 - DNA, 15 bp, Homo sapiens
tcccagatatctcca

SEQ ID NO: 19157 - DNA, 15 bp, Homo sapiens
ttcccagatatctcc

SEQ ID NO: 19158 - DNA, 15 bp, Homo sapiens
tttcccagatatctc

SEQ ID NO: 19159 - DNA, 15 bp, Homo sapiens
ttttcccagatatct

SEQ ID NO: 19160 - DNA, 15 bp, Homo sapiens
tttttcccagatatc

SEQ ID NO: 19161 - DNA, 15 bp, Homo sapiens
atttttcccagatat

SEQ ID NO: 19162 - DNA, 15 bp, Homo sapiens
tatttttcccagata

SEQ ID NO: 19163 - DNA, 15 bp, Homo sapiens
atatttttcccagat

SEQ ID NO: 19164 - DNA, 15 bp, Homo sapiens
catatttttcccaga

SEQ ID NO: 19165 - DNA, 15 bp, Homo sapiens
acatatttttcccag

SEQ ID NO: 19166 - DNA, 15 bp, Homo sapiens
tacatatttttccca

SEQ ID NO: 19167 - DNA, 15 bp, Homo sapiens
ttacatatttttccc

SEQ ID NO: 19168 - DNA, 15 bp, Homo sapiens
attacatatttttcc

SEQ ID NO: 19169 - DNA, 15 bp, Homo sapiens
tattacatatttttc

SEQ ID NO: 19170 - DNA, 15 bp, Homo sapiens
atattacatattttt

SEQ ID NO: 19171 - DNA, 15 bp, Homo sapiens
tatattacatatttt

SEQ ID NO: 19172 - DNA, 15 bp, Homo sapiens
atatattacatattt

SEQ ID NO: 19173 - DNA, 15 bp, Homo sapiens
tatatattacatatt

SEQ ID NO: 19174 - DNA, 15 bp, Homo sapiens
atatatattacatat

SEQ ID NO: 19175 - DNA, 15 bp, Homo sapiens
tatatatattacata

SEQ ID NO: 19176 - DNA, 15 bp, Homo sapiens
atatatatattacat

SEQ ID NO: 19177 - DNA, 15 bp, Homo sapiens
aatatatatattaca

SEQ ID NO: 19178 - DNA, 15 bp, Homo sapiens
aaatatatatattac

SEQ ID NO: 19179 - DNA, 15 bp, Homo sapiens
gaaatatatatatta

SEQ ID NO: 19180 - DNA, 15 bp, Homo sapiens
agaaatatatatatt

SEQ ID NO: 19181 - DNA, 15 bp, Homo sapiens
gagaaatatatatat

SEQ ID NO: 19182 - DNA, 15 bp, Homo sapiens
agagaaatatatata

SEQ ID NO: 19183 - DNA, 15 bp, Homo sapiens
aagagaaatatatat

SEQ ID NO: 19184 - DNA, 15 bp, Homo sapiens
taagagaaatatata

SEQ ID NO: 19185 - DNA, 15 bp, Homo sapiens
gtaagagaaatatat

SEQ ID NO: 19186 - DNA, 15 bp, Homo sapiens
tgtaagagaaatata

SEQ ID NO: 19187 - DNA, 15 bp, Homo sapiens
atgtaagagaaatat

SEQ ID NO: 19188 - DNA, 15 bp, Homo sapiens
catgtaagagaaata

SEQ ID NO: 19189 - DNA, 15 bp, Homo sapiens
acatgtaagagaaat

SEQ ID NO: 19190 - DNA, 15 bp, Homo sapiens
tacatgtaagagaaa

SEQ ID NO: 19191 - DNA, 15 bp, Homo sapiens
atacatgtaagagaa

SEQ ID NO: 19192 - DNA, 15 bp, Homo sapiens
catacatgtaagaga

SEQ ID NO: 19193 - DNA, 15 bp, Homo sapiens
tcatacatgtaagag

SEQ ID NO: 19194 - DNA, 15 bp, Homo sapiens
ctcatacatgtaaga

SEQ ID NO: 19195 - DNA, 15 bp, Homo sapiens
tctcatacatgtaag

SEQ ID NO: 19196 - DNA, 15 bp, Homo sapiens
gtctcatacatgtaa

SEQ ID NO: 19197 - DNA, 15 bp, Homo sapiens
agtctcatacatgta

SEQ ID NO: 19198 - DNA, 15 bp, Homo sapiens
cagtctcatacatgt

SEQ ID NO: 19199 - DNA, 15 bp, Homo sapiens
ccagtctcatacatg

SEQ ID NO: 19200 - DNA, 15 bp, Homo sapiens
gccagtctcatacat

SEQ ID NO: 19201 - DNA, 15 bp, Homo sapiens
agccagtctcataca

SEQ ID NO: 19202 - DNA, 15 bp, Homo sapiens
aagccagtctcatac

SEQ ID NO: 19203 - DNA, 15 bp, Homo sapiens
caagccagtctcata

SEQ ID NO: 19204 - DNA, 15 bp, Homo sapiens
ccaagccagtctcat

SEQ ID NO: 19205 - DNA, 15 bp, Homo sapiens
cccaagccagtctca

SEQ ID NO: 19206 - DNA, 15 bp, Homo sapiens
gcccaagccagtctc

SEQ ID NO: 19207 - DNA, 15 bp, Homo sapiens
agcccaagccagtct

SEQ ID NO: 19208 - DNA, 15 bp, Homo sapiens
cagcccaagccagtc

SEQ ID NO: 19209 - DNA, 15 bp, Homo sapiens
ccagcccaagccagt

SEQ ID NO: 19210 - DNA, 15 bp, Homo sapiens
cccagcccaagccag

SEQ ID NO: 19211 - DNA, 15 bp, Homo sapiens
ccccagcccaagcca

SEQ ID NO: 19212 - DNA, 15 bp, Homo sapiens
accccagcccaagcc

SEQ ID NO: 19213 - DNA, 15 bp, Homo sapiens
gaccccagcccaagc

SEQ ID NO: 19214 - DNA, 15 bp, Homo sapiens
agaccccagcccaag

SEQ ID NO: 19215 - DNA, 15 bp, Homo sapiens
cagaccccagcccaa

SEQ ID NO: 19216 - DNA, 15 bp, Homo sapiens
gcagaccccagccca

SEQ ID NO: 19217 - DNA, 15 bp, Homo sapiens
ggcagaccccagccc

SEQ ID NO: 19218 - DNA, 15 bp, Homo sapiens
gggcagaccccagcc

SEQ ID NO: 19219 - DNA, 15 bp, Homo sapiens
agggcagaccccagc

SEQ ID NO: 19220 - DNA, 15 bp, Homo sapiens
aagggcagaccccag

SEQ ID NO: 19221 - DNA, 15 bp, Homo sapiens
caagggcagacccca

SEQ ID NO: 19222 - DNA, 15 bp, Homo sapiens
tcaagggcagacccc

SEQ ID NO: 19223 - DNA, 15 bp, Homo sapiens
ttcaagggcagaccc

SEQ ID NO: 19224 - DNA, 15 bp, Homo sapiens
tttcaagggcagacc

SEQ ID NO: 19225 - DNA, 15 bp, Homo sapiens
ttttcaagggcagac

SEQ ID NO: 19226 - DNA, 15 bp, Homo sapiens
gttttcaagggcaga

SEQ ID NO: 19227 - DNA, 15 bp, Homo sapiens
agttttcaagggcag

SEQ ID NO: 19228 - DNA, 15 bp, Homo sapiens
cagttttcaagggca

SEQ ID NO: 19229 - DNA, 15 bp, Homo sapiens
ccagttttcaagggc

SEQ ID NO: 19230 - DNA, 15 bp, Homo sapiens
gccagttttcaaggg

SEQ ID NO: 19231 - DNA, 15 bp, Homo sapiens
tgccagttttcaagg

SEQ ID NO: 19232 - DNA, 15 bp, Homo sapiens
ctgccagttttcaag

SEQ ID NO: 19233 - DNA, 15 bp, Homo sapiens
gctgccagttttcaa

SEQ ID NO: 19234 - DNA, 15 bp, Homo sapiens
agctgccagttttca

SEQ ID NO: 19235 - DNA, 15 bp, Homo sapiens
cagctgccagttttc

SEQ ID NO: 19236 - DNA, 15 bp, Homo sapiens
ccagctgccagtttt

SEQ ID NO: 19237 - DNA, 15 bp, Homo sapiens
tccagctgccagttt

SEQ ID NO: 19238 - DNA, 15 bp, Homo sapiens
ctccagctgccagtt

SEQ ID NO: 19239 - DNA, 15 bp, Homo sapiens
actccagctgccagt

SEQ ID NO: 19240 - DNA, 15 bp, Homo sapiens
gactccagctgccag

SEQ ID NO: 19241 - DNA, 15 bp, Homo sapiens
agactccagctgcca

SEQ ID NO: 19242 - DNA, 15 bp, Homo sapiens
aagactccagctgcc

SEQ ID NO: 19243 - DNA, 15 bp, Homo sapiens
caagactccagctgc

SEQ ID NO: 19244 - DNA, 15 bp, Homo sapiens
tcaagactccagctg

SEQ ID NO: 19245 - DNA, 15 bp, Homo sapiens
ctcaagactccagct

SEQ ID NO: 19246 - DNA, 15 bp, Homo sapiens
actcaagactccagc

SEQ ID NO: 19247 - DNA, 15 bp, Homo sapiens
tactcaagactccag

SEQ ID NO: 19248 - DNA, 15 bp, Homo sapiens
gtactcaagactcca

SEQ ID NO: 19249 - DNA, 15 bp, Homo sapiens
agtactcaagactcc

SEQ ID NO: 19250 - DNA, 15 bp, Homo sapiens
aagtactcaagactc

SEQ ID NO: 19251 - DNA, 15 bp, Homo sapiens
aaagtactcaagact

SEQ ID NO: 19252 - DNA, 15 bp, Homo sapiens
gaaagtactcaagac

SEQ ID NO: 19253 - DNA, 15 bp, Homo sapiens
ggaaagtactcaaga

SEQ ID NO: 19254 - DNA, 15 bp, Homo sapiens
aggaaagtactcaag

SEQ ID NO: 19255 - DNA, 15 bp, Homo sapiens
caggaaagtactcaa

SEQ ID NO: 19256 - DNA, 15 bp, Homo sapiens
tcaggaaagtactca

SEQ ID NO: 19257 - DNA, 15 bp, Homo sapiens
ctcaggaaagtactc

SEQ ID NO: 19258 - DNA, 15 bp, Homo sapiens
actcaggaaagtact

SEQ ID NO: 19259 - DNA, 15 bp, Homo sapiens
gactcaggaaagtac

SEQ ID NO: 19260 - DNA, 15 bp, Homo sapiens
tgactcaggaaagta

SEQ ID NO: 19261 - DNA, 15 bp, Homo sapiens
atgactcaggaaagt

SEQ ID NO: 19262 - DNA, 15 bp, Homo sapiens
aatgactcaggaaag

SEQ ID NO: 19263 - DNA, 15 bp, Homo sapiens
aaatgactcaggaaa

SEQ ID NO: 19264 - DNA, 15 bp, Homo sapiens
aaaatgactcaggaa

SEQ ID NO: 19265 - DNA, 15 bp, Homo sapiens
aaaaatgactcagga

SEQ ID NO: 19266 - DNA, 15 bp, Homo sapiens
aaaaaatgactcagg

SEQ ID NO: 19267 - DNA, 15 bp, Homo sapiens
caaaaaatgactcag

SEQ ID NO: 19268 - DNA, 15 bp, Homo sapiens
tcaaaaaatgactca

SEQ ID NO: 19269 - DNA, 15 bp, Homo sapiens
ctcaaaaaatgactc

SEQ ID NO: 19270 - DNA, 15 bp, Homo sapiens
gctcaaaaaatgact

SEQ ID NO: 19271 - DNA, 15 bp, Homo sapiens
agctcaaaaaatgac

SEQ ID NO: 19272 - DNA, 15 bp, Homo sapiens
gagctcaaaaaatga

SEQ ID NO: 19273 - DNA, 15 bp, Homo sapiens
agagctcaaaaaatg

SEQ ID NO: 19274 - DNA, 15 bp, Homo sapiens
aagagctcaaaaaat

SEQ ID NO: 19275 - DNA, 15 bp, Homo sapiens
aaagagctcaaaaaa

SEQ ID NO: 19276 - DNA, 15 bp, Homo sapiens
caaagagctcaaaaa

SEQ ID NO: 19277 - DNA, 15 bp, Homo sapiens
gcaaagagctcaaaa

SEQ ID NO: 19278 - DNA, 15 bp, Homo sapiens
tgcaaagagctcaaa

SEQ ID NO: 19279 - DNA, 15 bp, Homo sapiens
ttgcaaagagctcaa

SEQ ID NO: 19280 - DNA, 15 bp, Homo sapiens
cttgcaaagagctca

SEQ ID NO: 19281 - DNA, 15 bp, Homo sapiens
tcttgcaaagagctc

SEQ ID NO: 19282 - DNA, 15 bp, Homo sapiens
atcttgcaaagagct

SEQ ID NO: 19283 - DNA, 15 bp, Homo sapiens
tatcttgcaaagagc

SEQ ID NO: 19284 - DNA, 15 bp, Homo sapiens
ttatcttgcaaagag

SEQ ID NO: 19285 - DNA, 15 bp, Homo sapiens
attatcttgcaaaga

SEQ ID NO: 19286 - DNA, 15 bp, Homo sapiens
cattatcttgcaaag

SEQ ID NO: 19287 - DNA, 15 bp, Homo sapiens
acattatcttgcaaa

SEQ ID NO: 19288 - DNA, 15 bp, Homo sapiens
aacattatcttgcaa

SEQ ID NO: 19289 - DNA, 15 bp, Homo sapiens
taacattatcttgca

SEQ ID NO: 19290 - DNA, 15 bp, Homo sapiens
ttaacattatcttgc

SEQ ID NO: 19291 - DNA, 15 bp, Homo sapiens
tttaacattatcttg

SEQ ID NO: 19292 - DNA, 15 bp, Homo sapiens
ttttaacattatctt

SEQ ID NO: 19293 - DNA, 15 bp, Homo sapiens
tttttaacattatct

SEQ ID NO: 19294 - DNA, 15 bp, Homo sapiens
atttttaacattatc

SEQ ID NO: 19295 - DNA, 15 bp, Homo sapiens
aatttttaacattat

SEQ ID NO: 19296 - DNA, 15 bp, Homo sapiens
gaatttttaacatta

SEQ ID NO: 19297 - DNA, 15 bp, Homo sapiens
tgaatttttaacatt

SEQ ID NO: 19298 - DNA, 15 bp, Homo sapiens
ttgaatttttaacat

SEQ ID NO: 19299 - DNA, 15 bp, Homo sapiens
cttgaatttttaaca

SEQ ID NO: 19300 - DNA, 15 bp, Homo sapiens
tcttgaatttttaac

SEQ ID NO: 19301 - DNA, 15 bp, Homo sapiens
ctcttgaatttttaa

SEQ ID NO: 19302 - DNA, 15 bp, Homo sapiens
cctcttgaattttta

SEQ ID NO: 19303 - DNA, 15 bp, Homo sapiens
gcctcttgaattttt

SEQ ID NO: 19304 - DNA, 15 bp, Homo sapiens
ggcctcttgaatttt

SEQ ID NO: 19305 - DNA, 15 bp, Homo sapiens
cggcctcttgaattt

SEQ ID NO: 19306 - DNA, 15 bp, Homo sapiens
ccggcctcttgaatt

SEQ ID NO: 19307 - DNA, 15 bp, Homo sapiens
cccggcctcttgaat

SEQ ID NO: 19308 - DNA, 15 bp, Homo sapiens
acccggcctcttgaa

SEQ ID NO: 19309 - DNA, 15 bp, Homo sapiens
cacccggcctcttga

SEQ ID NO: 19310 - DNA, 15 bp, Homo sapiens
acacccggcctcttg

SEQ ID NO: 19311 - DNA, 15 bp, Homo sapiens
cacacccggcctctt

SEQ ID NO: 19312 - DNA, 15 bp, Homo sapiens
ccacacccggcctct

SEQ ID NO: 19313 - DNA, 15 bp, Homo sapiens
accacacccggcctc

SEQ ID NO: 19314 - DNA, 15 bp, Homo sapiens
caccacacccggcct

SEQ ID NO: 19315 - DNA, 15 bp, Homo sapiens
ccaccacacccggcc

SEQ ID NO: 19316 - DNA, 15 bp, Homo sapiens
tccaccacacccggc

SEQ ID NO: 19317 - DNA, 15 bp, Homo sapiens
atccaccacacccgg

SEQ ID NO: 19318 - DNA, 15 bp, Homo sapiens
gatccaccacacccg

SEQ ID NO: 19319 - DNA, 15 bp, Homo sapiens
tgatccaccacaccc

SEQ ID NO: 19320 - DNA, 15 bp, Homo sapiens
atgatccaccacacc

SEQ ID NO: 19321 - DNA, 15 bp, Homo sapiens
catgatccaccacac

SEQ ID NO: 19322 - DNA, 15 bp, Homo sapiens
gcatgatccaccaca

SEQ ID NO: 19323 - DNA, 15 bp, Homo sapiens
ggcatgatccaccac

SEQ ID NO: 19324 - DNA, 15 bp, Homo sapiens
aggcatgatccacca

SEQ ID NO: 19325 - DNA, 15 bp, Homo sapiens
caggcatgatccacc

SEQ ID NO: 19326 - DNA, 15 bp, Homo sapiens
ccaggcatgatccac

SEQ ID NO: 19327 - DNA, 15 bp, Homo sapiens
tccaggcatgatcca

SEQ ID NO: 19328 - DNA, 15 bp, Homo sapiens
ttccaggcatgatcc

SEQ ID NO: 19329 - DNA, 15 bp, Homo sapiens
attccaggcatgatc

SEQ ID NO: 19330 - DNA, 15 bp, Homo sapiens
gattccaggcatgat

SEQ ID NO: 19331 - DNA, 15 bp, Homo sapiens
ggattccaggcatga

SEQ ID NO: 19332 - DNA, 15 bp, Homo sapiens
gggattccaggcatg

SEQ ID NO: 19333 - DNA, 15 bp, Homo sapiens
tgggattccaggcat

SEQ ID NO: 19334 - DNA, 15 bp, Homo sapiens
ctgggattccaggca

SEQ ID NO: 19335 - DNA, 15 bp, Homo sapiens
gctgggattccaggc

SEQ ID NO: 19336 - DNA, 15 bp, Homo sapiens
tgctgggattccagg

SEQ ID NO: 19337 - DNA, 15 bp, Homo sapiens
gtgctgggattccag

SEQ ID NO: 19338 - DNA, 15 bp, Homo sapiens
agtgctgggattcca

SEQ ID NO: 19339 - DNA, 15 bp, Homo sapiens
aagtgctgggattcc

SEQ ID NO: 19340 - DNA, 15 bp, Homo sapiens
aaagtgctgggattc

SEQ ID NO: 19341 - DNA, 15 bp, Homo sapiens
ttcaaagtgctggga

SEQ ID NO: 19342 - DNA, 15 bp, Homo sapiens
tttcaaagtgctggg

SEQ ID NO: 19343 - DNA, 15 bp, Homo sapiens
ctttcaaagtgctgg

SEQ ID NO: 19344 - DNA, 15 bp, Homo sapiens
cctttcaaagtgctg

SEQ ID NO: 19345 - DNA, 15 bp, Homo sapiens
gcctttcaaagtgct

SEQ ID NO: 19346 - DNA, 15 bp, Homo sapiens
ggcctttcaaagtgc

SEQ ID NO: 19347 - DNA, 15 bp, Homo sapiens
cggcctttcaaagtg

SEQ ID NO: 19348 - DNA, 15 bp, Homo sapiens
tcggcctttcaaagt

SEQ ID NO: 19349 - DNA, 15 bp, Homo sapiens
ctcggcctttcaaag

SEQ ID NO: 19350 - DNA, 15 bp, Homo sapiens
cctcggcctttcaaa

SEQ ID NO: 19351 - DNA, 15 bp, Homo sapiens
gcctcggcctttcaa

SEQ ID NO: 19352 - DNA, 15 bp, Homo sapiens
cgcctcggcctttca

SEQ ID NO: 19353 - DNA, 15 bp, Homo sapiens
ccgcctcggcctttc

SEQ ID NO: 19354 - DNA, 15 bp, Homo sapiens
cccgcctcggccttt

SEQ ID NO: 19355 - DNA, 15 bp, Homo sapiens
gcccgcctcggcctt

SEQ ID NO: 19356 - DNA, 15 bp, Homo sapiens
cgcccgcctcggcct

SEQ ID NO: 19357 - DNA, 15 bp, Homo sapiens
ccgcccgcctcggcc

SEQ ID NO: 19358 - DNA, 15 bp, Homo sapiens
tccgcccgcctcggc

SEQ ID NO: 19359 - DNA, 15 bp, Homo sapiens
atccgcccgcctcgg

SEQ ID NO: 19360 - DNA, 15 bp, Homo sapiens
gatccgcccgcctcg

SEQ ID NO: 19361 - DNA, 15 bp, Homo sapiens
ggtgatccgcccgcc

SEQ ID NO: 19362 - DNA, 15 bp, Homo sapiens
aggtgatccgcccgc

SEQ ID NO: 19363 - DNA, 15 bp, Homo sapiens
caggtgatccgcccg

SEQ ID NO: 19364 - DNA, 15 bp, Homo sapiens
tcaggtgatccgccc

SEQ ID NO: 19365 - DNA, 15 bp, Homo sapiens
ctcaggtgatccgcc

SEQ ID NO: 19366 - DNA, 15 bp, Homo sapiens
cctcaggtgatccgc

SEQ ID NO: 19367 - DNA, 15 bp, Homo sapiens
acctcaggtgatccg

SEQ ID NO: 19368 - DNA, 15 bp, Homo sapiens
gacctcaggtgatcc

SEQ ID NO: 19369 - DNA, 15 bp, Homo sapiens
tgacctcaggtgatc

SEQ ID NO: 19370 - DNA, 15 bp, Homo sapiens
ctgacctcaggtgat

SEQ ID NO: 19371 - DNA, 15 bp, Homo sapiens
cctgacctcaggtga

SEQ ID NO: 19372 - DNA, 15 bp, Homo sapiens
tcctgacctcaggtg

SEQ ID NO: 19373 - DNA, 15 bp, Homo sapiens
ctcctgacctcaggt

SEQ ID NO: 19374 - DNA, 15 bp, Homo sapiens
actcctgacctcagg

SEQ ID NO: 19375 - DNA, 15 bp, Homo sapiens
tgaactcctgacctc

SEQ ID NO: 19376 - DNA, 15 bp, Homo sapiens
ttgaactcctgacct

SEQ ID NO: 19377 - DNA, 15 bp, Homo sapiens
cttgaactcctgacc

SEQ ID NO: 19378 - DNA, 15 bp, Homo sapiens
tcttgaactcctgac

SEQ ID NO: 19379 - DNA, 15 bp, Homo sapiens
gtcttgaactcctga

SEQ ID NO: 19380 - DNA, 15 bp, Homo sapiens
ggtcttgaactcctg

SEQ ID NO: 19381 - DNA, 15 bp, Homo sapiens
tggtcttgaactcct

SEQ ID NO: 19382 - DNA, 15 bp, Homo sapiens
ctggtcttgaactcc

SEQ ID NO: 19383 - DNA, 15 bp, Homo sapiens
gctggtcttgaactc

SEQ ID NO: 19384 - DNA, 15 bp, Homo sapiens
ggctggtcttgaact

SEQ ID NO: 19385 - DNA, 15 bp, Homo sapiens
aggctggtcttgaac

SEQ ID NO: 19386 - DNA, 15 bp, Homo sapiens
caggctggtcttgaa

SEQ ID NO: 19387 - DNA, 15 bp, Homo sapiens
ccaggctggtcttga

SEQ ID NO: 19388 - DNA, 15 bp, Homo sapiens
gccaggctggtcttg

SEQ ID NO: 19389 - DNA, 15 bp, Homo sapiens
ggccaggctggtctt

SEQ ID NO: 19390 - DNA, 15 bp, Homo sapiens
tatgttggccaggct

SEQ ID NO: 19391 - DNA, 15 bp, Homo sapiens
ctatgttggccaggc

SEQ ID NO: 19392 - DNA, 15 bp, Homo sapiens
actatgttggccagg

SEQ ID NO: 19393 - DNA, 15 bp, Homo sapiens
cactatgttggccag

SEQ ID NO: 19394 - DNA, 15 bp, Homo sapiens
tcactatgttggcca

SEQ ID NO: 19395 - DNA, 15 bp, Homo sapiens
ttcactatgttggcc

SEQ ID NO: 19396 - DNA, 15 bp, Homo sapiens
tttcactatgttggc

SEQ ID NO: 19397 - DNA, 15 bp, Homo sapiens
gtttcactatgttgg

SEQ ID NO: 19398 - DNA, 15 bp, Homo sapiens
ggtttcactatgttg

SEQ ID NO: 19399 - DNA, 15 bp, Homo sapiens
gggtttcactatgtt

SEQ ID NO: 19400 - DNA, 15 bp, Homo sapiens
agggtttcactatgt

SEQ ID NO: 19401 - DNA, 15 bp, Homo sapiens
tagggtttcactatg

SEQ ID NO: 19402 - DNA, 15 bp, Homo sapiens
gtagggtttcactat

SEQ ID NO: 19403 - DNA, 15 bp, Homo sapiens
ggtagggtttcacta

SEQ ID NO: 19404 - DNA, 15 bp, Homo sapiens
aggtagggtttcact

SEQ ID NO: 19405 - DNA, 15 bp, Homo sapiens
gaggtagggtttcac

SEQ ID NO: 19406 - DNA, 15 bp, Homo sapiens
agaggtagggtttca

SEQ ID NO: 19407 - DNA, 15 bp, Homo sapiens
tagaggtagggtttc

SEQ ID NO: 19408 - DNA, 15 bp, Homo sapiens
gtagaggtagggttt

SEQ ID NO: 19409 - DNA, 15 bp, Homo sapiens
agtagaggtagggtt

SEQ ID NO: 19410 - DNA, 15 bp, Homo sapiens
tagtagaggtagggt

SEQ ID NO: 19411 - DNA, 15 bp, Homo sapiens
ttagtagaggtaggg

SEQ ID NO: 19412 - DNA, 15 bp, Homo sapiens
tttagtagaggtagg

SEQ ID NO: 19413 - DNA, 15 bp, Homo sapiens
ttttagtagaggtag

SEQ ID NO: 19414 - DNA, 15 bp, Homo sapiens
tttttagtagaggta

SEQ ID NO: 19415 - DNA, 15 bp, Homo sapiens
atttttagtagaggt

SEQ ID NO: 19416 - DNA, 15 bp, Homo sapiens
tatttttagtagagg

SEQ ID NO: 19417 - DNA, 15 bp, Homo sapiens
gtaattttttttttt

SEQ ID NO: 19418 - DNA, 15 bp, Homo sapiens
ggtaatttttttttt

SEQ ID NO: 19419 - DNA, 15 bp, Homo sapiens
aggtaattttttttt

SEQ ID NO: 19420 - DNA, 15 bp, Homo sapiens
caggtaatttttttt

SEQ ID NO: 19421 - DNA, 15 bp, Homo sapiens
ccaggtaattttttt

SEQ ID NO: 19422 - DNA, 15 bp, Homo sapiens
cccaggtaatttttt

SEQ ID NO: 19423 - DNA, 15 bp, Homo sapiens
gcccaggtaattttt

SEQ ID NO: 19424 - DNA, 15 bp, Homo sapiens
tgcccaggtaatttt

SEQ ID NO: 19425 - DNA, 15 bp, Homo sapiens
atgcccaggtaattt

SEQ ID NO: 19426 - DNA, 15 bp, Homo sapiens
catgcccaggtaatt

SEQ ID NO: 19427 - DNA, 15 bp, Homo sapiens
ccatgcccaggtaat

SEQ ID NO: 19428 - DNA, 15 bp, Homo sapiens
cccatgcccaggtaa

SEQ ID NO: 19429 - DNA, 15 bp, Homo sapiens
ccccatgcccaggta

SEQ ID NO: 19430 - DNA, 15 bp, Homo sapiens
accccatgcccaggt

SEQ ID NO: 19431 - DNA, 15 bp, Homo sapiens
gaccccatgcccagg

SEQ ID NO: 19432 - DNA, 15 bp, Homo sapiens
cgaccccatgcccag

SEQ ID NO: 19433 - DNA, 15 bp, Homo sapiens
gcgaccccatgccca

SEQ ID NO: 19434 - DNA, 15 bp, Homo sapiens
cgcgaccccatgccc

SEQ ID NO: 19435 - DNA, 15 bp, Homo sapiens
gcgcgaccccatgcc

SEQ ID NO: 19436 - DNA, 15 bp, Homo sapiens
tgcgcgaccccatgc

SEQ ID NO: 19437 - DNA, 15 bp, Homo sapiens
gtgcgcgaccccatg

SEQ ID NO: 19438 - DNA, 15 bp, Homo sapiens
ggtgcgcgaccccat

SEQ ID NO: 19439 - DNA, 15 bp, Homo sapiens
aggtgcgcgacccca

SEQ ID NO: 19440 - DNA, 15 bp, Homo sapiens
caggtgcgcgacccc

SEQ ID NO: 19441 - DNA, 15 bp, Homo sapiens
acaggtgcgcgaccc

SEQ ID NO: 19442 - DNA, 15 bp, Homo sapiens
tacaggtgcgcgacc

SEQ ID NO: 19443 - DNA, 15 bp, Homo sapiens
ctacaggtgcgcgac

SEQ ID NO: 19444 - DNA, 15 bp, Homo sapiens
actacaggtgcgcga

SEQ ID NO: 19445 - DNA, 15 bp, Homo sapiens
gactacaggtgcgcg

SEQ ID NO: 19446 - DNA, 15 bp, Homo sapiens
ggactacaggtgcgc

SEQ ID NO: 19447 - DNA, 15 bp, Homo sapiens
gggactacaggtgcg

SEQ ID NO: 19448 - DNA, 15 bp, Homo sapiens
ctgggactacaggtg

SEQ ID NO: 19449 - DNA, 15 bp, Homo sapiens
gctgggactacaggt

SEQ ID NO: 19450 - DNA, 15 bp, Homo sapiens
tgagtagctgggact

SEQ ID NO: 19451 - DNA, 15 bp, Homo sapiens
ctgagtagctgggac

SEQ ID NO: 19452 - DNA, 15 bp, Homo sapiens
cctgagtagctggga

SEQ ID NO: 19453 - DNA, 15 bp, Homo sapiens
tcctgagtagctggg

SEQ ID NO: 19454 - DNA, 15 bp, Homo sapiens
ctcctgagtagctgg

SEQ ID NO: 19455 - DNA, 15 bp, Homo sapiens
cctcctgagtagctg

SEQ ID NO: 19456 - DNA, 15 bp, Homo sapiens
gcctcctgagtagct

SEQ ID NO: 19457 - DNA, 15 bp, Homo sapiens
agcctcctgagtagc

SEQ ID NO: 19458 - DNA, 15 bp, Homo sapiens
cttagcctcctgagt

SEQ ID NO: 19459 - DNA, 15 bp, Homo sapiens
ccttagcctcctgag

SEQ ID NO: 19460 - DNA, 15 bp, Homo sapiens
gccttagcctcctga

SEQ ID NO: 19461 - DNA, 15 bp, Homo sapiens
tgccttagcctcctg

SEQ ID NO: 19462 - DNA, 15 bp, Homo sapiens
atgccttagcctcct

SEQ ID NO: 19463 - DNA, 15 bp, Homo sapiens
catgccttagcctcc

SEQ ID NO: 19464 - DNA, 15 bp, Homo sapiens
ccatgccttagcctc

SEQ ID NO: 19465 - DNA, 15 bp, Homo sapiens
cccatgccttagcct

SEQ ID NO: 19466 - DNA, 15 bp, Homo sapiens
tcccatgccttagcc

SEQ ID NO: 19467 - DNA, 15 bp, Homo sapiens
ttcccatgccttagc

SEQ ID NO: 19468 - DNA, 15 bp, Homo sapiens
attcccatgccttag

SEQ ID NO: 19469 - DNA, 15 bp, Homo sapiens
tattcccatgcctta

SEQ ID NO: 19470 - DNA, 15 bp, Homo sapiens
ttattcccatgcctt

SEQ ID NO: 19471 - DNA, 15 bp, Homo sapiens
attattcccatgcct

SEQ ID NO: 19472 - DNA, 15 bp, Homo sapiens
aattattcccatgcc

SEQ ID NO: 19473 - DNA, 15 bp, Homo sapiens
aaattattcccatgc

SEQ ID NO: 19474 - DNA, 15 bp, Homo sapiens
caaattattcccatg

SEQ ID NO: 19475 - DNA, 15 bp, Homo sapiens
tcaaattattcccat

SEQ ID NO: 19476 - DNA, 15 bp, Homo sapiens
ttcaaattattccca

SEQ ID NO: 19477 - DNA, 15 bp, Homo sapiens
gttcaaattattccc

SEQ ID NO: 19478 - DNA, 15 bp, Homo sapiens
ggttcaaattattcc

SEQ ID NO: 19479 - DNA, 15 bp, Homo sapiens
aggttcaaattattc

SEQ ID NO: 19480 - DNA, 15 bp, Homo sapiens
caggttcaaattatt

SEQ ID NO: 19481 - DNA, 15 bp, Homo sapiens
ccaggttcaaattat

SEQ ID NO: 19482 - DNA, 15 bp, Homo sapiens
cccaggttcaaatta

SEQ ID NO: 19483 - DNA, 15 bp, Homo sapiens
tcccaggttcaaatt

SEQ ID NO: 19484 - DNA, 15 bp, Homo sapiens
ctcccaggttcaaat

SEQ ID NO: 19485 - DNA, 15 bp, Homo sapiens
cctcccaggttcaaa

SEQ ID NO: 19486 - DNA, 15 bp, Homo sapiens
ctccacctcccaggt

SEQ ID NO: 19487 - DNA, 15 bp, Homo sapiens
gcctccacctcccag

SEQ ID NO: 19488 - DNA, 15 bp, Homo sapiens
agcctccacctccca

SEQ ID NO: 19489 - DNA, 15 bp, Homo sapiens
cagcctccacctccc

SEQ ID NO: 19490 - DNA, 15 bp, Homo sapiens
gcagcctccacctcc

SEQ ID NO: 19491 - DNA, 15 bp, Homo sapiens
cgcagcctccacctc

SEQ ID NO: 19492 - DNA, 15 bp, Homo sapiens
ccgcagcctccacct

SEQ ID NO: 19493 - DNA, 15 bp, Homo sapiens
accgcagcctccacc

SEQ ID NO: 19494 - DNA, 15 bp, Homo sapiens
caccgcagcctccac

SEQ ID NO: 19495 - DNA, 15 bp, Homo sapiens
tcaccgcagcctcca

SEQ ID NO: 19496 - DNA, 15 bp, Homo sapiens
ctcaccgcagcctcc

SEQ ID NO: 19497 - DNA, 15 bp, Homo sapiens
actcaccgcagcctc

SEQ ID NO: 19498 - DNA, 15 bp, Homo sapiens
gactcaccgcagcct

SEQ ID NO: 19499 - DNA, 15 bp, Homo sapiens
tgactcaccgcagcc

SEQ ID NO: 19500 - DNA, 15 bp, Homo sapiens
ttgactcaccgcagc

SEQ ID NO: 19501 - DNA, 15 bp, Homo sapiens
attgactcaccgcag

SEQ ID NO: 19502 - DNA, 15 bp, Homo sapiens
tattgactcaccgca

SEQ ID NO: 19503 - DNA, 15 bp, Homo sapiens
atattgactcaccgc

SEQ ID NO: 19504 - DNA, 15 bp, Homo sapiens
gatattgactcaccg

SEQ ID NO: 19505 - DNA, 15 bp, Homo sapiens
tgatattgactcacc

SEQ ID NO: 19506 - DNA, 15 bp, Homo sapiens
gtgatattgactcac

SEQ ID NO: 19507 - DNA, 15 bp, Homo sapiens
tgtgatattgactca

SEQ ID NO: 19508 - DNA, 15 bp, Homo sapiens
atgtgatattgactc

SEQ ID NO: 19509 - DNA, 15 bp, Homo sapiens
gatgtgatattgact

SEQ ID NO: 19510 - DNA, 15 bp, Homo sapiens
tgatgtgatattgac

SEQ ID NO: 19511 - DNA, 15 bp, Homo sapiens
gtgatgtgatattga

SEQ ID NO: 19512 - DNA, 15 bp, Homo sapiens
agtgatgtgatattg

SEQ ID NO: 19513 - DNA, 15 bp, Homo sapiens
cagtgatgtgatatt

SEQ ID NO: 19514 - DNA, 15 bp, Homo sapiens
gcagtgatgtgatat

SEQ ID NO: 19515 - DNA, 15 bp, Homo sapiens
tgcagtgatgtgata

SEQ ID NO: 19516 - DNA, 15 bp, Homo sapiens
gagtgcagtgatgtg

SEQ ID NO: 19517 - DNA, 15 bp, Homo sapiens
ggagtgcagtgatgt

SEQ ID NO: 19518 - DNA, 15 bp, Homo sapiens
tggagtgcagtgatg

SEQ ID NO: 19519 - DNA, 15 bp, Homo sapiens
ctggagtgcagtgat

SEQ ID NO: 19520 - DNA, 15 bp, Homo sapiens
gctggagtgcagtga

SEQ ID NO: 19521 - DNA, 15 bp, Homo sapiens
acccaggctggagtg

SEQ ID NO: 19522 - DNA, 15 bp, Homo sapiens
cacccaggctggagt

SEQ ID NO: 19523 - DNA, 15 bp, Homo sapiens
ccacccaggctggag

SEQ ID NO: 19524 - DNA, 15 bp, Homo sapiens
gccacccaggctgga

SEQ ID NO: 19525 - DNA, 15 bp, Homo sapiens
tgccacccaggctgg

SEQ ID NO: 19526 - DNA, 15 bp, Homo sapiens
ctgccacccaggctg

SEQ ID NO: 19527 - DNA, 15 bp, Homo sapiens
tctgccacccaggct

SEQ ID NO: 19528 - DNA, 15 bp, Homo sapiens
ctctgccacccaggc

SEQ ID NO: 19529 - DNA, 15 bp, Homo sapiens
actctgccacccagg

SEQ ID NO: 19530 - DNA, 15 bp, Homo sapiens
cactctgccacccag

SEQ ID NO: 19531 - DNA, 15 bp, Homo sapiens
acactctgccaccca

SEQ ID NO: 19532 - DNA, 15 bp, Homo sapiens
cacactctgccaccc

SEQ ID NO: 19533 - DNA, 15 bp, Homo sapiens
tcacactctgccacc

SEQ ID NO: 19534 - DNA, 15 bp, Homo sapiens
gtcacactctgccac

SEQ ID NO: 19535 - DNA, 15 bp, Homo sapiens
agtcacactctgcca

SEQ ID NO: 19536 - DNA, 15 bp, Homo sapiens
gagtcacactctgcc

SEQ ID NO: 19537 - DNA, 15 bp, Homo sapiens
agagtcacactctgc

SEQ ID NO: 19538 - DNA, 15 bp, Homo sapiens
cagagtcacactctg

SEQ ID NO: 19539 - DNA, 15 bp, Homo sapiens
acagagtcacactct

SEQ ID NO: 19540 - DNA, 15 bp, Homo sapiens
aacagagtcacactc

SEQ ID NO: 19541 - DNA, 15 bp, Homo sapiens
caacagagtcacact

SEQ ID NO: 19542 - DNA, 15 bp, Homo sapiens
tcaacagagtcacac

SEQ ID NO: 19543 - DNA, 15 bp, Homo sapiens
ttcaacagagtcaca

SEQ ID NO: 19544 - DNA, 15 bp, Homo sapiens
tttcaacagagtcac

SEQ ID NO: 19545 - DNA, 15 bp, Homo sapiens
ttttcaacagagtca

SEQ ID NO: 19546 - DNA, 15 bp, Homo sapiens
tttttcaacagagtc

SEQ ID NO: 19547 - DNA, 15 bp, Homo sapiens
ttttttcaacagagt

SEQ ID NO: 19548 - DNA, 15 bp, Homo sapiens
tttttttcaacagag

SEQ ID NO: 19549 - DNA, 15 bp, Homo sapiens
ttttttttcaacaga

SEQ ID NO: 19550 - DNA, 15 bp, Homo sapiens
tttttttttcaacag

SEQ ID NO: 19551 - DNA, 15 bp, Homo sapiens
ttttttttttcaaca

SEQ ID NO: 19552 - DNA, 15 bp, Homo sapiens
tttttttttttcaac

SEQ ID NO: 19553 - DNA, 15 bp, Homo sapiens
ttttttttttttcaa

SEQ ID NO: 19554 - DNA, 15 bp, Homo sapiens
tttttttttttttca

SEQ ID NO: 19555 - DNA, 15 bp, Homo sapiens
atttttttttttttc

SEQ ID NO: 19556 - DNA, 15 bp, Homo sapiens
gattttttttttttt

SEQ ID NO: 19557 - DNA, 15 bp, Homo sapiens
tgatttttttttttt

SEQ ID NO: 19558 - DNA, 15 bp, Homo sapiens
ttgattttttttttt

SEQ ID NO: 19559 - DNA, 15 bp, Homo sapiens
cttgatttttttttt

SEQ ID NO: 19560 - DNA, 15 bp, Homo sapiens
tcttgattttttttt

SEQ ID NO: 19561 - DNA, 15 bp, Homo sapiens
ttcttgatttttttt

SEQ ID NO: 19562 - DNA, 15 bp, Homo sapiens
gttcttgattttttt

SEQ ID NO: 19563 - DNA, 15 bp, Homo sapiens
agttcttgatttttt

SEQ ID NO: 19564 - DNA, 15 bp, Homo sapiens
cagttcttgattttt

SEQ ID NO: 19565 - DNA, 15 bp, Homo sapiens
acagttcttgatttt

SEQ ID NO: 19566 - DNA, 15 bp, Homo sapiens
aacagttcttgattt

SEQ ID NO: 19567 - DNA, 15 bp, Homo sapiens
caacagttcttgatt

SEQ ID NO: 19568 - DNA, 15 bp, Homo sapiens
gcaacagttcttgat

SEQ ID NO: 19569 - DNA, 15 bp, Homo sapiens
tgcaacagttcttga

SEQ ID NO: 19570 - DNA, 15 bp, Homo sapiens
atgcaacagttcttg

SEQ ID NO: 19571 - DNA, 15 bp, Homo sapiens
tatgcaacagttctt

SEQ ID NO: 19572 - DNA, 15 bp, Homo sapiens
atatgcaacagttct

SEQ ID NO: 19573 - DNA, 15 bp, Homo sapiens
aatatgcaacagttc

SEQ ID NO: 19574 - DNA, 15 bp, Homo sapiens
aaatatgcaacagtt

SEQ ID NO: 19575 - DNA, 15 bp, Homo sapiens
aaaatatgcaacagt

SEQ ID NO: 19576 - DNA, 15 bp, Homo sapiens
taaaatatgcaacag

SEQ ID NO: 19577 - DNA, 15 bp, Homo sapiens
ataaaatatgcaaca

SEQ ID NO: 19578 - DNA, 15 bp, Homo sapiens
aataaaatatgcaac

SEQ ID NO: 19579 - DNA, 15 bp, Homo sapiens
aaataaaatatgcaa

SEQ ID NO: 19580 - DNA, 15 bp, Homo sapiens
taaataaaatatgca

SEQ ID NO: 19581 - DNA, 15 bp, Homo sapiens
ataaataaaatatgc

SEQ ID NO: 19582 - DNA, 15 bp, Homo sapiens
gataaataaaatatg

SEQ ID NO: 19583 - DNA, 15 bp, Homo sapiens
agataaataaaatat

SEQ ID NO: 19584 - DNA, 15 bp, Homo sapiens
aagataaataaaata

SEQ ID NO: 19585 - DNA, 15 bp, Homo sapiens
aaagataaataaaat

SEQ ID NO: 19586 - DNA, 15 bp, Homo sapiens
caaagataaataaaa

SEQ ID NO: 19587 - DNA, 15 bp, Homo sapiens
acaaagataaataaa

SEQ ID NO: 19588 - DNA, 15 bp, Homo sapiens
tacaaagataaataa

SEQ ID NO: 19589 - DNA, 15 bp, Homo sapiens
atacaaagataaata

SEQ ID NO: 19590 - DNA, 15 bp, Homo sapiens
aatacaaagataaat

SEQ ID NO: 19591 - DNA, 15 bp, Homo sapiens
aaatacaaagataaa

SEQ ID NO: 19592 - DNA, 15 bp, Homo sapiens
aaaatacaaagataa

SEQ ID NO: 19593 - DNA, 15 bp, Homo sapiens
gaaaatacaaagata

SEQ ID NO: 19594 - DNA, 15 bp, Homo sapiens
agaaaatacaaagat

SEQ ID NO: 19595 - DNA, 15 bp, Homo sapiens
cagaaaatacaaaga

SEQ ID NO: 19596 - DNA, 15 bp, Homo sapiens
tcagaaaatacaaag

SEQ ID NO: 19597 - DNA, 15 bp, Homo sapiens
ctcagaaaatacaaa

SEQ ID NO: 19598 - DNA, 15 bp, Homo sapiens
tctcagaaaatacaa

SEQ ID NO: 19599 - DNA, 15 bp, Homo sapiens
atctcagaaaataca

SEQ ID NO: 19600 - DNA, 15 bp, Homo sapiens
tatctcagaaaatac

SEQ ID NO: 19601 - DNA, 15 bp, Homo sapiens
atatctcagaaaata

SEQ ID NO: 19602 - DNA, 15 bp, Homo sapiens
aatatctcagaaaat

SEQ ID NO: 19603 - DNA, 15 bp, Homo sapiens
aaatatctcagaaaa

SEQ ID NO: 19604 - DNA, 15 bp, Homo sapiens
aaaatatctcagaaa

SEQ ID NO: 19605 - DNA, 15 bp, Homo sapiens
aaaaatatctcagaa

SEQ ID NO: 19606 - DNA, 15 bp, Homo sapiens
caaaaatatctcaga

SEQ ID NO: 19607 - DNA, 15 bp, Homo sapiens
tcaaaaatatctcag

SEQ ID NO: 19608 - DNA, 15 bp, Homo sapiens
gtcaaaaatatctca

SEQ ID NO: 19609 - DNA, 15 bp, Homo sapiens
agtcaaaaatatctc

SEQ ID NO: 19610 - DNA, 15 bp, Homo sapiens
cagtcaaaaatatct

SEQ ID NO: 19611 - DNA, 15 bp, Homo sapiens
tcagtcaaaaatatc

SEQ ID NO: 19612 - DNA, 15 bp, Homo sapiens
gtcagtcaaaaatat

SEQ ID NO: 19613 - DNA, 15 bp, Homo sapiens
ggtcagtcaaaaata

SEQ ID NO: 19614 - DNA, 15 bp, Homo sapiens
gggtcagtcaaaaat

SEQ ID NO: 19615 - DNA, 15 bp, Homo sapiens
agggtcagtcaaaaa

SEQ ID NO: 19616 - DNA, 15 bp, Homo sapiens
tagggtcagtcaaaa

SEQ ID NO: 19617 - DNA, 15 bp, Homo sapiens
ttagggtcagtcaaa

SEQ ID NO: 19618 - DNA, 15 bp, Homo sapiens
tttagggtcagtcaa

SEQ ID NO: 19619 - DNA, 15 bp, Homo sapiens
ttttagggtcagtca

SEQ ID NO: 19620 - DNA, 15 bp, Homo sapiens
attttagggtcagtc

SEQ ID NO: 19621 - DNA, 15 bp, Homo sapiens
cattttagggtcagt

SEQ ID NO: 19622 - DNA, 15 bp, Homo sapiens
tcattttagggtcag

SEQ ID NO: 19623 - DNA, 15 bp, Homo sapiens
ctcattttagggtca

SEQ ID NO: 19624 - DNA, 15 bp, Homo sapiens
gctcattttagggtc

SEQ ID NO: 19625 - DNA, 15 bp, Homo sapiens
tgctcattttagggt

SEQ ID NO: 19626 - DNA, 15 bp, Homo sapiens
atgctcattttaggg

SEQ ID NO: 19627 - DNA, 15 bp, Homo sapiens
gatgctcattttagg

SEQ ID NO: 19628 - DNA, 15 bp, Homo sapiens
agatgctcattttag

SEQ ID NO: 19629 - DNA, 15 bp, Homo sapiens
cagatgctcatttta

SEQ ID NO: 19630 - DNA, 15 bp, Homo sapiens
ccagatgctcatttt

SEQ ID NO: 19631 - DNA, 15 bp, Homo sapiens
tccagatgctcattt

SEQ ID NO: 19632 - DNA, 15 bp, Homo sapiens
atccagatgctcatt

SEQ ID NO: 19633 - DNA, 15 bp, Homo sapiens
catccagatgctcat

SEQ ID NO: 19634 - DNA, 15 bp, Homo sapiens
ccatccagatgctca

SEQ ID NO: 19635 - DNA, 15 bp, Homo sapiens
accatccagatgctc

SEQ ID NO: 19636 - DNA, 15 bp, Homo sapiens
taccatccagatgct

SEQ ID NO: 19637 - DNA, 15 bp, Homo sapiens
ctaccatccagatgc

SEQ ID NO: 19638 - DNA, 15 bp, Homo sapiens
tctaccatccagatg

SEQ ID NO: 19639 - DNA, 15 bp, Homo sapiens
atctaccatccagat

SEQ ID NO: 19640 - DNA, 15 bp, Homo sapiens
catctaccatccaga

SEQ ID NO: 19641 - DNA, 15 bp, Homo sapiens
tcatctaccatccag

SEQ ID NO: 19642 - DNA, 15 bp, Homo sapiens
gtcatctaccatcca

SEQ ID NO: 19643 - DNA, 15 bp, Homo sapiens
cgtcatctaccatcc

SEQ ID NO: 19644 - DNA, 15 bp, Homo sapiens
ccgtcatctaccatc

SEQ ID NO: 19645 - DNA, 15 bp, Homo sapiens
gccgtcatctaccat

SEQ ID NO: 19646 - DNA, 15 bp, Homo sapiens
tgccgtcatctacca

SEQ ID NO: 19647 - DNA, 15 bp, Homo sapiens
ctgccgtcatctacc

SEQ ID NO: 19648 - DNA, 15 bp, Homo sapiens
gctgccgtcatctac

SEQ ID NO: 19649 - DNA, 15 bp, Homo sapiens
cgctgccgtcatcta

SEQ ID NO: 19650 - DNA, 15 bp, Homo sapiens
ccgctgccgtcatct

SEQ ID NO: 19651 - DNA, 15 bp, Homo sapiens
tccgctgccgtcatc

SEQ ID NO: 19652 - DNA, 15 bp, Homo sapiens
ttccgctgccgtcat

SEQ ID NO: 19653 - DNA, 15 bp, Homo sapiens
cttccgctgccgtca

SEQ ID NO: 19654 - DNA, 15 bp, Homo sapiens
tcttccgctgccgtc

SEQ ID NO: 19655 - DNA, 15 bp, Homo sapiens
atcttccgctgccgt

SEQ ID NO: 19656 - DNA, 15 bp, Homo sapiens
catcttccgctgccg

SEQ ID NO: 19657 - DNA, 15 bp, Homo sapiens
tcatcttccgctgcc

SEQ ID NO: 19658 - DNA, 15 bp, Homo sapiens
ttcatcttccgctgc

SEQ ID NO: 19659 - DNA, 15 bp, Homo sapiens
cttcatcttccgctg

SEQ ID NO: 19660 - DNA, 15 bp, Homo sapiens
tcttcatcttccgct

SEQ ID NO: 19661 - DNA, 15 bp, Homo sapiens
ttcttcatcttccgc

SEQ ID NO: 19662 - DNA, 15 bp, Homo sapiens
attcttcatcttccg

SEQ ID NO: 19663 - DNA, 15 bp, Homo sapiens
aattcttcatcttcc

SEQ ID NO: 19664 - DNA, 15 bp, Homo sapiens
taattcttcatcttc

SEQ ID NO: 19665 - DNA, 15 bp, Homo sapiens
ttaattcttcatctt

SEQ ID NO: 19666 - DNA, 15 bp, Homo sapiens
cttaattcttcatct

SEQ ID NO: 19667 - DNA, 15 bp, Homo sapiens
tcttaattcttcatc

SEQ ID NO: 19668 - DNA, 15 bp, Homo sapiens
ttcttaattcttcat

SEQ ID NO: 19669 - DNA, 15 bp, Homo sapiens
cttcttaattcttca

SEQ ID NO: 19670 - DNA, 15 bp, Homo sapiens
acttcttaattcttc

SEQ ID NO: 19671 - DNA, 15 bp, Homo sapiens
cacttcttaattctt

SEQ ID NO: 19672 - DNA, 15 bp, Homo sapiens
ccacttcttaattct

SEQ ID NO: 19673 - DNA, 15 bp, Homo sapiens
accacttcttaattc

SEQ ID NO: 19674 - DNA, 15 bp, Homo sapiens
aaccacttcttaatt

SEQ ID NO: 19675 - DNA, 15 bp, Homo sapiens
aaaccacttcttaat

SEQ ID NO: 19676 - DNA, 15 bp, Homo sapiens
aaaaccacttcttaa

SEQ ID NO: 19677 - DNA, 15 bp, Homo sapiens
aaaaaccacttctta

SEQ ID NO: 19678 - DNA, 15 bp, Homo sapiens
caaaaaccacttctt

SEQ ID NO: 19679 - DNA, 15 bp, Homo sapiens
tcaaaaaccacttct

SEQ ID NO: 19680 - DNA, 15 bp, Homo sapiens
atcaaaaaccacttc

SEQ ID NO: 19681 - DNA, 15 bp, Homo sapiens
aatcaaaaaccactt

SEQ ID NO: 19682 - DNA, 15 bp, Homo sapiens
aaatcaaaaaccact

SEQ ID NO: 19683 - DNA, 15 bp, Homo sapiens
caaatcaaaaaccac

SEQ ID NO: 19684 - DNA, 15 bp, Homo sapiens
acaaatcaaaaacca

SEQ ID NO: 19685 - DNA, 15 bp, Homo sapiens
tacaaatcaaaaacc

SEQ ID NO: 19686 - DNA, 15 bp, Homo sapiens
ttacaaatcaaaaac

SEQ ID NO: 19687 - DNA, 15 bp, Homo sapiens
attacaaatcaaaaa

SEQ ID NO: 19688 - DNA, 15 bp, Homo sapiens
tattacaaatcaaaa

SEQ ID NO: 19689 - DNA, 15 bp, Homo sapiens
atattacaaatcaaa

SEQ ID NO: 19690 - DNA, 15 bp, Homo sapiens
aatattacaaatcaa

SEQ ID NO: 19691 - DNA, 15 bp, Homo sapiens
aaatattacaaatca

SEQ ID NO: 19692 - DNA, 15 bp, Homo sapiens
aaaatattacaaatc

SEQ ID NO: 19693 - DNA, 15 bp, Homo sapiens
aaaaatattacaaat

SEQ ID NO: 19694 - DNA, 15 bp, Homo sapiens
aaaaaatattacaaa

SEQ ID NO: 19695 - DNA, 15 bp, Homo sapiens
taaaaaatattacaa

SEQ ID NO: 19696 - DNA, 15 bp, Homo sapiens
ctaaaaaatattaca

SEQ ID NO: 19697 - DNA, 15 bp, Homo sapiens
actaaaaaatattac

SEQ ID NO: 19698 - DNA, 15 bp, Homo sapiens
tactaaaaaatatta

SEQ ID NO: 19699 - DNA, 15 bp, Homo sapiens
ctactaaaaaatatt

SEQ ID NO: 19700 - DNA, 15 bp, Homo sapiens
tctactaaaaaatat

SEQ ID NO: 19701 - DNA, 15 bp, Homo sapiens
atctactaaaaaata

SEQ ID NO: 19702 - DNA, 15 bp, Homo sapiens
tatctactaaaaaat

SEQ ID NO: 19703 - DNA, 15 bp, Homo sapiens
atatctactaaaaaa

SEQ ID NO: 19704 - DNA, 15 bp, Homo sapiens
aatatctactaaaaa

SEQ ID NO: 19705 - DNA, 15 bp, Homo sapiens
taatatctactaaaa

SEQ ID NO: 19706 - DNA, 15 bp, Homo sapiens
ataatatctactaaa

SEQ ID NO: 19707 - DNA, 15 bp, Homo sapiens
aataatatctactaa

SEQ ID NO: 19708 - DNA, 15 bp, Homo sapiens
taataatatctacta

SEQ ID NO: 19709 - DNA, 15 bp, Homo sapiens
ctaataatatctact

SEQ ID NO: 19710 - DNA, 15 bp, Homo sapiens
actaataatatctac

SEQ ID NO: 19711 - DNA, 15 bp, Homo sapiens
aactaataatatcta

SEQ ID NO: 19712 - DNA, 15 bp, Homo sapiens
caactaataatatct

SEQ ID NO: 19713 - DNA, 15 bp, Homo sapiens
tcaactaataatatc

SEQ ID NO: 19714 - DNA, 15 bp, Homo sapiens
atcaactaataatat

SEQ ID NO: 19715 - DNA, 15 bp, Homo sapiens
catcaactaataata

SEQ ID NO: 19716 - DNA, 15 bp, Homo sapiens
gcatcaactaataat

SEQ ID NO: 19717 - DNA, 15 bp, Homo sapiens
ggcatcaactaataa

SEQ ID NO: 19718 - DNA, 15 bp, Homo sapiens
cggcatcaactaata

SEQ ID NO: 19719 - DNA, 15 bp, Homo sapiens
gcggcatcaactaat

SEQ ID NO: 19720 - DNA, 15 bp, Homo sapiens
tgcggcatcaactaa

SEQ ID NO: 19721 - DNA, 15 bp, Homo sapiens
ctgcggcatcaacta

SEQ ID NO: 19722 - DNA, 15 bp, Homo sapiens
actgcggcatcaact

SEQ ID NO: 19723 - DNA, 15 bp, Homo sapiens
aactgcggcatcaac

SEQ ID NO: 19724 - DNA, 15 bp, Homo sapiens
caactgcggcatcaa

SEQ ID NO: 19725 - DNA, 15 bp, Homo sapiens
acaactgcggcatca

SEQ ID NO: 19726 - DNA, 15 bp, Homo sapiens
aacaactgcggcatc

SEQ ID NO: 19727 - DNA, 15 bp, Homo sapiens
caacaactgcggcat

SEQ ID NO: 19728 - DNA, 15 bp, Homo sapiens
tcaacaactgcggca

SEQ ID NO: 19729 - DNA, 15 bp, Homo sapiens
gtcaacaactgcggc

SEQ ID NO: 19730 - DNA, 15 bp, Homo sapiens
agtcaacaactgcgg

SEQ ID NO: 19731 - DNA, 15 bp, Homo sapiens
cagtcaacaactgcg

SEQ ID NO: 19732 - DNA, 15 bp, Homo sapiens
acagtcaacaactgc

SEQ ID NO: 19733 - DNA, 15 bp, Homo sapiens
tacagtcaacaactg

SEQ ID NO: 19734 - DNA, 15 bp, Homo sapiens
atacagtcaacaact

SEQ ID NO: 19735 - DNA, 15 bp, Homo sapiens
aatacagtcaacaac

SEQ ID NO: 19736 - DNA, 15 bp, Homo sapiens
aaatacagtcaacaa

SEQ ID NO: 19737 - DNA, 15 bp, Homo sapiens
taaatacagtcaaca

SEQ ID NO: 19738 - DNA, 15 bp, Homo sapiens
ataaatacagtcaac

SEQ ID NO: 19739 - DNA, 15 bp, Homo sapiens
gataaatacagtcaa

SEQ ID NO: 19740 - DNA, 15 bp, Homo sapiens
agataaatacagtca

SEQ ID NO: 19741 - DNA, 15 bp, Homo sapiens
gagataaatacagtc

SEQ ID NO: 19742 - DNA, 15 bp, Homo sapiens
ggagataaatacagt

SEQ ID NO: 19743 - DNA, 15 bp, Homo sapiens
gggagataaatacag

SEQ ID NO: 19744 - DNA, 15 bp, Homo sapiens
tgggagataaataca

SEQ ID NO: 19745 - DNA, 15 bp, Homo sapiens
ttgggagataaatac

SEQ ID NO: 19746 - DNA, 15 bp, Homo sapiens
cttgggagataaata

SEQ ID NO: 19747 - DNA, 15 bp, Homo sapiens
ccttgggagataaat

SEQ ID NO: 19748 - DNA, 15 bp, Homo sapiens
cccttgggagataaa

SEQ ID NO: 19749 - DNA, 15 bp, Homo sapiens
gcccttgggagataa

SEQ ID NO: 19750 - DNA, 15 bp, Homo sapiens
tgcccttgggagata

SEQ ID NO: 19751 - DNA, 15 bp, Homo sapiens
atgcccttgggagat

SEQ ID NO: 19752 - DNA, 15 bp, Homo sapiens
tatgcccttgggaga

SEQ ID NO: 19753 - DNA, 15 bp, Homo sapiens
ctatgcccttgggag

SEQ ID NO: 19754 - DNA, 15 bp, Homo sapiens
cctatgcccttggga

SEQ ID NO: 19755 - DNA, 15 bp, Homo sapiens
tcctatgcccttggg

SEQ ID NO: 19756 - DNA, 15 bp, Homo sapiens
ttcctatgcccttgg

SEQ ID NO: 19757 - DNA, 15 bp, Homo sapiens
cttcctatgcccttg

SEQ ID NO: 19758 - DNA, 15 bp, Homo sapiens
gcttcctatgccctt

SEQ ID NO: 19759 - DNA, 15 bp, Homo sapiens
ggcttcctatgccct

SEQ ID NO: 19760 - DNA, 15 bp, Homo sapiens
gggcttcctatgccc

SEQ ID NO: 19761 - DNA, 15 bp, Homo sapiens
ggggcttcctatgcc

SEQ ID NO: 19762 - DNA, 15 bp, Homo sapiens
gggggcttcctatgc

SEQ ID NO: 19763 - DNA, 15 bp, Homo sapiens
agggggcttcctatg

SEQ ID NO: 19764 - DNA, 15 bp, Homo sapiens
aagggggcttcctat

SEQ ID NO: 19765 - DNA, 15 bp, Homo sapiens
caagggggcttccta

SEQ ID NO: 19766 - DNA, 15 bp, Homo sapiens
gcaagggggcttcct

SEQ ID NO: 19767 - DNA, 15 bp, Homo sapiens
tgcaagggggcttcc

SEQ ID NO: 19768 - DNA, 15 bp, Homo sapiens
ctgcaagggggcttc

SEQ ID NO: 19769 - DNA, 15 bp, Homo sapiens
tctgcaagggggctt

SEQ ID NO: 19770 - DNA, 15 bp, Homo sapiens
atctgcaagggggct

SEQ ID NO: 19771 - DNA, 15 bp, Homo sapiens
tatctgcaagggggc

SEQ ID NO: 19772 - DNA, 15 bp, Homo sapiens
atatctgcaaggggg

SEQ ID NO: 19773 - DNA, 15 bp, Homo sapiens
aatatctgcaagggg

SEQ ID NO: 19774 - DNA, 15 bp, Homo sapiens
taatatctgcaaggg

SEQ ID NO: 19775 - DNA, 15 bp, Homo sapiens
gtaatatctgcaagg

SEQ ID NO: 19776 - DNA, 15 bp, Homo sapiens
agtaatatctgcaag

SEQ ID NO: 19777 - DNA, 15 bp, Homo sapiens
gagtaatatctgcaa

SEQ ID NO: 19778 - DNA, 15 bp, Homo sapiens
agagtaatatctgca

SEQ ID NO: 19779 - DNA, 15 bp, Homo sapiens
tagagtaatatctgc

SEQ ID NO: 19780 - DNA, 15 bp, Homo sapiens
gtagagtaatatctg

SEQ ID NO: 19781 - DNA, 15 bp, Homo sapiens
ggtagagtaatatct

SEQ ID NO: 19782 - DNA, 15 bp, Homo sapiens
aggtagagtaatatc

SEQ ID NO: 19783 - DNA, 15 bp, Homo sapiens
taggtagagtaatat

SEQ ID NO: 19784 - DNA, 15 bp, Homo sapiens
ctaggtagagtaata

SEQ ID NO: 19785 - DNA, 15 bp, Homo sapiens
gctaggtagagtaat

SEQ ID NO: 19786 - DNA, 15 bp, Homo sapiens
ggctaggtagagtaa

SEQ ID NO: 19787 - DNA, 15 bp, Homo sapiens
aggctaggtagagta

SEQ ID NO: 19788 - DNA, 15 bp, Homo sapiens
caggctaggtagagt

SEQ ID NO: 19789 - DNA, 15 bp, Homo sapiens
tcaggctaggtagag

SEQ ID NO: 19790 - DNA, 15 bp, Homo sapiens
gtcaggctaggtaga

SEQ ID NO: 19791 - DNA, 15 bp, Homo sapiens
agtcaggctaggtag

SEQ ID NO: 19792 - DNA, 15 bp, Homo sapiens
cagtcaggctaggta

SEQ ID NO: 19793 - DNA, 15 bp, Homo sapiens
ccagtcaggctaggt

SEQ ID NO: 19794 - DNA, 15 bp, Homo sapiens
cccagtcaggctagg

SEQ ID NO: 19795 - DNA, 15 bp, Homo sapiens
acccagtcaggctag

SEQ ID NO: 19796 - DNA, 15 bp, Homo sapiens
cacccagtcaggcta

SEQ ID NO: 19797 - DNA, 15 bp, Homo sapiens
acacccagtcaggct

SEQ ID NO: 19798 - DNA, 15 bp, Homo sapiens
aacacccagtcaggc

SEQ ID NO: 19799 - DNA, 15 bp, Homo sapiens
aaacacccagtcagg

SEQ ID NO: 19800 - DNA, 15 bp, Homo sapiens
caaacacccagtcag

SEQ ID NO: 19801 - DNA, 15 bp, Homo sapiens
ccaaacacccagtca

SEQ ID NO: 19802 - DNA, 15 bp, Homo sapiens
cccaaacacccagtc

SEQ ID NO: 19803 - DNA, 15 bp, Homo sapiens
ccccaaacacccagt

SEQ ID NO: 19804 - DNA, 15 bp, Homo sapiens
tccccaaacacccag

SEQ ID NO: 19805 - DNA, 15 bp, Homo sapiens
ctccccaaacaccca

SEQ ID NO: 19806 - DNA, 15 bp, Homo sapiens
cctccccaaacaccc

SEQ ID NO: 19807 - DNA, 15 bp, Homo sapiens
ccctccccaaacacc

SEQ ID NO: 19808 - DNA, 15 bp, Homo sapiens
tccctccccaaacac

SEQ ID NO: 19809 - DNA, 15 bp, Homo sapiens
ctccctccccaaaca

SEQ ID NO: 19810 - DNA, 15 bp, Homo sapiens
tctccctccccaaac

SEQ ID NO: 19811 - DNA, 15 bp, Homo sapiens
ctctccctccccaaa

SEQ ID NO: 19812 - DNA, 15 bp, Homo sapiens
tctctccctccccaa

SEQ ID NO: 19813 - DNA, 15 bp, Homo sapiens
ttctctccctcccca

SEQ ID NO: 19814 - DNA, 15 bp, Homo sapiens
cttctctccctcccc

SEQ ID NO: 19815 - DNA, 15 bp, Homo sapiens
tcttctctccctccc

SEQ ID NO: 19816 - DNA, 15 bp, Homo sapiens
ctcttctctccctcc

SEQ ID NO: 19817 - DNA, 15 bp, Homo sapiens
cctcttctctccctc

SEQ ID NO: 19818 - DNA, 15 bp, Homo sapiens
acctcttctctccct

SEQ ID NO: 19819 - DNA, 15 bp, Homo sapiens
aacctcttctctccc

SEQ ID NO: 19820 - DNA, 15 bp, Homo sapiens
taacctcttctctcc

SEQ ID NO: 19821 - DNA, 15 bp, Homo sapiens
ttaacctcttctctc

SEQ ID NO: 19822 - DNA, 15 bp, Homo sapiens
gttaacctcttctct

SEQ ID NO: 19823 - DNA, 15 bp, Homo sapiens
tgttaacctcttctc

SEQ ID NO: 19824 - DNA, 15 bp, Homo sapiens
ttgttaacctcttct

SEQ ID NO: 19825 - DNA, 15 bp, Homo sapiens
attgttaacctcttc

SEQ ID NO: 19826 - DNA, 15 bp, Homo sapiens
tattgttaacctctt

SEQ ID NO: 19827 - DNA, 15 bp, Homo sapiens
ttattgttaacctct

SEQ ID NO: 19828 - DNA, 15 bp, Homo sapiens
tttattgttaacctc

SEQ ID NO: 19829 - DNA, 15 bp, Homo sapiens
atttattgttaacct

SEQ ID NO: 19830 - DNA, 15 bp, Homo sapiens
gatttattgttaacc

SEQ ID NO: 19831 - DNA, 15 bp, Homo sapiens
ggatttattgttaac

SEQ ID NO: 19832 - DNA, 15 bp, Homo sapiens
aggatttattgttaa

SEQ ID NO: 19833 - DNA, 15 bp, Homo sapiens
caggatttattgtta

SEQ ID NO: 19834 - DNA, 15 bp, Homo sapiens
gcaggatttattgtt

SEQ ID NO: 19835 - DNA, 15 bp, Homo sapiens
tgcaggatttattgt

SEQ ID NO: 19836 - DNA, 15 bp, Homo sapiens
ttgcaggatttattg

SEQ ID NO: 19837 - DNA, 15 bp, Homo sapiens
attgcaggatttatt

SEQ ID NO: 19838 - DNA, 15 bp, Homo sapiens
tattgcaggatttat

SEQ ID NO: 19839 - DNA, 15 bp, Homo sapiens
atattgcaggattta

SEQ ID NO: 19840 - DNA, 15 bp, Homo sapiens
catattgcaggattt

SEQ ID NO: 19841 - DNA, 15 bp, Homo sapiens
acatattgcaggatt

SEQ ID NO: 19842 - DNA, 15 bp, Homo sapiens
cacatattgcaggat

SEQ ID NO: 19843 - DNA, 15 bp, Homo sapiens
gcacatattgcagga

SEQ ID NO: 19844 - DNA, 15 bp, Homo sapiens
tgcacatattgcagg

SEQ ID NO: 19845 - DNA, 15 bp, Homo sapiens
ctgcacatattgcag

SEQ ID NO: 19846 - DNA, 15 bp, Homo sapiens
tctgcacatattgca

SEQ ID NO: 19847 - DNA, 15 bp, Homo sapiens
ttctgcacatattgc

SEQ ID NO: 19848 - DNA, 15 bp, Homo sapiens
cttctgcacatattg

SEQ ID NO: 19849 - DNA, 15 bp, Homo sapiens
acttctgcacatatt

SEQ ID NO: 19850 - DNA, 15 bp, Homo sapiens
aacttctgcacatat

SEQ ID NO: 19851 - DNA, 15 bp, Homo sapiens
aaacttctgcacata

SEQ ID NO: 19852 - DNA, 15 bp, Homo sapiens
aaaacttctgcacat

SEQ ID NO: 19853 - DNA, 15 bp, Homo sapiens
aaaaacttctgcaca

SEQ ID NO: 19854 - DNA, 15 bp, Homo sapiens
taaaaacttctgcac

SEQ ID NO: 19855 - DNA, 15 bp, Homo sapiens
gtaaaaacttctgca

SEQ ID NO: 19856 - DNA, 15 bp, Homo sapiens
tgtaaaaacttctgc

SEQ ID NO: 19857 - DNA, 15 bp, Homo sapiens
gtgtaaaaacttctg

SEQ ID NO: 19858 - DNA, 15 bp, Homo sapiens
agtgtaaaaacttct

SEQ ID NO: 19859 - DNA, 15 bp, Homo sapiens
aagtgtaaaaacttc

SEQ ID NO: 19860 - DNA, 15 bp, Homo sapiens
caagtgtaaaaactt

SEQ ID NO: 19861 - DNA, 15 bp, Homo sapiens
acaagtgtaaaaact

SEQ ID NO: 19862 - DNA, 15 bp, Homo sapiens
cacaagtgtaaaaac

SEQ ID NO: 19863 - DNA, 15 bp, Homo sapiens
acacaagtgtaaaaa

SEQ ID NO: 19864 - DNA, 15 bp, Homo sapiens
aacacaagtgtaaaa

SEQ ID NO: 19865 - DNA, 15 bp, Homo sapiens
aaacacaagtgtaaa

SEQ ID NO: 19866 - DNA, 15 bp, Homo sapiens
gaaacacaagtgtaa

SEQ ID NO: 19867 - DNA, 15 bp, Homo sapiens
agaaacacaagtgta

SEQ ID NO: 19868 - DNA, 15 bp, Homo sapiens
cagaaacacaagtgt

SEQ ID NO: 19869 - DNA, 15 bp, Homo sapiens
gcagaaacacaagtg

SEQ ID NO: 19870 - DNA, 15 bp, Homo sapiens
tgcagaaacacaagt

SEQ ID NO: 19871 - DNA, 15 bp, Homo sapiens
atgcagaaacacaag

SEQ ID NO: 19872 - DNA, 15 bp, Homo sapiens
tatgcagaaacacaa

SEQ ID NO: 19873 - DNA, 15 bp, Homo sapiens
atatgcagaaacaca

SEQ ID NO: 19874 - DNA, 15 bp, Homo sapiens
aatatgcagaaacac

SEQ ID NO: 19875 - DNA, 15 bp, Homo sapiens
aaatatgcagaaaca

SEQ ID NO: 19876 - DNA, 15 bp, Homo sapiens
aaaatatgcagaaac

SEQ ID NO: 19877 - DNA, 15 bp, Homo sapiens
gaaaatatgcagaaa

SEQ ID NO: 19878 - DNA, 15 bp, Homo sapiens
agaaaatatgcagaa

SEQ ID NO: 19879 - DNA, 15 bp, Homo sapiens
aagaaaatatgcaga

SEQ ID NO: 19880 - DNA, 15 bp, Homo sapiens
taagaaaatatgcag

SEQ ID NO: 19881 - DNA, 15 bp, Homo sapiens
ctaagaaaatatgca

SEQ ID NO: 19882 - DNA, 15 bp, Homo sapiens
tctaagaaaatatgc

SEQ ID NO: 19883 - DNA, 15 bp, Homo sapiens
ttctaagaaaatatg

SEQ ID NO: 19884 - DNA, 15 bp, Homo sapiens
tttctaagaaaatat

SEQ ID NO: 19885 - DNA, 15 bp, Homo sapiens
ttttctaagaaaata

SEQ ID NO: 19886 - DNA, 15 bp, Homo sapiens
tttttctaagaaaat

SEQ ID NO: 19887 - DNA, 15 bp, Homo sapiens
ctttttctaagaaaa

SEQ ID NO: 19888 - DNA, 15 bp, Homo sapiens
cctttttctaagaaa

SEQ ID NO: 19889 - DNA, 15 bp, Homo sapiens
ccctttttctaagaa

SEQ ID NO: 19890 - DNA, 15 bp, Homo sapiens
accctttttctaaga

SEQ ID NO: 19891 - DNA, 15 bp, Homo sapiens
gaccctttttctaag

SEQ ID NO: 19892 - DNA, 15 bp, Homo sapiens
ggaccctttttctaa

SEQ ID NO: 19893 - DNA, 15 bp, Homo sapiens
tggaccctttttcta

SEQ ID NO: 19894 - DNA, 15 bp, Homo sapiens
gtggaccctttttct

SEQ ID NO: 19895 - DNA, 15 bp, Homo sapiens
tgtggaccctttttc

SEQ ID NO: 19896 - DNA, 15 bp, Homo sapiens
ctgtggacccttttt

SEQ ID NO: 19897 - DNA, 15 bp, Homo sapiens
actgtggaccctttt

SEQ ID NO: 19898 - DNA, 15 bp, Homo sapiens
aactgtggacccttt

SEQ ID NO: 19899 - DNA, 15 bp, Homo sapiens
aaactgtggaccctt

SEQ ID NO: 19900 - DNA, 15 bp, Homo sapiens
aaaactgtggaccct

SEQ ID NO: 19901 - DNA, 15 bp, Homo sapiens
gaaaactgtggaccc

SEQ ID NO: 19902 - DNA, 15 bp, Homo sapiens
tgaaaactgtggacc

SEQ ID NO: 19903 - DNA, 15 bp, Homo sapiens
atgaaaactgtggac

SEQ ID NO: 19904 - DNA, 15 bp, Homo sapiens
aatgaaaactgtgga

SEQ ID NO: 19905 - DNA, 15 bp, Homo sapiens
taatgaaaactgtgg

SEQ ID NO: 19906 - DNA, 15 bp, Homo sapiens
ataatgaaaactgtg

SEQ ID NO: 19907 - DNA, 15 bp, Homo sapiens
tataatgaaaactgt

SEQ ID NO: 19908 - DNA, 15 bp, Homo sapiens
atataatgaaaactg

SEQ ID NO: 19909 - DNA, 15 bp, Homo sapiens
aatataatgaaaact

SEQ ID NO: 19910 - DNA, 15 bp, Homo sapiens
gaatataatgaaaac

SEQ ID NO: 19911 - DNA, 15 bp, Homo sapiens
agaatataatgaaaa

SEQ ID NO: 19912 - DNA, 15 bp, Homo sapiens
gagaatataatgaaa

SEQ ID NO: 19913 - DNA, 15 bp, Homo sapiens
tgagaatataatgaa

SEQ ID NO: 19914 - DNA, 15 bp, Homo sapiens
ttgagaatataatga

SEQ ID NO: 19915 - DNA, 15 bp, Homo sapiens
tttgagaatataatg

SEQ ID NO: 19916 - DNA, 15 bp, Homo sapiens
ctttgagaatataat

SEQ ID NO: 19917 - DNA, 15 bp, Homo sapiens
cctttgagaatataa

SEQ ID NO: 19918 - DNA, 15 bp, Homo sapiens
tcctttgagaatata

SEQ ID NO: 19919 - DNA, 15 bp, Homo sapiens
ctcctttgagaatat

SEQ ID NO: 19920 - DNA, 15 bp, Homo sapiens
tctcctttgagaata

SEQ ID NO: 19921 - DNA, 15 bp, Homo sapiens
gtctcctttgagaat

SEQ ID NO: 19922 - DNA, 15 bp, Homo sapiens
ggtctcctttgagaa

SEQ ID NO: 19923 - DNA, 15 bp, Homo sapiens
aggtctcctttgaga

SEQ ID NO: 19924 - DNA, 15 bp, Homo sapiens
taggtctcctttgag

SEQ ID NO: 19925 - DNA, 15 bp, Homo sapiens
ataggtctcctttga

SEQ ID NO: 19926 - DNA, 15 bp, Homo sapiens
cataggtctcctttg

SEQ ID NO: 19927 - DNA, 15 bp, Homo sapiens
tcataggtctccttt

SEQ ID NO: 19928 - DNA, 15 bp, Homo sapiens
gtcataggtctcctt

SEQ ID NO: 19929 - DNA, 15 bp, Homo sapiens
agtcataggtctcct

SEQ ID NO: 19930 - DNA, 15 bp, Homo sapiens
aagtcataggtctcc

SEQ ID NO: 19931 - DNA, 15 bp, Homo sapiens
taagtcataggtctc

SEQ ID NO: 19932 - DNA, 15 bp, Homo sapiens
ttaagtcataggtct

SEQ ID NO: 19933 - DNA, 15 bp, Homo sapiens
attaagtcataggtc

SEQ ID NO: 19934 - DNA, 15 bp, Homo sapiens
cattaagtcataggt

SEQ ID NO: 19935 - DNA, 15 bp, Homo sapiens
tcattaagtcatagg

SEQ ID NO: 19936 - DNA, 15 bp, Homo sapiens
ttcattaagtcatag

SEQ ID NO: 19937 - DNA, 15 bp, Homo sapiens
tttcattaagtcata

SEQ ID NO: 19938 - DNA, 15 bp, Homo sapiens
ttttcattaagtcat

SEQ ID NO: 19939 - DNA, 15 bp, Homo sapiens
cttttcattaagtca

SEQ ID NO: 19940 - DNA, 15 bp, Homo sapiens
acttttcattaagtc

SEQ ID NO: 19941 - DNA, 15 bp, Homo sapiens
aacttttcattaagt

SEQ ID NO: 19942 - DNA, 15 bp, Homo sapiens
taacttttcattaag

SEQ ID NO: 19943 - DNA, 15 bp, Homo sapiens
ttaacttttcattaa

SEQ ID NO: 19944 - DNA, 15 bp, Homo sapiens
cttaacttttcatta

SEQ ID NO: 19945 - DNA, 15 bp, Homo sapiens
acttaacttttcatt

SEQ ID NO: 19946 - DNA, 15 bp, Homo sapiens
gacttaacttttcat

SEQ ID NO: 19947 - DNA, 15 bp, Homo sapiens
agacttaacttttca

SEQ ID NO: 19948 - DNA, 15 bp, Homo sapiens
aagacttaacttttc

SEQ ID NO: 19949 - DNA, 15 bp, Homo sapiens
caagacttaactttt

SEQ ID NO: 19950 - DNA, 15 bp, Homo sapiens
acaagacttaacttt

SEQ ID NO: 19951 - DNA, 15 bp, Homo sapiens
aacaagacttaactt

SEQ ID NO: 19952 - DNA, 15 bp, Homo sapiens
taacaagacttaact

SEQ ID NO: 19953 - DNA, 15 bp, Homo sapiens
ctaacaagacttaac

SEQ ID NO: 19954 - DNA, 15 bp, Homo sapiens
tctaacaagacttaa

SEQ ID NO: 19955 - DNA, 15 bp, Homo sapiens
ctctaacaagactta

SEQ ID NO: 19956 - DNA, 15 bp, Homo sapiens
cctctaacaagactt

SEQ ID NO: 19957 - DNA, 15 bp, Homo sapiens
tcctctaacaagact

SEQ ID NO: 19958 - DNA, 15 bp, Homo sapiens
ttcctctaacaagac

SEQ ID NO: 19959 - DNA, 15 bp, Homo sapiens
cttcctctaacaaga

SEQ ID NO: 19960 - DNA, 15 bp, Homo sapiens
tcttcctctaacaag

SEQ ID NO: 19961 - DNA, 15 bp, Homo sapiens
ctcttcctctaacaa

SEQ ID NO: 19962 - DNA, 15 bp, Homo sapiens
actcttcctctaaca

SEQ ID NO: 19963 - DNA, 15 bp, Homo sapiens
cactcttcctctaac

SEQ ID NO: 19964 - DNA, 15 bp, Homo sapiens
tcactcttcctctaa

SEQ ID NO: 19965 - DNA, 15 bp, Homo sapiens
gtcactcttcctcta

SEQ ID NO: 19966 - DNA, 15 bp, Homo sapiens
tgtcactcttcctct

SEQ ID NO: 19967 - DNA, 15 bp, Homo sapiens
atgtcactcttcctc

SEQ ID NO: 19968 - DNA, 15 bp, Homo sapiens
tatgtcactcttcct

SEQ ID NO: 19969 - DNA, 15 bp, Homo sapiens
atatgtcactcttcc

SEQ ID NO: 19970 - DNA, 15 bp, Homo sapiens
aatatgtcactcttc

SEQ ID NO: 19971 - DNA, 15 bp, Homo sapiens
taatatgtcactctt

SEQ ID NO: 19972 - DNA, 15 bp, Homo sapiens
ataatatgtcactct

SEQ ID NO: 19973 - DNA, 15 bp, Homo sapiens
tataatatgtcactc

SEQ ID NO: 19974 - DNA, 15 bp, Homo sapiens
ctataatatgtcact

SEQ ID NO: 19975 - DNA, 15 bp, Homo sapiens
cctataatatgtcac

SEQ ID NO: 19976 - DNA, 15 bp, Homo sapiens
ccctataatatgtca

SEQ ID NO: 19977 - DNA, 15 bp, Homo sapiens
accctataatatgtc

SEQ ID NO: 19978 - DNA, 15 bp, Homo sapiens
aaccctataatatgt

SEQ ID NO: 19979 - DNA, 15 bp, Homo sapiens
taaccctataatatg

SEQ ID NO: 19980 - DNA, 15 bp, Homo sapiens
ataaccctataatat

SEQ ID NO: 19981 - DNA, 15 bp, Homo sapiens
cataaccctataata

SEQ ID NO: 19982 - DNA, 15 bp, Homo sapiens
acataaccctataat

SEQ ID NO: 19983 - DNA, 15 bp, Homo sapiens
gacataaccctataa

SEQ ID NO: 19984 - DNA, 15 bp, Homo sapiens
agacataaccctata

SEQ ID NO: 19985 - DNA, 15 bp, Homo sapiens
aagacataaccctat

SEQ ID NO: 19986 - DNA, 15 bp, Homo sapiens
gaagacataacccta

SEQ ID NO: 19987 - DNA, 15 bp, Homo sapiens
tgaagacataaccct

SEQ ID NO: 19988 - DNA, 15 bp, Homo sapiens
atgaagacataaccc

SEQ ID NO: 19989 - DNA, 15 bp, Homo sapiens
tatgaagacataacc

SEQ ID NO: 19990 - DNA, 15 bp, Homo sapiens
ttatgaagacataac

SEQ ID NO: 19991 - DNA, 15 bp, Homo sapiens
attatgaagacataa

SEQ ID NO: 19992 - DNA, 15 bp, Homo sapiens
cattatgaagacata

SEQ ID NO: 19993 - DNA, 15 bp, Homo sapiens
acattatgaagacat

SEQ ID NO: 19994 - DNA, 15 bp, Homo sapiens
aacattatgaagaca

SEQ ID NO: 19995 - DNA, 15 bp, Homo sapiens
aaacattatgaagac

SEQ ID NO: 19996 - DNA, 15 bp, Homo sapiens
gaaacattatgaaga

SEQ ID NO: 19997 - DNA, 15 bp, Homo sapiens
agaaacattatgaag

SEQ ID NO: 19998 - DNA, 15 bp, Homo sapiens
aagaaacattatgaa

SEQ ID NO: 19999 - DNA, 15 bp, Homo sapiens
aaagaaacattatga

SEQ ID NO: 20000 - DNA, 15 bp, Homo sapiens
aaaagaaacattatg

SEQ ID NO: 20001 - DNA, 15 bp, Homo sapiens
aaaaagaaacattat

SEQ ID NO: 20002 - DNA, 15 bp, Homo sapiens
aaaaaagaaacatta

SEQ ID NO: 20003 - DNA, 15 bp, Homo sapiens
aaaaaaagaaacatt

SEQ ID NO: 20004 - DNA, 15 bp, Homo sapiens
gaaaaaaagaaacat

SEQ ID NO: 20005 - DNA, 15 bp, Homo sapiens
agaaaaaaagaaaca

SEQ ID NO: 20006 - DNA, 15 bp, Homo sapiens
cagaaaaaaagaaac

SEQ ID NO: 20007 - DNA, 15 bp, Homo sapiens
tcagaaaaaaagaaa

SEQ ID NO: 20008 - DNA, 15 bp, Homo sapiens
ttcagaaaaaaagaa

SEQ ID NO: 20009 - DNA, 15 bp, Homo sapiens
tttcagaaaaaaaga

SEQ ID NO: 20010 - DNA, 15 bp, Homo sapiens
atttcagaaaaaaag

SEQ ID NO: 20011 - DNA, 15 bp, Homo sapiens
aatttcagaaaaaaa

SEQ ID NO: 20012 - DNA, 15 bp, Homo sapiens
taatttcagaaaaaa

SEQ ID NO: 20013 - DNA, 15 bp, Homo sapiens
ctaatttcagaaaaa

SEQ ID NO: 20014 - DNA, 15 bp, Homo sapiens
tctaatttcagaaaa

SEQ ID NO: 20015 - DNA, 15 bp, Homo sapiens
aatctaatttcagaa

SEQ ID NO: 20016 - DNA, 15 bp, Homo sapiens
caatctaatttcaga

SEQ ID NO: 20017 - DNA, 15 bp, Homo sapiens
ccaatctaatttcag

SEQ ID NO: 20018 - DNA, 15 bp, Homo sapiens
gccaatctaatttca

SEQ ID NO: 20019 - DNA, 15 bp, Homo sapiens
tgccaatctaatttc

SEQ ID NO: 20020 - DNA, 15 bp, Homo sapiens
ctgccaatctaattt

SEQ ID NO: 20021 - DNA, 15 bp, Homo sapiens
actgccaatctaatt

SEQ ID NO: 20022 - DNA, 15 bp, Homo sapiens
gactgccaatctaat

SEQ ID NO: 20023 - DNA, 15 bp, Homo sapiens
ggactgccaatctaa

SEQ ID NO: 20024 - DNA, 15 bp, Homo sapiens
tggactgccaatcta

SEQ ID NO: 20025 - DNA, 15 bp, Homo sapiens
ttggactgccaatct

SEQ ID NO: 20026 - DNA, 15 bp, Homo sapiens
attggactgccaatc

SEQ ID NO: 20027 - DNA, 15 bp, Homo sapiens
tattggactgccaat

SEQ ID NO: 20028 - DNA, 15 bp, Homo sapiens
gtattggactgccaa

SEQ ID NO: 20029 - DNA, 15 bp, Homo sapiens
cgtattggactgcca

SEQ ID NO: 20030 - DNA, 15 bp, Homo sapiens
gcgtattggactgcc

SEQ ID NO: 20031 - DNA, 15 bp, Homo sapiens
agcgtattggactgc

SEQ ID NO: 20032 - DNA, 15 bp, Homo sapiens
cagcgtattggactg

SEQ ID NO: 20033 - DNA, 15 bp, Homo sapiens
ccagcgtattggact

SEQ ID NO: 20034 - DNA, 15 bp, Homo sapiens
gccagcgtattggac

SEQ ID NO: 20035 - DNA, 15 bp, Homo sapiens
tgccagcgtattgga

SEQ ID NO: 20036 - DNA, 15 bp, Homo sapiens
gtgccagcgtattgg

SEQ ID NO: 20037 - DNA, 15 bp, Homo sapiens
cgtgccagcgtattg

SEQ ID NO: 20038 - DNA, 15 bp, Homo sapiens
tcgtgccagcgtatt

SEQ ID NO: 20039 - DNA, 15 bp, Homo sapiens
ttcgtgccagcgtat

SEQ ID NO: 20040 - DNA, 15 bp, Homo sapiens
gttcgtgccagcgta

SEQ ID NO: 20041 - DNA, 15 bp, Homo sapiens
agttcgtgccagcgt

SEQ ID NO: 20042 - DNA, 15 bp, Homo sapiens
cagttcgtgccagcg

SEQ ID NO: 20043 - DNA, 15 bp, Homo sapiens
tcagttcgtgccagc

SEQ ID NO: 20044 - DNA, 15 bp, Homo sapiens
ctcagttcgtgccag

SEQ ID NO: 20045 - DNA, 15 bp, Homo sapiens
cctcagttcgtgcca

SEQ ID NO: 20046 - DNA, 15 bp, Homo sapiens
ccctcagttcgtgcc

SEQ ID NO: 20047 - DNA, 15 bp, Homo sapiens
accctcagttcgtgc

SEQ ID NO: 20048 - DNA, 15 bp, Homo sapiens
gaccctcagttcgtg

SEQ ID NO: 20049 - DNA, 15 bp, Homo sapiens
agaccctcagttcgt

SEQ ID NO: 20050 - DNA, 15 bp, Homo sapiens
gagaccctcagttcg

SEQ ID NO: 20051 - DNA, 15 bp, Homo sapiens
tgagaccctcagttc

SEQ ID NO: 20052 - DNA, 15 bp, Homo sapiens
gtgagaccctcagtt

SEQ ID NO: 20053 - DNA, 15 bp, Homo sapiens
tgtgagaccctcagt

SEQ ID NO: 20054 - DNA, 15 bp, Homo sapiens
gtgtgagaccctcag

SEQ ID NO: 20055 - DNA, 15 bp, Homo sapiens
agtgtgagaccctca

SEQ ID NO: 20056 - DNA, 15 bp, Homo sapiens
aagtgtgagaccctc

SEQ ID NO: 20057 - DNA, 15 bp, Homo sapiens
aaagtgtgagaccct

SEQ ID NO: 20058 - DNA, 15 bp, Homo sapiens
aaaagtgtgagaccc

SEQ ID NO: 20059 - DNA, 15 bp, Homo sapiens
caaaagtgtgagacc

SEQ ID NO: 20060 - DNA, 15 bp, Homo sapiens
gcaaaagtgtgagac

SEQ ID NO: 20061 - DNA, 15 bp, Homo sapiens
agcaaaagtgtgaga

SEQ ID NO: 20062 - DNA, 15 bp, Homo sapiens
cagcaaaagtgtgag

SEQ ID NO: 20063 - DNA, 15 bp, Homo sapiens
acagcaaaagtgtga

SEQ ID NO: 20064 - DNA, 15 bp, Homo sapiens
tacagcaaaagtgtg

SEQ ID NO: 20065 - DNA, 15 bp, Homo sapiens
ttacagcaaaagtgt

SEQ ID NO: 20066 - DNA, 15 bp, Homo sapiens
gttacagcaaaagtg

SEQ ID NO: 20067 - DNA, 15 bp, Homo sapiens
agttacagcaaaagt

SEQ ID NO: 20068 - DNA, 15 bp, Homo sapiens
gagttacagcaaaag

SEQ ID NO: 20069 - DNA, 15 bp, Homo sapiens
tgagttacagcaaaa

SEQ ID NO: 20070 - DNA, 15 bp, Homo sapiens
ttgagttacagcaaa

SEQ ID NO: 20071 - DNA, 15 bp, Homo sapiens
tttgagttacagcaa

SEQ ID NO: 20072 - DNA, 15 bp, Homo sapiens
atttgagttacagca

SEQ ID NO: 20073 - DNA, 15 bp, Homo sapiens
aatttgagttacagc

SEQ ID NO: 20074 - DNA, 15 bp, Homo sapiens
gaatttgagttacag

SEQ ID NO: 20075 - DNA, 15 bp, Homo sapiens
agaatttgagttaca

SEQ ID NO: 20076 - DNA, 15 bp, Homo sapiens
cagaatttgagttac

SEQ ID NO: 20077 - DNA, 15 bp, Homo sapiens
ccagaatttgagtta

SEQ ID NO: 20078 - DNA, 15 bp, Homo sapiens
accagaatttgagtt

SEQ ID NO: 20079 - DNA, 15 bp, Homo sapiens
gaccagaatttgagt

SEQ ID NO: 20080 - DNA, 15 bp, Homo sapiens
ggaccagaatttgag

SEQ ID NO: 20081 - DNA, 15 bp, Homo sapiens
aggaccagaatttga

SEQ ID NO: 20082 - DNA, 15 bp, Homo sapiens
aaggaccagaatttg

SEQ ID NO: 20083 - DNA, 15 bp, Homo sapiens
taaggaccagaattt

SEQ ID NO: 20084 - DNA, 15 bp, Homo sapiens
gtaaggaccagaatt

SEQ ID NO: 20085 - DNA, 15 bp, Homo sapiens
agtaaggaccagaat

SEQ ID NO: 20086 - DNA, 15 bp, Homo sapiens
aagtaaggaccagaa

SEQ ID NO: 20087 - DNA, 15 bp, Homo sapiens
aaagtaaggaccaga

SEQ ID NO: 20088 - DNA, 15 bp, Homo sapiens
taaagtaaggaccag

SEQ ID NO: 20089 - DNA, 15 bp, Homo sapiens
gtaaagtaaggacca

SEQ ID NO: 20090 - DNA, 15 bp, Homo sapiens
agtaaagtaaggacc

SEQ ID NO: 20091 - DNA, 15 bp, Homo sapiens
aagtaaagtaaggac

SEQ ID NO: 20092 - DNA, 15 bp, Homo sapiens
gaagtaaagtaagga

SEQ ID NO: 20093 - DNA, 15 bp, Homo sapiens
agaagtaaagtaagg

SEQ ID NO: 20094 - DNA, 15 bp, Homo sapiens
tagaagtaaagtaag

SEQ ID NO: 20095 - DNA, 15 bp, Homo sapiens
gtagaagtaaagtaa

SEQ ID NO: 20096 - DNA, 15 bp, Homo sapiens
agtagaagtaaagta

SEQ ID NO: 20097 - DNA, 15 bp, Homo sapiens
cagtagaagtaaagt

SEQ ID NO: 20098 - DNA, 15 bp, Homo sapiens
gcagtagaagtaaag

SEQ ID NO: 20099 - DNA, 15 bp, Homo sapiens
ggcagtagaagtaaa

SEQ ID NO: 20100 - DNA, 15 bp, Homo sapiens
aggcagtagaagtaa

SEQ ID NO: 20101 - DNA, 15 bp, Homo sapiens
aaggcagtagaagta

SEQ ID NO: 20102 - DNA, 15 bp, Homo sapiens
taaggcagtagaagt

SEQ ID NO: 20103 - DNA, 15 bp, Homo sapiens
ttaaggcagtagaag

SEQ ID NO: 20104 - DNA, 15 bp, Homo sapiens
tttaaggcagtagaa

SEQ ID NO: 20105 - DNA, 15 bp, Homo sapiens
ctttaaggcagtaga

SEQ ID NO: 20106 - DNA, 15 bp, Homo sapiens
gctttaaggcagtag

SEQ ID NO: 20107 - DNA, 15 bp, Homo sapiens
ggctttaaggcagta

SEQ ID NO: 20108 - DNA, 15 bp, Homo sapiens
tggctttaaggcagt

SEQ ID NO: 20109 - DNA, 15 bp, Homo sapiens
gtggctttaaggcag

SEQ ID NO: 20110 - DNA, 15 bp, Homo sapiens
agtggctttaaggca

SEQ ID NO: 20111 - DNA, 15 bp, Homo sapiens
gagtggctttaaggc

SEQ ID NO: 20112 - DNA, 15 bp, Homo sapiens
tgagtggctttaagg

SEQ ID NO: 20113 - DNA, 15 bp, Homo sapiens
ttgagtggctttaag

SEQ ID NO: 20114 - DNA, 15 bp, Homo sapiens
tttgagtggctttaa

SEQ ID NO: 20115 - DNA, 15 bp, Homo sapiens
gtttgagtggcttta

SEQ ID NO: 20116 - DNA, 15 bp, Homo sapiens
tgtttgagtggcttt

SEQ ID NO: 20117 - DNA, 15 bp, Homo sapiens
ttgtttgagtggctt

SEQ ID NO: 20118 - DNA, 15 bp, Homo sapiens
tttgtttgagtggct

SEQ ID NO: 20119 - DNA, 15 bp, Homo sapiens
ttttgtttgagtggc

SEQ ID NO: 20120 - DNA, 15 bp, Homo sapiens
cttttgtttgagtgg

SEQ ID NO: 20121 - DNA, 15 bp, Homo sapiens
tcttttgtttgagtg

SEQ ID NO: 20122 - DNA, 15 bp, Homo sapiens
gtcttttgtttgagt

SEQ ID NO: 20123 - DNA, 15 bp, Homo sapiens
ggtcttttgtttgag

SEQ ID NO: 20124 - DNA, 15 bp, Homo sapiens
aggtcttttgtttga

SEQ ID NO: 20125 - DNA, 15 bp, Homo sapiens
caggtcttttgtttg

SEQ ID NO: 20126 - DNA, 15 bp, Homo sapiens
tcaggtcttttgttt

SEQ ID NO: 20127 - DNA, 15 bp, Homo sapiens
atcaggtcttttgtt

SEQ ID NO: 20128 - DNA, 15 bp, Homo sapiens
aatcaggtcttttgt

SEQ ID NO: 20129 - DNA, 15 bp, Homo sapiens
caatcaggtcttttg

SEQ ID NO: 20130 - DNA, 15 bp, Homo sapiens
gcaatcaggtctttt

SEQ ID NO: 20131 - DNA, 15 bp, Homo sapiens
agcaatcaggtcttt

SEQ ID NO: 20132 - DNA, 15 bp, Homo sapiens
tagcaatcaggtctt

SEQ ID NO: 20133 - DNA, 15 bp, Homo sapiens
ctagcaatcaggtct

SEQ ID NO: 20134 - DNA, 15 bp, Homo sapiens
tctagcaatcaggtc

SEQ ID NO: 20135 - DNA, 15 bp, Homo sapiens
ttctagcaatcaggt

SEQ ID NO: 20136 - DNA, 15 bp, Homo sapiens
attctagcaatcagg

SEQ ID NO: 20137 - DNA, 15 bp, Homo sapiens
aattctagcaatcag

SEQ ID NO: 20138 - DNA, 15 bp, Homo sapiens
taattctagcaatca

SEQ ID NO: 20139 - DNA, 15 bp, Homo sapiens
ctaattctagcaatc

SEQ ID NO: 20140 - DNA, 15 bp, Homo sapiens
cctaattctagcaat

SEQ ID NO: 20141 - DNA, 15 bp, Homo sapiens
acctaattctagcaa

SEQ ID NO: 20142 - DNA, 15 bp, Homo sapiens
aacctaattctagca

SEQ ID NO: 20143 - DNA, 15 bp, Homo sapiens
caacctaattctagc

SEQ ID NO: 20144 - DNA, 15 bp, Homo sapiens
tcaacctaattctag

SEQ ID NO: 20145 - DNA, 15 bp, Homo sapiens
ctcaacctaattcta

SEQ ID NO: 20146 - DNA, 15 bp, Homo sapiens
tctcaacctaattct

SEQ ID NO: 20147 - DNA, 15 bp, Homo sapiens
ttctcaacctaattc

SEQ ID NO: 20148 - DNA, 15 bp, Homo sapiens
cttctcaacctaatt

SEQ ID NO: 20149 - DNA, 15 bp, Homo sapiens
tcttctcaacctaat

SEQ ID NO: 20150 - DNA, 15 bp, Homo sapiens
gtcttctcaacctaa

SEQ ID NO: 20151 - DNA, 15 bp, Homo sapiens
tgtcttctcaaccta

SEQ ID NO: 20152 - DNA, 15 bp, Homo sapiens
gtgtcttctcaacct

SEQ ID NO: 20153 - DNA, 15 bp, Homo sapiens
tgtgtcttctcaacc

SEQ ID NO: 20154 - DNA, 15 bp, Homo sapiens
ttgtgtcttctcaac

SEQ ID NO: 20155 - DNA, 15 bp, Homo sapiens
tttgtgtcttctcaa

SEQ ID NO: 20156 - DNA, 15 bp, Homo sapiens
ctttgtgtcttctca

SEQ ID NO: 20157 - DNA, 15 bp, Homo sapiens
actttgtgtcttctc

SEQ ID NO: 20158 - DNA, 15 bp, Homo sapiens
aactttgtgtcttct

SEQ ID NO: 20159 - DNA, 15 bp, Homo sapiens
aaactttgtgtcttc

SEQ ID NO: 20160 - DNA, 15 bp, Homo sapiens
caaactttgtgtctt

SEQ ID NO: 20161 - DNA, 15 bp, Homo sapiens
tcaaactttgtgtct

SEQ ID NO: 20162 - DNA, 15 bp, Homo sapiens
ttcaaactttgtgtc

SEQ ID NO: 20163 - DNA, 15 bp, Homo sapiens
cttcaaactttgtgt

SEQ ID NO: 20164 - DNA, 15 bp, Homo sapiens
ccttcaaactttgtg

SEQ ID NO: 20165 - DNA, 15 bp, Homo sapiens
cccttcaaactttgt

SEQ ID NO: 20166 - DNA, 15 bp, Homo sapiens
gcccttcaaactttg

SEQ ID NO: 20167 - DNA, 15 bp, Homo sapiens
tgcccttcaaacttt

SEQ ID NO: 20168 - DNA, 15 bp, Homo sapiens
ttgcccttcaaactt

SEQ ID NO: 20169 - DNA, 15 bp, Homo sapiens
tttgcccttcaaact

SEQ ID NO: 20170 - DNA, 15 bp, Homo sapiens
ttttgcccttcaaac

SEQ ID NO: 20171 - DNA, 15 bp, Homo sapiens
attttgcccttcaaa

SEQ ID NO: 20172 - DNA, 15 bp, Homo sapiens
aattttgcccttcaa

SEQ ID NO: 20173 - DNA, 15 bp, Homo sapiens
aaattttgcccttca

SEQ ID NO: 20174 - DNA, 15 bp, Homo sapiens
gaaattttgcccttc

SEQ ID NO: 20175 - DNA, 15 bp, Homo sapiens
agaaattttgccctt

SEQ ID NO: 20176 - DNA, 15 bp, Homo sapiens
cagaaattttgccct

SEQ ID NO: 20177 - DNA, 15 bp, Homo sapiens
tcagaaattttgccc

SEQ ID NO: 20178 - DNA, 15 bp, Homo sapiens
atcagaaattttgcc

SEQ ID NO: 20179 - DNA, 15 bp, Homo sapiens
tatcagaaattttgc

SEQ ID NO: 20180 - DNA, 15 bp, Homo sapiens
ttatcagaaattttg

SEQ ID NO: 20181 - DNA, 15 bp, Homo sapiens
attatcagaaatttt

SEQ ID NO: 20182 - DNA, 15 bp, Homo sapiens
cattatcagaaattt

SEQ ID NO: 20183 - DNA, 15 bp, Homo sapiens
acattatcagaaatt

SEQ ID NO: 20184 - DNA, 15 bp, Homo sapiens
aacattatcagaaat

SEQ ID NO: 20185 - DNA, 15 bp, Homo sapiens
aaacattatcagaaa

SEQ ID NO: 20186 - DNA, 15 bp, Homo sapiens
caaacattatcagaa

SEQ ID NO: 20187 - DNA, 15 bp, Homo sapiens
tcaaacattatcaga

SEQ ID NO: 20188 - DNA, 15 bp, Homo sapiens
gtcaaacattatcag

SEQ ID NO: 20189 - DNA, 15 bp, Homo sapiens
ggtcaaacattatca

SEQ ID NO: 20190 - DNA, 15 bp, Homo sapiens
gggtcaaacattatc

SEQ ID NO: 20191 - DNA, 15 bp, Homo sapiens
tgggtcaaacattat

SEQ ID NO: 20192 - DNA, 15 bp, Homo sapiens
ctgggtcaaacatta

SEQ ID NO: 20193 - DNA, 15 bp, Homo sapiens
actgggtcaaacatt

SEQ ID NO: 20194 - DNA, 15 bp, Homo sapiens
aactgggtcaaacat

SEQ ID NO: 20195 - DNA, 15 bp, Homo sapiens
aaactgggtcaaaca

SEQ ID NO: 20196 - DNA, 15 bp, Homo sapiens
aaaactgggtcaaac

SEQ ID NO: 20197 - DNA, 15 bp, Homo sapiens
caaaactgggtcaaa

SEQ ID NO: 20198 - DNA, 15 bp, Homo sapiens
gcaaaactgggtcaa

SEQ ID NO: 20199 - DNA, 15 bp, Homo sapiens
tgcaaaactgggtca

SEQ ID NO: 20200 - DNA, 15 bp, Homo sapiens
atgcaaaactgggtc

SEQ ID NO: 20201 - DNA, 15 bp, Homo sapiens
tatgcaaaactgggt

SEQ ID NO: 20202 - DNA, 15 bp, Homo sapiens
atatgcaaaactggg

SEQ ID NO: 20203 - DNA, 15 bp, Homo sapiens
tatatgcaaaactgg

SEQ ID NO: 20204 - DNA, 15 bp, Homo sapiens
ttatatgcaaaactg

SEQ ID NO: 20205 - DNA, 15 bp, Homo sapiens
attatatgcaaaact

SEQ ID NO: 20206 - DNA, 15 bp, Homo sapiens
cattatatgcaaaac

SEQ ID NO: 20207 - DNA, 15 bp, Homo sapiens
acattatatgcaaaa

SEQ ID NO: 20208 - DNA, 15 bp, Homo sapiens
tacattatatgcaaa

SEQ ID NO: 20209 - DNA, 15 bp, Homo sapiens
atacattatatgcaa

SEQ ID NO: 20210 - DNA, 15 bp, Homo sapiens
aatacattatatgca

SEQ ID NO: 20211 - DNA, 15 bp, Homo sapiens
aaatacattatatgc

SEQ ID NO: 20212 - DNA, 15 bp, Homo sapiens
aaaatacattatatg

SEQ ID NO: 20213 - DNA, 15 bp, Homo sapiens
aaaaatacattatat

SEQ ID NO: 20214 - DNA, 15 bp, Homo sapiens
taaaaatacattata

SEQ ID NO: 20215 - DNA, 15 bp, Homo sapiens
ataaaaatacattat

SEQ ID NO: 20216 - DNA, 15 bp, Homo sapiens
aataaaaatacatta

SEQ ID NO: 20217 - DNA, 15 bp, Homo sapiens
aaataaaaatacatt

SEQ ID NO: 20218 - DNA, 15 bp, Homo sapiens
caaataaaaatacat

SEQ ID NO: 20219 - DNA, 15 bp, Homo sapiens
acaaataaaaataca

SEQ ID NO: 20220 - DNA, 15 bp, Homo sapiens
aacaaataaaaatac

SEQ ID NO: 20221 - DNA, 15 bp, Homo sapiens
caacaaataaaaata

SEQ ID NO: 20222 - DNA, 15 bp, Homo sapiens
tcaacaaataaaaat

SEQ ID NO: 20223 - DNA, 15 bp, Homo sapiens
atcaacaaataaaaa

SEQ ID NO: 20224 - DNA, 15 bp, Homo sapiens
catcaacaaataaaa

SEQ ID NO: 20225 - DNA, 15 bp, Homo sapiens
tcatcaacaaataaa

SEQ ID NO: 20226 - DNA, 15 bp, Homo sapiens
ttcatcaacaaataa

SEQ ID NO: 20227 - DNA, 15 bp, Homo sapiens
attcatcaacaaata

SEQ ID NO: 20228 - DNA, 15 bp, Homo sapiens
tattcatcaacaaat

SEQ ID NO: 20229 - DNA, 15 bp, Homo sapiens
atattcatcaacaaa

SEQ ID NO: 20230 - DNA, 15 bp, Homo sapiens
aatattcatcaacaa

SEQ ID NO: 20231 - DNA, 15 bp, Homo sapiens
aaatattcatcaaca

SEQ ID NO: 20232 - DNA, 15 bp, Homo sapiens
gaaatattcatcaac

SEQ ID NO: 20233 - DNA, 15 bp, Homo sapiens
ggaaatattcatcaa

SEQ ID NO: 20234 - DNA, 15 bp, Homo sapiens
gggaaatattcatca

SEQ ID NO: 20235 - DNA, 15 bp, Homo sapiens
agggaaatattcatc

SEQ ID NO: 20236 - DNA, 15 bp, Homo sapiens
aagggaaatattcat

SEQ ID NO: 20237 - DNA, 15 bp, Homo sapiens
aaagggaaatattca

SEQ ID NO: 20238 - DNA, 15 bp, Homo sapiens
aaaagggaaatattc

SEQ ID NO: 20239 - DNA, 15 bp, Homo sapiens
caaaagggaaatatt

SEQ ID NO: 20240 - DNA, 15 bp, Homo sapiens
acaaaagggaaatat

SEQ ID NO: 20241 - DNA, 15 bp, Homo sapiens
aacaaaagggaaata

SEQ ID NO: 20242 - DNA, 15 bp, Homo sapiens
caacaaaagggaaat

SEQ ID NO: 20243 - DNA, 15 bp, Homo sapiens
gcaacaaaagggaaa

SEQ ID NO: 20244 - DNA, 15 bp, Homo sapiens
agcaacaaaagggaa

SEQ ID NO: 20245 - DNA, 15 bp, Homo sapiens
tagcaacaaaaggga

SEQ ID NO: 20246 - DNA, 15 bp, Homo sapiens
ttagcaacaaaaggg

SEQ ID NO: 20247 - DNA, 15 bp, Homo sapiens
tttagcaacaaaagg

SEQ ID NO: 20248 - DNA, 15 bp, Homo sapiens
ttttagcaacaaaag

SEQ ID NO: 20249 - DNA, 15 bp, Homo sapiens
cttttagcaacaaaa

SEQ ID NO: 20250 - DNA, 15 bp, Homo sapiens
acttttagcaacaaa

SEQ ID NO: 20251 - DNA, 15 bp, Homo sapiens
cacttttagcaacaa

SEQ ID NO: 20252 - DNA, 15 bp, Homo sapiens
ccacttttagcaaca

SEQ ID NO: 20253 - DNA, 15 bp, Homo sapiens
gccacttttagcaac

SEQ ID NO: 20254 - DNA, 15 bp, Homo sapiens
tgccacttttagcaa

SEQ ID NO: 20255 - DNA, 15 bp, Homo sapiens
ttgccacttttagca

SEQ ID NO: 20256 - DNA, 15 bp, Homo sapiens
tttgccacttttagc

SEQ ID NO: 20257 - DNA, 15 bp, Homo sapiens
atttgccacttttag

SEQ ID NO: 20258 - DNA, 15 bp, Homo sapiens
tatttgccactttta

SEQ ID NO: 20259 - DNA, 15 bp, Homo sapiens
ttatttgccactttt

SEQ ID NO: 20260 - DNA, 15 bp, Homo sapiens
attatttgccacttt

SEQ ID NO: 20261 - DNA, 15 bp, Homo sapiens
gattatttgccactt

SEQ ID NO: 20262 - DNA, 15 bp, Homo sapiens
tgattatttgccact

SEQ ID NO: 20263 - DNA, 15 bp, Homo sapiens
ctgattatttgccac

SEQ ID NO: 20264 - DNA, 15 bp, Homo sapiens
tctgattatttgcca

SEQ ID NO: 20265 - DNA, 15 bp, Homo sapiens
gtctgattatttgcc

SEQ ID NO: 20266 - DNA, 15 bp, Homo sapiens
tgtctgattatttgc

SEQ ID NO: 20267 - DNA, 15 bp, Homo sapiens
atgtctgattatttg

SEQ ID NO: 20268 - DNA, 15 bp, Homo sapiens
tatgtctgattattt

SEQ ID NO: 20269 - DNA, 15 bp, Homo sapiens
ctatgtctgattatt

SEQ ID NO: 20270 - DNA, 15 bp, Homo sapiens
tctatgtctgattat

SEQ ID NO: 20271 - DNA, 15 bp, Homo sapiens
atctatgtctgatta

SEQ ID NO: 20272 - DNA, 15 bp, Homo sapiens
aatctatgtctgatt

SEQ ID NO: 20273 - DNA, 15 bp, Homo sapiens
taatctatgtctgat

SEQ ID NO: 20274 - DNA, 15 bp, Homo sapiens
gtaatctatgtctga

SEQ ID NO: 20275 - DNA, 15 bp, Homo sapiens
agtaatctatgtctg

SEQ ID NO: 20276 - DNA, 15 bp, Homo sapiens
tagtaatctatgtct

SEQ ID NO: 20277 - DNA, 15 bp, Homo sapiens
ttagtaatctatgtc

SEQ ID NO: 20278 - DNA, 15 bp, Homo sapiens
attagtaatctatgt

SEQ ID NO: 20279 - DNA, 15 bp, Homo sapiens
aattagtaatctatg

SEQ ID NO: 20280 - DNA, 15 bp, Homo sapiens
taattagtaatctat

SEQ ID NO: 20281 - DNA, 15 bp, Homo sapiens
ttaattagtaatcta

SEQ ID NO: 20282 - DNA, 15 bp, Homo sapiens
gttaattagtaatct

SEQ ID NO: 20283 - DNA, 15 bp, Homo sapiens
tgttaattagtaatc

SEQ ID NO: 20284 - DNA, 15 bp, Homo sapiens
ctgttaattagtaat

SEQ ID NO: 20285 - DNA, 15 bp, Homo sapiens
actgttaattagtaa

SEQ ID NO: 20286 - DNA, 15 bp, Homo sapiens
gactgttaattagta

SEQ ID NO: 20287 - DNA, 15 bp, Homo sapiens
agactgttaattagt

SEQ ID NO: 20288 - DNA, 15 bp, Homo sapiens
cagactgttaattag

SEQ ID NO: 20289 - DNA, 15 bp, Homo sapiens
gcagactgttaatta

SEQ ID NO: 20290 - DNA, 15 bp, Homo sapiens
ggcagactgttaatt

SEQ ID NO: 20291 - DNA, 15 bp, Homo sapiens
aggcagactgttaat

SEQ ID NO: 20292 - DNA, 15 bp, Homo sapiens
gaggcagactgttaa

SEQ ID NO: 20293 - DNA, 15 bp, Homo sapiens
tgaggcagactgtta

SEQ ID NO: 20294 - DNA, 15 bp, Homo sapiens
ctgaggcagactgtt

SEQ ID NO: 20295 - DNA, 15 bp, Homo sapiens
actgaggcagactgt

SEQ ID NO: 20296 - DNA, 15 bp, Homo sapiens
aactgaggcagactg

SEQ ID NO: 20297 - DNA, 15 bp, Homo sapiens
aaactgaggcagact

SEQ ID NO: 20298 - DNA, 15 bp, Homo sapiens
aaaactgaggcagac

SEQ ID NO: 20299 - DNA, 15 bp, Homo sapiens
aaaaactgaggcaga

SEQ ID NO: 20300 - DNA, 15 bp, Homo sapiens
aaaaaactgaggcag

SEQ ID NO: 20301 - DNA, 15 bp, Homo sapiens
aaaaaaactgaggca

SEQ ID NO: 20302 - DNA, 15 bp, Homo sapiens
aaaaaaaactgaggc

SEQ ID NO: 20303 - DNA, 15 bp, Homo sapiens
aaaaaaaaactgagg

SEQ ID NO: 20304 - DNA, 15 bp, Homo sapiens
aaaaaaaaaactgag

SEQ ID NO: 20305 - DNA, 15 bp, Homo sapiens
aaaaaaaaaaactga

SEQ ID NO: 20306 - DNA, 15 bp, Homo sapiens
aaaaaaaaaaaactg

SEQ ID NO: 20307 - DNA, 15 bp, Homo sapiens
aaaaaaaaaaaaact

SEQ ID NO: 20308 - DNA, 15 bp, Homo sapiens
aaaaaaaaaaaaaac

SEQ ID NO: 20309 - DNA, 15 bp, Homo sapiens
taaaaaaaaaaaaaa

SEQ ID NO: 20310 - DNA, 15 bp, Homo sapiens
ttaaaaaaaaaaaaa

SEQ ID NO: 20311 - DNA, 15 bp, Homo sapiens
attaaaaaaaaaaaa

SEQ ID NO: 20312 - DNA, 15 bp, Homo sapiens
aattaaaaaaaaaaa

SEQ ID NO: 20313 - DNA, 15 bp, Homo sapiens
taattaaaaaaaaaa

SEQ ID NO: 20314 - DNA, 15 bp, Homo sapiens
ttaattaaaaaaaaa

SEQ ID NO: 20315 - DNA, 15 bp, Homo sapiens
attaattaaaaaaaa

SEQ ID NO: 20316 - DNA, 15 bp, Homo sapiens
cattaattaaaaaaa

SEQ ID NO: 20317 - DNA, 15 bp, Homo sapiens
tcattaattaaaaaa

SEQ ID NO: 20318 - DNA, 15 bp, Homo sapiens
ttcattaattaaaaa

SEQ ID NO: 20319 - DNA, 15 bp, Homo sapiens
tttcattaattaaaa

SEQ ID NO: 20320 - DNA, 15 bp, Homo sapiens
gtttcattaattaaa

SEQ ID NO: 20321 - DNA, 15 bp, Homo sapiens
agtttcattaattaa

SEQ ID NO: 20322 - DNA, 15 bp, Homo sapiens
aagtttcattaatta

SEQ ID NO: 20323 - DNA, 15 bp, Homo sapiens
caagtttcattaatt

SEQ ID NO: 20324 - DNA, 15 bp, Homo sapiens
ccaagtttcattaat

SEQ ID NO: 20325 - DNA, 15 bp, Homo sapiens
cccaagtttcattaa

SEQ ID NO: 20326 - DNA, 15 bp, Homo sapiens
gcccaagtttcatta

SEQ ID NO: 20327 - DNA, 15 bp, Homo sapiens
agcccaagtttcatt

SEQ ID NO: 20328 - DNA, 15 bp, Homo sapiens
aagcccaagtttcat

SEQ ID NO: 20329 - DNA, 15 bp, Homo sapiens
gaagcccaagtttca

SEQ ID NO: 20330 - DNA, 15 bp, Homo sapiens
tgaagcccaagtttc

SEQ ID NO: 20331 - DNA, 15 bp, Homo sapiens
atgaagcccaagttt

SEQ ID NO: 20332 - DNA, 15 bp, Homo sapiens
gatgaagcccaagtt

SEQ ID NO: 20333 - DNA, 15 bp, Homo sapiens
tgatgaagcccaagt

SEQ ID NO: 20334 - DNA, 15 bp, Homo sapiens
ttgatgaagcccaag

SEQ ID NO: 20335 - DNA, 15 bp, Homo sapiens
cttgatgaagcccaa

SEQ ID NO: 20336 - DNA, 15 bp, Homo sapiens
gcttgatgaagccca

SEQ ID NO: 20337 - DNA, 15 bp, Homo sapiens
agcttgatgaagccc

SEQ ID NO: 20338 - DNA, 15 bp, Homo sapiens
gagcttgatgaagcc

SEQ ID NO: 20339 - DNA, 15 bp, Homo sapiens
tgagcttgatgaagc

SEQ ID NO: 20340 - DNA, 15 bp, Homo sapiens
ctgagcttgatgaag

SEQ ID NO: 20341 - DNA, 15 bp, Homo sapiens
cctgagcttgatgaa

SEQ ID NO: 20342 - DNA, 15 bp, Homo sapiens
acctgagcttgatga

SEQ ID NO: 20343 - DNA, 15 bp, Homo sapiens
cacctgagcttgatg

SEQ ID NO: 20344 - DNA, 15 bp, Homo sapiens
ccacctgagcttgat

SEQ ID NO: 20345 - DNA, 15 bp, Homo sapiens
tccacctgagcttga

SEQ ID NO: 20346 - DNA, 15 bp, Homo sapiens
ttccacctgagcttg

SEQ ID NO: 20347 - DNA, 15 bp, Homo sapiens
attccacctgagctt

SEQ ID NO: 20348 - DNA, 15 bp, Homo sapiens
cattccacctgagct

SEQ ID NO: 20349 - DNA, 15 bp, Homo sapiens
ccattccacctgagc

SEQ ID NO: 20350 - DNA, 15 bp, Homo sapiens
tccattccacctgag

SEQ ID NO: 20351 - DNA, 15 bp, Homo sapiens
atccattccacctga

SEQ ID NO: 20352 - DNA, 15 bp, Homo sapiens
tatccattccacctg

SEQ ID NO: 20353 - DNA, 15 bp, Homo sapiens
atatccattccacct

SEQ ID NO: 20354 - DNA, 15 bp, Homo sapiens
gatatccattccacc

SEQ ID NO: 20355 - DNA, 15 bp, Homo sapiens
tgatatccattccac

SEQ ID NO: 20356 - DNA, 15 bp, Homo sapiens
gtgatatccattcca

SEQ ID NO: 20357 - DNA, 15 bp, Homo sapiens
tgtgatatccattcc

SEQ ID NO: 20358 - DNA, 15 bp, Homo sapiens
ctgtgatatccattc

SEQ ID NO: 20359 - DNA, 15 bp, Homo sapiens
actgtgatatccatt

SEQ ID NO: 20360 - DNA, 15 bp, Homo sapiens
cactgtgatatccat

SEQ ID NO: 20361 - DNA, 15 bp, Homo sapiens
gcactgtgatatcca

SEQ ID NO: 20362 - DNA, 15 bp, Homo sapiens
agcactgtgatatcc

SEQ ID NO: 20363 - DNA, 15 bp, Homo sapiens
aagcactgtgatatc

SEQ ID NO: 20364 - DNA, 15 bp, Homo sapiens
aaagcactgtgatat

SEQ ID NO: 20365 - DNA, 15 bp, Homo sapiens
taaagcactgtgata

SEQ ID NO: 20366 - DNA, 15 bp, Homo sapiens
ataaagcactgtgat

SEQ ID NO: 20367 - DNA, 15 bp, Homo sapiens
aataaagcactgtga

SEQ ID NO: 20368 - DNA, 15 bp, Homo sapiens
aaataaagcactgtg

SEQ ID NO: 20369 - DNA, 15 bp, Homo sapiens
aaaataaagcactgt

SEQ ID NO: 20370 - DNA, 15 bp, Homo sapiens
aaaaataaagcactg

SEQ ID NO: 20371 - DNA, 15 bp, Homo sapiens
aaaaaataaagcact

SEQ ID NO: 20372 - DNA, 15 bp, Homo sapiens
gaaaaaataaagcac

SEQ ID NO: 20373 - DNA, 15 bp, Homo sapiens
agaaaaaataaagca

SEQ ID NO: 20374 - DNA, 15 bp, Homo sapiens
cagaaaaaataaagc

SEQ ID NO: 20375 - DNA, 15 bp, Homo sapiens
tcagaaaaaataaag

SEQ ID NO: 20376 - DNA, 15 bp, Homo sapiens
gtcagaaaaaataaa

SEQ ID NO: 20377 - DNA, 15 bp, Homo sapiens
tgtcagaaaaaataa

SEQ ID NO: 20378 - DNA, 15 bp, Homo sapiens
atgtcagaaaaaata

SEQ ID NO: 20379 - DNA, 15 bp, Homo sapiens
gatgtcagaaaaaat

SEQ ID NO: 20380 - DNA, 15 bp, Homo sapiens
tgatgtcagaaaaaa

SEQ ID NO: 20381 - DNA, 15 bp, Homo sapiens
ttgatgtcagaaaaa

SEQ ID NO: 20382 - DNA, 15 bp, Homo sapiens
tttgatgtcagaaaa

SEQ ID NO: 20383 - DNA, 15 bp, Homo sapiens
ttttgatgtcagaaa

SEQ ID NO: 20384 - DNA, 15 bp, Homo sapiens
cttttgatgtcagaa

SEQ ID NO: 20385 - DNA, 15 bp, Homo sapiens
tcttttgatgtcaga

SEQ ID NO: 20386 - DNA, 15 bp, Homo sapiens
ttcttttgatgtcag

SEQ ID NO: 20387 - DNA, 15 bp, Homo sapiens
tttcttttgatgtca

SEQ ID NO: 20388 - DNA, 15 bp, Homo sapiens
atttcttttgatgtc

SEQ ID NO: 20389 - DNA, 15 bp, Homo sapiens
aatttcttttgatgt

SEQ ID NO: 20390 - DNA, 15 bp, Homo sapiens
aaatttcttttgatg

SEQ ID NO: 20391 - DNA, 15 bp, Homo sapiens
gaaatttcttttgat

SEQ ID NO: 20392 - DNA, 15 bp, Homo sapiens
agaaatttcttttga

SEQ ID NO: 20393 - DNA, 15 bp, Homo sapiens
aagaaatttcttttg

SEQ ID NO: 20394 - DNA, 15 bp, Homo sapiens
aaagaaatttctttt

SEQ ID NO: 20395 - DNA, 15 bp, Homo sapiens
caaagaaatttcttt

SEQ ID NO: 20396 - DNA, 15 bp, Homo sapiens
acaaagaaatttctt

SEQ ID NO: 20397 - DNA, 15 bp, Homo sapiens
gacaaagaaatttct

SEQ ID NO: 20398 - DNA, 15 bp, Homo sapiens
tgacaaagaaatttc

SEQ ID NO: 20399 - DNA, 15 bp, Homo sapiens
ttgacaaagaaattt

SEQ ID NO: 20400 - DNA, 15 bp, Homo sapiens
tttgacaaagaaatt

SEQ ID NO: 20401 - DNA, 15 bp, Homo sapiens
ctttgacaaagaaat

SEQ ID NO: 20402 - DNA, 15 bp, Homo sapiens
actttgacaaagaaa

SEQ ID NO: 20403 - DNA, 15 bp, Homo sapiens
cactttgacaaagaa

SEQ ID NO: 20404 - DNA, 15 bp, Homo sapiens
acactttgacaaaga

SEQ ID NO: 20405 - DNA, 15 bp, Homo sapiens
tacactttgacaaag

SEQ ID NO: 20406 - DNA, 15 bp, Homo sapiens
ctacactttgacaaa

SEQ ID NO: 20407 - DNA, 15 bp, Homo sapiens
tctacactttgacaa

SEQ ID NO: 20408 - DNA, 15 bp, Homo sapiens
gtctacactttgaca

SEQ ID NO: 20409 - DNA, 15 bp, Homo sapiens
tgtctacactttgac

SEQ ID NO: 20410 - DNA, 15 bp, Homo sapiens
atgtctacactttga

SEQ ID NO: 20411 - DNA, 15 bp, Homo sapiens
catgtctacactttg

SEQ ID NO: 20412 - DNA, 15 bp, Homo sapiens
acatgtctacacttt

SEQ ID NO: 20413 - DNA, 15 bp, Homo sapiens
aacatgtctacactt

SEQ ID NO: 20414 - DNA, 15 bp, Homo sapiens
aaacatgtctacact

SEQ ID NO: 20415 - DNA, 15 bp, Homo sapiens
caaacatgtctacac

SEQ ID NO: 20416 - DNA, 15 bp, Homo sapiens
acaaacatgtctaca

SEQ ID NO: 20417 - DNA, 15 bp, Homo sapiens
aacaaacatgtctac

SEQ ID NO: 20418 - DNA, 15 bp, Homo sapiens
caacaaacatgtcta

SEQ ID NO: 20419 - DNA, 15 bp, Homo sapiens
acaacaaacatgtct

SEQ ID NO: 20420 - DNA, 15 bp, Homo sapiens
cacaacaaacatgtc

SEQ ID NO: 20421 - DNA, 15 bp, Homo sapiens
tcacaacaaacatgt

SEQ ID NO: 20422 - DNA, 15 bp, Homo sapiens
gtcacaacaaacatg

SEQ ID NO: 20423 - DNA, 15 bp, Homo sapiens
agtcacaacaaacat

SEQ ID NO: 20424 - DNA, 15 bp, Homo sapiens
cagtcacaacaaaca

SEQ ID NO: 20425 - DNA, 15 bp, Homo sapiens
gcagtcacaacaaac

SEQ ID NO: 20426 - DNA, 15 bp, Homo sapiens
ggcagtcacaacaaa

SEQ ID NO: 20427 - DNA, 15 bp, Homo sapiens
aggcagtcacaacaa

SEQ ID NO: 20428 - DNA, 15 bp, Homo sapiens
aaggcagtcacaaca

SEQ ID NO: 20429 - DNA, 15 bp, Homo sapiens
aaaggcagtcacaac

SEQ ID NO: 20430 - DNA, 15 bp, Homo sapiens
aaaaggcagtcacaa

SEQ ID NO: 20431 - DNA, 15 bp, Homo sapiens
caaaaggcagtcaca

SEQ ID NO: 20432 - DNA, 15 bp, Homo sapiens
acaaaaggcagtcac

SEQ ID NO: 20433 - DNA, 15 bp, Homo sapiens
cacaaaaggcagtca

SEQ ID NO: 20434 - DNA, 15 bp, Homo sapiens
acacaaaaggcagtc

SEQ ID NO: 20435 - DNA, 15 bp, Homo sapiens
cacacaaaaggcagt

SEQ ID NO: 20436 - DNA, 15 bp, Homo sapiens
ccacacaaaaggcag

SEQ ID NO: 20437 - DNA, 15 bp, Homo sapiens
cccacacaaaaggca

SEQ ID NO: 20438 - DNA, 15 bp, Homo sapiens
acccacacaaaaggc

SEQ ID NO: 20439 - DNA, 15 bp, Homo sapiens
aacccacacaaaagg

SEQ ID NO: 20440 - DNA, 15 bp, Homo sapiens
gaacccacacaaaag

SEQ ID NO: 20441 - DNA, 15 bp, Homo sapiens
agaacccacacaaaa

SEQ ID NO: 20442 - DNA, 15 bp, Homo sapiens
aagaacccacacaaa

SEQ ID NO: 20443 - DNA, 15 bp, Homo sapiens
aaagaacccacacaa

SEQ ID NO: 20444 - DNA, 15 bp, Homo sapiens
aaaagaacccacaca

SEQ ID NO: 20445 - DNA, 15 bp, Homo sapiens
gaaaagaacccacac

SEQ ID NO: 20446 - DNA, 15 bp, Homo sapiens
agaaaagaacccaca

SEQ ID NO: 20447 - DNA, 15 bp, Homo sapiens
gagaaaagaacccac

SEQ ID NO: 20448 - DNA, 15 bp, Homo sapiens
ggagaaaagaaccca

SEQ ID NO: 20449 - DNA, 15 bp, Homo sapiens
gggagaaaagaaccc

SEQ ID NO: 20450 - DNA, 15 bp, Homo sapiens
tgggagaaaagaacc

SEQ ID NO: 20451 - DNA, 15 bp, Homo sapiens
ctgggagaaaagaac

SEQ ID NO: 20452 - DNA, 15 bp, Homo sapiens
gctgggagaaaagaa

SEQ ID NO: 20453 - DNA, 15 bp, Homo sapiens
ggctgggagaaaaga

SEQ ID NO: 20454 - DNA, 15 bp, Homo sapiens
gggctgggagaaaag

SEQ ID NO: 20455 - DNA, 15 bp, Homo sapiens
agggctgggagaaaa

SEQ ID NO: 20456 - DNA, 15 bp, Homo sapiens
gagggctgggagaaa

SEQ ID NO: 20457 - DNA, 15 bp, Homo sapiens
agagggctgggagaa

SEQ ID NO: 20458 - DNA, 15 bp, Homo sapiens
gagagggctgggaga

SEQ ID NO: 20459 - DNA, 15 bp, Homo sapiens
ggagagggctgggag

SEQ ID NO: 20460 - DNA, 15 bp, Homo sapiens
aggagagggctggga

SEQ ID NO: 20461 - DNA, 15 bp, Homo sapiens
taggagagggctggg

SEQ ID NO: 20462 - DNA, 15 bp, Homo sapiens
gtaggagagggctgg

SEQ ID NO: 20463 - DNA, 15 bp, Homo sapiens
agtaggagagggctg

SEQ ID NO: 20464 - DNA, 15 bp, Homo sapiens
tagtaggagagggct

SEQ ID NO: 20465 - DNA, 15 bp, Homo sapiens
gtagtaggagagggc

SEQ ID NO: 20466 - DNA, 15 bp, Homo sapiens
tgtagtaggagaggg

SEQ ID NO: 20467 - DNA, 15 bp, Homo sapiens
ctgtagtaggagagg

SEQ ID NO: 20468 - DNA, 15 bp, Homo sapiens
cctgtagtaggagag

SEQ ID NO: 20469 - DNA, 15 bp, Homo sapiens
tcctgtagtaggaga

SEQ ID NO: 20470 - DNA, 15 bp, Homo sapiens
ctcctgtagtaggag

SEQ ID NO: 20471 - DNA, 15 bp, Homo sapiens
tctcctgtagtagga

SEQ ID NO: 20472 - DNA, 15 bp, Homo sapiens
ctctcctgtagtagg

SEQ ID NO: 20473 - DNA, 15 bp, Homo sapiens
tctctcctgtagtag

SEQ ID NO: 20474 - DNA, 15 bp, Homo sapiens
ctctctcctgtagta

SEQ ID NO: 20475 - DNA, 15 bp, Homo sapiens
tctctctcctgtagt

SEQ ID NO: 20476 - DNA, 15 bp, Homo sapiens
ctctctctcctgtag

SEQ ID NO: 20477 - DNA, 15 bp, Homo sapiens
tctctctctcctgta

SEQ ID NO: 20478 - DNA, 15 bp, Homo sapiens
atctctctctcctgt

SEQ ID NO: 20479 - DNA, 15 bp, Homo sapiens
tatctctctctcctg

SEQ ID NO: 20480 - DNA, 15 bp, Homo sapiens
ttatctctctctcct

SEQ ID NO: 20481 - DNA, 15 bp, Homo sapiens
attatctctctctcc

SEQ ID NO: 20482 - DNA, 15 bp, Homo sapiens
cattatctctctctc

SEQ ID NO: 20483 - DNA, 15 bp, Homo sapiens
ccattatctctctct

SEQ ID NO: 20484 - DNA, 15 bp, Homo sapiens
gccattatctctctc

SEQ ID NO: 20485 - DNA, 15 bp, Homo sapiens
ggccattatctctct

SEQ ID NO: 20486 - DNA, 15 bp, Homo sapiens
gggccattatctctc

SEQ ID NO: 20487 - DNA, 15 bp, Homo sapiens
agggccattatctct

SEQ ID NO: 20488 - DNA, 15 bp, Homo sapiens
aagggccattatctc

SEQ ID NO: 20489 - DNA, 15 bp, Homo sapiens
aaagggccattatct

SEQ ID NO: 20490 - DNA, 15 bp, Homo sapiens
caaagggccattatc

SEQ ID NO: 20491 - DNA, 15 bp, Homo sapiens
gcaaagggccattat

SEQ ID NO: 20492 - DNA, 15 bp, Homo sapiens
agcaaagggccatta

SEQ ID NO: 20493 - DNA, 15 bp, Homo sapiens
gagcaaagggccatt

SEQ ID NO: 20494 - DNA, 15 bp, Homo sapiens
ggagcaaagggccat

SEQ ID NO: 20495 - DNA, 15 bp, Homo sapiens
aggagcaaagggcca

SEQ ID NO: 20496 - DNA, 15 bp, Homo sapiens
gaggagcaaagggcc

SEQ ID NO: 20497 - DNA, 15 bp, Homo sapiens
tgaggagcaaagggc

SEQ ID NO: 20498 - DNA, 15 bp, Homo sapiens
atgaggagcaaaggg

SEQ ID NO: 20499 - DNA, 15 bp, Homo sapiens
aatgaggagcaaagg

SEQ ID NO: 20500 - DNA, 15 bp, Homo sapiens
gaatgaggagcaaag

SEQ ID NO: 20501 - DNA, 15 bp, Homo sapiens
ggaatgaggagcaaa

SEQ ID NO: 20502 - DNA, 15 bp, Homo sapiens
cggaatgaggagcaa

SEQ ID NO: 20503 - DNA, 15 bp, Homo sapiens
gcggaatgaggagca

SEQ ID NO: 20504 - DNA, 15 bp, Homo sapiens
tgcggaatgaggagc

SEQ ID NO: 20505 - DNA, 15 bp, Homo sapiens
atgcggaatgaggag

SEQ ID NO: 20506 - DNA, 15 bp, Homo sapiens
aatgcggaatgagga

SEQ ID NO: 20507 - DNA, 15 bp, Homo sapiens
gaatgcggaatgagg

SEQ ID NO: 20508 - DNA, 15 bp, Homo sapiens
tgaatgcggaatgag

SEQ ID NO: 20509 - DNA, 15 bp, Homo sapiens
ctgaatgcggaatga

SEQ ID NO: 20510 - DNA, 15 bp, Homo sapiens
tctgaatgcggaatg

SEQ ID NO: 20511 - DNA, 15 bp, Homo sapiens
gtctgaatgcggaat

SEQ ID NO: 20512 - DNA, 15 bp, Homo sapiens
ggtctgaatgcggaa

SEQ ID NO: 20513 - DNA, 15 bp, Homo sapiens
tggtctgaatgcgga

SEQ ID NO: 20514 - DNA, 15 bp, Homo sapiens
ctggtctgaatgcgg

SEQ ID NO: 20515 - DNA, 15 bp, Homo sapiens
tctggtctgaatgcg

SEQ ID NO: 20516 - DNA, 15 bp, Homo sapiens
atctggtctgaatgc

SEQ ID NO: 20517 - DNA, 15 bp, Homo sapiens
aatctggtctgaatg

SEQ ID NO: 20518 - DNA, 15 bp, Homo sapiens
gaatctggtctgaat

SEQ ID NO: 20519 - DNA, 15 bp, Homo sapiens
ggaatctggtctgaa

SEQ ID NO: 20520 - DNA, 15 bp, Homo sapiens
gggaatctggtctga

SEQ ID NO: 20521 - DNA, 15 bp, Homo sapiens
ggggaatctggtctg

SEQ ID NO: 20522 - DNA, 15 bp, Homo sapiens
tggggaatctggtct

SEQ ID NO: 20523 - DNA, 15 bp, Homo sapiens
ctggggaatctggtc

SEQ ID NO: 20524 - DNA, 15 bp, Homo sapiens
gctggggaatctggt

SEQ ID NO: 20525 - DNA, 15 bp, Homo sapiens
agctggggaatctgg

SEQ ID NO: 20526 - DNA, 15 bp, Homo sapiens
cagctggggaatctg

SEQ ID NO: 20527 - DNA, 15 bp, Homo sapiens
gcagctggggaatct

SEQ ID NO: 20528 - DNA, 15 bp, Homo sapiens
tgcagctggggaatc

SEQ ID NO: 20529 - DNA, 15 bp, Homo sapiens
ttgcagctggggaat

SEQ ID NO: 20530 - DNA, 15 bp, Homo sapiens
attgcagctggggaa

SEQ ID NO: 20531 - DNA, 15 bp, Homo sapiens
gattgcagctgggga

SEQ ID NO: 20532 - DNA, 15 bp, Homo sapiens
agattgcagctgggg

SEQ ID NO: 20533 - DNA, 15 bp, Homo sapiens
gagattgcagctggg

SEQ ID NO: 20534 - DNA, 15 bp, Homo sapiens
ggagattgcagctgg

SEQ ID NO: 20535 - DNA, 15 bp, Homo sapiens
aggagattgcagctg

SEQ ID NO: 20536 - DNA, 15 bp, Homo sapiens
caggagattgcagct

SEQ ID NO: 20537 - DNA, 15 bp, Homo sapiens
gcaggagattgcagc

SEQ ID NO: 20538 - DNA, 15 bp, Homo sapiens
ggcaggagattgcag

SEQ ID NO: 20539 - DNA, 15 bp, Homo sapiens
tggcaggagattgca

SEQ ID NO: 20540 - DNA, 15 bp, Homo sapiens
atggcaggagattgc

SEQ ID NO: 20541 - DNA, 15 bp, Homo sapiens
gatggcaggagattg

SEQ ID NO: 20542 - DNA, 15 bp, Homo sapiens
cgatggcaggagatt

SEQ ID NO: 20543 - DNA, 15 bp, Homo sapiens
ccgatggcaggagat

SEQ ID NO: 20544 - DNA, 15 bp, Homo sapiens
tccgatggcaggaga

SEQ ID NO: 20545 - DNA, 15 bp, Homo sapiens
atccgatggcaggag

SEQ ID NO: 20546 - DNA, 15 bp, Homo sapiens
aatccgatggcagga

SEQ ID NO: 20547 - DNA, 15 bp, Homo sapiens
caatccgatggcagg

SEQ ID NO: 20548 - DNA, 15 bp, Homo sapiens
gcaatccgatggcag

SEQ ID NO: 20549 - DNA, 15 bp, Homo sapiens
tgcaatccgatggca

SEQ ID NO: 20550 - DNA, 15 bp, Homo sapiens
atgcaatccgatggc

SEQ ID NO: 20551 - DNA, 15 bp, Homo sapiens
gatgcaatccgatgg

SEQ ID NO: 20552 - DNA, 15 bp, Homo sapiens
tgatgcaatccgatg

SEQ ID NO: 20553 - DNA, 15 bp, Homo sapiens
gtgatgcaatccgat

SEQ ID NO: 20554 - DNA, 15 bp, Homo sapiens
ggtgatgcaatccga

SEQ ID NO: 20555 - DNA, 15 bp, Homo sapiens
tggtgatgcaatccg

SEQ ID NO: 20556 - DNA, 15 bp, Homo sapiens
ttggtgatgcaatcc

SEQ ID NO: 20557 - DNA, 15 bp, Homo sapiens
gttggtgatgcaatc

SEQ ID NO: 20558 - DNA, 15 bp, Homo sapiens
agttggtgatgcaat

SEQ ID NO: 20559 - DNA, 15 bp, Homo sapiens
gagttggtgatgcaa

SEQ ID NO: 20560 - DNA, 15 bp, Homo sapiens
tgagttggtgatgca

SEQ ID NO: 20561 - DNA, 15 bp, Homo sapiens
ttgagttggtgatgc

SEQ ID NO: 20562 - DNA, 15 bp, Homo sapiens
gttgagttggtgatg

SEQ ID NO: 20563 - DNA, 15 bp, Homo sapiens
ggttgagttggtgat

SEQ ID NO: 20564 - DNA, 15 bp, Homo sapiens
aggttgagttggtga

SEQ ID NO: 20565 - DNA, 15 bp, Homo sapiens
taggttgagttggtg

SEQ ID NO: 20566 - DNA, 15 bp, Homo sapiens
ttaggttgagttggt

SEQ ID NO: 20567 - DNA, 15 bp, Homo sapiens
attaggttgagttgg

SEQ ID NO: 20568 - DNA, 15 bp, Homo sapiens
aattaggttgagttg

SEQ ID NO: 20569 - DNA, 15 bp, Homo sapiens
caattaggttgagtt

SEQ ID NO: 20570 - DNA, 15 bp, Homo sapiens
ccaattaggttgagt

SEQ ID NO: 20571 - DNA, 15 bp, Homo sapiens
accaattaggttgag

SEQ ID NO: 20572 - DNA, 15 bp, Homo sapiens
caccaattaggttga

SEQ ID NO: 20573 - DNA, 15 bp, Homo sapiens
tcaccaattaggttg

SEQ ID NO: 20574 - DNA, 15 bp, Homo sapiens
ctcaccaattaggtt

SEQ ID NO: 20575 - DNA, 15 bp, Homo sapiens
tctcaccaattaggt

SEQ ID NO: 20576 - DNA, 15 bp, Homo sapiens
atctcaccaattagg

SEQ ID NO: 20577 - DNA, 15 bp, Homo sapiens
catctcaccaattag

SEQ ID NO: 20578 - DNA, 15 bp, Homo sapiens
acatctcaccaatta

SEQ ID NO: 20579 - DNA, 15 bp, Homo sapiens
gacatctcaccaatt

SEQ ID NO: 20580 - DNA, 15 bp, Homo sapiens
tgacatctcaccaat

SEQ ID NO: 20581 - DNA, 15 bp, Homo sapiens
gtgacatctcaccaa

SEQ ID NO: 20582 - DNA, 15 bp, Homo sapiens
agtgacatctcacca

SEQ ID NO: 20583 - DNA, 15 bp, Homo sapiens
gagtgacatctcacc

SEQ ID NO: 20584 - DNA, 15 bp, Homo sapiens
ggagtgacatctcac

SEQ ID NO: 20585 - DNA, 15 bp, Homo sapiens
gggagtgacatctca

SEQ ID NO: 20586 - DNA, 15 bp, Homo sapiens
agggagtgacatctc

SEQ ID NO: 20587 - DNA, 15 bp, Homo sapiens
gagggagtgacatct

SEQ ID NO: 20588 - DNA, 15 bp, Homo sapiens
ggagggagtgacatc

SEQ ID NO: 20589 - DNA, 15 bp, Homo sapiens
gggagggagtgacat

SEQ ID NO: 20590 - DNA, 15 bp, Homo sapiens
agggagggagtgaca

SEQ ID NO: 20591 - DNA, 15 bp, Homo sapiens
gagggagggagtgac

SEQ ID NO: 20592 - DNA, 15 bp, Homo sapiens
ggagggagggagtga

SEQ ID NO: 20593 - DNA, 15 bp, Homo sapiens
tggagggagggagtg

SEQ ID NO: 20594 - DNA, 15 bp, Homo sapiens
gtggagggagggagt

SEQ ID NO: 20595 - DNA, 15 bp, Homo sapiens
ggtggagggagggag

SEQ ID NO: 20596 - DNA, 15 bp, Homo sapiens
cggtggagggaggga

SEQ ID NO: 20597 - DNA, 15 bp, Homo sapiens
gcggtggagggaggg

SEQ ID NO: 20598 - DNA, 15 bp, Homo sapiens
agcggtggagggagg

SEQ ID NO: 20599 - DNA, 15 bp, Homo sapiens
gagcggtggagggag

SEQ ID NO: 20600 - DNA, 15 bp, Homo sapiens
tgagcggtggaggga

SEQ ID NO: 20601 - DNA, 15 bp, Homo sapiens
gtgagcggtggaggg

SEQ ID NO: 20602 - DNA, 15 bp, Homo sapiens
agtgagcggtggagg

SEQ ID NO: 20603 - DNA, 15 bp, Homo sapiens
gagtgagcggtggag

SEQ ID NO: 20604 - DNA, 15 bp, Homo sapiens
agagtgagcggtgga

SEQ ID NO: 20605 - DNA, 15 bp, Homo sapiens
gagagtgagcggtgg

SEQ ID NO: 20606 - DNA, 15 bp, Homo sapiens
tgagagtgagcggtg

SEQ ID NO: 20607 - DNA, 15 bp, Homo sapiens
atgagagtgagcggt

SEQ ID NO: 20608 - DNA, 15 bp, Homo sapiens
aatgagagtgagcgg

SEQ ID NO: 20609 - DNA, 15 bp, Homo sapiens
aaatgagagtgagcg

SEQ ID NO: 20610 - DNA, 15 bp, Homo sapiens
gaaatgagagtgagc

SEQ ID NO: 20611 - DNA, 15 bp, Homo sapiens
agaaatgagagtgag

SEQ ID NO: 20612 - DNA, 15 bp, Homo sapiens
gagaaatgagagtga

SEQ ID NO: 20613 - DNA, 15 bp, Homo sapiens
tgagaaatgagagtg

SEQ ID NO: 20614 - DNA, 15 bp, Homo sapiens
ctgagaaatgagagt

SEQ ID NO: 20615 - DNA, 15 bp, Homo sapiens
actgagaaatgagag

SEQ ID NO: 20616 - DNA, 15 bp, Homo sapiens
cactgagaaatgaga

SEQ ID NO: 20617 - DNA, 15 bp, Homo sapiens
tcactgagaaatgag

SEQ ID NO: 20618 - DNA, 15 bp, Homo sapiens
ctcactgagaaatga

SEQ ID NO: 20619 - DNA, 15 bp, Homo sapiens
actcactgagaaatg

SEQ ID NO: 20620 - DNA, 15 bp, Homo sapiens
aactcactgagaaat

SEQ ID NO: 20621 - DNA, 15 bp, Homo sapiens
aaactcactgagaaa

SEQ ID NO: 20622 - DNA, 15 bp, Homo sapiens
taaactcactgagaa

SEQ ID NO: 20623 - DNA, 15 bp, Homo sapiens
ctaaactcactgaga

SEQ ID NO: 20624 - DNA, 15 bp, Homo sapiens
gctaaactcactgag

SEQ ID NO: 20625 - DNA, 15 bp, Homo sapiens
agctaaactcactga

SEQ ID NO: 20626 - DNA, 15 bp, Homo sapiens
gagctaaactcactg

SEQ ID NO: 20627 - DNA, 15 bp, Homo sapiens
agagctaaactcact

SEQ ID NO: 20628 - DNA, 15 bp, Homo sapiens
cagagctaaactcac

SEQ ID NO: 20629 - DNA, 15 bp, Homo sapiens
acagagctaaactca

SEQ ID NO: 20630 - DNA, 15 bp, Homo sapiens
gacagagctaaactc

SEQ ID NO: 20631 - DNA, 15 bp, Homo sapiens
tgacagagctaaact

SEQ ID NO: 20632 - DNA, 15 bp, Homo sapiens
gtgacagagctaaac

SEQ ID NO: 20633 - DNA, 15 bp, Homo sapiens
agtgacagagctaaa

SEQ ID NO: 20634 - DNA, 15 bp, Homo sapiens
gagtgacagagctaa

SEQ ID NO: 20635 - DNA, 15 bp, Homo sapiens
agagtgacagagcta

SEQ ID NO: 20636 - DNA, 15 bp, Homo sapiens
gagagtgacagagct

SEQ ID NO: 20637 - DNA, 15 bp, Homo sapiens
agagagtgacagagc

SEQ ID NO: 20638 - DNA, 15 bp, Homo sapiens
gagagagtgacagag

SEQ ID NO: 20639 - DNA, 15 bp, Homo sapiens
agagagagtgacaga

SEQ ID NO: 20640 - DNA, 15 bp, Homo sapiens
tagagagagtgacag

SEQ ID NO: 20641 - DNA, 15 bp, Homo sapiens
ttagagagagtgaca

SEQ ID NO: 20642 - DNA, 15 bp, Homo sapiens
tttagagagagtgac

SEQ ID NO: 20643 - DNA, 15 bp, Homo sapiens
ttttagagagagtga

SEQ ID NO: 20644 - DNA, 15 bp, Homo sapiens
cttttagagagagtg

SEQ ID NO: 20645 - DNA, 15 bp, Homo sapiens
acttttagagagagt

SEQ ID NO: 20646 - DNA, 15 bp, Homo sapiens
aacttttagagagag

SEQ ID NO: 20647 - DNA, 15 bp, Homo sapiens
taacttttagagaga

SEQ ID NO: 20648 - DNA, 15 bp, Homo sapiens
gtaacttttagagag

SEQ ID NO: 20649 - DNA, 15 bp, Homo sapiens
agtaacttttagaga

SEQ ID NO: 20650 - DNA, 15 bp, Homo sapiens
gagtaacttttagag

SEQ ID NO: 20651 - DNA, 15 bp, Homo sapiens
agagtaacttttaga

SEQ ID NO: 20652 - DNA, 15 bp, Homo sapiens
aagagtaacttttag

SEQ ID NO: 20653 - DNA, 15 bp, Homo sapiens
caagagtaactttta

SEQ ID NO: 20654 - DNA, 15 bp, Homo sapiens
acaagagtaactttt

SEQ ID NO: 20655 - DNA, 15 bp, Homo sapiens
aacaagagtaacttt

SEQ ID NO: 20656 - DNA, 15 bp, Homo sapiens
aaacaagagtaactt

SEQ ID NO: 20657 - DNA, 15 bp, Homo sapiens
aaaacaagagtaact

SEQ ID NO: 20658 - DNA, 15 bp, Homo sapiens
taaaacaagagtaac

SEQ ID NO: 20659 - DNA, 15 bp, Homo sapiens
ctaaaacaagagtaa

SEQ ID NO: 20660 - DNA, 15 bp, Homo sapiens
actaaaacaagagta

SEQ ID NO: 20661 - DNA, 15 bp, Homo sapiens
cactaaaacaagagt

SEQ ID NO: 20662 - DNA, 15 bp, Homo sapiens
tcactaaaacaagag

SEQ ID NO: 20663 - DNA, 15 bp, Homo sapiens
atcactaaaacaaga

SEQ ID NO: 20664 - DNA, 15 bp, Homo sapiens
aatcactaaaacaag

SEQ ID NO: 20665 - DNA, 15 bp, Homo sapiens
aaatcactaaaacaa

SEQ ID NO: 20666 - DNA, 15 bp, Homo sapiens
caaatcactaaaaca

SEQ ID NO: 20667 - DNA, 15 bp, Homo sapiens
ccaaatcactaaaac

SEQ ID NO: 20668 - DNA, 15 bp, Homo sapiens
cccaaatcactaaaa

SEQ ID NO: 20669 - DNA, 15 bp, Homo sapiens
acccaaatcactaaa

SEQ ID NO: 20670 - DNA, 15 bp, Homo sapiens
cacccaaatcactaa

SEQ ID NO: 20671 - DNA, 15 bp, Homo sapiens
acacccaaatcacta

SEQ ID NO: 20672 - DNA, 15 bp, Homo sapiens
tacacccaaatcact

SEQ ID NO: 20673 - DNA, 15 bp, Homo sapiens
ttacacccaaatcac

SEQ ID NO: 20674 - DNA, 15 bp, Homo sapiens
tttacacccaaatca

SEQ ID NO: 20675 - DNA, 15 bp, Homo sapiens
gtttacacccaaatc

SEQ ID NO: 20676 - DNA, 15 bp, Homo sapiens
tgtttacacccaaat

SEQ ID NO: 20677 - DNA, 15 bp, Homo sapiens
atgtttacacccaaa

SEQ ID NO: 20678 - DNA, 15 bp, Homo sapiens
aatgtttacacccaa

SEQ ID NO: 20679 - DNA, 15 bp, Homo sapiens
caatgtttacaccca

SEQ ID NO: 20680 - DNA, 15 bp, Homo sapiens
tcaatgtttacaccc

SEQ ID NO: 20681 - DNA, 15 bp, Homo sapiens
atcaatgtttacacc

SEQ ID NO: 20682 - DNA, 15 bp, Homo sapiens
catcaatgtttacac

SEQ ID NO: 20683 - DNA, 15 bp, Homo sapiens
tcatcaatgtttaca

SEQ ID NO: 20684 - DNA, 15 bp, Homo sapiens
atcatcaatgtttac

SEQ ID NO: 20685 - DNA, 15 bp, Homo sapiens
gatcatcaatgttta

SEQ ID NO: 20686 - DNA, 15 bp, Homo sapiens
ggatcatcaatgttt

SEQ ID NO: 20687 - DNA, 15 bp, Homo sapiens
aggatcatcaatgtt

SEQ ID NO: 20688 - DNA, 15 bp, Homo sapiens
aaggatcatcaatgt

SEQ ID NO: 20689 - DNA, 15 bp, Homo sapiens
gaaggatcatcaatg

SEQ ID NO: 20690 - DNA, 15 bp, Homo sapiens
agaaggatcatcaat

SEQ ID NO: 20691 - DNA, 15 bp, Homo sapiens
tagaaggatcatcaa

SEQ ID NO: 20692 - DNA, 15 bp, Homo sapiens
ttagaaggatcatca

SEQ ID NO: 20693 - DNA, 15 bp, Homo sapiens
attagaaggatcatc

SEQ ID NO: 20694 - DNA, 15 bp, Homo sapiens
tattagaaggatcat

SEQ ID NO: 20695 - DNA, 15 bp, Homo sapiens
gtattagaaggatca

SEQ ID NO: 20696 - DNA, 15 bp, Homo sapiens
agtattagaaggatc

SEQ ID NO: 20697 - DNA, 15 bp, Homo sapiens
gagtattagaaggat

SEQ ID NO: 20698 - DNA, 15 bp, Homo sapiens
agagtattagaagga

SEQ ID NO: 20699 - DNA, 15 bp, Homo sapiens
cagagtattagaagg

SEQ ID NO: 20700 - DNA, 15 bp, Homo sapiens
acagagtattagaag

SEQ ID NO: 20701 - DNA, 15 bp, Homo sapiens
gacagagtattagaa

SEQ ID NO: 20702 - DNA, 15 bp, Homo sapiens
ggacagagtattaga

SEQ ID NO: 20703 - DNA, 15 bp, Homo sapiens
aggacagagtattag

SEQ ID NO: 20704 - DNA, 15 bp, Homo sapiens
gaggacagagtatta

SEQ ID NO: 20705 - DNA, 15 bp, Homo sapiens
agaggacagagtatt

SEQ ID NO: 20706 - DNA, 15 bp, Homo sapiens
aagaggacagagtat

SEQ ID NO: 20707 - DNA, 15 bp, Homo sapiens
taagaggacagagta

SEQ ID NO: 20708 - DNA, 15 bp, Homo sapiens
ttaagaggacagagt

SEQ ID NO: 20709 - DNA, 15 bp, Homo sapiens
attaagaggacagag

SEQ ID NO: 20710 - DNA, 15 bp, Homo sapiens
aattaagaggacaga

SEQ ID NO: 20711 - DNA, 15 bp, Homo sapiens
aaattaagaggacag

SEQ ID NO: 20712 - DNA, 15 bp, Homo sapiens
gaaattaagaggaca

SEQ ID NO: 20713 - DNA, 15 bp, Homo sapiens
agaaattaagaggac

SEQ ID NO: 20714 - DNA, 15 bp, Homo sapiens
gagaaattaagagga

SEQ ID NO: 20715 - DNA, 15 bp, Homo sapiens
agagaaattaagagg

SEQ ID NO: 20716 - DNA, 15 bp, Homo sapiens
tagagaaattaagag

SEQ ID NO: 20717 - DNA, 15 bp, Homo sapiens
ttagagaaattaaga

SEQ ID NO: 20718 - DNA, 15 bp, Homo sapiens
cttagagaaattaag

SEQ ID NO: 20719 - DNA, 15 bp, Homo sapiens
acttagagaaattaa

SEQ ID NO: 20720 - DNA, 15 bp, Homo sapiens
aacttagagaaatta

SEQ ID NO: 20721 - DNA, 15 bp, Homo sapiens
gaacttagagaaatt

SEQ ID NO: 20722 - DNA, 15 bp, Homo sapiens
agaacttagagaaat

SEQ ID NO: 20723 - DNA, 15 bp, Homo sapiens
gagaacttagagaaa

SEQ ID NO: 20724 - DNA, 15 bp, Homo sapiens
agagaacttagagaa

SEQ ID NO: 20725 - DNA, 15 bp, Homo sapiens
aagagaacttagaga

SEQ ID NO: 20726 - DNA, 15 bp, Homo sapiens
aaagagaacttagag

SEQ ID NO: 20727 - DNA, 15 bp, Homo sapiens
gaaagagaacttaga

SEQ ID NO: 20728 - DNA, 15 bp, Homo sapiens
agaaagagaacttag

SEQ ID NO: 20729 - DNA, 15 bp, Homo sapiens
tagaaagagaactta

SEQ ID NO: 20730 - DNA, 15 bp, Homo sapiens
ctagaaagagaactt

SEQ ID NO: 20731 - DNA, 15 bp, Homo sapiens
actagaaagagaact

SEQ ID NO: 20732 - DNA, 15 bp, Homo sapiens
cactagaaagagaac

SEQ ID NO: 20733 - DNA, 15 bp, Homo sapiens
tcactagaaagagaa

SEQ ID NO: 20734 - DNA, 15 bp, Homo sapiens
atcactagaaagaga

SEQ ID NO: 20735 - DNA, 15 bp, Homo sapiens
gatcactagaaagag

SEQ ID NO: 20736 - DNA, 15 bp, Homo sapiens
agatcactagaaaga

SEQ ID NO: 20737 - DNA, 15 bp, Homo sapiens
aagatcactagaaag

SEQ ID NO: 20738 - DNA, 15 bp, Homo sapiens
caagatcactagaaa

SEQ ID NO: 20739 - DNA, 15 bp, Homo sapiens
acaagatcactagaa

SEQ ID NO: 20740 - DNA, 15 bp, Homo sapiens
gacaagatcactaga

SEQ ID NO: 20741 - DNA, 15 bp, Homo sapiens
agacaagatcactag

SEQ ID NO: 20742 - DNA, 15 bp, Homo sapiens
gagacaagatcacta

SEQ ID NO: 20743 - DNA, 15 bp, Homo sapiens
ggagacaagatcact

SEQ ID NO: 20744 - DNA, 15 bp, Homo sapiens
gggagacaagatcac

SEQ ID NO: 20745 - DNA, 15 bp, Homo sapiens
tgggagacaagatca

SEQ ID NO: 20746 - DNA, 15 bp, Homo sapiens
ctgggagacaagatc

SEQ ID NO: 20747 - DNA, 15 bp, Homo sapiens
actgggagacaagat

SEQ ID NO: 20748 - DNA, 15 bp, Homo sapiens
cactgggagacaaga

SEQ ID NO: 20749 - DNA, 15 bp, Homo sapiens
acactgggagacaag

SEQ ID NO: 20750 - DNA, 15 bp, Homo sapiens
cacactgggagacaa

SEQ ID NO: 20751 - DNA, 15 bp, Homo sapiens
ccacactgggagaca

SEQ ID NO: 20752 - DNA, 15 bp, Homo sapiens
accacactgggagac

SEQ ID NO: 20753 - DNA, 15 bp, Homo sapiens
caccacactgggaga

SEQ ID NO: 20754 - DNA, 15 bp, Homo sapiens
ccaccacactgggag

SEQ ID NO: 20755 - DNA, 15 bp, Homo sapiens
cccaccacactggga

SEQ ID NO: 20756 - DNA, 15 bp, Homo sapiens
acccaccacactggg

SEQ ID NO: 20757 - DNA, 15 bp, Homo sapiens
tacccaccacactgg

SEQ ID NO: 20758 - DNA, 15 bp, Homo sapiens
atacccaccacactg

SEQ ID NO: 20759 - DNA, 15 bp, Homo sapiens
tatacccaccacact

SEQ ID NO: 20760 - DNA, 15 bp, Homo sapiens
atatacccaccacac

SEQ ID NO: 20761 - DNA, 15 bp, Homo sapiens
aatatacccaccaca

SEQ ID NO: 20762 - DNA, 15 bp, Homo sapiens
gaatatacccaccac

SEQ ID NO: 20763 - DNA, 15 bp, Homo sapiens
agaatatacccacca

SEQ ID NO: 20764 - DNA, 15 bp, Homo sapiens
cagaatatacccacc

SEQ ID NO: 20765 - DNA, 15 bp, Homo sapiens
ccagaatatacccac

SEQ ID NO: 20766 - DNA, 15 bp, Homo sapiens
gccagaatataccca

SEQ ID NO: 20767 - DNA, 15 bp, Homo sapiens
agccagaatataccc

SEQ ID NO: 20768 - DNA, 15 bp, Homo sapiens
tagccagaatatacc

SEQ ID NO: 20769 - DNA, 15 bp, Homo sapiens
ctagccagaatatac

SEQ ID NO: 20770 - DNA, 15 bp, Homo sapiens
tctagccagaatata

SEQ ID NO: 20771 - DNA, 15 bp, Homo sapiens
gtctagccagaatat

SEQ ID NO: 20772 - DNA, 15 bp, Homo sapiens
ggtctagccagaata

SEQ ID NO: 20773 - DNA, 15 bp, Homo sapiens
tggtctagccagaat

SEQ ID NO: 20774 - DNA, 15 bp, Homo sapiens
ctggtctagccagaa

SEQ ID NO: 20775 - DNA, 15 bp, Homo sapiens
cctggtctagccaga

SEQ ID NO: 20776 - DNA, 15 bp, Homo sapiens
acctggtctagccag

SEQ ID NO: 20777 - DNA, 15 bp, Homo sapiens
gacctggtctagcca

SEQ ID NO: 20778 - DNA, 15 bp, Homo sapiens
tgacctggtctagcc

SEQ ID NO: 20779 - DNA, 15 bp, Homo sapiens
atgacctggtctagc

SEQ ID NO: 20780 - DNA, 15 bp, Homo sapiens
aatgacctggtctag

SEQ ID NO: 20781 - DNA, 15 bp, Homo sapiens
caatgacctggtcta

SEQ ID NO: 20782 - DNA, 15 bp, Homo sapiens
acaatgacctggtct

SEQ ID NO: 20783 - DNA, 15 bp, Homo sapiens
aacaatgacctggtc

SEQ ID NO: 20784 - DNA, 15 bp, Homo sapiens
aaacaatgacctggt

SEQ ID NO: 20785 - DNA, 15 bp, Homo sapiens
taaacaatgacctgg

SEQ ID NO: 20786 - DNA, 15 bp, Homo sapiens
ataaacaatgacctg

SEQ ID NO: 20787 - DNA, 15 bp, Homo sapiens
cataaacaatgacct

SEQ ID NO: 20788 - DNA, 15 bp, Homo sapiens
ccataaacaatgacc

SEQ ID NO: 20789 - DNA, 15 bp, Homo sapiens
accataaacaatgac

SEQ ID NO: 20790 - DNA, 15 bp, Homo sapiens
caccataaacaatga

SEQ ID NO: 20791 - DNA, 15 bp, Homo sapiens
ccaccataaacaatg

SEQ ID NO: 20792 - DNA, 15 bp, Homo sapiens
gccaccataaacaat

SEQ ID NO: 20793 - DNA, 15 bp, Homo sapiens
tgccaccataaacaa

SEQ ID NO: 20794 - DNA, 15 bp, Homo sapiens
ctgccaccataaaca

SEQ ID NO: 20795 - DNA, 15 bp, Homo sapiens
gctgccaccataaac

SEQ ID NO: 20796 - DNA, 15 bp, Homo sapiens
ggctgccaccataaa

SEQ ID NO: 20797 - DNA, 15 bp, Homo sapiens
gggctgccaccataa

SEQ ID NO: 20798 - DNA, 15 bp, Homo sapiens
ggggctgccaccata

SEQ ID NO: 20799 - DNA, 15 bp, Homo sapiens
aggggctgccaccat

SEQ ID NO: 20800 - DNA, 15 bp, Homo sapiens
gaggggctgccacca

SEQ ID NO: 20801 - DNA, 15 bp, Homo sapiens
agaggggctgccacc

SEQ ID NO: 20802 - DNA, 15 bp, Homo sapiens
cagaggggctgccac

SEQ ID NO: 20803 - DNA, 15 bp, Homo sapiens
acagaggggctgcca

SEQ ID NO: 20804 - DNA, 15 bp, Homo sapiens
gacagaggggctgcc

SEQ ID NO: 20805 - DNA, 15 bp, Homo sapiens
tgacagaggggctgc

SEQ ID NO: 20806 - DNA, 15 bp, Homo sapiens
atgacagaggggctg

SEQ ID NO: 20807 - DNA, 15 bp, Homo sapiens
gatgacagaggggct

SEQ ID NO: 20808 - DNA, 15 bp, Homo sapiens
agatgacagaggggc

SEQ ID NO: 20809 - DNA, 15 bp, Homo sapiens
cagatgacagagggg

SEQ ID NO: 20810 - DNA, 15 bp, Homo sapiens
tcagatgacagaggg

SEQ ID NO: 20811 - DNA, 15 bp, Homo sapiens
ttcagatgacagagg

SEQ ID NO: 20812 - DNA, 15 bp, Homo sapiens
attcagatgacagag

SEQ ID NO: 20813 - DNA, 15 bp, Homo sapiens
aattcagatgacaga

SEQ ID NO: 20814 - DNA, 15 bp, Homo sapiens
aaattcagatgacag

SEQ ID NO: 20815 - DNA, 15 bp, Homo sapiens
taaattcagatgaca

SEQ ID NO: 20816 - DNA, 15 bp, Homo sapiens
ttaaattcagatgac

SEQ ID NO: 20817 - DNA, 15 bp, Homo sapiens
cttaaattcagatga

SEQ ID NO: 20818 - DNA, 15 bp, Homo sapiens
gcttaaattcagatg

SEQ ID NO: 20819 - DNA, 15 bp, Homo sapiens
cgcttaaattcagat

SEQ ID NO: 20820 - DNA, 15 bp, Homo sapiens
acgcttaaattcaga

SEQ ID NO: 20821 - DNA, 15 bp, Homo sapiens
gacgcttaaattcag

SEQ ID NO: 20822 - DNA, 15 bp, Homo sapiens
ggacgcttaaattca

SEQ ID NO: 20823 - DNA, 15 bp, Homo sapiens
gggacgcttaaattc

SEQ ID NO: 20824 - DNA, 15 bp, Homo sapiens
tgggacgcttaaatt

SEQ ID NO: 20825 - DNA, 15 bp, Homo sapiens
atgggacgcttaaat

SEQ ID NO: 20826 - DNA, 15 bp, Homo sapiens
aatgggacgcttaaa

SEQ ID NO: 20827 - DNA, 15 bp, Homo sapiens
aaatgggacgcttaa

SEQ ID NO: 20828 - DNA, 15 bp, Homo sapiens
aaaatgggacgctta

SEQ ID NO: 20829 - DNA, 15 bp, Homo sapiens
aaaaatgggacgctt

SEQ ID NO: 20830 - DNA, 15 bp, Homo sapiens
aaaaaatgggacgct

SEQ ID NO: 20831 - DNA, 15 bp, Homo sapiens
gaaaaaatgggacgc

SEQ ID NO: 20832 - DNA, 15 bp, Homo sapiens
cgaaaaaatgggacg

SEQ ID NO: 20833 - DNA, 15 bp, Homo sapiens
ccgaaaaaatgggac

SEQ ID NO: 20834 - DNA, 15 bp, Homo sapiens
accgaaaaaatggga

SEQ ID NO: 20835 - DNA, 15 bp, Homo sapiens
taccgaaaaaatggg

SEQ ID NO: 20836 - DNA, 15 bp, Homo sapiens
gtaccgaaaaaatgg

SEQ ID NO: 20837 - DNA, 15 bp, Homo sapiens
agtaccgaaaaaatg

SEQ ID NO: 20838 - DNA, 15 bp, Homo sapiens
tagtaccgaaaaaat

SEQ ID NO: 20839 - DNA, 15 bp, Homo sapiens
ctagtaccgaaaaaa

SEQ ID NO: 20840 - DNA, 15 bp, Homo sapiens
gctagtaccgaaaaa

SEQ ID NO: 20841 - DNA, 15 bp, Homo sapiens
tgctagtaccgaaaa

SEQ ID NO: 20842 - DNA, 15 bp, Homo sapiens
atgctagtaccgaaa

SEQ ID NO: 20843 - DNA, 15 bp, Homo sapiens
catgctagtaccgaa

SEQ ID NO: 20844 - DNA, 15 bp, Homo sapiens
ccatgctagtaccga

SEQ ID NO: 20845 - DNA, 15 bp, Homo sapiens
gccatgctagtaccg

SEQ ID NO: 20846 - DNA, 15 bp, Homo sapiens
agccatgctagtacc

SEQ ID NO: 20847 - DNA, 15 bp, Homo sapiens
gagccatgctagtac

SEQ ID NO: 20848 - DNA, 15 bp, Homo sapiens
tgagccatgctagta

SEQ ID NO: 20849 - DNA, 15 bp, Homo sapiens
gtgagccatgctagt

SEQ ID NO: 20850 - DNA, 15 bp, Homo sapiens
agtgagccatgctag

SEQ ID NO: 20851 - DNA, 15 bp, Homo sapiens
cagtgagccatgcta

SEQ ID NO: 20852 - DNA, 15 bp, Homo sapiens
gcagtgagccatgct

SEQ ID NO: 20853 - DNA, 15 bp, Homo sapiens
tgcagtgagccatgc

SEQ ID NO: 20854 - DNA, 15 bp, Homo sapiens
ttgcagtgagccatg

SEQ ID NO: 20855 - DNA, 15 bp, Homo sapiens
gttgcagtgagccat

SEQ ID NO: 20856 - DNA, 15 bp, Homo sapiens
ggttgcagtgagcca

SEQ ID NO: 20857 - DNA, 15 bp, Homo sapiens
ggaggttgcagtgag

SEQ ID NO: 20858 - DNA, 15 bp, Homo sapiens
cggaggttgcagtga

SEQ ID NO: 20859 - DNA, 15 bp, Homo sapiens
gcggaggttgcagtg

SEQ ID NO: 20860 - DNA, 15 bp, Homo sapiens
ggcggaggttgcagt

SEQ ID NO: 20861 - DNA, 15 bp, Homo sapiens
aggcggaggttgcag

SEQ ID NO: 20862 - DNA, 15 bp, Homo sapiens
gaggcggaggttgca

SEQ ID NO: 20863 - DNA, 15 bp, Homo sapiens
ggaggcggaggttgc

SEQ ID NO: 20864 - DNA, 15 bp, Homo sapiens
aggaggcggaggttg

SEQ ID NO: 20865 - DNA, 15 bp, Homo sapiens
caggaggcggaggtt

SEQ ID NO: 20866 - DNA, 15 bp, Homo sapiens
ccaggaggcggaggt

SEQ ID NO: 20867 - DNA, 15 bp, Homo sapiens
cccaggaggcggagg

SEQ ID NO: 20868 - DNA, 15 bp, Homo sapiens
gcccaggaggcggag

SEQ ID NO: 20869 - DNA, 15 bp, Homo sapiens
agcccaggaggcgga

SEQ ID NO: 20870 - DNA, 15 bp, Homo sapiens
gagcccaggaggcgg

SEQ ID NO: 20871 - DNA, 15 bp, Homo sapiens
ggagcccaggaggcg

SEQ ID NO: 20872 - DNA, 15 bp, Homo sapiens
tggagcccaggaggc

SEQ ID NO: 20873 - DNA, 15 bp, Homo sapiens
ctggagcccaggagg

SEQ ID NO: 20874 - DNA, 15 bp, Homo sapiens
gctggagcccaggag

SEQ ID NO: 20875 - DNA, 15 bp, Homo sapiens
tgctggagcccagga

SEQ ID NO: 20876 - DNA, 15 bp, Homo sapiens
ttgctggagcccagg

SEQ ID NO: 20877 - DNA, 15 bp, Homo sapiens
attgctggagcccag

SEQ ID NO: 20878 - DNA, 15 bp, Homo sapiens
gattgctggagccca

SEQ ID NO: 20879 - DNA, 15 bp, Homo sapiens
ggattgctggagccc

SEQ ID NO: 20880 - DNA, 15 bp, Homo sapiens
aggattgctggagcc

SEQ ID NO: 20881 - DNA, 15 bp, Homo sapiens
gaggattgctggagc

SEQ ID NO: 20882 - DNA, 15 bp, Homo sapiens
ggaggattgctggag

SEQ ID NO: 20883 - DNA, 15 bp, Homo sapiens
gggaggattgctgga

SEQ ID NO: 20884 - DNA, 15 bp, Homo sapiens
tgggaggattgctgg

SEQ ID NO: 20885 - DNA, 15 bp, Homo sapiens
gtgggaggattgctg

SEQ ID NO: 20886 - DNA, 15 bp, Homo sapiens
ggtgggaggattgct

SEQ ID NO: 20887 - DNA, 15 bp, Homo sapiens
gggtgggaggattgc

SEQ ID NO: 20888 - DNA, 15 bp, Homo sapiens
agggtgggaggattg

SEQ ID NO: 20889 - DNA, 15 bp, Homo sapiens
gagggtgggaggatt

SEQ ID NO: 20890 - DNA, 15 bp, Homo sapiens
cgagggtgggaggat

SEQ ID NO: 20891 - DNA, 15 bp, Homo sapiens
ccgagggtgggagga

SEQ ID NO: 20892 - DNA, 15 bp, Homo sapiens
cccgagggtgggagg

SEQ ID NO: 20893 - DNA, 15 bp, Homo sapiens
acccgagggtgggag

SEQ ID NO: 20894 - DNA, 15 bp, Homo sapiens
tacccgagggtggga

SEQ ID NO: 20895 - DNA, 15 bp, Homo sapiens
ctacccgagggtggg

SEQ ID NO: 20896 - DNA, 15 bp, Homo sapiens
gctacccgagggtgg

SEQ ID NO: 20897 - DNA, 15 bp, Homo sapiens
agctacccgagggtg

SEQ ID NO: 20898 - DNA, 15 bp, Homo sapiens
cagctacccgagggt

SEQ ID NO: 20899 - DNA, 15 bp, Homo sapiens
ccagctacccgaggg

SEQ ID NO: 20900 - DNA, 15 bp, Homo sapiens
cccagctacccgagg

SEQ ID NO: 20901 - DNA, 15 bp, Homo sapiens
ccccagctacccgag

SEQ ID NO: 20902 - DNA, 15 bp, Homo sapiens
gccccagctacccga

SEQ ID NO: 20903 - DNA, 15 bp, Homo sapiens
agccccagctacccg

SEQ ID NO: 20904 - DNA, 15 bp, Homo sapiens
tagccccagctaccc

SEQ ID NO: 20905 - DNA, 15 bp, Homo sapiens
atagccccagctacc

SEQ ID NO: 20906 - DNA, 15 bp, Homo sapiens
tatagccccagctac

SEQ ID NO: 20907 - DNA, 15 bp, Homo sapiens
ctatagccccagcta

SEQ ID NO: 20908 - DNA, 15 bp, Homo sapiens
cctatagccccagct

SEQ ID NO: 20909 - DNA, 15 bp, Homo sapiens
gcctatagccccagc

SEQ ID NO: 20910 - DNA, 15 bp, Homo sapiens
tgcctatagccccag

SEQ ID NO: 20911 - DNA, 15 bp, Homo sapiens
atgcctatagcccca

SEQ ID NO: 20912 - DNA, 15 bp, Homo sapiens
catgcctatagcccc

SEQ ID NO: 20913 - DNA, 15 bp, Homo sapiens
acatgcctatagccc

SEQ ID NO: 20914 - DNA, 15 bp, Homo sapiens
cacatgcctatagcc

SEQ ID NO: 20915 - DNA, 15 bp, Homo sapiens
gcacatgcctatagc

SEQ ID NO: 20916 - DNA, 15 bp, Homo sapiens
ggcacatgcctatag

SEQ ID NO: 20917 - DNA, 15 bp, Homo sapiens
aggcgtggtggcaca

SEQ ID NO: 20918 - DNA, 15 bp, Homo sapiens
caggcgtggtggcac

SEQ ID NO: 20919 - DNA, 15 bp, Homo sapiens
ccaggcgtggtggca

SEQ ID NO: 20920 - DNA, 15 bp, Homo sapiens
gccaggcgtggtggc

SEQ ID NO: 20921 - DNA, 15 bp, Homo sapiens
agccaggcgtggtgg

SEQ ID NO: 20922 - DNA, 15 bp, Homo sapiens
tagccaggcgtggtg

SEQ ID NO: 20923 - DNA, 15 bp, Homo sapiens
ttagccaggcgtggt

SEQ ID NO: 20924 - DNA, 15 bp, Homo sapiens
attagccaggcgtgg

SEQ ID NO: 20925 - DNA, 15 bp, Homo sapiens
aattagccaggcgtg

SEQ ID NO: 20926 - DNA, 15 bp, Homo sapiens
aaattagccaggcgt

SEQ ID NO: 20927 - DNA, 15 bp, Homo sapiens
aaaattagccaggcg

SEQ ID NO: 20928 - DNA, 15 bp, Homo sapiens
caaaaaaaaatacaa

SEQ ID NO: 20929 - DNA, 15 bp, Homo sapiens
acaaaaaaaaataca

SEQ ID NO: 20930 - DNA, 15 bp, Homo sapiens
tacaaaaaaaaatac

SEQ ID NO: 20931 - DNA, 15 bp, Homo sapiens
ctacaaaaaaaaata

SEQ ID NO: 20932 - DNA, 15 bp, Homo sapiens
tctacaaaaaaaaat

SEQ ID NO: 20933 - DNA, 15 bp, Homo sapiens
atctacaaaaaaaaa

SEQ ID NO: 20934 - DNA, 15 bp, Homo sapiens
tatctacaaaaaaaa

SEQ ID NO: 20935 - DNA, 15 bp, Homo sapiens
cttatctacaaaaaa

SEQ ID NO: 20936 - DNA, 15 bp, Homo sapiens
tcttatctacaaaaa

SEQ ID NO: 20937 - DNA, 15 bp, Homo sapiens
ctcttatctacaaaa

SEQ ID NO: 20938 - DNA, 15 bp, Homo sapiens
cctcttatctacaaa

SEQ ID NO: 20939 - DNA, 15 bp, Homo sapiens
acctcttatctacaa

SEQ ID NO: 20940 - DNA, 15 bp, Homo sapiens
aacctcttatctaca

SEQ ID NO: 20941 - DNA, 15 bp, Homo sapiens
aaacctcttatctac

SEQ ID NO: 20942 - DNA, 15 bp, Homo sapiens
gaaacctcttatcta

SEQ ID NO: 20943 - DNA, 15 bp, Homo sapiens
tgaaacctcttatct

SEQ ID NO: 20944 - DNA, 15 bp, Homo sapiens
gtgaaacctcttatc

SEQ ID NO: 20945 - DNA, 15 bp, Homo sapiens
ggtgaaacctcttat

SEQ ID NO: 20946 - DNA, 15 bp, Homo sapiens
tggtgaaacctctta

SEQ ID NO: 20947 - DNA, 15 bp, Homo sapiens
atggtgaaacctctt

SEQ ID NO: 20948 - DNA, 15 bp, Homo sapiens
catggtgaaacctct

SEQ ID NO: 20949 - DNA, 15 bp, Homo sapiens
acatggtgaaacctc

SEQ ID NO: 20950 - DNA, 15 bp, Homo sapiens
gcaacatggtgaaac

SEQ ID NO: 20951 - DNA, 15 bp, Homo sapiens
ggcaacatggtgaaa

SEQ ID NO: 20952 - DNA, 15 bp, Homo sapiens
gggcaacatggtgaa

SEQ ID NO: 20953 - DNA, 15 bp, Homo sapiens
tgggcaacatggtga

SEQ ID NO: 20954 - DNA, 15 bp, Homo sapiens
ctgggcaacatggtg

SEQ ID NO: 20955 - DNA, 15 bp, Homo sapiens
cctgggcaacatggt

SEQ ID NO: 20956 - DNA, 15 bp, Homo sapiens
cagcctgggcaacat

SEQ ID NO: 20957 - DNA, 15 bp, Homo sapiens
agaccagcctgggca

SEQ ID NO: 20958 - DNA, 15 bp, Homo sapiens
ggagtttgagaccag

SEQ ID NO: 20959 - DNA, 15 bp, Homo sapiens
aggagtttgagacca

SEQ ID NO: 20960 - DNA, 15 bp, Homo sapiens
caggagtttgagacc

SEQ ID NO: 20961 - DNA, 15 bp, Homo sapiens
cccaggagtttgaga

SEQ ID NO: 20962 - DNA, 15 bp, Homo sapiens
gcccaggagtttgag

SEQ ID NO: 20963 - DNA, 15 bp, Homo sapiens
agcccaggagtttga

SEQ ID NO: 20964 - DNA, 15 bp, Homo sapiens
gagcccaggagtttg

SEQ ID NO: 20965 - DNA, 15 bp, Homo sapiens
tgagcccaggagttt

SEQ ID NO: 20966 - DNA, 15 bp, Homo sapiens
ttgagcccaggagtt

SEQ ID NO: 20967 - DNA, 15 bp, Homo sapiens
cttgagcccaggagt

SEQ ID NO: 20968 - DNA, 15 bp, Homo sapiens
gcttgagcccaggag

SEQ ID NO: 20969 - DNA, 15 bp, Homo sapiens
tgcttgagcccagga

SEQ ID NO: 20970 - DNA, 15 bp, Homo sapiens
ttgcttgagcccagg

SEQ ID NO: 20971 - DNA, 15 bp, Homo sapiens
attgcttgagcccag

SEQ ID NO: 20972 - DNA, 15 bp, Homo sapiens
gattgcttgagccca

SEQ ID NO: 20973 - DNA, 15 bp, Homo sapiens
ggattgcttgagccc

SEQ ID NO: 20974 - DNA, 15 bp, Homo sapiens
tggattgcttgagcc

SEQ ID NO: 20975 - DNA, 15 bp, Homo sapiens
atggattgcttgagc

SEQ ID NO: 20976 - DNA, 15 bp, Homo sapiens
gatggattgcttgag

SEQ ID NO: 20977 - DNA, 15 bp, Homo sapiens
ggatggattgcttga

SEQ ID NO: 20978 - DNA, 15 bp, Homo sapiens
tggatggattgcttg

SEQ ID NO: 20979 - DNA, 15 bp, Homo sapiens
gtggatggattgctt

SEQ ID NO: 20980 - DNA, 15 bp, Homo sapiens
ggtggatggattgct

SEQ ID NO: 20981 - DNA, 15 bp, Homo sapiens
aggtggatggattgc

SEQ ID NO: 20982 - DNA, 15 bp, Homo sapiens
gaggtggatggattg

SEQ ID NO: 20983 - DNA, 15 bp, Homo sapiens
tgaggtggatggatt

SEQ ID NO: 20984 - DNA, 15 bp, Homo sapiens
ctgaggtggatggat

SEQ ID NO: 20985 - DNA, 15 bp, Homo sapiens
gctgaggtggatgga

SEQ ID NO: 20986 - DNA, 15 bp, Homo sapiens
ggctgaggtggatgg

SEQ ID NO: 20987 - DNA, 15 bp, Homo sapiens
aggctgaggtggatg

SEQ ID NO: 20988 - DNA, 15 bp, Homo sapiens
gaggctgaggtggat

SEQ ID NO: 20989 - DNA, 15 bp, Homo sapiens
ggaggctgaggtgga

SEQ ID NO: 20990 - DNA, 15 bp, Homo sapiens
gggaggctgaggtgg

SEQ ID NO: 20991 - DNA, 15 bp, Homo sapiens
cgggaggctgaggtg

SEQ ID NO: 20992 - DNA, 15 bp, Homo sapiens
tcgggaggctgaggt

SEQ ID NO: 20993 - DNA, 15 bp, Homo sapiens
ttcgggaggctgagg

SEQ ID NO: 20994 - DNA, 15 bp, Homo sapiens
cttcgggaggctgag

SEQ ID NO: 20995 - DNA, 15 bp, Homo sapiens
acttcgggaggctga

SEQ ID NO: 20996 - DNA, 15 bp, Homo sapiens
cacttcgggaggctg

SEQ ID NO: 20997 - DNA, 15 bp, Homo sapiens
acacttcgggaggct

SEQ ID NO: 20998 - DNA, 15 bp, Homo sapiens
aacacttcgggaggc

SEQ ID NO: 20999 - DNA, 15 bp, Homo sapiens
caacacttcgggagg

SEQ ID NO: 21000 - DNA, 15 bp, Homo sapiens
ccaacacttcgggag

SEQ ID NO: 21001 - DNA, 15 bp, Homo sapiens
cccaacacttcggga

SEQ ID NO: 21002 - DNA, 15 bp, Homo sapiens
tcccaacacttcggg

SEQ ID NO: 21003 - DNA, 15 bp, Homo sapiens
atcccaacacttcgg

SEQ ID NO: 21004 - DNA, 15 bp, Homo sapiens
aatcccaacacttcg

SEQ ID NO: 21005 - DNA, 15 bp, Homo sapiens
taatcccaacacttc

SEQ ID NO: 21006 - DNA, 15 bp, Homo sapiens
cacctgtaatcccaa

SEQ ID NO: 21007 - DNA, 15 bp, Homo sapiens
tggtggctcacacct

SEQ ID NO: 21008 - DNA, 15 bp, Homo sapiens
atggtggctcacacc

SEQ ID NO: 21009 - DNA, 15 bp, Homo sapiens
catggtggctcacac

SEQ ID NO: 21010 - DNA, 15 bp, Homo sapiens
gcatggtggctcaca

SEQ ID NO: 21011 - DNA, 15 bp, Homo sapiens
ggcatggtggctcac

SEQ ID NO: 21012 - DNA, 15 bp, Homo sapiens
gggcatggtggctca

SEQ ID NO: 21013 - DNA, 15 bp, Homo sapiens
cgggcatggtggctc

SEQ ID NO: 21014 - DNA, 15 bp, Homo sapiens
ccgggcatggtggct

SEQ ID NO: 21015 - DNA, 15 bp, Homo sapiens
gccgggcatggtggc

SEQ ID NO: 21016 - DNA, 15 bp, Homo sapiens
agccgggcatggtgg

SEQ ID NO: 21017 - DNA, 15 bp, Homo sapiens
cagccgggcatggtg

SEQ ID NO: 21018 - DNA, 15 bp, Homo sapiens
tcagccgggcatggt

SEQ ID NO: 21019 - DNA, 15 bp, Homo sapiens
gtcagccgggcatgg

SEQ ID NO: 21020 - DNA, 15 bp, Homo sapiens
agtcagccgggcatg

SEQ ID NO: 21021 - DNA, 15 bp, Homo sapiens
aagtcagccgggcat

SEQ ID NO: 21022 - DNA, 15 bp, Homo sapiens
aaagtcagccgggca

SEQ ID NO: 21023 - DNA, 15 bp, Homo sapiens
caaagtcagccgggc

SEQ ID NO: 21024 - DNA, 15 bp, Homo sapiens
gcaaagtcagccggg

SEQ ID NO: 21025 - DNA, 15 bp, Homo sapiens
ggcaaagtcagccgg

SEQ ID NO: 21026 - DNA, 15 bp, Homo sapiens
aggcaaagtcagccg

SEQ ID NO: 21027 - DNA, 15 bp, Homo sapiens
taggcaaagtcagcc

SEQ ID NO: 21028 - DNA, 15 bp, Homo sapiens
gtaggcaaagtcagc

SEQ ID NO: 21029 - DNA, 15 bp, Homo sapiens
agtaggcaaagtcag

SEQ ID NO: 21030 - DNA, 15 bp, Homo sapiens
gagtaggcaaagtca

SEQ ID NO: 21031 - DNA, 15 bp, Homo sapiens
agagtaggcaaagtc

SEQ ID NO: 21032 - DNA, 15 bp, Homo sapiens
aagagtaggcaaagt

SEQ ID NO: 21033 - DNA, 15 bp, Homo sapiens
caagagtaggcaaag

SEQ ID NO: 21034 - DNA, 15 bp, Homo sapiens
gcaagagtaggcaaa

SEQ ID NO: 21035 - DNA, 15 bp, Homo sapiens
ggcaagagtaggcaa

SEQ ID NO: 21036 - DNA, 15 bp, Homo sapiens
gggcaagagtaggca

SEQ ID NO: 21037 - DNA, 15 bp, Homo sapiens
agggcaagagtaggc

SEQ ID NO: 21038 - DNA, 15 bp, Homo sapiens
tagggcaagagtagg

SEQ ID NO: 21039 - DNA, 15 bp, Homo sapiens
ttagggcaagagtag

SEQ ID NO: 21040 - DNA, 15 bp, Homo sapiens
cttagggcaagagta

SEQ ID NO: 21041 - DNA, 15 bp, Homo sapiens
tcttagggcaagagt

SEQ ID NO: 21042 - DNA, 15 bp, Homo sapiens
ttcttagggcaagag

SEQ ID NO: 21043 - DNA, 15 bp, Homo sapiens
tttcttagggcaaga

SEQ ID NO: 21044 - DNA, 15 bp, Homo sapiens
ttttcttagggcaag

SEQ ID NO: 21045 - DNA, 15 bp, Homo sapiens
attttcttagggcaa

SEQ ID NO: 21046 - DNA, 15 bp, Homo sapiens
aattttcttagggca

SEQ ID NO: 21047 - DNA, 15 bp, Homo sapiens
caattttcttagggc

SEQ ID NO: 21048 - DNA, 15 bp, Homo sapiens
tcaattttcttaggg

SEQ ID NO: 21049 - DNA, 15 bp, Homo sapiens
ttcaattttcttagg

SEQ ID NO: 21050 - DNA, 15 bp, Homo sapiens
cttcaattttcttag

SEQ ID NO: 21051 - DNA, 15 bp, Homo sapiens
gcttcaattttctta

SEQ ID NO: 21052 - DNA, 15 bp, Homo sapiens
tgcttcaattttctt

SEQ ID NO: 21053 - DNA, 15 bp, Homo sapiens
ttgcttcaattttct

SEQ ID NO: 21054 - DNA, 15 bp, Homo sapiens
tttgcttcaattttc

SEQ ID NO: 21055 - DNA, 15 bp, Homo sapiens
gtttgcttcaatttt

SEQ ID NO: 21056 - DNA, 15 bp, Homo sapiens
ggtttgcttcaattt

SEQ ID NO: 21057 - DNA, 15 bp, Homo sapiens
tggtttgcttcaatt

SEQ ID NO: 21058 - DNA, 15 bp, Homo sapiens
ttggtttgcttcaat

SEQ ID NO: 21059 - DNA, 15 bp, Homo sapiens
tttggtttgcttcaa

SEQ ID NO: 21060 - DNA, 15 bp, Homo sapiens
ctttggtttgcttca

SEQ ID NO: 21061 - DNA, 15 bp, Homo sapiens
tctttggtttgcttc

SEQ ID NO: 21062 - DNA, 15 bp, Homo sapiens
ctctttggtttgctt

SEQ ID NO: 21063 - DNA, 15 bp, Homo sapiens
cctctttggtttgct

SEQ ID NO: 21064 - DNA, 15 bp, Homo sapiens
tcctctttggtttgc

SEQ ID NO: 21065 - DNA, 15 bp, Homo sapiens
ttcctctttggtttg

SEQ ID NO: 21066 - DNA, 15 bp, Homo sapiens
attcctctttggttt

SEQ ID NO: 21067 - DNA, 15 bp, Homo sapiens
gattcctctttggtt

SEQ ID NO: 21068 - DNA, 15 bp, Homo sapiens
ggattcctctttggt

SEQ ID NO: 21069 - DNA, 15 bp, Homo sapiens
tggattcctctttgg

SEQ ID NO: 21070 - DNA, 15 bp, Homo sapiens
ctggattcctctttg

SEQ ID NO: 21071 - DNA, 15 bp, Homo sapiens
tctggattcctcttt

SEQ ID NO: 21072 - DNA, 15 bp, Homo sapiens
ttctggattcctctt

SEQ ID NO: 21073 - DNA, 15 bp, Homo sapiens
tttctggattcctct

SEQ ID NO: 21074 - DNA, 15 bp, Homo sapiens
gtttctggattcctc

SEQ ID NO: 21075 - DNA, 15 bp, Homo sapiens
agtttctggattcct

SEQ ID NO: 21076 - DNA, 15 bp, Homo sapiens
aagtttctggattcc

SEQ ID NO: 21077 - DNA, 15 bp, Homo sapiens
gaagtttctggattc

SEQ ID NO: 21078 - DNA, 15 bp, Homo sapiens
tgaagtttctggatt

SEQ ID NO: 21079 - DNA, 15 bp, Homo sapiens
ttgaagtttctggat

SEQ ID NO: 21080 - DNA, 15 bp, Homo sapiens
attgaagtttctgga

SEQ ID NO: 21081 - DNA, 15 bp, Homo sapiens
tattgaagtttctgg

SEQ ID NO: 21082 - DNA, 15 bp, Homo sapiens
gtattgaagtttctg

SEQ ID NO: 21083 - DNA, 15 bp, Homo sapiens
ggtattgaagtttct

SEQ ID NO: 21084 - DNA, 15 bp, Homo sapiens
tggtattgaagtttc

SEQ ID NO: 21085 - DNA, 15 bp, Homo sapiens
gtggtattgaagttt

SEQ ID NO: 21086 - DNA, 15 bp, Homo sapiens
tgtggtattgaagtt

SEQ ID NO: 21087 - DNA, 15 bp, Homo sapiens
atgtggtattgaagt

SEQ ID NO: 21088 - DNA, 15 bp, Homo sapiens
gatgtggtattgaag

SEQ ID NO: 21089 - DNA, 15 bp, Homo sapiens
agatgtggtattgaa

SEQ ID NO: 21090 - DNA, 15 bp, Homo sapiens
tagatgtggtattga

SEQ ID NO: 21091 - DNA, 15 bp, Homo sapiens
atagatgtggtattg

SEQ ID NO: 21092 - DNA, 15 bp, Homo sapiens
gatagatgtggtatt

SEQ ID NO: 21093 - DNA, 15 bp, Homo sapiens
ggatagatgtggtat

SEQ ID NO: 21094 - DNA, 15 bp, Homo sapiens
aggatagatgtggta

SEQ ID NO: 21095 - DNA, 15 bp, Homo sapiens
gaggatagatgtggt

SEQ ID NO: 21096 - DNA, 15 bp, Homo sapiens
tgaggatagatgtgg

SEQ ID NO: 21097 - DNA, 15 bp, Homo sapiens
ttgaggatagatgtg

SEQ ID NO: 21098 - DNA, 15 bp, Homo sapiens
gttgaggatagatgt

SEQ ID NO: 21099 - DNA, 15 bp, Homo sapiens
ggttgaggatagatg

SEQ ID NO: 21100 - DNA, 15 bp, Homo sapiens
tggttgaggatagat

SEQ ID NO: 21101 - DNA, 15 bp, Homo sapiens
ctggttgaggataga

SEQ ID NO: 21102 - DNA, 15 bp, Homo sapiens
tctggttgaggatag

SEQ ID NO: 21103 - DNA, 15 bp, Homo sapiens
ttctggttgaggata

SEQ ID NO: 21104 - DNA, 15 bp, Homo sapiens
gttctggttgaggat

SEQ ID NO: 21105 - DNA, 15 bp, Homo sapiens
ggttctggttgagga

SEQ ID NO: 21106 - DNA, 15 bp, Homo sapiens
gggttctggttgagg

SEQ ID NO: 21107 - DNA, 15 bp, Homo sapiens
tgggttctggttgag

SEQ ID NO: 21108 - DNA, 15 bp, Homo sapiens
gtgggttctggttga

SEQ ID NO: 21109 - DNA, 15 bp, Homo sapiens
ggtgggttctggttg

SEQ ID NO: 21110 - DNA, 15 bp, Homo sapiens
gggtgggttctggtt

SEQ ID NO: 21111 - DNA, 15 bp, Homo sapiens
tgggtgggttctggt

SEQ ID NO: 21112 - DNA, 15 bp, Homo sapiens
ttgggtgggttctgg

SEQ ID NO: 21113 - DNA, 15 bp, Homo sapiens
cttgggtgggttctg

SEQ ID NO: 21114 - DNA, 15 bp, Homo sapiens
ccttgggtgggttct

SEQ ID NO: 21115 - DNA, 15 bp, Homo sapiens
gccttgggtgggttc

SEQ ID NO: 21116 - DNA, 15 bp, Homo sapiens
ggccttgggtgggtt

SEQ ID NO: 21117 - DNA, 15 bp, Homo sapiens
tggccttgggtgggt

SEQ ID NO: 21118 - DNA, 15 bp, Homo sapiens
gtggccttgggtggg

SEQ ID NO: 21119 - DNA, 15 bp, Homo sapiens
ggtggccttgggtgg

SEQ ID NO: 21120 - DNA, 15 bp, Homo sapiens
gggtggccttgggtg

SEQ ID NO: 21121 - DNA, 15 bp, Homo sapiens
agggtggccttgggt

SEQ ID NO: 21122 - DNA, 15 bp, Homo sapiens
tagggtggccttggg

SEQ ID NO: 21123 - DNA, 15 bp, Homo sapiens
ttagggtggccttgg

SEQ ID NO: 21124 - DNA, 15 bp, Homo sapiens
gttagggtggccttg

SEQ ID NO: 21125 - DNA, 15 bp, Homo sapiens
ggttagggtggcctt

SEQ ID NO: 21126 - DNA, 15 bp, Homo sapiens
cggttagggtggcct

SEQ ID NO: 21127 - DNA, 15 bp, Homo sapiens
acggttagggtggcc

SEQ ID NO: 21128 - DNA, 15 bp, Homo sapiens
cacggttagggtggc

SEQ ID NO: 21129 - DNA, 15 bp, Homo sapiens
acacggttagggtgg

SEQ ID NO: 21130 - DNA, 15 bp, Homo sapiens
tacacggttagggtg

SEQ ID NO: 21131 - DNA, 15 bp, Homo sapiens
gtacacggttagggt

SEQ ID NO: 21132 - DNA, 15 bp, Homo sapiens
tgtacacggttaggg

SEQ ID NO: 21133 - DNA, 15 bp, Homo sapiens
atgtacacggttagg

SEQ ID NO: 21134 - DNA, 15 bp, Homo sapiens
aatgtacacggttag

SEQ ID NO: 21135 - DNA, 15 bp, Homo sapiens
caatgtacacggtta

SEQ ID NO: 21136 - DNA, 15 bp, Homo sapiens
acaatgtacacggtt

SEQ ID NO: 21137 - DNA, 15 bp, Homo sapiens
tacaatgtacacggt

SEQ ID NO: 21138 - DNA, 15 bp, Homo sapiens
gtacaatgtacacgg

SEQ ID NO: 21139 - DNA, 15 bp, Homo sapiens
ggtacaatgtacacg

SEQ ID NO: 21140 - DNA, 15 bp, Homo sapiens
gggtacaatgtacac

SEQ ID NO: 21141 - DNA, 15 bp, Homo sapiens
tgggtacaatgtaca

SEQ ID NO: 21142 - DNA, 15 bp, Homo sapiens
atgggtacaatgtac

SEQ ID NO: 21143 - DNA, 15 bp, Homo sapiens
gatgggtacaatgta

SEQ ID NO: 21144 - DNA, 15 bp, Homo sapiens
ggatgggtacaatgt

SEQ ID NO: 21145 - DNA, 15 bp, Homo sapiens
aggatgggtacaatg

SEQ ID NO: 21146 - DNA, 15 bp, Homo sapiens
gaggatgggtacaat

SEQ ID NO: 21147 - DNA, 15 bp, Homo sapiens
ggaggatgggtacaa

SEQ ID NO: 21148 - DNA, 15 bp, Homo sapiens
aggaggatgggtaca

SEQ ID NO: 21149 - DNA, 15 bp, Homo sapiens
aaggaggatgggtac

SEQ ID NO: 21150 - DNA, 15 bp, Homo sapiens
aaaggaggatgggta

SEQ ID NO: 21151 - DNA, 15 bp, Homo sapiens
taaaggaggatgggt

SEQ ID NO: 21152 - DNA, 15 bp, Homo sapiens
gtaaaggaggatggg

SEQ ID NO: 21153 - DNA, 15 bp, Homo sapiens
agtaaaggaggatgg

SEQ ID NO: 21154 - DNA, 15 bp, Homo sapiens
aagtaaaggaggatg

SEQ ID NO: 21155 - DNA, 15 bp, Homo sapiens
taagtaaaggaggat

SEQ ID NO: 21156 - DNA, 15 bp, Homo sapiens
gtaagtaaaggagga

SEQ ID NO: 21157 - DNA, 15 bp, Homo sapiens
agtaagtaaaggagg

SEQ ID NO: 21158 - DNA, 15 bp, Homo sapiens
gagtaagtaaaggag

SEQ ID NO: 21159 - DNA, 15 bp, Homo sapiens
tgagtaagtaaagga

SEQ ID NO: 21160 - DNA, 15 bp, Homo sapiens
ttgagtaagtaaagg

SEQ ID NO: 21161 - DNA, 15 bp, Homo sapiens
tttgagtaagtaaag

SEQ ID NO: 21162 - DNA, 15 bp, Homo sapiens
ctttgagtaagtaaa

SEQ ID NO: 21163 - DNA, 15 bp, Homo sapiens
actttgagtaagtaa

SEQ ID NO: 21164 - DNA, 15 bp, Homo sapiens
gactttgagtaagta

SEQ ID NO: 21165 - DNA, 15 bp, Homo sapiens
tgactttgagtaagt

SEQ ID NO: 21166 - DNA, 15 bp, Homo sapiens
gtgactttgagtaag

SEQ ID NO: 21167 - DNA, 15 bp, Homo sapiens
ggtgactttgagtaa

SEQ ID NO: 21168 - DNA, 15 bp, Homo sapiens
aggtgactttgagta

SEQ ID NO: 21169 - DNA, 15 bp, Homo sapiens
gaggtgactttgagt

SEQ ID NO: 21170 - DNA, 15 bp, Homo sapiens
ggaggtgactttgag

SEQ ID NO: 21171 - DNA, 15 bp, Homo sapiens
gggaggtgactttga

SEQ ID NO: 21172 - DNA, 15 bp, Homo sapiens
agggaggtgactttg

SEQ ID NO: 21173 - DNA, 15 bp, Homo sapiens
aagggaggtgacttt

SEQ ID NO: 21174 - DNA, 15 bp, Homo sapiens
gaagggaggtgactt

SEQ ID NO: 21175 - DNA, 15 bp, Homo sapiens
agaagggaggtgact

SEQ ID NO: 21176 - DNA, 15 bp, Homo sapiens
gagaagggaggtgac

SEQ ID NO: 21177 - DNA, 15 bp, Homo sapiens
agagaagggaggtga

SEQ ID NO: 21178 - DNA, 15 bp, Homo sapiens
gagagaagggaggtg

SEQ ID NO: 21179 - DNA, 15 bp, Homo sapiens
agagagaagggaggt

SEQ ID NO: 21180 - DNA, 15 bp, Homo sapiens
aagagagaagggagg

SEQ ID NO: 21181 - DNA, 15 bp, Homo sapiens
gaagagagaagggag

SEQ ID NO: 21182 - DNA, 15 bp, Homo sapiens
agaagagagaaggga

SEQ ID NO: 21183 - DNA, 15 bp, Homo sapiens
cagaagagagaaggg

SEQ ID NO: 21184 - DNA, 15 bp, Homo sapiens
gcagaagagagaagg

SEQ ID NO: 21185 - DNA, 15 bp, Homo sapiens
tgcagaagagagaag

SEQ ID NO: 21186 - DNA, 15 bp, Homo sapiens
atgcagaagagagaa

SEQ ID NO: 21187 - DNA, 15 bp, Homo sapiens
gatgcagaagagaga

SEQ ID NO: 21188 - DNA, 15 bp, Homo sapiens
ggatgcagaagagag

SEQ ID NO: 21189 - DNA, 15 bp, Homo sapiens
gggatgcagaagaga

SEQ ID NO: 21190 - DNA, 15 bp, Homo sapiens
agggatgcagaagag

SEQ ID NO: 21191 - DNA, 15 bp, Homo sapiens
tagggatgcagaaga

SEQ ID NO: 21192 - DNA, 15 bp, Homo sapiens
atagggatgcagaag

SEQ ID NO: 21193 - DNA, 15 bp, Homo sapiens
catagggatgcagaa

SEQ ID NO: 21194 - DNA, 15 bp, Homo sapiens
tcatagggatgcaga

SEQ ID NO: 21195 - DNA, 15 bp, Homo sapiens
atcatagggatgcag

SEQ ID NO: 21196 - DNA, 15 bp, Homo sapiens
aatcatagggatgca

SEQ ID NO: 21197 - DNA, 15 bp, Homo sapiens
aaatcatagggatgc

SEQ ID NO: 21198 - DNA, 15 bp, Homo sapiens
gaaatcatagggatg

SEQ ID NO: 21199 - DNA, 15 bp, Homo sapiens
ggaaatcatagggat

SEQ ID NO: 21200 - DNA, 15 bp, Homo sapiens
gggaaatcataggga

SEQ ID NO: 21201 - DNA, 15 bp, Homo sapiens
ggggaaatcataggg

SEQ ID NO: 21202 - DNA, 15 bp, Homo sapiens
aggggaaatcatagg

SEQ ID NO: 21203 - DNA, 15 bp, Homo sapiens
aaggggaaatcatag

SEQ ID NO: 21204 - DNA, 15 bp, Homo sapiens
aaaggggaaatcata

SEQ ID NO: 21205 - DNA, 15 bp, Homo sapiens
taaaggggaaatcat

SEQ ID NO: 21206 - DNA, 15 bp, Homo sapiens
ctaaaggggaaatca

SEQ ID NO: 21207 - DNA, 15 bp, Homo sapiens
actaaaggggaaatc

SEQ ID NO: 21208 - DNA, 15 bp, Homo sapiens
cactaaaggggaaat

SEQ ID NO: 21209 - DNA, 15 bp, Homo sapiens
ccactaaaggggaaa

SEQ ID NO: 21210 - DNA, 15 bp, Homo sapiens
tccactaaaggggaa

SEQ ID NO: 21211 - DNA, 15 bp, Homo sapiens
atccactaaagggga

SEQ ID NO: 21212 - DNA, 15 bp, Homo sapiens
gatccactaaagggg

SEQ ID NO: 21213 - DNA, 15 bp, Homo sapiens
ggatccactaaaggg

SEQ ID NO: 21214 - DNA, 15 bp, Homo sapiens
cggatccactaaagg

SEQ ID NO: 21215 - DNA, 15 bp, Homo sapiens
gcggatccactaaag

SEQ ID NO: 21216 - DNA, 15 bp, Homo sapiens
agcggatccactaaa

SEQ ID NO: 21217 - DNA, 15 bp, Homo sapiens
aagcggatccactaa

SEQ ID NO: 21218 - DNA, 15 bp, Homo sapiens
taagcggatccacta

SEQ ID NO: 21219 - DNA, 15 bp, Homo sapiens
gtaagcggatccact

SEQ ID NO: 21220 - DNA, 15 bp, Homo sapiens
tgtaagcggatccac

SEQ ID NO: 21221 - DNA, 15 bp, Homo sapiens
ttgtaagcggatcca

SEQ ID NO: 21222 - DNA, 15 bp, Homo sapiens
tttgtaagcggatcc

SEQ ID NO: 21223 - DNA, 15 bp, Homo sapiens
gtttgtaagcggatc

SEQ ID NO: 21224 - DNA, 15 bp, Homo sapiens
tgtttgtaagcggat

SEQ ID NO: 21225 - DNA, 15 bp, Homo sapiens
atgtttgtaagcgga

SEQ ID NO: 21226 - DNA, 15 bp, Homo sapiens
catgtttgtaagcgg

SEQ ID NO: 21227 - DNA, 15 bp, Homo sapiens
gcatgtttgtaagcg

SEQ ID NO: 21228 - DNA, 15 bp, Homo sapiens
agcatgtttgtaagc

SEQ ID NO: 21229 - DNA, 15 bp, Homo sapiens
tagcatgtttgtaag

SEQ ID NO: 21230 - DNA, 15 bp, Homo sapiens
atagcatgtttgtaa

SEQ ID NO: 21231 - DNA, 15 bp, Homo sapiens
aatagcatgtttgta

SEQ ID NO: 21232 - DNA, 15 bp, Homo sapiens
caatagcatgtttgt

SEQ ID NO: 21233 - DNA, 15 bp, Homo sapiens
acaatagcatgtttg

SEQ ID NO: 21234 - DNA, 15 bp, Homo sapiens
aacaatagcatgttt

SEQ ID NO: 21235 - DNA, 15 bp, Homo sapiens
aaacaatagcatgtt

SEQ ID NO: 21236 - DNA, 15 bp, Homo sapiens
aaaacaatagcatgt

SEQ ID NO: 21237 - DNA, 15 bp, Homo sapiens
aaaaacaatagcatg

SEQ ID NO: 21238 - DNA, 15 bp, Homo sapiens
gaaaaacaatagcat

SEQ ID NO: 21239 - DNA, 15 bp, Homo sapiens
agaaaaacaatagca

SEQ ID NO: 21240 - DNA, 15 bp, Homo sapiens
aagaaaaacaatagc

SEQ ID NO: 21241 - DNA, 15 bp, Homo sapiens
gaagaaaaacaatag

SEQ ID NO: 21242 - DNA, 15 bp, Homo sapiens
agaagaaaaacaata

SEQ ID NO: 21243 - DNA, 15 bp, Homo sapiens
tagaagaaaaacaat

SEQ ID NO: 21244 - DNA, 15 bp, Homo sapiens
ctagaagaaaaacaa

SEQ ID NO: 21245 - DNA, 15 bp, Homo sapiens
gctagaagaaaaaca

SEQ ID NO: 21246 - DNA, 15 bp, Homo sapiens
tgctagaagaaaaac

SEQ ID NO: 21247 - DNA, 15 bp, Homo sapiens
ttgctagaagaaaaa

SEQ ID NO: 21248 - DNA, 15 bp, Homo sapiens
tttgctagaagaaaa

SEQ ID NO: 21249 - DNA, 15 bp, Homo sapiens
ttttgctagaagaaa

SEQ ID NO: 21250 - DNA, 15 bp, Homo sapiens
gttttgctagaagaa

SEQ ID NO: 21251 - DNA, 15 bp, Homo sapiens
agttttgctagaaga

SEQ ID NO: 21252 - DNA, 15 bp, Homo sapiens
aagttttgctagaag

SEQ ID NO: 21253 - DNA, 15 bp, Homo sapiens
aaagttttgctagaa

SEQ ID NO: 21254 - DNA, 15 bp, Homo sapiens
taaagttttgctaga

SEQ ID NO: 21255 - DNA, 15 bp, Homo sapiens
gtaaagttttgctag

SEQ ID NO: 21256 - DNA, 15 bp, Homo sapiens
agtaaagttttgcta

SEQ ID NO: 21257 - DNA, 15 bp, Homo sapiens
aagtaaagttttgct

SEQ ID NO: 21258 - DNA, 15 bp, Homo sapiens
aaagtaaagttttgc

SEQ ID NO: 21259 - DNA, 15 bp, Homo sapiens
caaagtaaagttttg

SEQ ID NO: 21260 - DNA, 15 bp, Homo sapiens
tcaaagtaaagtttt

SEQ ID NO: 21261 - DNA, 15 bp, Homo sapiens
atcaaagtaaagttt

SEQ ID NO: 21262 - DNA, 15 bp, Homo sapiens
gatcaaagtaaagtt

SEQ ID NO: 21263 - DNA, 15 bp, Homo sapiens
ggatcaaagtaaagt

SEQ ID NO: 21264 - DNA, 15 bp, Homo sapiens
gggatcaaagtaaag

SEQ ID NO: 21265 - DNA, 15 bp, Homo sapiens
tgggatcaaagtaaa

SEQ ID NO: 21266 - DNA, 15 bp, Homo sapiens
gtgggatcaaagtaa

SEQ ID NO: 21267 - DNA, 15 bp, Homo sapiens
ggtgggatcaaagta

SEQ ID NO: 21268 - DNA, 15 bp, Homo sapiens
aggtgggatcaaagt

SEQ ID NO: 21269 - DNA, 15 bp, Homo sapiens
caggtgggatcaaag

SEQ ID NO: 21270 - DNA, 15 bp, Homo sapiens
acaggtgggatcaaa

SEQ ID NO: 21271 - DNA, 15 bp, Homo sapiens
gacaggtgggatcaa

SEQ ID NO: 21272 - DNA, 15 bp, Homo sapiens
agacaggtgggatca

SEQ ID NO: 21273 - DNA, 15 bp, Homo sapiens
gagacaggtgggatc

SEQ ID NO: 21274 - DNA, 15 bp, Homo sapiens
agagacaggtgggat

SEQ ID NO: 21275 - DNA, 15 bp, Homo sapiens
cagagacaggtggga

SEQ ID NO: 21276 - DNA, 15 bp, Homo sapiens
acagagacaggtggg

SEQ ID NO: 21277 - DNA, 15 bp, Homo sapiens
tacagagacaggtgg

SEQ ID NO: 21278 - DNA, 15 bp, Homo sapiens
ctacagagacaggtg

SEQ ID NO: 21279 - DNA, 15 bp, Homo sapiens
gctacagagacaggt

SEQ ID NO: 21280 - DNA, 15 bp, Homo sapiens
agctacagagacagg

SEQ ID NO: 21281 - DNA, 15 bp, Homo sapiens
tagctacagagacag

SEQ ID NO: 21282 - DNA, 15 bp, Homo sapiens
gtagctacagagaca

SEQ ID NO: 21283 - DNA, 15 bp, Homo sapiens
ggtagctacagagac

SEQ ID NO: 21284 - DNA, 15 bp, Homo sapiens
tggtagctacagaga

SEQ ID NO: 21285 - DNA, 15 bp, Homo sapiens
gtggtagctacagag

SEQ ID NO: 21286 - DNA, 15 bp, Homo sapiens
cgtggtagctacaga

SEQ ID NO: 21287 - DNA, 15 bp, Homo sapiens
gcgtggtagctacag

SEQ ID NO: 21288 - DNA, 15 bp, Homo sapiens
ggcgtggtagctaca

SEQ ID NO: 21289 - DNA, 15 bp, Homo sapiens
tggcgtggtagctac

SEQ ID NO: 21290 - DNA, 15 bp, Homo sapiens
atggcgtggtagcta

SEQ ID NO: 21291 - DNA, 15 bp, Homo sapiens
aatggcgtggtagct

SEQ ID NO: 21292 - DNA, 15 bp, Homo sapiens
gaatggcgtggtagc

SEQ ID NO: 21293 - DNA, 15 bp, Homo sapiens
ggaatggcgtggtag

SEQ ID NO: 21294 - DNA, 15 bp, Homo sapiens
aggaatggcgtggta

SEQ ID NO: 21295 - DNA, 15 bp, Homo sapiens
gaggaatggcgtggt

SEQ ID NO: 21296 - DNA, 15 bp, Homo sapiens
agaggaatggcgtgg

SEQ ID NO: 21297 - DNA, 15 bp, Homo sapiens
cagaggaatggcgtg

SEQ ID NO: 21298 - DNA, 15 bp, Homo sapiens
ccagaggaatggcgt

SEQ ID NO: 21299 - DNA, 15 bp, Homo sapiens
accagaggaatggcg

SEQ ID NO: 21300 - DNA, 15 bp, Homo sapiens
gaccagaggaatggc

SEQ ID NO: 21301 - DNA, 15 bp, Homo sapiens
ggaccagaggaatgg

SEQ ID NO: 21302 - DNA, 15 bp, Homo sapiens
gggaccagaggaatg

SEQ ID NO: 21303 - DNA, 15 bp, Homo sapiens
ggggaccagaggaat

SEQ ID NO: 21304 - DNA, 15 bp, Homo sapiens
aggggaccagaggaa

SEQ ID NO: 21305 - DNA, 15 bp, Homo sapiens
aaggggaccagagga

SEQ ID NO: 21306 - DNA, 15 bp, Homo sapiens
aaaggggaccagagg

SEQ ID NO: 21307 - DNA, 15 bp, Homo sapiens
taaaggggaccagag

SEQ ID NO: 21308 - DNA, 15 bp, Homo sapiens
ataaaggggaccaga

SEQ ID NO: 21309 - DNA, 15 bp, Homo sapiens
cataaaggggaccag

SEQ ID NO: 21310 - DNA, 15 bp, Homo sapiens
tcataaaggggacca

SEQ ID NO: 21311 - DNA, 15 bp, Homo sapiens
ttcataaaggggacc

SEQ ID NO: 21312 - DNA, 15 bp, Homo sapiens
tttcataaaggggac

SEQ ID NO: 21313 - DNA, 15 bp, Homo sapiens
ctttcataaagggga

SEQ ID NO: 21314 - DNA, 15 bp, Homo sapiens
tctttcataaagggg

SEQ ID NO: 21315 - DNA, 15 bp, Homo sapiens
ctctttcataaaggg

SEQ ID NO: 21316 - DNA, 15 bp, Homo sapiens
gctctttcataaagg

SEQ ID NO: 21317 - DNA, 15 bp, Homo sapiens
agctctttcataaag

SEQ ID NO: 21318 - DNA, 15 bp, Homo sapiens
gagctctttcataaa

SEQ ID NO: 21319 - DNA, 15 bp, Homo sapiens
ggagctctttcataa

SEQ ID NO: 21320 - DNA, 15 bp, Homo sapiens
aggagctctttcata

SEQ ID NO: 21321 - DNA, 15 bp, Homo sapiens
gaggagctctttcat

SEQ ID NO: 21322 - DNA, 15 bp, Homo sapiens
tgaggagctctttca

SEQ ID NO: 21323 - DNA, 15 bp, Homo sapiens
ttgaggagctctttc

SEQ ID NO: 21324 - DNA, 15 bp, Homo sapiens
tttgaggagctcttt

SEQ ID NO: 21325 - DNA, 15 bp, Homo sapiens
ctttgaggagctctt

SEQ ID NO: 21326 - DNA, 15 bp, Homo sapiens
tctttgaggagctct

SEQ ID NO: 21327 - DNA, 15 bp, Homo sapiens
atctttgaggagctc

SEQ ID NO: 21328 - DNA, 15 bp, Homo sapiens
aatctttgaggagct

SEQ ID NO: 21329 - DNA, 15 bp, Homo sapiens
caatctttgaggagc

SEQ ID NO: 21330 - DNA, 15 bp, Homo sapiens
acaatctttgaggag

SEQ ID NO: 21331 - DNA, 15 bp, Homo sapiens
tacaatctttgagga

SEQ ID NO: 21332 - DNA, 15 bp, Homo sapiens
atacaatctttgagg

SEQ ID NO: 21333 - DNA, 15 bp, Homo sapiens
catacaatctttgag

SEQ ID NO: 21334 - DNA, 15 bp, Homo sapiens
acatacaatctttga

SEQ ID NO: 21335 - DNA, 15 bp, Homo sapiens
tacatacaatctttg

SEQ ID NO: 21336 - DNA, 15 bp, Homo sapiens
gtacatacaatcttt

SEQ ID NO: 21337 - DNA, 15 bp, Homo sapiens
ggtacatacaatctt

SEQ ID NO: 21338 - DNA, 15 bp, Homo sapiens
tggtacatacaatct

SEQ ID NO: 21339 - DNA, 15 bp, Homo sapiens
ttggtacatacaatc

SEQ ID NO: 21340 - DNA, 15 bp, Homo sapiens
gttggtacatacaat

SEQ ID NO: 21341 - DNA, 15 bp, Homo sapiens
tgttggtacatacaa

SEQ ID NO: 21342 - DNA, 15 bp, Homo sapiens
atgttggtacataca

SEQ ID NO: 21343 - DNA, 15 bp, Homo sapiens
aatgttggtacatac

SEQ ID NO: 21344 - DNA, 15 bp, Homo sapiens
aaatgttggtacata

SEQ ID NO: 21345 - DNA, 15 bp, Homo sapiens
caaatgttggtacat

SEQ ID NO: 21346 - DNA, 15 bp, Homo sapiens
gcaaatgttggtaca

SEQ ID NO: 21347 - DNA, 15 bp, Homo sapiens
tgcaaatgttggtac

SEQ ID NO: 21348 - DNA, 15 bp, Homo sapiens
ctgcaaatgttggta

SEQ ID NO: 21349 - DNA, 15 bp, Homo sapiens
actgcaaatgttggt

SEQ ID NO: 21350 - DNA, 15 bp, Homo sapiens
aactgcaaatgttgg

SEQ ID NO: 21351 - DNA, 15 bp, Homo sapiens
gaactgcaaatgttg

SEQ ID NO: 21352 - DNA, 15 bp, Homo sapiens
cgaactgcaaatgtt

SEQ ID NO: 21353 - DNA, 15 bp, Homo sapiens
acgaactgcaaatgt

SEQ ID NO: 21354 - DNA, 15 bp, Homo sapiens
gacgaactgcaaatg

SEQ ID NO: 21355 - DNA, 15 bp, Homo sapiens
agacgaactgcaaat

SEQ ID NO: 21356 - DNA, 15 bp, Homo sapiens
gagacgaactgcaaa

SEQ ID NO: 21357 - DNA, 15 bp, Homo sapiens
ggagacgaactgcaa

SEQ ID NO: 21358 - DNA, 15 bp, Homo sapiens
aggagacgaactgca

SEQ ID NO: 21359 - DNA, 15 bp, Homo sapiens
aaggagacgaactgc

SEQ ID NO: 21360 - DNA, 15 bp, Homo sapiens
aaaggagacgaactg

SEQ ID NO: 21361 - DNA, 15 bp, Homo sapiens
gaaaggagacgaact

SEQ ID NO: 21362 - DNA, 15 bp, Homo sapiens
tgaaaggagacgaac

SEQ ID NO: 21363 - DNA, 15 bp, Homo sapiens
atgaaaggagacgaa

SEQ ID NO: 21364 - DNA, 15 bp, Homo sapiens
aatgaaaggagacga

SEQ ID NO: 21365 - DNA, 15 bp, Homo sapiens
gaatgaaaggagacg

SEQ ID NO: 21366 - DNA, 15 bp, Homo sapiens
ggaatgaaaggagac

SEQ ID NO: 21367 - DNA, 15 bp, Homo sapiens
gggaatgaaaggaga

SEQ ID NO: 21368 - DNA, 15 bp, Homo sapiens
agggaatgaaaggag

SEQ ID NO: 21369 - DNA, 15 bp, Homo sapiens
gagggaatgaaagga

SEQ ID NO: 21370 - DNA, 15 bp, Homo sapiens
agagggaatgaaagg

SEQ ID NO: 21371 - DNA, 15 bp, Homo sapiens
aagagggaatgaaag

SEQ ID NO: 21372 - DNA, 15 bp, Homo sapiens
taagagggaatgaaa

SEQ ID NO: 21373 - DNA, 15 bp, Homo sapiens
ttaagagggaatgaa

SEQ ID NO: 21374 - DNA, 15 bp, Homo sapiens
cttaagagggaatga

SEQ ID NO: 21375 - DNA, 15 bp, Homo sapiens
tcttaagagggaatg

SEQ ID NO: 21376 - DNA, 15 bp, Homo sapiens
gtcttaagagggaat

SEQ ID NO: 21377 - DNA, 15 bp, Homo sapiens
ggtcttaagagggaa

SEQ ID NO: 21378 - DNA, 15 bp, Homo sapiens
tggtcttaagaggga

SEQ ID NO: 21379 - DNA, 15 bp, Homo sapiens
gtggtcttaagaggg

SEQ ID NO: 21380 - DNA, 15 bp, Homo sapiens
agtggtcttaagagg

SEQ ID NO: 21381 - DNA, 15 bp, Homo sapiens
gagtggtcttaagag

SEQ ID NO: 21382 - DNA, 15 bp, Homo sapiens
tgagtggtcttaaga

SEQ ID NO: 21383 - DNA, 15 bp, Homo sapiens
ttgagtggtcttaag

SEQ ID NO: 21384 - DNA, 15 bp, Homo sapiens
tttgagtggtcttaa

SEQ ID NO: 21385 - DNA, 15 bp, Homo sapiens
atttgagtggtctta

SEQ ID NO: 21386 - DNA, 15 bp, Homo sapiens
gatttgagtggtctt

SEQ ID NO: 21387 - DNA, 15 bp, Homo sapiens
tgatttgagtggtct

SEQ ID NO: 21388 - DNA, 15 bp, Homo sapiens
ctgatttgagtggtc

SEQ ID NO: 21389 - DNA, 15 bp, Homo sapiens
cctgatttgagtggt

SEQ ID NO: 21390 - DNA, 15 bp, Homo sapiens
gcctgatttgagtgg

SEQ ID NO: 21391 - DNA, 15 bp, Homo sapiens
tgcctgatttgagtg

SEQ ID NO: 21392 - DNA, 15 bp, Homo sapiens
ctgcctgatttgagt

SEQ ID NO: 21393 - DNA, 15 bp, Homo sapiens
tctgcctgatttgag

SEQ ID NO: 21394 - DNA, 15 bp, Homo sapiens
gtctgcctgatttga

SEQ ID NO: 21395 - DNA, 15 bp, Homo sapiens
ggtctgcctgatttg

SEQ ID NO: 21396 - DNA, 15 bp, Homo sapiens
gggtctgcctgattt

SEQ ID NO: 21397 - DNA, 15 bp, Homo sapiens
ggggtctgcctgatt

SEQ ID NO: 21398 - DNA, 15 bp, Homo sapiens
gggggtctgcctgat

SEQ ID NO: 21399 - DNA, 15 bp, Homo sapiens
agggggtctgcctga

SEQ ID NO: 21400 - DNA, 15 bp, Homo sapiens
tagggggtctgcctg

SEQ ID NO: 21401 - DNA, 15 bp, Homo sapiens
gtagggggtctgcct

SEQ ID NO: 21402 - DNA, 15 bp, Homo sapiens
ggtagggggtctgcc

SEQ ID NO: 21403 - DNA, 15 bp, Homo sapiens
tggtagggggtctgc

SEQ ID NO: 21404 - DNA, 15 bp, Homo sapiens
ctggtagggggtctg

SEQ ID NO: 21405 - DNA, 15 bp, Homo sapiens
actggtagggggtct

SEQ ID NO: 21406 - DNA, 15 bp, Homo sapiens
gactggtagggggtc

SEQ ID NO: 21407 - DNA, 15 bp, Homo sapiens
ggactggtagggggt

SEQ ID NO: 21408 - DNA, 15 bp, Homo sapiens
tggactggtaggggg

SEQ ID NO: 21409 - DNA, 15 bp, Homo sapiens
ctggactggtagggg

SEQ ID NO: 21410 - DNA, 15 bp, Homo sapiens
actggactggtaggg

SEQ ID NO: 21411 - DNA, 15 bp, Homo sapiens
tactggactggtagg

SEQ ID NO: 21412 - DNA, 15 bp, Homo sapiens
ttactggactggtag

SEQ ID NO: 21413 - DNA, 15 bp, Homo sapiens
tttactggactggta

SEQ ID NO: 21414 - DNA, 15 bp, Homo sapiens
ttttactggactggt

SEQ ID NO: 21415 - DNA, 15 bp, Homo sapiens
gttttactggactgg

SEQ ID NO: 21416 - DNA, 15 bp, Homo sapiens
agttttactggactg

SEQ ID NO: 21417 - DNA, 15 bp, Homo sapiens
cagttttactggact

SEQ ID NO: 21418 - DNA, 15 bp, Homo sapiens
gcagttttactggac

SEQ ID NO: 21419 - DNA, 15 bp, Homo sapiens
agcagttttactgga

SEQ ID NO: 21420 - DNA, 15 bp, Homo sapiens
gagcagttttactgg

SEQ ID NO: 21421 - DNA, 15 bp, Homo sapiens
agagcagttttactg

SEQ ID NO: 21422 - DNA, 15 bp, Homo sapiens
aagagcagttttact

SEQ ID NO: 21423 - DNA, 15 bp, Homo sapiens
caagagcagttttac

SEQ ID NO: 21424 - DNA, 15 bp, Homo sapiens
acaagagcagtttta

SEQ ID NO: 21425 - DNA, 15 bp, Homo sapiens
gacaagagcagtttt

SEQ ID NO: 21426 - DNA, 15 bp, Homo sapiens
tgacaagagcagttt

SEQ ID NO: 21427 - DNA, 15 bp, Homo sapiens
ttgacaagagcagtt

SEQ ID NO: 21428 - DNA, 15 bp, Homo sapiens
tttgacaagagcagt

SEQ ID NO: 21429 - DNA, 15 bp, Homo sapiens
ctttgacaagagcag

SEQ ID NO: 21430 - DNA, 15 bp, Homo sapiens
actttgacaagagca

SEQ ID NO: 21431 - DNA, 15 bp, Homo sapiens
aactttgacaagagc

SEQ ID NO: 21432 - DNA, 15 bp, Homo sapiens
taactttgacaagag

SEQ ID NO: 21433 - DNA, 15 bp, Homo sapiens
ataactttgacaaga

SEQ ID NO: 21434 - DNA, 15 bp, Homo sapiens
aataactttgacaag

SEQ ID NO: 21435 - DNA, 15 bp, Homo sapiens
taataactttgacaa

SEQ ID NO: 21436 - DNA, 15 bp, Homo sapiens
ctaataactttgaca

SEQ ID NO: 21437 - DNA, 15 bp, Homo sapiens
cctaataactttgac

SEQ ID NO: 21438 - DNA, 15 bp, Homo sapiens
ccctaataactttga

SEQ ID NO: 21439 - DNA, 15 bp, Homo sapiens
tccctaataactttg

SEQ ID NO: 21440 - DNA, 15 bp, Homo sapiens
gtccctaataacttt

SEQ ID NO: 21441 - DNA, 15 bp, Homo sapiens
ggtccctaataactt

SEQ ID NO: 21442 - DNA, 15 bp, Homo sapiens
aggtccctaataact

SEQ ID NO: 21443 - DNA, 15 bp, Homo sapiens
gaggtccctaataac

SEQ ID NO: 21444 - DNA, 15 bp, Homo sapiens
ggaggtccctaataa

SEQ ID NO: 21445 - DNA, 15 bp, Homo sapiens
aggaggtccctaata

SEQ ID NO: 21446 - DNA, 15 bp, Homo sapiens
aaggaggtccctaat

SEQ ID NO: 21447 - DNA, 15 bp, Homo sapiens
caaggaggtccctaa

SEQ ID NO: 21448 - DNA, 15 bp, Homo sapiens
acaaggaggtcccta

SEQ ID NO: 21449 - DNA, 15 bp, Homo sapiens
aacaaggaggtccct

SEQ ID NO: 21450 - DNA, 15 bp, Homo sapiens
caacaaggaggtccc

SEQ ID NO: 21451 - DNA, 15 bp, Homo sapiens
gcaacaaggaggtcc

SEQ ID NO: 21452 - DNA, 15 bp, Homo sapiens
agcaacaaggaggtc

SEQ ID NO: 21453 - DNA, 15 bp, Homo sapiens
tagcaacaaggaggt

SEQ ID NO: 21454 - DNA, 15 bp, Homo sapiens
ttagcaacaaggagg

SEQ ID NO: 21455 - DNA, 15 bp, Homo sapiens
tttagcaacaaggag

SEQ ID NO: 21456 - DNA, 15 bp, Homo sapiens
atttagcaacaagga

SEQ ID NO: 21457 - DNA, 15 bp, Homo sapiens
gatttagcaacaagg

SEQ ID NO: 21458 - DNA, 15 bp, Homo sapiens
ggatttagcaacaag

SEQ ID NO: 21459 - DNA, 15 bp, Homo sapiens
tggatttagcaacaa

SEQ ID NO: 21460 - DNA, 15 bp, Homo sapiens
ctggatttagcaaca

SEQ ID NO: 21461 - DNA, 15 bp, Homo sapiens
actggatttagcaac

SEQ ID NO: 21462 - DNA, 15 bp, Homo sapiens
tactggatttagcaa

SEQ ID NO: 21463 - DNA, 15 bp, Homo sapiens
ctactggatttagca

SEQ ID NO: 21464 - DNA, 15 bp, Homo sapiens
gctactggatttagc

SEQ ID NO: 21465 - DNA, 15 bp, Homo sapiens
ggctactggatttag

SEQ ID NO: 21466 - DNA, 15 bp, Homo sapiens
aggctactggattta

SEQ ID NO: 21467 - DNA, 15 bp, Homo sapiens
caggctactggattt

SEQ ID NO: 21468 - DNA, 15 bp, Homo sapiens
acaggctactggatt

SEQ ID NO: 21469 - DNA, 15 bp, Homo sapiens
aacaggctactggat

SEQ ID NO: 21470 - DNA, 15 bp, Homo sapiens
gaacaggctactgga

SEQ ID NO: 21471 - DNA, 15 bp, Homo sapiens
agaacaggctactgg

SEQ ID NO: 21472 - DNA, 15 bp, Homo sapiens
gagaacaggctactg

SEQ ID NO: 21473 - DNA, 15 bp, Homo sapiens
tgagaacaggctact

SEQ ID NO: 21474 - DNA, 15 bp, Homo sapiens
ctgagaacaggctac

SEQ ID NO: 21475 - DNA, 15 bp, Homo sapiens
actgagaacaggcta

SEQ ID NO: 21476 - DNA, 15 bp, Homo sapiens
gactgagaacaggct

SEQ ID NO: 21477 - DNA, 15 bp, Homo sapiens
ggactgagaacaggc

SEQ ID NO: 21478 - DNA, 15 bp, Homo sapiens
aggactgagaacagg

SEQ ID NO: 21479 - DNA, 15 bp, Homo sapiens
aaggactgagaacag

SEQ ID NO: 21480 - DNA, 15 bp, Homo sapiens
taaggactgagaaca

SEQ ID NO: 21481 - DNA, 15 bp, Homo sapiens
gtaaggactgagaac

SEQ ID NO: 21482 - DNA, 15 bp, Homo sapiens
ggtaaggactgagaa

SEQ ID NO: 21483 - DNA, 15 bp, Homo sapiens
aggtaaggactgaga

SEQ ID NO: 21484 - DNA, 15 bp, Homo sapiens
aaggtaaggactgag

SEQ ID NO: 21485 - DNA, 15 bp, Homo sapiens
taaggtaaggactga

SEQ ID NO: 21486 - DNA, 15 bp, Homo sapiens
ataaggtaaggactg

SEQ ID NO: 21487 - DNA, 15 bp, Homo sapiens
aataaggtaaggact

SEQ ID NO: 21488 - DNA, 15 bp, Homo sapiens
gaataaggtaaggac

SEQ ID NO: 21489 - DNA, 15 bp, Homo sapiens
ggaataaggtaagga

SEQ ID NO: 21490 - DNA, 15 bp, Homo sapiens
tggaataaggtaagg

SEQ ID NO: 21491 - DNA, 15 bp, Homo sapiens
gtggaataaggtaag

SEQ ID NO: 21492 - DNA, 15 bp, Homo sapiens
ggtggaataaggtaa

SEQ ID NO: 21493 - DNA, 15 bp, Homo sapiens
aggtggaataaggta

SEQ ID NO: 21494 - DNA, 15 bp, Homo sapiens
gaggtggaataaggt

SEQ ID NO: 21495 - DNA, 15 bp, Homo sapiens
agaggtggaataagg

SEQ ID NO: 21496 - DNA, 15 bp, Homo sapiens
gagaggtggaataag

SEQ ID NO: 21497 - DNA, 15 bp, Homo sapiens
tgagaggtggaataa

SEQ ID NO: 21498 - DNA, 15 bp, Homo sapiens
ttgagaggtggaata

SEQ ID NO: 21499 - DNA, 15 bp, Homo sapiens
attgagaggtggaat

SEQ ID NO: 21500 - DNA, 15 bp, Homo sapiens
tattgagaggtggaa

SEQ ID NO: 21501 - DNA, 15 bp, Homo sapiens
ctattgagaggtgga

SEQ ID NO: 21502 - DNA, 15 bp, Homo sapiens
gctattgagaggtgg

SEQ ID NO: 21503 - DNA, 15 bp, Homo sapiens
tgctattgagaggtg

SEQ ID NO: 21504 - DNA, 15 bp, Homo sapiens
atgctattgagaggt

SEQ ID NO: 21505 - DNA, 15 bp, Homo sapiens
gatgctattgagagg

SEQ ID NO: 21506 - DNA, 15 bp, Homo sapiens
tgatgctattgagag

SEQ ID NO: 21507 - DNA, 15 bp, Homo sapiens
ttgatgctattgaga

SEQ ID NO: 21508 - DNA, 15 bp, Homo sapiens
gttgatgctattgag

SEQ ID NO: 21509 - DNA, 15 bp, Homo sapiens
tgttgatgctattga

SEQ ID NO: 21510 - DNA, 15 bp, Homo sapiens
gtgttgatgctattg

SEQ ID NO: 21511 - DNA, 15 bp, Homo sapiens
agtgttgatgctatt

SEQ ID NO: 21512 - DNA, 15 bp, Homo sapiens
cagtgttgatgctat

SEQ ID NO: 21513 - DNA, 15 bp, Homo sapiens
gcagtgttgatgcta

SEQ ID NO: 21514 - DNA, 15 bp, Homo sapiens
agcagtgttgatgct

SEQ ID NO: 21515 - DNA, 15 bp, Homo sapiens
cagcagtgttgatgc

SEQ ID NO: 21516 - DNA, 15 bp, Homo sapiens
tcagcagtgttgatg

SEQ ID NO: 21517 - DNA, 15 bp, Homo sapiens
atcagcagtgttgat

SEQ ID NO: 21518 - DNA, 15 bp, Homo sapiens
gatcagcagtgttga

SEQ ID NO: 21519 - DNA, 15 bp, Homo sapiens
tgatcagcagtgttg

SEQ ID NO: 21520 - DNA, 15 bp, Homo sapiens
gtgatcagcagtgtt

SEQ ID NO: 21521 - DNA, 15 bp, Homo sapiens
agtgatcagcagtgt

SEQ ID NO: 21522 - DNA, 15 bp, Homo sapiens
gagtgatcagcagtg

SEQ ID NO: 21523 - DNA, 15 bp, Homo sapiens
ggagtgatcagcagt

SEQ ID NO: 21524 - DNA, 15 bp, Homo sapiens
gggagtgatcagcag

SEQ ID NO: 21525 - DNA, 15 bp, Homo sapiens
agggagtgatcagca

SEQ ID NO: 21526 - DNA, 15 bp, Homo sapiens
gagggagtgatcagc

SEQ ID NO: 21527 - DNA, 15 bp, Homo sapiens
ggagggagtgatcag

SEQ ID NO: 21528 - DNA, 15 bp, Homo sapiens
aggagggagtgatca

SEQ ID NO: 21529 - DNA, 15 bp, Homo sapiens
gaggagggagtgatc

SEQ ID NO: 21530 - DNA, 15 bp, Homo sapiens
ggaggagggagtgat

SEQ ID NO: 21531 - DNA, 15 bp, Homo sapiens
tggaggagggagtga

SEQ ID NO: 21532 - DNA, 15 bp, Homo sapiens
atggaggagggagtg

SEQ ID NO: 21533 - DNA, 15 bp, Homo sapiens
catggaggagggagt

SEQ ID NO: 21534 - DNA, 15 bp, Homo sapiens
tcatggaggagggag

SEQ ID NO: 21535 - DNA, 15 bp, Homo sapiens
gtcatggaggaggga

SEQ ID NO: 21536 - DNA, 15 bp, Homo sapiens
agtcatggaggaggg

SEQ ID NO: 21537 - DNA, 15 bp, Homo sapiens
gagtcatggaggagg

SEQ ID NO: 21538 - DNA, 15 bp, Homo sapiens
agagtcatggaggag

SEQ ID NO: 21539 - DNA, 15 bp, Homo sapiens
aagagtcatggagga

SEQ ID NO: 21540 - DNA, 15 bp, Homo sapiens
aaagagtcatggagg

SEQ ID NO: 21541 - DNA, 15 bp, Homo sapiens
gaaagagtcatggag

SEQ ID NO: 21542 - DNA, 15 bp, Homo sapiens
aagaaagagtcatgg

SEQ ID NO: 21543 - DNA, 15 bp, Homo sapiens
gaagaaagagtcatg

SEQ ID NO: 21544 - DNA, 15 bp, Homo sapiens
tgaagaaagagtcat

SEQ ID NO: 21545 - DNA, 15 bp, Homo sapiens
atgaagaaagagtca

SEQ ID NO: 21546 - DNA, 15 bp, Homo sapiens
aatgaagaaagagtc

SEQ ID NO: 21547 - DNA, 15 bp, Homo sapiens
aaatgaagaaagagt

SEQ ID NO: 21548 - DNA, 15 bp, Homo sapiens
caaatgaagaaagag

SEQ ID NO: 21549 - DNA, 15 bp, Homo sapiens
ccaaatgaagaaaga

SEQ ID NO: 21550 - DNA, 15 bp, Homo sapiens
gccaaatgaagaaag

SEQ ID NO: 21551 - DNA, 15 bp, Homo sapiens
agccaaatgaagaaa

SEQ ID NO: 21552 - DNA, 15 bp, Homo sapiens
aagccaaatgaagaa

SEQ ID NO: 21553 - DNA, 15 bp, Homo sapiens
gaagccaaatgaaga

SEQ ID NO: 21554 - DNA, 15 bp, Homo sapiens
agaagccaaatgaag

SEQ ID NO: 21555 - DNA, 15 bp, Homo sapiens
tagaagccaaatgaa

SEQ ID NO: 21556 - DNA, 15 bp, Homo sapiens
ctagaagccaaatga

SEQ ID NO: 21557 - DNA, 15 bp, Homo sapiens
cctagaagccaaatg

SEQ ID NO: 21558 - DNA, 15 bp, Homo sapiens
tcctagaagccaaat

SEQ ID NO: 21559 - DNA, 15 bp, Homo sapiens
gtcctagaagccaaa

SEQ ID NO: 21560 - DNA, 15 bp, Homo sapiens
tgtcctagaagccaa

SEQ ID NO: 21561 - DNA, 15 bp, Homo sapiens
gtgtcctagaagcca

SEQ ID NO: 21562 - DNA, 15 bp, Homo sapiens
ggtgtcctagaagcc

SEQ ID NO: 21563 - DNA, 15 bp, Homo sapiens
gggtgtcctagaagc

SEQ ID NO: 21564 - DNA, 15 bp, Homo sapiens
ggggtgtcctagaag

SEQ ID NO: 21565 - DNA, 15 bp, Homo sapiens
tggggtgtcctagaa

SEQ ID NO: 21566 - DNA, 15 bp, Homo sapiens
gtggggtgtcctaga

SEQ ID NO: 21567 - DNA, 15 bp, Homo sapiens
tgtggggtgtcctag

SEQ ID NO: 21568 - DNA, 15 bp, Homo sapiens
gtgtggggtgtccta

SEQ ID NO: 21569 - DNA, 15 bp, Homo sapiens
cgtgtggggtgtcct

SEQ ID NO: 21570 - DNA, 15 bp, Homo sapiens
gcgtgtggggtgtcc

SEQ ID NO: 21571 - DNA, 15 bp, Homo sapiens
agcgtgtggggtgtc

SEQ ID NO: 21572 - DNA, 15 bp, Homo sapiens
gagcgtgtggggtgt

SEQ ID NO: 21573 - DNA, 15 bp, Homo sapiens
ggagcgtgtggggtg

SEQ ID NO: 21574 - DNA, 15 bp, Homo sapiens
aggagcgtgtggggt

SEQ ID NO: 21575 - DNA, 15 bp, Homo sapiens
caggagcgtgtgggg

SEQ ID NO: 21576 - DNA, 15 bp, Homo sapiens
ccaggagcgtgtggg

SEQ ID NO: 21577 - DNA, 15 bp, Homo sapiens
accaggagcgtgtgg

SEQ ID NO: 21578 - DNA, 15 bp, Homo sapiens
aaccaggagcgtgtg

SEQ ID NO: 21579 - DNA, 15 bp, Homo sapiens
aaaccaggagcgtgt

SEQ ID NO: 21580 - DNA, 15 bp, Homo sapiens
gaaaccaggagcgtg

SEQ ID NO: 21581 - DNA, 15 bp, Homo sapiens
ggaaaccaggagcgt

SEQ ID NO: 21582 - DNA, 15 bp, Homo sapiens
gggaaaccaggagcg

SEQ ID NO: 21583 - DNA, 15 bp, Homo sapiens
tgggaaaccaggagc

SEQ ID NO: 21584 - DNA, 15 bp, Homo sapiens
gtgggaaaccaggag

SEQ ID NO: 21585 - DNA, 15 bp, Homo sapiens
ggtgggaaaccagga

SEQ ID NO: 21586 - DNA, 15 bp, Homo sapiens
gggtgggaaaccagg

SEQ ID NO: 21587 - DNA, 15 bp, Homo sapiens
tgggtgggaaaccag

SEQ ID NO: 21588 - DNA, 15 bp, Homo sapiens
atgggtgggaaacca

SEQ ID NO: 21589 - DNA, 15 bp, Homo sapiens
aatgggtgggaaacc

SEQ ID NO: 21590 - DNA, 15 bp, Homo sapiens
taatgggtgggaaac

SEQ ID NO: 21591 - DNA, 15 bp, Homo sapiens
ataatgggtgggaaa

SEQ ID NO: 21592 - DNA, 15 bp, Homo sapiens
gataatgggtgggaa

SEQ ID NO: 21593 - DNA, 15 bp, Homo sapiens
agataatgggtggga

SEQ ID NO: 21594 - DNA, 15 bp, Homo sapiens
aagataatgggtggg

SEQ ID NO: 21595 - DNA, 15 bp, Homo sapiens
aaagataatgggtgg

SEQ ID NO: 21596 - DNA, 15 bp, Homo sapiens
aaaagataatgggtg

SEQ ID NO: 21597 - DNA, 15 bp, Homo sapiens
caaaagataatgggt

SEQ ID NO: 21598 - DNA, 15 bp, Homo sapiens
gcaaaagataatggg

SEQ ID NO: 21599 - DNA, 15 bp, Homo sapiens
agcaaaagataatgg

SEQ ID NO: 21600 - DNA, 15 bp, Homo sapiens
cagcaaaagataatg

SEQ ID NO: 21601 - DNA, 15 bp, Homo sapiens
tcagcaaaagataat

SEQ ID NO: 21602 - DNA, 15 bp, Homo sapiens
atcagcaaaagataa

SEQ ID NO: 21603 - DNA, 15 bp, Homo sapiens
aatcagcaaaagata

SEQ ID NO: 21604 - DNA, 15 bp, Homo sapiens
gaatcagcaaaagat

SEQ ID NO: 21605 - DNA, 15 bp, Homo sapiens
agaatcagcaaaaga

SEQ ID NO: 21606 - DNA, 15 bp, Homo sapiens
aagaatcagcaaaag

SEQ ID NO: 21607 - DNA, 15 bp, Homo sapiens
gaagaatcagcaaaa

SEQ ID NO: 21608 - DNA, 15 bp, Homo sapiens
ggaagaatcagcaaa

SEQ ID NO: 21609 - DNA, 15 bp, Homo sapiens
aggaagaatcagcaa

SEQ ID NO: 21610 - DNA, 15 bp, Homo sapiens
gaggaagaatcagca

SEQ ID NO: 21611 - DNA, 15 bp, Homo sapiens
agaggaagaatcagc

SEQ ID NO: 21612 - DNA, 15 bp, Homo sapiens
aagaggaagaatcag

SEQ ID NO: 21613 - DNA, 15 bp, Homo sapiens
taagaggaagaatca

SEQ ID NO: 21614 - DNA, 15 bp, Homo sapiens
ttaagaggaagaatc

SEQ ID NO: 21615 - DNA, 15 bp, Homo sapiens
gttaagaggaagaat

SEQ ID NO: 21616 - DNA, 15 bp, Homo sapiens
cgttaagaggaagaa

SEQ ID NO: 21617 - DNA, 15 bp, Homo sapiens
acgttaagaggaaga

SEQ ID NO: 21618 - DNA, 15 bp, Homo sapiens
aacgttaagaggaag

SEQ ID NO: 21619 - DNA, 15 bp, Homo sapiens
caacgttaagaggaa

SEQ ID NO: 21620 - DNA, 15 bp, Homo sapiens
ccaacgttaagagga

SEQ ID NO: 21621 - DNA, 15 bp, Homo sapiens
tccaacgttaagagg

SEQ ID NO: 21622 - DNA, 15 bp, Homo sapiens
ctccaacgttaagag

SEQ ID NO: 21623 - DNA, 15 bp, Homo sapiens
cctccaacgttaaga

SEQ ID NO: 21624 - DNA, 15 bp, Homo sapiens
ccctccaacgttaag

SEQ ID NO: 21625 - DNA, 15 bp, Homo sapiens
gccctccaacgttaa

SEQ ID NO: 21626 - DNA, 15 bp, Homo sapiens
ggccctccaacgtta

SEQ ID NO: 21627 - DNA, 15 bp, Homo sapiens
gggccctccaacgtt

SEQ ID NO: 21628 - DNA, 15 bp, Homo sapiens
tgggccctccaacgt

SEQ ID NO: 21629 - DNA, 15 bp, Homo sapiens
ctgggccctccaacg

SEQ ID NO: 21630 - DNA, 15 bp, Homo sapiens
cctgggccctccaac

SEQ ID NO: 21631 - DNA, 15 bp, Homo sapiens
tcctgggccctccaa

SEQ ID NO: 21632 - DNA, 15 bp, Homo sapiens
gtcctgggccctcca

SEQ ID NO: 21633 - DNA, 15 bp, Homo sapiens
ggtcctgggccctcc

SEQ ID NO: 21634 - DNA, 15 bp, Homo sapiens
gggtcctgggccctc

SEQ ID NO: 21635 - DNA, 15 bp, Homo sapiens
tgggtcctgggccct

SEQ ID NO: 21636 - DNA, 15 bp, Homo sapiens
ctgggtcctgggccc

SEQ ID NO: 21637 - DNA, 15 bp, Homo sapiens
actgggtcctgggcc

SEQ ID NO: 21638 - DNA, 15 bp, Homo sapiens
gactgggtcctgggc

SEQ ID NO: 21639 - DNA, 15 bp, Homo sapiens
ggactgggtcctggg

SEQ ID NO: 21640 - DNA, 15 bp, Homo sapiens
aggactgggtcctgg

SEQ ID NO: 21641 - DNA, 15 bp, Homo sapiens
aaggactgggtcctg

SEQ ID NO: 21642 - DNA, 15 bp, Homo sapiens
caaggactgggtcct

SEQ ID NO: 21643 - DNA, 15 bp, Homo sapiens
ccaaggactgggtcc

SEQ ID NO: 21644 - DNA, 15 bp, Homo sapiens
tccaaggactgggtc

SEQ ID NO: 21645 - DNA, 15 bp, Homo sapiens
gtccaaggactgggt

SEQ ID NO: 21646 - DNA, 15 bp, Homo sapiens
ggtccaaggactggg

SEQ ID NO: 21647 - DNA, 15 bp, Homo sapiens
aggtccaaggactgg

SEQ ID NO: 21648 - DNA, 15 bp, Homo sapiens
gaggtccaaggactg

SEQ ID NO: 21649 - DNA, 15 bp, Homo sapiens
ggaggtccaaggact

SEQ ID NO: 21650 - DNA, 15 bp, Homo sapiens
aggaggtccaaggac

SEQ ID NO: 21651 - DNA, 15 bp, Homo sapiens
gaggaggtccaagga

SEQ ID NO: 21652 - DNA, 15 bp, Homo sapiens
agaggaggtccaagg

SEQ ID NO: 21653 - DNA, 15 bp, Homo sapiens
gagaggaggtccaag

SEQ ID NO: 21654 - DNA, 15 bp, Homo sapiens
agagaggaggtccaa

SEQ ID NO: 21655 - DNA, 15 bp, Homo sapiens
cagagaggaggtcca

SEQ ID NO: 21656 - DNA, 15 bp, Homo sapiens
acagagaggaggtcc

SEQ ID NO: 21657 - DNA, 15 bp, Homo sapiens
gacagagaggaggtc

SEQ ID NO: 21658 - DNA, 15 bp, Homo sapiens
ggacagagaggaggt

SEQ ID NO: 21659 - DNA, 15 bp, Homo sapiens
gggacagagaggagg

SEQ ID NO: 21660 - DNA, 15 bp, Homo sapiens
ggggacagagaggag

SEQ ID NO: 21661 - DNA, 15 bp, Homo sapiens
tggggacagagagga

SEQ ID NO: 21662 - DNA, 15 bp, Homo sapiens
gtggggacagagagg

SEQ ID NO: 21663 - DNA, 15 bp, Homo sapiens
agtggggacagagag

SEQ ID NO: 21664 - DNA, 15 bp, Homo sapiens
cagtggggacagaga

SEQ ID NO: 21665 - DNA, 15 bp, Homo sapiens
acagtggggacagag

SEQ ID NO: 21666 - DNA, 15 bp, Homo sapiens
aacagtggggacaga

SEQ ID NO: 21667 - DNA, 15 bp, Homo sapiens
caacagtggggacag

SEQ ID NO: 21668 - DNA, 15 bp, Homo sapiens
gcaacagtggggaca

SEQ ID NO: 21669 - DNA, 15 bp, Homo sapiens
ggcaacagtggggac

SEQ ID NO: 21670 - DNA, 15 bp, Homo sapiens
cggcaacagtgggga

SEQ ID NO: 21671 - DNA, 15 bp, Homo sapiens
acggcaacagtgggg

SEQ ID NO: 21672 - DNA, 15 bp, Homo sapiens
aacggcaacagtggg

SEQ ID NO: 21673 - DNA, 15 bp, Homo sapiens
aaacggcaacagtgg

SEQ ID NO: 21674 - DNA, 15 bp, Homo sapiens
caaacggcaacagtg

SEQ ID NO: 21675 - DNA, 15 bp, Homo sapiens
acaaacggcaacagt

SEQ ID NO: 21676 - DNA, 15 bp, Homo sapiens
gacaaacggcaacag

SEQ ID NO: 21677 - DNA, 15 bp, Homo sapiens
tgacaaacggcaaca

SEQ ID NO: 21678 - DNA, 15 bp, Homo sapiens
atgacaaacggcaac

SEQ ID NO: 21679 - DNA, 15 bp, Homo sapiens
gatgacaaacggcaa

SEQ ID NO: 21680 - DNA, 15 bp, Homo sapiens
agatgacaaacggca

SEQ ID NO: 21681 - DNA, 15 bp, Homo sapiens
gagatgacaaacggc

SEQ ID NO: 21682 - DNA, 15 bp, Homo sapiens
tgagatgacaaacgg

SEQ ID NO: 21683 - DNA, 15 bp, Homo sapiens
gtgagatgacaaacg

SEQ ID NO: 21684 - DNA, 15 bp, Homo sapiens
ggtgagatgacaaac

SEQ ID NO: 21685 - DNA, 15 bp, Homo sapiens
tggtgagatgacaaa

SEQ ID NO: 21686 - DNA, 15 bp, Homo sapiens
ctggtgagatgacaa

SEQ ID NO: 21687 - DNA, 15 bp, Homo sapiens
actggtgagatgaca

SEQ ID NO: 21688 - DNA, 15 bp, Homo sapiens
tactggtgagatgac

SEQ ID NO: 21689 - DNA, 15 bp, Homo sapiens
atactggtgagatga

SEQ ID NO: 21690 - DNA, 15 bp, Homo sapiens
gatactggtgagatg

SEQ ID NO: 21691 - DNA, 15 bp, Homo sapiens
ggatactggtgagat

SEQ ID NO: 21692 - DNA, 15 bp, Homo sapiens
aggatactggtgaga

SEQ ID NO: 21693 - DNA, 15 bp, Homo sapiens
caggatactggtgag

SEQ ID NO: 21694 - DNA, 15 bp, Homo sapiens
ccaggatactggtga

SEQ ID NO: 21695 - DNA, 15 bp, Homo sapiens
accaggatactggtg

SEQ ID NO: 21696 - DNA, 15 bp, Homo sapiens
aaccaggatactggt

SEQ ID NO: 21697 - DNA, 15 bp, Homo sapiens
aaaccaggatactgg

SEQ ID NO: 21698 - DNA, 15 bp, Homo sapiens
taaaccaggatactg

SEQ ID NO: 21699 - DNA, 15 bp, Homo sapiens
ttaaaccaggatact

SEQ ID NO: 21700 - DNA, 15 bp, Homo sapiens
tttaaaccaggatac

SEQ ID NO: 21701 - DNA, 15 bp, Homo sapiens
atttaaaccaggata

SEQ ID NO: 21702 - DNA, 15 bp, Homo sapiens
tatttaaaccaggat

SEQ ID NO: 21703 - DNA, 15 bp, Homo sapiens
gtatttaaaccagga

SEQ ID NO: 21704 - DNA, 15 bp, Homo sapiens
agtatttaaaccagg

SEQ ID NO: 21705 - DNA, 15 bp, Homo sapiens
tagtatttaaaccag

SEQ ID NO: 21706 - DNA, 15 bp, Homo sapiens
atagtatttaaacca

SEQ ID NO: 21707 - DNA, 15 bp, Homo sapiens
gatagtatttaaacc

SEQ ID NO: 21708 - DNA, 15 bp, Homo sapiens
agatagtatttaaac

SEQ ID NO: 21709 - DNA, 15 bp, Homo sapiens
cagatagtatttaaa

SEQ ID NO: 21710 - DNA, 15 bp, Homo sapiens
tcagatagtatttaa

SEQ ID NO: 21711 - DNA, 15 bp, Homo sapiens
ttcagatagtattta

SEQ ID NO: 21712 - DNA, 15 bp, Homo sapiens
attcagatagtattt

SEQ ID NO: 21713 - DNA, 15 bp, Homo sapiens
cattcagatagtatt

SEQ ID NO: 21714 - DNA, 15 bp, Homo sapiens
gcattcagatagtat

SEQ ID NO: 21715 - DNA, 15 bp, Homo sapiens
agcattcagatagta

SEQ ID NO: 21716 - DNA, 15 bp, Homo sapiens
cagcattcagatagt

SEQ ID NO: 21717 - DNA, 15 bp, Homo sapiens
ccagcattcagatag

SEQ ID NO: 21718 - DNA, 15 bp, Homo sapiens
gccagcattcagata

SEQ ID NO: 21719 - DNA, 15 bp, Homo sapiens
agccagcattcagat

SEQ ID NO: 21720 - DNA, 15 bp, Homo sapiens
gagccagcattcaga

SEQ ID NO: 21721 - DNA, 15 bp, Homo sapiens
tgagccagcattcag

SEQ ID NO: 21722 - DNA, 15 bp, Homo sapiens
ttgagccagcattca

SEQ ID NO: 21723 - DNA, 15 bp, Homo sapiens
tttgagccagcattc

SEQ ID NO: 21724 - DNA, 15 bp, Homo sapiens
atttgagccagcatt

SEQ ID NO: 21725 - DNA, 15 bp, Homo sapiens
aatttgagccagcat

SEQ ID NO: 21726 - DNA, 15 bp, Homo sapiens
aaatttgagccagca

SEQ ID NO: 21727 - DNA, 15 bp, Homo sapiens
gaaatttgagccagc

SEQ ID NO: 21728 - DNA, 15 bp, Homo sapiens
agaaatttgagccag

SEQ ID NO: 21729 - DNA, 15 bp, Homo sapiens
tagaaatttgagcca

SEQ ID NO: 21730 - DNA, 15 bp, Homo sapiens
atagaaatttgagcc

SEQ ID NO: 21731 - DNA, 15 bp, Homo sapiens
gatagaaatttgagc

SEQ ID NO: 21732 - DNA, 15 bp, Homo sapiens
agatagaaatttgag

SEQ ID NO: 21733 - DNA, 15 bp, Homo sapiens
gagatagaaatttga

SEQ ID NO: 21734 - DNA, 15 bp, Homo sapiens
agagatagaaatttg

SEQ ID NO: 21735 - DNA, 15 bp, Homo sapiens
tagagatagaaattt

SEQ ID NO: 21736 - DNA, 15 bp, Homo sapiens
ctagagatagaaatt

SEQ ID NO: 21737 - DNA, 15 bp, Homo sapiens
gctagagatagaaat

SEQ ID NO: 21738 - DNA, 15 bp, Homo sapiens
ggctagagatagaaa

SEQ ID NO: 21739 - DNA, 15 bp, Homo sapiens
gggctagagatagaa

SEQ ID NO: 21740 - DNA, 15 bp, Homo sapiens
tgggctagagataga

SEQ ID NO: 21741 - DNA, 15 bp, Homo sapiens
ctgggctagagatag

SEQ ID NO: 21742 - DNA, 15 bp, Homo sapiens
tctgggctagagata

SEQ ID NO: 21743 - DNA, 15 bp, Homo sapiens
gtctgggctagagat

SEQ ID NO: 21744 - DNA, 15 bp, Homo sapiens
ggtctgggctagaga

SEQ ID NO: 21745 - DNA, 15 bp, Homo sapiens
aggtctgggctagag

SEQ ID NO: 21746 - DNA, 15 bp, Homo sapiens
gaggtctgggctaga

SEQ ID NO: 21747 - DNA, 15 bp, Homo sapiens
agaggtctgggctag

SEQ ID NO: 21748 - DNA, 15 bp, Homo sapiens
aagaggtctgggcta

SEQ ID NO: 21749 - DNA, 15 bp, Homo sapiens
gaagaggtctgggct

SEQ ID NO: 21750 - DNA, 15 bp, Homo sapiens
ggaagaggtctgggc

SEQ ID NO: 21751 - DNA, 15 bp, Homo sapiens
aggaagaggtctggg

SEQ ID NO: 21752 - DNA, 15 bp, Homo sapiens
gaggaagaggtctgg

SEQ ID NO: 21753 - DNA, 15 bp, Homo sapiens
agaggaagaggtctg

SEQ ID NO: 21754 - DNA, 15 bp, Homo sapiens
cagaggaagaggtct

SEQ ID NO: 21755 - DNA, 15 bp, Homo sapiens
tcagaggaagaggtc

SEQ ID NO: 21756 - DNA, 15 bp, Homo sapiens
ttcagaggaagaggt

SEQ ID NO: 21757 - DNA, 15 bp, Homo sapiens
gttcagaggaagagg

SEQ ID NO: 21758 - DNA, 15 bp, Homo sapiens
agttcagaggaagag

SEQ ID NO: 21759 - DNA, 15 bp, Homo sapiens
cagttcagaggaaga

SEQ ID NO: 21760 - DNA, 15 bp, Homo sapiens
gcagttcagaggaag

SEQ ID NO: 21761 - DNA, 15 bp, Homo sapiens
tgcagttcagaggaa

SEQ ID NO: 21762 - DNA, 15 bp, Homo sapiens
atgcagttcagagga

SEQ ID NO: 21763 - DNA, 15 bp, Homo sapiens
tatgcagttcagagg

SEQ ID NO: 21764 - DNA, 15 bp, Homo sapiens
gtatgcagttcagag

SEQ ID NO: 21765 - DNA, 15 bp, Homo sapiens
agtatgcagttcaga

SEQ ID NO: 21766 - DNA, 15 bp, Homo sapiens
aagtatgcagttcag

SEQ ID NO: 21767 - DNA, 15 bp, Homo sapiens
caagtatgcagttca

SEQ ID NO: 21768 - DNA, 15 bp, Homo sapiens
gcaagtatgcagttc

SEQ ID NO: 21769 - DNA, 15 bp, Homo sapiens
tgcaagtatgcagtt

SEQ ID NO: 21770 - DNA, 15 bp, Homo sapiens
atgcaagtatgcagt

SEQ ID NO: 21771 - DNA, 15 bp, Homo sapiens
aatgcaagtatgcag

SEQ ID NO: 21772 - DNA, 15 bp, Homo sapiens
aaatgcaagtatgca

SEQ ID NO: 21773 - DNA, 15 bp, Homo sapiens
gaaatgcaagtatgc

SEQ ID NO: 21774 - DNA, 15 bp, Homo sapiens
ggaaatgcaagtatg

SEQ ID NO: 21775 - DNA, 15 bp, Homo sapiens
tggaaatgcaagtat

SEQ ID NO: 21776 - DNA, 15 bp, Homo sapiens
ctggaaatgcaagta

SEQ ID NO: 21777 - DNA, 15 bp, Homo sapiens
actggaaatgcaagt

SEQ ID NO: 21778 - DNA, 15 bp, Homo sapiens
aactggaaatgcaag

SEQ ID NO: 21779 - DNA, 15 bp, Homo sapiens
caactggaaatgcaa

SEQ ID NO: 21780 - DNA, 15 bp, Homo sapiens
acaactggaaatgca

SEQ ID NO: 21781 - DNA, 15 bp, Homo sapiens
aacaactggaaatgc

SEQ ID NO: 21782 - DNA, 15 bp, Homo sapiens
aaacaactggaaatg

SEQ ID NO: 21783 - DNA, 15 bp, Homo sapiens
taaacaactggaaat

SEQ ID NO: 21784 - DNA, 15 bp, Homo sapiens
gtaaacaactggaaa

SEQ ID NO: 21785 - DNA, 15 bp, Homo sapiens
agtaaacaactggaa

SEQ ID NO: 21786 - DNA, 15 bp, Homo sapiens
aagtaaacaactgga

SEQ ID NO: 21787 - DNA, 15 bp, Homo sapiens
gaagtaaacaactgg

SEQ ID NO: 21788 - DNA, 15 bp, Homo sapiens
tgaagtaaacaactg

SEQ ID NO: 21789 - DNA, 15 bp, Homo sapiens
gtgaagtaaacaact

SEQ ID NO: 21790 - DNA, 15 bp, Homo sapiens
tgtgaagtaaacaac

SEQ ID NO: 21791 - DNA, 15 bp, Homo sapiens
atgtgaagtaaacaa

SEQ ID NO: 21792 - DNA, 15 bp, Homo sapiens
gatgtgaagtaaaca

SEQ ID NO: 21793 - DNA, 15 bp, Homo sapiens
agatgtgaagtaaac

SEQ ID NO: 21794 - DNA, 15 bp, Homo sapiens
aagatgtgaagtaaa

SEQ ID NO: 21795 - DNA, 15 bp, Homo sapiens
gaagatgtgaagtaa

SEQ ID NO: 21796 - DNA, 15 bp, Homo sapiens
agaagatgtgaagta

SEQ ID NO: 21797 - DNA, 15 bp, Homo sapiens
tagaagatgtgaagt

SEQ ID NO: 21798 - DNA, 15 bp, Homo sapiens
atagaagatgtgaag

SEQ ID NO: 21799 - DNA, 15 bp, Homo sapiens
catagaagatgtgaa

SEQ ID NO: 21800 - DNA, 15 bp, Homo sapiens
acatagaagatgtga

SEQ ID NO: 21801 - DNA, 15 bp, Homo sapiens
aacatagaagatgtg

SEQ ID NO: 21802 - DNA, 15 bp, Homo sapiens
gaacatagaagatgt

SEQ ID NO: 21803 - DNA, 15 bp, Homo sapiens
tgaacatagaagatg

SEQ ID NO: 21804 - DNA, 15 bp, Homo sapiens
ctgaacatagaagat

SEQ ID NO: 21805 - DNA, 15 bp, Homo sapiens
tctgaacatagaaga

SEQ ID NO: 21806 - DNA, 15 bp, Homo sapiens
atctgaacatagaag

SEQ ID NO: 21807 - DNA, 15 bp, Homo sapiens
gatctgaacatagaa

SEQ ID NO: 21808 - DNA, 15 bp, Homo sapiens
agatctgaacataga

SEQ ID NO: 21809 - DNA, 15 bp, Homo sapiens
cagatctgaacatag

SEQ ID NO: 21810 - DNA, 15 bp, Homo sapiens
tcagatctgaacata

SEQ ID NO: 21811 - DNA, 15 bp, Homo sapiens
ttcagatctgaacat

SEQ ID NO: 21812 - DNA, 15 bp, Homo sapiens
tttcagatctgaaca

SEQ ID NO: 21813 - DNA, 15 bp, Homo sapiens
ttttcagatctgaac

SEQ ID NO: 21814 - DNA, 15 bp, Homo sapiens
attttcagatctgaa

SEQ ID NO: 21815 - DNA, 15 bp, Homo sapiens
gattttcagatctga

SEQ ID NO: 21816 - DNA, 15 bp, Homo sapiens
agattttcagatctg

SEQ ID NO: 21817 - DNA, 15 bp, Homo sapiens
cagattttcagatct

SEQ ID NO: 21818 - DNA, 15 bp, Homo sapiens
tcagattttcagatc

SEQ ID NO: 21819 - DNA, 15 bp, Homo sapiens
ttcagattttcagat

SEQ ID NO: 21820 - DNA, 15 bp, Homo sapiens
gttcagattttcaga

SEQ ID NO: 21821 - DNA, 15 bp, Homo sapiens
agttcagattttcag

SEQ ID NO: 21822 - DNA, 15 bp, Homo sapiens
gagttcagattttca

SEQ ID NO: 21823 - DNA, 15 bp, Homo sapiens
ggagttcagattttc

SEQ ID NO: 21824 - DNA, 15 bp, Homo sapiens
aggagttcagatttt

SEQ ID NO: 21825 - DNA, 15 bp, Homo sapiens
caggagttcagattt

SEQ ID NO: 21826 - DNA, 15 bp, Homo sapiens
tcaggagttcagatt

SEQ ID NO: 21827 - DNA, 15 bp, Homo sapiens
atcaggagttcagat

SEQ ID NO: 21828 - DNA, 15 bp, Homo sapiens
gatcaggagttcaga

SEQ ID NO: 21829 - DNA, 15 bp, Homo sapiens
agatcaggagttcag

SEQ ID NO: 21830 - DNA, 15 bp, Homo sapiens
gagatcaggagttca

SEQ ID NO: 21831 - DNA, 15 bp, Homo sapiens
ggagatcaggagttc

SEQ ID NO: 21832 - DNA, 15 bp, Homo sapiens
gggagatcaggagtt

SEQ ID NO: 21833 - DNA, 15 bp, Homo sapiens
cgggagatcaggagt

SEQ ID NO: 21834 - DNA, 15 bp, Homo sapiens
acgggagatcaggag

SEQ ID NO: 21835 - DNA, 15 bp, Homo sapiens
tacgggagatcagga

SEQ ID NO: 21836 - DNA, 15 bp, Homo sapiens
ttacgggagatcagg

SEQ ID NO: 21837 - DNA, 15 bp, Homo sapiens
tttacgggagatcag

SEQ ID NO: 21838 - DNA, 15 bp, Homo sapiens
gtttacgggagatca

SEQ ID NO: 21839 - DNA, 15 bp, Homo sapiens
ggtttacgggagatc

SEQ ID NO: 21840 - DNA, 15 bp, Homo sapiens
gggtttacgggagat

SEQ ID NO: 21841 - DNA, 15 bp, Homo sapiens
ggggtttacgggaga

SEQ ID NO: 21842 - DNA, 15 bp, Homo sapiens
tggggtttacgggag

SEQ ID NO: 21843 - DNA, 15 bp, Homo sapiens
ttggggtttacggga

SEQ ID NO: 21844 - DNA, 15 bp, Homo sapiens
tttggggtttacggg

SEQ ID NO: 21845 - DNA, 15 bp, Homo sapiens
ctttggggtttacgg

SEQ ID NO: 21846 - DNA, 15 bp, Homo sapiens
gctttggggtttacg

SEQ ID NO: 21847 - DNA, 15 bp, Homo sapiens
agctttggggtttac

SEQ ID NO: 21848 - DNA, 15 bp, Homo sapiens
cagctttggggttta

SEQ ID NO: 21849 - DNA, 15 bp, Homo sapiens
tcagctttggggttt

SEQ ID NO: 21850 - DNA, 15 bp, Homo sapiens
atcagctttggggtt

SEQ ID NO: 21851 - DNA, 15 bp, Homo sapiens
gatcagctttggggt

SEQ ID NO: 21852 - DNA, 15 bp, Homo sapiens
ggatcagctttgggg

SEQ ID NO: 21853 - DNA, 15 bp, Homo sapiens
gggatcagctttggg

SEQ ID NO: 21854 - DNA, 15 bp, Homo sapiens
tgggatcagctttgg

SEQ ID NO: 21855 - DNA, 15 bp, Homo sapiens
gtgggatcagctttg

SEQ ID NO: 21856 - DNA, 15 bp, Homo sapiens
tgtgggatcagcttt

SEQ ID NO: 21857 - DNA, 15 bp, Homo sapiens
ctgtgggatcagctt

SEQ ID NO: 21858 - DNA, 15 bp, Homo sapiens
actgtgggatcagct

SEQ ID NO: 21859 - DNA, 15 bp, Homo sapiens
gactgtgggatcagc

SEQ ID NO: 21860 - DNA, 15 bp, Homo sapiens
agactgtgggatcag

SEQ ID NO: 21861 - DNA, 15 bp, Homo sapiens
aagactgtgggatca

SEQ ID NO: 21862 - DNA, 15 bp, Homo sapiens
caagactgtgggatc

SEQ ID NO: 21863 - DNA, 15 bp, Homo sapiens
gcaagactgtgggat

SEQ ID NO: 21864 - DNA, 15 bp, Homo sapiens
agcaagactgtggga

SEQ ID NO: 21865 - DNA, 15 bp, Homo sapiens
aagcaagactgtggg

SEQ ID NO: 21866 - DNA, 15 bp, Homo sapiens
caagcaagactgtgg

SEQ ID NO: 21867 - DNA, 15 bp, Homo sapiens
acaagcaagactgtg

SEQ ID NO: 21868 - DNA, 15 bp, Homo sapiens
gacaagcaagactgt

SEQ ID NO: 21869 - DNA, 15 bp, Homo sapiens
agacaagcaagactg

SEQ ID NO: 21870 - DNA, 15 bp, Homo sapiens
gagacaagcaagact

SEQ ID NO: 21871 - DNA, 15 bp, Homo sapiens
tgagacaagcaagac

SEQ ID NO: 21872 - DNA, 15 bp, Homo sapiens
ctgagacaagcaaga

SEQ ID NO: 21873 - DNA, 15 bp, Homo sapiens
tctgagacaagcaag

SEQ ID NO: 21874 - DNA, 15 bp, Homo sapiens
atctgagacaagcaa

SEQ ID NO: 21875 - DNA, 15 bp, Homo sapiens
tatctgagacaagca

SEQ ID NO: 21876 - DNA, 15 bp, Homo sapiens
ttatctgagacaagc

SEQ ID NO: 21877 - DNA, 15 bp, Homo sapiens
tttatctgagacaag

SEQ ID NO: 21878 - DNA, 15 bp, Homo sapiens
ctttatctgagacaa

SEQ ID NO: 21879 - DNA, 15 bp, Homo sapiens
cctttatctgagaca

SEQ ID NO: 21880 - DNA, 15 bp, Homo sapiens
gcctttatctgagac

SEQ ID NO: 21881 - DNA, 15 bp, Homo sapiens
tgcctttatctgaga

SEQ ID NO: 21882 - DNA, 15 bp, Homo sapiens
ttgcctttatctgag

SEQ ID NO: 21883 - DNA, 15 bp, Homo sapiens
attgcctttatctga

SEQ ID NO: 21884 - DNA, 15 bp, Homo sapiens
cattgcctttatctg

SEQ ID NO: 21885 - DNA, 15 bp, Homo sapiens
acattgcctttatct

SEQ ID NO: 21886 - DNA, 15 bp, Homo sapiens
cacattgcctttatc

SEQ ID NO: 21887 - DNA, 15 bp, Homo sapiens
tcacattgcctttat

SEQ ID NO: 21888 - DNA, 15 bp, Homo sapiens
atcacattgccttta

SEQ ID NO: 21889 - DNA, 15 bp, Homo sapiens
aatcacattgccttt

SEQ ID NO: 21890 - DNA, 15 bp, Homo sapiens
gaatcacattgcctt

SEQ ID NO: 21891 - DNA, 15 bp, Homo sapiens
agaatcacattgcct

SEQ ID NO: 21892 - DNA, 15 bp, Homo sapiens
aagaatcacattgcc

SEQ ID NO: 21893 - DNA, 15 bp, Homo sapiens
gaagaatcacattgc

SEQ ID NO: 21894 - DNA, 15 bp, Homo sapiens
ggaagaatcacattg

SEQ ID NO: 21895 - DNA, 15 bp, Homo sapiens
tggaagaatcacatt

SEQ ID NO: 21896 - DNA, 15 bp, Homo sapiens
ttggaagaatcacat

SEQ ID NO: 21897 - DNA, 15 bp, Homo sapiens
attggaagaatcaca

SEQ ID NO: 21898 - DNA, 15 bp, Homo sapiens
aattggaagaatcac

SEQ ID NO: 21899 - DNA, 15 bp, Homo sapiens
caattggaagaatca

SEQ ID NO: 21900 - DNA, 15 bp, Homo sapiens
gcaattggaagaatc

SEQ ID NO: 21901 - DNA, 15 bp, Homo sapiens
ggcaattggaagaat

SEQ ID NO: 21902 - DNA, 15 bp, Homo sapiens
gggcaattggaagaa

SEQ ID NO: 21903 - DNA, 15 bp, Homo sapiens
ggggcaattggaaga

SEQ ID NO: 21904 - DNA, 15 bp, Homo sapiens
tggggcaattggaag

SEQ ID NO: 21905 - DNA, 15 bp, Homo sapiens
ctggggcaattggaa

SEQ ID NO: 21906 - DNA, 15 bp, Homo sapiens
actggggcaattgga

SEQ ID NO: 21907 - DNA, 15 bp, Homo sapiens
aactggggcaattgg

SEQ ID NO: 21908 - DNA, 15 bp, Homo sapiens
aaactggggcaattg

SEQ ID NO: 21909 - DNA, 15 bp, Homo sapiens
aaaactggggcaatt

SEQ ID NO: 21910 - DNA, 15 bp, Homo sapiens
caaaactggggcaat

SEQ ID NO: 21911 - DNA, 15 bp, Homo sapiens
ccaaaactggggcaa

SEQ ID NO: 21912 - DNA, 15 bp, Homo sapiens
tccaaaactggggca

SEQ ID NO: 21913 - DNA, 15 bp, Homo sapiens
ctccaaaactggggc

SEQ ID NO: 21914 - DNA, 15 bp, Homo sapiens
actccaaaactgggg

SEQ ID NO: 21915 - DNA, 15 bp, Homo sapiens
gactccaaaactggg

SEQ ID NO: 21916 - DNA, 15 bp, Homo sapiens
tgactccaaaactgg

SEQ ID NO: 21917 - DNA, 15 bp, Homo sapiens
atgactccaaaactg

SEQ ID NO: 21918 - DNA, 15 bp, Homo sapiens
gatgactccaaaact

SEQ ID NO: 21919 - DNA, 15 bp, Homo sapiens
agatgactccaaaac

SEQ ID NO: 21920 - DNA, 15 bp, Homo sapiens
aagatgactccaaaa

SEQ ID NO: 21921 - DNA, 15 bp, Homo sapiens
aaagatgactccaaa

SEQ ID NO: 21922 - DNA, 15 bp, Homo sapiens
caaagatgactccaa

SEQ ID NO: 21923 - DNA, 15 bp, Homo sapiens
acaaagatgactcca

SEQ ID NO: 21924 - DNA, 15 bp, Homo sapiens
tacaaagatgactcc

SEQ ID NO: 21925 - DNA, 15 bp, Homo sapiens
ctacaaagatgactc

SEQ ID NO: 21926 - DNA, 15 bp, Homo sapiens
actacaaagatgact

SEQ ID NO: 21927 - DNA, 15 bp, Homo sapiens
gactacaaagatgac

SEQ ID NO: 21928 - DNA, 15 bp, Homo sapiens
ggactacaaagatga

SEQ ID NO: 21929 - DNA, 15 bp, Homo sapiens
aggactacaaagatg

SEQ ID NO: 21930 - DNA, 15 bp, Homo sapiens
aaggactacaaagat

SEQ ID NO: 21931 - DNA, 15 bp, Homo sapiens
aaaggactacaaaga

SEQ ID NO: 21932 - DNA, 15 bp, Homo sapiens
gaaaggactacaaag

SEQ ID NO: 21933 - DNA, 15 bp, Homo sapiens
agaaaggactacaaa

SEQ ID NO: 21934 - DNA, 15 bp, Homo sapiens
aagaaaggactacaa

SEQ ID NO: 21935 - DNA, 15 bp, Homo sapiens
aaagaaaggactaca

SEQ ID NO: 21936 - DNA, 15 bp, Homo sapiens
gaaagaaaggactac

SEQ ID NO: 21937 - DNA, 15 bp, Homo sapiens
agaaagaaaggacta

SEQ ID NO: 21938 - DNA, 15 bp, Homo sapiens
gagaaagaaaggact

SEQ ID NO: 21939 - DNA, 15 bp, Homo sapiens
cgagaaagaaaggac

SEQ ID NO: 21940 - DNA, 15 bp, Homo sapiens
acgagaaagaaagga

SEQ ID NO: 21941 - DNA, 15 bp, Homo sapiens
tacgagaaagaaagg

SEQ ID NO: 21942 - DNA, 15 bp, Homo sapiens
atacgagaaagaaag

SEQ ID NO: 21943 - DNA, 15 bp, Homo sapiens
tatacgagaaagaaa

SEQ ID NO: 21944 - DNA, 15 bp, Homo sapiens
gtatacgagaaagaa

SEQ ID NO: 21945 - DNA, 15 bp, Homo sapiens
ggtatacgagaaaga

SEQ ID NO: 21946 - DNA, 15 bp, Homo sapiens
gggtatacgagaaag

SEQ ID NO: 21947 - DNA, 15 bp, Homo sapiens
tgggtatacgagaaa

SEQ ID NO: 21948 - DNA, 15 bp, Homo sapiens
gtgggtatacgagaa

SEQ ID NO: 21949 - DNA, 15 bp, Homo sapiens
tgtgggtatacgaga

SEQ ID NO: 21950 - DNA, 15 bp, Homo sapiens
atgtgggtatacgag

SEQ ID NO: 21951 - DNA, 15 bp, Homo sapiens
gatgtgggtatacga

SEQ ID NO: 21952 - DNA, 15 bp, Homo sapiens
ggatgtgggtatacg

SEQ ID NO: 21953 - DNA, 15 bp, Homo sapiens
tggatgtgggtatac

SEQ ID NO: 21954 - DNA, 15 bp, Homo sapiens
ttggatgtgggtata

SEQ ID NO: 21955 - DNA, 15 bp, Homo sapiens
attggatgtgggtat

SEQ ID NO: 21956 - DNA, 15 bp, Homo sapiens
cattggatgtgggta

SEQ ID NO: 21957 - DNA, 15 bp, Homo sapiens
gcattggatgtgggt

SEQ ID NO: 21958 - DNA, 15 bp, Homo sapiens
tgcattggatgtggg

SEQ ID NO: 21959 - DNA, 15 bp, Homo sapiens
ctgcattggatgtgg

SEQ ID NO: 21960 - DNA, 15 bp, Homo sapiens
gctgcattggatgtg

SEQ ID NO: 21961 - DNA, 15 bp, Homo sapiens
tgctgcattggatgt

SEQ ID NO: 21962 - DNA, 15 bp, Homo sapiens
ctgctgcattggatg

SEQ ID NO: 21963 - DNA, 15 bp, Homo sapiens
tctgctgcattggat

SEQ ID NO: 21964 - DNA, 15 bp, Homo sapiens
atctgctgcattgga

SEQ ID NO: 21965 - DNA, 15 bp, Homo sapiens
gatctgctgcattgg

SEQ ID NO: 21966 - DNA, 15 bp, Homo sapiens
ggatctgctgcattg

SEQ ID NO: 21967 - DNA, 15 bp, Homo sapiens
aggatctgctgcatt

SEQ ID NO: 21968 - DNA, 15 bp, Homo sapiens
caggatctgctgcat

SEQ ID NO: 21969 - DNA, 15 bp, Homo sapiens
gcaggatctgctgca

SEQ ID NO: 21970 - DNA, 15 bp, Homo sapiens
agcaggatctgctgc

SEQ ID NO: 21971 - DNA, 15 bp, Homo sapiens
cagcaggatctgctg

SEQ ID NO: 21972 - DNA, 15 bp, Homo sapiens
ccagcaggatctgct

SEQ ID NO: 21973 - DNA, 15 bp, Homo sapiens
accagcaggatctgc

SEQ ID NO: 21974 - DNA, 15 bp, Homo sapiens
aaccagcaggatctg

SEQ ID NO: 21975 - DNA, 15 bp, Homo sapiens
gaaccagcaggatct

SEQ ID NO: 21976 - DNA, 15 bp, Homo sapiens
agaaccagcaggatc

SEQ ID NO: 21977 - DNA, 15 bp, Homo sapiens
tagaaccagcaggat

SEQ ID NO: 21978 - DNA, 15 bp, Homo sapiens
atagaaccagcagga

SEQ ID NO: 21979 - DNA, 15 bp, Homo sapiens
aatagaaccagcagg

SEQ ID NO: 21980 - DNA, 15 bp, Homo sapiens
aaatagaaccagcag

SEQ ID NO: 21981 - DNA, 15 bp, Homo sapiens
aaaatagaaccagca

SEQ ID NO: 21982 - DNA, 15 bp, Homo sapiens
gaaaatagaaccagc

SEQ ID NO: 21983 - DNA, 15 bp, Homo sapiens
ggaaaatagaaccag

SEQ ID NO: 21984 - DNA, 15 bp, Homo sapiens
aggaaaatagaacca

SEQ ID NO: 21985 - DNA, 15 bp, Homo sapiens
taggaaaatagaacc

SEQ ID NO: 21986 - DNA, 15 bp, Homo sapiens
ttaggaaaatagaac

SEQ ID NO: 21987 - DNA, 15 bp, Homo sapiens
attaggaaaatagaa

SEQ ID NO: 21988 - DNA, 15 bp, Homo sapiens
tattaggaaaataga

SEQ ID NO: 21989 - DNA, 15 bp, Homo sapiens
gtattaggaaaatag

SEQ ID NO: 21990 - DNA, 15 bp, Homo sapiens
agtattaggaaaata

SEQ ID NO: 21991 - DNA, 15 bp, Homo sapiens
cagtattaggaaaat

SEQ ID NO: 21992 - DNA, 15 bp, Homo sapiens
tcagtattaggaaaa

SEQ ID NO: 21993 - DNA, 15 bp, Homo sapiens
ttcagtattaggaaa

SEQ ID NO: 21994 - DNA, 15 bp, Homo sapiens
attcagtattaggaa

SEQ ID NO: 21995 - DNA, 15 bp, Homo sapiens
aattcagtattagga

SEQ ID NO: 21996 - DNA, 15 bp, Homo sapiens
aaattcagtattagg

SEQ ID NO: 21997 - DNA, 15 bp, Homo sapiens
taaattcagtattag

SEQ ID NO: 21998 - DNA, 15 bp, Homo sapiens
ataaattcagtatta

SEQ ID NO: 21999 - DNA, 15 bp, Homo sapiens
tataaattcagtatt

SEQ ID NO: 22000 - DNA, 15 bp, Homo sapiens
gtataaattcagtat

SEQ ID NO: 22001 - DNA, 15 bp, Homo sapiens
tgtataaattcagta

SEQ ID NO: 22002 - DNA, 15 bp, Homo sapiens
ctgtataaattcagt

SEQ ID NO: 22003 - DNA, 15 bp, Homo sapiens
tctgtataaattcag

SEQ ID NO: 22004 - DNA, 15 bp, Homo sapiens
ttctgtataaattca

SEQ ID NO: 22005 - DNA, 15 bp, Homo sapiens
attctgtataaattc

SEQ ID NO: 22006 - DNA, 15 bp, Homo sapiens
gattctgtataaatt

SEQ ID NO: 22007 - DNA, 15 bp, Homo sapiens
ggattctgtataaat

SEQ ID NO: 22008 - DNA, 15 bp, Homo sapiens
cggattctgtataaa

SEQ ID NO: 22009 - DNA, 15 bp, Homo sapiens
ccggattctgtataa

SEQ ID NO: 22010 - DNA, 15 bp, Homo sapiens
accggattctgtata

SEQ ID NO: 22011 - DNA, 15 bp, Homo sapiens
gaccggattctgtat

SEQ ID NO: 22012 - DNA, 15 bp, Homo sapiens
tgaccggattctgta

SEQ ID NO: 22013 - DNA, 15 bp, Homo sapiens
atgaccggattctgt

SEQ ID NO: 22014 - DNA, 15 bp, Homo sapiens
tatgaccggattctg

SEQ ID NO: 22015 - DNA, 15 bp, Homo sapiens
atatgaccggattct

SEQ ID NO: 22016 - DNA, 15 bp, Homo sapiens
aatatgaccggattc

SEQ ID NO: 22017 - DNA, 15 bp, Homo sapiens
aaatatgaccggatt

SEQ ID NO: 22018 - DNA, 15 bp, Homo sapiens
aaaatatgaccggat

SEQ ID NO: 22019 - DNA, 15 bp, Homo sapiens
taaaatatgaccgga

SEQ ID NO: 22020 - DNA, 15 bp, Homo sapiens
gtaaaatatgaccgg

SEQ ID NO: 22021 - DNA, 15 bp, Homo sapiens
cgtaaaatatgaccg

SEQ ID NO: 22022 - DNA, 15 bp, Homo sapiens
tcgtaaaatatgacc

SEQ ID NO: 22023 - DNA, 15 bp, Homo sapiens
atcgtaaaatatgac

SEQ ID NO: 22024 - DNA, 15 bp, Homo sapiens
gatcgtaaaatatga

SEQ ID NO: 22025 - DNA, 15 bp, Homo sapiens
agatcgtaaaatatg

SEQ ID NO: 22026 - DNA, 15 bp, Homo sapiens
gagatcgtaaaatat

SEQ ID NO: 22027 - DNA, 15 bp, Homo sapiens
ggagatcgtaaaata

SEQ ID NO: 22028 - DNA, 15 bp, Homo sapiens
tggagatcgtaaaat

SEQ ID NO: 22029 - DNA, 15 bp, Homo sapiens
gtggagatcgtaaaa

SEQ ID NO: 22030 - DNA, 15 bp, Homo sapiens
agtggagatcgtaaa

SEQ ID NO: 22031 - DNA, 15 bp, Homo sapiens
cagtggagatcgtaa

SEQ ID NO: 22032 - DNA, 15 bp, Homo sapiens
gcagtggagatcgta

SEQ ID NO: 22033 - DNA, 15 bp, Homo sapiens
agcagtggagatcgt

SEQ ID NO: 22034 - DNA, 15 bp, Homo sapiens
tagcagtggagatcg

SEQ ID NO: 22035 - DNA, 15 bp, Homo sapiens
gtagcagtggagatc

SEQ ID NO: 22036 - DNA, 15 bp, Homo sapiens
agtagcagtggagat

SEQ ID NO: 22037 - DNA, 15 bp, Homo sapiens
cagtagcagtggaga

SEQ ID NO: 22038 - DNA, 15 bp, Homo sapiens
acagtagcagtggag

SEQ ID NO: 22039 - DNA, 15 bp, Homo sapiens
gacagtagcagtgga

SEQ ID NO: 22040 - DNA, 15 bp, Homo sapiens
ggacagtagcagtgg

SEQ ID NO: 22041 - DNA, 15 bp, Homo sapiens
aggacagtagcagtg

SEQ ID NO: 22042 - DNA, 15 bp, Homo sapiens
caggacagtagcagt

SEQ ID NO: 22043 - DNA, 15 bp, Homo sapiens
ccaggacagtagcag

SEQ ID NO: 22044 - DNA, 15 bp, Homo sapiens
accaggacagtagca

SEQ ID NO: 22045 - DNA, 15 bp, Homo sapiens
gaccaggacagtagc

SEQ ID NO: 22046 - DNA, 15 bp, Homo sapiens
agaccaggacagtag

SEQ ID NO: 22047 - DNA, 15 bp, Homo sapiens
tagaccaggacagta

SEQ ID NO: 22048 - DNA, 15 bp, Homo sapiens
ctagaccaggacagt

SEQ ID NO: 22049 - DNA, 15 bp, Homo sapiens
cctagaccaggacag

SEQ ID NO: 22050 - DNA, 15 bp, Homo sapiens
ccctagaccaggaca

SEQ ID NO: 22051 - DNA, 15 bp, Homo sapiens
cccctagaccaggac

SEQ ID NO: 22052 - DNA, 15 bp, Homo sapiens
tcccctagaccagga

SEQ ID NO: 22053 - DNA, 15 bp, Homo sapiens
gtcccctagaccagg

SEQ ID NO: 22054 - DNA, 15 bp, Homo sapiens
ggtcccctagaccag

SEQ ID NO: 22055 - DNA, 15 bp, Homo sapiens
tggtcccctagacca

SEQ ID NO: 22056 - DNA, 15 bp, Homo sapiens
atggtcccctagacc

SEQ ID NO: 22057 - DNA, 15 bp, Homo sapiens
aatggtcccctagac

SEQ ID NO: 22058 - DNA, 15 bp, Homo sapiens
caatggtcccctaga

SEQ ID NO: 22059 - DNA, 15 bp, Homo sapiens
gcaatggtcccctag

SEQ ID NO: 22060 - DNA, 15 bp, Homo sapiens
agcaatggtccccta

SEQ ID NO: 22061 - DNA, 15 bp, Homo sapiens
aagcaatggtcccct

SEQ ID NO: 22062 - DNA, 15 bp, Homo sapiens
aaagcaatggtcccc

SEQ ID NO: 22063 - DNA, 15 bp, Homo sapiens
aaaagcaatggtccc

SEQ ID NO: 22064 - DNA, 15 bp, Homo sapiens
aaaaagcaatggtcc

SEQ ID NO: 22065 - DNA, 15 bp, Homo sapiens
gaaaaagcaatggtc

SEQ ID NO: 22066 - DNA, 15 bp, Homo sapiens
agaaaaagcaatggt

SEQ ID NO: 22067 - DNA, 15 bp, Homo sapiens
cagaaaaagcaatgg

SEQ ID NO: 22068 - DNA, 15 bp, Homo sapiens
ccagaaaaagcaatg

SEQ ID NO: 22069 - DNA, 15 bp, Homo sapiens
tccagaaaaagcaat

SEQ ID NO: 22070 - DNA, 15 bp, Homo sapiens
ttccagaaaaagcaa

SEQ ID NO: 22071 - DNA, 15 bp, Homo sapiens
attccagaaaaagca

SEQ ID NO: 22072 - DNA, 15 bp, Homo sapiens
aattccagaaaaagc

SEQ ID NO: 22073 - DNA, 15 bp, Homo sapiens
caattccagaaaaag

SEQ ID NO: 22074 - DNA, 15 bp, Homo sapiens
gcaattccagaaaaa

SEQ ID NO: 22075 - DNA, 15 bp, Homo sapiens
ggcaattccagaaaa

SEQ ID NO: 22076 - DNA, 15 bp, Homo sapiens
aggcaattccagaaa

SEQ ID NO: 22077 - DNA, 15 bp, Homo sapiens
gaggcaattccagaa

SEQ ID NO: 22078 - DNA, 15 bp, Homo sapiens
ggaggcaattccaga

SEQ ID NO: 22079 - DNA, 15 bp, Homo sapiens
aggaggcaattccag

SEQ ID NO: 22080 - DNA, 15 bp, Homo sapiens
aaggaggcaattcca

SEQ ID NO: 22081 - DNA, 15 bp, Homo sapiens
taaggaggcaattcc

SEQ ID NO: 22082 - DNA, 15 bp, Homo sapiens
gtaaggaggcaattc

SEQ ID NO: 22083 - DNA, 15 bp, Homo sapiens
agtaaggaggcaatt

SEQ ID NO: 22084 - DNA, 15 bp, Homo sapiens
aagtaaggaggcaat

SEQ ID NO: 22085 - DNA, 15 bp, Homo sapiens
caagtaaggaggcaa

SEQ ID NO: 22086 - DNA, 15 bp, Homo sapiens
acaagtaaggaggca

SEQ ID NO: 22087 - DNA, 15 bp, Homo sapiens
gacaagtaaggaggc

SEQ ID NO: 22088 - DNA, 15 bp, Homo sapiens
agacaagtaaggagg

SEQ ID NO: 22089 - DNA, 15 bp, Homo sapiens
gagacaagtaaggag

SEQ ID NO: 22090 - DNA, 15 bp, Homo sapiens
agagacaagtaagga

SEQ ID NO: 22091 - DNA, 15 bp, Homo sapiens
gagagacaagtaagg

SEQ ID NO: 22092 - DNA, 15 bp, Homo sapiens
agagagacaagtaag

SEQ ID NO: 22093 - DNA, 15 bp, Homo sapiens
cagagagacaagtaa

SEQ ID NO: 22094 - DNA, 15 bp, Homo sapiens
gcagagagacaagta

SEQ ID NO: 22095 - DNA, 15 bp, Homo sapiens
agcagagagacaagt

SEQ ID NO: 22096 - DNA, 15 bp, Homo sapiens
aagcagagagacaag

SEQ ID NO: 22097 - DNA, 15 bp, Homo sapiens
gaagcagagagacaa

SEQ ID NO: 22098 - DNA, 15 bp, Homo sapiens
ggaagcagagagaca

SEQ ID NO: 22099 - DNA, 15 bp, Homo sapiens
aggaagcagagagac

SEQ ID NO: 22100 - DNA, 15 bp, Homo sapiens
gaggaagcagagaga

SEQ ID NO: 22101 - DNA, 15 bp, Homo sapiens
ggaggaagcagagag

SEQ ID NO: 22102 - DNA, 15 bp, Homo sapiens
gggaggaagcagaga

SEQ ID NO: 22103 - DNA, 15 bp, Homo sapiens
agggaggaagcagag

SEQ ID NO: 22104 - DNA, 15 bp, Homo sapiens
aagggaggaagcaga

SEQ ID NO: 22105 - DNA, 15 bp, Homo sapiens
caagggaggaagcag

SEQ ID NO: 22106 - DNA, 15 bp, Homo sapiens
ccaagggaggaagca

SEQ ID NO: 22107 - DNA, 15 bp, Homo sapiens
gccaagggaggaagc

SEQ ID NO: 22108 - DNA, 15 bp, Homo sapiens
ggccaagggaggaag

SEQ ID NO: 22109 - DNA, 15 bp, Homo sapiens
gggccaagggaggaa

SEQ ID NO: 22110 - DNA, 15 bp, Homo sapiens
tgggccaagggagga

SEQ ID NO: 22111 - DNA, 15 bp, Homo sapiens
atgggccaagggagg

SEQ ID NO: 22112 - DNA, 15 bp, Homo sapiens
catgggccaagggag

SEQ ID NO: 22113 - DNA, 15 bp, Homo sapiens
ccatgggccaaggga

SEQ ID NO: 22114 - DNA, 15 bp, Homo sapiens
tccatgggccaaggg

SEQ ID NO: 22115 - DNA, 15 bp, Homo sapiens
ctccatgggccaagg

SEQ ID NO: 22116 - DNA, 15 bp, Homo sapiens
cctccatgggccaag

SEQ ID NO: 22117 - DNA, 15 bp, Homo sapiens
gcctccatgggccaa

SEQ ID NO: 22118 - DNA, 15 bp, Homo sapiens
agcctccatgggcca

SEQ ID NO: 22119 - DNA, 15 bp, Homo sapiens
cagcctccatgggcc

SEQ ID NO: 22120 - DNA, 15 bp, Homo sapiens
ccagcctccatgggc

SEQ ID NO: 22121 - DNA, 15 bp, Homo sapiens
accagcctccatggg

SEQ ID NO: 22122 - DNA, 15 bp, Homo sapiens
gaccagcctccatgg

SEQ ID NO: 22123 - DNA, 15 bp, Homo sapiens
agaccagcctccatg

SEQ ID NO: 22124 - DNA, 15 bp, Homo sapiens
cagaccagcctccat

SEQ ID NO: 22125 - DNA, 15 bp, Homo sapiens
tcagaccagcctcca

SEQ ID NO: 22126 - DNA, 15 bp, Homo sapiens
ttcagaccagcctcc

SEQ ID NO: 22127 - DNA, 15 bp, Homo sapiens
gttcagaccagcctc

SEQ ID NO: 22128 - DNA, 15 bp, Homo sapiens
ggttcagaccagcct

SEQ ID NO: 22129 - DNA, 15 bp, Homo sapiens
gggttcagaccagcc

SEQ ID NO: 22130 - DNA, 15 bp, Homo sapiens
ggggttcagaccagc

SEQ ID NO: 22131 - DNA, 15 bp, Homo sapiens
tggggttcagaccag

SEQ ID NO: 22132 - DNA, 15 bp, Homo sapiens
gtggggttcagacca

SEQ ID NO: 22133 - DNA, 15 bp, Homo sapiens
tgtggggttcagacc

SEQ ID NO: 22134 - DNA, 15 bp, Homo sapiens
ctgtggggttcagac

SEQ ID NO: 22135 - DNA, 15 bp, Homo sapiens
actgtggggttcaga

SEQ ID NO: 22136 - DNA, 15 bp, Homo sapiens
tactgtggggttcag

SEQ ID NO: 22137 - DNA, 15 bp, Homo sapiens
ctactgtggggttca

SEQ ID NO: 22138 - DNA, 15 bp, Homo sapiens
tctactgtggggttc

SEQ ID NO: 22139 - DNA, 15 bp, Homo sapiens
ctctactgtggggtt

SEQ ID NO: 22140 - DNA, 15 bp, Homo sapiens
cctctactgtggggt

SEQ ID NO: 22141 - DNA, 15 bp, Homo sapiens
ccctctactgtgggg

SEQ ID NO: 22142 - DNA, 15 bp, Homo sapiens
tccctctactgtggg

SEQ ID NO: 22143 - DNA, 15 bp, Homo sapiens
atccctctactgtgg

SEQ ID NO: 22144 - DNA, 15 bp, Homo sapiens
gatccctctactgtg

SEQ ID NO: 22145 - DNA, 15 bp, Homo sapiens
ggatccctctactgt

SEQ ID NO: 22146 - DNA, 15 bp, Homo sapiens
aggatccctctactg

SEQ ID NO: 22147 - DNA, 15 bp, Homo sapiens
aaggatccctctact

SEQ ID NO: 22148 - DNA, 15 bp, Homo sapiens
aaaggatccctctac

SEQ ID NO: 22149 - DNA, 15 bp, Homo sapiens
aaaaggatccctcta

SEQ ID NO: 22150 - DNA, 15 bp, Homo sapiens
gaaaaggatccctct

SEQ ID NO: 22151 - DNA, 15 bp, Homo sapiens
tgaaaaggatccctc

SEQ ID NO: 22152 - DNA, 15 bp, Homo sapiens
ttgaaaaggatccct

SEQ ID NO: 22153 - DNA, 15 bp, Homo sapiens
tttgaaaaggatccc

SEQ ID NO: 22154 - DNA, 15 bp, Homo sapiens
atttgaaaaggatcc

SEQ ID NO: 22155 - DNA, 15 bp, Homo sapiens
gatttgaaaaggatc

SEQ ID NO: 22156 - DNA, 15 bp, Homo sapiens
tgatttgaaaaggat

SEQ ID NO: 22157 - DNA, 15 bp, Homo sapiens
ctgatttgaaaagga

SEQ ID NO: 22158 - DNA, 15 bp, Homo sapiens
tctgatttgaaaagg

SEQ ID NO: 22159 - DNA, 15 bp, Homo sapiens
ttctgatttgaaaag

SEQ ID NO: 22160 - DNA, 15 bp, Homo sapiens
cttctgatttgaaaa

SEQ ID NO: 22161 - DNA, 15 bp, Homo sapiens
acttctgatttgaaa

SEQ ID NO: 22162 - DNA, 15 bp, Homo sapiens
cacttctgatttgaa

SEQ ID NO: 22163 - DNA, 15 bp, Homo sapiens
ccacttctgatttga

SEQ ID NO: 22164 - DNA, 15 bp, Homo sapiens
tccacttctgatttg

SEQ ID NO: 22165 - DNA, 15 bp, Homo sapiens
atccacttctgattt

SEQ ID NO: 22166 - DNA, 15 bp, Homo sapiens
tatccacttctgatt

SEQ ID NO: 22167 - DNA, 15 bp, Homo sapiens
atatccacttctgat

SEQ ID NO: 22168 - DNA, 15 bp, Homo sapiens
catatccacttctga

SEQ ID NO: 22169 - DNA, 15 bp, Homo sapiens
acatatccacttctg

SEQ ID NO: 22170 - DNA, 15 bp, Homo sapiens
aacatatccacttct

SEQ ID NO: 22171 - DNA, 15 bp, Homo sapiens
caacatatccacttc

SEQ ID NO: 22172 - DNA, 15 bp, Homo sapiens
gcaacatatccactt

SEQ ID NO: 22173 - DNA, 15 bp, Homo sapiens
agcaacatatccact

SEQ ID NO: 22174 - DNA, 15 bp, Homo sapiens
aagcaacatatccac

SEQ ID NO: 22175 - DNA, 15 bp, Homo sapiens
gaagcaacatatcca

SEQ ID NO: 22176 - DNA, 15 bp, Homo sapiens
tgaagcaacatatcc

SEQ ID NO: 22177 - DNA, 15 bp, Homo sapiens
ctgaagcaacatatc

SEQ ID NO: 22178 - DNA, 15 bp, Homo sapiens
cctgaagcaacatat

SEQ ID NO: 22179 - DNA, 15 bp, Homo sapiens
acctgaagcaacata

SEQ ID NO: 22180 - DNA, 15 bp, Homo sapiens
aacctgaagcaacat

SEQ ID NO: 22181 - DNA, 15 bp, Homo sapiens
aaacctgaagcaaca

SEQ ID NO: 22182 - DNA, 15 bp, Homo sapiens
gaaacctgaagcaac

SEQ ID NO: 22183 - DNA, 15 bp, Homo sapiens
ggaaacctgaagcaa

SEQ ID NO: 22184 - DNA, 15 bp, Homo sapiens
tggaaacctgaagca

SEQ ID NO: 22185 - DNA, 15 bp, Homo sapiens
ttggaaacctgaagc

SEQ ID NO: 22186 - DNA, 15 bp, Homo sapiens
cttggaaacctgaag

SEQ ID NO: 22187 - DNA, 15 bp, Homo sapiens
acttggaaacctgaa

SEQ ID NO: 22188 - DNA, 15 bp, Homo sapiens
gacttggaaacctga

SEQ ID NO: 22189 - DNA, 15 bp, Homo sapiens
agacttggaaacctg

SEQ ID NO: 22190 - DNA, 15 bp, Homo sapiens
cagacttggaaacct

SEQ ID NO: 22191 - DNA, 15 bp, Homo sapiens
gcagacttggaaacc

SEQ ID NO: 22192 - DNA, 15 bp, Homo sapiens
tgcagacttggaaac

SEQ ID NO: 22193 - DNA, 15 bp, Homo sapiens
ctgcagacttggaaa

SEQ ID NO: 22194 - DNA, 15 bp, Homo sapiens
actgcagacttggaa

SEQ ID NO: 22195 - DNA, 15 bp, Homo sapiens
cactgcagacttgga

SEQ ID NO: 22196 - DNA, 15 bp, Homo sapiens
tcactgcagacttgg

SEQ ID NO: 22197 - DNA, 15 bp, Homo sapiens
gtcactgcagacttg

SEQ ID NO: 22198 - DNA, 15 bp, Homo sapiens
agtcactgcagactt

SEQ ID NO: 22199 - DNA, 15 bp, Homo sapiens
gagtcactgcagact

SEQ ID NO: 22200 - DNA, 15 bp, Homo sapiens
ggagtcactgcagac

SEQ ID NO: 22201 - DNA, 15 bp, Homo sapiens
gggagtcactgcaga

SEQ ID NO: 22202 - DNA, 15 bp, Homo sapiens
ggggagtcactgcag

SEQ ID NO: 22203 - DNA, 15 bp, Homo sapiens
tggggagtcactgca

SEQ ID NO: 22204 - DNA, 15 bp, Homo sapiens
atggggagtcactgc

SEQ ID NO: 22205 - DNA, 15 bp, Homo sapiens
aatggggagtcactg

SEQ ID NO: 22206 - DNA, 15 bp, Homo sapiens
gaatggggagtcact

SEQ ID NO: 22207 - DNA, 15 bp, Homo sapiens
ggaatggggagtcac

SEQ ID NO: 22208 - DNA, 15 bp, Homo sapiens
tggaatggggagtca

SEQ ID NO: 22209 - DNA, 15 bp, Homo sapiens
ctggaatggggagtc

SEQ ID NO: 22210 - DNA, 15 bp, Homo sapiens
actggaatggggagt

SEQ ID NO: 22211 - DNA, 15 bp, Homo sapiens
aactggaatggggag

SEQ ID NO: 22212 - DNA, 15 bp, Homo sapiens
caactggaatgggga

SEQ ID NO: 22213 - DNA, 15 bp, Homo sapiens
acaactggaatgggg

SEQ ID NO: 22214 - DNA, 15 bp, Homo sapiens
tacaactggaatggg

SEQ ID NO: 22215 - DNA, 15 bp, Homo sapiens
ttacaactggaatgg

SEQ ID NO: 22216 - DNA, 15 bp, Homo sapiens
attacaactggaatg

SEQ ID NO: 22217 - DNA, 15 bp, Homo sapiens
tattacaactggaat

SEQ ID NO: 22218 - DNA, 15 bp, Homo sapiens
ttattacaactggaa

SEQ ID NO: 22219 - DNA, 15 bp, Homo sapiens
tttattacaactgga

SEQ ID NO: 22220 - DNA, 15 bp, Homo sapiens
gtttattacaactgg

SEQ ID NO: 22221 - DNA, 15 bp, Homo sapiens
cgtttattacaactg

SEQ ID NO: 22222 - DNA, 15 bp, Homo sapiens
gcgtttattacaact

SEQ ID NO: 22223 - DNA, 15 bp, Homo sapiens
cgcgtttattacaac

SEQ ID NO: 22224 - DNA, 15 bp, Homo sapiens
tcgcgtttattacaa

SEQ ID NO: 22225 - DNA, 15 bp, Homo sapiens
ttcgcgtttattaca

SEQ ID NO: 22226 - DNA, 15 bp, Homo sapiens
tttcgcgtttattac

SEQ ID NO: 22227 - DNA, 15 bp, Homo sapiens
ctttcgcgtttatta

SEQ ID NO: 22228 - DNA, 15 bp, Homo sapiens
tctttcgcgtttatt

SEQ ID NO: 22229 - DNA, 15 bp, Homo sapiens
gtctttcgcgtttat

SEQ ID NO: 22230 - DNA, 15 bp, Homo sapiens
ggtctttcgcgttta

SEQ ID NO: 22231 - DNA, 15 bp, Homo sapiens
aggtctttcgcgttt

SEQ ID NO: 22232 - DNA, 15 bp, Homo sapiens
aaggtctttcgcgtt

SEQ ID NO: 22233 - DNA, 15 bp, Homo sapiens
taaggtctttcgcgt

SEQ ID NO: 22234 - DNA, 15 bp, Homo sapiens
gtaaggtctttcgcg

SEQ ID NO: 22235 - DNA, 15 bp, Homo sapiens
tgtaaggtctttcgc

SEQ ID NO: 22236 - DNA, 15 bp, Homo sapiens
ctgtaaggtctttcg

SEQ ID NO: 22237 - DNA, 15 bp, Homo sapiens
actgtaaggtctttc

SEQ ID NO: 22238 - DNA, 15 bp, Homo sapiens
cactgtaaggtcttt

SEQ ID NO: 22239 - DNA, 15 bp, Homo sapiens
tcactgtaaggtctt

SEQ ID NO: 22240 - DNA, 15 bp, Homo sapiens
atcactgtaaggtct

SEQ ID NO: 22241 - DNA, 15 bp, Homo sapiens
gatcactgtaaggtc

SEQ ID NO: 22242 - DNA, 15 bp, Homo sapiens
agatcactgtaaggt

SEQ ID NO: 22243 - DNA, 15 bp, Homo sapiens
tagatcactgtaagg

SEQ ID NO: 22244 - DNA, 15 bp, Homo sapiens
gtagatcactgtaag

SEQ ID NO: 22245 - DNA, 15 bp, Homo sapiens
tgtagatcactgtaa

SEQ ID NO: 22246 - DNA, 15 bp, Homo sapiens
ctgtagatcactgta

SEQ ID NO: 22247 - DNA, 15 bp, Homo sapiens
cctgtagatcactgt

SEQ ID NO: 22248 - DNA, 15 bp, Homo sapiens
tcctgtagatcactg

SEQ ID NO: 22249 - DNA, 15 bp, Homo sapiens
gtcctgtagatcact

SEQ ID NO: 22250 - DNA, 15 bp, Homo sapiens
ggtcctgtagatcac

SEQ ID NO: 22251 - DNA, 15 bp, Homo sapiens
gggtcctgtagatca

SEQ ID NO: 22252 - DNA, 15 bp, Homo sapiens
agggtcctgtagatc

SEQ ID NO: 22253 - DNA, 15 bp, Homo sapiens
cagggtcctgtagat

SEQ ID NO: 22254 - DNA, 15 bp, Homo sapiens
acagggtcctgtaga

SEQ ID NO: 22255 - DNA, 15 bp, Homo sapiens
aacagggtcctgtag

SEQ ID NO: 22256 - DNA, 15 bp, Homo sapiens
aaacagggtcctgta

SEQ ID NO: 22257 - DNA, 15 bp, Homo sapiens
taaacagggtcctgt

SEQ ID NO: 22258 - DNA, 15 bp, Homo sapiens
ataaacagggtcctg

SEQ ID NO: 22259 - DNA, 15 bp, Homo sapiens
gataaacagggtcct

SEQ ID NO: 22260 - DNA, 15 bp, Homo sapiens
ggataaacagggtcc

SEQ ID NO: 22261 - DNA, 15 bp, Homo sapiens
aggataaacagggtc

SEQ ID NO: 22262 - DNA, 15 bp, Homo sapiens
caggataaacagggt

SEQ ID NO: 22263 - DNA, 15 bp, Homo sapiens
gcaggataaacaggg

SEQ ID NO: 22264 - DNA, 15 bp, Homo sapiens
ggcaggataaacagg

SEQ ID NO: 22265 - DNA, 15 bp, Homo sapiens
aggcaggataaacag

SEQ ID NO: 22266 - DNA, 15 bp, Homo sapiens
caggcaggataaaca

SEQ ID NO: 22267 - DNA, 15 bp, Homo sapiens
ccaggcaggataaac

SEQ ID NO: 22268 - DNA, 15 bp, Homo sapiens
gccaggcaggataaa

SEQ ID NO: 22269 - DNA, 15 bp, Homo sapiens
agccaggcaggataa

SEQ ID NO: 22270 - DNA, 15 bp, Homo sapiens
aagccaggcaggata

SEQ ID NO: 22271 - DNA, 15 bp, Homo sapiens
gaagccaggcaggat

SEQ ID NO: 22272 - DNA, 15 bp, Homo sapiens
tgaagccaggcagga

SEQ ID NO: 22273 - DNA, 15 bp, Homo sapiens
atgaagccaggcagg

SEQ ID NO: 22274 - DNA, 15 bp, Homo sapiens
gatgaagccaggcag

SEQ ID NO: 22275 - DNA, 15 bp, Homo sapiens
agatgaagccaggca

SEQ ID NO: 22276 - DNA, 15 bp, Homo sapiens
gagatgaagccaggc

SEQ ID NO: 22277 - DNA, 15 bp, Homo sapiens
ggagatgaagccagg

SEQ ID NO: 22278 - DNA, 15 bp, Homo sapiens
gggagatgaagccag

SEQ ID NO: 22279 - DNA, 15 bp, Homo sapiens
ggggagatgaagcca

SEQ ID NO: 22280 - DNA, 15 bp, Homo sapiens
aggggagatgaagcc

SEQ ID NO: 22281 - DNA, 15 bp, Homo sapiens
aaggggagatgaagc

SEQ ID NO: 22282 - DNA, 15 bp, Homo sapiens
taaggggagatgaag

SEQ ID NO: 22283 - DNA, 15 bp, Homo sapiens
gtaaggggagatgaa

SEQ ID NO: 22284 - DNA, 15 bp, Homo sapiens
agtaaggggagatga

SEQ ID NO: 22285 - DNA, 15 bp, Homo sapiens
tagtaaggggagatg

SEQ ID NO: 22286 - DNA, 15 bp, Homo sapiens
ctagtaaggggagat

SEQ ID NO: 22287 - DNA, 15 bp, Homo sapiens
actagtaaggggaga

SEQ ID NO: 22288 - DNA, 15 bp, Homo sapiens
aactagtaaggggag

SEQ ID NO: 22289 - DNA, 15 bp, Homo sapiens
aaactagtaagggga

SEQ ID NO: 22290 - DNA, 15 bp, Homo sapiens
caaactagtaagggg

SEQ ID NO: 22291 - DNA, 15 bp, Homo sapiens
acaaactagtaaggg

SEQ ID NO: 22292 - DNA, 15 bp, Homo sapiens
cacaaactagtaagg

SEQ ID NO: 22293 - DNA, 15 bp, Homo sapiens
gcacaaactagtaag

SEQ ID NO: 22294 - DNA, 15 bp, Homo sapiens
agcacaaactagtaa

SEQ ID NO: 22295 - DNA, 15 bp, Homo sapiens
gagcacaaactagta

SEQ ID NO: 22296 - DNA, 15 bp, Homo sapiens
tgagcacaaactagt

SEQ ID NO: 22297 - DNA, 15 bp, Homo sapiens
atgagcacaaactag

SEQ ID NO: 22298 - DNA, 15 bp, Homo sapiens
aatgagcacaaacta

SEQ ID NO: 22299 - DNA, 15 bp, Homo sapiens
taatgagcacaaact

SEQ ID NO: 22300 - DNA, 15 bp, Homo sapiens
ataatgagcacaaac

SEQ ID NO: 22301 - DNA, 15 bp, Homo sapiens
tataatgagcacaaa

SEQ ID NO: 22302 - DNA, 15 bp, Homo sapiens
atataatgagcacaa

SEQ ID NO: 22303 - DNA, 15 bp, Homo sapiens
catataatgagcaca

SEQ ID NO: 22304 - DNA, 15 bp, Homo sapiens
tcatataatgagcac

SEQ ID NO: 22305 - DNA, 15 bp, Homo sapiens
ctcatataatgagca

SEQ ID NO: 22306 - DNA, 15 bp, Homo sapiens
cctcatataatgagc

SEQ ID NO: 22307 - DNA, 15 bp, Homo sapiens
gcctcatataatgag

SEQ ID NO: 22308 - DNA, 15 bp, Homo sapiens
tgcctcatataatga

SEQ ID NO: 22309 - DNA, 15 bp, Homo sapiens
ctgcctcatataatg

SEQ ID NO: 22310 - DNA, 15 bp, Homo sapiens
cctgcctcatataat

SEQ ID NO: 22311 - DNA, 15 bp, Homo sapiens
gcctgcctcatataa

SEQ ID NO: 22312 - DNA, 15 bp, Homo sapiens
tgcctgcctcatata

SEQ ID NO: 22313 - DNA, 15 bp, Homo sapiens
tgtgcctcagcctcc

SEQ ID NO: 22314 - DNA, 15 bp, Homo sapiens
ttgtgcctcagcctc

SEQ ID NO: 22315 - DNA, 15 bp, Homo sapiens
cttgtgcctcagcct

SEQ ID NO: 22316 - DNA, 15 bp, Homo sapiens
tcttgtgcctcagcc

SEQ ID NO: 22317 - DNA, 15 bp, Homo sapiens
ttcttgtgcctcagc

SEQ ID NO: 22318 - DNA, 15 bp, Homo sapiens
attcttgtgcctcag

SEQ ID NO: 22319 - DNA, 15 bp, Homo sapiens
gattcttgtgcctca

SEQ ID NO: 22320 - DNA, 15 bp, Homo sapiens
cgattcttgtgcctc

SEQ ID NO: 22321 - DNA, 15 bp, Homo sapiens
gcgattcttgtgcct

SEQ ID NO: 22322 - DNA, 15 bp, Homo sapiens
agcgattcttgtgcc

SEQ ID NO: 22323 - DNA, 15 bp, Homo sapiens
aagcgattcttgtgc

SEQ ID NO: 22324 - DNA, 15 bp, Homo sapiens
caagcgattcttgtg

SEQ ID NO: 22325 - DNA, 15 bp, Homo sapiens
tcaagcgattcttgt

SEQ ID NO: 22326 - DNA, 15 bp, Homo sapiens
ttcaagcgattcttg

SEQ ID NO: 22327 - DNA, 15 bp, Homo sapiens
gttcaagcgattctt

SEQ ID NO: 22328 - DNA, 15 bp, Homo sapiens
gggttcaagcgattc

SEQ ID NO: 22329 - DNA, 15 bp, Homo sapiens
tgggttcaagcgatt

SEQ ID NO: 22330 - DNA, 15 bp, Homo sapiens
ctgggttcaagcgat

SEQ ID NO: 22331 - DNA, 15 bp, Homo sapiens
cctgggttcaagcga

SEQ ID NO: 22332 - DNA, 15 bp, Homo sapiens
tcctgggttcaagcg

SEQ ID NO: 22333 - DNA, 15 bp, Homo sapiens
ctcctgggttcaagc

SEQ ID NO: 22334 - DNA, 15 bp, Homo sapiens
cctcctgggttcaag

SEQ ID NO: 22335 - DNA, 15 bp, Homo sapiens
gcctcctgggttcaa

SEQ ID NO: 22336 - DNA, 15 bp, Homo sapiens
caacctctgcctcct

SEQ ID NO: 22337 - DNA, 15 bp, Homo sapiens
gcaacctctgcctcc

SEQ ID NO: 22338 - DNA, 15 bp, Homo sapiens
tgcaacctctgcctc

SEQ ID NO: 22339 - DNA, 15 bp, Homo sapiens
atgcaacctctgcct

SEQ ID NO: 22340 - DNA, 15 bp, Homo sapiens
aatgcaacctctgcc

SEQ ID NO: 22341 - DNA, 15 bp, Homo sapiens
caatgcaacctctgc

SEQ ID NO: 22342 - DNA, 15 bp, Homo sapiens
tcaatgcaacctctg

SEQ ID NO: 22343 - DNA, 15 bp, Homo sapiens
ctcaatgcaacctct

SEQ ID NO: 22344 - DNA, 15 bp, Homo sapiens
gctcaatgcaacctc

SEQ ID NO: 22345 - DNA, 15 bp, Homo sapiens
agctcaatgcaacct

SEQ ID NO: 22346 - DNA, 15 bp, Homo sapiens
cagctcaatgcaacc

SEQ ID NO: 22347 - DNA, 15 bp, Homo sapiens
tcagctcaatgcaac

SEQ ID NO: 22348 - DNA, 15 bp, Homo sapiens
ctcagctcaatgcaa

SEQ ID NO: 22349 - DNA, 15 bp, Homo sapiens
tctcagctcaatgca

SEQ ID NO: 22350 - DNA, 15 bp, Homo sapiens
atctcagctcaatgc

SEQ ID NO: 22351 - DNA, 15 bp, Homo sapiens
gatctcagctcaatg

SEQ ID NO: 22352 - DNA, 15 bp, Homo sapiens
cgatctcagctcaat

SEQ ID NO: 22353 - DNA, 15 bp, Homo sapiens
acgatctcagctcaa

SEQ ID NO: 22354 - DNA, 15 bp, Homo sapiens
cacgatctcagctca

SEQ ID NO: 22355 - DNA, 15 bp, Homo sapiens
gcacgatctcagctc

SEQ ID NO: 22356 - DNA, 15 bp, Homo sapiens
agcacgatctcagct

SEQ ID NO: 22357 - DNA, 15 bp, Homo sapiens
tagcacgatctcagc

SEQ ID NO: 22358 - DNA, 15 bp, Homo sapiens
gtagcacgatctcag

SEQ ID NO: 22359 - DNA, 15 bp, Homo sapiens
agtagcacgatctca

SEQ ID NO: 22360 - DNA, 15 bp, Homo sapiens
cagtagcacgatctc

SEQ ID NO: 22361 - DNA, 15 bp, Homo sapiens
gcagtagcacgatct

SEQ ID NO: 22362 - DNA, 15 bp, Homo sapiens
tgcagtagcacgatc

SEQ ID NO: 22363 - DNA, 15 bp, Homo sapiens
gtgcagtagcacgat

SEQ ID NO: 22364 - DNA, 15 bp, Homo sapiens
cgtgcagtagcacga

SEQ ID NO: 22365 - DNA, 15 bp, Homo sapiens
gcgtgcagtagcacg

SEQ ID NO: 22366 - DNA, 15 bp, Homo sapiens
ggcgtgcagtagcac

SEQ ID NO: 22367 - DNA, 15 bp, Homo sapiens
tggcgtgcagtagca

SEQ ID NO: 22368 - DNA, 15 bp, Homo sapiens
ctggcgtgcagtagc

SEQ ID NO: 22369 - DNA, 15 bp, Homo sapiens
gctggcgtgcagtag

SEQ ID NO: 22370 - DNA, 15 bp, Homo sapiens
ggctggcgtgcagta

SEQ ID NO: 22371 - DNA, 15 bp, Homo sapiens
aggctggcgtgcagt

SEQ ID NO: 22372 - DNA, 15 bp, Homo sapiens
caggctggcgtgcag

SEQ ID NO: 22373 - DNA, 15 bp, Homo sapiens
ccaggctggcgtgca

SEQ ID NO: 22374 - DNA, 15 bp, Homo sapiens
tccaggctggcgtgc

SEQ ID NO: 22375 - DNA, 15 bp, Homo sapiens
atccaggctggcgtg

SEQ ID NO: 22376 - DNA, 15 bp, Homo sapiens
tatccaggctggcgt

SEQ ID NO: 22377 - DNA, 15 bp, Homo sapiens
ttatccaggctggcg

SEQ ID NO: 22378 - DNA, 15 bp, Homo sapiens
gttatccaggctggc

SEQ ID NO: 22379 - DNA, 15 bp, Homo sapiens
tgttatccaggctgg

SEQ ID NO: 22380 - DNA, 15 bp, Homo sapiens
ctgttatccaggctg

SEQ ID NO: 22381 - DNA, 15 bp, Homo sapiens
tctgttatccaggct

SEQ ID NO: 22382 - DNA, 15 bp, Homo sapiens
ctctgttatccaggc

SEQ ID NO: 22383 - DNA, 15 bp, Homo sapiens
gctctgttatccagg

SEQ ID NO: 22384 - DNA, 15 bp, Homo sapiens
tgctctgttatccag

SEQ ID NO: 22385 - DNA, 15 bp, Homo sapiens
ttgctctgttatcca

SEQ ID NO: 22386 - DNA, 15 bp, Homo sapiens
cttgctctgttatcc

SEQ ID NO: 22387 - DNA, 15 bp, Homo sapiens
tcttgctctgttatc

SEQ ID NO: 22388 - DNA, 15 bp, Homo sapiens
atcttgctctgttat

SEQ ID NO: 22389 - DNA, 15 bp, Homo sapiens
catcttgctctgtta

SEQ ID NO: 22390 - DNA, 15 bp, Homo sapiens
gcatcttgctctgtt

SEQ ID NO: 22391 - DNA, 15 bp, Homo sapiens
agcatcttgctctgt

SEQ ID NO: 22392 - DNA, 15 bp, Homo sapiens
cagcatcttgctctg

SEQ ID NO: 22393 - DNA, 15 bp, Homo sapiens
acagcatcttgctct

SEQ ID NO: 22394 - DNA, 15 bp, Homo sapiens
gacagcatcttgctc

SEQ ID NO: 22395 - DNA, 15 bp, Homo sapiens
agacagcatcttgct

SEQ ID NO: 22396 - DNA, 15 bp, Homo sapiens
gagacagcatcttgc

SEQ ID NO: 22397 - DNA, 15 bp, Homo sapiens
tgagacagcatcttg

SEQ ID NO: 22398 - DNA, 15 bp, Homo sapiens
ttgagacagcatctt

SEQ ID NO: 22399 - DNA, 15 bp, Homo sapiens
tttgagacagcatct

SEQ ID NO: 22400 - DNA, 15 bp, Homo sapiens
gtttgagacagcatc

SEQ ID NO: 22401 - DNA, 15 bp, Homo sapiens
tgtttgagacagcat

SEQ ID NO: 22402 - DNA, 15 bp, Homo sapiens
gtgtttgagacagca

SEQ ID NO: 22403 - DNA, 15 bp, Homo sapiens
tgtgtttgagacagc

SEQ ID NO: 22404 - DNA, 15 bp, Homo sapiens
ttgtgtttgagacag

SEQ ID NO: 22405 - DNA, 15 bp, Homo sapiens
tttgtgtttgagaca

SEQ ID NO: 22406 - DNA, 15 bp, Homo sapiens
gtttgtgtttgagac

SEQ ID NO: 22407 - DNA, 15 bp, Homo sapiens
tgtttgtgtttgaga

SEQ ID NO: 22408 - DNA, 15 bp, Homo sapiens
ttgtttgtgtttgag

SEQ ID NO: 22409 - DNA, 15 bp, Homo sapiens
tttgtttgtgtttga

SEQ ID NO: 22410 - DNA, 15 bp, Homo sapiens
gtttgtttgtgtttg

SEQ ID NO: 22411 - DNA, 15 bp, Homo sapiens
tgtttgtttgtgttt

SEQ ID NO: 22412 - DNA, 15 bp, Homo sapiens
ttgtttgtttgtgtt

SEQ ID NO: 22413 - DNA, 15 bp, Homo sapiens
tttgtttgtttgtgt

SEQ ID NO: 22414 - DNA, 15 bp, Homo sapiens
gtttgtttgtttgtg

SEQ ID NO: 22415 - DNA, 15 bp, Homo sapiens
tgtttgtttgtttgt

SEQ ID NO: 22416 - DNA, 15 bp, Homo sapiens
ttgtttgtttgtttg

SEQ ID NO: 22417 - DNA, 15 bp, Homo sapiens
gttttttgtttgttt

SEQ ID NO: 22418 - DNA, 15 bp, Homo sapiens
tgttttttgtttgtt

SEQ ID NO: 22419 - DNA, 15 bp, Homo sapiens
gtttgttttttgttt

SEQ ID NO: 22420 - DNA, 15 bp, Homo sapiens
tgtttgttttttgtt

SEQ ID NO: 22421 - DNA, 15 bp, Homo sapiens
ttgtttgttttttgt

SEQ ID NO: 22422 - DNA, 15 bp, Homo sapiens
cttgtttgttttttg

SEQ ID NO: 22423 - DNA, 15 bp, Homo sapiens
acttgtttgtttttt

SEQ ID NO: 22424 - DNA, 15 bp, Homo sapiens
cacttgtttgttttt

SEQ ID NO: 22425 - DNA, 15 bp, Homo sapiens
acacttgtttgtttt

SEQ ID NO: 22426 - DNA, 15 bp, Homo sapiens
cacacttgtttgttt

SEQ ID NO: 22427 - DNA, 15 bp, Homo sapiens
gcacacttgtttgtt

SEQ ID NO: 22428 - DNA, 15 bp, Homo sapiens
tgcacacttgtttgt

SEQ ID NO: 22429 - DNA, 15 bp, Homo sapiens
ttgcacacttgtttg

SEQ ID NO: 22430 - DNA, 15 bp, Homo sapiens
attgcacacttgttt

SEQ ID NO: 22431 - DNA, 15 bp, Homo sapiens
gattgcacacttgtt

SEQ ID NO: 22432 - DNA, 15 bp, Homo sapiens
ggattgcacacttgt

SEQ ID NO: 22433 - DNA, 15 bp, Homo sapiens
gggattgcacacttg

SEQ ID NO: 22434 - DNA, 15 bp, Homo sapiens
agggattgcacactt

SEQ ID NO: 22435 - DNA, 15 bp, Homo sapiens
cagggattgcacact

SEQ ID NO: 22436 - DNA, 15 bp, Homo sapiens
tcagggattgcacac

SEQ ID NO: 22437 - DNA, 15 bp, Homo sapiens
ctcagggattgcaca

SEQ ID NO: 22438 - DNA, 15 bp, Homo sapiens
tctcagggattgcac

SEQ ID NO: 22439 - DNA, 15 bp, Homo sapiens
ttctcagggattgca

SEQ ID NO: 22440 - DNA, 15 bp, Homo sapiens
tttctcagggattgc

SEQ ID NO: 22441 - DNA, 15 bp, Homo sapiens
ttttctcagggattg

SEQ ID NO: 22442 - DNA, 15 bp, Homo sapiens
tttttctcagggatt

SEQ ID NO: 22443 - DNA, 15 bp, Homo sapiens
atttttctcagggat

SEQ ID NO: 22444 - DNA, 15 bp, Homo sapiens
tatttttctcaggga

SEQ ID NO: 22445 - DNA, 15 bp, Homo sapiens
atatttttctcaggg

SEQ ID NO: 22446 - DNA, 15 bp, Homo sapiens
gatatttttctcagg

SEQ ID NO: 22447 - DNA, 15 bp, Homo sapiens
tgatatttttctcag

SEQ ID NO: 22448 - DNA, 15 bp, Homo sapiens
ctgatatttttctca

SEQ ID NO: 22449 - DNA, 15 bp, Homo sapiens
actgatatttttctc

SEQ ID NO: 22450 - DNA, 15 bp, Homo sapiens
aactgatatttttct

SEQ ID NO: 22451 - DNA, 15 bp, Homo sapiens
gaactgatatttttc

SEQ ID NO: 22452 - DNA, 15 bp, Homo sapiens
tgaactgatattttt

SEQ ID NO: 22453 - DNA, 15 bp, Homo sapiens
ttgaactgatatttt

SEQ ID NO: 22454 - DNA, 15 bp, Homo sapiens
attgaactgatattt

SEQ ID NO: 22455 - DNA, 15 bp, Homo sapiens
gattgaactgatatt

SEQ ID NO: 22456 - DNA, 15 bp, Homo sapiens
agattgaactgatat

SEQ ID NO: 22457 - DNA, 15 bp, Homo sapiens
aagattgaactgata

SEQ ID NO: 22458 - DNA, 15 bp, Homo sapiens
aaagattgaactgat

SEQ ID NO: 22459 - DNA, 15 bp, Homo sapiens
caaagattgaactga

SEQ ID NO: 22460 - DNA, 15 bp, Homo sapiens
acaaagattgaactg

SEQ ID NO: 22461 - DNA, 15 bp, Homo sapiens
aacaaagattgaact

SEQ ID NO: 22462 - DNA, 15 bp, Homo sapiens
caacaaagattgaac

SEQ ID NO: 22463 - DNA, 15 bp, Homo sapiens
tcaacaaagattgaa

SEQ ID NO: 22464 - DNA, 15 bp, Homo sapiens
atcaacaaagattga

SEQ ID NO: 22465 - DNA, 15 bp, Homo sapiens
gatcaacaaagattg

SEQ ID NO: 22466 - DNA, 15 bp, Homo sapiens
agatcaacaaagatt

SEQ ID NO: 22467 - DNA, 15 bp, Homo sapiens
aagatcaacaaagat

SEQ ID NO: 22468 - DNA, 15 bp, Homo sapiens
aaagatcaacaaaga

SEQ ID NO: 22469 - DNA, 15 bp, Homo sapiens
taaagatcaacaaag

SEQ ID NO: 22470 - DNA, 15 bp, Homo sapiens
ataaagatcaacaaa

SEQ ID NO: 22471 - DNA, 15 bp, Homo sapiens
aataaagatcaacaa

SEQ ID NO: 22472 - DNA, 15 bp, Homo sapiens
caataaagatcaaca

SEQ ID NO: 22473 - DNA, 15 bp, Homo sapiens
acaataaagatcaac

SEQ ID NO: 22474 - DNA, 15 bp, Homo sapiens
gacaataaagatcaa

SEQ ID NO: 22475 - DNA, 15 bp, Homo sapiens
ggacaataaagatca

SEQ ID NO: 22476 - DNA, 15 bp, Homo sapiens
gggacaataaagatc

SEQ ID NO: 22477 - DNA, 15 bp, Homo sapiens
cgggacaataaagat

SEQ ID NO: 22478 - DNA, 15 bp, Homo sapiens
tcgggacaataaaga

SEQ ID NO: 22479 - DNA, 15 bp, Homo sapiens
atcgggacaataaag

SEQ ID NO: 22480 - DNA, 15 bp, Homo sapiens
aatcgggacaataaa

SEQ ID NO: 22481 - DNA, 15 bp, Homo sapiens
caatcgggacaataa

SEQ ID NO: 22482 - DNA, 15 bp, Homo sapiens
tcaatcgggacaata

SEQ ID NO: 22483 - DNA, 15 bp, Homo sapiens
atcaatcgggacaat

SEQ ID NO: 22484 - DNA, 15 bp, Homo sapiens
aatcaatcgggacaa

SEQ ID NO: 22485 - DNA, 15 bp, Homo sapiens
taatcaatcgggaca

SEQ ID NO: 22486 - DNA, 15 bp, Homo sapiens
ctaatcaatcgggac

SEQ ID NO: 22487 - DNA, 15 bp, Homo sapiens
gctaatcaatcggga

SEQ ID NO: 22488 - DNA, 15 bp, Homo sapiens
agctaatcaatcggg

SEQ ID NO: 22489 - DNA, 15 bp, Homo sapiens
cagctaatcaatcgg

SEQ ID NO: 22490 - DNA, 15 bp, Homo sapiens
gcagctaatcaatcg

SEQ ID NO: 22491 - DNA, 15 bp, Homo sapiens
tgcagctaatcaatc

SEQ ID NO: 22492 - DNA, 15 bp, Homo sapiens
atgcagctaatcaat

SEQ ID NO: 22493 - DNA, 15 bp, Homo sapiens
catgcagctaatcaa

SEQ ID NO: 22494 - DNA, 15 bp, Homo sapiens
acatgcagctaatca

SEQ ID NO: 22495 - DNA, 15 bp, Homo sapiens
gacatgcagctaatc

SEQ ID NO: 22496 - DNA, 15 bp, Homo sapiens
tgacatgcagctaat

SEQ ID NO: 22497 - DNA, 15 bp, Homo sapiens
ctgacatgcagctaa

SEQ ID NO: 22498 - DNA, 15 bp, Homo sapiens
gctgacatgcagcta

SEQ ID NO: 22499 - DNA, 15 bp, Homo sapiens
ggctgacatgcagct

SEQ ID NO: 22500 - DNA, 15 bp, Homo sapiens
aggctgacatgcagc

SEQ ID NO: 22501 - DNA, 15 bp, Homo sapiens
aaggctgacatgcag

SEQ ID NO: 22502 - DNA, 15 bp, Homo sapiens
aaaggctgacatgca

SEQ ID NO: 22503 - DNA, 15 bp, Homo sapiens
caaaggctgacatgc

SEQ ID NO: 22504 - DNA, 15 bp, Homo sapiens
tcaaaggctgacatg

SEQ ID NO: 22505 - DNA, 15 bp, Homo sapiens
gtcaaaggctgacat

SEQ ID NO: 22506 - DNA, 15 bp, Homo sapiens
agtcaaaggctgaca

SEQ ID NO: 22507 - DNA, 15 bp, Homo sapiens
cagtcaaaggctgac

SEQ ID NO: 22508 - DNA, 15 bp, Homo sapiens
acagtcaaaggctga

SEQ ID NO: 22509 - DNA, 15 bp, Homo sapiens
cacagtcaaaggctg

SEQ ID NO: 22510 - DNA, 15 bp, Homo sapiens
acacagtcaaaggct

SEQ ID NO: 22511 - DNA, 15 bp, Homo sapiens
aacacagtcaaaggc

SEQ ID NO: 22512 - DNA, 15 bp, Homo sapiens
aaacacagtcaaagg

SEQ ID NO: 22513 - DNA, 15 bp, Homo sapiens
gaaacacagtcaaag

SEQ ID NO: 22514 - DNA, 15 bp, Homo sapiens
ggaaacacagtcaaa

SEQ ID NO: 22515 - DNA, 15 bp, Homo sapiens
gggaaacacagtcaa

SEQ ID NO: 22516 - DNA, 15 bp, Homo sapiens
tgggaaacacagtca

SEQ ID NO: 22517 - DNA, 15 bp, Homo sapiens
ctgggaaacacagtc

SEQ ID NO: 22518 - DNA, 15 bp, Homo sapiens
tctgggaaacacagt

SEQ ID NO: 22519 - DNA, 15 bp, Homo sapiens
atctgggaaacacag

SEQ ID NO: 22520 - DNA, 15 bp, Homo sapiens
catctgggaaacaca

SEQ ID NO: 22521 - DNA, 15 bp, Homo sapiens
gcatctgggaaacac

SEQ ID NO: 22522 - DNA, 15 bp, Homo sapiens
agcatctgggaaaca

SEQ ID NO: 22523 - DNA, 15 bp, Homo sapiens
gagcatctgggaaac

SEQ ID NO: 22524 - DNA, 15 bp, Homo sapiens
tgagcatctgggaaa

SEQ ID NO: 22525 - DNA, 15 bp, Homo sapiens
gtgagcatctgggaa

SEQ ID NO: 22526 - DNA, 15 bp, Homo sapiens
cgtgagcatctggga

SEQ ID NO: 22527 - DNA, 15 bp, Homo sapiens
tcgtgagcatctggg

SEQ ID NO: 22528 - DNA, 15 bp, Homo sapiens
gtcgtgagcatctgg

SEQ ID NO: 22529 - DNA, 15 bp, Homo sapiens
tgtcgtgagcatctg

SEQ ID NO: 22530 - DNA, 15 bp, Homo sapiens
ctgtcgtgagcatct

SEQ ID NO: 22531 - DNA, 15 bp, Homo sapiens
tctgtcgtgagcatc

SEQ ID NO: 22532 - DNA, 15 bp, Homo sapiens
atctgtcgtgagcat

SEQ ID NO: 22533 - DNA, 15 bp, Homo sapiens
gatctgtcgtgagca

SEQ ID NO: 22534 - DNA, 15 bp, Homo sapiens
cgatctgtcgtgagc

SEQ ID NO: 22535 - DNA, 15 bp, Homo sapiens
tcgatctgtcgtgag

SEQ ID NO: 22536 - DNA, 15 bp, Homo sapiens
atcgatctgtcgtga

SEQ ID NO: 22537 - DNA, 15 bp, Homo sapiens
gatcgatctgtcgtg

SEQ ID NO: 22538 - DNA, 15 bp, Homo sapiens
tgatcgatctgtcgt

SEQ ID NO: 22539 - DNA, 15 bp, Homo sapiens
gtgatcgatctgtcg

SEQ ID NO: 22540 - DNA, 15 bp, Homo sapiens
agtgatcgatctgtc

SEQ ID NO: 22541 - DNA, 15 bp, Homo sapiens
aagtgatcgatctgt

SEQ ID NO: 22542 - DNA, 15 bp, Homo sapiens
caagtgatcgatctg

SEQ ID NO: 22543 - DNA, 15 bp, Homo sapiens
tcaagtgatcgatct

SEQ ID NO: 22544 - DNA, 15 bp, Homo sapiens
atcaagtgatcgatc

SEQ ID NO: 22545 - DNA, 15 bp, Homo sapiens
catcaagtgatcgat

SEQ ID NO: 22546 - DNA, 15 bp, Homo sapiens
acatcaagtgatcga

SEQ ID NO: 22547 - DNA, 15 bp, Homo sapiens
aacatcaagtgatcg

SEQ ID NO: 22548 - DNA, 15 bp, Homo sapiens
caacatcaagtgatc

SEQ ID NO: 22549 - DNA, 15 bp, Homo sapiens
acaacatcaagtgat

SEQ ID NO: 22550 - DNA, 15 bp, Homo sapiens
aacaacatcaagtga

SEQ ID NO: 22551 - DNA, 15 bp, Homo sapiens
aaacaacatcaagtg

SEQ ID NO: 22552 - DNA, 15 bp, Homo sapiens
aaaacaacatcaagt

SEQ ID NO: 22553 - DNA, 15 bp, Homo sapiens
gaaaacaacatcaag

SEQ ID NO: 22554 - DNA, 15 bp, Homo sapiens
tgaaaacaacatcaa

SEQ ID NO: 22555 - DNA, 15 bp, Homo sapiens
ttgaaaacaacatca

SEQ ID NO: 22556 - DNA, 15 bp, Homo sapiens
gttgaaaacaacatc

SEQ ID NO: 22557 - DNA, 15 bp, Homo sapiens
tgttgaaaacaacat

SEQ ID NO: 22558 - DNA, 15 bp, Homo sapiens
ctgttgaaaacaaca

SEQ ID NO: 22559 - DNA, 15 bp, Homo sapiens
cctgttgaaaacaac

SEQ ID NO: 22560 - DNA, 15 bp, Homo sapiens
gcctgttgaaaacaa

SEQ ID NO: 22561 - DNA, 15 bp, Homo sapiens
tgcctgttgaaaaca

SEQ ID NO: 22562 - DNA, 15 bp, Homo sapiens
ctgcctgttgaaaac

SEQ ID NO: 22563 - DNA, 15 bp, Homo sapiens
actgcctgttgaaaa

SEQ ID NO: 22564 - DNA, 15 bp, Homo sapiens
gactgcctgttgaaa

SEQ ID NO: 22565 - DNA, 15 bp, Homo sapiens
tgactgcctgttgaa

SEQ ID NO: 22566 - DNA, 15 bp, Homo sapiens
atgactgcctgttga

SEQ ID NO: 22567 - DNA, 15 bp, Homo sapiens
catgactgcctgttg

SEQ ID NO: 22568 - DNA, 15 bp, Homo sapiens
tcatgactgcctgtt

SEQ ID NO: 22569 - DNA, 15 bp, Homo sapiens
ttcatgactgcctgt

SEQ ID NO: 22570 - DNA, 15 bp, Homo sapiens
tttcatgactgcctg

SEQ ID NO: 22571 - DNA, 15 bp, Homo sapiens
atttcatgactgcct

SEQ ID NO: 22572 - DNA, 15 bp, Homo sapiens
catttcatgactgcc

SEQ ID NO: 22573 - DNA, 15 bp, Homo sapiens
tcatttcatgactgc

SEQ ID NO: 22574 - DNA, 15 bp, Homo sapiens
ctcatttcatgactg

SEQ ID NO: 22575 - DNA, 15 bp, Homo sapiens
gctcatttcatgact

SEQ ID NO: 22576 - DNA, 15 bp, Homo sapiens
tgctcatttcatgac

SEQ ID NO: 22577 - DNA, 15 bp, Homo sapiens
ctgctcatttcatga

SEQ ID NO: 22578 - DNA, 15 bp, Homo sapiens
tctgctcatttcatg

SEQ ID NO: 22579 - DNA, 15 bp, Homo sapiens
gtctgctcatttcat

SEQ ID NO: 22580 - DNA, 15 bp, Homo sapiens
agtctgctcatttca

SEQ ID NO: 22581 - DNA, 15 bp, Homo sapiens
cagtctgctcatttc

SEQ ID NO: 22582 - DNA, 15 bp, Homo sapiens
tcagtctgctcattt

SEQ ID NO: 22583 - DNA, 15 bp, Homo sapiens
ctcagtctgctcatt

SEQ ID NO: 22584 - DNA, 15 bp, Homo sapiens
cctcagtctgctcat

SEQ ID NO: 22585 - DNA, 15 bp, Homo sapiens
acctcagtctgctca

SEQ ID NO: 22586 - DNA, 15 bp, Homo sapiens
gacctcagtctgctc

SEQ ID NO: 22587 - DNA, 15 bp, Homo sapiens
tgacctcagtctgct

SEQ ID NO: 22588 - DNA, 15 bp, Homo sapiens
ctgacctcagtctgc

SEQ ID NO: 22589 - DNA, 15 bp, Homo sapiens
actgacctcagtctg

SEQ ID NO: 22590 - DNA, 15 bp, Homo sapiens
cactgacctcagtct

SEQ ID NO: 22591 - DNA, 15 bp, Homo sapiens
acactgacctcagtc

SEQ ID NO: 22592 - DNA, 15 bp, Homo sapiens
tacactgacctcagt

SEQ ID NO: 22593 - DNA, 15 bp, Homo sapiens
ctacactgacctcag

SEQ ID NO: 22594 - DNA, 15 bp, Homo sapiens
actacactgacctca

SEQ ID NO: 22595 - DNA, 15 bp, Homo sapiens
tactacactgacctc

SEQ ID NO: 22596 - DNA, 15 bp, Homo sapiens
atactacactgacct

SEQ ID NO: 22597 - DNA, 15 bp, Homo sapiens
tatactacactgacc

SEQ ID NO: 22598 - DNA, 15 bp, Homo sapiens
ctatactacactgac

SEQ ID NO: 22599 - DNA, 15 bp, Homo sapiens
tctatactacactga

SEQ ID NO: 22600 - DNA, 15 bp, Homo sapiens
atctatactacactg

SEQ ID NO: 22601 - DNA, 15 bp, Homo sapiens
tatctatactacact

SEQ ID NO: 22602 - DNA, 15 bp, Homo sapiens
atatctatactacac

SEQ ID NO: 22603 - DNA, 15 bp, Homo sapiens
aatatctatactaca

SEQ ID NO: 22604 - DNA, 15 bp, Homo sapiens
aaatatctatactac

SEQ ID NO: 22605 - DNA, 15 bp, Homo sapiens
caaatatctatacta

SEQ ID NO: 22606 - DNA, 15 bp, Homo sapiens
acaaatatctatact

SEQ ID NO: 22607 - DNA, 15 bp, Homo sapiens
gacaaatatctatac

SEQ ID NO: 22608 - DNA, 15 bp, Homo sapiens
tgacaaatatctata

SEQ ID NO: 22609 - DNA, 15 bp, Homo sapiens
ctgacaaatatctat

SEQ ID NO: 22610 - DNA, 15 bp, Homo sapiens
gctgacaaatatcta

SEQ ID NO: 22611 - DNA, 15 bp, Homo sapiens
cgctgacaaatatct

SEQ ID NO: 22612 - DNA, 15 bp, Homo sapiens
acgctgacaaatatc

SEQ ID NO: 22613 - DNA, 15 bp, Homo sapiens
cacgctgacaaatat

SEQ ID NO: 22614 - DNA, 15 bp, Homo sapiens
ccacgctgacaaata

SEQ ID NO: 22615 - DNA, 15 bp, Homo sapiens
accacgctgacaaat

SEQ ID NO: 22616 - DNA, 15 bp, Homo sapiens
aaccacgctgacaaa

SEQ ID NO: 22617 - DNA, 15 bp, Homo sapiens
caaccacgctgacaa

SEQ ID NO: 22618 - DNA, 15 bp, Homo sapiens
gcaaccacgctgaca

SEQ ID NO: 22619 - DNA, 15 bp, Homo sapiens
ggcaaccacgctgac

SEQ ID NO: 22620 - DNA, 15 bp, Homo sapiens
tggcaaccacgctga

SEQ ID NO: 22621 - DNA, 15 bp, Homo sapiens
ttggcaaccacgctg

SEQ ID NO: 22622 - DNA, 15 bp, Homo sapiens
gttggcaaccacgct

SEQ ID NO: 22623 - DNA, 15 bp, Homo sapiens
agttggcaaccacgc

SEQ ID NO: 22624 - DNA, 15 bp, Homo sapiens
cagttggcaaccacg

SEQ ID NO: 22625 - DNA, 15 bp, Homo sapiens
gcagttggcaaccac

SEQ ID NO: 22626 - DNA, 15 bp, Homo sapiens
ggcagttggcaacca

SEQ ID NO: 22627 - DNA, 15 bp, Homo sapiens
aggcagttggcaacc

SEQ ID NO: 22628 - DNA, 15 bp, Homo sapiens
aaggcagttggcaac

SEQ ID NO: 22629 - DNA, 15 bp, Homo sapiens
aaaggcagttggcaa

SEQ ID NO: 22630 - DNA, 15 bp, Homo sapiens
gaaaggcagttggca

SEQ ID NO: 22631 - DNA, 15 bp, Homo sapiens
ggaaaggcagttggc

SEQ ID NO: 22632 - DNA, 15 bp, Homo sapiens
aggaaaggcagttgg

SEQ ID NO: 22633 - DNA, 15 bp, Homo sapiens
gaggaaaggcagttg

SEQ ID NO: 22634 - DNA, 15 bp, Homo sapiens
agaggaaaggcagtt

SEQ ID NO: 22635 - DNA, 15 bp, Homo sapiens
aagaggaaaggcagt

SEQ ID NO: 22636 - DNA, 15 bp, Homo sapiens
gaagaggaaaggcag

SEQ ID NO: 22637 - DNA, 15 bp, Homo sapiens
agaagaggaaaggca

SEQ ID NO: 22638 - DNA, 15 bp, Homo sapiens
tagaagaggaaaggc

SEQ ID NO: 22639 - DNA, 15 bp, Homo sapiens
ttagaagaggaaagg

SEQ ID NO: 22640 - DNA, 15 bp, Homo sapiens
cttagaagaggaaag

SEQ ID NO: 22641 - DNA, 15 bp, Homo sapiens
tcttagaagaggaaa

SEQ ID NO: 22642 - DNA, 15 bp, Homo sapiens
atcttagaagaggaa

SEQ ID NO: 22643 - DNA, 15 bp, Homo sapiens
aatcttagaagagga

SEQ ID NO: 22644 - DNA, 15 bp, Homo sapiens
caatcttagaagagg

SEQ ID NO: 22645 - DNA, 15 bp, Homo sapiens
gcaatcttagaagag

SEQ ID NO: 22646 - DNA, 15 bp, Homo sapiens
ggcaatcttagaaga

SEQ ID NO: 22647 - DNA, 15 bp, Homo sapiens
gggcaatcttagaag

SEQ ID NO: 22648 - DNA, 15 bp, Homo sapiens
agggcaatcttagaa

SEQ ID NO: 22649 - DNA, 15 bp, Homo sapiens
aagggcaatcttaga

SEQ ID NO: 22650 - DNA, 15 bp, Homo sapiens
aaagggcaatcttag

SEQ ID NO: 22651 - DNA, 15 bp, Homo sapiens
taaagggcaatctta

SEQ ID NO: 22652 - DNA, 15 bp, Homo sapiens
ataaagggcaatctt

SEQ ID NO: 22653 - DNA, 15 bp, Homo sapiens
aataaagggcaatct

SEQ ID NO: 22654 - DNA, 15 bp, Homo sapiens
caataaagggcaatc

SEQ ID NO: 22655 - DNA, 15 bp, Homo sapiens
acaataaagggcaat

SEQ ID NO: 22656 - DNA, 15 bp, Homo sapiens
cacaataaagggcaa

SEQ ID NO: 22657 - DNA, 15 bp, Homo sapiens
acacaataaagggca

SEQ ID NO: 22658 - DNA, 15 bp, Homo sapiens
cacacaataaagggc

SEQ ID NO: 22659 - DNA, 15 bp, Homo sapiens
tcacacaataaaggg

SEQ ID NO: 22660 - DNA, 15 bp, Homo sapiens
atcacacaataaagg

SEQ ID NO: 22661 - DNA, 15 bp, Homo sapiens
aatcacacaataaag

SEQ ID NO: 22662 - DNA, 15 bp, Homo sapiens
taatcacacaataaa

SEQ ID NO: 22663 - DNA, 15 bp, Homo sapiens
ataatcacacaataa

SEQ ID NO: 22664 - DNA, 15 bp, Homo sapiens
tataatcacacaata

SEQ ID NO: 22665 - DNA, 15 bp, Homo sapiens
atataatcacacaat

SEQ ID NO: 22666 - DNA, 15 bp, Homo sapiens
aatataatcacacaa

SEQ ID NO: 22667 - DNA, 15 bp, Homo sapiens
taatataatcacaca

SEQ ID NO: 22668 - DNA, 15 bp, Homo sapiens
gtaatataatcacac

SEQ ID NO: 22669 - DNA, 15 bp, Homo sapiens
tgtaatataatcaca

SEQ ID NO: 22670 - DNA, 15 bp, Homo sapiens
atgtaatataatcac

SEQ ID NO: 22671 - DNA, 15 bp, Homo sapiens
aatgtaatataatca

SEQ ID NO: 22672 - DNA, 15 bp, Homo sapiens
aaatgtaatataatc

SEQ ID NO: 22673 - DNA, 15 bp, Homo sapiens
aaaatgtaatataat

SEQ ID NO: 22674 - DNA, 15 bp, Homo sapiens
aaaaatgtaatataa

SEQ ID NO: 22675 - DNA, 15 bp, Homo sapiens
taaaaatgtaatata

SEQ ID NO: 22676 - DNA, 15 bp, Homo sapiens
ctaaaaatgtaatat

SEQ ID NO: 22677 - DNA, 15 bp, Homo sapiens
actaaaaatgtaata

SEQ ID NO: 22678 - DNA, 15 bp, Homo sapiens
aactaaaaatgtaat

SEQ ID NO: 22679 - DNA, 15 bp, Homo sapiens
caactaaaaatgtaa

SEQ ID NO: 22680 - DNA, 15 bp, Homo sapiens
ccaactaaaaatgta

SEQ ID NO: 22681 - DNA, 15 bp, Homo sapiens
gccaactaaaaatgt

SEQ ID NO: 22682 - DNA, 15 bp, Homo sapiens
tgccaactaaaaatg

SEQ ID NO: 22683 - DNA, 15 bp, Homo sapiens
atgccaactaaaaat

SEQ ID NO: 22684 - DNA, 15 bp, Homo sapiens
catgccaactaaaaa

SEQ ID NO: 22685 - DNA, 15 bp, Homo sapiens
tcatgccaactaaaa

SEQ ID NO: 22686 - DNA, 15 bp, Homo sapiens
ttcatgccaactaaa

SEQ ID NO: 22687 - DNA, 15 bp, Homo sapiens
tttcatgccaactaa

SEQ ID NO: 22688 - DNA, 15 bp, Homo sapiens
ttttcatgccaacta

SEQ ID NO: 22689 - DNA, 15 bp, Homo sapiens
attttcatgccaact

SEQ ID NO: 22690 - DNA, 15 bp, Homo sapiens
cattttcatgccaac

SEQ ID NO: 22691 - DNA, 15 bp, Homo sapiens
gcattttcatgccaa

SEQ ID NO: 22692 - DNA, 15 bp, Homo sapiens
ggcattttcatgcca

SEQ ID NO: 22693 - DNA, 15 bp, Homo sapiens
gggcattttcatgcc

SEQ ID NO: 22694 - DNA, 15 bp, Homo sapiens
tgggcattttcatgc

SEQ ID NO: 22695 - DNA, 15 bp, Homo sapiens
atgggcattttcatg

SEQ ID NO: 22696 - DNA, 15 bp, Homo sapiens
aatgggcattttcat

SEQ ID NO: 22697 - DNA, 15 bp, Homo sapiens
aaatgggcattttca

SEQ ID NO: 22698 - DNA, 15 bp, Homo sapiens
taaatgggcattttc

SEQ ID NO: 22699 - DNA, 15 bp, Homo sapiens
ctaaatgggcatttt

SEQ ID NO: 22700 - DNA, 15 bp, Homo sapiens
actaaatgggcattt

SEQ ID NO: 22701 - DNA, 15 bp, Homo sapiens
cactaaatgggcatt

SEQ ID NO: 22702 - DNA, 15 bp, Homo sapiens
tcactaaatgggcat

SEQ ID NO: 22703 - DNA, 15 bp, Homo sapiens
ttcactaaatgggca

SEQ ID NO: 22704 - DNA, 15 bp, Homo sapiens
tttcactaaatgggc

SEQ ID NO: 22705 - DNA, 15 bp, Homo sapiens
atttcactaaatggg

SEQ ID NO: 22706 - DNA, 15 bp, Homo sapiens
catttcactaaatgg

SEQ ID NO: 22707 - DNA, 15 bp, Homo sapiens
tcatttcactaaatg

SEQ ID NO: 22708 - DNA, 15 bp, Homo sapiens
atcatttcactaaat

SEQ ID NO: 22709 - DNA, 15 bp, Homo sapiens
catcatttcactaaa

SEQ ID NO: 22710 - DNA, 15 bp, Homo sapiens
tcatcatttcactaa

SEQ ID NO: 22711 - DNA, 15 bp, Homo sapiens
ctcatcatttcacta

SEQ ID NO: 22712 - DNA, 15 bp, Homo sapiens
cctcatcatttcact

SEQ ID NO: 22713 - DNA, 15 bp, Homo sapiens
tcctcatcatttcac

SEQ ID NO: 22714 - DNA, 15 bp, Homo sapiens
atcctcatcatttca

SEQ ID NO: 22715 - DNA, 15 bp, Homo sapiens
gatcctcatcatttc

SEQ ID NO: 22716 - DNA, 15 bp, Homo sapiens
agatcctcatcattt

SEQ ID NO: 22717 - DNA, 15 bp, Homo sapiens
aagatcctcatcatt

SEQ ID NO: 22718 - DNA, 15 bp, Homo sapiens
gaagatcctcatcat

SEQ ID NO: 22719 - DNA, 15 bp, Homo sapiens
ggaagatcctcatca

SEQ ID NO: 22720 - DNA, 15 bp, Homo sapiens
aggaagatcctcatc

SEQ ID NO: 22721 - DNA, 15 bp, Homo sapiens
caggaagatcctcat

SEQ ID NO: 22722 - DNA, 15 bp, Homo sapiens
ccaggaagatcctca

SEQ ID NO: 22723 - DNA, 15 bp, Homo sapiens
cccaggaagatcctc

SEQ ID NO: 22724 - DNA, 15 bp, Homo sapiens
ccccaggaagatcct

SEQ ID NO: 22725 - DNA, 15 bp, Homo sapiens
cccccaggaagatcc

SEQ ID NO: 22726 - DNA, 15 bp, Homo sapiens
tcccccaggaagatc

SEQ ID NO: 22727 - DNA, 15 bp, Homo sapiens
ttcccccaggaagat

SEQ ID NO: 22728 - DNA, 15 bp, Homo sapiens
cttcccccaggaaga

SEQ ID NO: 22729 - DNA, 15 bp, Homo sapiens
tcttcccccaggaag

SEQ ID NO: 22730 - DNA, 15 bp, Homo sapiens
ttcttcccccaggaa

SEQ ID NO: 22731 - DNA, 15 bp, Homo sapiens
attcttcccccagga

SEQ ID NO: 22732 - DNA, 15 bp, Homo sapiens
aattcttcccccagg

SEQ ID NO: 22733 - DNA, 15 bp, Homo sapiens
gaattcttcccccag

SEQ ID NO: 22734 - DNA, 15 bp, Homo sapiens
agaattcttccccca

SEQ ID NO: 22735 - DNA, 15 bp, Homo sapiens
cagaattcttccccc

SEQ ID NO: 22736 - DNA, 15 bp, Homo sapiens
ccagaattcttcccc

SEQ ID NO: 22737 - DNA, 15 bp, Homo sapiens
gccagaattcttccc

SEQ ID NO: 22738 - DNA, 15 bp, Homo sapiens
cgccagaattcttcc

SEQ ID NO: 22739 - DNA, 15 bp, Homo sapiens
acgccagaattcttc

SEQ ID NO: 22740 - DNA, 15 bp, Homo sapiens
tacgccagaattctt

SEQ ID NO: 22741 - DNA, 15 bp, Homo sapiens
ttacgccagaattct

SEQ ID NO: 22742 - DNA, 15 bp, Homo sapiens
cttacgccagaattc

SEQ ID NO: 22743 - DNA, 15 bp, Homo sapiens
tcttacgccagaatt

SEQ ID NO: 22744 - DNA, 15 bp, Homo sapiens
ttcttacgccagaat

SEQ ID NO: 22745 - DNA, 15 bp, Homo sapiens
cttcttacgccagaa

SEQ ID NO: 22746 - DNA, 15 bp, Homo sapiens
gcttcttacgccaga

SEQ ID NO: 22747 - DNA, 15 bp, Homo sapiens
agcttcttacgccag

SEQ ID NO: 22748 - DNA, 15 bp, Homo sapiens
aagcttcttacgcca

SEQ ID NO: 22749 - DNA, 15 bp, Homo sapiens
aaagcttcttacgcc

SEQ ID NO: 22750 - DNA, 15 bp, Homo sapiens
gaaagcttcttacgc

SEQ ID NO: 22751 - DNA, 15 bp, Homo sapiens
agaaagcttcttacg

SEQ ID NO: 22752 - DNA, 15 bp, Homo sapiens
aagaaagcttcttac

SEQ ID NO: 22753 - DNA, 15 bp, Homo sapiens
gaagaaagcttctta

SEQ ID NO: 22754 - DNA, 15 bp, Homo sapiens
tgaagaaagcttctt

SEQ ID NO: 22755 - DNA, 15 bp, Homo sapiens
ctgaagaaagcttct

SEQ ID NO: 22756 - DNA, 15 bp, Homo sapiens
tctgaagaaagcttc

SEQ ID NO: 22757 - DNA, 15 bp, Homo sapiens
atctgaagaaagctt

SEQ ID NO: 22758 - DNA, 15 bp, Homo sapiens
aatctgaagaaagct

SEQ ID NO: 22759 - DNA, 15 bp, Homo sapiens
taatctgaagaaagc

SEQ ID NO: 22760 - DNA, 15 bp, Homo sapiens
gtaatctgaagaaag

SEQ ID NO: 22761 - DNA, 15 bp, Homo sapiens
agtaatctgaagaaa

SEQ ID NO: 22762 - DNA, 15 bp, Homo sapiens
tagtaatctgaagaa

SEQ ID NO: 22763 - DNA, 15 bp, Homo sapiens
ttagtaatctgaaga

SEQ ID NO: 22764 - DNA, 15 bp, Homo sapiens
cttagtaatctgaag

SEQ ID NO: 22765 - DNA, 15 bp, Homo sapiens
gcttagtaatctgaa

SEQ ID NO: 22766 - DNA, 15 bp, Homo sapiens
tgcttagtaatctga

SEQ ID NO: 22767 - DNA, 15 bp, Homo sapiens
gtgcttagtaatctg

SEQ ID NO: 22768 - DNA, 15 bp, Homo sapiens
agtgcttagtaatct

SEQ ID NO: 22769 - DNA, 15 bp, Homo sapiens
gagtgcttagtaatc

SEQ ID NO: 22770 - DNA, 15 bp, Homo sapiens
agagtgcttagtaat

SEQ ID NO: 22771 - DNA, 15 bp, Homo sapiens
tagagtgcttagtaa

SEQ ID NO: 22772 - DNA, 15 bp, Homo sapiens
ttagagtgcttagta

SEQ ID NO: 22773 - DNA, 15 bp, Homo sapiens
tttagagtgcttagt

SEQ ID NO: 22774 - DNA, 15 bp, Homo sapiens
ttttagagtgcttag

SEQ ID NO: 22775 - DNA, 15 bp, Homo sapiens
cttttagagtgctta

SEQ ID NO: 22776 - DNA, 15 bp, Homo sapiens
ccttttagagtgctt

SEQ ID NO: 22777 - DNA, 15 bp, Homo sapiens
accttttagagtgct

SEQ ID NO: 22778 - DNA, 15 bp, Homo sapiens
gaccttttagagtgc

SEQ ID NO: 22779 - DNA, 15 bp, Homo sapiens
ggaccttttagagtg

SEQ ID NO: 22780 - DNA, 15 bp, Homo sapiens
gggaccttttagagt

SEQ ID NO: 22781 - DNA, 15 bp, Homo sapiens
tgggaccttttagag

SEQ ID NO: 22782 - DNA, 15 bp, Homo sapiens
ctgggaccttttaga

SEQ ID NO: 22783 - DNA, 15 bp, Homo sapiens
cctgggaccttttag

SEQ ID NO: 22784 - DNA, 15 bp, Homo sapiens
acctgggacctttta

SEQ ID NO: 22785 - DNA, 15 bp, Homo sapiens
aacctgggacctttt

SEQ ID NO: 22786 - DNA, 15 bp, Homo sapiens
taacctgggaccttt

SEQ ID NO: 22787 - DNA, 15 bp, Homo sapiens
ataacctgggacctt

SEQ ID NO: 22788 - DNA, 15 bp, Homo sapiens
cataacctgggacct

SEQ ID NO: 22789 - DNA, 15 bp, Homo sapiens
ccataacctgggacc

SEQ ID NO: 22790 - DNA, 15 bp, Homo sapiens
cccataacctgggac

SEQ ID NO: 22791 - DNA, 15 bp, Homo sapiens
ccccataacctggga

SEQ ID NO: 22792 - DNA, 15 bp, Homo sapiens
gccccataacctggg

SEQ ID NO: 22793 - DNA, 15 bp, Homo sapiens
agccccataacctgg

SEQ ID NO: 22794 - DNA, 15 bp, Homo sapiens
gagccccataacctg

SEQ ID NO: 22795 - DNA, 15 bp, Homo sapiens
agagccccataacct

SEQ ID NO: 22796 - DNA, 15 bp, Homo sapiens
cagagccccataacc

SEQ ID NO: 22797 - DNA, 15 bp, Homo sapiens
ccagagccccataac

SEQ ID NO: 22798 - DNA, 15 bp, Homo sapiens
tccagagccccataa

SEQ ID NO: 22799 - DNA, 15 bp, Homo sapiens
ttccagagccccata

SEQ ID NO: 22800 - DNA, 15 bp, Homo sapiens
tttccagagccccat

SEQ ID NO: 22801 - DNA, 15 bp, Homo sapiens
ctttccagagcccca

SEQ ID NO: 22802 - DNA, 15 bp, Homo sapiens
actttccagagcccc

SEQ ID NO: 22803 - DNA, 15 bp, Homo sapiens
tactttccagagccc

SEQ ID NO: 22804 - DNA, 15 bp, Homo sapiens
ttactttccagagcc

SEQ ID NO: 22805 - DNA, 15 bp, Homo sapiens
gttactttccagagc

SEQ ID NO: 22806 - DNA, 15 bp, Homo sapiens
cgttactttccagag

SEQ ID NO: 22807 - DNA, 15 bp, Homo sapiens
tcgttactttccaga

SEQ ID NO: 22808 - DNA, 15 bp, Homo sapiens
atcgttactttccag

SEQ ID NO: 22809 - DNA, 15 bp, Homo sapiens
catcgttactttcca

SEQ ID NO: 22810 - DNA, 15 bp, Homo sapiens
gcatcgttactttcc

SEQ ID NO: 22811 - DNA, 15 bp, Homo sapiens
cgcatcgttactttc

SEQ ID NO: 22812 - DNA, 15 bp, Homo sapiens
tcgcatcgttacttt

SEQ ID NO: 22813 - DNA, 15 bp, Homo sapiens
ttcgcatcgttactt

SEQ ID NO: 22814 - DNA, 15 bp, Homo sapiens
attcgcatcgttact

SEQ ID NO: 22815 - DNA, 15 bp, Homo sapiens
tattcgcatcgttac

SEQ ID NO: 22816 - DNA, 15 bp, Homo sapiens
gtattcgcatcgtta

SEQ ID NO: 22817 - DNA, 15 bp, Homo sapiens
agtattcgcatcgtt

SEQ ID NO: 22818 - DNA, 15 bp, Homo sapiens
aagtattcgcatcgt

SEQ ID NO: 22819 - DNA, 15 bp, Homo sapiens
gaagtattcgcatcg

SEQ ID NO: 22820 - DNA, 15 bp, Homo sapiens
tgaagtattcgcatc

SEQ ID NO: 22821 - DNA, 15 bp, Homo sapiens
gtgaagtattcgcat

SEQ ID NO: 22822 - DNA, 15 bp, Homo sapiens
agtgaagtattcgca

SEQ ID NO: 22823 - DNA, 15 bp, Homo sapiens
aagtgaagtattcgc

SEQ ID NO: 22824 - DNA, 15 bp, Homo sapiens
caagtgaagtattcg

SEQ ID NO: 22825 - DNA, 15 bp, Homo sapiens
ccaagtgaagtattc

SEQ ID NO: 22826 - DNA, 15 bp, Homo sapiens
accaagtgaagtatt

SEQ ID NO: 22827 - DNA, 15 bp, Homo sapiens
aaccaagtgaagtat

SEQ ID NO: 22828 - DNA, 15 bp, Homo sapiens
taaccaagtgaagta

SEQ ID NO: 22829 - DNA, 15 bp, Homo sapiens
ataaccaagtgaagt

SEQ ID NO: 22830 - DNA, 15 bp, Homo sapiens
cataaccaagtgaag

SEQ ID NO: 22831 - DNA, 15 bp, Homo sapiens
acataaccaagtgaa

SEQ ID NO: 22832 - DNA, 15 bp, Homo sapiens
cacataaccaagtga

SEQ ID NO: 22833 - DNA, 15 bp, Homo sapiens
tcacataaccaagtg

SEQ ID NO: 22834 - DNA, 15 bp, Homo sapiens
atcacataaccaagt

SEQ ID NO: 22835 - DNA, 15 bp, Homo sapiens
aatcacataaccaag

SEQ ID NO: 22836 - DNA, 15 bp, Homo sapiens
aaatcacataaccaa

SEQ ID NO: 22837 - DNA, 15 bp, Homo sapiens
aaaatcacataacca

SEQ ID NO: 22838 - DNA, 15 bp, Homo sapiens
aaaaatcacataacc

SEQ ID NO: 22839 - DNA, 15 bp, Homo sapiens
taaaaatcacataac

SEQ ID NO: 22840 - DNA, 15 bp, Homo sapiens
ataaaaatcacataa

SEQ ID NO: 22841 - DNA, 15 bp, Homo sapiens
aataaaaatcacata

SEQ ID NO: 22842 - DNA, 15 bp, Homo sapiens
aaataaaaatcacat

SEQ ID NO: 22843 - DNA, 15 bp, Homo sapiens
aaaataaaaatcaca

SEQ ID NO: 22844 - DNA, 15 bp, Homo sapiens
aaaaataaaaatcac

SEQ ID NO: 22845 - DNA, 15 bp, Homo sapiens
caaaaataaaaatca

SEQ ID NO: 22846 - DNA, 15 bp, Homo sapiens
gcaaaaataaaaatc

SEQ ID NO: 22847 - DNA, 15 bp, Homo sapiens
ggcaaaaataaaaat

SEQ ID NO: 22848 - DNA, 15 bp, Homo sapiens
aggcaaaaataaaaa

SEQ ID NO: 22849 - DNA, 15 bp, Homo sapiens
aaggcaaaaataaaa

SEQ ID NO: 22850 - DNA, 15 bp, Homo sapiens
caaggcaaaaataaa

SEQ ID NO: 22851 - DNA, 15 bp, Homo sapiens
ccaaggcaaaaataa

SEQ ID NO: 22852 - DNA, 15 bp, Homo sapiens
tccaaggcaaaaata

SEQ ID NO: 22853 - DNA, 15 bp, Homo sapiens
ttccaaggcaaaaat

SEQ ID NO: 22854 - DNA, 15 bp, Homo sapiens
cttccaaggcaaaaa

SEQ ID NO: 22855 - DNA, 15 bp, Homo sapiens
acttccaaggcaaaa

SEQ ID NO: 22856 - DNA, 15 bp, Homo sapiens
gacttccaaggcaaa

SEQ ID NO: 22857 - DNA, 15 bp, Homo sapiens
agacttccaaggcaa

SEQ ID NO: 22858 - DNA, 15 bp, Homo sapiens
aagacttccaaggca

SEQ ID NO: 22859 - DNA, 15 bp, Homo sapiens
aaagacttccaaggc

SEQ ID NO: 22860 - DNA, 15 bp, Homo sapiens
gaaagacttccaagg

SEQ ID NO: 22861 - DNA, 15 bp, Homo sapiens
agaaagacttccaag

SEQ ID NO: 22862 - DNA, 15 bp, Homo sapiens
cagaaagacttccaa

SEQ ID NO: 22863 - DNA, 15 bp, Homo sapiens
gcagaaagacttcca

SEQ ID NO: 22864 - DNA, 15 bp, Homo sapiens
tgcagaaagacttcc

SEQ ID NO: 22865 - DNA, 15 bp, Homo sapiens
ttgcagaaagacttc

SEQ ID NO: 22866 - DNA, 15 bp, Homo sapiens
tttgcagaaagactt

SEQ ID NO: 22867 - DNA, 15 bp, Homo sapiens
gtttgcagaaagact

SEQ ID NO: 22868 - DNA, 15 bp, Homo sapiens
tgtttgcagaaagac

SEQ ID NO: 22869 - DNA, 15 bp, Homo sapiens
ttgtttgcagaaaga

SEQ ID NO: 22870 - DNA, 15 bp, Homo sapiens
cttgtttgcagaaag

SEQ ID NO: 22871 - DNA, 15 bp, Homo sapiens
acttgtttgcagaaa

SEQ ID NO: 22872 - DNA, 15 bp, Homo sapiens
gacttgtttgcagaa

SEQ ID NO: 22873 - DNA, 15 bp, Homo sapiens
agacttgtttgcaga

SEQ ID NO: 22874 - DNA, 15 bp, Homo sapiens
aagacttgtttgcag

SEQ ID NO: 22875 - DNA, 15 bp, Homo sapiens
gaagacttgtttgca

SEQ ID NO: 22876 - DNA, 15 bp, Homo sapiens
ggaagacttgtttgc

SEQ ID NO: 22877 - DNA, 15 bp, Homo sapiens
tggaagacttgtttg

SEQ ID NO: 22878 - DNA, 15 bp, Homo sapiens
ctggaagacttgttt

SEQ ID NO: 22879 - DNA, 15 bp, Homo sapiens
actggaagacttgtt

SEQ ID NO: 22880 - DNA, 15 bp, Homo sapiens
cactggaagacttgt

SEQ ID NO: 22881 - DNA, 15 bp, Homo sapiens
ccactggaagacttg

SEQ ID NO: 22882 - DNA, 15 bp, Homo sapiens
tccactggaagactt

SEQ ID NO: 22883 - DNA, 15 bp, Homo sapiens
ctccactggaagact

SEQ ID NO: 22884 - DNA, 15 bp, Homo sapiens
cctccactggaagac

SEQ ID NO: 22885 - DNA, 15 bp, Homo sapiens
gcctccactggaaga

SEQ ID NO: 22886 - DNA, 15 bp, Homo sapiens
agcctccactggaag

SEQ ID NO: 22887 - DNA, 15 bp, Homo sapiens
gagcctccactggaa

SEQ ID NO: 22888 - DNA, 15 bp, Homo sapiens
tgagcctccactgga

SEQ ID NO: 22889 - DNA, 15 bp, Homo sapiens
atgagcctccactgg

SEQ ID NO: 22890 - DNA, 15 bp, Homo sapiens
aatgagcctccactg

SEQ ID NO: 22891 - DNA, 15 bp, Homo sapiens
aaatgagcctccact

SEQ ID NO: 22892 - DNA, 15 bp, Homo sapiens
aaaatgagcctccac

SEQ ID NO: 22893 - DNA, 15 bp, Homo sapiens
taaaatgagcctcca

SEQ ID NO: 22894 - DNA, 15 bp, Homo sapiens
ctaaaatgagcctcc

SEQ ID NO: 22895 - DNA, 15 bp, Homo sapiens
cctaaaatgagcctc

SEQ ID NO: 22896 - DNA, 15 bp, Homo sapiens
tcctaaaatgagcct

SEQ ID NO: 22897 - DNA, 15 bp, Homo sapiens
ttcctaaaatgagcc

SEQ ID NO: 22898 - DNA, 15 bp, Homo sapiens
attcctaaaatgagc

SEQ ID NO: 22899 - DNA, 15 bp, Homo sapiens
cattcctaaaatgag

SEQ ID NO: 22900 - DNA, 15 bp, Homo sapiens
acattcctaaaatga

SEQ ID NO: 22901 - DNA, 15 bp, Homo sapiens
cacattcctaaaatg

SEQ ID NO: 22902 - DNA, 15 bp, Homo sapiens
tcacattcctaaaat

SEQ ID NO: 22903 - DNA, 15 bp, Homo sapiens
gtcacattcctaaaa

SEQ ID NO: 22904 - DNA, 15 bp, Homo sapiens
cgtcacattcctaaa

SEQ ID NO: 22905 - DNA, 15 bp, Homo sapiens
tcgtcacattcctaa

SEQ ID NO: 22906 - DNA, 15 bp, Homo sapiens
atcgtcacattccta

SEQ ID NO: 22907 - DNA, 15 bp, Homo sapiens
catcgtcacattcct

SEQ ID NO: 22908 - DNA, 15 bp, Homo sapiens
gcatcgtcacattcc

SEQ ID NO: 22909 - DNA, 15 bp, Homo sapiens
tgcatcgtcacattc

SEQ ID NO: 22910 - DNA, 15 bp, Homo sapiens
atgcatcgtcacatt

SEQ ID NO: 22911 - DNA, 15 bp, Homo sapiens
aatgcatcgtcacat

SEQ ID NO: 22912 - DNA, 15 bp, Homo sapiens
caatgcatcgtcaca

SEQ ID NO: 22913 - DNA, 15 bp, Homo sapiens
gcaatgcatcgtcac

SEQ ID NO: 22914 - DNA, 15 bp, Homo sapiens
agcaatgcatcgtca

SEQ ID NO: 22915 - DNA, 15 bp, Homo sapiens
cagcaatgcatcgtc

SEQ ID NO: 22916 - DNA, 15 bp, Homo sapiens
tcagcaatgcatcgt

SEQ ID NO: 22917 - DNA, 15 bp, Homo sapiens
atcagcaatgcatcg

SEQ ID NO: 22918 - DNA, 15 bp, Homo sapiens
tatcagcaatgcatc

SEQ ID NO: 22919 - DNA, 15 bp, Homo sapiens
ctatcagcaatgcat

SEQ ID NO: 22920 - DNA, 15 bp, Homo sapiens
cctatcagcaatgca

SEQ ID NO: 22921 - DNA, 15 bp, Homo sapiens
acctatcagcaatgc

SEQ ID NO: 22922 - DNA, 15 bp, Homo sapiens
tacctatcagcaatg

SEQ ID NO: 22923 - DNA, 15 bp, Homo sapiens
ctacctatcagcaat

SEQ ID NO: 22924 - DNA, 15 bp, Homo sapiens
cctacctatcagcaa

SEQ ID NO: 22925 - DNA, 15 bp, Homo sapiens
tcctacctatcagca

SEQ ID NO: 22926 - DNA, 15 bp, Homo sapiens
atcctacctatcagc

SEQ ID NO: 22927 - DNA, 15 bp, Homo sapiens
catcctacctatcag

SEQ ID NO: 22928 - DNA, 15 bp, Homo sapiens
acatcctacctatca

SEQ ID NO: 22929 - DNA, 15 bp, Homo sapiens
cacatcctacctatc

SEQ ID NO: 22930 - DNA, 15 bp, Homo sapiens
ccacatcctacctat

SEQ ID NO: 22931 - DNA, 15 bp, Homo sapiens
gccacatcctaccta

SEQ ID NO: 22932 - DNA, 15 bp, Homo sapiens
agccacatcctacct

SEQ ID NO: 22933 - DNA, 15 bp, Homo sapiens
aagccacatcctacc

SEQ ID NO: 22934 - DNA, 15 bp, Homo sapiens
aaagccacatcctac

SEQ ID NO: 22935 - DNA, 15 bp, Homo sapiens
gaaagccacatccta

SEQ ID NO: 22936 - DNA, 15 bp, Homo sapiens
agaaagccacatcct

SEQ ID NO: 22937 - DNA, 15 bp, Homo sapiens
tagaaagccacatcc

SEQ ID NO: 22938 - DNA, 15 bp, Homo sapiens
atagaaagccacatc

SEQ ID NO: 22939 - DNA, 15 bp, Homo sapiens
tatagaaagccacat

SEQ ID NO: 22940 - DNA, 15 bp, Homo sapiens
gtatagaaagccaca

SEQ ID NO: 22941 - DNA, 15 bp, Homo sapiens
tgtatagaaagccac

SEQ ID NO: 22942 - DNA, 15 bp, Homo sapiens
ctgtatagaaagcca

SEQ ID NO: 22943 - DNA, 15 bp, Homo sapiens
gctgtatagaaagcc

SEQ ID NO: 22944 - DNA, 15 bp, Homo sapiens
tgctgtatagaaagc

SEQ ID NO: 22945 - DNA, 15 bp, Homo sapiens
ctgctgtatagaaag

SEQ ID NO: 22946 - DNA, 15 bp, Homo sapiens
tctgctgtatagaaa

SEQ ID NO: 22947 - DNA, 15 bp, Homo sapiens
ctctgctgtatagaa

SEQ ID NO: 22948 - DNA, 15 bp, Homo sapiens
actctgctgtataga

SEQ ID NO: 22949 - DNA, 15 bp, Homo sapiens
aactctgctgtatag

SEQ ID NO: 22950 - DNA, 15 bp, Homo sapiens
aaactctgctgtata

SEQ ID NO: 22951 - DNA, 15 bp, Homo sapiens
caaactctgctgtat

SEQ ID NO: 22952 - DNA, 15 bp, Homo sapiens
ccaaactctgctgta

SEQ ID NO: 22953 - DNA, 15 bp, Homo sapiens
cccaaactctgctgt

SEQ ID NO: 22954 - DNA, 15 bp, Homo sapiens
ccccaaactctgctg

SEQ ID NO: 22955 - DNA, 15 bp, Homo sapiens
cccccaaactctgct

SEQ ID NO: 22956 - DNA, 15 bp, Homo sapiens
ccccccaaactctgc

SEQ ID NO: 22957 - DNA, 15 bp, Homo sapiens
accccccaaactctg

SEQ ID NO: 22958 - DNA, 15 bp, Homo sapiens
caccccccaaactct

SEQ ID NO: 22959 - DNA, 15 bp, Homo sapiens
ccaccccccaaactc

SEQ ID NO: 22960 - DNA, 15 bp, Homo sapiens
cccaccccccaaact

SEQ ID NO: 22961 - DNA, 15 bp, Homo sapiens
tcccaccccccaaac

SEQ ID NO: 22962 - DNA, 15 bp, Homo sapiens
gtcccaccccccaaa

SEQ ID NO: 22963 - DNA, 15 bp, Homo sapiens
agtcccaccccccaa

SEQ ID NO: 22964 - DNA, 15 bp, Homo sapiens
cagtcccacccccca

SEQ ID NO: 22965 - DNA, 15 bp, Homo sapiens
ccagtcccacccccc

SEQ ID NO: 22966 - DNA, 15 bp, Homo sapiens
gccagtcccaccccc

SEQ ID NO: 22967 - DNA, 15 bp, Homo sapiens
tgccagtcccacccc

SEQ ID NO: 22968 - DNA, 15 bp, Homo sapiens
ctgccagtcccaccc

SEQ ID NO: 22969 - DNA, 15 bp, Homo sapiens
cctgccagtcccacc

SEQ ID NO: 22970 - DNA, 15 bp, Homo sapiens
acctgccagtcccac

SEQ ID NO: 22971 - DNA, 15 bp, Homo sapiens
cacctgccagtccca

SEQ ID NO: 22972 - DNA, 15 bp, Homo sapiens
tcacctgccagtccc

SEQ ID NO: 22973 - DNA, 15 bp, Homo sapiens
ctcacctgccagtcc

SEQ ID NO: 22974 - DNA, 15 bp, Homo sapiens
actcacctgccagtc

SEQ ID NO: 22975 - DNA, 15 bp, Homo sapiens
tactcacctgccagt

SEQ ID NO: 22976 - DNA, 15 bp, Homo sapiens
ctactcacctgccag

SEQ ID NO: 22977 - DNA, 15 bp, Homo sapiens
gctactcacctgcca

SEQ ID NO: 22978 - DNA, 15 bp, Homo sapiens
agctactcacctgcc

SEQ ID NO: 22979 - DNA, 15 bp, Homo sapiens
gagctactcacctgc

SEQ ID NO: 22980 - DNA, 15 bp, Homo sapiens
tgagctactcacctg

SEQ ID NO: 22981 - DNA, 15 bp, Homo sapiens
ttgagctactcacct

SEQ ID NO: 22982 - DNA, 15 bp, Homo sapiens
gttgagctactcacc

SEQ ID NO: 22983 - DNA, 15 bp, Homo sapiens
ggttgagctactcac

SEQ ID NO: 22984 - DNA, 15 bp, Homo sapiens
gggttgagctactca

SEQ ID NO: 22985 - DNA, 15 bp, Homo sapiens
tgggttgagctactc

SEQ ID NO: 22986 - DNA, 15 bp, Homo sapiens
ctgggttgagctact

SEQ ID NO: 22987 - DNA, 15 bp, Homo sapiens
cctgggttgagctac

SEQ ID NO: 22988 - DNA, 15 bp, Homo sapiens
gcctgggttgagcta

SEQ ID NO: 22989 - DNA, 15 bp, Homo sapiens
agcctgggttgagct

SEQ ID NO: 22990 - DNA, 15 bp, Homo sapiens
aagcctgggttgagc

SEQ ID NO: 22991 - DNA, 15 bp, Homo sapiens
gaagcctgggttgag

SEQ ID NO: 22992 - DNA, 15 bp, Homo sapiens
agaagcctgggttga

SEQ ID NO: 22993 - DNA, 15 bp, Homo sapiens
cagaagcctgggttg

SEQ ID NO: 22994 - DNA, 15 bp, Homo sapiens
tcagaagcctgggtt

SEQ ID NO: 22995 - DNA, 15 bp, Homo sapiens
ctcagaagcctgggt

SEQ ID NO: 22996 - DNA, 15 bp, Homo sapiens
cctcagaagcctggg

SEQ ID NO: 22997 - DNA, 15 bp, Homo sapiens
ccctcagaagcctgg

SEQ ID NO: 22998 - DNA, 15 bp, Homo sapiens
accctcagaagcctg

SEQ ID NO: 22999 - DNA, 15 bp, Homo sapiens
gaccctcagaagcct

SEQ ID NO: 23000 - DNA, 15 bp, Homo sapiens
ggaccctcagaagcc

SEQ ID NO: 23001 - DNA, 15 bp, Homo sapiens
aggaccctcagaagc

SEQ ID NO: 23002 - DNA, 15 bp, Homo sapiens
aaggaccctcagaag

SEQ ID NO: 23003 - DNA, 15 bp, Homo sapiens
gaaggaccctcagaa

SEQ ID NO: 23004 - DNA, 15 bp, Homo sapiens
tgaaggaccctcaga

SEQ ID NO: 23005 - DNA, 15 bp, Homo sapiens
atgaaggaccctcag

SEQ ID NO: 23006 - DNA, 15 bp, Homo sapiens
catgaaggaccctca

SEQ ID NO: 23007 - DNA, 15 bp, Homo sapiens
acatgaaggaccctc

SEQ ID NO: 23008 - DNA, 15 bp, Homo sapiens
gacatgaaggaccct

SEQ ID NO: 23009 - DNA, 15 bp, Homo sapiens
agacatgaaggaccc

SEQ ID NO: 23010 - DNA, 15 bp, Homo sapiens
aagacatgaaggacc

SEQ ID NO: 23011 - DNA, 15 bp, Homo sapiens
aaagacatgaaggac

SEQ ID NO: 23012 - DNA, 15 bp, Homo sapiens
aaaagacatgaagga

SEQ ID NO: 23013 - DNA, 15 bp, Homo sapiens
caaaagacatgaagg

SEQ ID NO: 23014 - DNA, 15 bp, Homo sapiens
ccaaaagacatgaag

SEQ ID NO: 23015 - DNA, 15 bp, Homo sapiens
tccaaaagacatgaa

SEQ ID NO: 23016 - DNA, 15 bp, Homo sapiens
ttccaaaagacatga

SEQ ID NO: 23017 - DNA, 15 bp, Homo sapiens
gttccaaaagacatg

SEQ ID NO: 23018 - DNA, 15 bp, Homo sapiens
tgttccaaaagacat

SEQ ID NO: 23019 - DNA, 15 bp, Homo sapiens
gtgttccaaaagaca

SEQ ID NO: 23020 - DNA, 15 bp, Homo sapiens
tgtgttccaaaagac

SEQ ID NO: 23021 - DNA, 15 bp, Homo sapiens
ttgtgttccaaaaga

SEQ ID NO: 23022 - DNA, 15 bp, Homo sapiens
attgtgttccaaaag

SEQ ID NO: 23023 - DNA, 15 bp, Homo sapiens
aattgtgttccaaaa

SEQ ID NO: 23024 - DNA, 15 bp, Homo sapiens
aaattgtgttccaaa

SEQ ID NO: 23025 - DNA, 15 bp, Homo sapiens
caaattgtgttccaa

SEQ ID NO: 23026 - DNA, 15 bp, Homo sapiens
tcaaattgtgttcca

SEQ ID NO: 23027 - DNA, 15 bp, Homo sapiens
ttcaaattgtgttcc

SEQ ID NO: 23028 - DNA, 15 bp, Homo sapiens
tttcaaattgtgttc

SEQ ID NO: 23029 - DNA, 15 bp, Homo sapiens
ttttcaaattgtgtt

SEQ ID NO: 23030 - DNA, 15 bp, Homo sapiens
attttcaaattgtgt

SEQ ID NO: 23031 - DNA, 15 bp, Homo sapiens
gattttcaaattgtg

SEQ ID NO: 23032 - DNA, 15 bp, Homo sapiens
tgattttcaaattgt

SEQ ID NO: 23033 - DNA, 15 bp, Homo sapiens
gtgattttcaaattg

SEQ ID NO: 23034 - DNA, 15 bp, Homo sapiens
agtgattttcaaatt

SEQ ID NO: 23035 - DNA, 15 bp, Homo sapiens
cagtgattttcaaat

SEQ ID NO: 23036 - DNA, 15 bp, Homo sapiens
gcagtgattttcaaa

SEQ ID NO: 23037 - DNA, 15 bp, Homo sapiens
agcagtgattttcaa

SEQ ID NO: 23038 - DNA, 15 bp, Homo sapiens
aagcagtgattttca

SEQ ID NO: 23039 - DNA, 15 bp, Homo sapiens
aaagcagtgattttc

SEQ ID NO: 23040 - DNA, 15 bp, Homo sapiens
taaagcagtgatttt

SEQ ID NO: 23041 - DNA, 15 bp, Homo sapiens
ttaaagcagtgattt

SEQ ID NO: 23042 - DNA, 15 bp, Homo sapiens
attaaagcagtgatt

SEQ ID NO: 23043 - DNA, 15 bp, Homo sapiens
aattaaagcagtgat

SEQ ID NO: 23044 - DNA, 15 bp, Homo sapiens
caattaaagcagtga

SEQ ID NO: 23045 - DNA, 15 bp, Homo sapiens
gcaattaaagcagtg

SEQ ID NO: 23046 - DNA, 15 bp, Homo sapiens
agcaattaaagcagt

SEQ ID NO: 23047 - DNA, 15 bp, Homo sapiens
tagcaattaaagcag

SEQ ID NO: 23048 - DNA, 15 bp, Homo sapiens
ttagcaattaaagca

SEQ ID NO: 23049 - DNA, 15 bp, Homo sapiens
tttagcaattaaagc

SEQ ID NO: 23050 - DNA, 15 bp, Homo sapiens
atttagcaattaaag

SEQ ID NO: 23051 - DNA, 15 bp, Homo sapiens
aatttagcaattaaa

SEQ ID NO: 23052 - DNA, 15 bp, Homo sapiens
gaatttagcaattaa

SEQ ID NO: 23053 - DNA, 15 bp, Homo sapiens
agaatttagcaatta

SEQ ID NO: 23054 - DNA, 15 bp, Homo sapiens
tagaatttagcaatt

SEQ ID NO: 23055 - DNA, 15 bp, Homo sapiens
ctagaatttagcaat

SEQ ID NO: 23056 - DNA, 15 bp, Homo sapiens
tctagaatttagcaa

SEQ ID NO: 23057 - DNA, 15 bp, Homo sapiens
ttctagaatttagca

SEQ ID NO: 23058 - DNA, 15 bp, Homo sapiens
tttctagaatttagc

SEQ ID NO: 23059 - DNA, 15 bp, Homo sapiens
ttttctagaatttag

SEQ ID NO: 23060 - DNA, 15 bp, Homo sapiens
gttttctagaattta

SEQ ID NO: 23061 - DNA, 15 bp, Homo sapiens
ggttttctagaattt

SEQ ID NO: 23062 - DNA, 15 bp, Homo sapiens
aggttttctagaatt

SEQ ID NO: 23063 - DNA, 15 bp, Homo sapiens
caggttttctagaat

SEQ ID NO: 23064 - DNA, 15 bp, Homo sapiens
ccaggttttctagaa

SEQ ID NO: 23065 - DNA, 15 bp, Homo sapiens
tccaggttttctaga

SEQ ID NO: 23066 - DNA, 15 bp, Homo sapiens
atccaggttttctag

SEQ ID NO: 23067 - DNA, 15 bp, Homo sapiens
catccaggttttcta

SEQ ID NO: 23068 - DNA, 15 bp, Homo sapiens
gcatccaggttttct

SEQ ID NO: 23069 - DNA, 15 bp, Homo sapiens
ggcatccaggttttc

SEQ ID NO: 23070 - DNA, 15 bp, Homo sapiens
gggcatccaggtttt

SEQ ID NO: 23071 - DNA, 15 bp, Homo sapiens
agggcatccaggttt

SEQ ID NO: 23072 - DNA, 15 bp, Homo sapiens
tagggcatccaggtt

SEQ ID NO: 23073 - DNA, 15 bp, Homo sapiens
atagggcatccaggt

SEQ ID NO: 23074 - DNA, 15 bp, Homo sapiens
aatagggcatccagg

SEQ ID NO: 23075 - DNA, 15 bp, Homo sapiens
aaatagggcatccag

SEQ ID NO: 23076 - DNA, 15 bp, Homo sapiens
taaatagggcatcca

SEQ ID NO: 23077 - DNA, 15 bp, Homo sapiens
ttaaatagggcatcc

SEQ ID NO: 23078 - DNA, 15 bp, Homo sapiens
tttaaatagggcatc

SEQ ID NO: 23079 - DNA, 15 bp, Homo sapiens
ttttaaatagggcat

SEQ ID NO: 23080 - DNA, 15 bp, Homo sapiens
tttttaaatagggca

SEQ ID NO: 23081 - DNA, 15 bp, Homo sapiens
ttttttaaatagggc

SEQ ID NO: 23082 - DNA, 15 bp, Homo sapiens
tttttttaaataggg

SEQ ID NO: 23083 - DNA, 15 bp, Homo sapiens
ctttttttaaatagg

SEQ ID NO: 23084 - DNA, 15 bp, Homo sapiens
tctttttttaaatag

SEQ ID NO: 23085 - DNA, 15 bp, Homo sapiens
ctctttttttaaata

SEQ ID NO: 23086 - DNA, 15 bp, Homo sapiens
gctctttttttaaat

SEQ ID NO: 23087 - DNA, 15 bp, Homo sapiens
agctctttttttaaa

SEQ ID NO: 23088 - DNA, 15 bp, Homo sapiens
aagctctttttttaa

SEQ ID NO: 23089 - DNA, 15 bp, Homo sapiens
taagctcttttttta

SEQ ID NO: 23090 - DNA, 15 bp, Homo sapiens
ctaagctcttttttt

SEQ ID NO: 23091 - DNA, 15 bp, Homo sapiens
gctaagctctttttt

SEQ ID NO: 23092 - DNA, 15 bp, Homo sapiens
agctaagctcttttt

SEQ ID NO: 23093 - DNA, 15 bp, Homo sapiens
aagctaagctctttt

SEQ ID NO: 23094 - DNA, 15 bp, Homo sapiens
taagctaagctcttt

SEQ ID NO: 23095 - DNA, 15 bp, Homo sapiens
ctaagctaagctctt

SEQ ID NO: 23096 - DNA, 15 bp, Homo sapiens
actaagctaagctct

SEQ ID NO: 23097 - DNA, 15 bp, Homo sapiens
cactaagctaagctc

SEQ ID NO: 23098 - DNA, 15 bp, Homo sapiens
acactaagctaagct

SEQ ID NO: 23099 - DNA, 15 bp, Homo sapiens
gacactaagctaagc

SEQ ID NO: 23100 - DNA, 15 bp, Homo sapiens
tgacactaagctaag

SEQ ID NO: 23101 - DNA, 15 bp, Homo sapiens
ttgacactaagctaa

SEQ ID NO: 23102 - DNA, 15 bp, Homo sapiens
tttgacactaagcta

SEQ ID NO: 23103 - DNA, 15 bp, Homo sapiens
ctttgacactaagct

SEQ ID NO: 23104 - DNA, 15 bp, Homo sapiens
tctttgacactaagc

SEQ ID NO: 23105 - DNA, 15 bp, Homo sapiens
ctctttgacactaag

SEQ ID NO: 23106 - DNA, 15 bp, Homo sapiens
cctctttgacactaa

SEQ ID NO: 23107 - DNA, 15 bp, Homo sapiens
tcctctttgacacta

SEQ ID NO: 23108 - DNA, 15 bp, Homo sapiens
ttcctctttgacact

SEQ ID NO: 23109 - DNA, 15 bp, Homo sapiens
gttcctctttgacac

SEQ ID NO: 23110 - DNA, 15 bp, Homo sapiens
agttcctctttgaca

SEQ ID NO: 23111 - DNA, 15 bp, Homo sapiens
tagttcctctttgac

SEQ ID NO: 23112 - DNA, 15 bp, Homo sapiens
ctagttcctctttga

SEQ ID NO: 23113 - DNA, 15 bp, Homo sapiens
cctagttcctctttg

SEQ ID NO: 23114 - DNA, 15 bp, Homo sapiens
acctagttcctcttt

SEQ ID NO: 23115 - DNA, 15 bp, Homo sapiens
aacctagttcctctt

SEQ ID NO: 23116 - DNA, 15 bp, Homo sapiens
gaacctagttcctct

SEQ ID NO: 23117 - DNA, 15 bp, Homo sapiens
ggaacctagttcctc

SEQ ID NO: 23118 - DNA, 15 bp, Homo sapiens
tggaacctagttcct

SEQ ID NO: 23119 - DNA, 15 bp, Homo sapiens
ctggaacctagttcc

SEQ ID NO: 23120 - DNA, 15 bp, Homo sapiens
actggaacctagttc

SEQ ID NO: 23121 - DNA, 15 bp, Homo sapiens
aactggaacctagtt

SEQ ID NO: 23122 - DNA, 15 bp, Homo sapiens
aaactggaacctagt

SEQ ID NO: 23123 - DNA, 15 bp, Homo sapiens
aaaactggaacctag

SEQ ID NO: 23124 - DNA, 15 bp, Homo sapiens
taaaactggaaccta

SEQ ID NO: 23125 - DNA, 15 bp, Homo sapiens
ctaaaactggaacct

SEQ ID NO: 23126 - DNA, 15 bp, Homo sapiens
gctaaaactggaacc

SEQ ID NO: 23127 - DNA, 15 bp, Homo sapiens
agctaaaactggaac

SEQ ID NO: 23128 - DNA, 15 bp, Homo sapiens
gagctaaaactggaa

SEQ ID NO: 23129 - DNA, 15 bp, Homo sapiens
agagctaaaactgga

SEQ ID NO: 23130 - DNA, 15 bp, Homo sapiens
cagagctaaaactgg

SEQ ID NO: 23131 - DNA, 15 bp, Homo sapiens
gcagagctaaaactg

SEQ ID NO: 23132 - DNA, 15 bp, Homo sapiens
tgcagagctaaaact

SEQ ID NO: 23133 - DNA, 15 bp, Homo sapiens
ctgcagagctaaaac

SEQ ID NO: 23134 - DNA, 15 bp, Homo sapiens
tctgcagagctaaaa

SEQ ID NO: 23135 - DNA, 15 bp, Homo sapiens
atctgcagagctaaa

SEQ ID NO: 23136 - DNA, 15 bp, Homo sapiens
gatctgcagagctaa

SEQ ID NO: 23137 - DNA, 15 bp, Homo sapiens
tgatctgcagagcta

SEQ ID NO: 23138 - DNA, 15 bp, Homo sapiens
gtgatctgcagagct

SEQ ID NO: 23139 - DNA, 15 bp, Homo sapiens
ggtgatctgcagagc

SEQ ID NO: 23140 - DNA, 15 bp, Homo sapiens
tggtgatctgcagag

SEQ ID NO: 23141 - DNA, 15 bp, Homo sapiens
ctggtgatctgcaga

SEQ ID NO: 23142 - DNA, 15 bp, Homo sapiens
gctggtgatctgcag

SEQ ID NO: 23143 - DNA, 15 bp, Homo sapiens
agctggtgatctgca

SEQ ID NO: 23144 - DNA, 15 bp, Homo sapiens
cagctggtgatctgc

SEQ ID NO: 23145 - DNA, 15 bp, Homo sapiens
acagctggtgatctg

SEQ ID NO: 23146 - DNA, 15 bp, Homo sapiens
cacagctggtgatct

SEQ ID NO: 23147 - DNA, 15 bp, Homo sapiens
acacagctggtgatc

SEQ ID NO: 23148 - DNA, 15 bp, Homo sapiens
cacacagctggtgat

SEQ ID NO: 23149 - DNA, 15 bp, Homo sapiens
tcacacagctggtga

SEQ ID NO: 23150 - DNA, 15 bp, Homo sapiens
gtcacacagctggtg

SEQ ID NO: 23151 - DNA, 15 bp, Homo sapiens
ggtcacacagctggt

SEQ ID NO: 23152 - DNA, 15 bp, Homo sapiens
aggtcacacagctgg

SEQ ID NO: 23153 - DNA, 15 bp, Homo sapiens
aaggtcacacagctg

SEQ ID NO: 23154 - DNA, 15 bp, Homo sapiens
caaggtcacacagct

SEQ ID NO: 23155 - DNA, 15 bp, Homo sapiens
tcaaggtcacacagc

SEQ ID NO: 23156 - DNA, 15 bp, Homo sapiens
ttcaaggtcacacag

SEQ ID NO: 23157 - DNA, 15 bp, Homo sapiens
attcaaggtcacaca

SEQ ID NO: 23158 - DNA, 15 bp, Homo sapiens
tattcaaggtcacac

SEQ ID NO: 23159 - DNA, 15 bp, Homo sapiens
atattcaaggtcaca

SEQ ID NO: 23160 - DNA, 15 bp, Homo sapiens
catattcaaggtcac

SEQ ID NO: 23161 - DNA, 15 bp, Homo sapiens
acatattcaaggtca

SEQ ID NO: 23162 - DNA, 15 bp, Homo sapiens
gacatattcaaggtc

SEQ ID NO: 23163 - DNA, 15 bp, Homo sapiens
tgacatattcaaggt

SEQ ID NO: 23164 - DNA, 15 bp, Homo sapiens
gtgacatattcaagg

SEQ ID NO: 23165 - DNA, 15 bp, Homo sapiens
agtgacatattcaag

SEQ ID NO: 23166 - DNA, 15 bp, Homo sapiens
gagtgacatattcaa

SEQ ID NO: 23167 - DNA, 15 bp, Homo sapiens
tgagtgacatattca

SEQ ID NO: 23168 - DNA, 15 bp, Homo sapiens
ttgagtgacatattc

SEQ ID NO: 23169 - DNA, 15 bp, Homo sapiens
cttgagtgacatatt

SEQ ID NO: 23170 - DNA, 15 bp, Homo sapiens
gcttgagtgacatat

SEQ ID NO: 23171 - DNA, 15 bp, Homo sapiens
agcttgagtgacata

SEQ ID NO: 23172 - DNA, 15 bp, Homo sapiens
cagcttgagtgacat

SEQ ID NO: 23173 - DNA, 15 bp, Homo sapiens
acagcttgagtgaca

SEQ ID NO: 23174 - DNA, 15 bp, Homo sapiens
gacagcttgagtgac

SEQ ID NO: 23175 - DNA, 15 bp, Homo sapiens
agacagcttgagtga

SEQ ID NO: 23176 - DNA, 15 bp, Homo sapiens
cagacagcttgagtg

SEQ ID NO: 23177 - DNA, 15 bp, Homo sapiens
gcagacagcttgagt

SEQ ID NO: 23178 - DNA, 15 bp, Homo sapiens
tgcagacagcttgag

SEQ ID NO: 23179 - DNA, 15 bp, Homo sapiens
gtgcagacagcttga

SEQ ID NO: 23180 - DNA, 15 bp, Homo sapiens
tgtgcagacagcttg

SEQ ID NO: 23181 - DNA, 15 bp, Homo sapiens
ttgtgcagacagctt

SEQ ID NO: 23182 - DNA, 15 bp, Homo sapiens
attgtgcagacagct

SEQ ID NO: 23183 - DNA, 15 bp, Homo sapiens
aattgtgcagacagc

SEQ ID NO: 23184 - DNA, 15 bp, Homo sapiens
taattgtgcagacag

SEQ ID NO: 23185 - DNA, 15 bp, Homo sapiens
ttaattgtgcagaca

SEQ ID NO: 23186 - DNA, 15 bp, Homo sapiens
attaattgtgcagac

SEQ ID NO: 23187 - DNA, 15 bp, Homo sapiens
aattaattgtgcaga

SEQ ID NO: 23188 - DNA, 15 bp, Homo sapiens
caattaattgtgcag

SEQ ID NO: 23189 - DNA, 15 bp, Homo sapiens
tcaattaattgtgca

SEQ ID NO: 23190 - DNA, 15 bp, Homo sapiens
atcaattaattgtgc

SEQ ID NO: 23191 - DNA, 15 bp, Homo sapiens
aatcaattaattgtg

SEQ ID NO: 23192 - DNA, 15 bp, Homo sapiens
aaatcaattaattgt

SEQ ID NO: 23193 - DNA, 15 bp, Homo sapiens
caaatcaattaattg

SEQ ID NO: 23194 - DNA, 15 bp, Homo sapiens
acaaatcaattaatt

SEQ ID NO: 23195 - DNA, 15 bp, Homo sapiens
aacaaatcaattaat

SEQ ID NO: 23196 - DNA, 15 bp, Homo sapiens
aaacaaatcaattaa

SEQ ID NO: 23197 - DNA, 15 bp, Homo sapiens
caaacaaatcaatta

SEQ ID NO: 23198 - DNA, 15 bp, Homo sapiens
acaaacaaatcaatt

SEQ ID NO: 23199 - DNA, 15 bp, Homo sapiens
tacaaacaaatcaat

SEQ ID NO: 23200 - DNA, 15 bp, Homo sapiens
ttacaaacaaatcaa

SEQ ID NO: 23201 - DNA, 15 bp, Homo sapiens
cttacaaacaaatca

SEQ ID NO: 23202 - DNA, 15 bp, Homo sapiens
ccttacaaacaaatc

SEQ ID NO: 23203 - DNA, 15 bp, Homo sapiens
accttacaaacaaat

SEQ ID NO: 23204 - DNA, 15 bp, Homo sapiens
taccttacaaacaaa

SEQ ID NO: 23205 - DNA, 15 bp, Homo sapiens
ttaccttacaaacaa

SEQ ID NO: 23206 - DNA, 15 bp, Homo sapiens
cttaccttacaaaca

SEQ ID NO: 23207 - DNA, 15 bp, Homo sapiens
ccttaccttacaaac

SEQ ID NO: 23208 - DNA, 15 bp, Homo sapiens
tccttaccttacaaa

SEQ ID NO: 23209 - DNA, 15 bp, Homo sapiens
ctccttaccttacaa

SEQ ID NO: 23210 - DNA, 15 bp, Homo sapiens
actccttaccttaca

SEQ ID NO: 23211 - DNA, 15 bp, Homo sapiens
tactccttaccttac

SEQ ID NO: 23212 - DNA, 15 bp, Homo sapiens
atactccttacctta

SEQ ID NO: 23213 - DNA, 15 bp, Homo sapiens
catactccttacctt

SEQ ID NO: 23214 - DNA, 15 bp, Homo sapiens
ccatactccttacct

SEQ ID NO: 23215 - DNA, 15 bp, Homo sapiens
tccatactccttacc

SEQ ID NO: 23216 - DNA, 15 bp, Homo sapiens
gtccatactccttac

SEQ ID NO: 23217 - DNA, 15 bp, Homo sapiens
agtccatactcctta

SEQ ID NO: 23218 - DNA, 15 bp, Homo sapiens
tagtccatactcctt

SEQ ID NO: 23219 - DNA, 15 bp, Homo sapiens
ctagtccatactcct

SEQ ID NO: 23220 - DNA, 15 bp, Homo sapiens
tctagtccatactcc

SEQ ID NO: 23221 - DNA, 15 bp, Homo sapiens
atctagtccatactc

SEQ ID NO: 23222 - DNA, 15 bp, Homo sapiens
catctagtccatact

SEQ ID NO: 23223 - DNA, 15 bp, Homo sapiens
tcatctagtccatac

SEQ ID NO: 23224 - DNA, 15 bp, Homo sapiens
gtcatctagtccata

SEQ ID NO: 23225 - DNA, 15 bp, Homo sapiens
ggtcatctagtccat

SEQ ID NO: 23226 - DNA, 15 bp, Homo sapiens
aggtcatctagtcca

SEQ ID NO: 23227 - DNA, 15 bp, Homo sapiens
gaggtcatctagtcc

SEQ ID NO: 23228 - DNA, 15 bp, Homo sapiens
tgaggtcatctagtc

SEQ ID NO: 23229 - DNA, 15 bp, Homo sapiens
gtgaggtcatctagt

SEQ ID NO: 23230 - DNA, 15 bp, Homo sapiens
tgtgaggtcatctag

SEQ ID NO: 23231 - DNA, 15 bp, Homo sapiens
gtgtgaggtcatcta

SEQ ID NO: 23232 - DNA, 15 bp, Homo sapiens
agtgtgaggtcatct

SEQ ID NO: 23233 - DNA, 15 bp, Homo sapiens
cagtgtgaggtcatc

SEQ ID NO: 23234 - DNA, 15 bp, Homo sapiens
tcagtgtgaggtcat

SEQ ID NO: 23235 - DNA, 15 bp, Homo sapiens
atcagtgtgaggtca

SEQ ID NO: 23236 - DNA, 15 bp, Homo sapiens
gatcagtgtgaggtc

SEQ ID NO: 23237 - DNA, 15 bp, Homo sapiens
tgatcagtgtgaggt

SEQ ID NO: 23238 - DNA, 15 bp, Homo sapiens
gtgatcagtgtgagg

SEQ ID NO: 23239 - DNA, 15 bp, Homo sapiens
agtgatcagtgtgag

SEQ ID NO: 23240 - DNA, 15 bp, Homo sapiens
aagtgatcagtgtga

SEQ ID NO: 23241 - DNA, 15 bp, Homo sapiens
aaagtgatcagtgtg

SEQ ID NO: 23242 - DNA, 15 bp, Homo sapiens
gaaagtgatcagtgt

SEQ ID NO: 23243 - DNA, 15 bp, Homo sapiens
agaaagtgatcagtg

SEQ ID NO: 23244 - DNA, 15 bp, Homo sapiens
tagaaagtgatcagt

SEQ ID NO: 23245 - DNA, 15 bp, Homo sapiens
ttagaaagtgatcag

SEQ ID NO: 23246 - DNA, 15 bp, Homo sapiens
cttagaaagtgatca

SEQ ID NO: 23247 - DNA, 15 bp, Homo sapiens
gcttagaaagtgatc

SEQ ID NO: 23248 - DNA, 15 bp, Homo sapiens
agcttagaaagtgat

SEQ ID NO: 23249 - DNA, 15 bp, Homo sapiens
gagcttagaaagtga

SEQ ID NO: 23250 - DNA, 15 bp, Homo sapiens
ggagcttagaaagtg

SEQ ID NO: 23251 - DNA, 15 bp, Homo sapiens
tggagcttagaaagt

SEQ ID NO: 23252 - DNA, 15 bp, Homo sapiens
ctggagcttagaaag

SEQ ID NO: 23253 - DNA, 15 bp, Homo sapiens
tctggagcttagaaa

SEQ ID NO: 23254 - DNA, 15 bp, Homo sapiens
ttctggagcttagaa

SEQ ID NO: 23255 - DNA, 15 bp, Homo sapiens
tttctggagcttaga

SEQ ID NO: 23256 - DNA, 15 bp, Homo sapiens
ttttctggagcttag

SEQ ID NO: 23257 - DNA, 15 bp, Homo sapiens
gttttctggagctta

SEQ ID NO: 23258 - DNA, 15 bp, Homo sapiens
ggttttctggagctt

SEQ ID NO: 23259 - DNA, 15 bp, Homo sapiens
aggttttctggagct

SEQ ID NO: 23260 - DNA, 15 bp, Homo sapiens
taggttttctggagc

SEQ ID NO: 23261 - DNA, 15 bp, Homo sapiens
ttaggttttctggag

SEQ ID NO: 23262 - DNA, 15 bp, Homo sapiens
attaggttttctgga

SEQ ID NO: 23263 - DNA, 15 bp, Homo sapiens
aattaggttttctgg

SEQ ID NO: 23264 - DNA, 15 bp, Homo sapiens
caattaggttttctg

SEQ ID NO: 23265 - DNA, 15 bp, Homo sapiens
acaattaggttttct

SEQ ID NO: 23266 - DNA, 15 bp, Homo sapiens
aacaattaggttttc

SEQ ID NO: 23267 - DNA, 15 bp, Homo sapiens
taacaattaggtttt

SEQ ID NO: 23268 - DNA, 15 bp, Homo sapiens
ttaacaattaggttt

SEQ ID NO: 23269 - DNA, 15 bp, Homo sapiens
attaacaattaggtt

SEQ ID NO: 23270 - DNA, 15 bp, Homo sapiens
cattaacaattaggt

SEQ ID NO: 23271 - DNA, 15 bp, Homo sapiens
gcattaacaattagg

SEQ ID NO: 23272 - DNA, 15 bp, Homo sapiens
agcattaacaattag

SEQ ID NO: 23273 - DNA, 15 bp, Homo sapiens
aagcattaacaatta

SEQ ID NO: 23274 - DNA, 15 bp, Homo sapiens
taagcattaacaatt

SEQ ID NO: 23275 - DNA, 15 bp, Homo sapiens
ttaagcattaacaat

SEQ ID NO: 23276 - DNA, 15 bp, Homo sapiens
attaagcattaacaa

SEQ ID NO: 23277 - DNA, 15 bp, Homo sapiens
aattaagcattaaca

SEQ ID NO: 23278 - DNA, 15 bp, Homo sapiens
caattaagcattaac

SEQ ID NO: 23279 - DNA, 15 bp, Homo sapiens
acaattaagcattaa

SEQ ID NO: 23280 - DNA, 15 bp, Homo sapiens
cacaattaagcatta

SEQ ID NO: 23281 - DNA, 15 bp, Homo sapiens
gcacaattaagcatt

SEQ ID NO: 23282 - DNA, 15 bp, Homo sapiens
cgcacaattaagcat

SEQ ID NO: 23283 - DNA, 15 bp, Homo sapiens
tcgcacaattaagca

SEQ ID NO: 23284 - DNA, 15 bp, Homo sapiens
ctcgcacaattaagc

SEQ ID NO: 23285 - DNA, 15 bp, Homo sapiens
gctcgcacaattaag

SEQ ID NO: 23286 - DNA, 15 bp, Homo sapiens
agctcgcacaattaa

SEQ ID NO: 23287 - DNA, 15 bp, Homo sapiens
cagctcgcacaatta

SEQ ID NO: 23288 - DNA, 15 bp, Homo sapiens
acagctcgcacaatt

SEQ ID NO: 23289 - DNA, 15 bp, Homo sapiens
cacagctcgcacaat

SEQ ID NO: 23290 - DNA, 15 bp, Homo sapiens
gcacagctcgcacaa

SEQ ID NO: 23291 - DNA, 15 bp, Homo sapiens
agcacagctcgcaca

SEQ ID NO: 23292 - DNA, 15 bp, Homo sapiens
gagcacagctcgcac

SEQ ID NO: 23293 - DNA, 15 bp, Homo sapiens
cgagcacagctcgca

SEQ ID NO: 23294 - DNA, 15 bp, Homo sapiens
ccgagcacagctcgc

SEQ ID NO: 23295 - DNA, 15 bp, Homo sapiens
cccgagcacagctcg

SEQ ID NO: 23296 - DNA, 15 bp, Homo sapiens
tcccgagcacagctc

SEQ ID NO: 23297 - DNA, 15 bp, Homo sapiens
ttcccgagcacagct

SEQ ID NO: 23298 - DNA, 15 bp, Homo sapiens
cttcccgagcacagc

SEQ ID NO: 23299 - DNA, 15 bp, Homo sapiens
ccttcccgagcacag

SEQ ID NO: 23300 - DNA, 15 bp, Homo sapiens
cccttcccgagcaca

SEQ ID NO: 23301 - DNA, 15 bp, Homo sapiens
gcccttcccgagcac

SEQ ID NO: 23302 - DNA, 15 bp, Homo sapiens
agcccttcccgagca

SEQ ID NO: 23303 - DNA, 15 bp, Homo sapiens
cagcccttcccgagc

SEQ ID NO: 23304 - DNA, 15 bp, Homo sapiens
acagcccttcccgag

SEQ ID NO: 23305 - DNA, 15 bp, Homo sapiens
cacagcccttcccga

SEQ ID NO: 23306 - DNA, 15 bp, Homo sapiens
acacagcccttcccg

SEQ ID NO: 23307 - DNA, 15 bp, Homo sapiens
aacacagcccttccc

SEQ ID NO: 23308 - DNA, 15 bp, Homo sapiens
gaacacagcccttcc

SEQ ID NO: 23309 - DNA, 15 bp, Homo sapiens
agaacacagcccttc

SEQ ID NO: 23310 - DNA, 15 bp, Homo sapiens
tagaacacagccctt

SEQ ID NO: 23311 - DNA, 15 bp, Homo sapiens
ctagaacacagccct

SEQ ID NO: 23312 - DNA, 15 bp, Homo sapiens
actagaacacagccc

SEQ ID NO: 23313 - DNA, 15 bp, Homo sapiens
tactagaacacagcc

SEQ ID NO: 23314 - DNA, 15 bp, Homo sapiens
gtactagaacacagc

SEQ ID NO: 23315 - DNA, 15 bp, Homo sapiens
ggtactagaacacag

SEQ ID NO: 23316 - DNA, 15 bp, Homo sapiens
aggtactagaacaca

SEQ ID NO: 23317 - DNA, 15 bp, Homo sapiens
aaggtactagaacac

SEQ ID NO: 23318 - DNA, 15 bp, Homo sapiens
gaaggtactagaaca

SEQ ID NO: 23319 - DNA, 15 bp, Homo sapiens
agaaggtactagaac

SEQ ID NO: 23320 - DNA, 15 bp, Homo sapiens
aagaaggtactagaa

SEQ ID NO: 23321 - DNA, 15 bp, Homo sapiens
gaagaaggtactaga

SEQ ID NO: 23322 - DNA, 15 bp, Homo sapiens
ggaagaaggtactag

SEQ ID NO: 23323 - DNA, 15 bp, Homo sapiens
aggaagaaggtacta

SEQ ID NO: 23324 - DNA, 15 bp, Homo sapiens
gaggaagaaggtact

SEQ ID NO: 23325 - DNA, 15 bp, Homo sapiens
tgaggaagaaggtac

SEQ ID NO: 23326 - DNA, 15 bp, Homo sapiens
atgaggaagaaggta

SEQ ID NO: 23327 - DNA, 15 bp, Homo sapiens
gatgaggaagaaggt

SEQ ID NO: 23328 - DNA, 15 bp, Homo sapiens
tgatgaggaagaagg

SEQ ID NO: 23329 - DNA, 15 bp, Homo sapiens
gtgatgaggaagaag

SEQ ID NO: 23330 - DNA, 15 bp, Homo sapiens
agtgatgaggaagaa

SEQ ID NO: 23331 - DNA, 15 bp, Homo sapiens
cagtgatgaggaaga

SEQ ID NO: 23332 - DNA, 15 bp, Homo sapiens
acagtgatgaggaag

SEQ ID NO: 23333 - DNA, 15 bp, Homo sapiens
gacagtgatgaggaa

SEQ ID NO: 23334 - DNA, 15 bp, Homo sapiens
tgacagtgatgagga

SEQ ID NO: 23335 - DNA, 15 bp, Homo sapiens
atgacagtgatgagg

SEQ ID NO: 23336 - DNA, 15 bp, Homo sapiens
aatgacagtgatgag

SEQ ID NO: 23337 - DNA, 15 bp, Homo sapiens
aaatgacagtgatga

SEQ ID NO: 23338 - DNA, 15 bp, Homo sapiens
gaaatgacagtgatg

SEQ ID NO: 23339 - DNA, 15 bp, Homo sapiens
tgaaatgacagtgat

SEQ ID NO: 23340 - DNA, 15 bp, Homo sapiens
ctgaaatgacagtga

SEQ ID NO: 23341 - DNA, 15 bp, Homo sapiens
actgaaatgacagtg

SEQ ID NO: 23342 - DNA, 15 bp, Homo sapiens
tactgaaatgacagt

SEQ ID NO: 23343 - DNA, 15 bp, Homo sapiens
atactgaaatgacag

SEQ ID NO: 23344 - DNA, 15 bp, Homo sapiens
aatactgaaatgaca

SEQ ID NO: 23345 - DNA, 15 bp, Homo sapiens
taatactgaaatgac

SEQ ID NO: 23346 - DNA, 15 bp, Homo sapiens
ataatactgaaatga

SEQ ID NO: 23347 - DNA, 15 bp, Homo sapiens
gataatactgaaatg

SEQ ID NO: 23348 - DNA, 15 bp, Homo sapiens
agataatactgaaat

SEQ ID NO: 23349 - DNA, 15 bp, Homo sapiens
tagataatactgaaa

SEQ ID NO: 23350 - DNA, 15 bp, Homo sapiens
gtagataatactgaa

SEQ ID NO: 23351 - DNA, 15 bp, Homo sapiens
tgtagataatactga

SEQ ID NO: 23352 - DNA, 15 bp, Homo sapiens
gtgtagataatactg

SEQ ID NO: 23353 - DNA, 15 bp, Homo sapiens
agtgtagataatact

SEQ ID NO: 23354 - DNA, 15 bp, Homo sapiens
cagtgtagataatac

SEQ ID NO: 23355 - DNA, 15 bp, Homo sapiens
tcagtgtagataata

SEQ ID NO: 23356 - DNA, 15 bp, Homo sapiens
atcagtgtagataat

SEQ ID NO: 23357 - DNA, 15 bp, Homo sapiens
gatcagtgtagataa

SEQ ID NO: 23358 - DNA, 15 bp, Homo sapiens
agatcagtgtagata

SEQ ID NO: 23359 - DNA, 15 bp, Homo sapiens
aagatcagtgtagat

SEQ ID NO: 23360 - DNA, 15 bp, Homo sapiens
gaagatcagtgtaga

SEQ ID NO: 23361 - DNA, 15 bp, Homo sapiens
tgaagatcagtgtag

SEQ ID NO: 23362 - DNA, 15 bp, Homo sapiens
gtgaagatcagtgta

SEQ ID NO: 23363 - DNA, 15 bp, Homo sapiens
tgtgaagatcagtgt

SEQ ID NO: 23364 - DNA, 15 bp, Homo sapiens
ttgtgaagatcagtg

SEQ ID NO: 23365 - DNA, 15 bp, Homo sapiens
tttgtgaagatcagt

SEQ ID NO: 23366 - DNA, 15 bp, Homo sapiens
atttgtgaagatcag

SEQ ID NO: 23367 - DNA, 15 bp, Homo sapiens
tatttgtgaagatca

SEQ ID NO: 23368 - DNA, 15 bp, Homo sapiens
atatttgtgaagatc

SEQ ID NO: 23369 - DNA, 15 bp, Homo sapiens
aatatttgtgaagat

SEQ ID NO: 23370 - DNA, 15 bp, Homo sapiens
gaatatttgtgaaga

SEQ ID NO: 23371 - DNA, 15 bp, Homo sapiens
agaatatttgtgaag

SEQ ID NO: 23372 - DNA, 15 bp, Homo sapiens
cagaatatttgtgaa

SEQ ID NO: 23373 - DNA, 15 bp, Homo sapiens
gcagaatatttgtga

SEQ ID NO: 23374 - DNA, 15 bp, Homo sapiens
tgcagaatatttgtg

SEQ ID NO: 23375 - DNA, 15 bp, Homo sapiens
gtgcagaatatttgt

SEQ ID NO: 23376 - DNA, 15 bp, Homo sapiens
tgtgcagaatatttg

SEQ ID NO: 23377 - DNA, 15 bp, Homo sapiens
gtgtgcagaatattt

SEQ ID NO: 23378 - DNA, 15 bp, Homo sapiens
agtgtgcagaatatt

SEQ ID NO: 23379 - DNA, 15 bp, Homo sapiens
aagtgtgcagaatat

SEQ ID NO: 23380 - DNA, 15 bp, Homo sapiens
caagtgtgcagaata

SEQ ID NO: 23381 - DNA, 15 bp, Homo sapiens
ccaagtgtgcagaat

SEQ ID NO: 23382 - DNA, 15 bp, Homo sapiens
tccaagtgtgcagaa

SEQ ID NO: 23383 - DNA, 15 bp, Homo sapiens
atccaagtgtgcaga

SEQ ID NO: 23384 - DNA, 15 bp, Homo sapiens
aatccaagtgtgcag

SEQ ID NO: 23385 - DNA, 15 bp, Homo sapiens
gaatccaagtgtgca

SEQ ID NO: 23386 - DNA, 15 bp, Homo sapiens
agaatccaagtgtgc

SEQ ID NO: 23387 - DNA, 15 bp, Homo sapiens
tagaatccaagtgtg

SEQ ID NO: 23388 - DNA, 15 bp, Homo sapiens
ttagaatccaagtgt

SEQ ID NO: 23389 - DNA, 15 bp, Homo sapiens
gttagaatccaagtg

SEQ ID NO: 23390 - DNA, 15 bp, Homo sapiens
ggttagaatccaagt

SEQ ID NO: 23391 - DNA, 15 bp, Homo sapiens
aggttagaatccaag

SEQ ID NO: 23392 - DNA, 15 bp, Homo sapiens
caggttagaatccaa

SEQ ID NO: 23393 - DNA, 15 bp, Homo sapiens
gcaggttagaatcca

SEQ ID NO: 23394 - DNA, 15 bp, Homo sapiens
tgcaggttagaatcc

SEQ ID NO: 23395 - DNA, 15 bp, Homo sapiens
ttgcaggttagaatc

SEQ ID NO: 23396 - DNA, 15 bp, Homo sapiens
attgcaggttagaat

SEQ ID NO: 23397 - DNA, 15 bp, Homo sapiens
tattgcaggttagaa

SEQ ID NO: 23398 - DNA, 15 bp, Homo sapiens
atattgcaggttaga

SEQ ID NO: 23399 - DNA, 15 bp, Homo sapiens
aatattgcaggttag

SEQ ID NO: 23400 - DNA, 15 bp, Homo sapiens
caatattgcaggtta

SEQ ID NO: 23401 - DNA, 15 bp, Homo sapiens
gcaatattgcaggtt

SEQ ID NO: 23402 - DNA, 15 bp, Homo sapiens
agcaatattgcaggt

SEQ ID NO: 23403 - DNA, 15 bp, Homo sapiens
cagcaatattgcagg

SEQ ID NO: 23404 - DNA, 15 bp, Homo sapiens
acagcaatattgcag

SEQ ID NO: 23405 - DNA, 15 bp, Homo sapiens
aacagcaatattgca

SEQ ID NO: 23406 - DNA, 15 bp, Homo sapiens
caacagcaatattgc

SEQ ID NO: 23407 - DNA, 15 bp, Homo sapiens
ccaacagcaatattg

SEQ ID NO: 23408 - DNA, 15 bp, Homo sapiens
cccaacagcaatatt

SEQ ID NO: 23409 - DNA, 15 bp, Homo sapiens
ccccaacagcaatat

SEQ ID NO: 23410 - DNA, 15 bp, Homo sapiens
accccaacagcaata

SEQ ID NO: 23411 - DNA, 15 bp, Homo sapiens
aaccccaacagcaat

SEQ ID NO: 23412 - DNA, 15 bp, Homo sapiens
taaccccaacagcaa

SEQ ID NO: 23413 - DNA, 15 bp, Homo sapiens
ataaccccaacagca

SEQ ID NO: 23414 - DNA, 15 bp, Homo sapiens
tataaccccaacagc

SEQ ID NO: 23415 - DNA, 15 bp, Homo sapiens
ctataaccccaacag

SEQ ID NO: 23416 - DNA, 15 bp, Homo sapiens
tctataaccccaaca

SEQ ID NO: 23417 - DNA, 15 bp, Homo sapiens
ttctataaccccaac

SEQ ID NO: 23418 - DNA, 15 bp, Homo sapiens
tttctataaccccaa

SEQ ID NO: 23419 - DNA, 15 bp, Homo sapiens
atttctataacccca

SEQ ID NO: 23420 - DNA, 15 bp, Homo sapiens
tatttctataacccc

SEQ ID NO: 23421 - DNA, 15 bp, Homo sapiens
atatttctataaccc

SEQ ID NO: 23422 - DNA, 15 bp, Homo sapiens
tatatttctataacc

SEQ ID NO: 23423 - DNA, 15 bp, Homo sapiens
ctatatttctataac

SEQ ID NO: 23424 - DNA, 15 bp, Homo sapiens
tctatatttctataa

SEQ ID NO: 23425 - DNA, 15 bp, Homo sapiens
atctatatttctata

SEQ ID NO: 23426 - DNA, 15 bp, Homo sapiens
aatctatatttctat

SEQ ID NO: 23427 - DNA, 15 bp, Homo sapiens
taatctatatttcta

SEQ ID NO: 23428 - DNA, 15 bp, Homo sapiens
ataatctatatttct

SEQ ID NO: 23429 - DNA, 15 bp, Homo sapiens
tataatctatatttc

SEQ ID NO: 23430 - DNA, 15 bp, Homo sapiens
atataatctatattt

SEQ ID NO: 23431 - DNA, 15 bp, Homo sapiens
catataatctatatt

SEQ ID NO: 23432 - DNA, 15 bp, Homo sapiens
tcatataatctatat

SEQ ID NO: 23433 - DNA, 15 bp, Homo sapiens
atcatataatctata

SEQ ID NO: 23434 - DNA, 15 bp, Homo sapiens
catcatataatctat

SEQ ID NO: 23435 - DNA, 15 bp, Homo sapiens
ccatcatataatcta

SEQ ID NO: 23436 - DNA, 15 bp, Homo sapiens
accatcatataatct

SEQ ID NO: 23437 - DNA, 15 bp, Homo sapiens
taccatcatataatc

SEQ ID NO: 23438 - DNA, 15 bp, Homo sapiens
ataccatcatataat

SEQ ID NO: 23439 - DNA, 15 bp, Homo sapiens
aataccatcatataa

SEQ ID NO: 23440 - DNA, 15 bp, Homo sapiens
aaataccatcatata

SEQ ID NO: 23441 - DNA, 15 bp, Homo sapiens
taaataccatcatat

SEQ ID NO: 23442 - DNA, 15 bp, Homo sapiens
ctaaataccatcata

SEQ ID NO: 23443 - DNA, 15 bp, Homo sapiens
cctaaataccatcat

SEQ ID NO: 23444 - DNA, 15 bp, Homo sapiens
ccctaaataccatca

SEQ ID NO: 23445 - DNA, 15 bp, Homo sapiens
accctaaataccatc

SEQ ID NO: 23446 - DNA, 15 bp, Homo sapiens
taccctaaataccat

SEQ ID NO: 23447 - DNA, 15 bp, Homo sapiens
ttaccctaaatacca

SEQ ID NO: 23448 - DNA, 15 bp, Homo sapiens
cttaccctaaatacc

SEQ ID NO: 23449 - DNA, 15 bp, Homo sapiens
gcttaccctaaatac

SEQ ID NO: 23450 - DNA, 15 bp, Homo sapiens
tgcttaccctaaata

SEQ ID NO: 23451 - DNA, 15 bp, Homo sapiens
atgcttaccctaaat

SEQ ID NO: 23452 - DNA, 15 bp, Homo sapiens
aatgcttaccctaaa

SEQ ID NO: 23453 - DNA, 15 bp, Homo sapiens
aaatgcttaccctaa

SEQ ID NO: 23454 - DNA, 15 bp, Homo sapiens
aaaatgcttacccta

SEQ ID NO: 23455 - DNA, 15 bp, Homo sapiens
aaaaatgcttaccct

SEQ ID NO: 23456 - DNA, 15 bp, Homo sapiens
taaaaatgcttaccc

SEQ ID NO: 23457 - DNA, 15 bp, Homo sapiens
ataaaaatgcttacc

SEQ ID NO: 23458 - DNA, 15 bp, Homo sapiens
gataaaaatgcttac

SEQ ID NO: 23459 - DNA, 15 bp, Homo sapiens
agataaaaatgctta

SEQ ID NO: 23460 - DNA, 15 bp, Homo sapiens
gagataaaaatgctt

SEQ ID NO: 23461 - DNA, 15 bp, Homo sapiens
agagataaaaatgct

SEQ ID NO: 23462 - DNA, 15 bp, Homo sapiens
tagagataaaaatgc

SEQ ID NO: 23463 - DNA, 15 bp, Homo sapiens
ttagagataaaaatg

SEQ ID NO: 23464 - DNA, 15 bp, Homo sapiens
tttagagataaaaat

SEQ ID NO: 23465 - DNA, 15 bp, Homo sapiens
ttttagagataaaaa

SEQ ID NO: 23466 - DNA, 15 bp, Homo sapiens
attttagagataaaa

SEQ ID NO: 23467 - DNA, 15 bp, Homo sapiens
cattttagagataaa

SEQ ID NO: 23468 - DNA, 15 bp, Homo sapiens
tcattttagagataa

SEQ ID NO: 23469 - DNA, 15 bp, Homo sapiens
ctcattttagagata

SEQ ID NO: 23470 - DNA, 15 bp, Homo sapiens
actcattttagagat

SEQ ID NO: 23471 - DNA, 15 bp, Homo sapiens
aactcattttagaga

SEQ ID NO: 23472 - DNA, 15 bp, Homo sapiens
taactcattttagag

SEQ ID NO: 23473 - DNA, 15 bp, Homo sapiens
ctaactcattttaga

SEQ ID NO: 23474 - DNA, 15 bp, Homo sapiens
tctaactcattttag

SEQ ID NO: 23475 - DNA, 15 bp, Homo sapiens
atctaactcatttta

SEQ ID NO: 23476 - DNA, 15 bp, Homo sapiens
tatctaactcatttt

SEQ ID NO: 23477 - DNA, 15 bp, Homo sapiens
atatctaactcattt

SEQ ID NO: 23478 - DNA, 15 bp, Homo sapiens
gatatctaactcatt

SEQ ID NO: 23479 - DNA, 15 bp, Homo sapiens
tgatatctaactcat

SEQ ID NO: 23480 - DNA, 15 bp, Homo sapiens
ttgatatctaactca

SEQ ID NO: 23481 - DNA, 15 bp, Homo sapiens
cttgatatctaactc

SEQ ID NO: 23482 - DNA, 15 bp, Homo sapiens
ccttgatatctaact

SEQ ID NO: 23483 - DNA, 15 bp, Homo sapiens
tccttgatatctaac

SEQ ID NO: 23484 - DNA, 15 bp, Homo sapiens
atccttgatatctaa

SEQ ID NO: 23485 - DNA, 15 bp, Homo sapiens
catccttgatatcta

SEQ ID NO: 23486 - DNA, 15 bp, Homo sapiens
ccatccttgatatct

SEQ ID NO: 23487 - DNA, 15 bp, Homo sapiens
gccatccttgatatc

SEQ ID NO: 23488 - DNA, 15 bp, Homo sapiens
tgccatccttgatat

SEQ ID NO: 23489 - DNA, 15 bp, Homo sapiens
atgccatccttgata

SEQ ID NO: 23490 - DNA, 15 bp, Homo sapiens
catgccatccttgat

SEQ ID NO: 23491 - DNA, 15 bp, Homo sapiens
ccatgccatccttga

SEQ ID NO: 23492 - DNA, 15 bp, Homo sapiens
accatgccatccttg

SEQ ID NO: 23493 - DNA, 15 bp, Homo sapiens
taccatgccatcctt

SEQ ID NO: 23494 - DNA, 15 bp, Homo sapiens
ataccatgccatcct

SEQ ID NO: 23495 - DNA, 15 bp, Homo sapiens
aataccatgccatcc

SEQ ID NO: 23496 - DNA, 15 bp, Homo sapiens
taataccatgccatc

SEQ ID NO: 23497 - DNA, 15 bp, Homo sapiens
ctaataccatgccat

SEQ ID NO: 23498 - DNA, 15 bp, Homo sapiens
tctaataccatgcca

SEQ ID NO: 23499 - DNA, 15 bp, Homo sapiens
atctaataccatgcc

SEQ ID NO: 23500 - DNA, 15 bp, Homo sapiens
aatctaataccatgc

SEQ ID NO: 23501 - DNA, 15 bp, Homo sapiens
taatctaataccatg

SEQ ID NO: 23502 - DNA, 15 bp, Homo sapiens
gtaatctaataccat

SEQ ID NO: 23503 - DNA, 15 bp, Homo sapiens
tgtaatctaatacca

SEQ ID NO: 23504 - DNA, 15 bp, Homo sapiens
gtgtaatctaatacc

SEQ ID NO: 23505 - DNA, 15 bp, Homo sapiens
tgtgtaatctaatac

SEQ ID NO: 23506 - DNA, 15 bp, Homo sapiens
ttgtgtaatctaata

SEQ ID NO: 23507 - DNA, 15 bp, Homo sapiens
attgtgtaatctaat

SEQ ID NO: 23508 - DNA, 15 bp, Homo sapiens
tattgtgtaatctaa

SEQ ID NO: 23509 - DNA, 15 bp, Homo sapiens
atattgtgtaatcta

SEQ ID NO: 23510 - DNA, 15 bp, Homo sapiens
aatattgtgtaatct

SEQ ID NO: 23511 - DNA, 15 bp, Homo sapiens
aaatattgtgtaatc

SEQ ID NO: 23512 - DNA, 15 bp, Homo sapiens
caaatattgtgtaat

SEQ ID NO: 23513 - DNA, 15 bp, Homo sapiens
tcaaatattgtgtaa

SEQ ID NO: 23514 - DNA, 15 bp, Homo sapiens
ttcaaatattgtgta

SEQ ID NO: 23515 - DNA, 15 bp, Homo sapiens
tttcaaatattgtgt

SEQ ID NO: 23516 - DNA, 15 bp, Homo sapiens
ttttcaaatattgtg

SEQ ID NO: 23517 - DNA, 15 bp, Homo sapiens
cttttcaaatattgt

SEQ ID NO: 23518 - DNA, 15 bp, Homo sapiens
tcttttcaaatattg

SEQ ID NO: 23519 - DNA, 15 bp, Homo sapiens
ttcttttcaaatatt

SEQ ID NO: 23520 - DNA, 15 bp, Homo sapiens
attcttttcaaatat

SEQ ID NO: 23521 - DNA, 15 bp, Homo sapiens
tattcttttcaaata

SEQ ID NO: 23522 - DNA, 15 bp, Homo sapiens
ttattcttttcaaat

SEQ ID NO: 23523 - DNA, 15 bp, Homo sapiens
attattcttttcaaa

SEQ ID NO: 23524 - DNA, 15 bp, Homo sapiens
tattattcttttcaa

SEQ ID NO: 23525 - DNA, 15 bp, Homo sapiens
ttattattcttttca

SEQ ID NO: 23526 - DNA, 15 bp, Homo sapiens
cttattattcttttc

SEQ ID NO: 23527 - DNA, 15 bp, Homo sapiens
tcttattattctttt

SEQ ID NO: 23528 - DNA, 15 bp, Homo sapiens
ttcttattattcttt

SEQ ID NO: 23529 - DNA, 15 bp, Homo sapiens
tttcttattattctt

SEQ ID NO: 23530 - DNA, 15 bp, Homo sapiens
ttttcttattattct

SEQ ID NO: 23531 - DNA, 15 bp, Homo sapiens
tttttcttattattc

SEQ ID NO: 23532 - DNA, 15 bp, Homo sapiens
atttttcttattatt

SEQ ID NO: 23533 - DNA, 15 bp, Homo sapiens
gatttttcttattat

SEQ ID NO: 23534 - DNA, 15 bp, Homo sapiens
ggatttttcttatta

SEQ ID NO: 23535 - DNA, 15 bp, Homo sapiens
aggatttttcttatt

SEQ ID NO: 23536 - DNA, 15 bp, Homo sapiens
caggatttttcttat

SEQ ID NO: 23537 - DNA, 15 bp, Homo sapiens
gcaggatttttctta

SEQ ID NO: 23538 - DNA, 15 bp, Homo sapiens
tgcaggatttttctt

SEQ ID NO: 23539 - DNA, 15 bp, Homo sapiens
ctgcaggatttttct

SEQ ID NO: 23540 - DNA, 15 bp, Homo sapiens
cctgcaggatttttc

SEQ ID NO: 23541 - DNA, 15 bp, Homo sapiens
tcctgcaggattttt

SEQ ID NO: 23542 - DNA, 15 bp, Homo sapiens
atcctgcaggatttt

SEQ ID NO: 23543 - DNA, 15 bp, Homo sapiens
taaatcctgcaggat

SEQ ID NO: 23544 - DNA, 15 bp, Homo sapiens
ttaaatcctgcagga

SEQ ID NO: 23545 - DNA, 15 bp, Homo sapiens
tttaaatcctgcagg

SEQ ID NO: 23546 - DNA, 15 bp, Homo sapiens
ttttaaatcctgcag

SEQ ID NO: 23547 - DNA, 15 bp, Homo sapiens
tttttaaatcctgca

SEQ ID NO: 23548 - DNA, 15 bp, Homo sapiens
atttttaaatcctgc

SEQ ID NO: 23549 - DNA, 15 bp, Homo sapiens
gatttttaaatcctg

SEQ ID NO: 23550 - DNA, 15 bp, Homo sapiens
agatttttaaatcct

SEQ ID NO: 23551 - DNA, 15 bp, Homo sapiens
aagatttttaaatcc

SEQ ID NO: 23552 - DNA, 15 bp, Homo sapiens
taagatttttaaatc

SEQ ID NO: 23553 - DNA, 15 bp, Homo sapiens
ataagatttttaaat

SEQ ID NO: 23554 - DNA, 15 bp, Homo sapiens
aataagatttttaaa

SEQ ID NO: 23555 - DNA, 15 bp, Homo sapiens
taataagatttttaa

SEQ ID NO: 23556 - DNA, 15 bp, Homo sapiens
ctaataagattttta

SEQ ID NO: 23557 - DNA, 15 bp, Homo sapiens
actaataagattttt

SEQ ID NO: 23558 - DNA, 15 bp, Homo sapiens
tactaataagatttt

SEQ ID NO: 23559 - DNA, 15 bp, Homo sapiens
gtactaataagattt

SEQ ID NO: 23560 - DNA, 15 bp, Homo sapiens
agtactaataagatt

SEQ ID NO: 23561 - DNA, 15 bp, Homo sapiens
gagtactaataagat

SEQ ID NO: 23562 - DNA, 15 bp, Homo sapiens
agagtactaataaga

SEQ ID NO: 23563 - DNA, 15 bp, Homo sapiens
aagagtactaataag

SEQ ID NO: 23564 - DNA, 15 bp, Homo sapiens
gaagagtactaataa

SEQ ID NO: 23565 - DNA, 15 bp, Homo sapiens
agaagagtactaata

SEQ ID NO: 23566 - DNA, 15 bp, Homo sapiens
cagaagagtactaat

SEQ ID NO: 23567 - DNA, 15 bp, Homo sapiens
acagaagagtactaa

SEQ ID NO: 23568 - DNA, 15 bp, Homo sapiens
tacagaagagtacta

SEQ ID NO: 23569 - DNA, 15 bp, Homo sapiens
ctacagaagagtact

SEQ ID NO: 23570 - DNA, 15 bp, Homo sapiens
tctacagaagagtac

SEQ ID NO: 23571 - DNA, 15 bp, Homo sapiens
ttctacagaagagta

SEQ ID NO: 23572 - DNA, 15 bp, Homo sapiens
tttctacagaagagt

SEQ ID NO: 23573 - DNA, 15 bp, Homo sapiens
atttctacagaagag

SEQ ID NO: 23574 - DNA, 15 bp, Homo sapiens
tatttctacagaaga

SEQ ID NO: 23575 - DNA, 15 bp, Homo sapiens
gtatttctacagaag

SEQ ID NO: 23576 - DNA, 15 bp, Homo sapiens
agtatttctacagaa

SEQ ID NO: 23577 - DNA, 15 bp, Homo sapiens
aagtatttctacaga

SEQ ID NO: 23578 - DNA, 15 bp, Homo sapiens
aaagtatttctacag

SEQ ID NO: 23579 - DNA, 15 bp, Homo sapiens
taaagtatttctaca

SEQ ID NO: 23580 - DNA, 15 bp, Homo sapiens
ctaaagtatttctac

SEQ ID NO: 23581 - DNA, 15 bp, Homo sapiens
cctaaagtatttcta

SEQ ID NO: 23582 - DNA, 15 bp, Homo sapiens
ccctaaagtatttct

SEQ ID NO: 23583 - DNA, 15 bp, Homo sapiens
tccctaaagtatttc

SEQ ID NO: 23584 - DNA, 15 bp, Homo sapiens
ttccctaaagtattt

SEQ ID NO: 23585 - DNA, 15 bp, Homo sapiens
attccctaaagtatt

SEQ ID NO: 23586 - DNA, 15 bp, Homo sapiens
cattccctaaagtat

SEQ ID NO: 23587 - DNA, 15 bp, Homo sapiens
ccattccctaaagta

SEQ ID NO: 23588 - DNA, 15 bp, Homo sapiens
accattccctaaagt

SEQ ID NO: 23589 - DNA, 15 bp, Homo sapiens
aaccattccctaaag

SEQ ID NO: 23590 - DNA, 15 bp, Homo sapiens
gaaccattccctaaa

SEQ ID NO: 23591 - DNA, 15 bp, Homo sapiens
tgaaccattccctaa

SEQ ID NO: 23592 - DNA, 15 bp, Homo sapiens
ctgaaccattcccta

SEQ ID NO: 23593 - DNA, 15 bp, Homo sapiens
tctgaaccattccct

SEQ ID NO: 23594 - DNA, 15 bp, Homo sapiens
gtctgaaccattccc

SEQ ID NO: 23595 - DNA, 15 bp, Homo sapiens
tgtctgaaccattcc

SEQ ID NO: 23596 - DNA, 15 bp, Homo sapiens
ctgtctgaaccattc

SEQ ID NO: 23597 - DNA, 15 bp, Homo sapiens
actgtctgaaccatt

SEQ ID NO: 23598 - DNA, 15 bp, Homo sapiens
tactgtctgaaccat

SEQ ID NO: 23599 - DNA, 15 bp, Homo sapiens
atactgtctgaacca

SEQ ID NO: 23600 - DNA, 15 bp, Homo sapiens
gatactgtctgaacc

SEQ ID NO: 23601 - DNA, 15 bp, Homo sapiens
tgatactgtctgaac

SEQ ID NO: 23602 - DNA, 15 bp, Homo sapiens
ctgatactgtctgaa

SEQ ID NO: 23603 - DNA, 15 bp, Homo sapiens
cctgatactgtctga

SEQ ID NO: 23604 - DNA, 15 bp, Homo sapiens
acctgatactgtctg

SEQ ID NO: 23605 - DNA, 15 bp, Homo sapiens
cacctgatactgtct

SEQ ID NO: 23606 - DNA, 15 bp, Homo sapiens
gcacctgatactgtc

SEQ ID NO: 23607 - DNA, 15 bp, Homo sapiens
agcacctgatactgt

SEQ ID NO: 23608 - DNA, 15 bp, Homo sapiens
cagcacctgatactg

SEQ ID NO: 23609 - DNA, 15 bp, Homo sapiens
acagcacctgatact

SEQ ID NO: 23610 - DNA, 15 bp, Homo sapiens
cacagcacctgatac

SEQ ID NO: 23611 - DNA, 15 bp, Homo sapiens
ccacagcacctgata

SEQ ID NO: 23612 - DNA, 15 bp, Homo sapiens
cccacagcacctgat

SEQ ID NO: 23613 - DNA, 15 bp, Homo sapiens
acccacagcacctga

SEQ ID NO: 23614 - DNA, 15 bp, Homo sapiens
cacccacagcacctg

SEQ ID NO: 23615 - DNA, 15 bp, Homo sapiens
acacccacagcacct

SEQ ID NO: 23616 - DNA, 15 bp, Homo sapiens
tacacccacagcacc

SEQ ID NO: 23617 - DNA, 15 bp, Homo sapiens
ttacacccacagcac

SEQ ID NO: 23618 - DNA, 15 bp, Homo sapiens
cttacacccacagca

SEQ ID NO: 23619 - DNA, 15 bp, Homo sapiens
gcttacacccacagc

SEQ ID NO: 23620 - DNA, 15 bp, Homo sapiens
tgcttacacccacag

SEQ ID NO: 23621 - DNA, 15 bp, Homo sapiens
atgcttacacccaca

SEQ ID NO: 23622 - DNA, 15 bp, Homo sapiens
catgcttacacccac

SEQ ID NO: 23623 - DNA, 15 bp, Homo sapiens
ccatgcttacaccca

SEQ ID NO: 23624 - DNA, 15 bp, Homo sapiens
gccatgcttacaccc

SEQ ID NO: 23625 - DNA, 15 bp, Homo sapiens
ggccatgcttacacc

SEQ ID NO: 23626 - DNA, 15 bp, Homo sapiens
tggccatgcttacac

SEQ ID NO: 23627 - DNA, 15 bp, Homo sapiens
gtggccatgcttaca

SEQ ID NO: 23628 - DNA, 15 bp, Homo sapiens
ggtggccatgcttac

SEQ ID NO: 23629 - DNA, 15 bp, Homo sapiens
aggtggccatgctta

SEQ ID NO: 23630 - DNA, 15 bp, Homo sapiens
caggtggccatgctt

SEQ ID NO: 23631 - DNA, 15 bp, Homo sapiens
gcaggtggccatgct

SEQ ID NO: 23632 - DNA, 15 bp, Homo sapiens
agcaggtggccatgc

SEQ ID NO: 23633 - DNA, 15 bp, Homo sapiens
tagcaggtggccatg

SEQ ID NO: 23634 - DNA, 15 bp, Homo sapiens
ctagcaggtggccat

SEQ ID NO: 23635 - DNA, 15 bp, Homo sapiens
gctagcaggtggcca

SEQ ID NO: 23636 - DNA, 15 bp, Homo sapiens
agctagcaggtggcc

SEQ ID NO: 23637 - DNA, 15 bp, Homo sapiens
gagctagcaggtggc

SEQ ID NO: 23638 - DNA, 15 bp, Homo sapiens
agagctagcaggtgg

SEQ ID NO: 23639 - DNA, 15 bp, Homo sapiens
cagagctagcaggtg

SEQ ID NO: 23640 - DNA, 15 bp, Homo sapiens
acagagctagcaggt

SEQ ID NO: 23641 - DNA, 15 bp, Homo sapiens
cacagagctagcagg

SEQ ID NO: 23642 - DNA, 15 bp, Homo sapiens
tcacagagctagcag

SEQ ID NO: 23643 - DNA, 15 bp, Homo sapiens
ttcacagagctagca

SEQ ID NO: 23644 - DNA, 15 bp, Homo sapiens
gttcacagagctagc

SEQ ID NO: 23645 - DNA, 15 bp, Homo sapiens
ggttcacagagctag

SEQ ID NO: 23646 - DNA, 15 bp, Homo sapiens
aggttcacagagcta

SEQ ID NO: 23647 - DNA, 15 bp, Homo sapiens
caggttcacagagct

SEQ ID NO: 23648 - DNA, 15 bp, Homo sapiens
ccaggttcacagagc

SEQ ID NO: 23649 - DNA, 15 bp, Homo sapiens
tccaggttcacagag

SEQ ID NO: 23650 - DNA, 15 bp, Homo sapiens
gtccaggttcacaga

SEQ ID NO: 23651 - DNA, 15 bp, Homo sapiens
tgtccaggttcacag

SEQ ID NO: 23652 - DNA, 15 bp, Homo sapiens
ttgtccaggttcaca

SEQ ID NO: 23653 - DNA, 15 bp, Homo sapiens
tttgtccaggttcac

SEQ ID NO: 23654 - DNA, 15 bp, Homo sapiens
atttgtccaggttca

SEQ ID NO: 23655 - DNA, 15 bp, Homo sapiens
catttgtccaggttc

SEQ ID NO: 23656 - DNA, 15 bp, Homo sapiens
ccatttgtccaggtt

SEQ ID NO: 23657 - DNA, 15 bp, Homo sapiens
gccatttgtccaggt

SEQ ID NO: 23658 - DNA, 15 bp, Homo sapiens
agccatttgtccagg

SEQ ID NO: 23659 - DNA, 15 bp, Homo sapiens
aagccatttgtccag

SEQ ID NO: 23660 - DNA, 15 bp, Homo sapiens
taagccatttgtcca

SEQ ID NO: 23661 - DNA, 15 bp, Homo sapiens
ctaagccatttgtcc

SEQ ID NO: 23662 - DNA, 15 bp, Homo sapiens
gctaagccatttgtc

SEQ ID NO: 23663 - DNA, 15 bp, Homo sapiens
agctaagccatttgt

SEQ ID NO: 23664 - DNA, 15 bp, Homo sapiens
cagctaagccatttg

SEQ ID NO: 23665 - DNA, 15 bp, Homo sapiens
gcagctaagccattt

SEQ ID NO: 23666 - DNA, 15 bp, Homo sapiens
agcagctaagccatt

SEQ ID NO: 23667 - DNA, 15 bp, Homo sapiens
gagcagctaagccat

SEQ ID NO: 23668 - DNA, 15 bp, Homo sapiens
agagcagctaagcca

SEQ ID NO: 23669 - DNA, 15 bp, Homo sapiens
cagagcagctaagcc

SEQ ID NO: 23670 - DNA, 15 bp, Homo sapiens
acagagcagctaagc

SEQ ID NO: 23671 - DNA, 15 bp, Homo sapiens
cacagagcagctaag

SEQ ID NO: 23672 - DNA, 15 bp, Homo sapiens
gcacagagcagctaa

SEQ ID NO: 23673 - DNA, 15 bp, Homo sapiens
ggcacagagcagcta

SEQ ID NO: 23674 - DNA, 15 bp, Homo sapiens
aggcacagagcagct

SEQ ID NO: 23675 - DNA, 15 bp, Homo sapiens
caggcacagagcagc

SEQ ID NO: 23676 - DNA, 15 bp, Homo sapiens
tcaggcacagagcag

SEQ ID NO: 23677 - DNA, 15 bp, Homo sapiens
ctcaggcacagagca

SEQ ID NO: 23678 - DNA, 15 bp, Homo sapiens
actcaggcacagagc

SEQ ID NO: 23679 - DNA, 15 bp, Homo sapiens
tactcaggcacagag

SEQ ID NO: 23680 - DNA, 15 bp, Homo sapiens
ttactcaggcacaga

SEQ ID NO: 23681 - DNA, 15 bp, Homo sapiens
tttactcaggcacag

SEQ ID NO: 23682 - DNA, 15 bp, Homo sapiens
ctttactcaggcaca

SEQ ID NO: 23683 - DNA, 15 bp, Homo sapiens
actttactcaggcac

SEQ ID NO: 23684 - DNA, 15 bp, Homo sapiens
tactttactcaggca

SEQ ID NO: 23685 - DNA, 15 bp, Homo sapiens
ctactttactcaggc

SEQ ID NO: 23686 - DNA, 15 bp, Homo sapiens
tctactttactcagg

SEQ ID NO: 23687 - DNA, 15 bp, Homo sapiens
ctctactttactcag

SEQ ID NO: 23688 - DNA, 15 bp, Homo sapiens
tctctactttactca

SEQ ID NO: 23689 - DNA, 15 bp, Homo sapiens
atctctactttactc

SEQ ID NO: 23690 - DNA, 15 bp, Homo sapiens
tatctctactttact

SEQ ID NO: 23691 - DNA, 15 bp, Homo sapiens
ctatctctactttac

SEQ ID NO: 23692 - DNA, 15 bp, Homo sapiens
actatctctacttta

SEQ ID NO: 23693 - DNA, 15 bp, Homo sapiens
tactatctctacttt

SEQ ID NO: 23694 - DNA, 15 bp, Homo sapiens
ttactatctctactt

SEQ ID NO: 23695 - DNA, 15 bp, Homo sapiens
attactatctctact

SEQ ID NO: 23696 - DNA, 15 bp, Homo sapiens
tattactatctctac

SEQ ID NO: 23697 - DNA, 15 bp, Homo sapiens
ctattactatctcta

SEQ ID NO: 23698 - DNA, 15 bp, Homo sapiens
gctattactatctct

SEQ ID NO: 23699 - DNA, 15 bp, Homo sapiens
tgctattactatctc

SEQ ID NO: 23700 - DNA, 15 bp, Homo sapiens
atgctattactatct

SEQ ID NO: 23701 - DNA, 15 bp, Homo sapiens
gatgctattactatc

SEQ ID NO: 23702 - DNA, 15 bp, Homo sapiens
tgatgctattactat

SEQ ID NO: 23703 - DNA, 15 bp, Homo sapiens
ttgatgctattacta

SEQ ID NO: 23704 - DNA, 15 bp, Homo sapiens
gttgatgctattact

SEQ ID NO: 23705 - DNA, 15 bp, Homo sapiens
ggttgatgctattac

SEQ ID NO: 23706 - DNA, 15 bp, Homo sapiens
aggttgatgctatta

SEQ ID NO: 23707 - DNA, 15 bp, Homo sapiens
gaggttgatgctatt

SEQ ID NO: 23708 - DNA, 15 bp, Homo sapiens
ggaggttgatgctat

SEQ ID NO: 23709 - DNA, 15 bp, Homo sapiens
aggaggttgatgcta

SEQ ID NO: 23710 - DNA, 15 bp, Homo sapiens
gaggaggttgatgct

SEQ ID NO: 23711 - DNA, 15 bp, Homo sapiens
cgaggaggttgatgc

SEQ ID NO: 23712 - DNA, 15 bp, Homo sapiens
acgaggaggttgatg

SEQ ID NO: 23713 - DNA, 15 bp, Homo sapiens
cacgaggaggttgat

SEQ ID NO: 23714 - DNA, 15 bp, Homo sapiens
acacgaggaggttga

SEQ ID NO: 23715 - DNA, 15 bp, Homo sapiens
aacacgaggaggttg

SEQ ID NO: 23716 - DNA, 15 bp, Homo sapiens
caacacgaggaggtt

SEQ ID NO: 23717 - DNA, 15 bp, Homo sapiens
acaacacgaggaggt

SEQ ID NO: 23718 - DNA, 15 bp, Homo sapiens
tacaacacgaggagg

SEQ ID NO: 23719 - DNA, 15 bp, Homo sapiens
ttacaacacgaggag

SEQ ID NO: 23720 - DNA, 15 bp, Homo sapiens
tttacaacacgagga

SEQ ID NO: 23721 - DNA, 15 bp, Homo sapiens
ttttacaacacgagg

SEQ ID NO: 23722 - DNA, 15 bp, Homo sapiens
tttttacaacacgag

SEQ ID NO: 23723 - DNA, 15 bp, Homo sapiens
ctttttacaacacga

SEQ ID NO: 23724 - DNA, 15 bp, Homo sapiens
actttttacaacacg

SEQ ID NO: 23725 - DNA, 15 bp, Homo sapiens
tactttttacaacac

SEQ ID NO: 23726 - DNA, 15 bp, Homo sapiens
ttactttttacaaca

SEQ ID NO: 23727 - DNA, 15 bp, Homo sapiens
cttactttttacaac

SEQ ID NO: 23728 - DNA, 15 bp, Homo sapiens
acttactttttacaa

SEQ ID NO: 23729 - DNA, 15 bp, Homo sapiens
cacttactttttaca

SEQ ID NO: 23730 - DNA, 15 bp, Homo sapiens
tcacttactttttac

SEQ ID NO: 23731 - DNA, 15 bp, Homo sapiens
ttcacttacttttta

SEQ ID NO: 23732 - DNA, 15 bp, Homo sapiens
attcacttacttttt

SEQ ID NO: 23733 - DNA, 15 bp, Homo sapiens
aattcacttactttt

SEQ ID NO: 23734 - DNA, 15 bp, Homo sapiens
taattcacttacttt

SEQ ID NO: 23735 - DNA, 15 bp, Homo sapiens
ttaattcacttactt

SEQ ID NO: 23736 - DNA, 15 bp, Homo sapiens
gttaattcacttact

SEQ ID NO: 23737 - DNA, 15 bp, Homo sapiens
tgttaattcacttac

SEQ ID NO: 23738 - DNA, 15 bp, Homo sapiens
atgttaattcactta

SEQ ID NO: 23739 - DNA, 15 bp, Homo sapiens
tatgttaattcactt

SEQ ID NO: 23740 - DNA, 15 bp, Homo sapiens
atatgttaattcact

SEQ ID NO: 23741 - DNA, 15 bp, Homo sapiens
tatatgttaattcac

SEQ ID NO: 23742 - DNA, 15 bp, Homo sapiens
atatatgttaattca

SEQ ID NO: 23743 - DNA, 15 bp, Homo sapiens
tatatatgttaattc

SEQ ID NO: 23744 - DNA, 15 bp, Homo sapiens
ttatatatgttaatt

SEQ ID NO: 23745 - DNA, 15 bp, Homo sapiens
tttatatatgttaat

SEQ ID NO: 23746 - DNA, 15 bp, Homo sapiens
ctttatatatgttaa

SEQ ID NO: 23747 - DNA, 15 bp, Homo sapiens
gctttatatatgtta

SEQ ID NO: 23748 - DNA, 15 bp, Homo sapiens
tgctttatatatgtt

SEQ ID NO: 23749 - DNA, 15 bp, Homo sapiens
ttgctttatatatgt

SEQ ID NO: 23750 - DNA, 15 bp, Homo sapiens
attgctttatatatg

SEQ ID NO: 23751 - DNA, 15 bp, Homo sapiens
aattgctttatatat

SEQ ID NO: 23752 - DNA, 15 bp, Homo sapiens
aaattgctttatata

SEQ ID NO: 23753 - DNA, 15 bp, Homo sapiens
caaattgctttatat

SEQ ID NO: 23754 - DNA, 15 bp, Homo sapiens
ccaaattgctttata

SEQ ID NO: 23755 - DNA, 15 bp, Homo sapiens
cccaaattgctttat

SEQ ID NO: 23756 - DNA, 15 bp, Homo sapiens
ccccaaattgcttta

SEQ ID NO: 23757 - DNA, 15 bp, Homo sapiens
gccccaaattgcttt

SEQ ID NO: 23758 - DNA, 15 bp, Homo sapiens
ggccccaaattgctt

SEQ ID NO: 23759 - DNA, 15 bp, Homo sapiens
tggccccaaattgct

SEQ ID NO: 23760 - DNA, 15 bp, Homo sapiens
ctggccccaaattgc

SEQ ID NO: 23761 - DNA, 15 bp, Homo sapiens
cctggccccaaattg

SEQ ID NO: 23762 - DNA, 15 bp, Homo sapiens
gcctggccccaaatt

SEQ ID NO: 23763 - DNA, 15 bp, Homo sapiens
cgcctggccccaaat

SEQ ID NO: 23764 - DNA, 15 bp, Homo sapiens
gcgcctggccccaaa

SEQ ID NO: 23765 - DNA, 15 bp, Homo sapiens
cgcgcctggccccaa

SEQ ID NO: 23766 - DNA, 15 bp, Homo sapiens
ccgcgcctggcccca

SEQ ID NO: 23767 - DNA, 15 bp, Homo sapiens
accgcgcctggcccc

SEQ ID NO: 23768 - DNA, 15 bp, Homo sapiens
caccgcgcctggccc

SEQ ID NO: 23769 - DNA, 15 bp, Homo sapiens
ccaccgcgcctggcc

SEQ ID NO: 23770 - DNA, 15 bp, Homo sapiens
gccaccgcgcctggc

SEQ ID NO: 23771 - DNA, 15 bp, Homo sapiens
agccaccgcgcctgg

SEQ ID NO: 23772 - DNA, 15 bp, Homo sapiens
gagccaccgcgcctg

SEQ ID NO: 23773 - DNA, 15 bp, Homo sapiens
tgagccaccgcgcct

SEQ ID NO: 23774 - DNA, 15 bp, Homo sapiens
atgagccaccgcgcc

SEQ ID NO: 23775 - DNA, 15 bp, Homo sapiens
catgagccaccgcgc

SEQ ID NO: 23776 - DNA, 15 bp, Homo sapiens
gcatgagccaccgcg

SEQ ID NO: 23777 - DNA, 15 bp, Homo sapiens
ggcatgagccaccgc

SEQ ID NO: 23778 - DNA, 15 bp, Homo sapiens
tctcggcctcccaaa

SEQ ID NO: 23779 - DNA, 15 bp, Homo sapiens
gtctcggcctcccaa

SEQ ID NO: 23780 - DNA, 15 bp, Homo sapiens
cgtctcggcctccca

SEQ ID NO: 23781 - DNA, 15 bp, Homo sapiens
ccgtctcggcctccc

SEQ ID NO: 23782 - DNA, 15 bp, Homo sapiens
cccgtctcggcctcc

SEQ ID NO: 23783 - DNA, 15 bp, Homo sapiens
acccgtctcggcctc

SEQ ID NO: 23784 - DNA, 15 bp, Homo sapiens
cacccgtctcggcct

SEQ ID NO: 23785 - DNA, 15 bp, Homo sapiens
ccacccgtctcggcc

SEQ ID NO: 23786 - DNA, 15 bp, Homo sapiens
tccacccgtctcggc

SEQ ID NO: 23787 - DNA, 15 bp, Homo sapiens
atccacccgtctcgg

SEQ ID NO: 23788 - DNA, 15 bp, Homo sapiens
gatccacccgtctcg

SEQ ID NO: 23789 - DNA, 15 bp, Homo sapiens
tgatccacccgtctc

SEQ ID NO: 23790 - DNA, 15 bp, Homo sapiens
gtgatccacccgtct

SEQ ID NO: 23791 - DNA, 15 bp, Homo sapiens
cgtgatccacccgtc

SEQ ID NO: 23792 - DNA, 15 bp, Homo sapiens
tcgtgatccacccgt

SEQ ID NO: 23793 - DNA, 15 bp, Homo sapiens
ctcgtgatccacccg

SEQ ID NO: 23794 - DNA, 15 bp, Homo sapiens
cctcgtgatccaccc

SEQ ID NO: 23795 - DNA, 15 bp, Homo sapiens
gtgttagccaggatg

SEQ ID NO: 23796 - DNA, 15 bp, Homo sapiens
cgtgttagccaggat

SEQ ID NO: 23797 - DNA, 15 bp, Homo sapiens
ccgtgttagccagga

SEQ ID NO: 23798 - DNA, 15 bp, Homo sapiens
accgtgttagccagg

SEQ ID NO: 23799 - DNA, 15 bp, Homo sapiens
caccgtgttagccag

SEQ ID NO: 23800 - DNA, 15 bp, Homo sapiens
tcaccgtgttagcca

SEQ ID NO: 23801 - DNA, 15 bp, Homo sapiens
ttcaccgtgttagcc

SEQ ID NO: 23802 - DNA, 15 bp, Homo sapiens
tttcaccgtgttagc

SEQ ID NO: 23803 - DNA, 15 bp, Homo sapiens
gtttcaccgtgttag

SEQ ID NO: 23804 - DNA, 15 bp, Homo sapiens
ggtttcaccgtgtta

SEQ ID NO: 23805 - DNA, 15 bp, Homo sapiens
gggtttcaccgtgtt

SEQ ID NO: 23806 - DNA, 15 bp, Homo sapiens
ggggtttcaccgtgt

SEQ ID NO: 23807 - DNA, 15 bp, Homo sapiens
cggggtttcaccgtg

SEQ ID NO: 23808 - DNA, 15 bp, Homo sapiens
acggggtttcaccgt

SEQ ID NO: 23809 - DNA, 15 bp, Homo sapiens
gacggggtttcaccg

SEQ ID NO: 23810 - DNA, 15 bp, Homo sapiens
tagagacggggtttc

SEQ ID NO: 23811 - DNA, 15 bp, Homo sapiens
gtagagacggggttt

SEQ ID NO: 23812 - DNA, 15 bp, Homo sapiens
agtagagacggggtt

SEQ ID NO: 23813 - DNA, 15 bp, Homo sapiens
tagtagagacggggt

SEQ ID NO: 23814 - DNA, 15 bp, Homo sapiens
gccggctaatttttt

SEQ ID NO: 23815 - DNA, 15 bp, Homo sapiens
ggccggctaattttt

SEQ ID NO: 23816 - DNA, 15 bp, Homo sapiens
aggccggctaatttt

SEQ ID NO: 23817 - DNA, 15 bp, Homo sapiens
caggccggctaattt

SEQ ID NO: 23818 - DNA, 15 bp, Homo sapiens
tcaggccggctaatt

SEQ ID NO: 23819 - DNA, 15 bp, Homo sapiens
atcaggccggctaat

SEQ ID NO: 23820 - DNA, 15 bp, Homo sapiens
catcaggccggctaa

SEQ ID NO: 23821 - DNA, 15 bp, Homo sapiens
ccatcaggccggcta

SEQ ID NO: 23822 - DNA, 15 bp, Homo sapiens
gccatcaggccggct

SEQ ID NO: 23823 - DNA, 15 bp, Homo sapiens
tgccatcaggccggc

SEQ ID NO: 23824 - DNA, 15 bp, Homo sapiens
ctgccatcaggccgg

SEQ ID NO: 23825 - DNA, 15 bp, Homo sapiens
cctgccatcaggccg

SEQ ID NO: 23826 - DNA, 15 bp, Homo sapiens
gcctgccatcaggcc

SEQ ID NO: 23827 - DNA, 15 bp, Homo sapiens
cgcctgccatcaggc

SEQ ID NO: 23828 - DNA, 15 bp, Homo sapiens
gcgcctgccatcagg

SEQ ID NO: 23829 - DNA, 15 bp, Homo sapiens
ggcgcctgccatcag

SEQ ID NO: 23830 - DNA, 15 bp, Homo sapiens
aggcgcctgccatca

SEQ ID NO: 23831 - DNA, 15 bp, Homo sapiens
caggcgcctgccatc

SEQ ID NO: 23832 - DNA, 15 bp, Homo sapiens
acaggcgcctgccat

SEQ ID NO: 23833 - DNA, 15 bp, Homo sapiens
tacaggcgcctgcca

SEQ ID NO: 23834 - DNA, 15 bp, Homo sapiens
ctacaggcgcctgcc

SEQ ID NO: 23835 - DNA, 15 bp, Homo sapiens
actacaggcgcctgc

SEQ ID NO: 23836 - DNA, 15 bp, Homo sapiens
gactacaggcgcctg

SEQ ID NO: 23837 - DNA, 15 bp, Homo sapiens
ggactacaggcgcct

SEQ ID NO: 23838 - DNA, 15 bp, Homo sapiens
tccgagtagctggga

SEQ ID NO: 23839 - DNA, 15 bp, Homo sapiens
ttccgagtagctggg

SEQ ID NO: 23840 - DNA, 15 bp, Homo sapiens
cttccgagtagctgg

SEQ ID NO: 23841 - DNA, 15 bp, Homo sapiens
ccttccgagtagctg

SEQ ID NO: 23842 - DNA, 15 bp, Homo sapiens
gccttccgagtagct

SEQ ID NO: 23843 - DNA, 15 bp, Homo sapiens
agccttccgagtagc

SEQ ID NO: 23844 - DNA, 15 bp, Homo sapiens
cagccttccgagtag

SEQ ID NO: 23845 - DNA, 15 bp, Homo sapiens
tcagccttccgagta

SEQ ID NO: 23846 - DNA, 15 bp, Homo sapiens
ctcagccttccgagt

SEQ ID NO: 23847 - DNA, 15 bp, Homo sapiens
cctcagccttccgag

SEQ ID NO: 23848 - DNA, 15 bp, Homo sapiens
gcctcagccttccga

SEQ ID NO: 23849 - DNA, 15 bp, Homo sapiens
tgcctcagccttccg

SEQ ID NO: 23850 - DNA, 15 bp, Homo sapiens
ctgcctcagccttcc

SEQ ID NO: 23851 - DNA, 15 bp, Homo sapiens
cctgcctcagccttc

SEQ ID NO: 23852 - DNA, 15 bp, Homo sapiens
tcctgcctcagcctt

SEQ ID NO: 23853 - DNA, 15 bp, Homo sapiens
tgggttcacaccatt

SEQ ID NO: 23854 - DNA, 15 bp, Homo sapiens
ctgggttcacaccat

SEQ ID NO: 23855 - DNA, 15 bp, Homo sapiens
cctgggttcacacca

SEQ ID NO: 23856 - DNA, 15 bp, Homo sapiens
tcctgggttcacacc

SEQ ID NO: 23857 - DNA, 15 bp, Homo sapiens
ctcctgggttcacac

SEQ ID NO: 23858 - DNA, 15 bp, Homo sapiens
cctcctgggttcaca

SEQ ID NO: 23859 - DNA, 15 bp, Homo sapiens
ggctcactgcaagct

SEQ ID NO: 23860 - DNA, 15 bp, Homo sapiens
cggctcactgcaagc

SEQ ID NO: 23861 - DNA, 15 bp, Homo sapiens
tcggctcactgcaag

SEQ ID NO: 23862 - DNA, 15 bp, Homo sapiens
ctcggctcactgcaa

SEQ ID NO: 23863 - DNA, 15 bp, Homo sapiens
tctcggctcactgca

SEQ ID NO: 23864 - DNA, 15 bp, Homo sapiens
atctcggctcactgc

SEQ ID NO: 23865 - DNA, 15 bp, Homo sapiens
aatctcggctcactg

SEQ ID NO: 23866 - DNA, 15 bp, Homo sapiens
caatctcggctcact

SEQ ID NO: 23867 - DNA, 15 bp, Homo sapiens
gcaatctcggctcac

SEQ ID NO: 23868 - DNA, 15 bp, Homo sapiens
cgcaatctcggctca

SEQ ID NO: 23869 - DNA, 15 bp, Homo sapiens
gcgcaatctcggctc

SEQ ID NO: 23870 - DNA, 15 bp, Homo sapiens
ggcgcaatctcggct

SEQ ID NO: 23871 - DNA, 15 bp, Homo sapiens
tggcgcaatctcggc

SEQ ID NO: 23872 - DNA, 15 bp, Homo sapiens
gtggcgcaatctcgg

SEQ ID NO: 23873 - DNA, 15 bp, Homo sapiens
agtggcgcaatctcg

SEQ ID NO: 23874 - DNA, 15 bp, Homo sapiens
cagtggcgcaatctc

SEQ ID NO: 23875 - DNA, 15 bp, Homo sapiens
gcagtggcgcaatct

SEQ ID NO: 23876 - DNA, 15 bp, Homo sapiens
tgcagtggcgcaatc

SEQ ID NO: 23877 - DNA, 15 bp, Homo sapiens
gtgcagtggcgcaat

SEQ ID NO: 23878 - DNA, 15 bp, Homo sapiens
agtgcagtggcgcaa

SEQ ID NO: 23879 - DNA, 15 bp, Homo sapiens
gagtgcagtggcgca

SEQ ID NO: 23880 - DNA, 15 bp, Homo sapiens
ggagtgcagtggcgc

SEQ ID NO: 23881 - DNA, 15 bp, Homo sapiens
tcacccaggctggag

SEQ ID NO: 23882 - DNA, 15 bp, Homo sapiens
gtcacccaggctgga

SEQ ID NO: 23883 - DNA, 15 bp, Homo sapiens
tgtcacccaggctgg

SEQ ID NO: 23884 - DNA, 15 bp, Homo sapiens
ctgtcacccaggctg

SEQ ID NO: 23885 - DNA, 15 bp, Homo sapiens
tctgtcacccaggct

SEQ ID NO: 23886 - DNA, 15 bp, Homo sapiens
ctctgtcacccaggc

SEQ ID NO: 23887 - DNA, 15 bp, Homo sapiens
gctctgtcacccagg

SEQ ID NO: 23888 - DNA, 15 bp, Homo sapiens
tgctctgtcacccag

SEQ ID NO: 23889 - DNA, 15 bp, Homo sapiens
ttgctctgtcaccca

SEQ ID NO: 23890 - DNA, 15 bp, Homo sapiens
cttgctctgtcaccc

SEQ ID NO: 23891 - DNA, 15 bp, Homo sapiens
tcttgctctgtcacc

SEQ ID NO: 23892 - DNA, 15 bp, Homo sapiens
gtcttgctctgtcac

SEQ ID NO: 23893 - DNA, 15 bp, Homo sapiens
agtcttgctctgtca

SEQ ID NO: 23894 - DNA, 15 bp, Homo sapiens
atggagtcttgctct

SEQ ID NO: 23895 - DNA, 15 bp, Homo sapiens
gatggagtcttgctc

SEQ ID NO: 23896 - DNA, 15 bp, Homo sapiens
agatggagtcttgct

SEQ ID NO: 23897 - DNA, 15 bp, Homo sapiens
gagatggagtcttgc

SEQ ID NO: 23898 - DNA, 15 bp, Homo sapiens
tgagatggagtcttg

SEQ ID NO: 23899 - DNA, 15 bp, Homo sapiens
ttgagatggagtctt

SEQ ID NO: 23900 - DNA, 15 bp, Homo sapiens
gcttttttttttttt

SEQ ID NO: 23901 - DNA, 15 bp, Homo sapiens
tgctttttttttttt

SEQ ID NO: 23902 - DNA, 15 bp, Homo sapiens
ttgcttttttttttt

SEQ ID NO: 23903 - DNA, 15 bp, Homo sapiens
attgctttttttttt

SEQ ID NO: 23904 - DNA, 15 bp, Homo sapiens
aattgcttttttttt

SEQ ID NO: 23905 - DNA, 15 bp, Homo sapiens
aaattgctttttttt

SEQ ID NO: 23906 - DNA, 15 bp, Homo sapiens
caaattgcttttttt

SEQ ID NO: 23907 - DNA, 15 bp, Homo sapiens
ccaaattgctttttt

SEQ ID NO: 23908 - DNA, 15 bp, Homo sapiens
tccaaattgcttttt

SEQ ID NO: 23909 - DNA, 15 bp, Homo sapiens
ttccaaattgctttt

SEQ ID NO: 23910 - DNA, 15 bp, Homo sapiens
gttccaaattgcttt

SEQ ID NO: 23911 - DNA, 15 bp, Homo sapiens
tgttccaaattgctt

SEQ ID NO: 23912 - DNA, 15 bp, Homo sapiens
atgttccaaattgct

SEQ ID NO: 23913 - DNA, 15 bp, Homo sapiens
tatgttccaaattgc

SEQ ID NO: 23914 - DNA, 15 bp, Homo sapiens
ctatgttccaaattg

SEQ ID NO: 23915 - DNA, 15 bp, Homo sapiens
tctatgttccaaatt

SEQ ID NO: 23916 - DNA, 15 bp, Homo sapiens
ttctatgttccaaat

SEQ ID NO: 23917 - DNA, 15 bp, Homo sapiens
cttctatgttccaaa

SEQ ID NO: 23918 - DNA, 15 bp, Homo sapiens
gcttctatgttccaa

SEQ ID NO: 23919 - DNA, 15 bp, Homo sapiens
tgcttctatgttcca

SEQ ID NO: 23920 - DNA, 15 bp, Homo sapiens
gtgcttctatgttcc

SEQ ID NO: 23921 - DNA, 15 bp, Homo sapiens
agtgcttctatgttc

SEQ ID NO: 23922 - DNA, 15 bp, Homo sapiens
gagtgcttctatgtt

SEQ ID NO: 23923 - DNA, 15 bp, Homo sapiens
tgagtgcttctatgt

SEQ ID NO: 23924 - DNA, 15 bp, Homo sapiens
ttgagtgcttctatg

SEQ ID NO: 23925 - DNA, 15 bp, Homo sapiens
cttgagtgcttctat

SEQ ID NO: 23926 - DNA, 15 bp, Homo sapiens
tcttgagtgcttcta

SEQ ID NO: 23927 - DNA, 15 bp, Homo sapiens
ttcttgagtgcttct

SEQ ID NO: 23928 - DNA, 15 bp, Homo sapiens
tttcttgagtgcttc

SEQ ID NO: 23929 - DNA, 15 bp, Homo sapiens
atttcttgagtgctt

SEQ ID NO: 23930 - DNA, 15 bp, Homo sapiens
catttcttgagtgct

SEQ ID NO: 23931 - DNA, 15 bp, Homo sapiens
acatttcttgagtgc

SEQ ID NO: 23932 - DNA, 15 bp, Homo sapiens
tacatttcttgagtg

SEQ ID NO: 23933 - DNA, 15 bp, Homo sapiens
ttacatttcttgagt

SEQ ID NO: 23934 - DNA, 15 bp, Homo sapiens
cttacatttcttgag

SEQ ID NO: 23935 - DNA, 15 bp, Homo sapiens
gcttacatttcttga

SEQ ID NO: 23936 - DNA, 15 bp, Homo sapiens
ggcttacatttcttg

SEQ ID NO: 23937 - DNA, 15 bp, Homo sapiens
cggcttacatttctt

SEQ ID NO: 23938 - DNA, 15 bp, Homo sapiens
acggcttacatttct

SEQ ID NO: 23939 - DNA, 15 bp, Homo sapiens
aacggcttacatttc

SEQ ID NO: 23940 - DNA, 15 bp, Homo sapiens
taacggcttacattt

SEQ ID NO: 23941 - DNA, 15 bp, Homo sapiens
gtaacggcttacatt

SEQ ID NO: 23942 - DNA, 15 bp, Homo sapiens
ggtaacggcttacat

SEQ ID NO: 23943 - DNA, 15 bp, Homo sapiens
aggtaacggcttaca

SEQ ID NO: 23944 - DNA, 15 bp, Homo sapiens
gaggtaacggcttac

SEQ ID NO: 23945 - DNA, 15 bp, Homo sapiens
ggaggtaacggctta

SEQ ID NO: 23946 - DNA, 15 bp, Homo sapiens
tggaggtaacggctt

SEQ ID NO: 23947 - DNA, 15 bp, Homo sapiens
atggaggtaacggct

SEQ ID NO: 23948 - DNA, 15 bp, Homo sapiens
tatggaggtaacggc

SEQ ID NO: 23949 - DNA, 15 bp, Homo sapiens
gtatggaggtaacgg

SEQ ID NO: 23950 - DNA, 15 bp, Homo sapiens
tgtatggaggtaacg

SEQ ID NO: 23951 - DNA, 15 bp, Homo sapiens
ttgtatggaggtaac

SEQ ID NO: 23952 - DNA, 15 bp, Homo sapiens
tttgtatggaggtaa

SEQ ID NO: 23953 - DNA, 15 bp, Homo sapiens
atttgtatggaggta

SEQ ID NO: 23954 - DNA, 15 bp, Homo sapiens
tatttgtatggaggt

SEQ ID NO: 23955 - DNA, 15 bp, Homo sapiens
ttatttgtatggagg

SEQ ID NO: 23956 - DNA, 15 bp, Homo sapiens
attatttgtatggag

SEQ ID NO: 23957 - DNA, 15 bp, Homo sapiens
aattatttgtatgga

SEQ ID NO: 23958 - DNA, 15 bp, Homo sapiens
taattatttgtatgg

SEQ ID NO: 23959 - DNA, 15 bp, Homo sapiens
ataattatttgtatg

SEQ ID NO: 23960 - DNA, 15 bp, Homo sapiens
aataattatttgtat

SEQ ID NO: 23961 - DNA, 15 bp, Homo sapiens
taataattatttgta

SEQ ID NO: 23962 - DNA, 15 bp, Homo sapiens
ataataattatttgt

SEQ ID NO: 23963 - DNA, 15 bp, Homo sapiens
tataataattatttg

SEQ ID NO: 23964 - DNA, 15 bp, Homo sapiens
ttataataattattt

SEQ ID NO: 23965 - DNA, 15 bp, Homo sapiens
attataataattatt

SEQ ID NO: 23966 - DNA, 15 bp, Homo sapiens
cattataataattat

SEQ ID NO: 23967 - DNA, 15 bp, Homo sapiens
acattataataatta

SEQ ID NO: 23968 - DNA, 15 bp, Homo sapiens
cacattataataatt

SEQ ID NO: 23969 - DNA, 15 bp, Homo sapiens
ccacattataataat

SEQ ID NO: 23970 - DNA, 15 bp, Homo sapiens
cccacattataataa

SEQ ID NO: 23971 - DNA, 15 bp, Homo sapiens
acccacattataata

SEQ ID NO: 23972 - DNA, 15 bp, Homo sapiens
aacccacattataat

SEQ ID NO: 23973 - DNA, 15 bp, Homo sapiens
aaacccacattataa

SEQ ID NO: 23974 - DNA, 15 bp, Homo sapiens
taaacccacattata

SEQ ID NO: 23975 - DNA, 15 bp, Homo sapiens
ataaacccacattat

SEQ ID NO: 23976 - DNA, 15 bp, Homo sapiens
aataaacccacatta

SEQ ID NO: 23977 - DNA, 15 bp, Homo sapiens
aaataaacccacatt

SEQ ID NO: 23978 - DNA, 15 bp, Homo sapiens
gaaataaacccacat

SEQ ID NO: 23979 - DNA, 15 bp, Homo sapiens
agaaataaacccaca

SEQ ID NO: 23980 - DNA, 15 bp, Homo sapiens
aagaaataaacccac

SEQ ID NO: 23981 - DNA, 15 bp, Homo sapiens
aaagaaataaaccca

SEQ ID NO: 23982 - DNA, 15 bp, Homo sapiens
gaaagaaataaaccc

SEQ ID NO: 23983 - DNA, 15 bp, Homo sapiens
ggaaagaaataaacc

SEQ ID NO: 23984 - DNA, 15 bp, Homo sapiens
tggaaagaaataaac

SEQ ID NO: 23985 - DNA, 15 bp, Homo sapiens
ctggaaagaaataaa

SEQ ID NO: 23986 - DNA, 15 bp, Homo sapiens
actggaaagaaataa

SEQ ID NO: 23987 - DNA, 15 bp, Homo sapiens
gactggaaagaaata

SEQ ID NO: 23988 - DNA, 15 bp, Homo sapiens
agactggaaagaaat

SEQ ID NO: 23989 - DNA, 15 bp, Homo sapiens
aagactggaaagaaa

SEQ ID NO: 23990 - DNA, 15 bp, Homo sapiens
aaagactggaaagaa

SEQ ID NO: 23991 - DNA, 15 bp, Homo sapiens
aaaagactggaaaga

SEQ ID NO: 23992 - DNA, 15 bp, Homo sapiens
taaaagactggaaag

SEQ ID NO: 23993 - DNA, 15 bp, Homo sapiens
ttaaaagactggaaa

SEQ ID NO: 23994 - DNA, 15 bp, Homo sapiens
tttaaaagactggaa

SEQ ID NO: 23995 - DNA, 15 bp, Homo sapiens
ttttaaaagactgga

SEQ ID NO: 23996 - DNA, 15 bp, Homo sapiens
attttaaaagactgg

SEQ ID NO: 23997 - DNA, 15 bp, Homo sapiens
tattttaaaagactg

SEQ ID NO: 23998 - DNA, 15 bp, Homo sapiens
ttattttaaaagact

SEQ ID NO: 23999 - DNA, 15 bp, Homo sapiens
cttattttaaaagac

SEQ ID NO: 24000 - DNA, 15 bp, Homo sapiens
gcttattttaaaaga

SEQ ID NO: 24001 - DNA, 15 bp, Homo sapiens
tgcttattttaaaag

SEQ ID NO: 24002 - DNA, 15 bp, Homo sapiens
atgcttattttaaaa

SEQ ID NO: 24003 - DNA, 15 bp, Homo sapiens
catgcttattttaaa

SEQ ID NO: 24004 - DNA, 15 bp, Homo sapiens
acatgcttattttaa

SEQ ID NO: 24005 - DNA, 15 bp, Homo sapiens
tacatgcttatttta

SEQ ID NO: 24006 - DNA, 15 bp, Homo sapiens
ttacatgcttatttt

SEQ ID NO: 24007 - DNA, 15 bp, Homo sapiens
tttacatgcttattt

SEQ ID NO: 24008 - DNA, 15 bp, Homo sapiens
ttttacatgcttatt

SEQ ID NO: 24009 - DNA, 15 bp, Homo sapiens
tttttacatgcttat

SEQ ID NO: 24010 - DNA, 15 bp, Homo sapiens
atttttacatgctta

SEQ ID NO: 24011 - DNA, 15 bp, Homo sapiens
tatttttacatgctt

SEQ ID NO: 24012 - DNA, 15 bp, Homo sapiens
ctatttttacatgct

SEQ ID NO: 24013 - DNA, 15 bp, Homo sapiens
actatttttacatgc

SEQ ID NO: 24014 - DNA, 15 bp, Homo sapiens
aactatttttacatg

SEQ ID NO: 24015 - DNA, 15 bp, Homo sapiens
aaactatttttacat

SEQ ID NO: 24016 - DNA, 15 bp, Homo sapiens
aaaactatttttaca

SEQ ID NO: 24017 - DNA, 15 bp, Homo sapiens
taaaactatttttac

SEQ ID NO: 24018 - DNA, 15 bp, Homo sapiens
ttaaaactattttta

SEQ ID NO: 24019 - DNA, 15 bp, Homo sapiens
attaaaactattttt

SEQ ID NO: 24020 - DNA, 15 bp, Homo sapiens
gattaaaactatttt

SEQ ID NO: 24021 - DNA, 15 bp, Homo sapiens
tgattaaaactattt

SEQ ID NO: 24022 - DNA, 15 bp, Homo sapiens
atgattaaaactatt

SEQ ID NO: 24023 - DNA, 15 bp, Homo sapiens
tatgattaaaactat

SEQ ID NO: 24024 - DNA, 15 bp, Homo sapiens
atatgattaaaacta

SEQ ID NO: 24025 - DNA, 15 bp, Homo sapiens
aatatgattaaaact

SEQ ID NO: 24026 - DNA, 15 bp, Homo sapiens
caatatgattaaaac

SEQ ID NO: 24027 - DNA, 15 bp, Homo sapiens
gcaatatgattaaaa

SEQ ID NO: 24028 - DNA, 15 bp, Homo sapiens
tgcaatatgattaaa

SEQ ID NO: 24029 - DNA, 15 bp, Homo sapiens
gtgcaatatgattaa

SEQ ID NO: 24030 - DNA, 15 bp, Homo sapiens
agtgcaatatgatta

SEQ ID NO: 24031 - DNA, 15 bp, Homo sapiens
tagtgcaatatgatt

SEQ ID NO: 24032 - DNA, 15 bp, Homo sapiens
ctagtgcaatatgat

SEQ ID NO: 24033 - DNA, 15 bp, Homo sapiens
cctagtgcaatatga

SEQ ID NO: 24034 - DNA, 15 bp, Homo sapiens
tcctagtgcaatatg

SEQ ID NO: 24035 - DNA, 15 bp, Homo sapiens
ttcctagtgcaatat

SEQ ID NO: 24036 - DNA, 15 bp, Homo sapiens
cttcctagtgcaata

SEQ ID NO: 24037 - DNA, 15 bp, Homo sapiens
tcttcctagtgcaat

SEQ ID NO: 24038 - DNA, 15 bp, Homo sapiens
atcttcctagtgcaa

SEQ ID NO: 24039 - DNA, 15 bp, Homo sapiens
aatcttcctagtgca

SEQ ID NO: 24040 - DNA, 15 bp, Homo sapiens
aaatcttcctagtgc

SEQ ID NO: 24041 - DNA, 15 bp, Homo sapiens
caaatcttcctagtg

SEQ ID NO: 24042 - DNA, 15 bp, Homo sapiens
acaaatcttcctagt

SEQ ID NO: 24043 - DNA, 15 bp, Homo sapiens
aacaaatcttcctag

SEQ ID NO: 24044 - DNA, 15 bp, Homo sapiens
aaacaaatcttccta

SEQ ID NO: 24045 - DNA, 15 bp, Homo sapiens
aaaacaaatcttcct

SEQ ID NO: 24046 - DNA, 15 bp, Homo sapiens
aaaaacaaatcttcc

SEQ ID NO: 24047 - DNA, 15 bp, Homo sapiens
caaaaacaaatcttc

SEQ ID NO: 24048 - DNA, 15 bp, Homo sapiens
acaaaaacaaatctt

SEQ ID NO: 24049 - DNA, 15 bp, Homo sapiens
aacaaaaacaaatct

SEQ ID NO: 24050 - DNA, 15 bp, Homo sapiens
aaacaaaaacaaatc

SEQ ID NO: 24051 - DNA, 15 bp, Homo sapiens
gaaacaaaaacaaat

SEQ ID NO: 24052 - DNA, 15 bp, Homo sapiens
agaaacaaaaacaaa

SEQ ID NO: 24053 - DNA, 15 bp, Homo sapiens
aagaaacaaaaacaa

SEQ ID NO: 24054 - DNA, 15 bp, Homo sapiens
taagaaacaaaaaca

SEQ ID NO: 24055 - DNA, 15 bp, Homo sapiens
ttaagaaacaaaaac

SEQ ID NO: 24056 - DNA, 15 bp, Homo sapiens
tttaagaaacaaaaa

SEQ ID NO: 24057 - DNA, 15 bp, Homo sapiens
atttaagaaacaaaa

SEQ ID NO: 24058 - DNA, 15 bp, Homo sapiens
tatttaagaaacaaa

SEQ ID NO: 24059 - DNA, 15 bp, Homo sapiens
atatttaagaaacaa

SEQ ID NO: 24060 - DNA, 15 bp, Homo sapiens
tatatttaagaaaca

SEQ ID NO: 24061 - DNA, 15 bp, Homo sapiens
atatatttaagaaac

SEQ ID NO: 24062 - DNA, 15 bp, Homo sapiens
tatatatttaagaaa

SEQ ID NO: 24063 - DNA, 15 bp, Homo sapiens
gtatatatttaagaa

SEQ ID NO: 24064 - DNA, 15 bp, Homo sapiens
tgtatatatttaaga

SEQ ID NO: 24065 - DNA, 15 bp, Homo sapiens
ctgtatatatttaag

SEQ ID NO: 24066 - DNA, 15 bp, Homo sapiens
tctgtatatatttaa

SEQ ID NO: 24067 - DNA, 15 bp, Homo sapiens
ttctgtatatattta

SEQ ID NO: 24068 - DNA, 15 bp, Homo sapiens
attctgtatatattt

SEQ ID NO: 24069 - DNA, 15 bp, Homo sapiens
aattctgtatatatt

SEQ ID NO: 24070 - DNA, 15 bp, Homo sapiens
aaattctgtatatat

SEQ ID NO: 24071 - DNA, 15 bp, Homo sapiens
gaaattctgtatata

SEQ ID NO: 24072 - DNA, 15 bp, Homo sapiens
ggaaattctgtatat

SEQ ID NO: 24073 - DNA, 15 bp, Homo sapiens
gggaaattctgtata

SEQ ID NO: 24074 - DNA, 15 bp, Homo sapiens
agggaaattctgtat

SEQ ID NO: 24075 - DNA, 15 bp, Homo sapiens
aagggaaattctgta

SEQ ID NO: 24076 - DNA, 15 bp, Homo sapiens
aaagggaaattctgt

SEQ ID NO: 24077 - DNA, 15 bp, Homo sapiens
aaaagggaaattctg

SEQ ID NO: 24078 - DNA, 15 bp, Homo sapiens
aaaaagggaaattct

SEQ ID NO: 24079 - DNA, 15 bp, Homo sapiens
gaaaaagggaaattc

SEQ ID NO: 24080 - DNA, 15 bp, Homo sapiens
agaaaaagggaaatt

SEQ ID NO: 24081 - DNA, 15 bp, Homo sapiens
cagaaaaagggaaat

SEQ ID NO: 24082 - DNA, 15 bp, Homo sapiens
gcagaaaaagggaaa

SEQ ID NO: 24083 - DNA, 15 bp, Homo sapiens
agcagaaaaagggaa

SEQ ID NO: 24084 - DNA, 15 bp, Homo sapiens
aagcagaaaaaggga

SEQ ID NO: 24085 - DNA, 15 bp, Homo sapiens
gaagcagaaaaaggg

SEQ ID NO: 24086 - DNA, 15 bp, Homo sapiens
agaagcagaaaaagg

SEQ ID NO: 24087 - DNA, 15 bp, Homo sapiens
aagaagcagaaaaag

SEQ ID NO: 24088 - DNA, 15 bp, Homo sapiens
aaagaagcagaaaaa

SEQ ID NO: 24089 - DNA, 15 bp, Homo sapiens
taaagaagcagaaaa

SEQ ID NO: 24090 - DNA, 15 bp, Homo sapiens
ataaagaagcagaaa

SEQ ID NO: 24091 - DNA, 15 bp, Homo sapiens
tataaagaagcagaa

SEQ ID NO: 24092 - DNA, 15 bp, Homo sapiens
atataaagaagcaga

SEQ ID NO: 24093 - DNA, 15 bp, Homo sapiens
aatataaagaagcag

SEQ ID NO: 24094 - DNA, 15 bp, Homo sapiens
aaatataaagaagca

SEQ ID NO: 24095 - DNA, 15 bp, Homo sapiens
taaatataaagaagc

SEQ ID NO: 24096 - DNA, 15 bp, Homo sapiens
ttaaatataaagaag

SEQ ID NO: 24097 - DNA, 15 bp, Homo sapiens
attaaatataaagaa

SEQ ID NO: 24098 - DNA, 15 bp, Homo sapiens
tattaaatataaaga

SEQ ID NO: 24099 - DNA, 15 bp, Homo sapiens
ttattaaatataaag

SEQ ID NO: 24100 - DNA, 15 bp, Homo sapiens
gttattaaatataaa

SEQ ID NO: 24101 - DNA, 15 bp, Homo sapiens
tgttattaaatataa

SEQ ID NO: 24102 - DNA, 15 bp, Homo sapiens
ttgttattaaatata

SEQ ID NO: 24103 - DNA, 15 bp, Homo sapiens
cttgttattaaatat

SEQ ID NO: 24104 - DNA, 15 bp, Homo sapiens
tcttgttattaaata

SEQ ID NO: 24105 - DNA, 15 bp, Homo sapiens
gtcttgttattaaat

SEQ ID NO: 24106 - DNA, 15 bp, Homo sapiens
tgtcttgttattaaa

SEQ ID NO: 24107 - DNA, 15 bp, Homo sapiens
atgtcttgttattaa

SEQ ID NO: 24108 - DNA, 15 bp, Homo sapiens
aatgtcttgttatta

SEQ ID NO: 24109 - DNA, 15 bp, Homo sapiens
gaatgtcttgttatt

SEQ ID NO: 24110 - DNA, 15 bp, Homo sapiens
agaatgtcttgttat

SEQ ID NO: 24111 - DNA, 15 bp, Homo sapiens
tagaatgtcttgtta

SEQ ID NO: 24112 - DNA, 15 bp, Homo sapiens
ctagaatgtcttgtt

SEQ ID NO: 24113 - DNA, 15 bp, Homo sapiens
cctagaatgtcttgt

SEQ ID NO: 24114 - DNA, 15 bp, Homo sapiens
tcctagaatgtcttg

SEQ ID NO: 24115 - DNA, 15 bp, Homo sapiens
atcctagaatgtctt

SEQ ID NO: 24116 - DNA, 15 bp, Homo sapiens
tatcctagaatgtct

SEQ ID NO: 24117 - DNA, 15 bp, Homo sapiens
ctatcctagaatgtc

SEQ ID NO: 24118 - DNA, 15 bp, Homo sapiens
tctatcctagaatgt

SEQ ID NO: 24119 - DNA, 15 bp, Homo sapiens
gtctatcctagaatg

SEQ ID NO: 24120 - DNA, 15 bp, Homo sapiens
agtctatcctagaat

SEQ ID NO: 24121 - DNA, 15 bp, Homo sapiens
tagtctatcctagaa

SEQ ID NO: 24122 - DNA, 15 bp, Homo sapiens
ttagtctatcctaga

SEQ ID NO: 24123 - DNA, 15 bp, Homo sapiens
cttagtctatcctag

SEQ ID NO: 24124 - DNA, 15 bp, Homo sapiens
gcttagtctatccta

SEQ ID NO: 24125 - DNA, 15 bp, Homo sapiens
ggcttagtctatcct

SEQ ID NO: 24126 - DNA, 15 bp, Homo sapiens
aggcttagtctatcc

SEQ ID NO: 24127 - DNA, 15 bp, Homo sapiens
aaggcttagtctatc

SEQ ID NO: 24128 - DNA, 15 bp, Homo sapiens
aaaggcttagtctat

SEQ ID NO: 24129 - DNA, 15 bp, Homo sapiens
aaaaggcttagtcta

SEQ ID NO: 24130 - DNA, 15 bp, Homo sapiens
gaaaaggcttagtct

SEQ ID NO: 24131 - DNA, 15 bp, Homo sapiens
tgaaaaggcttagtc

SEQ ID NO: 24132 - DNA, 15 bp, Homo sapiens
atgaaaaggcttagt

SEQ ID NO: 24133 - DNA, 15 bp, Homo sapiens
catgaaaaggcttag

SEQ ID NO: 24134 - DNA, 15 bp, Homo sapiens
ccatgaaaaggctta

SEQ ID NO: 24135 - DNA, 15 bp, Homo sapiens
gccatgaaaaggctt

SEQ ID NO: 24136 - DNA, 15 bp, Homo sapiens
agccatgaaaaggct

SEQ ID NO: 24137 - DNA, 15 bp, Homo sapiens
tagccatgaaaaggc

SEQ ID NO: 24138 - DNA, 15 bp, Homo sapiens
ttagccatgaaaagg

SEQ ID NO: 24139 - DNA, 15 bp, Homo sapiens
attagccatgaaaag

SEQ ID NO: 24140 - DNA, 15 bp, Homo sapiens
aattagccatgaaaa

SEQ ID NO: 24141 - DNA, 15 bp, Homo sapiens
caattagccatgaaa

SEQ ID NO: 24142 - DNA, 15 bp, Homo sapiens
acaattagccatgaa

SEQ ID NO: 24143 - DNA, 15 bp, Homo sapiens
gacaattagccatga

SEQ ID NO: 24144 - DNA, 15 bp, Homo sapiens
ggacaattagccatg

SEQ ID NO: 24145 - DNA, 15 bp, Homo sapiens
aggacaattagccat

SEQ ID NO: 24146 - DNA, 15 bp, Homo sapiens
caggacaattagcca

SEQ ID NO: 24147 - DNA, 15 bp, Homo sapiens
acaggacaattagcc

SEQ ID NO: 24148 - DNA, 15 bp, Homo sapiens
cacaggacaattagc

SEQ ID NO: 24149 - DNA, 15 bp, Homo sapiens
ccacaggacaattag

SEQ ID NO: 24150 - DNA, 15 bp, Homo sapiens
tccacaggacaatta

SEQ ID NO: 24151 - DNA, 15 bp, Homo sapiens
ttccacaggacaatt

SEQ ID NO: 24152 - DNA, 15 bp, Homo sapiens
attccacaggacaat

SEQ ID NO: 24153 - DNA, 15 bp, Homo sapiens
aattccacaggacaa

SEQ ID NO: 24154 - DNA, 15 bp, Homo sapiens
gaattccacaggaca

SEQ ID NO: 24155 - DNA, 15 bp, Homo sapiens
agaattccacaggac

SEQ ID NO: 24156 - DNA, 15 bp, Homo sapiens
aagaattccacagga

SEQ ID NO: 24157 - DNA, 15 bp, Homo sapiens
aaagaattccacagg

SEQ ID NO: 24158 - DNA, 15 bp, Homo sapiens
aaaagaattccacag

SEQ ID NO: 24159 - DNA, 15 bp, Homo sapiens
taaaagaattccaca

SEQ ID NO: 24160 - DNA, 15 bp, Homo sapiens
ctaaaagaattccac

SEQ ID NO: 24161 - DNA, 15 bp, Homo sapiens
actaaaagaattcca

SEQ ID NO: 24162 - DNA, 15 bp, Homo sapiens
aactaaaagaattcc

SEQ ID NO: 24163 - DNA, 15 bp, Homo sapiens
aaactaaaagaattc

SEQ ID NO: 24164 - DNA, 15 bp, Homo sapiens
aaaactaaaagaatt

SEQ ID NO: 24165 - DNA, 15 bp, Homo sapiens
aaaaactaaaagaat

SEQ ID NO: 24166 - DNA, 15 bp, Homo sapiens
gaaaaactaaaagaa

SEQ ID NO: 24167 - DNA, 15 bp, Homo sapiens
agaaaaactaaaaga

SEQ ID NO: 24168 - DNA, 15 bp, Homo sapiens
gagaaaaactaaaag

SEQ ID NO: 24169 - DNA, 15 bp, Homo sapiens
agagaaaaactaaaa

SEQ ID NO: 24170 - DNA, 15 bp, Homo sapiens
aagagaaaaactaaa

SEQ ID NO: 24171 - DNA, 15 bp, Homo sapiens
gaagagaaaaactaa

SEQ ID NO: 24172 - DNA, 15 bp, Homo sapiens
ggaagagaaaaacta

SEQ ID NO: 24173 - DNA, 15 bp, Homo sapiens
tggaagagaaaaact

SEQ ID NO: 24174 - DNA, 15 bp, Homo sapiens
atggaagagaaaaac

SEQ ID NO: 24175 - DNA, 15 bp, Homo sapiens
catggaagagaaaaa

SEQ ID NO: 24176 - DNA, 15 bp, Homo sapiens
acatggaagagaaaa

SEQ ID NO: 24177 - DNA, 15 bp, Homo sapiens
aacatggaagagaaa

SEQ ID NO: 24178 - DNA, 15 bp, Homo sapiens
aaacatggaagagaa

SEQ ID NO: 24179 - DNA, 15 bp, Homo sapiens
taaacatggaagaga

SEQ ID NO: 24180 - DNA, 15 bp, Homo sapiens
ataaacatggaagag

SEQ ID NO: 24181 - DNA, 15 bp, Homo sapiens
tataaacatggaaga

SEQ ID NO: 24182 - DNA, 15 bp, Homo sapiens
atataaacatggaag

SEQ ID NO: 24183 - DNA, 15 bp, Homo sapiens
tatataaacatggaa

SEQ ID NO: 24184 - DNA, 15 bp, Homo sapiens
atatataaacatgga

SEQ ID NO: 24185 - DNA, 15 bp, Homo sapiens
aatatataaacatgg

SEQ ID NO: 24186 - DNA, 15 bp, Homo sapiens
aaatatataaacatg

SEQ ID NO: 24187 - DNA, 15 bp, Homo sapiens
caaatatataaacat

SEQ ID NO: 24188 - DNA, 15 bp, Homo sapiens
tcaaatatataaaca

SEQ ID NO: 24189 - DNA, 15 bp, Homo sapiens
atcaaatatataaac

SEQ ID NO: 24190 - DNA, 15 bp, Homo sapiens
tatcaaatatataaa

SEQ ID NO: 24191 - DNA, 15 bp, Homo sapiens
atatcaaatatataa

SEQ ID NO: 24192 - DNA, 15 bp, Homo sapiens
catatcaaatatata

SEQ ID NO: 24193 - DNA, 15 bp, Homo sapiens
tcatatcaaatatat

SEQ ID NO: 24194 - DNA, 15 bp, Homo sapiens
atcatatcaaatata

SEQ ID NO: 24195 - DNA, 15 bp, Homo sapiens
aatcatatcaaatat

SEQ ID NO: 24196 - DNA, 15 bp, Homo sapiens
aaatcatatcaaata

SEQ ID NO: 24197 - DNA, 15 bp, Homo sapiens
aaaatcatatcaaat

SEQ ID NO: 24198 - DNA, 15 bp, Homo sapiens
gaaaatcatatcaaa

SEQ ID NO: 24199 - DNA, 15 bp, Homo sapiens
agaaaatcatatcaa

SEQ ID NO: 24200 - DNA, 15 bp, Homo sapiens
cagaaaatcatatca

SEQ ID NO: 24201 - DNA, 15 bp, Homo sapiens
ccagaaaatcatatc

SEQ ID NO: 24202 - DNA, 15 bp, Homo sapiens
accagaaaatcatat

SEQ ID NO: 24203 - DNA, 15 bp, Homo sapiens
taccagaaaatcata

SEQ ID NO: 24204 - DNA, 15 bp, Homo sapiens
ctaccagaaaatcat

SEQ ID NO: 24205 - DNA, 15 bp, Homo sapiens
tctaccagaaaatca

SEQ ID NO: 24206 - DNA, 15 bp, Homo sapiens
ttctaccagaaaatc

SEQ ID NO: 24207 - DNA, 15 bp, Homo sapiens
attctaccagaaaat

SEQ ID NO: 24208 - DNA, 15 bp, Homo sapiens
aattctaccagaaaa

SEQ ID NO: 24209 - DNA, 15 bp, Homo sapiens
gaattctaccagaaa

SEQ ID NO: 24210 - DNA, 15 bp, Homo sapiens
agaattctaccagaa

SEQ ID NO: 24211 - DNA, 15 bp, Homo sapiens
aagaattctaccaga

SEQ ID NO: 24212 - DNA, 15 bp, Homo sapiens
caagaattctaccag

SEQ ID NO: 24213 - DNA, 15 bp, Homo sapiens
tcaagaattctacca

SEQ ID NO: 24214 - DNA, 15 bp, Homo sapiens
ttcaagaattctacc

SEQ ID NO: 24215 - DNA, 15 bp, Homo sapiens
tttcaagaattctac

SEQ ID NO: 24216 - DNA, 15 bp, Homo sapiens
ttttcaagaattcta

SEQ ID NO: 24217 - DNA, 15 bp, Homo sapiens
tttttcaagaattct

SEQ ID NO: 24218 - DNA, 15 bp, Homo sapiens
ttttttcaagaattc

SEQ ID NO: 24219 - DNA, 15 bp, Homo sapiens
attttttcaagaatt

SEQ ID NO: 24220 - DNA, 15 bp, Homo sapiens
tattttttcaagaat

SEQ ID NO: 24221 - DNA, 15 bp, Homo sapiens
ttattttttcaagaa

SEQ ID NO: 24222 - DNA, 15 bp, Homo sapiens
gttattttttcaaga

SEQ ID NO: 24223 - DNA, 15 bp, Homo sapiens
agttattttttcaag

SEQ ID NO: 24224 - DNA, 15 bp, Homo sapiens
cagttattttttcaa

SEQ ID NO: 24225 - DNA, 15 bp, Homo sapiens
gcagttattttttca

SEQ ID NO: 24226 - DNA, 15 bp, Homo sapiens
tgcagttattttttc

SEQ ID NO: 24227 - DNA, 15 bp, Homo sapiens
atgcagttatttttt

SEQ ID NO: 24228 - DNA, 15 bp, Homo sapiens
gatgcagttattttt

SEQ ID NO: 24229 - DNA, 15 bp, Homo sapiens
tgatgcagttatttt

SEQ ID NO: 24230 - DNA, 15 bp, Homo sapiens
gtgatgcagttattt

SEQ ID NO: 24231 - DNA, 15 bp, Homo sapiens
tgtgatgcagttatt

SEQ ID NO: 24232 - DNA, 15 bp, Homo sapiens
gtgtgatgcagttat

SEQ ID NO: 24233 - DNA, 15 bp, Homo sapiens
tgtgtgatgcagtta

SEQ ID NO: 24234 - DNA, 15 bp, Homo sapiens
ctgtgtgatgcagtt

SEQ ID NO: 24235 - DNA, 15 bp, Homo sapiens
actgtgtgatgcagt

SEQ ID NO: 24236 - DNA, 15 bp, Homo sapiens
tactgtgtgatgcag

SEQ ID NO: 24237 - DNA, 15 bp, Homo sapiens
ctactgtgtgatgca

SEQ ID NO: 24238 - DNA, 15 bp, Homo sapiens
gctactgtgtgatgc

SEQ ID NO: 24239 - DNA, 15 bp, Homo sapiens
agctactgtgtgatg

SEQ ID NO: 24240 - DNA, 15 bp, Homo sapiens
gagctactgtgtgat

SEQ ID NO: 24241 - DNA, 15 bp, Homo sapiens
agagctactgtgtga

SEQ ID NO: 24242 - DNA, 15 bp, Homo sapiens
gagagctactgtgtg

SEQ ID NO: 24243 - DNA, 15 bp, Homo sapiens
ggagagctactgtgt

SEQ ID NO: 24244 - DNA, 15 bp, Homo sapiens
aggagagctactgtg

SEQ ID NO: 24245 - DNA, 15 bp, Homo sapiens
gaggagagctactgt

SEQ ID NO: 24246 - DNA, 15 bp, Homo sapiens
agaggagagctactg

SEQ ID NO: 24247 - DNA, 15 bp, Homo sapiens
gagaggagagctact

SEQ ID NO: 24248 - DNA, 15 bp, Homo sapiens
ggagaggagagctac

SEQ ID NO: 24249 - DNA, 15 bp, Homo sapiens
gggagaggagagcta

SEQ ID NO: 24250 - DNA, 15 bp, Homo sapiens
tgggagaggagagct

SEQ ID NO: 24251 - DNA, 15 bp, Homo sapiens
atgggagaggagagc

SEQ ID NO: 24252 - DNA, 15 bp, Homo sapiens
aatgggagaggagag

SEQ ID NO: 24253 - DNA, 15 bp, Homo sapiens
aaatgggagaggaga

SEQ ID NO: 24254 - DNA, 15 bp, Homo sapiens
aaaatgggagaggag

SEQ ID NO: 24255 - DNA, 15 bp, Homo sapiens
taaaatgggagagga

SEQ ID NO: 24256 - DNA, 15 bp, Homo sapiens
ataaaatgggagagg

SEQ ID NO: 24257 - DNA, 15 bp, Homo sapiens
aataaaatgggagag

SEQ ID NO: 24258 - DNA, 15 bp, Homo sapiens
aaataaaatgggaga

SEQ ID NO: 24259 - DNA, 15 bp, Homo sapiens
aaaataaaatgggag

SEQ ID NO: 24260 - DNA, 15 bp, Homo sapiens
taaaataaaatggga

SEQ ID NO: 24261 - DNA, 15 bp, Homo sapiens
ataaaataaaatggg

SEQ ID NO: 24262 - DNA, 15 bp, Homo sapiens
aataaaataaaatgg

SEQ ID NO: 24263 - DNA, 15 bp, Homo sapiens
aaataaaataaaatg

SEQ ID NO: 24264 - DNA, 15 bp, Homo sapiens
gtaaaataaaataaa

SEQ ID NO: 24265 - DNA, 15 bp, Homo sapiens
agtaaaataaaataa

SEQ ID NO: 24266 - DNA, 15 bp, Homo sapiens
aagtaaaataaaata

SEQ ID NO: 24267 - DNA, 15 bp, Homo sapiens
caagtaaaataaaat

SEQ ID NO: 24268 - DNA, 15 bp, Homo sapiens
gcaagtaaaataaaa

SEQ ID NO: 24269 - DNA, 15 bp, Homo sapiens
agcaagtaaaataaa

SEQ ID NO: 24270 - DNA, 15 bp, Homo sapiens
cagcaagtaaaataa

SEQ ID NO: 24271 - DNA, 15 bp, Homo sapiens
tcagcaagtaaaata

SEQ ID NO: 24272 - DNA, 15 bp, Homo sapiens
ctcagcaagtaaaat

SEQ ID NO: 24273 - DNA, 15 bp, Homo sapiens
cctcagcaagtaaaa

SEQ ID NO: 24274 - DNA, 15 bp, Homo sapiens
gcctcagcaagtaaa

SEQ ID NO: 24275 - DNA, 15 bp, Homo sapiens
agcctcagcaagtaa

SEQ ID NO: 24276 - DNA, 15 bp, Homo sapiens
cagcctcagcaagta

SEQ ID NO: 24277 - DNA, 15 bp, Homo sapiens
ccagcctcagcaagt

SEQ ID NO: 24278 - DNA, 15 bp, Homo sapiens
tccagcctcagcaag

SEQ ID NO: 24279 - DNA, 15 bp, Homo sapiens
atccagcctcagcaa

SEQ ID NO: 24280 - DNA, 15 bp, Homo sapiens
tatccagcctcagca

SEQ ID NO: 24281 - DNA, 15 bp, Homo sapiens
atatccagcctcagc

SEQ ID NO: 24282 - DNA, 15 bp, Homo sapiens
aatatccagcctcag

SEQ ID NO: 24283 - DNA, 15 bp, Homo sapiens
taatatccagcctca

SEQ ID NO: 24284 - DNA, 15 bp, Homo sapiens
ataatatccagcctc

SEQ ID NO: 24285 - DNA, 15 bp, Homo sapiens
tataatatccagcct

SEQ ID NO: 24286 - DNA, 15 bp, Homo sapiens
atataatatccagcc

SEQ ID NO: 24287 - DNA, 15 bp, Homo sapiens
aatataatatccagc

SEQ ID NO: 24288 - DNA, 15 bp, Homo sapiens
gaatataatatccag

SEQ ID NO: 24289 - DNA, 15 bp, Homo sapiens
agaatataatatcca

SEQ ID NO: 24290 - DNA, 15 bp, Homo sapiens
aagaatataatatcc

SEQ ID NO: 24291 - DNA, 15 bp, Homo sapiens
aaagaatataatatc

SEQ ID NO: 24292 - DNA, 15 bp, Homo sapiens
aaaagaatataatat

SEQ ID NO: 24293 - DNA, 15 bp, Homo sapiens
caaaagaatataata

SEQ ID NO: 24294 - DNA, 15 bp, Homo sapiens
ccaaaagaatataat

SEQ ID NO: 24295 - DNA, 15 bp, Homo sapiens
gccaaaagaatataa

SEQ ID NO: 24296 - DNA, 15 bp, Homo sapiens
agccaaaagaatata

SEQ ID NO: 24297 - DNA, 15 bp, Homo sapiens
cagccaaaagaatat

SEQ ID NO: 24298 - DNA, 15 bp, Homo sapiens
tcagccaaaagaata

SEQ ID NO: 24299 - DNA, 15 bp, Homo sapiens
cttcagccaaaagaa

SEQ ID NO: 24300 - DNA, 15 bp, Homo sapiens
acttcagccaaaaga

SEQ ID NO: 24301 - DNA, 15 bp, Homo sapiens
gacttcagccaaaag

SEQ ID NO: 24302 - DNA, 15 bp, Homo sapiens
tgacttcagccaaaa

SEQ ID NO: 24303 - DNA, 15 bp, Homo sapiens
gtgacttcagccaaa

SEQ ID NO: 24304 - DNA, 15 bp, Homo sapiens
ggtgacttcagccaa

SEQ ID NO: 24305 - DNA, 15 bp, Homo sapiens
tggtgacttcagcca

SEQ ID NO: 24306 - DNA, 15 bp, Homo sapiens
atggtgacttcagcc

SEQ ID NO: 24307 - DNA, 15 bp, Homo sapiens
tatggtgacttcagc

SEQ ID NO: 24308 - DNA, 15 bp, Homo sapiens
ctatggtgacttcag

SEQ ID NO: 24309 - DNA, 15 bp, Homo sapiens
actatggtgacttca

SEQ ID NO: 24310 - DNA, 15 bp, Homo sapiens
cactatggtgacttc

SEQ ID NO: 24311 - DNA, 15 bp, Homo sapiens
ccactatggtgactt

SEQ ID NO: 24312 - DNA, 15 bp, Homo sapiens
tccactatggtgact

SEQ ID NO: 24313 - DNA, 15 bp, Homo sapiens
atccactatggtgac

SEQ ID NO: 24314 - DNA, 15 bp, Homo sapiens
aatccactatggtga

SEQ ID NO: 24315 - DNA, 15 bp, Homo sapiens
gaatccactatggtg

SEQ ID NO: 24316 - DNA, 15 bp, Homo sapiens
tgaatccactatggt

SEQ ID NO: 24317 - DNA, 15 bp, Homo sapiens
atgaatccactatgg

SEQ ID NO: 24318 - DNA, 15 bp, Homo sapiens
tatgaatccactatg

SEQ ID NO: 24319 - DNA, 15 bp, Homo sapiens
gtatgaatccactat

SEQ ID NO: 24320 - DNA, 15 bp, Homo sapiens
tgtatgaatccacta

SEQ ID NO: 24321 - DNA, 15 bp, Homo sapiens
ttgtatgaatccact

SEQ ID NO: 24322 - DNA, 15 bp, Homo sapiens
gttgtatgaatccac

SEQ ID NO: 24323 - DNA, 15 bp, Homo sapiens
agttgtatgaatcca

SEQ ID NO: 24324 - DNA, 15 bp, Homo sapiens
tagttgtatgaatcc

SEQ ID NO: 24325 - DNA, 15 bp, Homo sapiens
ttagttgtatgaatc

SEQ ID NO: 24326 - DNA, 15 bp, Homo sapiens
attagttgtatgaat

SEQ ID NO: 24327 - DNA, 15 bp, Homo sapiens
aattagttgtatgaa

SEQ ID NO: 24328 - DNA, 15 bp, Homo sapiens
aaattagttgtatga

SEQ ID NO: 24329 - DNA, 15 bp, Homo sapiens
gaaattagttgtatg

SEQ ID NO: 24330 - DNA, 15 bp, Homo sapiens
ggaaattagttgtat

SEQ ID NO: 24331 - DNA, 15 bp, Homo sapiens
tggaaattagttgta

SEQ ID NO: 24332 - DNA, 15 bp, Homo sapiens
ctggaaattagttgt

SEQ ID NO: 24333 - DNA, 15 bp, Homo sapiens
gctggaaattagttg

SEQ ID NO: 24334 - DNA, 15 bp, Homo sapiens
ggctggaaattagtt

SEQ ID NO: 24335 - DNA, 15 bp, Homo sapiens
tggctggaaattagt

SEQ ID NO: 24336 - DNA, 15 bp, Homo sapiens
ctggctggaaattag

SEQ ID NO: 24337 - DNA, 15 bp, Homo sapiens
actggctggaaatta

SEQ ID NO: 24338 - DNA, 15 bp, Homo sapiens
aactggctggaaatt

SEQ ID NO: 24339 - DNA, 15 bp, Homo sapiens
aaactggctggaaat

SEQ ID NO: 24340 - DNA, 15 bp, Homo sapiens
taaactggctggaaa

SEQ ID NO: 24341 - DNA, 15 bp, Homo sapiens
ataaactggctggaa

SEQ ID NO: 24342 - DNA, 15 bp, Homo sapiens
cataaactggctgga

SEQ ID NO: 24343 - DNA, 15 bp, Homo sapiens
acataaactggctgg

SEQ ID NO: 24344 - DNA, 15 bp, Homo sapiens
tacataaactggctg

SEQ ID NO: 24345 - DNA, 15 bp, Homo sapiens
ctacataaactggct

SEQ ID NO: 24346 - DNA, 15 bp, Homo sapiens
tctacataaactggc

SEQ ID NO: 24347 - DNA, 15 bp, Homo sapiens
atctacataaactgg

SEQ ID NO: 24348 - DNA, 15 bp, Homo sapiens
gatctacataaactg

SEQ ID NO: 24349 - DNA, 15 bp, Homo sapiens
tgatctacataaact

SEQ ID NO: 24350 - DNA, 15 bp, Homo sapiens
atgatctacataaac

SEQ ID NO: 24351 - DNA, 15 bp, Homo sapiens
aatgatctacataaa

SEQ ID NO: 24352 - DNA, 15 bp, Homo sapiens
aaatgatctacataa

SEQ ID NO: 24353 - DNA, 15 bp, Homo sapiens
caaatgatctacata

SEQ ID NO: 24354 - DNA, 15 bp, Homo sapiens
gcaaatgatctacat

SEQ ID NO: 24355 - DNA, 15 bp, Homo sapiens
tgcaaatgatctaca

SEQ ID NO: 24356 - DNA, 15 bp, Homo sapiens
ttgcaaatgatctac

SEQ ID NO: 24357 - DNA, 15 bp, Homo sapiens
tttgcaaatgatcta

SEQ ID NO: 24358 - DNA, 15 bp, Homo sapiens
atttgcaaatgatct

SEQ ID NO: 24359 - DNA, 15 bp, Homo sapiens
catttgcaaatgatc

SEQ ID NO: 24360 - DNA, 15 bp, Homo sapiens
acatttgcaaatgat

SEQ ID NO: 24361 - DNA, 15 bp, Homo sapiens
tacatttgcaaatga

SEQ ID NO: 24362 - DNA, 15 bp, Homo sapiens
atacatttgcaaatg

SEQ ID NO: 24363 - DNA, 15 bp, Homo sapiens
aatacatttgcaaat

SEQ ID NO: 24364 - DNA, 15 bp, Homo sapiens
taatacatttgcaaa

SEQ ID NO: 24365 - DNA, 15 bp, Homo sapiens
ctaatacatttgcaa

SEQ ID NO: 24366 - DNA, 15 bp, Homo sapiens
actaatacatttgca

SEQ ID NO: 24367 - DNA, 15 bp, Homo sapiens
aactaatacatttgc

SEQ ID NO: 24368 - DNA, 15 bp, Homo sapiens
taactaatacatttg

SEQ ID NO: 24369 - DNA, 15 bp, Homo sapiens
gtaactaatacattt

SEQ ID NO: 24370 - DNA, 15 bp, Homo sapiens
tgtaactaatacatt

SEQ ID NO: 24371 - DNA, 15 bp, Homo sapiens
ctgtaactaatacat

SEQ ID NO: 24372 - DNA, 15 bp, Homo sapiens
tctgtaactaataca

SEQ ID NO: 24373 - DNA, 15 bp, Homo sapiens
ctctgtaactaatac

SEQ ID NO: 24374 - DNA, 15 bp, Homo sapiens
tctctgtaactaata

SEQ ID NO: 24375 - DNA, 15 bp, Homo sapiens
ctctctgtaactaat

SEQ ID NO: 24376 - DNA, 15 bp, Homo sapiens
cctctctgtaactaa

SEQ ID NO: 24377 - DNA, 15 bp, Homo sapiens
gcctctctgtaacta

SEQ ID NO: 24378 - DNA, 15 bp, Homo sapiens
agcctctctgtaact

SEQ ID NO: 24379 - DNA, 15 bp, Homo sapiens
gagcctctctgtaac

SEQ ID NO: 24380 - DNA, 15 bp, Homo sapiens
ggagcctctctgtaa

SEQ ID NO: 24381 - DNA, 15 bp, Homo sapiens
tggagcctctctgta

SEQ ID NO: 24382 - DNA, 15 bp, Homo sapiens
ctggagcctctctgt

SEQ ID NO: 24383 - DNA, 15 bp, Homo sapiens
cctggagcctctctg

SEQ ID NO: 24384 - DNA, 15 bp, Homo sapiens
ccctggagcctctct

SEQ ID NO: 24385 - DNA, 15 bp, Homo sapiens
cccctggagcctctc

SEQ ID NO: 24386 - DNA, 15 bp, Homo sapiens
acccctggagcctct

SEQ ID NO: 24387 - DNA, 15 bp, Homo sapiens
cacccctggagcctc

SEQ ID NO: 24388 - DNA, 15 bp, Homo sapiens
acacccctggagcct

SEQ ID NO: 24389 - DNA, 15 bp, Homo sapiens
tacacccctggagcc

SEQ ID NO: 24390 - DNA, 15 bp, Homo sapiens
gtacacccctggagc

SEQ ID NO: 24391 - DNA, 15 bp, Homo sapiens
ggtacacccctggag

SEQ ID NO: 24392 - DNA, 15 bp, Homo sapiens
tggtacacccctgga

SEQ ID NO: 24393 - DNA, 15 bp, Homo sapiens
ttggtacacccctgg

SEQ ID NO: 24394 - DNA, 15 bp, Homo sapiens
tttggtacacccctg

SEQ ID NO: 24395 - DNA, 15 bp, Homo sapiens
ctttggtacacccct

SEQ ID NO: 24396 - DNA, 15 bp, Homo sapiens
tctttggtacacccc

SEQ ID NO: 24397 - DNA, 15 bp, Homo sapiens
ttctttggtacaccc
